United States Patent 9,782,462 (MODIFIED POLYNUCLEOTIDES FOR THE PRODUCTION OF PROTEINS ASSOCIATED WITH HUMAN DISEASE) - sequence listing, part 98

SEQ ID NO: 191917 - DNA, 738 bp, Artificial Sequence
  Description of Artificial Sequence: Synthetic coding sequence
atgtgcgccgaggtgggccccgccctgtgccggggcatggagcggaacagcctgggttgttgcgaggctcccaaaaagttgagtctttccttttctatcgaggcgattctaaaacggcctgcccgccgctccgacatggatcgccccgaggggccaggcgaagagggccccggagaagccgcagcctctggttctggtctggagaagccaccaaaggaccagccacaagagggccgcaaaagtaagcggcgtgtgaggactacatttacaaccgagcagttgcacgaactcgagaagatcttccacttcacccattatccggatgtccacattcgatctcagctggccgcccgaatcaacctccctgaggcccgagtacaaatctggtttcagaatcagcgagcaaaatggagaaagcaggaaaaaatcggaaacttgggggctccccagcagctttcggaggctagcgtggccctgccaacaaacctggacgtagctggccccacttggaccagcaccgccttgcgcaggcttgctccccctactagctgttgcccctcagcgcaggatcaactggcttcagcttggtttcccgcctggatcaccctgctgcctgcacacccatgggaaacccagccagttcctggcctcccgatccatcagacatgtatcccagtgctttgcattcttccgcccccccatcccaaatgggggagtatatgcgctacatccacctag

SEQ ID NO: 191918 - DNA, 1749 bp, Artificial Sequence
  Description of Artificial Sequence: Synthetic coding sequence
atggccaacgaggactgccccaaggccgccgacagccccttcagcagcgataagcacgcgcaactcattctggcccagattaataagatgagaaatggccagcatttctgtgatgtgcaacttcaggttgggcaggaatcattcaaagctcatcggctcgtgctggctgctagctccccttactttgccgctcttttcacaggggggatgaaggagagcagtaaggatgttgtgccaattttaggcatcgaggccggcattttccagattcttctcgattttatttatacaggcatcgttaacataggagtcaacaacgtgcaggaactgatcattgccgcagatatgctccagttgaccgaggtggtgcatctgtgttgtgagtttctgaaaggtcagatcgatccactcaattgtataggaatttttcagttcagtgagcagattgcttgccacgatctactggaattcagcgaaaactacattcacgttcactttctggaggtccacagcggcgaggagttcttagctctcacaaaggatcagcttattaaaatcctgcgctcagaagaattgagtattgaggatgagtaccaggtctttctggccgctatgcagtggattctcaaagatttgggtaagcgaaggaaacacgtggtggaggtgctcgacccaatcagattccccctcctccctcctcagcgcctcttgaagtacatcgaaggcgtgtccgacttcaacctacgcgttgctctgcaaacgctgctgaaggagtactgcgaagtgtgtaagtcacctaaggagaataagttttgttcattcctgcagacgtctaaggtccggccacgaaaaaaggctagaaagtacttatatgccgttggaggctacactcggctgcagggaggtcgttggtctgactctagagctctctcttgcgttgagcggtttgataccttcagccagtattggaccacagtgagtagtctacaccaggccaggagcgggctcggagtcaccgtgctggggggtatggtctacgctatcggcggcgagaaggattcaatgatcttcgactgtacagagtgttacgatcctgttacgaaacagtggaccaccgtcgccagcatgaaccatccacggtgtggactcggcgtttgcgtttgttacggagcaatttatgccctcggcgggtgggtgggtgctgagatcgggaacactatagaaagattcgaccctgacgaaaacaagtgggaagtcgtgggcaacatggctgtgagcagatattacttcggatgctgcgaaatgcagggcctcatctatgtgatcggcggtattagcaacgaggggatagagctgaggagcttcgaggtgtacgatccactttccaagaggtggtcacctttgccccctatgggcactagaagagcctacctaggcgtggccgccctcaatgactgcatctatagcgtcggcggctggaatgaaacacaggatgccctgcatacggtggagaagtatagtttcgaggaagagaaatgggttgaggtggcttctatgaaagtcccccgcgcaggaatgtgtgtggtcgcagtcaacggcctcttgtacgttagcgggggaagatcctcatcacatgactttctggcccccgatactcacaggtatgaagttttcagattaaaatgggaaaacatgtgcatcctatttaatgatcacaaaactctgaccaaaggtatcttcaatctttag

SEQ ID NO: 191919 - DNA, 1755 bp, Artificial Sequence
  Description of Artificial Sequence: Synthetic coding sequence
atggccaacgaggactgccccaaggccgccgacagccccttcagcagcgataagcacgcacaacttattttagcacagataaacaagatgaggaacggacaacacttctgcgatgtccagctgcaggtgggccaggagtcattcaaggcacaccggctcgtactcgccgcctcctccccttattttgctgcccttttcaccggaggcatgaaggagagctcaaaggatgtagtgcccatacttggcattgaagccggaatctttcaaatcctgctggactttatttacaccgggattgtgaacatcggagtaaataatgtgcaggaactgataatcgcagcagacatgctgcagctgaccgaggtggttcatctgtgctgcgagtttctgaaggggcaaatcgaccccttgaactgtattggtatctttcagttttctgaacagatagcatgtcatgatcttctggagtttagtgaaaattacatccacgttcactttctggaagtacatagtggtgaggaattcctggctctgactaaagatcagctgatcaaaatactcaggtctgaagagctcagtattgaggatgagtaccaggtgttcctggccgcaatgcagtggatactcaaagacctggggaagcggagaaaacatgtcgtcgaagttctggatccaattcgattcccactgctgcctccacaaaggctgttaaagtacattgagggcgtgagcgactttaacctgagggtggccctgcagacccttctgaaagaatactgtgaggtttgcaagtcacctaaagaaaacaagttttgctcctttttgcagactagcaaggtgagaccccgtaagaaagcccggaagtacctgtatgccgtaggcggctacactaggctgcagggcggccgttggtctgatagccgagcactcagttgtgtggaacgatttgatactttttcacagtattggaccactgtatccagtctgcatcaggctcggtccggcctgggcgtgacggttctgggaggaatggtgtatgccatcggcggagaaaaagacagtatgatctttgactgtaccgagtgttacgatcccgttactaaacagtggacaacggtggcctcaatgaaccatccaagatgtggtctgggggtctgcgtatgctacggcgccatttatgcgctgggagggtgggtaggcgcagaaattggaaacacaattgagcggttcgacccagatgagaataaatgggaggtggtgggtaacatggcggtctcccgctactacttcggctgttgcgaaatgcaggggcttatatatgttattggaggcatctcaaacgagggtatcgaactccgttcttttgaggtgtacgacccactgagtaaaaggtggtctcctcttccacccatgggcactaggcgcgcctacctgggcgttgcggccctcaatgattgtatatatagtgtgggcggctggaatgaaactcaggatgctctgcatacagtagagaagtattctttcgaggaagagaagtgggtggaagtagctagcatgaaagtcccaagggctgggatgtgcgtggttgccgtgaatggcctgctgtatgtgtccggagggagaagtagcagccacgacttccttgcccccgggacacttgacagcgtggaagtctataatccacattcggatacatggactgaaattggaaacatgatcacctccaggtgtgaagggggtgtggccgtgctatag

SEQ ID NO: 191920 - DNA, 3879 bp, Artificial Sequence
  Description of Artificial Sequence: Synthetic coding sequence
atgcgggccgtgctgacctggcgggacaaggccgagcactgcatcaacgatatcgcctttaagcccgatggcactcagctgattctggcagctgggtccaggttactggtgtacgatacctctgatggtaccctcctccaacctctgaaaggccataaagacaccgtgtattgcgtcgcgtacgccaaggatggcaagcggtttgcttccggctccgccgataaatcagtgatcatctggacttcaaaattggaaggtatccttaaatatacctcatggtccgtgatgagcagcctccatttgcaccttcctttcctgggcctgcacaaaacagtgcgagtaacggccacagataaggcccccaagggccagggggggcggattgactgtctcaggccaagtgtgcagaaccagccaggccagaagcacaatgatgccattcaatgcgtgagttataatcccattactcatcagctggcctcatgttctagttctgatttcggcctgtggtctcctgagcagaaatccgtgtcaaagcacaaatcaagttcaaagattatttgctgcagttggactaacgatggtcagtatctagcccttggtatgtttaacggaatcattagtatacgaaacaaaaacggcgaggagaaagttaagatcgaacggccaggcggttctctgtccccaatctggtctatatgttggaacccatcatctcgctgggaatccttctggatgaaccgcgaaaatgaagacgctgaagacgtgatcgtgaaccgttacattcaggagattccttctactctgaaaagcgctgtttatagtagtcagggcagcgaggctgaagaggaggaaccggaagaagaagacgatagtccaagagacgacaacttagaagagaggaacgacatactggcagtcgcggactggggacaaaaggtgagcttctaccagctgtccgggaagcagataggaaaggaccgcgccctaaacttcgacccgtgttgcatctcatacttcaccaaaggcgaatatatcctgcttggaggcagtgacaaacaagtgagcctatttaccaaggacggtgtgagactgggaactgtcggagagcaaaattcatgggtgtggacgtgccaggcgaagcctgactccaactacgtggtcgtcggatgtcaggatggaacaatatcattctatcagctcattttctcaacagtgcatggtctatacaaggacaggtatgcctatagggattctatgacagatgtgattgtccagcaccttattacagaacagaaggtgcggattaagtgcaaggaattggtgaagaaaatcgctatctaccgtaaccgcctcgcaatacagctgccggagaaaattttaatctacgaattatactccgaggatctgtccgatatgcattacagggtgaaggagaagatcattaaaaagtttgaatgtaaccttctagtggtttgcgctaatcacattattctgtgccaggaaaaacggctccagtgtctgagctttagtggtgtgaaagaacgggaatggcagatggaatcattaatccgctacattaaagtgatcggggggcccccaggccgggagggcctcttggtaggacttaagaacgggcagatcctcaagatcttcgtcgacaatctgttcgccatcgttctgctgaagcaagcaacagccgtgagatgtcttgatatgtccgcttctagaaagaagttagcggtggtggacgaaaacgatacatgcttggtttacgacatagacactaaggagttgctgttccaggagcctaatgcaaattctgttgcttggaacacccagtgcgaagacatgctgtgttttagtggcggcggatatctgaacattaaggcctccacttttcctgtgcaccggcaaaagctgcagggttttgtggtaggatacaatggcagcaagattttttgtctgcatgtattttccatctctgccgtggaagtgccccagagcgcacctatgtatcaatatctcgacaggaagctgttcaaggaggcgtatcaaatagcctgtctgggtgtgacggacactgattggcgggagttagctatggaagccttggagggattagacttcgagactgctaagaaagctttcattcgcgtccaggacctgcgctacttagagttgatctctagcattgaggagcggaaaaagcgtggcgagaccaacaatgatctgtttcttgctgacgtgttttcctatcaggggaaattccacgaagcggccaagctatacaagcgcagcgggcacgaaaatctggcgttggaaatgtataccgatctatgtatgttcgaatatgcgaaagatttccttgggtcaggggacccgaaagagaccaagatgctcataacaaaacaggcggactgggcccgcaatatcaaggagccgaaggccgccgtggagatgtatatcagcgccggtgagcatgtcaaagccatcgaaatttgtggagatcatggctgggtggacatgttgatcgatattgcccgaaagttggataaagccgaacgcgaaccattgctcctgtgtgctacatacctgaagaagctggacagcccagggtatgcagctgaaacctatctaaaaatgggtgacctcaaatctttggttcagctgcatgtggagactcagagatgggatgaggctttcgcattaggggagaaacaccccgaatttaaggacgacatttacatgccctacgcccagtggttagcagagaatgatagattcgaggaagcccaaaaggcatttcataaggccggccgtcagcgggaagctgtccaggtgctcgagcagttgactaacaacgccgttgcggaatccagattcaatgacgccgcctactattattggatgctttcaatgcagtgccttgacatagctcaagaccccgctcagaaagacacgatgctgggaaagttctaccattttcaacggttggcagagttatatcacggctatcacgccatccatcgacacacagaagatcccttcagtgttcaccggccagaaaccctatttaacattagtagatttttgctgcattctctgcccaaggatacaccctccggaatcagtaaggtgaaaatcctgtttaccctggccaagcagagcaaggccctcggtgcatatcgtctcgccaggcacgcctatgacaagttgagggggctgtacatcccagcccgtttccagaaatctatcgagttgggaactctgactatccgagcgaagccctttcatgactcagaggagctcgtgcctctgtgctatagatgttccacgaataaccctctgctgaacaacctgggcaatgtgtgtatcaactgccgtcagcctttcatattttccgcctcctcctacgacgtgctgcacttagtggagttctacttggaagaagggattactgatgaggaggccatatcactgatagatctcgaggtgcttcgtcccaagagagacgaccggcagttggagatcgctaataactcatcccagatcctccgtctggtggaaacaaaagatagcatcggtgatgaggatccgtttaccgcaaagctgtctttcgaacaaggtggaagcgaatttgtgcccgtggtggtatcaagactggtcctacggagtatgtcacgaagggacgtgctgatcaaaagatggccgccaccactgcgatggcaatatttccgcagcttattgcccgacgcatctatcacaatgtgtccttcctgttttcaaatgtttcatagcgaagattatgagctgctggtgctgcagcatggctgctgcccctactgtcgccgttgtaaggatgaccctggcccatag

SEQ ID NO: 191921 - DNA, 3549 bp, Artificial Sequence
  Description of Artificial Sequence: Synthetic coding sequence
atgcgggccgtgctgacctggcgggacaaggccgagcactgcatcaacgacattgctttcaagcccgatggcacacaactgatcctcgccgccggcagcagattgctggtgtacgatacgagcgatgggactctgttacagcccctgaagggccataaagatacagtgtattgtgtggcgtatgccaaggatgggaaacggtttgcttctggctctgccgataagtctgtaatcatctggacaagtaaactggaggggatcctaaaatatacgcacaatgacgccatccagtgcgtatcctacaacccaattacccatcaactggcatcctgtagtagcagcgatttcgggctctggtcccccgaacagaaatcagtaagcaaacataagagctcatccaagattatttgctgttcttggaccaacgatggtcagtacctcgctttaggcatgtttaacggaatcatttccattaggaataaaaacggagaagaaaaggtaaagattgaacgcccgggcgggagcctctctccaatttggtcaatctgttggaatcctagtcgcgaggaacggaacgatatcctagcggtagcagattgggggcagaaagttagcttttaccagctcagcggtaagcagataggcaaagacagagctttaaatttcgatccttgttgcatcagttacttcactaagggcgaatacatcttgctcggcggttctgataagcaagtgagcttattcacaaaagacggggtgaggctcgggaccgtgggagagcaaaattcatgggtctggacgtgccaggcgaagccagatagcaattatgttgtagtcggttgccaggacggcacaatatccttctatcagctcatctttagcactgttcacggtctgtacaaagatagatatgcgtacagagatagcatgactgatgtaattgtccagcatctgataacagaacagaaagttagaattaagtgcaaggagttagtcaaaaagatagcaatttaccggaatagactagctattcaattgcccgaaaagatcttaatttacgaactctatagtgaagatctctcggatatgcattaccgtgtcaaggagaagattattaaaaaatttgagtgtaatctgctcgtcgtttgcgcaaatcatattatcctgtgccaggaaaagagattgcaatgcctttccttctcaggtgttaaggaaagggagtggcaaatggaatctctgatcagatatatcaaggtaatcggcggccccccgggccgagagggcctcctggtcgggttgaagaatgggcagatactcaagatttttgttgacaatctgttcgccatcgtgctgctcaagcaggcaaccgcagtgcgctgcctggacatgtccgcaagtcgcaagaagctggctgtggtggacgagaatgacacttgtttggtctacgatatcgacacaaaggaactgcttttccaggagcccaatgctaattccgtggcatggaatacccagtgtgaagatatgctctgtttcagcggtgggggatatctcaatattaaggcgtcaaccttccccgtgcacaggcagaaactccagggattcgtggtgggttacaacggaagcaagattttttgtctgcacgtcttttcaatttctgccgttgaggtccctcagtcagcgcccatgtaccagtaccttgatcgaaaactgttcaaagaggcttatcagatcgcctgtcttggtgtgacagacacagactggagggagctggctatggaggccttggagggtctcgatttcgaaactgccaaaaaagcctttatccgagttcaagacctccgctatctggaactaattagttctattgaggaacggaagaagcgcggcgagaccaacaatgatctgttcctggcagatgtgttttcatatcagggcaaatttcatgaggccgctaaattgtataagcggtctggccacgagaacctggctctagagatgtatacggatctgtgcatgtttgagtatgccaaggatttcctgggctctggggaccccaaggagaccaaaatgttgatcacaaaacaggctgactgggcccgcaatataaaggaacccaaggccgccgttgagatgtatatctctgctggcgagcatgtgaaggcgatcgaaatctgcggcgaccacggctgggtggacatgttaatcgacattgcaagaaagctggacaaggcagagcgggaaccattattgctgtgcgccacatatctgaagaaactcgattcgccaggatacgccgccgagacctatctcaagatgggcgaccttaaatcccttgtacagcttcacgttgagacacagcgctgggatgaagcatttgctctgggtgagaaacaccccgaatttaaagacgatatctacatgccatatgcacagtggctggctgaaaatgacaggttcgaggaagctcagaaggctttccacaaagcgggccggcaaagggaagccgtgcaggtcctggaacaattgactaacaacgctgtggcagagtcgaggtttaacgacgctgcttactattactggatgttatctatgcagtgtctggacatcgcccaagatccggcacagaaagatacgatgctgggtaaattctatcactttcagaggctggcagaactctaccacggctaccacgctattcatcggcatactgaggacccattctccgttcatagacctgagactctttttaacatcagcagattcctcctccactcactaccaaaggatacaccctctggaatttcaaaggtgaagatactctttacattggccaaacagagtaaggccctcggagcatatcggttagcccggcatgcctacgataaactaaggggactctacatcccagctcgttttcaaaagtctatcgagctcggcacactcacaatccgggccaaaccatttcatgactcggaggagctggtgcctctctgctacaggtgctccacaaacaatcctctcctcaataacctcggcaacgtgtgtattaactgccgacagccttttattttcagcgcatcttcgtacgacgttctgcacctggtcgagttttatcttgaggaaggaattaccgatgaagaggctatctcgttgattgacttagaggtgctgcggccaaaaagggatgataggcagcttgaaattgcgaacaattctagtcagatcctgaggctcgtggagaccaaggactcgatcggagatgaggacccattcacagcgaaactgtcgttcgaacaggggggatcagagttcgtaccggtcgtcgtgagcaggctagtactgaggtcaatgtctagacgggatgtgcttatcaagcgatggccccctccactgagatggcagtacttccggtctttactgccggatgcatctatcactatgtgcccttcttgcttccagatgtttcactcagaagattacgaactgcttgtgctgcagcatggatgttgtccatattgcagacggtgtaaggacgaccccggtccctag

SEQ ID NO: 191922 - DNA, 3726 bp, Artificial Sequence
  Description of Artificial Sequence: Synthetic coding sequence
atgcgggccgtgctgacctggcgggacaaggccgagcactgcatcaacgacatcgcctttaaaccggatggaacacagctaatacttgcagcaggaagccgactgcttgtgtacgacacctccgacgggacccttttgcagcccctgaagggacacaaggatacggtgtattgcgtggcatacgccaaggacggtaagcggtttgcctcaggtagtgctgataagagcgtgattatatggacttcaaaactagagggaatcctgaagtacacacacaacgatgccatccagtgtgtgtcctacaaccctatcacacaccaactggcctcttgctcctcctccgatttcgggttatggtcgccagagcaaaaaagcgtctctaaacacaagtcatccagcaaaatcatttgttgcagctggaccaacgacggtcaatatctcgccctgggcatgttcaacggcatcattagcatcaggaacaaaaacggagaggagaaggtcaagattgaaagaccaggcggttctctgtctcccatttggagcatctgctggaatccatcatctagatgggagagcttctggatgaatagggaaaacgaggatgccgaggatgtcattgttaatcggtacatacaggagattccaagcacactaaagagcgctgtgtattcctctcagggcagcgaagcggaggaggaagaacccgaagaagaggatgacagtcccagagatgataacctggaagagcggaacgatatcctggccgttgccgattgggggcagaaagtgtccttctaccagcttagtgggaaacagattggcaaggacagggctttgaactttgacccgtgttgtatatcttacttcaccaagggcgagtatatcctactgggaggctctgacaaacaggttagcctctttacaaaagacggcgtgagacttggcactgtcggcgagcagaattcgtgggtctggacatgtcaggccaagcccgattcaaactatgtggttgtcggttgccaagatgggacgatttccttttaccagctgatattctcaactgttcatggactatataaagacagatatgcgtacagggatagcatgaccgatgtgatagtccagcaccttatcactgaacagaaagtgcgaatcaagtgcaaggagcttgtcaagaagatcgccatatacagaaatcgactagctatccagttacctgaaaagatcctcatctatgagctatactcagaagacttaagtgacatgcactatcgagtcaaagaaaaaattattaagaagtttgaatgcaacctcctcgtagtatgtgcaaaccacatcattctgtgtcaggagaaacggctgcaatgcttatcattcagcggagtgaaagaacgagaatggcagatggagagccttatccggtacatcaaggtaatcgggggccctcctggtagagagggactgcttgtaggtttaaagaacggacagatcctcaagatctttgttgataatctgtttgccatagttctgctgaaacaggcaaccgcagtccgttgcctggatatgtccgcatcacgcaaaaagttggccgttgtggacgaaaatgatacttgtctggtgtacgacattgataccaaagaattgctattccaggaaccgaatgcaaactccgtcgcgtggaacacccagtgcgaagacatgctgtgctttagcggcgggggctatctgaacatcaaggcctcaactttcccagtccatcggcaaaaactccaaggtttcgtggtgggatacaacggatcgaaaattttctgtctgcatgtgttctcaatctccgccgtagaggtaccccaatcggcccctatgtaccagtatctagatagaaaattattcaaggaagcgtatcagatcgcttgtctcggtgtgacggatacggactggagggaactggctatggaggccctcgaagggttggattttgaaactgctaaaaaggcctttattcgtgttcaagacctgcgatacctggagctgatctccagcatcgaggagcgcaaaaaaaggggggagaccaacaatgacttgtttctcgccgacgtcttcagctaccaaggcaaattccatgaagccgctaaactgtataagaggagtgggcacgaaaacctcgctctcgagatgtataccgacttgtgcatgtttgagtacgctaaggactttctcggatctggagacccaaaggagacaaagatgttgattactaaacaggcagattgggctagaaacatcaaggaacctaaggcagcggttgagatgtacatctccgccggcgaacacgtaaaggccattgagatttgcggggatcacggctgggtcgacatgctgatcgatattgccaggaagctagacaaagccgagagggagccactgctgctgtgcgctacttatctgaagaaactagactctcctggctacgctgccgagacttacctgaaaatgggggatctcaaatctctagttcaattacatgtcgagacacagagatgggacgaagcgttcgcattgggagaaaaacacccagagtttaaggacgacatctatatgccatatgcacaatggctggccgagaatgacaggtttgaagaggctcagaaggcattccacaaggcggggcggcagagggaggccgtacaggtcctggagcagctgactaataacgctgtcgcagaaagtcgctttaacgatgcagcatattactattggatgctgagcatgcaatgtctggatatagcacaggatccagctcagaaagataccatgctgggcaaattctaccatttccagcgactcgccgaactctatcatggctaccacgcaatccatcgtcacaccgaggatccctttagcgtacatcgccctgagacactgttcaacatttcacgctttttgctgcattcactaccaaaggacacacctagtggcatcagcaaggtcaaaattcttttcactcttgccaaacagtctaaggccttaggagcgtacagactggcgaggcacgcttatgacaagcttcgaggtctgtatatccctgcccgcttccaaaagagcatcgaacttggcacccttacgatccgggctaagcctttccacgacagcgaggaactggtccctctgtgctatagatgctctactaacaatccactgttgaataatttggggaatgtgtgcattaactgccggcagccatttatattcagcgcgtctagttatgacgttctgcatctggtcgaattttatctggaagaaggcattaccgatgaggaggccatttctctcatagatcttgaggtcctgcgccctaaaagagacgacagacagcttgagatcgcaaacaatagctctcagattctgagattagtggagaccaaggattccattggcgacgaggatcctttcactgcgaaactctcgttcgagcagggaggatcggagttcgttccagtggtggtgagccggctcgtactacgcagcatgtcacgaagagatgtattaattaaaagatggccgcccccactccgttggcagtacttccgctcattgctacccgacgcatcaataaccatgtgtcctagctgctttcagatgttccactctgaagattacgagttgcttgtgctccaacatggatgttgtccctactgccgcaggtgcaaggatgatccaggcccgtag

SEQ ID NO: 191923 - DNA, 3396 bp, Artificial Sequence
  Description of Artificial Sequence: Synthetic coding sequence
atgcgggccgtgctgacctggcgggacaaggccgagcactgcatcaatgatattgcattcaaacccgacggaacccaactcattctggccgcaggtagcagactcctcgtctacgatacttccgatggaaccctacttcagcctctgaagggacacaaagacactgtttattgcgttgcatacgcaaaggatgggctctggtcgcctgaacaaaagtccgtgtccaagcacaagtcctcttccaaaataatttgctgctcttggacgaacgacggtcagtaccttgctcttggaatgttcaacggtattatcagcatcaggaacaaaaacggggaggagaaggtgaagattgagagaccgggtggcagtctgagtccaatctggtccatctgctggaatccatcgcgcgaagagcggaacgatatcctggctgtcgccgactgggggcaaaaagtctccttttatcagctctccggaaagcagatcggtaaggacagggcactgaactttgatccctgttgtatctcatacttcaccaagggtgaatacatcctactgggaggctctgacaagcaggtatccttgtttaccaaggatggggtacgactcggcaccgttggcgaacaaaatagttgggtttggacttgccaagccaagcccgatagcaattacgtggtggtgggatgccaggacgggacgatcagtttctatcaactgattttcagcaccgtccatggactttataaagaccgctatgcttatcgcgattcaatgacagacgttattgtgcagcatctgattacagaacagaaggttcgaattaagtgtaaagaactggtcaagaagatagcaatctaccggaaccgattagcaatccaattgcccgagaaaatcctcatctacgaattatacagtgaagatctatcagatatgcactacagggtcaaggaaaaaattatcaaaaaattcgagtgtaaccttctagtcgtttgcgccaatcatataattctgtgccaggaaaagagacttcagtgcctgtctttttccggcgtgaaagaacgagaatggcaaatggagtcactgattcgctacattaaagtcattggcggcccacccggcagagaagggctgctcgttggactgaaaaacggccaaatcctcaaaatctttgtcgataacctgtttgcgattgtgctactgaaacaggccactgctgtccgttgcttggacatgtccgcttcacgaaaaaagctggccgttgtcgacgaaaatgacacctgtctggtttacgacattgatacaaaggagctgctgtttcaggagcctaacgcaaactctgtggcatggaatactcagtgtgaggatatgctgtgtttctcagggggcggatacctcaatattaaagcatccacgttccctgttcatcggcaaaagttgcaggggtttgtggtgggttacaacggatccaagatattctgtcttcacgtatttagcatcagcgcagtggaggtgccacagagtgctcccatgtatcagtacttagataggaagctcttcaaggaggcttaccagatcgcctgtttgggagtaacagacacagactggagggagttagccatggaagcgttagaggggctcgatttcgagacagctaagaaagcttttatacgggtgcaggacttgagatacctcgagttgataagcagcattgaagagaggaagaaacggggtgaaactaacaacgacttgtttctggccgatgtgttctcctatcagggaaaattccacgaggcggcgaagctctataagaggagtggccacgagaatctggctctggagatgtataccgacttatgcatgtttgagtacgccaaggactttctgggctcaggcgacccaaaagaaaccaagatgctgattactaagcaagccgattgggctaggaatattaaggagcccaaagcagctgtcgaaatgtatattagtgctggagagcatgtcaaagccatcgaaatttgtggagatcatggatgggtggacatgcttattgatatcgcccgcaaactggataaagccgagcgcgagcctctgctcttatgcgcaacttacttgaaaaagcttgattcacctgggtacgcagccgaaacttatctaaaaatgggcgacctcaagagcttggtgcagttgcatgtggagacgcagcgctgggatgaggctttcgccttgggtgagaaacaccccgaattcaaagatgacatctatatgccttatgctcagtggctcgcagagaatgataggttcgaggaggctcagaaggctttccacaaggcaggcagacagcgcgaggccgttcaggtcttggagcagctgaccaataatgccgtggccgaaagccggttcaacgatgccgcttactactactggatgttaagcatgcagtgccttgacatcgctcaggccgaccctgctcagaaggatacaatgctgggcaaattttaccactttcagaggttggcggaactctaccacggttaccacgccatccaccggcacacagaagatccattttctgttcaccgtcccgaaacactattcaatatcagccgcttccttctgcatagtttgccaaaggatacaccaagtgggatatctaaagttaagatcctgtttaccctggccaagcagtccaaggccctgggggcctacaggctggctcgccatgcttatgataaactgagaggcctgtacatccccgctcgatttcagaaatccattgaactgggcacattgacaatccgggcgaagccctttcacgactctgaggagctcgtccccctgtgctatcggtgtagcacaaacaatcccctccttaacaacctgggaaacgtctgcataaattgtcgacaaccattcattttctctgcctctagctacgacgtattgcacctggttgagttttacttggaagaaggtatcaccgatgaggaagctattagccttattgatttggaggtgttaagacccaaaagggacgacaggcagcttgagatagccaataattcaagccagatcctgaggttggtggaaactaaggattcgataggcgatgaggatccttttaccgctaaactaagttttgagcagggcggcagtgagtttgtacccgtcgtcgtgtcccggctagtcctacggtctatgtctcgccgggacgtcctcatcaagagatggccacccccactgcgatggcaatattttcggtcactgctacctgacgcttcaataaccatgtgtccttcctgtttccagatgttccattctgaggattatgaacttctggttttacagcatggttgttgcccgtattgtcgcaggtgcaaggacgatcccgggccttag

SEQ ID NO: 191924 - DNA, 3276 bp, Artificial Sequence
  Description of Artificial Sequence: Synthetic coding sequence
atgttcaacggcatcatcagcatccggaacaagaacggcgaggagaaggtgaagattgagagacccgggggaagcctctcaccgatttggtccatttgttggaacccctccagcagatgggaatctttctggatgaaccgcgagaatgaggatgcagaggacgtgatcgtgaatagatatatccaggagatccccagcaccttgaaatctgcagtgtacagcagccaaggctcagaagccgaagaggaggaacctgaggaagaggatgattcgccgagggatgacaacttagaggagcgcaatgatatcctagcagtggccgattggggacagaaagtgtccttttaccaactgtcaggtaagcaaattggcaaagatagagctttaaatttcgacccttgctgcataagttatttcaccaaaggcgaatacatccttctcggggggtccgataagcaagtgagcctgtttactaaggacggggtgaggctcgggacagtgggggaacaaaacagctgggtgtggacatgccaggccaaacctgactccaactatgttgtggttgggtgtcaggatggcacaatcagcttttaccagctgattttctccacagtgcacggcctgtacaaggatcgctacgcttacagagactctatgactgatgttatcgtccagcacctgattacagagcagaaggtaaggattaagtgcaaagagctcgtaaagaagattgctatctatcgaaatcgactcgcaattcagctgcccgaaaagattttaatctatgaactgtatagtgaagacctgagtgacatgcattacagagtgaaggaaaagatcataaagaagtttgagtgcaacttactggtggtttgtgccaatcacattatcctgtgtcaagagaagagattgcagtgtctttcattttccggtgtgaaagaacgggagtggcagatggagagcctgatcagatacattaaagtgatcggggggccccctgggcgtgagggccttttagtcgggctgaagaatggccagattcttaagatcttcgtggacaatttgtttgcaatcgtcctcctgaagcaagccactgccgtgcggtgtttagatatgagcgctagtaggaagaaactggccgttgtggatgagaacgacacatgcctggtttacgacatcgataccaaggaactcctgttccaggagcctaacgctaatagcgttgcttggaacactcaatgtgaggacatgctctgtttttcggggggcggatacctgaatataaaggccagtaccttccctgtacacagacagaagctgcaaggctttgttgtgggctataacggtagtaaaattttttgtctccatgtcttctctatttctgccgtcgaggtgccacagtcagcacctatgtaccagtatctggatcgcaaactcttcaaggaggcctatcaaatagcctgcctgggcgtgactgataccgattggcgtgagctggctatggaggcactggaaggactcgacttcgagacggccaaaaaggcattcatcagggtacaggacctcaggtatctggaactgatctccagcatcgaggaaaggaaaaaaagaggagaaaccaacaacgacctctttctcgccgatgtgtttagttatcagggaaagttccatgaggctgccaaactgtataagcggagtggccatgagaatctagccctggaaatgtacacagatctgtgtatgtttgaatatgcgaaggattttctgggatctggcgaccctaaggagacaaagatgctgattacaaagcaggccgattgggcacgtaacatcaaggaaccaaaagcggccgtggagatgtatatatctgccggggagcatgtaaaagctatcgagatctgcggcgatcatggatgggtggatatgctgattgatatcgctaggaagctggacaaagcggagcgtgagcccttattgctgtgcgctacgtacttgaagaaactggacagcccaggatacgctgccgagacgtatctcaagatgggagatctgaagtctttagttcagctgcacgtcgaaacacagcgctgggatgaagcatttgctctcggcgagaaacaccccgaatttaaggacgatatttacatgccttatgcacagtggctggccgaaaacgatcgattcgaagaagctcaaaaagcctttcacaaagcaggtcgccaacgagaagctgtacaggtgctcgaacagctaactaacaacgcagttgctgaatctcggtttaatgatgcagcatactattactggatgctcagcatgcagtgcttggacatcgcacaggacccggcacagaaggacactatgctcggcaagttctatcactttcaacggctggcagaactttaccatggctatcatgctattcaccgtcacactgaggatccgttttctgtgcacaggcctgagaccttgtttaacattagtagatttttgctgcacagcctaccgaaggacacgccgtcaggtataagcaaggtgaagatcctgtttacattagccaaacagtcaaaagctctgggcgcctaccgcctggcccgccacgcctacgataagctgagaggactctatatcccagcccgatttcagaagtctatcgagttgggaacactcacaatcagggccaagccatttcacgatagtgaagagctggtcccactctgctatcgctgtagcaccaataaccccctcttaaacaatctgggaaacgtctgtatcaattgcagacagccattcatcttttccgctagctcgtacgacgtactgcacttggttgagttctacctggaggagggcataacggacgaagaagctatctcattgattgatctggaggttttgcgaccaaaaagagatgacagacaactggagatagccaacaatagctcccagatcctcagactggtggagacaaaggattcaattggggacgaggaccccttcaccgctaagctgtcttttgagcagggaggatccgagttcgtccccgtggtggtgtccagactggtgctccggagtatgtcaagaagggatgtactgattaagagatggccaccccctttacggtggcagtactttcgctccctcctgccagacgcaagcatcacaatgtgtccatcctgttttcagatgtttcactcagaagactacgaactgcttgttctgcaacatgggtgttgtccatactgcaggcgatgtaaggacgacccaggaccctag

SEQ ID NO: 191925 - DNA, 3099 bp, Artificial Sequence
  Description of Artificial Sequence: Synthetic coding sequence
atgttcaacggcatcatcagcatccggaacaagaacggcgaggagaaggtcaaaatcgagaggccggggggctccctttcacctatctggtcgatttgctggaatccaagtagggaggaacggaatgatatcctagctgtggctgactggggacagaaagtttcattctatcagttgagcggcaagcagatcggtaaggaccgcgcattgaatttcgatccgtgctgcatctcatactttaccaaaggggagtacattttgctgggcgggtccgacaaacaggtgagcctgtttacaaaggacggagttaggctcggcactgtcggggagcagaattcgtgggtgtggacatgccaggcaaaaccagatagcaattacgtggtagttggatgtcaagacgggaccatttccttctatcaactgatcttctccacagtgcatggattatacaaagaccgctatgcctatagagactcgatgaccgacgttattgtgcaacacctgattaccgaacagaaggtcagaattaaatgcaaggagctggtgaagaagattgctatttacagaaacagactcgcgattcagctgcctgaaaaaattctaatctacgagctgtactctgaagacctgagtgatatgcactaccgtgtgaaagagaagataattaagaagttcgagtgcaatctactggtggtgtgcgcaaatcacattatcttgtgccaggagaaacgcctacaatgtctgtccttctctggagttaaggaacgagagtggcaaatggagtccttaatacgctacattaaagtcataggcggtccccctggcagagagggtctcctagtggggctgaaaaatgggcaaatcctcaagatttttgtggataatctctttgcgattgtgctgctgaagcaggcaacagctgttaggtgcctggacatgagcgcctcacgcaaaaagctggccgttgtagacgaaaacgatacttgtttagtatacgacatcgacactaaggagctgctctttcaggagcccaacgccaattcggttgcatggaacacacagtgtgaggatatgctctgtttctctggtggcggctacctgaacatcaaagcctctacttttcccgtgcaccggcagaaacttcagggtttcgttgttggctataatggttcaaagatcttttgcctgcacgtgttctccattagcgccgtagaagttcctcaatctgcccccatgtatcagtatctagataggaagctgttcaaggaagcataccagattgcttgtctgggtgtcactgatactgattggcgggagttggccatggaagctctggaaggacttgatttcgagaccgccaagaaggcattcattagagtacaagacttgcggtatctggagctcatctctagtattgaagagcgcaagaaacggggggagacaaataacgatttatttcttgcagatgtgttttcctatcagggcaagtttcatgaggccgccaaactgtataaacgcagcggacatgagaacttggccctggagatgtacactgacctttgcatgttcgagtatgccaaggacttcctgggctcaggtgatcctaaggaaacaaagatgttgatcaccaaacaagccgactgggctcgcaacattaaggagccaaaggcggcagtggagatgtatatttccgccggtgagcatgttaaggcaatcgaaatttgtggcgaccatgggtgggtagacatgctgatcgacatagcccgcaaactggataaggccgagcgcgagcctctgttgttgtgtgcaacctacttaaagaaactggacagccctgggtatgccgcggagacatacttaaagatgggagacctcaagtctctggtccagctgcatgtggagacacagagatgggacgaagcgttcgcgctaggagagaagcacccagaatttaaggatgatatttatatgccatatgcccaatggttagctgaaaatgaccggttcgaagaagctcagaaggccttccataaggcgggtcggcaaagggaagctgtgcaagtgctcgaacaacttaccaacaatgctgtcgcagagagtagattcaacgacgccgcttattattattggatgctgagcatgcagtgtctggacattgcccaggatccagcacagaaggacactatgctggggaaattttatcatttccagcgcctcgccgaactgtaccatggctatcacgccattcacaggcatactgaagatcccttctctgttcataggccagagactctctttaatataagtcggtttctactacatagcctccccaaggacacacctagcggtattagtaaggttaagatcttgttcacactggctaagcaaagtaaggccctcggagcctacagacttgcaagacatgcctacgataagcttagagggttgtacatccccgcgagatttcagaagagcatcgagctgggaaccttaacaatccgcgccaagccattccatgactcagaggaactggttccgctctgctaccggtgttccaccaataatccacttttaaacaatctgggcaacgtttgcattaattgtcgccagccattcatctttagcgcatcttcatacgatgtgctgcatctggtcgagttctatctggaagaaggcatcaccgatgaggaggccatcagcctcattgatcttgaggtgctcaggcctaaacgcgatgaccgccaattagaaattgccaataactcaagtcagatcttgcgactggtggaaaccaaagacagtatcggagacgaggatccttttactgccaagctctccttcgagcaaggaggctcagagtttgtccctgtggtggtaagtcgcctcgtattacgctcaatgtctagaagggatgtgctaattaaacgctggccccctccactgcggtggcagtattttaggtccttactgccggacgcctccatcaccatgtgtccgtcttgctttcagatgtttcattccgaagactatgaactgctggtactgcagcacgggtgctgcccatattgcaggcgctgtaaggatgatccgggaccctag

SEQ ID NO: 191926 - DNA, 3252 bp, Artificial Sequence
  Description of Artificial Sequence: Synthetic coding sequence
atgcgggccgtgctgacctggcgggacaaggccgagcactgcatcaacgacatcgctttcaagcctgacggtacccagttaattttagccgcaggatcacggctgcttgtctacgatacctcggatggcaccctacttcaacccctgaaagggcacaaggacacagtctactgcgttgcttacgcaaaggatggattgtggtcaccagagcagaaatctgtgtcaaagcacaaaagttcctccaagataatatgttgcagggaggaaaggaatgatattttggcggtggctgactgggggcaaaaagtgtcattctaccaactttccggtaagcagattggcaaggaccgcgcactgaacttcgatccatgctgtatctcttatttcacaaagggcgagtacatcctgctggggggttctgacaaacaagttagcctgtttacgaaagacggcgttcggctcggcactgtgggcgaacagaattcctgggtttggacctgccaggcaaaacctgactcgaattacgtcgtggtgggctgccaggacgggaccatcagcttctaccagttaatcttcagtaccgtgcacgggttatataaggatcgttatgcctatcgggacagtatgaccgacgtgatcgtgcagcacctcatcaccgaacagaaagtaaggattaagtgcaaggagcttgtgaagaagattgctatctaccgtaaccgcttggcaatccaactccctgagaagatcttgatatatgaactgtactctgaagatctgagcgatatgcactatcgagtgaaggagaagattatcaagaaattcgaatgcaatttactcgtcgtgtgtgccaatcacataattttgtgtcaagagaaacgtctgcagtgtctgtcttttagtggtgtcaaagagcgcgaatggcagatggagtcccttatcagatatattaaagtcatcggtgggcctcccggccgggagggcctccttgttggcttgaagaacggccagatattgaagatcttcgtggacaacctgtttgccatagttctgctcaaacaggccactgccgtcaggtgcctagacatgtccgccagtagaaaaaagctcgcagtggttgatgagaacgacacctgtctggtgtacgacattgacaccaaagaactactgttccaggagccaaacgctaatagcgtggcttggaacacacaatgcgaggatatgctgtgcttttcggggggaggctatctgaacatcaaagctagtacatttccggttcaccgccaaaagctgcaggggtttgtggttggctataatggatcaaagatcttttgcctgcacgttttctccatttcagctgtcgaggtaccacagtccgcaccaatgtaccagtacttggatcgaaaacttttcaaggaggcttatcagatcgcttgcctgggcgtaacagatactgactggagggaactggctatggaagctctggaaggactcgacttcgagaccgctaagaaggcgttcatcagggtccaagatttgcggtacctcgagctcatcagttccatcgaagagcggaaaaagcgaggcgaaaccaacaatgatctttttctcgctgacgtgtttagctaccaaggcaagttccacgaggcggccaagttgtacaaaaggtcaggtcatgaaaacttagccctcgagatgtacacggacctctgcatgttcgagtacgccaaagacttcttaggctcgggagatcctaaggagaccaaaatgttgattactaagcaagctgattgggcccggaacattaaggaacctaaggccgctgtggagatgtacatctccgccggggagcacgtcaaggcgatagaaatctgtggggaccacggctgggtggatatgctgatcgatatcgctcgtaagctcgataaagctgagcgcgagcccctactgctctgcgccacatacctgaagaagctggattcacccggctacgcagccgaaacataccttaaaatgggggatctcaagagtttagttcagctgcacgtggaaactcagagatgggacgaggcgtttgccctgggggagaagcacccagagtttaaggatgacatctatatgccctatgcacaatggctggccgaaaatgatcgatttgaagaggctcaaaaggcctttcacaaggcaggtcggcaaagggaggccgtgcaggttctggaacaactcaccaataacgcggtggctgagagtagatttaacgacgcagcttattactactggatgctttccatgcagtgtctcgacatcgctcaggccgatcccgcccaaaaagataccatgctagggaagttttatcattttcagaggctggccgaactgtaccatggatatcatgctatccaccgccacacagaagatcctttctccgtgcacagaccagaaactctctttaatatttcccgatttttactgcacagcctgcctaaggacacgccatcagggatctcaaaggtgaggaaaatcttattcactctcgccaagcagagcaaggcccttggggcatacagacttgcgaggcacgcctatgacaaactgcgcggcttgtacattccagccagatttcagaagagcatcgagctggggacattgaccatccgggccaagccattccacgactccgaggagctggtcccgctttgctacaggtgctctaccaacaatcctctgctgaataatctaggaaatgtgtgtatcaattgtcgccagccattcatcttttctgccagctcatacgacgtgctgcatctggtggaattctatctggaggagggcatcacagacgaggaggctatctcattaatcgacctggaggtgctgaggccaaaacgtgatgacaggcagcttgagatcgctaataattcttctcagatcctgcgcctggtggaaaccaaagactctatcggagacgaagacccttttaccgcgaagctcagtttcgaacagggcggtagcgagtttgtgccagttgtggtgtcccggcttgtactgcgctccatgtccaggcgcgatgtcctcattaaaaggtggcctccccctctgcggtggcagtactttcgctccctcctcccagacgcttcaataaccatgtgcccatcctgtttccaaatgtttcattcagaggactatgagctgctcgtgttacagcacggctgttgcccttattgccggcgatgcaaggacgatccaggaccttag

SEQ ID NO: 191927 - DNA, 2886 bp, Artificial Sequence
  Description of Artificial Sequence: Synthetic coding sequence
atgcgggccgtgctgacctggcgggacaaggccgagcactgcatcaatgacatcgccttcaaaccagatggaactcagttaatcttggctgccgggtcacgcctcttagtctatgacaccagcgatgggactttgcttcagccactcaaaggacataaggacacagtctattgcgtcgcatacgccaaggatggcaagagattcgcaagcgggagcgctgataagtcagtcataatctggacctccaagcttgagggaattctaaaatatacgcataatgacgccatccaatgcgtttcctataatcccataacccatcagctggcaagctgctcatcatcggattttggactgtggtcccccgagcaaaaatccgtcagtaagcacaagtctagttctaaaatcatctgttgttcatggacgaacgacgggcagtacctggcattgggaatgtttaatggtatcatatcaattagaaacaaaaacggagaggagaaagtgaagatcgagcgacccgggggcagtttaagccctatttggagtatttgttggaatccgagccgggaggaacggaacgacatccttgctgtggcagactggggacagaaggtaagcttctaccagcttagcggaaagcagataggcaaagatcgggctctgaatttcgacccatgctgcataagctacttcacgaaaggagagtacattctgttgggcggatccgataagcaagtctctttgttcacaaaggatggcgttcgcctcggcacagtgggcgagcaaaattcctgggtttggacctgtcaggctaaaccagacagtaactatgtcgtggttgggtgtcaagatggaactatctctttctaccagctgattttctctaccgtacacggcctttataaagacagatatgcttacagggattccatgaccgacgtcattgtgcagcatttaatcacagaacagaaggtgcggataaaatgtaaagagctggtcaaaaaaatcgcgatctaccgcaatagactcgctatccaacttccggaaaagatcctaatctacgaactgtattccgaggacctgagcgatatgcactaccgcgtgaaagagaaaattatcaagaaatttgagtgtaacctgctggtcgtttgcgcaaatcacatcatactgtgtcaggagaagagactccaatgccttagcttctctggcgtgaaggaacgcgagtggcagatggaaagtcttattcggtacatcaaagtgattggcggcccccccggcagggagggcttgctagttggcttaaagaacgggcagattctgaagattttcgtggataacttgtttgccattgtactgctgaagcaagctaccgccgttcgttgtctagacatgagcgcgtcgagaaaaaaactcgccgtcgtggacgaaaacgacacttgcctcgtgtacgatattgacaccaaagagttgcttttccaggagcccaacgctaactccgtggcctggaatacccagtgcgaggatatgttgtgctttagcggcggaggataccttaatatcaaggcttcgacctttcctgtgcatcggcagaagcttcagggctttgtggtgggatataatgggagtaagatcttctgcctccatgtcttctcaatatcggccgtggaagttccccagtcggccccaatgtaccaatatctggatcgcaaactatttaaagaagcataccagattgcctgcctgggggtaacggacacagattggagagaactggctatggaggccttggaaggcctcgactttgagactgccaaaaaggcttttataagggtgcaggatctgcggtatctcgagctcattagcagtatagaggagagaaaaaagcgcggcgaaactaataacgatctttttctcgccgatgtattcagttaccagggcaaattccatgaggcagcgaagttgtacaagcggtccggtcacgaaaacctggcccttgagatgtacactgacttatgtatgttcgaatacgccaaagacttccttggatcaggcgaccccaaggagactaaaatgctcattaccaagcaggcagattgggctcgcaatataaaagagcctaaggccgcagtggaaatgtatatcagcgcaggggaacatgtcaaagccatcgaaatttgtggggaccatggctgggtggatatgctgatcgatatcgcccgaaagctggataaggcagagcgagaaccactgctcctgtgcgccacataccttaagaagctcgactcgccaggttacgccgcagaaacatatttgaaaatgggggacctgaagtccctcgtccagttgcacgttgagacccagcgatgggacgaggctttcgccttaggcgagaaacaccctgagtttaaagatgatatctacatgccatacgcacagtggctggccgagaacgatcgattcgaagaagcccagaaagcctttcacaaggcgggacgtcagcgggaggctgtgcaagtgctggagcagctgaccaacaatgccgtggccgagtccagattcaacgacgcagcctactactattggatgctttctatgcagtgcctcgacatcgcccaggatcctgctcagaaagatacaatgctgggcaagttttatcactttcagaggctggctgagctctaccacgggtaccacgccatccatcgccataccgaagaccctttctctgttcaccgcccagagaccctttttaatatttctcgtttcctgcttcattcgttacccaaagacacaccttccggaatcagcaaggtctgcgagaataccctacacctcggccaggccgaacagggtcctcggtgtctgcaggccggcccagcaaggctgtag

SEQ ID NO: 191928 - DNA, 3357 bp, Artificial Sequence
  Description of Artificial Sequence: Synthetic coding sequence
atgcgggccgtgctgacctggcgggacaaggccgagcactgcatcaatgacatagccttcaaacctgatgggacccagctgatcttagccgctggctctcgactcctagtttatgatacaagtgacggaacactattgcagcccctcaaaggacacaaggataccgtctactgtgtcgcttacgctaaggatgtgctctgcatcgaaggcctttggtctccggaacagaagtcagtcagtaagcacaaaagttcttccaaaatcatctgttgcagttggacaaatgatggccaatacctggccctcggtatgtttaatggaatcatttccatccgcaataagaatggggaagaaaaagtgaagattgaacggcccggtggctctctgagcccgatctggtcaatatgttggaatccctcaagagaagagcgcaacgatattctcgccgtggccgactgggggcaaaaggtaagcttctatcagttgtcaggcaaacaaatcggaaaggaccgggccctgaacttcgacccctgctgcatatcttatttcaccaagggcgaatacattctcctgggtgggagcgataagcaagtttccctgttcactaaagacggtgtacggcttgggactgtcggtgaacagaactcgtgggtatggacatgtcaggcgaagccagacagtaattatgtggtggttggttgtcaggatggtacaatctccttttatcagctaattttttctaccgtgcacggactgtataaggatcggtacgcctacagggattctatgacggacgtcatagttcaacatctgataaccgaacaaaaggtgagaattaaatgtaaagagctggtcaaaaagatcgcaatttacagaaatcggttagccatacagttgcctgaaaagattctgatctacgaactgtactctgaggaccttagcgacatgcattatcgtgtaaaggaaaagatcattaagaaattcgagtgcaatctgctggtggtgtgcgctaatcatattatcctttgccaagagaaaagactccagtgcctttcgttttcaggcgtcaaggaaagggaatggcaaatggagagtctgatccggtatatcaaagtcattgggggccctcctgggcgggaggggctgctggtggggttgaaaaatggccagatcctgaaaatatttgtcgacaacctgtttgcaatagtgcttctaaaacaggcaacagcagtacgctgcttagatatgagtgcatctcgcaagaagcttgcagttgtagatgagaacgacacttgtctggtttacgacatagatacaaaggagctcctgttccaagagccgaacgctaacagtgtagcatggaatacacagtgtgaggatatgctgtgcttcagcggaggtggttatttaaatattaaagcctcgactttcccagtccacagacagaagctgcaaggattcgtggtgggttacaacggctccaagatcttttgtctccatgtgttttccattagtgctgtggaggtcccacaaagtgctcctatgtaccagtatctcgaccgaaaactctttaaagaggcctaccagattgcgtgtttaggggtcacggacaccgattggcgggaacttgccatggaagcccttgagggacttgattttgaaaccgccaaaaaggagcggaagaaaagaggcgagaccaacaatgatctgttcctggccgatgtgttctcctaccaggggaaattccatgaggccgcaaagttgtataagcgcagtggtcacgaaaatctggccctcgagatgtacaccgatctctgcatgttcgaatacgccaaagacttccttggatcaggagacccaaaagagacaaagatgttgatcacgaagcaagcggactgggcccgcaatatcaaggaaccaaaggccgccgtcgaaatgtatatttcagcaggagaacacgtaaaagcaattgaaatatgtggagatcatggctgggtggacatgcttatcgacattgcaagaaaattagacaaagctgagagggagccattgctcctctgtgcgacatatctgaaaaaactggactcccctggctatgccgctgaaacataccttaagatgggtgatttgaagagcttggtccagttgcatgtcgagacacaacgatgggatgaggcatttgccctcggtgagaagcaccctgaatttaaagatgacatctacatgccatacgctcagtggctagcggagaatgataggttcgaggaagctcagaaggcttttcacaaagcgggccgtcaacgggaggctgtgcaggtactggagcagctgaccaacaatgctgtggcagagagtcgctttaacgacgctgcttattactattggatgctgtcgatgcagtgtctggatatcgcccaggcagatcctgcccaaaaggacacaatgctggggaagttctaccacttccagcgtttggccgaactgtaccacggctaccatgcgatccaccgacataccgaggatccttttagtgtgcatcggcctgagacattgttcaacatcagtaggttccttctgcactcactgcccaaagatacaccttccggtatcagcaaggtgaagatcctcttcactctggcgaagcagtctaaagccttgggggcgtacagactggctaggcatgcctatgacaagttacggggtctgtatatccccgcaaggtttcagaaatccatagagctgggcaccctgacgatccgcgccaagccattccacgacagtgaagagttggttcccctctgttaccgttgttcgaccaacaatccactcctgaacaatctgggcaacgtttgcataaactgtaggcagccattcatcttctccgctagtagctatgacgtgctacatctggtggaattttatcttgaggagggtatcaccgacgaggaggcaatttccctcatcgatctcgaggttctgaggcccaagagggacgataggcagctggaaatcgcgaataactcaagccagatattaagactggtcgaaaccaaggactcaattggagatgaagatcctttcacagcaaagctatcattcgagcaggggggctcagaattcgtccccgtcgtagtgtcgaggctcgtcctccggtccatgagtcgtagagatgtgcttatcaagcgatggccaccaccactacgctggcagtacttccggtctttgttacctgatgcctccatcaccatgtgtccctcctgtttccaaatgtttcactcagaagattacgaactgttggttctccaacatgggtgctgcccttactgtcggcgctgcaaagacgaccctggcccatag

SEQ ID NO: 191929 - DNA, 5250 bp, Artificial Sequence
  Description of Artificial Sequence: Synthetic coding sequence
atgcacctgaagcacctgcggaccctgctgagcccccaggacggcgcagctaaagtcacatgtatggcttggtcccaaaacaacgctaaattcgccgtgtgtacggttgaccgtgtagtactgctgtacgacgagcacggcgaacgcagagacaagttcagcacaaaaccagccgacatgaagtacggccgcaaaagctacatggtaaaaggtatggcatttagtcccgacagcacgaagatagcgatcggccagacagataacattatttacgtctataaaattggcgaagattggggcgacaagaaagtgatttgtaataaatttatccagacctccgcagtgacctgtttgcagtggcccgcggaatacattatcgtgtttggcctcgctgagggcaaagttaggctcgccaacacaaagacaaacaagagcagcacgatctacggcacagaatcttatgtggtatctctcaccaccaactgttcaggcaagggtatcctgagcgggcacgcagacgggactatcgtacggtatttcttcgacgatgagggaagcggagagagccaggggaaactggtgaaccacccatgtccaccttatgccctcgcctgggctactaactccatagtggcagcgggctgtgatcgcaaaatagtcgcctacgggaaggagggccacatgctgcagaccttcgactacagccgcgatcctcaggagcgagagttcacgacggccgtctcctctcccggaggacaaagtgtggtgcttggatcatacgaccggctacgggtcttcaactggatacctcggagaagtatctgggaggaggccaaacccaaggaaattacaaacctgtacactatcactgccctggcatggaaacgcgatggctcccgactgtgcgtgggaacactgtgtggcggtgtcgaacagtttgactgctgcctcaggcggtcgatttacaagaataagtttgagctcacatacgtcggaccttctcaggtgatagtgaagaatctctcctctgggacacgggttgtccttaaatctcattacggatatgaggttgaagaggtgaaaattcttggcaaagagaggtatctggttgcccatacaagcgagactttgctgcttggcgatctgaacaccaatcgcttatcagagattgcttggcagggtagcggaggcaatgagaagtatttcttcgaaaacgagaatgtgtgcatgatcttcaacgccggcgagttgactctggttgagtacggtaataatgacactctgggctccgtacgtacggagtttatgaacccccacttgatctctgtgaggatcaatgaaagatgccagaggggcacggaggataacaaaaagctagcttatctgattgacataaagacaattgccattgttgatctgattggaggttataacataggcaccgtgtctcatgagagtcgggtcgattggcttgagctcaacgagaccggccacaagttgttatttagagataggaagctcaggctgcacctctacgacatcgaaagctgtagcaaaacaatgattcttaatttctgttcttacatgcagtgggtgcctggttcagacgtgctcgtggcccagaaccgcaactctctttgtgtgtggtataatatagaggcccctgagagagttaccatgtttaccattcgcggtgacgttatcggcctcgaaaggggtgggggaaagacagaagtgatggtgatggaaggagtcacaacagtggcatacactttggacgagggcttaatcgaattcggcaccgcaattgatgatgggaactacattcgggccacggccttcctggagacactggagatgacacctgagacggaggccatgtggaagactctgagtaagctagctttggaagcccggcagctgcatatcgccgagcggtgttttagcgcgctgggtcaggtggctaaggcaaggttcttgcatgaaacaaatgagatcgcggatcaggtgtcacgggaatatggcggcgagggtactgatttctaccaggtccgtgcccgcctcgctatgctggaaaaaaattacaagctggctgagatgatcttcctcgaacagaatgctgtggaggaggccatgggtatgtaccaagagctgcatagatgggacgagtgtatcgctgtggcagaagcgaaagggcatcccgccttggaaaagctgcgtagaagctattatcagtggctaatggatactcagcaggaagaacgcgccggggagctccaagagagccagggggacggcttagccgccatctcactatatctgaaggctggattgcccgcaaaagcagccagactggtattgactcgggaagagctgcttgccaacacagagcttgttgagcacattacagccgctctgatcaagggggagctctacgagcgggcgggagacctgttcgagaagatccacaacccgcagaaagccttagagtgctaccgcaagggtaatgcgttcatgaaggctgttgagttggctcgattggcttttcccgtcgaggtcgtaaaactagaagaggcttggggagatcatctggtccagcagaagcaactggacgccgcaatcaatcattacatagaagctaggtgttcaattaaagctattgaagccgcccttggcgcgcggcagtggaaaaaagctatttacatcctggacttgcaagatcgcaacaccgctagcaagtattacccactggtagcacagcactatgcctcattgcaggaatatgaaattgctgaagagctctatacaaaaggagaccgcacaaaggatgctattgatatgtatacccaagcgggacggtgggagcaggctcacaagttggccatgaaatgcatgaggcccgaggacgtgtcagttctgtatataactcaggcacaggagatggaaaagcaggggaaatacagggaggcagagagactgtatgttacagttcaagaacccgatctcgccataacaatgtataagaagcacaagctgtatgacgacatgatcaggctggtggggaaacatcaccctgacttattgagtgatacacacctccatttagggaaggaactggaagccgaaggaagactccaggaagctgagtaccactacctagaggcccaggaatggaaggccaccgtgaacatgtaccgggctagtggcctgtgggaggaagcgtatcgtgtcgctagaacgcagggcggagctaacgcacataagcacgtggcatatttatgggccaaaagcctggggggcgaagccgccgtgcggttgctcaataagttgggcctccttgaggctgccgtcgatcatgctgccgataactgttccttcgagttcgctttcgaattaagtcgactggctctgaagcataaaacgcccgaagtccacttgaagtacgctatgttcctggaggacgaaggcaaatttgaagaggcggaggctgagtttatcagagccggaaaacctaaagaagctgtgctgatgtttgtccataatcaagactgggaggccgcccagcgagtggcagaagcccatgatcctgactccgtcgcggaggtgctggttggccaagcccgaggcgctctggaggaaaaagatttccagaaagccgagggcctgctgcttagggcccagcgccccggacttgccctgaattactataaggaggctggcctctggagcgacgcactccgcatctgcaaagactatgtgcctagtcagctcgaagccctccaggaggagtacgaacgcgaggccaccaaaaagggggcaaggggggttgaaggattcgtggagcaggcccgacattgggagcaagcaggggaatattctcgggctgtggattgctatctgaaggtcagggacagcggtaacagcggcctggccgagaagtgttggatgaaggcggccgaactgtcaataaagtttctcccacctcagcggaacatggaggtcgttctggccgtcggccctcagctcatcggaattggcaaacactccgcagcagccgagctgtatttgaatctcgacctggttaaagaggcaatcgatgccttcattgagggcgaagaatggaataaagctaagagagttgccaaagaattggacccccgctacgaagactatgtggatcagcactacaaagagtttctgaaaaaccagggtaaagtggattcgcttgtgggggttgacgtaatcgccgctctcgacctgtatgtagaacagggccagtgggataagtgcatcgagacagccaccaaacagaactacaagatactgcataaatatgtcgcactctacgctacccatttgatccgggagggatcgagtgcacaagctctcgctctttatgtgcagcacggagctccagccaaccctcaaaactttaacatttataagcggatctttacagacatggtctccagccccggcacaaactgcgctgaagcctaccatagctgggcagacctgagagacgtcctgtttaacctctgtgaaaacctggtcaaatccagtgaagctaatagccctgcacatgaggagttcaagaccatgctgcttatcgcacactactatgccacgagatctgccgcccagagtgttaagcagcttgagaccgtcgcagctagattgtcggtgagcctgctgcggcatacccagctgctccccgtggacaaggcgttctacgaagccggcattgcagctaaggcggtggggtgggataatatggcatttatctttttgaaccggttcctggaccttactgatgctatcgaagagggaaccttagatgggctggatcactctgacttccaagacaccgatatccccttcgaagtgcccctgcctgctaagcaacacgtacccgaagccgaacgcgaggaagtgagagactgggtgctgaccgtcagcatggatcagcgccttgaacaggtgctgcctagggacgagcgtggcgcctatgaggcgtcactggttgcagcctccacaggagttagggccctgccatgcctcattactgggtatcctatactgcgcaataagatagaatttaagcggcctgggaaggctgctaataaggacaactggaacaaattcctgatggccatcaaaaccagccacagccccgtctgccaggacgtgctgaagtttatttctcagtggtgcggcggcctcccaagcacatctttcagctttcagtag

SEQ ID NO: 191930 - DNA, 1536 bp, Artificial Sequence
  Description of Artificial Sequence: Synthetic coding sequence
atggcctggagccagaacaacgccaagttcgccgtgtgcaccgtggaccgggtggtgctcctttacgacgaacacggggaaaggagggataaattctcgaccaagccagccgacatgaagtacggacgtaagtcctatatggtcaagggcatggcattctcccctgattccacgaagattgctattggccaaacagataatattatttacgtatacaaaatcggcgaggactggggtgacaagaaggtcatatgtaataaattcatccagacttccgcagtcacgtgtcttcagtggcccgcagagtatattatcgtctttggtttggcagaaggtaaggttcgactggccaacaccaagaccaacaagagctccaccatttacggtaccgagtcatatgtggtctccctaactaccaactgcagtggtaaaggcattctgtcaggacacgccgacgggactatcgtcaggtactttttcgacgatgaagggagcggcgaaagccagggtaaactcgtgaaccatccttgtcccccctatgcattagcgtgggccactaattccatcgtggcagccggatgtgatcgaaagattgtggcctacggcaaggaggggcatatgctacagaccttcgattattctcgcgacccccaggaacgcgaatttaccaccgctgtctccagccctggaggtcagtcagtcgttctgggaagttatgaccgcctccgtgtgtttaattggatcccccggcggtctatctgggaagaggccaaacctaaggaaatcacaaatctgtataccataactgccctggcttggaaaagggacggaagccgcctgtgcgtggggactctctgtggaggtgttgaacagttcgactgttgtttaaggagaagcatctacaagaataagtttgagcttacatacgtgggccctagtcaagttattgtgaagaatttgagtagcggaactagggtggtgctgaagtcacattatggatatgaagtggaagaggttaaaattcttgggaaggagcgatatctggtagcccacaccagcgaaaccctgttattgggggatctaaataccaacagactatccgagattgcatggcaggggagcggcggaaatgaaaagtacttctttgagaatgagaacgtgtgcatgattttcaacgccggtgagctcacactggtggagtacgggaacaatgacaccctgggatccgtgcgaaccgaatttatgaacccccacctcatctcagtgcgaatcaacgagcggtgtcaacgaggcacagaggacaacaagaaactggcctaccttattgacataaagacaattgctatagtggatttaatcgggggctataacatcggcacagtgagtcacgaatcgcgggtagactggttagagctcaatgaaacaggccacaaactacttttcagagaccgaaaattaagagtgagaagggctacaaaggccttggggattgggtggcctactgaaggggttaggcaggccgctacgagggactag

SEQ ID NO: 191931 - DNA, 369 bp, Artificial Sequence
  Description of Artificial Sequence: Synthetic coding sequence
atgacccacctgctgctgaccgccaccgtgacccccagcgagcagaacagtagccgcgagcctggttgggagaccgcaatggccaaagacattctaggcgaagctggcctacacttcgacgagctgaacaaactccgggtgttagaccccgaagtgacgcagcaaaccatcgagctcaaggaggagtgtaaggacttcgttgacaaaattgggcagtttcagaagatcgtgggcggtctcattgaactggtggatcaactggctaaggaggccgaaaatgagaagatgaaggtcaggtcggcgtgtctgcctccaacaagctggcccggaacactggttcattaccctctgatccctcttccgtcctag

SEQ ID NO: 191932 - DNA, 447 bp, Artificial Sequence
  Description of Artificial Sequence: Synthetic coding sequence
atggccaaggacatcctgggcgaggccggcctgcacttcgacgagctcaataagctgcgcgtcctagatccagaagttacccagcaaaccattgagctgaaggaagagtgcaaagatttcgtggataagattggccagttccaaaagattgtgggcgggcttattgaactagtcgaccagctcgctaaggaggcagagaatgaaaaaatgaaaagtctagctgtgtccccgcggcttgaatgtactggagctatttcagcccactgtaagctttgtctgagcgacagtagcgatagccctacctccccatcccgcgtggggggcacgaccggccatcgatgttctgagctggcacaaatctattccaaggctgagagaagctccacagctgccacatcatctcccaacagtagaaaggagaacgctgccagaaaggtttcgggatag

SEQ ID NO: 191933 - DNA, 399 bp, Artificial Sequence
  Description of Artificial Sequence: Synthetic coding sequence
atggccaaggacatcctgggcgaggccggcctgcacttcgacgagttgaacaagttacgcgtgctagacccggaggtcacacaacagactatagaattgaaagaggaatgtaaggattttgtagacaagattggccaatttcagaagattgtgggcgggcttattgagctggtagatcagctcgccaaagaggccgaaaacgaaaaaatgaaggcaataggggctaggaacctgcttaagagcatagccaagcagcgtgaggctcaacaacagcaactgcaggctctcatcgccgaaaagaagatgcagctggagcggtaccgggttgagtatgaagctctatgcaaagtcgaggccgaacagaacgagttcattgaccaattcattttccaaaaatag

SEQ ID NO: 191934 - DNA, 216 bp, Artificial Sequence
  Description of Artificial Sequence: Synthetic coding sequence
gacatcctgggcgaggccggcctgcacttcgacgagctgaacaagctgcgcgtgctggatccagaagttactcaacagacgatcgaattaaaggaggagtgcaaagacttcgtcgacaagattggacagttccagaagattgtgggggggctgattgagctcgtagaccagctggcaaaggaagctgagaacgaaaaaatgaaggtgtctggctag

SEQ ID NO: 191935 - DNA, 345 bp, Artificial Sequence
  Description of Artificial Sequence: Synthetic coding sequence
atggccaaggacatcctgggcgaggccggcctgcacttcgacgagcttaataagcttcgtgtgctagaccctgaggtcactcagcagactattgaactgaaggaggaatgcaaagacttcgttgacaagattggtcagtttcagaaaatcgttggtgggctgattgagctggttgaccagttagccaaggaggcggaaaatgagaaaatgaaggcaatcggcgccagaaatctgctaaagtccatcgccaagcagagagaggcacagcaacagcagctgcaggcgctgattgctgaaaagaagatgcaactcgagagaaatgaacttaagatctctttactgtag

SEQ ID NO: 191936 - DNA, 477 bp, Artificial Sequence
  Description of Artificial Sequence: Synthetic coding sequence
atgacccacctgctgctgaccgccaccgtgacccccagcgagcagaattcaagccgcgagccgggctgggagactgccatggccaaggacattctcggcgaagcagggctccacttcgacgaactgaataaactcagggtgctcgatcctgaagtgacccaacagactatcgagctgaaggaagagtgcaaagatttcgtggataaaatcggtcagtttcagaaaatcgtcggaggtctcattgaactggttgatcaactggctaaggaagctgaaaacgagaaaatgaaggcaattggagcgcgcaatctcctcaaatctatagctaaacaaagggaggcacaacaacagcaactgcaggcccttatcgccgaaaaaaaaatgcagctggagcggtaccgcgtcgaatacgaggctttatgcaaagttgaggcagaacagaacgagttcattgatcagtttattttccaaaagtag

SEQ ID NO: 191937 - DNA, 399 bp, Artificial Sequence
  Description of Artificial Sequence: Synthetic coding sequence
atggccaaggacatcctgggcgaggccggcctgcacttcgacgagttgaataagttacgcgtactggacccagaggttacacaacagaccattgagctaaaagaagagtgcaaagatttcgttgacaagattggccagtttcagaaaattgtcgggggactgattgagttggtcgaccaactcgccaaagaagccgagaacgaaaaaatgaaggcaattggggcccgcaatctcctgaaatccatcgccaaacagcgcgaagctcagcaacaacaacttcaagctctcatcgccgaaaaaaaaatgcaacttgagcgttatagggtggaatacgaggcgctgtgcaaggtggaagcagaacaaaatgaattcattgaccaattcatctttcagaaatag

SEQ ID NO: 191938 - DNA, 642 bp, Artificial Sequence
  Description of Artificial Sequence: Synthetic coding sequence
atggaggacctgctggacctggacgaggagctgcggtacagcctggctaccagcagggctaagatggggcgccgggctcaacaagagagcgctcaggccgagaatcacctcaacggcaagaatagctcactgactctgactggcgaaacttcgagcgcaaaattaccccgctgcaggcagggcggctgggctggcgacagcgtgaaggcatcaaacggcacacagactggcaagcagcaacttgatttaaacgcctgttatcataaaacccatcaccgagacctgggcctcgccagcctcgaggaagcagacattcccattattcctgatttagaagaagtgcaggaggaagactttgttctgcaagtggctgccccacctagtatacaaattaagcgggtcatgacttatcgggaccttgacaacgatctcatgaagtatagtgccatccagaccctagatggcgagattgacctgaaactgctgacaaaggtgttagccccggaacacgaggtacgggaggacgacgtgggctgggattgggatcacctgtttacagaagtgtcatccgaagttcttacggagtgggatcctctgcagactgaaaaggaggacccagccggccaagctcggcacacctag

SEQ ID NO: 191939 - DNA, 627 bp, Artificial Sequence
  Description of Artificial Sequence: Synthetic coding sequence
atggaggacctgctggacctggacgaggagctgcggtacagcctggccacatccagggcaaaaatgggccgtcgcgcccaacaggagagcgctcaggccgagaatcacttaaacggcaagaatagctcactcacactgacaggagagacatctagtgcgaagttgccccgttgccgccaaggagggtgggccggcgactccgtgaaggcctctaagtttcgacggaaggcctcagaagagatcgaggattttagactcaggccccaaagtttaaacggcagcgattacggcggtgatatcccaattatccctgatctggaagaagttcaggaggaagactttgtcctccaagtggcagcccccccatcgattcaaattaaacgagtcatgacataccgggacctggacaacgacctgatgaagtatagcgccattcagacgcttgatggggaaattgatctgaagttgctgaccaaggtgctggcgcccgagcatgaagttcgcgaagatgacgtcggctgggactgggatcacctctttactgaagtttcctccgaagtgctgaccgaatgggatccactgcagactgagaaagaggatcccgcaggacaggcacggcacacgtag

SEQ ID NO: 191940 - DNA, 342 bp, Artificial Sequence
  Description of Artificial Sequence: Synthetic coding sequence
atggaggacctgctggacctggacgaggagctgcggtacagcctggcaaccagtcgagccaaaatgggccgtcgggcccagcaggagagtgcacaggcagagaaccacctaaatggaaagaactccagcctaaccttgactggggagacatcatcggccaaactgcccagatgtcggcagggcggttgggcaggcgatagtgtgaaggcctcaaaatttcggaggaaggcttccgaggaaatagaagaatatgtgagctctatcttaattctcatggtcagttatgtggacttgggtcaacagtgctccctgggaggtcacgatttgttccatttgtgttag

SEQ ID NO: 191941 - DNA, 1290 bp, Artificial Sequence
  Description of Artificial Sequence: Synthetic coding sequence
atgaccgccgccctggccgtggtgaccaccagcggcctggaggacggagtgccacgcagcaggggcgagggaacaggcgaggtggtgctagaaaggggccctggagctgcttaccacatgtttgtggtaatggaggacctggtggagaagctgaagttgctgagatatgaggaggaatttttgaggaaatccaatctcaaagccccgagccgacactactttgccctgccaactaatcctggggaacagttttatatgttctgcacactcgccgcttggttaattaataaggctgggcggccattcgaacaacctcaggaatatgatgaccctaacgccactatttcaaacatcctctccgaattgagatctttcggacgcactgcggacttcccgccatccaaattgaaatctggatacggagagcacgtgtgctatgtgctggactgcttcgcagaggaagctctgaaatacatcggattcacctggaagcgccctatatatcctgtggaggaactggaggaagagagtgtcgctgaggatgacgctgagctgactctgaataaagtggacgaggagttcgtggaagaggagacggacaacgaagaaaactttattgatctaaatgtgctgaaggctcaaacatatcatctggatatgaacgagacagctaagcaggaagacatcctggaatctacaactgacgcagctgagtggtctctggaggttgagcgagtgctgccccagttgaaggtgacgattagaactgacaacaaggattggcgaattcatgtggatcaaatgcaccagcacagatccggcatcgagtccgcactcaaggagaccaaggggttcctcgataagttacacaatgagattacacgaacactggaaaagattagttcccgggagaagtacataaataatcagctagagaacttggtgcaggagtatagggcggcacaagcccaactgtcggaggccaaagagagataccagcaggggaatggcggtgtcaccgaaagaactagactactgagtgaggtaatggaagaattggagaaggttaaacaggagatggaggagaagggtagcagcatgaccgacggggcccccctggtcaagataaaacagagtctgactaagctgaagcaagaaaccgttgagatggatattcgcatcggaatcgtggaacataccctgctgcagtctaaacttaaagagaaaagtaatatgacaagaaacatgcatgcgactgtgatccccgagcccgcaaccggattttactag

SEQ ID NO: 191942 - DNA, 2334 bp, Artificial Sequence
  Description of Artificial Sequence: Synthetic coding sequence
atgcggctgaagatcagcctgctgaaggagcccaagcaccaggagcttgtgtcctgtgttggctggactacagcagaggagctgtactcctgtagcgatgatcaccagatcgtcaagtggaatttactcacatctgaaaccacccagattgtgaagctcccagatgacatttaccccatagattttcactggtttccaaagtcgctgggagtgaaaaaacagacacaagccgagtccttcgtccttacgagcagtgatggcaagttccatctcatatccaagttgggaagagtagagaagtccgtggaggctcactgcggcgctgtactcgccggcaggtggaattacgagggtaccgcactggttacagttggggaggacgggcaaatcaagatatggagcaagactggcatgctgaggagcaccctggcgcagcaggggactccagtttactctgttgcctggggcccagacagcgagaaagtcctatataccgccgggaagcagttgatcattaagccactgcaacccaacgccaaggtgttgcaatggaaagcacatgacggcatcatcctaaaggtagattggaatagtgtgaacgatctgattctaagcgctggagaggactgtaagtataaggtctgggacagctatgggcggcccctgtataacagccagccacacgagcatcctatcacttcagtggcttgggcacctgatggcgagctctttgctgtcgggtcatttcacacactgaggctatgcgacaagacgggatggtcttacgccctggaaaaaccaaacacaggtagcatttttaacattgcctggagtatagacggcacccagatcgcaggggcatgcggcaacgggcacgtggtctttgcccatgtcgtggagcagcactgggagtggaaaaattttcaagtcacactgacaaaacgtagagctatgcaggtgcggaacgtgctgaacgacgcagttgatctgcttgagttcagagatcgggtaataaaggcatccttgaattacgcccacttggttgtttccacctcactccagtgctacgtgttttcaaccaagaactggaatactcctatcatctttgacctgaaggagggcactgtctcactcatcctgcaggcagagagacactttcttctagtggacggcagctccatttacctatattcttatgagggccggtttatctccagtcccaagttcccggggatgaggactgacatacttaatgctcagacagtctcactgagcaatgacactatcgcaatacgcgacaaggcagacgaaaaaattatctttttgttcgaagcgagcactggaaagccactcggagatggtaaatttctgtcccacaagaacgagattctggagatcgcacttgaccagaagggcctgacaaacgacaggaaaatcgcttttatcgataaaaatagggacctctgcataactagcgtcaaacgctttggaaaagaggagcagatcattaaactgggaacaatggtgcatactttagcatggaacgacacctgtaatatcttatgcggcctccaagatacgagatttattgtgtggtactaccccaacacagtgtatgtcgatagagatatcctgcctaaaactctatacgaacgggatgcatctgagttctcgaagaatccccacattgtgagctttgttggcaaccaggtcacaatccgccgcgccgatggatccttggtgcatatttctatcacgccctaccccgccatccttcacgaatacgtatctagctccaaatgggaagacgcagttcgcctgtgcaggtttgtaaaggagcaaaccatgtgggcgtgcctggctgctatggctgttgctaacagggacatgactactgccgaaatcgcatacgccgcaataggtgaaatcgataaagtgcagtacattaattcaattaagaacctgccttctaaagaatcgaagatggcacacatactgctgttcagcggaaatattcaggaggccgaaattgttcttttacaggcaggtcttgtataccaagctatccagattaatataaacctttataactgggagcgcgccctggagctggcagtcaagtacaaaacccacgttgataccgtattggcctacagacagaagttcctggagacatttggcaagcaagaaacaaataagcgatatctccactacgctgaggggctgcagatcgattgggaaaagataaaggctaaaatagaaatggaaattacaaaggagagggaacagagctcttcatcgcaaagtagtaagagcatcggactgaaaccctag

SEQ ID NO: 191943 - DNA, 195 bp, Artificial Sequence
  Description of Artificial Sequence: Synthetic coding sequence
atgcggctgaagatcagcctgctgaaggagcccaagcaccaggagcttgtgagttgtgtgggctggaccacggcagaagagctgtactcctgttctgatgatcaccagattgtcaagtggaatctccttacttctgagactacccaaatagtaaagttgcctgacgatatatatcccatcgacttccactggtag

SEQ ID NO: 191944 - DNA, 1923 bp, Artificial Sequence
  Description of Artificial Sequence: Synthetic coding sequence
atgctgcggagcaccctggcccagcagggcacccccgtgtacagcgtggcctgggggcctgacagcgagaaagtgctgtacacagccggaaagcagctgatcattaagcccctgcagcccaatgccaaggtcctccagtggaaggcacatgatgggatcatcctcaaggtggactggaatagtgtgaacgatttgattctgagcgctggcgaggattgtaagtataaggtgtgggactcatacggcaggccattgtacaatagccagcctcacgaacaccccattacatcggtggcatgggctcctgacggggagcttttcgccgtaggatcctttcataccctgcggttgtgcgacaagaccggttggtcctatgccctcgaaaaaccaaatactggctcaattttcaacatcgcatggtctatcgacggaacccagatcgccggagcttgtgggaacggccacgtggtgttcgcccatgtggtggaacaacattgggaatggaaaaacttccaggtaactctgaccaagcggagggcaatgcaggtgcggaacgtgctcaacgatgcagtcgatctgctggagtttcgggacagagtcattaaggcatcactgaactacgcgcacctcgtggtgtctaccagcctgcagtgctacgtgttctccacaaaaaactggaatacaccaataatcttcgaccttaaggaaggaacggtaagccttattctgcaggctgagcgtcacttcctgctggtggacggctcttccatctacctgtactcctatgaaggccgattcatcagttccccgaaattccccggaatgagaacagacattctcaatgcacagacagtgagtctgagcaatgacaccattgccatccgcgacaaggccgacgaaaagattattttcctgttcgaggcctcaacgggtaagcccctcggagacggtaagtttctttcacacaagaatgaaatcctggagatagcgctagaccagaagggcctgaccaacgatcgaaagattgcttttattgacaagaacagagacctgtgtataactagtgtgaaacggtttggaaaggaggaacagataataaagctcggaaccatggtgcataccctggcgtggaacgatacatgcaatattctgtgtgggctgcaggatacacggtttatcgtgtggtattatcctaacacggtgtatgttgatcgggatatattgccgaagaccctctatgagagggatgctagtgagttctccaagaaccctcacattgtctcttttgtagggaaccaggtaaccatcaggagagcagatgggagtcttgtacacatttcaattacaccctacccggctatcctgcatgaatatgtctcgagcagcaagtgggaagacgccgtccggctttgccgatttgtgaaggagcaaactatgtgggcatgtttggccgctatggcggtcgcaaacagagatatgacgacagccgagattgcttatgcggcgatcggtgagattgacaaggtgcaatacattaatagcatcaagaacctccctagcaaggagtcgaagatggctcatatactcctgttctccggcaacattcaagaagcggagattgttctgcttcaggctgggcttgtgtaccaggctattcagataaacattaacctttacaattgggagcgcgccttggagttggccgttaagtacaaaactcacgtggacacagtacttgcttaccggcagaaatttctggagaccttcgggaaacaagaaacaaacaagcgttatctgcactacgccgaggggcttcagatcgactgggagaagataaaagctaaaattgaaatggaaatcactaaagaacgcgagcaatcttcttcctcacagtctagcaaatctatcggcttgaaaccatag

SEQ ID NO: 191945 - DNA, 366 bp, Artificial Sequence
  Description of Artificial Sequence: Synthetic coding sequence
atgcggctgaagatcagcctgctgaaggagcccaagcaccaggagctcgtttcttgcgttggctggacgacagctgaagagctctattcatgttccgacgatcaccagatcgtcaagtggaatctactgacttctgaaaccacacagatcgtgaaactccccgatgacatctacccaatagatttccattggttccccaagagtctcggcgtaaagaaacagactcaggccgagtctttcgtattaacaagcagtgacggcaaattccacctgataagcaagttggggcgcgtggagaaaagcgtcgaggcacattgcggcgccgtcctggctgggagatggaactacgaagggaccgctctttag

SEQ ID NO: 191946 - DNA, 1923 bp, Artificial Sequence
  Description of Artificial Sequence: Synthetic coding sequence
atgctgcggagcaccctggcccagcagggcacccccgtgtacagcgtcgcctgggggcccgacagtgagaaagtgctgtacaccgctggtaaacagctgataattaaacctttacaaccaaatgctaaggtgctgcagtggaaagctcacgatggaatcatccttaaggtggactggaattcagtcaatgaccttattctgtccgccggagaagactgtaagtacaaggtatgggattcttatggaagacctttgtataactcacaacctcacgaacaccccataacaagcgttgcctgggcgcccgatggcgagttatttgcggtgggctctttccacacgctgagactgtgcgacaaaactggatggagttatgccttggagaaacccaacaccggcagcatctttaatatcgcgtggtctatagatggcactcagatcgccggtgcatgcggtaacggccatgtcgtcttcgcacatgtcgtggagcagcattgggagtggaagaatttccaggtgactctgaccaaacggagagcaatgcaagtgcggaatgtactcaacgacgcagtcgatctgttagaatttagagatagggttataaaggccagtcttaactacgcccatttagtcgtgagtacatcccttcaatgttatgtgttcagcaccaagaattggaacactcccatcatatttgatctgaaggagggaactgtatccctcatcttacaggcagagagacacttcctactggtcgacggctcctccatctacctgtacagctatgagggcagatttatctcctcccctaagttcccagggatgaggacggacatcctgaacgcccagacggtgagcctttctaacgataccattgccattcgcgacaaggcagatgaaaaaatcatcttcctctttgaagccagtaccggaaagcccctgggagacgggaaatttttgtctcacaagaatgaaatcctggaaatagctctggatcagaagggcctcacgaacgaccgaaaaattgccttcatcgacaagaatcgggacctctgtatcacctcagtcaaaaggttcggaaaagaggaacagatcatcaagctcgggaccatggtgcataccctcgcctggaacgatacatgcaacattctatgcggcctccaggacaccaggtttatcgtctggtactacccaaataccgtctacgtggaccgggacatcctgcccaagacattgtacgaaagagacgctagcgagttttccaagaacccacacattgtgtctttcgtcggaaatcaggtgacgatcaggagggcggatggctctctagtccacattagcatcactccctacccggctattctacatgagtacgtatcatcctctaagtgggaggacgccgtgcgtctgtgccggttcgttaaagagcaaacgatgtgggcctgcctggctgcaatggccgtggctaatcgggatatgacaactgcggagattgcttacgcggccatcggcgagatagacaaagtacagtatattaactccatcaagaatcttccatcaaaagagtcaaagatggcccatatcctcctgttctctggaaatatacaggaagctgagatcgttttgctccaggcaggactcgtctaccaggcaatacagattaacataaacctgtataactgggagcgggctcttgaattggcagtgaagtacaagacacatgtggatacagtcctggcttacaggcagaaatttctggagaccttcggaaagcaggagacaaacaaaagatatttgcattacgccgagggactccagattgactgggaaaagataaaggccaaaatcgaaatggaaatcacgaaggagagggagcagagctcctccagccagtcgtcaaagagcattggattgaaaccctag

SEQ ID NO: 191947 - DNA, 540 bp, Artificial Sequence
  Description of Artificial Sequence: Synthetic coding sequence
atgcggctgaagatcagcctgctgaaggagcccaagcaccaggagctggtatcatgcgttggatggactaccgcagaagaattatatagttgttccgacgatcaccaaatcgtcaaatggaacctgctgacctctgagaccactcagattgtgaagctgccggacgacatctatcccatagacttccactggtttcccaagtcgctgggagtcaagaagcagacgcaggcagagtctttcgtcctgactagttcagacggcaagttccacctgatatcaaaacttgggagagtggagaaatcagtggaagcacactgcggcgctgttctcgccggccgttggaactacgagggcaccgctctggtcacagtcggtgaagatgggcagataaagatctggagtaagacaggcatgctaaggtctaccctggcacagcaaggcaccccagtctattccgtcgcttgggggcccgattccgagaaggttctctacaccgcgggcaaacagttgatcattaaacctctccaacccaacgcttag

SEQ ID NO: 191948 - DNA, 1227 bp, Artificial Sequence
  Description of Artificial Sequence: Synthetic coding sequence
atggccagcgtggccagctgcgacagccggcccagcagcgacgagttgcccggggatccatcatctcaggaggaggacgaggactacgatttcgaggaccgagtgtctgattctggaagttactccagcgcctcctccgattacgacgacctcgagcccgaatggctggattccgtgcagaagaacggtgagctgttctacctggagctcagcgaagatgaggaagagtccctgctgcccgagacaccaaccgtcaaccacgtgcgcttctcagaaaacgagatcatcatcgaagacgattataaggagaggaagaagtacgaacctaagctgaagcaattcaccaagattctgagacgtaaacgccttttgcccaagcgttgtaacaagaagaacagcaatgacaacggacctgtgagcatattaaaacaccagtctaatcagaagacaggtgtgattgttcagcagagatacaaggatgtcaatgtctacgtgaatcccaagaagctaacagtcatcaaggctaaagaacagttgaagctgctggaggtattggtgggcattattcatcagaccaaatggagctggcgccgaacggggaagcagggggatggcgagaggctcgttgtgcacgggttactaccaggtggcagcgccatgaaatctggccaagtgctaataggtgatgtactcgtggcagtgaacgacgttgacgtgacaacagagaatatcgagcgggtcttgagctgcattcccggtcctatgcaagtcaagctgacgtttgaaaacgcatatgacgtcaaacgcgagacctctcacccccggcagaagaagacgcagtccaacacctccgatctggtcaaactgctgtggggcgaggaggtcgagggcatacagcagagtgggctgaatacacctcacattatcatgtacctcaccctccagctcgacagcgagacatcaaaggaggagcaggagatactctaccactatcccatgtcggaggctagccaaaaactgaagtcagtcagaggcatcttcctgacactttgtgacatgcttgaaaacgtgaccggcacacaagtgacatctagcagcctgctactcaatggaaagcagatccatgttgcatattggaaggagagtgacaagctcttgcttatcggcctccccgccgaagagatcgaactgcctagcagcgcacacactcacggcgagcggaactag

SEQ ID NO: 191949 - DNA, 2829 bp, Artificial Sequence
  Description of Artificial Sequence: Synthetic coding sequence
atggccagcgtggccagctgcgacagccggcccagcagcgacgagctccctggggatccctcctctcaagaagaagatgaagactatgattttgaggaccgtgtctccgatagtggatcatactcgagcgcatcttccgactatgacgacttagaaccagagtggttggattctgtgcaaaaaaatggcgagctcttctacctggaactctctgaagacgaggaagaatccctgctcccggaaactcccacggtgaatcatgtgcgattttcagagaatgagatcatcattgaggacgactataaggaacggaaaaagtatgagccaaaactcaagcaatttaccaagattttgcgtcggaagaggctactgcccaaacgctgtaacaagaagaatagcaacgacaacgggcccgtatccattctgaaacaccagtctaaccaaaaaacgggagtcattgtccagcagcggtacaaggatgtgaatgtgtacgtaaatccaaagaagctcacagtcataaaagccaaggagcagctcaagctcctggaagtgctggtgggtatcatccatcaaactaaatggtcttggaggcgaactggtaagcagggtgatggcgaacgactagtggttcacgggctcctgccaggcgggtccgctatgaagtcgggccaggtgttgatcggggatgtgctggtggcagtgaatgacgttgacgttacaactgagaatatagagagagtcctctcgtgtattcccggccctatgcaggttaaattgacattcgagaacgcatacgacgtaaaacgagagactagtcacccacgtcagaagaaaacccagagcaacacttcagacctagtgaagctgttgtggggagaagaggtggagggtatccagcaatctggtttaaacactccgcatattatcatgtatctcaccctgcaactggacagtgagacctccaaggaggagcaagaaatcctatatcattaccccatgagtgaggcttctcagaaacttaagtcggtgaggggtattttcctgactctgtgcgacatgctcgagaacgtgaccggcactcaggtgacctcatcctccctgctacttaatggcaagcagatccacgtagcatactggaaggagagcgacaagctgcttctcatcggattaccagcagaggaggtcccacttcctcgcttaagaaacatgatcgaaaacgtgatacaaaccttaaaattcatgtacgggtctctcgacagtgcattttgtcaaattgagaacgtccctagacttgaccacttttttaatttgttttttcaacgcgccctccagcctgctaagttacactcaagcgcaagtcctagcgcgcaacagtacgatgcctcaagcgccgttcttctagataacttgcccggcgttcgttggctgactctccccctagagataaagatggagctggatatggctctgtcagatctcgaggccgccgactttgccgagctgagtgaagactattacgatatgagaaggctctacactattttggggtcgagcctgttctataagggttacctcatttgttctcaccttccaaaagatgatctgatcgatatagcggtgtactgtcggcattattgtctgctgcctctggccgctaaacagagaattggacagctgatcatttggcgggaagtgtttcctcaacaccatctgaggcctctcgcagactcaagtacggaggtgttccctgagcccgaagggaggtacttcctcctcgtcgtcggcctgaaacattatatgctgtgtgtgctgctggaggcaggaggctgtgccagtaaggccatcgggtcccccggtccagattgcgtctacgtagatcaggtgaagaccacactgcatcagctcgatggtgtagatagcagaatagatgaaaggctggctagctctcccgtgccgtgcctgtcatgtgcggactggttcctcaccggctcacgcgaaaagacagactcattgacaacgtcccccattttaagtcggctgcaaggaaccagcaaagttgcgacttcgccaacttgtcgccgaaccttgtttggagattacagcctgaaaacaaggaagccatcaccatcctgttctagcggtggttcagacaatgggtgtgaggggggtgaagacgacggctttagcccacacacaactccagatgcagttagaaagcagcgagaaagccaggggtccgacggcctggaagaatcaggaaccctgcttaaggtaacaaaaaagaaaagcactctccctaaccctttccacctggggaatctcaaaaaggatttgcccgagaaagagctggagatttacaatactgtcaagctgacatccggaccagaaaatactctttttcattacgtggctcttgagaccgtccaggggatttttattacccccacattggaagaggtggcacaactttccggttctatccaccctcagctgattaaaaattttcaccagtgctgcctgtccatccgagctgtgttccagcagactctcgtggaagagaagaaaaaagggctgaactctggtgatcactctgatagcgccaagagcgtgagtagcctgaatcccgtgaaggagcacggcgtccttttcgagtgcagccccggaaactggacagatcagaaaaaagcacctcccgtgatggcttactgggttgtaggcaggctgttcttacaccccaaaccccaagagttgtatgtctgcttccacgattctgtgactgaaatcgcaatcgagatcgcctttaaactgttcttcggactcaccctctag

SEQ ID NO: 191950 - DNA, 2688 bp, Artificial Sequence
  Description of Artificial Sequence: Synthetic coding sequence
atgaacaagagcgagaacctgctgttcgccggcagcagcctggcctctcaagtccacgccgctgccgttaacggggacaaaggtgctttgcagagattgatcgttgggaacagcgctctcaaagataaggaggatcagttcggtcgaacccctctgatgtattgtgtgctcgcggacaggttagattgcgccgacgcactgttgaaggcaggtgctgacgtaaacaagacagatcactcacagaggaccgccctgcacctagcagcccagaaaggcaactacaggttcatgaagctgctgctcaccagacgagccaattggatgcaaaaggatctggaagagatgaccccactccatttaaccactcggcatcgatctcctaagtgcctggccctgctcctcaagttcatggcaccaggtgaagtcgatacacaggataagaataaacaaactgccctgcattggtccgcttactacaacaaccctgagcatgtgaagttgctgattaagcatgattccaacatcgggatccccgatgtggaagggaagattccccttcactgggcagccaatcacaaagatccctctgcggtgcatacggttaggtgtatcttggacgcagccccgactgaatcgttgctgaactggcaggattatgagggcagaacccccctccactttgcggtcgccgacggaaatgtaacggtggtcgacgtcctgacttcttatgaaagctgcaacattaccagctatgacaacctgtttagaacgcctcttcactgggcggctctactaggacacgcccagatcgtgcacctgcttctcgagaggaacaagagcggcacaataccgtccgattctcaaggagctaccccactgcactatgcagcccagagtaactttgctgagacagtaaaggtctttcttaagcatccgtctgtgaaagatgattccgatctggagggacgtacctcttttatgtgggcagccggcaaggggtcagatgacgtattgaggaccatgctaagcctgaaaagcgatatagatataaacatggccgataagtacggcgggacagctcttcacgctgctgccctttctggccatgtcagtactgttaaactgctccttgaaaataatgctcaggtcgacgccaccgacgtcatgaaacataccccactgttccgggcctgcgaaatgggccacaaagatgtgatacagaccctgattaagggcggagcgcgtgtcgatctcgtggaccaagacggacattccctgctgcattgggctgctctaggcgggaacgctgacgtgtgtcagatactgattgaaaacaagatcaacccaaacgtgcaagactatgccggaaggactccacttcagtgtgcagcatatgggggttacatcaactgtatggctgtcctaatggagaacaacgccgacccaaacattcaggataaagagggccgcaccgcccttcactggagttgtaacaacgggtatctggatgcaattaaactgctgttagatttcgcggccttcccaaatcagatggaaaacaacgaagagaggtacacaccactagactatgcactgctgggtgagagacatgaggtcatccagttcatgctggaacacggggcgctgtctattgctgcaatacaagatattgccgcctttaaaatacaggccgtgtacaagggctacaaagtgagaaaggctttccgtgacagaaagaaccttctcatgaaacatgagcagctgagaaaggacgcagcggccaagaagagagaggaggaaaacaagcggaaggaagcggaacaacagaaaggccgccgatcccccgatagttgccggccacaggccctgccgtgcttaccctccacccaagacgtgccttcgcgtcagtcaagagcaccaagcaagcaaccccccgccgggaacgtggcccagggacctgaacccagggacagccggggctcgcccggaggttctcttgggggggccctgcagaaggagcagcatgtaagctctgaccttcaaggtaccaattcgcggcgaccaaacgagactgctcgagagcactcgaaaggacagtctgcgtgtgtgcatttccggccaaacgagggtagcgacggctcccggcatccgggcgtgccaagcgtagagaagtcccgcgagttaagactacagataatccagcgcgaaaggaggcgtaaggaactcttccggaagaagaacaaagccgccgctgttatccagagagcttggcggagctatcagcttcggaagcacctgtcccatctgagacacatgaagcaactgggtgctggggacgttgaccgctggcgccaggagtcaaccgctcttttactgcaggtgtggcggaaggagctggagctgaaattcccccagaccactgccgtgagcaaagcacctaaaagccctagcaagggtaccagcggaacaaagtctacgaaacactccgtgttgaaacagatatatggttgtagtcacgaggggaaaatccatcatcccacccggtctgtgaaagctagctccgtgctcagactcaacagcgtctccaatctccagtgcattcatctcctggagaattccggtagaagtaagaacttctcgtacaatttacagtccgccactcagcctaaaaacaagacaaagccttag

SEQ ID NO: 191951 - DNA, 3198 bp, Artificial Sequence
  Description of Artificial Sequence: Synthetic coding sequence
atgaacaagagcgagaacctgctgttcgccggcagcagcctggcctcccaggttcatgccgcggctgtgaatggtgataagggtgcactccagcgactaatagtgggcaactcagccctgaaggacaaggaggaccagttcgggcggacaccccttatgtactgtgtactcgccgatcgtcttgattgtgcagacgcccttttgaaggccggtgctgatgtcaacaaaactgatcatagccagaggaccgcactgcatcttgccgcccagaagggaaactacaggttcatgaagcttctgctcaccaggcgggccaactggatgcaaaaggacctggaagagatgacgcccttacacctgactacacgccatcgcagtcctaaatgcctggccctcctgcttaagtttatggccccgggcgaagttgatacacaggacaagaataaacagactgccctgcactggagtgcctactacaataacccagagcacgtaaaattgctgatcaagcacgacagcaacataggtataccagacgttgaaggcaagatccctcttcattgggccgctaatcacaaggatccttcagccgtgcatactgtgcggtgcattctggatgccgccccaaccgaaagccttttgaactggcaagactatgagggacggacccccctccattttgctgtcgccgacgggaatgtcactgtcgtagatgtgcttacatcatatgagtcatgtaacattacttcatacgacaacctgtttaggacaccccttcactgggctgcccttctgggccatgctcagattgttcacctgctattggaacggaacaagtctggcactatccccagcgacagccagggagccacccccctgcactatgccgcccagtcgaattttgccgagaccgttaaagtgttcctcaaacacccctcggtcaaggacgactcagatctggaaggacgaacgtcatttatgtgggctgcagggaaaggcagcgacgatgtgcttcgtacaatgctgtctctgaaaagcgatatagatattaacatggccgataagtacggcgggaccgcactgcacgccgccgcactgtcaggccacgtgtccacagttaagctgctccttgagaacaacgcccaggtggacgccacagacgtaatgaagcatacacccctctttcgtgcatgtgagatgggccacaaggacgtgatccagaccctgattaagggaggagcccgcgtagatcttgtggaccaggacggtcattcacttttgcactgggctgcactcggaggcaacgccgatgtctgtcagattctcattgagaataaaatcaacccaaacgtacaagactacgccgggagaacccccttacagtgcgcagcctatggagggtacattaattgtatggcagtcctaatggaaaataatgctgacccaaacatccaggacaaagagggcaggacggcactgcactggtcatgcaacaacggctacctagatgctataaagctcctcctggatttcgccgcatttccaaaccaaatggaaaataatgaggagcgctacacaccactggattacgctttgctgggagagcgccatgaagttatccagttcatgctggagcacggcgcactgtcaatcgcagctattcaagatatcgctgctttcaaaatccaagcagtgtataaggggtacaaagtccgcaaagctttcagagaccgcaagaatctgttaatgaagcatgaacaactgcggaaggatgctgcagccaagaagcgggaggaggagaataagcgaaaagaagccgagcagcagaaagggagacgtagccctgattcctgtcgcccacaagcactaccatgtctgccaagcacacaagacgtgccaagcaggcagtccagggctccttccaagcagcctccggccggcaatgtggctcagggtcccgagcctcgcgactcccgaggctcccctgggggatctctcggtggcgcgctgcaaaaggagcagcacgtctcatcggaccttcaggggaccaattctcggaggccgaacgagacggcaagggaacatagcaaaggacagtcagcctgtgtgcatttcaggcccaacgagggatctgatggctctaggcacccgggggtaccgtctgttgaaaagtcccgcggcgagaccgctggcgacgaaaggtgcgccaagggcaaggggttcgttaagcagccaagttgcatccgagtcgccggccctgacgagaaaggcgaagattcccgccgggccgctgcatctttacccccccatgactcccattggaaaccttcaagaaggcacgatacggaacccaaggccaaatgcgcaccacagaaaagaagaacacaggaacttcgcgggggcagatgttcgccagcagggagttcacgtcctggctctgctcgcggtgaggccgtgcacgccggccagaaccctccccatcaccggacacctcgaaataaagttacacaggcaaagctcacagggggactttacagccacctaccacagtctaccgaggaattaagatccggtgctaggagattggaaacctcaactctgagcgaggatttccaggtgtctaaggagacggatcccgctcccgggcccctctccgggcagtctgtgaacattgaccttctcccagtggagctacgcctccagataattcagcgagagcgaaggcgcaaggagctgttcaggaaaaagaataaagccgctgctgtaatccagagggcctggcgctcctaccagctgagaaagcatttgagtcacctccgccatatgaaacagctgggagcaggtgacgttgaccgctggcggcaagagtcgacggccttacttctccaggtatggcggaaagagctggaactcaaattccctcagactaccgcggtttcaaaagcgccgaagtctccatccaaaggaacttccggcacaaagtcaacaaaacattcggtcctgaagcagatatatggatgtagtcatgaaggtaagattcatcaccccactcgctcagtaaaggcctcttctgtgctccggctgaatagtgtttccaaccttcagtgtatccacttgttagagaattcaggcagaagtaaaaatttcagttacaatttgcaaagtgccacacagcccaagaataagacaaaaccctag

SEQ ID NO: 191952 - DNA, 306 bp, Artificial Sequence
  Description of Artificial Sequence: Synthetic coding sequence
atgaacaagagcgagaacctgctgttcgccggcagcagcctggccagtcaagtgcacgccgcggcggttaatggagacaagggcgccctccagagactgatcgtaggaaacagtgccctgaaagataaggaagaccagttcggaaggaccccgctgatgtattgtgtgctcgccgatcggttggattgtgccgacgcccttctgaaggccggagccgacgttaacaagacagaccatagtcaacgcactgctctgcatcttgcagcccagaaggctctgcggactatctccaccggtcggatttag

SEQ ID NO: 191953 - DNA, 2967 bp, Artificial Sequence
  Description of Artificial Sequence: Synthetic coding sequence
atgaagctgctgctgacccggcgggccaactggatgcagaaggacctagaagagatgacgccactgcacttgacaacccgtcatagatcacctaaatgtctcgcgctgctactcaaattcatggctcccggggaagtcgacacacaggacaagaataaacagactgcactgcactggagtgcctactacaacaatccagaacatgtcaagctcctcattaagcacgatagcaacataggaattccagatgttgagggaaagatcccgctccattgggcagccaatcacaaggatcccagtgccgtgcataccgtacggtgcattctcgacgccgcccctacagagtcactcttgaattggcaggactatgaagggcgcacaccgcttcacttcgcggtggctgatggcaatgtgacagtggtggacgtgttaactagttatgaaagctgcaacatcacgagttacgataatctctttcgaactccactccactgggcggctctcctcgggcatgcacagattgtgcacctgcttttagaaaggaacaaaagtggtacaattccttctgacagtcagggggctactccactgcattacgctgctcagagcaatttcgcagagaccgtgaaggtgttcctgaaacacccatccgtaaaagatgacagcgatcttgaaggtcgtaccagctttatgtgggccgccgggaagggaagtgacgatgtactgaggaccatgcttagcctcaaatcggacatcgacatcaacatggctgacaaatacggtggcacagctctacacgctgccgccctctccgggcacgtgagcacagtcaagctgcttttggagaacaatgctcaggttgacgccacggatgtgatgaagcacaccccactgtttagagcatgcgagatggggcataaggacgtgatccaaacacttataaagggcggtgcccgggtcgacttagttgatcaggacggccattcgcttctgcattgggcggccttgggtggtaatgctgatgtctgtcaaatcctaatcgagaacaagatcaaccctaatgtgcaggactacgcggggaggacccccctccagtgtgccgcttacggtggctatatcaactgtatggcggtgttgatggaaaacaacgccgatccaaatatccaggataaagaaggcagaaccgctttgcattggtcttgtaacaacggctacctggatgccattaaacttctcctggacttcgcagccttccccaaccagatggaaaacaacgaggagaggtatactccactcgattacgcgcttctcggggagcggcacgaggtgatccagttcatgttagaacatggagcactcagcatcgcggccattcaggacatcgctgcatttaagatccaggcggtttacaagggctacaaagtccgcaaggcattccgggacagaaaaaacctactcatgaagcacgagcagctgcgcaaagacgctgctgccaaaaagagggaggaagagaacaaacgcaaggaggccgaacagcagaagggcaggcgctcgcccgacagctgccgcccccaggccctgccttgtctgccatctactcaggatgtgccaagccgccaatctagagccccttcaaaacagccccctgcagggaacgttgcgcagggccctgagcccagagacagccggggttctccggggggaagccttgggggggcgctgcaaaaggaacagcatgtctcaagcgatctgcagggcaccaacagtcgacgccctaacgagaccgctcgagaacacagcaagggccagtccgcctgcgtccactttcggcccaatgagggaagtgatggaagccggcaccccggtgtgccctcagtcgagaagagcagaggtgaaacagctggagacgaacggtgcgctaagggaaagggcttcgtaaaacagccctcctgcattcgagtagcagggcccgatgaaaaaggggaggattcaaggcgtgccgctgccagtctgcccccacatgattcacactggaagcctagcaggagacatgacaccgaaccaaaagctaagtgtgcaccccagaaacgcaggacgcaggagcttcgcggtggtcggtgcagcccagcgggcagctccagacccggcagcgctagaggcgaagcggtgcatgcaggccagaatccaccccaccatagaacaccccggaacaaagtaactcaagcaaaattgaccgggggcctctatagccacctgccccagtctacagaggaacttcgtagtggagctaggcgccttgagacctctacactttcagaagattttcaagtcagcaaggaaaccgacccagccccgggcccgctcagcggacagtctgttaacatagaccttcttcctgttgagcttcgcctccagattatacagagggagagaagacggaaagaacttttcaggaagaagaacaaggccgcagctgtgatccagcgtgcctggaggagctatcagctgcgaaagcatttgtcacacttgcgacacatgaaacagctcggtgcaggcgacgtggataggtggcgacaagagagcacggcccttttgcttcaagtgtggcgcaaggaactagagttaaagttcccccaaaccacggctgtttctaaagcaccaaagtcgccatccaaaggaacaagtgggacaaaatccactaaacacagtgtcctgaagcaaatttatggatgcagccatgaggggaaaatccatcatcctaccaggagcgttaaggcttcgtcagtccttcgccttaattcagggaaggcagccaccgcaaagcagatggtgggtaaaaacatggggaaacatttcccactgtttcatccccagagacagaagaccctcgagcagatctggccaggattttccaacggccacctcatctcgtgggattactattgttctcaacatctttcgccctag

SEQ ID NO: 191954 - DNA, 3723 bp, Artificial Sequence
  Description of Artificial Sequence: Synthetic coding sequence
atgagcgtgaaggagggcgcccagcggaagtgggccgccctgaaggagaaacttggtcctcaggattctgatccgacagaggcaaacctggaatctgcagatcctgagctgtgtatcagactactccaaatgccctcagtcgtgaactactcaggccttcggaagaggttggaggggagtgatggaggatggatggttcagttcctggagcaatccggcttagacctgctgctcgaggccttggcgcgtctctcgggtagaggtgtggcgagaattagcgacgcactgctacaactgacatgtgtttcctgcgtccgggcagtgatgaacagtagacagggcattgagtacattcttagtaatcaaggatacgttaggcagctgtcccaggctcttgataccagcaacgttatggttaagaaacaagtgttcgaattactggccgctttatgtatttacagcccagaaggccatgtgctgaccctggacgcccttgatcattataaaactgtttgttcccagcagtacaggttttcgattgtgatgaacgagctttcagggtctgacaacgttccctatgtggtgacactactgtccgtgattaacgccgtcatcctgggccccgaagacctaagggcaagaacacagctgagaaacgagttcattggcctacagctgttggatgtgctggccaggcttcgcgatctggaggacgctgatctgctgattcagctggaggcctttgaggaagcgaaagcagaagacgaagaggaattgctacgggtgtctggtggtgtggatatgagttctcaccaagaagtctttgcttctctgttccataaagtatcatgtagccctgttagcgctcaattgttgtctgtgctgcagggtctgctgcacctcgagccaactctccggagctcccagctcctctgggaggcactggagtccctggttaatagggcggtcctgcttgctagcgacgcccaggagtgtactttggaggaggtcgtggaacgactcctctcagtgaaggggaggccgcgcccctccccactggtgaaggcacataagtccgtccaggccaatttggaccagagccagaggggtagttcccctcagaataccactacaccgaagccaagcgtagaggggcagcagcctgcggcagctgcagcgtgtgagcccgtcgatcacgctcagtctgagagcatcctaaaagtatcacagccccgagccttagagcagcaggctagtacccctccacccccaccgccgccccccctcttgcccggatcttccgcggaaccaccgcccccacctccaccacccccactcccctcagtgggggccaaagcactgcctacagccccgccccccccccctctgccgggactgggtgccatggcccccccagctcccccactgcctccacctcttccagggagctgcgaattccttcctccaccacccccgccactgccaggtctgggatgcccccctcctcctccacctctgcttcccgggatgggatggggcccccccccccccccacccccactcctgccatgtacttgtagccctcctgtggcaggtggcatggaggaagttatcgtggcgcaggtggaccacggcctaggaagcgcttgggtgccatctcatagaagggtcaatccaccaacactgaggatgaaaaagttgaactggcagaagctcccgagcaacgttgcacgagaacataatagtatgtgggcctccctatcatctcccgacgcagaggccgttgagccagacttctcctcaatcgagcgtctgttctctttccccgctgccaaaccaaaggaacctacgatggttgcaccacgggcccgaaaggagcccaaggagatcacttttctggatgccaaaaagtccctcaacctcaatattttcttgaaacaattcaagtgttcaaacgaagaagtggccgctatgatccgtgccggcgatacaaccaagtttgatgttgaggtcttgaaacagctgttgaaattactgcccgagaaacatgagattgagaatcttagggccttcaccgaagaacgcgctaagctggccagcgcagatcatttctatttacttctgctggctatcccctgctaccagctgcgcattgagtgtatgcttctctgcgagggggcagccgcggttctcgacatggtacggcctaaagcacagcttgtgcttgcagcctgcgagagcttattgactagccgtcaactgccaattttctgtcagcttatcctaaggatagggaactttctgaactatggttcacacacaggcgatgccgacgggtttaagatctctactctgcttaaactgacagagaccaaaagccagcagaaccgcgtaaccttgctgcaccacgtgctcgaggaagccgaaaagtcacatccagatttactgcagctcccaagggacctggaacagccctctcaagccgcaggcatcaacttggaaattatccgctctgaggcaagtagtaacctgaagaaactccttgaaaccgaacgaaaagtcagcgcctctgttgctgaagtgcaggagcagtacaccgagcgtttgcaagcaagcattagtgccttccgggcactggacgaactgttcgaggctatcgaacaaaaacaacgcgaactcgctgattacctctgcgaagacgcccagcagctgtcactagaggacactttttcaaccatgaaggcatttcgggacctttttttgcgagcactcaaggaaaataaagataggaaggaacaggcagcgaaagctgaacgaaggaagcagcagctcgcagaggaagaagctaggcggccacgcggcgaggacggcaagcccgtgaggaaaggtcctggcaagcaggaagaggtatgcgtaatcgatgccttgcttgccgatatcaggaagggcttccaactccgcaagaccgcccggggacgtggcgataccgacggagggtccaaagctgcatctatggatccccctcgggctacggagcccgtggcaacctccaatcctgctggcgacccagttggctccacaaggtgccctgctagtgagcccggcttggatgcaacaactgcaagtgagagccgggggtgggacctggttgatgccgttactccagggccccaacctactcttgagcaactggaggaagggggcccacgacccctggagcgaaggagttcctggtatgtggatgcatccgatgtcctcaccaccgaagacccacagtgcccccaacctctggagggggcctggccagttaccctgggggatgcacaggcacttaagccactgaagttttcttcgaaccagcccccagccgccggatcatccagacaggacgctaaggatcctacaagcctgctgggcgtacttcaggccgaggccgattccacttccgaaggtcttgaagatgcagttcacagccgcggagctcgccccccagctgccggccccggaggagacgaggatgaggatgaggaagatactgccccagagtctgctctggataccagccttgataaaagcttcagcgaagacgctgtcactgactcctccggttctggtacactccctcgcgcccgcggaagagcatctaagggcactggcaagagaaggaagaagcggccatcgagatctcaggagggtttaagaccccgccctaaggctaaatag

SEQ ID NO: 191955 - DNA, 3750 bp, Artificial Sequence
  Description of Artificial Sequence: Synthetic coding sequence
atgagcgtgaaggagggcgcccagcggaagtgggccgccctgaaggaaaaactgggcccccaagacagcgatccaactgaggctaacctcgaatccgcagaccctgagctgtgtattcgcttgctgcagatgccctcagttgtaaactactccggcctgcggaagagactggaaggatccgacggaggctggatggtgcagttcttggagcagtccggcctcgacctcttgctcgaagcacttgcacggttgtccggccgtggtgttgcccgaatatctgatgctctgttacagctgacctgcgtgtcctgtgtcagggcagtcatgaattctcgacagggtattgaatatattttgagtaaccagggctacgtgcgtcagctcagtcaagccctcgatacctccaatgtcatggtcaagaaacaagtgttcgaattactggccgctttatgtatttacagtcctgagggtcatgtgcttacactggatgctttggaccattataaaaccgtttgctcacagcagtaccgattctccatcgtcatgaacgagctgagtgggtccgataacgtgccctacgtggtcacacttctctctgtcattaacgctgtcatcctgggaccagaggacctccgcgccagaacgcaactacgtaacgaattcattggtctccagctcctagacgtattggcgcgcttgagggacctggaggacgcggatctcctcatccagctcgaggcttttgaggaggccaaggcagaagacgaagaggagcttcttcgagtgtcaggcggagtggatatgtcaagccatcaagaggtgtttgcatccctgttccacaaggtatcctgtagtcccgtctccgcacagttgctcagtgtgctgcaggggctactgcacctggagcccactttgcggtcttcccagttgctatgggaagccttagaatctcttgttaacagagcagtcttattagccagcgacgcccaagagtgtacgttggaggaggtggtcgaaaggctgctttccgtgaagggccgccccagaccatctcccctcgtgaaggctcataagtctgtgcaggctaacctggaccaatcccagcggggatctagcccacagaacacgacaacgccaaagccatcagtggagggccagcagccagccgctgctgctgcatgtgagccagtcgaccacgcccaatccgagtctatcctcaaagtgtcccagcctcgtgctctggagcagcaggctagcacgcccccacctcctcccccgccaccattactcccaggaagctccgcggagcctccaccacccccacctccccccccactgccttcggttggagcgaaggccctgcctactgcccctcccccacccccacttccgggactcggtgcaatggctccaccggcaccgccactgcctcctcctcttccaggctcctgcgaattcctgcctccccctcccccgcccttgcccggactgggctgcccaccacccccccctcccctgcttcctggtatggggtgggggccaccccccccacccccaccattactgccctgtacctgttcccctcccgtcgccggcgggatggaagaagttatcgtggcccaggtggatcacggcctaggctccgcatgggtgccttcacaccggcgcgtcaatccacccactttgaggatgaagaagctcaattggcaaaaactgccgtctaacgtcgcccgagagcacaattcaatgtgggcatcattatccagtcccgatgcggaggcggtggaaccggactttagtagtattgagcggcttttctcgttccccgctgctaagcccaaggagcctactatggtcgctccgagggcaaggaaagagcccaaagagatcactttcctggacgccaagaaatccctgaacctaaacatctttttgaaacagttcaagtgttctaatgaagaggtagccgcaatgatacgcgctggcgacacgacgaagttcgatgtggaggtgttgaagcaactcctgaagctgcttcccgaaaagcatgaaattgaaaacctgcgtgctttcaccgaagagagggcgaagctcgcatccgctgatcacttctatttgctcctgttagctatcccatgctatcagctgagaatagagtgcatgctgctctgtgaaggcgctgctgccgtgcttgacatggtgcggcccaaagcccagcttgtcttggctgcttgcgagtcattactgacctcccgtcagttgcccattttctgccaactgattctcagaatcggaaatttcctaaattacggcagtcacacaggggatgctgatggtttcaagatctctactttgctcaaactcactgaaaccaagtcgcagcagaacagagttacactactacatcacgtgctggaggaggcggaaaagagccatccagacctactccagctccctcgggaccttgaacagccgagccaggctgctggcattaatctggaaataatcaggtccgaagccagttccaacctaaaaaagctgctggaaactgagagaaaggtttccgccagcgttgccgaagttcaagaacagtacacagagagattgcaggcatctatctcagctttccgcgcattggacgaactcttcgaggccattgagcagaaacagcgagagcttgctgattacctgtgtgaggacgcccagcagctgagtctagaagacactttctcgacaatgaaggctttccgggatctgtttctccgggcccttaaagaaaacaaggataggaaggagcaggccgccaaggccgagcgtaggaaacagcagttggcagaggaggaggccagaaggccgaggggcgaagacggaaaaccagtgcggaaggggcctggaaagcaagaggaggtatgtgtaatcgacgcccttcttgccgatattcgcaaggggtttcaactacggaagaccgcacgtggtaggggggacaccgacggcggctccaaggccgcatcaatggacccccccagagccaccgaaccagttgctactagcaatcccgctggagatccagttggatctaccagatgccccgcaagcgagccagggctggacgcaaccaccgcctctgaatcacgaggctgggaccttgtcgacgcggtcacccccgggccacaacctactcttgagcagttggaagagggggggcccagacccctcgaacgaagatcaagttggtatgtggatgcctctgacgtgctcacaacagaggatccccagtgtccgcagcctctagaaggagcatggccagtgacactaggcgatgctcaggcccttaagcctctgaagttttcatctaatcagccacctgctgccggttcttcaagacaggacgctaaagacccgacctctctattgggagtacttcaagccgaagccgactctaccagtgagggtttggaagatgcggtgcactcacggggggcgaggcctccggctgctggacctgggggggatgaggacgaggatgaggaagataccgccccggagagcgctctggacacttctctggacaagagtttcagcgaggacgccgtgaccgactcctctggatcagggactctcccccgagcaagaggaagagcgagcaaggggacgggtaagcggcggaagaagcgccccagccgctctcaagaggaagtccccccagattccgacgacaataagaccaaaaaactttgcgtcatacagtag

SEQ ID NO: 191956 - DNA, 705 bp, Artificial Sequence
  Description of Artificial Sequence: Synthetic coding sequence
atgagcgtgaaggagggcgcccagcggaagtgggccgccctgaaggagaagctggggccgcaagacagtgaccctacggaagccaatctggagtctgcggacccggaattgtgcatacgccttctccaaatgccctctgttgtgaattactctgggttacgcaaacggttagaaggatctgatgggggctggatggtgcaattcttggaacaatcgggactcgatctgctgcttgaagcacttgctcgtctatccggccgtggcgttgcacggattagtgatgcgcttctccagctgacctgtgtgtcttgtgtgcgagcagtgatgaatagtagacagggcatcgaatacatcctgtctaatcagggctacgttcgtcaactgagccaggccctggatacatctaacgttatggtgaaaaagcaggtctttgaactattggcagctttgtgtatctattcccccgaggggcacgttctgactctggatgcactcgaccactataagacagtgtgctcccagcagtatcgctttagtatcgtaatgaacgagcttagcgggtctgacaatgtgccttacgtcgtgactctactgtccgtgatcaacgccgtgattttgggtcctgaggaccttcgcgccagaactcagctccgcaatgagttcatcggcctgcagctgctggatgttttagcccgattgcggtag

SEQ ID NO: 191957 - DNA, 1758 bp, Artificial Sequence
  Description of Artificial Sequence: Synthetic coding sequence
atgagccagcagcacaccctgcccgtgaccctgagccccgccctgagccaagagctgctgaaaaccgtgcctccccccgtgaacacacatcaggagcagatgaagcaaccaactcctctgcctccaccatgtcagaaagtgcctgtcgagctccccgtggaagtgccaagcaagcaggaagagaaacatatgactgccgtgaagggccttccagaacaagaatgtgaacagcaacagaaggaaccacaagaacaggagctacagcagcagcactgggagcaacacgaggagtaccagaaggccgagaaccccgaacagcagctcaagcaggaaaagactcagcgtgaccagcagctcaacaaacagcttgaggaggaaaaaaaactgcttgatcaacagctagaccaggagctggtcaaaagagacgagcaactggggatgaagaaagaacagctgctggagctgcctgaacaacaagaggggcatctgaaacatttagagcagcaagaaggacagctgaaacatcctgagcagcaggaaggacagcttgagcttcccgagcagcaggaaggtcagctggagttacctgaacagcaagagggacaactggaattgcctgaacaacaggaaggccagcttgagcttcctgagcagcaagagggccagctggagctccctgaacagcaggaaggccagctggagttgcctcagcagcaagagggccaactggaactgagcgagcagcaggagggccagctcgaactttccgagcaacaggagggccagttaaagcacctagagcatcaggaggggcagttggaagttcccgaagaacaaatgggccagttgaagtaccttgaacaacaggaggggcagctcaagcacctagaccaacaggaaaagcagcctgagctgccagagcagcagatgggccaattgaaacacctggaacagcaggaggggcagcccaagcaccttgagcagcaagagggacagttggagcagttagaggagcaggaaggacagctcaaacacttagagcagcaggaagggcaacttgagcacctggaacaccaggagggccagctgggcttaccggagcaacaggtactgcaattaaagcagctggaaaaacaacaggggcaaccaaaacacttggaagaggaggaaggacagctgaaacatttggtgcagcaggaaggccagctcaagcacttagtgcagcaggaggggcaactggagcagcaggagcgtcaagttgagcatctggagcagcaggtgggccagctcaaacatctggaggagcaggaaggccaactgaagcatctcgaacagcaacagggacagctcgaggtgcccgagcagcaagtgggtcagcctaagaacctggaacaggaagagaagcagctggaattaccagagcagcaggaagggcaggtgaagcatctggaaaaacaggaagctcagttggaactccctgaacagcaggtagggcagcctaaacacctagagcagcaggagaagcatcttgaacaccccgaacagcaagacggacaacttaagcaccttgagcagcaggaggggcagctgaaggatctggaacagcagaagggccaattggagcaacccgtcttcgcaccagcccctggccaggttcaagacatccagcccgcgctccctaccaagggagaagtactgctgccggtcgagcatcaacagcaaaaacaagaggtccagtggccaccaaagcacaagtag

SEQ ID NO: 191958 - DNA, 1320 bp, Artificial Sequence
  Description of Artificial Sequence: Synthetic coding sequence
atgaagaaggagcagctgctggagctgcccgagcagcaggagggccatctgaaacatctggagcagcaggaaggacagttaaaacacccagagcaacaggaagggcagctggaactgcctgaacagcaagaaggtcaactggagttgccagagcagcaggaaggacagttagagctgcctgagcagcaggagggccaactggaactgccagaacagcaagagggccaactggagctgcccgaacagcaggaaggccaactggagttaccccagcaacaggaaggccagttggaactgtccgagcaacaggaggggcaacttgagttgtccgaacagcaggagggccagctgaagcacctggaacaccaggaaggccagctagaggtcccggaggaacagatggggcagctcaagtacctagaacagcaggaaggtcagctgaagcatctggatcagcaggagaaacagccagaactacctgagcagcaaatgggccagttgaagcatctggagcaacaggagggacagcccaaacacctggagcaacaagaagggcaactggagcagctggaggaacaggagggccaacttaagcacctggaacaacaggagggtcagctcgagcacttagaacaccaggaaggtcagctgggcctgccggagcaacaagtcctgcaactgaagcagcttgaaaagcaacagggccaaccaaaacacctagaagaagaagagggccagctgaagcatctagtgcagcaggaaggtcagctgaagcatctggtgcagcaggagggccagctggagcagcaggagaggcaggtggaacatctggaacaacaagtgggtcagctgaaacacctcgaagaacaggaagggcaactgaaacacctcgagcagcagcaggggcagcttgaggtacccgaacagcaagtggggcagcctaaaaacctggagcaggaggagaaacaacttgagctgcctgagcagcaggagggtcaggtgaagcacctcgaaaaacaggaggctcagctggagctgcctgagcagcaggtgggccagcccaagcatctggaacagcaggagaaacacctggaacacccggaacagcaagatgggcagttaaagcacctagagcagcaggagggtcagctgaaggacctagagcagcaaaagggacagctcgaacagcccgtgttcgcaccagccccaggccaagtgcaggatattcaacccgccttacccaccaagggggaggtgctactgccggtagagcaccagcagcagaaacaagaagtccagtggcccccaaagcataaatag

SEQ ID NO: 191959 - DNA, 1914 bp, Artificial Sequence
  Description of Artificial Sequence: Synthetic coding sequence
atgggcctgctgagccagggcagccccctgagctgggaggagaccaagaggcacgcagaccatgtgaggcggcacggtatattgcagttcctgcacatctatcatgctgtcaaagatagacataaggacgtgctgaaatggggcgatgaagttgaatatatgctagtgtctttcgaccacgaaaataaaaaggtgcgactagtcctgagcggcgaaaaagtgctggagacactccaagaaaagggcgagaggaccaatcctaaccaccccaccctgtggcgtcccgagtatgggtcctatatgattgagggaacaccggggcagccctacggggggacaatgtctgagttcaacacggtggaggctaatatgcggaaacggcgcaaggaggctacctctattctggaggagaaccaggccctgtgcacaattacatcttttcctagactgggctgccctggattcactctgccggaagtgaaaccaaacccagtggagggcggagccagcaagtctctgttctttccggacgaggccatcaataaacaccctagattctctactttgacacgcaacataaggcataggcggggcgagaaagtcgtgataaacgtgcctatcttcaaggacaaaaacacaccctctccattcatcgagacattcacagaagatgacgaggctagtagggctagtaaaccagatcacatctacatggacgctatgggattcggcatgggaaactgctgcttgcaggttacctttcaagcttgtagcatcagtgaagccagatatttgtacgaccagcttgccaccatctgccccattgttatggctctgagcgccgcatctccattctataggggctatgtgagcgatatcgactgccgttggggagtgatcagtgcttccgtcgatgatagaactagggaggaaaggggtctggagcctctgaagaacaataactaccgcatcagcaaatcgcggtacgactccattgactcctacttatcaaagtgcggagagaaatacaatgatatcgacttgacaatcgacaaggagatatatgaacagctgctgcaggagggcatagatcacctgctggcccagcacgtggcccatctttttataagagaccccctgactttatttgaggagaagattcatttggacgatgccaatgaaagcgatcactttgaaaacatccagtccacaaattggcaaacgatgaggtttaagcctccaccccccaacagcgacatcggatggcgcgtagagtttaggcctatggaggttcagctgacagatttcgagaattcagcttacgtcgtgttcgttgtgctcctcacgcgtgtaattctgtcttacaagctggactttcttattccgctgagcaaggtggacgaaaacatgaaagtggcccaaaagcgagatgccgtgctacaaggtatgttctactttagaaaggatatttgcaagggcggcaatgctgtggttgacggctgcggtaaggcgcagaactctaccgagttggcagcagaagagtacaccctgatgtcaattgacacgattattaatggaaaagaaggggtgtttcctggcctgatcccaatcctgaattcataccttgaaaacatggaagtagatgtcgacacacggtgtagcatcttgaactacctgaaactcataaaaaaacgcgcttccggcgaacttatgactgtggcaaggtggatgcgggagtttatcgctaaccatcccgactacaagcaggactccgtgattacagatgagatgaattattcactgatcttgaaatgtaaccagattgctaacgagctgtgtgaatgtccggaattgcttgggagcgccttcaggaaggtgaaatatagcggatcaaagacggactcctcgaactag

SEQ ID NO: 191960 - DNA, 870 bp, Artificial Sequence
  Description of Artificial Sequence: Synthetic coding sequence
atgtacttcctgacccccatcctggtggccatcctgtgcatcctggtggtgtggatcttcaaaaatgccgaccgaagcatggagaagaagaagggagaaccacggacacgagcggaagcgcggccttgggttgatgaggatctcaaggatagttcggacctgcaccaagctgaggaggatgctgacgagtggcaggaaagtgaagagaatgtggagcacattccatttagtcataatcactacccagagaaggagatggttaagaggtctcaagaattttacgagcttttaaacaagcggagatccgtccgatttatctccaatgagcaggttccaatggaagtgattgacaacgtcattcgcacagccggcaccgcaccctcaggggcccatactgagccgtggacatttgtcgtggtgaaagaccctgacgtcaaacacaaaattcgcaaaattatagaagaggaggaagaaataaactatatgaaaaggatgggccaccggtgggtgactgatctgaagaaacttcgcaccaattggatcaaggagtacctggatacagcaccaatccttatcctgatattcaagcaggtccacggcttcgcggcgaatggtaagaaaaaggtgcactattataatgaaatttcagtcagcattgcctgcggcattctactggccgcactgcagaatgccggactggtgaccgttactaccaccccccttaattgcgggcccaggttgcgggtgttactgggcagacctgcccatgaaaagctgttgatgttactgccagtggggtatccctccaaagaagcaaccgtccctgatcttaaaagaaaaccactcgaccagatcatggtgactgtctag

SEQ ID NO: 191961 - DNA, 813 bp, Artificial Sequence
  Description of Artificial Sequence: Synthetic coding sequence
atgtacttcctgacccccatcctggtggccatcctgtgcatcctggtggtctggatcttcaagaatgccgatagaagtatggagaaaaagaagggcgaaccaaggactagagcagaagcccgcccttgggtcgacgaggatttgaaggacagctcagacctccaccaggcagaggaggacgccgacgagtggcaggagtcagaggagaatgttgagcatatcccattttcccacaaccactatcccgaaaaggagatggttaaaagatctcaggagttttatgagcttctaaacaagcggcggtctgtaaggttcatttctaacgagcaagttcccatggaggtcatcgacaacgtgattagaactgccgggaccgctcctagcggtgcacacactgagccttggacattcgtggtggttaaggacccagacgtaaaacacaagatcaggaagatcatcgaagaagaagaggagattaattacatgaagagaatgggccacaggtgggtgacagacttaaaaaaactgcgaaccaattggatcaaagagtacctggataccgcccctatcctgatcctgatcttcaaacaggtgcacggtttcgcagccaatgggaaaaagaaagtacattattataatgagatcagtgtgtcaatcgcttgcggaatcctgttggccgccttgcaggtgaataatggaattacaatgaggcatcagactgcaaggcatcgacacctgattgaggggcccggacgctcaagcgaagcctgctctaaactgtcgtcccagggatgcccaggattctactgctag

SEQ ID NO: 191962 - DNA, 744 bp, Artificial Sequence
  Description of Artificial Sequence: Synthetic coding sequence
atgtacttcctgacccccatcctggtggccatcctgtgcatcctggtcgtttggatatttaaaaacgccgatcggtctatggaaaagaaaaagggtgagccccgaactagagctgaggcgcggccatgggtggacgaagacctgaaggattccagcgacctgcaccaggccgaagaagatgctgatgaatggcaagaatccgaggaaaatgtggaacatatccctttctctcacaaccattacccagagaaggaaatggttaagcgaagccaagaattttacgagcttctgaacaagcgccggtcagtccgttttatcagtaatgagcaagtgcccatggaggtcattgataacgtgataagaactgccggcactgctccaagcggcgcccatacggaaccttggacttttgtggtggtgaaagaccccgacgttaaacacaagatcagaaaaatcattgaggaggaggaagaaattaactacatgaagaggatgggtcataggtgggttaccgacctaaaaaagttgcgaaccaactggattaaagagtacttagacactgctcccatccttattctgatttttaagcaagtccacggctttgccgcaaacggcaagaagaaagtccattattataacgagatctctgtaagcatagcttgcggcattctgctggctgccttacaggtgttcggaaagataattctcaaggagttagccctcatatcttttctcaatctttag

SEQ ID NO: 191963 - DNA, 855 bp, Artificial Sequence
  Description of Artificial Sequence: Synthetic coding sequence
atgtacttcctgacccccatcctggtggccatcctgtgcatcctggtggtctggattttcaagaacgctgaccgatcaatggaaaagaagaagggtgaaccccgcacgagagccgaagcacgaccatgggttgatgaggatctgaaggacagctccgatctgcatcaagccgaggaggatgctgacgagtggcaggagtctgaggaaaatgtagagcacattcccttttcacataaccattatccagaaaaggagatggtgaaacggagtcaggagttttatgaactgttgaacaaacgaagatccgtgcgcttcatatcaaatgagcaggtgcccatggaagtgattgacaatgttatccgcaccgccgggaccgctcccagtggagcccatacagagccttggacatttgtagtggtgaaggaccctgatgtgaaacacaaaattagaaaaatcatcgaggaagaggaagaaattaattacatgaaacgcatggggcatcgatgggttaccgatctgaagaaactgcggactaactggataaaggagtatctggacacggcccccatcttgattctgatctttaagcaggtgcacgggtttgccgcgaatggtaagaagaaggtgcactactataatgaaataagcgtttcaattgcgtgtggaatcttattggcggcacttcaagtcaataacggtatcactatgcggcaccagacagcccgccacaggcacttaattgagggtcccggacgttcttcggaagcctgtagtaagttgtccagtcagggctgtccaggcgccagcgctgctggaagtctgtttcactttgcaattgaatttgcagctccttag

SEQ ID NO: 191964 - DNA, 2850 bp, Artificial Sequence
  Description of Artificial Sequence: Synthetic coding sequence
atggagccccccggccggagcagccggagcaccgccagccacacccttcaccaatactgttgtcctacccaagtgttagactctatgaaacttacacccagtggcagactggctgagtccagcgttgagggggatgctcccggatccgacctctcgacagccgtagattccccaggaagtcagccaccctatcgcctgagccaactaccgccctcctcctcccacatggggggtccccccgctggagtcgggctgccatgggctcaacgagcccgccttcaaccggcctcagtggccctgcgcaaacaggaagaggaggagatcaaaaggtccaaggcgctgtccgactcttacgaactgtccaccgacctccaggacaaaaaggtagaaatgctggagaggaaatatggcggctcttttctcagcagaagggctgcgcggaccattcagaccgctttccggcaatatcgaatgaataagaacttcgagagattgcgctcatcagcctctgagtctcgcatgtctcgtcggatcatccttagcaacatgagaatgcagttctcttttgaagaatacgaaaaggcacagaatcccgcttactttgagggtaagcccgccagtctggatgaaggcgccatggcaggagctagatctcatcggctcgaacgggggctgccctatggtgggtcctgcggcggtggcatagatggtggggggtcatctgtcaccacttctggagagttcagtaacgacattacggaattagaggacagtttttcgaaacaggttaaatcactcgctgagagcatagacgaagccctcaattgtcatccttctggtccaatgagcgaagagccaggaagtgcccagttagagaagcgagaaagcaaagagcaacaggaagattcatctgccacgagttttagtgatctccccctgtatcttgacgacaccgtgcctcagcaaagtccagaacggctaccctcaacagagccgccacctcagggaagaccagagttctgggcccctgcaccgttgcctcctgtccccccgccagtaccctcaggcacaagagaagacggatcccgggaagagggaacccggaggggcccgggttgcttggaatgtcgcgatttccggctcagagcagcccacctgcctcttctgaccattgaacctccctcagacagctccgtggacctgtccgacaggtctgatagagggtcagtgcaccgacagttagtctacgaggccgacggttgttcaccccacggcaccctcaagcacaagggacctcctggccgtgctccaattccccatcggcactacccggcccctgaaggcccggcccccgctccgccaggcccactgccccccgctccaaattctggaaccgggccaagcggagtggccggcgggcggcgactcggtaagtgcgaagctgctggcgaaaactccgacggcggcgacaatgaaagcctggagtcttcaagcaacagcaatgaaaccatcaactgcagtagcggatcaagctcacgggatagtctgcgcgagccacccgcaacaggactatgcaagcaaacctaccagcgcgaaacccgacactcttgggattcacccgcattcaacaacgatgtcgtgcagcggagacattacagaatcggcctaaatctttttaataagaaaccggagaaagggattcaatatctgattgagcgaggatttctcagcgatacaccagtgggcgtggcacacttcatacttgaacgcaaaggcctgtcacgtcagatgattggtgagttccttgggaatagacagaagcaatttaacagggatgtgctggattgcgtggtggacgaaatggatttctcatcaatggacttggatgacgctctgcgaaagttccagtcccatatccgtgtacagggcgaggcccagaaggtagagcgactgattgaggcttttagccagcgctattgcgtgtgcaatcctgctctggtgagacagtttcgcaatcctgacacaatcttcatcctggcctttgctatcatcctccttaatacagatatgtacagcccttccgtcaaagcagaacgtaagatgaaactggacgatttcattaagaacctgcggggcgtggacaatggagaagatatcccgcgtgacctactggtgggcatctatcaaaggattcagggcagagagctccggaccaatgacgaccacgtgagtcaagttcaggccgtcgagcgcatgattgttggcaagaagccagtcctgtccttaccccaccgccggctcgtgtgctgttgccagctgtatgaggtgccggacccgaaccgccctcagcggctcggcctccatcagcgagaagttttcctctttaatgatctcctcgttgtgacaaaaatttttcaaaagaaaaagatacttgtgacatacagtttcagacagtctttccctttggttgaaatgcatatgcagttattccagaacagctattaccaatttggtatcaagttactaagcgccgtccccggcggagagagaaaggtgctgatcatctttaacgcgccaagcctccaagaccggctgcgatttaccagcgatctcagggagtctatcgcagaggtccaggaaatggaaaaataccgcgttgaatccgagctggagaaacaaaagggtatgatgaggccaaacgctagccagcctggaggggctaaggacagcgtcaacggcactatggccagaagctctttggaagacacctacggcgcaggagatggtctgaagcggggagcactgagctcttccctgagggatctgtccgacgctggtgtgtgttactag

SEQ ID NO: 191965 - DNA, 4437 bp, Artificial Sequence
  Description of Artificial Sequence: Synthetic coding sequence
atggaggccggcagcggcccccccggcggccccggcagcgagagccccaatcgggccgttgaatatctcctggagttaaataacattatcgagtcccagcagcagctactggaaacacagcgccggaggatcgaggagctggaaggccagctggaccagcttacacaggaaaacagagatctccgggaggagtctcagctccatagaggcgagcttcacagagatccacatggtgctagggactcccctggaagagagagtcagtatcaaaatctgcgggagactcaatttcaccatcgggagctaagagaaagtcaattccatcaggccgccagggacgtgggctatccaaatcgtgagggcgcttatcagaatcgtgaggccgtttatcgcgataaagaacgcgatgcatcctatccactccaggacacaacaggctacaccgcaagagagcgcgacgttgcccagtgtcatctccatcatgaaaacccggccctaggtcgagaacgtggtgggcgggaagctggaccagctcacccaggacgggagaaggaggccggttactcagctgccgttggggtgggaccacgtccccccagagagcgcggacagctgtctcgcggggctagtcgatcctcttcgccaggggccggcggaggacactcaacaagcactagcactagcccagctacaaccttacagaggaacgtggaaggagatgccccagggagcgacctttctaccgcagtagattctcccggatcgcagccaccgtatcgactttcccagcttccgccgagcagttcccatatgggtggccctccagcaggggtaggtttgccttgggcgcagcgggctagactacaaccagctagcgtggctttgaggaagcaggaagaagaggaaatcaaaagaagtaaggcgctgagcgactcctatgagctgtccaccgacctccaagataaaaaggtggaaatgttggagcggaagtatgggggtagctttctgagcagacgtgccgctagaactatacaaacagcatttcggcagtatagaatgaataagaacttcgagagactgcgcagctccgcttccgagtcccgcatgtccagaagaattatcctatcaaacatgcggatgcaattttccttcgaagaatacgagaaggcccagaatccagcctacttcgaagggaaaccagccagcctagacgagggagccatggctggagccagatcacatcgattggaacgcggcctcccctacgggggaagttgcggaggaggaatcgacgggggcggatcaagtgtaactacctccggagaattttccaatgacatcacagaactggaggatagctttagcaagcaagtaaagagcctagcagagagcatagacgaggccttaaattgtcatccctcaggtcccatgagcgaggaaccaggcagcgcccagctcgagaagcgcgaatccaaggagcaacaggaagactcaagcgctacatctttttcggatctgccactctacctggatgacacagtgcctcagcaatcgccggagcgcctcccctcaacagaaccccccccccagggccggccagagttttgggcgccagcccccctgccacccgtcccgccacccgtgccctctggaacgagagaggatggcagtcgagaggagggaaccaggcggggaccgggctgtctcgagtgcagagacttcagactgcgggccgcccacctaccactgctgactattgagcctccttcagattctagtgtggatctttctgatagaagcgatcgcggcagcgtccatcgtcagcttgtctacgaagcggatggctgcagcccccatgggactctaaagcacaagggtcccccaggtagagcccccatccctcaccgacactaccctgctccagaggggcccgcccccgctccacccggtcctctgcctcccgcaccaaacagcggcactggaccctccggagtggcagggggacgccgtcttggtaagtgtgaggctgccggcgagaattccgacggtggggacaacgaaagcttagagtcatcgtcaaattccaacgagaccattaactgttctagtggatcctcttcaagagactcactgagggagcccccagcaaccggcctctgtaaacagacctatcagagggagacaaggcactcctgggactctccagcttttaataacgatgtggtccagaggcgacattatcgcatcggcctgaatctcttcaataagaagcctgagaagggcatacaatatctgattgaaaggggattcctgtccgacacccctgtgggagttgctcattttatcttagaaagaaagggcctcagcagacaaatgatcggcgaattcctggggaatcgacagaagcagtttaatagggatgtcctcgactgcgtcgtggacgaaatggatttttcaagtatggacctcgatgacgctctccgcaagtttcagtcacatatcagagtgcagggtgaggcgcagaaagtcgaaagactcattgaagctttcagccaacgatattgcgtgtgtaatcctgctcttgtgcgtcagtttagaaacccagacactatttttatcttggcattcgcaatcatcctgttgaacaccgacatgtactccccatctgtgaaggcggaacgcaagatgaagctggatgacttcattaaaaatctgcgtggtgtcgacaatggggaggatattcctcgggatctccttgttggaatttaccagcggatacagggccgcgagctgcgcaccaacgacgaccatgtttcccaagtacaagccgtcgagcggatgattgtggggaaaaagcctgtgctctctctccctcatcgaaggctcgtgtgttgctgccagctttatgaagtccctgaccccaataggccccagcgacttggcctgcaccagagagaagtatttctgtttaatgatctgctggtcgtgactaagatcttccagaagaagaagatccttgtgacctactcattcaggcagtcttttcctctggtggagatgcatatgcagctattccagaactcctattaccagtttgggattaaattactgtcagccgtccctggcggggaacggaaagtcctgattattttcaacgctccatcattacaggacaggcttagattcacttctgatctgagggaatcgattgcggaagtccaggaaatggagaagtatcgagtcgagtccgaactcgagaagcagaaagggatgatgcgtcctaatgcaagccaacccggcggagctaaggactccgtcaacgggacaatggctagatccagcctggaggatacctatggcgcgggcgacggcctcaagaggggagctttgagttcttcgctccgagatctgtcggacgcgggtaaacgcggacggcgcaatagcgtgggctcgctggattccaccatcgaaggatcggtgataagcagtccaagaccacaccagagaatgccccccccccctcccccccctcctcctgaggagtacaaatcccaacgccctgtctccaacagcagcagttttctgggttcacttttcggctccaaaaggggcaagggcccatttcagatgcctccccccccgacaggccaggcaagcgcatccagctcatccgcctcctcaactcatcatcatcaccaccaccatcaccacggccactcacacggaggcctgggagtgttacccgatggacaaagcaagctgcaggctcttcacgctcagtattgtcaaggacctggcccggctcctcccccttacctccctcctcagcaaccttcattgccgccacctccgcaacagccccctcctctaccacagttaggtagtatccctccaccgccagcgtcagcaccacctgtggggcctcaccgtcacttccatgcccacggcccagtgcccgggccccagcactatactctcggtcgacctgggagggcacctaggagaggcgctgggggtcatccacagttcgctcctcatggacgtcacccactccatcagccgacgtcaccactccccctctactctccggcaccccagcaccctcccgcccataagcaggggcctaaacacttcatcttctctcatcatccgcagatgatgcccgccgccggcgctgcaggtggcccagggagtagaccacccgggggatcatactcccatccccaccaccctcagtctcccctttccccgcactccccaattcctccccacccatcctacccgcctttgcctcccccctcccctcacactccacattcgccactgccacctacctccccacatgggcccttgcacgcctccgggcctccaggcaccgcaaacccaccctctgccaaccctaaggcgaagcctagtaggatctcaactgtcgtgtag

SEQ ID NO: 191966 - DNA, 4467 bp, Artificial Sequence
  Description of Artificial Sequence: Synthetic coding sequence
atggaggccggcagcggcccccccggcggccccggcagcgagagccccaaccgggcagtcgaatacttgttagaacttaacaacataatcgaatcccagcagcagctgttggagactcaacgtaggcgcattgaggagctggagggccagctggatcagctgacgcaggaaaatagggacctgcgcgaggagtctcagttacacaggggagaactgcatagagacccccatggtgcaagagactcgcctggccgggaatcacagtatcagaatctcagagaaactcagtttcatcacagagaattacgtgagagtcagttccatcaggccgcacgtgatgtgggatatcccaatagagaaggagcctaccagaatcgtgaagctgtgtacagggataaagagcgggacgcgtcttacccactccaggatacaaccggatatacagctcgcgagcgcgacgtagcccagtgtcatctccaccacgaaaacccagccctggggagagagcgagggggcagagaggccggtcccgcacaccctggacgggaaaaggaagcaggctattcagctgcagtgggagtgggccccaggccccctcgggagcggggccagctgtcccgaggtgcatcgcgctccagcagtcccggcgctggcggaggccattcaacctctaccagcacctctccagcgaccacgctgcagcgaaagagtgacggtgaaaacagccggacggtcagtgtcgagggggacgcgcccggctctgacctcagtacagcggtagactctccaggatctcagcccccataccggctcagccagttacctccaagctcctctcatatggggggacctccagccggggtaggcctgccctgggcacagagggctcggttgcagccggcgtcagtggctctgcgaaaacaggaggaagaggagatcaagagatcaaaggctctctcggactcttatgagttaagtaccgacctccaggacaagaaggtcgagatgctggagagaaaatatggcggcagttttttaagccgccgcgctgcacgcaccatccaaacagccttccggcagtacaggatgaataaaaactttgagcgacttcgctccagcgcatcagagtcacggatgtctagaaggattatactctccaatatgagaatgcagttcagttttgaagagtacgagaaggcccagaaccctgcatactttgagggtaaacctgcttccttagacgagggagccatggcgggggccaggtcccaccgcctggaacgggggctcccgtacgggggatcttgtggcgggggcatcgacggagggggatcctccgtgactacctcaggagaattctcaaacgatattacagagcttgaagactccttttctaagcaggtcaaaagcctggctgagagcatagacgaagccttaaattgtcatccatctgggcccatgagcgaggaacccggctcagcccaactggagaagcgggaatccaaagaacagcaggaggactcttctgccacatcttttagcgacctcccgttgtatctggatgacaccgttccacagcaaagcccagagaggctgccatctacggagccaccccctcagggacggcctgaattttgggcccctgctccccttcccccggtcccgcctcccgtgccttcgggcactagggaagacgggtctagagaggaaggcactcgaagagggcccggctgtctggagtgtagggatttccggctacgcgcggctcatctgcccctgcttactatcgagcctccgtcagactcttctgtggatctgtcagaccgttccgaccgtggttcagtccataggcagttggtgtacgaggctgatggctgcagcccccatgggaccctgaagcataaaggaccgccagggagagcccccatcccacatcggcactatcctgctcccgaagggcctgcacccgctcctccgggccccttgccccctgcgccaaactctggtacaggtccaagcggggtggctggcgggcgccgactgggtaaatgcgaagccgctggtgagaattcagatgggggagataatgaatcccttgagtcttcctccaactccaatgagaccatcaattgttcttcagggagcagttccagggactcccttcgagagccccccgctacaggcctatgcaaacagacctatcagagagaaacccgacattcctgggactctccggcttttaacaacgatgtggtgcagaggcgacactatagaattggcctcaatttatttaacaaaaagccagagaagggcattcaatacttgattgagagggggttcctttccgacaccccagttggggttgcacatttcatcctagaacgtaaggggctgagcagacaaatgatcggggaatttctgggcaataggcagaaacaattcaaccgtgacgtccttgactgtgtggttgatgaaatggacttttctagcatggatctggacgacgcactgcgcaaattccagagtcacattagggtccagggcgaggcacagaaggtggagagactgatcgaggctttctcccagcgatactgcgtctgcaacccagcactcgtgaggcagtttaggaaccccgatacaatattcatactggcatttgcgattattctactcaacacggatatgtacagccccagcgtgaaggctgagcgaaagatgaagctggacgattttataaagaacttgcggggtgtcgacaacggggaggacattcctcgtgacctgctcgttggtatttaccagcggatccagggccgcgaactgagaacaaatgatgaccacgtgagccaggtgcaggctgtcgagagaatgatcgtggggaaaaaaccagttctatctctcccccatcgcaggctcgtatgttgttgtcagctgtacgaggtaccagaccctaatagaccccagcggctcgggctgcaccagcgcgaagtttttctttttaatgacttactggttgtgacgaaaattttccagaagaagaagatcctggttacatatagcttccgccagtcatttcctctggtcgagatgcacatgcagctcttccagaatagttattatcagttcggcataaaactactcagcgccgtgcctggcggagaacgaaaggtattaattatctttaacgcgccctcacttcaggaccgactccggttcacttcagacctgagggaatccattgctgaggtgcaggagatggagaagtacagagtcgagtcggagctggaaaaacagaagggtatgatgcgtcccaatgccagccagcctgggggcgctaaggatagcgtaaacgggaccatggctcgctcttctctcgaggatacgtatggagccggagatgggttgaagcggggtgctctaagctcaagtttgagggacctgagcgatgccggaaaaagagggagaaggaactctgtgggtagcctggactccactattgagggtagcgtgatttctagtcctaggcctcatcaaagaatgccacctccaccaccaccaccacctccagaagagtataagtctcagaggcctgtgtccaattccagttcctttctgggcagtctattcggctctaaaaggggaaaagggcctttccagatgcccccaccaccgaccggtcaagctagcgccagcagctcaagtgcatcctccacgcatcaccaccatcatcaccatcaccacggacatagtcacggcggcctgggagtgctgccagatggacagtcgaaactgcaggctttgcacgcacagtattgtcagggccctggacccgccccacccccgtacctgccaccacagcagccatcgttgccgccccctccacaacagccaccgcctctacctcagttgggaagcatacccccaccgcccgccagtgcccctcccgttggccctcaccgacatttccacgcacatggcccagtacccggtccacagcattatacactcggacgaccggggcgtgcgcctcgtagaggcgcaggaggtcacccccagtttgcccctcacggccggcaccccctgcaccagccaacctcgcctcttccactctactctcccgcccctcagcatccccccgcgcacaaacaaggcccaaagcattttattttctcccatcatccgcaaatgatgcccgcagctggcgcagccggggggcctggctcacggccaccaggtggaagctactcgcacccgcatcacccacagagccccctgtcaccccactcgcctattccaccacatcctagttaccctcccctgccacctccctctccccacaccccacactcccccttgcctccaacgtccccccacggccctcttcacgcatccgggcctcccgggacagccaacccccccagcgcgaacccaaaagccaagccgtcacgtatctcaaccgtagtgtag

SEQ ID NO: 191967 - DNA, 3549 bp, Artificial Sequence
  Description of Artificial Sequence: Synthetic coding sequence
atggagagcctgctggagaaccccgtgcgggccgtgctgtacctgaaggagttaacagcgatcgtccaaaatcaacagtccctcatccacacacagagggagaggatcgatgaactggagcgaaggctggacgaattgtctgccgagaataggtcactgtgggagcaccagcagctacttcaggcccagcccccacccggacttgttcctccttctagcgcaccactacccgccgcacccgccactgcaccggcagcagcggcgcgcgctcaggagcccctgcaggatcaaggtcagagatcagctgccgccccccaccctgcgcctgacaggccgccacgtcagcaccatggccagctcctggagcagccgcagagaggccccggctctagagcccacactccacagtcaccgcataaacacctcggcactcagggagcagtcaccgacaaagagaaagagagacctccgtcatgttgcgcagctgcgggcgcacttttacagcataagtctccctccgcacttggcaaaggggtgctgtccagaagacccgaaaatgaaaccgtgctacatcagttctgttgtcctgccgctgatgcctgcagcgatctggcctctcagagcgacgggagctgtacccaggctggtggggggatggaagatagcgtggtggccgcagctgctgtggctgccgggcgcccgtccgctcatgcccccaaagcccaagcacaggaactccaggaggaggaagagcgccctggcgcaggagccgcaagccccagggccgggcctcaacacaaagcttctcctggacgccagcaacccgccctggcaacagccttatgtccacacgctcctgcagcatcagactatgagctgtcactggacctgaagaataagcaaatcgagatgctggagcacaagtacgggggccatctagtttccaggagggctgcctgcacaatccagaccgcattcagacaataccaacttagcaaaaatttcgaaaagattcgcaattcactcctcgagagccgcctgccaaggcggattagcctcagaaaggtgcgctctcccaccgccgaaagcctggctgccgaaaaagcactcatggagggatatggcctagttgggttacctttggtgcggagtccctcactgcccccgacgtttgcgggaacactcacggagttagaagactcctttaccgaacaggtgcagagcctggctaaaagtatagacgacgccctctcaacgtggagcctgaaaactatgtgttcactgagggagagcggagcttatcaactgcatcaggctctgcaggctgctgccgggccacctggcctggaggcagaaggtagagccccagaatcagctgggccggggccgggcgacgacgccgccgagactcccggcttgcctccagcacattctggtacccttatgatggcctttcgagatgtgactgtgcagatcgctaatcaaaatatttctgtaagttcctctacagccttgagtgtggccaattgcctgggagctcagactgtacaagcacctgccgagccggctgccggcaaggctgagcaaggggaaacatccggcagggaggctcctgaagcccccgctgttgggcgggaggatgcgtctgctgaagattcctgtgcagaagccgcagcttcgggcgccgctgacggagctaccgctcccaaaacagaagaagaggaagaagaggaagagactgctgaggtcgggcggggcgcagaagctgaggcaggcgatttggaacaattgtcctccagctcaacgagcaccaaaagcgccaagagtggaagcgaggccagcgccagcgcatctaaagacgcacttcaggctatgatactgtcgttgcctcggtaccattgtgagaatcctgcctcttgtaaatcgcctacccttagcacagacaccctaaggaagcggctctatcggataggtctcaacctctttaacatcaaccctgataaagggatccaatttctaatatcccgcggctttattccagataccccaattggagtggctcacttcctgctacagcgcaaaggattatctagacagatgatcggagagttcctcggtaacagcaagaagcaattcaatcgagatgtgctggattgcgtggtggatgagatggatttctcttctatggagttagacgaggcgttgcgcaagtttcaagcccatatacgggtccagggagaagctcagaaggtcgaaagactgattgaagcattttcccaacggtattgtatgtgtaatcctgaggtggtgcagcagttccacaaccccgacactatcttcatcttggccttcgccattatacttctgaacacagatatgtactctcctaatatcaagcccgatcggaaaatgatgttagaagatttcattaggaatcttagaggggtggacgatggggcggacatcccccgggagctcgtggttggtatctacgaacgcattcagcaaaaagaactgaagagtaacgaggatcatgtgacctacgtcactaaagttgaaaaatctatagttgggatgaagactgtgctgtcagtgcctcatcgccggcttgtttgttgttcacgactcttcgaagtaactgatgtgaacaagctacagaagcaggccgcacaccagagggaggtgtttttgttcaatgatctgctcgtaatcctgaagctctgtcctaagaagaagtcttcctctacgtacaccttctgcaaatcggtcgggcttctaggcatgcagtttcagttgtttgaaaatgaatattactcacatggcataacactagtaaccccactgtcgggaagcgaaaaaaagcaggtgttgcatttttgcgcgttaggttcagacgagatgcagaagttcgtcgaggatcttaaagaaagcattgctgaagtcaccgagctcgagcaaattcggatagagtgggagctggagaagcagcaggggacaaaaacgctttcttttaagccttgcggagcacagggggacccccagagtaagcaggggtctcccacagctaaacgagaggcagctctgcgagaaaggcctgccgaatccactgtcgaggtgagcatacataatcgcctccagactagccagcataactctgggctgggcgccgaacgcggggctcccgtaccccctccggatctacagccctccccacccaggcagcagacccccccactgccacccccacctcccacccctccaggcaccctggtccagtgtcagcagatcgtgaaggtgattgtcttagataaaccatgcctggccaggatggaaccactactgtcacaggctctgtcgtgctataccagctctagttctgacagttgcggctctacccccttagggggcccaggatccccagttaaggtgacacaccagccacccctgccacctccacctccaccttataatcatccacaccagttctgcccgccaggatcgctgctgcatggtcatcgctattccagcggtagtcgttcattggtctag

SEQ ID NO: 191968 - DNA, 2280 bp, Artificial Sequence
  Description of Artificial Sequence: Synthetic coding sequence
atgctggagcacaagtacggcggccacctggtgagccggcgggccgcttgtacgatccagaccgcctttagacaataccagctatcaaaaaatttcgaaaaaatcaggaacagcctgctggagtctcgactaccaagacggatttccctgaggaaggtgcgcagtccaaccgctgagtcactcgcagctgaaaaagctctgatggaaggctacgggctggttgggttgcccttggtgcggagcccttcgctgccacctaccttcgctggcactctgaccgaattggaggacagctttactgaacaggtgcagagtttggcaaaatcgatcgacgacgccctctctacatggtccctaaaaaccatgtgtagcttgagggagtccggagcgtatcagctgcatcaggcgctgcaggccgccgccgggcctccggggctcgaggcagaaggaagggctcccgagtccgctgggccagggcccggagacgatgccgctgaaacaccagggctgcccccggcacattccgggaccctgatgatggctttccgtgatgtcactgtgcagatagctaaccagaatatctctgtctcatcatccacagctctgtccgtggccaattgcttgggggcccagaccgtacaggcacccgcggagcccgccgccggaaaggccgaacagggcgagacatcgggtcgggaagcccctgaggcccctgcagtcgggcgcgaggatgcctctgcagaagattcatgtgccgaagccgctgcatctggggcagccgacggggcaactgcaccaaagaccgaggaggaggaggaagaagaggaaacagctgaggtgggaagaggagcagaagccgaggcaggggatttagaacagttgagctcatcctccacttctactaagagcgccaagtccggtagcgaagctagtgcttccgcatccaaggatgctttacaggccatgatactgagcctgcctagataccattgtgagaatcccgcctcttgcaagtccccaactctctctacagacactctgaggaaaaggctgtataggataggcctgaatctgttcaatataaaccctgataaaggtatccaattcttgatctctcgtggtttcataccggacacacctataggggtcgcccactttctcctgcagaggaaagggctgtctcgacagatgattggggaattcctcggtaattcaaaaaagcaattcaatcgggatgtccttgattgcgtagtggatgagatggatttcagctccatggaactcgatgaagccctcaggaagttccaggcacacataagggtgcagggagaagcacagaaagttgaaagacttatcgaagcctttagtcagagatattgtatgtgtaaccccgaagttgtgcagcagtttcacaatccagacacgatctttatcttggcttttgccatcatcctgcttaacacagacatgtattcacctaacattaagccggacagaaagatgatgttggaggattttatccggaacttacgtggagttgatgacggagccgacatcccaagagaactggttgtgggaatttatgaaagaatccagcagaaggagctcaaaagtaacgaggaccatgttacctacgtgacaaaggttgaaaaaagcatcgtcggtatgaaaacagtgttgtctgttccccataggaggttagtttgctgcagccgcctgttcgaggtcaccgacgtgaataagctgcagaaacaggccgcacaccagagggaagtgtttctcttcaatgacctgctggtcatactgaagctctgtccaaaaaaaaaaagctccagtacctacacattttgtaaaagtgtggggttactcggcatgcagttccagctatttgagaacgagtattactcccacggaatcacactggtgacaccattgtcaggttctgagaagaaacaagttctgcacttctgtgctctaggaagcgatgagatgcagaagttcgtggaggacctgaaggagagcattgcagaggtcaccgagctcgagcagatccgcatagagtgggagctagaaaagcagcaagggactaagactctgtccttcaaaccctgcggagcccagggagacccccagagtaagcagggatctcctaccgctaaaagagaggccgccctccgggaaagacccgctgaatcaactgtagaagtgttaataaatgctagccctgctagattgacaatcctgcccatttccagagacacaataaagagttactgctag

SEQ ID NO: 191969 - DNA, 3549 bp, Artificial Sequence
  Description of Artificial Sequence: Synthetic coding sequence
atggagagcctgctggagaaccccgtgcgggccgtgctgtacctgaaagagttaactgcgatagtccagaaccaacagtccctgatccatacccagagggagcgcattgacgaactcgagcgtcgtctcgatgaactgtctgctgaaaacagatcattatgggagcatcagcagttgctacaggcccagcctcccccaggcctggtacctccaagttcagccccgctccctgctgcccccgccaccgcccctgctgctgcagcacgggcccaggagcccctgcaggatcagggacagcgatctgctgccgctccacacccagctccggaccggcccccacggcagcaccacgggcaactgctggagcagccacagagggggcctggttcacgggcgcacactcctcagtcccctcacaagcacctgggtactcaaggggctgttaccgataaggagaaagagagacctccaagttgctgcgccgccgcgggcgctctgctccagcacaagagcccgagtgcattgggaaagggcgttctcagccgaagacctgagaacgaaactgtgctccaccaattctgctgccctgctgctgacgcctgttcagacctggcatcccagtccgacggctcttgtacacaggccgggggtgggatggaggactccgttgtagccgcagctgcagttgcggccggccgcccttccgctcacgccccgaaagcgcaagcccaagaactgcaggaggaggaggagagacccggagcgggtgccgctagtccccgggcgggacctcagcataaggcctcaccgggcagacaacagcctgccttggcaacggccctgtgcccacacgcccctgcagcttccgactatgagctgagtttggatctcaagaataaacagattgaaatgctggagcacaaatacggcgggcacttggtgtctaggcgcgccgcatgtaccatccaaacagctttcaggcagtatcaactctccaaaaattttgaaaaaatccggaatagcctcctcgagtcccggctgccccgcagaatctccctgagaaaagtcaggtcccctacagctgaatctctcgcagccgagaaagccctcatggagggttatgggctggttggcttgcccctcgtaagaagcccgtccctgcctcccaccttcgcaggtacactcacagaactggaggacagctttacggaacaggtgcagtccctagccaagagcatcgacgacgccctatccacatggagtttgaagacgatgtgctccctgagagagtccggtgcgtatcagttgcaccaggcgctccaggctgcagcagggccacccggactggaggcagaaggccgagccccagagtcagcagggcctggtcccggcgacgacgccgctgagactcccggcctgccacccgcccacagtggaacactcatgatggctttcagggatgttaccgtccagatcgccaaccagaacatcagtgtctccagttccacagcgctttctgtggctaattgcctgggagctcaaacggttcaggccccagcagagcccgccgcaggcaaggctgaacagggggagaccagcgggcgtgaagccccggaagctcctgcggtggggagggaagatgcgtccgccgaagacagctgtgctgaggccgcagctagtggggccgctgacggcgcgacggcccctaagaccgaggaagaagaagaagaggaggagaccgccgaggtgggtagaggagcagaggccgaagccggtgacctggaacaactctctagctcatccacatccacaaagtcagccaaaagcggctccgaagcttccgctagcgctagtaaggatgcactccaggccatgatcctgtcactgccacgctaccactgcgagaacccagcctcatgtaagtcccccacgctcagtaccgatacccttagaaagcggctataccgcataggccttaatctttttaacatcaacccagacaagggcatccagttcctgatctctcggggcttcataccagacacccccatcggagtggctcatttcctacttcaacgcaaaggcctttcccgccagatgattggtgaatttttaggaaattctaaaaaacagtttaatcgcgatgtgctggattgtgtggtagacgaaatggatttcagcagcatggaactagatgaggccctacgaaagtttcaggcacacattagggtacagggcgaggcccagaaggtcgagcggctcatcgaggcctttagccaaaggtattgcatgtgtaacccagaggtagtgcagcagtttcacaaccctgatacgatttttatcctggcctttgccattattctgctcaacaccgatatgtatagccctaatattaaacccgaccggaagatgatgctcgaggacttcattagaaatcttcgcggagtcgatgatggagctgacatcccacgggaactggtggttggaatatacgagcgtatacagcagaaagagctgaaatccaacgaagaccacgtgacctacgtgacaaaggtggaaaagtctattgtggggatgaagacagtgttatcggtgccccaccggagactggtttgctgtagtagactattcgaggtcacagatgtgaataagttgcagaaacaggctgcccatcagagggaggtttttctgtttaatgacctgctggtgatcctcaaattgtgtcctaagaaaaagtcttcttccacatatactttctgcaaatccgtgggactgcttgggatgcagttccagctattcgagaatgaatattatagccacggcatcaccctggtcactccgctgagcggcagcgaaaagaagcaagtgctgcatttctgcgctttaggttctgacgagatgcagaaattcgtggaagacctgaaggagtccatcgcagaagtcacagaactggagcaaataagaatcgaatgggaactggagaagcagcaaggaacaaagaccctatccttcaaaccttgcggggcacagggggacccccagtccaaacagggatcccctacagcgaagagggaagctgccctgagggaaaggccagcggagtctactgtagaagtctctattcacaatcgtctgcaaaccagtcaacacaatagcgggctgggtgccgagcggggtgccccagtgcctccacctgacttgcaacccagtccaccccgccagcagacgccgcctctgccgccacccccaccaaccccacccgggaccttggtccaatgccagcagatcgtgaaggtgatcgtgctggataagccctgtctggcgcgcatggaacctctcttgagtcaagcactgtcatgttacacctcctcctcctccgactcctgcggctctacccctctgggtggcccaggttcgccggtgaaggtgacacaccaacccccactgccgccgcctccacccccatataaccacccacaccagttttgtccacccgggagtctgcttcatggtcataggtatagttcaggcagtcgtagcctagtatag

SEQ ID NO: 191970 - DNA, 1797 bp, Artificial Sequence
  Description of Artificial Sequence: Synthetic coding sequence
atgaagcccaccggcaccgacccccggatcctgagcatcgccgccgaagtggcaaagtccccggagcagaacgtccctgttatcctgctgaagctaaaggagatcattaatatcacacccctcggcagcagcgaactcaagaagatcaagcaggacatttattgctatgacttaatacagtattgtctgttagtgctttcccaggattatagccggattcaggggggatggaccaccatctctcagctgactcagattttaagtcattgctgcgtgggcctcgaacctggagaggacgccgaagagttttacaacgaactcctgccttcagctgccgagaactttctagtgctcggaaggcagcttcagacttgttttataaatgccgccaaggccgaagagaaagatgagcttctgcactttttccagatcgtgactgactctcttttttggctcctgggaggccatgtggagctcatccaaaacgtgctgcagtccgaccattttctgcacttgctacaggcagataatgtgcagatcgggtctgcagtaatgatgatgcttcagaatattctgcagattaactccggcgacctcctgagaatcggcagaaaagcgctctactcgattctggacgaggtgatttttaagctgttctcaacaccatctccagtaattagatctactgccactaagctattactgcttatggccgaatcacaccaggaaatattaatcctgctgaggcaaagcacttgctacaagggcctccgtagactcttgtccaagcaagagactgggactgagttctcccaggaactacgccagctcgttgggttattgtccccgatggtgtaccaagaggtagaagagcagaagctacaccaggcggcctgcctgatccaagcatactggaaggggtttcagacgagaaaaaggcttaagaaactgccatcagccgtgattgccttgcaacggtcctttaggagcaagcgttccaaaatgctgttagaaatcaatcgccagaaagaggaggaagacctcaagctacaacttcagctgcagagacagcgcgccatgaggctttctcgcgagctacagctgagtatgctggagatagtgcatccaggacaggtggagaagcattacagggagatggaggaaaaaagtgcgttaattatacagaagcattggcgcggatatcgtgagaggaaaaactttcaccagcaaaggcaatccctgattgaatataaagcggcagtcacgttgcaacgggctgctttaaagttcctggcgaaatgccgcaagaagaaaaagctgttcgctccatggaggggactgcaagaattaaccgatgctaggagggtcgagctcaagaagcgggttgatgattacgtgcgcagacacctaggctctcctatgagcgacgtcgtcagtagggagctgcatgctcaggcccaagaacgtctgcagcactacttcatggggcgcgcactcgaggaaagggcacagcagcaccgcgaagcattgatagcccagatttctactaatgtagaacaattgatgaaagcgccgagtctcaaggaagccgaaggaaaggaaccagaactgtttctttctcgatccagacccgtggccgcaaaggcaaagcaggctcatctgaccacactcaagcacattcaagccccttggtggaagaagctaggcgaagaatcaggagatgagatcgacgtccccaaagatgagctgtctatcgaattggaaaatcttttcattggggggacaaagcccccatag

SEQ ID NO: 191971 - DNA, 1398 bp, Artificial Sequence
  Description of Artificial Sequence: Synthetic coding sequence
atgaagcccaccggcaccgacccccggatcctgagcatcgccgccgaggtcgccaagagcccagagcagaacgttcccgtaatactgctcaaactaaaagagatcatcaatattacccctctcgggtctagcgagttaaagaagattaagcaagacatttactgttacgaccttattcagtactgcttgctggtgctgagtcaggactactcacggatccagggcggctggaccaccatcagtcagcttacccagatactatcccattgttgtgttggcctcgagccaggggaggatgccgaagagttttacaacgagttgctccctagcgcagccgagaattttcttgtgctcgggagacaactgcaaacatgtttcattaatgcagcgaaagccgaggagaaggatgaactcctccacttttttcagattgtcactgatagcttgttttggctgttgggcggccatgtggaactgatccagaatgtactccagtctgatcactttctgcatttgctacaggccgataacgtgcagatcggcagtgcggtgatgatgatgctgcaaaacattttacagattaacagatctaaaagaagcaaaatgctgctcgagattaacaggcaaaaagaggaggaagacctcaagcttcagcttcaattacagcgacaacgagcaatgcgtctctccagagagctccagctttctatgctggaaatcgtgcaccccgggcaggtagagaagcactatcgcgagatggaggagaagagcgccttgatcatccaaaaacattggcggggatacagggaaagaaagaactttcatcagcagcgccagagtctgatagaatataaagccgcggtgaccctccagcgcgctgctctgaaattcttggcaaaatgtcggaagaagaagaagctgtttgccccctggcgcggtttacaggaactcactgatgccagaagggttgaactgaaaaaaagggtcgacgattacgtgcggaggcacctggggtcacccatgtccgacgtggtaagtcgcgaactccacgctcaggctcaggagaggctgcagcactactttatgggtcgtgctctcgaagaaagagctcagcagcatagggaagccctgatcgcccagatctctacgaacgtggaacaactcatgaaggcccccagtctgaaagaggcagaggggaaggagcctgaattgtttctgtctcggagcaggcccgtggcggcaaaagctaagcaggcccacttgaccaccctgaaacatattcaggcaccatggtggaagaaactgggagaagagtcgggagatgagatcgatgtaccgaaggatgaactgtctatcgaactggagaacctctttatcggcggtactaagcccccttag

SEQ ID NO: 191972 - DNA, 264 bp, Artificial Sequence
  Description of Artificial Sequence: Synthetic coding sequence
atgaagcccaccggcaccgacccccggatcctgagcatcgccgccgaggtcgccaaaagccctgagcagaacgtgcccgtgatccttcttaagctgaaggaaattatcaacattacgcctctgggctcatccgaactgaagaaaattaagcaggatatttactgctacgaccttatccaatattgtctccttgtgttatcccaagattacagtaggatccagggcgggtggacgaccatctcccagcttacccagattctgtag

SEQ ID NO: 191973 - DNA, 1332 bp, Artificial Sequence
  Description of Artificial Sequence: Synthetic coding sequence
atggaggaggacagcctggaggacagcaacctgccccccaaggtgtggcattccgagatgactgtgagtgtcaccggagagcctccttctaccgtggaagaggaaggaattcccaaggagactgacatagaaatcattccggaaatcccagagactctagagcccctatcccttcccgacgtgctgcggatttccgccgtgctggaagacactactgaccagttgtctattctgaactatattatgccagttcagtacgaggggaggcagtccatctgcgttaaatcacgagaaatgaacctcgagggaactaacctggataaattaccgatggcaagtactatcacgaaaatcccttcaccccttatcactgaggaaggaccaaatctaccggagattcgccatcgggggaggttcgccgtcgagtttaataaaatgcaggatcttgtgtttaaaaaacccacacggcagactatcatgacaactgaaactctgaaaaaaattcagatagacagacagttcttttcggacgtgatcgccgacaccataaaagagctgcaagacagtgctacatacaatagtctgctgcaggccctctctaaggaaagggagaataaaatgcacttctacgatattattgctcgcgaagaaaaaggcagaaagcagataatctcgctgcaaaagcagctgattaatgtaaagaaagaatggcagtttgaggtacaaagccaaaatgaatacatcgcgaacttaaaggatcagctccaggagatgaaggccaagagcaatctggaaaaccgctacatgaaaaccaatacagagctacagattgcgcaaacacagaagaagtgcaacaggacagaggagctcttggttgaagagatcgaaaaactgaggatgaagacagaagaagaggccagaacacacacagaaatcgaaatgtttctcagaaaggaacagcagaaactggaagaaagattggagttctggatggagaaatacgacaaggacaccgagatgaagcaaaatgagctgaacgccctgaaagccactaaggctagcgacctggcacatttgcaggacctcgcaaagatgataagagagtatgaacaggtgatcatagaagataggatcgaaaaggagagaagtaagaagaaggtaaagcaggacctcctggagcttaaatctgtcatcaagttacaggcctggtggagaggcacgatgatcagacgagagattggaggttttaagatgcctaaggacaaagtggactcaaaggacagcaagggcaaaggaaaagggaaggataaacgtaggggaaagaagaaatag

SEQ ID NO: 191974 - DNA, 165 bp, Artificial Sequence
  Description of Artificial Sequence: Synthetic coding sequence
atggaggaggacagcctggaggacagcaacctgccccccaaggtgtggcactcagaaatgacagtctcagtgaccggtgagcctccatccacagtcgaagaggagggcattcccaaggaaactgacatagaaatcatacccgagatcccagaaaccttggagtag

SEQ ID NO: 191975 - DNA, 1332 bp, Artificial Sequence
  Description of Artificial Sequence: Synthetic coding sequence
atggaggaggacagcctggaggacagcaacctgccccccaaggtgtggcatagtgagatgactgtgagcgtcactggggaacctcctagtacggtcgaggaagaaggtatacctaaagagacagacattgagattatacccgagatcccggaaactcttgaacctctgtctttgccggatgtgcttagaatatccgcagtccttgaagacacaacagatcagctatcgattctcaactacataatgcctgttcaatacgagggaaggcagagtatttgtgtcaaatctcgtgaaatgaatctggagggcaccaacctggacaaattgccaatggccagcacgatcactaaaatcccttccccattgatcacggaggaaggacccaatctgcccgagatcagacatagagggcgctttgcagtggagtttaataagatgcaggaccttgtctttaagaaacctacccgtcagaccatcatgaccacggagactcttaagaagattcaaattgatcgccagtttttctctgatgtgattgccgataccattaaggagctacaggattctgccacctataacagcctgctacaggccctttcgaaagaaagggagaacaagatgcacttctacgatattatcgctagagaagaaaaaggacggaagcagattatatctctgcaaaagcagctgattaatgtgaagaaagaatggcaattcgaggtccaatcgcagaacgaatacatcgcaaatcttaaagatcaactgcaagagatgaaggcaaagagtaatctggaaaaccgatacatgaaaactaacacagaactgcagatcgctcagactcagaaaaaatgtaatcgcaccgaagaactcctggtggaagaaattgagaaactgcgcatgaaaacagaggaggaggcacgaacccatacagagatcgaaatgttcttacggaaagagcagcaaaagcttgaggagcgtctggagttctggatggaaaagtacgataaagatacagaaatgaaacagaatgaattgaacgccctgaaggctaccaaagcgtctgaccttgcgcatttacaggatctggcgaagatgatccgggagtatgaacaagtcattattgaggatcggatagagaaagaaaggagtaagaaaaaagttaaacaggaccttctagagctcaagtccgtcatcaaactgcaggcctggtggcgtggtaccatgattcggcgagagataggggggttcaaaatgcccaaagacaaggtcgactccaaagattccaaaggaaaagggaaaggcaaggataagaggagaggcaaaaaaaagtag

SEQ ID NO: 191976 - DNA, 4974 bp, Artificial Sequence
  Description of Artificial Sequence: Synthetic coding sequence
atgagcgccgccgacgaggtggacggcctgggcgtggcccggccccactacgggtcagtccttgataatgaacgcttaaccgctgaagagatggacgagcgaagacgacaaaatgtagcctatgaatatttatgccacctcgaagaagccaagcgctggatggaagcctgtttgggagaggatctccctcctactacggagcttgaagagggcctaagaaacggggtgtatctggcaaagctgggcaatttcttcagccccaaagtagtgtctctcaagaagatttacgatagagagcagacaagatataaagctacaggtttacatttcaggcacaccgacaacgtcatacagtggctgaacgccatggacgaaatcgggttgcccaagatcttttatcccgagaccactgacatctacgacagaaagaacatgcctaggtgcatttattgcatacacgcactgagtctctacctgttcaaactgggacttgcgccccagattcaggatctctacggaaaagtcgatttcacagaagaggagatcaacaacatgaagactgagctggaaaagtatggcatccaaatgcctgccttcagtaagatcggcgggatactcgcgaacgagctgtcagtcgatgaagccgccctgcatgcagcagtgattgccattaatgaggctatagacaggcgcataccagccgatacatttgccgccctaaaaaatcccaatgccatgctggttaaccttgaagagcctctggcctccacttaccaggacatcctgtaccaggcaaaacaggataagatgactaatgccaaaaaccgcacagaaaatagcgagcgcgaaagagatgtatatgaagaacttctcacacaggcggagatccaaggaaatatcaacaaagtcaacacttttagcgcccttgccaacattgacttggctctcgaacagggtgacgccctggcactctttcgcgccctgcaatctccagctctgggactgcgaggcctgcaacagcaaaattctgactggtatctcaagcagctcctgtccgacaagcagcagaagcgccagtctggtcagacggatccactgcagaaggaggagctgcagtccggagtcgacgctgcgaatagcgcagcacagcagtaccaacgacggctggccgcagtggctctgatcaacgctgctattcagaaaggggtcgcagagaaaaccgtcctcgagctgatgaatcctgaagcacaactgccacaggtgtacccgttcgcggcggatctgtaccagaaggaacttgccactctgcagcgacagtcccctgagcataaccttactcatcccgagttgtccgtagctgtggagatgctatcctcagttgccttgattaatcgggctcttgaatcaggcgatgtgaatacagtgtggaagcagctatcaagtagcgtgaccggacttaccaacattgaagaggagaactgccagaggtacttggacgagctcatgaaactgaaggctcaagctcacgctgagaataatgaatttataacctggaatgatattcaggcctgcgttgaccacgtaaatttggttgtccaggaggagcacgagcggatcctagcgatcggtttgattaacgaagcgctcgatgagggtgacgctcagaagacactgcaagcgctgcagattcccgccgccaaactggaaggagtccttgccgaggtggcccagcattaccaggacacacttatccgggccaagcgagagaaagcccaggagattcaggacgaatcagccgtcctctggctggacgaaattcagggtggaatttggcaatccaacaaggacacccaggaggcacaaaagtttgcactgggtattttcgcaatcaacgaggcagtggagtcaggggatgttggcaagaccttgtctgcacttcgatcgcccgatgttggattgtacggcgttattccagagtgcggagagacctaccacagcgatctggctgaggctaagaaaaagaagctagctgttggggataacaattctaagtgggttaaacattgggttaagggcggttactactactaccataacttggaaacccaggaaggtggctgggatgaacctcccaactttgtgcaaaatagcatgcagctttcccgagaggagatacagagctccattagtggggtcaccgccgcatataacagggagcagctatggctggcgaacgaggggctaatcacacggcttcaagctcggtgcagagggtaccttgtgaggcaggaatttagaagcagaatgaacttcctgaagaaacagattcctgccataacatgcatccagtctcaatggcgaggatacaagcagaaaaaagcctaccaagaccggctggcctacttgcggtcccacaaggatgaagtcgtcaagattcagtccctcgccaggatgcaccaagccaggaaacgctatagagatcgcctgcaatactttcgcgatcatattaatgatataatcaagattcaggccttcattagggctaataaagcaagagatgattataaaacgctgataaatgccgaggatccgcccatggtggttgtcagaaagttcgtccaccttctggaccagtctgatcaggactttcaggaggaactggacctcatgaagatgcgcgaggaggtgatcaccctgatccgttctaatcagcagctggagaatgacctgaatctgatggacattaaaataggccttttggtgaaaaacaagatcaccctgcaggatgtggtgtcacattcaaagaaactgacgaagaagaacaaagaacagctgtctgacatgatgatgataaataagcagaaggggggcctgaaggccttaagtaaagagaaaagggagaagctggaggcgtaccaacatctgttttacctgctgcagacgaatcccacctatctggctaagctgatctttcaaatgccccagaataaatctaccaaattcatggattctgtgattttcacgctctataactacgcgtctaaccagagagaagagtacctgcttttgcgcttgttcaagactgccctgcaggaggaaatcaagtctaaggtggatcagatccaggaaatcgtcaccggcaaccctaccgtgataaaaatggtcgtctccttcaatcgcggcgcccgaggtcagaacgccctgcggcagatccttgccccagtcgtgaaggaaattatggatgacaagtctttgaatattaaaacagatcccgtcgacatttacaagtcttgggtgaatcagatggagagccagacaggggaggctagtaagcttccgtacgatgtgaccccagaacaggccctggcgcatgaggaggtgaagaccagactggatagctcaatacgtaatatgagggctgtcactgataaatttttgtccgccatagtatcaagtgtggataaaatcccctatggtatgaggttcatcgcaaaggtgcttaaggatagcctgcatgagaagttcccagatgcgggagaagacgagttgctgaagattataggaaatctgctgtattaccggtatatgaacccggccatcgtggctccagacgcttttgatatcatcgacctctccgctggagggcagcttactaccgaccagcgccggaacctgggttccatagccaaaatgctgcagcatgctgctagtaacaaaatgttcttgggtgataatgcccatctgagtatcatcaacgaatatctgtctcagagctaccagaagttcagaagattctttcagaccgcctgcgatgtgcctgagctgcaggataaattcaacgtggatgaatacagcgacctagtcactctcacaaagcccgtcatctatatctcaatcggggagattataaatactcatacacttctgctggatcaccaggacgctattgcacctgaacataatgacccaattcacgaactgctggatgacctgggcgaagtgcccaccattgagtctctcatcggggagagttctggtaatctgaatgatcctaacaaagaggccttggcaaaaactgaggtttccctaacactgactaataagttcgatgttcctggggacgagaacgctgaaatggacgctcgcaccatcttactgaatacgaagcgcctgatcgttgacgttatcaggttccagcccggtgaaacgcttactgagatactggaaaccccagcaacctctgagcaggaagcagagcaccaaagggctatgcaaaggagagccattcgtgacgctaaaactcccgacaagatgaaaaagagcaaatccgttaaagaagattccaatcttaccctgcaggagaagaaagagaagattcaaaccggactaaagaagctgactgaactcggtacggtggatcctaaaaataaataccaggagctgattaacgacattgctcgcgacattaggaatcagcgcaggtatagacaacgacgcaaagccgaactggtgaaactgcagcagacatatgccgccttgaattctaaggcaaccttttatggtgaacaggtagattactataagagttacattaaaacttgtctagacaacctggccagtaagggtaaagtctctaaaaagcctcgggaaatgaaaggtaagaaatccaaaaagatcagtctcaagtatactgcagcccgtctgcacgagaagggtgtcctgcttgagatcgaagacttgcaggtgaatcaattcaagaacgtaatctttgaaatttctcccacggaagaagtgggcgactttgaagtgaaggcaaagtttatgggggtgcaaatggagacctttatgctgcattatcaggatttgctgcagctacagtatgaaggtgtggccgtgatgaagctttttgaccgcgccaaggtgaacgttaacctgctgatttttctgctaaacaagaagttctatgggaagtag

SEQ ID NO: 191977 - DNA, 4728 bp, Artificial Sequence
  Description of Artificial Sequence: Synthetic coding sequence
atgccccacgaggagctgcccagcctgcagcggccccggtacggctccattgtggacgatgagagactgtccgctgaagagatggatgaacgtcggcggcaaaacatcgcatatgaatacttgtgccacctggaagaagcgaagaggtggatggaagtatgcttagtggaagaactccctccaaccacggagctggaggagggcctgaggaatggagtgtatcttgccaagctggccaagtttttcgcacccaagatggtgagtgagaagaagatctatgatgttgagcagaccagatataagaaatccggccttcacttccgccacaccgacaatacagtccagtggctgagagctatggaaagcattgggcttccaaaaatcttctatcctgaaaccacagacgtctatgaccgaaaaaatatcccgcgtatgatttattgtatccacgccctttctttgtaccttttcaagctgggtatcgcccctcagattcaggacttactcggtaaggttgattttaccgaggaggaaatcagtaacatgaggaaggaacttgagaagtacgggattcagatgccttctttttctaagataggcgggatactagcaaatgagctgtctgtggatgaggctgccctgcacgcagcagtcatagccattaatgaagctgtagaaaaaggtatagctgagcagaccgtggtaactctgagaaacccaaacgcagtcctgaccctggtcgatgacaacctggcccctgaataccaaaaggaactgtgggatgcaaagaaaaagaaggaggagaacgcgcgtttaaaaaattcttgtatttccgaggaggaaagggacgcctatgaggagctgctaactcaggcggagatccaaggcaacatcaacaaggtgaacaggcaggcagcggttgaccacataaatgcagttattcccgaaggagacccagaaaatactctgctcgctctgaaaaagcctgaagcgcagctaccagcggtgtacccttttgccgccgctatgtatcagaacgagctcttcaacttgcagaagcagaacacgatgaattacttggcacacgaagagctgctgatagctgtggaaatgctatcagcggtcgctctcctgaaccaagcactggagagcaatgatctcgtgtccgtccagaatcagctgcgctcccccgctatcggtctgaataatctagacaaggcctatgttgaaagatacgctaatacactcctttctgtaaaactggaggtgctatcccaaggccaagataacctgagctggaacgaaatccagaattgtattgatatggttaatgctcagatccaggaggaaaacgatagggttgttgctgtggggtacattaacgaggctattgatgaaggcaatccgctcagaacccttgaaactcttcttctgcctactgcgaacatctctgatgtggatcccgcacacgctcagcactatcaggacgtcctttaccatgcgaagagtcagaaacttggggactccgagagcgtgtcaaaagtcctgtggctagatgaaatccagcaagccgtggatgacgctaatgttgataaggaccgggctaaacagtgggttaccctcgtcgttgatgttaatcaatgccttgaagggaaaaagagctctgatattctgagtgtcctgaagagtagcacatccaacgctaatgacataattcctgaatgtgcggataagtactacgacgccctcgttaaagctaaggagttaaagtctgaacgggtttcatccgatggctcgtggctcaagttgaacctccacaaaaagtatgattactactataatacggacagtaaagaaagctcctgggtcactccggagagttgcctgtataaagaatcttggctgacaggcaaggagattgaggatataattgaggaggtgaccgtgggttacatacgcgagaatatctggagcgcttctgaagagttgcttctgcgcttccaggccacatctagcggtccaattctgcgcgaggagtttgaggcgcgaaagtccttcttgcacgagcaggaagagaatgtggtcaagattcaggccttctggaagggatacaaacaacggaaagagtacatgcaccggcgtcagactttcatcgacaacacagacagcattgttaagatccagagctggtttcgcatggctacggcacgcaagtcttacctgagccggctgcagtatttcagggatcataataacgaaattgtaaaaattcagtcactgctgcgagccaataaggctcgcgatgattataagaccttggtaggctcagaaaacccacccctcaccgttatccggaagtttgtgtacctcctggatcagagcgatctcgactttcaagaagaactggaggtggcccgactgagggaggaggtggtcactaagataagggcaaatcagcaattggaaaaagatctcaaccttatggatatcaaaattggacttctggttaagaatcgaatcactctggaagacgtgatctcacactcaaaaaaacttaataagaaaaaaggaggtgaaatggagattcttaataatacagacaatcaggggattaaaagcttgtctaaagaacgcaggaagaccctcgaaacctatcagcagcttttctatctccttcaaacaaacccactttatttagctaagttgattttccagatgccgcaaaataagtccacaaagttcatggacacggtcatattcacgctatataactatgcgtctaatcagagagaagaatacctgcttctgaaattgttcaaaaccgcattggaggaggagatcaaatctaaggtggaccaggtccaggacatagttaccggcaatccaacagtgatcaagatggttgtctcttttaacaggggtgcgcgaggccagaacactctgcgccaattactcgcccctgtggtgaaagagatcatagatgacaagtccctgatcattaatacgaacccagtggaggtttacaaggcctgggtgaatcagctagaaactcagactggggaggcatccaagctcccctatgacgtcactaccgagcaagccctcacgtaccctgaggtcaagaataaacttgaggcatcaatcgagaacttgcgacgggtaacggacaaggtgctgaacagtattataagctccctcgacttgcttccctacggattacgctacatcgccaaggtgctgaaaaactctattcacgagaagttcccggacgcaaccgaagatgagctgctgaagattgtgggcaacctcttgtattaccgttacatgaaccccgccatcgtggcacctgacggcttcgatattatcgatatgactgctggagggcagatcaatagtgaccagagacgcaaccttggctccgtggcaaaagtgttacagcacgccgccagtaacaaactgtttgagggcgagaacgagcatctgtcctctatgaataactacctcagcgagacctatcaggaattccgaaaatattttaaagaggcatgtaacgtgcccgagcccgaagaaaaatttaacatggacaaatacaccgacctggtcactgtctccaaaccagtgatctatatctccattgaagagattatctccactcactccttacttcttgaacaccaggatgccattgcccccgagaaaaacgatctcctatctgagttgctaggaagcctaggtgaggtccctactgtggaaagctttctgggcgagggcgccgtcgacccaaatgacccaaacaaagctaatacactctcgcagctgtccaagaccgagatttccctggtcctcacatcaaaatatgatatcgaagatggtgaagcaattgattctcggagcctgatgataaaaactaagaaactgatcatcgatgtcatacgaaatcaacctggaaacactcttacagaaatacttgaaacacctgccacagcccagcaagaagtggaccatgccaccgacatggtctcccgcgcaatgatcgacagcagaacccctgaggaaatgaaacacagtcagtctatgattgaggatgcccaactcccgttggagcaaaagaagaggaaaatccagcgtaacctccgcacgctggagcagaccggtcatgtcagctcagagaacaaataccaggatatcctgaacgaaatagcgaaggatattagaaatcagaggatctaccggaagctgagaaaagccgaactggccaaactgcaacaaactctaaatgcgctgaataaaaaggctgctttttatgaagaacagatcaattattatgacacctatatcaagacctgcctggataacctgaagaggaaaaacactcgcagaagtattaaacttgacggcaaaggagaacccaagggggcgaagcgcgccaagcctgttaagtacaccgcggcaaagctgcacgagaagggtgtcctgctggacatcgatgatctgcaaactaatcaattcaaaaatgtgacattcgacatcatcgcaacggaagacgttgggatcttcgacgttcggtcaaagttccttggggtggagatggaaaaagttcagctgaatatccaagacctgcttcagatgcagtacgaaggcgtcgcagttatgaagatgttcgacaaggtaaaagtcaacgtgaatttgctcatctacctgctgaacaagaagttctacggaaaatag

SEQ ID NO: 191978 - DNA, 3234 bp, Artificial Sequence
  Description of Artificial Sequence: Synthetic coding sequence
atggtgaacgcccagatccaggaggagaacgaccgggtggtggccgtcggatatattaacgaggccattgatgagggcaacccattgcggactctggagactttgttgctgcctaccgccaatattagcgatgtggatcccgctcacgcacagcactatcaggatgtcttgtaccatgcaaagagtcaaaagttgggcgactcagagagcgtctcgaaagtactgtggctggatgaaattcagcaggcagtagacgatgcgaatgtggacaaggatcgggccaaacagtgggtgactttagtagtagatgttaaccagtgtctagaaggcaaaaaatcatccgacattctttccgtactgaagtcgtcaacttctaacgctaatgacatcattccagaatgcgctgataaatactacgatgccttggtgaaggcaaaagagctgaagtctgagcgggtgagctcggatgggtcttggctcaagctgaatctccataagaagtacgactattactataacacagatagcaaagagagtagctgggtgacaccggagtcttgcctgtacaaggaatcatggctgacaggtaaagagatcgaggccttttggaagggctataagcagaggaaggagtatatgcatcgacggcagacattcattgataatacagactcaattgtgaaaatccaaagctggtttagaatggccactgcacgaaagtcttacctgtccagactgcagtacttcagagatcacaataatgaaatagtcaaaatccagagcttattaagggccaacaaggccagggacgactacaaaacgttggtggggtcggaaaacccccctctgaccgtcatccggaagttcgtctatctcctggatcagtctgacctggactttcaagaagaactggaagtcgccaggctgcgggaggaagtagtcaccaagatccgcgcaaaccagcagcttgagaaagacctgaatctgatggacataaagatcgggctgctggtgaaaaaccgcatcacgctagaggatgtgatcagccacagcaagaaattgaataagaaaaagggaggcgaaatggagatcctcaataacaccgacaaccaagggataaagtcactctctaaggagcggcggaaaaccctggagacttatcagcaattgttctatctcctgcagactaaccctctttacctggccaaattaattttccagatgccacaaaataaatccactaagtttatggatacagtgatctttaccctgtataactacgcatcaaatcaaagggaggaatacttgcttctcaagctctttaagactgccctcgaggaagaaattaagagcaaggttgaccaggtacaggacatcgtgactggaaaccccaccgtaattaagatggtagtgtctttcaatagaggtgctcgggggcaaaacaccttgagacaattactagctcccgtggtgaaggaaattattgacgataaatccctcattatcaacactaatcccgtcgaggtctacaaggcttgggttaatcagctcgagacgcagaccggggaagcctcaaaactgccctatgacgttacgacggagcaggctttaacttacccagaggtgaaaaacaagctggaggcatcaatcgagaaccttcgacgggtgaccgataaggttcttaatagcatcatcagctccctggacctacttccctacggcctcagatacatcgcaaaagtgctcaagaatagtatacacgagaagttccctgacgccactgaggacgaacttctgaaaatcgtaggcaatctgctctactaccggtatatgaatccggcaatcgtggccccagatgggtttgacatcatagacatgaccgctggcggacagatcaactccgatcagaggcgcaacctcggctctgtggctaaggtgctccagcatgctgccagtaacaagctgtttgagggcgagaatgaacatctgtcctcgatgaacaattatctgtctgagacttatcaggagttccgtaaatacttcaaagaggcctgcaacgtgcctgagcctgaagaaaagtttaatatggacaaatatacagacctcgtgacggtttccaaaccagtaatatatatcagtatcgaggaaataatctctacacacagcttactccttgagcaccaggacgccattgcccctgaaaaaaacgacctgttgtcagagttgctgggtagcctaggcgaggttccaacggtcgaatcttttctgggggagggcgccgtcgatccaaatgatcccaataaagccaacacactcagtcagctgtccaaaacagaaataagcctggtgctaacatccaagtacgacatagaagacggtgaggccatcgactcccgaagcctaatgatcaaaacaaagaaactgattatcgacgttatacgcaaccagcccggaaataccctcactgaaatactggagaccccagcgaccgcccagcaggaagtcgaccatgcaaccgacatggtcagcagagccatgatcgacagtagaactcctgaagaaatgaaacattctcagtctatgattgaggacgctcagctgcctctcgaacagaagaaaagaaagatccagagaaacctgaggacactggaacagactgggcatgtgagttcagaaaataagtatcaggatattctcaacgagatcgccaaggacatcagaaaccagcggatctacaggaaactgaggaaagccgaactggctaaattgcagcagaccctgaatgctctcaataagaaggccgccttctatgaggagcagatcaattattatgatacctacatcaagacatgcctagacaatttgaaacgaaaaaacacgagaagatctattaaattggacgggaaaggcgagccaaaaggtgccaaacgggctaagccggtgaagtacactgccgccaagttgcatgagaagggcgtgctcctggatatcgacgatcttcagacaaatcagtttaagaatgtgacttttgatataatagctaccgaagatgtcggcattttcgatgtgagaagcaagttccttggagtggagatggagaaggtccagttaaacattcaggatctactacaaatgcaatatgaaggcgtggccgtgatgaagatgttcgataaggtcaaggtcaacgtcaatctgctcatttacctcttgaacaagaagttttacggaaagtag

SEQ ID NO: 191979 - DNA, 3216 bp, Artificial Sequence
  Description of Artificial Sequence: Synthetic coding sequence
atgcacagcctgcccggcgtggtggccgtgggctacatcaacgaggcaatagatgaggggaaccccttacgcacacttgagactttgctactcccaacggctaatatcagtgatgtggacccggcacacgctcagcactaccaggacgtgttgtatcacgccaaaagtcagaaattgggagattcagaatcagtatcaaaagtgttatggcttgatgagatccaacaggctgtggatgatgccaatgtggacaaggatagggccaagcagtgggttaccctggttgtcgatgttaatcagtgtttagagggtaaaaagagctcagacattctgagtgtcctgaaaagctccacctccaacgccaacgatattatccccgaatgtgccgacaagtactatgatgcccttgttaaagccaaggagcttaaaagtgagagagtgtccagtgatggtagctggttgaagctgaatcttcataagaagtatgattactactataacaccgattctaaggagagcagttgggtgacacctgagagttgtttgtataaggaatcttggctcacaggcaaggaaatcgaggcattctggaaaggctataagcagcggaaagagtatatgcaccgccgacagacattcatcgacaacaccgatagcattgtgaaaattcagtcctggtttaggatggctacagcacgtaagtcgtacttaagtaggctgcaatatttccgtgatcataacaatgagatcgttaaaatacagtccctgctgagggcaaacaaagcgagggacgactataaaacgctggtcggttccgagaatcctcccttgactgttatccggaagtttgtttatctgctggatcagtccgatctggattttcaggaagaactagaagtcgcgcggctcagggaggaagtggttacgaaaatacgggccaaccaacagctcgagaaggatcttaaccttatggacatcaaaatcggattgttagtaaagaacagaataactttggaagacgtgatctcccattccaaaaagcttaacaaaaaaaaaggcggcgaaatggaaattctcaataatacagataaccagggtatcaagagcctgtcaaaagaacgcagaaagactctggaaacctatcaacagctgttttatttgttacagaccaaccccctgtacctggccaaactaatctttcagatgccccagaacaaaagcactaaatttatggataccgttatctttacactctacaactatgcaagtaaccaacgagaggagtatctgctcctaaagttattcaaaacagccctggaggaggagatcaaatcgaaagtggatcaggtgcaggacatcgtgacaggtaatcccacagttataaaaatggtggttagcttcaaccgcggggcgagagggcagaacacgctccgacaacttctggcccctgtggtgaaagagatcatcgacgacaaatccctgattataaatacaaaccccgttgaggtgtataaggcttgggtcaatcagctcgaaacgcagacaggggaagcctcgaaactaccctacgatgtcaccaccgaacaggctctaacatatccagaggtgaagaacaaattggaagcaagtatcgagaacctacgcagagtgactgataaggtcctgaactccataatctcgagtttggatttgttgccttacgggctcagatacatcgccaaagtgcttaagaatagcatccatgagaaatttcccgatgctactgaagatgagctccttaaaatagtcggaaatttactgtactatagatatatgaaccccgccattgtcgccccagacggcttcgatatcatcgacatgactgctggagggcaaattaactctgatcagcgtcgcaatcttgggagtgtggccaaggttctccagcatgcggcctctaacaagttgttcgaaggtgagaatgaacatctaagctccatgaataactatctgtctgagacgtaccaggagttcaggaagtacttcaaggaagcctgcaatgtgcccgagcctgaggagaaatttaacatggacaaatataccgacctggtgacagtgtcaaaaccagtgatttatatttccattgaagaaatcatatcaacccactctctcctgctcgagcatcaggacgcaattgctcccgagaaaaacgatttgctgagtgagttactgggctccctcggggaggtcccgactgtggaaagctttctcggtgagggagccgtggatccaaacgatcctaataaagccaacaccctgagtcagctatccaaaaccgagatcagcctcgtcctgacatcaaaatatgacatcgaggatggcgaggccatcgacagccgcagcttaatgatcaaaaccaaaaagctcattatcgacgtaatccggaaccagccgggcaacaccttgacagagatactggagactcctgccacggctcagcaagaagtcgaccacgcaacagacatggtttcaagggcgatgatcgattccagaactcccgaagaaatgaagcacagccagtccatgatagaggacgcacaactgcctttggagcaaaagaaacgaaagatacagcggaatctcagaaccctcgaacaaacggggcatgtatctagcgaaaacaaataccaggacattctaaacgaaattgccaaggacattaggaaccagaggatttaccgcaagctgcgcaaggctgagctagccaaactgcagcagactcttaacgctctcaacaagaaagctgcattctacgaggagcagattaattattatgacacttacatcaagacctgtctcgataaccttaagcggaagaacaccagacggtctatcaagctggatgggaaaggagagccaaaaggggctaaacgggcgaagccagtaaagtacactgcagccaagttgcatgaaaaaggagtcttactcgatattgacgatctgcagacaaaccagttcaaaaatgttactttcgatattatagccacggaagatgtcgggattttcgacgttcgatctaaattcctaggcgtggaaatggagaaagtacagctgaatatccaggacctgctgcagatgcagtatgagggggtggccgtcatgaaaatgttcgacaaggtaaaagtgaacgtcaatctgctcatatatctcctcaataagaagttttatggaaaatag

SEQ ID NO: 191980 - DNA, 1134 bp, Artificial Sequence
  Description of Artificial Sequence: Synthetic coding sequence
atgggctgcttcaagggcgtggtggccgtgggctacatcaacgaggctatcgacgaggggaacccactgagaacccttgagacactgctcctaccaacggctaatatttccgatgttgatccagcacacgcccagcattatcaggacgtgctctatcacgccaaaagccagaaactcggcgacagcgagagtgtgtccaaagttctttggttagatgagatccagcaggctgtcgatgatgcgaacgtggataaagacagggccaagcagtgggtcactcttgtagtcgacgtcaatcagtgtctggaaggaaaaaaatccagtgatatcctgagtgtgctcaaatccagtacctccaatgctaacgatatcatccctgagtgtgccgacaaatattacgacgctctggtgaaggccaaagagctgaagtccgaaagagtctcctccgacgggtcatggcttaagctgaacctgcataagaaatacgattattactataacactgatagcaaagagagctcttgggtgacacccgagagttgcttgtataaagagtcctggctgacagggaaggaaatagaagatattattgaagaggtcaccgtggggtatatcagggagaacatctggtctgcgtcagaggagctgctgctcaggttccaggccacgagctcaggaccaattctgcgggaggagtttgaggcgcggaaaagctttctgcatgagcaggaggaaaatgttgtaaaaattcaggccttttggaagggatacaaacaaaggaaggagtatatgcaccggaggcagacgtttattgataatacggattccattgttaagattcagtcgtggtttagaatggccactgcacgtaagtcatatctctccagactgcagtactttagggatcacaacaacgaaatcgtcaagatccagagcctcctcagagcaaacaaagcgagagatgactataaaacactggttggctccgaaaatccccccttgactgtgattcggaaatttgtctacctgctcgatcagagtgatctggactttcaggaagaactggaggtagcaaggctgcgcgaggaggtcgtgacgaagatcagggcaaaccagcagctagaaaagacgtag

SEQ ID NO: 191981 - DNA, 3084 bp, Artificial Sequence
  Description of Artificial Sequence: Synthetic coding sequence
atggcccagaacaccgagaaccacgaccccgtgggcagcatcctgatccagatccatgaggatttgtatcagctgaaagagaaacttacaaagttttctcccgaggagaagggggagaccctggatattcagtctttggaaactgccattaagagaacggaagtcggcctccggatccatatcgagaagtatctaaacgtggtgaaccagaacgtgctcaccacaagcgtaaacgacgaatcgctgtacacacctcaagcttctaagtggcttctgccaaccgtgatagatcagaagagcttcatttttccccaggaaagtgaaggcactttttggcaacctcagcgccaacatagcagctctctacccgtgtttcctagggcaaaaattaaggtgagtaagctgattaagggatccaacataagctcgctaaccgtgctgccttcatcacactgcacggatccttacttcacccctattccagtgttgcaggccgacgcacacaaggggatactgtctatgattgaacgggggctgataccacccacggctcgcattacctttcagaacccaccaattacccccagggccgctcctctgcactcatttgatgaagccaggaaaattccaaccgttgccaccttcaccattcctagagagccaccgccatcgcccgctgaggtcaaatttttccccaagaagcagagatctaagggaaaatctcgtaggagccgcggtcatcacgatagaaaggccatgaaggtgaagacccctttgcgagccctcaaatcactatgggactatgatttcctcatatacgacggtgttattgataataccgcacccgacttcttggctttcaaggagcatttctccctggcttgggggggcattttttcactactggaacatgtcgagaaattcttgaggaattacgcgattccagaggttaagatcaaggggaataacctggtcgccttactgcccgagttcgaactaacgaacaagctcaccagatatgacttgctgtccgtccttgaagaccctgcccatgtgcagatgctcattaatctccccggacaaagatacaagggtcaggacggcaactctgaggccgcaatgaaaatccaagccacctggaaatgttacaaagctcggaagttcttcctgttttaccgccagcagaagtgggctagcggtgtcatagccatcgcgtggttactgtactgtcacaaaactcggctcaagaaaattctgaaggagagccggcaaaggcatctggagaatttcaggataagggctaagcacttggctgcaaattggaatcggatcagaacctctcgtaggaccattatacatatccccagccttgggtattcgcaacctgttcgggagcacatcgctgacttcaacacccagcagaacatgcagcttgggcgactctgtgacatattagatgcaaatgtgaacgtgatatacatatgttcccatcacatgaatgatgaattggtgctttactataagaaaattctatctttgcacgccgcagtgaagtcgggcaaccttgaggatcggtcagacttacaggataggttcaagatcatcacccccgaggccgtgaatatattcccaaaacaccatatgtgtctggcaacacatttaatgtacagcccaaaggctattaagaggattaaaaatctaattaggggtaccgaagcctacatagtcagtgggctcctgcatcgggacgaccttgccgtggctgacatgttggacattcccatccttgggagcgagcccgagctcgcacatctgtactcgactaagtctggtggaaagagggtgttcgattccgcaaacgtcgcagtaccacctggtatttatgacatatacagtcagcagcagatgattgaacagctgagtcaattgatcacagatcatcttcaaattcagaggtggctcttcaaaatggacagcgagtttaggggcaacgggacggcgttctgcgacataccaagttatcttaagtgctacaagtgggtgttgaaagagtcttcgcgttacggattggaggattggcggaaaaagtgggcacaggagcccgcactggtcaaaatcagtgaggagcttgccgggatcttggcacagcatgcccagccggtgaacgaaaagcgcttccctacgtggcgtaagtttttgcagacctttctttcacagggaggagtgatcgaggcctttccccctgcagataatgtcaccaaccttactgtagacatgctgatagagcccaatgggaagatctctgtgctgtccaccggagatcagttacatgcggaaagcccattcataagttctgggaccaccgtgccacagacaagtgttgacccacaggtccttacatacctctgcttacagattgggaaggcttgccgcatgagggatgtcgtgggatacttttcaattgatctggtgaccttcattgatccaagtacattggaacagcaggtctgggcaacagggctcaacctggcctacagcgaccaactggcgcttactcagctcacactttacctgactaacgggcaccttgattgctctctgagtactctagaggtcccaaggttcgtgcctaaggagaggaagaaaacaaagtgcatgtccgctctgtccatgcctatgctggccacttcaagatacgctgtgatgacgacccagctgcgccacagcaatctcagcctcgtatttcactacgtttttctgcagatctgccgggcccatggcatcggctacgatgtggaggaacgtcagggaactgtatttatcctatatgaacaccttaaacggcataagcttgggatgttaaccatcggggaggacttgcagggcgttctgatgactttcgctaggcaccttttcatcatccaccaagaaatttctgcccccaacatgcagggggagaccaatttcaagaccaccattgctgacattgagactattctgcgggtgaccaaagagaataagatgcggtttgaggaggaacagcagtccaaagacgataagaacctgagcaagcctaaaaaatag

SEQ ID NO: 191982 - DNA, 2091 bp, Artificial Sequence
  Description of Artificial Sequence: Synthetic coding sequence
atgatcgagcggggcctgatcccccccaccgcccggatcaccttccaaaacccccccataacgccccgcgctgcaccgctgcattcattcgacgaagcccggaaaattccaacagtcgcaacatttacaatcccacgggaaccacccccctcaccagccgaagtaaagttcttccctaagaagcagcgatccaagggaaaatcacggcgcagtcgtggtcaccacgaccggaaagccatgaaagtcaaaacccccttgagggccctcaaaagcctttgggactacgatttcctcatctatgatggcgtgatcgataatacagcacccgactttcttgcgtttaaggagcactttagcctggcgtggggcgggatcttctccctgttggaacacgttgaaaagttcctcaggaactatgctattccggaggtaaaaatcaagggaaataacctggtggcactcttgcctgagtttgaacttactaacaaactgacgcgctacgatttgctgagcgtcttggaggatcctgcccatgttcaaatgctgatcaatctgcccggtcaaagatacaagggacaggatggcaattcagaagctgcaatgaagatccaggcaacgtggaagtgttacaaggcgcgcaagttcttcctcttctaccgtcagcagaagtgggcaagtggcgtcatagcaatcgcctggttgttatattgtcataaaaccaggctgaaaaaaattctcaaggaaagcagacagcggcatttggagaactttcgcatcagggccaagcacctcgccgcgaactggaatagaatcaggaccagtcgccggactatcatccacattccctcactgggatacagccagccagtgcgcgagcacatcgctgacttcaacacccagcaaaatatgcagctgggcaggctctgtgacatccttgatgctaatgtgaacgtaatttacatatgctcacaccacatgaatgatgaattagttttgtattacaagaagatcctgtctttacacgccgctgtgaagagcggtaatctggaggaccgctcagatttacaggacagattcaagattatcactcccgaggctgttaacatattccccatgatcgagcagctatctcagctgataactgatcatctccagatccaacgttggctgttcaagatggatagcgagtttcgaggcaacggtacagccttctgcgacattccctcttacctaaaatgctataaatgggttcttaaagagagtagtcgatacggactggaagattggcgcaaaaaatgggctcaggaaccagccttagttaagatatctgaagaactcgcgggcatcctggctcaacatgcccagcccgttaatgaaaagagattcccaacttggagaaagtttctgcagacatttctgtctcagggtggggtgatcgaagcgttcccgccagccgacaatgtgactaatttgactgttgacatgttaattgaacctaatggaaagatctccgttctaagcactggcgatcagctgcacgccgaatccccattcatttcatccggcacaactgtgccacagaccagcgtggacccccaagtgctgacctatctctgtttgcagatcggcaaagcatgccggatgcgagatgttgtgggctatttctcgatcgatttagtcacttttatagacccgagcaccttagagcagcaggtctgggctactggcttaaatctagcctactccgatcagctggcgctgacccaactaactctctatctcactaatgggcacttggattgctccctgagtacgttggaggtccctcgcttcgtgccgaaggagcggaagaagacaaagtgcatgtccgccctgtcgatgcccatgctggcaacaagtaggtacgcagtgatgactacccagctccggcactctaacctatctctggtgttccactatgtcttcttgcaaatttgccgcgcccatggtatcggctacgacgtagaaaacaaccggaggggatctcctgggggaccacacgatctttgttccccgtccctgcaccacccttcccgtaacatatccacttag

SEQ ID NO: 191983 - DNA, 1866 bp, Artificial Sequence
  Description of Artificial Sequence: Synthetic coding sequence
atgaccaaggccatgaaggtgaagacccccctgcgggccctgaagtccctctgggattacgattttctcatctatgacggcgtaattgataacactgctccggattttctggccttcaaagagcacttcagcctggcctggggcggcatattttccctgctggagcatgtggaaaagtttctaaggaattatgcaatacccgaagttaaaataaaggggaataacctggtggcgctcctgcctgagttcgagctgactaataaattgacgaggtacgatctgctgtcagtcctcgaggatcctgcccacgttcagatgcttattaacctgcccggccagcgctacaagggccaggacgggaacagtgaagcagcaatgaagatccaagccacctggaaatgctacaaggcacggaaattctttctattttacagacagcagaaatgggcttccggcgtgattgctatcgcatggttgctctactgccacaagacgcgtctgaagaaaatcctcaaagaaagccgacagcgtcatctggagaattttcgtataagggctaaacatcttgctgccaactggaataggatccggaccagtcggcggacaattattcatataccttcccttggctattcccagccagtccgcgaacacattgccgatttcaatacccagcaaaacatgcaattgggcagactctgcgacattttagacgcgaacgtcaacgtaatatatatatgttctcatcacatgaatgacgagctcgtgctgtattacaaaaagattctgtcattacacgctgcagtcaagtccgggaatctcgaggataggtccgatctgcaggaccggttcaagatcatcaccccagaggcagttaatatattcccaatgattgagcagctctcccagttgattaccgaccatctccagattcagcgctggctgttcaagatggattcagaatttagaggtaacgggactgccttctgcgatatccccagctacctgaagtgttacaagtgggtactaaaagaatcctctagatacggattggaagactggaggaagaagtgggcccaggagccagccctagttaaaataagtgaggagcttgcaggcatcctggcccagcacgcccagcctgtgaacgagaagaggttccccacctggaggaagttccttcaaacctttcttagccaaggaggcgtgatcgaggccttcccccccgctgacaacgtcacgaacctgaccgtggatatgctaatcgagccgaatggcaagatctccgtgctcagtacaggtgatcaactgcacgcagagtcacctttcatcagttctgggactactgtccctcaaacaagcgttgacccccaggtgcttacatatttgtgtttacagatcggaaaggcctgccgtatgagggatgtagtaggctattttagcatcgacctagtcacttttattgacccgtccactctggagcaacaggtctgggccacagggcttaacttagcgtacagtgatcagcttgcccttacccaacttacactgtatctgacaaatggccacttggactgctccctttcaacactggaagtacctcggtttgtccctaaagagcggaaaaaaaccaagtgcatgagtgctctgtccatgccaatgctcgctacatcaagatacgccgtcatgaccacccagctgcggcattctaacctgtccttggtttttcactacgtgttcctgcagatctgccgcgcccacgggataggttatgatgtggagaacaataggcgtggaagcccaggtggaccgcacgacctctgcagtccatcacttcaccacccatcaagaaatatctccacctag

SEQ ID NO: 191984 - DNA, 2055 bp, Artificial Sequence
  Description of Artificial Sequence: Synthetic coding sequence
atgaaggtgaagacccccctgcgggccctgaagagcctgtgggactatgactttctgatatatgatggcgtgatcgacaatacggcccccgactttttagcttttaaggagcattttagcttggcctggggtggcatcttcagtctcctggagcacgtggagaagttcctgcgtaattacgctattcctgaggtgaagatcaagggaaacaatttagtcgccctgctgcctgaattcgagctcacgaataaattaacgagatacgacttgctgtcagttctcgaggatccagcccatgtgcagatgttaattaacctacccgggcaaagatataaaggccaggatggcaacagtgaagcagccatgaagatacaggcaacatggaagtgctataaggctcgcaaattttttctgttttacagacagcagaagtgggcctcaggtgtgattgcaatcgcttggcttctgtattgccacaagaccagactaaagaagatcctgaaggagtcgcggcagcgccatctagaaaattttagaattagagccaagcatcttgctgctaattggaaccgtattcgtacgagtcgccgaacaataatccacataccctccctgggctactctcagccggttagggagcatatcgccgacttcaacactcagcagaatatgcaactgggacgcctgtgtgacatcctggacgctaacgttaatgttatctacatttgtagtcatcacatgaacgatgaacttgtcctgtattataaaaaaattctcagcttgcatgcagccgtgaagtctggaaacctcgaagaccggtccgacctccaggataggttcaagatcataactcctgaggccgtgaatatctttcctatgatcgagcagctaagccaattgattactgatcatttacagatacagcgatggctattcaagatggattctgaattcaggggaaatggtaccgccttctgcgatattccttcctacttgaagtgctataagtgggtgctcaaagagtcgtccaggtacggactagaagattggcgcaagaagtgggcccaggaacccgccctggtgaagatttcggaagagctcgccggaattcttgcccagcacgctcagccagtcaacgagaaacgctttcccacatggagaaagttcctccagacttttcttagccaggggggcgtgattgaggcgtttccccccgcggacaatgttaccaatttaacagtcgacatgctcatcgagcccaatgggaaaattagcgttctctctaccggcgatcagctgcacgcggagtccccatttatttcttctgggactacagtgccacagacatctgtcgaccctcaagtactcacctatttgtgtctgcaaatagggaaggcttgcaggatgcgagacgtggtcggttatttttcaatagatctggtcacattcattgatccaagcaccctggagcagcaggtgtgggcaaccgggctcaacctcgcctactctgatcagctcgcactgacacaactgaccttgtacctcaccaacggccacctggactgcagcctttcaacgttggaagttccccgcttcgtgcccaaggagcggaaaaagactaaatgtatgtcagctctgagcatgccaatgctggcgacctcacgctacgcagtgatgacaactcagcttcgccactccaatttatcacttgtgttccactatgttttcttgcagatctgcagagcacacggcattggatacgacgtggaagaaagacagggaaccgtgttcatcttgtacgagcaccttaagagacataagctcggcatgttaacaatcggcgaagatctgcagggcgttttgatgaccttcgccagacacctttttattattcaccaagagatctcggctcccaacatgcaaggagaaaccaattttaaaacgacaatagcggacatcgaaacaatcctgcgagtgacaaaggagaacaagatgcgctttgaggaggagcaacaatctaaagacgataaaaatctgtctaagcctaaaaagtag

SEQ ID NO: 191985 - DNA, 507 bp, Artificial Sequence
  Description of Artificial Sequence: Synthetic coding sequence
atggcccagaacaccgagaaccacgaccccgtgggcagcatcctgatccagatccacgaggacctctaccagctgaaggagaagctaaccaagtttagtcctgaagagaagggagaaactctagatattcagagcttggaaacagcaataaaacgcacagaggtcgggctccgcattcatattgaaaagtatctcaacgtcgtgaaccaaaacgtactgacaaccagcgttaacgatgaaagcctctatactccgcaagcgtccaagtggctcttgcccacagtaattgaccagaagagctttatctttccccaagaatcagaagggacattctggcagccccaacgtcaacactcctcatccctgcctgtgttcccaagggcgaaacggaagatcggactcaatgtcaaaatcctgcaggatcccgagaacattcatcacagggctgcagttaacgccaactacggaatctcactcccgtacattaaccagagaaaggcatgttag

SEQ ID NO: 191986 - DNA, 339 bp, Artificial Sequence
  Description of Artificial Sequence: Synthetic coding sequence
atgcggctggaggagctgaagcggctgcagaaccccctggagcaggttaatgacgggaagtatagcttcgagaaccaccagctcgcaatggatgcggagaacaacatcgagaaatatccgttaaacctacaaccgctggaaagcaaagtgaaaattatccagcgtgcctggagagaatatcttcagaggcaggaaccactgggcaagcgaagtccctcccccccctccgtgtcatccgaaaagctctcgagttcagtgagcatgaacacgttcagtgatagcagcactcccgtgtcagttatgttcctgttcctttgtcccgacctcaccttcaactag

SEQ ID NO: 191987 - DNA, 480 bp, Artificial Sequence
  Description of Artificial Sequence: Synthetic coding sequence
atgcggctggaggagctgaagcggctgcagaaccccctggagcaggtgaacgacggtaagtactcctttgaaaaccatcagctggccatggacgccgaaaacaacatcgagaaatatcctctaaacctgcagccgcttgagtcgaaagtgaagataatccagagggcgtggagggagtacctgcagagacaggagcccctggggaagaggagtcctagcccacctagcgtgtcatccgaaaaattgtcttcttcagtatcaatgaatacattctcagattccagcaccccttttgctagggctccagtgggtaagattcacccatacatcagctggcgactccagtcccccggcgacaagctgccaggcgggagaaaggttatcctgctgtacctggaccagctggcaaggcctaccggctttatccatacactaaaggagccacagatagaacgactcggtttcttgaccctccagtag

SEQ ID NO: 191988 - DNA, 399 bp, Artificial Sequence
  Description of Artificial Sequence: Synthetic coding sequence
atgcggctggaggagctgaagcggctgcagaaccccctggagcaggttaatgatggcaagtacagtttcgagaatatccagagagcttggagggaatatctgcagcgtcaagagcccctggggaaaagatcacccagcccaccaagcgtgagctctgagaaattgagctccagcgtgtcaatgaatactttttccgactcgagcactcccttcgcccgcgccccagtcggtaagattcacccctacatctcttggcgcctgcaaagtcccggcgataagttacctgggggccgaaaagtgatattactatatttagatcagctggcccgtccgacaggtttcattcatactttgaaggagccccagatagagagactgggcttcctgaccctgcagtag

SEQ ID NO: 191989 - DNA, 2892 bp, Artificial Sequence
  Description of Artificial Sequence: Synthetic coding sequence
atggacgcccccaaggccggctacgccttcgagtacctgatcgagactctcaacgactccagtcacaagaagttcttcgatgtgagcaagctggggactaaatatgacgtgctgccatattcaattcgagtccttctggaggcagctgtgcgcaattgcgatggcttcctgatgaaaaaggaagacgtcatgaatatcctcgactggaaaactaagcagtctaatgttgaggtgccattctttcctgccagagttctgttgcaggacttcacgggcatccctgccatggtagatttcgccgcaatgcgagaggccgtgaaaactcttggaggcgacccagagaaggtgcaccctgcctgccctacagatctgacggtggaccactcgttgcagatcgatttctccaaatgcgctattcagaatgcccctaaccccggcggaggcgatttgcagaaagccggaaagctgtcacctgttaaagtgcagcctaagaaactcccttgtcgtggccagacgacctgccgtggatcatgcgatagtggagagctcgggcggaacagcggcactttctcatcacagatcgagaacactcccatcctgtgccctttccacttgcagccggtacccgagccagagaccgtgctgaaaaatcaggaggttgaattcggtcgtaaccgtgaaaggctacaattctttaagtggagcagcagagttttcaagaacgtagccgttattcctcctggcaccggcatggcgcatcagattaatttagaatacctttctcgcgtggtgttcgaagagaaggacttgttgtttcccgactccgtagtcgggaccgattcccatattacgatggtgaatgggctcggcatccttggctggggagtcggggggatagaaacagaggccgtaatgttgggattgccagtgtcgctgacactacccgaggtggtcggatgtgaacttacgggcagcagcaacccatttgtcacatctatcgatgtggtcctaggaatcactaaacacctccggcaggtgggtgtggcgggaaagttcgtggaattctttggttcgggggtttcccagctcagcattgtggaccgaactactatcgccaatatgtgccccgaatacggagccatcctctccttctttcccgttgacaatgtgacacttaagcatttggaacacaccgggttcagcaaagccaaattagagtctatggaaacctatttgaaggccgtgaagctctttaggaatgaccaaaattcctccggcgaaccagagtatagtcaggtgattcagattaaccttaattcaatcgtgccgtctgtgtcagggccaaagcgtcctcaggaccgagtggcggtgaccgacatgaaaagcgattttcaggcatgcctgaacgagaaggtggggtttaagggctttcagatagcagccgagaaacagaaagacatagtgtcaatacactatgagggaagcgagtataagctatcacatggctcggtggtgattgctgccgtgatttcatgcacaaacaactgcaaccctagtgttatgctggctgcgggtttactcgctaaaaaggcggtggaggcaggccttagagtgaaaccctacatccgcacgagcttatctccggggtccggaatggtcacgcactacctgtcttcttcaggtgttctgccttatctgagtaaactcgggttcgaaattgtcggatatggatgttcgatttgcgtgggcaacacagcacccctgagtgatgctgttctaaacgcggttaagcagggggacttggttacatgcggaatcctgtctggcaataagaactttgaaggccgcctgtgcgattgcgtccgtgcaaactatctggcaagcccacctttggttgtcgcgtacgccatcgctggaacggtgaatattgatttccaaacagaaccattgggaaccgatcccactgggaaaaatatctacctgcacgacatctggccgagccgggaagaagtccatagagtcgaagaggagcacgtgatcctgagcatgttcaaagccctgaaagataagatcgagatgggcaataaacgatggaacagtctggaggctcctgactccgtgctttttccatgggatcttaaatcaacctacattcgctgtccgtcattttttgataaattgaccaaggagccgatcgccctccaggctatcgaaaacgcacatgttctcttgtacctgggtgactccgtcacaacagaccatatctccccagccggctcaatcgccaggaattcagcagccgccaagtatttgaccaacagaggactaactcccagagagttcaacagttacggtgcccggagaggcaatgatgcagtcatgacacgcggaacgttcgcaaatatcaaattgttcaataagttcatcggcaagccggcgcccaagacgatccactttccttccggccagaccttggatgtttttgaagctgctgaattgtaccagaaggagggaatcccactgattatcctggcagggaaaaaatacggtagtggcaacagccgcgactgggccgcgaagggcccctacctgctgggtgtgaaggcagtactcgcggaaagttatgaaaaaatccacaaggatcatctgatagggataggtatcgctcccctacagttcctgcccggagagaatgcagacagcctgggcctttctgggcgcgagactttttcgcttacttttcctgaggagctgagtccagggatcaccctgaacatacaaaccagcactggcaaggttttttcagtgatcgcatccttcgaagatgacgtcgagattactctctataaacatggaggactcctcaatttcgtggcccgcaagttctcctag

SEQ ID NO: 191990 - DNA, 96 bp, Artificial Sequence
  Description of Artificial Sequence: Synthetic coding sequence
atggactacgtggaggacaagctgagcagcgagttcgtgttcaacaacccgaacattaaggggacctgtggctgtggcgagagcttcaatatctag

SEQ ID NO: 191991 - DNA, 261 bp, Artificial Sequence
  Description of Artificial Sequence: Synthetic coding sequence
atgagcgccagcctggtgcgggccaccgtgcgggccgtgagcaagcgtaagctgcaaccaacccgggctgcactaaccctgacgccctcggccgtcaataaaattaagcagctccttaaggacaagcccgaacatgtcggcgtgaaagtcggagtgcgaacaaggggctgcaacggcctgagctacactctggagtacacaaaaacgaaaggggactctgacgaggaggtgatacaggacggatggtcggcagtcgtctag

SEQ ID NO: 191992 - DNA, 390 bp, Artificial Sequence
  Description of Artificial Sequence: Synthetic coding sequence
atgagcgccagcctggtgcgggccaccgtgcgggccgtgagcaagcgcaagttacaaccaacacgcgctgccctcaccttaacaccaagcgccgtaaacaagatcaagcaactgttgaaagacaagcccgagcatgtgggagtgaaggtcggtgtcaggacaaggggatgtaacggcctgtcatatacactggagtacacaaaaaccaaaggagactccgatgaagaggtcatccaggacggagtcagggtttttatagagaaaaaagcccagctcacgctgttggggacagagatggactatgtcgaggacaagctgtcaagtgagtttgtgttcaataacccgaacatcaaaggcacgtgtggctgcggggaatcctttaatatttag

SEQ ID NO: 191993 - DNA, 531 bp, Artificial Sequence
  Description of Artificial Sequence: Synthetic coding sequence
atggtggccgccggcggcggcgcccggaccgagggcgccgtgcggaggtcactatggagacagtgtgctaggagggtacacggagagaaactcagaagacctacttttggacctagacatcgtggagccggaacagcaaagatgagtgcttccctggttcgcgcaactgtgcgcgccgtgtccaaaagaaaactgcagccgactagagccgcgctgactttgactccatcggctgttaacaagatcaagcagctgttaaaggataaaccagagcatgtcggagtgaaggttggcgtgcggacaagggggtgtaacgggttgtcctatacactggagtacaccaagactaaaggcgactccgacgaggaggtcatccaggacggcgtgcgggtgtttatcgagaagaaggcgcagctgaccctgttagggaccgaaatggattatgtcgaggataaactgagctcggagtttgtttttaataaccctaatatcaagggcacgtgtggctgcggggagtctttcaacatctag

SEQ ID NO: 191994 - DNA, 504 bp, Artificial Sequence
  Description of Artificial Sequence: Synthetic coding sequence
atggccgccgccggcgccttccggctgcggcgggccgccagcgccctgcttctccgctccccaagactgccagctcgggagctctctgcccccgccagattataccacaagaaagtagtcgaccactacgagaatccaaggaatgtggggagtctagataaaaccagtaagaatgtgggcaccggtctggtgggtgcgcctgcctgtggcgatgtgatgaagcttcaaatccaagtcgacgaaaaaggaaagatcgttgatgccagattcaaaaccttcggctgtggaagcgccatagcaagcagctccctggctaccgaatgggtaaagggaaagactgtcgaggaggcccttactattaaaaacaccgacatcgccaaagagctgtgtttgccaccagttaagttacattgctccatgcttgctgaggacgctataaaggccgccctggccgactataaattaaagcaggaaccaaaaaaaggggaagccgagaagaagtag

SEQ ID NO: 191995 - DNA, 390 bp, Artificial Sequence
  Description of Artificial Sequence: Synthetic coding sequence
atggtgctgatcgacatgagcgtggacctgagcacccaggtggtggaccactacgaaaatcccaggaacgtggggtctctcgacaaaacctctaagaatgtcggcactggactggtgggggcgcccgcttgcggggatgtgatgaaactccaaatccaagtggacgagaagggaaagatcgttgacgcaaggttcaaaactttcggttgtggcagcgcgatagctagcagctctcttgctactgagtgggtgaaagggaaaactgtggaagaggcattgacaattaagaatacagatatagcgaaggagctttgtctgccacccgttaaactgcactgttccaagtctgtcctgttcccggccgaagaaaagactcagttaagtccatag

SEQ ID NO: 191996 - DNA, 429 bp, Artificial Sequence
  Description of Artificial Sequence: Synthetic coding sequence
atggtgctgatcgacatgagcgtggacctgagcacccaggtggtggatcattatgagaatcctcgaaacgtagggtctctggacaagaccagcaagaacgtgggcacgggcctcgtgggcgcacctgcctgcggcgatgtcatgaagcttcagatccaggtggatgagaaaggcaaaattgtcgatgctcggtttaagacttttggctgtggctccgctattgccagctcctcgctggcaactgagtgggtcaagggcaagacggttgaggaggcattgacaatcaagaataccgatattgccaaagagctttgcctgcccccagtgaagttgcattgctctatgcttgccgaagacgccatcaaggccgctcttgccgactacaagctgaagcaggagcccaagaagggagaagctgaaaaaaagtag

SEQ ID NO: 191997 - DNA, 1443 bp, Artificial Sequence
  Description of Artificial Sequence: Synthetic coding sequence
atgagcttcccccagctgggctacccccagtacctgagcgccgccggacctggagcctacggcggtgaaagaccgggcgtgctagcagctgcggctgcagccgccgcagcagcatcttcgggacgacctggtgcagcagaattgggcgggggggccggagctgcagccgtgactagtgtgcttggtatgtatgccgccgcagggccttacgctggggcacccaattattcggcctttcttccgtacgccgctgatttgagcctgttttctcagatgggaagccagtacgaactcaaagacaaccccggtgtccatccagccaccttcgcagcacacactgctccggcctattacccctatggccagttccagtatggagaccccggcaggccgaaaaatgcaacacgggagagcacatcgacactgaaggcttggctaaatgagcaccgcaagaatccttaccccacaaaaggagagaaaataatgctcgcgatcataacgaaaatgacgctgactcaggtgtctacttggtttgcgaacgccaggagacgtctgaaaaaagagaacaaggtgacatggggggcacgtagcaaagaccaggaagatggggctctattcgggtctgataccgaaggagacccagagaaagccgaagatgacgaagagatcgacctcgagagcatcgatattgataagatagatgagcacgacggcgaccagtctaacgaggacgacgaagataaggccgaggcccctcatgctcctgccgccccgagcgctcttgcccgggatcagggaagccccttagccgccgccgatgtgttgaaacctcaggattcaccattgggtctcgcaaaggaagcaccggaaccaggcagtacaagactgttgagccccggtgctgctgctggtgggctacaaggggccccacacggaaagcctaagatttggagcttggcagaaacagctacgtctcctgatggggccccaaaagccagtccaccaccgcctgccggacatcccggtgcacatgggccctctgcgggcgcccctttgcagcacccagcattcctgcctagccacggtttgtatacctgccatatcggcaagttctcaaattggacgaattcggctttcctggcacaagggagtctgctgaacatgcgctccttcctcggcgtcggcgccccccacgccgctcctcacggacctcatcttcccgctccccctcccccccaaccacctgtggccatcgcgcccggagctctcaatggcgacaaggctagtgtgcgatccagccctactctccccgagcgcgacctggtgcccaggcctgactctcccgcccagcagttgaaaagtccttttcagcccgttagagacaactcactggcaccgcaggagggaactccaaggattctcgccgcgctaccctcagcttag

SEQ ID NO: 191998 - DNA, 1416 bp, Artificial Sequence
  Description of Artificial Sequence: Synthetic coding sequence
atgagctacccccagggctacctgtaccaggcccccggcagcctggctctgtacagttgccctgcttatggcgcaagcgcattagctgccccccgcagtgaggaactagctcgaagcgcatctgggtcagccttcagcccctaccccggctcggcggcgttcacggcgcaggccgcaactgggttcggttcgcctttacagtactctgctgacgccgccgctgcggcagcaggctttccatcttacatgggagcaccatacgacgcacacactactgggatgaccggcgcaattagttatcatccatacggatctgctgcttacccataccagttgaacgatcctgcctataggaagaatgccaccagagacgccacagcaaccctgaaggcatggttaaatgagcacagaaaaaacccctatcctactaagggagagaaaatcatgctagccattattacgaaaatgactctgacacaggtttccacctggttcgctaacgcacgtagaaggctcaagaaagaaaacaagatgacttgggctccccgtaataagagcgaagacgaagatgaggacgagggcgacgctactagatcaaaagacgaatcacccgataaggcccaggaaggtactgaaacaagcgctgaagatgaagggatttcattgcatgtagacagcttgacagaccactcctgctcggctgaatcggacggcgaaaaactgccgtgccgggccggggaccccttatgtgaatccggaagcgaatgtaaggataagtatgatgacttggaggatgatgaggatgacgatgaagagggagagcgggggctggcccctcctaagcctgttacaagttctcctctgactggtctggaagcccccctcctatccccacccccagaggcagcccctcgggggggaaggaagacgccccaggggtcccggacatccccgggcgcaccacctcctgcctcaaagccaaagttgtggtccctcgccgaaattgccacctccgacctgaaacaaccatccctgggaccgggttgtggacctcctgggttgcccgcggctgctgccccagcttcaaccggtgcccccccaggcggcagcccctaccctgcttccccgttgctcgggaggcccctctactatacgtcccctttttacgggaactatactaattacgggaacctgaatgccgccttgcaggggcagggccttctgagatataattctgccgccgcagctcctggggaagctctgcacacagctcccaaggcggccagtgacgccgggaaggcaggagcgcatccacttgagagccactatcgctctcccggcggcggttacgagcccaagaaagacgcctccgaaggatgcaccgtcgtgggagggggagtgcagccctatctgtag

SEQ ID NO: 191999 - DNA, 1416 bp, Artificial Sequence
  Description of Artificial Sequence: Synthetic coding sequence
atgagctacccccagggctacctgtaccaggcccccggcagcctggcgctttactcatgtccggcatatggagcttctgcccttgctgcccctcgaagcgaggaattagcccgctcagcatctgggtccgctttcagcccttaccccgggagtgctgcattcacggctcaggcagccactggctttgggtcaccacttcagtattccgcagacgctgctgccgccgctgccggtttcccttcgtatatgggagcaccctacgatgctcataccacggggatgaccggtgctatctcttatcatccgtacggcagcgccgcctacccctatcagctaaacgatcctgcctatcggaaaaatgcaaccagggacgccaccgcgacactcaaggcttggctgaacgagcaccgcaagaacccgtacccaaccaagggcgaaaagattatgttggcaatcatcaccaagatgacgctgacacaggtgtcaacttggttcgccaacgcgaggcgccgcttgaagaaggagaacaagatgacgtgggccccacggaacaagtccgaggatgaagacgaagatgagggggacgcaacgcgctcaaaagacgaatcccctgataaagcccaggaagggacggagacgagcgcagaggacgagggtatctccctccatgttgacagcctcacagatcattcctgtagtgctgaaagtgatggagaaaagctaccatgccgggcaggggaccctctgtgtgagagtggcagcgaatgtaaggacaaatacgatgacctagaagatgacgaggacgatgatgaagaaggcgaacgaggattggccccaccgaaacctgtaaccagttcaccactgacggggctggaagcacctttgctgagcccccccccggaggctgctcccagaggagggagaaaaaccccgcagggctctcggacgtcccctggtgctccccccccagcaagtaaacctaagttgtggtctttggccgaaatagcaactagtgatttaaaacagccctcactcggccccggatgtgggccccccggtctgccagcagccgcggctccagcttctaccggcgcaccacctgggggctctccctaccccgcatctccactgctgggtcgccccctctattatactagtcctttttatggcaattacactaactatggcaacttaaatgcagctctgcagggccaaggattactcaggtacaattccgccgccgcggctcccggtgaagctcttcacacagcccccaaagccgcatcggacgctggcaaagcaggcgcccacccactcgagtcccattatcgttccccgggtggaggttacgagcctaagaaggatgctagtgaggggtgcaccgttgtgggcggcggggtgcagccatatctttag

SEQ ID NO: 192000 - DNA, 1506 bp, Artificial Sequence
  Description of Artificial Sequence: Synthetic coding sequence
atgagcttcccccagctgggctaccagtacatccggcccctgtaccccagtgaacgccccggtgccgctgggggctccggcggctcagccggcgccagagggggcctgggcgcaggggcatccgagctgaacgcctctggatctctgagtaacgtcttgagcagcgtgtacggtgcgccctatgcagccgcggccgctgcagcagcagctcagggatacggggccttccttccttatgcggccgagcttcccatctttccccagttaggggcacaatacgagctcaaggactctcccggggtgcagcatcccgctgcggccgcggcttttccacatccacaccctgccttttatccctacgggcaataccagttcggtgacccatcccggccaaagaacgccacccgcgagtcaacttctacgctgaaagcttggttgaatgagcatcgcaaaaacccttacccaaccaagggtgaaaaaatcatgcttgccattattacaaagatgacactgacccaggtttccacctggtttgctaatgccagacggcgcctgaagaaggaaaacaaaatgacctgggctccacggagccggacagacgaagaaggtaatgcctatggcagcgaacgggaggaagaggacgaggaggaagacgaagaagatggcaaacgggaattggagctagaggaggaagaacttggaggagaagaagaagacacaggaggggaaggtctcgcagacgacgacgaagacgaagagatcgaccttgaaaatctggatggagcagccacggagccagagctcagtctggcaggggctgctcggcgggacggagatctgggcctgggccccatctccgactctaagaactcagactctgaagacagttctgaaggattggaggatcggcctctcccagttctatcgctcgctcctgcacctccacccgttgctgttgcatcacctagcttaccgtcgccgccggtctcactagacccatgcgctccggcacccgccccagcctctgccttacagaagcccaaaatttggtccttggcagaaactgctacgtcccccgataaccccagaaggtcccctccaggcgctgggggcagccccccaggtgcggcagtagctccatccgcactccagctttccccagctgcagcagcagcagccgctcaccgcctggtgtctgcacctctcggcaaattccctgcttggaccaacaggccattccccggacctcccccgggccccaggcttcacccactctccctccttggatcggccccaccccacctgctggggctgcctggggccgcaggacatccagccgcggccgccgcattcgcaagacccgctgagcccgaaggggggacagacagatgctctgccctggaagtggagaagaagctgctaaagaccgcttttcaacctgtgccaaggcgacctcagaaccacctggacgctgcactggtcctatccgcgctgagcagttcatag

SEQ ID NO: 192001 - DNA, 741 bp, Artificial Sequence
  Description of Artificial Sequence: Synthetic coding sequence
atgctgtggcggcagctgatctactggcagctgctggccctgttcttcctacccttttgcctgtgtcaggacgaatatatggagtccccgcaaacaggcgggctgccccccgattgtagcaagtgctgtcatggtgattactccttccgtggctaccaggggcctcctggaccacctggcccccctgggattcccggtaaccacggcaacaacgggaacaatggagcaactggccatgagggagccaaaggagagaagggtgataagggcgatcttggccctcggggagaacgggggcagcatggaccaaagggggagaaaggatatcctgggatcccacctgagcttcaaatagcgtttatggcttctttggcgactcattttagtaaccagaattccggcataattttcagcagcgtggagacgaatatcggcaacttctttgacgtgatgaccggaagattcggcgctcccgttagcggtgtctacttcttcacattctcgatgatgaagcacgaggacgtggaggaagtgtacgtttatctcatgcacaacggcaacacagtgtttagtatgtactcgtacgaaatgaagggcaaatcagatacctcaagtaatcacgccgtattgaaattggcgaaaggtgacgaggtgtggctacggatgggtaacggcgcactccacggggatcaccagaggttctctaccttcgcaggatttctcttatttgaaacgaaatag

SEQ ID NO: 192002 - DNA, 1560 bp, Artificial Sequence
  Description of Artificial Sequence: Synthetic coding sequence
atgagctacccccagttcggctacccctacagcagcgccccccagttcttaatggctaccaacagtctgagcacctgctgtgagtccggagggagaacattggctgacagcggcccagcagcctctgcgcaggcacctgtatactgcccagtgtacgaatcaagattattggccacggcacgtcacgagctgaacagcgccgctgcactgggcgtgtacggcggaccctacggaggctcacaggggtacggtaactatgtgacctatggcagcgaggccagcgcattctacagcttgaactcttttgattccaaggatggatcagggtcagcccacgggggactggcccccgctgcggccgcgtactacccgtatgagcctgcactaggtcagtacccctatgatcggtacggcacaatggactccggtacccggagaaagaatgccacacgggaaacgacctctaccctcaaggcgtggctgcaggagcaccgaaagaacccgtatccaaccaagggtgagaagattatgttggcgattattactaaaatgacattaacccaggtttctacctggttcgccaatgcacgtagacgccttaaaaaggagaataaaatgacctggcccccgcgaaataaatgtgccgatgaaaagcggccgtacgctgagggagaggaagaggaaggaggagaagaggaagcccgggaagagcccctgaaaagctctaagaatgcagagcccgtcggaaaggaggagaaagaactggagttgagcgatttggatgatttcgatcccttggaggcggagcctcctgcatgtgagttaaaacctccctttcactctttggacggcggcctggaaagggtgcccgcagccccggacggcccggtcaaggaagcgtcaggagcactgaggatgagtttggccgcaggagggggtgctgccttggatgaagacctcgagcgcgcgaggagttgcctgcgctctgcggccgcaggccccgagccgctacctggagctgagggagggcctcaggtctgtgaggcaaagctgggctttgtccctgcaggggcctccgctggtctggaggccaagcctaggatctggtcgctcgcacacacagccactgcagctgccgcggccgcaacatctctttcgcaaaccgagtttccctcttgcatgcttaagagacagggccctgctgcacccgccgcagtcagctccgcccctgctacatcaccatcagtggcccttccgcattctggcgcccttgatagacatcaggactcaccagttaccagcctgcgcaactgggtggacggagtgttccacgaccccattcttaggcatagcacactgaaccaggcgtgggccacagctaaaggtgccctgctagatccgggtccactgggacgttccctgggtgccggcgccaacgtgctgaccgccccactggccagagctttccctcctgctgtgccccaggacgcacccgcagcaggcgccgcaagagaactcctagccctgccaaaggctgggggcaagccgttctgcgcctag

SEQ ID NO: 192003 - DNA, 1560 bp, Artificial Sequence
  Description of Artificial Sequence: Synthetic coding sequence
atgagctacccccagttcggctacccctacagcagcgccccccagtttctaatggctacaaattctctgtcaacttgctgtgaatctggcggacggactcttgccgactcggggcccgcagccagcgcccaggccccagtatactgccccgtatatgagagtcgcttactcgcgacagcccgccacgaactgaatagcgcagccgccctaggcgtctacggagggccctacggtgggagtcaagggtacggcaactacgtgacctatggcagtgaagcttcagccttctattctctgaatagctttgacagcaaggacggcagcggctctgcccacggcggactggcacctgcggcagccgcctattatccctatgaaccagccctgggacagtatccttacgataggtatggcactatggatagcggtacaaggcggaagaatgcaacccgagagaccacttccactctgaaagcatggcttcaggagcatcggaagaatccatacccaactaagggtgagaaaattatgttagcgatcattactaagatgaccttaacccaggtatcgacttggtttgccaatgctcggcgccgacttaaaaaagaaaacaaaatgacctggccgcctagaaacaagtgcgccgacgaaaagaggccctatgctgagggggaggaagaagagggaggcgaggaggaggcccgggaggagcccctcaaaagctcgaagaatgctgagcccgtcgggaaggaagagaaggaactcgaattaagtgatctggacgactttgatcctctggaggctgagccacctgcatgcgaattgaaaccaccctttcacagcttggatggcggcctggaacgtgtgccagcggcacccgacggcccagtcaaggaggcatccggggctctgagaatgtccttggccgctggtggcggggcagcgttagatgaggatctagagagggcgagaagttgccttcggtcagccgccgctggacctgaaccactgcctggagccgaaggaggccctcaggtgtgcgaagcaaagcttgggttcgttcccgcgggggccagcgcgggactggaggctaagccccgtatctggagcctcgctcacactgcaactgcggccgccgcagctgccaccagcctgagccagactgagttccctagctgcatgctcaaacgtcaagggcccgcggctccagccgcagtttctagcgcccctgctacaagtcctagcgtggcactgcctcatagtggtgctcttgaccgacatcaggattccccagtgacatcattgcggaattgggtggatggagtgttccatgatcccattctgcggcacagtaccttgaaccaggcctgggcaacagcaaaaggagccttattggatccgggacctctcggccggagtcttggcgcaggcgctaatgtgctgaccgcccccctcgccagggcgtttcccccagctgttccacaggatgcgccagccgctggagcggcgcgggagctgctagcgcttcctaaggcaggaggtaagccattttgtgcatag

SEQ ID NO: 192004 - DNA, 1452 bp, Artificial Sequence
  Description of Artificial Sequence: Synthetic coding sequence
atgagctacccccagggctacctgtaccagcccagcgccagcctggctctgtacagttgccctgcatattcgactagtgttataagcggtccccgtacagatgagttgggccgctcgtctagcggatctgctttctctccctacgctggcagcaccgccttcaccgcccccagcccgggttacaactcccacctgcagtacggcgcagatcccgccgcggcagctgctgcagccttttcctcctacgtcggcagcccttatgatcatacacctggaatggctgggagcctggggtaccatccttatgctgcccccctggggtcttatccttacggagatcccgcctatcgtaagaacgccacgcgggacgctaccgcgacattaaaggcctggctgaacgagcatcgcaagaatccctaccccactaaaggagagaaaattatgctggctatcataaccaagatgacactcacacaggtgagtacctggttcgccaacgcccggcgtagactgaagaaggagaacaaaatgacctggacccctagaaaccgcagcgaagacgaggaggaagaggaaaacatcgacctcgagaaaaacgatgaggacgaacctcaaaaaccagaagacaagggggatcctgaagggccagaagcaggcggggcagagcagaaagcggcgagcggatgcgaaaggctgcagggccccccaactccagctggtaaagagaccgaaggttccctcagcgattccgatttcaaggagccaccaagtgaaggcagactggacgcacttcagggccctcctcgcaccggcggcccctcccctgcaggcccggctgccgcgcgcctggccgaggacccggcgcctcattatcctgcaggggccccagctccaggcccacatcccgctgcaggcgaagtgcccccagggcctggcgggcccagcgtaatccatagcccgccaccgccccctccacctgcagttcttgctaaacccaagctgtggtctctagccgagatcgccacttccagcgataaggttaaggacggcggaggcggaaacgaggggtctccttgtcccccgtgccccgggccaatcgcagggcaggccctgggaggttctcgtgcctcgcctgctcccgcccctagcaggagcccctccgctcagtgcccatttcccggcggcactgtgctgagcagaccactctattatacggcccccttttaccctggctacaccaattacggcagcttcgggcatctgcacggacaccccggtcccggtccaggacccaccaccggccctggatcacactttaacggactaaaccaaacggtgctgaaccgcgccgatgctctggccaaagatcccaaaatgcttaggagccagagccaactggatctttgtaaagactccccgtacgagttgaagaaaggaatgagtgatatttag

SEQ ID NO: 192005 - DNA, 441 bp, Artificial Sequence
  Description of Artificial Sequence: Synthetic coding sequence
atgagctacccccagggctacctgtaccagcccagcgccagcctggccctctacagttgccccgcgtatagcacttccgtcatctcagggccgaggacggacgagctggggcgaagtagctctggctccgccttttccccatatgccggctccactgcattcaccgcaccatcccccggctacaatagtcatctgcagtatggagccgaccccgcagccgccgctgcagcagcattcagcagctacgtgctgctgaagaaggagaagaaaagtttggatttcccatgttttcctcccttaaggcccacctgcgtacgctctcctgcagaaagaggagtcgcctccgtagcccaggcatcaatatgtatggaaggacgcgccgccgtggcacggtccgcccatggcggttcaccctatgctcaccgcgttccagggccatag

SEQ ID NO: 192006 - DNA, 498 bp, Artificial Sequence
  Description of Artificial Sequence: Synthetic coding sequence
atgggctgggacctgaccgtgaagatgctggccggcaacgagttccaggtcagcctgagtagctcaatgagcgtgtccgaactgaaggctcaaatcactcagaagatcggcgtccacgccttccagcaacggctggccgttcaccctagtggggtagccttgcaggatcgggttcccctggccagccaggggctcggcccaggctccactgtcctactggtagtggataagtgtgatgagccgctgtctattcttgtacgcaataataaagggaggtcttcaacctatgaagtgcgactgacacagacggtggcacatttgaagcagcaggtatccggacttgagggcgtccaagacgatctgttttggctcactttcgaaggcaaaccgctggaggaccagctgcctcttggtgaatatggcctgaaaccactcagcacagtgtttatgaatctgcggttacgcggtgggggtactgagccaggaggtagatcttag

SEQ ID NO: 192007 - DNA, 3129 bp, Artificial Sequence
  Description of Artificial Sequence: Synthetic coding sequence
atggccgacgccttcggcgacgagctgttcagcgtgttcgagggcgacagtacaaccgccgcgggcactaaaaaggacaaggagaaggacaaaggcaagtggaagggtcctcccggtagcgcagataaggccggaaagcgctttgatggaaagctgcagagcgaatccaccaataacggcaagaataaacgcgacgtggatttcgaggggacggatgagccaattttcggtaagaaacctagaatcgaggagtcaatcaccgaagacctgagtctcgccgacttgatgcctcgggtgaaagtacagagcgtagagactgtagagggctgcacacacgaagttgcactgccggccgaagaagactacttgccgcttaagcctagagtggggaaagctgccaaagagtacccattcatcctggacgccttccagagggaagcgattcagtgcgtcgataataaccagtctgtcttggtgagcgcgcacacttcggccggcaagaccgtgtgtgcagagtacgcgatcgcactggcacttagggaaaagcagagggtcattttcacaagcccaataaaggctttgtccaatcagaagtaccgggaaatgtatgaggaatttcaggacgtgggacttatgacaggggacgtcaccattaatccgactgcctcctgtctggtgatgacaactgaaatcttaagaagcatgctctataggggatccgaggtgatgcgggaggtggcgtgggtcatcttcgacgagatccactacatgagagatagcgagcggggcgtggtgtgggaggagaccatcattctcctgccagataacgtccattacgttttcctttcagctacgatacctaacgcgaggcagttcgccgaatggatctgccacctgcacaagcagccttgtcacgttatctatacagactacaggccgactcccttacaacactacattttccccgccggaggagacggattgcatctagtcgttgacgagaacggcgattttagagaggataactttaacacagccatgcaggtgctgagagatgcaggggatttggccaaaggggatcaaaaggggcggaaaggtggcacaaaggggccgtctaacgtgttcaagatcgtcaaaatgatcatggagaggaacttccagcctgtgatcatcttcagtttttctaaaaaagactgcgaggcctacgctctgcaaatgaccaagcttgattttaatacagatgaagaaaaaaagatggtcgaggaggtttttagcaacgccattgactgtcttagcgatgaagataagaaactgccgcaagtggaacacgtcctcccacttctcaaacgagggatcggcatccatcacggaggtctgttgcccatccttaaggaaacaattgaaatcttatttagcgagggactcatcaaagcattattcgccactgagacatttgccatgggaatcaacatgcccgcacgaacagtattgtttaccaacgctcgaaaattcgatggaaaggattttaggtggattagcagcggcgagtatattcagatgtccggccgggcaggacgcaggggaatggacgacaggggtatcgtgatcttgatggttgacgaaaaaatgtctcctactatcggtaagcagcttcttaaaggaagtgcagatccgctgaacagtgccttccatctcacctacaacatggtgttaaatctccttcgcgtcgaggaaattaatccagagtatatgctggagaaatctttttatcagttccagcactatcgggccatcccaggggtcgtggaaaaggttaaaaatagtgaagaacagtataataagatcgttattccgaacgaagagtctgtggtcatctactacaagatccgtcagcagctggctaaactgggtaaggagatagaagagtacattcacaaaccaaaatattgcttgcccttcttgcagccaggccgtctcgttaaagtgaagaatgaaggagacgactttggctggggtgtagttgtgaacttcagcaaaaagtcaaatgtcaagcccaactctggcgaactcgacccattgtacgttgtcgaagtcctgctgaggtgttcaaaagagtcactcaagaatagtgccaccgaagcggcgaaaccagctaagcctgacgagaagggcgagatgcaagtcgtgccagtcttggtgcacctgctgtctgccatcagcagtgtccggttatacatccccaaagacctgagaccagtggacaacaggcagagcgtgctgaaaagtatccaagaggtgcagaaacgatttccagatggcatcccactactggatccgatcgatgacatggggatacaggaccaaggcctgaagaaagtgattcaaaaggtggaagccttcgagcacaggatgtactcacaccccctccataacgatcccaacctggaaaccgtttacactctgtgcgagaagaaagcgcaaattgccattgacattaagtcagcaaaacgcgagctgaaaaaggccagaaccgtactgcaaatggatgagctgaaatgtaggaaacgcgttctgaggaggttaggattcgcgacaagctccgacgtgatcgaaatgaaagggagagtggcctgtgagattagttcagcagacgaattattgctgacagagatgatgtttaacggactattcaacgatctctcagccgagcaggccacagccttgctcagctgcttcgtattccaagagaactcttctgagatgcccaaactcacagaacaactggctgggccgcttagacagatgcaagagtgtgcaaaacgcattgccaaggtgagcgcagaagccaagctcgaaatcgatgaggagacctacctgagctccttcaaacctcatttaatggacgtcgtgtacacctgggctaccggcgctacatttgctcacatttgtaagatgaccgatgtgtttgaaggtagtatcattagatgtatgaggagactggaggagctgctgaggcagatgtgccaagcagcaaaagctatcggaaacaccgagttggagaacaaatttgctgagggcataaccaagattaaaagggacatcgtctttgcagcctcactgtacctatag

SEQ ID NO: 192008 - DNA, 981 bp, Artificial Sequence
  Description of Artificial Sequence: Synthetic coding sequence
atgggcgacatgggcgacccccccaagaagaagcggctgatcagcttgtgcgttggatgcggcaaccagatccacgaccagtacatattacgggtgtccccagacctcgagtggcatgccgcgtgtctgaaatgcgctgagtgcaatcaatatcttgacgagtcttgtacctgtttcgtgcgagacgggaagacctattgcaagcgcgattacatacgtctctacggcatcaagtgcgccaaatgttctatcggcttcagcaagaacgacttcgtgatgagggccaggagcaaagtctaccacatcgaatgcttcagatgcgtggcatgttcacgccaattgatccctggtgatgaatttgctctccgagaggacggcctattttgtcgagctgatcacgacgtcgtcgagcgcgcatccctgggagcgggcgatccactgagccccctccatccggcgaggccgctacaaatggccgctgagcccatcagcgcccggcagccagctctgagaccccatgtgcataaacagcccgaaaagacaacaagagtgaggacagtgctgaacgagaagcagctccacacactccggacctgttatgctgctaatcctcgtccagacgctctgatgaaggaacaactggtcgagatgacgggcttatccccccgagtgataagggtatggttccagaataagcgatgcaaggataagaagaggagtataatgatgaaacaactccagcaacagcagccaaacgataaaaccgccaacccggtcgaagtgcagagttaccaaccgccatggaaagtcctgtctgacttcgctctgcagagtgacattgaccagccagcttttcagcaattggtcaacttttctgagggcggcccaggttcgaattctaccggttccgaggtggcaagcatgtcctcccagttacccgacactccaaatagcatggtggcttcaccaatcgaagcttag

SEQ ID NO: 192009 - DNA, 270 bp, Artificial Sequence
  Description of Artificial Sequence: Synthetic coding sequence
atgggcatcctgaagctgcaggtgttcctgatcgtgctgagcgtggcattaaaccacctgaaggccaccccaatcgagtcacatcaggtcgagaagaggaaatgtaatactgccacctgcgctactcagagactggccaacttcctcgtgcactcctcaaataacttcggggccattctgtctagcaccaacgtcggttcaaacacgtacggtaagcggaacgcagtcgaggttctcaaacgcgaacccttgaattacctgccactgtag

SEQ ID NO: 192010 - DNA, 240 bp, Artificial Sequence
  Description of Artificial Sequence: Synthetic coding sequence
atgggcatcctgaagctgcaggtgttcctgatcgtgctgagcgtggcactcaatcacctgaaagccacaccaatcgagtcccaccaggttgagaagagaaaatgcaatacagccacatgtgcaactcagcgactggcgaatttcctcgttcattccagcaacaacttcggcgccatactgtctagcacaaacgtgggaagcaatacatacggaaagcgtaacgccgtggaggttttatag

SEQ ID NO: 192011 - DNA, 270 bp, Artificial Sequence
  Description of Artificial Sequence: Synthetic coding sequence
atgggcatcctgaagctgcaggtgttcctgatcgtgctgagcgtggcattaaaccatctcaaggctaccccaattgaaagccatcaagtggaaaagagaaagtgcaatacagctacttgtgccacccagagactggctaattttctcgtccactctagtaataattttggggctatcctgtctagcactaatgtagggagcaacacctacgggaaaagaaacgcagtagaagtgctgaagcgagagccacttaattatctgccactgtag

SEQ ID NO: 192012 - DNA, 1449 bp, Artificial Sequence
  Description of Artificial Sequence: Synthetic coding sequence
atgagcggccacaagtgctacccctgggacctgcaggaccggtacgctcaggacaagtccgtggtcaataagatgcagcagaaatattgggagaccaagcaggcattcattaaggcaacaggcaagaaggaggatgagcatgttgttgctagtgatgcagacctggatgccaaactcgaactgttccatagtatacaaagaacttgtttggacctgagtaaggcaatcgtactctaccagaagcgcatttgtttcctcagtcaggaggaaaatgaactggggaaatttttaaggagccagggctttcaggataagacacgcgctggcaaaatgatgcaggcaactggaaaggccctgtgcttttcctcacagcagagactggctctccggaaccctctgtgtcggttccatcaggaggtcgaaacgttccggcatcgagcgatctccgatacttggctcactgtcaatagaatggaacaatgtcggacagagtacagaggtgctttactctggatgaaggatgtgtcacaggagttggatccagacctgtacaagcagatggagaagttcagaaaggtacagacacaggtgagacttgctaagaagaactttgataaattgaaaatggacgtgtgtcaaaaggttgacctgctcggagcctccaggtgtaatctgctctcccatatgctcgccacctatcagacgaccctgttgcacttctgggaaaagacaagccacaccatggccgcaattcatgaatctttcaagggctaccagccatatgaatttacaacattgaagagtctccaggaccccatgaagaaactggttgagaaagaggagaagaagaagattaaccagcaggaaagtactgatgctgccgtgcaagagccctcacagctgatttcactggaggaagaaaaccaacgtaaggaatccagcagcttcaaaactgaggatggcaaatcgattctgagcgccttggacaaaggatccactcacacagcatgttccggtccgattgacgaactgctggacatgaaaagtgaggagggagcgtgtttgggcccagtggctgggaccccagaacccgaaggagcggataaggacgatctgctccttctctccgaaatcttcaacgcttcaagcctggaggaaggcgaattctctaaagaatgggctgcagtgtttggcgacggacaggtaaaggagcctgtccccacaatggcactgggcgagcctgaccccaaggcccagacaggatctggttttctgccctcccagctgctcgaccagaacatgaaagatctgcaagccagtcttcaggaaccagctaaagcggcgagcgatttgacagcgtggttcagtctgttcgctgacctggatccactatccaacccggatgctgtcggaaaaactgacaaggagcatgaattgctcaatgcttag

SEQ ID NO: 192013 - DNA, 774 bp, Artificial Sequence
  Description of Artificial Sequence: Synthetic coding sequence
atgagcggccacaagtgcagctacccctgggacctgcaggaccggtacgcccaagacaaaagtgttgtgaataaaatgcagcagaagtactgggaaacgaagcaggcctttatcaaagccaccggcaagaaagaggatgagcatgtggtggccagtgacgcagatctggacgctaagcttgaactttttcatagtattcaaagaacttgtttggacttgagcaaggccatagtgctctatcagaagcggatctgttttttatcccaggaagagaacgaacttggcaagtttctcagatctcagggctttcaggacaaaaccagggccggcaagatgatgcaagctaccggaaaagctctgtgcttctcatcacagcaacgcttagcactgcggaaccccctgtgccggttccaccaggaggtcgagactttccgacatcgggccatatctgatacttggcttaccgtgaaccgaatggagcagtgccggacagaataccggggagcacttctctggatgaaagacgtcagccaggagctggatcctgatctgtacaagcagatggagaagttccggaaagtgcagacccaagtccgattagcaaagaaaaattttgataagctgaaaatggatgtatgtcagaaggtagatttgctgggtgcatcgagatgtaacctcctgagccatatgctggcaacctaccagctggcctgggaccagtggcaagggccaaggaatctcaaggttctgaccaagatgacttgctgttgctag

SEQ ID NO: 192014 - DNA, 1452 bp, Artificial Sequence
  Description of Artificial Sequence: Synthetic coding sequence
atgagcggccacaagtgcagctacccctgggacctgcaggaccggtatgcccaggataaaagtgtggtgaacaagatgcagcagaagtactgggagactaaacaagctttcatcaaggccaccggcaaaaaagaggatgagcacgtagtggccagtgatgctgatttggatgctaagctggagcttttccattccatacagcgcacatgtctggacttgtcaaaagctatcgtactgtatcagaagaggatctgctttctctctcaggaggagaatgaactgggcaaattcctgcgcagtcagggattccaggacaaaactcgggcgggtaagatgatgcaggcaaccgggaaagcactgtgcttctccagtcagcagagattggcgctccggaatcctttatgcagatttcaccaggaggtggaaaccttccgccatcgggcgatctctgacacatggttaacagtgaacaggatggagcagtgcagaacagagtacagaggcgcactactgtggatgaaagacgtcagtcaagaactagatcccgatctctacaagcagatggagaaatttcgtaaggtgcagacccaggtgagactcgcaaaaaagaatttcgacaagctgaagatggacgtgtgccagaaagtggatctattgggggcttccaggtgtaatcttctgtctcacatgctcgctacataccagactactttattgcacttctgggagaaaaccagccacacgatggctgccatccatgagtcttttaagggttaccagccatacgagtttaccaccttgaaaagcctccaagaccccatgaagaaattggtcgaaaaggaggaaaagaaaaagattaaccagcaggagtctactgacgctgcagttcaggagccttcgcagctcatctccctggaggaggagaatcagaggaaagagtcttcttccttcaagacagaggatggaaagtcgatcctcagcgccctggataaggggtctacgcacaccgcatgctccggccccatagacgagcttcttgatatgaagagtgaggagggagcttgcttgggaccagtggctggtacaccggagcctgaaggcgcagataaagacgacctccttcttctctctgaaatctttaacgcctcttccctcgaggagggcgagtttagtaaagaatgggcagccgtctttggcgacgggcaggtcaaagagccggtgccgacgatggcattgggggaaccagacccaaaagcccagacgggatcggggtttctgccatcccaattactagatcaaaatatgaaagacttacaagctagcctccaggaacctgccaaggccgccagcgacctgacggcttggttctccttatttgccgatctggatcccctctcaaaccctgatgccgttggaaagacagataaagagcacgaactgctgaacgcctag

SEQ ID NO: 192015 - DNA, 1452 bp, Artificial Sequence
  Description of Artificial Sequence: Synthetic coding sequence
atgagcggccacaagtgcagctacccctgggacctgcaggaccggtacgcccaggacaagagcgttgtgaataaaatgcagcagaaatactgggagacgaagcaggcatttattaaagccacgggaaaaaaggaggatgagcatgtagtggcctcagacgcggacctggatgcaaaactcgagctctttcatagtatccaaaggacctgcctagatttatctaaagctatcgtcctgtaccaaaaaaggatctgctttttgtcacaggaagagaacgaactagggaaattccttagaagccagggattccaggacaaaaccagggccggtaagatgatgcaagcaaccgggaaggcgctgtgctttagtagtcagcagagacttgccttgaggaatccactgtgccgcttccatcaggaggtggaaacttttaggcacagagcgatttccgatacatggttgactgtcaaccgcatggagcagtgtcgaacagagtataggggtgccttactctggatgaaagatgtttctcaggaacttgaccccgacttgtacaagcagatggaaaagtttagaaaggtacagacacaggtcaggctggccaagaaaaacttcgataaactgaagatggatgtttgccagaaggtggatttactcggcgcatccagatgcaatctccttagccacatgctggctacatatcagaccactttgttacatttctgggaaaaaacttctcatacaatggcagctatccatgagagctttaaagggtatcaaccttacgaattcacaacactaaaatcactgcaggaccctatgaaaaaactggtggaaaaggaagagaagaagaaaatcaaccagcaggagtcaacagacgccgccgtgcaggagccctctcagctgatctctttagaagaggaaaaccaacgaaaagagtctagttccttcaagaccgaggatggcaagagcatcctatctgcattggacaagggtagtactcacaccgcttgttctgggcccattgatgagctactggacatgaagtccgaggaaggcgcctgtctggggcctgttgctggcacgccagagcctgaaggtgctgacaaggatgacttattgcttctgtcagagatcttcaacgcttcttccctggaagagggggaattttccaaggagtgggctgccgttttcggggacggccaggtaaaggagcccgtgcccaccatggccctcggcgaaccggaccctaaggctcaaacagggtccggttttctgcctagccagttattagaccaaaatatgaaggaccttcaggctagtcttcaggaaccagccaaggccgcaagcgacttaacggcgtggttctccctgttcgctgacctggatccactgtccaatccggatgcggtcggtaagacagataaagagcatgagctgctgaacgcctag

SEQ ID NO: 192016 - DNA, 1452 bp, Artificial Sequence
  Description of Artificial Sequence: Synthetic coding sequence
atgagcggccacaagtgcagctacccctgggacctgcaggaccggtatgctcaggacaagagcgtcgtgaacaaaatgcaacagaagtactgggagactaaacaggctttcataaaggcaactggcaagaaagaggacgagcatgttgtagctagtgacgccgacctcgatgctaaactggaactgtttcattcaattcagaggacttgcctagatttatccaaggccatagtcctgtatcaaaagaggatctgcttcttaagtcaggaggagaatgaactgggcaagttcctacgatcacaggggttccaggacaaaacaagagccgggaagatgatgcaggctaccgggaaggcgctttgtttttcgtcacagcagagactggcacttaggaacccgctgtgtaggtttcatcaagaagtggaaacctttcgacatcgtgccatatctgatacttggctcacagttaacaggatggaacagtgcagaaccgaatatcgaggcgctttactgtggatgaaagatgtatcacaggagctcgaccccgacctgtacaaacaaatggagaaatttaggaaagtccagacccaggtccgcctggctaagaaaaattttgataagctcaagatggatgtgtgtcaaaaagtggacttactcggggcttctcgctgtaatttattatctcatatgctggccacttatcagacaaccctgctgcacttctgggagaaaaccagtcacactatggctgctattcatgaatcgtttaaggggtatcagccatacgagttcactactcttaaaagcctgcaagatcctatgaaaaagttggtagagaaggaagaaaagaagaagatcaaccagcaagaatccacagatgccgccgtgcaggaaccgagtcagctgatatcattggaagaggaaaaccaacgaaaggagtctagcagttttaagactgaggacgggaagtcaatcctgtccgccctcgacaagggatccacccacaccgcgtgttcaggaccaatcgacgagctgctcgatatgaagagtgaagagggcgcgtgtctgggtcctgtggcgggaacaccagagcctgaaggggctgataaggatgatctgcttttactctctgagatctttaacgcttctagcctggaggaaggagagttctccaaagaatgggcagccgtgtttggcgatggacaggttaaggagccagtgcccaccatggccttgggcgagccagaccccaaggcacagacaggcagtgggttcctgccgtcgcagctgctagatcagaatatgaaggatcttcaggcctccctgcaggaaccggctaaggctgcgagcgatctgaccgcctggttcagcctttttgccgacttggatcctcttagcaacccggatgccgtgggaaaaaccgataaggaacatgagctgcttaatgcctag

SEQ ID NO: 192017 - DNA, 1539 bp, Artificial Sequence
  Description of Artificial Sequence: Synthetic coding sequence
atgagcggccacaagtgcagctacccctgggacctgcaggaccggtatgctcaggacaaaagcgtcgtcaacaaaatgcagcaaaaatactgggaaactaagcaagcatttattaaagctacaggcaagaaagaagatgagcacgttgtcgccagcgacgccgacctcgacgctaagctggagctgttccattccattcagagaacatgcctcgacttgtccaaggcaatcgtcctgtaccaaaagcgtatttgctttctctctcaggaggagaatgaactgggcaaatttctgagatcgcagggttttcaagacaagactcgtgccggcaaaatgatgcaagcgacaggcaaggcactctgcttctctagccagcagagacttgccctccggaatccactctgtcgattccaccaggaagtggaaacgttccgtcatagagccattagcgatacatggctcaccgtgaaccgaatggaacaatgccggactgaatatcgcggggcactcctttggatgaaagacgtaagtcaggaactagatcctgacctctacaagcaaatggagaaatttcggaaggtgcagacacaggtgcggttagccaaaaagaacttcgacaagctcaagatggacgtttgtcagaaagtggatttgttgggcgcttctcgctgcaacctcttgagccacatgctggccacatatcaaactaccctgctgcacttctgggagaaaacatcacatacaatggctgccatccatgagagtttcaaagggtaccaaccttatgaattcaccaccctcaaaagcctccaggatcccatgaaaaaactggtggaaaaagaagagaaaaagaagatcaatcagcaggaaagcaccgacgccgccgtgcaggaacccagccagtacttacagaacatctgcctggaaatgaaggccaacagtgacatcaaaatgttgcagaaaggaaaggagggccagcaaattggcattctcatcagcctagaagaggagaaccagagaaaggaatctagttctttcaagacagaagacgggaaatctattctgtccgcacttgataagggttccacacatactgcatgttcaggaccaattgatgagcttctcgatatgaagtctgaggagggtgcctgcttaggacccgttgccggcacccccgagccagaaggtgccgacaaggatgatttgcttcttctgtcggagatttttaatgcatctagtttggaggaaggagagttctccaaggaatgggctgctgtgttcggcgacggccaagtgaaggaacctgtgccaacgatggctctgggtgaacccgacccaaaagcacagacagggagtggattcttacccagccagctgctggaccagaacatgaaagacctgcaagctagtctgcaagagcccgccaaggctgctagtgacctcactgcctggttttccctgttcgccgatcttgatcctctgtcaaatcctgacgctgtgggcaagactgacaaggagcacgagttactcaacgcgtag

SEQ ID NO: 192018 - DNA, 405 bp, Artificial Sequence
  Description of Artificial Sequence: Synthetic coding sequence
atgagcggccacaagtgctacccctgggacctgcaggaccggtacgctcaagacaagagcgtcgtgaacaagatgcagcagaagtactgggaaactaaacaggctttcatcaaggcgaccgggaaaaaagaagacgaacatgtggtggcgtctgatgcagacttggacgccaagctggagctctttcactctatccaaaggacttgcctcgacctgtctaaagcaatcgtgctctatcaaaagcggatctgtttcttgtcacaggaggaaaacgagctgggcaaatttctccgctcccaaggctttcaggataaaacacgagccggaaagatgatgcaggcaaccggaaaggccctgtgcttctcctcacaacagcgtcttgccctgagaaaccccttatgctag

SEQ ID NO: 192019 - DNA, 489 bp, Artificial Sequence
  Description of Artificial Sequence: Synthetic coding sequence
atgagcggccacaagtgcagctacccctgggacctgcaggaccggtacgctcaagacaaatccgtcgttaacaagatgcaacagaaatactgggaaacaaagcaagcttttatcaaagcaactggcaagaaggaggacgagcacgttgtggcctccgacgctgatctggatgcgaagttagagctgtttcatagtatccagagaacgtgcctcgatttatccaaagcaatcgtgttgtaccaaaagagaatctgcttcctgagccaggaagagaacgagctgggtaaattcctgcgctctcaagggtttcaagacaagactcgtgccgggaaaatgatgcaagctacagggaaggctttgtgtttttcaagccagcaaaggctagcgcttcgcaatcccctctgtagattccaccaggaggtcgagacattcagacatcgtgccatcagtgatacttggttaacggtcaatcggatggagcagtgctag

SEQ ID NO: 192020 - DNA, 666 bp, Artificial Sequence
  Description of Artificial Sequence: Synthetic coding sequence
atggccgccgcccggcccagcctgggccgggtgctgcccggcagcagtgtgcttttcctgtgtgatatgcaggaaaaatttcggcataatatcgcctattttccccagattgtcagcgtggcagcccggatgctgaaagtggctagactcctggaggtgccggtcatgctgactgagcagtaccctcaaggcttaggcccaactgtgcccgaactgggaaccgaagggctcagacctctcgcgaagacctgttttagtatggtacctgctttgcagcaggagcttgacagtcgaccacagttaaggtctgtgcttttgtgcggaatcgaagctcaggcttgcatccttgacccacggagctatcctggcctggctttgaccagtttgtatccgcagaataccactctggatctgttggacagaggtctgcaggtgcacgtggtcgtggacgcttgttcttccaggagtcaagtcgataggttggttgcattggctcgaatgcggcaatccggggcattcctcagtacaagcgaaggcctgatcctgcagctcgtgggcgacgcggttcacccacagtttaaagagattcagaaactgattaaggagcctgcgccagactctggactcctgggcctatttcaaggtcagaactccttactccattag

SEQ ID NO: 192021 - DNA, 618 bp, Artificial Sequence
  Description of Artificial Sequence: Synthetic coding sequence
atggccgccgcccggcccagcctgggccgggtgctgcccggcagctcagtgttgtttctgtgcgacatgcaggaaaagttccgacacaacatcgcttattttccacagatcgtgagcgtcgcagccagaatgctcaaggtcgctcgcctactcgaagtgcccgtcatgctaactgaacagtatccccagggcctggggcccacggtgccagaactaggcactgaaggactccggccactagctaaaacttgttttagcatggtgcctgccctgcagcaggagctggactcccgccctcagcttcggtccgtgttgttgtgtgggattgaggcgcaagcttgcatcctcaacacaactctggaccttttggaccgaggtttacaggtccatgtggtggttgatgcttgcagctcaagaagccaggtggaccggctggttgcgctggctagaatgaggcagagcggggcctttctgagtacctcggagggtctcattctgcaactggtaggcgacgccgtgcatcctcagttcaaagagatacagaaactcattaaagagccagccccagattcgggactgctggggctgttccagggacagaatagtcttttgcactag

SEQ ID NO: 192022 - DNA, 408 bp, Artificial Sequence
  Description of Artificial Sequence: Synthetic coding sequence
atggccgccgcccggcccagcctgggccgggtgctgcccggcagctctgttctttttctttgcgacatgcaggaaaagttccgccataatatcgcttacttcccccagatcgtgagcgtggccgccagaatgttgaaaaatacaactctagatctgctcgaccgcggactccaagtacatgtggtagttgatgcatgcagctcccgcagtcaagtggatcggctcgtggccctggctcggatgaggcaaagcggtgcatttctgtctacatccgagggtctcatactgcaacttgtgggcgatgccgttcacccacagtttaaagagatccagaagcttatcaaagagccagcccctgattcaggtttactgggcctttttcagggtcagaatagcctcctgcattag

SEQ ID NO: 192023 - DNA, 1101 bp, Artificial Sequence
  Description of Artificial Sequence: Synthetic coding sequence
atggccggccccgcctggatcagcaaggtgagccggctgctgggcgcgttccacaaccctaagcaagttacccggggcttcacagggggagtgcaaaccgtaaccctcatccctggagacggaattggtccagagattagcgcagctgttatgaagatattcgacgccgcaaaagcacccattcagtgggaggagcgtaacgtgaccgctattcagggtcccggaggcaagtggatgatcccttccgaagcaaaagaatcgatggataagaacaagatggggctgaaagggccattgaaaacaccaatcgccgccgggcacccttcaatgaacctcctacttcgtaagaccttcgacctgtatgctaatgtcagaccatgtgttagtattgaaggctacaagactccctacacggacgttaatattgttaccatcagggaaaacacagaaggggaatatagtgggattgagcacgttatcgtcgatggggttgtgcaaagcatcaagcttattaccgaaggagcttccaagaggatcgcagaatttgcattcgaatatgcaaggaataatcacagatctaacgtaacagccgttcacaaggcgaacattatgaggatgtccgacgggttatttctacagaagtgccgtgaagtggcagaaagttgtaaggatatcaaatttaatgagatgtacctggacacggtctgcctcaatatggtgcaagatcctagccagttcgatgtgctggtcatgccaaacctctacggcgatatcctgagcgacttgtgcgcgggactgattggggggctgggcgttacccctagcgggaacattggggccaatggtgtagccatttttgagagcgttcacggcacagcccccgatattgccggaaaagatatggcaaatcctacagctcttctgttgagtgctgtgatgatgctgaggcacatgggtttattcgaccacgcagcccgcattgaagcagcttgttttgccacgataaaggatgggaagagccttacgaaggacctcggtggaaatgctaaatgctcagacttcacagaggaaatctgccgccgggttaaagatttggattag

SEQ ID NO: 192024 - DNA, 774 bp, Artificial Sequence
  Description of Artificial Sequence: Synthetic coding sequence
atgaacctgctgctgcggaagaccttcgacctgtacgccaacgtgcggccatgcgtttcaatcgaaggatacaagaccccctacacagacgtcaatatagtgaccatcagagagaataccgagggagagtactccggcatcgagcacgtgattgtggatggagttgtgcaatcgattaagctgattacggagggcgcgtctaagcgtatcgcagagtttgcgtttgagtacgctagaaataaccatcgttcgaacgtaacagccgtgcataaggctaatatcatgcggatgagtgacggcttgttcctgcagaagtgtcgtgaagtggccgagagctgtaaggatatcaagttcaatgaaatgtatctcgacactgtgtgtctgaatatggtgcaggatccttcacagttcgatgtgctggtcatgcctaacctgtacggagatattttgagtgacctgtgtgcagggcttatcgggggtctgggggtgaccccatccggtaatattggtgctaacggggtcgcaattttcgaatcagttcatggaacggcccccgacatcgctggcaaggacatggcgaatcctaccgctctgctgctgagcgctgtgatgatgctgagacacatgggtttatttgatcacgccgcgaggatcgaagccgcctgttttgcaactattaaggatgggaagagcctcactaaggacctggggggaaacgccaagtgcagtgacttcaccgaggagatctgccgcagagtgaaagaccttgattag

SEQ ID NO: 192025 - DNA, 495 bp, Artificial Sequence
  Description of Artificial Sequence: Synthetic coding sequence
atggccgccctgagcggcgtgcggtggctgacccgggccctggtgtcagcaggtaatccaggtgcgtggcgaggcctgagtacgtcggcagcagctcacgccgcgagccggagccaggccgaggatgtgcgtgtagagggcagcttccccgtgaccatgctgcctggcgacggagttgggccagaactgatgcatgctgtcaaagaagtgtttaaggccgctgcagttccagtggagtttcaggaacaccacctatctgaagtgcagaacatggcctctgaagaaaagctggaacaggtcctctcatctatgaaagaaaataaagtggctattatcgggaagattcatacgccgatggagtacaaaggcgaattagcttcctacgacatgcggttgaggcgaaaactggatctgttcgctaacgtggtccacgtgaagtcactgcccgggtatgattccgcccaacagagcagacctggcgatcatagcagatag

SEQ ID NO: 192026 - DNA, 1158 bp, Artificial Sequence
  Description of Artificial Sequence: Synthetic coding sequence
atggccgccctgagcggcgtgcggtggctgacccgggccctggtgtccgccggaaatccaggagcgtggcgcgggctgagcacatctgctgctgcacacgccgcaagtcgatcacaagctgaggacgtgagggttgagggttcttttcccgtgactatgctgcccggggacggcgtggggcccgaactgatgcatgcggtgaaggaggttttcaaagcggcagcagtccctgtcgaatttcaggagcaccatttaagtgaggttcagaacatggcctccgaggagaagctggaacaagtgctgagcagcatgaaagagaataaagtcgccataattggcaaaatacataccccaatggagtacaagggggagcttgcgtcctacgatatgcgtctgaggaggaaactggatctgtttgccaatgtggttcatgtgaaatccctccctgggtatatgactcggcacaataatctcgacctcgtcatcattagggaacagacggaaggtgaatactcttccctggaacatgagtcggcacgtggtgttatcgagtgcctgaaaatcgtgacgagggcaaaatcacagagaattgcaaagttcgcctttgattatgctacaaaaaaaggacgcgggaaggtgacggccgtgcacaaggccaacatcatgaagctgggggacggactgttcctgcagtgctgcgaagaagtcgccgaactctaccctaagataaaattcgaaaccatgatcatcgataattgttgcatgcagctggtccagaacccttaccagttcgacgtgctggtcatgcccaatctctacggaaacattatcgacaatctggctgctggattggttggcggcgccggagtggtgcccggtgaatcctactccgccgagtatgcggtctttgaaacaggagccaggcacccttttgctcaggccgtgggacggaatattgctaaccccactgcgatgctgctatccgccagtaacatgctccgacacctgaatctagagtaccattcctcgatgatcgctgatgccgtgaagaaggttatcaaggtggggaaagttcgtaccagggatatgggcggttacagcacaacaactgatttcatcaaatctgtgattggacacctgcagacaaaggggtcctag

SEQ ID NO: 192027 - DNA, 1152 bp, Artificial Sequence
  Description of Artificial Sequence: Synthetic coding sequence
atggccgccctgagcggcgtgcggtggctgacccgggccctggtgtccgctgggaacccaggagcatggcggggcttatcaacaagtgcggcggctcatgcagcttctcggagtcaggccgaggatgtgcgagtggagggcagttttccagttaccatgctgccgggcgatggcgtaggacccgagctcatgcacgcagtgaaagaggtgttcaaggcggccgccgtgcctgtcgagttccaagaacaccacttgtccgaagtgcagaatatggcaagcgaagagaagttggaacaggtgttgtcttccatgaaggagaacaaggtcgctatcattggcaaaattcacacacccatggagtacaaaggtgaacttgccagctacgatatgaggctgaggagaaagctcgacttgtttgcaaacgtcgttcacgtgaaatcactgcccggatatatgacccgccataacaacctggacctcgttattatccgggaacaaacagaaggagaatactccagcctcgagcacgaatcagcaaggggggttattgaatgcctcaagattgtcactcgcgcgaagagccagcgcatagccaagtttgctttcgattacgcaacaaaaaaaggaagaggcaaggtcacagcggtccataaagctaacattatgaagctaggtgatggcctgttccttcagtgctgcgaagaggtcgctgagttgtatcccaagattaaatttgagactatgatcatcgacaactgttgtatgcaactggtccagaacccctaccagtttgatgtgcttgtaatgcccaatctatatggcaacatcattgataacctcgccgccggcctagttggaggagccggcgtcgtgcccggtgagtcatactccgcagagtacgcggtgttcgagacaggcgcccggcatccttttgcccaggctgtcggccggaacatagccaaccctaccgccatgctgttatctgcctctaatatgctgcgacacttgaatctcgagtatcactcctctatgattgcggatgccgtgaagaaggttataaaggttggcaaagttaggacaagtgacatgggtggttacgctacctgccacgacttcacagaagcagtcattgctgctctcccgcacccctag

SEQ ID NO: 192028 - DNA, 702 bp, Artificial Sequence
  Description of Artificial Sequence: Synthetic coding sequence
atgaagatgggcgagcggtggagcagcctgttccccttccccgtgtctccctcttgctgtttcctgcttacccagagcgcacggggcgttattgagtgtctgaagatcgttacccgtgccaagtcacagcgaattgccaaattcgcttttgattatgctaccaagaaaggaaggggcaaggtgacagccgtgcacaaagccaacataatgaagctgggtgatggtctgtttttacagtgttgtgaagaggtggccgaactgtatcccaaaataaagtttgaaactatgataattgacaactgctgtatgcagctggtccagaatccttaccagtttgatgtcttggtcatgcctaacctatacgggaatataatcgacaatctggccgccggccttgtcggcggcgcgggagtcgtgcccggcgagtcgtatagcgccgagtatgccgtgtttgagaccggagctcgacacccattcgcccaggctgtaggccgaaacattgccaaccctacagctatgttactttcagccagcaacatgctgcggcacctgaatcttgaataccacagctcaatgatcgctgacgctgtcaagaaagtgattaaggttggaaaggtccgaacaagagacatgggcggttatagcacaacaacagactttataaagagcgttatcggccatttacagacaaaggggagctag

SEQ ID NO: 192029 - DNA, 795 bp, Artificial Sequence
  Description of Artificial Sequence: Synthetic coding sequence
atggagagcggcaagaccgccagccccaagagcatgcccaaggacgcccagatgatggctcagattcttaaagacatgggcatcacggagtatgaacctagggtgataaatcagatgctggaattcgcctttcgctatgtgactactatcctcgacgacgctaagatctactcaagccatgctaagaaggccaccgtggacgctgatgacgtgcggctggccattcagtgcagggctgatcaatcttttacctcccctcccccgagagacttccttctcgacattgctagacagcgtaatcaaaccccactgcccctgatcaagccttattccggcccgaggttgccaccagatcgctactgcctcactgcacctaattatcggctgaagagcctgcagaagaaggccagtacttctgccggcaggatcacagtacctcggctgtcggtgggctcggttacctcccgaccgagcactcccacactcggcacgcccactccacagaccatgtctgtgtccactaaggtcggcacgccaatgtccctgacagggcagcggttcactgtccagatgccgaccagccagagcccagccgtcaaggcatccataccagccacctccgccgtccagaacgtcttaataaaccccagcctaatcgggtctaaaaatattctgatcactaccaacatgatgtctagccaaaacaccgctaatgagagcagcaacgccctaaagagaaaacgagaggatgatgacgacgacgacgacgacgacgatgactatgacaacctgtag

SEQ ID NO: 192030 - DNA, 906 bp, Artificial Sequence
  Description of Artificial Sequence: Synthetic coding sequence
atggccatccggcggaaccgggtggccctgaagggcaacatcgagaccaaccataatctgccacctagccacaaatcaaggaataatattctgagaaccagcctggatctctacgctaatgtcatccactgcaagtccttaccgggagtcgtgacacggcataaagatatcgatatcctgattgtgagagagaatacagagggggaatactcatctttggagcacgaatctgttgctggcgtcgtagaaagcctgaagatcattacgaaagccaaaagtcttaggatcgcagaatacgcctttaaactcgcgcaggagtctgggcgtaaaaaggttacagcagtgcacaaagctaatattatgaaacttggcgacggtctctttctgcaatgctgtcgggaggtggccgcacggtacccgcagatcactttcgaaaatatgatcgtagataacactacgatgcagctcgtctctagacctcagcaattcgacgtcatggttatgcctaacttgtacggtaacattgttaataacgtatgtgccggcctagtgggaggacccggcctcgtggcaggcgctaattatggtcacgtttatgccgtgtttgagactgccacgcgcaatacagggaaatcaatcgccaacaaaaacatagcaaaccctacagcaacactgttagctagttgtatgatgttggatcacctgaagcttcactcttatgccacttctattcgcaaggccgttctggcctccatggacaatgaaaatgggctggtgtgcgccgagccggcatgtgtgctgcagatgcatacacccgacattggaggccagggaacgactagcgaagcgatccaagacgtgataaggcacatccgagtgatcaacggcagagcagtagaagcctag

SEQ ID NO: 192031 - DNA, 1143 bp, Artificial Sequence
  Description of Artificial Sequence: Synthetic coding sequence
atggccctgaaggtggccaccgtggccggcagcgccgccaaggccgtgctaggaccggcacttctttgccggccttgggaggtgctgggggcacacgaggttcccagtcgaaacatcttcagtgagcagacaatcccaccatccgcaaagtatggcggccgacacacagtgaccatgatcccaggggacggaatcggacccgagctcatgctgcatgtcaaatctgtttttcgccacgcctgtgtccctgttgattttgaggaagtacacgtctcctccaacgccgatgaggaggatatcaggaatgccatcatggcaatccggcgcaaccgagttgctctgaagggcaatattgaaaccaaccacaatctacctccgagccacaagtcccggaacaatattctgcggacatcgctggatctgtatgctaacgtcatccactgcaagtccctccctggcgtggttactagacataaggatattgacatccttattgtccgggaaaacacagagggcgagtattcatccctcgaacatgagtctgtggcaggcgttgtggagtcgttaaaaattatcacgaaagctaagtcactccgtatagcagagtacgcattcaagctggcacaggaaagcggcagaaagaaagtgacagcagtgcacaaggccaacattatgaaactgggcgacgggctgtttctgcagtgctgtcgggaagtggccgccaggtacccccaaattacctttgagaacatgatcgttgataacaccactatgcagttggtctcccgtccacaacagtttgacgtaatggttatgccaaatttgtatggcaacatagtaaacaacgtctgtgcaggtctagtggggggcccaggcctggtggctggtgcaaattatgggcacgtttacgccgtattcgagaccgcaacccgcaacactgggaagtccatcgccaacaagaacatcgccaacccaaccgcgacgctgttagcgtcatgcatgatgttggaccatctgaaactgcacagttatgccacctccatacgaaaggccgtcctcgcttctatggataacgaaaatgtccgcttcccttctcacccgacgctgttaccccggccggtttcaccctgtagcctgctctag

SEQ ID NO: 192032 - DNA, 525 bp, Artificial Sequence
  Description of Artificial Sequence: Synthetic coding sequence
atgtacaccttcgaccaggccaccggcggcaccgcccagttcgaggcccactcagatgctcaggccttggtccttctggatgtcactcctgaccagagcatggtggatgagggaatggcaagggaggtgattaacagaatccagaagcttagaaaaaagtgtaacctcgtcccaactgacgaaatcaccgtatattacaaggcgaaatctgagggtacctatttgaattcagtgattgagagccacacagaattcatttttacaacaatcaaagctccactgaaaccttaccctgtaagcccgtcggataaagtcctgattcaggagaaaacccagctgaagggtagtgagttagaaatcaccctgactcgtggctccagcctcccaggtccagcatgcgcctacgtgaacctgaacatttgtgccaatggatctgaacagggcgagatgcagtggattatccctgaaatttaccatttctggaagcctcgatggtcaattgccccaggaaagtcaaagaggtag

SEQ ID NO: 192033 - DNA, 525 bp, Artificial Sequence
  Description of Artificial Sequence: Synthetic coding sequence
atgtacaccttcgaccaggccaccggcggcaccgcccagttcgaggcccacagcgatgctcaagcattggttctgttagacgtgactccggatcagtcaatggtggatgaggggatggctcgagaagtcattaatagaatccagaaactgaggaaaaagtgtaatctggtgcccacggatgaaataaccgtatactacaaggcaaagagcgagggaacgtatctgaacagtgtgattgagtcccatactgaattcatattcactacaatcaaggctccactaaaaccctacccggtgagtccctcagacaaagtgctgatccaggaaaaaacccagttaaaaggatctgagctggagattactctgacccgcggttcttcacttcctgggcccgcgtgcgcctatgtgaatctgaacatttgcgccaatggttcagaacagggagagatgcaatggatcatcccggagatttaccacttttggaaacctaggtggagcattgctcccggcaaatcaaagcggtag

SEQ ID NO: 192034 - DNA, 3789 bp, Artificial Sequence
  Description of Artificial Sequence: Synthetic coding sequence
atgctgcagcaggtgcccgagaacatcaacttccccgccgaggaggagaaaatattggaattctggaccgagttcaactgttttcaggaatgtttgaaacagtcaaaacataagccgaaatttaccttttatgacgggccgcccttcgcgaccggcctaccccattacgggcatatcctggccggaacgattaaggacatcgtgacaagatacgctcaccagagcgggtttcacgttgaccgtcggttcggttgggactgtcacggtctccctgtggagtacgaaattgataaaacgctcgggatcagaggccctgaagatgttgctaagatggggatcacagaatacaataatcagtgtcgcgctatagttatgcgctatagcgcagagtggaagtctacagtcagcaggctggggagatggatcgacttcgataatgactacaaaactctgtaccctcaatttatggaaagtgtctggtgggtattcaaacagctctacgataagggactcgtgtaccgaggtgtgaaagtcatgccgtttagcaccgcctgcaacaccccgctctcgaactttgagagccaccaaaattacaaagacgtccaggacccctcagtgttcgtcacattccctctggaggaggatgagacagtgtcgctggtcgcctggacgactaccccctggacgctgccaagcaacctcgccgtgtgcgtcaatcctgaaatgcaatacgtgaagatcaaagatgtggcgagaggtcgactgttaatattaatggaagcccggttatctgccctttacaaacttgagtccgattacgagatcctggaacgctttcccggggcctacctgaagggcaagaagtacaggcctctattcgattactttttgaaatgcaaggagaacggagccttcaccgtacttgtggataactacgtcaaagaagaagaaggaactggagtggtgcaccaggcaccttactttggcgcggaagactatcgggtatgcatggattttaacattattcgaaaggattctctgcctgtctgccccgtggacgctagtggctgctttacaacagaggtcacggattttgccgggcaatacgtgaaggatgcagataaaagcataatcaggacccttaaagagcaaggccgtttactggttgctaccacattcacccacagctatcctttctgttggaggagtgacactccacttatttacaaagcggttcccagctggtttgtgagggtcgagaatatggttgaccagcttctgagaaataatgacctgtgttactgggtccccgaacttgtcagagagaaaagatttggtaactggctgaaggacgcccgggattggactatctcaagaaataggtattggggtacccccatccccctttgggtgtccgacgactttgaggaggtggtatgtatcggtagtgtggccgagctagaggagctgagcggcgccaagatttcggacctgcatagagagtctgtggaccacctgaccataccctctcgatgcgggaagggcagccttcacaggatatcagaggtttttgattgctggtttgaaagcgggtctatgccatatgcacaggtacactacccattcgagaataaacgggaattcgaagatgcttttccagctgactttatcgctgaaggtatcgaccagacacgtggatggttttataccctcctggtgttggctaccgcgttgtttggccagccccccttcaaaaacgtgatcgtgaatggattagtgctagccagcgacggacaaaaaatgagcaaaagaaaaaagaattatcccgaccccgtaagcatcatacagaagtacggcgcagacgccctgcgtctatatctcattaactctcccgtcgtgagagctgagaatttgcgctttaaagaagagggggttcgtgatgttttgaaagatgtactcctgccctggtataatgcctaccggtttctgatccagaacgttctgcggctgcaaaaagaagaggagattgagttcctctataatgagaacactgtccgggaatctcccaatattaccgacaggtggatcttatccttcatgcagtccctgatcggattcttcgaaacagaaatggcagcgtacaggttatacactgtcgtgccacggctcgtgaagttcgtggatatcttaacaaactggtacgtcaggatgaacaggcgtcgacttaaaggggaaaatggcatggaggattgcgtgatggctcttgagacattgttcagcgtgctcctctcgctgtgccgcctcatggctccatatacgccatttctgacagagttgatgtaccaaaatttaaaagtcctgattgatcccgtgtctgtgcaagacaaggacactctcagtattcattacctaatgctgccccgtgtgagggaggagttaatcgataagaaaacagaatctgctgtcagccagatgcaatccgtgatcgaactggggagagtgataagagacagaaagaccattcctattaagtacccactcaaagagatcgtcgtcattcatcaggatcccgaagccctcaaggacattaagtcattagaaaagtatattatcgaggaattgaatgtgcgaaaggtcactctgtccacagacaagaacaaatacgggatccgtctccgagccgaacccgatcacatggttctgggcaaacgtctgaagggtgcttttaaagcagttatgactagtatcaaacaactctcttcagaagagctcgagcagttccagaagacgggcacaattgtagtcgaaggccatgaactgcacgacgaagacattagactgatgtacacctttgatcaggctactggcggcactgctcagttcgaggctcacagcgatgcacaggccctggtgctgttggacgtgaccccagatcagagcatggtcgacgagggaatggcgagggaggtgattaaccgaatccaaaagttgaggaagaagtgtaacctggtacctaccgacgaaataaccgtgtactacaaagccaagtcagagggaacatacctgaactcagtgatagagagccacacagagtttatctttacaacgatcaaagctcccttaaaaccataccctgtgagtccctcggacaaggtgctcatccaggaaaagacccaacttaaaggttccgaactcgaaatcactttgacaagggggagctctctgcccggcccagcttgtgcctatgtgaatctcaacatttgtgcaaacggctcggagcagggtggcgtccttctgctcgagaatcccaagggcgataataggcttgacctcctaaagctgaaatcagtggtgacttccattttcggggtgaaaaataccgagctggctgtgttccatgatgagaccgagattcagaatcagaccgacttgctgtccctctcgggaaagacattatgtgtgactgccgggtctgcaccctctcttatcaattcatctagcaccctgttgtgccaatacatcaacctccagcttctgaacgcaaaaccccaagagtgtctgatgggcaccgtgggaaccctcctgttggaaaatcccttgggccagaacgggcttacgcatcagggcctgctgtatgaagcagccaaagtgttcgggttgaggtcccggaaactaaagctctttctgaatgagactcaaacccaggagatcaccgaggatatccctgtcaaaaccttgaatatgaaaacagtttatgtgagcgttttaccgacgacagccgacttctag

SEQ ID NO: 192035 - DNA, 3729 bp, Artificial Sequence
  Description of Artificial Sequence: Synthetic coding sequence
atgctgcagcaggtgcccgagaacatcaacttccccgccgaggaggaaaaaatcctggagttttggactgagtttaactgtttccaggaatgcctgaaacagagcaagcacaaacccaagttcacgttttatgacggccctcccttcgctactggcctcccccactacggccatatcctggctggaacgataaaggatatcgtaaccagatatgcccatcaatcgggcttccacgtggaccgccggttcggctgggactgtcacgggttgccagttgaatacgagatcgataaaactttgggtatacggggaccagaggacgtggctaaaatgggcattacagaatacaataaccagtgtagagcaattgtgatgcgctactccgctgagtggaagtcaaccgtatccagacttggacgatggatcgacttcgacaacgactacaagaccttatatcctcaatttatggaatccgtttggtgggtttttaagcaactttacgataaggggctcgtgtacagaggggtgaaagttatgccctttagcaccgcctgcaacacacccttatcgaacttcgagtctcatcaaaattataaggatgtgcaagatccatccgtgttcgtcacattccccctggaagaagacgagaccgttagtctggttgcctggacgacgaccccttggaccctcccttccaacctggccgtttgtgtgaatcctgagatgcagtatgtcaagattaaggatgtggcccgaggaagactgcttatcctaatggaagcacgtctgtcagctctgtataagcttgaatcagattatgaaattctggaaaggtttcctggggcctatctcaagggaaagaagtatcggccactgttcgattacttcctgaaatgtaaagagaacggggcattcacagtgctcgtggataattatgtgaaggaggaggaggggaccggggtcgtgcaccaggccccttactttggggccgaagactatagagtttgcatggatttcaacattatcaggaaagactctctaccagtgtgtcctgtggacgcctctggttgcttcactaccgaagtgacggattttgccggccagtatgtcaaagatgctgacaaaagcattatccggaccctgaaggagcaaggcagactcctggtggctactacgttcacccactcttaccccttttgctggagatccgacacccccctgatttacaaggccgtgccctcctggtttgtccgagttgagaatatggtagatcagctacttcgcaataatgacctatgctactgggtgccagagctggtgcgcgagaaacgctttggcaactggctgaaggacgcccgggactggaccatctcgcgaaatcgttactgggggacacctatacctctgtgggtatcggatgattttgaagaggtcgtatgtataggatctgtggcggaactggaagagctcagcggagccaagatatccgacctacacagggagtctgtcgaccatctaaccattccttctcgctgtgggaaggggtccctacatcggatctccgaagtatttgattgttggtttgaaagcgggtctatgccgtacgcacaggtccactatccttttgaaaataagagagagtttgaagatgcgttcccagccgattttattgctgaaggaatcgatcagacgcgagggtggttttatactctcttggtactcgctaccgcactctttggccagccccctttcaaaaacgttattgtgaatgggctggttctggcatcagacggccagaaaatgtccaaacggaagaaaaattatcccgacccggtctccataatccagaagtatggggcggatgccctgaggctatatctgattaatagccctgttgtgagggctgagaaccttaggttcaaggaggagggcgtgagggacgtgctcaaggacgtgctattgccctggtataacgcctatcgattcttgattcaaaacgtcctcaggttgcagaaggaggaagaaattgaattcttgtacaacgaaaacaccgtccgggaaagcccaaatatcactgatagatggatcctctcttttatgcagtcactgattggcttctttgagacagaaatggcagcttatagattgtatacagtggtcccaaggctggtgaagtttgtggatatactgacaaactggtatgtgcgcatgaacaggaggcgcctgaaaggtgagaatgggatggaagactgcgtgatggcactggaaacactgttcagtgtgcttttaagtttgtgtaggttgatggctccctatactcctttcctaacggaactcatgtaccaaaatctgaaggtccttatcgatccggtgtccgtacaggacaaagacacactctccatccactacttgatgctacctagagtgcgcgaggagctaatcgataaaaaaacagagtcggccgtatcccagatgcagagtgtgatcgaactggggcgagtgattagagaccggaagaccataccaataaagtatcctctgaaggagatcgtagttattcatcaggacccagaagctctgaaggatataaagtctctggaaaaatatatcatcgaagagttgaatgtgaggaaagtcaccttgagcaccgacaagaataagtatggaatcagactgagagcagagcctgatcacatggtgttggggaaacgcctcaaaggagccttcaaggccgttatgacatctataaagcaattgtccagtgaggagctggaacagtttcaaaagacaggaaccatagtggtggagggccatgagttacatgacgaggacattcgactgatgtacacgttcgatcaggccactggcggcacagcccagttcgaggctcactctgacgcccaggccctggtcttgctggacgtcaccccagaccagtcaatggtagatgagggcatggcgagggaggtcataaacagaattcagaagcttcgcaagaagtgcaacctggtcccaacagatgagattaccgtgtactacaaagcaaagtctgagggcacctatttgaacagtgttatagagtcccacaccgaatttattttcaccactatcaaggcgccactcaagccctacccagtgtccccttctgacaaggtgctcatccaagagaagacacaactgaagggttcagagctcgaaataaccctcactcgcggctccagcctgcccggtcctgcatgtgcctatgtcaatctcaacatctgcgcgaacggctcagaacaaggtggcgtcctgctgcttgagaatccaaagggagacaatcgtctggatttgcttaagttgaaatcagttgtcacctcgatatttggggtgaagaatacagagttagccgtgttccacgatgaaactgaaatccaaaaccaaaccgatttactatcactgtcaggtaagactctctgcgttactgcaggaagtgcccccagtctgatcaactcctcatccactttgctttgtcagtacattaatcttcagcttcttaacgctaagccccaggagtgcctgatggggaccgtggggaccctgctgttagaaaatcccctgggccagaacggactgactcatcagggcttactctacgaggcagccaaagtttttggcctccgcagcaggaaactgaaactcttcctgaatgagacacagacacaagaaattactgaagacatcccttag

SEQ ID NO: 192036 - DNA, 993 bp, Artificial Sequence
  Description of Artificial Sequence: Synthetic coding sequence
atgctgcagcaggtgcccgagaacatcaacttccccgccgaggaggaaaagatccttgaattctggacggagttcaattgcttccaggagtgtctgaagcagtctaagcacaaaccaaaatttactttctatgacgggccacccttcgctacaggactcccccactacggccacatactggctggaaccatcaaagacatcgttactcggtacgctcaccagtctgggtttcatgttgacaggcgattcggctgggactgccatgggcttcccgttgagtatgaaattgataagacactgggcattagggggcccgaggatgtggcaaagatggggattacagaatataacaaccagtgccgggccatcgtaatgcgctattcagctgagtggaagtccaccgtgagcaggcttggtagatggattgacttcgataatgattataagaccttgtatccccagtttatggagagtgtctggtgggtttttaagcagctttatgacaaagggctcgtgtaccggggtgtgaaggttatgcccttttcaaccgcatgtaacaccccactgtccaattttgagtcacaccagaactataaggacgtgcaggacccttcggtattcgttactttccccttggaagaggatgagacggttagcttggtagcctggacgactaccccttggactctaccaagcaatttagccgtgtgtgttaaccccgaaatgcagtacgtgaaaatcaaggacgttgcccgaggtcggctcctgattctaatggaggccagactgagcgccttgtacaaactggagtcggattatgagattctcgagcgtttccccggcgcttatctgaagggaaaaaagtaccgacccctgtttgactacttcctcaaatgtaaagaaaacggcgcctttaccgtgttggtggacaattacgtcaaagaggaggaggggaccggcgtggtgcatcaggcaccatacttcggcgcatag

SEQ ID NO: 192037 - DNA, 513 bp, Artificial Sequence
  Description of Artificial Sequence: Synthetic coding sequence
atggccccctacacccccttcctgaccgagctgatgtaccagaacctcaaggttctgattgacccagtgagcgtccaggacaaggataccttaagcatccattacctgatgctaccacgcgtgagagaagaactcattgacaagaagaccgaatccgctgtgtcacaaatgcagtcagtgatcgagctaggaagagtgattagggatcgaaaaaccatcccaattaaattgaaaggcagcgaattggagatcacgctgacccgggggagctcattacctggtcctgcttgcgcatatgtgaacttgaatatctgcgctaatggttccgaacaaggaggtgtgctgttgcttgaaaaccccaagggggacaaccgtctcgatttactcaagcttaaatcagtggtgacctcgatattcggtgtcaagaatacggagttagcagtgttccacgacgaaacggagatacagaaccagaccgacttgctcagtctttccggcaaaacactgtgttag

SEQ ID NO: 192038 - DNA, 3789 bp, Artificial Sequence
  Description of Artificial Sequence: Synthetic coding sequence
atgctgcagcaggtgcccgagaacatcaacttccccgccgaggaggaaaaaatcttggagttctggactgagtttaactgttttcaggaatgtttgaagcaatccaaacataagccaaagtttacgttctacgacggcccccctttcgcaaccggccttccacactacgggcatatcctggctggcactattaaggatattgtaactcggtatgcacatcagtcagggtttcatgtagacaggaggtttgggtgggattgccatgggctgcctgtggagtacgagatcgataaaacgctcggaattcgcggaccggaggatgtggccaaaatgggaataacggagtataacaaccaatgtcgagccattgtgatgaggtacagtgcggaatggaagagtacagtgtctcgtctgggacgctggattgattttgacaatgattataagaccttgtacccacagtttatggagagtgtctggtgggtcttcaaacagttgtacgataagggcctggtgtatagaggagtgaaagtgatgcccttttctacagcatgcaacactcccctgtctaactttgaaagccaccagaactacaaagatgtgcaagatccttctgtcttcgtgacattccccctggaggaagatgagactgtaagtctagtcgcctggactactacgccctggacgcttccatcaaatttggctgtgtgtgtgaatccagaaatgcagtacgttaagataaaagacgtggccaggggtcgcttactcatcctcatggaggcccggctctcagcgctgtataagttggaatccgactacgagatcctggagcggtttcctggagcttaccttaagggtaagaagtataggcccctgtttgactactttttgaaatgtaaagagaacggcgcttttaccgtgctcgtcgataactatgtgaaagaagaggagggtacaggcgtcgtgcatcaggcaccttatttcggtgctgaggactatagggtttgcatggatttcaacattattaggaaagactcactgccggtctgccctgttgacgcctcaggctgcttcaccaccgaagtgactgactttgcagggcaatacgtcaaagatgctgacaaatcaattatcaggactctcaaggagcagggaaggctgcttgtagctaccacctttacccattcctaccccttttgttggcggagcgatactcctcttatctataaagccgtgccatcctggttcgtgcgagtcgagaacatggttgatcagctgctgcgaaataacgatttgtgctactgggtgcccgagttagtgcgagagaagcgcttcgggaactggctgaaggatgcacgcgactggaccatctcgaggaaccgctattgggggacacctattcctctttgggtgtccgacgattttgaagaggtggtctgcattggctcggtcgcagaactggaagaattatccggcgcaaagatatcagaccttcatcgtgagagtgtggaccatctgacgattccgtcgcgctgtggaaaaggtagtctgcataggatcagcgaagtcttcgattgctggtttgagagcgggagtatgccatatgcccaggttcattaccccttcgagaacaaacgggagtttgaggacgcgttccctgcggacttcatcgctgaagggattgaccagaccaggggctggttttacacattgctggtgctagcaactgccctatttgggcaaccaccctttaaaaatgtcatagtgaatggcttagttttggccagcgacggccagaaaatgagcaagcgaaaaaaaaattatcctgatcctgtgtcaatcatccagaaatacggagccgacgcattgaggctgtacctgattaatagtccagtggtgcgcgctgagaaccttagatttaaagaggagggggtgcgggatgtcctgaaagacgtcctgctcccgtggtacaacgcgtatcggtttcttatccagaatgtcctgagactgcagaaggaagaagagattgagttcctgtacaacgagaacactgtccgggagagcccaaacatcacagaccggtggatcctcagttttatgcaatcgctgatagggtttttcgagacagagatggcggcctaccgactatacactgttgttccacggctcgtgaaatttgtcgacatcttaaccaattggtatgtgcggatgaatcgccgaagactgaagggggaaaacggcatggaggactgtgtgatggcactcgagaccctcttctctgtgctgctcagcctttgtcgcctgatggcaccttataccccattcctaacagaactgatgtaccagaacttaaaggtcttaattgatcccgtgagcgtccaggacaaagacacactgagcatccactatttaatgctcccacgggtccgggaggagcttattgacaagaagacagaatctgctgtgtctcaaatgcaatccgtcatagaactcggaagggtgatcagggaccgcaaaactatccccatcaaataccccctgaaggagatagtggtgatacatcaggaccccgaggccctgaaggacatcaagtcgcttgaaaaatacatcattgaggaactgaatgtgcggaaagttaccctaagcaccgataagaacaaatacgggattcgcctgcgggcagagcccgatcatatggtgctcggcaagcgcctcaaaggcgcgtttaaggcagtcatgaccagtatcaaacagctgtcaagcgaggagctggagcagttccaaaaaacaggtaccatagttgtggagggtcatgagctgcatgacgaggacattagactgatgtacacattcgaccaggctacaggcggcaccgcccagtttgaggctcatagtgacgcccaggctttagtgttgctggatgtgacacccgatcagagcatggtggacgagggcatggcccgcgaagtgatcaaccgtattcagaaactccgaaagaagtgtaacttagtccccaccgacgagatcaccgtgtactataaagccaagtcagagggcacctacctgaactctgtgatagaatctcacacagagttcatattcactaccataaaggctcccctgaagccatatcccgtttctcccagcgataaggttcttattcaagagaaaacacagttaaaaggcagcgagctggaaattaccctgacgcgggggtcttctctgcctgggcccgcgtgtgcttatgttaacctcaacatttgcgcgaacgggtctgagcagggtggagtgttgctattggaaaaccctaagggagacaatagactagacctattgaagcttaagagtgtggtgacttcaatttttggcgtgaaaaacaccgaattggctgtgtttcatgacgaaactgaaatccagaaccagaccgacttgctgtccttatccgggaagacactctgcgtgacggcaggttccgcaccatctctgattaactcaagctccacgctcctctgtcagtatataaacttacagcttttgaacgctaaaccccaggagtgtctcatgggcactgtcggcacgctgctcctcgagaatcccctgggccagaatgggcttacgcaccagggactcttatatgaggcggcgaaagtttttggcctgagaagcagaaaattaaagctgtttctgaacgagacccagacccaggagatcacagaggacattcctgtcaagacgctgaatatgaagaccgtgtacgtgtctgtgttgcctactactgcagatttctag

SEQ ID NO: 192039 - DNA, 3459 bp, Artificial Sequence
  Description of Artificial Sequence: Synthetic coding sequence
atgggcatcaccgagtacaacaaccagtgccgggccatcgtgatgagatacagtgccgagtggaagtcgaccgtgagtagactggggagatggatcgatttcgataacgactataaaacactctatccacagtttatggagtccgtgtggtgggtgttcaagcagttatatgacaaaggactggtttacaggggtgtcaaggtgatgccttttagcactgcctgcaacactccgctttctaatttcgagtcacaccagaactacaaagacgtccaggatccttccgtgtttgtaaccttccccctggaggaagacgaaacagtttcgcttgttgcatggaccacaacaccatggacattaccttctaatttggcggtgtgtgtcaatcccgagatgcaatatgtgaaaattaaagacgtcgctcggggaaggttactgatcctgatggaggcccgccttagtgccctatataaactggagtcagactacgaaattctggagcgctttcccggcgcttacctcaaggggaagaaatacaggccgctgttcgactattttctaaagtgcaaagaaaacggtgcctttacagtcttggtggataactatgtcaaggaagaagaagggacaggcgttgtccaccaggcaccctattttggcgcagaagattatagggtttgcatggatttcaatattataaggaaggattcacttcccgtttgccccgtcgacgccagtgggtgcttcaccaccgaagtaaccgatttcgcaggccagtacgtcaaagatgcagacaagtccatcatacggaccttaaaggaacaggggaggcttctggtggccactacatttacccacagctaccccttttgctggaggtccgacacccctcttatctataaggcggttcctagctggtttgtgagagtggaaaacatggtggaccagctgctccggaataatgatctgtgttattgggttcctgaattagtgagagagaaacgctttgggaactggctgaaagatgcgcgggactggactatcagtcgcaaccgatactggggaaccccaatcccactatgggtgtccgatgattttgaggaggtagtgtgtatcgggtctgtggccgaactagaagaattgagtggcgccaagatctcagacctacacagggagagcgtggaccatctgaccatcccttcgcggtgtggtaaaggctcactccacagaatctcagaggtgttcgattgttggtttgaatccggctctatgccctacgcacaagtacactatccttttgaaaacaagcgcgagttcgaagatgcgttccctgctgattttatcgcagagggcatcgaccagactagagggtggttttacacccttctggtcctcgctacggcactattcggacagccgccattcaagaacgtcatcgtgaacggtttggtcctcgcgtccgacggccagaagatgtccaagaggaagaaaaactatcccgacccggtgtctatcatccagaaatatggcgcggatgcccttagactttacctcataaatagccccgtggttagggctgaaaatttgagattcaaggaggaaggtgtgagagatgtgctcaaagatgtgctgctgccctggtacaacgcttatcgttttctcattcagaacgttttgaggctccagaaggaggaggagatagaattcctctataacgagaacactgtcagagagagccccaatatcaccgacagatggatactgtcctttatgcagtccctgatcggattttttgagacagaaatggcagcctatcggttatacacggttgtgccaagattagtgaagttcgtggatattctgaccaactggtacgttcgcatgaaccgacgtagactcaaaggggaaaatggaatggaggattgcgtgatggccctcgaaacattgtttagtgtattactgtcactctgtcgcctaatggctccatatacccctttcctcactgagctgatgtaccagaatttgaaagttcttatcgatcccgtgagcgtgcaggacaaggataccctgtcgattcattatctaatgctgccacgcgtgcgggaggaattgatagataaaaaaactgaatccgcagtgtcccaaatgcagtcagtcatcgagctgggccgagtgatccgcgataggaagacaatccccatcaaatacccactgaaagagattgtggtgatccatcaggaccctgaggcactgaaagatatcaaatctctcgagaaatacatcatcgaagaactgaacgtgagaaaagtgactctatccacagataaaaataaatatggcataagactcagagctgaacccgatcacatggtgttagggaagaggctgaagggagcattcaaagctgtcatgacatcaattaagcagttgagtagtgaggaactggagcagttccaaaaaactggcactatcgttgtggagggtcacgagttgcatgacgaagatatcagactgatgtacacctttgatcaagctaccggaggcaccgcacagtttgaggctcacagtgatgcacaggctcttgtactgctggacgttacccctgaccagtctatggtagatgagggcatggcccgcgaagtgatcaacagaattcagaaactgaggaagaaatgtaacctggtgccaacagatgaaatcaccgtgtactacaaggcgaagtcggaagggacataccttaattccgttattgagtcacataccgagtttatattcaccactatcaaggccccacttaaaccctatccagtgtccccctctgacaaagtgctcatccaggagaaaactcagttaaagggctcggagctagagattactttgacacggggaagcagcttgccaggcccagcttgcgcatacgtcaatttgaacatttgtgcaaacgggtccgaacaaggcggtgtgctgctgctggaaaaccccaagggggataatcgcctggatctactcaaactgaaatccgtcgtcacttccatcttcggcgtgaagaacactgagctcgcggtctttcacgacgagacggagatacagaatcagactgatttgctgagtctcagcggcaagacactatgcgtgaccgccgggagcgccccttctctgatcaattctagtagtaccctgttatgtcaatatattaacctgcagctgctgaatgcaaagccccaggagtgtttgatggggacagtgggaacgttgctgttggaaaaccccctgggacagaatggcctgacacaccaaggcctcctgtacgaggccgccaaagtattcggactgcgctcacgcaagcttaaattatttctcaatgaaacacagacccaagaaattactgaggacatcccagtgaagactctgaacatgaagacagtctatgtctccgtgctcccgacaaccgcggatttttag

SEQ ID NO: 192040 - DNA, 750 bp, Artificial Sequence
  Description of Artificial Sequence: Synthetic coding sequence
atggccccctacacccccttcctgaccgagctgatgtaccagaacttaaaagttttgatcgacccagtgagcgtgcaggacaaagatactctgtctatacactacctgatgttacctcgcgtgagggaggagctaatagacaagaaaactgagtctgccgttagccagatgcagtccgtgattgaactgggccgcgttatccgggacaggaagacaattcctataaagtatcccctcaaggagatcgttgtcattcatcaggaccctgaggccctgaaggatattaaatccctcgaaaaatacattatcgaagagcttaatgtgagaaaagtcacattgagtaccgataagaacaaatacggcattaggttgagagcagagccagatcatatggtgctcggtaaaaggttaaagggcgctttcaaggccgtcatgacctcgattaagcagcttagctcagaggaattggagcagttccaaaaaacaggaactattgtggtggaggggcacgagctgcatgatgaagacatccggttgatgtatacattcgaccaggccacaggtggtacagcccaattcgaggctcattctgacgcacaagcactcgtgctgttagacgtcaccccagatcaatccatggtggacgaagggatggcgagagaggtaattaataggattcagaaactgcgcaagaagtgcaatttggttccaaccgacgagattactgtctattataaagcaaaatcttag

SEQ ID NO: 192041 - DNA, 513 bp, Artificial Sequence
  Description of Artificial Sequence: Synthetic coding sequence
atggccccctacacccccttcctgaccgagctgatgtaccagaacctgaaggttctcatcgaccccgttagcgtgcaggataaggatactctgtcgatacactacctaatgctgccccgggttagggaagagctcattgataaaaaaactgaatcagccgtatcccagatgcaatccgtgattgagctggggagggtcattcgagacagaaaaacgatacccattaaattaaagggatctgagctggagattacgctgactcggggctcatccctccctggcccagcttgtgcatacgtgaacctaaatatctgtgccaatggctccgagcaggggggagtgctgctcttggagaaccccaagggcgacaataggctggacctgcttaagctcaagtctgtagttacctctatctttggcgtgaagaacaccgaactggccgtgttccatgatgagaccgagattcaaaaccagacggatctgctatctctgtctggtaaaaccctctgctag

SEQ ID NO: 192042 - DNA, 816 bp, Artificial Sequence
  Description of Artificial Sequence: Synthetic coding sequence
atgatggtgctgctgctgcagctggactgcctgaccatggacatctatctccgagacaaagacactctgtctatccattacctgatgctgcccagagtccgtgaggaactgatagataaaaaaaccgaaagcgctgtgtcgcaaatgcaatctgtcatagaattaggccgcgtgattcgtgacagaaaaactattcccatcaaattaaagggctcagagctggagattacactcacgcgcgggtcttcactccccgggcccgcttgcgcatatgtgaacctaaatatatgcgctaacggttctgaacaggggggggttctgctcttggagaaccctaagggggataacagactggacctgctaaagttgaagtcagtggtgaccagcatcttcggcgtcaaaaatactgagctcgccgtgtttcatgacgagactgagatccaaaatcaaacggacttgcttagcttgagtggtaaaacactgtgtgtgacagccggatccgccccgtctctcattaatagctcatccaccctgctgtgccaatatattaacctgcagctcctgaacgccaagcctcaggaatgcctgatgggtacagtcggcaccctgctgctggagaatccactgggtcagaatggcttgacgcatcaaggactgctctacgaagctgcaaaagtgtttggtctccgctctcgaaagttgaaactctttctgaacgagacccagacccaagagatcactgaggacattccggtgaaaacactcaatatgaaaacggtctacgtgtctgttctgcctactacagccgacttttag

SEQ ID NO: 192043 - DNA, 3039 bp, Artificial Sequence
  Description of Artificial Sequence: Synthetic coding sequence
atgcggtggggcctgcggccccggggccccggcgccgccgccctggccactgcccgctccctttggggcacgccacgactgccttgcagtcctgggtggcagggcgctacaaagagactgctggttcggagcgttagcggcgcctcgaatcatcagcccaactccaattccggaagataccgcgatacagtgctgcttccacagacctcttttccaatgaagttgttaggacgccaacagccagataccgaactggagatccagcaaaagtgtggcttcagcgagctgtactcctggcagcgtgaaagaaaagtgaagacagagttctgtttgcacgacggtcccccctatgccaatggtgaccctcacgttggccacgcactgaacaagattctcaaggacatagccaacagattccacatgatgaacggcagcaaaatccacttcgttccaggctgggactgccacggcctgccaatcgagattaaagtcctcagcgaactcggccgcgaggctcagaatctgtctgccatggaaatccggaaaaaggcacgtagctttgcaaaggccgccatcgagaaacagaagagcgcgtttataagatggggcatcatggcagactggaataactgttactacaccttcgacggtaagtacgaagccaagcagctccgcacattttatcaaatgtacgataaaggtctggtatacagatcgtataagcctgtgttctggtctccatcctctcgcacagcccttgctgaggctgaactagaatacaatcctgagcacgtaagccggtctatatatgtgaagtttccattgcttaagccatctccaaaactggcgtcactgatcgacggtagctcccccgtgagcatattagtttggaccacccagccttggactattcccgcgaatgaagcagtgtgctacatgcccgagtccaagtacgccgtcgtgaaatgctccaagtcaggggacctttatgtcctggccgccgataaagtcgccagtgtagcttccaccctggaaaccacctttgagacaattagtacccttagtggcgtggacttggaaaacggaacctgttctcatccacttatccctgacaaagcgtcgccactgctgcctgccaatcatgtaaccatggctaagggtacaggtctggtccacacagccccagcccacgggatggaggactacggcgtggccagtcagcataacctacccatggattgcctggtggatgaggacggagtgttcactgatgtcgccgggcccgaactgcagaataaggccgtcctggaggagggcacagacgtggtcattaagatgctgcagaccgctaaaaacctgctcaaggaagaaaaactggtccatagctatccgtatgattggaggaccaaaaaaccagtggtgatcagggcatcaaagcagtggtttataaacatcacggacatcaaaacagctgccaaggagttgctaaagaaggtcaagttcataccggggagtgccttgaatggtatggtcgagatgatggatcgccggccctattggtgcatcagccgccagcgcgtgtggggagtgcccatccccgtttttcatcacaagacaaaggatgaatatctgataaacagccaaactaccgagcacatagtgaagttggtggagcagcacggctctgacatttggtggactctcccacctgaacagctgctccctaaagaagtgctgagtgaggtaggcggtcctgatgccctggagtatgttccggggcaagacattctggatatttggtttgattccgggacatcctggtcttatgtgctcccaggcccggaccagcgggcagatctgtacttagagggcaaggaccaacttggtgggtggtttcagagctcattgctgacgtctgtagctgcacgaaagagagctccctacaaaaccgtcatcgtccatggtttcacactgggagagaagggagaaaagatgagtaaatccctcggaaatgtgatccacccggacgtggtcgtgaacgggggccaggatcaatcaaaagagccaccctacggcgctgatgtgcttcgttggtgggtggcggattccaacgtctttactgaggtcgcaattggccccagcgtcttaaacgccgctcgggatgacatatctaagctgcgtaacacactcaggtttttgttgggaaatgttgcagacttcaacccagaaacagacagcatcccagtgaatgatatgtacgtgatagatcagtatatgctccatctcctgcaggacttagctaacaagataactgagctgtacaaacaatacgattttgggaaagtagtgcgacttttgcgcacgttttatacccgggaacttagtaacttttatttttccatcattaaagacaggctgtactgtgaaaaggagaatgatcctaaaagaagatcttgtcagactgccctagtggagattctagatgtgatcgtgaggagctttgcccccattttaccccacctcgcggaagaagtctttcaacatatcccgtatattaaggaaccgaagtctgtgtttaggaccggctggatatcaacgtcttccatatggaagaaacccggcctggaagaagccgtcgagtctgcctgcgcgatgagggactctttcctcggatcaattcctggcaagaacgccgccgaatacaaggtcattaccgtgattgaacctggcctgcttttcgagatcatcgaaatgctgcaatcagaggagacaagctccacttcccagctcaacgaattgatgatggcctccgagagcaccttactcgcacaggaaccccgggaaatgactgcagatgtcatcgaactcaagggtaaattccttatcaatctggaggggggtgacatcagagaagagagttcatataaggtgatcgtgatgcccaccaccaaggaaaagtgccccaggtgctggaaatacaccgccgagtcatctgataccctgtgtccacgttgcgccgaagtggtctccggtaaatag

SEQ ID NO: 192044 - DNA, 2823 bp, Artificial Sequence
  Description of Artificial Sequence: Synthetic coding sequence
atgaagctgctgggccggcagcagcccgacaccgagctggagatccagcagaaatgcggattctcggagctgtattcatggcagagggaacgtaaggtgaagacagaattctgtctacatgatggccctccatatgctaacggagatccacatgtggggcacgcattgaataagatccttaaagacattgcaaaccgcttccacatgatgaatgggagcaagatccatttcgttcccggctgggactgtcatggcctacccatcgaaatcaaggtactgtctgaactggggagagaggcccagaatttaagtgctatggagatcagaaagaaggccagatctttcgccaaagctgcaatcgagaagcaaaagagcgcattcatccggtgggggatcatggccgattggaacaattgttactacacttttgatggaaagtacgaggccaagcagctgaggacattctatcagatgtacgataaggggctggtataccggtcctataagcccgttttttggtctccttcatctcggactgccctagccgaagccgagcttgaatataaccccgagcatgtaagtcgttctatctacgtaaaattccctctcttaaagccctcccctaagctggcctcgcttattgacggttccagccctgtgagcatactcgtgtggaccacacagccctggactatcccggcaaacgaagccgtctgttacatgccagaatcaaagtacgctgtagtcaagtgtagcaaatccggtgatctgtatgttctggccgccgataaggtcgccagtgtggccagcactctggagacaacgtttgaaacaatttcaacgcttagcggagtggacttggagaacggcacatgcagtcatcctctgatccctgataaggctagtcctctcttgcccgctaatcatgtcaccatggcgaagggcaccgggcttgtgcacaccgcaccagctcatggaatggaggactatggggtggcgtctcagcataacctgcccatggactgccttgttgatgaggacggggtgttcaccgacgtagctgggcccgaattgcaaaataaagcagtcctggaagaggggaccgacgtagtcattaaaatgttgcaaaccgccaagaacctacttaaggaggagaaactggtgcatagctacccatacgattggagaacgaagaagccagtggttattcgcgcttcgaagcagtggtttattaatattacagacatcaaaactgcagccaaagagctgttaaaaaaagtcaaattcattcctggctctgctctgaatggaatggttgagatgatggacagacggccctactggtgcattagtaggcagcgggtgtggggtgtacctatccctgtgttccaccacaagactaaagacgagtatctgatcaattcccagactaccgaacatatagtaaagttggtggaacagcatggctctgacatttggtggacacttccacctgaacagctcctgcctaaagaggtgctgtctgaagtaggcggacccgatgccctggaatacgtgcctggtcaggatattctcgatatctggtttgacagcggcacgagttggtcttatgttcttcccgggcccgatcagagagccgacctgtacctggagggcaaggatcagttgggcgggtggttccagtcatccttactgaccagcgtagcggcccggaaaagagcgccctataaaactgtgattgtgcacggctttactttgggcgagaagggagagaagatgtcaaaatccctgggaaacgtgattcaccccgacgtcgtggtcaacggcggccaagatcagtccaaggaaccgccatatggcgcagacgtgcttagatggtgggtagctgattctaatgtttttactgaggttgcaatcggtccgtccgtcttgaatgctgccagagacgatattagcaagctgcggaatactcttcggttcctgctcggaaatgtggcagattttaacccagagaccgactctatacccgttaatgatatgtacgtgatagaccagtacatgctccacctcctgcaagatctcgccaacaaaatcacggagctctataagcagtacgatttcggtaaagttgtgcggttattgcgcaccttctatacacgcgagctttccaacttttatttttctattatcaaggatagactgtactgtgagaaagaaaacgaccctaagagacgaagctgtcagacagcacttgtcgagatcctggacgttatagtccggtcatttgctccgatactcccacacctggctgaggaggttttccaacacatcccgtatattaaggaaccaaagagtgttttcagaaccggttggatttcaacttcttctatttggaagaagcctggcttggaggaggcagtagagtctgcatgtgccatgagagacagcttccttggatcaattcctggcaagaacgccgctgaatataaggttatcactgttatcgaacctggactgttattcgagattatcgagatgcttcagagtgaagagacctcctccacgtcacagctgaacgagctgatgatggcctcagaatccacactcttggcccaggaaccccgcgagatgaccgctgacgtgattgagctaaagggaaagttcttaatcaatctggagggaggcgatatccgggaggagtccagttataaggttatcgttatgcctaccaccaaggaaaagtgcccccgctgttggaagtatacagcagagagcagtgacacactttgccccaggtgcgccgaagtagtctctggtaaatag

SEQ ID NO: 192045 - DNA, 855 bp, Artificial Sequence
  Description of Artificial Sequence: Synthetic coding sequence
atggccggctgcgccgcccgggccccccccggcagcgaggcccggctatcactcgccacttttctgttgggcgccagcgtgcttgctctgcccctccttacccgcgcaggtctccagggacgcaccgggctcgctctgtacgtggctggcttgaatgccctgctgttactactgtaccgcccgccacgctaccagattgctataagagcttgttttctagggtttgtgttcggttgtggcaccctactctctttcagccagtcctcctggagccatttcggctggtatatgtgctcacttagtctcttccactacagtgaatacctggttaccgcggtgaacaaccccaaaagcctgagccttgattcatttctgctgaatcattctctcgagtataccgtggccgctttgagctcatggctggaatttacccttgaaaatatattttggccagagctgaagcagataacctggttatcggttaccggactcctgatggtcgttttcggcgagtgtctgcgcaaggccgccatgtttacagccgggtccaattttaaccacgtggtccagaatgaaaaatccgatacacatactctggtgacttccggcgtatatgcctggttccgacaccctagctacgtgggttggttttactggtcaattggcactcaagtcatgctgtgcaaccctatttgcggtgtctcctatgctctcacagtctggcgctttttcagggacaggactgaagaggaggagatcagcctgatacatttcttcggcgaggagtacctcgagtacaagaagcgtgttccgacgggcttacctttcatcaaaggggtgaaagtcgacttgtag

SEQ ID NO: 192046 - DNA, 351 bp, Artificial Sequence
  Description of Artificial Sequence: Synthetic coding sequence
atggccggctgcgccgcccgggccccccccggcagcgaggcccggctcagtctggctactttcctgcttggcgccagcgttcttgccctgcctttactcacccgggctggccttcaggggaggacgggtttggcgctttatgtcgccggactcaatgctctgctactgctgctctaccggcctccacgctaccagatagccatacgggcttgcttcttggggttcgtcttcggctgcgggacattgctctcgttctctcagtcttcctggtcccatttcggttggagtcacttggttcacccgcactcccattgtagaatattcccgtacacaatgatctctgtgccttag

SEQ ID NO: 192047 - DNA, 567 bp, Artificial Sequence
  Description of Artificial Sequence: Synthetic coding sequence
atgtgcagcctgagcctgttccactacagcgagtacctggtgaccgctgtgaataaccccaagtctttatccttggactcattcctgctgaaccattccctggaatacactgtggctgccttgtcctcgtggctggagtttaccctggaaaatatcttctggccggaactgaaacaaatcacttggctttcagtcactgggctgttgatggtcgtctttggggagtgccttcggaaggccgcaatgtttacggccggcagtaacttcaaccatgtggtgcagaacgaaaagtctgacacccacacgctggtgactagtggggtgtatgcgtggtttaggcacccttcatacgtggggtggttctactggtctattggtacgcaggtgatgctgtgcaatcccatttgcggggtctcttatgctctgaccgtttggcgctttttccgcgaccgtacggaggaggaggaaatatccctgatccatttcttcggagaggagtacttggagtacaagaaacgcgttcctacagggctgccattcatcaagggcgtgaaggtggatttgtag

SEQ ID NO: 192048 - DNA, 1272 bp, Artificial Sequence
  Description of Artificial Sequence: Synthetic coding sequence
atggccaccgccacccggctgctgggctggcgggtggccagctggaggctgcggcctccactggcagggtttgtgtctcagcgggctcactctctccttccagttgacgacgcaatcaacgggctgtccgaggagcagaggcaactccgacaaaccatggcaaagttcttgcaagagcacttggcaccaaaggcgcaggaaattgaccggtcaaacgagtttaagaatctccgcgagttctggaagcagctggggaatctgggtgtgctcggtataacggcccctgtccaatacggaggttccggcttggggtaccttgagcatgtgctggtcatggaggaaatcagccgggcttcaggagcagtaggcttgtcctacggagcccatagcaatctgtgtatcaaccagttagtccgaaatggcaacgaggcccagaaggaaaaatacctccccaagcttatcagcggcgaatacatcggcgcccttgcaatgtcggaacccaatgccggctctgatgtggtgagcatgaaactgaaagcggagaaaaagggcaaccactatatactcaatggaaataagttctggattaccaacggtcctgatgcagacgtcttgatcgtgtacgccaagaccgacttggctgcagtacccgcaagccgcggcattacagcgtttattgtcgagaaagggatgccaggtttcagtacaagcaagaagctggataagctcggtatgaggggtagtaacacctgcgagttgatattcgaggactgcaagataccggctgccaacattctgggacatgagaataagggcgtgtacgtgttgatgtcagggctggatctcgaacgcttggtgctggccgggggacccctgggtctgatgcaggctgtgctggatcacactatcccgtaccttcacgtgagagaggcgttcgggcagaagattggccacttccagctcatgcagggtaagatggccgacatgtatacgaggctgatggcttgcagacaatacgtgtacaatgtggctaaggcctgtgacgaaggacactgcactgcgaaagattgcgccggcgttattctttatagtgcagaatgtgccacacaggtggcacttgacggcatacaatgctttggcggcaacgggtacatcaacgattttcccatgggacggttcctgagggatgcaaagctatacgagataggcgcaggaacatccgaggttcggcgcctggtgattggtcgcgctttcaacgcggacttccactag

SEQ ID NO: 192049 - DNA, 1191 bp, Artificial Sequence
  Description of Artificial Sequence: Synthetic coding sequence
atggccgagatggccaccgccacccggctgctgggctggcgggtggcctcctggagattgcgccctcctctcgccggtttcgtgagtcagcgagcacactctctgcttcccgtcgatgacgctatcaatggcctatccgaggagcagcgacaggaattctggaaacagttagggaatctgggtgtgttgggtataaccgcgcccgttcagtacggtggctcagggctggggtatctggaacatgttcttgtgatggaggaaatttccagggcctctggcgccgtcggtctgtcatacggcgcccactccaatttatgtataaaccagctggttagaaacggaaacgaggcacaaaaggaaaagtatctgccaaagctcatcagcggcgagtacataggtgcccttgccatgtcagaacccaatgccggcagcgacgtagtttccatgaaattgaaagctgagaagaaagggaatcactatatcctgaacggtaacaaattctggatcactaacggccccgacgcagacgttctgatcgtctacgctaaaactgatctggcagccgtccccgcttcccgaggaatcactgcctttattgtcgagaagggcatgcccggtttctcaacttctaagaagctggataagctgggcatgcgcggtagcaacacctgcgagctaatattcgaggactgtaagatcccagcagctaacatcctgggtcatgaaaacaagggcgtttatgtgctcatgagcggcctcgatctcgagcgcctggtgcttgctgggggtcccctgggactgatgcaggccgtcctggaccataccatcccatacctgcatgtgagagaggcctttggtcagaaaatcgggcactttcagcttatgcaaggtaagatggctgacatgtacacacgactgatggcctgtaggcagtacgtttataacgtggccaaggcgtgtgatgaagggcactgtacagctaaggattgcgccggcgtgatactgtacagtgcagaatgcgctacccaagttgcccttgatggaattcagtgttttggtggtaacgggtacatcaatgatttccccatgggaaggttcctgcgcgacgcaaaactgtatgaaattggtgcgggcaccagcgaggtccggcggttagtgatcggccgggccttcaacgctgatttccattag

SEQ ID NO: 192050 - DNA, 1281 bp, Artificial Sequence
  Description of Artificial Sequence: Synthetic coding sequence
atggccgagatggccaccgccacccggctgctgggctggcgggtggcttcttggcgccttcgcccacctctggccggatttgtgagtcagcgcgcccatagcttactgcccgtagacgatgccataaatgggctgagcgaagaacagcgtcagttacgccaaacgatggccaagtttttacaggagcacctagcccccaaagcacaagagatcgacaggtccaatgaattcaagaacttgagagagttctggaagcaactgggtaatctgggagtgcttggaattacagctccggtacagtatggcggctcaggactggggtacttagaacacgtcctcgtaatggaagaaatctctagagcatcaggtgcggttggtctgtcttatggcgcccatagcaatctgtgtattaatcaattggttcggaatgggaatgaggctcaaaaggagaagtatctccccaagctgatctcaggtgagtacatcggggccctcgcaatgagtgagcccaatgctggttccgacgtcgtgtctatgaagctgaaggctgaaaagaagggaaaccactatatcctcaacggaaacaaattctggattacaaacggacctgatgctgacgtgctgattgtatacgcaaagactgacctagccgctgttccagcttcacgaggcatcaccgccttcatagtcgagaaaggcatgccggggtttagcaccagcaagaaactggacaagctcggcatgcgagggagcaacacgtgcgaactgatttttgaagactgcaaaatccctgctgctaacatcctgggtcatgaaaacaagggtgtatatgtgctgatgagtggtctggatcttgagcgtcttgtactggccgggggccccctgggactgatgcaggctgtgcttgatcacactatcccatacttacacgtgagggaagctttcggacagaaaattggacactttcagctgatgcagggtaaaatggccgatatgtatactcgactaatggcttgccgtcagtacgtgtataatgtggctaaggcgtgtgatgagggccactgtacagcaaaagactgcgccggagtaatcctttacagcgccgagtgcgccactcaggttgctctggacggcatccaatgctttggggggaatggatacattaatgatttccccatgggtcggtttctaagagacgctaaactgtatgagatcggggccgggacctcagaggtcaggagattagttatcgggcgtgctttcaacgctgacttccactag

SEQ ID NO: 192051 - DNA, 1716 bp, Artificial Sequence
  Description of Artificial Sequence: Synthetic coding sequence
atgcgggccctgcgggaccgggccggcctgctgctgtgcgtgctgttgctggcagcccttctagaagcagccctgggcctgcccgtgaaaaaacctcgtctgcgcggcccaaggccaggatctctgactcggctcgccgaggtcagtgcgtcccctgaccccagacctctgaaagaggaggaagaggcacctcttttgccacgcactcacctgcaagcagagcctcaccagcatgggtgttggactgtgacagaacccgccgcaatgacccctggcaatgctactcccccccggactccggaggttacccccctgagattggaactgcagaaactacctggcctcgcgaatacaactttgtccacaccgaaccccgacacccaggcctctgccagccccgaccctcggccacttcgcgaggaggaggaggcaaggttgctgcctcgcactcaccttcaggccgaactgcaccaacacggttgctggactgtgacagagccggccgccctgacccctggcaacgcaacccccccaaggacccaagaagtaacgcccctgctgttggagcttcagaaactgcctgagctggttcatgccacactgtccacacctaatccagataaccaggtgactatcaaggtagttgaagacccccaagctgaggtttcaattgacttgttggctgagccttccaatccaccgccacaggacacactgagctggctccctgcgctctggtcttttttatggggtgattacaaaggagaggagaaagatcgtgcccccggagaaaaaggcgaggagaaagaagaagatgaagattacccctccgaggacatcgagggggaggaccaggaggataaggaagaggatgaggaagaacaggccctgtggtttaatggcacgacggataattgggatcaggggtggcttgcccctggggattgggtgtttaaggacagtgtatcgtacgattacgagccgcagaaagagtggtctccctggtccccatgttcaggcaattgttctaccggtaagcaacagcgcaccaggccttgcggatacgggtgcaccgcgactgagacaaggacctgcgatcttccctcctgcccaggtaccgaggataaggacaccctaggactgcctagtgaagaatggaaactcctggccaggaacgcgacagatatgcacgaccaggacgttgattcttgtgaaaaatggttaaactgcaagagcgactttctgatcaaatatctttcacagatgctgcgagacctcccctcatgcccatgtgcttatccactcgaagcaatggattctcccgtgagtctgcaggatgagcatcaaggcagatcctttagatggcgcgatgcctcgggtcctcgcgaacgcctggatatataccagccaactgcacggttttgtctgcggtccatgttaagcggagaatcatctaccctcgcagcccagcattgctgctacgatgaggactcacgtctgctcactcgaggaaagggcgccggtatgccgaatctgattagcaccgactttagtcctaagctccattttaaatttgatactacgccctggatcctatgcaagggagattggtctcgccttcacgcagtcttgccacccaataacgggcgtgcctgcacagataacccgcttgaggaagagtatctggcccagttgcaggaggccaaggagtactag

SEQ ID NO: 192052 - DNA, 1452 bp, Artificial Sequence
  Description of Artificial Sequence: Synthetic coding sequence
atgacccccggcaacgccacccccccccggacccccgaggtgacccctctccggctcgagctgcagaagctccctggcctggctaacacgacgctctccaccccgaatccagacacacaggcatccgcgtctccggatcctcgccccttgcgcgaggaggaggaggcgaggctgctgcctcggacccatctacaggcagaactacaccagcacgggtgttggacagtgactgagcctgccgctttgaccccaggcaatgccactccacccagaactcaggaggtaaccccgctgctgttagagcttcaaaagctgcctgaactggtacacgccacgctctctacccctaaccccgacaaccaagtcactataaaggtcgtggaggatcctcaggctgaagtaagcatcgaccttctggccgagccctcaaaccctcctccccaggatacactgtcttggttgcccgccttgtggtcttttctctggggagattataagggggaggaaaaggaccgcgcccccggggagaaaggagaagagaaggaggaggacgaggactatccctcggaggacattgagggagaggaccaggaggacaaggaggaggatgaggaagaacaggctctgtggttcaacggcacaacagataattgggaccaggggtggctcgctcccggcgactgggtgtttaaggattcggtgtcatatgactacgagccacagaaagagtggagcccctggtctccatgctctgggaactgcagcactggaaaacagcagaggaccaggccctgcggatacggctgcacagccactgaaactcgtacttgtgacctgccctcatgccctggaactgaggacaaggacacccttggcctgccgagtgaggaatggaagctattggctcgcaacgccaccgatatgcacgaccaggatgttgactcttgcgagaaatggttgaactgtaaatccgactttttaataaagtacctgtcccagatgctaagggatctcccttcctgcccttgtgcctatcccctagaagctatggactcccctgtctccctgcaggatgagcatcagggcaggtctttcagatggcgcgacgcatccggccctcgtgaaaggttagatatttaccagcccactgcccgcttttgtctgcgctctatgctgagcggtgagtcttccacactcgcagcccagcattgttgctatgacgaggatagtagattactgacccgaggaaaaggcgctggaatgcctaatctaatttctactgatttttctcctaagttgcacttcaagtttgacacaaccccatggatcctctgcaagggcgactggtccagattgcacgccgtcctgccccccaataacggccgggcgtgcaccgataaccccctggaggaggagtacctggcacaattgcaggaggccaaggaatactag

SEQ ID NO: 192053 - DNA, 1473 bp, Artificial Sequence
  Description of Artificial Sequence: Synthetic coding sequence
atgcgggccctgcgggaccgggccggcctgctgctgtgcgtgctgctgctggcagctcttttggaggcggctcttggcctacccgtcaaaaaacccagactgagagggccaaggccaggctcccttaccagactcgcggaggtgtcagcttcgcctgacccccgccccctgaaagaggaggaggaggcgccactgttgccccgtacacatctccaggcagagccacatcaacatggttgctggacggtgacagaacccgctgccatgacacccggcaatgctactcctcctagaacacctgaagtaacacccttgcgccttgagttgcagaagctgccaggcttggcgaacactacactctctacacctaaccctgacacccaggttactattaaggtggtggaagacccccaggctgaggtatctattgacttactcgcggagccgtcgaatcctccgccccaggataccctctcatggttgccagcactttggagtttcctttggggtgactataaaggcgaggaaaaggacagggcacccggcgaaaaaggagaggaaaaggaggaggatgaggattatcctagcgaagatatcgagggtgaggatcaggaagataaagaggaggatgaggaagagcaggcattatggttcaacggcaccacagacaactgggatcaagggtggctggcacccggcgattgggttttcaaggattctgtctcctacgattacgaaccccagaaggaatggagcccatggtccccctgttccggcaattgctctaccggcaagcaacagcgtacgagaccttgcggctatggatgcacagctactgagacacggacctgtgacctgccatcatgcccaggaactgaggataaggataccttgggactccccagtgaggaatggaagctactggctcggaacgcgaccgatatgcacgatcaggacgtcgatagttgtgagaagtggctcaattgcaaatccgattttctgattaaatacctgagccagatgctgcgggacctcccaagctgcccttgcgcgtacccccttgaagccatggactcaccggtaagcctgcaggatgagcatcaagggagatcctttcgatggcgcgacgcatccgggcctcgcgaaaggttggacatataccagccgacagcccggttctgtttgcgatccatgctgagcggagagagtagcactctggccgctcagcattgttgttacgacgaagactcccgactgcttacacggggtaagggagcagggatgccgaatctgatctccacagactttagtcccaagctgcactttaaattcgacacaaccccatggatcctgtgtaaaggcgattggagccgcttgcatgccgtgctgccacccaacaatgggagagcttgtaccgacaatccgctggaggaagagtatcttgcccaattgcaggaagctaaggagtattag

SEQ ID NO: 192054 - DNA, 1473 bp, Artificial Sequence
  Description of Artificial Sequence: Synthetic coding sequence
atgcgggccctgcgggaccgggccggcctgctgctgtgcgtgctgctgttggccgctctgctcgaggccgcactcggtctccccgtcaagaaaccaaggctgcgtggcccacggcctggtagtttaacacgcctggccgaagcgtcagccagtccagatcccagaccccttcgggaagaggaggaagcacgcctattaccaaggacacatttacaggccgaactgcaccagcacggatgctggacagtgactgagcctgccgcactcacacccgggaacgccaccccaccgaggacgcaggaagtaactcccctgctgctcgagttgcagaagctgcctgagctagtccacgcaaccctgtctacccccaatccggataatcaagttactatcaaggtggtggaggatccccaggcggaagtgtccatcgatctcctcgctgagccatccaatcctccaccacaggataccctctcttggctgcctgctctgtggtcatttttatggggagactacaaaggtgaggagaaggaccgcgcacctggggaaaaaggtgaggaaaaagaggaagatgaggattaccctagcgaagatatcgagggagaagaccaggaggataaagaagaagatgaggaagagcaggcgctgtggtttaacgggacaactgacaactgggatcagggatggctcgcccccggagattgggtgtttaaagactccgtgagctacgattacgaaccacagaaggagtggtctccctggagcccttgctccggaaactgtagtacaggaaagcaacagaggacccggccctgcggatacggctgtaccgccaccgagactaggacatgcgacttgcccagctgccctgggactgaagacaaagacacgctcggcttgcccagtgaagaatggaagttgctggctagaaacgctacagatatgcacgatcaggacgtagactcatgcgagaagtggctgaactgtaagtcagactttttgatcaagtacttgtcccagatgttacgggacctgcccagctgcccctgtgcctatccactggaggcaatggatagtcccgtaagcctgcaagatgagcaccagggccgatcgtttaggtggcgcgacgccagcggcccacgggagcgactggacatatatcaaccaacagcccgtttctgtttgcggagcatgttgtctggtgagtctagcaccctcgcagctcagcactgctgctacgatgaggatagtagactcttgacccggggtaagggtgcggggatgccaaacctgatttcaacagatttctcccccaaactgcatttcaaatttgacactaccccttggatactgtgcaaaggtgattggtctaggctccacgcagtgcttccccccaacaacgggagggcctgtaccgacaatccactcgaggaggagtatctggcgcagctccaagaagctaaagagtactag

SEQ ID NO: 192055 - DNA, 879 bp, Artificial Sequence
  Description of Artificial Sequence: Synthetic coding sequence
atgcgggccctgcgggaccgggccggcctgctgctgtgcgtgctgctgctagcggctctgcttgaggcagccttggggctccccgtgaagaaacctcggctgcgcgggccccggcccggctccctcacacgcctggccgaggtttcagcatctccggatcctcgcccactgaaggaagaggaagaggctccgctactgcctagaacacatctgcaggccgagccccaccaacatggatgctggacggtcaccgagcccgctgccatgacacccgggaatgcaacccctcctcggactccagaggtgaccccccttcgcctggagctgcaaaaactgccggggctggcgaatactaccctgtctactcccaacccggatacacaggccagcgccagtcccgaccccaggcctctgcgcgaggaagaagaggctagactactcccccgcactcatctgcaggcagagctacaccagcacggatgctggactgtaaccgaacccgccgcccttaccccgggcaatgccacccctcctagaacccaagaggtcacccctctcctactggaattgcagaaactgcctgaactggtgcacgctacactgagcactcccaatccggataaccagacaatgagccttaggcgcagcggcgttcctggactcccggctgtgggtaccgccgcgctggctagttctcgaggcctcggtccagttgctatggcagccctgcctcctcgccccgttccagtcacttgtccgcccgttctcgcattgaggaccaggaccccctgggcttcccccgtgaggtccggctccagctggcccgcgatgctccgaacatgcatgataaagatgtggactgctgttagaagtggttag

SEQ ID NO: 192056 - DNA, 924 bp, Artificial Sequence
  Description of Artificial Sequence: Synthetic coding sequence
atggcccggaacgccgagaaggccatgaccgccctggcccggttccggcaggctcagctcgaagagggcaaagttaaagagagaaggccatttctggcctctgagtgtactgaattgccaaaggccgagaaatggcggcgacagatcatcggcgaaatatccaaaaaggtggcccagattcagaatgctggcctaggggaatttagaatcagagacttgaacgacgaaattaacaagcttctgcgtgaaaaagggcactgggaggtaagaataaaagaactggggggccccgattatgggaaagtaggcccgaagatgctggaccatgaagggaaagaggtaccaggtaaccggggctacaaatacttcggggctgccaaggatctcccaggtgtgcgcgagctcttcgagaaggagaggcaggtcaggtggttgatgcccgtaatccctgcactatgggaagccgaggcaggcggcagtcaggccctgcctccccctcgcaagacccgggctgaactgatgaaggccattgactttgaatattacgggtatcttgatgaagacgatggagtgatcgtcccactcgaacaggagtatgagaagaaactgagggccgaacttgtggaaaaatggaaggcagaaagagaggctcggctggctagaggcgagaaagaggaagaagaggaagaggaggaggagattaatatctacgccgtgacagaagaggagtccgacgaggaggggtcccaggaaaaaggcggcgacgactcgcagcaaaaattcatcgcccacgtgcctgtcccgagccagcaggagatcgaggaagccctggtcaggaggaagaaaatggaactccttcagaaatatgcttctgagacactgcaggcccagtcagaagaggcccgacgactcctcggatactag

SEQ ID NO: 192057 - DNA, 858 bp, Artificial Sequence
  Description of Artificial Sequence: Synthetic coding sequence
atggcccggaacgccgagaaggccatgaccgccctggcccggttccggcaggcccagctggaagaaggcaaggtgaaagagaggagaccttttctggcatcagaatgtaccgagctcccgaaggctgaaaaatggcgccggcagataatcggggaaatttccaaaaaggtggcgcagatccaaaatgctggactgggcgaatttcgcatccgagaccttaatgatgaaatcaacaagttgctaagagagaagggccactgggaggtgagaatcaaggaactgggcggccccgattacgggaaggtcgggccgaaaatgttagaccatgaaggcaaagaggtgccaggcaaccgcggttacaagtactttggcgcagcaaaggacctgcctggtgtgcgcgaattgttcgaaaaagagccactgccacccccaaggaagacacgcgcagagctaatgaaggccattgactttgagtactacgggtacctagacgaagacgacggcgtgattgtgccactggaacaggaatacgagaaaaaacttcgcgccgagttggtggaaaaatggaaagcggaaagggaggcccgcctggcgagaggagagaaggaagaggaagaggaggaagaagaggagattaatatttacgccgttactgaggaagaatccgatgaggaaggaagtcaggagaaaggcggagacgactctcaacagaagtttatcgcgcatgtgccagtcccaagccagcaggaaattgaagaggcattagtccgacgcaagaaaatggagttgcttcaaaagtatgcatctgagactcttcaggctcagtctgaggaggcgaggagacttctcggatattag

SEQ ID NO: 192058 - DNA, 2712 bp, Artificial Sequence
  Description of Artificial Sequence: Synthetic coding sequence
atgagcgacagcggcagccagctgggcagcatgggcagcctgaccatgaagtctcaactccaaatcaccgtgattagtgccaagctgaaggaaaacaagaaaaactggttcggtcctagtccttatgtagaagtgactgttgacgggcagagcaagaagaccgaaaaatgtaataataccaattccccaaagtggaagcagccactgaccgtgatagtgacacctgttagtaaactgcattttcgcgtctggtctcatcagactttgaaaagcgatgtgctgttgggcactgctgccctcgacatttacgaaactctcaagagcaataacatgaagttggaagaagtagttgtgaccttgcagctcgggggtgataaggaacccacagaaactatcggcgacttgagcatttgtctggacggtttgcaattggaatccgaggttgtgacaaacggagagacgacctgtagcgaaaacggcgtatcactgtgtttacccaggttagaatgtaatagtgcaataagcgcacattgcaacctttgtctgcctggcctgagcgattctccaatcagcgcgagcagggtggccgggtttactggcgctagccagaacgacgacgggtctagatccaaggacgagactcgggttagtaccaacggttcagacgatcccgaagatgccggtgccggcgaaaaccgcagggtctcgggtaataatagtccatctctgtccaatgggggcttcaaacctagccgaccgccacggcccagccggcccccaccacccacccctagacgtccagcttctgtaaacggcagcccctcagctactagcgagtctgatggttcaagcacaggttcactaccccccaccaacaccaatacaaacacctccgagggcgctaccagcgggctgatcattccccttacaatctctggcgggtctggcccccgaccccttaatcccgtcactcaagctcccttacctccaggctgggagcagcgggtcgatcaacatgggagagtatactacgtggatcacgtcgagaagaggaccacttgggacaggccagagcctttgcccccaggttgggaaagaagagtggataacatgggccgcatttactacgtagatcacttcaccagaaccacaacctggcagaggcccacgttagagagcgtccggaactacgaacaatggcagctgcagcgctctcagcttcagggcgctatgcaacagttcaaccagcgctttatatatggcaatcaagatctgtttgccaccagtcagtccaaagagttcgatcctctggggcccctccctcccggatgggagaagcgcacagactccaatggcagggtgtacttcgttaaccataatactaggattactcaatgggaggacccccgcagtcagggccagctcaacgagaaacctttaccagaaggctgggagatgagattcacagtggatggaattccctatttcgtcgatcacaatcggcgcaccactacctatatcgacccacgaacaggaaagtccgccctcgataatggacctcagatcgcatatgtgcgcgacttcaaggcaaaggtgcaatatttcagattctggtgccagcaactggcaatgcctcagcatataaaaattacggtcactcgaaagactctctttgaggattctttccaacagattatgtctttcagcccccaggacctgcgccgccgcctatgggtgatctttccaggtgaggaggggctcgactacggtggagtagcacgcgagtggttcttcctcctatcacatgaggttctgaatccaatgtactgtttattcgaatacgccgggaaagacaactactgcttgcaaatcaatcccgcttcctatattaaccctgaccatctcaagtacttccggttcattggccggttcatcgccatggccttgtttcatgggaaattcatcgatacaggtttcagtctgcccttttacaagcggatactcaacaagcccgtcggtctgaaggatcttgaatccatcgatccggagttctataattctttgatctgggtcaaggagaacaacattgaggaatgcgacttggagatgtacttctccgtggataaagaaatcttgggtgagatcaagagccatgatctcaaacctaacggtggaaacattctggtcaccgaggagaacaaagaggagtacattcggatggttgctgagtggcggctctctagaggcgttgaggagcagacccaagccttctttgaaggcttcaatgagatcctgccccagcaatacctccagtacttcgacgcaaaggaattggaagtcctactgtgcggaatgcaagagattgatctcaacgactggcagcgtcacgcaatatataggcactacgcccgaacatcaaagcagataatgtggttttggcagttcgttaaagaaattgacaatgaaaagcgtatgcggctgctgcaattcgttacaggcacatgtagactcccagtgggtggctttgcggatcttatggggtccaatggcccgcagaagttctgcatagaaaaagttggcaaggagaactggcttcctcgatcacatacttgcttcaatcggctagacctccccccttacaagtcatatgaacagcttaaagagaaactcctgtttgcaatcgaggaaacagagggctttggccaagagtag

SEQ ID NO: 192059 - DNA, 2589 bp, Artificial Sequence
  Description of Artificial Sequence: Synthetic coding sequence
atgagcgacagcggcagccagctgggcagcatgggcagcctgaccatgaagtctcaactccaaatcacagtaatctccgcaaagctgaaagaaaataagaagaactggttcggaccctccccttacgtcgaggtgaccgttgatgggcaaagtaaaaaaaccgagaaatgcaacaacactaactcacctaagtggaaacagcccttgactgtgattgtaaccccggtctccaagctgcattttagggtctggtcccatcaaactttgaagtcagacgtgctcctagggacggctgctctcgatatttatgaaactctgaaatctaacaacatgaaactcgaagaggtcgtggtaactctgcagctggggggcgataaggagcctactgagactatcggcgatctttcaatttgcctcgacggcctccaactggagagtgaagtagttactaacggcgaaaccacatgtagcgaaagtgccagccaaaacgatgatgggtccagaagcaaagacgaaacgcgggtgagcaccaatggaagtgacgatccggaggatgctggggctggggaaaatcgtagggtgagcgggaacaactctccgagtctgagcaatggaggatttaagccatctaggcctccacggccctcgcgccctccgcctcccactccaagacggcctgcttccgtaaacggctcaccctctgctacctccgagtctgacgggtccagtacgggttctcttccacccacaaataccaatacgaatacatctgagggggccacaagtggattaattattcctcttaccatttcaggcggtagcggaccacggcccctcaaccccgtcacccaggcccctctgcctcctggctgggaacagcgcgtggaccaacatgggcgcgtgtattacgtagaccacgtcgagaagagaactacttgggacagacctgagccactgccacccggctgggaacggagggtggataacatgggccgcatttattatgtggatcacttcactaggaccacgacctggcagcgccccacacttgagagcgtgcggaattacgagcagtggcaacttcagcgttcccagttgcaaggggccatgcagcagttcaaccaacggtttatttatggcaatcaggacctgttcgcaacctctcagtcaaaagagtttgaccccctggggcccttaccgccaggctgggagaaaaggaccgattcgaatggaagagtttacttcgtaaaccacaacactcggattacacaatgggaagatccgcgcagtcagggacagctgaacgagaaacctctgcccgaggggtgggagatgcgcttcacggtcgatggaattccatatttcgtcgaccataacagaaggactacaacttacattgaccccagaactggaaaaagtgccctggacaatggtcctcagatcgcatacgtgcgcgacttcaaagccaaagtccagtattttagattctggtgccagcagctggccatgccccagcatatcaaaataacggtgactcgcaaaacattgtttgaagattcttttcagcagataatgagcttcagcccccaggatttgcggcgtcggctctgggtgatcttccccggggaggaagggctggattatggaggcgtggccagggagtggttcttcctgctgtcacatgaagtgttgaacccaatgtactgtctgtttgaatatgcgggtaaggataactactgcctgcagatcaaccctgcttcctacattaaccctgatcatctgaaatacttccggttcattggacgatttattgctatggcgctctttcatgggaaatttatagacactggattcagcctcccattttacaagcggatactcaacaagccagtgggactgaaagaccttgagtccatagatcccgaattttacaacagtctcatttgggtgaaggagaataatatcgaggagtgcgatctggaaatgtacttttcagttgacaaagaaatcctgggagagatcaagtcacatgacttgaaaccgaatggagggaacatccttgtgactgaggagaacaaggaagagtatatccggatggttgccgaatggagactatcaaggggggtagaggagcaaacacaggccttcttcgagggctttaacgagatattgccccagcagtacctacagtactttgacgctaaggagctggaggtgctcttgtgtggtatgcaggagatcgacttaaacgactggcagcggcacgcaatttatagacactatgcccgcaccagcaaacagataatgtggttctggcagtttgtgaaagagatagacaacgagaaacggatgagactgctgcagtttgtgaccgggacctgccggttgccagtcggcgggttcgcggacctgatgggatctaacgggccacagaagttttgcattgagaaggttgggaaggagaattggttaccgaggagccacacctgcttcaataggttagacctcccgccttataagagctacgagcaattgaaggaaaagctcctttttgccatcgaagagaccgaggggtttggccaggagtag

SEQ ID NO: 192060 - DNA, 2259 bp, Artificial Sequence
  Description of Artificial Sequence: Synthetic coding sequence
atgaagctggaggaggtggtggtgaccctgcagctgggcggcgacaaagaacccacagagacaattggggacttgtctatctgtctggacggccttcagcttgagtctgaggtcgtcaccaatggggagacgacctgctcagagtctgcatcacaaaacgacgatggatcaagaagtaaggatgaaacccgcgtatccactaatggaagcgatgaccccgaagacgctggagcaggagaaaacagaagggtgtctgggaacaattctccatctctctccaatggggggttcaagcccagtcgcccaccacgcccttcccgacctccccctccaacccccagaagacccgcttctgtaaacggtagtccctctgctacatccgaaagtgatggcagtagtactgggtcccttcctcccacaaatacaaacacaaatacatcagaaggcgccacttctggcctcataattccactgacgatatcaggagggtccgggcctcgccccttgaatcccgtgacacaggcgcctctaccccccgggtgggagcagcgggtggaccagcacggaagggtatattatgtggaccacgtcgaaaagcgaaccacctgggatagacctgagccgctgcctcccggatgggagcgaagggttgataatatgggcagaatttactacgtagaccatttcaccaggacaaccacatggcaaaggccgacattggagagcgtgaggaactacgagcaatggcagctgcaacgtagccagcttcagggtgcgatgcagcagtttaatcagcgatttatctatgggaaccaggatctattcgccacaagccagtccaaggaattcgaccccctaggcccacttcctcctgggtgggagaagcgtacagattcaaacggcagggtgtactttgttaatcacaacactcggataacccagtgggaagatccaaggtcacagggccagttgaacgaaaagcctttaccggaaggttgggaaatgagatttaccgtggatggaatcccgtactttgtcgaccacaacaggcggactaccacctatatagatccccggactggcaagagcgccctagacaacggaccccagatcgcatacgtgagggatttcaaagccaaggtccagtattttagattttggtgtcagcaactagccatgccacaacacattaaaattacagtgactcggaaaactctcttcgaggactcttttcaacaaataatgtcttttagcccgcaagaccttagaagacgactgtgggtgatctttcctggcgaagagggtctagattatggtggcgttgctcgtgagtggtttttcttactgagtcatgaagtgctgaaccccatgtattgtctgtttgaatacgcgggaaaagataattattgcttgcagatcaaccccgcctcctatatcaacccggaccatctgaagtactttaggtttataggacgtttcattgcaatggcactgtttcatgggaaatttatcgacacggggttctccttaccattttataagaggatcttaaacaaaccagtgggtttgaaagatctggaaagcattgatcccgaattttacaactcactgatttgggttaaggagaacaacatcgaggagtgcgatctagaaatgtactttagcgttgacaaagagattctgggggaaatcaagagccatgaccttaagcccaacggtggaaatatactggtcactgaagaaaacaaggaagagtacatccgaatggtcgccgaatggcgcctgtcgcgaggagtggaggagcagacgcaggccttcttcgaggggttcaacgaaatactgccacagcaatatctgcaatatttcgatgccaaggagctagaggtattactctgcggaatgcaagaaatagatctaaacgattggcagagacatgctatctaccggcattatgccagaaccagtaaacagattatgtggttttggcagttcgtcaaagagattgacaatgaaaaaagaatgagattgcttcaatttgtgacagggacatgcaggctgccagtcggagggttcgccgatctgatgggttccaatggcccccagaagttctgtatcgaaaaggtgggaaaagagaactggctgcctcgaagtcatacttgtttcaaccgccttgacctccccccttacaagtcttatgaacagctgaaggagaagctcctatttgcaatagaagaaacggaaggatttggccaggagtag

SEQ ID NO: 192061 - DNA, 3717 bp, Artificial Sequence
  Description of Artificial Sequence: Synthetic coding sequence
atgcgggcccagggccggggccggctgccccggcggctgctgctgctgcttgctctttgggtccaagccgctcggcccatggggtacttcgaactccaactttcagctctccgcaatgtcaacggggagctcttgtctggggcctgctgtgacggggatggccgcacaacaagggccggagggtgtggacacgacgaatgcgacacatatgtccgcgtttgtttaaaagagtatcaagccaaagtcactcctaccggaccatgctcgtatggacacggggcaacgcccgttctgggtggcaactctttctacctgccgcccgcaggagctgccggcgacagagcaagggctcgtgccagagcgggcggagatcaggacccaggactagtcgtcatcccatttcaattcgcttggcccaggtccttcacacttatcgtggaagcatgggattgggacaacgacacaactcccaacgaggaactgctaatagagcgtgtctctcacgccgggatgatcaaccctgaagacagatggaagagcctgcatttctctggccatgtagctcatctggagctgcaaatacgagttaggtgtgacgagaattactacagcgcaacgtgtaataaattttgtcggcctcgaaacgacttctttggacactacacatgcgaccaatatggcaataaagcatgtatggatggttggatgggcaaagagtgtaaggaggccgtctgcaaacaggggtgtaatctgctacatggtggctgtaccgtacccggggaatgtcgctgctcgtacggttggcagggccgattttgcgacgaatgcgtgccctacccaggatgtgtgcacggttcatgcgtggaaccctggcagtgcaactgcgagacaaattggggcggattgctgtgtgacaaagacctgaattattgcggaagtcaccacccctgtaccaacgggggaacttgcattaacgctgagcccgatcagtataggtgcacttgtccagatggctactcaggcaggaactgcgagaaagcagagcacgcttgtacaagcaatccttgtgctaacggcgggtcctgccacgaagttcccagcggatttgagtgccattgtccatcaggatggtcaggcccaacctgcgccttagatattgacgaatgtgctagtaatccctgcgcagctggagggacatgtgtggatcaggtggacggtttcgagtgcatctgccccgaacagtgggtgggggccacatgtcagctggacgctaacgagtgtgagggcaaaccttgtctgaatgctttttcctgtaaaaacctcattggagggtattattgcgactgtatacccggctggaagggcatcaattgtcacattaatgtcaatgactgccggggtcagtgccaacatggcgggacatgtaaggatctggtgaacggttatcagtgtgtttgccctaggggattcggcggaaggcactgcgaattggagagagatgagtgtgctagctctccgtgccatagcggggggctgtgtgaagatctcgcagacggtttccattgtcactgtccgcagggattcagcggtccactgtgtgaggtggatgtcgacctttgtgagcctagcccctgccgcaatggtgctaggtgctacaacctcgagggagactattactgcgcatgtccagatgattttgggggcaagaactgttctgtgcctagagaaccctgtcctggcggcgcttgccgagtaattgatggatgcggctctgacgccggtcctggaatgcctggaactgcggccagcggcgtctgtgggccccacggaaggtgcgtctcccagcccggcggaaacttcagctgcatatgcgattccggattcaccgggacgtattgtcatgagaacattgacgactgcctaggccagccttgtcgcaatggcggcacatgcatcgacgaagtggacgccttccgatgcttttgtccttccggctgggaaggcgagctatgcgataccaaccccaatgattgtttaccagacccttgccacagccgcggacgttgttacgatctggtaaacgatttttactgtgcttgcgatgacggatggaagggcaaaacttgtcatagtcgcgaattccagtgtgacgcctatacatgttctaacggaggaacatgctatgacagcggtgatacatttcggtgcgcctgtcccccggggtggaagggaagtacctgtgcggtggctaagaacagctcgtgtttaccaaatccttgtgtgaatggagggacatgcgtgggaagcggggcctcgtttagttgcatttgtagagacggctgggagggtagaacatgtacacacaacactaatgactgcaatcccctgccgtgctataatgggggaatttgtgtggacggagtgaactggtttcgctgtgagtgcgctccagggtttgccggccctgactgccgaatcaatattgacgaatgtcagagctctccctgtgcatatggtgctacatgcgtagacgaaatcaatggatataggtgtagctgcccacccggacgagctggcccccgatgccaagaggttatcggcttcggacggtcttgctggtcacggggaacacctttcccacacggatcctcttgggttgaggattgcaactcctgtcgctgtctcgacggcaggagagactgttcaaaagtttggtgtgggtggaaaccctgtttgttggccggacagcctgaagcattgagtgctcagtgtccgcttggccagcggtgtctggaaaaggcgccaggacagtgcctgagaccaccgtgtgaagcctggggggaatgcggagccgaagaaccgccttcaaccccatgtttaccccgctctggccacctggataataattgtgcacgcttgaccttacattttaaccgtgaccacgtgcctcagggaacaaccgtcggtgccatatgttctgggattcgcagtctcccagccacgcgcgctgttgccagggacaggctcctggtgctgctgtgtgaccgggccagcagtggagcctccgctgtagaagtggcagtcagcttttctcctgcacgcgacctgcctgactcttctcttatccaaggcgctgctcatgccatagtggcagccataacacagcgcgggaatagtagcctgctcctggctgtcactgaagtaaaagttgaaacggtcgtgaccgggggttcctcgactggcttgctcgtgccggtgctgtgcggtgcattttccgtgctgtggctagcttgtgtcgttctgtgcgtttggtggactcggaagcgaagaaaagagcgtgagagaagtcgcctgccgcgggaggaaagtgccaataatcagtgggccccacttaatcctatcaggaatcctatcgagcggccaggaggacataaggacgtgctgtaccaatgcaaaaatttcacaccgcccccacgaagagccgacgaggcactgcccggcccagctggacacgccgccgttcgcgaggatgaggaagacgaggacttgggccgtggggaggaagatagtttagaggcagagaagtttctgtcacataagtttactaaggatccaggacggtctcctggacggccagcccattgggcctccggcccaaaggtagataatcgggctgtccggtcaataaacgaagctcggtatgctggcaaagaatag

SEQ ID NO: 192062 - DNA, 3603 bp, Artificial Sequence
  Description of Artificial Sequence: Synthetic coding sequence
atgcgggcccagggccggggccggctgccccggcggctgctgctgctgcttgccttgtgggtgcaggcagcacgccctatgggctattttgaacttcaattatcggccttacgaaacgtcaacggggaactgttgtccggagcctgttgcgacggagacggccgtactacgcgcgccggcggctgtgggcacgacgagtgcgatacatacgtccgcgtgtgtttaaaagagtaccaggctaaggttacccctacagggccatgtagctatggacatggcgcaacaccagttttgggaggaaactctttttacttacctccagcaggagctgctggcgatagggctagagcccgagctcgcgccggcggggaccaggatcctggcctcgtggtcatacctttccagtttgcttggccccggagctttaccctcatcgttgaagcttgggattgggacaatgacacaactcccaacgaggaactgctcattgagagagtgtctcacgctggcatgattaatcctgaggacaggtggaaaagcctgcacttctcaggccacgttgcacatctggagctacagataagagtgaggtgcgatgaaaactactatagcgccacatgcaataaattttgtagacctcgaaatgatttcttcggacattacacttgtgaccagtatggaaataaagcctgtatggatggatggatggggaaagaatgtaaagaagcggtttgcaagcagggttgtaacctcctgcacgggggctgcacagttccgggcgagtgccgctgttcctatgggtggcaaggccggttctgtgatgagtgtgtgccctaccccggttgtgtgcacgggagttgtgtggagccctggcagtgcaactgcgagaccaactggggaggacttctctgtgataaagatctcaattactgtgggagccaccatccttgtaccaacggcgggacctgcatcaacgctgagccagaccaatatcgctgtacctgcccagacgggtacagtggaaggaactgcgaaaaggccgagcacgcatgcacgagcaatccatgcgctaatggtgggagttgtcacgaggtcccttcgggtttcgaatgtcattgcccctccggatggagcgggcctacgtgcgccctcgatatagatgagtgcgcgtctaatccatgcgctgcgggaggcacatgtgtcgatcaggtcgatgggtttgagtgtatttgcccagagcagtgggtgggtgccacatgccaactggatgtgaacgactgccgcggccagtgccagcatggcggcacttgcaaagacctcgtcaatgggtatcagtgcgtatgtcccaggggctttggcggacgccactgcgaattagagcgcgacgaatgtgcatcctcaccatgccacagcgggggtctttgcgaagatctggccgacggctttcactgccattgcccacagggattttcaggtcctttatgtgaggtggacgttgacttgtgcgaaccgtcaccgtgtcggaatggcgccagatgctataatctggaaggggactattattgtgcctgcccggatgacttcggcggcaagaactgttcggttcctcgggagccttgccccggaggagcatgccgggtgatagacggatgtggctcggacgccgggccagggatgccgggcacagccgctagcggggtttgcggcccccacggacggtgcgtgagccaacctgggggcaacttctcatgcatctgcgacagtggattcaccggaacctattgtcacgagaacattgacgactgtctgggtcaaccatgtaggaatggtggaacttgtatcgatgaagtggatgctttcagatgcttctgtcctagtgggtgggaaggtgaattatgtgatacgaaccctaatgactgcctcccagatccatgccattctagaggccggtgttacgacctcgttaacgacttctactgtgcgtgtgacgacggatggaaaggaaagacatgccacagtcgtgagtttcagtgtgatgcttatacctgctctaatgggggaacctgctatgattcaggcgacacgttccgctgtgcgtgtccaccaggatggaaggggtctacatgtgcagtggcgaagaactcatcttgcctgccgaatccttgcgtgaatggcgggacttgcgtgggtagcggcgccagcttctcatgtatatgtagggacgggtgggaagggcggacatgcacccataataccaacgactgcaaccccctgccttgttacaatggcgggatctgtgtggatggagtgaactggtttagatgtgaatgcgctcccggcttcgccggaccagactgcaggattaacatcgacgaatgccagtcttcgccctgcgcctatggggccacctgcgtagacgaaatcaacggttataggtgttcgtgtccacccgggagggccggacctcgctgtcaggaagtgattgggtttgggcgctcttgctggtcccggggcactccatttccccacgggtcttcttgggtggaagattgcaatagctgtcgttgtttggatggtcggcgcgattgttcaaaggtgtggtgtggctggaaaccatgcctcctagccggccaacctgaggcccttagtgcacagtgtcctctgggccagaggtgtttagaaaaggcccctggccagtgtctgagaccaccttgcgaggcctggggggaatgcggcgctgaggagcctccaagcaccccatgcttgccccggagtggccatttagataacaattgcgcccgtctgacattgcatttcaacagggaccacgtgccgcaagggacgacggtcggggcaatatgcagcggcatcaggtccctccccgctacacgggctgtcgcccgcgacagactcctggttctgctctgcgacagggcttcatcaggcgcttcagccgtggaggtggcagtcagttttagtccggctagagatcttcccgactcctctttaatacagggagccgcccatgctatcgtggcagccatcacacaacgtggtaattcttctctgctgctggctgtgaccgaagtgaaggtggagacggttgtgaccgggggatcctcgacaggtctgctggtgccagtgttgtgtggcgcgttttccgtactgtggcttgcctgcgttgtactgtgtgtgtggtggacgcgcaagcggcggaaggaaagggagaggagcagactgcctcgggaagaatcagccaacaatcagtgggcaccattaaatcccattcgcaatccgatagagcgccccggggggcataaggacgtgctgtatcaatgtaagaacttcacgccaccccccagaagagcagatgaagccctgcccgggcctgccggtcatgcggccgtgcgggaggacgaggaggacgaggacctggggaggggcgaagaggactcacttgaggcggagaaatttctgtctcataaattcactaaagatcccgggcgctctccaggccgcccggcgcactgggcgtccggaccaaaagtcgataacagggccgtgagatctatcaatgaagccagatatgcaggtaaggagtag

SEQ ID NO: 192063 - DNA, 3465 bp, Artificial Sequence
  Description of Artificial Sequence: Synthetic coding sequence
atgcagtacctgaacatcaaggaggactgcaacgccatggccttctgcgccaagatgcgcagctccaaaaaaactgaagtgaacttagaggctccagagccgggagtcgaggttatattttacctgtccgacagagagcccttgaggctgggatccggcgagtacaccgccgaagaactttgcatccgcgccgcacaagcatgtagaatttccccactttgccacaatttgtttgctctgtacgatgagaatactaaattatggtacgctccaaatcgaaccattactgtagacgacaagatgagccttaggttgcactaccgaatgagattttattttactaactggcacgggacgaacgacaacgagcagtcagtttggagacactctccaaagaagcaaaaaaatggctacgaaaaaaagaagatccccgatgccactccacttctggacgcctcatccttagagtatctgtttgctcaagggcagtacgacctggtaaagtgccttgcccctatccgggacccgaaaaccgaacaagatggccacgatatcgaaaatgagtgtttaggtatggccgtcttagcaatcagccattacgctatgatgaagaagatgcagctgcctgaactgccaaaggacatctcttataaaaggtatataccggaaactttgaacaagtccatccgccagaggaacttgctaactcgcatgcgaatcaacaacgttttcaaagacttcctgaaagaatttaataataagactatttgtgattcgtcagtgtcgactcacgacctcaaagtgaaatacctagctacgctggaaactctcacgaagcactacggagcagagattttcgagacctctatgctccttatatcctccgaaaacgagatgaattggttccatagtaacgatggcggtaatgtcctatattacgaggttatggtgactgggaaccttgggatccaatggagacacaaacccaatgtggtctcggtggaaaaggaaaagaacaagctcaagagaaaaaaattagaaaataagcacaagaaggacgaagagaaaaataaaatcagggaagaatggaacaacttcagctactttccagagatcacacatatagtgatcaaggagagtgttgtatcgattaacaaacaggataataagaaaatggagctcaaactgagttcgcatgaggaagccctgagcttcgtgagcctcgtcgacggctatttccgcctgacagctgacgcccaccattatctctgcactgacgtggccccccccctgattgtccacaacatccaaaatggatgccatggacctatttgtacagaatacgcaataaataaactgcgacaggagggctcagaggaggggatgtatgtcctccggtggtcttgtacagattttgacaacatactgatgacagtaacatgttttgagaagtcagagcaagttcaaggagcccaaaagcagtttaaaaactttcaaatcgaagtccagaagggcagatacagtctgcacgggtccgacaggtcctttccatcgctgggtgatctgatgtctcacctgaagaaacagattctgagaactgacaatatttccttcatgctaaaaagatgttgtcagccaaagccccgggaaatcagcaacctgctggtagctacaaagaaggcccaggaatggcaacccgtgtaccccatgagtcagctttcattcgatcgtattctgaagaaagacctggtgcaaggcgagcatctgggccgcggcacaagaacacacatttactccggcacccttatggactacaaagacgacgaggggacctctgaggagaagaaaatcaaggtaatcctgaaggtactggacccctctcacagagatatcagcctggcattttttgaggcagcttccatgatgagacaagtcagccataaacacattgtgtacctgtacggggtgtgcgttcgcgatgtggagaatatcatggtagaagagtttgtcgaaggcggcccgctggacctgtttatgcatcggaagtccgacgtgctgaccacaccatggaaattcaaggttgccaaacagcttgccagcgccttgagctacctagaggataaggatttggtgcacggtaacgtgtgcacaaaaaacttgttactcgctcgcgagggcattgactcagaatgcggcccttttattaaattaagcgatccgggaatcccgataacagtactctctcgacaagaatgtatcgaaagaattccgtggatcgctcccgaatgtgtcgaggacagtaagaatctttccgttgctgccgacaaatggagtttcggcacgaccctgtgggagatttgttacaacggcgaaatccccctgaaggacaagaccctgattgagaaggagagattctatgaatcccgttgccgacccgtgacgccttcttgtaaagaactcgcggaccttatgacaagatgtatgaattatgatccaaaccaaagacctttttttagggccataatgcgtgatattaacaaacttgaagaacagaatcccgacatcgtgtcagagaagaagcctgcgactgaagttgacccaactcattttgagaaacggtttctcaagcgaatccgggaccttggcgaggggcattttggaaaggtcgagctctgtaggtacgatcctgagggtgataacacgggggagcaggtcgcagttaagtccctgaagccggagagcggcgggaaccacatcgcggacctgaagaaagagattgagatcctgcgtaacctgtatcacgagaacattgtgaaatataaaggaatctgcaccgaggacggcggcaatggtatcaaacttattatggaattcctcccttcgggctctctcaaggaatacctgcctaagaataaaaacaagatcaatctgaaacagcagctcaagtacgctgtgcaaatatgcaagggaatggattacctgggaagcagacaatacgtgcatcgtgacctggctgctcgaaatgtcctggtcgaatctgaacaccaggtcaaaataggtgatttcggtctgacaaaggctatcgaaaccgacaaggagtactacacagttaaggacgaccgggacagccccgttttctggtatgcccccgaatgcttgatgcagtctaaattctatattgcatcagacgtctggtcttttggagtgacactgcacgaattacttacatattgtgactctgatagctcgcccatggccttatttctaaaaatgatcggacctactcacgggcagatgactgtgaccaggctggttaacacgctaaaggaaggtaagcgtctgccctgtcccccaaattgtcccgatgaagtgtaccaattgatgcggaaatgctgggagtttcagccttcaaatcggacttcattccaaaacctgattgagggctttgaagcactcctcaagtag

SEQ ID NO: 192064 - DNA, 1860 bp, Artificial Sequence
  Description of Artificial Sequence: Synthetic coding sequence
atggccccccccagcgaggagacccccctgatcccccagcggagctgctcactactatctacagaggccggtgccctgcacgtgcttctgcctgcgcgcgggccggggcctccccagagactgagtttctcttttggtgaccaccttgcagaagacctctgtgtacaagccgccaaagcctctggcatcttacccgtgtaccacagcctgttcgccctggcaacagaggatttgagctgttggttccctccttcccatatcttttccgtcgaggacgccagcacccaggtcctcctgtataggattaggttttatttcccgaactggttcgggttggaaaagtgtcaccgttttgggctgcggaaagatttagctagtgctattctggatttgccagtcctggaacacctcttcgcccagcatcgctcggatctggttagcgggcgactccccgtcgggctctcgctcaaagaacagggggaatgtctttccctggcagtactggatcttgccaggatggctcgggaacaggcgcaaagacccggagagcttctgaagaccgtgtcatataaggcttgcctccccccatcactgcgtgacttaatacaggggctttcttttgtgacacgtagacgcattcgccggacagtgagacgcgctcttcggagagtggcagcgtgccaggctgaccgccactccctaatggccaagtacatcatggatttggagcggttggaccctgcaggggctgcagagaccttccacgtgggcctgcccggcgccctcggcgggcatgacgggctcggtctcctgcgggtcgccggcgacgggggcatagcgtggacccagggcgagcaggaagtgctgcagcccttttgtgacttccccgaaatagtcgatatcagtataaaacaggctcccagagtgggtcctgctggcgaacacaggttagtgaccgttacacggacagataatcagattcttgaggcagagtttcccggactgccagaagcgctttcctttgtcgccctggtcgatggatactttcgactgaccaccgacagccaacacttcttttgtaaagaagtcgctcctcctagactgctcgaggaggtggccgaacaatgccacggtccaatcactttagatttcgctataaataagttaaaaactggtgggtccaggcccgggagctacgtgctacgcaggtcccctcaagatttcgattcctttctcttaactgtatgcgtgcaaaaccccttgggccctgattacaaaggctgtctgattcgcaggtctcctacaggtaccttcctgctggtcggcttgtcacgtccacattcttcactaagggaactgctggcgacctgctgggacggcgggctccatgtggacggagtggctgtgactctaactagctgttgcattccccggcctaaagaaaagagcaacctgattgtggtccagcgcggacactctccccccacttcgtctctggttcagccccaatcccagtaccagctttctcagatgacgtttcataaaatccctgccgactcgctagaatggcacgagaacttaggccacggatccttcaccaaaatctataggggatgtcgtcatgaggtggttgatggcgaggcgcgtaagaccgaagtactgctgaaagttatggatgccaagcacaaaaactgcatggaatcattcttagaagcagcatcgctcatgtcgcaggtgtcctaccgccacttagttttgcttcacggtgtgtgcatggctggagacagcgagtctcccccacccacacaccctactcctgccagcccgaaatctagattatttttccctccactcttttag

SEQ ID NO: 192065 - DNA, 3375 bp, Artificial Sequence
  Description of Artificial Sequence: Synthetic coding sequence
atggccccccccagcgaggagacccccctgatcccccagcggagctgcagcctgctgagtaccgaggcaggcgccctgcatgtcctgctcccggctagaggccccggcccgccgcagaggctctcctttagctttggagaccacttggctgaagatctttgcgtccaggcggcgaaggcttctggaatccttcctgtgtatcacagcttgtttgcccttgccacggaagacctgtcctgttggtttccaccatcacatatcttcagtgtcgaggatgcatccactcaggtgctcctctacaggatcagattctacttcccgaactggtttggcctggagaaatgtcacagatttggactacgcaaggatctcgcttcagcgattctggacctgcctgtgctcgaacacctgttcgcccagcacaggagtgacctagtaagtggccggttgccagtgggattatctctcaaagagcaaggagagtgtctgtcactggccgttctcgacttagcaaggatggcccgcgagcaggcccagcggccaggagagttgttaaagaccgtttcatataaagcttgcctccccccatcactgcgcgacttgatccagggcttgtcctttgtcaccagaagaagaatccggcgaacagtacgccgtgcactgagacgggtcgcagcttgccaggctgatagacactctttaatggcaaagtacatcatggacctggaaagacttgatcctgctggggctgctgagacgttccatgttggcctgcccggagcacttggcggtcacgacggcttgggcttactgagggtcgcaggtgacggcgggatcgcatggactcagggagaacaggaggttctccagccattttgtgattttcccgagatcgtcgacatcagtattaagcaagcaccacgcgtcgggcctgcaggtgaacaccggctggttactgtgacacgaacagataatcagattctggaggccgagttccccggtttgcccgaggccctgagttttgtggccttggtcgatgggtatttccgactgacgacagactctcagcactttttctgtaaagaggtggctcctccacgcctgctagaggaggtggctgaacagtgccacggacccataacattggactttgcgataaataaactgaaaacaggaggctccagacccggttcctatgttctgaggcgcagcccacaagactttgattcgttccttctcacagtgtgtgtgcagaatccattgggacccgactataaaggctgcctgatccggcggtcacctactggcacattcctcctagtgggtctctctagacctcacagctcactccgagagctcctggcaacatgctgggacggcggcctgcacgttgatggagttgcggtcaccctcacaagctgttgtatacccagacccaaagaaaaatccaatctgatagtagttcagaggggccactccccaccaaccagcagcctggtacagcctcagtcccagtaccagctttctcagatgacattccacaagatccctgctgactccctggaatggcacgaaaacctgggccatgggtcctttaccaagatctacagggggtgtagacacgaagtggtggacggtgaagcccggaagactgaggtgcttctcaaggtaatggacgccaaacacaagaattgcatggagagctttctggaggctgccagtctgatgtcccaggtgtcatatcggcaccttgtactattgcatggcgtctgcatggctggagattccaccatggttcaagagttcgtccatctgggagccatcgatatgtacttgaggaaacgggggcacctggtccccgccagctggaagcttcaagttgttaaacaactcgcttacgcgctgaattacctggaggataaaggcctgccacacgggaacgtgagtgcccggaaggtcttactggcacgcgagggggccgacggctcacctccgtttattaaattaagcgatccaggagtctcccccgccgtcctgagcttggaaatgcttactgaccgcattccgtgggtggctcccgaatgtctaagggaagcacaaacattgtctttggaggcagataagtggggcttcggggctaccgtttgggaggtgttttccggcgtgacaatgccaatttcagccctggaccctgctaaaaaattgcagttttatgaggaccggcaacagcttccagctcccaaatggacagaattggcccttctgatccaacaatgcatggcttacgagcctgtacagagaccatcttttcgcgcggtaatcagagatctgaactccctaatcagctctgattacgagttgctttcggaccccacaccaggcgcactggcccccagggatggtctttggaatggagcccagctatacgcatgtcaggacccaaccattttcgaagaacgccatcttaagtacatctcccaattgggaaagggcaacttcggttccgttgaactatgtcgctacgatcctctcggagataatacaggtgcactggtggctgtcaagcagctgcagcatagcggtcctgaccaacagcgcgattttcagagagagatccagatcttgaaggctctgcacagcgatttcatcgtcaagtatcgcggtgtatcatatggccccggtaggcagtccctccgcttagtgatggagtaccttccttctggatgcctgagagatttcctgcagcgtcatagagccagacttgacgccagtagattgttgctctacagctcacagatatgtaaagggatggagtacctcggatctcgccgctgcgtccatcgcgacctggcagctagaaatatcctcgttgagtccgaagctcatgtgaagatcgccgactttggcttagccaaactgctccccttggacaaagactattacgtagtgagagagcctggccagtctcctatcttttggtatgcgcccgagagtttgagtgacaacatcttctccagacagtccgacgtctggtcttttggcgtcgtgttgtatgagctcttcacttactgcgacaaatcgtgctctcctagtgccgagttcctccgtatgatggggtgtgaaagggacgtgcctgccctctgccgtttactggagctgctggaagaaggccagcgcttgcccgcccccccggcttgcccggccgaagttcacgaactgatgaagctgtgctgggccccatccccgcaggatagaccgtctttctctgccctgggtccccagctcgacatgttgtggtctggtagcaggggatgtgaaacacatgctttcaccgcccaccctgaagggaaacaccactccctcagtttctcttag

SEQ ID NO: 192066 - DNA, 3375 bp, Artificial Sequence
  Description of Artificial Sequence: Synthetic coding sequence
atggccccccccagcgaggagacccccctgatcccccagcggagctgcagtctactgagtacagaagctggagccctgcacgtccttctgcccgcgcgggggccaggtcccccccaaagactgagcttttctttcggcgaccatcttgccgaggacctgtgtgttcaagccgccaaggcatctggtattctgcctgtctatcactcattgtttgcactcgcgaccgaggatctatcttgttggttcccgccctcgcacattttctcggtggaagacgcctcgactcaagtgctcctctataggattcggttctacttcccgaattggttcggcttagagaagtgccacaggttcgggcttaggaaggacttggcctctgctatcttagatctcccagtactcgagcatcttttcgcccagcaccgttctgatctcgtgtcgggaaggctccctgtgggactctccttgaaggagcagggagaatgcttaagcttggctgttcttgacctggctagaatggcaagggaacaggcccagcggccaggggagttactcaaaactgtgagctacaaggcgtgtctcccccccagcctgcgcgatttgatacaggggctatctttcgtgactagaaggaggatccgccggacggtgcggcgcgccctgaggagagtggctgcctgccaggctgatcgtcattcactcatggccaagtatattatggatttggaaaggctagaccccgcaggcgccgcggaaactttccacgtggggctgcctggagctcttggcgggcacgatgggttaggcttgctaagggtagccggcgatgggggcatcgcctggacccagggagaacaggaagtcctgcagcccttttgtgactttcccgagatcgttgatatctctattaaacaggcccccagggttggacctgcgggtgagcacagactcgtgacagtgaccaggacggataatcaaattctcgaggctgaatttcctggcttgcctgaagcgctgagcttcgtcgctctggttgacggatatttccggttgacgacagactcgcagcattttttctgcaaagaggtcgctcctccccggcttctggaagaagtcgcagagcagtgccacggacctattacattagatttcgccatcaacaaactaaagacaggcggatctcgcccgggctcctacgtgttgcggagaagccctcaggattttgattcctttcttctgaccgtctgcgtgcagaatccactcggccctgactataagggttgtctgattaggcgttcccccactggcaccttcttgctggtcgggttgtcccggccccatagctctctcagagagcttctggccacctgctgggatggaggcctgcacgtcgatggggtggcagttacccttacgtcttgctgcatccctcgccccaaggagaaatctaacctgatcgtggttcaacgcggtcattcgccgcccacctcatccctggtacaacctcaaagtcagtaccagttatctcaaatgactttccataagatcccagcagattccctcgagtggcacgagaacttgggccatgggagcttcacgaagatatatagaggatgtaggcacgaagtagtggacggtgaggcccggaagaccgaggttctcctgaaggtgatggatgctaagcacaagaactgcatggaatccttcctcgaagccgctagcctcatgtctcaagtctcttaccgccacttagttcttctgcatggcgtgtgcatggctggtgatagcaccatggtgcaggaatttgttcacctcggcgccatcgacatgtatctaaggaaacgaggccacctagttcctgcttcatggaagctccaggtggtcaagcagctggcatatgccctgaattatctcgaggacaagggcttaccacacggaaacgttagcgccaggaaggtcctgctggctagggagggtgcagacggctcccctccgtttatcaagctgtccgatccgggcgtgtcacccgccgtgttgagcttggaaatgctgaccgacaggatcccgtgggtcgccccagaatgtcttagagaggcgcaaaccctgtctcttgaagccgataagtggggatttggagcgacggtctgggaagtgttttcaggtgtcacaatgcccattagcgctctggaccctgcgaaaaagctccagttttatgaagacagacagcagctcccagcgccgaaatggaccgagctggcgctgttaatccagcagtgcatggcgtatgaacctgtgcaacgcccgtcgtttagggctgtaatcagggatttgaatagtctcatctcatcagattatgaacttctgtctgatcctacaccgggcgcgctggctcctagagacggactgtggaatggtgcccagctgtatgcgtgccaagatcccaccatctttgaggagaggcacctaaagtacatctcccagctgggaaagggtaactttggaagtgtcgagctctgccgctatgaccctctgggtgataataccggagcgctggtggctgttaagcagctgcagcattcaggacccgatcagcagcgggatttccagagggagatacagatactgaaagccctgcactccgattttatcgtgaaatatcgcggagtatcctatggccccggcaggcaaagtcttcgtctggtgatggaatatcttcctagcggatgcttgcgcgatttccttcagcggcatcgcgctagactggacgcaagccggcttttgctctactcttctcagatctgcaagggtatggagtacttgggatcacggcgttgcgttcacagggacctcgctgctaggaatatcctggttgagtccgaagcccacgtgaagatcgccgactttggcttggctaagttgttaccgcttgacaaggattactacgtcgtgcgggagcccggccaatcgccaattttttggtacgctcctgagagcctgtcagacaatatattttcccgtcagtccgacgtgtggtcctttggcgtggtgctctacgagctttttacatattgtgacaaaagctgtagcccatctgccgagttcctgcgcatgatgggatgcgagagagacgtccccgccctgtgccgattgctggaactgctcgaagagggtcagagactacccgccccgcctgcctgccctgcagaagtccatgaattgatgaagctgtgttgggcacccagccctcaggaccgtccatccttctctgcgctcgggccccagcttgacatgctgtggtcgggatccaggggatgcgagacacacgcatttacggctcacccagagggaaagcatcactccctgtccttctcctag

SEQ ID NO: 192067 - DNA, 3285 bp, Artificial Sequence
  Description of Artificial Sequence: Synthetic coding sequence
atggccccccccagcgaggagacccccctgatcccccagcggagctgttcactgttgagcaccgaagccggagcattacatgtcctactgccagctcggggaccggggcccccacagcgcttgagctttagctttggggaccacctcgcagaggacctgtgcgtgcaagcagcaaaagccagtgggattctccctgtgtatcatagcttgttcgctttagccactgaagatttaagttgttggttcccgccctcccacatctttagtgttgaggacgcttctacccaagtcttactataccgcataagattttacttccccaactggtttgggttagagaaatgtcacagattcggcctgaggaaagatctggcaagtgcaatactggatctcccggtcctggagcacctcttcgcacagcaccggtctgatctggtctctgggaggctccctgtggggttatcacttaaagagcaaggcgagtgtcttagtttggccgtattggatctggccagaatggcaagagagcaggctcaacggcctggtgagttgttgaagacagtctcctataaagcttgcctcccccctagcctccgggatctgatccagggcctgtcttttgtgaccagaaggcggatcaggaggacagtgcggcgagctcttcgcagggtggctgcatgccaggctgacaggcacagtctcatggcaaagtacataatggatctcgagcgactggaccctgctggagcagccgagacgttccatgttggactgccgggtgccttgggcggccacgatggcttgggcctgctcagagtggccggcgatggcggcattgcatggacccaaggcgaacaggaagttctccagccgttctgtgactttcccgagattgttgacatcagcattaagcaggcaccaagggtgggccccgctggcgagcaccggctggtgacagttaccagaacagacaatcaaattctggaggcagaattcccaggactgcctgaggcattatccttcgtggctttagtggacgggtacttcagactcaccactgactctcagcatttcttttgtaaggaagtagccccccctagactgctggaagaggtggctgagcaatgccacggacctattactctggattttgcaattaataagctcaagaccggaggcagccgacccgggagctacgttctgcgaaggtcaccacaggactttgattccttcttgctgacagtgtgtgttcagaacccccttggtcccgactacaaggggtgtctgattcggagaagtcctacaggaaccttcctgctggtgggtctgagcaggccacacagttcactgagagagcttttagcaacctgttgggatggtggtctccacgtggacggggtcgccgtcacactcacaagttgctgtattccgcgccccaaagaaaagtccaacttaatagttgttcagcgcggacactccccgcctacctcgtccctcgtccagcctcaatcccaatatcagctctcccagatgacctttcataagatccctgctgacagtctcgaatggcatgaaaacctgggccatggaagctttactaagatatatcgcggctgcagacacgaggttgtggatggcgaggcccggaaaacggaggtgttactcaaggttatggatgctaagcacaagaattgtatggagagttttctggaagccgcatccttaatgtcccaggtgagttacagacacctggtattgctccacggcgtgtgcatggctggcgactctacgatggtccaggaattcgtccatcttggtgctattgatatgtatttgcggaaaaggggacaccttgtgccagcgagctggaaattgcaagttgtcaagcagctggcctacgcgttgaactacctagaggacaagggcttgccacacgggaatgtgtcagcccggaaggtgcttctcgcccgggaaggggctgacggatctccgcccttcatcaaactgtcagaccccggggttagtcctgcagtcctgtcactggagatgctcactgatcggattccctgggtggcccccgaatgcctccgcgaggcacagaccctcagcttggaagccgacaagtggggatttggtgccaccgtttgggaagtcttctccggtgtaactatgcccattagcgctctggaccctgctaagaagttgcagttctacgaagacaggcagcagctccctgcaccgaagtggactgagctggctttacttatccagcagtgcatggcatatgagcccgttcagcggccttctttcagggccgtcatccgtgacttaaactcactgatctcttcagattacgagttgttatctgacccaacacctggcgcgctggctccacgcgatgggctgtggaacggggcccagctctacgcctgccaggatcccaccattttcgaggaacgccatctgaaatacatttcacaactcggtaagggaaacttcggttcagtcgaactttgccgctatgaccccttgggcgataacactggtgctttggtcgcagtgaaacagctacagcactctggccctgatcagcagcgcgactttcaacgagaaatccagatactcaaggctctgcatagcgacttcatcgtgaagtaccgaggggtgagttacggcccgggaagacagtccctgaggctggtgatggagtacttgcctagcggctgtctgagagatttccttcaacgccaccgagctaggctggatgcgtcccgtctgctcctctactcctctcagatctgtaaaggaatggagtatttgggttcaagacgctgcgtgcacagagatctggccgctcggaatatactggtggaaagcgaagcacatgtgaaaatcgccgattttgggcttgccaagctcctaccactcgataaggactactacgtggtgcgcgagcccggacaaagccccatattctggtatgcccccgaatccctaagcgataacattttttctaggcagtccgacgtctggagcttcggggtcgtcctctacgagctttttacatattgcgacaaatcttgcagcccaagcgctgaattcttaagaatgatgggttgtgaacgtgacgttcctgccctctgccgcctactggaactgctcgaagaaggccagaggctcccagcacctcctgcatgccctgcagaagtttctgcggccggactcgccagcgtcagccagtccgttgattgggcaggcgtgtccggcaagcctgcaggcgcctag

SEQ ID NO: 192068 - DNA, 1575 bp, Artificial Sequence
  Description of Artificial Sequence: Synthetic coding sequence
atgagcggcaagcggaagcgggtggtgctgaccatcaaggacaagctggacattatcaaaaaactggaagatggtggaagcagcaaacagctggctgtcatttatggaatcggcgaaactactgtgagagatatccgcaaaaacaaggaaaagatcataacttatgccagctcatccgattccacaagcttgttagcaaagcgaaagtctatgaaaccctcaatgtatgaggagctggaccgcgccatgttggaatggtttaaccagcagagggcaaagggaaatcctattagtggccctatttgcgctaagagggcagaattcttcttttacgcactgggcatggatggcgattttaacccaagcgccggttggctcactaggtttaaacagcggcactctattagagagataaatattcgcaatgagcggctgaatggcgacgagacagccgtagaggatttctgcaataacttcagagatttcattgaacgcgagaacctgcagccggagcagatctataacgcagacgagaccggcctcttctggaaatgcctgcccagtagaattagcgtgattaagggtaaatgcaccgtgccagggcataagtcaattgaagagagggtgacgatcatgtgttgtgctaatgccacgggcctccacaaactgaagttatgtgtggttggcaaagctaagaagcccagatccttcaaatccacggatactttgaatctgccagtttcttacttcagtcagaaaggcgcctggatggacctcagtatctttaggcagtggttcgacaagatcttcgttccccaagtgcgggaatatctcagatctaaggggctgcaggagaaagcagttctcttactcgacaactcgcctacccatccaaatgagaatgtgctgaggtccgacgacggacagatcttcgccaaatatctgccacccaatgttgctagcctgattcaaccatcagatcagggagtcatcgctaccatgaaaagaaattaccgtgctggcctgcttcagaacaacctggaagaagggaatgacctgaaatccttctggaagaagctgacgttgctggacgcgttgtatgagatcgcaatggcttggaatttggtaaagccagtcaccatctccagagcctggaaaaaaatccttcccatggtggaggagaaggagtccttagattttgatgtggaagacataagcgtggccacagtagcagctattttacagcataccaagggcctggagaatgtcacaacagaaaacctggagaagtggttggaggtcgacagtactgaacctgggtatgaggtcctcaccgactccgagatcatccgccgcgcacagggccaagccgatgagtcctctgagaacgaggaggaagagattgagctgatccctgagaagcatataaatcatgccgcggccctgcaatggaccgaaaacctactagactatctggaacagcagggcgatatgatcctccccgatagactcgttatccgcaagttacgtgcgacgatccgtaataaacagaagatgacaaagtcatcacagtag

SEQ ID NO: 192069 - DNA, 1575 bp, Artificial Sequence
  Description of Artificial Sequence: Synthetic coding sequence
atgagcggcaagcggaagcgggtggtgctgaccatcaaggacaagctggatattatcaagaagctagaagacggcgggtcatccaagcaactggcagtgatatacgggattggcgagacgaccgtgagggacattcgaaagaataaggagaagataatcacttacgccagttcttccgactccaccagtctcctcgcaaaaagaaaatctatgaagccatcaatgtacgaggagttggaccgagctatgctggagtggttcaatcagcagagagccaaaggaaaccccataagtggccctatctgcgccaagagggccgagttctttttctatgctctgggaatggacggggatttcaaccctagcgctggctggcttaccagattcaagcagcgacatagcatacgggaaatcaacatacggaatgaacggctgaacggggatgaaaccgccgtcgaggatttttgtaacaacttccgggatttcatcgagcgagaaaaccttcagcccgagcaaatttacaacgctgatgaaactgggcttttctggaagtgtctgccatcgcggatcagcgtcatcaaagggaaatgtactgtgcccggtcacaagagcatcgaggaacgcgtcaccatcatgtgttgtgcgaatgccaccggactgcacaagcttaagttatgtgtcgtggggaaagcaaaaaagcccagaagttttaagagtaccgataccttaaacctgccagtgtcttatttttcccaaaagggcgcgtggatggatttatccatctttcgccaatggtttgacaagatcttcgtaccgcaggttagagagtacctgcgctctaagggtctccaagaaaaggcagtcttgttgctggacaactcccccacccatccaaacgagaatgtcttaaggagtgacgacggccaaatttttgcgaagtacctaccccccaacgtggcctctctgattcagcccagtgatcaaggcgttatcgcaactatgaaacgcaactaccgggctggcctgctgcagaacaacctcgaggagggaaatgacctgaaaagtttctggaagaaattaacacttcttgacgccctatacgaaatcgcaatggcttggaatcttgtcaagcccgtgacaatttcacgggcctggaagaagattttgccgatggtagaagagaaggagtcactggattttgatgtggaagatatctccgtagcaacagtggcggctattctccagcacactaagggtctcgaaaacgtgaccaccgagaatctggagaagtggctcgaagttgacagcaccgagcccggatatgaggtgctgacagattccgagatcattcgccgagcccaggggcaagccgatgagagttctgagaatgaagaggaggagatagaactgattccggaaaaacatatcaaccacgccgcagctttgcagtggaccgagaatcttctggattacctggagcagcagggcgacatgattttgcccgaccggttggtgatccgcaaactgcgagcaactataaggaacaagcaaaagatgacaaaatcctcccaatag

SEQ ID NO: 192070 - DNA, 1251 bp, Artificial Sequence
  Description of Artificial Sequence: Synthetic coding sequence
atggccggcgacacccactgccccgccgagcccctggcccgggagggtaccctctgggaggcactgcgggcattgcttccacatagtaaagaggacctgaagctggatctcggtgagaaggtggagaggtctgtggtcacactattgcagcgcgccactgagctcttttatgaaggccgccgggacgagtgtcttcagagtagtgaggtgatcctagactacagttgggaaaaactaaacacaggtacctggcaggatgtagacaaagattggcgtcgagtatacgctattgggtgcctgctgaaggccctgtgtctgtgtcaggccccagaggacgccaacactgtggccgcagcactgcgcgtgtgtgacatggggctgctcatgggagccgcaatcctgggggacattctgctcaaggttgcggcaatacttcagacacacttgccaggcaagcgtcccgctcggggtagcctgcctgaacaaccttgtacaaagaaggcaagggccgatcacggactcatcccggacgttaaactggaaaagaccgtgcctcgcctgcaccggccaagcttgcagcatttccgggaacagtttttagtaccagggcgcccagtcatactgaaaggggttgccgatcactggccctgcatgcagaagtggagcctagaatacattcaggagatcgccggatgcagaactgtgcctgtggaagttggcagccgatacacagacgaggagtggagtcagacactcatgactgttaacgagtttatctcgaagtatattgtgaacgagccgcgggatgtagggtacctcgcacagcaccagctctttgaccagataccggagctcaagcaggacatatcaatacctgactactgttctctgggcgacggggaggaggaagaaatcacgataaacgcttggttcggacctcagggcaccatatccccactccatcaggatcctcagcagaacttccttgtccaggtcatgggccggaagtatatccggctgtacagtccacaggagtcaggcgctctgtacccccatgacacacatctactccacaacacctcacaggtggatgtcgagaatcccgatctggagaaatttccgaaatttgcgaaggctccttttttatcatgcatcctgtctccaggggagattctgtttattcctgtgaagtattggcattacgtgagggctctcgatctctccttctctgtatctttctggtggtcttag

SEQ ID NO: 192071 - DNA, 663 bp, Artificial Sequence
  Description of Artificial Sequence: Synthetic coding sequence
atggccggcgacacccactgccccgccgagcccctggcccgggagggcacactgtgggaggcactcagggccctgctaccccactccaaagaggacctcaaactggatcttggtgagaaggtagaaaggagtgtcgttacactgctccagagggcaacagagctcttctacgaaggtagacgggatgaatgcctgcagtccagtgaggttatactcgattatagctgggaaaaactgaacaccggcacttggcaggacgtggacaaagactggaggagggtgtatgctattggctgcctgttgaaggctctctgcctttgccaggcccctgaagacgccaatacagtggccgcggcactgagagtctgtgatatgggactactcatgggtgctgccattctgggggacatactgctcaaggtggctgctatcttgcagacgcacttgcctggtaaaaggcccgcccggggttcccttccagaacagccgtgcaccaaagtggatgttgaaaaccccgatctggagaaattcccaaagttcgccaaagcgccatttctctcttgcatcctctctcccggcgagatactgtttatcccagtgaagtactggcactacgttagggccctggacctgagcttctcagttagcttttggtggtcatag

SEQ ID NO: 192072 - DNA, 1365 bp, Artificial Sequence
  Description of Artificial Sequence: Synthetic coding sequence
atgagccgggagaagtgcagccccggcgagggcgccgaggagggcagaggttctgaagccagcggactgaaagcgagtgctggccatggcaccgaacccgcgggtggtggccctatggcaggggacacccactgcccggccgaaccgctggcccgcgagggaactctttgggaagctctgcgcgccctgctgccgcactctaaagaagacctcaaactggaccttggcgagaaggtcgaaagatccgtggtgaccctgctccagcgcgctactgagcttttctacgaagggcggagagacgagtgcttacaatctagcgaagtgatactggactactcctgggaaaagttgaacaccggcacatggcaggacgtagacaaggattggcggcgagtctacgccattgggtgtttgctcaaagcactgtgcctttgtcaggcacccgaagacgccaatacagttgcggctgccctaagggtttgcgacatggggctgctcatgggagccgcgatcctgggcgacatcctcctcaaggttgccgcaattttgcagactcacctgccaggcaaaaggcctgccagaggctccctcccagaacagccatgtactaaaaaggcacgcgctgatcacgggttgattcccgatgtgaagctcgagaaaacagtaccccgattacaccgcccttcactgcagcacttccgagaacagttcctggttccagggagacccgtgattctcaagggtgttgctgatcactggccctgcatgcaaaaatggtccctcgaatatattcaggagattgctgggtgcaggacggttcctgtggaggtgggctctcgctatactgatgaagaatggtctcagactcttatgacggtcaacgaattcatatcgaagtacattgttaacgaacctagagacgtgggctatcttgcgcagcaccaactgttcgatcaaatacccgaacttaagcaggatatctcaattcctgactattgctccctcggagacggagaggaggaagaaataactattaatgcctggttcgggccccagggaacgattagcccccttcatcaggatccccagcaaaacttcctggtgcaagtgatgggccgcaagtacatccggctctactccccacaggagtcaggcgctctttatccgcatgatacccatttgctccataacactagtcaggtggacgttgaaaatccagacctggagaagttccccaagtttgcgaaggcccccttcctgtcttgcatactgtccccaggtgaaattctttttattcctgtgaagtattggcattacgtgcgcgccctcgatctaagcttcagtgtgtccttctggtggtcctag

SEQ ID NO: 192073 - DNA, 441 bp, Artificial Sequence
  Description of Artificial Sequence: Synthetic coding sequence
atgaccgtgaacgagttcatcagcaagtacatcgtgaacgagccccgggatgtgggatatcttgcacaacatcagctctttgatcagatccctgagctcaagcaggacatctccattcctgattattgtagcttgggcgacggggaagaggaggaaattaccatcaatgcctggtttgggccccaggggactatatccccgctccaccaggaccctcaacagaactttttggtacaagttatgggtcgcaagtacattcgactgtattcaccacaagaatcaggtgccttatacccccacgacacacacctgctccacaatactagccaagtcgatgtggagaaccccgacctcgaaaagttccccaagtttgccaaggcgccattcctgtcatgtatactctccccaggggagatactatttattcctgtcaaatattag

SEQ ID NO: 192074 - DNA, 1119 bp, Artificial Sequence
  Description of Artificial Sequence: Synthetic coding sequence
atgaaccacaagagcaagaagcggatccgggaggccaagcggagcgctcgtccagaactaaaagattcacttgactggacgcggcacaattattatgaatccttttcgctatcccccgccgccgttgctgacaatgtggagagggccgacgcactacagctgtccgtcgaagaatttgtggagcggtacgagcgaccctacaaacctgttgttctcctgaatgcccaggaaggttggtcagcccaggagaagtggacactggagcgcctaaaaagaaagtaccgcaaccaaaagttcaaatgtggagaggataatgacggctactccgtcaaaatgaagatgaaatactacatcgaatacatggaatcaacgcgggacgattcacccctgtatattttcgatagttcttacggagaacaccctaagcgccgcaagctcctggaggactataaagtgcctaaattttttaccgacgatctgttccagtatgctggagaaaaaagaagaccaccttacaggtggttcgtcatgggacccccacgctccgggactggaattcacatcgatccactcgggacaagtgcatggaacgctctcgtgcaggggcacaagcgctggtgcctgtttcctacaagcacccccagggagttaatcaaggtcacccgcgatgaagggggtaaccagcaagatgaggctatcacttggttcaacgtgatttatcctagaacccaactcccgacatggcctccagaatttaagccgctggagatcttgcaaaaaccgggtgagacagtatttgtgcccggaggctggtggcacgttgttctgaacctcgacacaacgattgctataacccaaaatttcgcaagcagcactaatttcccggtagtttggcataaaaccgtgcgagggcggcctaagctgtcccgtaagtggtatcgcattctgaagcaggaacaccctgagctggctgtcctcgccgattcagtggatctccaggaaagcacaggtatcgcgagtgactcttcctccgactcttctagcagctctagttccagctcgtcagactccgacagcgagcgaatcagagacacctgtggtgggcgggcacacccgtag

SEQ ID NO: 192075 - DNA, 1212 bp, Artificial Sequence
  Description of Artificial Sequence: Synthetic coding sequence
atgaaccacaagagcaagaagcggatccgggaggccaagcggagcgcacgaccagaacttaaagatagcctcgattggacacgccacaattattatgagtcattctctctgtcacctgctgctgtcgccgacaatgtagagagggccgacgccctgcaactgtccgtggaggaatttgtggagcgatatgaaaggccttacaaacctgtggtcttgcttaacgcccaggaggggtggtctgcccaggaaaaatggaccctggaaagacttaaacggaaatacaggaatcagaagtttaagtgcggcgaggacaacgacggctactctgtgaaaatgaagatgaaatattatatcgaatatatggagagcactcgcgacgattctccactctacatattcgattcatcatatggcgagcatcccaagcgacgaaagctgcttgaggactacaaagtgcccaagtttttcactgatgatctgttccagtatgcaggtgagaaaaggagacctccataccgctggtttgtgatgggaccccctaggtcagggaccggaatccacattgacccattgggcacgtctgcttggaatgctctggtccagggccataagagatggtgtctcttccctactagcactccccgcgagttgatcaaggtcacaagggacgaaggcggtaatcagcaggatgaagctatcacatggtttaacgtgatctatcctagaacccagttgccaacatggccacccgagttcaaaccactggagattctccaaaagcctggcgaaactgtgttcgtgccaggcggctggtggcacgttgtgctgaacctggataccacaatcgccatcacacagaacttcgcgtcttctaccaatttccccgtggtctggcataagaccgtcagaggcagacctaagctcagtagaaaatggtatagaatacttaagcaggaacatcctgaactggctgttctggcagactccgtggaccttcaggaaagtacaggcattgcctctgatagttcctccgacagttcctccagctcctcttcatctagctcggactccgactcagagtgcgagagtggatcagaaggagacgggactgtgcaccgccgcaagaaacggcgcacatgctctatggttggaaatggcgatacgacaagtcaagacgattgcgtttccaaggagcgaagcagttccaggtag

SEQ ID NO: 192076 - DNA, 1245 bp, Artificial Sequence
  Description of Artificial Sequence: Synthetic coding sequence
atgaaccacaagagcaagaagcggatccgggaggccaagcggagcgcgaggcccgagttaaaagattctctggattggacccgtcataattactacgagagcttctccttaagtccagcagccgtagctgacaacgtcgagcgagctgacgccctgcagcttagcgtggaagaatttgttgagaggtatgaacgcccgtataagccagtagtcctgcttaatgcgcaagaaggatggagtgctcaggagaagtggacattggagcgcctcaaacggaaatatagaaatcagaaatttaaatgtggggaggacaatgacggctattccgttaaaatgaagatgaagtattatatcgaatacatggaatctaccagagatgactcgccattatacatctttgacagcagctatggtgagcacccaaaacgccgaaaattactggaagactacaaggtacctaagtttttcacggacgacctgttccagtacgcaggggagaaacgtaggcccccctacaggtggttcgttatgggcccccctcgctctgggaccggcatacatatcgacccattggggaccagtgcttggaacgcacttgttcagggacacaaacggtggtgcttgtttcctacatccacaccaagggagctgataaaggtgactagagatgagggcggaaaccaacaggatgaggccataacatggttcaacgttatttatccccggactcaattacccacctggccaccagagttcaagccgctcgaaatactccagaagcccggtgaaaccgtgtttgtgcctggtggttggtggcacgtggtgcttaacttagacacgaccatagccatcactcagaactttgcatccagcactaattttcccgtggtgtggcacaagaccgtaaggggccgtcccaaattgtcccgcaaatggtacaggatactgaagcaggaacatccggaactggccgtgcttgctgattcagttgacctccaggagtctaccggcatagcttccgacagcagtagcgacagttctagttcctccagttctagttcgtcagactcagattccgagtgcgagagtggctctgagggcgacggaacagttcatagaagaaaaaagcggcggacctgttctatggtgggcaatggagacacaacatctcaagatgattgtgtcagtaaagaacgcagttcctcacgaattcgcgatacatgcggcggccgtgcccacccatag

SEQ ID NO: 192077 - DNA, 441 bp, Artificial Sequence
  Description of Artificial Sequence: Synthetic coding sequence
atgctggccggcgccggccggcccggcctgccccagggccggcacctctgttggttgctctgcgcttttaccctaaagctgtgccaagcagaggctcccgttcaggaagagaagttgagcgcttcaaccagtaaccttccctgctggctggtcgaagaatttgtggtcgcagaagagtgtagcccctgttcaaattttcgagctaagaccacgcctgaatgtggacccactggctatgtggagaagattacttgctcctctagcaaaagaaatgagtttaaaagttgccgtagcgcgctcatggagcagcgactgttttggaaattcgagggggccgtggtgtgcgtggctcttatctttgcctgtttagtgattattcgtcagcgtcagctggataggaaggctctagagaaagtcaggaagcagattgagagtatttag

SEQ ID NO: 192078 - DNA, 354 bp, Artificial Sequence
  Description of Artificial Sequence: Synthetic coding sequence
atggcctggggctggcacctgagcttcctgagcgccagcaccagcaacctaccttgctggctggtcgaggaatttgtggtggcagaggagtgctcaccttgctctaacttcagggccaagactacccccgagtgtgggcccaccggatacgtggaaaagattacctgttcaagctccaagcggaacgagtttaagtcctgccgcagtgcgcttatggagcagcggctcttttggaagttcgagggtgcggttgtgtgtgtggccctgattttcgcttgcctcgtcattattagacaacgccagctcgatcgcaaggcactggaaaaagttaggaaacagattgagagtatctag

SEQ ID NO: 192079 - DNA, 354 bp, Artificial Sequence
  Description of Artificial Sequence: Synthetic coding sequence
atggcctggggctggcacctgagcttcctgagcgccagcaccagcaatctcccatgttggctggtggaagagtttgtcgttgctgaggagtgcagtccttgctcgaactttcgcgccaagacaacccccgagtgcggccctaccggttatgttgagaaaataacctgcagctccagcaaacgcaacgagttcaaatcgtgccggtcagccctgatggagcaacggctcttttggaaatttgagggggctgtcgtctgcgtggcactcatatttgcttgcctcgtcatcatcagacagaggcagcttgatcgcaaagccctcgagaaggtgcgtaaacaaatcgagtcgatctag

SEQ ID NO: 192080 - DNA, 354 bp, Artificial Sequence
  Description of Artificial Sequence: Synthetic coding sequence
atggcctggggctggcacctgagcttcctgagcgccagcaccagcaatctgccctgctggctggtggaagagttcgttgtcgctgaggagtgttctccctgtagcaacttccgggccaagaccacgccagagtgtgggcccactggatatgtcgaaaaaatcacttgcagctcaagcaaaagaaatgagtttaaaagctgtcgcagcgccctgatggaacagcggctgttctggaaattcgagggggcggtggtctgcgtcgctcttatattcgcgtgcttagtcattattaggcagaggcagctcgacaggaaggcactcgagaaagtgaggaagcagattgagtccatttag

SEQ ID NO: 192081 - DNA, 1044 bp, Artificial Sequence
  Description of Artificial Sequence: Synthetic coding sequence
atggagacccccttctacggcgacgaggccctgagcggcctgggcgggggcgcctctggctccggcggctctttcgccagcccgggaaggctgtttccaggagcacctccaactgctgctgctggaagcatgatgaagaaagacgcactcaccctgtcactgtcagagcaggtggccgctgccctgaagccggccgccgccccccctcctacccctctgcgggcagatggcgccccatctgccgcccctccggacggtctgctggctagccccgatctgggactgctgaagctcgcatcaccggagctagaaaggctgattatacagagtaacggactggtgaccacaacaccaacaagttcccagttcctgtatcccaaagtggcagcatcagaggagcaggaattcgccgagggttttgttaaggcactcgaagatttgcacaaacagaatcagcttggcgctggagcagctgccgccgcagccgccgccgccgccggaggcccgagtggaaccgctacgggatcagctcctcctggggaactggcccccgcagccgccgccccagaggctcctgtgtatgccaatttgtcatcctacgcggggggcgctggcggtgccgggggcgccgcaacggtagcctttgccgctgagcctgtacccttcccgccaccacccccaccaggtgccctcggccctccgaggctagccgcactgaaggacgagccacagactgtccccgacgtgcctagcttcggggagtcccctcctctgtcacccatcgatatggacacacaagagcggatcaaagctgagcgtaagaggttgcgaaaccgcatcgcagcctcaaaatgcagaaaaagaaagctcgagcgtatctctcggctcgaggagaaagtcaaaaccctgaaatctcaaaatacggaattggcaagcactgctagcctgttgcgcgaacaggtcgcacagctcaagcagaaagtactaagtcatgttaactctggttgccagctacttcctcagcaccaggtcccagcctactag

SEQ ID NO: 192082 - DNA, 2934 bp, Artificial Sequence
  Description of Artificial Sequence: Synthetic coding sequence
atgagcttcgccctggaggagaccctggagagcgactgggtggccgtgcggccccacgtgtttgacgagagagaaaagcacaaattcgttttcatcgtagcctggaacgaaatagaaggcaagttcgcgattacctgccacaacagaacggcacagaggcagcgaagcgggtcaagagagcaggcaggtgccaggggcggcgcagaggctggtggcgctgcatccgatgggagccgcggccccgggagccctgcagggaggggaagaccagaggcaactgcttccgccacgttagtgcggtcccccggtcctcggaggagttccgcttgggccgagggcgggagccctagatctaccagatccctgttgggtgatccaaggttacgaagccccggcagtaaaggcgcagaaagccgtctcaggtctcccgtgcgcgctaagcccatacctggacagaagactagcgaagctgacgacgcggctggggccgcagcagccgcagcacgccctgcgcctcgggaggcccaggttagctcagtgcgaatagtgagcgcatccggcactgtgtctgaagagattgaggtcctggagatggtgaaagaagacgaggctccactagcactaagcgacgctgagcagcctcctcctgcaacagagctcgagagtcccgcggaagaatgtagctgggccggccttttttccttccaggatctgcgggctgtgcaccagcagctttgttccgtgaatagtcaactggaaccttgcctccctgtgtttcccgaagagccctccggcatgtggaccgttctctttgggggagctcccgaaatgacggagcaggagatcgataccttgtgctaccagcttcaggtctatttgggacacggcctggacacgtgtggctggaaaatactcagccaagtgctctttacagaaactgatgatccagaggaatactatgaatcactgtctgaactgcggcaaaagggatacgaagaagtactccaacgggctcgcaagcgcattcaggagctgctcgataaacataagaataccgaatctatggtcgagttgctcgatctctaccaaatggaagatgaggcatactcgtccctggctgaggctacaacggagttgtatcagtacctgttgcaaccgtttagagatatgcgggaactggcgatgttaaggcgccagcagatcaagatcagtatggaaaacgactacctgggcccgagaaggattgaatcgttgcagaaagaagacgccgactggcagaggaaagcgcatatggcggtgcttagcatccaggatctgacagtgaaatactttgagatcaccgcaaaggcccagaaggcagtgtacgatagaatgagagctgaccagaagaaatttggtaaagcttcatgggctgcagccgccgagagaatggaaaagctgcagtacgctgtgtcaaaagagactctgcaaatgatgagagccaaggagatctgcctggagcagcggaagcatgctctaaaggaagagatgcaatcactgcgggggggaaccgaagctatcgcccgcctcgatcaactggaagccgattactatgatctccagctgcagctatatgaggttcagtttgaaatcctcaaatgcgaggagcttctgctaacagcccagttagagagtatcaaacgactgatttccgaaaaaagggatgaggtggtctactatgacacatacgagtctatggaggcaatgttggagaaggaggaaatggctgcgtctgcgtacctccagagggaggaactacagaaactgcagcagaaagcacggcagctcgaggcccgacgagggagagtgagtgcaaaaaagtcttacctccggaacaagaaagaaatttgcattgctaagcacaatgaaaagattcagcaacgcaccagaattgaagacgagtacagaacacaccacacagtgcagctgaagcgcgaaaaattgcatgatgaggaggaaaggaaatccgcctgggtgagccaagagagacaacgaacccttgacaggctaaggacctttaagcagcgctacccgggccaggtgatcctgaagagtacgagacttcggttggcacatgccagaagaaagggcgctgcaagtcctgtcctacaggaagatcactgcgatagtctaccctctgtgctgcaagtggaggaaaagaccgaagaggtcggagagggaagagttaaacgcggaccctctcaaacgaccgagccacaatctctggtgcagctcgaagatacgtctttgacccagctggaggcaacgtccctgcctcttagcggcgtgacatccgaactccctccgaccatcagcctcccactgctgaacaataatctggagccctgctctgtgacgataaatcccctgccctcccctctgcctccaactcctccaccacccctgccggtcgccaaggatagcgggccggaaaccttggagaaggatctcccaaggaaggagggcaacgagaaacgtatacccaaatcagcttcggctccctccgcccacctgtttgactctagccagcttgtcagcgcccggaagaaactgcgaaagaccgccgaggggctgcagaggcggcgggtgagttcaccgatggacgaagtgctggcatcccttaagagaggcagttttcacctcaagaaggtggagcagcgtacactcccaccattcccagacgaggacgacagcaacaatattctagcccagattagaaagggggtgaagcttaaaaaggtccagaaggacgtcctccgcgagagctttactctgttgcctgacactgatccattgactaggagtattcacgaagctctgcggaggattaaagaggcttctccagagagcgaagacgaggaagaggccctgccttgcaccgattgggaaaactag

SEQ ID NO: 192083 - DNA, 2967 bp, Artificial Sequence
  Description of Artificial Sequence: Synthetic coding sequence
atgagcttcgccctggaggagaccctggagagcgactgggtggccgtgaggccccatgtctttgatgaaagggagaagcacaaatttgttttcatcgttgcatggaacgagatcgaaggcaaatttgctataacctgccataacagaacagcacagaggcagcgcagcggctctcgggagcaagctggggcaagaggtggagctgaagccgggggagctgcaagcgacggctctcgggggcccggctcacccgccggcaggggccggcctgaagctactgcttccgctactcttgtgcggtctcccgggccccgccgatccagtgcctgggcagaagggggttctccacgcagcacacgatccttgttgggcgacccccgtttgaggtcccctggatcgaagggcgctgaaagtcggctaagaagtcccgtccgagctaagcctatcccaggccagaagacatcagaagctgacgacgcggccggggccgcagccgctgctgcgcggccagcacctcgcgaggcccaagtttcatccgtgcgtattgtctccgcctccggcacggtcagcgaggaaatagaggttcttgagatggtaaaggaggatgaagcaccactggccctctctgatgctgaacagccgcccccggcaaccgaactggagtccccagccgaggaatgttcatgggccggtctgttctccttccaggacctgagggcggtccaccagcaattatgctccgtgaactcgcagctggagccttgcctgccggtgttccctgaggagccctcgggcatgtggacggtgctatttggcggtgcccccgagatgactgagcaggagatcgataccctgtgttaccaactgcaggtgtatctgggccacgggctagatacatgcggctggaaaatcctgagtcaggtgttgttcactgaaactgacgatcccgaggagtattacgaaagtctgtctgaactgcgccagaagggatatgaagaagtcctccagagggcccggaagcgtattcaggaactgctcgataaacataagaataccgagagcatggttgagctactggacctttaccagatggaggacgaggcctactctagcttggccgaagctactacagaattataccagtacctcctgcagcccttcagggatatgcgcgagttggccatgttgagacgccagcaaataaagatctccatggaaaatgactacttggggccccgccgtatcgagtccctccaaaaagaggacgcggactggcagaggaaggctcatatggcagtactgtccatccaagatctgacagtaaaatactttgagatcaccgccaaagcacagaaggcagtgtacgaccgcatgcgcgcagaccagaagaagttcggaaaagcatcctgggctgccgctgccgaacggatggagaaactgcagtacgccgtgagcaaagagactttgcagatgatgagagccaaagagatctgcctggagcaaaggaagcacgcactcaaggaagaaatgcagtccttaagaggcggaacagaagcaattgcgaggctcgatcaactcgaggctgattactatgatcttcagctacaattatacgaggttcaattcgaaattctcaaatgcgaagagcttcttctgacagcccagttggaaagtattaagaggctgatcagcgagaagagagacgaggtggtgtattatgatacctatgaatcaatggaggcgatgctcgagaaagaggaaatggccgcttcggcctaccttcagcgcgaggaacttcagaaattacagcagaaggctagacagctggaggcccgaagggggagagtttcagccaaaaaaagctacctgcgaaacaagaaggaaatttgtatagcaaagcataacgagaaaattcaacaacgtacacgtatcgaggacgaataccgcacccaccacacagtccaacttaaacgagagaaactgcatgacgaggaagagcggaaatcggcttgggtgagtcaggaaaggcagcggacacttgatagactgcgcacttttaagcagaggtacccggggcaggtcattcttaaatcaacacgcctccggctcgcccatgctcggcggaagggggctgctagcccagttctgcaggaggatcattgtgattcccttccgtcagtcctccaagtggaggagaagactgaggaggttggagagggcagggtcaagcgcgggcctagccagaccaccgaaccacagtctctcgtccaactagaagatacaagcctcacccagcttgaagccaccagcttaccactgtccggggtgaccagtgaactgccaccaaccatctcactgccactgttaaataacaatttggagccatgttcagtgacaatcaaccctctcccaagccccctgccacccacacccccccctccgccacctcccccccctcctccacctcccccacccctgcctgtggctaaagattcgggccccgagactctggaaaaagacctgccacggaaggagggcaatgagaaaaggattcccaaatcagccagtgctcccagtgcccatctgtttgacagctctcagctggttagtgccagaaaaaagctgcgcaagacagccgagggccttcagcgtagacgagttagttcccctatggatgaggttctggcatccctgaagcgcggttcttttcacttaaagaaggtcgagcaaagaactctccctccctttccagatgaggacgactcaaacaatattttggcccagatccgcaagggagttaagcttaagaaagtacagaaggatgtgctgagggagagttttactctgctccctgacaccgaccccctgacaaggagtatccatgaagcactaagaagaattaaagaagcatccccagagagtgaagatgaggaggaggcactgccttgtacagactgggagaattag

SEQ ID NO: 192084 - DNA, 2238 bp, Artificial Sequence
  Description of Artificial Sequence: Synthetic coding sequence
atggaggtgatgaacctgatggagcagcccatcaaggtgaccgagtggcagcagacatatacatatgactccggcatccactcaggagcaaatacctgcgtgcccagtgtgtcaagcaaaggaatcatggaggaagatgaggcttgtggtaggcagtatactctgaaaaaaacaacaacttacacacagggggttccaccttcccagggggatctagaatatcagatgtcaacgaccgcgagggcgaaacgtgtgagggaagccatgtgtcccggcgtcagcggggaggacagcagtttgctgctcgcaacgcaagtcgagggccaagctacgaacctccaaaggctggccgaaccttcgcaactgttaaaaagtgccattgtgcacctgattaactaccaagatgacgcagaactggccacgcgtgccctgccagaacttaccaagttacttaatgatgaagaccccgtcgtggttaccaaggcagccatgattgtaaatcagctgtcaaaaaaagaggcttcgcggcgggcactgatgggcagccctcagttggttgctgccgtcgtaagaacaatgcagaacacttctgacctcgatacagctcgatgtacaacttctattctccacaacctgagccaccaccgggaaggcctgcttgcaatctttaagagcggcggaattcctgcactggtacgcatgctatcctccccagtagaatcagtgttattctatgcaattactactctgcacaatctgctgctgtaccaggagggcgcgaaaatggccgtgcgcctggcggatgggctgcagaagatggtgccactgctgaataaaaacaaccctaagttcctcgctatcactaccgattgtctgcagttgttagcttatggtaatcaggagagcaagctcattatcctggcaaacggcgggccccaggccctcgtgcagattatgagaaactacagttacgagaagttgttgtggaccacgtccagagtgcttaaagttctttcggtttgtccctctaacaagccagctatcgtggaggctgggggcatgcaagcccttgggaagcacctgacctccaacagcccaagactggtacagaactgcctgtggaccctgcggaacctcagcgacgtcgccactaaacaggagggactggagtcggtactgaagatccttgtcaatcagctgtccgtcgacgacgttaatgtgctgacctgtgccactgggaccctttcaaacctgacgtgtaacaacagcaaaaataagacgttagtgacccaaaactcaggggtggaggctttaattcacgccatcctgcgggcgggggataaggatgatataacggaaccggcggtttgtgctttgcggcacctcacctcccggcaccctgaagcagagatggcccagaactccgtcagactgaactatggtatccccgcgatcgtgaaactactgaatcaaccaaaccaatggcctctggtgaaagccactattggcttgatccggaatctcgccttgtgccccgccaaccacgctccattgcaggaagccgccgtgattccacgcctagtacagctgttggtgaaagcgcatcaggacgctcaaagacatgtagccgccgggacccagcagccctacacagatggggtacgaatggaagagattgtggagggttgcacaggggcactgcatatcctagctcgagatcctatgaataggatggagatttttcggctgaataccattcccctcttcgtgcagttgctgtactcctcagttgaaaacatccagcgcgtagcagctggagtcttgtgtgagctagcccaggataaagaggctgctgatgctatagacgcagagggggcatcagccccactgatggagctgttacacagccgcaatgagggcacagccacatatgcggcggcagttctgttccggatctcagaggacaagaacccggattatcgtaagagggtgagcgtggaactgacgaactccctgttcaaacacgacccagcagcgtgggaagctgcgcaaagcatgatccctatcaacgaaccttatggagatgacatggatgcgacgtacagacccatgtatagttccgatgtcccactggaccctttggagatgcatatggatatggacggcgactatccaatagacacgtacagtgatggactgcgaccaccttaccccactgcagaccacatgctagcatag

SEQ ID NO: 192085 - DNA, 2238 bp, Artificial Sequence
  Description of Artificial Sequence: Synthetic coding sequence
atggaggtgatgaacctgatggagcagcccatcaaggtgaccgagtggcagcaaacgtacacatacgacagcgggatacatagcggggcaaacacatgtgtgcctagcgtttcgtcgaaaggtatcatggaagaagacgaggcgtgtgggcgccaatacacacttaagaagacaacgacctacacacagggtgtgcctccttctcagggagaccttgagtatcagatgtctacaacagcgagagcaaagcgtgtaagagaggctatgtgcccaggagtctccggagaggattcaagtctgctgctggcgacccaggtggaggggcaggcaactaatctacagaggcttgctgagccttctcagctgctgaagagcgccatcgtccatctcatcaattatcaggacgacgccgagctggcgactagggccctgcctgaactcacaaaactcctgaatgatgaagatccagtcgtggtgaccaaggccgccatgatcgtgaatcagctgagcaaaaaagaagcatctcgtagagccctcatggggagtcctcagctggtggcagccgtggtccggactatgcagaatacaagtgatctggacacagctcgatgtacgacgagcatcctgcacaacctttctcaccatcgagaaggcctcctggctattttcaagagcggcggaatccccgccttagtcaggatgctgtcctccccagtagaaagtgtactgttttacgcgataactactctacataaccttctcctttatcaggagggggctaaaatggccgtcagactggctgatggccttcagaagatggttcccttgctgaacaagaataaccctaagttcctggcaattacaacggattgtctgcaattactggcttacggaaaccaagagtctaaacttatcatcctggctaatggcggcccacaggctctggttcagattatgcgcaactattcctacgagaagctcttgtggaccaccagccgtgttctcaaggttctcagtgtgtgcccttctaataagcctgccatcgttgaggccggaggaatgcaggccctcgggaaacatttgacctccaactccccacgactcgtgcagaactgtctttggacacttcggaatctgagtgatgtggctaccaaacaggaagggttggagagtgtgttaaagattctggtgaaccagctttccgtggacgacgtaaatgtgctgacctgcgcgacaggaactttgagcaacctgacgtgtaataactccaagaacaaaacacttgttacacagaattccggcgtggaggctttgattcacgcaatcctcagagcaggcgataaggacgatattaccgagccagctgtctgtgctctcagacacctcacttcccgacaccccgaggccgaaatggctcagaactctgtccgcctaaattacggcattcctgccattgtcaaactcctgaatcagccgaatcaatggccactagtcaaagccaccatagggcttatccgcaatttagccttgtgccctgccaaccacgcccccttgcaggaggcagctgtgatccctcggttggtccagctgctcgtgaaagcccaccaggatgcccaaagacatgtagccgctggcacccaacagccgtatactgatggtgtgcgaatggaggaaatagtagagggctgtaccggtgccctgcatattctcgcaagagatccaatgaacagaatggagatattccgccttaataccattcccctatttgtgcagctgttatattcttctgttgaaaatatccagagagtggcagcaggcgtcctctgcgaactggctcaagataaagaagctgccgatgcaatagacgcagagggcgcatctgcacctctcatggagctgttacattcaaggaatgaagggactgcaacatacgctgccgcggtcctgttccggatttccgaagacaagaaccccgactatagaaaacgtgtgtctgttgaattgacaaattcgctgttcaaacatgatcctgccgcttgggaagccgcacagtctatgattcccatcaacgaaccctatggagacgacatggacgcgacatatcgccccatgtactcttcagatgtgccactcgatcccctggaaatgcatatggatatggatggggattaccctatcgatacctactcagacgggttgagaccaccttatccaacagccgatcacatgctcgcgtag

SEQ ID NO: 192086 - DNA, 2238 bp, Artificial Sequence
  Description of Artificial Sequence: Synthetic coding sequence
atggaggtgatgaacctgatggagcagcccatcaaggtgaccgagtggcagcaaacatatacttacgatagcggtattcattcgggggccaacacttgtgtgccaagtgtgagttcaaagggtataatggaggaagacgaagcctgcggccgccaatacaccctcaagaagacaaccacatacacccagggcgtccctccaagccagggcgacctcgaataccagatgtctaccactgcacgcgctaagcgtgtacgggaagctatgtgtcctggcgtctccggcgaagatagcagtctcctactcgccacgcaggttgagggacaagccaccaatctgcaaagactcgccgagccgagccagcttcttaaatctgctattgtgcatctgatcaactatcaagacgacgccgagctagcaacccgcgcccttcccgagttaacgaaactgttaaatgacgaggatcccgtggtcgtgacaaaagcagccatgattgtcaatcaactgtctaaaaaagaagcttcccgccgagctctcatgggcagtcctcagctggtggccgcggtggtgagaactatgcaaaataccagcgacctggataccgcccgctgcaccacctccatattgcataatctgagccatcacagggagggactcctcgctatattcaagtccgggggaatccctgctctggtgcgcatgctgtcgtcaccagtcgaatccgtgcttttttatgctattactaccctccacaatttgctcctgtatcaggagggagcaaagatggccgtgcgactggccgatgggttacagaagatggtgccactgctgaataagaataatcctaagttcctggctattactacagattgtctgcagcttctagcctatgggaaccaggagtccaagttgatcatcctagcaaatggtgggccccaggcactggttcagataatgcggaactatagttatgaaaagctgctttggaccacatcccgcgtcctgaaggtgctgagtgtctgtccatccaataaaccggctatagtggaagcaggcgggatgcaggccctgggtaaacacctaaccagcaattccccgagattagtgcagaactgtctttggacactgcggaacctatcggacgtcgctacaaagcaggagggcctggagagcgtgctgaagatactagttaatcaacttagtgtcgatgatgtgaatgtcctaacttgcgccactggaacactgagtaatctcacttgtaacaacagcaaaaacaaaacactcgtcacgcagaacagtggagtggaggccctgattcatgccatattgcgggcgggggataaagacgacatcaccgaaccagctgtgtgcgccctgcggcatctcacatcacggcaccccgaagctgagatggctcagaactctgttcgcctgaactacgggatcccggccatcgtgaagctgctgaaccagcctaaccagtggcctctcgtcaaagcaaccatcggtttgatacgcaatctggccttgtgtccagcaaatcacgcacccctgcaggaagccgccgtgatccctcgcctggtgcagctgctcgtgaaggctcaccaggacgcccagagacacgtagccgcaggaacccagcagccttacacggatggagtgcggatggaagagatcgtcgaaggctgtactggggcactccatatattagccagggacccaatgaaccggatggaaatctttcgcctgaatactattccgctgtttgtccaactgctctattcaagtgtcgagaatatccagcgggtcgctgctggggtgctgtgtgaactcgcccaagacaaagaagctgctgatgccatcgacgccgaaggggctagtgcgcctcttatggaattactccattcccgtaacgagggaaccgccacatacgccgccgccgtgctgttccggatttccgaagataagaatcccgattaccgtaaaagggtttctgtggaactaactaactcgctatttaaacacgaccctgccgcttgggaggcggcacagtccatgattcccataaacgagccctatggggacgatatggacgctacctacagaccgatgtacagtagcgacgtcccgctggatcctctcgagatgcatatggatatggacggggattatcccattgacacctattcagatggactcagaccaccatatccgaccgcggaccatatgctagcctag

SEQ ID NO: 192087 - DNA, 834 bp, Artificial Sequence
  Description of Artificial Sequence: Synthetic coding sequence
atggaggtgatgaacctgatggagcagcccatcaaggtgaccgagtggcagcagacctacacctacgacagcggaatccattctggagccaatacttgtgtgccatctgtgtcaagcaagggcattatggaagaggacgaggcctgcgggagacagtacaccctgaagaaaaccacaacatacacacagggagtgcctccatctcagggcgacctcgaatatcagatgagcaccaccgctagagcaaaacgggtgagggaggccatgtgccctggggtaagcggggaggactcaagccttctgctcgccacccaggtggagggtcaggccactaaccttcagagactcgcggaaccctcccagctgttgaagagcgccatcgtgcacctgatcaactaccaagatgacgccgaacttgcaacaagggctctcccagaactaacaaaactgcttaacgacgaagacccggtagtagtgaccaaggctgcgatgatagtgaatcagctgtcaaagaaagaagcttcccggagggccctgatggggagtccccaacttgtggccgctgtggtgcggacaatgcagaacacttcagatttagacactgcccgatgcacaacgagtatcctccacaatctctcgcatcatagggaggggttgctggcaatctttaagtcaggaggcattcctgcacttgtgcgaatgctatctagcccggtggaatctgtcctcttctatgccatcaccacactgcacaatctgctgctgtaccaagagggggcaaaaatggcagtcaggctggctgacggacttcagaagatggtgcccctgctgtag

SEQ ID NO: 192088 - DNA, 708 bp, Artificial Sequence
  Description of Artificial Sequence: Synthetic coding sequence
atggaggtgatgaacctgatggagcagcccatcaaggtgaccgagtggcagcagacttacacatatgactccggcatccatagcggagctaacacatgtgttccctctgttagctctaagggaataatggaagaggatgaggcatgtggtaggcagtacacactgaagaagactactacttatactcagggtgtacccccttcgcagggggacctggagtaccaaatgtcaacaaccgcccgcgccaagcgggtcagggaggctatgtgcccaggggtctctggcgaagatagctcccttctccttgctactcaagttgagggacaggcaacgaatcttcaaaggttggccgaaccgagtcaattgctcaagtctgctattgtccacctgattaactatcaagacgacgcagaactggccacccgtgccctccccgagctgacgaaactgctcaatgatgaggacccagttgttgtcaccaaggcagccatgattgtgaatcagctcagcaagaaggaggcctcacggcgcgcccttatggggagcccacaattagtagctgccgtcgtgcggaccatgcagaataccagtgatttggacaccgccaggtgtacaacttctatcctccacaatttaagtcaccatagagagggcctactggctatttttaagtccggcggcatcccagctctcgtcaggatgctgtag

SEQ ID NO: 192089 - DNA, 891 bp, Artificial Sequence
  Description of Artificial Sequence: Synthetic coding sequence
atggaggtgatgaacctgatggagcagcccatcaaggtgaccgagtggcaacaaacgtatacatatgattctggaatccattcgggagcaaacacctgtgtgcccagcgtttcttccaaagggatcatggaagaagacgaagcttgtgggaggcagtatacactgaagaagaccactacttacactcagggggtgccgccaagtcaaggggacctagaatatcagatgtctaccaccgccagggccaagcgagtccgcgaggccatgtgcccgggcgtctcgggtgaagattccagccttcttctggccacacaagtggagggtcaagcaactaacctgcaacgcctcgcggaacccagccagctgctgaaaagtgcgatcgttcacttgataaactaccaggatgacgcggagctggcaacccgcgcacttccagagcttaccaagctactgaacgatgaggatcctgtcgtcgtgacaaaagccgctatgattgtgaaccagctgtccaagaaggaggccagccggcgggctctgatgggctcaccacagctggttgcagccgttgtccggaccatgcaaaacacatcagatctggacactgctagatgcacaacctctatcttacacaacctaagccaccatcgcgaggggctgctggccattttcaaatccggcggcataccagctctggttagaatgctgtcaagccccgtggaaagtgtcctgttttatgctatcacaaccctgcacaatctgctcctttatcaggaaggggctaagatggcagtgaggctggccgatgggttacagaaaatggtgcctttgctgaacaaaaataatcctaaatttctggcgatcaccacggactgcctgcagttattggcctag

SEQ ID NO: 192090 - DNA, 261 bp, Artificial Sequence
  Description of Artificial Sequence: Synthetic coding sequence
atggaggtgatgaacctgatggagcagcccatcaaggtgaccgagtggcagcagacttatacctacgattcaggcatacactctggggctaatacatgtgtgccttcagtgagttccaagggcatcatggaggaggacgaggcctgtggacggcagtacacacttaagaagaccacgacatacacacagggggtgccgccaagccaaggagatctcgaataccagatgagcacaactgctcgagccaaacgagtgaggtag

SEQ ID NO: 192091 - DNA, 897 bp, Artificial Sequence
  Description of Artificial Sequence: Synthetic coding sequence
atggaggtgatgaacctgatggagcagcccatcaaggtgaccgagtggcaacagacatacacctatgacagcgggatacactcaggggctaatacttgtgtgccctctgtttcctccaaaggcatcatggaggaagacgaggcctgcgggcggcagtatacactgaaaaagacaaccacttacacacagggagttccgccatctcagggcgaccttgaataccaaatgtcgactacagcaagggccaaaagagtaagggaggctatgtgcccaggggtctctggcgaagattcttccctgctgttagccacccaggtggaggggcaagcaaccaacttgcagcggctggccgagccttcccagcttctaaaatccgctatcgttcatctgatcaattatcaagatgacgccgaactggcaacacgtgcgctccccgaactcaccaagttgctcaacgacgaagatccagtggtcgtgactaaggcagcaatgattgtgaatcaactgtctaaaaaggaggcgtcacgccgggccctaatgggaagccctcagctggtggcggcagtcgtgagaaccatgcagaacacttctgatctagatacagcccgctgcaccacctcaatactgcacaatttatcacaccatcgcgaggggctgcttgcaattttcaaatccggaggaatcccagccctggttcggatgctgtcatcacctgtggaaagtgtgttattttatgccattaccacgttacataatctgctactgtaccaggagggcgccaaaatggcagtgagattggccgatggtctgcagaagatggtgcccctgcttaataaaaataaccctaagtttttagccattactacagactgtctccagttacttgcctacggctag

SEQ ID NO: 192092 - DNA, 1776 bp, Artificial Sequence
  Description of Artificial Sequence: Synthetic coding sequence
atggaggtgatgaacctgatggagcagcccatcaaggtgaccgagtggcagcagacctatacttacgatagtggcattcacagcggcgctaacacatgtgtcccatctgtgagcagcaaaggaatcatggaagaagatgaggcctgcggccgccaatatactttaaagaagaccacaacgtatacgcagggcgttcctccttcccagggtgaccttgaataccagatgagcactaccgcgcgtgcaaagagagtcagagaagctatgtgtcccggggtctccggagaggattcttcccttctgctggcaacgcaagttgaaggtcaagctactaacttacagagactggctgaaccaagccagctcctgaagtctgccatcgtgcatttgatcaactaccaggatgatgcggagttggcaacccgggccttgcctgagttgaccaaattgctgaacgacgaggacccagtggtcgtaacaaaagctgctatgatcgtcaatcagctttctaaaaaagaggccagccggagggctctgatgggcagtccccaactggtggctgctgtcgtcagaactatgcaaaacactagcgacctggatacagcccgatgtactaccagtatcttacacaatctttcacaccaccgcgaaggattgcttgccatcttcaagtctggaggcatccccgcgctggtgaggatgttaagctcacctgtggagagtgtcctgttttacgctatcactaccctgcacaatctgctcttataccaagaaggcgctaagatggccgttaggctcgcagatgggctgcagaagatggttccccttttgaataagaacaacccaaagtttttagccatcacaacggactgcctacagctgctggcttatggtaaccaggagtcaaagatcctcactgcaaccgttgacaacgctaacattctcctgcagattgacaatgcccggctggctgctgacgattttaggaccaagtttgagaccgaacaggcccttcggttaagcgtggaggccgatatcaatggcctcaggcgcgtgctggacgagcttacgctagcgcgtgccgatctagagatgcagattgagaatctgaaggaggagttggcgtaccttaagaagaaccatgaggaagagatgaacgcgcttaggggccaagtggggggagagataaacgtggagatggatgcagcgccgggcgtagatctctcaaggatactcaacgagatgcgcgatcaatatgaaaagatggctgagaagaaccgcaaagatgctgaggattggttcttttcaaaaaccgaagagctcaatcgcgaggtggcgactaattccgaactagtgcagtctggaaaaagtgaaatttccgagctgcggagaaccatgcaggcactggaaattgaactgcagtcacagttgtccatgaaggcctctttagagggaaatctggctgagaccgagaatcgttattgtgttcaactgtcccagattcagggcctgataggtagcgtcgaagagcaactggcccagctgcgctgcgagatggagcagcaaaatcaggagtacaagatactgttggacgtgaagactaggttagagcaggaaatagctacctatcggaggctccttgaaggagaagacgcccacctgacacagtataagaaggaacccgtgacgacacgacaggttaggacaattgtggaagaggtgcaggacggaaaggtgatatcttctcgtgaacaggtccaccagacgactcggtag

SEQ ID NO: 192093 - DNA, 897 bp, Artificial Sequence
  Description of Artificial Sequence: Synthetic coding sequence
atggcccggcggagccggcaccggctgctgctgctgctgctgcggtacttagtggttgcgctcggctatcacaaggcatatggatttagcgcccctaaggatcaacaggtggtaactgctgtcgagtatcaggaggcgattcttgcctgcaagacaccaaagaaaaccgtatcatctaggctagaatggaagaaattgggacgcagcgtttccttcgtttactaccagcagacacttcaaggagactttaaaaatagagctgaaatgattgatttcaatattaggatcaaaaatgtaacaagatcagacgccggcaagtaccggtgtgaagtttctgctccgtccgaacagggtcaaaacctggaggaagacacagtgacacttgaagtgctcgtagcccccgctgtcccaagctgcgaggttccatcttcggcactgtctggcactgtcgtcgagctgaggtgccaggataaggagggtaaccccgcccccgaatatacttggttcaaagatggaatcaggcttctggaaaatccaagacttgggtcacaaagcaccaatagctcctataccatgaataccaagaccggcactctccagtttaacacagttagtaaacttgatactggggaatattcctgcgaagcccgaaacagcgttggctacaggcggtgccctgggaagcgcatgcaagttgacgacttgaacatctccggcatcatagcggccgtggtggttgttgccctggtgatttcagtgtgcggtttgggcgtctgctacgcacaacgcaaggggtattttagttctaagtatatgtttatgaagtctaattcctcatcgaaagcaacaacgatgagtgaaaacgactttaaacacactaaatctttcattatatag

SEQ ID NO: 192094 - DNA, 789 bp, Artificial Sequence
  Description of Artificial Sequence: Synthetic coding sequence
atggcccggcggagccggcaccggctgctgctgctgctgctgcggtatctggtggtcgccctaggataccacaaggcctacggcttctcagctccaaaagatcagcaggtcgttacagccgtcgaatatcagggagattttaagaaccgcgctgagatgattgattttaacattcgaataaagaatgtgactcgttcagacgctggtaaatacagatgtgaagtgagcgctccctcggagcaaggtcagaaccttgaggaggacaccgtgaccttggaggtactagtcgccccagctgtgccctcctgcgaggtcccatctagtgctttatccggcactgttgtcgaactcaggtgccaggataaggaagggaatcccgctccggaatatacatggttcaaggacgggatcagattgctagaaaatccccgcctgggatcacagtcgaccaattcctcttacactatgaataccaagaccggtactctccagtttaatacagtcagcaagttagacacgggtgagtatagttgcgaggccagaaacagcgtcggatacaggaggtgccctggaaaaagaatgcaggtcgatgatttaaacatttctggcataatcgcagctgttgtggtggtcgccttggtcattagcgtgtgcggacttggtgtgtgttatgcccaacgaaaaggatatttttcaaaggaaacctcgttccagaaaagtaatagctcttccaaagcaacaaccatgtccgaaaatgacttcaaacatacaaagagttttattatctag

SEQ ID NO: 192095 - DNA, 897 bp, Artificial Sequence
  Description of Artificial Sequence: Synthetic coding sequence
atggcccggcggagccggcaccggctgctgctgctgctgctgcggtacctggtggttgcccttggctaccacaaggcatacggcttctccgcccctaaggatcagcaggtggtgactgcggtggagtaccaggaggctattctggcttgcaagactcctaaaaaaaccgtaagcagcaggttggagtggaaaaaactgggccgttcagtcagcttcgtgtattatcagcaaaccctccagggcgacttcaagaatcgcgccgagatgattgacttcaatatacggattaagaatgtgacaagatcggatgccggtaagtacaggtgcgaggtttccgcacctagcgagcagggacagaatctggaagaggatactgtcactctggaggttctagtagctcctgctgttcctagctgcgaggtgccaagttcggctctctccggaacggttgtggagctgaggtgtcaggataaggaaggaaaccccgcccccgaatacacctggttcaaagacggcatccgtctgcttgaaaatcctagattaggctctcagagcacgaactccagctacacgatgaatacgaagactgggactctccagttcaataccgttagcaagttggatactggcgaatactcctgcgaggcccgaaattccgttggttataggcgatgccctggcaaacgaatgcaggtggacgacctgaatatcagcggaattattgccgcagtcgttgttgtcgcactcgtaatctcagtgtgcggcttgggtgtctgctacgctcagcgaaaaggctattttagcaaagagacctctttccaaaagtctaacagcagcagtaaagccactacaatgagcgaaaacgacttcaaacacactaaatcctttattatctag

SEQ ID NO: 192096 - DNA, 939 bp, Artificial Sequence
  Description of Artificial Sequence: Synthetic coding sequence
atggcccggcggagccggcaccggctgctgctgctgctgctgcggtacttggtggtggcactggggtatcataaagcctatggcttctctgctcccaaggaccagcaggtggtgaccgctgtggaatatcaggaagccattttggcatgcaaaactcccaaaaagactgtgtcgagtcgactggaatggaagaagctgggacgcagtgtaagcttcgtgtattatcagcagacactccaaggcgactttaagaaccgcgctgaaatgatcgattttaacatccggattaaaaacgtcaccaggtcagatgccggaaaataccgttgcgaagtcagcgcaccgtctgaacaggggcagaacctggaagaggatacggtcaccctcgaggtccttgtggcaccggccgtgcctagttgcgaagtgccctcctccgcgctgtctggaacggtggtcgagttaaggtgccaggataaagagggtaacccagcccctgagtacacttggtttaaggacggtattaggctcctggagaatccaaggcttggatcgcagtccactaatagctcatacaccatgaatacgaaaacagggactctgcagtttaataccgtcagtaagctggacactggagagtactcttgcgaagcccgtaattctgttggatatcgaagatgtcccggcaagcgcatgcaagtagatgacctcaatatctccggcatcatcgccgccgtggtggtggtggcgttggtgattagcgtgtgtggtttgggcgtgtgttacgcacagcggaaagggtatttttccaaagagacatctttccagaagtctaattcctcaagcaaagcaactactatgtccgagaatgtccagtggctgactccagtcatacccgccctttggaaagcagcagctggtggctcccgtggccaggagttctag

SEQ ID NO: 192097 - DNA, 933 bp, Artificial Sequence
  Description of Artificial Sequence: Synthetic coding sequence
atggccctgcggcggcccccccggctgcggctgtgcgcccggctgccagattttttcctccttctacttttcaggggctgcttaatcggcgctgtcaatctcaaatcatcgaaccgcacgcccgtagttcaggaattcgaaagcgtggagcttagctgtataattaccgactctcaaacaagcgacccacgaattgagtggaaaaaaattcaggacgagcagaccacctacgtgttttttgataacaagattcagggcgacctggctgggagagccgaaatcctcggcaagacaagtctgaaaatatggaacgtgacgaggcgggactccgcgctttaccggtgtgaggtcgtggccagaaatgatagaaaggagatcgacgagatagtgatagagctaacggttcaggtgaaacccgtgactcctgtctgcagagtgccaaaggcagttcccgttgggaagatggccacattgcattgccaggagagcgaaggccacccaaggccacactactcgtggtaccgcaacgatgtgcccttacctacagatagtagagcaaacccaagatttcgtaactcctcttttcacctcaattctgaaactggtacactagtcttcactgccgttcacaaagacgactccgggcagtactattgtattgcctctaacgacgccggttctgctaggtgtgaagaacaagaaatggaagtctatgatcttaatattggcggaattatcggcggtgtccttgtggttctggccgtcctggccctaattacattagggatatgttgtgcctatcgcagaggttacttcatcaataacaaacaagatggtgaatcctacaagaatcccgggaagccagacggtgtgaactacatcagaaccgacgaggagggcgattttcgtcataagtcatcctttgttatctag

SEQ ID NO: 192098 - DNA, 780 bp, Artificial Sequence
  Description of Artificial Sequence: Synthetic coding sequence
atggccctgcggcggcccccccggctgcggctgtgcgcccggctgccagacttttttttattgttactgttcagagggtgcctgataggcgcagtcaatctcaagtcaagtaataggacaccagtggtgcaggagtttgaatccgttgagctgtcctgcattataaccgattctcagacgagcgacccgagaattgagtggaagaagatccaggatgaacagactacgtacgtgttcttcgataacaaaattcaggtcaagccagtaacccctgtgtgtcgtgtccccaaagccgtgcccgtaggtaaaatggccactctgcactgccaagaatctgaggggcacccacgcccccactactcttggtataggaacgacgttccgttgccaactgactcccgggcgaacccccggttccggaactctagttttcacctaaacagtgagactggaactttggtgttcaccgccgtccacaaagatgacagtgggcagtactactgcattgcctctaacgacgctggtagcgctcgttgcgaggagcaggagatggaagtgtatgatctgaacatcggcggtattatcggaggagttcttgtcgtcctggccgtactagctctgattaccctggggatctgctgtgcctacagacggggttatttcattaataataagcaagacggggagtcctacaagaacccagggaagcccgacggcgtgaactatattagaaccgatgaagaaggtgatttccgccacaaatcctccttcgtgatctag

SEQ ID NO: 192099 - DNA, 1068 bp, Artificial Sequence
  Description of Artificial Sequence: Synthetic coding sequence
atggtgcccgcccggctgggccccgccgtggccatggtgaccggcgcaggccgccgggtgctcgccggctgggcccatgccagaggcgattataagccgcgtagagccgctgctggacccagcgctactctggatatggctcttagacgacctccgcggctgcggctgtgtgcgcggctgcccgacttttttctgcttctactgttccgaggatgtctcatcggagcggtcaacttgaagtccagcaaccggacgcccgtggtccaggagttcgagagcgtggagctgagttgcatcatcaccgactctcagactagtgacccgcgcatcgagtggaaaaagattcaggacgaacagactacctatgtgttcttcgataataagatccagggggatctggcagggagagctgaaatcctaggaaaaacatctttgaagatttggaacgtgacacggcgggattcagctctctatcggtgtgaagtggtagctcgtaacgatagaaaagagattgatgagatagttatcgagctgaccgtccaggtgaagcccgtaacaccagtgtgtagagtgcccaaggccgtgccggtggggaaaatggccacattacactgccaggagagcgagggccacccgagaccacattattcttggtataggaacgacgtccccctgcctacagattcacgtgctaaccctagattcagaaacagctccttccaccttaattcggaaaccggtaccttggtctttacagctgttcacaaggatgatagtggtcagtattattgcatcgcttccaatgacgccggtagcgcaaggtgcgaagagcaagaaatggaagtctatgatcttaacatcggcgggattatcggcggtgtgttagtggtgctggcggtgttagccttgattactttgggaatctgctgcgcctaccgccgcgggtattttatcaataacaaacaggatggggaaagttataaaaacccagggaagcctgacggggtcaactatatccgcaccgatgaagaaggcgacttccgccacaagagctcatttgtcatttag

SEQ ID NO: 192100 - DNA, 1986 bp, Artificial Sequence
  Description of Artificial Sequence: Synthetic coding sequence
atgaccggcggccggttcgacttcgacgacggcggcacctactgcgggggctgggaggagggcaaagcacacggccatggcatatgcaccggaccgaaaggtcagggggagtattcagggtcctggtcccatggttttgaggtggtgggagggtatacttggccttctgggaatacctatcagggttactgggcgcagggtaagagacacggcctgggcgtggagacaaagggcaagtggatgtatagaggggagtggagccatggctttaagggcagatatggcgttaggcagtccctgtgcactcccgcccgatatgaaggcacctggagtaacgggctgcaggacgggtatggggtcgagacatatggtgacggcggaacgtaccaggggcagtgggcaggaggtatgagacacggatatggagtcagacaaagtgtgccatacggcatggccacggtcatcagatccccactccggacgagcctggccagtctccggtcggagcagtcaaatggaagtgtccttcacgatgccgccgctgctgccgacagtcccgccggtactaggggaggttttgtgcttaatttccatgctgacgctgagctggctggcaagaaaaaaggcgggctgtttaggcgtggttctcttctcggttccatgaagctgagaaagtctgaaagcaagagtagtattagcagtaagaggtctagcgtgcggagtgatgctgccatgtctcggatttcgtcatctgatgctaacagcacaatttcctttggcgatgtcgattgtgacttctgtcccgtcgaggatcacgtcgacgcaacaactactgaaacttacatgggggaatggaagaatgataaacggaacggtttcggcgtctccgaacgctccaatggcatgaaatatgaaggtgaatgggctaacaacaaacggcacgggtacggttgtaccgtttttcccgatggaagcaaggaagaggggaagtataagaataatatcctggtgagaggtatacggaaacagttaatacccatcaggcatacaaaaactagagagaaggtggatcgggctattgaaggcgcacagcgggccgcagccatggcacgtacaaaagttgaaatagccaactcacggaccgctcacgcgcgcgccaaagcggacgcagctgaccaggccgctctggccgcgaggcaggagtgcgatattgctagggccgtcgcaagggaactgagtcccgatttctaccagcccggacccgactatgttaaacagaggtttcaggagggcgtcgatgcgaaagaaaaccccgaggagaaagtgcccgagaagccccctaccccaaaggaatcgcctcacttctacagaaaaggaacaacacccccaagaagtcctgaggcatcccctaaacactcccactctcctgcatctagtccaaagcctctcaagaagcaaaatccttctagcggcgcacgactcaaccaggacaagcgttccgtggctgacgaacaggtgacagccatcgttaataaaccccttatgtctaaagctcccacgaaggaggccggggcagtagtcccccagtcaaagtattccggccgccaccatattccgaatccgtccaacggcgagcttcattcccagtatcacggctactacgtgaagctgaacgccccgcagcacccgccggttgacgtggaagatggcgacggtagctctcaaagctcttctgcactcgtacataaaccaagcgcaaacaaatggtcgccttccaagtctgtgactaaacctgtcgcaaaagagtctaaggccgagccaaaagcaaaaaagagtgagctggctattccaaagaatcctgcctcgaatgacagttgtccggccctagaaaaggaagccaactcaggtccaaattccatcatgatcgtgttggttatgctgctgaatatcggtctggccattctctttgtgcacttcctgacatag

SEQ ID NO: 192101 - DNA, 390 bp, Artificial Sequence
  Description of Artificial Sequence: Synthetic coding sequence
atgagcggcggccggttcgacttcgacgacggcggcgcctactgcggcggctgggagggcggtaaagcgcacgggcatggcctgtgtaccggaccaaaggggcaaggagaatactcgggcagctggaacttcggctttgaggtggctggagtctatacttggcctagtggcaacacgtttgagggttattggagtcaggggaagagacatggtctgggaattgagaccaagggacgatggctgtacaagggtgaatggacacacggattcaagggtagatatgggattagacagtcttcctcatctggcgccaaatatgagggaacttggaataacggcctccaagacggatatgggacggaaacgtacgccgatgggggcatgtgttag

SEQ ID NO: 192102 - DNA, 2091 bp, Artificial Sequence
  Description of Artificial Sequence: Synthetic coding sequence
atgagcggcggccggttcgacttcgacgacggcggcgcctactgcggtggttgggaaggcggcaaagcccatggtcacggcctctgcactggaccaaaagggcagggggagtactccggcagctggaatttcggattcgaggtcgccggagtctatacttggccttcgggaaatacattcgaaggctattggtcacagggcaagaggcacggcctcggcatcgaaacgaaaggacgctggttgtataagggggagtggacccatgggtttaaaggcaggtacggaatccgccaaagcagctcctctggcgctaaatatgaagggacctggaataacgggctccaggacgggtatgggactgagacctatgcggacggcgggacttatcagggacagtttaccaacggcatgcgacacggttacggtgtgagacagtctgtcccctacggcatggccgtggttgtccggagtcccctgcggacttccctaagtagcctaagaagtgaacacagtaacggcaccgtcgctcccgactcacccgccagtcctgccagcgacgggccggctctgccttcacccgcgatccctcgcggggggttcgcgctgtcattgctggccaatgcagaagctgcggctcgcgccccaaaaggcggaggcctctttcagagaggagctctgcttggaaagcttagaagggcggaatctcggacgtcagtgggcagccaacgatccagggtctctttcctgaagagtgatcttagctcaggcgcctcggacgccgccagcaccgcgagcttaggtgaagctgcggagggggctgatgaggcagctccattcgaagccgacatcgacgccaccaccacagagacttatatgggcgaatggaagaatgacaagcgaagcggtttcggggtttcagagagatcttctggtctgagatacgagggggaatggctggacaatctccgccatggatacgggtgcaccaccctgcctgacgggcaccgggaggaaggcaagtacagacataacgtgctggtcaaagatacaaagcgacgcatgctccagctaaagtctaacaaagtgcgtcaaaaagtcgagcattccgtcgagggcgctcagagagctgccgcaattgctaggcagaaggcagaaatcgcagcatctcggacctcccatgccaaggccaaagcagaggcagctgaacaggccgccttggctgccaatcaggagagtaatattgctcggaccctagctagagaactggctcccgacttctaccagcccggaccagagtaccagaagcgaagactactgcaggaaattctagaaaatagcgaaagtctgctggagcccccagatagaggtgctggcgccgccggactcccgcaacccccgcgcgagtctccccagttgcatgagagggagacacccagaccagaaggtggcagcccttcacctgccggaactcctcctcagccaaagagacccagacccggagtttccaaggacggtcttttatcaccaggggcctggaatggcgaaccctctggtgagggcagccgtagcgttactccctcagagggcgctggcagaaggtcaccagccaggccagctacggaaaggatggctatcgaagcactccaggctccacccgctccctctagagaacccgaggttgccctctaccaggggtaccacagttatgccgtccgtactactccgccggaaccgccccctttcgaggatcagcctgagcctgaggtttccggcagcgaatcggcccccagcagtccagccacagctcccctgcaagccccaactcttcgggggccagagcctgccagggagacccctgcgaagctggagccaaaacccattatccccaaagcagaacctcgggccaaggcgcgaaaaacagaggccagaggactcaccaaagctggagcaaagaagaaggcccggaaggaggctgcgctggcagccgaagctgaggtagaggtggaagaagtgccgaacaccatcttgatttgcatggtgatcctccttaacatcggcctggcaatcttgtttgtgcatttacttacttag

SEQ ID NO: 192103 - DNA, 2247 bp, Artificial Sequence
  Description of Artificial Sequence: Synthetic coding sequence
atgagcagcggcggccggttcaacttcgacgacggcggcagctactgcggaggctgggaggatggtaaggctcacggccatggcgtctgcaccgggcccaaaggccagggcgagtataccggttcctggtctcacgggttcgaagtattgggtgtctacacatggccctcagggaacacctaccaggggacctgggcccagggcaaacgacacgggatagggttagagagcaaggggaagtgggtgtacaagggcgaatggacgcatgggtttaaagggaggtacggtgtccgcgagtgcgcagggaacggggcgaagtatgaagggacttggtccaacgggttacaggacggctatgggacagagacgtatagcgacggcggaacataccaggggcagtgggtaggtggcatgcgccaggggtatggggttcgccagtccgtcccgtacgggatggcagcggtgattagatcccctttgcggacgtccataaacagtctgcgcagtgaacacaccaacggtacggccctgcaccctgacgcgtctcctgctgtggctgggtcaccagccgtcagccggggtggtttcgtgctagtggcccacagcgacagtgaaattctgaaatccaagaagaaagggcttttccgcaggtccctgcttagcggactgaaacttagaaagagcgaatccaaaagcagtctggcttctcagaggagtaagcagagtagtttccggtccgaggctgggatgtcaacagtcagttctaccgccagtgacatccactctaccatcagcctcggggaggcggaagctgagctcgctgtgatcgaggatgatatcgacgcaaccactacggagacttatgtcggcgagtggaaaaatgataaaaggagtgggtttggcgtatcacaacgctctgatggtctgaagtacgaaggcgaatgggcctccaaccgaaggcatgggtatggatgcatgacttttcccgatggcacaaaggaagagggaaaatacaagcagaatatcttagtcggcggaaagcggaagaatctgatcccgctgagagccagcaagatcagagagaaggtagatcgcgcggttgaggctgcagagcgtgccgccacaattgctaaacaaaaagccgaaattgccgctagccggactagtcactctcgggcaaaggccgaggccgccctaacggccgcccaaaaagctcaggaagaagcaagaatagcacgcataactgctaaggagtttagcccctccttccagcacagggaaaacgggctggagtaccagcgcccaaagcgccagacctcgtgcgatgacatagaggtgctgtctactgggacaccgctgcagcaggagtcccctgagctgtaccgtaaagggaccacgcctagtgatctcactcccgatgatagccctctccagtcctttccgaccagccccgctgccacgcctcctccagctccagctgctcggaacaaagtggcccatttctcaaggcaggtaagcgtggatgaagagagaggcggagatatccagatgctcctggagggacgggccggtgactgtgcccggtcatcttggggggaggagcaagctggaggaagcagaggagtgcgctctggagccttaaggggtggcctgctggtggatgacttcagaactaggggatctggtcgaaagcagccaggaaatcccaaacctagagagcggagaacagaaagcccccccgtcttcacatggacctctcaccacagggcatcaaaccattccccgggagggagccgtctactggagctgcaggaagagaaactgagcaattatcgcatggagatgaaaccgctactgaggatggagacccacccccagaagagacgctacagcaagggcggagcctgccgtgggctgggagacgaccacagacccgaagatcggggattcggagtgcagagactgcgctcaaaagcgcagaacaaagagaatttccgcccagccagttccgctgagcccgccgtccagaaactggcctcactgcgactgggaggagctgaacctaggcttctaaggtgggatttgaccttttctcccccccagaagtcattgccggtggccctggaaagcgatgaggaaaatggagacgaattgaagtccagtactggctccgcccccattcttgttgtgatggtgatcctcctgaatattggagtcgcaattcttttcatcaatttttttatctag

SEQ ID NO: 192104 - DNA, 561 bp, Artificial Sequence
  Description of Artificial Sequence: Synthetic coding sequence
atgagcagcggcggccggttcaacttcgacgacggcggcagctactgcggcggatgggaggatggcaaagctcatgggcacggtgtgtgtactggccctaaaggccagggggagtataccggttcttggtcccacggcttcgaagtgctcggtgtgtatacttggccgtcgggcaacacatatcaaggaacatgggcgcaggggaagcgtcacggcatcggcctcgagtctaaaggcaaatgggtttataagggagagtggacgcacggcttcaaaggaagatatggcgtgagggagtgcgccggtaacggggcgaaatacgagggcacatggtctaatgggctccaggatggctatggaaccgagacctactcggatggagatgccactgccttcggcgccgaaccaggacccgaggctagagagctgcccgctgcagccgccgccgccgcagcagccgccgcagcagctgtcaggtggttcctctgtcgggagccatggccagccctccagctgccagcatgcctagactctccaatctctactcctcagtgtacctag

SEQ ID NO: 192105 - DNA, 96 bp, Artificial Sequence
  Description of Artificial Sequence: Synthetic coding sequence
atgcccccccacagcggccagagccggggccggaagcccggcagctgtttgctcttgcttctgctcctcctcctactcctcctgctgctcctgtag

SEQ ID NO: 192106 - DNA, 1836 bp, Artificial Sequence
  Description of Artificial Sequence: Synthetic coding sequence
atgcggcagggctacggcgtgcggcagagcgtgccctacggcatggcagctgtcatacggagccccctgcggacgagcattaatagccttcgttcagaacacacaaatggtactgcgctgcatccagatgcgagccctgcggtggcaggctcccccgccgtgtcaagagggggatttgttctggtggcacattcggatagtgagatccttaaaagtaagaaaaaaggtctctttcggaggtcactgctgtctggcctgaagctcaggaagtccgagagtaaaagctcacttgcctctcaacggagcaaacagtcgtcctttcgaagcgaggctggtatgtccaccgtatcaagtacggcatcagacattcatagcacaattagtctgggcgaggctgaggcagagttggccgttattgaggatgacatcgatgccacaacaaccgaaacttacgtgggagaatggaaaaatgacaagcgttccgggttcggcgtgagccaacgctctgatggactaaagtatgagggcgaatgggctagtaataggcggcacggctacggctgcatgacttttccagacgggacaaaagaagaaggaaagtacaagcagaacatcctggttggtgggaagagaaagaacctgatccccctacgggcctcaaagattcgggagaaggtagatcgcgccgtcgaagccgcagaacgtgccgccacaatagcaaaacagaaagccgagatcgccgcgtcacgcaccagccatagtagggcgaaggcggaagccgctttaactgcagctcagaaggcccaggaagaggcgaggatcgcccgcataaccgcaaaggagttttcccctagcttccagcaccgtgaaaacggcctcgagtaccagcgccctaaaagacagacttcatgtgatgatatcgaggttctgtccacgggaacacctctacaacaggaaagtccggagctataccgcaagggcaccacacctagcgatttgactcccgatgactcccccctacagtcttttcccacctctcccgccgcaacccctccgcctgcaccggctgcccgcaacaaggtggcccacttctccagacaggtcagcgtggatgaggaacgcggaggggatattcaaatgctcttggagggcagggctggggactgtgctagatctagctggggggaggagcaagctggcggttcccgaggcgttcgatctggagcattgcggggaggtctgttggtagatgatttcaggactaggggttctggacgcaagcaacccggaaatcccaaacctagggagcggagaactgagagcccccctgtgtttacctggactagccatcacagagcctctaatcactcaccagggggatcaagactgctagagttacaggaggaaaagctgtcgaattatagaatggagatgaaacctcttctaagaatggaaacacatccccagaaacggcggtactccaaggggggtgcctgtaggggccttggggacgaccaccgccctgaagatcggggtttcggagtgcagaggcttagatccaaggctcagaataaggagaattttcggccggcctcatcagccgagccagctgtacagaaactcgcatcattgaggctgggtggtgccgaaccccggcttctgcgatgggacctaacattctccccgcctcaaaagtcacttccagtggcactggagtccgatgaggagaacggcgatgagctgaagtcctctacaggctctgctccaattctggttgtaatggtcattttgttgaacatcggggttgccattctgtttatcaacttcttcatctag

SEQ ID NO: 192107 - DNA, 1347 bp, Artificial Sequence
  Description of Artificial Sequence: Synthetic coding sequence
atgaccagcagctgctgcgtgaccaacaacctgcaggccagcctgaagtcttgcccccgacccgcctccgtgtgttcttccggggttaattgtcgccccgagctgtgtctgggctacgtgtgccagcctatggcctgcctgccttccgtgtgcctgcccacaactttccgcccggcctcctgcctgtccaaaacctatctttctagtagctgccaggccgcttccggcatctcaggctcaatgggccctggtagttggtattcagagggagcctttaatggcaacgagaaggagactatgcaattcctgaacgaccgcctggcgagctacctaacaagggtgcgacagcttgagcaagagaacgcagaattagagagtagaattcaagaagcttcacactcccaggtactgacgatgactccggattatcagagccatttcaggacaatcgaagaactgcagcagaaaatcctgtgcacgaaggcagagaatgctcggatggtggtgaatatcgacaacgccaaactcgctgccgacgatttccgggccaagtacgaagcggaattggcgatgcggcaattagtggaggccgacatcaatggcctccggcggatactggacgacctgactctgtgtaaagctgatctggaggctcaggtggagagcctcaaagaagagctgatgtgtctgaagaagaaccatgaggaggaggtgggcagcctgcgctgtcagctcggcgaccgtttaaacattgaagtcgatgccgccccacctgtggacctcactcgcgtcctggaggaaatgcgttgccagtatgaagctatggtggaggccaatagaagagacgtggaggaatggtttaacatgcagatggaggagctcaatcaacaggttgcgacttcctccgaacagctgcaaaactatcagagtgacatcatcgatctcaggcggaccgtcaacacactggagattgagttacaagcccaacacagcctccgcgatagcctagagaacacgctgacggaaagcgaggcaaggtatagctcacagcttgctcagatgcagtgcatgatcacaaatgttgaggcccagcttgccgagattcgcgccgatcttgaacggcagaatcaggaatatcaggttctgctggacgttcgagctcgattggagggagagatcaacacctacaggtccctgctcgagaacgaggattgtaagttgccgtgcaacccgtgttccaccccctcttgcactacatgtgttccttcaccttgcgtcccaagaactgtgtgcgttcctcgtaccgtgggtatgccatgctctccatgcccgcaaggaagatactag

SEQ ID NO: 192108 - DNA, 1641 bp, Artificial Sequence
  Description of Artificial Sequence: Synthetic coding sequence
atggccgaggtggtgagccccgtgcccggcgccggccggcgggagcccggcgaggtgggccgcgcacgcggaccgccggtcgccgatcccggcgtggcgctctctcctcaaggagaaatcattgagggttgccgtctaccggtgctgcgcaggaaccaggacaacgaagacgaatggcctctggcagaaatcctgagcgtcaaggatatcagtggccggaaactgttttacgtacattatatagactttaacaagcgtttggacgaatgggtgacacacgagcgactagacctcaaaaagatccagttccccaaaaaggaagccaagacccccaccaaaaatggactgccgggctctcgtcctggttcacctgagcgggaagtcccagcctctgcgcaggccagcgggaagacactgcctattcctgtgcagatcaccctaagatttaatcttcctaaggaaagggaggccatacctggaggagaacccgaccaacccctgtcaagcagctcttgcttacagcccaaccaccgcagcacgaaaagaaaggtggaagtcgtgagcccagccactcccgttccgagcgagacggccccggcaagtgtgttcccccagaacggagcagcaaggcgagccgtggccgctcaaccaggccgtaaaagaaagagtaactgtctcggcacagacgaggactcccaagattcctcggatggaattccctccgccccgagaatgactgggtctctggtctccgatcgatcgcatgacgacatcgttacaagaatgaaaaacattgagtgcatagagctgggccggcaccgcctcaagccatggtatttcagcccttaccctcaggagctgacaaccctcccagtgctgtacctgtgcgagttttgcctcaagtacggacggagcctgaagtgcttacagcgacatcttacaaaatgtgacctgaggcatccacctggaaatgagatttatcggaagggaactatctcctttttcgagatcgacggacgaaaaaataagtcttacagccagaatttgtgtctgctggcgaaatgctttctggatcacaaaaccctatattacgacactgaccctttcctgttttatgtcatgactgagtatgattgcaaggggtttcacattgtaggttatttctccaaagaaaaggagtcgaccgaggactacaacgtggcatgtatcctgaccttgcccccataccagcgcaggggctacggcaaattgttgatcgagttcagctacgagctgtcgaaggtcgagggaaaaactggaacgccagagaaaccgctgagtgacttaggccttctctcttaccgctcctattggagccagacaattctggagattctgatgggcttaaaatctgaatccggggaaagaccacagattacaataaatgagattagcgagatcacaagcattaagaaggaagacgtcattagcaccctacaatacctcaacctgatcaactattacaaggggcagtacattttaacactctctgaggatattgtcgatgggcacgaacgcgcaatgctgaagcggttgctaagaattgattcaaaatgtctccactttacacctaaggattggtccaagagaggaaaatggtag

SEQ ID NO: 192109 - DNA, 1386 bp, Artificial Sequence
  Description of Artificial Sequence: Synthetic coding sequence
atggccgaggtgggcgagatcatcgagggctgccggctgcccgtgctaaggcgcaaccaggataacgaagatgaatggcccctggcagagattctctctgtgaaagatatctcaggtcggaaactcttttatgttcactatatcgacttcaacaagcgcctggatgaatgggtcactcacgagcgactcgacctaaaaaagatacagtttcctaaaaaagaagccaagaccccgaccaaaaatggtctgccaggctcacggcccggcagccctgagcgcgaagtcaaacgaaaagtcgaagtcgtctctcccgctactccggtcccctcagaaacagccccggcctctgtattccctcaaaacggagcggcccggcgagcagtggctgctcaacctggccgcaagaggaaatccaattgcctgggaaccgatgaagactctcaagattcaagtgatggtatcccttcggcccctcggatgaccggcagccttgtatcagaccgctcgcacgatgacatcgtgactcggatgaagaacattgagtgcatcgaactgggaaggcatcgtctgaaaccctggtatttttctccctacccccaggagcttaccactctgccagtgctgtacctgtgtgagttctgcctaaaatatggccgttctcttaaatgtctgcagagacatctgactaagtgtgatctacggcaccctcctggtaacgagatatatcgaaaggggactatcagttttttcgaaatagatggaagaaaaaacaagtcttatagtcagaatctgtgcctgttggctaagtgtttccttgatcacaagactctgtattatgacaccgaccctttcctgttttacgtgatgaccgagtacgactgtaagggttttcacatcgtcggctacttctccaaggagaaagagtcaactgaagactataacgttgcttgcatactcacactccctccctaccagcggcggggttatggaaagctgttgatcgagttttcttacgagcttagcaaggtcgagggcaagactggtactcctgagaagcccttatcagatttaggcctgttgagctatagatcctattggtcgcaaactatcctggagatcctaatggggttgaagagcgaaagtggcgagaggccacagataacgattaatgaaattagcgagatcacatctatcaaaaaagaagatgtgatcagtacgctgcagtacctcaacctcattaattattacaagggtcagtacatactgacattgagcgaagacattgtggacgggcacgaaagagccatgctgaaaagactgctgcgcatcgactcaaaatgcctgcacttcacgccaaaagattggagcaagcgcggcaaatggtag

SEQ ID NO: 192110 - DNA, 1542 bp, Artificial Sequence
  Description of Artificial Sequence: Synthetic coding sequence
atggccgaggtgggcgagatcatcgagggctgccggctgcccgtgctccggcggaaccaggataacgaagatgagtggccccttgccgaaattctatctgtgaaagacattagtgggaggaaactgttctatgttcactacatcgatttcaataagcgcctcgacgaatgggtcacacatgaaagactggacttaaagaagattcagttccccaaaaaggaagctaaaactcccaccaaaaatggcctgcctggctccaggccaggaagtcctgaaagagaggtccctgcatctgctcaggcttccggaaagacactgcccattcctgtgcaaatcacgctgcggttcaacctgcccaaagagcgtgaggccataccagggggggaacctgaccagcccttgagtagtagttcatgcctccaaccaaaccatcgttctacaaagcggaaagtagaagtggttagcccagcaacaccagttcctagcgagacggcacccgcatccgtgtttccacagaacggtgccgcccgacgagccgtcgccgctcagcctggtaggaagaggaagtcaaattgtctgggcaccgacgaggacagtcaggactcttccgatggaatcccttcagcgccccgaatgaccgggagtctggtaagtgatcgctcccacgacgatatagttacacgaatgaaaaatatcgaatgcattgagcttggcagacacagattgaaaccgtggtacttcagcccgtacccacaagagctcactaccctgcccgtattgtacctgtgcgaattttgtcttaagtatggcagatcattgaagtgtctgcagagacacctgaccaagtgtgatctccgacacccacccggcaatgaaatctaccgcaaaggaaccatttccttctttgaaattgatggtcggaaaaacaagtcgtacagccagaacttgtgcctgctggcaaagtgctttttggaccataagaccctgtattacgacaccgatccatttctgttttacgtaatgacggagtatgattgcaagggatttcatatcgtggggtatttttcaaaagagaaagaaagcactgaggactataatgtggcatgtatcctgacactccctccataccagcggagaggctatggaaaattgctcatcgagttctcttatgagctatctaaggtggagggcaagaccggaacgcctgaaaagcccctatctgatctgggcttactgtcatatcgctcctactggagccagacaatacttgaaatccttatgggcttgaaaagtgagagcggggagagaccgcagataacaattaacgagatttccgaaattactagcataaaaaaagaggacgtcataagcacgctgcaatacctgaacctcattaactattacaagggccagtacatcctgaccctgtcagaagacatagttgacggacacgaacgcgccatgttgaaacgcttgctgagaatcgattctaagtgtctacacttcacacctaaagactggagcaaacgcgggaagtggtag

SEQ ID NO: 192111 - DNA, 1485 bp, Artificial Sequence
  Description of Artificial Sequence: Synthetic coding sequence
atggccgaggtggtgagccccgtgcccggcgccggccggcgggagccaggggaagtgggtcgagcacgtgggccaccggttgcagatcctggggtcgcacttagtccgcaaggggaaattattgaagggtgtcggctgcccgtgctacggcgcaaccaggacaatgaggacgagtggcctctcgccgagattctgtcagtgaaagacatttccggaagaaaactcttctacgtccactacatagactttaacaaacgattagacgagtgggttactcacgagcgcctggatttgaagaagatccagtttcccaagaaagaggcgaagactccaactaaaaacgggctgcccggtagccgacccggctcgcctgagcgtgaagttaaaagaaaggtggaagtcgtgagccctgcgacccccgttcctagcgagaccgcccccgcttccgtctttcctcagaacggcgcagcccgacgtgccgttgccgcgcagcccggcagaaagagaaagtccaactgtctgggaactgacgaggactctcaggatagctccgatggcatcccatctgcacctcgcatgacagggtcactagtgagcgacagaagccatgatgatatcgtgacgcggatgaagaatatcgagtgcatcgaactgggcaggcaccgtctcaagccatggtacttcagtccctacccccaagagctcacgacgcttcccgtattgtacctttgcgagttctgtctgaagtatgggcgcagtctcaagtgcctgcagcgacatctgacgaaatgtgatctgaggcatccccccgggaacgagatttaccggaagggcaccatcagtttctttgagatcgacggacgcaaaaacaaatcttacagccagaatctttgtctgttggcgaaatgctttcttgatcataagaccctctactacgatactgacccgtttctgttttacgtgatgacggagtatgattgcaaaggttttcacatcgtggggtattttagcaaagaaaaggaatcaacggaggactacaacgtggcgtgtattttgaccctgccaccctaccagcgtcgaggatacgggaagctcctcatcgaattcagctacgaactctctaaagtggaaggaaaaactggcactccagaaaagccactgtcagatcttgggttactctcataccgctcgtattggtcccagaccattctggagattctgatgggcctgaagagcgaaagcggggaacggcctcaaatcaccatcaatgagatctccgagattactagtatcaagaaggaggacgttatatcaacactgcagtatctgaacttaataaattactataaaggccagtatattcttaccttatctgaggacattgtggacggccatgagcgagcaatgctgaagcggctgctccgaatcgactcaaagtgcctccattttacgcctaaagactggtccaagcggggtaagtggtag

SEQ ID NO: 192112 - DNA, 6222 bp, Artificial Sequence
  Description of Artificial Sequence: Synthetic coding sequence
atggtgaagctggccaaccccctgtacaccgagtggatcctggaggccatccagaagattaaaaagcagaagcagcggccatctgaggaacggatatgccacgcggtatccacaagccacggcctggataagaaaactgtatccgagcaactcgaacttagtgtgcaagacggttccgtcctgaaggtgacgaataagggcctggcgtcatacaaggacccagacaatcccggacgcttcagctcagtgaagcctggaacattccccaagtctgcaaaggggtcaaggggctcctgcaacgatctgcggaatgtggattggaacaagctcctccggcgagccatcgagggccttgaggaacctaacggtagcagtttgaagaatatcgagaagtacctgagaagccaaagcgatctgacctcaacgacaaacaatccagcctttcagcagcgcctgcggctgggcgccaagcgtgcagttaacaacgggagattgttaaaagacgggccccagtaccgggttaattatggctccctcgatggtaagggcgctcctcagtacccatctgcgtttccttccagcttacctcccgtttccctgcttccccacgagaaagaccagccccgcgcagaccctatacccatttgttccttttgtctgggcacgaaggagtccaatcgagagaagaagcctgaggaactcctcagttgtgccgattgcggctctagtggccacccgagctgcctgaaattttgtcccgagctgaccaccaatgtaaaggccctacgctggcagtgcattgagtgcaaaacatgctcagcttgccgagtgcagggccgaaatgctgacaacatgcttttctgcgactcgtgtgatagggggttccatatggagtgctgtgacccccccctgagcaggatgccgaagggcatgtggatctgccaagtgtgtcggcctaagaagaagggaagaaaacttttacatgaaaaggcagcccagattaagcgccgatacgccaaaccaatcggccgcccgaagaacaagctgaaacaaaggctgctctctgtgacaagcgacgagggtagtatgaatgcattcactggacgaggctcccccgggcgcggacaaaagaccaaggtgtgcacaacaccaagttccggacacgccgcttccggaaaagattcatcctccagacttgcagtgaccgacccaaccaggccaggcgcgacaacgaagatcaccacaactagtacctacatttctgcaagcactctgaaggttaataaaaagaccaagggcctaattgacgggctgactaagttctttaccccctcacctgatggccgccgaagccgcggagagataatcgacttcagcaaacattacagaccccggaagaaggtttctcagaaacagagttgcacctctcacgttctggccacaggaaccacccagaaattgaagcctccacctagtagcctgccccctcccactcctatttctggtcaaagcccgagcagtcagaagtcgtctactgctacatccagcccctcaccacagtcctctagctcccagtgtagtgttccttccttgagcagcctgacgactaactcccagctcaaggccttgtttgatggtctgtcccatatctacacaacgcaaggtcaaagccgcaaaaaaggccatccttcctatgctcccccaaagcgcatgcggaggaagacagaactttccagcactgctaaaagtaaagctcacttcttcggaaagcgtgatatcagatctcggttcatcagccattcctcgtcttcgtcttggggcatggcacggggaagtatttttaaagcgatagctcacttcaaacggacaacatttcttaagaagcacaggatgctgggcaggctgaagtacaaagtgactccacagatgggcactccttcccctggcaagggttctctgacagacggcaggattaagcctgatcaggatgacgacacagagatcaagataaatattaagcaagaatccgccgatgtcaatgtgatcgggaataaagacgtagtgaccgaggaggatctggatgtgttcaaacaggctcaggaactttcctgggagaaaatcgaatgcgaatctggagtagaggattgtggacgttaccctagcgtcatcgagttcggaaaatacgagatccaaacttggtatagtagtccgtatccacaggagtatgccagattgcctaaactgtacttgtgtgagttttgtcttaaatatatgaagagtaagaacattctgttgagacactcgaagaaatgtgggtggttccacccgccagccaacgaaatctacaggagaaaggatctttctgttttcgaggtcgatggaaacatgtcgaagatttattgccagaatctctgcttgttagccaaactctttttggaccacaaaacactttactatgacgtggaacccttcctgttttatgtgctaacgaagaatgacgagaaggggtgccacctggtcggttacttttcaaaggagaagctctgtcagcaaaaatacaacgtgtcctgcataatgattatgcctcagcaccagagacagggatttggacgtttcctgatcgacttctcttacttgttgtcaagacgcgaggggcaggccggctccccagaaaaaccactctctgatttggggcgactctcttatctcgcctattggaaaagcgtgatattggaatacctgtaccaccaccacgaacggcacattagcataaaggccatctcccgagcaaccggaatgtgtccacacgacattgcaaccaccctccagcatctgcacatgattgataaaagggacggacgcttcgtgattatcaggagagagaagttaatactcagccacatggagaagctgaagacttgcagccgtgcgaatgaactcgatcccgattcactcaggtggactcccatcctaatcagtaacgcagccgtctcagaggaagaacgagaggcggagaaggaggcggagcgtctgatggagcaggcctcctgttgggagaaagaagagcaggagatcctcagcaccagggccaacagcaggcaatctcccgcgaaggtccaatccaagaataagtatttacattcacctgagtctagacctgtcacaggtgaaaggggccagcttctggaactttccaaggaatctagcgaagaggaggaggaggaagaggacgaggaggaggaagaggaggaagaagaggaagaggaagacgaagaggaggaagaagaagaagaggaggaggaggaggaggagaatatccagagctcgcccccccggctgaccaagcctcagtcggtggctataaaaagaaagagaccgttcgtgttaaagaagaagaggggcagaaagcgcaggaggataaactcaagcgtgactactgaaacaattagtgaaactactgaggtgttaaacgagccttttgataatagtgatgaagagcgacctatgcctcagctcgagccaacttgcgagatagaagtggaagaagatggccgcaaaccagttctgcgaaaggcttttcagcatcagcccggcaaaaaacgccagaccgaggaggaggaaggcaaagataatcactgtttcaagaatgctgatccttgccggaacaacatgaatgatgacagctccaacctgaaagaaggcagtaaggacaatcccgagcccttaaagtgcaagcaagtatggcctaaaggcacgaagagaggcctgagtaagtggcgccagaacaaggagcgcaaaactggatttaagctcaacttgtacactccccctgaaactcctatggagcctgacgagcaggtcactgtggaagagcagaaggaaacctccgaaggaaaaacatcaccttctccaatccgcatcgaggaggaagtgaaggaaacgggtgaggcactgcttcctcaggaggagaatcgcagggaagaaacctgtgccccggtcagtccaaataccagccccggagagaaacccgaagacgatctgataaagccagaggaggaggaggaggaggaagaggaggaggaagaggaggaggaggaggaagaaggagaagaagaggaaggcggaggcaacgttgagaaagaccctgatggcgccaagtctcaggagaaggaggaaccggagatctccaccgaaaaggaggatagcgcacgccttgacgaccatgaagaagaagaagaggaggacgaggaaccttcacacaacgaggatcatgatgcagacgacgaggatgacagccacatggagtcagcagaggtggaaaaggaggagctcccaagggaatcgtttaaagaagttcttgagaatcaagagacatttctggatctaaacgtccagcccggccactctaatcccgaagtgttgatggattgcggagttgatctgaccgcatcatgtaacagcgagcccaaagaactcgctggcgatcctgaggctgtgcctgaatccgacgaagagccacctcccggggagcaagcacagaaacaggatcagaagaatagtaaggaagtggacactgaatttaaggagggaaatccggctaccatggaaatcgacagcgaaaccgtccaggccgtgcagagtctgacccaggagtcctccgagcaagacgacacttttcaggattgcgccgagacccaagaggcctgtagatctttacaaaattataccagggctgatcaaagtcctcagatcgcaacaacactggatgactgtcaacagtccgaccactcctcccccgtgtcctctgtccactcccacccaggccagagcgttcggtctgtgaacagcccctcagtccccgctttggaaaacagttatgcacagatctccccagatcagagcgccatcagcgtgccatcactgcagaacatggaaacctctcccatgatggatgtgccatccgtgtcggatcacagccagcaggtcgttgattctggattcagtgatttaggcagcattgagagtaccacagaaaactatgagaatcccagtagttacgattccacaatgggcggctcgatttgcgggaacggtagcagccaaaacagctgcagctattctaacctcacttcctcctctttgactcagtcgagctgcgctgttacacaacagatgtctaatatatcaggttcctgctctatgctgcagcagaccagcatcagcagcccgccgacttgctctgtgaaatctcctcagggctgtgtcgtcgaacgccctccctctagctctcaacagctggcccaatgttcaatggccgccaatttcaccccgccgatgcagctggctgagataccagagacaagtaatgcgaacattggactgtacgaacggatggggcagtcagatttcggtgccggtcactacccccagccttccgccactttttcgcttgccaaactgcaacaacttaccaacaccctcatcgaccattccctcccatactctcattcagccgccgtaactagttacgcgaactcagcctctctctccactccgctgagtaacacaggcctggtgcagctttcccaaagcccgcattcagtgccaggtggccctcaggcccaggcgacaatgactccacctccgaacctgacaccccctcccatgaatttaccccctcctctgctccagcgaaacatggccgcatcaaatatcggcatatctcattcccagcgattacaaacccagattgcaagcaaaggtcatatttccatgcggactaagagtgcaagcctgtccccagcagccgctactcatcagagccagatctacggccggtcccagaccgtggctatgcaaggccccgcccggactctcactatgcagagagggatgaatatgagcgtcaatctcatgcccgctccggcctataatgtgaacagcgtcaatatgaatatgaacactctaaatgccatgaacgggtattccatgtcacagcctatgatgaactccggctaccacagcaatcatggatacatgaatcagactcctcaataccctatgcagatgcagatggggatgatgggaacccaaccctacgcccagcaacctatgcagaccccccctcatgggaacatgatgtacaccgcccctggtcaccatgggtatatgaataccggcatgagtaaacagtccctgaacgggtcctatatgaggcgctag

SEQ ID NO: 192113 - DNA, 5673 bp, Artificial Sequence
  Description of Artificial Sequence: Synthetic coding sequence
atggtgaagctggccaaccccctgtacaccgagtggatcctggaggcaattcagaagattaaaaagcagaagcaaaggccgagcgaggagcgtatctgccacgcggtgtctactagccacggactggataagaaaacagtatcagagcaactggagctgagtgtgcaggatggaagcgtgttaaaggtgactaataaaggattagcttcctacaaagatcccgacaaccccggaaggttttcctctgtgaagcccggcacattcccaaagtctgccaaaggctcccgcggctcttgtaatgacctaagaaacgtggactggaacaagctgctccggcgtgcgatagagggcttagaagaacctaatggaagtagcctgaaaaacattgagaaatatctccgctcccagtccgatttgacctccaccacgaataaccccgcctttcagcagagactcaggcttggagcaaagcgagccgtgaacaatggtcgattgcttaaggacggcccacagtatcgggtaaattatgggtcattagacggcaaaggggcgccccagtatccatccgcgttcccgtcctcattgcccccagtctccttgctgcctcacgagaaggatcaaccccgggccgatccgatacccatctgttctttctgcctaggtaccaaggagagcaaccgtgaaaaaaaacctgaggagctcctctcttgcgccgactgcggatcatcaggacatccatcttgtctgaagttctgccctgagctaaccacaaatgtaaaggctctcagatggcagtgtatagagtgtaaaacctgctctgcctgccgggttcagggtcgaaatgctgacaatatgctcttctgtgatagctgtgaccgtgggttccacatggagtgttgtgaccccccactgtctaggatgcctaaagggatgtggatatgtcaggtgtgtcggcctaagaagaagggacgaaaacttttgcacgagaaagccgcacagattaagaggaggtacgctaagcccatcggtagacccaagaacaagctgaaacagcgccttctgtccgtgacatcagatgaaggctctatgaatgctttcacaggcagaggatcgccaggcagaggacaaaaaacaaaggtctgcactacccccagctccggacacgctgcctccggaaaggactcctcatcacggcttgctgttacagatccaacacggcccggggccaccaccaaaatcactaccacatcgacatatatcagcgcctctacactcaaagtgaacaaaaagacaaaaggcctaatagatggtcttaccaaatttttcactccatctcccgacggacgccgcagtaggggcgagatcattgactttagcaaacattatcggccgaggaaaaaagtatcccagaagcaatcttgcacctcccacgtcctggccaccgataccgagattaaaatcaatatcaagcaggagagtgctgatgttaatgttattggcaacaaagacgtcgtgacagaggaagacctggatgtgtttaagcaggcccaggaattatcctgggaaaagatagagtgtgaaagcggagtagaagattgcggccgatacccatcggtgatcgagttcgggaaatatgagatccagacatggtacagttcgccatatcctcaagagtatgccagactgcctaaactgtacctctgtgaattctgcttgaaatatatgaagagcaagaatatcctcttaaggcatagcaagaagtgcggctggttccatccccccgccaacgagatttataggcgcaaggatctgagtgtgtttgaggtggatggcaacatgtctaagatttactgtcagaatttgtgcttgctggctaaactctttctcgatcataaaacattgtactatgatgtcgaacccttcctgttctatgtcctcacaaagaacgatgagaaaggttgtcacctggtgggttatttctcgaaggagaaactgtgtcaacagaagtacaatgtgtcatgcataatgataatgcctcagcaccaacgtcaagggttcggccgatttttaatcgatttttcctacctcctgtcccgccgagagggtcaggccggcagccctgaaaagcccctatcggacctcggtagactgtcatatctcgcatattggaaatctgtgatcttagagtacctgtatcatcaccacgagcgccacatctcaatcaaggctattagccgcgccacaggtatgtgtcctcacgacattgccacaactctccagcatttgcatatgattgataagcgcgatggtcggtttgtgattattcgtagggagaagttgatcctgtcccatatggaaaaactgaagacatgttctcgtgccaacgagctcgaccccgattcgcttagatggacacctatactgatttcgaatgcagctgtgtccgaggaggaacgagaagcagaaaaagaggcagagaggctgatggagcaggcctcgtgttgggagaaggaggaacaggaaatcctgagcaccagagccaatagcagacaaagtcctgctaaggttcaaagtaaaaacaaatacctgcactccccagagagccggcccgttacaggcgaacgtggccagctcctggaactgagtaaggagtcctccgaagaggaagaagaagaagaggatgaggaagaagaggaggaagaagaggaggaggaggaggatgaagaggaagaagaagaggaggaggaggaagaagaggaggaaaacattcagtcctccccgccccggctcacaaaaccccagagcgttgctatcaagcggaaaagacccttcgtgctaaagaaaaaacgggggagaaaacggagacgaatcaactcatctgtcaccactgaaacaattagtgagaccactgaggtcctcaacgagccatttgacaatagcgacgaagaaaggcctatgccgcagttggagccgacttgcgagatcgaggtcgaggaggacggccgaaagcccgtcctgagaaaagcgttccagcaccagcccggcaagaaacgccaaacagaagaggaagaggggaaggacaaccactgttttaaaaatgctgacccatgcagaaacaacatgaacgacgacagtagtaatctgaaagagggatcaaaggataaccccgaacccctgaagtgcaaacaggtttggccaaaagggacgaaaaggggcctgtctaaatggcggcagaataaagagagaaagactggcttcaagctgaacctgtacacgccaccagaaactccaatggaacccgacgagcaggtcaccgtggaggagcagaaggaaacaagcgagggtaaaactagtccatcacccatcagaattgaggaagaggtcaaggagacaggtgaggccttattaccccaggaggaaaatagacgagaggaaacctgtgcgccagttagccctaacaccagtccaggcgagaaacctgaagatgatctgattaagccggaggaggaagaggaggaggaggaagaggaggaggaggaggaagaggaggaagaaggtgaggaggaagagggcgggggcaatgtggaaaaggatccagatggtgccaaatcacaggagaaggaagagcccgagatctcaacagagaaagaggattcagcgcgtctcgacgaccacgaggaagaagaggaagaagacgaggaacctagccacaatgaagatcatgatgctgatgatgaagacgattcacacatggagagtgccgaagtggaaaaggaagaactgccaagggagtcttttaaggaagtgttggagaaccaggaaacgtttcttgaccttaacgtgcaaccaggacacagcaatcctgaggtgctcatggattgcggcgtcgatttaacagctagctgcaactccgaacctaaagagcttgctggtgaccccgaggcggtcccagagtccgacgaagagcccccacctggggagcaagcccagaaacaagaccaaaaaaactcaaaggaggttgatacagaatttaaggaagggaaccccgctacaatggaaattgattccgagactgtgcaagccgtccagtccctcacccaggaaagtagcgagcaggatgatacatttcaggattgcgccgagacacaggaagcctgtcggtctctgcagaattacacgcgggcagaccaaagtccgcagatcgctacgacactggatgattgtcagcaatcggaccactctagtccagtatcttcagtacacagccacccgggacagtccgtgaggtcagtaaatagtcccagcgtgcccgcactggaaaattcctacgcccagatctcacctgaccagtcagcaatctcggtgccctctctgcagaatatggagacttcacctatgatggatgttccaagcgtaagcgatcactcacagcaggtcgtggatagcggcttttccgacctaggttctatcgagagtaccactgagaactatgaaaatccctccagttacgatagcacaatgggtggctcgatttgcgggaacgggtcaagtcagaactcatgttcctactcgaacctcaccagcagctccctcactcagagctcttgcgcggttactcagcagatgtctaatattagcggaagctgctcaatgctccagcagacaagtatatcatcaccacccacatgttcagtgaagtcccctcagggatgcgttgttgaacggcccccgtcctcaagccaacagctggctcagtgttctatggctgccaatttcaccccccctatgcagctcgctgagatcccagaaaccagtaatgctaacatcgggctgtatgagcgcatgggacagagtgattttggcgccggacactatcctcaacctagtgcaacattctcccttgctaagctgcagcagctcaccaataccctgatagaccactctcttccatactcccactcggcagccgtcacatcatatgcgaactccgcatctctatccacaccacttagcaataccggcctggttcagttgtcacagtccccccattctgtccccggtggaccgcaggcccaggccaccatgactccaccccccaatcttacacccccgccgatgaatcttcctccacccctgctccagagaaatatggcagcttccaacattggaatttcccacagtcagcggttacaaacccagatcgccagtaagggccacattagcatgcgcaccaaatctgcctcactcagccccgcagctgctacccaccagtcacagatttacgggcggtcacagactgtggctatgcaggggccagctagaacattgacaatgcagcggggcatgaatatgtcagtcaacctgatgcctgcgcccgcgtacaacgtaaacagcgttaacatgaacatgaatacactgaatgcaatgaatggttattccatgtctcaaccaatgatgaacagcggatatcacagcaaccacgggtatatgaaccagaccccccagtatccaatgcagatgcaaatgggtatgatgggtactcagccttatgcacagcagcccatgcagacacctccacacggcaatatgatgtacacagcacctggacaccacggatacatgaataccggcatgtccaagcagtccttgaatggcagctacatgcggcgatag

SEQ ID NO: 192114 - DNA, 5346 bp, Artificial Sequence
  Description of Artificial Sequence: Synthetic coding sequence
atggtgaagctggccaaccccctgtacaccgagtggatcctggaggctattcagaaaataaaaaagcagaagcagagaccctctgaggagcggatctgccacgctgtctctacttcacacggactcgacaagaaaactgtgagcgagcagttggagctgagtgttcaagacggaagcgtacttaaggtgaccaacaagggtctggcgagctataaggatcctgacaatcctggtagattctcaagcgtcaaaccagggacattcccaaaaagtgccaaaggcagccggggctcatgcaacgacctgcgtaatgtagactggaataagcttttgcggcgggcaatcgagggcttggaagaacctaatggctcctccctgaagaacattgaaaaatatctcaggtcacagtcggacctaactagtactactaataaccctgctttccagcaaaggctgaggctgggggctaaacgggcagtgaataatggccggctgctgaaagacggcccccaataccgcgttaattacggctccttggatgggaagggtgcaccccaatatccttccgcctttcctagctcactgcccccagtatccctgctgccccatgagaaggatcagccacgagctgacccaatccctatctgctctttttgcctggggacaaaggagtccaatagagaaaaaaagcctgaggaattgctaagttgcgccgattgtggatcctccggtcatccttcgtgtctgaagttctgcccagaacttacaacaaatgtcaaagccctccggtggcagtgtatcgagtgtaaaacatgctcagcatgtcgggtgcagggcagaaatgcggataatatgctcttttgcgattcttgcgataggggtttccacatggagtgctgcgacccacccctctctcgcatgcccaaggggatgtggatctgccaggtgtgcagacctaaaaagaaaggccgcaagctgctgcacgaaaaagcagcccagatcaagagacgatacgctaagccaatagggaggccaaaaaacaagttaaagcagaggctgttatctgtcacatcggacgaggggtcaatgaacgctttcaccggacgaggtagccccgatactgaaattaagattaatattaagcaggaatcagccgacgtgaacgtgattggcaacaaagatgtcgttaccgaagaagacctagatgttttcaaacaggcgcaggagctgtcctgggagaagattgagtgcgaatctggggtcgaggattgtggccgatacccgagcgtcatcgagtttggcaagtatgagattcagacttggtatagctcaccgtatccacaagagtatgctcgactcccaaagctgtatctgtgtgaattctgcctcaagtacatgaagagcaagaatattctgttaaggcactcaaagaagtgtggatggttccatccgcctgccaatgagatttaccggcgcaaggacctctcagtcttcgaagtggatggaaacatgtcgaaaatttactgccagaacttgtgtctcttggccaagctgtttctggatcataagaccctatactacgacgtggagccttttcttttctatgttcttacaaaaaacgacgagaaaggatgtcacctcgtgggatacttttctaaggaaaagttgtgtcagcagaagtacaatgtaagctgtatcatgatcatgccacagcaccagagacaggggtttgggcgctttcttattgatttttcttatctgctgtctcgtcgggagggccaggcaggctcaccagagaagcccctgtccgacctgggccgcttatcatatctggcctattggaaatcagtgatcctagagtatctttaccatcaccacgagcgccatattagcatcaaggctatttctagagctaccgggatgtgccctcatgacattgctaccaccctgcagcatttacacatgattgacaagagggatgggcggttcgtgataattcggcgggagaagttgatcctcagtcacatggaaaagctaaaaacgtgcagtagggcaaatgagctggatcctgacagtctgagatggaccccaattctcatctccaatgcagccgtttcagaggaagaacgggaagccgagaaagaagcggaaagactgatggagcaggccagctgttgggagaaggaggaacaggagatcctgtcgacaagggcaaattctcgccaatcgcctgctaaggttcagtctaaaaataagtatctccattcccccgaatccagaccagtaactggcgaaagggggcaactgcttgaattgtctaaagaatcctcggaggaggaagaagaggaagaggacgaagaggaagaggaggaagaggaagaggaggaggaagatgaggaggaggaggaagaagaggaggaggaggaagaggaggagaacatccagtctagcccccctagacttaccaagccgcagtctgtggccattaagaggaagcgcccattcgttctgaagaaaaaaagaggacggaaacgccgccgtataaatagctccgtaacaacagaaacgataagcgagacaaccgaagtcttgaatgagccgtttgataactcagacgaggaaaggcccatgccccagctggagcccacatgtgaaatcgaggttgaagaagatggccgaaagccagttctgaggaaagcttttcagcaccagccaggtaagaaaaggcagacagaggaagaagagggaaaagataaccactgttttaagaatgccgacccctgccgcaataacatgaatgacgattccagcaatctcaaagaggggagtaaggataatccagagcccctgaaatgtaaacaggtatggcctaagggaacaaaacggggcttgtcaaaatggaggcagaacaaagaacgcaagactggtttcaagctgaacctctacacgccacccgagacacctatggagccggatgagcaagtgactgttgaagagcagaaggaaaccagcgaaggtaagacctcaccatctccaatccgaattgaggaggaagtgaaggaaaccggcgaagcccttctgccgcaggaggaaaataggcgggaggaaacctgcgcgccagtaagtcctaatacctcccctggggagaagcccgaggacgacctgatcaaacccgaggaggaagaagaggaggaagaggaggaagaagaagaggaagaagaagaggagggagaagaagaggaaggcggcgggaacgtggagaaagatccagacggcgccaaaagccaggagaaagaagagcccgagataagtacagaaaaagaggattcagcgagactggatgatcacgaagaagaagaagaggaggacgaggagccatctcacaacgaggatcacgatgccgacgacgaggatgatagccacatggagagcgccgaggtggaaaaggaagagttaccaagggagtccttcaaagaggtgctggagaatcaagaaacgttcttggacttgaatgttcaacctggacactcgaatcctgaggtactcatggattgcggagtggaccttaccgcaagttgtaattctgaacccaaagaattggctggagaccccgaagccgtaccagaatctgacgaggagccgcctccaggagagcaggcacagaagcaagatcagaaaaattcaaaggaggtggacaccgagttcaaggagggaaatcctgccaccatggagattgattccgaaacagtgcaggccgttcagtctcttacacaggagagctctgaacaagacgacacatttcaggattgtgccgagacgcaagaagcctgcaggagcctccaaaattatacaagggcggatcagtctcctcaaattgccactacgcttgatgactgccagcagagcgaccatagctcacccgtcagcagtgtccattctcatcccggacagtctgtgcgatccgtgaacagccctagcgttcccgcacttgagaacagctacgctcagatttcacccgaccagagtgcaatctctgtgccatccctacagaacatggagacaagccccatgatggacgtcccctcagtatcggaccactcccaacaggtggtcgattcgggcttcagtgacctaggcagtatcgagtctaccaccgagaattatgagaacccgagctcgtacgacagcacgatgggaggaagcatttgcggaaacggcagtagccaaaattcgtgctcatacagcaatctgacatcctcttctttgacacaatcaagctgtgctgttacacagcagatgtcaaacatctccggatcatgtagtatgctgcagcagacatctatcagtagccctcctacatgttccgtcaaatcaccacagggttgcgtggtggagaggccaccaagctcttctcagcagctcgctcaatgcagcatggcagccaatttcacgccaccaatgcagctggcagagatccccgaaacatctaatgcaaacatcggcctttatgagcgaatgggtcagtctgacttcggggcaggacactaccctcagccctcggccaccttctcattggctaagttgcagcagcttactaataccctgatcgaccattccttaccctattcacactctgccgcagtgactagttacgccaatagtgctagcctgtccacccccctaagcaatacaggactggtgcagctaagtcaatctccccactctgttcctgggggtccacaagcccaggccacaatgactcccccccccaacctgaccccgcccccgatgaacttgcctcctccgctcctgcagcggaatatggcagcctctaatataggaatctctcacagtcaacgcctgcagacacagatcgcgtcaaagggtcacatttcaatgcgaactaaaagtgcgtcattgtctcccgctgccgccacccatcagtctcaaatttacggaaggtcacagacagtggcgatgcaggggcccgcccgcacgcttactatgcaacgcggaatgaatatgagtgtgaacctcatgcctgcccctgcatacaatgtcaactctgtaaacatgaatatgaacacactcaatgccatgaacgggtattcgatgagtcaacccatgatgaatagtgggtatcactcaaaccatggatacatgaaccagacaccccagtacccgatgcagatgcagatggggatgatgggcacccagccttatgcccagcaacccatgcaaactcccccacatggtaacatgatgtatactgctccaggccatcatggctatatgaatactggaatgagcaagcaatccttaaacggcagttacatgaggaggtag

SEQ ID NO: 192115 - DNA, 5346 bp, Artificial Sequence
  Description of Artificial Sequence: Synthetic coding sequence
atggtgaagctggccaaccccctgtacaccgagtggatcctggaggctatacaaaaaatcaagaaacagaaacagagaccctcggaagaaagaatttgtcatgccgtgagtaccagccacggcttagacaaaaagactgtgtccgaacaactggaacttagtgtgcaggatgggagtgtcctgaaggtgaccaataaagggctagcatcgtataaggatccagacaatcctgggcgctttagctcagtaaagcccggcacattccccaagtcagccaagggctctcgaggatcatgcaacgacctgcggaacgtggattggaacaagctcctccgacgtgccatcgaaggcctggaggagccgaatgggtcgagcctcaagaatatcgaaaagtaccttaggagtcaaagcgatttgacttccacgactaataaccctgctttccagcagaggctgcggctcggcgccaagcgcgctgtcaataacggtcgactgctgaaggatggccctcagtacagggtgaactatggatctttggacggaaaaggggcccctcagtacccctccgcattcccgtcttcgttacctcccgtgtctcttctcccccacgaaaaagatcagcctcgggccgaccctatacctatctgcagcttttgcctgggaaccaaagagtcaaatagggagaagaagcccgaggagcttctgagttgcgccgactgcggatcctctggccatccatcttgtctaaagttctgtcccgagctaacaacgaatgtgaaggctctgaggtggcaatgcatagagtgtaaaacttgctcagcttgcagagtccaagggcgcaacgccgacaacatgctgttctgcgacagttgtgatcggggatttcacatggaatgttgcgacccaccactgtccaggatgcctaaaggcatgtggatctgccaggtgtgtcggcctaagaaaaagggccggaaacttttgcatgagaaggctgcgcagattaaacgtaggtacgctaagccaatcggcaggccaaagaacaagttgaaacagcgtctcctgtccgtgacttcagacgaaggtagcatgaatgcctttacaggacggggcagccccgacactgaaattaaaatcaatatcaaacaggagtccgcagatgtgaatgtaatcggcaacaaagacgttgtgactgaggaggatctggatgtgtttaagcaagctcaggaactcagttgggagaagatagagtgtgagtccggtgtggaagattgtggacgctaccctagcgtgatcgaatttgggaaatatgaaattcagacatggtattcctctccctatccccaggaatacgcaagattgcccaagctgtatctatgcgagttttgtttgaaatatatgaaatctaaaaacatcctactgcggcacagcaagaaatgtggctggttccatccacccgctaacgagatttatagacgaaaggacctgtccgttttcgaggtcgacgggaatatgagcaaaatctattgccagaacctgtgtttgctggctaagttgtttctggatcataagaccctttactatgatgtagaaccgtttttgttctacgtgctgaccaaaaacgatgagaagggatgtcatctggtgggctacttctccaaggagaagctatgccagcagaaatacaacgtgtcttgcatcatgatcatgccacaacatcagcggcaggggttcgggaggttcctgatcgattttagctacctgctgtctcgccgtgagggccaggccggtagccccgaaaagcctttgtcagatcttgggcgacttagttacctggcctattggaaaagcgtgattctggagtatctgtaccatcaccatgagagacacatttccatcaaggctataagtcgcgcgaccggcatgtgcccccacgatatcgctactacactccagcatctgcatatgatcgataagagagatggtcgattcgtaattatccgcagggaaaaattgatcctctctcacatggagaagctaaaaacttgcagcagggcgaatgagctggatcctgactcgttacgctggacgccgattttaatttcaaatgccgcagtatccgaggaagagcgcgaagccgaaaaagaggccgagcgactgatggaacaggcttcctgttgggaaaaggaggagcaggagattctgagcacacgggctaactcccgccagagccctgccaaagttcagagcaagaacaaatatctgcactccccggaaagtagaccagtcacaggcgagaggggtcaattgttggagctgtcaaaggagtcttccgaagaggaagaagaggaagaggatgaagaagaggaggaggaagaggaagaagaagaggaagacgaagaggaggaagaagaagaggaggaggaagaggaagaggagaacatccagagctcacctccccgccttacaaagccgcagtccgttgccataaagaggaagaggccgttcgtattgaaaaagaagaggggcagaaaaagacgccggataaacagtagcgtgaccacggagacaatcagcgaaacaacagaggtgttgaatgagccctttgataactccgacgaggagcggcctatgcctcagctggagccaacgtgtgagatcgaggtggaagaagacggaaggaaaccggtcctgagaaaggcttttcagcaccagcccgggaaaaagcgacaaaccgaggaggaagagggaaaggataaccactgctttaagaacgccgacccttgccggaacaacatgaatgatgacagctcaaacttgaaggaaggatcaaaagacaaccccgaaccccttaagtgcaagcaggtgtggcccaaaggcactaagagaggacttagcaagtggagacagaacaaggagagaaagacagggttcaaactgaacctgtatacccctcccgagacccctatggaaccggatgaacaagttacagtcgaagagcagaaggaaacaagtgaaggcaaaacatctccctctccaatccgcattgaggaggaggtcaaggagacaggcgaggcattactcccacaggaggaaaaccgccgagaggagacatgcgcccccgtgtcgcctaacactagccccggagagaaaccagaggacgacctcattaaaccagaggaagaggaagaggaggaggaagaggaggaagaagaggaagaagaagaggaaggcgaggaagaggagggcgggggaaacgtcgaaaaggacccggatggcgccaaatcgcaggagaaggaggagcccgagatttctacagagaaggaagatagtgccaggctggatgatcacgaggaggaagaagaggaggatgaggagccgagccacaacgaggaccatgacgccgacgatgaggacgacagccacatggaatcagcggaggtcgagaaggaggagctcccacgggagtcatttaaggaggttctagagaatcaggaaacttttctggacctgaatgtccaacccggtcattccaaccccgaagtcctgatggactgtggcgtggatctcactgccagttgcaatagcgaacctaaggagctagccggggatcccgaagccgtgccagaatccgatgaggagcctccacctggcgaacaggctcagaagcaggaccagaagaacagcaaagaggtggacaccgagtttaaagagggtaaccccgccactatggaaattgactcagaaacggtgcaggcagtacagagcctgactcaagaaagcagtgagcaagatgacacatttcaagattgtgccgaaacgcaggaagcatgccgcagtctgcaaaattatactcgcgccgaccagagtcctcagatcgctacaaccttggatgactgccaacaaagtgaccactcatcccccgtatcctctgttcattcccaccccggtcagagcgttagatcagtaaattccccaagtgttcctgcactggagaattcctatgcccagatttcgccagatcagagcgccatatccgtgccctcattgcagaatatggagacatcacccatgatggacgttcctagcgttagtgaccattcccagcaggtagtcgattcggggttttctgatctgggaagcatcgagtctaccacagaaaactatgaaaacccaagttcctacgacagtacaatgggcggtagcatctgtggaaatgggagtagccagaattcttgcagttacagcaacctcaccagctcctctctaacccaaagctcttgcgctgtcacccagcaaatgtcgaacatctctgggtcatgctcaatgttacagcagacctcaattagctcacctcccacttgcagtgtaaagtccccccagggttgcgtggtggaaagaccaccgagctcaagtcagcagctagctcagtgtagcatggccgcaaatttcactccccctatgcaactggcggaaataccagagaccagcaacgccaatataggactgtatgagagaatgggccagtccgatttcggggccggccactaccctcagccttccgcaacgttttctctcgcgaagcttcaacagttgaccaacactctgatcgatcactccctgccatacagccactccgccgccgtaaccagttacgcaaactcagcgtcgttgagtacaccactcagcaacaccggcctagtgcagctgtctcagagcccacactcggtgcctggcgggccacaggcccaagcaactatgacccccccgcctaacttgacccctcccccgatgaatcttcctccgccccttttgcaaaggaatatggccgcctcaaatatcgggatcagccattcgcagcggctccagacccagattgcttcgaagggccacatttctatgcggaccaaatccgccagcttaagtcccgctgcagccactcaccagtcacagatctatgggcggtctcagaccgtagcaatgcaaggccccgcccgaacccttaccatgcagaggggtatgaacatgtcggtgaacttgatgccagcaccagcgtacaatgtcaatagcgttaacatgaatatgaataccctgaacgccatgaacggctacagtatgagtcagcctatgatgaactctgggtatcacagcaaccatggctacatgaaccagaccccacaatacccgatgcagatgcagatgggaatgatgggcacccagccttatgcgcaacagcccatgcagacgccaccacacgggaacatgatgtataccgctcctggacaccatggctacatgaataccgggatgtctaagcagtccctgaacgggtcttatatgagacgatag

SEQ ID NO: 192116 - DNA, 5346 bp, Artificial Sequence
  Description of Artificial Sequence: Synthetic coding sequence
atggtgaagctggccaaccccctgtacaccgagtggatcctggaggccattcagaagatcaaaaagcagaaacagaggccctcggaagaacggatctgtcatgctgtgtcgacctcccacgggttggacaaaaaaaccgtctctgagcagctcgagctgagcgtgcaggatggaagtgtcctgaaggtgaccaataaggggcttgcttcatacaaggatccagataaccccgggcgcttttccagtgtcaagcccgggacttttccgaagtcggcaaagggctctcggggctcatgcaatgaccttcgtaacgtggactggaataaacttctccggcgcgccattgagggtctcgaagaacccaacggctcaagtctcaagaacatagagaaataccttcgatctcagtccgacttaaccagcacaacgaacaaccccgcctttcagcagaggttgaggctcggagccaaaagggccgttaacaacgggagattgcttaaagacgggcctcagtaccgcgtgaactatggcagcttagatgggaaaggcgccccccaataccccagtgcctttcctagctccttaccacccgttagccttctgccccatgaaaaagaccagccgcgcgccgatcctattccaatctgcagcttctgcttgggcacaaaggagtcaaaccgcgagaagaagcccgaagagctactgtcatgcgccgactgtggctcgtcaggtcaccccagttgccttaagttctgtcctgagcttaccactaacgtgaaagctctccggtggcagtgcatcgagtgtaaaacctgttccgcctgcagagtgcagggcagaaatgcggataacatgctattttgcgactcttgcgatcgcgggtttcatatggaatgttgtgaccctccactatctagaatgccaaaaggaatgtggatctgtcaggtttgtcgccctaagaaaaagggccgaaagctgctgcacgagaaggctgcacaaatcaaacgccggtatgccaagcctatcgggaggccgaaaaacaagctgaaacagagacttttgtctgtaactagcgacgagggctctatgaacgcctttaccggacgaggcagccctgataccgagattaagatcaacatcaaacaggaatcagccgacgtcaatgtgataggtaataaagacgtggtgactgaagaggatctagacgtgtttaagcaggcccaggagctaagctgggagaaaatcgagtgcgaatcaggggtcgaggactgtggcaggtaccccagcgtgatcgaatttggaaaatacgagatccaaacttggtactcatccccctatccccaagaatatgctagactgcccaagctgtacttatgtgagttttgcctaaagtatatgaagtcaaaaaatatcctcctaagacactccaagaaatgcggatggtttcacccccccgccaatgagatttatagaaggaaagacttgtctgtctttgaagtcgacggtaacatgtcaaaaatctactgtcagaacctgtgtctcctagccaagctgttcctcgatcacaaaacgctctactatgatgtcgaacctttcctgttttacgttcttacaaaaaacgacgaaaaggggtgtcacctcgtcggctatttttcaaaagagaagctctgtcaacagaagtataacgtttcatgcataatgataatgccccaacaccaaaggcagggcttcggacgtttcttgattgattttagttacctgttgtcccggcgggagggccaagccggtagtccagagaaacccctaagcgacctcggcaggctctcttacttggcttattggaaaagtgttatcttagaatacctgtatcaccaccacgaaagacacatctccataaaagctatatccagagccacaggaatgtgccctcatgatatcgctaccactttacagcatttgcatatgatagataagagagacgggcgattcgtaatcatccggagagagaagctcattctaagccatatggaaaagctgaagacatgtagcagggccaacgagctcgaccccgattctttacgttggacacctattctaatatctaatgctgccgtgtccgaagaggaacgggaagcagaaaaggaggcagagagacttatggagcaagcgagttgctgggagaaggaggaacaggagattctctcaactcgtgcaaatagtaggcagagccccgccaaagtacaaagtaaaaataagtacctgcatagtcccgaaagccgtcctgtgactggtgagagggggcagcttctagaactatccaaagagtccagtgaggaggaggaggaagaggaagacgaggaggaagaggaagaggaagaggaggaggaagaggatgaggaagaagaggaggaggaagaggaagaagaagaagaagagaatatccagtcatctcccccgcgattaacgaagccccagagcgttgcaatcaagaggaagcggccctttgtcctaaaaaagaagcgcggaaggaagcgaagacgcataaatagcagcgttaccactgaaactatttccgaaaccacggaggtcctgaacgagccatttgataacagcgatgaggagcgccctatgccacaacttgagcccacatgcgaaattgaagtcgaagaagatggtaggaaaccagtcctcaggaaagcctttcaacaccaacctggaaagaagagacagacagaggaggaagagggaaaggataatcactgttttaaaaacgccgatccctgccggaataacatgaatgacgatagctccaacctgaaagaaggtagcaaagacaatcccgaacctctcaagtgtaaacaagtctggccaaaggggaccaaaagaggattgagcaagtggagacagaacaaagaaaggaaaaccggattcaagcttaacctatacacacccccagaaacgcccatggaacccgatgaacaggtgacagtcgaggagcagaaggagacatccgaaggcaagacctctccatcacccattaggatcgaggaggaagtgaaagaaacgggtgaagccctgcttccccaggaagagaatcgtagggaagagacttgcgcgcctgtttcccccaatacgtctccaggcgaaaaacccgaggacgatttgattaagccagaggaagaggaagaggaggaggaggaggaggaggaagaggaggaggaggaggaaggcgaagaggaggaggggggcggtaatgtggaaaaagatcccgacggtgcaaaaagtcaggagaaagaggagcctgagatctctacagaaaaggaagatagtgctcggctcgacgatcacgaagaagaagaggaggaagacgaggaaccttcacataatgaggatcacgatgccgacgacgaagatgactcccacatggaaagcgctgaagtcgagaaagaggaattgccccgggaaagtttcaaggaagtccttgaaaaccaggagaccttcctggacttaaatgtgcagccaggccactcaaaccctgaagtgctgatggactgcggtgtagatctgactgcgtcttgtaatagcgagccgaaagagctggccggagaccctgaggctgtgccggaatcagacgaagagcctcccccaggtgaacaggcgcagaagcaggatcagaagaattccaaagaagtcgacacggagttcaaagaaggcaacccggctaccatggagattgactccgagactgtgcaggcggtgcagtcccttacccaggaaagctctgaacaggacgatacttttcaggattgcgcagagactcaggaggcgtgtcggtcccttcagaactacacacgggccgaccagagccctcagatcgctaccacgctggatgattgccagcagtccgatcactctagcccagtcagttctgttcacagtcaccctggtcaaagcgtcagatccgtaaacagccctagtgttcctgcgcttgaaaactcctatgctcagatctctccagaccaaagcgcgatttccgttccatctctgcagaacatggaaaccagtcccatgatggatgtacccagcgtatctgaccacagtcagcaagttgtggatagcgggtttagcgacctgggctccatcgagtctactacagaaaactatgagaacccctcttcttatgactccacaatgggaggctccatctgcggtaacggaagctcacagaacagctgttcttactcgaacctgacgtcatcctcgttaacccagtccagttgcgctgtgacacagcagatgagcaacatctccggatcctgctctatgcttcagcagacgagtatttcatcgccaccaacctgtagcgtcaagagtcctcaggggtgtgtcgtggagagaccaccgtcttccagtcagcagctggctcagtgctccatggcagcgaacttcacgccccccatgcaactcgctgaaatacctgagacctccaacgcaaatattggcctgtacgagaggatgggacagagcgatttcggcgcaggtcattatccgcagcccagcgcaaccttcagcctggctaagctgcagcagcttacaaacacacttatcgaccattcgctcccctattcccactctgcagcggttacctcatatgctaactccgcctctcttagcactcctttgagtaatacaggtctggtccagctttcccaatcgccccatagtgtcccgggaggcccacaagcgcaggccacaatgacaccaccccctaacttgacacctcctcccatgaatctcccacccccacttctgcagaggaatatggcagccagcaacataggcatttcccactctcaacggctgcagacccagatcgcttcaaaaggccatatcagcatgcgcaccaaaagcgcgagcctgtcccctgctgccgccacacatcagagccaaatttacggtcggtcccagacagtcgcaatgcaaggtccagcgaggacactaactatgcagagaggaatgaatatgtctgtgaatctgatgccagcacccgcttacaacgtaaatagcgtaaatatgaacatgaatactctcaacgcaatgaacgggtactctatgagtcagcccatgatgaatagcgggtatcactctaaccatgggtacatgaaccagacccctcagtatcctatgcagatgcagatggggatgatgggcacacagccctacgctcagcagcccatgcaaacacccccccatggcaacatgatgtatactgcacctggccaccacgggtacatgaatacgggcatgtcaaagcagagcctaaatggatcctacatgaggcggtag

SEQ ID NO: 192117 - DNA, 4992 bp, Artificial Sequence
  Description of Artificial Sequence: Synthetic coding sequence
atgaccgaccggttctgggaccagtggtacctgtggtacctgcggcttctgagactgcttgatcggggaagctttagaaacgatggcctgaaagccagcgacgtgctgccaatccttaaagagaaggtggcctttgtgtctggcggacgcgacaagcgaggcggacccatcttgacattcccagcaagaagcaaccacgacagaattcggcaggaagaccttagaaagctggttacctacctggctagcgttccaagcgaggatgtgtgcaagcggggatttacagtcatcatcgatatgcggggctctaaatgggatcttataaagcctctgctaaaaaccctgcaggaggctttccctgcggagatccatgtggctcttattattaaacccgataatttttggcaaaagcaaaaaaccaacttcggctcaagtaagttcatcttcgagacttctatggtatccgtggaagggctgactaagctcgtcgacccctcccagctgaccgaggagttcgacggttccctggattacaaccatgaggagtggatcgagctgagactgtccctcgaggaatttttcaacagtgccgtgcatctcttgtctcgccttgaagatctccaggagatgctggcccgaaaagagtttccagtggacgtcgagggctctaggaggctgattgacgagcatactcagttgaagaagaaggtactgaaggctccagttgaagagctggacagagaagggcagcggctgttacagtgcatcagatgctctgatgggttctctggccgcaattgcatcccaggctctgcagatttccagagtctggtgccaaagatcacgtctctgttggacaaattgcacagcacccggcagcacttacatcagatgtggcatgttcgaaagttgaagctggaccagtgttttcagctcagattgtttgagcaggatgcagagaaaatgtttgactggatctcacacaacaaagagttgttcctacagagtcacacagaaattggtgtcagttaccaatacgctcttgacctgcagacccaacataatcactttgcgatgaactctatgaacgcttatgttaatattaaccgcatcatgagcgtggcaagccggctgtctgaggcgggacactacgctagtcagcagatcaagcagattagcacccagctggaccaggagtggaagagctttgcggctgcgctggacgaacgctccacaatattagcaatgtctgccgtgtttcatcagaaagccgagcagttcctgtctggcgtggatgcatggtgcaagatgtgctctgaaggggggctgccgtcagagatgcaggacctagaactggcaatccatcatcatcagaccctgtacgagcaggttactcaggcgtatacggaagttagccaggacgggaaggccttgttggacgtgttgcagaggcctttgtctccgggcaattcagaatcactaactgccactgccaactatagtaaagctgtccatcaggtccttgacgttgtacacgaggtgctgcatcatcaaaggcgcctggaaagtatctggcagcatcgaaaggttcgactgcatcagcggctacaactttgcgtttttcaacaggatgtccaacaggtgctggactggatcgagaatcacggagaagcttttctgagcaagcacacaggtgtgggaaagtctttgcatagggcccgggctctgcagaaacgccacgatgattttgaagaggtagcccagaatacctacaccaacgccgataagctgttagaagccgcagaacagctggctcagacaggagagtgcgacccagaggagatatacaaagctgccagacaccttgaggtacgcatacaagacttcgtaagacgagttgaacagcgtaaactacttttggacatgtctgtgagttttcatacccatacaaaagagctgtggacctggatggaagatctgcagaaggagatgctcgaggatgtctgtgccgatagcgtggacgccgttcaggagctgattaagcagttccaacagcagcagactgccacactggacgctactctgaacgtgatcaaagaaggagaagatctaatccaacagctgcgttcagctccacctagcctcggtgaacctagcgaggctagggactccgccgtgagcaacaataaaacaccacactcgtccagtatcagccatattgaatccgttctgcaacagctggacgacgcccaggttcagatggaggaactctttcacgagaggaaaattaagctggacattttcctacaactgcgtatattcgagcagtataccatcgaggtgaccgcagaactggacgcatggaatgaagaccttctccgtcagatgaacgactttaataccgaggaccttacactggccgaacaacggcttcaaagacacacggagcgcaagttagctatgaacaacatgacgtttgaggtcattcagcagggccaagatttacaccagtatatcacagaagtgcaggcaagcggaatagagttaatctgtgagaaggacattgaccttgccgcacaggttcaggagttgctggagttcctgcacgaaaagcagcacgagcttgagcttaacgctgagcagactcacaagcggttagagcagtgtctccagctccgccacctgcaggcagaagtgaaacaagtcctcggctggataaggaacggcgagagcatgttgaatgctagtcttgtcaacgcatcctctctgtccgaagcagagcagctgcagagagaacatgagcagtttcagctggcaattgaatctcttttccacgcaacctcccttcaaaaaacccaccagagcgcgctccaagtacagcagaaggcggaagtgctactgcaggctggtcactatgacgcagacgccattagagaatgcgctgagaaggtggccctgcattggcagcaactcatgttaaaaatggaagaccgcctgaagcttgtgaatgcctcagttgcgttctacaagacctctgaacaggtctgtagcgtacttgaaagtctggaacaggaatacaggagagatgaggactggtgtggcgggagagataaactgggtcccgcagctgaaatcgaccatgttatacctctgatttccaagcacttggagcagaaagaggcattcctcaaggcatgtacattagcaaggcgcaacgcagaggtttttctaaagtacatccaccgcaataatgtgagcatgccttcagtcgcttcccacactcggggacctgagcagcaagttaaggccatcctgtccgagctgctgcagcgagagaatcgagtcctccacttctggacactgaaaaagcgtaggttggatcagtgtcaacagtacgtggtcttcgagcgatccgccaaacaagccctggactggattcaggagactggcgagttctatctcagtacacatacttcgaccggagagaccacagaggaaacccaggaactcctgaaggagtacggagagtttcgagtccccgctaaacaaacaaaagagaaggtgaaacttctgattcagctggctgactccttcgttgagaagggccatatccacgccactgaaatccggaagtgggtcacaacagtggataagcattatcgggatttttctctcaggatgggcaagtaccgctactccctcgagaaggcactgggcgtcaatacagaagataataaggatctggagctcgacatcattccagcctccttgtcggaccgtgaagtgaagctgagagacgcaaaccatgaagtgaacgaggagaaacgtaagagcgctcgaaagaaggagtttattatggcagagctcctccagactgagaaggcatatgtgcgcgatcttcatgaatgccttgaaacctatctctgggagatgacgtccggagtggaagagatcccccctggcatcctgaataaggaacatataatcttcggaaacatccaggagatctatgattttcacaacaatattttcctgaaggagttggaaaagtacgaacagcttccagaagatgtgggccactgcttcgtcacctgggccgacaaattccagatgtatgtcacttactgcaagaataagccagacagcaaccagctgattctggaacacgccggcacctttttcgacgagatccagcagagacatggccttgcgaactcaatttcctcttacctgatcaagcccgtgcagcgcattactaaataccagttactcctcaaagaactgttgacttgttgtgaggagggaaagggagaactaaaagacggacttgaggtcatgctgagtgtccccaaaaaggccaacgatgcgatgcacgtgtctatgcttgaggggtttgacgagaacctagacgtgcaaggtgagctcatcttgcaggacgccttccaagtttgggaccccaagagcctgattcggaaaggacgcgagcggcacctgtttctctttgagataagtctagtgttttccaaagaaatcaaggatagctctggccacacaaagtacgtgtataaaaataagttactaacaagcgagctgggcgttaccgagcatgttgaaggtgacccgtgtaaattcgccctctggtccggtagaacccccagtagtgacaacaagaccgttctgaaggcgtccaatatcgagaccaaacaggagtggatcaagaacatccgcgaggtgatccaggagagaatcatccacctaaaaggcgccctgaaagagcctcttcagctccctaaaacacctgcaaaacaaagaaataacagcaagagggatggagtggaggacatcgacagccagggagacggatcttcacagcccgatacaatcagcattgctagccgcaccagccagaataccgtggactcagacaaggacggaaacttggtgcctagatggcacctgggccccggcgatcctttcagcacgtatgtgtag

SEQ ID NO: 192118 - DNA, 3870 bp, Artificial Sequence
  Description of Artificial Sequence: Synthetic coding sequence
atgaagggcggcgaccgggcctacacccggggccccagcctgggctggctgttcgcaaaatgttgctgttgttttccgtgcagggatgcctactcacactcttcatcagaaaatggagggaagtccgagagtgtggctaatctgcaggcccaaccatcactcaatagcatccactctagcccaggccccaagcggtcaacaaataccttgaagaagtggctgactagccctgtgagacgcctcaatagtggaaaggctgatggaaatatcaaaaagcagaagaaagttagggacggccgtaaaagcttcgatctgggctccccaaaacctggagatgagacgacacctcagggcgactcagcagatgagaaatctaaaaagggctggggggaggacgagccagacgaggagagccacacaccacttccccccccaatgaaaattttcgacaacgatccgacacaagacgagatgtctagttcactgctggctgctcgccaggcgtctactgaggtacctacagccgccgacctagtcaacgcaatagaaaagctggtcaagaacaagctaagtctagaaggctctagttatagaggctctctgaaggatccagctgggtgcttaaatgagggcatggcaccgcccacgcctccgaaaaatcccgaggaagagcagaaagccaaggccttaagaggacggatgttcgtgctcaacgagctagtgcagaccgagaaggattatgttaaggatctagggatcgtggtggagggatttatgaaacgcatcgaagagaaaggagttcctgaggacatgcgcggcaaggacaagatcgtcttcggcaatattcaccagatctatgattggcacaaggatttctttctagcagagctagagaaatgtatccaggagcaggacagactggcacagctgtttataaagcacgaacgtaagctacatatctacgtctggtattgtcagaacaagccaagaagtgagtacatcgtcgctgagtatgacgcctacttcgaggaggtgaaacaggagatcaatcagaggctgaccttatcagacttcttgataaagcccattcaaaggatcacaaaatatcaactgctgctgaaagactttctccgttactccgagaaagccggattggaatgttccgatattgagaaagccgtggagcttatgtgcctggtgccaaaacgctgcaatgatatgatgaacctcggaagattgcagggatttgagggaactctgacagcccaaggcaaactgctgcaacaggacactttctacgtgattgagctggacgcagggatgcagtcccggacaaaagaacgccgcgttttcctgttcgagcagatcgtcatcttttccgaactgctgcggaagggctcgttgactcccgggtatatgttcaaacgctctatcaaaatgaattacctcgtcctggaggaaaacgtggacaatgatccttgcaagttcgcattgatgaacagagagacctcagaacgggtcgtgttgcaagcagccaatgcagacattcagcaagcctgggttcaggacattaaccaggtgttagagacacagagagactttctcaacgccctgcaatcccccatcgagtatcagcgtaaggagcgcagtaccgccgtaatgcgatcccagccagcgaggctgcctcaggccagtcccaggccctactccagcgtacccgcgggctccgagaaaccgccgaaagggtcatcttataacccacccctgccccccctgaaaatctcaacctctaatgggagtcccggctttgaataccaccagcctggtgacaaattcgaagcctcaaaacagaacgacctcggaggatgcaatggtacgagtagtatggctgtgataaaagattattatgctcttaaggagaacgaaatttgtgtgagtcagggagaagtcgttcaagttctagccgtgaaccagcaaaacatgtgtttagtgtaccagccggctagtgatcacagccccgccgcggagggttgggtgccaggcagtatcctggctccacttaccaaagcaaccgcagctgaaagctctgatggctcaatcaagaagtcctgttcctggcataccttgagaatgcgcaaaagggctgaagtagagaatacaggtaaaaacgaggcaacggggcccaggaagccgaaggatatcctggggaataaggtcagtgtcaaagaaacaaactcttcagaggaatctgagtgcgatgacctggatccaaataccagtatggagattttaaatcccaactttatacaggaagttgcaccggaattcctggttccacttgtagatgtcacttgcctgctcggcgatacagtcatccttcagtgtaaagtctgcgggagacctaagcccactattacatggaaaggccctgaccaaaatattttagacaccgataattcctccgccacctacactgtgtcatcctgtgactcaggcgaaataaccctgaagatctgcaatcttatgccacaggattcgggaatctacacttgcatcgccacgaacgaccatggaactacatccaccagcgccacagtcaaagttcagggagtgcctgcagctccaaaccgtcccatcgcgcaagagcgttcttgcacatccgtgattcttaggtggctcccaccctcgagtaccgggaactgcacaatcagtgggtataccgtggaatatagggaggagggcagccagatctggcaacagagcgtggcttctacgctggacacttacctggtgattgaggacctgagccccggctgtccatatcagttcagagtaagcgccagcaacccttgggggatcagcctgccaagcgagccttctgagtttgtaaggctgcctgaatacgatgctgctgctgatggcgcgacaataagctggaaggagaactttgacagcgcatacactgagttgaacgaaatcggtcgcgggagattcagcatagtgaagaaatgcattcataaagcgaccaggaaggatgttgccgtgaagtttgtgtctaagaaaatgaaaaaaaaggaacaggcggcacatgaggcagccctgcttcagcacctacagcacccacaatacataactctgcacgatacctacgaaagccctacaagctacattctgattctggagctgatggacgatggccgactgttagactacctgatgaatcatgacgagctcatggaagagaaggtcgcattttacattagagacatcatggaagctttacagtatcttcacaattgccgcgtggcccatctggatatcaagcccgagaacttactaatagacctgcggataccagtaccaagggtgaaactgattgacctggaggatgcagtgcagattagtggccacttccacatccatcacttattgggtaatcctgagttcgccgctcctgaagtgatccaaggtatccctgtctctctgggcacagatatctggagcattggcgtactgacctatgtcatgttgtcaggagtcagccccttcttagacgagtcgaaagaggaaacctgtatcaacgtttgtcgcgtcgacttcagctttcctcacgaatacttctgtggcgtatctaacgctgcccgtgatttcatcaatgtgatccttcaggaggattttagacgtaggcccaccgcagcaacttgcttgcagcacccctggttacagcctcacaacggctcttatagcaagatccctctcgacacttcaagactagcgtgtttcatagagcggaggaagcaccagaacgacgtgcgacctatacctaacgtaaaatcatatattgtcaacagggtaaaccaaggaacatag

SEQ ID NO: 192119 - DNA, 8961 bp, Artificial Sequence
  Description of Artificial Sequence: Synthetic coding sequence
atgaccgaccggttctgggaccagtggtacctgtggtacctgcggctccttcgcttattagataggggttcgtttcgcaacgacggactcaaagcttcagatgtgttacctattctgaaagagaaggtggctttcgtgagcggcgggagggataagagaggtgggccaatcctcacttttccagctcgtagcaatcatgatagaattcgacaggaggacctccgaaaactcgtgacctatctagcttctgtgccatcagaagacgtttgcaagcgaggctttaccgttatcattgatatgcggggaagcaagtgggacttgatcaagccgttattgaaaaccttgcaagaggccttcccggcagagatccacgtggcgctcatcatcaagcccgataatttctggcaaaaacaaaagacaaacttcgggtcatccaagttcatcttcgaaacgtctatggtgagcgtggagggactcaccaagctggtagacccctctcagctgactgaggaattcgacgggagtctggactacaatcacgaggaatggatcgagttgaggcttagccttgaagagttcttcaactctgctgtccacctcctttctaggctagaggatctgcaggagatgctggcccgcaaagagtttcccgtagatgttgaagggtcccgtagacttattgacgagcacactcagctgaaaaagaaagtgttaaaagccccagtggaagagctggacagagaggggcagcggctgctccagtgtatccggtgctcagacgggtttagcgggcgcaactgcattccaggctcggccgatttccagagcctggtgcctaagattacgtccctgctggacaaactgcatagtacgcggcaacatctccaccagatgtggcacgtgcgtaaacttaagctcgaccagtgctttcagctcaggctctttgaacaggatgccgaaaaaatgttcgattggatctctcataataaagaactctttctccagagccataccgaaatcggagtaagctaccaatatgcattggacctccagacacagcacaaccacttcgccatgaattccatgaatgcctacgtgaacattaaccggatcatgtcagtggcatcaaggctctcggaagccggccattatgccagccagcaaattaagcagatatcaactcagctagatcaagagtggaagtctttcgctgccgccctggatgaacgcagtaccatcttggccatgagtgctgtgttccaccaaaaggcagagcagtttctgagtggtgtagatgcttggtgtaagatgtgtagtgagggcgggctgccgtcggagatgcaggacttggagcttgccatacaccatcaccaaaccctgtatgagcaggttacacaggcttacaccgaggtaagtcaagatggcaaagccctgttagacgttctgcagcggccattgtccccaggaaatagcgaatcactgaccgccacagccaattattctaaagccgtccatcaagtactggatgtggtccacgaagttttgcatcaccagcggagacttgagagcatctggcaacacagaaaagttagattgcaccagaggctccaactgtgcgtgtttcagcaggacgtgcagcaagtgttggactggattgagaatcatggcgaagcgttcctgagcaaacacactggcgtggggaaatctttgcacagggcaagggccctccagaaacggcatgatgactttgaagaggtagcgcagaatacctacaccaatgcagataaactgctcgaggccgccgagcagctggctcagacgggtgagtgcgacccagaggagatttacaaggcagctcgtcacctggaggtgcgcatccaggatttcgtgaggcgggtggagcagagaaaattgttactagatatgtccgtgtcctttcacacacatacaaaagaactatggacttggatggaggaccttcagaaggagatgctagaggacgtgtgcgcagatagcgtggacgccgtacaagagcttataaagcaattccaacaacagcagacagctactcttgacgccaccttgaacgtgattaaggagggcgaagacctgatccaacagctgcgctcagccccaccctctttgggggaaccctccgaggcaagggatagtgccgtcagcaataacaaaacacctcattcttccagtattagccacattgagagcgttcttcagcagttggatgacgcacaggtccagatggaggagctgttccatgagcgaaaaattaaactggacatttttctgcaactgaggatcttcgaacagtataccatcgaggttaccgctgagctggacgcctggaatgaagacctgctacgtcagatgaacgatttcaacactgaggacttgactctggccgagcaaaggctgcagcgccatacagagcgcaagctagcgatgaacaacatgacatttgaggtaattcaacagggacaggacctgcatcagtacattactgaggtgcaggctagcggtattgagcttatttgcgagaaagacattgacctggcggctcaggtccaggaactactggaatttctgcatgagaaacaacacgagctggaactgaatgctgagcagacccacaagcggctcgagcagtgcctgcaattaagacacttgcaggccgaggtaaaacaggtccttggatggattcgcaacggcgaatccatgcttaatgcatctctcgtgaatgcatcctctctctcagaagcagagcagctgcagcgcgagcacgagcagttccagctggccattgagagtctgtttcacgctacctccctccagaagactcaccagagcgccctgcaggtccagcagaaagccgaggttctgcttcaggcaggccactatgacgcagatgcgatacgcgagtgcgcagagaaggtagctttacactggcaacaacttatgctgaagatggaggatagactgaagctcgtcaatgcgagcgtggccttctataaaacatcagagcaagtctgtagcgttttggagagtttggagcaggaatatagacgggatgaagactggtgcggagggcgcgataagcttggcccagcggccgaaatagatcacgttataccattaatatctaagcacttggagcagaaggaggcttttctgaaggcctgcactcttgcacgtcgaaatgcagaggtttttctcaaatacatccatcgaaataacgtgtctatgccttcggtcgcgagccacaccagggggcctgaacagcaggtgaaggctatcttaagcgagttgttgcaacgagagaatcgcgtactccatttctggacattaaaaaaaagaagattggaccagtgccagcagtacgtggtcttcgaaagaagtgccaaacaagcgttggattggatccaggagacaggggagttttatctgagcacccacacaagcaccggcgagacaacagaggagacccaggaacttttaaaggagtacggcgagtttcgagtgcccgctaagcagacaaaagagaaggttaagctcctaatccagctcgctgattcctttgtggagaagggccacattcacgctacagagatccgcaaatgggtcacaacagtggacaaacattatcgggatttctctctgcgcatgggcaaataccgttattcactcgaaaaagctctgggcgtgaatactgaagataacaaggacttagagctagatatcatcccagcatcactcagtgatcgagaggtgaagctgagagacgccaaccacgaagtgaacgaggagaagcgcaaaagtgcccggaagaaggaatttatcatggcagaactcctgcaaactgagaaggcctacgtgcgggatctacacgagtgcctggaaacttacctgtgggaaatgaccagcggagtggaagagatccctccgggtatccttaataaggagcacatcatcttcgggaacatacaagagatctacgatttccacaacaatattttcctgaaagagctggagaaatatgagcagttgccagaagacgtggggcattgcttcgttacctgggcagataaatttcagatgtatgtcacatattgcaagaacaagccagattctaaccagttaatactcgagcatgcaggcacctttttcgatgaaatacagcagagacatggactggccaattctatctccagttacttgatcaaacctgttcagcggatcaccaagtatcagcttctccttaaggaactgcttacctgctgcgaggagggcaagggggaactgaaggatggactagaggtgatgctcagtgtgcccaaaaaggccaatgacgctatgcatgtgagcatgctggaaggattcgatgagaacctagatgtccaaggtgaacttatactacaggacgcctttcaagtgtgggaccctaagagcctgatccgcaagggtcgggaacgtcatttgttcctgttcgagatcagccttgtgttctcaaaggagatcaaggatagctcaggacacaccaagtatgtgtacaagaacaaattacttaccagcgagctgggggtcacagagcacgttgagggcgatccttgtaaatttgcgctgtggtcaggccggaccccctccagtgacaacaagactgtcctcaaggcgagtaacatagaaacgaaacaggaatggatcaaaaatataagagaagttatccaggaacgcattattcatcttaagggcgcgctaaaagagcctctgcagcttccaaagacaccagctaaacagaggaacaactctaagcgtgatggcgtcgaagatatagacagccagggagacggaagctcccagccagataccatctccattgcatcccggacttctcagaacacagtggacagcgacaagctgtctggaggatgtgaacttaccgtagtccttcaggacttttccgcgggtcacagcagtgagttaactattcaggttggacaaacagtggagttattagagcgtccatctgagcgaccaggctggtgcctggtgagaactactgaaaggagtccccctctggaaggcctcgttcccagctcagccctgtgtattagccactcccgttcaagtgtggagatggattgtttcttcccactcgtgaaggacgcatacagtcatagtagttccgaaaacggcggcaagagtgagtccgtagccaacctgcaggcccaaccatcacttaactctatccacagctcaccaggcccaaagcgctcgacaaacactctcaaaaaatggttgacatctcccgtgcggcggctgaactcagggaaagccgatggcaatataaaaaagcagaagaaagtaagagatggtcggaagagttttgacttaggatcacccaaacccggcgacgagacgactccgcagggagacagcgctgatgaaaaaagtaaaaagggatggggggaggatgagcccgacgaggagtcacacactccgctgccaccaccgatgaagattttcgacaacgatcccacacaggacgagatgtcttcctcactgctggccgcaaggcaggcttccacggaggtgccgacagccgccgacctcgtcaatgcaatagagaagctcgttaagaataagttaagcctggaaggatcgtcctatagaggcagcttgaaggatcccgctggatgtctgaacgagggaatggccccgcccacaccacctaagaaccccgaggaggagcaaaaggccaaagctctgcgaggtcgcatgttcgtcctcaacgaactggtgcagaccgagaaagactacgttaaagacctcggtatcgtagtggaaggcttcatgaaaagaatcgaggaaaagggagtacctgaggacatgcggggcaaagacaaaatcgtgttcggtaatatccaccagatatacgactggcacaaggacttcttcctggcggagctggaaaaatgcatacaggagcaagaccgtctcgcccagctgtttatcaaacacgagagaaagctccatatttacgtgtggtactgccagaacaagccccgatccgagtatatcgtggcggaatacgacgcttactttgaggaggtgaaacaggagatcaatcagagactcactctgtccgactttctgatcaaacctatacaacggatcactaagtatcaattactactcaaggatttcctccggtacagcgaaaaagccgggttggaatgcagcgatatagaaaaagccgtggagctcatgtgtctagttcccaaaagatgtaacgacatgatgaacctcggaaggttacaaggcttcgagggtacactgactgcacagggaaaactactccagcaagatacattttacgtcatagagctggacgctgggatgcagagtaggacaaaggagaggagggttttcctgttcgagcagatcgtcattttttctgaattgttgagaaaaggctcgctcacaccaggatacatgtttaaacgaagcataaagatgaactatctggtcttggaagaaaatgtggacaacgacccatgcaaattcgcgttgatgaaccgcgagacttccgagcgggtcgtcctacaggccgcaaatgctgatattcagcaggcatgggtacaggacattaaccaagtgctggagacgcaaagggacttcctgaatgccttgcagagccccattgaataccaaaggaaagagagatctaccgccgtgatgaggtcccagcctgctagattgcctcaggcatctccgcgtccgtatagctccgtgccggctgggagcgagaaaccccccaagggctcctcctacaatccccccttgccccctcttaaaattagcacctctaacggaagtcctgggttcgagtaccaccaaccaggcgataaatttgaagcttcaaaacagaacgatcttggcggttgcaatggaacatcctccatggctgtgatcaaggattactatgccttgaaggagaacgaaatttgcgtatcccaaggtgaggtggtgcaggtcctggcagtaaaccaacagaatatgtgtctggtgtaccagccagcctctgaccactccccagcagcagagggttgggttcccggatctattctggcccccttgaccaaggccacagctgcagagtctagcgacgggagcatcaagaagagctgcagttggcacactctccgtatgaggaaaagggccgaggtggagaacacagggaagaatgaagcaaccggacctaggaaacccaaggacattttgggcaataaagtatccgtgaaagagaccaattcatctgaagaatcggagtgcgacgacttggaccctaatacatcaatggagatcctcaacccaaacttcattcaagaagtcgcgcccgagtttctggtgcctctcgtagatgttacgtgcctccttggtgataccgtcattttgcagtgcaaagtctgtggtcgccccaagccaaccatcacttggaagggacctgatcagaacatcctggataccgataacagtagtgcaacgtacacagtgtctagctgcgactctggtgaaataaccctgaaaatttgcaatctgatgccccaggacagtgggatttatacatgcatcgccacaaatgaccatggtacaactagcacttccgccactgtgaaagtgcagggcgtgccagccgcgcccaacaggcctatcgcacaggagcggagctgcacttcagtgatactgcggtggctgccaccaagctcaacagggaactgtactatcagcggatacaccgtggagtaccgggaagaaggctcccagatctggcagcaatccgtcgcaagcacactggatacttatcttgttatcgaggacctgagccctgggtgcccctaccagttccgtgtgtcggccagtaacccctgggggatctctctgccgtccgagccatcagaatttgtacggctgccagaatacgacgccgcagccgatggagcaaccatcagctggaaggagaattttgacagcgcttacacagagctgaacgaaattggcagaggccgcttctctatagttaaaaagtgcatccataaagcaacccgaaaggatgttgcggtgaagtttgtgagtaagaagatgaagaaaaaagaacaggccgctcacgaggccgccctcttacagcatctccagcatccccagtatattactctgcacgatacttatgagtcacccacttcttacatcttgattctggagctaatggatgacggaaggctcctggattatctaatgaatcatgatgagctgatggaagaaaaagtggccttctacatccgggatattatggaagccctccaatacctgcacaattgccgggtggcgcaccttgacatcaagcccgaaaatcttttgatcgaccttcggatccccgtaccccgtgtgaaactcatcgaccttgaagatgctgtacagatctccgggcacttccacattcatcatttgctcggtaatcccgagttcgccgccccggaggttatccagggtattccggtgtctttgggcacagacatttggtctatcggagtgctcacctacgtgatgctgtccggcgtgtcccccttcctggatgaatctaaagaagagacttgtataaacgtgtgccgggtggattttagtttccctcatgaatatttttgcggagtttctaacgcagcacgagactttataaacgtaatcctgcaggaagatttccgcaggaggccaacggccgcaacatgtctccagcacccctggctgcagccccacaacgggagttacagcaagatccctctggataccagccgcctggcctgtttcatcgaacgccggaaacatcaaaacgatgtgcgaccaatcccaaacgtgaagtcttacatcgtgaatagagtaaaccagggcacatag

SEQ ID NO: 192120 - DNA, 3774 bp, Artificial Sequence
  Description of Artificial Sequence: Synthetic coding sequence
atgaagggcggcgaccgggcctacacccggggccccagcctgggctggctcttcgcaaaatgctgttgctgtttcccttgtagggatgcctattcccattctagtagcgaaaacggcgggaagtctgagtcggtcgctaacctgcaggcgcagccaagcctgaactccatacatagtagccccggccccaagagatctacaaacactcttaagaagtggctgacatcacctgtgcgccgtttgaactcagggaaggccgacggaaacattaagaagcagaagaaagtcagggacgggagaaagtcttttgacttaggatcacccaaaccaggggatgagaccactcctcagggcgacagcgccgatgagaaaagcaagaagggatggggcgaggacgagcccgatgaggagtcccacacacccctgccacctcctatgaagattttcgacaatgatcccacccaggacgagatgtctttagagggcagctcgtaccgggggtccctcaaagaccccgcaggatgtctgaatgagggaatggctccaccaacgcctccaaagaacccggaggaggaacagaaagccaaagctttgagaggacggatgtttgtcctgaatgaactagtacagaccgaaaaagactatgttaaagacctcgggatcgttgtggaggggttcatgaagcgaatcgaggaaaaaggcgtgccagaagatatgcgaggtaaagacaagatagtattcggcaatatccaccagatttatgactggcataaggatttctttcttgcagagcttgaaaaatgcattcaggaacaggataggctagcacaacttttcataaagcatgaaaggaaattgcatatatatgtgtggtactgtcagaacaagccccgttccgagtacattgtcgcagagtacgacgcgtatttcgaggaagtgaagcaggagatcaatcagaggttaaccctgtccgatttcttgataaagcccatacaacgaattacaaaataccagctgctcttgaaggattttctaaggtacagcgagaaggctggactggaatgttctgatatcgagaaggctgtagagctgatgtgtttagtgccaaagcggtgtaatgacatgatgaacctgggccgactgcaggggttcgaaggaacattaacggcccaggggaagctgctgcagcaagataccttctacgtcatcgagctggatgccggcatgcaatctagaaccaaggagcgccgtgtgttcttattcgaacaaattgtgatcttctccgaactgttaagaaagggatcactgacgcccggttacatgttcaagcgaagtattaagatgaattacctagtgttggaagagaatgtagacaacgatccttgtaagtttgcactgatgaacagagagaccagtgaacgcgtggtgctccaggctgccaatgccgatatccagcaggcttgggtccaggatatcaatcaagtcctcgagactcagcgagacttcttgaatgccctgcagagcccaatcgaataccagagaaaagagcgcagcaccgctgtgatgcgcagccagcccgcccgtttgcctcaggccagcccaagaccctactccagcgtgccggctggttccgaaaaaccccctaaggggtcttcatataacccgccattgcctccactaaagatttctaccagcaatggctcgcctggttttgagtaccaccaacctggggacaaattcgaagcctccaaacagaatgaccttgggggctgtaatggaaccagctctatggctgtgatcaaggattactatgccctcaaggagaatgaaatctgtgttagtcaaggggaggtagtccaggtgctggctgtgaaccaacagaacatgtgcttagtttatcagccggcatccgatcacagccccgctgctgagggctgggtccctggttcaatcctggcaccacttaccaaggccacagccgctgaatcgtcagatggaagcattaagaagtcttgtagctggcacaccctgagaatgaggaagagagcagaggtggaaaacacaggtaagaatgaggccaccggacctagaaagccaaaggatatccttggaaataaagtgagtgttaaagaaactaactccagcgaggaatcagaatgtgacgaccttgatcctaatacgtccatggagatcctaaaccctaatttcatccaggaagtggctcccgaatttttggttcccttggtggacgtcacatgcttgctcggtgacacagtaatactccagtgcaaagtgtgcggccggcctaaacctacgatcacgtggaaaggccccgatcagaatatcctggataccgacaattcaagtgccacatatactgtctccagctgtgattctggagagatcaccctgaaaatatgtaaccttatgccacaggactcgggaatttacacctgcatagctacaaatgaccacggtacgaccagtacgagcgctaccgtaaaggtccagggggtacccgccgcccctaatcggccaatagcccaggaacgtagttgtacatcagtaattcttcggtggttgcccccgagtagcactggcaattgcactatttcggggtacaccgtggaatatagagaggaaggatctcagatctggcaacagtccgtggcctccactctggatacgtatttggtcatcgaggacctcagccccggctgcccttaccaattcagagtcagcgctagcaacccttggggcatctcgcttccctctgagccatccgaatttgtcagactgcccgagtacgacgccgctgctgatggggctactatctcctggaaagaaaactttgacagcgcatacactgagctcaatgagattggcagaggaagattctctatcgttaagaaatgcattcataaagccaccagaaaggacgttgccgtgaaattcgtatcaaagaaaatgaaaaagaaggaacaggccgctcacgaagccgccttgctacaacatctccaacaccctcagtacatcactctgcacgacacatacgagtcacctaccagctatattttaattctggaacttatggatgacggaagactgctggactacctcatgaaccatgacgaactgatggaagagaaggttgccttctatatccgcgatatcatggaagccctacagtatttacataactgcagggtggcacatctcgatatcaaacctgagaatctactaatcgatctcaggatccccgtgcccagggtgaaactgatcgacctggaagatgctgtgcagatctcgggacacttccatattcatcatttgctcggtaatccggagttcgcagctcccgaagtcattcaaggaatccccgttagcctcggcactgacatctggtcaataggcgtgctgacttatgtgatgctctcgggggtcagcccttttttggatgagagtaaggaggagacttgcattaatgtgtgcagggtggatttcagtttcccgcacgagtacttttgcggggtgtccaacgccgctcgcgacttcatcaacgtcatcctccaggaagacttccgaaggcgtcctaccgccgccacatgtctgcagcatccctggctgcagccacataatggctcatactcaaagattccgctggataccagcagattggcttgctttatcgaacggcgcaagcaccagaacgacgtgcgcccgattcccaacgtgaagtcttacatcgttaatcgagtgaatcagggaacttag

SEQ ID NO: 192121 - DNA, 4965 bp, Artificial Sequence
  Description of Artificial Sequence: Synthetic coding sequence
atgaccgaccggttctgggaccagtggtacctgtggtacctgcggttactgaggctgctcgaccgcggcagttttagaaatgatggactgaaggcaagcgatgtgctccccattttaaaggagaaggtggccttcgtctcgggcgggcgcgacaaaaggggcggtcctatactgaccttccctgctcgctctaaccatgacaggattcggcaggaggatcttaggaagctcgtgacatacctcgcaagtgtgccatctgaagacgtctgtaagagagggttcacagtcattattgacatgcgcgggagcaaatgggatctgatcaagcccctgttgaagaccctgcaagaggcttttcccgctgagattcatgtagcgttgattatcaaaccagacaacttttggcagaaacagaagactaattttggaagctcaaagtttatttttgaaactagtatggtttccgtggagggactcaccaagctcgtcgacccatcccagctgacggaggagttcgacggatcactggactataaccatgaagagtggatagagctgcggttatccctggaagagttctttaattccgccgtccatctcctgagccggctggaagatctacaagagatgctcgcgcgtaaggagttcccagtggatgtggagggatcccggcgtctgattgatgaacacacccagctgaaaaagaaggtgttaaaggcccctgtggaggagctagaccgggaaggacaaagacttctccaatgtatccggtgctctgatggcttttctggccgcaactgtatccctggatcagctgactttcagtctctcgtccctaagattactagtctcctggataagttacattcaactagacaacacttgcaccagatgtggcacgtgcgtaagctaaagctggatcagtgttttcagttacggctgtttgagcaggatgcagagaagatgttcgactggatctcccacaacaaggagctgtttttgcagtctcacactgagatcggagtgtcataccagtatgccctagacctccagacccagcataaccacttcgccatgaacagcatgaatgcctatgtcaatataaatcggatcatgtcagtggcttctagattaagcgaagctggtcattacgctagccagcagatcaagcaaatttctacccagctcgaccaggaatggaaatctttcgccgccgcattagacgagagatcaaccatcctcgccatgtccgcggtctttcaccaaaaggcagaacaatttctaagcggcgtcgacgcctggtgtaaaatgtgctctgagggagggttgccatcagaaatgcaggaccttgagcttgctatccaccaccaccaaacactgtacgaacaggtaacccaggcctataccgaggtcagccaggacgggaaagctctgctcgacgtgttacaaaggcccttgagtccaggcaattctgagtctcttaccgccacggccaactattcgaaggcagtacaccaggtgttagacgtggttcacgaagtgctgcaccaccagcgtcgcctggagagtatatggcaacaccgaaaggttcgcttacatcagcgattgcagttgtgcgtgtttcagcaggacgtgcagcaggtactggattggatcgaaaatcatggagaggcgtttctcagtaaacatacaggagtgggcaagagtctccatcgggcgcgcgccctacagaagcgccatgatgatttcgaagaagtcgcccaaaacacctacactaatgccgataaactcttggaagctgccgagcaattagctcagacaggagagtgtgacccggaggaaatttacaaagcagcccgacaccttgaagttcgtatccaggactttgtcagaagagtggagcagagaaagttactcttggatatgtcggttagctttcacacacatacaaaagaactgtggacgtggatggaggatctacagaaggaaatgttagaagatgtttgcgccgactctgtggacgcagtccaagagctgattaagcagttccagcagcaacagactgcaacactggatgccaccctcaacgtgattaaggaaggtgaggatctgatccagcaactcaggtccgcaccacccagcctcggtgagccttccgaggctcgggactccgccgtgagcaataacaaaaccccccactcttcaagcatttctcatattgaatcagtgctgcagcagctcgacgacgctcaagtccagatggaagaactctttcatgagagaaagatcaagctggacattttcctacagctcaggattttcgagcagtatacaatcgaagttactgctgaacttgatgcttggaatgaagatcttttaaggcaaatgaacgattttaatactgaggatctcaccttggcggaacagcgtctgcaaaggcacaccgaaagaaaattagccatgaacaacatgactttcgaggtcatccagcagggtcaggatctgcatcagtacataacagaagtgcaggccagtggaattgaactcatctgcgagaaggatatcgaccttgccgcccaagtacaggagctgctagagttcttgcacgagaaacaacacgagcttgagcttaacgcggagcaaacccacaagaggctcgaacagtgcctccaactgcggcacctgcaagccgaagtgaagcaggttctgggctggatacgcaatggcgaaagtatgctgaatgcttcattggtgaacgccagtagcctaagcgaagcggagcaattgcaacgtgagcacgaacaatttcaattggctattgagaagacccaccaaagcgcgctgcaggtccaacaaaaggctgaagtgctgctgcaggccggtcattacgacgccgacgccatccgggagtgtgcagagaaagtggcactgcactggcaacagctgatgttgaagatggaagaccgcctaaagctggttaatgctagcgtggcattctacaaaacaagcgagcaggtttgttccgtcctggagtcgcttgagcaggagtacaggcgcgacgaggactggtgtggtggtcgcgataaactgggccccgctgccgagattgatcacgtgatccctctgatctccaagcatcttgaacagaaggaggcctttctgaaggcgtgtactctggccagaagaaatgctgaagtattcttaaaatatattcatcgtaacaacgtttccatgccatctgttgccagccacacacgaggccctgaacagcaggttaaggcaatactgtccgagctgctacagcgagaaaaccgagtactccatttttggacattgaagaaacgccggctggatcagtgtcagcagtacgtcgtgttcgaacgcagcgccaagcaggccttggactggatccaggagacgggggaattctacctgagtacccacactagcactggagaaaccactgaggaaacacaggaactgctgaaagaatacggggagtttcgcgtgcctgcgaaacagacaaaggagaaagtgaaacttttgatccagctggccgattccttcgtcgaaaaggggcatatccacgcaaccgagatcaggaagtgggtcaccaccgtagataagcattatagagacttctccctgaggatgggcaagtacaggtactctctcgaaaaagcactgggcgttaacacagaagacaacaaggacttagagctggacataattccagccagcctcagcgaccgcgaggtcaagctccgggacgcgaatcacgaagtcaacgaggaaaagaggaagtcagcccgtaaaaaggagtttatcatggcggagctgctccagaccgagaaagcttatgtgagggacctacatgagtgtctcgagacttacctctgggagatgaccagcggagtcgaagaaattcccccggggatcctgaacaaggagcacataatattcggaaacattcaggagatctacgactttcacaataacatttttctaaaggagttggaaaagtacgagcaactacctgaggacgtaggccactgctttgtgacttgggccgataaattccaaatgtatgtgacctattgtaaaaacaagccagattctaatcagctgatcctcgagcatgctgggacttttttcgacgagatccaacagagacacggcctggctaacagtatttctagttaccttatcaagccagttcaacgcattaccaagtaccagctcctcttgaaagagcttctcacctgctgcgaggaggggaagggagagctgaaagatgggctcgaagtcatgctaagtgtgcctaagaaggcaaatgatgcaatgcatgtgagcatgttggagggatttgatgagaacttagacgtgcagggagagcttatcctacaggacgcttttcaagtctgggacccaaaaagtttgatccggaaaggtcgagagcggcatctatttctgttcgagatttcactggtgttttctaaagagatcaaggattcctccggacataccaagtatgtttataagaacaagctgttaacatcagagctcggagtgacggagcacgtggagggggacccctgtaaattcgcgctgtggtccgggagaaccccgtcctccgacaacaaaaccgtactgaaggcctccaatattgagaccaagcaggagtggattaagaatatccgagaggtcatacaagaaagaattattcatctgaaaggggccctgaaagagcccttgcaactccccaaaacccctgccaagcagcgcaacaacagcaagcgggatggcgtggaggacatcgactctcaaggggacggatccagccagcccgataccatcagtatcgcaagcaggacctcccagaacaccgtcgacagtgataaggatggcaatctagtgccaagatggcacctggggcccggcgaccccttttccacttatgtgtag

SEQ ID NO: 192122 - DNA, 789 bp, Artificial Sequence
  Description of Artificial Sequence: Synthetic coding sequence
atgtggttcctggtgctgtgcctggccctgagcctgggcggcaccggtgccgctcccccgatccaatccagaatagtcggaggatgggaatgtgagcaacattctcaaccgtggcaagctgctctttatcactttagcacattccaatgtggtgggatcttggttcatagacaatgggtgctgaccgcagcccactgcatctcggacaactatcagctgtggctagggagacacaacctcttcgatgacgagaacaccgcccagttcgtccacgtgagtgaatcatttccccatcctggctttaacatgtctctcctcgagaaccacacccgacaggcggatgaggattactctcacgatttaatgctgttacgactgactgaacctgccgacactattacagatgccgtgaaggttgtggagctgccaactgaggaaccagaagtggggtcgacttgtttggcttctggctggggatctatcgaacctgagaactttagctttccagatgatctgcagtgtgtggaccttaaaattctcccaaatgatgaatgcaaaaaggcgcacgtgcagaaagtcacagacttcatgttatgtgttgggcacttggaggggggcaaagatacttgtgtgggcgatagcggtggccctctgatgtgcgatggcgtgttgcagggcgttacctcatggggttacgtcccatgtgggacccccaataagcctagcgtggctgtgcgtgtcctcagctatgtgaagtggatcgaagatactattgctgagaactcatag

SEQ ID NO: 192123 - DNA, 483 bp, Artificial Sequence
  Description of Artificial Sequence: Synthetic coding sequence
atgagcctgctggagaaccacacccggcaggccgacgaggactactcacacgaccttatgttgctcaggctgacggaacccgccgatactatcactgatgccgtaaaagtggtggagctgccaaccgaggagcccgaagttggtagtacctgcttggcctccggttggggaagtattgagcccgagaatttctctttcccagatgatcttcagtgtgtggaccttaagatcctaccgaacgacgaatgtaaaaaggcccacgtgcagaaggtgactgactttatgctgtgcgttgggcatctcgagggaggaaaagatacttgtgtcggggacagcggtggacctctgatgtgcgatggggtcctccagggtgttacgtcctggggctacgtcccatgcgggacacctaacaagccgagcgtagccgtgcgggtgctcagctacgtgaagtggatagaggataccatcgccgagaacagttag

SEQ ID NO: 192124 - DNA, 1917 bp, Artificial Sequence
  Description of Artificial Sequence: Synthetic coding sequence
atgatcctgttcaagcaggccacctacttcatcagcctgttcgccactgtttcttgcggctgtctgacacagctctatgagaacgctttcttcagagggggagatgttgcaagcatgtatacccctaacgctcaatactgtcagatgcggtgcacattccacccaaggtgcctgctattcagctttctacctgccagcagcatcaatgatatggagaaaagattcggttgttttttaaaggacagtgtgacaggcacgctacctaaagtgcacaggaccggcgccgtctcgggccactccctcaagcagtgtggtcaccagatctccgcctgccatcgcgacatatacaagggagttgacatgcgtggggtgaattttaatgtgagcaaggtatccagcgtcgaggagtgtcagaaacgttgtactagcaatatcaggtgccagtttttttcctacgctacacagacattccacaaggctgagtaccgcaataactgcctactcaaatattccccggggggaaccccaacagccatcaaggtgctgagtaatgttgagagcggctttagcctgaagccatgtgctctttccgagataggctgccatatgaatattttccaacatctcgcattctccgatgtcgatgtcgccagggtgctgacccccgacgcgtttgtgtgccgaaccatctgtacctaccatccaaactgcctcttcttcacattctacactaatgtgtggaagattgagtcacagagaaacgtgtgtttactgaagacatctgagtctgggaccccctcttcaagtaccccgcaggagaacacaatctccggttatagcctcctcacatgtaagaggaccttgccggagccttgtcactctaagatttatcccggtgtggatttcggaggcgaggagctgaatgtgacattcgtaaaaggcgtgaatgtctgccaggagacttgtaccaaaatgattaggtgtcagttttttacttatagtctgctgcccgaagactgcaaggaagagaagtgcaagtgcttcctgcggctgtctatggacggctctcccacccgaatcgcctacggaacacagggatcctccgggtactccttaagactctgtaatactggagataatagcgtgtgtacaacaaaaacatctacacgtatcgtcggaggtacaaactcctcttggggcgaatggccttggcaggtaagtctccaggtaaaactcactgcacagaggcacctgtgtggaggaagcctcatagggcaccaatgggttctgactgctgctcattgtttcgacgggttgccgcttcaggatgtgtggagaatttactctggcatcttgaacctatctgacatcacaaaagacacacccttttctcagatcaaagaaatcataatacatcagaattacaaagtatctgagggaaatcacgacattgctttgattaaactccaggccccactcaactacaccgaatttcagaaacccatatgtctgccttccaaaggggatacatccaccatatacactaactgctgggtgactgggtggggattttcgaaggaaaagggagagatccagaatattctgcaaaaggtcaacattcctttagtgacgaatgaggagtgccaaaaaagataccaggattacaaaatcacacagcggatggtatgtgctggttacaaagaggggggcaaagatgcatgtaaaggcgattctggtgggcccttggtttgtaaacataatggcatgtggcgactcgtgggaatcacgagctggggggagggctgtgcgcgtcgcgagcaaccaggagtttacacaaaagtggcagagtatatggactggattctggaaaaaacccaatcttccgacgggaaggcccaaatgcagtcgcccgcttag

SEQ ID NO: 192125 - DNA, 1545 bp, Artificial Sequence
  Description of Artificial Sequence: Synthetic coding sequence
atgtacacccccaacgcccagtactgccagatgcggtgcaccttccatccacgctgcctcctgttttcatttttgcccgcaagcagcatcaatgacatggagaaaagattcggctgtttcctgaaagactctgtgacaggaaccctacctaaggtccacagaaccggcgccgtctccggccattccctgaaacaatgtggccaccagattagtgcctgtcacagagacatttacaagggcgtggacatgagaggtgttaacttcaacgtttctaaggtttccagtgtagaggagtgccagaaaagatgcacctctaatatcaggtgccagttttttagctacgccacacaaacctttcataaggcggaataccggaataactgcttgctcaaatacagcccaggtggtacacccaccgctattaaggtactttccaacgtagagtccggattttcactgaaaccttgtgcactatccgagatagggtgccacatgaacatcttccagcacctggcctttagtgatgtcgacgtcgccagagtcctcacaccggacgctttcgtctgccgcaccatatgcacttatcatccgaactgtctcttcttcaccttttacaccaacgtttggaagatcgagtcccagcggaacgtgtgtctgctcaaaacttccgaaagcggcacccctagctcaagcactccccaagagaacaccatctctggttacagtcttctgacctgtaagagaaccctccccgagccctgtcattcaaagatttatccaggtgtcgattttgggggagaggagctgaatgtgaccttcgtgaaaggggtgaatgtttgccaggagacctgcaccaagatgattcgctgtcagttcttcacatactcactactgcctgaagattgtaaagaggagaaatgcaagtgcttcctacgactatctatggatggttcccccacccgtatagcgtatggcacgcagggcagctcagggtattcgctcagattgtgcaacacaggggacaactccgtatgcaccactaaaactagtactcgtatcgtaggaggcaccaactcttcttggggagagtggccatggcaggtgtcactccaggtgaagttgaccgcccagcgacacctgtgcggcggctctctcatcggccatcaatgggtgcttacagcagctcactgctttgacggactcccgctgcaggacgtctggcgcatctactccgggattctgaatctcagcgatatcacaaaggacacacctttttcacagattaaggagattattattcaccagaactacaaagtgtccgaaggcaaccatgatatcgcccttataaagctgcaagccccccttaactataccgaatttcaaaaacctatctgcttgcccagcaaaggcgatactagcacaatttacacaaactgctgggtgacagggtggggcttctcaaaggagaaagggcggttccgctggtcgttgtctctccaaacccagtggaatgtcgcattcggtggccaccatcagctggggtag

SEQ ID NO: 192126 - DNA, 447 bp, Artificial Sequence
  Description of Artificial Sequence: Synthetic coding sequence
atgatcctgttcaagcaggccacctacttcatcagcctgttcgccactgtatcatgcgggtgcttaactcagctgtatgaaaacgccttttttagaggaggagacgtggcaagcatgtacacccctaacgcccagtactgtcagatgagatgcactttccacccccgatgcctgcttttctcttttctcccagccagttccatcaatgacatggagaagaggtttgggtgtttccttaaagattcggtcactggtacattaccgaaagttcaccgtaccggtgccgtttccgggcatagcctgaagcagtgcgggcaccagataagtgcgtgccatagagatatttacaagggagtcgacatgcggggagttaacttcaatgtgtcaaaggtgtcctctgtcgaagaatgtcagaagcggtgtacatcaaacatcaggtgccaatag

SEQ ID NO: 192127 - DNA, 753 bp, Artificial Sequence
  Description of Artificial Sequence: Synthetic coding sequence
atgcggatcctgcagctgatcctgctggccctggccaccggcctggtaggcggcgaaacaaggatcatcaagggcttcgaatgcaaaccacatagtcagccttggcaggcggcactctttgagaagaccaggctcctgtgtggggctacacttatagcacccaggtggctcctgacggcagctcactgcctcaagccccgttacattgtacatcttggacagcataacctgcaaaaagaagagggctgcgaacagacaaggaccgcaactgaaagcttccctcaccccggtttcaacaactctcttccgaataaagatcatcgtaacgacattatgctagtgaagatggcatccccagtgtctatcacatgggctgttagacccctcaccctgtccagcagatgcgtcacagccggcacgagttgtcttatcagtggctgggggtcaacttcttctccacagctcaggctgccacataccctgaggtgtgccaatatcactatcatagagcatcagaaatgtgagaacgcatacccgggaaacatcactgataccatggtttgtgcttccgtgcaagaaggaggaaaggactcctgtcagggagattctgggggtcccctggtttgtaatcagtcactgcagggcattatcagttgggggcaggacccttgcgctattacgcggaagcctggcgtctatacgaaagtatgcaagtatgtggactggattcaggaaacaatgaagaataactag

SEQ ID NO: 192128 - DNA, 849 bp, Artificial Sequence
  Description of Artificial Sequence: Synthetic coding sequence
atgcagcggctgcggtggctgcgggactggaagagcagcggccgggggttgactgctgcaaaggagcctggcgcacgctccagtcccttgcaagctatgagaatcttacagctgatcctgcttgcgctcgccacgggtctggtaggtggagagactaggattattaaggggttcgagtgtaagccgcactcccagccatggcaggctgctctttttgagaaaacacgtctcctatgcggcgccacacttatagccccccggtggctcctcacagccgctcattgtttgaaaccacggtacatcgtgcacttgggccagcataacctccagaaggaggagggctgcgagcaaacccgcaccgcaactgaaagcttcccgcaccccgggttcaacaactccctgcccaataaagatcatagaaatgatattatgctggtcaagatggcatcccccgtttccatcacatgggctgtccggcctctcaccctgtcttccaggtgcgttaccgctggaactagctgtctaatttccgggtggggctccaccagttctccacagcttcggctgccccacacacttcggtgcgcaaatatcactatcatcgagcaccaaaagtgtgaaaatgcctatcctggaaatattacagatacaatggtgtgtgccagcgttcaggaaggaggaaaagattcttgtcagggcgactccggaggacccctcgtgtgcaatcaatctttgcagggtatcatttcatggggccaggacccatgtgccattaccagaaaacctggcgtatatacaaaggtatgtaaatacgtcgactggattcaggaaacgatgaaaaataactag

SEQ ID NO: 192129 - DNA, 828 bp, Artificial Sequence
  Description of Artificial Sequence: Synthetic coding sequence
atgcggatcctgcagctgatcctgctggccctggccaccggcctggtgggaggcgaaacccggatcataaagggtttcgaatgtaagccgcacagccaaccgtggcaagctgccctgtttgagaagactcggctcctctgcggcgccacgctcatcgccccacggtggcttctgacagcggctcattgccttaaaccctgggtgtcgctgacatcaccaacacatgtcagtccagacctcagcagctctaattactgtttatcgcacttatcaagatatatcgtccatctcggacagcacaacctacaaaaagaggaagggtgcgagcaaactagaactgcaaccgaaagtttcccacaccctggctttaataattccctccccaataaggaccatagaaatgacatcatgctggttaaaatggcttccccggtgtctatcacatgggcagtccgaccgctcacactgagtagtcgttgcgtgaccgccgggacttcttgtttgatatctggctgggggtctactagctcaccgcagcttaggctcccacataccctgcggtgcgccaatatcaccatcatcgagcatcaaaagtgcgagaatgcctaccccggtaatatcaccgacacgatggtgtgcgcctccgtccaagagggcggcaaggatagctgtcagggggattccggcgggccgctggtgtgtaaccagagtctccaggggattatcagttggggacaggacccatgtgctattacgcgcaaacctggggtctataccaaggtctgtaaatacgttgattggatccaagaaaccatgaagaacaattag

SEQ ID NO: 192130 - DNA, 753 bp, Artificial Sequence
  Description of Artificial Sequence: Synthetic coding sequence
atgcggatcctgcagctgatcctgctggccctggccaccggcctggtaggcggagagacaaggatcataaaagggtttgaatgcaaacctcacagccaaccatggcaggctgcgctttttgagaaaacaaggctgttatgtggcgctacactcatcgcccctaggtggttactgaccgcagcacactgcctcaagcctaggtatattgtccatttaggccagcataacctgcaaaaggaagagggatgtgagcagaccaggaccgctactgagagtttcccacatccaggttttaataatagtctgcctaacaaagatcatcggaacgatatcatgctcgtcaagatggcttcacccgtcagcatcacttgggcagtgcgcccgctcaccctgtcctctcggtgtgtcacagcaggcacctcctgccttatcagcggttggggctctacaagctcacctcagctgagattgcctcacactttgcgatgcgccaacattaccataatagagcaccagaagtgcgaaaacgcatacccaggaaatataacagacaccatggtctgcgcatccgtgcaggaaggtggtaaggactcctgtcaaggcgatagcggcgggccactggtctgtaatcagagcctccaaggtatcatttcatgggggcaggacccctgcgcaataacccgtaagccaggggtttatactaaggtttgtaagtacgtagactggatccaggaaaccatgaaaaacaattag

SEQ ID NO: 192131 - DNA, 849 bp, Artificial Sequence
  Description of Artificial Sequence: Synthetic coding sequence
atgcagcggctgcggtggctgcgggactggaagagcagcggccggggactaaccgccgccaaagagcctggcgcccgaagttctcctttgcaggcaatgagaatcctgcagctgatcctcctcgccctcgcaactggactcgttggtggcgagacacggataattaagggatttgaatgtaagcctcacagccaaccatggcaggcagcactgtttgaaaagactcgtctcctgtgtggtgcgaccctcatagcacctcgttggctcttaactgctgcacattgcctcaagcccaggtacattgtgcacctcgggcagcacaatctccagaaagaggagggttgcgaacaaacccgtaccgccaccgagtctttccctcacccaggtttcaacaactccctgccaaacaaagatcatcggaacgacatcatgttggtcaaaatggcgagcccagtgtcgatcacttgggctgtaaggcccctcaccctgtcttccaggtgtgtgacagcggggacttcctgcctaatttctggatggggctctactagcagcccacaactaagactgccgcacactttacggtgtgctaacataacgatcatagaacaccagaaatgcgagaatgcttacccaggtaacataactgacacaatggtgtgtgcatctgttcaggagggcggcaaagattcatgtcaaggagatagcgggggccccttagtgtgcaatcagtcactgcaggggattatttcctggggtcaagacccatgtgctattacgcgtaagcccggcgtgtatacaaaagtgtgtaaatatgtggattggatccaggaaaccatgaaaaataattag

SEQ ID NO: 192132 - DNA, 765 bp, Artificial Sequence
  Description of Artificial Sequence: Synthetic coding sequence
atgggcctgagcatcttcctgctgctgtgcgtgctgggcctgagccaagccgccacccccaagatcttcaacggaacagagtgtggacggaactctcaaccttggcaagtggggctctttgagggcacttcgctccggtgcggaggcgttctgatagaccataggtgggtcttgaccgccgcccattgtagcggctcccgttattgggtccgtctgggtgagcacagcctgtcccagctagactggaccgaacagatccggcattccggattttcagtgacacatcccggctacctgggcgcatcgacatcgcatgagcatgacctgagattattaaggctgcgactgcccgtgagggtcacctcttccgtgcagccactgcctctcccaaacgactgcgctacagcaggaacagagtgccacgtctcagggtgggggattaccaaccaccctcgcaacccatttcctgacctcctgcagtgcctgaatttgagtatagtatcccacgctacatgccatggggtgtacccaggacgcatcacaagtaatatggtttgtgccggtggcgtcccgggtcaagatgcctgccagggtgattccggaggccccctggtgtgcggtggcgttttgcagggtctcgtctcttgggggtctgttgggccgtgtggccaggatggcatacctggggtgtatacatacatctgcaactctacgctggtggggttgggcacctcttggaatttcaactcctgccagccattttag

SEQ ID NO: 192133 - DNA, 435 bp, Artificial Sequence
  Description of Artificial Sequence: Synthetic coding sequence
atggccctgagcgtgggcgtgacccacagccggggccggtggggctgcttaagagcacctgcctgtgcagccggcgtgagccttctgactaccggcggtagttcccagcgacttacggctgcagctgatccgttccctgacctgcttcagtgtctcaatctgagtattgtgtcacatgcaacctgccacggagtttatcccggccgaattacatcaaacatggtctgtgcgggaggcgttcccgggcaagatgcatgtcagggcgattccggtggccccttagtttgtggcggtgttctgcaaggcctggttagctgggggtcggtcggaccatgcggccaggatgggatccccggcgtgtatacatatatctgtaatagtaccttagttgggctcgggacctcctggaactttaactcttgccaacccttctag

SEQ ID NO: 192134 - DNA, 747 bp, Artificial Sequence
  Description of Artificial Sequence: Synthetic coding sequence
atgggcctgagcatcttcctgctgctgtgcgtgctgggcctgagccaggccgcaacgccgaaaatctttaacggaaccgaatgcggtaggaactctcagccgtggcaggtgggcttgttcgaagggactagtctgcggtgtggcggagtgctgatcgaccataggtgggtcctgaccgcagcccactgcagcggctcacgctactgggtacgcctgggagagcattccctcagccaactggactggaccgagcaaatacgacactcaggcttcagtgtgacgcaccctggctacctcggcgcatctacgtcacacgaacatgatctgcggctactgcgcctgagactgcccgtccgcgtgacgagttctgtgcagccactgccgctgccaaacgattgtgcaaccgcaggaactgaatgccacgttagtgggtggggaattactaatcacccacgaaacccattccctgacttactgcaatgtcttaatctgtctatagtttcccacgcgacctgccatggggtgtatcccggccgtattacttcgaatatggtatgtgccgggggggtccccggtcaagacgcatgccagggtgacagcggcgggccattggtgtgtggaggagtcctccaggggttggtttcctggggctcagtgggcccctgcgggcaagacggaatacctggagtctatacttatatctgtaaatacgtggactggatacggatgatcatgagaaataactag

SEQ ID NO: 192135 - DNA, 747 bp, Artificial Sequence
  Description of Artificial Sequence: Synthetic coding sequence
atgggcctgagcatcttcctgctgctgtgcgtgctgggcctgagccaggctgccacccccaagatcttcaatgggaccgaatgtggacgaaacagccagccatggcaagtggggctgttcgaggggacatctttacgatgtggtggtgttctgattgatcataggtgggttcttactgccgctcactgcagtggtagccgctactgggtgcgactaggcgagcattctttgtctcagcttgactggaccgagcagatccgacattcaggattctcagtcacacatccagggtacctcggagcctcaaccagccacgagcacgatctcagattattaaggctgaggctgcccgtgcgggttacttctagcgtccagcccctgcccctgcccaatgactgtgccacagcgggaactgagtgtcatgtgagtgggtggggcattacgaatcatccccggaaccccttccccgacctgttacagtgtctgaacttatctatcgtgtcccatgccacatgccatggcgtctatccagggagaatcacatcaaacatggtgtgcgcagggggtgtgcccggtcaggacgcctgccagggagacagcggaggtccactggtctgcggcggcgttctccagggcctggtgtcctggggttcggtcggcccctgtggccaagacggcatccccggggtgtacacttatatttgtaagtatgttgattggatccgcatgattatgaggaataactag

SEQ ID NO: 192136 - DNA, 336 bp, Artificial Sequence
  Description of Artificial Sequence: Synthetic coding sequence
atgggcctgagcatcttcctgctgctgtgcgtgctgggcctgagccaagcagcgaccccaaagatctttaacgggaccgaatgtgggcggaactcccagccttggcaggtgggactcttcgaaggtacatcattgcgctgtggtggcgtgctcatcgatcaccgctgggttctgactgccgcccattgctccggcaggccaatccctggaagcgctcctgttcctcaacctctccacagactgccatgtcacctgccctggtgtgtgtcccgcgaaaatcatgagcagcatggcgtctgccgccgtcggccaggagccgggtgtctaccggggtag

SEQ ID NO: 192137 - DNA, 834 bp, Artificial Sequence
  Description of Artificial Sequence: Synthetic coding sequence
atgtggcccctggccctggtgatcgccagcctgaccctggccctgtccggaggtgtgtctcaagagtccagcaaggtcctcaacaccaacggtaccagcggatttctgccaggcggctacacttgtttccctcattcacaaccatggcaggccgcccttctcgttcagggcagactgctctgtgggggagttctggtacacccaaaatgggtcctgaccgccgcacactgcctgaaggaggggctcaaggtataccttggtaaacacgcgctcggacgggtggaagcaggggaacaagttagggaggtggtgcattctatcccccatccagagtacagacggtctccaacgcatctcaatcatgaccacgatattatgctactcgagctgcaatctcccgtgcagctgacgggctacatacagacactgccactgtcacacaacaacaggctaacacctgggacaacatgcagggtatctgggtggggcaccacaacctcaccgcaggtaaattatcccaagacgcttcagtgcgccaacattcaactgcgaagcgacgaggaatgtcgacaggtttaccccgggaagattaccgacaatatgctctgtgccgggacgaaggagggcggcaaggatagttgtgaaggcgactccggcgggccgctggtttgcaatcgcaccctgtatggcatcgtctcttggggcgattttccctgcggtcaacctgaccggcccggggtttacactcgggtatctcgttacgttctttggattagagagaccatccgcaaatatgagactcagcagcaaaaatggctgaagggtcctcagtag

SEQ ID NO: 192138 - DNA, 378 bp, Artificial Sequence
  Description of Artificial Sequence: Synthetic coding sequence
atgtggcccctggccctggtgatcgccagcctgaccctggccctgtcgggcgtgaattatcccaaaacactgcaatgcgcgaatatccagctccgaagcgatgaggagtgccgacaggtgtatcctggcaagatcaccgacaatatgctgtgcgccgggaccaaggaggggggcaaggacagctgtgaaggggactccggtggacccctcgtctgcaaccgcacattgtacggaatagtatcctggggagacttcccttgcggacagccagaccgaccaggcgtttatacaagagtgagtcggtacgtgctttggatcagagaaacaatacgaaaatatgaaacgcaacagcagaaatggctcaaggggcctcagtag

SEQ ID NO: 192139 - DNA, 297 bp, Artificial Sequence
  Description of Artificial Sequence: Synthetic coding sequence
atgggcctgatctacaagtgcctgcccgagaaggtgaccgtgaacattgagactagatgccttcccggggtgttccaggggtcccagcaccagtgggaccagtgggtctctcctagatggctgcatctgctaccgcccctgtccgctctggcaggctgccccactagcgccagggctgccaccctgtggggcagccctggacccccacagatgggcccacactgtcgcactcttagcaagggtggggcccagagccttccaaggcaagcgagaccccgggcttgcggtagttggtag

SEQ ID NO: 192140 - DNA, 282 bp, Artificial Sequence
  Description of Artificial Sequence: Synthetic coding sequence
atgtggcccctggccctggtgatcgccagcctgaccctggccctgtcggggggggaggacttcaaagaaccttcacaaggccccagagacgtcatggctgcttcacggcctgaagcttttccgaaaggcctgaccctggagccaaggcccgagaagggaggcatttgtggatgccttgctcctggcacgatccttggcctgaaggtaggatggttgttctcttctggcgacaccccctggattcatgcgcgtgccacacccgagtgccataccctgggctag

SEQ ID NO: 192141 - DNA, 834 bp, Artificial Sequence
  Description of Artificial Sequence: Synthetic coding sequence
atgtggcccctggccctggtgatcgccagcctgaccctggccctgagtggaggcgtaagtcaggagagctccaaagtgttgaacactaacggcacatctgggtttctgcccggcgggtacacttgtttcccccactcccaaccatggcaggccgccctgctggtgcaggggcgtctactgtgtgggggagtcttagttcacccaaagtgggtgttgacagccgcccattgtttgaaagaaggattgaaggtttacctgggcaagcatgctctcgggcgcgttgaggccggcgaacaggtgagggaggtcgttcatagcatccctcacccggagtatcggcgtagccctacacatctgaaccacgatcatgacattatgctgctggaactccagagccccgtgcagcttacgggctatatacagaccctcccattatctcacaacaatcggctcactccaggcaccacttgtagggtgagcggatggggtacaaccacaagcccacaagtcaactacccaaagacgctccagtgcgcaaatatccagttaagatccgacgaggagtgcagacaggtatatcctggtaagatcaccgacaacatgctttgtgcgggtaccaaggaaggcggaaaagactcatgcgagggggactccggtggacctctggtatgtaaccgaaccctatatggcatagtgtcatggggcgacttcccttgcggccagccagatcgacccggcgtgtacacaagggtgagcagatatgtactgtggattcgcgagacgatccgtaagtatgagacccagcaacaaaaatggttaaaggggcctcagtag

SEQ ID NO: 192142 - DNA, 804 bp, Artificial Sequence
  Description of Artificial Sequence: Synthetic coding sequence
atgagcctgcgggtgctgggcagcggcacctggcccagcgcccccaaaatgtttcttttgttaactgccctgcaagtcctggcgatagccatgacccagtctcaggaagacgagaacaagattatcggaggacacacttgcacccggagctctcagccgtggcaggcagctttactggccgggcctagacgtcggtttctatgcggcggcgcactcctgtctgggcaatgggtcatcaccgccgcgcattgcggcagacccattctccaagtcgcactgggcaagcacaatctgcggcgttgggaggccactcagcaggtgttgagggttgtcaggcaggtgactcatcctaattacaactcccggacacacgataatgatttaatgctgttgcaactgcagcaaccagcgaggatcggccgggccgtgcggccaattgaagtgacgcaggcttgcgcgtctcccggcacaagctgcagagtttcagggtggggtacaatcagttcaccaatcgccagataccccgcatcactgcaatgcgtgaatattaacattagcccagatgaagtgtgtcagaaagcatacccccggacaatcactcctggcatggtgtgcgctggtgtaccccaggggggaaaggactcctgtcagggcgatagtggcggccctttggtgtgccgaggtcagttgcaaggattagttagctggggaatggaacgatgtgcactcccagggtaccctggtgtgtatactaacttatgcaagtataggtcctggatcgaagagacaatgagggataaatag

SEQ ID NO: 192143 - DNA, 804 bp, Artificial Sequence
  Description of Artificial Sequence: Synthetic coding sequence
atgagcctgcgggtgctgggcagcggcacctggcccagcgcccccaaaatgttcctgctacttactgcgctgcaggtcctggcaattgcaatgacgcagtctcaggaagacgagaataaaattatcgggggccatacatgtacccggtccagtcagccatggcaggctgcactgctagcaggcccgcgtagacggtttctgtgcggcggcgctttactgtcagggcagtgggtgatcacagcagcccactgtggccggcctattttgcaggtagcgctgggcaagcacaacctcagacgatgggaagcgactcaacaagtgctacgcgtagtgcgtcaggtgactcaccccaactacaactcccggacgcacgacaacgacctgatgctgctgcagctgcaacagcccgctaggattggcagagccgtacggcctattgaggtgacacaggcatgcgccagcccgggcacctcctgtcgagtttctggatggggaaccatttcatcacccattgcaagatatcctgcgtctctgcagtgtgtgaatatcaacatcagcccagatgaggtgtgtcagaaagcctatccgagaaccattacgccaggcatggtgtgcgccggcgttccacagggaggaaaagatagctgtcagggcgactctggaggaccattggtctgtcgggggcagctgcaaggactcgtctcttggggcatggagaggtgtgccctgccaggttatccaggggtctataccaacctctgcaaatatcggtcctggatcgaggaaactatgcgagataagtag

SEQ ID NO: 192144 - DNA, 804 bp, Artificial Sequence
  Description of Artificial Sequence: Synthetic coding sequence
atgagcctgcgggtgctgggcagcggcacctggcccagcgcccccaagatgtttcttctcctgaccgctctgcaggttcttgcaatagccatgacccagtctcaggaggacgaaaacaaaattattggcggtcacacgtgcactcggtcatctcagccatggcaggccgccttgctcgccggcccaaggcgacgatttctgtgcggcggtgccctgctatccgggcaatgggtcattaccgcggctcactgcggccggcctattctgcaagttgctcttggtaagcataatctgaggaggtgggaagctactcagcaggtgctacgtgtcgtgcgccaggtgacacaccccaactacaacagtcggacccacgataatgacctgatgctgctgcaacttcaacagcctgcccgtataggccgtgcagttcgccctatcgaggtaacacaggcgtgcgccagtcctggaactagctgccgcgtgtctggctggggaacaattagtagtccaatcgcgaggtaccccgccagcctccaatgcgtgaacatcaacatctcccccgacgaggtgtgtcagaaggcttaccccaggacgattacacctggtatggtgtgcgctggggtccctcagggcggcaaagacagctgtcagggagatagcggtggcccgctggtttgccgggggcaactgcaaggcttagtgtcctggggaatggagcgatgcgccctccccggatacccaggcgtgtacacgaacctgtgcaaataccgctcctggattgaggaaactatgcgagacaagtag

SEQ ID NO: 192145 - DNA, 486 bp, Artificial Sequence
  Description of Artificial Sequence: Synthetic coding sequence
atgtggctgctgctgaccctgagcttcctgctggccagcaccgccgcacaagatggcgacaagctgctggaaggagatgagtgcgcgccccactcccagccatggcaagtggcactttatgaaagaggcaggttcaactgtggcgcctccctgattagccctcactgggtgctttccgccgctcactgccagtctagatttatgcgcgttcggctgggagagcacaatctgcgtaaaagggatggcccggagcagctgcgcacgactagtagggttattccgcaccccaggtatgaagcccgcagtcacagaaacgacattatgctgctccgcctggtgcagccagccaggttgaacccgcaggtgagaccagctgttcttccaactaggtgtcctcacccaggggaagcttgtgtagtttcaggctggggtctcgtgtcacataatgagcccggaactgctggctcccctagaagtcagggatag

SEQ ID NO: 192146 - DNA, 771 bp, Artificial Sequence
  Description of Artificial Sequence: Synthetic coding sequence
atgtggctgctgctgaccctgagcttcctgctggccagcaccgccgcgcaggatggtgacaagttactggaaggcgacgaatgcgccccccacagccagccttggcaagtagctctttacgagcgcggccgcttcaactgtggcgcatccctgatctcccctcactgggtgctgtccgcggcgcattgccagtctcgctttatgcgggtgcgtctgggcgagcacaacctacgcaagcgggatggccccgaacagctcaggaccacttcacgcgttataccacatccacgttatgaagcgagaagccaccgtaatgacattatgcttctgaggctggtgcaaccggcaaggctcaatccacaggtacgccccgctgtgctcccaactcgttgcccccaccccggggaggcatgtgtggtttccgggtgggggctggttagccataacgaaccaggcaccgctggctctccgagatctcaggtcagcttacctgacactttacactgcgcaaatattagtatcatctctgacacgtcctgcgacaaaagttaccctggcagactaactaacacgatggtgtgcgctggtgctgaaggaagaggagcagaatcctgcgaaggggatagcgggggcccattggtatgtgggggtatcttgcagggcatagtcagttggggggacgtcccctgtgacaacactaccaaacccggagtatatacgaaggtgtgccattatttggaatggattagggagacgatgaagaggaactag

SEQ ID NO: 192147 - DNA, 516 bp, Artificial Sequence
  Description of Artificial Sequence: Synthetic coding sequence
atgtggctgctgctgaccctgagcttcctgctggccagcaccgccgcccaagatggcgacaagctgctggagggagacgaatgtgccccacatagccaaccatggcaggtagccctctacgagcgcggacggtttaactgtggggccagtcttattagtccacactgggttttgtccgccgcgcactgtcagtccaggttcatgcgcgttcggctcggcgaacacaacctgcgaaagcgcgatggacccgaacaattgcgaactacaagccgagtcatccctcacccacgctacgaggctaggtctcatcgcaatgacattatgctactaaggttagtgcagccagcccgactaaatccgcagggggactccggcggacctctggtgtgcggtgggattttacagggcatagtatcctggggagacgtgccctgcgataatactacgaagccaggtgtttataccaaggtctgtcattatctggaatggatacgggaaaccatgaagaggaattag

SEQ ID NO: 192148 - DNA, 489 bp, Artificial Sequence
  Description of Artificial Sequence: Synthetic coding sequence
atgtggctgctgctgaccctgagcttcctgctggccagcaccgccgcccaggacggtgacaagctcctcgagggcgacgagtgcgcccctcatagtcagccttggcaggtggctctgtatgagcgaggtcgattcaactgtggggccagccttatcagtccgcactgggtcctgagtgccgcccattgtcagtcccgattcatgagggttcggctgggcgagcacaacctgcgaaaacgcgacggccccgagcagctgcgtacaactagcagggtaattccacaccctagatatgaagctagatctcaccgcaacgatataatgttgctgcggctggtacagcctgctcgcctgaaccctcaggtacgacccgctgttctccccaccaggtgcccccaccccggcgaggcttgcgttgtaagtggatggggcctggtcagccacaatgaacctggcactgccgggtcaccccgatcccaaggcgcctag

SEQ ID NO: 192149 - DNA, 771 bp, Artificial Sequence
  Description of Artificial Sequence: Synthetic coding sequence
atgtggctgctgctgaccctgagcttcctgctggccagcaccgccgcccaggatggggataaattgctcgagggcgatgagtgtgcaccccattcccagccttggcaggtcgcactgtatgagcgtggacgctttaactgtggagcttccttaatctcgccccattgggtgctgtctgccgcacactgccagagcaggttcatgcgagtgcgcttaggagagcataatctgaggaagcgggatggccccgaacagctgagaaccacgtctcgggttatcccccatccacggtacgaggcacgatcccaccgtaacgacatcatgctgctgcggctcgtacagccggctaggctgaacccccaggtacgccccgcggtattaccaactaggtgtcctcaccccggtgaggcctgcgtagtgtctggatggggtctggtgtcccacaacgagccagggaccgctggctccccaaggtctcaggtgagtctgccggacactctgcactgtgccaatatctccatcatctcagacactagttgtgataagagttatcccggacgactgaccaacaccatggtttgtgcaggcgcagaaggcagaggcgcagagagctgcgagggcgatagcggtgggccgctggtatgtggaggcatcctgcaaggaatcgtgagttggggagacgtgccatgcgacaatacaactaaacctggcgtttatactaaagtgtgccactacctggagtggatcagagaaactatgaagagaaattag

SEQ ID NO: 192150 - DNA, 786 bp, Artificial Sequence
  Description of Artificial Sequence: Synthetic coding sequence
atgtgggacctggtgctgagcatcgccctgagcgtgggctgcaccggcgccgtacctcttatccagagccgcatcgtaggcggctgggagtgcgaaaagcactctcagccttggcaggttgccgtttatagccacggctgggcacactgtgggggtgtgttggtacacccccaatgggtcctgacggccgctcattgcctaaagaaaaacagtcaggtctggctcgggcgccacaatttgttcgaacccgaggataccggacaacgggtgccagtgtcccactcattccctcatcccctctacaacatgagtctgttaaagcaccaatccctcagacccgacgaagacagctcccacgatctaatgctcctgcgcctgtccgaaccagctaagataactgacgtcgttaaagtactgggcctccccacgcaggagccagcactgggaaccacctgctacgctagtggttggggtagtatcgagcccgaggaatttttgcgaccaagatcgctgcagtgcgtctcactgcatttactaagtaatgacatgtgcgctcgagcttacagcgaaaaagtgacggagttcatgttgtgtgccgggctgtggaccggcggcaaggacacttgcgggggggattcaggtgggcccctggtgtgtaacggcgtactacagggaattacctcttggggcccggagccttgcgccttaccagagaaacctgccgtgtataccaaggtggtccactataggaagtggatcaaagatacaattgcagccaacccttag

SEQ ID NO: 192151 - DNA, 672 bp, Artificial Sequence
  Description of Artificial Sequence: Synthetic coding sequence
atgtgggacctggtgctgagcatcgccctgagcgtgggctgcaccggggccgtcccacttatacaaagccgcattgtcggcggatgggagtgtgaaaagcatagccaaccttggcaggtcgctgtgtattcccacggctgggcgcattgcggtggggttctggtgcacccccagtgggtgttgacggccgctcattgcctgaaaaagaactctcaagtgtggctgggcagacacaacctctttgaacctgaggatacggggcagcgtgtgccagtctcacacagcttcccgcatcccctctacaatatgagtttgctgaagcaccaaagccttcgaccagacgaagatagctctcacgacctcatgctgctccgtctgagtgagcctgctaaaattaccgatgttgtaaaggtactgggactcccgacccaggagcccgccctgggaaccacctgctacgcctcggggtggggaagcattgaacccgaagaattcctgcgcccccgttccctccagtgcgtgtctctgcatctgctgtccaacgacatgtgcgcaagggcttatagcgaaaaggtgactgaatttatgctgtgtgccggtctgtggactgggggtaaagacacctgtggcgtttcacatccatactcccagcatctggagggcaagggatag

SEQ ID NO: 192152 - DNA, 480 bp, Artificial Sequence
  Description of Artificial Sequence: Synthetic coding sequence
atgagcctgctgaagcaccagagcctgcggcccgacgaggacagctctcatgacttgatgttgctgcgcctgtctgaacccgctaagatcactgatgtcgtgaaggtgttgggcctgcctacacaggagcctgcccttggaaccacttgctatgcgtctgggtggggatctattgagccagaggaatttctaagaccaagaagcctccagtgcgtttcgctgcatctgctgtctaacgatatgtgcgcgagggcctattccgagaaggttaccgagtttatgctctgtgcagggttgtggaccggaggaaaggacacttgtggcggcgactccggaggccctctggtgtgcaatggtgttttgcaaggaataacttcatgggggcctgaaccttgcgctttgcccgagaaaccagctgtgtacaccaaagtagtgcactaccggaagtggataaaggatactattgccgctaacccatag

SEQ ID NO: 192153 - DNA, 786 bp, Artificial Sequence
  Description of Artificial Sequence: Synthetic coding sequence
atgtgggtgcccgtggtgttcctgaccctgagcgtgacctggatcggagccgctcccctgattctttccagaatcgtcgggggttgggagtgtgagaagcattcccagccctggcaggtcctcgttgctagcagggggcgcgccgtctgtgggggagtgctggtgcatccgcagtgggtactgacagccgcacactgcatccggaacaaaagtgtaatcttgttgggccgacacagtttgttccacccagaagacaccggacaagtcttccaggttagccatagttttccacacccactttacgatatgagtttgctaaagaatagattcctgcgtccaggcgatgatagctctcatgatcttatgctcctcaggctgtccgagcctgctgagcttactgacgccgtcaaagttatggacctgcctacacaggagccggctctgggaacgacatgctacgcctcgggatggggctcgattgagccagaggaatttctaacccccaaaaaattacagtgcgttgacctgcacgtaatttccaatgacgtgtgcgcacaggtccatccacagaaagttactaagttcatgttgtgcgcaggtcgatggaccggtggcaaatctacttgtagcggggattccggggggcccctggtctgtaacggcgtcctgcagggaatcacgagctggggttccgagccctgtgcccttccagaacgcccttctctgtacactaaagtagtgcattacaggaagtggatcaaggataccattgtcgcaaatccatag

SEQ ID NO: 192154 - DNA, 663 bp, Artificial Sequence
  Description of Artificial Sequence: Synthetic coding sequence
atgtgggtgcccgtggtgttcctgaccctgagcgtgacctggatcggagcagctccactgatcctgagccgtatcgtgggtggctgggagtgtgaaaaacattctcagccatggcaggtactcgtagcttctagaggccgggctgtatgcgggggagtgctcgtgcacccacagtgggtgctgacagccgctcactgcataaggaacaagagcgtgattttattggggcgccattccctttttcatccagaggacaccggacaagtgtttcaggtaagccactccttccctcatcctctttacgacatgtcactccttaagaaccggttccttagaccaggcgacgattccagtatagagcctgaggagtttctgactcctaagaaactccagtgtgtagatttacatgtgatctccaacgatgtgtgtgcccaggtgcatccccaaaaagttacaaaatttatgctatgcgcgggaagatggacaggcgggaaaagcacctgtagtggagactccggtggccccctggtgtgcaacggagttctgcagggcattacctcctggggttcagaaccatgcgcgctgcccgaacgcccctccctctacactaaagttgtgcattacaggaagtggataaaggatacaatcgtggcaaacccttag

SEQ ID NO: 192155 - DNA, 717 bp, Artificial Sequence
  Description of Artificial Sequence: Synthetic coding sequence
atgtgggtgcccgtggtgttcctgaccctgagcgtgacctggatcggcgcagccccgcttattctctccagaatagtgggtgggtgggaatgcgagaagcactctcagccctggcaggtgctggtggcaagcagaggcagggccgtgtgtggaggagttttggtgcatccacaatgggttctgacggctgcccattgcatcagaaacaaaagcgttatcctgctgggcaggcatagcttgtttcacccagaggacactggccaggtttttcaggtgagtcatagttttccgcacccactgtacgacatgagcctcctgaaaaaccgtttcctgcgacctggcgatgactcatcccacgaccttatgttactccggctgtcggagcccgctgagctcaccgatgctgtaaaggtcatggatctgcctactcaggaacccgcactcgggacaacctgttacgccagcgggtggggttccatcgagccggaagagttcttgacccctaaaaaactgcagtgtgtagacctgcacgtgattagcaacgacgtgtgcgctcaggtgcacccacagaaagtgacaaagttcatgctgtgcgcgggtcgctggaccggcgggaagtcaacatgtagctgggtgatcctgattacggaactcactatgcctgcactccccatggtccttcacgggagcttagtgccttggagagggggtgtttag

SEQ ID NO: 192156 - DNA, 657 bp, Artificial Sequence
  Description of Artificial Sequence: Synthetic coding sequence
atgtgggtgcccgtggtgttcctgaccctgagcgtgacctggatcggggcggctccgctcattctgagtcgtattgtgggcgggtgggagtgcgagaaacattctcagccttggcaagtgctggtggcttccagaggcagggctgtgtgtgggggagtcctcgtccaccctcaatgggttctgacagctgcgcattgtattaggaaaccgggagatgacagctcccacgatttgatgctgctgaggctcagcgagcctgccgaattaaccgacgcggtgaaggttatggacctgcccacacaggaacccgctttaggaacaacctgctacgccagtgggtggggctccatcgagcctgaagagtttctgacacccaagaaactccaatgcgttgacctccatgtgatcagtaatgacgtgtgcgcacaggtgcacccccagaaagtgaccaagtttatgctgtgcgccggacgctggacaggcggcaaaagcacctgtagtggcgactctggtgggccattggtctgtaacggggtgctgcaagggatcacgtcttggggctccgaaccatgtgcacttccagaaaggcctagtttatacacaaaagtagtccactatagaaagtggatcaaagatacaatcgtggccaatccgtag

SEQ ID NO: 192157 - DNA, 210 bp, Artificial Sequence
  Description of Artificial Sequence: Synthetic coding sequence
atgtgggtgcccgtggtgttcctgaccctgagcgtgacctggatcggggctgcacccttgatcctctccagaatagtcgggggctgggaatgcgagaaacactctcagccctggcaggtcttggtggcgtccagggggagggccgtgtgtggtggcgtactagtgcatccacagtgggtgttaaccgctgcccattgtattcggaaatag

SEQ ID NO: 192158 - DNA, 765 bp, Artificial Sequence
  Description of Artificial Sequence: Synthetic coding sequence
atggccaccgccggcaacccctggggctggttcctgggctacctgattctgggcgtagccgggagtcttgtctcgggctcatgcagtcagataattaacggggaggattgtagcccccatagccaaccttggcaagcggccctagttatggaaaacgagcttttttgcagtggagtgctggttcacccccagtgggtgctgtctgcagcccattgtttccagaacagttacactatcgggctagggttgcactcactagaggcagaccaggaaccagggtcacagatggttgaggcaagtctgtcagtgagacatcctgagtataacagacccctcttggccaatgacctgatgctgatcaaactcgacgaatctgtgtccgagtccgacaccattagatctatcagcattgcttcacagtgtcccaccgcgggcaatagttgcctggtctcaggttggggactcctggcaaatggacgcatgccaacagtgcttcagtgcgttaacgtgagtgtggtgagtgaagaagtctgctctaaactgtatgatcccctttaccatccttcaatgttttgcgctggtggaggccacgaccagaaggactcgtgcaacggagatagcggaggacccctgatttgcaatggttaccttcagggcctggtctcttttggcaaggcaccatgtggccaggtcggggtgcccggtgtgtataccaatctttgcaagttcactgagtggatagagaaaaccgtgcaggcctcttag

SEQ ID NO: 192159 - DNA, 333 bp, Artificial Sequence
  Description of Artificial Sequence: Synthetic coding sequence
atggagaacgagctgttctgcagcggcgtgctggtgcacccccagtgggtcttaagcgccgcccattgtttccagaactcctatacaattgggctgggcctgcatagccttgaggccgatcaagaaccaggtagccaaatggtggaggcttcactgtctgtaagacaccccgagtacaatcgaccccttttggccaacgacctgatgctgatcaaactcgatgagtctgttagcgaatccgacaccatcagatctatcagcattgcttcgcagtgccccacagcggggaatagttgtctggtgtcgggctggggactcctggctaacggctag

SEQ ID NO: 192160 - DNA, 735 bp, Artificial Sequence
  Description of Artificial Sequence: Synthetic coding sequence
atgaagaagctgatggtggtgctgagcctgatcgccgccgcctgggcagaggaacagaacaagcttgtccacggcggcccgtgtgataaaacaagtcatccgtaccaggcggcgctatacacttctggtcaccttctttgtggaggggtgctcatccacccactatgggtgctgactgccgcccattgcaagaaaccgaaccttcaggtgtttctgggtaaacataatttacggcagcgagagtcttcacaagaacagagctcagtcgtacgggcagttattcatcctgattacgatgcggcgtctcatgaccaagatatcatgttgttgcgtctcgccagaccagccaaactttctgaattgatacagcctctgcctttggagcgggactgttcagccaatactacttcttgccatattctgggctggggaaagaccgctgatggagattttcccgacaccattcaatgcgcctacatccacctggtgagcagggaggaatgcgaacacgcatatccaggccagattactcaaaacatgctgtgcgcgggtgatgagaagtacgggaaagatagttgtcagggagattctgggggtcctttggtctgtggcgaccacctgcggggtcttgtgagttggggaaacatcccttgtggaagtaaggagaaaccaggcgtctacaccaatgtctgtagatacacaaactggattcaaaagactattcaggccaaatag

SEQ ID NO: 192161 - DNA, 735 bp, Artificial Sequence
  Description of Artificial Sequence: Synthetic coding sequence
atgaagaagctgatggtggtgctgagcctgatcgccgccgcctgggctgaggaacagaacaagctggttcacggcggcccgtgtgataaaacatcccacccttatcaggccgctctgtacacctctgggcacttgctctgcggcggggtgctgatccaccccctctgggtattgacagccgctcactgtaagaagcctaacctgcaggtgtttctcggtaagcacaatctcaggcaaagagaatcctctcaggagcaatcgtccgtagtgagagccgtgatccaccctgattatgatgccgcatcacatgatcaggatattatgctgctccggttagctaggcctgccaaactctcagaattgatccagcccctgccactggaaagagactgttccgctaacaccacctcctgccatattctcggttggggcaaaacggccgacggcgattttcccgatacaatacaatgcgcttacattcacttagtgagcagggaggaatgcgaacatgcatacccaggccaaataacccagaatatgctgtgtgcaggtgacgagaagtatggcaaggactcttgtcagggcgatagcggagggcctttggtgtgcggggatcatttgcgcggactggtgagctggggcaacatcccatgcgggtccaaggaaaaacctggggtgtacacgaatgtttgccggtatacaaactggatacagaagacaattcaagctaagtag

SEQ ID NO: 192162 - DNA, 363 bp, Artificial Sequence
  Description of Artificial Sequence: Synthetic coding sequence
atgaagaagctgatggtggtgctgagcctgatcgccgccgcctgggccgaggagcaaaataaattagtgcatgggggcccgtgtgacaaaacctctcacccatatcaagctgccctatacaccagcgggcatctattatgtggcggtgtactgatacaccctctgtgggtcctgactgcggcacactgcaaaaaacctgtcatcttgggggtgaggtggtacgtggagacaacctccgaggccttatgtcacggcgtgacctctcccgtggaccaaaggagatcccaagagtccacaccaacttccgctgacacacggaccggcagcaaaaaaccctttagaccgagcgaccctgatatgtag

SEQ ID NO: 192163 - DNA, 414 bp, Artificial Sequence
  Description of Artificial Sequence: Synthetic coding sequence
atgctgctgcggctggcccggcccgccaagctgagcgagctgatccaacctctgcctctagagagagattgttcagccaataccacatcgtgtcacatcttaggatgggggaaaactgcagatggtgattttccagacactattcagtgcgcctatatccacctggtttccagagaagagtgtgagcacgcttatccaggccaaattacacaaaatatgctctgcgcaggggatgagaaatatggtaaggactcctgtcagggggacagcggaggacctctcgtgtgtggggatcatctccgcggtctggtctcatggggcaatatcccttgcggctcgaaagagaagcccggtgtctacaccaacgtctgccgttatacaaactggattcagaagacaatccaggcgaaatag

SEQ ID NO: 192164 - DNA, 123 bp, Artificial Sequence
  Description of Artificial Sequence: Synthetic coding sequence
atgaagaagctgatggtggtgctgagcctgatcgccgccggcatcttcaggagctcctggggaagcattacttttgggaagggccgggtgccaaggagtcgcgtccttttgtccggcctgtag

SEQ ID NO: 192165 - DNA, 414 bp, Artificial Sequence
  Description of Artificial Sequence: Synthetic coding sequence
atgctgctgcggctggcccggcccgccaagctgagcgagctgatccagccactgcctttagagcgggattgttctgcaaatacaaccagctgccacattctggggtggggtaagaccgccgatggcgattttccggatacgatccagtgcgcatatatccacttagtgtcccgagaagagtgcgagcacgcctaccctggacagattacccagaatatgttgtgtgccggcgacgaaaagtatggtaaggattcatgccagggtgattctggtggcccactggtctgtggagatcaccttagaggtcttgtgtcctgggggaatattccgtgcggctcaaaggaaaaacccggagtctacaccaacgtgtgtagatataccaactggattcagaagacaattcaggccaaatag

SEQ ID NO: 192166 - DNA, 783 bp, Artificial Sequence
  Description of Artificial Sequence: Synthetic coding sequence
atgggccggccccggccccgggccgccaagacctggatgttcctgttgttgttggggggcgcatgggctggacactctcgagcccaggaggacaaggtgctggggggacacgaatgccaaccccactcccagccttggcaggcagctctgttccaggggcagcaactcctctgtgggggtgtgttggtcggcggcaactgggtgctgaccgctgcccattgcaagaagcccaagtatacagttcgtctcggtgatcacagcctgcagaacaaagatggacctgaacaggagattccggtcgtccagtcaattccgcatccttgttacaatagttctgatgtcgaggaccacaaccatgatttgatgttgcttcagctgagggatcaggcatccctgggatctaaggtcaaaccgatttctctggcagaccactgtacccagcctggccagaagtgcacggtgtccggttggggcaccgtgaccagcccacgcgagaacttcccagacaccctgaattgcgctgaagtgaagatctttccgcagaagaaatgtgaagacgcgtaccccggccaaatcaccgacggaatggtttgcgccggaagtagtaagggcgctgacacgtgccagggagacagcggtggccccttagtgtgcgatggcgccttgcagggaatcacttcgtggggctccgacccctgcggtcgaagtgacaaaccgggtgtgtatacaaatatatgtaggtatctggattggattaaaaaaataattggaagtaaggggtag

SEQ ID NO: 192167 - DNA, 99 bp, Artificial Sequence
  Description of Artificial Sequence: Synthetic coding sequence
atgggccggccccggccccgggccgccaagacctggatgttcctgctgctgcttggcggggcatgggctggccgcttctggcgcccccccggagtttag

SEQ ID NO: 192168 - DNA, 360 bp, Artificial Sequence
  Description of Artificial Sequence: Synthetic coding sequence
atgggccggccccggccccgggccgccaagacctggatgttcctgttgttgctcggcggggcctgggccgagaatttccccgacactctcaattgtgcggaggttaaaatcttcccgcaaaaaaaatgcgaggatgcctatcctggccagattactgatggtatggtgtgcgccggaagctctaagggagcggacacctgccagggcgactctggggggccactggtgtgcgacggtgcccttcaaggaatcaccagttggggctctgacccatgcgggcgctccgataagcccggcgtgtataccaatatttgtcgttacctcgattggattaaaaaaatcatcggctctaagggttag

SEQ ID NO: 192169 - DNA, 918 bp, Artificial Sequence
  Description of Artificial Sequence: Synthetic coding sequence
atgggccggccccggccccgggccgccaagacctggatgttcctgctgctccttggaggagcgtgggcagcctgcggttcgctggacctacttaccaaactctacgccgagaatctcccctgcgtccacttaaacccacagtggccgagccagccctctcactgccccagaggctggcgatctaacccactgccccccgcagcagggcacagtcgggcacaggaagataaggtgctgggggggcacgaatgtcagccacacagccagccatggcaagccgcactattccaaggccagcaactattatgcgggggggttctggtaggtgggaattgggttctgaccgccgctcattgtaaaaaaccaaaatacactgtgcggttaggagatcactccctccagaataaagatggcccagagcaagagatacccgtggttcaaagcattcctcacccatgttacaatagctctgatgtggaagaccacaaccatgacctcatgctcctccagctcagagatcaggcatcgcttggatctaaggtcaaaccaatctctctggccgatcactgtactcagccaggtcagaaatgtactgtgtcagggtggggaactgtaacaagcccacgtgagaatttccccgacactctcaactgcgcagaagtgaagatcttccctcagaagaagtgtgaggatgcttaccccgggcaaatcacagatggtatggtctgcgctggcagttctaaaggagccgacacctgccaaggtgactcagggggacccttagtgtgtgacggagctctccagggaatcacgagttggggcagcgacccatgtggcaggagcgacaaaccaggtgtgtatacaaacatttgtagatacctagactggatcaaaaagattatcggaagcaagggctag

SEQ ID NO: 192170 - DNA, 783 bp, Artificial Sequence
  Description of Artificial Sequence: Synthetic coding sequence
atgggccggccccggccccgggccgccaagacctggatgttcctgttattgcttggcggggcgtgggccggccatagtagagcacaagaagacaaggttttgggcgggcacgaatgtcaaccacatagccagccctggcaagcggccctcttccagggccagcagttattatgtggcggcgtgctagttggaggcaattgggttctcactgccgcccattgtaagaagccgaagtacactgttaggctgggggaccatagcttgcagaacaaagacggccccgagcaggagattcctgtcgtgcagtctatccctcacccttgctataactcctctgacgtagaggaccataaccatgatctcatgctgttacagctgagggatcaggcaagtttgggttccaaggtgaagccaattagcctcgccgaccactgcacccagcctggacagaaatgcaccgtgtctggatggggcacagtgactagtcctagagaaaatttccccgacacgctgaactgcgcagaggtgaagatttttccacagaaaaagtgtgaagatgcataccccggtcagattaccgacggcatggtgtgcgctggcagttctaaaggtgccgacacctgtcaaggagacagtggggggccattagtttgcgatggagcactgcaggggattactagttggggaagcgacccctgcggtcgatctgataaacccggggtgtataccaatatatgccgatacttggactggatcaagaagattatcggatctaagggctag

SEQ ID NO: 192171 - DNA, 753 bp, Artificial Sequence
  Description of Artificial Sequence: Synthetic coding sequence
atgaagctgggcctgctgtgcgccctgctgagcctgctggccggccacggctgggctgacacgagagccatcggcgccgaggaatgccgcccgaactctcaaccatggcaggctggcctctttcacctgacccgcttattctgcggagccaccttgatatctgaccgctggttattgaccgccgctcactgccggaagccgtatttgtgggtcagacttggcgagcaccacttgtggaaatgggaaggcccggagcaactgttccgtgtgacagacttctttccccacccaggtttcaacaaagaccttagcgctaatgaccacaacgatgatattatgttaatacgtctccctcggcaggcaaggctgtcacccgccgttcagccactaaacctaagtcaaacctgtgttagcccaggaatgcagtgcctgatctccgggtggggggccgttagctcccctaaggccttgttcccagttacgctgcaatgtgctaatatctccatcttagagaacaaattgtgtcattgggcctacccgggccatatatccgattctatgctctgtgcagggctctgggagggtggcaggggatcctgccagggtgattcgggcggcccattggtgtgcaatggaacgctagccggcgtggtgagcggcggagctgaaccctgttctcggcctcggcgccccgcggtttacacttccgtttgtcactacctggactggatacaagaaattatggaaaattag

SEQ ID NO: 192172 - DNA, 753 bp, Artificial Sequence
  Description of Artificial Sequence: Synthetic coding sequence
atgaagctgggcctgctgtgcgccctgctgagcctgctggccggccacggttgggctgacaccagggcaatcggcgcggaggagtgccgccccaacagccagccctggcaggctggtctgtttcatcttactcgattgttttgcggcgccaccctgatctctgaccggtggctgcttaccgctgctcattgccggaagccgtatctttgggtacggttgggggagcatcacctatggaaatgggaaggtcccgagcagcttttccgggtgaccgacttctttcctcacccggggtttaacaaagaccttagcgctaacgaccacaacgatgacatcatgttgattcgccttccccgccaggccagattgtccccagctgtgcaacccttgaacctgtcccagacctgtgttagccctggtatgcagtgtctcattagcggctggggcgcagtatcatctccaaaagctctgttccccgttactctgcagtgcgcgaacatctcaatcctcgagaacaagctgtgtcactgggcatatcccgggcacatctcagactcaatgttgtgcgcagggctgtgggagggcggcagaggttcgtgccagggcgattctggcggtcccctagtgtgcaacggtactcttgccggtgtggtgagcggtggggctgagccttgtagccgcccccgccgcccagcagtttatacaagtgtctgtcattacctggactggatccaggagataatggaaaattag

SEQ ID NO: 192173 - DNA, 186 bp, Artificial Sequence
  Description of Artificial Sequence: Synthetic coding sequence
atgaagctgggcctgctgtgcgccctgctgagcctgctggccggcatttgcggatccgcacttgaaagtaccaccagtggtaacgggagagtgcggtcaagctgttctggcttgcgcacttccagccccactttggcaagtactagaacatcagctccaatgacaaccatgatgacgagctgttag

SEQ ID NO: 192174 - DNA, 2043 bp, Artificial Sequence
  Description of Artificial Sequence: Synthetic coding sequence
atggtgcccggcgtgcccggcgccgtgctgaccctgtgcctgtggcttgccgcaagcagtggctgcctggcggcaggacctggcgccgccgctgcgcgcagactggacgagagcctgtctgctggttcagttcaaagagctcggtgtgccagccgttgtttatctttacagattacacgtatatctgcattcttccagcacttccaaaataatggtagcctggtgtggtgtcaaaatcacaaacagtgctccaagtgcctggagccatgcaaggagtccggcgatcttcgtaaacatcaatgccagtccttttgtgaacctctgtttcccaagaaaagttacgagtgtcttacctcatgcgaattccttaagtatattttactggtgaaacaaggcgactgtcccgcacccgagaaagcatctggctttgccgctgcttgtgtcgaatcatgtgaggtcgataatgaatgttcgggcgtgaagaagtgttgtagtaacggctgtggacacacgtgtcaggtgcccaagactctatacaagggcgtgcccttgaaaccccggaaggaactccggtttaccgaactacagtccggtcaattggaggtcaagtggagctcgaagtttaacatttctatcgaacctgtgatttacgtagtccagagacgctggaactacggaattcaccccagcgaggatgatgcaactcactggcagacggttgcgcaaacgactgatgagcgcgttcagctgactgacatccgcccctctcggtggtaccagtttagggtggccgctgtgaatgtccacgggacccggggcttcactgccccatctaagcattttcgttcaagcaaagatcccagcgccccacctgcacccgcaaatctgcggctggcaaattccacggtgaattcagatggttctgtaactgtcaccatagtctgggatctcccggaggagccagacatccctgtgcaccattataaggtgttttggagctggatggtctcttcaaaatcactagtgcctacgaaaaaaaagcggcggaagactactgatggatttcagaactccgtgattctcgaaaaacttcagcccgactgcgactatgtcgtcgaacttcaggctattacgtattggggccagaccagactcaagtccgctaaggtctcactgcactttacgtcgacccacgccaccaataataaagagcagcttgttaagacgagaaagggagggatccagactcaactgccttttcagagaagaaggcctaccagacccctcgaggtaggagctcccttttaccaggatggccaacttcaagtgaaggtctactggaaaaagactgaagatccaaccgtgaatcgatatcatgttagatggtttcccgaagcctgcgcccacaaccgaactacaggtagtgaggcttcctccgggatgacccacgaaaattacattattttacaggacttatccttttcatgtaaatataaagttaccgtgcagcctatccggcctaagagccattccaaggcggaagctgtgttctttacaacccctccatgcagtgcccttaagggcaagtcccacaagcccgtggggtgtctgggagaagctggtcatgtcctttctaaagtgctagctaagcccgaaaacctctccgcaagtttcatcgtgcaagatgtgaacatcacaggtcacttctcctggaagatggcgaaggccaacttgtaccagccaatgacagggtttcaagtcacatgggctgaagtaaccacagaatctcgtcagaatagcctgccaaactccattataagccagagccaaatcctgccgagtgatcattacgtcctaaccgtgccaaatctgagaccgtcgaccctatatcggctggaggtgcaggtcttgacaccaggcggggaggggcctgccaccatcaagacattcaggaccccagagctgccacctagttccgcccaccggagccacctgaaacacaggcatccccatcactataagcccagtcctgagcgctattag

SEQ ID NO: 192175 - DNA, 2631 bp, Artificial Sequence
  Description of Artificial Sequence: Synthetic coding sequence
atggagctgatcaccatcctggagaagaccgtgagccccgaccggcttgaactcgaggcagcccagaaattcctggaacgcgccgctgtggagaacttacctacctttctggtcgagctcagtagagtacttgccaatcctggcaattcacaagtggctcgtgtagctgcaggcctgcagatcaagaactctctgacgtccaaagatcccgatatcaaggcccagtaccagcagagatggctcgccattgacgccaacgcccgaagggaagtcaagaattatgtgctgcagacactcggcactgagacttacagaccatccagcgcttcccagtgcgtagcagggatcgcatgtgctgagattccagtgaaccaatggccagagctaattcctcagctggtggccaacgtcactaatcctaatagcacagaacacatgaaggagtcaactctggaagctattgggtatatttgccaggatatcgatcctgaacagctccaggacaagtctaacgaaatcctgacagccatcatccaggggatgcgtaaagaagaacccagcaataatgtcaaactggcagcaacgaacgccctgcttaactccctggaattcacgaaggccaatttcgacaaagagtcagagcggcacttcattatgcaggtggtgtgcgaggccacacagtgccctgacacccgcgtaagggtggccgctctccagaacctggtcaagataatgtccctgtattaccagtatatggagacatatatgggccctgccttgtttgccataacaatcgaggccatgaagagcgacatcgacgaagtcgccctgcagggaattgagttctggtcaaatgtatgtgatgaggaaatggacttggccatcgaggcttctgaagcagccgaacaaggccgtccaccagagcacacatccaagttttatgctaagggggccctgcagtatctggtgcctatcctgactcaaactctgacgaaacaagatgaaaacgatgatgatgacgattggaacccttgtaaagccgccggggtgtgcttgatgcttttggccacatgttgtgaggatgatattgtaccgcacgttctgccttttattaaggagcatattaaaaaccctgattggcgttatcgtgacgccgccgtgatggccttcggctgtatactggaaggtccagagcctagtcaactcaaacctctcgttatacaggcgatgccaacccttatcgaactgatgaaagatccgtccgtggtggtccgagacacagcagcatggaccgtgggccgcatctgcgagcttctgcctgaggccgctatcaacgatgtctatctcgccccactgctgcagtgcctgatcgagggactaagtgccgaaccccgagtcgcaagtaatgtgtgttgggctttttcatctctggctgaagctgcctatgaggccgccgatgtagccgacgaccaagaggagcccgctacatactgtttaagctcctcctttgaactgattgtgcaaaagctcctggagaccaccgaccgccctgacggacaccaaaacaatttaaggtcctctgcctatgagtccctcatggaaattgtgaaaaattccgcaaaggactgctatccggctgtgcagaaaactaccctggtcatcatggagaggcttcaacaagttctgcagatggagagtcacatccagtctacttccgacaggattcagttcaatgacctacagtcgctactgtgtgcaaccctgcaaaatgtgcttcgaaaagtacagcaccaggacgcattacaaatcagcgatgtagttatggccagcttgctgagaatgttccagtcaactgcaggctctgggggagtccaagaagacgccctaatggcagtgagtaccctagtggaggtgctaggtggggaattccttaaatacatggaagccttcaaaccgtttcttggcatcggcctgaaaaattatgctgaataccaggtgtgccttgctgcagtcggtctggtcggagacttgtgtagggccttgcagtccaatataatccccttctgcgatgaagtcatgcagctgctgctagaaaatctgggcaatgaaaacgtgcatcgctccgtcaaaccacaaattctttccgtattcggtgatattgccctcgcaattgggggggaattcaagaagtatctggaggtagttctcaacacactgcagcaagcctcacaggcccaggttgacaagtctgattatgacatggtggactatctgaacgagctccgtgaatcatgtcttgaggcatatactgggatcgtgcagggcctgaaaggcgatcaggagaacgttcacccagacgtgatgctggtgcaacctagagtagaattcatcctaagtttcatcgaccacatcgcaggagacgaggaccacaccgacggggtcgtggcatgtgccgccggattgatcggcgacctgtgcactgcctttggtaaagacgtgttgaagttggtcgaggctcggccaatgatccacgagctcttgacagaaggtaggagaagtaaaaccaacaaggccaaaaccctagctacctgggccaccaaggagctgcgcaaactgaagaatcaggcatag

SEQ ID NO: 192176 - DNA, 2196 bp, Artificial Sequence
  Description of Artificial Sequence: Synthetic coding sequence
atgaaggagagcaccctggaggccatcggctacatctgccaggacatagaccctgagcagcttcaagacaagtctaatgagattcttaccgcaatcattcagggcatgaggaaggaggaacctagtaataacgtcaaactggcagccactaacgctctgctgaatagcctggagttcaccaaggcgaatttcgataaggagtctgagaggcacttcataatgcaggtggtgtgcgaggcgacccaatgcccagatacccgcgtgagagttgccgcactgcagaacctggtgaaaattatgtctttgtactatcaatacatggaaacttatatgggtcctgccctgtttgcgatcaccatcgaggcaatgaaatcagatattgatgaggtggctcttcagggaatcgagttttggtctaacgtctgcgacgaggaaatggatctggccattgaagcgagcgaggcagcggagcaggggagacctcctgaacatacgagcaagttctacgccaaaggggcgctgcagtacctcgtgcccatcctcactcaaactctcaccaaacaagacgaaaatgatgatgacgacgactggaatccttgcaaggctgctggggtgtgtctgatgctgctggccacatgttgcgaggacgacatcgtgccacatgtgctccccttcataaaggagcatattaaaaacccagactggcggtacagggacgccgcagtgatggcttttggttgtatcctggaaggtcccgagccaagccagctgaagccactcgtcattcaagcgatgccgaccctgatcgagttgatgaaagatccctcggtagtagtgagggacacagcagcttggacagtgggtcgcatctgcgaacttctgcccgaagctgcaattaatgacgtatatctggctccactgttgcagtgcttaattgagggcctgagcgccgaaccaagggtggcttcaaatgtctgttgggccttcagttccctggcagaagctgcgtacgaggccgccgacgttgctgatgatcaggaggagcccgccacatactgtctctcaagtagctttgaattgattgtgcagaaactgctggagaccacagaccgcccagatggccatcagaataatctcagatccagcgcttacgaaagcctgatggagatcgtgaaaaatagcgccaaagactgctatccagccgtgcagaagacaacgctggtgatcatggaacgcctccagcaggtcctacagatggagtctcacattcagagcacttccgatagaatccagttcaacgacctccagtccctgctatgcgctactttgcagaacgtgctgagaaaggtccagcaccaggatgcccttcaaatctctgacgttgtgatggcctcccttctgagaatgttccagagcaccgctggcagtggaggggtgcaggaggacgctcttatggcggtaagcaccctggttgaggtattgggaggggagttcctcaaatacatggaggccttcaagccctttctggggattggactcaaaaattatgcagagtaccaggtttgtcttgcagcagttgggctcgttggggacctatgtcgagccctgcagtccaatatcatcccgttttgcgacgaagtgatgcaattgctgctagagaatctcggaaacgagaatgtgcatcggagtgtgaaaccccagatcctgtcagtatttggagacatcgcgttggccataggaggcgagtttaaaaagtatctggaggttgtcctgaacacgttgcagcaagcttcacaggcccaggtggataagtccgattacgacatggttgactatctgaacgaactcagggagtcctgcctggaagcctacacgggtatcgtgcaggggctgaagggcgatcaggagaacgtgcacccagacgtgatgctggtgcagccgcgagtggaattcatcctgagttttattgaccacattgctggtgatgaggatcacacagatggagtcgtggcttgtgccgctggccttatcggcgacttgtgtaccgccttcggcaaggacgttttaaaacttgtggaggcccgcccgatgatccatgaacttctcaccgaaggccgcaggagtaaaacaaacaaggccaaaaccctcgccacctgggccaccaaagagctacggaagctgaagaaccaggcatag

SEQ ID NO: 192177 - DNA, 1983 bp, Artificial Sequence
  Description of Artificial Sequence: Synthetic coding sequence
atgaaggagagcaccctggaggccatcggctacatctgccaggacatcgacccagaacagttacaggataaatcaaacgagattttgaccgcgatcattcaagggatgcggaaagaagagccttctaacaatgtgaagctggctgctaccaatgccctcctgaattccctcgagttcaccaaggctaattttgataaggaatccgaaaggcatttcattatgcaagtggtgtgcgaggcaacccaatgccctgacacaagagtgcgggtggccgccttacagaacctagtgaaaatcatgagcctatactaccagtacatggagacatacatggggcccgcactgttcgccgatgagaacgatgatgatgatgactggaatccttgcaaggccgctggtgtgtgcctgatgttgctggcaacgtgttgcgaggatgatatcgtgccccatgtgttaccttttatcaaagaacacatcaaaaatcccgactggcgataccgggatgctgcagtaatggcattcggctgcatcctagaaggaccggaaccctcccaactgaagcctttagttattcaagccatgccaactttgattgagctcatgaaggaccctagcgtggtggtgagggatacagcggcatggacggtgggtaggatttgcgaattgcttcccgaggccgcaatcaacgacgtgtatctggccccactcttgcagtgcctcatcgagggtctgtcagctgaaccaagagtagcgtccaacgtgtgctgggcattcagcagtttagccgaggctgcatatgaagccgctgacgtggccgatgaccaagaggagccagctacctattgtctctcaagttcatttgagctgattgtgcagaagttgctggagaccaccgaccgccctgatggccatcagaacaatctgaggtctagtgcctacgagagcctcatggagatcgtcaagaatagcgccaaagactgctatcccgctgtgcaaaagacaactctggtgatcatggagcggctgcagcaagtcctacagatggaatcacatattcagagcaccagcgacaggatacagtttaatgacttgcaaagcttgctgtgtgcaacactgcagaacgtactgcgaaaggtgcagcaccaagacgctttgcagatcagcgatgttgtgatggctagtctgcttaggatgttccagagcacagctgggtcagggggtgtccaagaagacgcgttgatggcagtgagcactctcgttgaagtacttgggggggagtttctcaaatatatggaagcctttaaacccttcctgggcattggcctgaagaattacgcagaataccaggtctgcctggccgcggtgggtctagtcggggacctgtgccgagcactgcaatcaaacataatccctttctgtgatgaggtgatgcagttgctgctggaaaatctcggcaacgaaaacgtgcaccgctctgtgaagccacagattttatctgtgtttggcgacattgcgcttgcaatcggcggcgagtttaagaaatacttagaagtggtcctgaacactctgcagcaggcgtctcaggctcaggtggacaaaagcgactacgatatggtcgactatctgaacgagctccgggagtcctgccttgaagcttacactgggatcgtccagggtttaaagggtgatcaggagaacgttcaccccgatgtcatgcttgtgcagccccgggtggaattcatcctttcctttattgatcacatcgcaggggacgaggaccatactgacggggtcgtggcctgcgcagctggactcatcggcgacctttgcacggcctttggaaaggatgtgttgaaattggtggaagctcgcccaatgatacacgagcttttgacagaaggacggagaagtaagaccaataaagccaagacactcgccacttgggctaccaaagagctacgaaagctgaaaaaccaagcctag

SEQ ID NO: 192178 - DNA, 2196 bp, Artificial Sequence
  Description of Artificial Sequence: Synthetic coding sequence
atgaaggagagcaccctggaggccatcggctacatctgccaggacatcgacccagaacaattgcaggataaatcaaacgagatcctcacagccataattcagggtatgaggaaagaggagccctcaaataatgttaagctcgctgcaactaatgccctgctgaattcccttgaattcacaaaagcaaattttgacaaggagagcgagcgtcattttatcatgcaagtggtttgcgaagccacccaatgtccagatactcgggtgcgcgtggcagccctgcagaatctggtgaagataatgagcctgtattaccaatacatggagacctacatgggtccggccctatttgcaataactattgaagccatgaagagcgacatcgatgaggtggctctgcagggcatcgagttctggtctaacgtatgcgatgaggaaatggatctcgccatagaagcttcagaggctgccgagcaaggccgacctcccgagcacacaagtaagttttatgccaaaggcgcactccaatacctggtacccatactcacgcagacgctgacaaagcaggacgagaatgatgacgacgacgattggaacccttgcaaggcagcgggcgtttgtttgatgctgctcgcgacttgttgcgaggatgatatcgtgccccacgtgttgccttttataaaggaacacattaagaaccctgattggcggtaccgtgacgctgccgtaatggctttcgggtgtatcttagagggaccagagcccagccagctcaagccactcgttatccaggcaatgccaactctaatcgaactgatgaaggacccatccgttgtggttagggatactgccgcctggacggtaggccgtatctgcgagctgcttcctgaggcagccataaacgatgtctatttggctccactactgcagtgccttatcgaaggcctgtccgcagaaccacgtgtagccagcaatgtgtgctgggccttctcttctcttgctgaggcagcttacgaagcggccgacgtcgccgacgaccaggaagaacccgctacatattgcctgtcaagctctttcgagttgattgttcagaaactgctcgagactacagatcgcccggacggtcatcaaaataatctgaggtcgagtgcatatgaaagcctaatggaaatcgtgaagaactcagccaaagattgctaccctgctgttcagaagacgaccctggtgattatggaaaggctgcagcaagttctgcagatggaatcacatatccagtccacatctgaccggatccagtttaacgatttgcaatcactcctctgtgccacgctgcagaatgtgctacggaaagtccaacatcaagatgcactgcagatctcagatgtggtgatggcgtcgctactgagaatgttccaaagtaccgccgggtccgggggcgtgcaggaggacgccttgatggccgtaagcacactggtggaagtgctagggggtgagttcctaaaatatatggaggcttttaagccattcttggggattggattgaagaattatgcggaataccaagtatgtctggccgcagtgggcctggtgggcgatctttgtagggctcttcagagcaatatcatcccattctgcgatgaagtaatgcaattgctcctcgagaacctgggcaatgaaaacgttcatagaagcgtcaaaccacagattctcagcgtttttggggacatcgccctggccatcgggggagaatttaaaaagtacctggaagtggtgctgaatacactccagcaagcttcacaggcacaggttgacaagtctgattatgatatggtcgattatctgaacgagctgcgagaaagttgtttggaggcctacaccggaatcgtgcaagggctcaaaggagatcaggaaaacgttcatcccgacgtgatgctggtgcaaccacgcgttgaatttattctgagttttatcgatcatattgctggcgacgaggatcacacggacggtgtcgtcgcctgtgctgctggtctcatcggagacttatgtaccgccttcgggaaggatgtgctcaagctggttgaagctcgaccgatgatccatgagttactgacagaggggagaagatctaagacgaataaagccaaaaccctggccacctgggccactaaggagttaaggaagctaaagaaccaagcatag

SEQ ID NO: 192179 - DNA, 1617 bp, Artificial Sequence
  Description of Artificial Sequence: Synthetic coding sequence
atgaccacccccggcaaggagaacttccggctgaagagctacaagaacaaatcacttaacccagacgaaatgagaaggcggcgggaggaagaaggactccagctgcggaagcagaagcgagaagagcagttatttaagaggagaaatgtggctactgccgaggaagagaccgaggaggaggtaatgtctgatggaggatttcatgaggctcagatctctaatatggaaatggcacccggaggggtaatcacctctgacatgattgagatgatcttctcaaagagcccagagcagcagctgagcgctactcagaaattcaggaaactgctgtccaaagagcctaacccacctattgacgaggtcatatccacacctggtgtggtggcacggttcgtagagtttctgaaacgcaaggaaaactgcacactgcaattcgagtccgcctgggtgctgactaacattgccagtggcaattcactccaaactcgcatcgtaattcaggcaggcgcagtacccatctttattgaactcctgtcctctgaattcgaagacgtgcaggaacaggctgtgtgggctctgggtaatatcgctggagacagcaccatgtgtagggattatgtgctggattgtaatatcctgccacccctcctccagctgtttagcaagcagaacaggctaacgatgacgcgtaacgccgtctgggctttatcaaacctgtgtaggggtaagagcccgcccccggagtttgccaaggtttccccttgtctcaacgttctaagctggctcctgttcgtgtctgacacggacgtcctggccgatgcatgctgggccctgtcctacctgtccgacgggcccaacgataagattcaagctgtgattgacgccggtgtgtgccgcagactcgtggaattgctcatgcacaacgactataaggtggtgtctcctgctttgagggccgtgggaaacatcgtgacaggcgacgacatccagactcaggtgattctcaactgtagcgctctccagagccttcttcacctgctgtcctctccaaaagagtccataaaaaaagaagcttgttggactattagtaacataacagcagggaaccgtgcccagatacagaccgtgatagatgccaacatctttccagctttgatctccatacttcagacggccgaatttcgaaccaggaaagaagccgcctgggcgatcacgaacgctacttccggcggtagcgccgaacagataaaatacctcgtggagctggggtgcattaagcctctttgcgatctccttaccgtgatggacagcaagatcgtgcaagtggctctgaatggactcgagaacatcctgcggctaggcgaacaggaagccaagcgcaacggtacaggcatcaatccttattgcgcactgatagaggaagcttacggcctggataaaattgagtttctgcagtcacatgaaaaccaggaaatctatcagaaggcttttgatctcattgaacactactttggcaccgaggatgaagacagttctatagccccacaggtagatctcaatcaacaacagtacatattccagcaatgcgaggcccccatggagggcttccagttgtag

SEQ ID NO: 192180 - DNA, 987 bp, Artificial Sequence
  Description of Artificial Sequence: Synthetic coding sequence
atgaccacccccggcaaggagaacttccggctgaagagctacaagaataagtctctgaaccccgacgagatgagaaggcgccgagaagaagaggggctgcagttaaggaaacagaaacgagaggagcagctgtttaagagaagaaacgtggcaaccgcggaagaggagactgaggaagaggtgatgagcgacggaggcttccacgaagcgcagattagcaatatggaaatggcgccagggggcgtgattacttctgacatgatagaaatgattttttctaaatcccccgagcagcagctgagtgcaactcagaagtttaggaaattgttgagcaaggagcctaacccccccatagacgaagtgatcagtacccctggggtcgtcgcccgatttgtggagttccttaaaagaaaagaaaattgcacactacagttcgagtctgcctgggtgctgacaaacatcgcttcgggcaactcattgcaaactaggatagttattcaggccggcgcggttccgattttcatcgagttgctctcatccgagttcgaggacgttcaagaacaagcagtttgggccctgggtaacatcgccggggactctactatgtgccgtgattatgtcctggactgcaacatacttccccccctcttacaacttttttctaaacaaaacagacttactatgactcgtaacgcggtgtgggccctctctaacctgtgtcggggaaaatctccaccaccagagtttgcaaaggtatccccatgccttaacgttctaagctggttgttgtttgtatcagacacagacgtgctggccgatgcctgttgggctttgagctaccttagtgacggtccgaacgacaaaattcaggcagtgatagacgcgggggtttgccgaagactggtggaactcctgatgcataatgactacaaggtcgtgtcccccgctctacgtgccgtcggtaatattgtgactggggacgattag

SEQ ID NO: 192181 - DNA, 648 bp, Artificial Sequence
  Description of Artificial Sequence: Synthetic coding sequence
atgaccacccccggcaaggagaacttccggctgaagagctacaagaacaaatctctcaatcctgacgaaatgagaagaaggagagaagaggagggtctacagttgcgaaaacaaaagcgggaggaacaattgttcaagcgacggaacgtagctactgctgaggaggaaaccgaagaggaggtgatgtcagatgggggcttccacgaagctcagatatccaacatggagatggcccctggaggcgtaatcacttctgacatgatcgagatgatattttccaagtcccctgagcagcaattgagcgcgacacagaagtttaggaaattactctccaaggagcctaacccccctattgacgaagtcatctcaactccaggagttgtggctcggttcgtggagtttcttaaacgcaaggagaattgtaccctgcaatttgaatcggcctgggttctcaccaatatcgcttcagggaatagtctgcagacgaggatcgtcatccaggcaggggcagttcccatctttatagagcttctgtcttcagaattcgaggacgtgcaagaacaggccgtctgggctttgggcaatatagccggcgattccacgatgtgcagggattatgtgctggattgtaatatcttgcccccttag

SEQ ID NO: 192182 - DNA, 525 bp, Artificial Sequence
  Description of Artificial Sequence: Synthetic coding sequence
atgaccacccccggcaaggagaacttccggctgaagagctacaagaataagtcacttaatccggacgaaatgcgacggcggagagaagaggaaggtctccagctacgcaagcagaagagggaagagcaacttttcaagcgacgaaatgtggccacagcagaggaggagaccgaagaggaagtaatgtcggacggaggctttcatgaggctcagatttccaacatggagatggccccgggaggcgtgataacttcagacatgattgagatgattttcagcaagtccccagaacagcagctgagcgcgacccagaaatttaggaaattgctctctaaagagcctaacccacctattgatgaggttatttccactcccggggtggtagccagatttgtggaatttctgaagaggaaggagaattgtactctgcagtttgaatccgcttgggtcttgaccaacatagccagcggcaactctctccagacacgcatcgtgatacaggccggggcagtccccattttttag

SEQ ID NO: 192183 - DNA, 1566 bp, Artificial Sequence
  Description of Artificial Sequence: Synthetic coding sequence
atggccgagaaccccagcctggagaaccaccggatcaagagcttcaagaataagggcagggacgtggagaccatgaggcgtcacagaaatgaggttaccgtggaactcagaaaaaacaagcgtgacgaacacctgcttaaaaaacgtaatgtgccccaagaggaatccttggaggacagcgatgtggacgcagactttaaagcccagaacgtgactctggaagcaatattacaaaatgcaacttccgataatccagtagttcagctttccgccgtgcaggccgcaagaaagctgctgtcaagcgataggaatccacccattgacgatctgatcaaatccggaatcctgccaatcctggttaagtgcctggaacgtgatgataaccccagcctacagttcgaagccgcctgggcgttaaccaacatcgcctctggcaccagcgctcaaacgcaagccgtggtccaaagcaacgccgtaccgctgtttttgcgcctactccggtcccctcatcagaatgtttgtgaacaggcggtctgggcactaggaaatattataggtgatggcccccagtgtcgggattatgtcataagcctgggcgtggtgaaacccttgttgagttttatcagcccttcaatccccatcacatttcttaggaacgtaacttgggtcatcgtcaatctatgtaggaataaagaccccccgcccccaatggaaaccgtccaggaaatccttcctgcactgtgcgtgctcatctatcacacagacatcaatattttagtcgacacggtatgggccttgagctatctgacagatggtggaaacgagcaaatccagatggtgatcgacagtggggtggtgccttttttggtgcccctcctgtcacatcaggaggtaaaggttcaaaccgccgcactccgcgcggtcggtaacatcgtaacggggaccgatgagcagacacaggtggtgctgaattgcgatgtgctgtctcacttccccaatctcctgagtcacccaaaagagaagatcaacaaggaagcggtatggttcctgtcaaatatcacagccggcaatcagcagcaggtgcaggccgtgatcgatgcaggcctgatcccgatgatcatacatcaactcgcgaagggcgacttcggcacgcagaaggaggctgcctgggcaatcagcaaccttacaatctcaggacgcaaagaccaggttgagtatttggtccagcaaaacgtcatccctcctttttgtaacctactctccgtgaaggatagccaggtggtacaggtagttctggatggtttaaagaatatcctgatcatggccggcgacgaagcatccacaattgcggaaataatcgaggagtgcggcggactggaaaagatcgaggtgctgcagcaacatgaaaacgaggacatctacaagctggcctttgaaatcatcgaccaatattttagtggcgatgatattgatgaagatccgtgcctcatccccgaggccactcaaggtggcacatacaactttgacccaactgccaaccttcagaccaaggagttcaacttctag

SEQ ID NO: 192184 - DNA, 1566 bp, Artificial Sequence
  Description of Artificial Sequence: Synthetic coding sequence
atggccgacaacgagaagctggacaaccagcggctgaagaacttcaagaataagggacgggacctcgagacgatgaggagacagcgcaacgaggttgttgtggagctgcgtaaaaacaagagggatgagcatctgctgaagagaaggaatgtaccacatgaggatatatgcgaggactccgacattgacggcgactaccgggttcaaaataccagtctggaggcaatagttcaaaatgccagcagtgacaaccagggcatccagctctccgccgtgcaggcagccagaaagttgctgtcctccgataggaaccctcctatagatgacctgattaaaagcggtattcttcctatactcgtgcattgcctggaaagagatgacaatccaagcttacaatttgaagccgcttgggccctcaccaacatcgccagcggtactagcgagcagactcaagccgtcgtacagagcaacgcggtaccccttttcctcagactgctgcactccccacaccagaacgtgtgtgaacaggctgtatgggcattgggcaatatcatcggcgatgggccacagtgtagggattacgtgatcagcctgggagtggtgaaacctctcctgtctttcatttccccctctattcctataaccttcctgagaaatgtgacctgggtgatggttaatctgtgccggcacaaagacccgccaccaccaatggagacgattcaggagatcctcccagcactctgcgtcttgatacaccataccgatgttaacatcctggttgatactgtttgggccttgtcctatctgaccgacgctggcaacgagcagatccagatggtaatcgattccggcattgtaccccacctggtgcctctgctttctcaccaggaagtgaaagttcagactgccgctttacgggccgtgggaaacattgttactggcaccgatgaacagactcaggtggtcctaaattgcgatgccctatcccactttccggccctgctcacccatccgaaagaaaagatcaataaggaagctgtctggttcctgagtaatatcacagcaggtaatcaacagcaagtgcaggccgtgattgatgccaatctggttcccatgatcatccacctgctggacaagggggacttcggaacgcagaaagaagccgcctgggccatttccaatctgacaatctctggccgcaaggaccaagtggcttatctgattcagcagaacgtgatacctccattctgcaatttgttaaccgtcaaagatgcgcaagtcgttcaggtggttctggatggcctctcaaatatcttgaagatggctgaggatgaagctgagaccattggtaatctcattgaggagtgcgggggcctcgaaaagattgagcagctgcaaaaccacgagaacgaagatatctataaactagcatacgagatcatcgaccaattcttctcaagcgatgacattgacgaggacccatctctggtccccgaggctatacaggggggcacattcggattcaatagttctgctaatgtccctactgagggattccaattttag

SEQ ID NO: 192185 - DNA, 1551 bp, Artificial Sequence
  Description of Artificial Sequence: Synthetic coding sequence
atgcccaccctggacgcccccgaggagcggcggcggaagttcaagtatagagggaaagatgtctcactgaggagacaacagcggatggccgtctcactggagctcaggaaggccaagaaagacgagcagactctcaagaggcgtaatattacaagcttttgcccagatacaccatctgagaaaactgccaagggggttgctgtttctctcacacttggcgagataattaaaggggttaacagcagcgatcccgtgttatgtttccaggcgacccaaaccgcccgcaagatgctgtcacaggagaaaaatccccccctgaaactcgtgattgaggctggacttattccaaggatggtagagtttctgaagtcttctctatatccttgcttgcagttcgaagccgcctgggccctcaccaatatcgcctccggcaccagcgagcagacacgcgccgtggtggaagggggtgccatccagccacttattgagttgctgtccagctcaaacgtggccgtgtgcgagcaggctgtatgggccctcggcaatatagcaggcgacggaccggaattccgggacaacgttatcacgtcaaacgctatacctcatttgttggctctaatctccccgaccctaccaatcacctttctcaggaacattacgtggaccttgtcaaatttgtgtagaaataaaaatccatatccgtgtgacaccgccgtgaagcagatcctgcctgcactgctgcatctacttcagcaccaagatagtgaggttctaagtgacgcttgctgggctctgtcatatctgaccgacggcagcaacaaacggatcggacaggtggttaacacaggcgtccttccccggctggttgttcttatgacctcaagcgaactcaacgttctcacgccttccctgcggacagttggtaacatcgtcactgggacagacgaacagacccagatggcaatagacgccggaatgttaaacgtgctgccccaactccttcagcacaataaacccagcatccagaaagaagccgcgtgggctctctctaacgtagcggcaggaccttgccaccacatacagcaattgctggcctacgacgtcttacctcctcttgtcgcattgctgaaaaatggcgaattcaaggtccagaaagaggccgtgtggatggtggcaaactttgccactggcgcaacaatggaccagctgatccagcttgtccactccggggtgcttgaaccgttggtgaacctcctaaccgcacctgacgtaaaaatcgtgctgataattctggatgtcatctcttgtatcctgcaggcagctgagaagcgcagtgaaaaagagaatttgtgtctgctgattgaagaactgggtggcattgataggatcgaggcactgcagctgcatgagaatcggcagatcggacagagcgcactgaatatcatcgagaaacatttcggggaggaggaggacgagtcccaaacactgctaagccaggtcatcgaccaagactatgagtttatcgattatgagtgcttggcaaagaaatag

SEQ ID NO: 192186 - DNA, 3318 bp, Artificial Sequence
  Description of Artificial Sequence: Synthetic coding sequence
atggccgccatggcccccgccctgaccgacgccgccgccgaggcccaccatatcaggttcaagttggctcctccttcctccaccctgtcacccggatccgccgaaaacaatggtaacgcgaatatccttattgccgctaacggcacaaagaggaaggccattgctgcagaggaccctagtttggatttccgtaacaaccctaccaaggaggatctgggaaagcttcagcccctcgtggcgtcctacttgtgttccgatgtgacaagtgtgccttctaaagagagtctgaagttacagggtgtgttttccaagcagacagtgctcaagtcccatcccttgctctcacaaagctacgagcttcgagctgagctgctgggtcggcagcctgtgctggagtttagcctggagaacctgcggacaatgaacacctctggccagaccgccctgccccaagcccccgtgaacgggctggccaagaagttaaccaagagctcaacacacagcgatcacgacaattctactagtcttaatggcggaaagcgtgccctgacatcatcagctctgcacggaggcgagatgggcggcagcgagtcaggggatctgaaaggtggaatgacaaactgcacactcccgcacaggtctcttgatgtcgagcacaccacactgtattcaaacaattccaccgccaacaaaagctcagtgaatagtatggaacaacccgccctgcaaggtagttccaggttgtcccccggtaccgactcttcctcaaatctcggaggagtgaagttggagggcaaaaagagtcctctctcctccatcttgttttctgcactggacagcgataccagaattactgcgttgttaaggaggcaagctgatattgagagtagggctcggcggctgcaaaagaggttgcaggtcgtacaagctaagcaagttgagcgtcatatacagcaccagcttggggggttcctggagaagacgctgtcaaagttgcccaatttagaatcgcttcgacctcgctctcagctcatgcttacgagaaaagccgaggccgccctccggaaagctgcttcagagaccacaactagcgaagggctctctaactttttgaaatcaaacagcatctccgaagagctagagcgcttcaccgcttcgggcattgcaaacctccggtgttccgagcaggccttcgactccgacgtgacagactcatcctctggcggggagagtgatatagaggaggaagaacttactagggcggatcccgaacagaggcacgtcccactgcgccgccggtccgagtggaagtgggccgccgaccgcgctgccatcgtctcacgctggaattggcttcaggcacatgtcagcgacttggaataccgcattcgtcagcagactgacatttataagcagatacgtgctaacaagggccttatcgtgctgggcgaggtgcctccccctgagcatactacggacctgttcttgcccttgtcaagtgaagtgaagaccgatcacggtaccgacaaattaattgaatcagtgtcgcagccgctcgagaatcacggcgcacggattattggccatataagcgaaagtctgtcaaccaagagttgtggagctttacggccagtcaatggggttataaacacattgcaacctgtgttagcggatcacattcccggcgattcatcagacgccgaggagcagctgcacaaaaagcagcgcctaaacctggtgtcaagctcttccgacggaacctgtgtggcagccagaacgcggccagttttgtcatgcaagaaaaggcgcctagtacggccaaactcaattgtccccctgtctaagaaggtccacagaaattctaccatacggcccggatgcgacgtgaatccaagctgtgcactgtgcggcagtggcagcattaatacaatgccacccgaaatccattatgaggctccactactggaacgcttaagccagctggattcttgcgtgcaccctgtgctagctttcccagacgatgtgccaacctctttacacttccagtccatgctgaaaagccagtggcagaacaagccttttgataagataaaacccccgaaaaagttgtctcttaagcatcgggctcccatgccgggatctttacctgacagtgcaagaaaggaccgtcacaagcttgtttcttccttccttactacggccaaactgtctcaccaccagactcggcccgaccggacccacagacagcaccttgacgacgtcggcgctgtgccaatggtagagcgggttactgcaccaaaagccgagagacttcttaatcctccgccacctgtccacgatccaaaccatagcaagatgagactgagggaccacagcagtgagaggtcagaggtcctcaagcaccacactgatatgagcagctccagctatcttgcagcaacgcaccatcccccacactcacccttagtccggcaactgagcaccagctccgattcacccgccccagcctccagcagtagtcaggtcacggcatctaccagccagcaaccagtgcgcagacggcggggtgagtcttctttcgacattaacaacatcgtcataccaatgagcgtggcagccacaactagggtggaaaagcttcagtacaaggagatactgaccccctcgtggagggaggtagatctccagtcactcaaaggctccccagacgaggagaacgaggagattgaggatctgagcgatgccgcgttcgctgcgttgcacgccaaatgtgaagagatggagagggccaggtggttgtggacgacgtcagtgcctccacagcgacgcggttcccggtcctatcgaagcagcgatgggcggacaaccccacagttgggctccgccaacccctctacgccccaaccggcctcaccagacgtcagtagctcacattcattgtccgaatattcccacgggcagagcccccgaagccctatctcacctgagctgcactccgcccccctgacccccgtggcacgcgatacaccccggcatctggcctcagaggatacccggtgcagcacgcctgagctggggctggatgagcagtctgttcaaccctgggagcgccgcacatttccattggcccacagtccccaggccgagtgcgaggatcagctggatgctcaggagcgggccgccagatgcactaggcgaacgtctggtagcaagactggacgggagaccgaagcagcgcctacctcgccaccaattgtacctctaaagagcaggcatttggttgctgctgccaccgcgcagcggcccacccaccggtag

SEQ ID NO: 192187 - DNA, 1200 bp, Artificial Sequence
  Description of Artificial Sequence: Synthetic coding sequence
atgccccccgagatccactacgaggcccccctgctggagcggctgagtcagctggacagctgcgtccaccctgtcctggccttccccgacgatgtccccacgtccttgcatttccagtcgatgctgaagtcccagtggcagaacaagccattcgataaaatcaaaccacccaagaagttaagtttaaagcaccgagcaccaatgcccggatccttaccagacagcgccagaaaggacagacacaaacttgtgtcctccttcctcacaacagctatgttgaaacaccatactgacatgagttcgagctcatatctggccgctacccatcatcccccacattccccactggtaagacagctgtcaacgagctccgacagtcccgctcccgcaagctctagctcacaagtgaccgcttcaacttcacagcaaccagttaggcggcgtagaggtgaatcttccttcgatattaacaatatcgtgatccctatgtccgtggcggccacgactagagttgagaagttgcagtataaagagattctgactccatcatggcgcgaggtggacctccagtcccttaagggcagtccagatgaggagaacgaggaaattgaggaccttagtgacgccgccttcgccgctttacacgcaaagtgcgaagaaatggaaagggcgcggtggttgtggactacatccgtacccccacaacgccgcgggagtaggagctacagatctagcgacgggagaaccacgccccaactcgggtctgcaaacccttctacacctcagccagcttcccccgacgtgtcctctagccattccctttcagagtattcccatggacagagcccccgctcccccattagcccagagcttcactctgcccccctgacacccgttgcccgggacacaccccgccatctagcaagcgaggatactaggtgcagcactcctgagctggggctggatgagcaaagtgtgcagccttgggaaagacggacgtttcccttagcacacagccctcaggcagagtgtgaagaccagcttgacgcccaggaaagagcggcgaggtgcactaggagaacttctggctctaagaccggccgcgagaccgaagccgcccccacgagccccccaatcgtcccgctgaagtctcgtcaccttgtggccgcggctaccgcgcagcgtccaacccacaggtag

SEQ ID NO: 192188 - DNA, 3318 bp, Artificial Sequence
  Description of Artificial Sequence: Synthetic coding sequence
atggccgccatggcccccgccctgaccgacgccgccgccgaggcccatcacattcgctttaagcttgcccccccaagctctactctttccccggggagtgcagaaaataatggtaacgccaacattctcatcgctgctaatggtacaaagaggaaggcaatcgctgccgaagacccctcactcgactttcggaacaatcctaccaaggaggatctgggcaaactgcagccactggtagcctcatacctgtgtagtgatgtcaccagcgtgcctagcaaggaaagccttaagctgcagggagtgttcagtaagcagactgtgcttaagtcccacccactcttaagtcaaagctacgagctcagagctgagctgttggggcgtcaacccgtccttgaattcagtttggaaaatctcaggaccatgaatacctccggacaaacagccttgcctcaggctcctgtgaacggccttgccaagaagcttaccaagagcagcacccactccgaccatgacaatagcacaagcctgaatggagggaaacgcgcccttaccagcagcgccctgcacgggggtgaaatgggcggaagtgaatcaggcgacctgaaaggcggtatgaccaactgtactcttcctcaccggtcactggatgtagaacacaccacactgtattccaataattcaacagcgaacaagtcaagcgtcaacagtatggaacagcccgccctgcaggggtcgtcaagactctcgccagggacggactccagttctaatctcggaggcgtgaagcttgaaggtaaaaaaagccccctgtcttcaatcctgttcagcgccctggatagcgacacccgaatcaccgcactgcttagacgacaggcagatattgaaagcagagcccggagattacagaaacggttgcaggtcgttcaggccaagcaagtagagcgccatattcaacaccaactcgggggctttctggaaaaaaccctaagcaagcttcccaacctagagtctcttcgccctaggagtcagctgatgctcactcgcaaagcagaagcagctctgagaaaagccgcctcagagaccacaacctctgagggcctgagcaactttttaaaaagcaatagtatctctgaagaactggaaagatttacagccagcgggatagccaacttgcggtgcagtgaacaggcattcgattctgacgttaccgattcctcttccggtggtgagtccgatatcgaggaagaggagctcaccagggccgaccctgagcagcgccacgtccccttacgaagacggtcggaatggaaatgggccgccgatagggccgccatcgtgtccaggtggaactggctccaggctcatgttagcgacctggagtacagaatcaggcagcaaacagacatctataaacagatcagggccaataaggggctcatagtattaggtgaggtgcccccccccgagcacacgacagatctgttcctgcctctctctagcgaagttaagacggaccacggtacagacaagctgattgagtcagtcagtcagcctctcgaaaaccatggagctagaatcatcggacatatttcggagtccttgtccaccaagtcctgtggggccctgcggccagtgaatggggtgattaacactcttcaaccggtactcgccgatcacatccccggcgattcaagtgacgcagaggaacagctgcacaagaaacagaggctgaacctcgttagcagtagctccgacggaacatgcgtggctgctcgcacgagaccggttctgtcctgcaagaagcgaagactggtgcggcccaatagcattgtgccgttatccaagaaggtgcatcgcaacagcacaatcagacccgggtgcgacgtgaacccttcatgcgctctatgcgggtcaggatctattaatactatgccacccgaaattcattatgaagcacccctgttggaacgcctcagtcagctcgacagttgtgtccatccagtgcttgcgttcccagacgacgtgcccacgtctctgcactttcaatcaatgctcaagagccagtggcagaacaagcccttcgataaaataaagcctccgaaaaagcttagcctcaaacatcgtgcccctatgccagggtctctgccagacagtgcgcgcaaggatagacacaagctcgtcagctcctttctgaccaccgccaagctcagccatcaccagactagacccgacaggacgcatcgtcagcatctggatgatgttggggctgtaccaatggtcgagcgagtgacagctcccaaagcagagaggctcctaaatcctcctccacctgtgcatgatccgaatcattctaaaatgcggttacgcgatcactctagtgaaaggagcgaggtcctgaagcatcacaccgacatgagctcatccagctatttggcagcgacccaccaccccccccatagccctctggttagacagctaagtacatcttccgacagtcccgcacccgcttcatcttcttcccaagtgaccgcaagtacctcccagcagccagttcggcgccgccgcggcgaatcatcctttgatatcaataatattgttatccctatgtcagttgccgccacaaccagggtcgaaaagctgcagtacaaggagatcctgacccctagctggcgggaggttgatctccaatccttgaaagggagtcctgacgaggagaatgaggagattgaggacctcagtgacgcggcctttgctgccctgcatgccaagtgtgaagaaatggagcgcgcacgatggctgtggacaacttccgtgccaccacagaggcgcggttcccgctcgtaccgcagcagtgacggaagaaccaccccccagttaggctccgccaacccgagtacgccacagcctgcctctcccgacgtcagcagtagccactccctgagtgagtacagccacgggcagagtccccgaagccccatctcccctgaacttcatagcgctcctctgacaccagtcgcaagggacacaccccggcacctcgctagcgaggatactcgttgtagcacacctgagcttggcttggatgagcagtctgtccagccatgggagcggagaacgtttccactggcccacagtcctcaggccgagtgcgaagaccaactggacgcacaggagcgggcagctcgctgcacccgcaggacttcggggtccaagaccgggagagagaccgaggcagctcccaccagccccccgattgttccccttaaatcgagacaccttgtcgccgccgctacagcccaaaggcccacgcaccgctag

SEQ ID NO: 192189 - DNA, 3318 bp, Artificial Sequence
  Description of Artificial Sequence: Synthetic coding sequence
atggccgccatggcccccgccctgaccgacgccgccgccgaggcccaccacatccggttcaaactggctcctccatcctccactctgtcaccaggctcggctgagaacaacgggaatgccaacattctcatagctgctaatggaaccaaaaggaaagcaatcgcagcagaggacccgtccttggactttcgcaataatccaaccaaggaggacttgggcaaactgcaaccacttgtggcttcatatctgtgttccgacgtcacatcagtgccgagtaaggagtctctgaagcttcagggagtgttcagcaaacaaacagtccttaagtctcacccactgcttagccaatcatacgagctgcgggccgagctcctcggtcgccagcctgttctggagttcagccttgagaatctcagaacaatgaacacctctggccagacagctctgccccaggcgcctgtaaatggattggctaagaaattaaccaaaagttcgacacattctgatcacgataactccacaagtctcaacggcggaaagcgagccttgactagctctgcactgcatggcggagagatgggcggcagcgagagcggggatcttaagggcggtatgactaactgcaccctgccccatcggtccctcgatgtggagcacacaacactgtactcaaacaattctacagctaacaagagttctgttaacagcatggagcagcccgcactccaggggagttctaggctatcaccaggcacggactcctcttcgaatctgggaggggtcaagctcgagggaaagaagtctcctttatcctccattcttttctccgcactggactccgacaccagaattaccgccctgctgaggagacaggcggatattgagagccgtgcccggcggctccagaaacgccttcaggttgtgcaggccaaacaagtagaacggcacattcaacatcaactcggtgggtttttggaaaagacgctgagcaaactgcccaacctggaatccctgagaccacggtcccagctcatgcttacccgaaaagctgaagccgcactgcgaaaggcagctagcgagaccacaacctccgaaggactttccaactttctgaaatctaactctatctcagaggagttggaacgattcacagcttctgggattgccaacctgcgttgttccgagcaagcttttgactcagatgtcacagattctagttcgggtggggaatccgatatcgaagaggaggaactgaccagagcagatcctgaacagaggcacgtccccctcaggagacgaagcgaatggaaatgggcagcagaccgagccgctatcgtgtcccggtggaactggctccaagcacatgtatcggacctagaataccgaattcggcaacaaaccgatatatacaaacaaatcagggctaataagggcttgattgttttaggagaggtgccacctccagagcatacaaccgatttatttttacccctgagctccgaggtgaaaaccgatcacggcactgacaaactaattgagtccgtgagccaacccctggaaaatcacggcgccagaatcatcggtcatatctctgagtcgctgagtaccaaaagttgtggggcactgcgccccgtgaatggtgttattaatactctccaaccagtcctagctgatcatatccctggcgacagctccgacgccgaggaacagctgcacaagaagcagagattaaacctggtgagttcctcctcggatggaacttgtgtggcggcacgaacgagaccggttctgtcatgtaaaaagcgccgactcgttcgtccaaactccattgtgcccctgtctaagaaggtgcatcgaaactccacgatacgcccaggatgcgatgtgaaccccagttgtgcattgtgcggttcagggagtattaataccatgccacctgaaattcactacgaagctcctctgctggagagactgagtcagctcgattcttgcgtacacccagtcctcgcgttcccagacgacgtaccgacgtctctacacttccaaagcatgctcaaatcccagtggcaaaataagccattcgacaagatcaaacccccaaagaagctttccctgaaacaccgggccccaatgccgggctccctaccggattccgctcgaaaggacaggcacaaacttgtctctagctttctgacgactgccaagttgagccatcaccagacacgacctgatcggactcaccgccaacacctggatgatgtgggtgccgttcccatggtagagcgcgtgaccgcgccaaaagccgaacggctgctcaatcctccaccccccgtccacgacccgaaccactcaaagatgaggctgagagaccattcttccgagaggtccgaggttcttaagcaccacactgatatgtcctcgtcatcatacctcgccgctacccatcacccccctcactcccctctggtcaggcagctgtccaccagctcggattctcctgctcctgcctcttcttccagtcaagtcaccgcatctacctctcagcagccagtgcggaggcggagaggcgagtctagcttcgacatcaataacattgtgatcccaatgtccgtcgctgccactaccagagtggagaagctacagtacaaggagattctgactccctcttggcgtgaggtggacctgcaaagcctgaaaggctctcccgatgaggaaaacgaagaaattgaagatctgtctgatgcagcattcgcagcactgcatgccaagtgtgaggagatggagcgggctcgctggctctggactacgtcagttccgccacagcgccggggtagtcggagctatcgctcttccgacggtcgaaccacgcctcagctagggagcgccaacccgagcactcctcaacccgccagtcctgacgtgtcttcaagccactctcttagtgagtactctcatgggcaatccccacgttccccaatctctcccgagctgcactccgctccgttgacccctgtggctcgggatacaccacggcatctcgcatctgaggatactcggtgcagcactccagaacttggattggacgagcagtccgtccaaccctgggagcgacggacctttcccctggcacatagcccccaggccgagtgcgaagatcagctggatgcacaagaaagggctgccaggtgcacccgaaggacaagcggatctaaaactggaagagagactgaagcagcccccaccagcccccctattgtaccactgaagtcgcgccacctggtagcagcagccacagcccagcgccccacccacaggtag

SEQ ID NO: 192190 - DNA, 3318 bp, Artificial Sequence
  Description of Artificial Sequence: Synthetic coding sequence
atggccgccatggcccccgccctgaccgacgccgccgccgaggcccatcacatccgctttaaactggcccctcctagcagcaccctttcccctggctctgctgagaacaacggcaatgcaaatattttaatcgccgcgaacgggacaaaaagaaaagcaattgcggcagaggaccctagtctagatttcaggaataaccctactaaggaggacctcggcaagctgcagcctctcgttgcctcatacttgtgtagcgacgtgacctcagtcccaagtaaagaatcgctcaagctgcaaggtgtgttcagtaagcagaccgtgctgaagagccacccccttctgtctcagtcatacgaactgcgtgccgagttgctcggtagacaacctgtcctggagttctcactggaaaacctacggaccatgaataccagcggtcagacagccctcccgcaggcccctgtgaatgggctggcaaagaaattaacaaagtccagcacccattcagatcatgataactcaacttctttgaacggcggtaagcgcgccctgacatcctctgccctgcatggcggtgagatgggtggatcagagtccggcgacttgaaaggaggaatgactaattgtactcttcctcaccgatctttggatgtggagcacaccaccctttacagtaataattctaccgccaataaatcatctgtcaacagtatggagcaaccggccctacaggggagctctcgccttagtcccggtactgattcgagctccaacctagggggggtaaaactcgaaggcaagaagtcccctcttagcagtatactgttctctgccttagattcagataccaggatcaccgccctgctgagacgacaggcagatattgagagcagggcccgaaggttgcagaaaagattgcaagtcgtacaggccaaacaggtagagagacatattcagcaccagcttggggggtttcttgagaagactttgagcaagctgcctaatctggagtctctgcgaccaagatcccagctgatgttgacccgcaaggccgaggctgccctgcgcaaagcagcctctgagactaccacttccgagggactgagtaactttctgaagtccaacagtatcagcgaggagttagagcgatttaccgcatcaggtattgctaacctgaggtgttccgaacaagcattcgacagtgacgtgacggacagttcaagcggaggcgaaagcgatattgaggaggaggaactaaccagggctgatcccgaacagagacacgtgcctctacgtagacgaagtgaatggaaatgggctgctgatagggccgccatcgtgtcaagatggaactggctgcaagcccatgtcagtgacctggaatacagaattcggcagcagactgatatttacaagcagattcgggccaataaaggactcattgttctgggggaggtgccacctccggagcacactaccgatttgttcttgcctctaagtagtgaggtgaagacagaccatggaacagacaaattgatcgagtcggtttcacagcctttagaaaaccatggggccaggataatcgggcacatttcagaaagtctatcaacgaagagctgtggcgctctgagaccggtgaatggagtaataaatacattgcagcctgttttggctgaccacattccaggcgatagcagcgatgcagaggagcagctccataaaaaacaacgtttaaacctggtgagctccagctccgacgggacatgcgtagcagcccgcacccgtcctgtcttatcatgtaaaaagcgtcgtctggtccgtcctaactctatagttcccctctccaagaaggtgcaccgcaatagcacaatcagaccgggctgtgatgtaaacccctcatgtgcactatgcggtagtgggagtataaacacaatgccccccgagatacactatgaggcacctctgcttgagcgcctgagtcaactggactcttgcgtgcaccctgtcctcgccttcccagatgacgtccccacctccctccactttcagtctatgctgaagtctcagtggcagaacaaacctttcgacaaaataaaaccacccaagaaactcagtctgaagcacagggcgccaatgcccggaagtctcccagattcagccagaaaggatagacataagctcgtttcctcctttctgaccacagctaaattgtctcaccatcagaccaggccggataggacacaccgtcaacatctagacgacgtgggagctgtgccaatggtcgagagagtaacggcgccgaaagccgaaagattgttaaacccccccccacctgtccacgatccaaaccacagcaagatgaggctaagggatcattccagcgagcggtccgaggtgctgaaacaccacacagacatgtcctcaagctcctatctggcggcaacccaccatccaccccattcccccttagtgcggcagctgtctaccagtagtgattccccagctcccgcatcatctagctctcaggttactgcatctacttcacagcagcccgtgcggcgccggcggggcgaaagctcattcgatattaataacattgtcatccccatgagtgtggcagccactactcgggtcgaaaagctacagtataaagaaatacttacgcctagctggagggaggtggatctgcagagcctgaaggggtctccagatgaggagaatgaagaaatagaggatctgagcgacgctgcctttgccgctctgcacgccaagtgcgaagagatggagagggccaggtggttgtggacaacatcagtgccccctcagcggcggggctcacgctcctataggagtagcgatgggagaacaactccacaattgggaagtgctaatccatcgacgccgcagcccgcatcccctgatgtcagtagctcccattctttgtccgagtattcacatgggcagtccccgcgttctcccatatcacctgagctgcactcagccccactgactccagtggcgcgcgatacacctcgccatctggcctccgaggacacccgctgtagtacacccgaactaggtctggatgagcaaagcgtccagccctgggaaaggcggactttccctttggcacatagcccccaggcggagtgcgaggaccagctggatgctcaggagcgggccgcacgatgtacacggcgcacatctggctcaaagacgggccgtgagacagaggccgccccgacctccccgccaattgtgccactcaaatcacgccacctggtcgcagctgccaccgcacagagaccgactcaccgttag

SEQ ID NO: 192191 - DNA, 936 bp, Artificial Sequence
  Description of Artificial Sequence: Synthetic coding sequence
atgagcctgctgatgatcagcgagaacgtgaagctggcccgggagtatgctctgctgggcaattacgattccgcaatggtatactatcagggagttctggatcaaatgaataagtacttatacagcgtgaaggacacctatctccagcagaaatggcagcaagtgtggcaggaaattaatgttgaggcaaagcacgtgaaggacatcatgaaaaccctagaaagctttaagcttgattctacccctttgaaggctgcacagcacgacctgccagcctccgagggagaggtctggagtatgcccgtacctgtggagcgccgcccaagccctggaccaaggaaaaggcaaagttcgcaatactccgatcccaaatcccacggaaatcggccctctaccaccgtccgagtccacaggtccagcgcgcaaaacgtacataatgacaggggaaaagccgttagatgccgcgaaaaaaaggaacagaacaagggacgcgaagagaaaggtgtcctcatggtgggcccacccgggacgggcaagacattactggccaaagctgtggcaaccgaatgcaagacgaccttttttaacgtgtcttcctcgactctaacgagcaagtatagaggtgagtccgagaaactagttcgccttctgtttgagatggcccgcttctattcgcccgccaccatttttatcgacgagatcgacagtatttgttctaggcgggggacaagtgaggagcatgaggctagtagacgcgtaaaggctgagttgctcgttcaaatggacggggtaggggggaccagtgagaacgacgatccctctaaaatggtgatggtgcttgcagctacgaatttcccttgggacatcgacgaagcgcttcgccgtcgtctggaaaaacgcatttatattcccctgcctagcggtatgaggccttag

SEQ ID NO: 192192 - DNA, 1476 bp, Artificial Sequence
  Description of Artificial Sequence: Synthetic coding sequence
atgagcctgctgatgatcagcgagaacgtgaagctggcccgggagtatgccctgcttggaaattatgactccgctatggtgtattatcagggtgtcttggaccagatgaataagtacctgtatagtgtcaaggacacatacctgcagcagaagtggcaacaggtgtggcaagagataaacgttgaagctaagcatgtcaaggacatcatgaagacactagaatctttcaaattagactctactcctctcaaggctgcacagcatgatttgcccgcttccgagggggaggtgtggtccatgccagtccccgtagagagaagaccatctccgggccctcgcaagcggcagagttcacaatacagcgatcctaaatctcacggcaacagaccttctactacagtgcgggtgcacagatcatcagcccaaaacgttcataatgacagaggcaaagctgtgcggtgtagagaaaagaaagagcaaaataagggtagggaggagaagaataagtctcctgcagcagtgaccgaacctgagaccaataagttcgacagtactgggtacgataaggacctggttgaagcactggaacgcgacatcatatcccaaaatcccaatgtgaggtgggatgatatagccgatttggtagaggcaaagaaattgttgaaggaagccgttgttcttccaatgtggatgcctgagttcttcaagggtatccgcagaccatggaagggcgtgctgatggtggggcccccaggaactgggaagacactgctggctaaggccgtggcaaccgaatgcaagacgacattcttcaatgtctcaagcagtacactgacctcgaagtaccggggcgaatccgagaagctggtgcgccttctattcgagatggcccggttttacagcccggctactatcttcatcgacgagatagattcaatctgcagcaggcgaggaacctctgaggaacacgaagcctcgcgtcgggtgaaggccgagttgctggtgcaaatggatggggtgggcggaaccagtgaaaacgatgacccgtccaagatggtgatggttctggcagcgactaactttccatgggacatagacgaggctcttcgcagacgactggaaaaacgtatttacattcccttgccgagcgctaaaggccgtgaggaactgttgcgcataagcctgcgggaactggagcttgccgacgatgtcgacctggctagcatcgcagagaatatggagggttatagcggggccgatatcactaacgtgtgccgcgatgcttccttgatggccatgagaagacggatcgagggattaacccccgaagaaatccgcaacctcagcaaggaggagatgcatatgcccacaacaatggaagattttgagatggctctgaagaaggtgagcaagagcgtgagtgctgccgatattgagaggtacgagaagtggatctttgagttcggtagctgctag

SEQ ID NO: 192193 - DNA, 1476 bp, Artificial Sequence
  Description of Artificial Sequence: Synthetic coding sequence
atgagcctgctgatgatcagcgagaacgtgaagctggcccgggagtacgcactcctaggaaactatgacagtgcaatggtgtactaccagggcgtccttgatcagatgaacaagtacctgtatagcgtgaaagatacttacttgcagcagaaatggcaacaagtgtggcaggagatcaatgtggaagccaagcacgttaaagatattatgaagactctggaaagcttcaaactggattccactcctctgaaggccgcccaacatgatctgcctgcgtccgaaggcgaagtttggtcaatgcccgtgccagtggaaaggcggccttccccggggccacgtaaaaggcagtcttcacagtactcagatccaaagtctcacggtaaccgtccatccacaactgtgcgggtgcaccgttcaagcgcccagaacgtccataatgatcggggaaaggccgttcgctgtcgcgaaaagaaggagcagaacaagggaagggaggagaaaaacaaatccccggctgccgtgactgagcctgaaacgaacaagtttgatagcactggctacgataaggacctggtcgaagctctcgaacgagacataatttctcaaaaccccaacgttcggtgggacgatattgctgatctcgtcgaagccaaaaagctcctgaaagaagccgtcgtgctccccatgtggatgccagaattttttaaggggatccgccgcccctggaagggagtgctgatggtgggaccccctgggacgggcaaaacgctcttggctaaagcagtggcaactgagtgcaaaaccacatttttcaatgtatcctccagtactctaacctccaagtacaggggcgagtctgagaagctggttcggctcttgttcgaaatggccagattttacagccccgccactattttcattgacgaaatagatagcatctgtagccgcaggggaaccagcgaagaacatgaggcgagccggagagtgaaggccgaactgctggtgcaaatggacggcgttggcggcacatccgagaacgatgaccccagcaagatggtaatggtccttgcggcaaccaatttcccctgggacatagacgaggccctccgccggcgactagagaagaggatctacatccctctcccatcagccaaggggcgcgaggagcttttgaggatcagtcttcgtgagctggagttagccgatgacgtggatcttgcttccattgccgagaacatggaaggatactctggtgccgacatcacgaacgtgtgccgcgacgcctctctcatggctatgcgccgtaggatcgagggcctgacaccagaggagattcgcaacctgagcaaggaggaaatgcacatgcctacgaccatggaggatttcgaaatggcactaaagaaagtgagtaaatcagtcagcgctgcagacatcgaacgatacgagaagtggatattcgagttcggttcctgttag

SEQ ID NO: 192194 - DNA, 636 bp, Artificial Sequence
  Description of Artificial Sequence: Synthetic coding sequence
atgagcctgctgatgatcagcgagaacgtgaagctggcccgggagtatgctcttcttggcaactacgatagtgcaatggtttactaccagggcgtattggatcaaatgaacaagtacttatattctgtaaaagatacctatctgcagcagaaatggcagcaggtttggcaggagatcaacgtagaggcgaagcacgtgaaggatattatgaagactcttgaatctttcaaattggattctacacctctgaaagccgctcaacatgatttacctgctagcgagggcgaggtttggtccatgccagtgcccgttgagcggagaccgagcccagggccccgcaagcgacaatcctctcagtattctgacccaaagagtcatggaaacaggcccagcaccactgtgcgggtacaccggtcatctgcgcagaatgtccataacgatcgcggcaaggccgtgcggtgtagagagaagaaagagcaaaacaaaggtcgggaggaaaagaataaaagtccagcagccgtgactgagcctgaaacaaacaagttcgactctacaggttatgataaggatctcgtggaagccctcgagcgcgacatcatcagtcagaaccctaatgtcagatgggatgatatttag

SEQ ID NO: 192195 - DNA, 843 bp, Artificial Sequence
  Description of Artificial Sequence: Synthetic coding sequence
atgagcctgctgatgatcagcgagaacgtgaagctggcccgggagtatgctcttctaggaaattacgattctgctatggtctactatcagggtgtgttggaccaaatgaataagtatttgtatagtgttaaggatacctatctccagcagaaatggcagcaggtgtggcaggaaattaacgtggaagccaagcacgttaaggacatcatgaagaccctcgagtcctttaaactcgactctacgccactgaaggcggcacagcacgacctcccagctagcgaaggcgaggtttggtctatgcccgtgcccgtagaacgaagaccctctcctgggccaaggaaaaggcagagcagccagtacagtgacccaaaaagccacggaaacaggccttctaccacagtgcgcgttcatcgcagcagtgctcaaaacgttcacaatgatcgcggcaaggccgtccggtgcagggagaaaaaggaacagaacaaaggccgcgaagagaagaataagagccctgcggcagtcaccgagccagaaacaaataagtttgactcgaccggatatgacaaagatcttgtggaagccctagagcgggatatcattagtcagaatcctaatgttaggtgggacgacatagctgacctggttgaagctaagaagttattaaaagaggcagtggtcctgccaatgtggatgcccgagttcttcaaaggtatccgccgaccctggaaaggtgtactgatggtagggcctccgggaaccgggaagacactgctggcgaaggccgttgctaccgagtgtaagacaacatttttcaatgtgtcatctagcaccctaacttcttag

SEQ ID NO: 192196 - DNA, 429 bp, Artificial Sequence
  Description of Artificial Sequence: Synthetic coding sequence
atgaactgcagcgagagccagcggctgcggaccctgctgagccggttactcctcgagttacatcatagaggtaatgcatcaggcctgggcgccggtcccagaccttcgatgggcatgggagtcgtgccagatccatttgtgggccgggaggtgacctccgccaagggtgatgacgcctacctgtatattctcttgatcatgatcttctacgcatgcctagcgggaggactgatactggcttatactcgttccaggaagctggtggaggccaaagatgagccatcgcaggcttgtgctgaacacgagtgggcgcccggaggggccttgacagccgatgcagaggcagccgctggttctcaggcagaagggagacggcagctggcctcggaaggactgcccgccttggcccagggcgctgagagagtctag

SEQ ID NO: 192197 - DNA, 1509 bp, Artificial Sequence
  Description of Artificial Sequence: Synthetic coding sequence
atgttcggcaccctgctgctgtactgcttcttcctggccaccgtgccggccctggccgagaccggcggtgagagacagctgagcccagagaaatccgaaatctggggccccggtttgaaggccgatgtggtacttcccgcccggtatttttatatccaagcagtcgacacatctggaaacaaattcactagctcacccggagaaaaggttttccaggtcaaagtctccgcccccgaggaacaatttactcgggtgggagtgcaggtcctcgacagaaaggatggcagcttcatagtccgctatcgcatgtatgcttcctacaaaaacctgaaggttgagatcaagttccagggtcaacacgttgcaaaatccccgtacattctgaagggcccagtatatcacgaaaactgcgattgcccgctgcaagactccgccgcatggcttagagagatgaactgtcccgaaacaattgcgcagattcagcgcgatctggctcactttcctgctgttgacccagagaagatcgcagtcgagattccgaagcggttcggacagcgtcaaagcctgtgtcattacaccctgaaggacaataaagtctatatcaagacccacggtgaacacgtagggttcaggatcttcatggacgcaatcctcctgtctttaacgagaaaggttaagatgcccgacgtggagctgttcgtgaacctgggagattggcctctcgagaaaaagaagtcaaactccaatatacatcccatcttcagctggtgcgggtcaacagacagtaaagacatcgtaatgcctacctacgatctgacagactccgtacttgaaacgatggggcgcgtgtcactagacatgatgtctgttcaggccaacaccggaccgccttgggagtcaaaaaacagcactgccgtttggcgcgggagggatagccgcaaggagcgattggagctcgtaaaattatctagaaagcatcccgagttgattgacgctgcttttactaactttttcttcttcaaacacgatgagaacttgtacggtcctattgtcaagcacatcagcttctttgatttcttcaagcataaataccagatcaacatagatggtactgtggccgcctaccgattgccctatcttttggttggggacagcgttgtgctcaaacaggactctatttattatgaacatttctataatgagttacaaccctggaagcactatattccagttaaaagcaatctttcagatctgttagaaaagctcaagtgggccaaagatcacgacgaggaggcaaaaaagatcgccaaggcagggcaggagttcgccagaaataatctgatgggagatgacatcttttgctactattttaaactgtttcaggagtacgcgaacctgcaggtatctgaacctcagataagagaagggatgaagagggtggagcctcagactgaagacgatcttttcccctgtacctgtcatcgcaaaaaaacgaaagacgagttgtag

SEQ ID NO: 192198 - DNA, 1065 bp, Artificial Sequence
  Description of Artificial Sequence: Synthetic coding sequence
atgagcgccggcggcggccgggccttcgcctggcaggtgttcccccccatgcctacctgcagggtgtatggtacggtggcgcatcaggatggacacctgcttgtactgggaggctgtggccgcgccggcctgcccctcgacaccgcagagaccctcgacatggcgagtcacacatggctagctcttgctccacttccaaccgctcgcgcaggagccgcggccgtcgttttagggaagcaggtccttgtcgttggaggtgtggatgaagtgcagagtccggttgctgcagtggaagcctttctgatggacgaggggagatgggagcggagagccaccttgccccaggctgcaatgggggttgccaccgttgagcgcgatgggatggtctacgccctcggcgggatgggtccagatactgcacctcaagcccaggtccgagtgtatgaaccacgtagagactgttggctgagcctgccatcgatgcccaccccttgttatggcgctagcacattcctccacggcaacaaaatatacgtgttgggaggtcggcagggaaagttgcctgtgaccgccttcgaagctttcgacttagaggctcgcacctggacccgccatccatccctcccctcccggcgggcttttgccggttgcgctatggctgaaggttctgtctttagtctgggaggtctccagcaaccagggcctcacaatttctatagccggccacatttcgtgaatacagtggaaatgtttgacctcgagcatggcagctggactaaacttcccagatcactaagaatgcgggacaaaagagcagattttgtcgttgggtctctgggcggtcacatagtggctattggagggcttggcaaccagccctgccctcttggcagtgtggaatcatttagtcttgcgagacgaagatgggaagccttacccgccatgccaaccgccagatgcagctgtagctctttgcaagcaggtccccgtctcttcgtaataggaggagtcgcacaagggcctagccaggccgtagaggcattgtgcttgagagatggtgtctag

SEQ ID NO: 192199 - DNA, 417 bp, Artificial Sequence
  Description of Artificial Sequence: Synthetic coding sequence
atgttcgacctggagcacggcagctggaccaagctgccccggagcttgcgcatgagagataagcgggcagactttgtggtaggcagcctgggaggtcacatcgtggctataggtggcctgggaaaccagccatgccctctcgggagtgtggaatctttttctctggcgaggagacgatgggaagctctccccgcgatgcctacggctcggtgttcgtgttctagtctgcaagctggccctcgattgtttgtgataggtggcgtagcccaaggtccctcccaagcggttgaagcattgtgcctccgagacggcgaggggcttgtcggcgctgtacattggtcatccagtttgccagaggcagcaatcagcatggcaccgttcgcagccgaggatacacattgcggctccgtgggttag

SEQ ID NO: 192200 - DNA, 1821 bp, Artificial Sequence
  Description of Artificial Sequence: Synthetic coding sequence
atggacagccagcgggagctggccgaggagctgcggctgtaccagtccactttgctgcaggacggcctcaaggatctcctagatgaaaagaaatttatcgattgcaccctcaaagccggtgataaaagtctcccttgtcacagactgatcctgagcgcatgctccccttacttccgcgaatacttcctgagtgaaatagatgaggctaagaaaaaagaggtggtgttggacaatgtcgacccggccatccttgatctgattattaaatatctatacagcgcctctatcgacttgaatgacggcaacgtgcaggacatcttcgcattggcttcccggtttcagatcccctcagtattcactgtatgcgtctcctacctccaaaagcggctggcccccggtaactgtctcgcaatcctgcgactgggtcttctgctggactgtccaaggctcgcaatatcggcccgggaattcgtgtcagatcggttcgtgcaaatctgcaaggaggaggacttcatgcagttatctccgcaagagctcatttctgtgatcagcaatgatagcctgaacgttgaaaaagaggaagccgtgttcgaggcagtgatgaagtgggtgcgcaccgataaggagaatcgcgtcaaaaacctttcagaagtgttcgactgcattagattccggttaatgactgaaaagtatttcaaagaccacgtggaaaaggacgacattataaagagcaatcccgacctgcagaaaaagattaaagtactgaaagacgcctttgcgggaaaacttcctgagcctagtaagaacgctgcaaaaaccggggcaggggaggtcaatggcgatgtgggagacgaagatttactgcccgggtacctgaacgacatccctcgccatgggatgttcgtgaaagacctgatattgctggtgaatgacacagctgccgtggcttacgatccgacggagaacgaatgctatctcacagccctcgcagagcagatcccacgtaaccactctagtatcgtgacacagcagaaccagatttacgtcgtgggcgggctgtatgttgacgaggaaaataaagaccagccactgcaatcctacttcttccagttggatagcatagcctcggagtgggtgggtctgccaccgcttccatctgcacggtgcctgttcgggctcggcgaggtggatgacaagatctatgtggtggccggcaaagatctgcaaaccgaagcttcactggattccgtgctgtgttacgacccagtcgccgccaaatggaacgaggtgaagaaacttcctatcaaagtgtacggacacaacgtgatctcgcacaagggcatgatttattgcctcggagggaagacagatgacaaaaagtgcacaaaccgcgtgttcattttcaatccaaagaaaggcgactggaaggacctggcaccaatgaagataccccgcagcatgtttggggtcgccgtccataaaggtaagatcgttatcgccgggggtgttaccgaggacggattaagcgccagtgtcgaagccttcgatctgaccactaacaagtgggacgtgatgaccgagttcccccaggaacgatcttctatctcgttagttagtcttgcaggctccctgtatgccattgggggctttgccatgattcagctagagtcaaaagagtttgctccaaccgaagtgaacgatatttggaagtacgaggatgataagaaggagtgggcaggaatgctgaaagaaattaggtatgcctccggggcctcctgtctggctacccgcctgaatttgttcaaactgtctaagctgtag

SEQ ID NO: 192201 - DNA, 1377 bp, Artificial Sequence
  Description of Artificial Sequence: Synthetic coding sequence
atggcccggggcccccagaccctggtgcaggtgtgggtgggcggccagttgtttcaggcagaccgggcactgctggtcgaacactgcgggttcttccgcggtcttttcagatctggcatgagagaaacccgggcagctgaggtgcgcctgggagtgttgagcgcaggcggattcagagccacactgcaggtcctgcgaggagaccgccccgcgctagctgccgaagatgagcttcttcaggccgtggaatgcgcagcgtttctacaggcgccggccctggccaggtttctcgagcacaatctcacatccgataactgcgcccttctctgtgacgctgcagcagcgttcgggctcagggacgtgtttcatagcgccgccttgtttatatgcgatggcgaacgcgagctggccgcagagctggccttaccagaggcacgtgcctatgttgccgccctcaggccgagtagttatgcagccgtctccacccataccccagctcccggattcctggaagatgctagtcggactctgtgttatctggatgaggaagaggatgcttggcggactctggccgccttacctctggaagctagtacactgttagccggtgtagctacactgggcaataagctgtatattgtgggtggcgtgcgtggggctagtaaggaagtcgtagaactggggttttgctacgaccctgatggcggcacctggcacgagttcccatcgccccaccagccgaggtacgatacggccctcgctggcttcgatggtcgactttacgcaattggcggcgagttccagaggactcccatcagttctgtcgaacgctacgaccctgccgcagggtgttggagctttgttgcagatctgccacaacccgcagccggagtgccctgtgcacaagcctgcggccgcctttttgtatgcttgtggcgacctgcagacaccacagctgtggtggaatacgccgtaagaaccgatgcttggctgcccgtggcggagctccgaaggccacagtcgtatggacactgcatggtggcacaccgggattcattgtacgtggtaagaaacggtccaagcgatgattttctgcattgcgccattgattgtctcaacctcgccactggtcagtggaccgctctgcctggccaattcgtgaacagtaaaggcgcacttttcaccgctgtggtacgaggcgacacggtgtacaccgtaaacaggatgtttacccttctatacgctattgagggcgggacttggcggttactgcgagagaaagcgggctttcccagacccggctctcttcagacctttctgctccgattaccccccggtgcgcctggccccgtcacctccaccactgctgaattgtag

SEQ ID NO: 192202 - DNA, 2247 bp, Artificial Sequence
  Description of Artificial Sequence: Synthetic coding sequence
atgagcggcagcggccggaaggacttcgacgtgaagcacatcctgcggctgagatggaaattgttctcccatccatctcccagcaccggtggaccagccgggggcggatgccttcagcaggatggctctggctcctttgagcattggggccctagccagtctaggcttctcaaatctcaggaacgcagcggcgtgtccacattttggaagaagcctagttcttcttcgagctctagctccagtccctctagctcatcctcctcgttcaaccctctgaacggtaccctgctccccgtggccactcggttgcagcagggagcccctggccagggtacccagcagcccgcacgaacattattttacgtagagtcattggaggaggaggtggtcccaggaatggattttcctggtccacacgagaaaggtctcgtgctgcaggaactaaaggttgaaccagacaatagcagtcaggccaccggagagggatgcgggcacagactgtctagcaccggacacagtatgactccacagtcagacctggatagctcatcctcggaggagttttatcaggctgtgcaccacgcggaacagaccttccgaaagatggagagttacctgaagcaacaacagttatgtgatgtaatcctgatagtagggaacaggaagatccctgcccaccggctggttctcagtagtgtgtccgattattttgcagctatgttcacgtcagatgtttgcgaagccaagcaagaagagataaaaatggaaggcatcgaccccaacgctctatgggatttggtgcagtttgcgtataccggctgcttagagcttaaggaagatacgatcgagaatcttctcgcggcggcttgtcttctccagctcccgcaggttgtggaggtctgttgtcacttcctgatgaagttactccacccaagcaactgcctgggcattcgcgcattcgcagatgctcaaggatgcatcgagctgatgaaagttgcccacagctacaccatggaaaatattatggaggtaatcaggaatcaggagtttctgttgctacccgccgaggaactgcacaagctgctggcctccgacgacgtgaacgtccctgatgaagagactatttttcacgcccttatgatgtgggtgaaatacgatatgcagtcccgttgtaacgacctgagcatgctgctagctttcattcgcctgcctttgctgccgcctcaaattctcgccgaccttgaaaatcacgccctattcaaaaatgacctcgagtgtcagaaactgattcttgaagcaatgaaatatcatctccttcccgaaaggagaacgctaatgcagtccccacggacaaaaccccggaaatcgaccgtaggcacactctacgccgttggcggaatggataataacaaaggcgccactactattgaaaagtatgacttacgaacaaacctttggatccaggccggcatgatgaacggaaggaggctacagttcggcgttgctgtgattgatgacaagcttttcgtcatcggcggtcgggatgggctgaaaacactgaatacagtcgaatgctataatcctaagactaagacatggaccgtgctcccacccatgtccacccataggcacggactgggtgtcaccgtcttagaagggccaatctacgccgtgggcgggcatgacggatggtcatatttaaatactgttgaaaggtgggacccccagtcccaacaatggactttcgtggcatcaatgtctatcgcccgatcaactgtgggagtagctgccctcaatggaaagctgtatagtgtgggtgggcgtgacgggagctcctgtctgtcatctatggagtattacgacccacacacgaacaagtggaatatgtgtgcgccgatgtgtaagcgaagaggtggcgtcggcgtggcgacttgcgatgggtttctgtacgcagtagggggccatgacgcacccgccagtaaccattgttcccggctcctcgattatgtagaaagatatgacccgaagacggatacctggacaatggtggcccctctctccatgcctagggacgcagtcggcgtttgcttgctgggggacaggttgtacgctgtgggcggctatgatggccagacctatctaaacaccatggagagctacgacccacagaccaatgagtggacccagatggcgtcccttaacatcggccgagcaggagcctgtgtggtggtcatcaagcagccttag

SEQ ID NO: 192203 - DNA, 1668 bp, Artificial Sequence
  Description of Artificial Sequence: Synthetic coding sequence
atggacttccccggcccccacgagaagggcctggtgctgcaggagctaaaagtggaaccagataactctagccaagcgactggtgagggctgcggtcataggttagtcctttctagcgtatctgactactttgccgcaatgttcaccagcgatgtctgcgaagctaaacaggaggagattaaaatggagggaatcgacccaaatgccctatgggatctggtacaattcgcctacactggctgtttagagcttaaggaggatacaatcgaaaatctgcttgcagctgcatgtctcctgcagctgccacaagtggtagaagtctgctgccattttctgatgaagttgctgcacccttcaaactgcctgggcattagagcatttgccgacgcccaggggtgcattgagctgatgaaggttgctcattcatatactatggaaaatatcatggaggtaataaggaaccaagagtttcttctcctccccgcggaggaattacacaagctgctggcctcagatgatgttaacgtgcccgacgaggagaccattttccacgccttgatgatgtgggtgaaatatgacatgcagtcaagatgcaatgatttgtctatgttactggcattcatacgcttgccactcctcccccctcagattttggccgacttagagaatcacgctctctttaaaaatgacctcgaatgccagaagctaatcctggaggctatgaagtatcatttgctgccggaaagaagaacgctcatgcagtctccccggacaaaaccccgcaagtccaccgtgggaaccctctatgctgtagggggaatggataacaataagggcgccaccacaatagagaaatacgatctcagaaccaacctgtggatccaggccgggatgatgaacggacggcgtctgcagttcggtgtcgccgtcattgatgacaagctcttcgtcatcggaggaagagatgggctgaagacactgaataccgttgagtgctacaatcctaaaacaaagacgtggaccgttctcccgcctatgagtacccatagacacggcctgggtgtcactgtactcgagggacctatctatgccgtcggcggacatgacgggtggtcttatttaaacacggtggaaaggtgggatccacagagccaacaatggacgtttgttgctagcatgagtattgctagatccacggtgggtgtcgccgccctgaatggcaaactgtactcagtaggcggtagggatgggagctcttgtttatcctccatggagtattacgatccgcacactaacaaatggaacatgtgcgcccctatgtgcaaacgaaggggcggcgtgggtgtcgctacttgtgatggattcctctatgccgtgggcggccatgatgctcccgcttccaaccactgcagtagactcctggattatgtcgaaagatatgatccgaagacagatacatggacgatggtagctcccctgtcgatgcccagggacgctgttggcgtgtgcctgctgggcgatcggctctacgccgtggggggatacgacggtcaaacctatttgaatacaatggagagctacgaccctcagactaacgaatggactcagatggcatccctcaatattgggcgggctggcgcttgcgttgtagtgataaagcagccgtag

SEQ ID NO: 192204 - DNA, 1167 bp, Artificial Sequence
  Description of Artificial Sequence: Synthetic coding sequence
atgagccggagcggcgaccggaccagcaccttcgaccccagccacagcgacaatctgctgcacggcctgaatctcctatggcgcaaacaactcttctgcgacgtaacactgacggcccaggggcagcagttccattgtcataaggcggtgttagcctcctgtagccagtatttcaggagtctattctcatcacatccacctctgggggggggggtgggaggacaggacggtctcggtgctccaaaggaccagcagcagcctccccagcagcagccctcacaacaacagcagccaccacctcaagaggagcccggtaccccatccagctctccagatgacaagctgctcacctcccctcgggcgatcaataatctggtcctccagggatgtagttccatcgggcttcgcttggttctggaatacctgtatactgccaacgttaccctctccctggatactgttgaagaagtcctgtctgtgtcaaagatacttcatattccgcaggttactaagctttgtgtacagtttcttaatgaccaaatcagtgtccagaattacaagcaggtttgcaagattgcagctctgcatgggttagaggagacaaagaagttagctaataaatatctcgtggaggacgtgcttctgcttaacttcgaggaaatgcgcgcgctgcttgactcactgcccccaccggtggaatcggaactggcgttatttcaaatgagcgtactgtggctggaacatgatagggagactcggatgcagtacgcacccgacctcatgaaaagactgcgcttcgcactgatcccagcaccggagcttgtggagcgtgtacagagcgtggatttcatgcgcaccgacccagtttgtcagaaactacttctggacgctatgaattatcacctgatgccttttcgccagcactgccgccagagtctcgcatcacgcatccgatccaacaaaaagatgctccttcttgtcggtggcttaccccccggcccggatcgcctccccagcaatctggtccagtattacgacgatgagaaaaagacctggaagattcttaccattacaggcccacatccaatttctggcaagcaagaaagcgcatcttcccctgaattccgtcgccgcaagacacgggagttttctaacaataccatgtag

SEQ ID NO: 192205 - DNA, 1887 bp, Artificial Sequence
  Description of Artificial Sequence: Synthetic coding sequence
atgagccggagcggcgaccggaccagcaccttcgaccccagccactcagataacctccttcacggactcaatcttctatggaggaaacagctcttttgtgatgtaactctcacagctcaggggcaacagtttcattgccataaggcagtactcgctagctgctcccagtactttaggtccctcttcagcagtcaccctcccttaggtggtggagtagggggacaggatggcctcggagccccgaaagaccagcagcaacctccccaacaacagccaagccagcagcagcagcctcctccccaggaagaaccggggacacccagctccagccccgacgataaactgttgacctctccccgagccatcaacaacctagttctacaggggtgtagcagtattggtctacgcttagtgttggagtacctctatacggccaatgtgaccttgtctctggacactgtggaagaggttttgagcgtgtctaagatcctgcacatcccccaggtcaccaagctttgcgtccagtttctgaacgaccagatttctgtacagaactacaaacaggtgtgtaagattgcggccctgcacgggctggaggaaacgaagaaactagctaataagtacctggtggaggacgttctgcttctgaatttcgaggagatgcgggccttacttgacagtctaccacccccggtggaatcggaactggcactgtttcagatgtcagtcctctggttagagcacgatagagaaacccggatgcaatatgccccagacctgatgaaaaggctcagatttgcccttatccccgcacccgagctcgttgagagagttcagtccgtagatttcatgaggacagatccagtgtgccaaaagcttctgctagatgctatgaactatcatcttatgccatttcgacagcattgcagacagagcctcgctagccggatcagatctaacaaaaaaatgcttctcctggtaggggggctgccacccgggcctgaccgattgccctctaacctggtgcagtactatgatgacgaaaaaaaaacatggaagatcctcaccatcatgccatacaactccgcccaccattgcgtcgtggaagtggagaattttctgttcgtgctcggcggcgaggaccagtggaaccctaacggcaagcactccaccaatttcgtgtcccggtacgatcctagatttaactcatggatccagctgcccccgatgcaggagagacgggccagcttctacgcgtgcagattagacaaacacctttatgtcatcgggggccgaaacgagaccgggtacttgtctagtgtggagtgctacaacctcgagacaaatgagtggcgatatgtgtcctcgttgccccagcctctagcggcacacgccggcgctgtgcacaatgggaagatctacatcagtgggggcgtgcacaatggggagtatgtgccctggctttattgttatgaccctgtgatggacgtatgggcgagaaagcaggatatgaataccaaacgcgctatccacaccttagccgttatgaatgatcgcttatatgctattggaggtaaccatctcaaggggttctcacacctcgacgtgatgttggtagagtgttatgatccaaaaggggatcagtggaacattctccagacccccattctggagggccggtctggtccagggtgtgccgtgctggatgattccatctatcttgtgggtggctactcctggagtatgggagcctacaaatcctctactatttgctactgtccagaaaaagggacctggactgagctcgaaggagacgtggccgagcctctcgcgggtccagcctgcgttactgtgattctgccttcatgtgtcccatacaacaagtag

SEQ ID NO: 192206 - DNA, 1794 bp, Artificial Sequence
  Description of Artificial Sequence: Synthetic coding sequence
atggtgtggctggaggcccggccccagatcctgttcgtgtgcaccaagcagggacaccagaaacccctcgatagcaaagatgacaataccgagaagcactgccctgtcaccgtgaatccctggcatatgaagaaagcctttaaggtgatgaacgaattgaggtctcagaacctgttgtgcgacgtaacaatcgtggccgaggacatggagatctccgctcatcgcgtcgtgttagccgcctgttccccctactttcacgcgatgttcactggcgagatgagtgagtctagagccaagcgagtacgcatcaaggaagtggacgggtggactcttaggatgctgatcgactatgtctacacagcagaaattcaggtgaccgaggaaaacgttcaagtcttgttacctgcagcaggcctcctgcagcttcaagacgtcaagaagacctgttgcgaattcctggaatcgcaattgcatccagtcaattgcctgggcattcgggcattcgcagatatgcacgcttgtacggatctcttgaacaaggccaacacgtacgctgagcagcactttgcagatgtggtactgtctgaggaattcctcaatctaggcatcgagcaggtgtgctctctcattagttcagacaaactcactatcagctcagaggaaaaggtttttgaggctgttattgcttgggtgaaccatgataaggatgtgcggcaggaattcatggcaaggctgatggaacacgttcgtctaccgttactgcctcgggaatacttggttcaaagagtcgaggaagaggctttggtcaaaaattcaagcgcctgcaaggattatctgattgaggctatgaagtaccaccttctgcctactgagcaaaggatcctcatgaagtccgtgcgcactagactgcgtacacccatgaacctacccaaactaatggtggtggtgggcggacaggccccgaaggcaatcagatcagtagagtgctacgacttcaaggaggagcggtggcaccaggtggccgaactcccgagccgacgctgcagggcgggcatggtctatatggcggggctcgttttcgccgtgggcggctttaacggtagtctgagagttaggacagtcgactcatatgatcctgttaaggaccagtggacaagcgtcgccaacatgcgggatagacgctctacgttgggggctgctgtgctgaatggacttctgtacgctgtgggcggtttcgatgggagcacagggctgtcctctgtggaggcctataacataaaaagtaatgaatggtttcacgtagcaccaatgaacacacggcgttcctcggtgggagttggagttgtcgggggtctgctatacgcagtgggcggctacgacggggcgagtaggcagtgcctgtccaccgtggaatgttacaatgcgaccaccaacgagtggacatacatagcggaaatgtccacacgcaggtccggtgcgggtgtaggcgtcctcaacaatctcctctatgcggtgggaggccacgacgggcctctggttcgaaagtccgtggaggtctacgaccccaccacgaatgcttggcgacaggtagccgatatgaatatgtgcagaagaaacgccggagtgtgcgccgtgaatggtttgctgtacgtagtgggcggggatgacggcagttgcaacctggcttcggtcgaatattacaacccaacaactgacaaatggaccgtggtgtctagttgtatgtctaccgggcgctcttacgctggggtcacagtgatagacaagcctttatag

SEQ ID NO: 192207 - DNA, 2640 bp, Artificial Sequence
  Description of Artificial Sequence: Synthetic coding sequence
atgcggctgcacctgctgctgctgctggccctgtgcggcgccggcactacagccgccgagctctcttactcgttgcgcggcaactggtctatctgtaatggaaatggcagcctcgagttgcctggcgcagttccaggctgtgtgcacagtgccctcttccagcaagggttgatacaggatagctactaccgattcaatgacttaaactaccgctgggtctctctggacaactggacttacagtaaggaattcaagataccctttgaaatctcaaaatggcagaaagtgaatctgattttggaaggagtagacaccgtgtccaagatccttttcaacgaggttacaatcggtgagacggacaatatgtttaatagatacagcttcgacattaccaacgtggtgagagacgtgaatagcatagaactgcgctttcaatctgccgtcctgtacgccgcccagcagagtaaagctcacactcggtaccaggtgcctcccgactgcccacccctggtgcagaagggggaatgccacgtcaacttcgtacggaaagagcagtgttcatttagctgggattggggaccttctttccccacacaaggtatatggaaggacgtgcggatcgaagcctataacatctgccatctgaattactttaccttctcaccaatctatgacaagagtgctcaggagtggaaccttgaaattgagagtaccttcgacgtagtgtcctcgaagccagtcggaggccaagtcatcgtggcaattcccaaactccagacacagcagacctattctattgagttacagcctgggaagagaatagttgaactgttcgtgaacatttcgaaaaacataacagttgaaacctggtggccccatggacacggaaatcagactggatataatatgactgtgctatttgagcttgatggcggcttgaatatcgagaagtcagctaaggtctattttcgaaccgtcgaactgatcgaagaacccattaagggtagccccggtttatccttctacttcaaaataaacggcttccctattttcctaaaagggtctaactggattcctgccgactcattccaagatcgggtgacgtcagaactgctccgcctgctattacagagcgtggtggacgccaacatgaataccttaagagtatggggtgggggaatttatgagcaggacgagttttatgagctctgtgacgaattgggtatcatggtttggcaggattttatgttcgcttgtgccctctatccgactgaccagggctttctcgactctgtgaccgccgaagttgcatatcagattaaaagactgaaatctcacccctcgattattatctggtcaggaaacaatgagaatgaggaagctctcatgatgaactggtaccacatcagctttaccgatcggcctatctacatcaaggactacgtcactctctatgtaaagaatattcgtgagctggttcttgcgggcgacaagagtcggcccttcatcactagctcccccacaaacggcgcggaaacggtggctgaagcatgggtttcacagaacccaaactccaactacttcggcgacgtgcatttctatgactacatctccgattgttggaactggaaggtcttccctaaagcccggttcgcatctgaatatggctatcaaagttggccttccttctctacgctggaaaaagtgagttctactgaggattggtctttcaacagcaagttcagcctgcatagacaacatcatgaggggggcaataaacagatgctgtatcaggcaggactgcacttcaaactaccccagtcaactgacccattgcgcactttcaaggataccatttacttgacacaggtaatgcaggctcagtgcgttaaaacagaaacagagttttatcggcgtagccgcagcgagattgtcgaccagcagggccataccatgggcgccttgtactggcagctgaatgacatttggcaggcgccttcttgggcctcgctggaatatggaggcaagtggaagatgctgcactactttgctcaaaactttttcgcaccacttctgccggtggggttcgagaatgaaaacacattctatatctacggcgtctctgaccttcacagtgactatagtatgaccctttcagtgcgtgtccacacatggtcctctctggaaccagtttgttcaagagtcacagagaggttcgtgatgaaaggaggagaagcagtgtgcctatatgaggagccagtgtccgaactcttacggcggtgcggcaattgtacacgagaaagttgcgtggtcagcttttacttaagcgccgaccacgaactgctctcacctactaattatcatttcctgtcctcaccaaaggaagcagttggactgtgtaaagcgcagattaccgcaattattagtcagcagggagacatcttcgtgtttgaccttgagacttccgcagtggcacccttcgtgtggctcgacgtcgggtccattccggggcggttcagcgataatggatttctgatgacagagaagacacgaactattctgttctatccgtgggaacccactagcaaaaatgaactcgagcagtcctttcatgtgacctccctcacagacatttactag

SEQ ID NO: 192208 - DNA, 1518 bp, Artificial Sequence
  Description of Artificial Sequence: Synthetic coding sequence
atgagcgagagccgggccaagcgggtgcggatcaaggaggtggacggctggactctccgcatgttaatcgactatgtatacacagccgaaatacaggtgactgaggaaaacgttcaggtactgcttcccgcagctggactgctccagctgcaggacgtgaaaaaaacctgttgcgagtttctggaatctcagctccaccctgtcaactgtctggggattcgggccttcgcagatatgcatgcgtgtactgacctgctgaacaaagctaatacctacgccgagcagcacttcgctgacgtggtgctctcggaagaattcctgaatttggggatcgaacaggtttgttcattgattagttccgacaaactgactatcagctctgaggaaaaagtgtttgaagccgttatcgcatgggtaaaccatgataaggacgtcagacaagagttcatggcccgcctgatggaacatgtccgtctccccttgttacctcgtgagtaccttgtgcagagggtggaggaggaggcactcgttaaaaattcttccgcgtgcaaggactatctgattgaagccatgaaataccatttgttgcccaccgagcagcggatccttatgaaaagcgtgaggacccgcctaagaacacccatgaacctgcctaaactaatggtagttgtaggcggccaagccccaaaggcgattcggagtgtcgagtgctatgacttcaaggaggaacggtggcatcaggtagccgagttaccgtctagaaggtgtcgggccggaatggtgtatatggctggattagtcttcgccgtcgggggctttaacggctcacttagagtgaggaccgtggatagttacgatccagttaaggatcagtggaccagcgtcgctaatatgagagacaggcggagtaccctaggggccgccgtgctgaatgggctgctgtacgcagtcggcgggttcgatggctctacggggctgagttctgtggaggcttataatattaaatcgaacgagtggtttcacgttgcaccgatgaacacgcggcggagtagcgttggtgtcggggtggtgggcggcctgctgtacgccgtggggggatacgacggcgcctcccgtcagtgtttatcaacggttgaatgttataatgccacaaccaatgagtggacatacattgctgaaatgagtactagaagatctggggccggcgtgggggtgctgaacaacctgttgtatgccgtcggcggccacgatggcccccttgtgcgaaagtctgttgaggtctacgaccctactactaacgcctggcgccaagtcgcggatatgaatatgtgcaggagaaacgcgggagtttgcgcagtcaatggcctgctctacgtggttggtggggacgatggtagttgcaatctggctagcgtcgagtactacaatcccaccaccgacaaatggaccgttgttagctcatgcatgagcaccggtcggagttatgctggggtgaccgtcatagataaacctctatag

SEQ ID NO: 192209 - DNA, 1764 bp, Artificial Sequence
  Description of Artificial Sequence: Synthetic coding sequence
atggagggcgagagcgtgaagctgagcagccagaccctgatccaggccggggatgacgaaaagaaccaaagaacgattactgtaaatccggcacacatggggaaagcgttcaaagtgatgaacgaactgcgcagcaagcagctgctttgtgacgtaatgatagtggcggaagacgtggaaatcgaggcacacagggtggtcctcgccgcatgctcgccatacttctgcgccatgttcactggtgatatgtccgagtccaaggccaaaaagatcgaaattaaggatgtcgacgggcagaccctctcaaagttaattgactatatctacacagcagagatcgaagtgaccgaggagaacgtccaggtgttgctccctgcagcttccctgttacagctgatggacgttcgccagaactgctgcgacttcctccaatctcagctgcaccctacaaactgtctaggaataagagcgtttgccgacgtgcatacgtgtactgacctgcttcagcaagctaatgcctacgccgagcagcattttcctgaagtgatgctcggcgaagagttcctaagtttgtcgctcgaccaggtgtgtagcttaatttccagcgacaaacttactgtgtcttctgaggaaaaggtatttgaggctgttatctcatggattaattatgaaaaggaaacaagactcgagcacatggcgaaactgatggagcatgtcagattgccccttttgccgcgagattaccttgtgcagactgtagaggaggaagcccttatcaagaataacaatacctgcaaagacttcctgatcgaggcaatgaagtaccacttgcttccgctggaccagcgcctactgatcaagaatccccggaccaagccaagaacaccggtgagcttgcctaaggtaatgatcgtcgttggagggcaggcacccaaggcaatcagaagcgtagaatgctacgactttgaagaggataggtgggatcagatcgcagaactgccatcaagaaggtgtcgcgctggggtggtgttcatggcgggacatgtctatgcggttggcgggttcaacggctccctgcgcgttcggactgtggatgtgtacgatggagttaaggatcagtggaccagcatcgcttcgatgcaggagcgtaggagcactctcggcgcggctgtgctaaatgacctgctgtatgcagtgggcggctttgatggcagcaccggtctggcctccgtggaagcatacagctataagaccaatgagtggttctttgtcgcccctatgaacacaaggcggtcctctgtcggcgtgggcgtggtggagggtaagctgtacgccgtcggggggtacgacggggcaagtagacagtgtttgagcaccgtagagcagtacaacccggccacaaatgagtggatttacgtggccgatatgtctactcgacggagcggcgccggtgtcggtgtgctgtctggccaactgtacgccacgggcggacacgacgggccgctggtgaggaaatctgtcgaggtttacgatcccgggacaaatacttggaaacaggtagccgatatgaacatgtgcaggcgtaacgctggcgtctgcgccgtgaacgggctgctgtatgttgttggaggagacgatggcagctgcaacctggcctccgtggagtattataaccccgtgactgacaagtggaccttactgcccactaacatgtctactggcaggtcttacgcaggggttgccgtgatccacaaatcactctag

SEQ ID NO: 192210 - DNA, 906 bp, Artificial Sequence
  Description of Artificial Sequence: Synthetic coding sequence
atggagggcgagagcgtgaagctgagcagccagaccctgatccaggcgggagacgatgagaagaaccagaggactatcactgtgaacccagcccacatgggcaaggcctttaaagtgatgaatgagctgcgatccaaacaattgctgtgcgacgtaatgattgtggccgaagacgtggagatcgaggcacaccgagtcgtgctggctgcttgcagcccctatttttgcgcaatgtttacaggtgatatgagcgaatccaaggctaaaaagattgaaataaaggacgtggacggacagacgctctctaaattaatcgattacatttacacagctgagattgaagtaacagaggagaatgtacaagtgctcctgccagccgcctcactgttacagttaatggacgtgaggcaaaactgttgtgattttctgcagtctcagttacaccccaccaattgccttggaatcagagccttcgccgacgtccatacttgcactgacctgctgcagcaggcgaatgcctacgcagaacaacacttccccgaagtgatgctgggtgaggaattcctcagtctgtcgttagatcaggtgtgctctctgatcagttcggataagttaacagtcagcagcgaagaaaaagtttttgaagccgtcatttcatggattaactatgaaaaggagacccggctggaacacatggctaagcttatggagcatgtgcgtctccccctgcttcctcgcgactacctggtgcagaccgtcgaggaggaggcccttatcaagaacaacaacacctgtaaagattttctgatcgaggcaatgaagtaccacctacttccattggaccagagactgttgatcaagaaccctcgaaccaaaccaagaacccctgtgagtctgcccaaatag

SEQ ID NO: 192211 - DNA, 1518 bp, Artificial Sequence
  Description of Artificial Sequence: Synthetic coding sequence
atgagcgagagcaaggccaagaagatcgagatcaaggacgtggacgggcagacactcagcaagttgattgactacatctacaccgccgagattgaagtgaccgaggaaaatgtgcaggtgttgctgcctgcagccagtcttctacagctgatggatgtcagacagaattgctgcgatttcctgcagtcccaactgcaccctacaaactgtctcggaattcgagccttcgctgatgtgcacacatgcacagatctgctacagcaggccaatgcttacgctgaacaacacttccctgaagtaatgctgggcgaggaatttcttagcctgagtttggaccaggtgtgcagtttgatttcaagtgacaagctgaccgtttcctccgaggaaaaggttttcgaagcggtgatctcctggataaattacgaaaaggaaactcgcctggaacacatggccaaattgatggaacatgtgcggttgccactgctcccccgtgattacctggttcagacggtcgaggaggaagccctgattaaaaataacaacacttgcaaagatttcctcatagaggccatgaagtatcacctgctgcccctggaccaaaggctactgatcaagaatcctcgcaccaagccaagaacaccggtatcacttcccaaggtgatgatcgtggttggcggacaggctccgaaggcgattcgaagtgttgagtgctacgattttgaagaagatcggtgggatcaaattgccgaacttcccagtagaaggtgtagggcaggcgttgtgttcatggctggccatgtgtacgccgtgggtggttttaatggaagtttacgcgtgcggacagtcgacgtctacgacggcgtgaaggatcagtggacttccatcgccagtatgcaggaacggagaagtaccctcggagcagccgtgctgaatgatctcctgtatgccgtaggcggcttcgacgggtctaccggtctcgcgagtgtcgaagcctatagctataagaccaacgaatggttttttgtggctccaatgaatacccgccgtagctccgtgggggtaggagttgtcgaaggaaaactatacgcggtgggcggctatgatggtgccagccgtcaatgtctgtccactgtggaacagtacaacccagccaccaatgagtggatttacgtagctgatatgtctacacggcggtcaggggctggagtcggagtgctatctggtcagctttacgccacaggcggccacgacggccccctggttcgcaagagcgtcgaagtctacgatcctggaacaaacacttggaagcaggtggccgatatgaatatgtgcaggcgcaatgctggcgtttgtgcagtaaacggattgctgtacgtggttggtggggatgacgggtcatgcaacctggcctccgtagagtactataatccagttacagataagtggacgttgctgccaactaatatgtctaccgggcgctcctacgccggtgtggcagtgatccacaaatccctgtag

SEQ ID NO: 192212 - DNA, 603 bp, Artificial Sequence
  Description of Artificial Sequence: Synthetic coding sequence
atgagccggtgctgcagccggcagcccgcctgctgcagcagctggatgttcggcaggaccgctgtgacttcctgttccctcagctgcatcccacccattgcgtgggcgagcgtccatttacagatgtataccccagccctaacattttgcagccgcccaatgcccacacagcactttcccgaggtcatgttgggcgaagaatttctgtctttgtctctggaccaggtatgtagccttattagcagtgacaaactgactgtgtccagcgaggaaaaggtgtttgaagcagtgatctcctggattaactatgaaaaggagacgcgactggagcacatggccaagctgatggaacatgtgaggctacccttgctgcccagagattacttggtgcagacagttgaagaagaggccttgatcaaaaacaataatacatgcaaagattttctgattgaagcaatgaagtaccatctactcccactggatcaacgactgttgattaagaatccccggactaagcccaggacaccagtgtcactgcccaaaggactcgagtgtctggcggattcttgtaccccacaagtggggatgatgggcctctggtag

SEQ ID NO: 192213 - DNA, 1668 bp, Artificial Sequence
  Description of Artificial Sequence: Synthetic coding sequence
atgggcaaggccttcaaggtgatgaacgagctgcggagcaagcagctgctgtgtgatgtaatgatcgtggcagaagatgtagagatagaggcccacagagtcgtgctggcagcttgctctccctatttctgcgctatgtttactggggacatgagcgagtccaaagctaagaagatagagattaaagacgtagatggtcaaacgttgagtaagctgatcgactacatttacaccgccgaaatcgaagtgacggaggagaatgtacaggtgctattgcctgctgcctcacttctgcagcttatggacgtccggcagaactgctgtgacttcctacaatcccagcttcatcctacaaattgcctcggcattagagcttttgccgacgtgcacacctgtactgacctactgcagcaggcaaatgcgtatgccgaacagcatttccccgaggtcatgttgggggaagagtttttgagtctgtctttggaccaggtgtgttccctgattagctctgataaactgactgtcagcagtgaggagaaagtcttcgaggcagtgattagttggatcaactacgagaaagagactcggctcgaacatatggccaagctgatggaacacgtgcggttaccactcctgccacgcgattaccttgtgcagaccgtcgaggaagaggctttgattaagaataacaacacctgtaaagacttcctcatcgaagccatgaaataccacctcctgcctcttgatcaacgccttcttatcaagaatccccgtaccaagcctcgaacccccgtctccctcccaaaagtgatgatagtggtcggagggcaagcaccaaaggccattcgcagcgtagaatgctacgactttgaagaggaccgttgggaccagatcgccgaattaccgagtcggcgctgtagagctggtgtcgtcttcatggcgggacacgtatacgccgtgggaggcttcaatggatccctcagagtgagaacagtggatgtgtacgacggggtgaaagatcagtggacttctatcgcctctatgcaagagcgccgctctacccttggggcagctgtcctgaacgacctgctgtatgccgtcggtggctttgatggcagtacaggactggcgtctgtcgaggcatactcctataagaccaacgagtggttttttgtagcgcccatgaacacaagacgcagttctgtgggggtgggtgttgtggagggaaagctatacgcagttggcggctacgatggcgccagtagacaatgtctgtccaccgtagaacagtataacccggccacaaacgaatggatttacgtggcagatatgagtacaagaagaagtggcgcgggagtaggagtcctcagcggtcaactctatgctaccggagggcacgacggcccccttgtccgtaagtcagtcgaggtctacgaccctggcaccaatacctggaagcaggtcgcagacatgaacatgtgcagaagaaatgcaggtgtgtgcgcggtgaacgggctcctttacgtggtggggggcgatgatggaagctgcaatcttgcatccgttgaatactataaccctgtcacggataagtggacattactgcccactaacatgtctactggacggtcatacgctggggttgcagtcatccacaagagcctgtag

SEQ ID NO: 192214 - DNA, 1905 bp, Artificial Sequence
  Description of Artificial Sequence: Synthetic coding sequence
atggcccccaagaagaagatcgtgaagaagaacaagggcgacatcaacgagatgaccataatagttgaggactcccccctcaataagctgaacgcactgaacggacttctagaggggggtaacggcctgtcttgcatctctagtgagctgacggacgcatcctacggcccaaatctgctcgaaggccttagcaagatgcggcaggagaattttctgtgcgacttagtcatcggaacgaagaccaagtccttcgatgtgcataaatccgtcatggcctcgtgcagtgaatatttttataatattcttaaaaaagacccctctatccaaagggtggacctgaatgacatcagtccactcggactggcaaccgtaatagcatacgcctatacggggaaattaaccctctctctgtacaccatcggatctattatatccgctgccgtttacctccagattcatacgctcgtcaagatgtgttcggattttctgattagggaaatgtcagtcgagaactgcatgtatgttgtgaacattgctgaaacttactcattgaaaaacgctaaagctgctgctcagaaattcattcgtgataactttttagagttcgcggaatccgaccagtttatgaagttgacatttgagcaaattaatgagctgctcatcgacgatgatctccagctcccatcggaaattgtggctttccaaatcgctatgaagtggctggagttcgatcagaagagggtgaaatatgcggcggacctgttgtctaatattagatttggcacgatctcggcacaggacctcgtcaattacgtccagagtgtcccccgaatgatgcaggatgctgattgccataggttgctggtcgacgccatgaactatcacttactcccttaccaccagaataccctgcagtctcgaagaacccgtattcgagggggatgcagggtgcttgtcaccgtgggcgggaggcctggactcaccgaaaagtcgttgtctcgagatatcctttacagagaccctgagaacggctggtcaaaactgacagaaatgcccgcaaagtctttcaaccagtgtgttgccgtgatggacggttttttgtacgtggccggcggggaggatcagaatgacgctcgaaatcaggccaagcatgccgtatccaacttttgcagatacgacccacggtttaacacctggattcacctagcgtcgatgaaccagaagaggacccacttcagcttgtccgtgttcaacgggctggtttacgcagccggtggtcgaaatgcagaagggagccttgcttccctggagtgttacgtgccctccaccaatcaatggcagcccaaaactcccctggaagttgctaggtgctgccacgcttcggccgtagcagacggcagggtcttagtcactggcgggtacatagccaatgcctacagccgatcagtgtgtgcatatgatccggcaagcgattcctggcaggagctgcccaatttgagtacgccccgagggtggcattgtgccgtgaccctctcagatcgggtatacgtcatgggcggttctcagcttgggcccagaggcgagagagtggacgtacttacggttgagtgctattcgccggccacaggccagtggagctacgctgcacctctccaggtaggagtatccaccgccggagtttccgctctgcacggcagggcttacctggtggggggctggaatgagggagagaagaagtataagaagtgtatccaatgcttctcccccgaacttaacgagtggaccgaggacgacgaactgcccgaggctacagttggagtgagctgctgtaccctgagtatgccaaacaatgtcacgagggaaagcagagcatcctccgtgtcttctgtcccagttagcatatag

SEQ ID NO: 192215 - DNA, 1905 bp, Artificial Sequence
  Description of Artificial Sequence: Synthetic coding sequence
atggcccccaagaagaagatcgtgaagaagaacaagggcgacatcaatgagatgaccatcattgtcgaggactcccccctgaacaagctaaatgcgctgaacggattgctggagggcgggaatggattgtcttgcatatcttccgaactgaccgatgctagctatggcccaaatttactcgaaggactctctaaaatgcggcaggagaacttcctatgcgacctggtgatcggcaccaagactaagtcctttgatgtgcataaatccgtgatggctagctgctctgaatatttttataacatcttgaaaaaggatccatccattcaaagagtggaccttaacgatataagccccctgggactcgcaacagtgatcgcatatgcctatacaggaaagctgacattatctctgtacaccattggcagtataatcagcgcggcggtgtacctgcaaatacacacactggtgaaaatgtgttcagacttcctgattcgggagatgagcgtagaaaattgcatgtacgtcgtgaatattgctgaaacttattctctcaaaaatgccaaagcagccgcacagaagttcatacgggacaacttcctggaatttgccgaatcagatcagtttatgaagctgacattcgaacaaatcaatgaactcctaattgatgatgacctgcaactgccctctgaaattgtggcattccagatcgctatgaagtggttagagtttgatcagaagcgcgttaaatatgccgccgatcttttgagcaatatccgcttcggaaccatctctgcacaggacctggtgaattatgtgcagagcgtgcccagaatgatgcaagacgctgactgccaccgtctgttagttgatgccatgaattaccacctgttgccgtatcaccagaataccctccaatctaggaggaccagaatcagaggcgggtgtagagtcctcgttacagtgggaggcaggcccgggctcactgaaaaaagtctgtccagagatattctgtaccgggaccccgaaaatggatggagtaagttgactgaaatgccagccaaatcatttaatcagtgtgtggccgttatggatggctttctgtacgtggctgggggggaagatcaaaacgatgctaggaaccaggccaaacacgctgtgagtaatttttgcaggtatgatcccaggtttaacacctggatccatctcgccagcatgaatcagaagcggacccatttctccctgtcagtatttaatggcctggtttatgccgcagggggacgaaatgctgaagggtccctcgctagcctggagtgttacgtcccttcaactaaccagtggcagcccaaaacacctttagaggtggctcggtgttgccacgcctctgcggtcgctgacggaagagtcttagtgacaggggggtatatcgccaatgcttatagcagatccgtctgcgcatatgatcctgctagcgatagctggcaggaactgcccaacttaagcacccccagaggatggcattgcgcagtgacactctccgatcgggtctatgtgatgggcgggtcccagcttggtccacgcggggaacgggtggatgtgctgacagtcgaatgctactctcctgcaactggccagtggagctatgctgcccctctgcaggtgggtgtgtccactgcaggtgtttccgcgctgcatggccgtgcgtatctcgtgggaggctggaacgaaggcgaaaagaagtataagaaatgtattcagtgtttcagccctgaattgaacgagtggacagaggacgatgaattgccagaagctaccgttggcgtatcgtgctgtacgctttcgatgcctaacaatgtgactagagagtcccgtgcgtccagcgtgagctctgtgcctgtgtcaatttag

SEQ ID NO: 192216 - DNA, 2313 bp, Artificial Sequence
  Description of Artificial Sequence: Synthetic coding sequence
atgaacgtgatctacttccccctgcacatcttcgtggtgtacagccgggcctacacgtcacttgttctggtggggtgcacaaatttatgcgcagtgctgttcgcaagatgtctcgacgatcacctggtcagcttgagaatgtccggatccaggaaagaattcgatgtgaagcagattttgaaaattcgctggcgctggttcggacatcaggcctcatctccaaatagcactgtggattctcagcaaggggagttctggaaccggggtcagacaggcgccaatggcggcagaaagtttctggatccttgtagtctgcagctgcctctggcctccatcggatacagacggtcttcccagcttgatttccagaatagcccctcttggcccatggcatcgacttcagaagttccagccttcgagtttacggctgaagattgtggaggcgctcattggctggaccgcccagaggtcgacgatggaacttcagaggaagaaaacgagtctgacagcagttcctgtcgaacaagcaactcatctcagaccctcagcagttgccacactatggaaccctgtacttctgatgaattctttcaggccctcaaccatgccgaacagacgtttaaaaaaatggaaaattacctacgtcacaagcagctttgcgacgttatcctggttgcgggcgatcgccggatccctgctcatcggttggtgttgtcaagtgtgtctgattactttgctgctatgttcacaaacgacgttagggaggctcggcaggaggagattaagatggagggggtggagccaaactccctatggtccctaatccagtacgcctacaccggaagactcgagctgaaggaagacaatatcgagtgcctgttgtctaccgcttgtctgctccagctcagccaggtcgtggaggcatgctgcaaattcttgatgaaacagttgcaccccagcaattgtttgggcatcaggtccttcgcagatgcccagggctgtacggatcttcacaaggtggctcacaattatacaatggaacattttatggaggtcataaggaatcaggagtttgtgctgctgccagcatcggagattgctaagttactggcgtccgacgacatgaatataccaaatgaggaaactatcttaaatgcattgctgacatgggtgcggcacgatttggaacagcggaggaaggatctctccaagctcctggcatatattaggctgcccctgctggcgcctcagtttctcgctgatatggaaaataacgttttgttccgtgatgacattgaatgccagaaacttatcatggaagccatgaaataccacctcctccctgagaggaggcctatgttgcagtcccctcgtacaaaaccacgcaaatcaaccgtcggaaccctctttgctgtggggggcatggattcaactaagggagcaaccagcatcgagaagtacgacctcagaaccaatatgtggacgccggtggctaacatgaatggccgaaggcttcagttcggagtcgccgtcctggatgacaagctgtacgtggttggcggccgggatggactgaaaactttaaatacagttgagtgctataatccaaaaaccaaaacttggagcgtgatgccccccatgtcaactcatagacacggattgggagtcgccgtgctggaggggccaatgtatgcggtcggcggtcacgacggttggtcttacctcaatacggtggagaggtgggacccacaggctaggcaatggaactttgtggccacaatgagtacaccacggtccaccgttggagtcgccgttctttcggggaaactctacgctgtgggaggtcgcgacggtagctcttgtctaaaaagtgtagaatgtttcgatccccacacaaacaagtggaccctgtgtgcccagatgtccaaacgcagaggcggagtcggggtgacaacgtggaatggtctgctgtacgccattggaggtcacgatgctccagcatcaaatcttacttctcggcttagtgactgtgtggagcgctacgaccctaagacagatatgtggaccgctgtagcatcaatgtctatttctcgcgatgcagtgggcgtgtgcctgttaggcgataaattgtacgccgtgggtggatatgacggccaggcctacttaaataccgtggaggcctacgacccccaaaccaacgagtggacacaggtattctcccatacctttgaagacagcaaagaccacctcgtcgccatcaagcagacaatttggcgccaaaactctctcagcgaggaattccgttctcactag

SEQ ID NO: 192217 - DNA, 2274 bp, Artificial Sequence
  Description of Artificial Sequence: Synthetic coding sequence
atgaacgtgatctacttccccctgcacatcttcgtggtgtacagcagggcgtacacatctttggtgttagtgggctgcaccaatttgtgcgccgttctcttcgccagatgtctggacgaccacttggtatcccttagaatgtcaggttcgcggaaagagttcgacgtgaaacagatcctgaagatacgttggcgatggtttggacaccaagcttcaagtcctaattccacagtggacagccaacagggcgaattttggaaccgcggacagacaggcgctaatggtggcaggaaatttcttgacccttgtagcctgcagctgccgctggcctccatagggtaccggagatcttctcagttagattttcagaactccccctcctggccaatggcgtccacaagcgaagttcccgcttttgaatttactgctgaagactgtggaggcgcccattggctggatagacccgaagtcgatgacggtacttcagaggaagaaaacgagtctgactcctcttcatgccgcacctccaacagcagccagaccctgtcaagctgccacactatggagccgtgtacctccgatgaatttttccaggctctcaaccacgcagagcagaccttcaaaaagatggagaactatctgagacacaaacagttatgcgatgtgatattggtcgccggcgatcggagaatccccgcacacagattagtcctgagttccgtcagtgactactttgcagccatgtttacaaacgatgtgcgggaagcccgacaggaggagattaagatggagggcgttgagccaaatagcctgtggagcttaatacagtatgcctataccgggcgcctggagctgaaggaggacaatatcgaatgcctactgtcaaccgcatgtttgctgcaactgagccaggtcgtggaggcttgttgcaagtttctcatgaaacagcttcatccctccaattgccttggcattagatctttcgccgatgcacagggttgcactgacctgcataaggtggcccataactataccatggagcactttatggaagttatccggaaccaggagttcgtgttgctgccagcctccgagatcgccaagctcctggcttctgacgacatgaacatcccaaatgaggaaacaatcctgaacgccctcctgacttgggtgagacatgacctggaacagcgccgtaaagatctctcaaaattattggcctacatccggctccctctcttggcaccacagttcttagcggacatggaaaataatgtgttattccgcgatgacatcgagtgtcagaagttgatcatggaggccatgaagtaccatcttctcccagagcgcaggccgatgctgcaaagcccaagaaccaagccccgcaaaagtactgtgggaaccttgtttgctgtcggcggcatggactcaacaaagggggccacgtccatcgagaagtatgacttgcggactaacatgtggacacctgtggctaatatgaacggaaggcgtttacagtttggcgtggccgtactcgacgataaactgtacgtggtcggaggccgagacggcctcaagaccctaaataccgtggaatgctataatcctaagaccaagacatggagcgtcatgccaccaatgtctacgcaccgccatgggctgggggtggccgttctggaaggacccatgtacgccgttggaggacatgacgggtggtcgtatctgaacacagtcgagcggtgggatccacaggcccgacagtggaattttgtggcaactatgagcactccacgctctacggtgggagtggccgtgctatccgggaagctgtacgccgtaggagggcgcgacgggagtagctgtctcaagagcgttgaatgctttgatccccacactaataaatggacactatgtgcgcaaatgtcaaaacgcagagggggggtgggggtcaccacatggaacggtctcctctacgccataggcgggcacgacgcgcctgcatctaatctaacatccagattgagtgactgcgtggaaagatacgatccaaaaaccgacatgtggactgctgtggcatcaatgtccatctcacgcgatgcagtgggggtgtgcttgctgggagacaagctctacgccgtaggcggctatgacggccaggcctatctgaatacagtcgaggcgtacgatccacagacaaatgaatggacacaggtttggcactcttgttttatcatcacgctgaccctttttctccttaaacagttcctctggtag

SEQ ID NO: 192218 - DNA, 2268 bp, Artificial Sequence
  Description of Artificial Sequence: Synthetic coding sequence
atgaacgtgatctacttccccctgcacatcttcgtggtgtacagccgcgcctacacaagcctggttttagtaggatgtactaatctgtgcgcagtcttgttcgccagatgcctggatgatcacttagtttctctgcgaatgagcggaagccgcaaggagtttgacgtgaaacagatcctgaaaataaggtggagatggtttgggcaccaggccagcagtcccaacagtacagttgacagtcagcaaggcgagttctggaacagaggtcagactggggccaatgggggccgcaagtttctcgatccctgcagcctgcagctgcctttggcatccattggctataggcgctcctctcagctcgatttccagaatagtccctcatggcctatggcttcgacatctgaagtacccgctttcgagtttactgcagaggattgcggcggagcacattggctagatcggcccgaggtcgacgacggaacatcagaagaggaaaatgagtccgacagcagttcctgcaggacatctaactccagccagaccttgagttcatgccacacaatggagccttgtactagcgacgagttctttcaggccctcaatcacgctgaacagacgtttaaaaagatggagaattacctgagacacaaacagctgtgtgacgtgattcttgtcgccggcgatcgacggataccagcccaccgcctcgtgttaagctctgtgtctgactactttgctgcaatgtttacgaacgacgtgagggaagcccgccaggaggagataaagatggagggagtagaacccaatagtctgtggagcctgattcagtacgcctatacaggaaggctcgagctaaaggaagataacattgagtgcctgttgtccacagcctgtctgttgcagctgagccaggtggttgaggcctgctgcaaattcctaatgaagcaactgcacccctccaactgcctgggcatcaggtcctttgctgacgcacaaggctgcactgacctgcacaaggtggcccataattacacaatggagcattttatggaggtcatccgaaatcaggagttcgtattgcttccggcatccgagatagctaaactactcgcttccgatgatatgaatatccctaatgaggagacaatcctgaatgcacttttaacttgggtgagacacgacctcgaacagaggagaaaggacctgtccaaacttctggcatatattcgcttgcctttgttagctccacagttcttggccgacatggaaaataatgttctcttccgtgacgatattgagtgtcaaaaactcatcatggaagcaatgaagtaccacctgcttcctgaacggcggccgatgctccagagcccaaggaccaagcctcgcaagagtactgtgggcactttgtttgccgttggtggaatggatagcactaagggagccaccagtatcgagaagtatgatctccggacaaatatgtggaccccagtcgccaatatgaacggaagacggctccaatttggagtggccgtgctcgacgataagctgtacgtggtgggtggccgtgacggcctcaaaactctcaatacagtggagtgctataatcctaaaacaaagacatggagtgtgatgccccccatgtcaacacacaggcacggtttgggagtcgctgtcttggaaggacccatgtatgctgtgggggggcatgacggctggtcgtacctcaacacagtggagcgctgggaccctcaggcacgccaatggaacttcgtggccaccatgagcacacctcggtccaccgtgggagtggccgtactgagcggaaaactatacgcagtcggcggccgcgacggctcaagttgcctcaaaagtgtcgagtgttttgatccccacaccaacaaatggaccctgtgtgcacagatgtccaaacggcgcggtggggtgggagtcaccacctggaatgggttgctatacgcgatcggaggccatgacgcccctgcatctaatctgacctcccgcctaagtgactgtgttgagcgatatgatcccaagaccgatatgtggaccgccgtagcatctatgtccatttctcgcgacgcagtcggtgtatgtcttttgggcgataaattatatgccgttggtgggtacgatgggcaggcgtacctcaataccgtggaggcctacgatcctcagaccaatgagtggacccaagtcgcgccactgtgcctgggcagagctggagcctgtgtggtcaccgtgaaattgtag

SEQ ID NO: 192219 - DNA, 849 bp, Artificial Sequence
  Description of Artificial Sequence: Synthetic coding sequence
tgacggaccaacatgtggacccccgtggccaacatgaacggccggagacttcagtttggggtggctgtattggacgacaagctgtatgtcgtcggcggccgggatggtctgaagacactgaacaccgtggaatgctataacccaaagaccaagacgtggagcgtaatgcctcctatgtcaacccaccggcacgggctgggagtggccgtcttggagggacccatgtacgccgtcgggggacatgatgggtggagctatttgaacacggtggaacgttgggacccccaagctcgccagtggaacttcgtggctacgatgtctaccccccggtccaccgtgggcgttgcagtgctttcaggtaaattatacgccgttggtggtagggatgggtcatcctgcttgaagtctgtggagtgttttgacccgcataccaacaagtggacactgtgcgcacagatgagtaaaagacgcggaggggtgggagtcaccacttggaacggcctgctgtacgctatcggtggacatgatgcccccgcatctaacttaacaagtaggttatccgactgtgttgagagatatgaccccaaaacagatatgtggaccgcagtggccagtatgtctatttcacgagacgccgtcggtgtatgccttctgggcgacaagttgtatgctgtgggtgggtatgatggccaggcctacctgaacaccgttgaagcatatgatccgcagaccaacgagtggacacaggttttttcccatactttcgaggacagcaaggaccacttagtagcaataaaacagactatctggagacaaaattccctgtctgaggagttccggtcccattag

SEQ ID NO: 192220 - DNA, 2370 bp, Artificial Sequence
  Description of Artificial Sequence: Synthetic coding sequence
atgcggctgcccggccagggcctgggcgcccgggagggccccagcatccctcttagctcccctgctccggcaccagcaagccccgcaccaccggcctggccacccagacctgccgtcacccacgggagattgcggtccccaacccgtagggcgtatacatcgctcgtcctagtgggatgcaccaatctttgcgccgtgcttttcgcacgttgccttgatgaccatttggtgtctctgcggatgtctgggagcaggaaggaatttgacgtgaagcaaatcttgaagatacggtggcgctggttcggtcatcaggccagctcacctaactccacggttgactctcaacaaggagagttctggaaccgcggccagaccggcgctaacgggggaaggaagttcctggatccctgctccttgcaactgcccctggcgtctattgggtacagaagatcttcccagctcgatttccaaaattccccttcctggcccatggcaagcaccagcgaagtgcccgcctttgagttcacagccgaggattgcggcggtgcccactggctggaccgtccagaagtggacgatgggaccagtgaggaagagaatgaaagtgattcctctagctgtcgtaccagtaactcttcccaaaccttatcgtcatgccataccatggaaccatgtacctcggacgagttcttccaagctctaaaccacgcagaacagacattcaaaaaaatggagaactacctgcggcacaagcaactgtgcgatgtgatcctggtggctggggaccgaagaatccctgcacatagactagtgctctcatctgtgtccgactacttcgctgctatgttcaccaacgatgtgcgtgaggccaggcaggaagagattaaaatggagggcgtagaacctaactccttgtggtctctgattcaatacgcgtataccgggcgcctggaattaaaggaagacaacattgagtgcctgctcagcacagcctgtttgctgcaactgagtcaggtagtggaagcatgctgcaagtttctaatgaaacagctgcatccaagcaattgcctcggtatacgctcatttgctgacgcccaaggctgcactgacctgcacaaagtggctcacaactatacaatggaacacttcatggaagtcattcggaaccaagaattcgtgctcctgcctgcatccgaaatcgccaagctgttggccagcgatgacatgaacatccccaacgaggagactattcttaacgcccttctcacctgggtgcggcatgatctggagcagcgcagaaaggacctgtcgaaactcctggcctacatcaggctgcccctgcttgctccacagtttctggccgacatggaaaacaacgtgcttttcagagacgatattgaatgtcaaaagttgattatggaggcaatgaaataccacctcctcccagaacgaagaccgatgctccagtctcctagaacaaagccaagaaagtcaaccgtggggacgttgtttgctgtcggggggatggatagcaccaagggagcaaccagcatcgaaaaatacgacctgcgaacaaatatgtggacccctgtggccaatatgaatggcagacgattgcagtttggcgttgccgtgttggatgataagctctacgtggtgggcggcagagatggactcaagacgctcaacaccgtagagtgctataatccaaagaccaagacatggtcggttatgccccccatgagcactcatcgtcatggacttggcgtggccgtccttgagggcccaatgtatgcggtaggcggccatgatggatggtcctacctcaacacagtagaacgatgggatccccaggctcgccaatggaatttcgtggcaacaatgagcaccccccggtctacggtgggcgttgctgtcctttcaggtaaactctatgctgtgggggggcgcgatggctcctcgtgcctaaagtctgtggagtgcttcgacccgcacaccaacaaatggacattgtgtgcccagatgtccaaacgtcgcggcggtgtcggtgtgacgacctggaacggtttactctacgctatcggcgggcacgatgcgcctgccagcaatctgacctctcggctctcagattgtgttgaaaggtatgacccaaaaactgatatgtggactgcagtggctagcatgagcatatctagggacgccgttggggtgtgtctgctcggagataaactttatgccgtaggcgggtatgatggtcaggcttaccttaacactgtcgaggcctacgacccacaaacaaacgagtggacccaggtggccccgttgtgcctgggaagagcgggagcttgtgttgtgactgtcaagctatag

SEQ ID NO: 192221 - DNA, 1050 bp, Artificial Sequence
  Description of Artificial Sequence: Synthetic coding sequence
aagaagcaccccagcaccgtgatggtgccccagttcctggccgacatggagaacaacgtgctgttcagagatgatattgagtgccagaaactgataatggaggccatgaaatatcatctgctgcccgaacgacgacctatgctgcagagccctagaacgaagccacgcaagtctaccgtggggaccctgttcgcagtgggcgggatggacagcacaaaaggcgcgacgtccatcgagaaatacgacttgcgtactaacatgtggaccccggtggcaaacatgaatgggcggaggcttcagttcggggtggcagttctcgatgacaaattgtatgtggtgggcggtagggatgggttgaagacattaaacacagtggaatgttacaaccctaagactaaaacatggtcagtcatgccgcccatgtccacgcacaggcacggtctgggcgtggcagttcttgaaggtcctatgtatgcggtggggggtcacgatggctggtcgtacttgaatacagtagaaagatgggatccccaagccagacaatggaactttgtggcaacaatgtccaccccacgcagcactgttggtgtagcggtactgtctggcaagctgtatgctgtcggaggccgggatggtagcagctgcctaaagtctgtggagtgttttgatccccatactaacaaatggactctctgtgctcaaatgagtaaaagacgggggggagtgggggttactacatggaatggcctgctatacgctatagggggccatgacgcacctgcctctaatttgacttcccggctgagtgattgtgtggagcggtacgatcctaaaacggatatgtggacagctgtcgcctcaatgtccatctcccgagacgctgtgggtgtttgtcttttgggtgataagctgtatgctgtcggtggctatgatggccaggcctacttgaacacagtagaggcgtatgacccccagaccaacgagtggacccaagtggctcctctctgcttaggtcgggccggcgcctgcgttgtcactgttaagctgtag

SEQ ID NO: 192222 - DNA, 2130 bp, Artificial Sequence
  Description of Artificial Sequence: Synthetic coding sequence
atgagcggcagccggaaggagttcgacgtgaagcagatcctgaagattcggtggcgctggtttggacaccaggcatcctctcccaattctacagtagattctcaacagggggagttctggaacagaggtcaaacaggcgccaacggcgggagaaagttcctcgatccttgttccctccaactccctttggcatccatcggctataggaggtcttctcagctagattttcagaactccccctcttggcctatggcatctactagcgaggttcctgcatttgagttcacagccgaagattgcggaggagcccactggttagatagacctgaggtggacgatggcacaagcgaagaagaaaatgaaagtgactctagcagctgccgtacaagtaacagctcacagacattgtcctcatgccacaccatggaaccatgtaccagcgacgagtttttccaggctttgaatcatgctgagcaaacattcaaaaaaatggaaaattacctccgccataaacagctgtgcgatgtgattttggttgccggcgatcgcaggattcccgcacatcgtcttgttctgtcttctgtctccgattatttcgccgcaatgttcacaaatgacgtgcgagaagccagacaggaggaaattaagatggagggtgtagagcctaacagcctctggtcactgattcagtacgcctatacgggaagactcgagctgaaggaggacaatatcgagtgtttgctgtctaccgcatgcctgctgcagctgagtcaagttgtggaagcctgttgcaagtttttgatgaagcagctccacccaagcaactgtttgggaataaggtcgttcgcagatgcacaaggctgcaccgatttgcataaagtggcccataattatacaatggagcacttcatggaggtgatccgtaaccaggagttcgttcttctgcctgcttctgagatcgccaagcttttggcctccgatgacatgaatatccctaatgaggaaacgattttgaacgctctgctgacttgggtgcgccacgatttagagcagagacggaaagacctgtcaaaactcctagcttatatcagactgcctcttctggctccacagtttttggccgatatggagaataacgtactcttccgcgatgatattgagtgtcagaagctgatcatggaagccatgaagtatcacctcctgccggaaaggaggcccatgttgcaaagcccacggaccaagccacggaagtcaaccgtgggcacactcttcgctgtgggaggaatggattccaccaaaggcgcgacttctatagaaaagtacgatctccgcacaaacatgtggacccctgtcgccaacatgaacggcagacggctccaattcggggtggctgtcctggacgacaaactctatgttgttggggggagagatggcttgaagacgctgaacacagttgagtgctataatcctaagactaagacttggtccgtgatgccaccaatgtccactcacagacacggactcggggtagccgtgctggagggacccatgtacgccgtcggcggtcacgacggctggtcatacctgaatacggttgagcggtgggatccacaggcccgtcagtggaactttgtggctaccatgtctacgcctcgctctaccgtgggagtggccgtgctcagtggcaaactgtatgccgtgggtggcagggatggttcaagctgtttaaaatctgtcgagtgcttcgatcctcacacaaacaagtggaccctgtgcgcccagatgagcaagcgcaggggcggggtcggcgtcaccacctggaacggcctgctgtacgccattgggggacacgatgccccagcatcaaatttgactagtagactttcggattgtgtggaaaggtatgatcccaagaccgatatgtggacggccgtagcctctatgagcatcagcagggacgcagtcggagtatgccttctgggtgataagctgtatgccgtggggggctatgatggacaggcatatctgaacactgtggaggcctacgacccgcaaacgaacgaatggacacaagtggcaccactgtgccttggacgggctggagcctgcgttgtgacagtgaaactttag

SEQ ID NO: 192223 - DNA, 2085 bp, Artificial Sequence
  Description of Artificial Sequence: Synthetic coding sequence
atgaacgtgatctacttccccctgcacatcttcgtggtgtacagccgtgcatacacaagtctggtcctggttggctgtacaaatctgtgcgccgtcctgttcgctagatgcttggacgatcacttggtcagcttgagaatgtcagggagcaggaaagagtttgatgtgaagcagattttgaaaatacggtggcggtggttcggccaccaagccagttcaccaaactccaccgtagactcacagcagggagagttttggaatcgggggcagacaggcgccaacggcggtcgaaagttcctcgatccctgttctctgcagctgcctctggcgagcatcggatacagaaggtccagtcagctggattttcagaattcaccctcgtggcctatggcctcaacttctgaagtgccagcattcgaatttacagcagaagactgcggaggggcccattggctggacagacccgaggttgatgacggcactagtgaggaggagaacgagtccgattcgtcttcctgcagactggttttatcctccgttagtgactatttcgctgcaatgttcaccaacgatgtccgggaggcaagacaggaggagatcaaaatggagggggtcgagcctaacagtttgtggagtctcatccaatacgcctacaccggacggcttgagctgaaggaggataacattgagtgcctgctgtctacagcttgtcttttacaactgtctcaggtggttgaagcttgttgcaaattcctgatgaaacagcttcacccctctaattgtctcggaatacgttccttcgccgacgcccaggggtgcactgatttgcacaaggtcgcccacaactataccatggagcacttcatggaggtaatacgaaaccaagaatttgttcttctccctgcgagcgaaattgcgaagttgttggcctctgatgacatgaatatccccaatgaggagacaattctgaacgcactgctgacctgggtgcggcacgatctggagcagcggaggaaggatttgagcaaattgctcgcctacattcggctacctctgttagcaccccagttcttagctgacatggagaacaacgtcctatttcgagatgacatcgagtgtcagaaactcatcatggaggctatgaagtaccatctcctgcccgaacgacgccccatgctccagtcccctagaacaaaaccaagaaagtcaactgtgggtactctgtttgctgttgggggcatggacagtaccaaaggagccacttccatcgagaaatacgatcttagaacgaacatgtggactcccgtagctaacatgaacggtagacggctgcagtttggcgttgctgtactagacgacaagctctacgttgtgggcggtcgagacggtctaaagacactgaatacggtggagtgttacaatcccaagaccaagacatggagcgtcatgccccccatgtccacacaccggcacggtctcggagtggccgtgctggagggtcctatgtacgctgtcggtggacatgacggctggtcttacctgaacaccgtggaacgctgggatccacaggctcggcagtggaactttgtcgccacaatgtccactccaaggtccaccgttggggtcgccgtcctgtcaggcaaactgtatgccgtcggcggtagggacggttcctcgtgtctgaagtcagtggaatgcttcgaccctcatacaaataagtggaccctgtgcgcccagatgtcgaaaaggcgtgggggcgtcggtgttactacatggaacggactcctctacgctattgggggccatgacgcacctgcctcaaatctgacatctagactcagcgactgcgtggaaagatatgaccccaagacagacatgtggactgcagtggcgtccatgtctatcagccgtgatgccgtcggtgtctgtctactgggggacaaactgtatgccgtgggcgggtatgacgggcaagcctatcttaacaccgtcgaggcatatgatcctcagactaacgagtggacccaggttgcacccctttgcctggggcgggccggagcatgcgtggtgacagtcaaactttag

SEQ ID NO: 192224 - DNA, 1707 bp, Artificial Sequence
  Description of Artificial Sequence: Synthetic coding sequence
atggagccctgcaccagcgacgagttcttccaggccctgaaccacgctgagcagactttcaaaaaaatggagaattatctgaggcacaagcagctttgtgacgtcatcctcgtggccggcgaccggaggatacccgctcaccgcctggtgttgtcatctgtctcagattacttcgctgccatgttcacaaatgatgtgagagaagcaaggcaggaagagatcaaaatggaaggcgtggagccaaactcactttggtccttgatacaatacgcctatactggtagacttgagctcaaagaggacaatattgagtgtctgctgtcaactgcttgcctgctccagttgtcacaggtagttgaagcatgctgcaagttcctgatgaagcaactgcatccctctaattgtcttggcataagatcttttgccgatgcccaggggtgtacggacctgcacaaggtcgctcacaattataccatggagcattttatggaagttattaggaaccaagaatttgtgttgctgccagcctctgagatcgcgaaactccttgcctcagacgatatgaatatccccaatgaggagaccatattgaacgccttgctgacctgggtgcgccatgatctggagcagagacgaaaggaccttagcaaattgctggcatatatcaggctgcctctgcttgcaccgcagtttctggccgacatggaaaacaacgttctcttccgtgacgatatagagtgccagaagctgataatggaagccatgaagtaccacctgctgcctgagcgcagaccgatgctgcagagccctcgcacgaaaccccggaaatccaccgtcgggactctgtttgccgtgggcgggatggatagtacaaaaggcgcaacgagcatcgagaagtatgacctgcgcactaatatgtggacgcctgttgcaaacatgaacggccgcaggctgcaattcggtgtggccgtgctggacgataagctttacgtggtaggaggcagggatgggctcaagacgctaaacacagttgaatgttataatcccaagacgaaaacctggtccgtgatgcctccgatgtctacacatcggcacggcctcggcgtggctgtgttggaagggccaatgtacgcagtgggtggacacgatggttggtcctacctcaatacggtcgagcgatgggacccccaggctcggcagtggaatttcgtcgccactatgagcacaccccggtctaccgttggcgtcgcagtacttagcggtaagctgtacgccgttggtggtagagacggctcttcttgtcttaaaagtgtagagtgttttgacccccacaccaacaagtggacactatgtgctcagatgagcaaaagacgtggcggtgtaggggtgactacctggaatggactgctatacgctatcggcggacacgacgcccccgcctccaacctgacctctcgcctgtctgattgcgtcgagagatatgacccgaagaccgacatgtggactgcggtcgctagcatgtcgatttcacgcgatgccgtcggagtttgcctacttggtgataagctgtacgcggtaggcggatacgatggtcaagcctatctcaacaccgtggaagcgtacgaccctcagacgaatgaatggacccaggttgcgcccctatgtttgggtagagcaggagcctgtgtcgtaacggtaaagctgtag

SEQ ID NO: 192225 - DNA, 1866 bp, Artificial Sequence
  Description of Artificial Sequence: Synthetic coding sequence
atgctgatggccggccagcggggcgcctggaccatgggcgacgtggtggagaaatctttggagggtcctcttgcccctagcacagatgaaccttctcagaagaccggagatttagttgaaatccttaacggggaaaaagtgaaattcgacgatgccgggctttccctgatcctgcagaatggcctggagactttgcgcatggaaaatgccttaacagatgtcatcctgtgcgtcgacatccaggagttttcatgccatcgcgtagtactagccgcagccagcaattactttagagccatgttctgtaacgatcttaaggagaagtacgaaaaacggatcataatcaagggagtggatgcagaaaccatgcacacccttcttgattacacctacacttcgaaggcgcttatcaccaagcagaacgttcagcgcgttctggaggctgctaatctgttccagttcctgcggatggttgacgcctgtgcaagcttcctgaccgaagcattaaatccagagaattgtgtgggcatactccgtctcgcagacacgcactcccttgacagtttgaaaaaacaagtccaaagctacatcatccaaaatttcgtgcagattttaaacagcgaggagtttttggacctaccagtggatactctgcaccacatcttaaagagcgacgacttgtacgtgacagaagaggcacaggtgtttgaaactgtcatgagctgggtgcgacacaaaccatccgagcggctgtgcttgctgccttatgtactggagaacgtgagactgcctctccttgacccatggtactttgtggagaccgtggaggctgaccctctgatcagacaatgccctgaggtattccccctcctgcaggaggcccggatgtatcacctgagcgggaacgagattattagcgagagaacgaagccacgaatgcatgaatttcaatcagaagtcttcatgatcatcggaggatgtacaaaggacgagaggtttgtagcagaggtgacatgcctggacccattgcgccgttctcggttagaagtggctaaactcccattaaccgagcatgagctcgaatctgaaaataaaaaatgggtggagtttgcctgtgtgaccctgaaaaatgaagtctatatctctggcggaaaggagacacaacacgatgtgtggaaatataattcctccatcaataaatggattcagatagagtatctgaacattgggaggtggagacacaagatggtcgttctgggcggcaaggtgtacgtaatcgggggatttgacgggctccagcggataaacaatgttgagacctatgacccattccataattgttggtctgaggcggctccccttctagtgcacgtatcgtctttcgctgccacttcacacaagaagaaactttatgtgataggaggcggccccaatggcaagctggcgactgacaaaacccagtgctacgatccatctactaacaaatggagtcttaaggccgcaatgcccgtggaagcaaaatgcatcaatgccgtgagcttcagggataggatatacgtggtaggcggtgccatgcgagcgctgtacgcctatagtcctttggaggactcatggtgtctcgtgacccagcttagccacgaaagagcatcatgcggaatcgcaccctgcaataaccgcctgtatattacaggtggaagagacgaaaagaacgaggtgatcgctacggtcctgtgttgggacccagaagctcaaaagcttaccgaagagtgtgtcctgcctcggggggtgagccaccatggcagcgtcaccattagaaagtcatacacccacatcagaagaatagttcctggggccgtgtcagtgtag

SEQ ID NO: 192226 - DNA, 1695 bp, Artificial Sequence
  Description of Artificial Sequence: Synthetic coding sequence
atgctgggcggcaccgactgccggaccttcctgaccagccacatcaacttaaaaaagactctgtgcgatgtcatcctgatggtccaagagagaaagattcccgcacaccgggtggtgctggctgctgcaagccacttctttaatcttatgtttacaactaatatgctggaaagtaagtccttcgaagttgaattgaaggacgcagaacctgacatcattgaacagttggtcgaattcgcctacactgccagaatatcagtaaactctaataatgtccagagtctgctggatgcagccaaccagtatcagattgaaccggtgaagaagatgtgcgtggattttctgaaagagcaagtggacgcctccaactgtctgggcatctccgtcctggccgagtgcctcgattgtcccgagctcaaagccactgccgacgacttcattcaccagcatttcaccgaggtctataaaaccgacgaattcctacagctggatgtgaagagagtcacacacctcctcaaccaagacaccttgaccgtccgggccgaagatcaggtctacgacgcggccgttagatggttgaaatacgacgaaccgaaccgccagccattcatggtggatattcttgcgaaggtcagatttcctctcattagtaagaactttctgtcaaagaccgtccaggccgagcctctcatccaggataaccctgagtgcctgaagatggtgatttccggcatgcgctatcacctgttaagtccggaggacagggaagaactcgtcgacggcactcgacccagaaggaagaagcacgattatagaattgcgctgttcggcggcagccagccacagtcgtgcaggtactttaaccctaaggactacagctggactgacatacggtgccctttcgaaaagagaagagacgccgcatgtgttttctgggacaatgtggtatatatacttggcggcagtcagcttttcccaataaaacggatggattgttacaatgtggtaaaagatagttggtactctaaactgggacctcctacaccgagagactcccttgcagcctgcgcggcagaaggcaaaatatacacttctggggggtcagaggtgggaaatagcgccctatacttgttcgagtgctatgatacaaggactgagtcttggcacactaagccctccatgctgacccagagatgttcccacggaatggtcgaggctaacggtcttatctacgtatgcggcggaagcttgggtaataacgttagcggtagagtcctcaactcctgcgaggtttatgatcccgctacagagacttggaccgagctatgtcctatgatcgaagcccgaaaaaatcatggcctggtctttgtgaaagataaaatttttgccgtcggggggcagaatggactgggaggactagataatgtggagtactacgatatcaagctcaacgagtggaaaatggtgtctcctatgccctggaaaggggtgacagtaaagtgtgcggcagtgggatctatagtttatgttctagcaggctttcagggggtcggccgcctgggacatatactggaatacaatacagagaccgacaagtgggtggccaactccaaagtaagggctttccctgttacttcttgcttgatatgcgtcgtcgacacttgcggcgcaaatgaagaaaccctggagacctag

SEQ ID NO: 192227 - DNA, 1761 bp, Artificial Sequence
  Description of Artificial Sequence: Synthetic coding sequence
atggccgccagcggcgtggagaagagcagcaagaagaagaccgagaagaaacttgcagctcgggaagaggctaaactcctagcgggcttcatgggtgtcatgaacaacatgcgcaaacaaaagactctgtgtgatgtgatccttatggtgcaagaaagaaaaattcctgctcatcgcgttgtgctggcagccgcctcccatttttttaacctcatgttcacaaccaatatgctcgagtcaaaaagtttcgaagtggagctgaaggacgctgaacctgacatcattgaacagcttgtggagtttgcttacacagcccgtatctccgtgaattctaataatgtacagagtctgttggacgcagcaaatcagtatcaaatagagcctgtgaaaaagatgtgtgtggatttcctgaaggaacaggtcgatgcatctaactgcttggggatctctgtacttgccgagtgtttggactgcccggagttaaaagcaactgccgatgacttcatccaccagcattttaccgaagtgtataagacggatgaattcctgcagctggacgtcaagcgcgtcacccacctactgaaccaggatacgctcaccgttagggccgaggatcaggtctatgatgccgctgtccgttggcttaaatatgacgagcctaacagacagccttttatggtggacattctggccaaggtcaggtttccccttatttcgaagaactttctgagcaagacagtgcaagccgaacccctcatccaagataatcccgagtgcttaaagatggtaatcagtggcatgcgctaccacctgctaagtcccgaggaccgtgaagaactggttgatgggaccagacctcggagaaagaagcacgattatcgaatagccttgttcgggggaagtcaaccccagagttgcaggtatttcaaccctaaggactactcatggactgacattaggtgccctttcgagaagcgtcgggatgccgcctgcgtcttttgggataacgtggtttacatattgggaggtagccagctcttccctataaagcggatggactgctacaatgtggtaaaggactcttggtatagcaagctaggcccacccactcccagagactctttagccgcctgtgccgccgagggtaaaatttacacctccggggggagcgaggtggggaacagcgctctgtatctcttcgagtgctacgacacaaggaccgagagttggcacacaaaacccagtatgctgacacagcgatgttcccatggcatggttgaggctaatgggctgatctacgtttgcggtggaagcctgggaaacaacgtgtcaggacgggtgctcaatagctgcgaggtctatgaccctgccaccgaaacatggaccgaattgtgcccaatgattgaagccagaaagaaccatggactcgtatttgtgaaggataagatttttgcagtcggcggccagaatggactgggcggcctggataacgtcgagtactacgacataaagctgaatgagtggaaaatggtatctccaatgccatggaagggagtgaccgtcaagtgtgccgccgttggtagtatcgtgtacgttttagcaggtttccagggagtgggtagactggggcatatactcgaatataatactgagactgataagtgggtggcaaactcaaaagtcagagcctttccagtcacctcctgccttatttgcgtagtggacacctgcggcgcaaatgaagaaacactcgagacttag

SEQ ID NO: 192228 - DNA, 1617 bp, Artificial Sequence
  Description of Artificial Sequence: Synthetic coding sequence
atggtgcaggagcggaagatccccgcccaccgggtggtgctggccgcggcttcacactttttcaatctcatgttcactacgaacatgctcgagagtaagagcttcgaagtggaactgaaagacgccgaacccgatataatagagcagttggtggagtttgcgtacactgcacgcatttctgtgaattctaacaacgtccagtcattgctcgacgcagcaaaccagtaccagatcgaaccagtaaaaaaaatgtgcgtagattttttgaaggaacaggtagacgcaagcaactgtctgggtatttcagtgctggctgaatgtctagattgtccggagcttaaagcaacagcggacgatttcattcatcagcactttacagaagtgtacaagacggatgaatttctacaattggatgtgaaacgggtgacacatttactgaatcaggacacactgacagtccgcgcggaggaccaggtgtatgacgcagccgtccgctggcttaaatatgatgagcccaaccggcagccgtttatggtcgacatcctggcaaaggtgaggtttcccctgatatccaagaatttccttagcaagacggttcaggcggaaccattgattcaggacaaccctgagtgcctaaaaatggtgatttccggcatgcggtaccacttgttatcaccagaggacagagaagagctggtggacgggactcgcccacgtcgtaagaagcacgactaccgcattgctctgttcggcggctcccaaccacaaagctgcaggtattttaatcccaaagattattcctggaccgacattaggtgcccttttgagaagagaagggacgccgcttgcgtattctgggacaacgttgtgtacatcctcggcggctcgcagctgttccccatcaaacgtatggattgctataacgtggttaaagactcatggtacagcaaactaggtccaccaacaccgcgggattcgctggctgcctgcgccgcagaagggaagatttacacctccggagggagcgaggttggaaactctgccctttaccttttcgagtgctatgatactaggacggagtcttggcatactaaaccatcaatgctgacacaaagatgcagtcatggcatggtggaagctaacgggcttatttacgtctgtggtgggtccctgggcaacaacgtgagtggccgcgtgctgaatagttgcgaagtctacgacccagccaccgagacttggactgagctgtgccccatgattgaggcgaggaagaaccacggtctggtgttcgtcaaagataagatttttgcagtagggggacagaacggtctgggcggccttgacaacgtcgaatactacgacataaagctgaacgagtggaaaatggtctctcccatgccatggaagggggtgactgtcaagtgcgcagcagtgggtagcatcgtctatgtgcttgccggtttccagggcgtgggcagattaggacacattctggaatacaacaccgagaccgataagtgggtggccaatagcaaagttcgagcatttccagtcacctcatgtcttatctgcgtggttgacacatgcggcgccaatgaggagactctggagacttag

SEQ ID NO: 192229 - DNA, 1161 bp, Artificial Sequence
  Description of Artificial Sequence: Synthetic coding sequence
atggccgccagcggcgtggagaagagcagcaagaagaagaccgagaagaagctggccgcacgcgaggaagccaagctgctggccgggttcatgggggtaatgaataacatgcgaaaacagaagaccctctgcgacgtcatcctgatggtgcaagagcgcaaaatccccgcacatagggtcgtgttggctgctgcctcccacttttttaatctaatgtttacaacaaacatgctggaatctaagtctttcgaagtggaacttaaggacgccgagcctgatatcattgagcagttgttacattacaagttctttaaaatgaagaacagaaaagacggccgcgtttctgtatcatacgccatactcatccaaggcctgaaaatttatgaaatttacagcaccaattttccagaacacttcacagaggtgtataagaccgacgaatttctgcagcttgacgttaaaagggtgactcacctgctgaatcaggacaccctgacggtccgtgctgaagatcaagtgtacgatgctgcggtgaggtggttgaagtatgacgagcctaaccggcagccttttatggttgacattctagccaaagtcaggtttcctctgatttcaaaaaattttctgtcaaaaacagtccaggctgagccactcatccaggataacccggaatgcctgaaaatggtgattagtggaatgaggtaccacctgttgtctcctgaggatagggaagagctggtggacgggacacggcctaggagaaagaaacacgactacagaattgcactattcgggggttcacaaccgcagagttgccgctattttaatccaaaggattactcatggactgatatcagatgtccatttgaaaagcgcagagacgctgcgtgcgtcttctgggacaatgtggtgtacatcttaggcgggtctcagcttttccccatcaaaagaatggattgctataatgtggtgaaagatagttggtactcaaaactcggcccgcccacacctcgtgattctctggccgcctgcgcggcggaggggaagatctataccagcggtggcagcgaagttggcaattccgccctctatcttttctgcctcataccagtgaagtttatgatactgccacagaagcacgggttaagttgtgtacagtag

SEQ ID NO: 192230 - DNA, 1284 bp, Artificial Sequence
  Description of Artificial Sequence: Synthetic coding sequence
atggccgccagcggcgtggagaagagcagcaagaagaagaccgagaaaaagctcgccgccagggaggaggccaagctgcttgctggattcatgggagtgatgaacaatatgcggaagcagaagacactgtgcgatgttatcttaatggtacaggaacgaaaaatccccgcccaccgggttgtgctggcagcagctagccatttcttcaacctgatgtttacaaccaacatgcttgaatcaaaaaatttcctttccaagacagtgcaggccgagcccctgatccaggataatcccgaatgtctgaagatggtgatttcaggtatgaggtaccatctactctcccccgaggacagagaggaattggtggacggaacccgacctcggagaaagaagcacgattatcgcatcgcgctgttcggtggaagccagcctcagagttgccgctactttaatcctaaggactacagttggactgacatccggtgcccatttgaaaagcgcagagacgcggcttgcgttttctgggataacgtggtttacatattagggggctcccagctttttcctatcaagagaatggactgctataacgtcgtgaaagacagctggtatagcaaactggggccccccaccccccgggactcactcgccgcttgtgctgccgaggggaaaatctataccagcggcgggagcgaagtggggaacagtgccttatacctctttgagtgctatgacacccggaccgaatcatggcatactaagccctcgatgctgactcagcggtgtagccacggcatggtggaggcgaacggcttgatctatgtctgtggtggctctctaggaaacaatgtgtctgggcgagtactgaacagctgcgaagtgtatgacccagctaccgagacctggaccgaactatgcccaatgatcgaagcccgcaaaaaccatggacttgtgtttgttaaagataaaattttcgctgtcggggggcagaatggcctgggtggcctggataatgtagagtactatgacatcaagctcaatgagtggaaaatggtgagtccgatgccctggaaaggagtgactgtcaagtgcgccgcagtcggctccattgtctacgttctcgctggctttcagggcgtgggccgcctcggccatatactggagtacaacacagaaactgacaaatgggtcgctaactctaaggtcagagcgttccccgtaacatcttgtctgatctgcgttgttgacacatgtggggccaacgaagaaacccttgagacctag

SEQ ID NO: 192231 - DNA, 1533 bp, Artificial Sequence
  Description of Artificial Sequence: Synthetic coding sequence
atgctggagagcaagagcttcgaggtggagctgaaggacgccgagcccgatatcatagagcaactggtggagttcgcatataccgcccgaattagtgtgaattcaaacaatgttcagtccttactcgatgctgctaaccagtaccagatagagcctgtaaagaaaatgtgcgttgactttctcaaagagcaagtcgatgctagcaactgcctaggcatatccgtgcttgccgagtgccttgactgtccagagctgaaagctacggctgacgattttatccaccagcatttcacggaggtctacaagacggatgagtttctccagctggacgtgaaacgggtgacacacctcctgaatcaagacaccctgaccgttcgcgctgaagatcaagtgtatgacgccgctgttcgatggctgaaatatgacgagcctaacaggcagcctttcatggtggacatcttggccaaggtcaggttccctcttatttccaagaactttttgtcaaaaaccgttcaggcggaaccactgattcaggataaccccgagtgtctaaagatggtcattagtggaatgcgatatcatctgctgagccctgaagacagggaagagctggtggatggaactaggcctagaaggaaaaagcatgactatagaatcgctctgttcggaggctctcagccccagtcttgcagatacttcaatccgaaagattacagctggacagacattcgctgcccgttcgaaaagagaagagacgctgcatgtgtgttctgggataacgtggtgtatatcctgggtggctcccagctctttcctataaaacggatggactgctataatgtggttaaagattcgtggtacagcaaattagggcctcccacaccacgagattcacttgcggcatgcgctgccgagggaaagatttacacttctggcggttcagaagtaggcaattctgccttgtacctttttgaatgctatgatactcggacagagtcatggcacaccaagccgagcatgctgacacagcgctgttctcatggcatggtcgaggcaaacggactcatttacgtttgcggggggtccctggggaacaatgtgtccggtagggtgttaaattcgtgcgaggtatatgaccctgcaacagagacatggaccgaactgtgccccatgatcgaggcaaggaagaaccatggtctagtcttcgtgaaggacaagatcttcgcagttggaggacaaaacggccttggaggcctggacaacgtcgagtactacgatattaagcttaacgaatggaaaatggtgtcccccatgccctggaagggcgtgaccgtgaagtgtgccgcagtagggtccatagtgtacgttctcgccggatttcaaggtgttggccgcttagggcatatcctggaatacaacaccgaaaccgacaaatgggtcgcaaactccaaggtacgcgccttccctgtgactagttgcctaatctgtgttgttgatacttgcggggctaacgaggagactctggaaacatag

SEQ ID NO: 192232 - DNA, 1086 bp, Artificial Sequence
  Description of Artificial Sequence: Synthetic coding sequence
atggtggacatcctggccaaggtgcggttccccctgatcagcaagaatttcctgtcaaagactgtgcaggccgagccactgattcaagataatcctgaatgtcttaagatggtgatcagcggcatgcgctaccatctacttagccccgaagatagggaagagctggtcgatgggactagaccccgacggaagaaacacgactaccgaattgctctgtttggaggctcacagccccagagttgtcgttacttcaatccaaaggactactcttggaccgatatacgctgcccgttcgagaaaaggcgagacgccgcttgtgttttctgggataacgttgtatatatattagggggctcccaactgtttcctattaagcggatggattgttataatgttgttaaggatagctggtactccaaactgggaccccctacgcctagagatagtctcgccgcctgcgctgcagaaggaaagatctacacaagtgggggcagcgaggtggggaatagcgccctatatctctttgagtgctatgatactcgaacagaatcctggcacacaaagccttcaatgcttactcagcgatgttctcatggtatggtagaagctaacgggcttatctacgtctgcggcggcagtctggggaacaacgtcagcggccgggtgctcaactcatgtgaggtttacgatcccgccacggaaacttggacagagctgtgccccatgattgaagcaagaaagaaccacggtctagtatttgtgaaggataagatattcgccgtgggcggtcagaacggtctgggcggacttgataacgtggagtactacgacattaagttgaatgagtggaaaatggtcagccctatgccctggaagggcgtgaccgttaaatgtgcagctgtgggcagcattgtttacgtgctggcaggatttcagggggtggggcggttgggtcatatcctggagtacaacacagaaaccgacaaatgggttgccaatagtaaggtgagggcctttccagtcacatcctgtctgatatgcgtcgtggacacctgcggtgcaaatgaggagaccctggaaacttag

SEQ ID NO: 192233 - DNA, 1695 bp, Artificial Sequence
  Description of Artificial Sequence: Synthetic coding sequence
atgctgggcggcaccgactgccggaccttcctgaccagccacatcaacctgaaaaagaccctctgcgacgtcattcttatggttcaggagcgtaaaattcctgcccacagagtggtgcttgctgctgcatctcacttctttaatctcatgttcactactaacatgctagagagcaagagcttcgaggtggagctgaaagacgctgaacccgacatcattgaacaactggtggagtttgcttacacagcccgcattagcgtgaatagtaataatgtgcagagtctcctcgacgcagccaaccaatatcaaatcgaacctgtgaaaaagatgtgcgtggactttctcaaggaacaagtcgacgcatccaattgtcttggtatcagtgtcctggcggagtgtctcgattgtcctgagctaaaagccaccgccgatgatttcattcatcagcattttactgaggtctacaagaccgacgaatttttgcagctggacgtgaagagggtgacgcacctcttaaatcaagacaccctgacagtccgtgctgaggatcaggtttatgatgcggctgtaagatggttgaaatacgacgagccgaatagacagccctttatggtggatatcctcgccaaagtgaggttccctcttatctcaaagaactttctttccaaaacggtccaggcagaacctcttatccaggacaaccccgagtgtctgaagatggtgatctcaggaatgcgctatcacctcctgtctcctgaagatagagaggagctcgtcgacggaacccggccaagacgaaagaagcacgattaccgtatagccttattcggggggagccaaccccagtcctgccggtacttcaacccaaaggattattcatggacggacatccggtgccctttcgagaagcggagggacgcggcctgcgtgttctgggacaacgtggtgtacatactcgggggctcgcagctgtttcctattaaacgtatggactgctacaatgtggtcaaggatagttggtactctaagctgggccctccaacaccccgtgattcactcgccgcatgtgccgctgagggtaagatttacaccagcggcggaagcgaggtggggaactctgccctctacctgttcgaatgttatgatacccgaacggaaagctggcatacaaagccaagtatgctcacccaaagatgttcacacgggatggtggaagccaatgggctgatttatgtttgtggcggaagcctgggaaataacgtctccggtcgggtacttaactcctgcgaagtgtacgacccagctacggagacatggaccgagttgtgtccgatgatcgaagccaggaaaaatcacgggctggtcttcgtaaaagacaaaattttcgctgtgggagggcagaacgggcttggggggctggacaatgtggagtactacgacatcaaattaaacgagtggaaaatggttagtcctatgccctggaagggcgtcacagtgaaatgtgctgcagtgggcagcattgtctacgtgctcgccgggtttcagggtgtgggtcgcctgggtcacatcttagagtataatacagaaaccgataaatgggttgctaacagcaaagttcgggccttccctgtgacttcatgtctgatttgcgtagttgatacctgcggggctaatgaggaaaccctcgaaacatag

SEQ ID NO: 192234 - DNA, 432 bp, Artificial Sequence
  Description of Artificial Sequence: Synthetic coding sequence
atgctgggcggcaccgactgccggaccttcctgaccagccacatcaaccttaaaaaaaccctgtgtgatgttatcctgatggtgcaggagcgaaagatcccagctcatagggtcgtcctggccgccgcctcccatttctttaatttgatgttcacaaccaatatgttggaaagtaagtcatttgaagtggagctaaaggatgcagaacctgacatcatcgagcaactcgttgaattcgcatatactgcccggattagcgtaaatagcaataacgtgcagtctctcctggatgccgcaaaccaataccagatagaaccagttaagaaaatgtgtgtagacttccttaaagagcaggtcgatgcttcgaattgcctgggcaagaagtaccagattcctgtggtgtgcttgttctgctttattctgtacttctag

SEQ ID NO: 192235 - DNA, 501 bp, Artificial Sequence
  Description of Artificial Sequence: Synthetic coding sequence
atggccgccagcggcgtggagaagagcagcaagaagaagaccgagaagaaactggctgcccgagaggaggccaagctcctcgcggggtttatgggggtgatgaacaatatgcgcaaacagaaaaccctgtgtgacgtgatcctgatggtgcaggagcgtaaaatccctgctcacagggtggtgttagccgctgccagtcactttttcaaccttatgtttacaaccaatatgctcgagagcaaatcatttgaagtggaactgaaggacgcggaacccgacatcattgaacagcttgtggagttcgcctacacagctcgtatatctgtgaactcaaataatgtgcagagcctcctggacgccgcaaatcagtaccaaatagagcccgtcaaaaaaatgtgtgttgacttcctcaaagagcaagtagacgccagtaattgcctgggagaagccgagaaggtggatcagtccctgcccgagtgtggaatgctgtttacagtgtag

SEQ ID NO: 192236 - DNA, 1863 bp, Artificial Sequence
  Description of Artificial Sequence: Synthetic coding sequence
atggccagcgacagcatgagcagcaagcaggcccggaaccacatcactaaaggaaagcggcagcagcagcaccaacagattaagaatcggtctagtatcagcgatggagatggcgaggacagtttcatttttgaggctaacgaagcttggaaggactttcacggcagcctcctgcggttctacgaaaatggagaattgtgtgacgtgacactgaaagtcggaagtaaattgataagctgccataaactagtactggcttgtgtgatcccgtactttcgggcgatgtttctgtcagagatggcggaggctaagcagactctcattgagatcagagactttgacggcgacgcaatcgaggatctcgttaaatttgtgtacagtagccgactgacccttaccgtcgacaacgtccagcccctgctctatgccgcctgtatcctgcaggtggagctagtcgctcgggcttgttgtgagtacatgaagttgcactttcatccgtccaactgtttggctgttagggcgttcgctgaatcacacaacagaattgacttgatggatatggctgatcaatacgcatgcgaccacttcaccgaagtggtggaatgtgaggactttgtgtccgtctcaccccagcacctccataagctgctgagctctagtgacctgaatattgagaatgagaaacaggtgtataatgccgccattaagtggctgcttgcgaatcctcagcatcattcaaaatggttggatgaaacactcgcacaggtccgtcttcccctgctgcccgtggacttccttatgggtgtggtagcgaaggagcagatcgtgaagcagaacctgaaatgtcgggacctcctggacgaagccaggaattaccacttgcatctttcgtcgagggccgttccagactttgagtattcgatccgcaccacaccccgcaagcacacagccggagttctgttttgtgtgggaggccggggcggctccggcgacccattccgtagtatcgaatgttattcaatcaacaagaacagctggttcttcggacccgaaatgaacagccggcggcgccacgtgggtgtgatcagtgtcgaaggaaaggtctatgctgtcggcggccacgacggcaatgagcatcttggatctatggagatgttcgatccactgactaataaatggatgatgaaagctagtatgaacactaaacggagaggtattgccttggcatccctgggaggcccaatttatgccataggggggctcgatgacaatacgtgttttaacgatgtcgagcgatatgacatagagagcgaccagtggagcaccgtcgcgccaatgaacacgcctcggggcggtgttggtagcgtggccctagttaaccacgtgtacgcggtcggtggcaacgatgggatggcatccctgagttctgtggagcgctacgacccccatttggataaatggatagaggttaaggagatgggccaacgcagagcagggaatggagtaagcaagcttcatggctgcctgtacgttgttggaggattcgatgacaattccccactgtccagcgtcgaacggtacgatcctcggtcaaacaagtgggattacgtcgccgccctcaccacccctcgaggcggggtgggtatagcgaccgtgatgggcaagatttttgctgtgggagggcataatggaaatgcgtacctaaatacagtggaagcatttgaccctgtcctgaataggtgggaactcgtggggtcagtgtctcattgccgcgccggagcgggagtggccgtctgctcatgcctgacttctcagataagagacgtcggccacggaagtaataatgtggtggactgcatgtag

SEQ ID NO: 192237 - DNA, 1863 bp, Artificial Sequence
  Description of Artificial Sequence: Synthetic coding sequence
atggccagcgacagcatgagcagcaagcaggcccggaaccacatcacaaagggcaaaagacagcagcagcaccagcaaatcaagaacaggtcatctatcagtgacggagacggcgaggacagtttcatattcgaagcaaacgaagcttggaaagacttccatgggagcctccttaggttctacgagaatggtgagctctgcgatgtgacattaaaggttgggtccaagctgatatcctgccacaagctggtgctggcctgtgtcattccttattttcgggccatgtttttgtcagaaatggccgaagctaagcagacactcattgagattcgagactttgatggcgatgctatcgaggacctggtaaaattcgtctatagcagtcgtttgactctgacggtagataatgttcagcctcttctctatgccgcatgcattctgcaggttgagctggtggccagagcttgttgcgagtacatgaagctgcactttcatcctagcaattgcctagctgtgagagcgtttgccgagtcgcacaaccggattgatctgatggatatggccgatcaatacgcctgcgaccactttacagaagtggttgaatgtgaggatttcgtaagtgttagcccccagcacctgcataaactcctgtctagcagcgaccttaacatagagaatgagaagcaggtctacaacgctgccatcaaatggcttctggccaatccgcagcaccactctaagtggctggatgagacccttgcccaagtgcgattacccctcctccctgttgacttcctgatgggagtggtggccaaggaacagatcgttaaacagaacctgaaatgtagggatctcttagatgaagccagaaactaccatttacatctgagtagcagagcagttcccgattttgaatattcaatccgcacaaccccgagaaagcacaccgcaggtgtgctcttttgtgtgggtggacgtggcgggtccggggatccattcagatccatcgaatgttacagcatcaacaagaactcatggttctttggcccagaaatgaactcccgccgacgacacgtcggcgtcatatctgtcgaaggaaaggtgtacgccgtgggaggccacgacggcaatgaacacctgggctccatggagatgtttgaccccttgaccaacaagtggatgatgaaagcatccatgaatactaagcggagaggaattgcattggcatctctgggaggcccaatttacgctatcggcggattggacgacaacacctgcttcaatgatgtggagcgctacgacatcgaatccgatcagtggtcaactgtggctcccatgaataccccccggggcggtgttggctcagtagccctcgttaatcacgtgtacgcagttggcggaaatgatggcatggcaagcctaagcagtgtcgaacgatacgatccccacttggacaagtggatcgaagttaaggaaatgggacagagacgtgcaggcaacggcgtgtcaaagttacacggatgcctatatgtggtggggggcttcgatgacaactcgcccctgagttcagtcgagaggtacgaccctcgatcaaataagtgggattacgttgcagcccttacaacacccagggggggagtcgggatcgccaccgtcatgggcaagatatttgctgtgggtggacacaatgggaatgcctatctgaataccgtagaagcatttgacccagtgctgaaccggtgggagttggtcggttccgtaagtcactgtagggctggcgccggagtcgctgtttgcagctgcctgacttctcaaatcagggacgtgggccacggcagcaacaatgtggttgattgtatgtag

SEQ ID NO: 192238 - DNA, 810 bp, Artificial Sequence
  Description of Artificial Sequence: Synthetic coding sequence
atgaacagccggcggcggcacgtgggcgtgatcagcgtggagggcaaggtgtatgctgtgggcggccatgacggtaacgagcatctgggtagcatggaaatgtttgaccctctgacaaataaatggatgatgaaggcttccatgaacaccaaaaggcgcggcatcgccctcgcctcacttggcggccccatctacgcaatcggagggctcgacgataatacatgctttaatgacgtggagaggtacgatatcgaatccgaccaatggtctaccgtggctcctatgaatacccccaggggaggggtcggcagcgtcgctctggtgaaccacgtctacgcagtgggaggtaatgacgggatggctagtctgagctctgtggagcggtacgaccctcaccttgataagtggatcgaagttaaagaaatgggacagcggcgagccggtaatggagtatcaaaactacacgggtgtttatacgtggtcggcggcttcgatgataattcacctctcagttctgtggaacgatacgacccacgctctaacaagtgggattatgtcgccgctctgaccacgcccagagggggagtcggaattgccaccgtcatgggcaaaatattcgcggtaggtgggcacaatggaaacgcatatcttaacaccgtggaggcattcgaccctgtgttgaaccgttgggaattagtgggatctgtgtcccattgccgcgcgggcgccggcgtggccgtgtgttcctgcttgacctcacaaatcagggacgtgggacacgggtcaaacaatgttgtcgactgcatgtag

SEQ ID NO: 192239 - DNA, 1875 bp, Artificial Sequence
  Description of Artificial Sequence: Synthetic coding sequence
atgcagcccgacccccggcccagcggcgccggcgcctgctgccggttcctcccactgcagtcccagtgccccgagggagccggagacgctgtcatgtacgccagtaccgagtgtaaggcagaagtgacaccctcccagcatgggaacaggaccttctcttacacacttgaggaccataccaagcaggcttttggtatcatgaatgaactgcggctctcacagcagctgtgcgatgtaactctccaggtgaaataccaagacgcacccgcagctcaatttatggcccataaggtggtgctggcatcgtccagccctgtatttaaggccatgtttacaaacggtctacgcgaacagggaatggaagtcgtgtcaatcgaaggcatacaccccaaagtcatggaacgcctgatcgaattcgcgtatacagctagcattagcatgggcgagaagtgcgttctccacgtcatgaacggcgccgtgatgtatcagattgatagtgtggttcgtgcctgcagcgacttcctcgttcaacagttggacccttctaatgccatcggaattgccaactttgccgaacaaattgggtgcgtggaactgcaccagagggcccgggagtacatttatatgcacttcggagaagtggctaagcaggaggaattcttcaatttgagtcattgtcaactcgttactctgattagcagagacgatctgaacgtgaggtgcgagtccgaagtttttcatgcttgtattaactgggtgaagtacgactgtgagcagcgccggttctacgtacaagcacttctccgggccgtgcggtgtcacagcctcacccccaatttcctccagatgcagctgcaaaagtgtgagatcctccaatctgattcacgctgtaaggattacctcgtcaagatctttgaagagctgactctgcacaaaccaacgcaggtgatgccctgtagagcccctaaagttggaagacttatctacacagcaggggggtatttcaggcagtccctctcatatctggaggcctacaacccttccgatggaacttggctgaggctggcagatctgcaggtgccaagaagtgggctggcgggttgtgtggtaggggggttgttgtacgctgtaggaggtaggaataattctcctgatgggaacacagatagctccgctctggactgttacaaccctatgacaaaccagtggtcaccttgtgctccaatgtcagtgccccgaaatcgaataggtgtgggggttattgatgggcatatctacgccgtcggtggttcccacggctgcattcaccacaattcagttgaaagatacgagcccgaacgggacgagtggcatttggtggcccccatgctgacccggagaattggagtgggagtcgctgtgctaaatcgactgctgtacgcagtaggaggatttgatggaactaatcgactgaattcagcagaatgttactatcccgaacggaacgagtggagaatgattacagctatgaatactattcgatctggagccggggtgtgtgtgttacataactgtatttacgccgccggcggttacgacggccaagaccagctgaattctgttgaacgttatgacgttgagacagagacttggacctttgtggctcccatgaaacaccggaggtcagctctgggcattacggtccaccaggggagaatctatgtgcttggaggctatgacgggcatacgtttttggactctgttgagtgctatgaccctgatacagacacgtggagcgaggtgacccgtatgaccagtggcaggagcggagtgggggtggcagtcacaatggaaccgtgtcgcaagcaaatcgaccagcagaactgcacatgttag

SEQ ID NO: 192240 - DNA, 1875 bp, Artificial Sequence
  Description of Artificial Sequence: Synthetic coding sequence
atgcagcccgacccccggcccagcggcgccggcgcctgctgccggtttctccctctccagagccagtgccccgaaggagccggggatgctgtcatgtatgcgtccactgaatgtaaggccgaagtgactccctcacagcacggtaataggaccttttcctatacccttgaggatcatacgaagcaggcttttggcatcatgaacgaactgcgattatctcagcagttatgcgatgtcactctgcaagtgaagtaccaggatgccccagctgctcagtttatggcccacaaggtcgtcctcgcttcaagctctccagtctttaaagcgatgttcactaatggcctacgagaacagggcatggaggttgtgtctattgaagggatacatccaaaagtgatggaacggttgatagaatttgcttataccgccagtatcagtatgggggaaaaatgcgtcctgcacgtcatgaacggtgcggttatgtaccagattgattccgttgtgcgagcttgcagcgatttcctcgtgcagcagcttgatccctcaaacgcaatcggcattgccaactttgccgagcaaatcggctgcgtggagctccaccagcgcgctcgagagtacatttacatgcacttcggtgaggttgcgaagcaggaggagttcttcaatctttctcattgtcagctggtgaccctaatttctcgtgatgacctgaatgttcgttgtgaaagcgaagtcttccatgcctgcataaattgggtgaaatatgattgcgaacaaagacgcttttatgttcaggccttgttgagagctgtccgctgtcactcgctcacgcctaattttctgcaaatgcagctgcagaagtgcgaaatcctgcagagcgactcccgctgtaaggactacctggttaagattttcgaagagctgacacttcacaagccaacccaggtgatgccctgtcgagctcccaaagtgggccggcttatttacaccgctggtggctatttccgacagtctctgagctacctcgaggcatacaacccgagcgatggaacttggttacggctagccgacctgcaggtgccgcgcagtgggctggccggttgcgttgtcggcggtctcttgtacgccgtaggggggcgaaataacagccctgacggcaacactgactccagtgctctggattgttacaatcccatgacgaaccaatggtccccttgtgccccgatgagtgtaccacggaacaggattggcgtcggagtcattgacggtcacatttatgccgtgggcggtagtcacggttgtatccaccacaattccgtggagagatatgagccagagcgcgatgaatggcatttagtggcccctatgttaacaaggcggatcggcgtcggcgtcgccgtccttaacaggctcctctatgcggtcgggggttttgacggaactaaccgcctcaattctgccgaatgttactaccccgagagaaatgagtggagaatgatcaccgccatgaataccattcggtccggagccggtgtatgtgtcctccacaattgtatctatgcagctggcggctatgacggccaggatcagctgaacagtgttgaaagatatgacgtcgaaacagaaacctggacattcgtagcgcctatgaagcatcggcggtcagcactgggcattacagtgcaccagggacggatctacgtgcttggcggttacgacggacatacctttctggacagcgtggaatgctacgatcctgacaccgacacttggtcggaagtcactcgaatgacaagcggcagaagtggtgtgggggtggccgttaccatggaaccctgccgaaagcagatagaccaacagaactgcacatgctag

SEQ ID NO: 192241 - DNA, 2199 bp, Artificial Sequence
  Description of Artificial Sequence: Synthetic coding sequence
atggagggcggcgaccagagcgaggaggagccccgggagcggagccaggccggagggatgggcactctatggtctcaggaatctacacccgaggagaggttacccgtcgaaggcagccggccctgggctgtggcccgaagggtgttaaccgctatattgatcctgggcctgctcctatgtttctccgttttgctgttttacaacttccagaactgtggtccgcgcccctgcgagacatctgtatgcttggatttgagagaccactatttagccagtgggaacacgagtgtcgccccttgcaccgatttcttcagtttcgcgtgtgggagggccaaagaaaccaataactcttttcaggaactcgcgacgaagaacaagaatagactaaggcggattctcgaggttcagaattcctggcaccccggctccggggaagagaaggcattccagttttacaattcatgtatggatacgctcgccattgaagcagccggcacgggacctcttcgtcaggtgattgaagaacttggtggatggcgcatctccggcaagtggactagtttaaactttaaccgtactctcagactgctgatgagccagtatggacacttccccttctttagggcctacttggggcctcatccagcttcaccacatacccccgtaattcagatcgaccagcctgagttcgatgtgcctctcaagcaggatcaggaacagaagatctacgctcagatctttcgggagtatctgacttatctgaaccagctgggaacactcttgggcggagatccctccaaggttcaggaacacagctctctcagtatttcaattacaagtaggctttttcagtttcttaggcccctggagcaaaggcgcgcccagggcaaactgttccagatggtgacaatagatcagctcaaggaaatggcaccggcaattgactggctgagctgcctccaagctaccttcacgcctatgtccctgtcaccgtcccagtctctcgtcgtgcacgacgttgagtaccttaagaatatgagccagctggtcgaagaaatgctactaaagcaacgcgattttctacagagccatatgattttagggttggttgtgacgttgtcaccagcgctcgactcccagttccaggaggctcggcgcaagctgagtcagaaactgcgggagctgacagaacagccacctatgccagcccgtccacggtggatgaaatgtgttgaggaaacagggacttttttcgaacctactctggctgcattgttcgtacgagaggccttcgggccttccactcgaagcgcggccatgaaactttttactgcaattcgcgatgctttaattactaggctcagaaatctcccatggatgaacgaagagacccagaatatggcccaagataaggtggcccagcttcaagttgagatgggcgcttctgagtgggcgctcaaaccagagcttgctaggcaggaatataatgacatccagctggggagttcattccttcaaagcgtgttgtcttgcgtgcggtcactgagagctcgtatcgtgcagtcgttccttcagcctcatccccagcaccgatggaaagtgtccccctgggatgtgaacgcctattacagtgtgtctgaccacgtggtggtttttccagctgggctgctgcaacctccttttttccacccaggatacccaagagccgtgaattttggcgccgccgggtctattatggcgcacgagctcctgcacattttttatcagctcttactccccggcggatgtttggcttgtgacaatcacgctctgcaggaggcgcatttgtgtcttaaaaggcactatgcagcctttccgctacctagtaggacatcctttaacgactccctgacctttctggagaatgctgccgatgtaggggggctcgccatcgctcttcaggcatactcaaagaggttactgaggcaccacggcgaaactgtgctcccgtccctggatttgtcccctcaacagatcttctttcgcagttacgcccaggtgatgtgcagaaaaccatccccacaggatagccacgacacccacagccccccacacctgcgggtccacggaccattatctagcacccccgccttcgcccgctactttaggtgtgctcggggtgcactccttaaccccagcagcaggtgtcagttgtggtag

SEQ ID NO: 192242 - DNA, 1935 bp, Artificial Sequence
  Description of Artificial Sequence: Synthetic coding sequence
atgagccggcagttcagcagccggagcggctaccggagcggcggcggtttttcttctggaagcgccggcattatcaactaccaaagacgcacgacatcttcctctacaagacgctctggcgggggtggaggaaggttcagctcatgcgggggtggtggcgggagcttcggcgcaggtggaggattcggttccagaagcctcgtgaatctggggggatctaaatcaatttccatctctgttgcgcgcggcggaggtcgggggagtggattcgggggagggtacgggggggggggctttggcggcgggggatttggcggaggagggttcggaggtggcggaataggtgggggaggctttggcggatttgggtccggcggaggcggattcggaggggggggcttcggcgggggtgggtatggcgggggctatggacctgtgtgtccacctgggggtatccaggaggtcacaatcaaccaatctcttctccagcccctgaatgtggaaattgatcccgagatccagaaagtgaagtcccgagagcgggagcagataaaatcactgaataatcagtttgcttccttcatcgataaggtcaggttcctggagcaacaaaaccaggtccttcagacaaagtgggagctgttgcagcaagtcgatacctcaaccaggacacataacttagagccatacttcgaaagctttatcaacaacctcagaaggagagtcgaccagcttaaatcagatcagtcaaggctggactcagaattgaaaaatatgcaggatatggtcgaagactaccgtaacaaatacgaagatgagataaacaagcgcactaacgccgagaatgagttcgttactattaaaaaagacgtcgatggcgcatacatgactaaagtggaccttcaggcaaagctcgataacctgcagcaagaaattgatttccttaccgcgctctatcaggccgagctgagtcagatgcaaacgcagatcagtgagaccaatgttatcctctccatggacaacaatcgaagcttggatctagactctataatcgctgaggtgaaagctcagtacgaggatatcgcgcagaaatccaaggccgaggctgagtcgctttatcagtcaaagtatgaggaactccagattaccgccgggagacacggcgactccgtgcgaaacagtaaaatcgagatcagcgaattaaaccgtgtcatacagcgcctcaggtccgaaattgacaacgtgaagaaacagatctctaacttacagcagtcaattagcgacgcagagcagcggggagaaaatgctctcaaggatgctaaaaacaaactgaatgacctggaagacgccctgcaacaagccaaggaggacctcgcacggcttctgcgcgactatcaggaattaatgaacactaaattagcccttgacctcgaaatcgccacataccgcacactgctggagggagaagaatccaggatgtcgggcgagtgtgctcctaatgttagcgtcagtgtgtcgactagtcacacgacaatcagcggtgggggctcacgcggcggtggcggcggcgggtacggcagtggaggtagtagctatggatctggcggggggtcttacggctctggcggagggggcggagggggccgaggcagctacgggagtggaggcagttcttatggctcaggtgggggttcatatgggtctgggggtggcggtggcgggcatgggtcttacggctccggaagctccagtggtggctacagaggaggttcagggggaggcggaggggggtcatcaggaggtaggggatccgggggcggatcttctggggggagcattggaggtaggggatcctcttctggcggagtgaaaagctctgggggctctagttccgttaagttcgtgtcaactacatactctggggtaacaagatag

SEQ ID NO: 192243 - DNA, 1755 bp, Artificial Sequence
  Description of Artificial Sequence: Synthetic coding sequence
atgagcgtgcggtacagcagcagcaagcactacagcagcagccggagcggcggcgggggtggcggcggaggctgtggtggcggcggtggcgtttcatccttacggatcagttcatcgaaaggtagtctcggcgggggatttagctcgggcgggtttagtggcggctccttctccagaggcagctcagggggaggatgtttcggcggatcctccggaggctatggaggcctgggcggcttcggcggcggctcattcaggggaagctacggaagcagctcatttggcggttcttatggcggaatatttgggggaggctcctttggaggtggttcctttggagggggaagtttcgggggaggtgggtttggcggcggaggctttggcggtgggtttggcggcgggttcggaggtgacggcggccttctttcaggcaatgaaaaagttactatgcagaacctgaacgatcgcctggcctcttacttagacaaagttagagcgcttgaggaatcaaactacgagttggaaggtaaaattaaggagtggtacgagaagcatgggaactcacaccagggtgagccacgcgactactctaaatattacaagactattgatgacctcaagaatcagatcctcaatctgaccaccgacaatgctaacattttactgcagattgataatgcgagactggctgccgacgattttcggttgaaatacgagaatgaagtagctctgagacagtcagtggaggcagacataaacggtctcaggagagtgctcgatgagctgaccctcaccaaagctgatcttgagatgcagattgagtccttaaccgaagagttggcatacctgaagaaaaatcatgaggaggagatgaaggatctacgaaatgtgtcaaccggggatgttaacgtcgagatgaacgccgctcctggcgttgacctgactcaacttttgaacaatatgcgaagccagtatgagcaacttgcagagcagaatagaaaggatgcagaagcatggttcaatgagaagtcgaaggagcttacaaccgagatagataacaatattgagcagatcagcagttacaaaagcgagataaccgaactgcggcgaaatgttcaggccctggaaattgaattgcagagccagctggcactgaaacagagcctggaagcttcgctggctgagaccgaaggcaggtattgcgtgcagcttagtcaaatacaagcccaaattagcgctttagaagaacagctgcaacagatccgggctgagacggaatgtcagaacaccgagtatcagcagctcctggatatcaaaattcggcttgagaatgaaattcagacttacaggtctctgctggagggggagggtagctccggggggggcgggagaggtggcggctcattcggcggcggttatggggggggaagcagcggtggaggcagtagcgggggcggccacggtggaggccacgggggaagtagtgggggcgggtacggtgggggttcaagtggggggggctcatccggaggtggctacgggggtggaagctcctcgggcggacatggagggtcgagcagtggcggctacggtggtgggtctagtggcggcggtggtgggggctatggcggcggtagctccggtggcggatcatcctcaggaggtgggtatggggggggcagtagttctgggggtcacaaatcttcttcgtcagggtctgtgggggagtccagctcgaaaggacctcgttactag

SEQ ID NO: 192244 - DNA, 1485 bp, Artificial Sequence
  Description of Artificial Sequence: Synthetic coding sequence
atggacctgagcaacaacaccatgagcctgagcgtgcggacccccgggcttagtagacgcttgagttcccagtctgtgatcgggaggccacgtggtatgtcagcaagctccgtgggcagcggatatggcgggagcgcatttggttttggggcttcatgcggaggtggatttagtgcggcatctatgtttggctcatcaagcggcttcggggggggatctggcagttcaatggccggcggcctcggagcgggctatgggagagcgctggggggaggaagctttggaggcctgggtatgggctttggcggttctcccggggggggtagcctgggaattctgtccggaaacgatggaggcctcctgagtgggagtgaaaaggagacaatgcaaaacctgaacgatcggcttgcgagttacctcgacaaggttcgagcactcgaggaagccaatactgagcttgagaataagatccgcgagtggtacgagacacggggcaccggcaccgctgatgccagccagagcgactattccaagtattaccctctgattgaagacctgcgtaacaagataattagcgcctccataggcaatgcccagcttctgttacagatcgataatgctcgcctagccgcagaggatttcaggatgaaatacgaaaatgaattggccctcaggcaaggcgttgaggccgacatcaacggcttacgccgcgtcttggacgaacttactcttactaggacagacctcgagatgcagatcgagagccttaatgaggagctggcgtatatgaaaaaaaaccacgaagacgagttgcagtcctttcgagtgggcgggcctggggaggtaagtgtcgaaatggacgctgcgccaggggttgacctgacgaggcttctgaacgacatgcgggcccagtacgagactatcgcggaacagaatcggaaggacgctgaagcctggtttatagagaagtccggtgaactccgaaaggaaatctctactaatacggagcagctgcagtcctcaaaatccgaagttacggatctgaggcgcgcgttccaaaacctcgagattgagttgcagtctcagctggccatgaaaaaatctttggaagattctctcgcagaggctgaaggtgactattgtgcccaactctcccaggtgcaacaacttatcagcaaccttgaggctcagctgctgcaggtcagagccgacgcggaacgtcaaaatgtcgaccaccagcggctcctcaacgtcaaagccagactggagctggaaatcgagacgtatcgtcgattgttggatggcgaggcacagggtgacggactagaggagtctctcttcgtcacagactctaaaagccaggcacagtctacagatagttccaaggaccccactaaaacgaggaagattaaaactgtggtccaggagatggtgaatggggaagtggtttccagccaggtgcaagaaatcgaggagctcatgtag

SEQ ID NO: 192245 - DNA, 1068 bp, Artificial Sequence
  Description of Artificial Sequence: Synthetic coding sequence
atgagcctgcggctgcagagcagcagcgccagctacggcggcggcttcggcggtggctcctgtcagttagggggcggacggggcgttagtacttgctcgactcgcttcgtgtccggcggatctgccggtggttacgggggaggcgtttcttgcggcttcggcggcggagccgggtcaggctttggcgggggactcgggggaggttttggagggggattcgctggaggctttgtggattttggggcctgtgatggcggcttgctgaccggcaacgaaaagattactatgcagaatctgaacgatcggctggcatcatacctggagaaagtgcgcgctctggaggaggcaaatgccgatctggaagtgaagattcgcgactggcaccttaaacagtcgcccgcttcaccagaacgagattactccccctactacaaaactattgaggagctccgggacaagatactaactgcgactatcgagaataacagagtgattctggaaatcgacaacgctcgtctggcagcagatgacttccggctgaagtacgagaacgagctcgccctccggcagtcagtcgaggccgatattaatggcctgcggcgcgtcttggatgaactgacgctaagcaagaccgaccttgagatgcagattgaatctctgaacgaggagttggcatacatgaagaaaaaccacgaggaggagatgaaagaattctcaaatcaggtggtgggacaggtgaatgtagagatggatgcaacccctgggatcgatctgactagagtcctagccgagatgcgcgagcaatatgaagcgatggcagaacggaatcggcgggatgccgaggagtggtttcacaccaagtccgccgagctgaacaaagaggtttcgaccaatactgcaatgattcagacttcaaagactgaaattacagaacttagacggacactgcagggcctagaaatagagctccagagccagctatcaatgaaagcgggtcttgaaaacactgccgctgacccaggcacccaccagcagcaccgcgggcctgcagagcgggcaccccagtag

SEQ ID NO: 192246 - DNA, 1377 bp, Artificial Sequence
  Description of Artificial Sequence: Synthetic coding sequence
atgagcctgcggctgcagagcagcagcgccagctacggcggcggctttggaggcggatcttgccagttggggggagggcgcggggtcagcacgtgttcaactagattcgtttccggcggtagcgccggtggatacggaggcggcgtttcgtgcgggtttggcggcggggcaggatctggattcgggggtgggtacggcggagggctgggcgggggttacggcgggggccttggagggggctttggggggggcttcgccggcggattcgtggattttggggcttgtgatggaggattactcaccggaaatgagaaaatcacaatgcaaaacttgaatgacagattggcgagttacctggagaaggtccgagcattggaagaggccaacgcagatttggaggtcaaaatcagagattggcacctgaaacaaagccccgcctctccagagcgggactactcaccatattacaagactattgaggaactcagagataaaatactgacggccacaatcgagaataaccgcgtcatcctggagattgacaatgctcggctcgcggccgacgacttcaggttgaagtacgaaaatgaactagcactgcggcagtctgtcgaggccgacataaatgggttgcggagagtgctcgacgaattgactctgagcaagacagacctagaaatgcagatagaatctctgaacgaagaattggcttacatgaaaaagaatcacgaggaggagatgaaagaattttccaaccaggttgtgggtcaagtgaacgtcgaaatggatgctacacccggcatcgacttaacgcgagttttagccgaaatgcgggagcagtatgaggcaatggccgaaagaaataggagggatgctgaggagtggttccacacaaagtcagccgaactaaacaaagaggttagtaccaatactgccatgatccagacaagtaaaaccgagatcactgagctgaggcgcaccctgcagggtttagagattgagcttcagtcccagctttccatgaaagcgggactggagaacacggtggctgagacggagtgcaggtacgctctgcagcttcagcagattcagggattaatctcctctatcgaggctcagctgtccgagcttagatccgagatggaatgccagaaccaagaatacaaaatgctacttgacataaagacacgccttgagcaagaaatcgccacatacaggtctcttctggaaggacaggacgccaagatgattgggttccccagtagcgccggttctgtctccccacgcagcacttcagtgaccactacttccagtgcctctgtcacgaccactagcaacgcctctgggagacgaacctcggatgtgagaaggccctag

SEQ ID NO: 192247 - DNA, 1263 bp, Artificial Sequence
  Description of Artificial Sequence: Synthetic coding sequence
atgagcctgcggctgcagagcagcagcgccagctacggcggcggcttcggtggcgggtcctgtcaactggggggtgggaggggggtgtcaacgtgtagcactagattcgtcagcggcggaagtgctggcggctatggaggaggggtgtcttgcggcttcggcgggggggccgggtccggtttcggcggagggtacggaggggggctgggcggtggctacgggggtggattaggtggcgggtttgggggcggcttcgctggagggttcgtcgacttcggagcttgcgacggtggcctactgaccggaaatgagaagataaccatgcagaatctgaatgataggctggcttcataccttgagaaagttagggctctagaagaggctaacgctgatcttgaggtgaaaatcagagattggcatctaaagcagagcccagcatccccagagcgcgactactcaccttattataaaaccatcgaagagctgagggacaagatcctcactgcaaccatagaaaacaatagggttattctcgagatagataacgcaagactcgcagccgacgacttcaggttgaaatacgaaaacgagctcgcactgagacaatctgtggaagcggacatcaatggtctgcgcagagtgctggacgagctgaccctcagtaaaacggatctcgaaatgcagatcgagagcttgaatgaggagctcgcctacatgaaaaagaaccatgaagaggaaatgaaagaattctcaaatcaggtagtgggtcaagtgaacgtagagatggacgctacaccagggatcgatcttactcgcgtgctggctgagatgcgcgaacaatacgaggctatggcagaacgcaacagacgggatgctgaagaatggtttcatactaaatcagctgaactgaacaaggaggtgagcaccaacaccgccatgattcagacttctaaaacagagatcaccgagcttcggaggactctccaggggttggaaattgagctgcagtcccaactgtcgatgaaggcaggtttagaaaacaccgttgctgagacggaatgtcgatatgctctgcaactgcaacaaatccagggactgatatcatcaatcgaagcacagctgtcagagttacgaagtgaaatggaatgccagaaccaggaatacaagatgttgttggatatcaaaacgaggctggagcaagaaattgctacctatcgctccttactggaaggccaagacgccaaaaagagacagcctccctag

SEQ ID NO: 192248 - DNA, 1371 bp, Artificial Sequence
  Description of Artificial Sequence: Synthetic coding sequence
atgaccaccaccttcctgcagaccagcagcagcaccttcggcggcggatccaccagaggagggtctcttctggctggcggcggcggattcggtgggggatctttgtccggtggaggaggcagccgttccatctccgccagttctgctagatttgtttcgtctgggtcaggaggcgggtacggcgggggcatgagagtttgcggattcggcgggggagctggtagtgtcttcggcggcggtttcggtggcggcgtgggcggtggctttggagggggcttcggtggcggcgatggaggcctgctgtctgggaatgagaagatcaccatgcagaacttgaatgacagactggcaagctacctggacaaggtgagagccttagaggaagctaacgcagatctggaagtcaagatccatgactggtatcagaaacagactcccacatcacctgaatgtgactactcgcagtacttcaaaaccattgaggagttacgcgataaaattatggccaccaccattgataattcccgcgtcatactggaaatcgacaatgcccgcctggcagcggatgattttcgcttgaagtatgagaatgagctcgccttgagacagggagtggaagcggatataaatggcctgcgaagagttctggacgagctaactcttgctaggaccgacctagagatgcagatagaagggctgaacgaagaactggcctacttgaagaaaaaccatgaggaagagatgaaggaattctcgagtcagctggcaggccaggtgaatgtcgagatggacgccgctcctggagttgatctgacccgagtcctggcagaaatgagagagcagtacgaggcaatggcagagaagaaccggcgggatgtggaagcctggttcttttctaaaacagaggaattgaacaaggaggtggcatcaaatactgagatgattcagacatcaaagaccgagatcactgacttgagaaggaccatgcaggaactcgagatagaactccagtcccaactgagtatgaaggccggtttggagaattcgcttgccgagactgagtgcaggtatgccacacaactgcagcaaatccaaggccttattggaggactcgaggcccagttgtccgaactacgctgcgagatggaggcgcagaaccaggaatataaaatgctactggatatcaaaacaagactggagcaggagattgccacttaccgctctctgctcgagggccaggatgccaaaatggcaggcatcgccatcagagaagcaagttccggaggaggagggagcagctcaaactttcacatcaacgtggaagagtcagtggatggccaggtggtcagctcacacaagcgggaaatctag

SEQ ID NO: 192249 - DNA, 876 bp, Artificial Sequence
  Description of Artificial Sequence: Synthetic coding sequence
atgaccggcacccggagccggccccagcccgcccagaacgccaccaccgctaacacctcgcggccactcaaatctagtgggacccgctacgagaatgagttagctcttaggcagggtgtggaagccgacataaatggactgcgacgtgtcctggatgaactaaccttagcccggaccgacctggagatgcaaatcgaggggcttaatgaggagctcgcctacttgaaaaaaaaccacgaggaagaaatgaaggaattctcatcccaactggctgggcaggttaacgtcgagatggacgctgccccaggcgtggatttaaccagggtacttgcagagatgcgcgagcagtacgaagccatggcggaaaagaataggcgcgacgtggaagcatggtttttcagtaagaccgaggagctgaacaaggaggttgcatcaaacaccgaaatgattcagacctccaagaccgagatcacagacctccgtagaactatgcaggagttggaaatcgaattacagtcacagttgagcatgaaggcaggactcgagaatagtttggccgagacggaatgtcggtatgctactcagttgcagcagatacaagggctgatcgggggcctcgaagcccaactgagcgagcttcgctgtgaaatggaggctcaaaatcaagagtacaagatgctgcttgacattaaaacaaggctcgagcaggagattgccacttatcgatctctgcttgagggccaagacgctaagatggccggcatcgctattagagaagctagcagtgggggcggtggctcttcatctaactttcatattaatgtggaggagtcagtcgatggtcaagtggtgtcttcccacaagcgcgagatttag

SEQ ID NO: 192250 - DNA, 1371 bp, Artificial Sequence
  Description of Artificial Sequence: Synthetic coding sequence
atgaccaccaccttcctgcagaccagcagcagcaccttcggcggcgggtcgacacggggaggtagcctgttggctgggggtggcggctttggcggcgggtccctcagcggagggggcggctctagatcaatttccgcgtcttctgcacgcttcgtgtcgagcggctctgggggcggctatgggggaggtatgcgcgtctgcggcttcggcggcggcgccggaagcgtgttcggagggggcttcggaggaggagtcggcggcggtttcggagggggttttggcggcggcgacggcggattgctcagcggtaatgagaaaatcaccatgcaaaacctgaacgacagactcgcctcatatttggacaaagtgcgcgcacttgaagaagccaatgctgacctagaagttaaaatccatgattggtatcagaagcagactcctaccagtcccgaatgcgactattcacagtatttcaagacaattgaggaattaagagataagatcatggccactacgatcgacaatagtcgtgtgatactcgaaatcgataatgcccgcctggctgccgatgacttccgcttgaaatacgaaaatgaactcgcattacggcagggcgtggaggctgacattaacggactccggagggtgctagacgagctcacactcgccaggaccgatctcgaaatgcaaatagagggcctgaatgaagaacttgcctatctgaagaaaaaccatgaagaagaaatgaaggaattctcatcacagctggctggccaggtgaatgtagagatggatgctgcacccggtgtggacttaactcgagtattggcagagatgcgcgaacagtacgaagcaatggctgaaaagaatcgacgagacgtggaagcttggttcttttctaaaaccgaagagctgaacaaagaagtggcgtctaacacggagatgatccagacaagtaaaacggagatcactgacctcaggaggaccatgcaggagttagaaatcgaactgcaatcccagctgtctatgaaggctggcctggaaaactctctagcagaaacagaatgccgctatgccacccagctccagcaaattcagggactgatcgggggtttggaggcccagctatcagagctgagatgcgaaatggaagctcagaaccaggagtacaaaatgttgctggatataaagactcgactggagcaagagatcgccacctatcggtccctgcttgaagggcaggacgccaaaatggccgggattgcaatccgagaggcctcgtcaggcggtgggggtagctcatcaaactttcacatcaacgttgaggagagcgttgacggtcaggtcgtgtctagtcataaacgcgagatttag

SEQ ID NO: 192251 - DNA, 756 bp, Artificial Sequence
  Description of Artificial Sequence: Synthetic coding sequence
atgaccggcacccggagccggccccagcccgcccagaacgccaccacagctaatacatcacgtcccctgaagtctagtggcacccgctacgagaacgaactcgccctacgacagggagtggaggcagacattaacggcctgagaagggttctggatgaactgaccctggctaggaccgatctggaaatgcagattgagggtcttaacgaagagctggcctaccttaaaaagaaccatgaggaagagatgaaagaattttcttcccagctcgccggccaggtgaacgttgaaatggacgccgcacccggcgtggatttgaccagggtgcttgcggagatgcgcgagcagtacgaggccatggctgaaaagaatcgtcgcgatgttgaagcctggtttttcagcaagacagaggaactcaacaaggaggtagctagcaacaccgaaatgattcagacaagtaagactgagatcaccgacctgagacggaccatgcaggagctcgagatcgaacttcaatcccagctgagcatgaaggccgggctggagaatagcttggccgagaccgaatgcagatacgcaacccagttgcagcagattcagggtctgattggcggcctagaggcacagctcagtgagcttcggtgcgagatggaggcccagaatcaagagtataagatgctccttgatattaagacacggctggagcaggagatcgccacttacagatcacttctcgagggccaggacgccaaatag

SEQ ID NO: 192252 - DNA, 663 bp, Artificial Sequence
  Description of Artificial Sequence: Synthetic coding sequence
atgaccggcacccggagccggccccagcccgcccagaacgccaccacagctaatacgtctaggccgctgaaaagcagtggcactaggtacgagaatgagcttgccttgcgacagggagttgaagctgatattaatggattacgtagagtccttgatgagctgaccctcgcacggacggatctggagatgcagattgaaggcttgaatgaagagttggcctacctgaaaaagaaccacgaagaggagatgaaagagttctcgagccagttggctgggcaggtgaatgtggaaatggacgccgcacccggggtggatctgacgcgtgtgctggcggaaatgagagagcaatacgaggcaatggccgaaaagaatcgccgtgacgtggaggcttggttcttctctaagacagaggagctgaacaaagaggtggcttccaataccgaaatgattcagacctcaaaaacagagatcaccgacctgcgccgcaccatgcaagagctggagatagaactgcagtcgcaactgagcatgaaggccggtctggagaacagcctggccgagacggagtgccgatacgccacacagctgcagcagattcaggggctcatagggggcttagaggcacagctctctgaacttagatgtgaaatggaggcccagtag

SEQ ID NO: 192253 - DNA, 1422 bp, Artificial Sequence
  Description of Artificial Sequence: Synthetic coding sequence
atgaccacctgcagccggcagttcaccagcagcagcagcatgaagggctcctgtggaattggaggcggtatcggcggtggctcctcccgcatcagctccgtccttgcgggtggaagctgtagagcaccctctacttacggcggcggtctgagcgtgtcatcaaggttctccagtgggggagcatgtggcctcggaggcgggtatggcggtggattcagcagcagcagcagctttggaagcggcttcggaggtggttatggtggaggtctcggcgccgggttcggtggaggcctgggcgcaggattcgggggaggtttcgcaggaggggatgggcttttggtgggcagcgagaaagtaacaatgcagaacctgaacgaccgcctggcctcctatttagacaaggtgagagcccttgaagaggctaacgcagacttggaagtcaaaattagggactggtatcagaggcagagaccttctgaaatcaaggactattctccttatttcaaaacaattgaggacttacgaaataaaatcattgccgcaaccatcgagaatgctcagccaatcctgcaaatagacaacgcacgcctcgcggccgatgactttcggacaaaatacgagcatgaactggcacttcgacagaccgtagaggccgatgtcaatggcctacgaagagtgttggacgagctaaccctggctagaacagatctggagatgcagatcgagggcttgaaagaggaactggcctatctgcgtaagaatcacgaggaggaaatgctagccctgaggggccaaaccggaggagatgtgaacgtggaaatggacgccgcccctggggttgacctgtccagaattcttaacgaaatgagggatcagtatgaacagatggcagagaagaacaggcgagacgctgagacttggtttctgagcaaaaccgaggaactgaataaggaagtggcatctaacagcgaactggtgcagagctcccgcagcgaggtgacagagttgcgtcgggttttgcaggggctggagattgaactccagagccagctttcaatgaaagcctcgctggaaaattcgctcgaggaaacaaaaggccgatactgtatgcagctctcccagatacagggcctcattggttctgtggaggagcaactagcccagcttcggtgcgagatggaacagcagtcacaggagtaccaaattctccttgacgtaaaaacccgcctcgaacaagagattgcaacctaccgcagactgctagaaggcgaagacgcacaccttagcagtcagcaagcctcaggacagagctacagcagtcgtgaggtgtttacgtccagctcctccagttctagccgccagactcgcccaatcctgaaggagcaatcctccagtagctttagccagggacaatcttcttag

SEQ ID NO: 192254 - DNA, 1299 bp, Artificial Sequence
  Description of Artificial Sequence: Synthetic coding sequence
atgaccaccagcatccggcagttcaccagcagcagcagcatcaagggctctagcggcctggggggcggcagtagccggaccagctgcagactgtccggcgggctcggagcaggaagctgtcggcttgggtctgcggggggcctgggctctactctcggagggtcatcatattccagttgctactcctttggaagtggagggggctacggctctagcttcgggggagttgatggcctgctggccggaggagaaaaggccaccatgcagaacttgaacgatagactcgcttcctatttggataaggtgagggccctggaggaggccaacacggagctcgaggtaaaaattcgggactggtatcagcggcaggcaccaggcccagctagagactactcgcagtactaccgtacaatcgaggagttacagaacaaaatcttgacggctacagttgataatgccaatatcctgctacagatcgacaacgcaaggctcgccgctgatgattttcgcactaagtttgagacagagcaggccctgcggcttagcgttgaggccgacattaatgggctccggcgggttctggacgaattaacacttgcccgagccgacctggaaatgcagattgaaaatcttaaggaagaactcgcctacctaaagaagaaccatgaagaggagatgaacgcattacgcggacaggtcggaggcgagataaacgtggaaatggatgcagccccaggagttgacctgtcgagaattctgaacgagatgagggaccagtacgagaaaatggcagagaagaatcgaaaagacgcagaggattggttctttagtaaaactgaggagctgaatagggaggtcgctactaattctgaattagtgcagtcgggtaagagcgagatctcagaattgcggagaaccatgcaggctctggagatcgagcttcagagccagttaagcatgaaagcgtccctggagggtaacctggctgagacagaaaatcgctactgtgttcagctgagccagatacagggtctgattgggtcagtggaggagcagctggcccagcttaggtgtgagatggagcagcagaatcaagaatacaagatcctacttgacgtcaaaactcgcttagaacaagagattgccacgtacagacgtttactcgagggagaagatgcccacctgacccagtataaaaaggagcccgttacaactaggcaggttcggacaattgttgaagaagttcaagatgggaaagtcatatctagtagagagcaggtacatcagactactcgatag

SEQ ID NO: 192255 - DNA, 1920 bp, Artificial Sequence
  Description of Artificial Sequence: Synthetic coding sequence
atgagctgccagatcagctgcaagagccggggccggggcggcggcgggggaggttttcgggggtttagcagcggctcagccgtcgtgagcggaggcagccgtaggtcaacctcttcattctcctgtttgtcccgccacggagggggaggcgggggcttcggcggtggcggtttcggaagtcgatctttggtcggcctaggtggaaccaaaagcatcagtatctctgtggccggtgggggcggtggctttggtgcagccggaggctttggcggcaggggtggcggtttcggtggaggttccagctttggggggggtagtgggttctccggtggcgggttcgggggagggggcttcggaggcggcagattcggcggttttgggggtccaggcggagtcggaggtttgggagggccaggaggctttggaccgggaggctatcctggtggcattcacgaagtctccgtcaaccagtctctgcttcagccgctcaatgttaaggtcgacccagagatccaaaacgtcaaagcccaggagcgggaacagatcaaaacactcaacaacaaatttgcttcctttattgataaggttagattcttggagcagcagaaccaagtgctgcagaccaagtgggaactgcttcagcaaatgaatgtggggaccaggcctatcaacctggagcccatcttccagggttatatcgacagcctgaagaggtaccttgacggccttactgcggaacggacctcacaaaattcagagttgaataacatgcaggacctcgtggaggattacaagaagaaatacgaggacgaaattaataagcgtactgccgccgagaatgacttcgttaccttgaagaaagacgtggacaacgcctatatgatcaaggtggagctccagtcgaaggtcgatttgctgaaccaagaaatagagttcctgaaagtgctctacgacgcggagatctcacaaatccatcagtcagtgacagatacaaatgtgatcctctcaatggacaactctaggaacctggacctggattccatcattgccgaagtcaaagcacaatatgaggagattgcgcaacggagtaaggaggaagcagaagccctctatcactccaagtacgaggagctgcaggttacagtaggtcggcacggggattctctgaaggaaataaagatcgaaatcagtgaactcaacagagtgatccaaaggttacaaggggaaatcgctcacgttaagaaacagtgcaaaaacgtacaagacgccatcgctgatgccgagcagagaggagagcacgcccttaaagacgccagaaacaagctgaacgacttagaggaggccctgcagcaggctaaagaagatcttgcgagactcctcagagattatcaagagctgatgaacgttaagctcgccctggatgtcgagatcgcaacatacagaaaactactggaaggagaagagtgcagaatgtccggcgacctgtcctccaatgtgactgtgagcgtcacatcttctacaatctcgagtaatgtcgcttccaaggcagccttcggggggagtggcggcagagggtcctcgtcaggcggcggctattcgagtggctcctcctcttacgggagtggaggaaggcaaagcgggagccgggggggcagcggggggggtggttcgatctctgggggaggttatggttctggggggggctccggcggcaggtatgggagcggagggggcagtaaagggggctccatatccggaggaggctatggaagcggtgggggtaaacacagctccggggggggaagtaggggcggttcatccagcggcggcggatacgggtccggcggcggagggagcagcagcgtaaaggggtcatccggggaagccttcggatcgtcggttaccttttccttccgctag

SEQ ID NO: 192256 - DNA, 1275 bp, Artificial Sequence
  Description of Artificial Sequence: Synthetic coding sequence
atggacttcagccggcggagcttccaccggagcctgagcagcagcctccaggcgccggtggtctccacggtggggatgcagcgtctgggcacaacaccctccgtgtatggcggcgcaggtggccgcggcatacgtataagtaactctaggcacaccgttaattatggctccgatttaaccggaggtggcgatctgtttgtgggcaacgaaaagatggccatgcagaacctgaatgatagactagcatcttacctcgagaaagtcagaacccttgagcagagcaatagcaaactcgaggtacaaattaaacaatggtacgaaacgaacgcacctcgtgctggacgagattacagcgcctactatcgacaaatagaggaattgcggtcccagatcaaagatgctcagctccaaaatgcccggtgtgttttacagatcgataatgcaaagctggccgccgaagattttagattgaaatacgagactgaaaggggaattaggctgactgtagaagctgaccttcagggcctgaataaggtattcgatgatttgaccctccacaagacagatctcgagatccagatcgaggagttgaacaaggacttggccctgttgaaaaaggaacatcaggaggaggtcgacggtctccataagcacctgggtaatactgtaaatgtggaggtggatgcggctcccggactgaacctgggtgtgattatgaacgagatgagacaaaaatacgaggtcatggctcaaaaaaacctgcaggaggcaaaagagcagttcgaacgccagactgctgttctgcagcagcaagtgaccgttaatacggaggagcttaaagggacagaggtgcagttgacggaattgcggcgcacatctcagtctcttgagattgagttgcagtcccacctaagtatgaaggaaagccttgagcacacactggaggaaacaaaagcccggtactctagccaactagccaaccttcaatcactgctctcctccctggaggctcagctgatgcagatccggagcaatatggagcgccagaacaacgaatatcacattctgctcgacattaaaaccaggctcgagcaggaaattgctacataccgccgcctcttagagggggaagacgtaaagacaacagaataccaattaagtacgttggaggagagggacatcaaaaagaccaggaagattaaaaccgtcgtccaggaggttgttgatggtaaggtggtgtcttccgaagtgaaggaagtggaagagaatatttag

SEQ ID NO: 192257 - DNA, 1578 bp, Artificial Sequence
  Description of Artificial Sequence: Synthetic coding sequence
atgagctgcagcagccgggccagcagcagccgggccggcggcagctcttccgcaagagttagcgcaggtggctcgtcattctcttcagggtctaggtgcggactcgggggaagttcagcccaggggtttcgaggcggcgctagtagttgcagcctctcaggtggatcatccggcgccttcggcggatcgtttggcggaggttttgggtcttgttcagtagggggcggattcgggggggcatccggcagcggcactgggttcgggggggggagtagcttcggaggcgttagtggattcggtcggggttccggattttgcggaagttcccgctttagctccggggcgactggcgggttttactcgtatgggggtggcatgggggggggcgtgggggacggaggtctgttcagcggtggggaaaagcaaacgatgcagaacctcaacgaccgtttggccaattacctggacaaggtgagggctttggaagaggcaaatacagacctagagaacaaaatcaaggagtggtacgacaaatacgggcctggctctggggatggtggtagtggaagggactacagcaagtactattccattattgaggatctgcggaatcaaatcatcgcagctaccgtggagaatgcaggaattatactgcatatagataatgccaggctggccgccgatgattttcgcctgaaatacgagaacgaattgtgtctaaggcaatctgtggaagccgacattaatgggctgcggaaagttttggacgacctgactatgacccgtagcgacctcgagatgcaaattgagtcgtttaccgaagaacttgcctacctgcgcaagaaccacgaagaagagatgaagaacatgcagggcagttcggggggtgaggtcactgtggagatgaatgccgcccctggaaccgacctgaccaagctccttaacgatatgcgggcacaatacgaggagctggcggagcagaacaggagggaggctgaagagaggtttaataaacagagtgcgtcattacaggctcagatttctaccgacgctggagccgccacatcggccaagaacgagataactgagctgaagaggacgctgcaggctctggagatagagctgcagagccagttagctatgaaatcatccctggaaggaacacttgcggacacagaggccggatatgtcgctcagttatctgagatccaaacacagatctctgccctggaggaggaaatctgccagatttggggtgaaactaagtgtcagaatgcagagtataagcagctgctggacatcaagacccgcctggaggtggaaatcgagacctatagaaggttgttagacggcgaaggaggcgggagtagttttgccgaatttgggggcagaaatagtgggtccgtcaatatgggttccagagatctggtctctggcgattcaagatctggaagctgctcggggcagggcagggattcttccaaaaccagggttacaaaaaccattgtagaggaactggtcgacgggaaggtcgtgtcttcccaagtttcttcgatttccgaggtcaaagtaaagtag

SEQ ID NO: 192258 - DNA, 1890 bp, Artificial Sequence
  Description of Artificial Sequence: Synthetic coding sequence
atgagccggcaggccagcaagaccagcggcggcggcagccagggcttttcagggcgatctgccgtggtgtccggcagctctcgcatgagctgtgtcgcccactctggtggggcaggcggaggtgcctacggcttcagatctggggcaggcgggtttggcagtcggagcctatataatctaggaggcaacaagagcatctcaataagcgtcgctgcaggcggctctcgagccggaggatttgggggagggcgatctagttgcgcttttgctggcggatatgggggcggctttggttccgggtacgggggaggctttggtggggggttcggaggcggcagaggaatggggggcggctttggaggagccggcggatttggcggagcaggtgggtttggcggtgcaggcgggtttggcggacccggtgggtttgggggatctggggggttcggaggaccaggtagcctgggctcaccgggagggttcggccccggaggatttcctggggggattcaggaagtgacaattaatcaatccttgctgcaaccactcaacgtggaaattgacccccaaattgggcaggtgaaagcccaggaacgggaacagattaaaacacttaacaataagttcgcatccttcatcgacaaggttcggtttctagaacagcagaataaggtgctggaaactaaatggaatctgctccaacagcagggaacctccagcatatcgggcactaataacttagaaccactcttcgagaatcacatcaattacctgagaagttatctggacaacattctgggggagagaggaagactggattcagaactcaagaacatggaggacctggtagaggacttcaagaaaaagtatgaggatgagatcaataaacgcactgctgctgagaatgaattcgtcacattaaagaaagatgtcgatagcgcttacatgaacaaggtcgagttgcaagccaaggtcgacgctctgatcgatgaaatcgactttttgcggaccctgtatgacgctgaactgtctcagatgcagagccacatcagcgacacatctgtagtattgagcatggacaacaacagatcattggatctcgatagcatcatagcagaggtgcgcgcacagtacgaagacattgcccaacgcagcaaggccgaggctgaagccctgtaccagacaaagctcggggaactccagaccacagccggtaggcatggtgatgatttacgcaacaccaaatctgagataattgaattgaaccgcatgatccaacggctccgggcagagatagaaggcgtgaagaaacaaaatgcaaacctgcaaacagctatagccgaagcggaacagcatggagaaatggccttgaaggacgctaacgctaagctccaggagctacaggcagccctgcagcaggccaaagacgacttggcccgccttctcagggattaccaagagttaatgaacgttaagcttgcactggacgttgagatcgccacttataggaaactgctggaaggcgaggagtatagtcggatgtcgggcgagtgcccctcagcggtttcaatctctgtcgtgtcttcaagcacgacttcagcctctgcagggggctatggcgggggctacggagggggcatggggggagggctaggtggggggttcagtgccggaggggggtccggtagcggtttcgggcgaggaggcgggggaggcattgggggaggttttggcggaggttcatcaggtttttccggcgggtcggggttcgggtccatctcaggagcacggtatggcgtatccggtggcgggtttagttcagccagtaaccgggggggcagcataaaattcagccagtctagccagtcaagtcagagatattcacgatag

SEQ ID NO: 192259 - DNA, 1887 bp, Artificial Sequence
  Description of Artificial Sequence: Synthetic coding sequence
atgagccggcaggccagcaagaccagcggcggcggcagccagggcttctctggcagatccgctgtggtctccggatcaagtcggatgagttgcgtggcccacagcggaggcgcagggggaggggcctatggatttcgctccggtgcgggtggcttcgggtctaggtcactgtataatctgggcgggaacaagagtatttctatctctgtggcagccggcggctctcgcgccgggggatttggcggcggccggagcagttgtgccttcgctgggggatacggcggaggcttcggtagcggctacggcggtgggttcggcgggggcttcggtgggggaaggggcatggggggtggatttggaggcgccgggggctttggaggcgctggcgggtttggcggagccgggggcttcggtggcccaggcggctttggggggtccggaggtttcggcggacccggcagcttgggctcgcccggcgggttcggcccgggtgggttccctgggggaattcaggaggtgacaattaaccaaagtctcctgcagcctctgaatgtggaaatcgatcctcagatcggacaagtgaaagcccaagagagagagcaaattaagactttgaataataagttcgcctccttcatcgacaaggtgcgcttcctggaacagcagaacaaggttctggagactaagtggaacctcctgcaacagcaaggaactagcagcatctcaggcaccaacaacctcgagcccctgtttgaaaatcacattaactacctgcggagctacctcgataacattctgggggagcgcggcaggctcgacagtgagttgaagaatatggaggacttggtcgaggacttcaagaaaaagtacgaagatgaaattaacaagcggacagctgctgaaaatgaatttgtcactttgaaaaaggacgttgattcagcctacatgaataaggttgagcttcaggccaaggtcgatgctttgatcgacgagattgacttcctgaggacactgtatgatgccgagctgagccagatgcagagccacatctccgacacctctgtcgtactctcaatggacaataaccgttcacttgacctggatagtatcatcgcagaggtgagagcacagtatgaggatatcgcccagcgttctaaagcggaggcggaggctctgtaccaaacaaagcttggagagctgcagacaactgccggccgtcatggtgatgacctcaggaacactaaaagtgagattatagagctgaatagaatgatccagcggctgcgagcggagattgaaggggtgaaaaaacagaacgccaatcttcaaaccgcgatcgccgaggccgagcaacatggcgaaatggcccttaaagatgccaacgctaagctccaagagctgcaggctgccttacagcaggctaaggacgacttagccagacttctacgggactatcaagagctgatgaacgtgaagttggccttggatgtggaaatcgcgacataccggaaacttctagagggtgaagaatacagaatgagcggagagtgcccttctgccgtgagcatttcggtcgtgtcctcaagcactacttcagccagcgcgggtggctacggcgggggatacggtggtggcatgggaggtggtctcggaggcggattcagcgccggagggggttctggctccggtttcggtagaggcggaggcggcggcattgggggcggcttcggtggaggctccagcggtttctccggaggcagcgggttcggtagcatttctggagccagatacggcgtttctggcggcggtttttcatcagcaagcaatcgggggggtagtattaagttctcacagtcaagccagtctagtcagcggtattctagatag

SEQ ID NO: 192260 - DNA, 1251 bp, Artificial Sequence
  Description of Artificial Sequence: Synthetic coding sequence
atgccctacaacttctgcctgcccagcctgagctgccggaccagctgctctagtagaccctgcgtgcccccaagttgtcacagttgtaccctgccaggcgcctgtaatatccctgccaatgtcagtaactgtaactggttctgtgagggatcttttaacggatccgagaaggagaccatgcagtttctcaacgacagactcgcctcctacctagaaaaggtgcgtcaattggagagggataacgctgaactggagaatttaattcgagaaagatctcaacagcaagaacccttattatgcccctcgtaccagagctacttcaagacaattgaagagctccagcagaaaatcctgtgtacaaagtcagagaatgctcggctggtcgtacagattgataatgctaagctggcagctgatgattttcggaccaaataccagaccgaactgagcctgcggcaacttgtggagagcgacatcaatggattacggaggattcttgatgagttgaccctttgcaaatccgatttagaggcacaggttgagtctctgaaggaggaactgctgtgcttaaagtccaaccatgaacaggaagtgaataccctgcggtgtcagctgggcgataggctgaatgttgaagtggacgctgctcccacagtagaccttaaccgggtactgaacgagactagaagccagtatgaagcactggtggagaccaaccgccgtgaggttgagcaatggttcactactcagactgaagagttaaataagcaagtggtgagcagcagtgagcagctgcagtcgtaccaagctgaaatcattgaactcaggagaaccgtgaatgcccttgaaattgaactgcaggctcagcacaatctccgtgatagtctggaaaacactttgaccgagtccgaggccaggtattcgtctcaactgagccaagtgcagagcttgatcacaaacgttgagagccaactcgccgagatacgatcagatttggagaggcaaaatcaagaataccaggtcctgctggacgtccgagccagactagagtgcgaaatcaacacatacagaagtctccttgaaagtgaggactgtaacctccctagtaacccatgcgcaactaccaacgcctgctctaagccaattggcccttgtctctccaatccctgcacgagctgcgtgccaccagctccctgtacgccttgcgccccaagaccaaggtgcggcccttgcaactcctttgttaggtag

SEQ ID NO: 192261 - DNA, 1674 bp, Artificial Sequence
  Description of Artificial Sequence: Synthetic coding sequence
atggtgagcaagctgaccagcctgcagcaggagctgctgagcgccctcctgtcatcgggggtcactaaggaagtgctggtccaggctctcgaggaacttctaccctcgcccaatttcggagtgaagctggagactttgccattgtccccagggtctggggcagagcccgacaccaaacccgtctttcataccctgactaatggacatgccaaagggcggctttcaggagatgagggaagcgaagatggagatgattacgacacgcccccaatcctgaaggagctccaggccctgaatactgaagaggccgccgagcaaagggccgaagtggatagaatgttaagtgaagacccttggagagctgcaaaaatgattaagggatacatgcagcagcataatatacctcagcgggaagtcgtcgatgttaccggcctgaaccagtctcatctgtcacagcatctcaacaaggggactccaatgaagacacagaagcgcgctgctctctatacctggtacgttaggaaacagcgcgagatccttcgacagtttaatcaaacagtccaatcatccggtaacatgaccgataagagcagccaggatcagctactgtttctgttcccggagttctcacagcagagccatggaccaggtcagagcgatgacgcttgttctgaaccgaccaataagaagatgcggcggaatcgcttcaaatgggggcccgccagtcaacaaattctttaccaggcttatgaccggcagaaaaatccaagcaaagaggagcgcgaagctctggtggaagaatgtaacagggctgaatgcctgcagcgcggcgtttcaccaagcaaggcccacggattaggttctaatttagtaacggaggttcgggtttataactggttcgccaaccgcaggaaggaggaggcgtttcggcagaaacttgctatggatgcctactcctccaaccagacacactctttgaatcctttattgtcccatggatcacctcatcatcagcctagtagtagtcctccaaacaagctttcgggggttagatattctcagcagggaaataacgagatcacatctagcagtaccattagtcaccacggcaattccgctatggttacctcacagtcggtgttgcagcaggtgagtccagcaagcttagacccaggtcacaatcttcttagccccgacggcaagatgatctctgtcagcggaggtggcctaccaccagtgtctacgctgaccaatatccatagcctgagtcatcacaacccgcagcaatcccaaaacttgatcatgacacccctgtctggtgtgatggcaattgcccagtcgctgaacacatctcaggcacagtcggtccccgtgatcaattcggtcgccggttctctggccgcactacagcccgttcaatttagccagcagttgcacagtccacaccagcaaccactcatgcagcagtctcccgggagccatatggcccagcagccgttcatggccgccgtaacacagctccagaacagccacatgtatgctcataaacaggagccaccccaatattctcatacctcacgtttccctagtgcgatggtcgtcaccgacacctcgagcatttccaccctaacaaatatgagcagctccaaacagtgcccattacaggcctggtag

SEQ ID NO: 192262 - DNA, 1215 bp, Artificial Sequence
  Description of Artificial Sequence: Synthetic coding sequence
atgagctacagctgcggcctgcccagcctgagctgccggaccagctgttcttctaggccatgtgtccctccttcgtgccacgggtgcactctgcctggggcatgcaacatcccggcaaatgtctccaactgcaactggttttgcgagggcagtttcaacggctcagaaaaggaaaccatgcagtttctcaacgataggctcgctagctatctggagaaagttcgtcagctcgaacgagacaacgccgaactcgagaatctgataagagaaaggtctcagcagcaggagcctttagtctgcgcgagctaccaaagctattttaagactattgaggagctacagcaaaagatcctctgcagcaaatctgaaaacgctcggctggttgttcagattgataacgccaagctggcgagcgatgacttcagaaccaaatatgaaaccgaactatctctgaggcaattggtggagtctgacatcaatggtctgcgacggattcttgatgaacttaccttgtgtaggagcgatcttgaagcccaggtggagtctctaaaggaggaactactatgcttgaaacagaatcacgagcaggaggtcaatacattacggtgtcagctcggtgatcggttaaatgtggaggtcgacgcagcccccacagtcgatctgaaccaagtgcttaatgaaactaggagccaatatgaagcgcttgtcgaaacgaaccgccgcgaggttgagcagtggtttgccacacagaccgaggagttgaataagcaggtggtgagtagcagtgaacagttacagtcataccaagctgagattattgagttgcgaaggactgtgaacgcacttgaaatcgagctgcaggcccagcacaacctccgtgatagcctggagaataccctcacggagtccgaggcccgttacagctctcagttgtcccaggtgcagcgcctcatcaccaatgttgagtcgcagctcgcggaaatccggtcggaccttgaacggcagaatcaggagtaccaggttttgcttgacgtgcgggcacgtttggagtgtgagattaacacgtacaggtccctactggagtccgaagactgtaagttaccctcgaatccttgcgccacgacaaacgcttgtgataagtctactggcccttgcatctcaaacccatgtggactgagggcgaggtgtggtccatgcaatacctttggctactag

SEQ ID NO: 192263 - DNA, 1215 bp, Artificial Sequence
  Description of Artificial Sequence: Synthetic coding sequence
atgccctacaacttctgcctgcccagcctgagctgccggaccagctgctcaagtagaccctgtgtgcctccctcatgccacggctatacgctccctggagcctgtaatattcccgccaacgtctctaattgtaactggttctgcgaaggctccttcaacggatccgagaaagagacaatgcagttcctcaacgacaggttggccagttatctggagaaagtcagacagctcgaacgcgacaacgcagagctggagaacctgataagagaaaggtcccagcaacaggagcccttgctgtgtccaagctatcaatcctatttcaagacaatcgaggaattgcagcaaaagatcctctgcagtaagtccgaaaacgccagattagtagtgcaaatcgataacgccaaactagccgccgacgacttccgaacgaagtaccagaccgaacagtctctgagacagctggttgagagtgatatcaactccttgcggcggatactggatgagctgactctgtgtcgttctgatctagaggcacaaatggaatctctcaaggaggaactgctgtcacttaaacagaaccatgaacaggaagtgaacactctaagatgccaactgggggaccgtctcaatgtggaagtagatgcggctcccgctgtggatctgaatcaggtccttaacgagactcgaaaccagtacgaggcccttgttgagactaaccgccgtgaggtggaacagtggttcgcgacccagactgaggaattaaacaaacaagtggtgtcatcctccgagcagctgcagtcgtatcaagccgaaatcatagaattgcgacgcacggtcaacgctcttgaaatagaacttcaggcgcagcacaacctgcgttattccctcgaaaataccctcacggagagcgaagccagatacagcagtcagctgtcccaagtgcagtccctcatcacaaacgtcgaatcccagctagcggaaattcgtagtgatctggaaaggcagaaccaagaatatcaggtgctgctggatgtgcgtgcgcgcctggagtgtgaaatcaatacctaccgctccttactagaaagcgaggattgtaagcttccatcgaatccttgcgctaccacaaacgcctgcgagaaaccaatcggttcctgcgtaacaaacccctgtggtcccaggagtaggtgcggcccctgcaatacctttggctactag

SEQ ID NO: 192264 - DNA, 1311 bp, Artificial Sequence
  Description of Artificial Sequence: Synthetic coding sequence
atgctgtacgccaagcccccccccaccatcaacggcatcaagggcttgcagcgaaaggaaagactgaagcctgcacacatacatttgcagcagctgacctgctttagcatcacctgcagcagcactatgagttacagttgctgcttgccgagcttaggatgcaggaccagttgttctagtaggccctgcgttccaccctcctgccatggttacaccctgcctggtgcttgtaatatccctgcaaacgtttccaactgtaactggttctgtgaaggctcatttaatggatctgagaaggaaacaatgcagttcctcaacgatcgcctcgctagttatctggagaaagtgagacagctggaacgggacaatgctgagctggagaagctgatacaggagaggtcccagcagcaggagccgctcctgtgtccatcctaccagagttattttaaaaccatcgaggagttgcaacaaaagatactctgcgcaaaagctgaaaacgcaagactcgtggtgaacatcgataatgccaagcttgcgagcgatgatttccgatctaagtaccagacggaacagagccttcgtctgctcgtggagtcagatattaactcaatcaggaggatcctggacgaactcactttgtgcaagtcagacctcgagtcccaggttgaatctcttcgcgaggagcttatctgtctgaaaaagaatcatgaagaggaggtcaatactctccgaagccagttaggtgatagattgaacgtggaagtcgatacagcccccacagttgacctgaaccaagtactgaacgagacaaggagtcagtacgaagcactcgtggagatcaatcgccgggaagtggagcagtggtttgctactcagactgaagagctcaataaacaggtcgtctccagctccgagcaactgcagtcttgccaggccgagatcattgagctcagaagaacagtcaacgccttggagatcgagttacaggctcagcataacctgcgggactcactcgagaacaccctgaccgaaagtgaggcacattacagcagccaactctcacaagtgcagtctctgattacgaatgtcgagtcacagctggccgagattcggtgcgatttagaaagacaaaatcaggagtatcaggtcctcttagacgtgcgggcccgactggaatgcgaaattaatacataccgctcgctgttagaaagcgaggactgcaagttgccgtgcaatccttgtgccactacaaacgctagtggcaattcatgcggcccatgcgggacctcgcaaaaaggatgctgtaactag

SEQ ID NO: 192265 - DNA, 1185 bp, Artificial Sequence
  Description of Artificial Sequence: Synthetic coding sequence
atgagctacagctgctgcctgcccagcctgggctgccggaccagctgctcatcaagaccatgcgttcctccctcctgccatggatacactttaccaggtgcatgcaatatcccagctaatgtgagcaactgcaattggttttgcgaaggttcttttaacggtagcgagaaggagacgatgcagtttctcaacgatagacttgcgtcctaccttgagaaagttagacaactggagcgggacaatgcagaactggagaaattgatacaagagaggagccaacagcaggaacccctgctatgtccgtcataccaatcctactttaaaactatcgaagaactccagcaaaaaatcttatgcgcaaaggctgaaaacgcccgcttggtggtcaacatcgacaacgcaaagctggcgagcgacgattttcgatctaaatatcaaactgagcaaagtctcagactcctcgtggaaagcgatatcaactctattcgccgcatcctggacgagctaacactgtgcaagagtgacctcgagagccaggtggagtccctgcgcgaagagctgatctgtcttaagaaaaaccatgaggaggaagtaaacaccttgcgctcacagctgggcgacagacttaatgtggaggtcgacactgctccaaccgtcgatctcaaccaggtcctgaacgagactcggtctcagtacgaggccctggtcgaaatcaatagacgggaggtcgagcagtggtttgcaacacaaaccgaggagttaaacaagcaagttgtgtcctccagcgagcagcttcagagctgccaagctgagatcatcgagctgaggcggacagtgaacgccctggagatcgagttacaggcgcagcacaacctgagggattccttggagaatacactcaccgagtcggaggcccactacagtagtcagttatcccaagtgcagtctctgataactaatgtggagagtcagctggcagaaatccgctgcgaccttgaacgccaaaaccaggagtatcaggtgctcttggacgtgcgcgccaggcttgagtgcgagattaacacctacagaagcttactcgagtcagaggattgcaagctcccttgcaatccgtgcgccactacaaatgcttcgggcaacagttgtggaccgtgtgggacttctcagaagggctgctgcaattag

SEQ ID NO: 192266 - DNA, 1278 bp, Artificial Sequence
  Description of Artificial Sequence: Synthetic coding sequence
atgtacagcagcagcagctgcaagctgcccagcctgagccccgtggcccggtcgtttagtgcttgcagtgttggactggggagatcaagctatagagcgacatcttgtttacccgctttatgtctccctgccgggggtttcgctacttcttactccggaggaggtggatggttcggagagggtattctgaccggcaatgagaaggaaaccatgcagagcctgaatgatcgtctggcaggctatttggaaaaagttaggcaactcgaacaagaaaatgcttccctggagtcaagaattagggaatggtgtgaacaacaggtgccatacatgtgtcccgactaccagtcctattttcgtactattgaagaacttcagaagaagacactgtgctcgaaagccgagaatgctcgactcgttgtagaaatagacaatgcgaagctggcggcggacgacttcagaacaaaatatgaaacggaagttagcctgcgccagttggtggaatcggacatcaacgggttaagaaggattctcgatgatctgactctgtgtaagtcagatttggaagctcaggtcgaaagcctaaaggaggaactcctatgccttaaaaaaaatcacgaggaagaggtcaatagtctacgctgtcaactgggggaccgcctaaatgtagaggtcgacgccgctcccccagtggatctgaaccgcgtactggaggagatgaggtgccagtatgaaacactagtcgagaacaatagacgcgacgccgaggattggttggacactcagagcgaggaactaaatcagcaggtagtctcaagtagcgagcagctgcaatcttgtcaggccgaaataatagagctgcggagaaccgtgaatgctttggagattgagctgcaagcccagcactcaatgcgcgatgctctggagtctacattggcagaaactgaggctcggtatagctcccaattggcccaaatgcagtgtatgattacgaacgtggaggctcagctcgcggaaatcagagctgaccttgaacgccagaatcaggaatatcaagttctccttgacgtccgagctagactggagtgcgaaataaacacatacagggggctgctggagagcgaggatagcaaacttccctgtaacccgtgcgcccccgattacagccctagtaagtcctgtctcccttgtttgcccgccgcgtcttgcggtccatctgcggctcgtacgaactgttcgcctcgtcccatctgtgttccctgccccggcggccggttttag

SEQ ID NO: 192267 - DNA, 1368 bp, Artificial Sequence
  Description of Artificial Sequence: Synthetic coding sequence
atggccagcaagtgcctgaaggccggcttcagcagcggcagcctgaagtcacctggcggcgcctccggcggttcaaccagagtgtctgcaatgtacagttcctcgtcttgcaaactgccctccttgtcacctgtggcacgttctttttccgcgtgtagtgttggcctgggtcgctctagttatcgtgcgacgtcctgtctcccagcgctttgcttgcctgcgggagggttcgctactagctatagcggaggggggggctggtttggggagggtattctgactgggaatgaaaaggagacaatgcaatccctgaatgaccgcctcgccggatacttggaaaaagtaaggcagttggagcaagaaaacgcttcgcttgaaagtcgaatacgcgaatggtgcgagcagcaagtgccctacatgtgtcccgactaccagtcatacttcaggacgattgaggaactgcagaagaagactctctgctcaaaggccgagaatgcacgcctcgtcgtagaaatcgacaacgcaaagttggccgctgacgactttagaactaaatatgagactgaggttagcctcaggcagcttgtggagtcggatatcaatggcctgaggagaatcctcgacgatctgacgctgtgcaaatctgatctggaggcacaggtggaaagcctcaaggaagaactcctgtgtctaaaaaaaaatcacgaggaggaagttaactcacttagatgccaactgggcgacagactaaatgttgaggtcgatgctgctccaccagtggatctgaaccgggtcctggaggagatgagatgtcagtacgagaccctagttgaaaataaccggcgggatgcggaagactggctggacacccaaagcgaggagttaaaccagcaggtcgtttcctctagtgagcagctccaatcttgccaagccgaaatcatagagctcaggagaactgtgaacgccctagaaattgaacttcaggcacaacatagtatgagagatgctctggagtctacattggccgagactgaagctcggtacagctcacaattagcccaaatgcaatgtatgatcacaaacgtcgaagcccagctcgcggaaattcgtgccgatctggagcgccagaatcaggagtaccaagtgctccttgacgttcgtgccaggctcgaatgtgaaatcaatacgtaccgtggcctgctggagtccgaagatagcaaattaccctgtaacccatgcgcaccagattattcccctagcaaaagttgtctgccatgccttccagcagcttcgtgtggtcctagcgcggccagaaccaattgctcacctagaccaatttgtgtaccttgccccggtggacggttttag

SEQ ID NO: 192268 - DNA, 1404 bp, Artificial Sequence
  Description of Artificial Sequence: Synthetic coding sequence
atggccacccagacctgcacccccaccttcagcaccggcagcatcaaaggcctatgtgggaccgcaggcggcatctcgcgggtaagctccattcggtcagtgggcagttgtcgcgtgcccagtctagcaggtgctgctgggtacatttcatctgcgagatcgggcctcagtggtctgggatcttgccttccaggatcatatctgagttctgagtgtcacacatctggttttgtcggatctggcggctggttctgtgaaggatcattcaacggcagtgagaaagagacgatgcaattcctgaacgaccgcttggcaaactacttagagaaggtgagacaactggagagggagaatgcagagctcgagtctcggatccaggaatggtatgagttccagattccttatatctgcccagactatcagagctattttaagactattgaggacttccagcaaaaaattctgctgacaaagagcgaaaatgcccgcctggtactgcagattgataacgccaaattggcggctgatgatttccggactaaatatgaaactgagctgagcctgcgtcaactggtcgaggccgatattaatggcctgcggagaatcctggatgagttgacgctttgtaaggcagatctagaggcacaggtcgaatctctaaaggaggagttgatgtgcctgaaaaaaaaccacgaggaagaagtctccgtgttgagatgccagctgggtgaccgtctgaatgttgaagtagacgccgcaccccccgtggacctcaataagattttggaggatatgcggtgccaatatgaggcgctcgtcgagaataaccgtagggacgtggaggcgtggtttaatacacagaccgaagagttaaaccagcaggttgtctccagcagtgagcagctccaatgttgtcaaactgagattatagagctgagacgcactgtgaatgccctagagatcgaacttcaagctcagcacagcatgaggaatagcctggaaagcacgctggccgaaacagaggcacggtacagttctcagttggctcaaatgcagtgtctgatcagcaatgtggaggctcagctgtccgagattagatgtgacctagagcgtcaaaaccaagaataccaggtgctgctcgatgttaaggcacgactcgagggagagattgccacataccggcatctcctagaaggagaagactgcaagttacccccacagccgtgcgctaccgcttgcaagcccgtgatacgcgtgccctccgttcctccagtcccatgcgtaccctcggtcccatgtactccagcaccccaggtgggcactcagatccggacgatcacggaggaaataagagacggtaaagtcatctcatccagagagcacgtccagagtcgacctctctag

SEQ ID NO: 192269 - DNA, 1254 bp, Artificial Sequence
  Description of Artificial Sequence: Synthetic coding sequence
atgctgcggagcggcctgagcggcctgggcagctgcctgcccggcagttacctctcctcagaatgtcacacatctggcttcgttggatcaggaggatggttctgcgaaggaagcttcaacggcagcgaaaaggagacgatgcagttcctgaacgatagattggccaattacctggagaaggtacggcagctggagagggaaaacgcagagctggaatccagaatccaggagtggtacgagttccagataccttatatttgtcccgactaccaatcttactttaagacaatcgaggatttccagcagaaaatcctgctgaccaaatccgagaacgcaagactcgttttgcagatagataatgcaaagctggcggcggacgacttcagaacaaagtacgagacggagttgtcactccgacagttagtggaagccgatatcaatggactaaggcgaatcctggacgaactcacattatgcaaggccgatttggaggcgcaggtggagagtctgaaagaggaactgatgtgcctgaaaaaaaaccatgaggaagaagtctccgtcctgcggtgccagctcggggatagactcaacgtggaagtcgacgccgctccacctgtggatctgaataagatcctcgaggatatgagatgtcagtatgaagcattagttgaaaataataggcgagacgtggaagcatggttcaacacacagaccgaagagcttaaccagcaggttgtctcatcctcagagcaactccaatgttgtcagaccgaaattattgagctcagacgcacagttaatgcacttgagatcgagctgcaagcacaacactcaatgcggaattccttagaatccacactagccgagacggaagccaggtacagctcacagctggcacagatgcagtgccttatcagcaatgttgaagcccagctgtccgaaattcgttgcgaccttgagagacagaaccaggagtaccaagtgctcctggacgtgaaagccagattggaaggagaaatcgccacataccgtcaccttctggagggcgaggactgcaaactgcccccccaaccctgcgccactgcctgtaagccagtgatccgggtgccatctgtaccacctgtcccttgcgtgccttctgtaccttgcactcccgccccacaggtgggtacccaaattagaacaatcactgaagaaatccgcgacggaaaggtcataagcagtagagaacatgtgcagtctcgaccactctag

SEQ ID NO: 192270 - DNA, 1200 bp, Artificial Sequence
  Description of Artificial Sequence: Synthetic coding sequence
atggcccggcggttccaggaggagctggccgccttcctgttcgagtatgacacccctaggatggtgcttgtgcgcaacaaaaaagtgggtgtcatcttccgcttaatacagctggtcgtgctggtgtacgttattggatgggtgttcctctatgagaaagggtatcagacctctagcggcctgatctcctcggtgtctgtgaaactgaaaggtctggctgtgacccagctgcctggactcggaccgcaggtgtgggatgtggcggattacgtctttcctgcgcagggcgacaattcgttcgttgttatgaccaatttcatcgtgactcccaagcagacacagggctattgcgcagagcatcccgaaggaggcatctgcaaggaggacagcggctgcacccccggaaaagccaagagaaaggcccagggcattcggacgggcaaatgcgtagcattcaatgataccgtgaagacgtgcgaaatcttcggttggtgtccagtggaagtggacgacgacattcctaggcctgccctccttcgcgaggctgagaacttcacactcttcataaaaaactctattagcttcccacgcttcaaagtgaacagacgaaacctggtggaggaggttaatgcagctcatatgaaaacatgcctctttcataaaacccttcaccccttgtgtccagtcttccaactcgggtatgtcgttcaggagtctgggcagaatttttctacgctggccgagaagggtggagtagtcggtatcacaatcgattggcattgcgacttagactggcacgttcggcattgtagacctatctacgaattccacggactgtatgaggagaagaatctgtcgcctggcttcaactttcgtttcgctcgccatttcgtcgagaacgggaccaactacagacacctgttcaaggtatttggaatacggtttgatatacttgtggatgggaaagctggcaagttcgatatcatccctacgatgactaccatagggtcagggatcgggattttcggggtggcaaccgtgctatgcgaccttctgttacttcacatcctgcccaagagacattattacaaacaaaagaaattcaaatacgctgaagacatggggcccggagcggcagaacgggacctggctgctacttcatctaccctgggtttacaagagaacatgcgcacttcctag

SEQ ID NO: 192271 - DNA, 1371 bp, Artificial Sequence
  Description of Artificial Sequence: Synthetic coding sequence
atgaccagcagctacagcagcagcagctgccccctgggctgcaccatggctccaggagctagaaatgtcagcgtgtcccctattgacatcggatgccaacctggggctgaagccaatattgcccccatgtgcctgctggcgaatgtggcccacgcaaaccgagttagagtcggctccacccccttgggacggccctctctgtgcttaccaccaacttgtcacacagcctgtccgctgcccggaacctgtcatatccctggcaacataggcatctgtggagcttacggggaaaatacattgaatgggcatgagaaggagacaatgcagtttctgaacgataggctggctaattacctggagaaagtgcgccagctagaacaggaaaacgctgaactagaggcaaccctgctcgaacggtctaagtgccatgaatccacagtttgccccgactaccagtcttacttccatactattgaagagctgcagcagaaaattttgtgttccaaggcagagaacgctagactgattgtacagatcgacaatgccaaactagccgctgacgactttagaatcaagctggagtcagagagatctttgaggcagctggtggaagcggacaagtgtggaacacaaaagttactagatgacgccacccttgccaaagctgacctggaagcacaacaggagtccttaaaagaagagcaattaagtctgaaaagcaaccatgagcaagaggtcaagattctccgaagccagttgggggaaaaactccgtatagagctggacattgaacctactattgacctcaatcgggtgttaggcgagatgagggcgcagtacgaagctatgctggagaccaatcgacaggacgtcgagcagtggtttcaagcccagagcgagggtatttccctccaagatatgtcctgcagcgaggagctccaatgctgtcagtccgagattctggagcttcggtgcaccgtaaacgcattggaggtggagagacaggcgcagcatacgctaaaggattgcctccagaactcactatgcgaagcagaagaccggtttggaaccgagctagcccagatgcaaagcctgatatcaaacgtcgaggagcagctgtccgagatccgcgcggatttagagaggcagaaccaggaataccaggttctgctcgacgtgaagacccggctggagaatgaaatcgccacataccgtaacctgcttgaaagcgaggattgcaaactgccctgcaatccctgctcgacaagccctagttgcgtgactgctccatgtgcaccacggccctcatgtgggccttgcactacatgtggacctacatgtggcgcctccacgacagggtccagattctag

SEQ ID NO: 192272 - DNA, 1785 bp, Artificial Sequence
  Description of Artificial Sequence: Synthetic coding sequence
atgaccagcgtgggcgtgttcagcgacatgctgaacggctgcggcaaggacgggctggtgcctcgagccaagccacgtgatgttagtgacttctcactgtacgcccctgccaccaaaccgtgctgctcgcgtacttataagaggcgcaggctgagagctccagccctaacaggtctcggcccagtcacctcactgatcgccccctcatctctctctgccgccatgatagctcgacagcaatgtgtacggggaggtccgcgaggcttttcctgtggatcagctattgtgggcggggggaagagaggcgccttctctagtgtctccatgagtggcggggccggcaggtgttcgagtggtggctttgggtcccgctccttgtacaatcttaggggtaacaaatccatcagtatgtccgtggcaggcagtagacagggagcctgtttcggcggagctggaggttttgggacaggtggctttggcggtggctttggagggagcttcagcgggaagggcggcccaggctttcccgtttgcccagcaggggggatccaggaggtgaccattaatcagtctctgttgacacccctgcacgtggagatcgacccagaaattcagaaggtaagaaccgaggagagagaacagataaagctgctcaataataaatttgccagtttcatcgataaagtgcagtttttggaacagcagaacaaagtgttagagactaagtggaatctgctgcagcagcaaactaccactacctcctcaaagaatttagagcccctattcgaaacctacctcagtgtgcttcgcaagcagttagatacgctggggaatgacaaggggagactgcagtctgagctgaagacgatgcaggactctgtagaggacttcaagacaaagtacgaagaggaaattaataaaaggaccgcagccgaaaacgactttgtcgtcctgaaaaaggacgtagacgccgcgtatctgaacaaggtcgagctcgaagcgaaagtggactccctcaacgacgaaatcaattttctgaaagtgttgtacgacgcagagctgtcccagatgcagacacatgtttccgacacctccgtcgtgctgagcatggataataataggaacctggacctggattccatcatcgccgaggtacgtgcccagtacgaggagattgcacagcgcagtaaggcagaggccgaagctctgtatcaaacaaaggtacaacaactccagataagtgtggatcaacacggagataatctgaaaaacactaagtcggaaatcgccgaactcaaccgcatgattcaacggctccgcgcggagatcgagaacattaaaaagcagtgtcagacccttcaggtttctgtggccgatgcagaacagaggggagagaatgcactgaaggacgctcattcaaagcgcgtcgagctcgaggctgcacttcaacaggcaaaagaagaacttgcacggatgctgcgtgagtaccaagagctgatgtccgtcaaacttgccctcgatatcgaaatcgcaacgtaccgcaaactgttggagggggaggaataccgtatgtctggagagtgccagtcagccgtgtctataagcgtagtgtctggatcaacttccaccggcggaatatctggtggtttgggctctggttcagggtttgggctgtcatcaggcttcggtagcggctccggttcagggtttggattcggggggtctgtaagcgggtcatccagtagcaaaattatttcaacaacgacgcttaacaagagaaggtag

SEQ ID NO: 192273 - DNA, 1503 bp, Artificial Sequence
  Description of Artificial Sequence: Synthetic coding sequence
atgatcgcccggcagcagtgcgtgcggggcggcccccggggcttcagttgcggctctgcaatagtcggaggtgggaagcgcggggcattctcttcagtatctatgagtggtggagctggtcggtgttcttcagggggcttcggctcaaaaggagcctgtttcggcggtgccggagggttcgggactggcggattcggggggggcttcggagggtccttctcaggcaaagggggtcccgggtttcctgtctgtcccgccggcggcatccaggaggtgactatcaatcagtctttattgaccccactgcacgtggaaattgatcccgaaatccagaaagtgcgcacagaggaacgtgaacagattaagctgttgaacaataagttcgcatccttcatagataaagtccaatttctggaacaacagaacaaagtcttggagactaagtggaacctgctccagcagcaaaccaccaccacctcaagtaagaatctggaaccactgttcgagacctaccttagcgtcctgcgtaaacagctggacacactaggcaatgataagggtaggttacagtctgagctgaagactatgcaagactctgtggaagacttcaagacgaaatacgaagaggaaatcaacaagcgcacagccgctgaaaacgactttgtggttctgaagaaggatgtcgatgcagcatatctcaataaggtcgagcttgaggctaaggtggattctctgaacgatgagataaacttcctgaaggtgctatatgacgctgaactgtcccagatgcagacccacgtgtctgacacatccgtggttctttcaatggataataaccgcaatctcgacctggactccatcattgcagaagttcgtgcgcagtacgaagagatcgcacaaagatccaaggctgaggccgaggcgctataccagacaaaggtccaacaattgcagatctccgtggaccagcatggagacaatctaaagaacacgaaatctgagatagcggaattgaaccggatgattcagaggctgcgagccgagatcgaaaatatcaaaaaacagtgtcaaactctgcaggtgtccgttgcggatgccgaacagagaggcgaaaatgcccttaaggacgcacacagtaagagggtcgaactcgaggccgcactgcagcaggctaaagaagagctcgctcgcatgcttcgggagtaccaggaactgatgtccgttaagctcgcactagacattgagatcgcaacctatagaaaactcctggaaggggaagagtatagaatgagcggcgagtgtcagtctgctgtctctatctctgtggtgagcggctcaaccagcaccggaggtatctctggtggcttaggctcaggatccggctttggactgtcaagtggctttgggagcggctccggcagtggttttgggttcggcggctcagtcagcggcagttcatcatctaagattatctctaccaccacgctcaataagcgaagatag

SEQ ID NO: 192274 - DNA, 1563 bp, Artificial Sequence
  Description of Artificial Sequence: Synthetic coding sequence
atgatcgcccggcagcagtgcgtgcggggcggcccccggggcttcagctgtggatctgccattgttggaggcggcaagaggggtgctttttcgtcagtctcgatgagtggtggagcaggacgctgtagcagtggagggtttgggtcaaggagcctatataacctgcgcggtaataagagtatctcgatgagcgtagccgggtcccggcagggggcatgttttgggggagccggaggtttcggcactggaggattcggagggggttttggaggctccttttccgggaaaggtggacctgggttcccggtgtgtccggccgggggcatccaggaagttacaatcaatcagtccctgctcactcccctccacgtcgaaatcgaccctgaaatccagaaggtgcgtactgaggagagagagcaaattaaactcctgaataataagtttgcctcctttatcgacaaggtgcagttcctagaacagcagaacaaagtcctggagaccaagtggaatctgctccaacagcaaacaaccaccacaagctccaagaacttggaaccattgttcgaaacgtacctctccgttctgcggaagcaactggatacccttggaaacgacaaagggcggctgcagtccgagctgaaaaccatgcaggactccgtggaggatttcaaaaccaagtatgaggaggaaatcaacaaacgcaccgccgcggagaacgactttgtcgtgctcaagaaggacgtggatgccgcatatctgaataaggtggagctggaggcaaaggtcgatagtctaaatgacgaaataaactttctgaaagttctttacgacgccgaactgtctcagatgcagactcacgtctccgatacttctgtggtactttcaatggacaacaacagaaatctggatctggacagtataattgcggaagtccgggcccagtacgaagagattgcacagcgcagcaaggccgaagccgaagctctctaccagacaaaagtccaacagctccagatctctgtagaccagcacggggacaaccttaagaatactaagtccgaaatcgcggaactgaatcgtatgattcagagacttcgggcagagatcgagaacattaaaaaacagtgtcagactctgcaggtgtctgtcgcggatgcagagcagaggggggagaatgctctcaaagacgcacatagcaaaagggtcgagctggaagctgcacttcagcaagctaaagaagagttggctcggatgcttcgcgaatatcaagagctgatgagcgtgaagcttgctctcgacatagagatcgccacttaccgtaagctgctagaaggtgaggaatatagaatgtctggagaatgccagtctgctgtgtcaataagtgtagtcagcggcagtaccagtacaggcggaataagtgggggtctaggaagcggctcaggatttggattgagttccggcttcgggagcggatctggcagtggattcggtttcggaggatctgtttctggctctagctcttctaaaatcatttccaccacaacattgaacaaacgccgatag

SEQ ID NO: 192275 - DNA, 1695 bp, Artificial Sequence
  Description of Artificial Sequence: Synthetic coding sequence
atggccagcaccagcaccaccatccggagccacagcagcagccggcggggcttctcggctaatagtgcccgcctgcccggcgtgtccagatctgggttctcttcagtgtcagtttcacgatcacgggggtccggcgggctgggcggcgcatgcggaggagctggttttgggtccagaagtctgtacggcctggggggttctaagagaatcagcatcggtggaggctcctgcgccatctcgggcgggtacggaagccgagccggaggaagttatggctttggaggtgctggtagcggattcgggttcggagggggcgctggcatcggtttcggtctgggaggcggggctgggctggctggtggattcgggggacctggattcccagtctgtcctcctgggggcatccaggaggtgactgtgaaccaatcacttttgacaccgctgaatctccagatagacccaacgatccagcgcgtccgagcagaagaaagagagcaaatcaagactctgaataacaaattcgcctcctttatcgataaggtgcggtttttagaacagcaaaataaggtgcttgagaccaagtggacactactccaagagcagggcaccaagaccgtgaggcagaacctcgagcctttattcgagcagtacatcaataatctgcgcagacaactcgatagcatcgtaggagagaggggcagacttgattctgaacttaggggaatgcaggatttggttgaagatttcaagaataagtacgaggatgaaataaataagaggaccgcagctgaaaacgagttcgtgacactgaagaaggatgttgacgccgcatatatgaataaggtcgaactgcaggccaaggcagacaccctgaccgacgaaattaatttcctgagggccctttatgacgccgagctatcccagatgcagacacatattagcgatacgtccgtggtcctgagtatggataacaataggaatttagacctagactcaatcattgctgaagttaaagcacagtacgaggaaattgcccagaggtctagagccgaggctgagagctggtatcaaacgaagtatgaggagctacaggtgacagccgggcggcatggcgatgatctccggaatacaaaacaggagatagctgagataaatcgtatgatacaacgattgcggtccgagattgaccacgtgaagaaacagtgcgccaatctccaagctgcaatagccgatgccgagcaaaggggcgaaatggccctaaaagatgcgaagaacaaattagagggcctcgaggacgccctacagaaagcaaagcaggacctggcacgcctgctcaaggaatatcaggagctcatgaatgtgaaactggcgctcgacgtggagattgctacttaccgtaagctcctggaaggagaggagtgtaggctgaatggggaaggcgtcggccaggtgaatatcagcgtggtgcagtctactgttagtagtggctacggaggtgccagcggcgttgggagcggactgggccttggtggtggctcaagctactcctatggcagcgggctcggcgtgggaggcggattctcttcctcatccggacgtgccattgggggtgggttaagctcagtggggggaggaagcagcaccattaagtatactactaccagctcctcgtcacggaaaagctacaagcactag

SEQ ID NO: 192276 - DNA, 1563 bp, Artificial Sequence
  Description of Artificial Sequence: Synthetic coding sequence
atggccagcaccagcaccaccatccggagccacagcggcagccggtctctctacggattggggggttcaaaacggatcagcattggcggcggaagctgtgcgatttctgggggctacggaagccgggcaggcggatcatatggcttcgggggagccgggtctgggtttggctttggaggaggcgccgggatcgggtttggcctcgggggcggagccggcctggccggggggtttggcggacctgggttccctgtttgcccccccggaggaattcaagaggtcactgtcaatcaatctctcttgacccccctgaacttgcagatcgatcctacgatccagcgtgtcagggcggaagaaagagaacagattaagactctcaataataagtttgctagcttcatcgataaggtgcggttccttgagcagcagaacaaagtgcttgaaacaaagtggactcttctccaagagcaaggcacaaagacagtgcgtcagaacctggaacccctctttgaacagtacataaataaccttagacggcagctagactccattgtaggggagcggggaaggctcgacagtgaactgcggggcatgcaagatttagttgaggactttaaaaataagtatgaggacgaaatcaataagcgcaccgccgctgaaaacgagtttgtcacattgaagaaggacgtcgacgccgcctacatgaacaaggtggaactgcaggctaaggccgacacccttaccgacgaaattaactttcttagggcgttgtatgatgcagaactgtcacagatgcaaactcatattagcgataccagcgtggtgctctctatggataataatcggaacctggaccttgactccattatcgctgaggtgaaggctcagtatgaagagattgctcagcgctcccgggcggaagcagaaagctggtaccaaacgaagtatgaagagctgcaagttacagcgggcagacacggagacgacctccgaaacacgaagcaagagatagccgaaatcaacaggatgattcagaggttacgttctgagatcgaccatgtcaaaaagcaatgtgccaatctgcaagccgcaatagctgatgcggagcaaagaggcgagatggccttaaaagatgctaagaacaagctggagggactcgaggacgccctgcagaaggcaaaacaggatttagcaagacttctgaaggaatatcaggagctcatgaacgtgaagctggccctggatgtggagatcgcgacttatcgaaaacttctggagggcgaagaatgccgattgaatggcgaaggcgtgggccaggtaaacatttcggtcgtccagagcaccgtatcttctggctacggaggggctagcggagtcggcagcgggctgggcttgggcggtggaagcagctacagctatggaagcggcctaggcgtgggcggcggattcagtagctcttccggaagggcaatcggaggaggtctttcttccgtcgggggtggctccagcacgatcaagtacaccacaacttcatcatcttcgcgcaagagttacaagcattag

SEQ ID NO: 192277 - DNA, 1695 bp, Artificial Sequence
  Description of Artificial Sequence: Synthetic coding sequence
atggccagcaccagcaccaccatccggagccacagcagcagccggagaggattctccgccaatagtgctcgcctgccaggcgtgtctcgctcaggcttcagctcaatatctgtgtcccgtagcaggggctctggcggcctggggggggcgtgtggcggggcaggatttggtagtagaagcctctacggtcttgggggttctaaaaggatctcaattggcggaggctcttgtgctatttccggcggatacggctcacgcgccggcgggtcatacgggtttggcggcgcagggtctgggttcggcttcggggggggggctggaattggttttggacttggagggggggctggtctagccggcgggtttggcggtccgggatttcccgtgtgcccgcctggggggatacaggaggtgaccgtcaaccagagccttctaacccctctgaatctgcaaattgatccagccatacagcgggtgcgggcggaggagagagaacagatcaaaaccctcaacaacaaatttgcatcttttatcgataaagtacgcttcctggagcaacagaataaagtgttggatacaaagtggaccttacttcaagaacagggaacaaagactgtgcgccagaaccttgaacccctgttcgagcagtatataaataacctccggcgtcaactggataacatcgtgggggaacgaggcaggttggactcagagctcagaaacatgcaggacttggtcgaggacctgaaaaacaagtatgaggatgaaattaataaaagaaccgccgctgagaatgagtttgtgacgctgaagaaggacgtggatgcagcctacatgaacaaggtggagttgcaggctaaggcggataccttgactgacgagatcaacttcctgagggccctgtatgacgccgaattgagtcaaatgcagacccacatcagcgacactagcgtcgtgttaagcatggacaacaatcgtaatctggatttggatagcatcatagcagaggttaaagcccaatatgaggagattgcccaacggtcaagagctgaggcggagagttggtatcaaactaaatatgaggaactgcagattactgcggggagacatggcgacgatctacgtaatacgaaacaggaaatcgctgagattaatcggatgatccagagactcaggtccgagattgatcatgttaaaaagcagtgcgctaatctacaggccgccatcgctgatgctgagcaacgaggggaaatggcccttaaggacgccaaaaacaagctcgagggattggaagacgcacttcaaaaggcaaagcaggacctggcaaggctcttgaaggagtatcaggagctcatgaacgtaaagctggccctcgatgtcgagatcgctacctacaggaaactgctggaaggggaggagtgccgtttgaatggagagggtgtgggccaagttaacatttccgttgttcagtctacagtttcctctgggtatgggggagcaagtggcgtgggctccggcctggggctggggggaggtagttcatactcttatgggagtggcctgggagtcggcggtggattctcgagctcttcaggacgagctacaggcggtggtttaagctccgtgggagggggatcttcaactatcaaatatacaactacctcctcttccagccgaaagtcatacaaacactag

SEQ ID NO: 192278 - DNA, 1575 bp, Artificial Sequence
  Description of Artificial Sequence: Synthetic coding sequence
atggccagcaccagcaccaccatccggagccacagcagcagccggcgggggttcagcgcaaattctgcacggctgccaggcgtgagccggagcggattcagtagcatcagtgttagccggagccgagggtccggaggcctggggggtgcgtgcggcggggcaggctttggctcgcgatcgctgtacggtttgggcggctctaagcgcatttctatcggtggcgggagctgcgccatatcagggggttatggcagtagggccggcggtagctatggtttcggtggcgccggctcaggcttcggcttcggcggtggcgccgggattggcttcggtctggggggcggtgcaggcctggccggaggattcggggggcccggtttcccggtttgcccgcccggcggcatccaggaagttaccgtcaaccagagtctgctgaccccattgaacctgcagattgatcctgccatccagcgcgttcgggctgaggagcgggaacagatcaagacactgaataacaagtttgcctcctttattgataaagttcgattcctcgagcagcagaacaaagtgctggatacaaaatggacgctgcttcaagaacagggcaccaaaaccgtgcgccaaaatttggagcctctgtttgagcagtacattaataacttgagacggcagctggataacattgtcggagagcgagggaggctggacagtgaactacgtaacatgcaggatctcgtggaggatttgaagaataaggatgaaattaattttctgagggcattgtacgacgcggagttatctcagatgcagacccacatctcagatacgagcgttgtgttaagtatggataataaccgcaaccttgatctggacagcatcatcgccgaggtgaaagcccagtatgaagaaatcgctcaacggagtcgcgctgaggccgagtcctggtaccagactaaatacgaggaactgcagatcactgccggcagacatggcgacgatctacgaaatactaagcaggaaatagcggaaattaaccgcatgatacagaggctgcgatcagagattgaccatgtaaagaagcaatgcgccaatcttcaggccgccatagcggacgcagagcagcgcggcgagatggcactgaaagatgctaaaaacaagctggaaggtttagaggacgcattgcagaaagcaaagcaagatcttgcccgtttgcttaaagaataccaggagctgatgaacgtgaaactggcactcgatgtggagatcgcaacttaccgcaagctgctggagggggaagagtgtagactcaacggcgagggcgtcggtcaggtgaatatctctgttgtgcagtccaccgtgtcgtccggttatggcggcgctagtggggtcggcagcggattagggttaggcggtggcagcagttactcttacgggtccgggttgggcgtgggaggaggcttctcctcctccagcggccgggccaccggaggcgggctttccagcgttggcggcgggagtagcaccatcaagtacacaaccacctcttcatcaagtcgcaaaagttataagcactag

SEQ ID NO: 192279 - DNA, 1695 bp, Artificial Sequence
  Description of Artificial Sequence: Synthetic coding sequence
atggccagcaccagcaccaccatccggagccacagcagcagccggagaggctttagtgccaatagtgctcgtctgccgggggtcagcaggagcggcttttccagtataagtgtgtcaagaagtcggggcagtggcggtctcggaggtgcttgcgggggcgccgggtttgggtcacgctcactgtatgggctgggagggtccaagcgtatctcgattggaggtggctcttgtgctatctcaggcgggtatggaagcagggccggtggctcctatggattcgggggcgcaggctcaggctttggtttcggggggggagccggaatagggtttggcctcggaggtggggccgggctggctgggggctttggggggccaggttttcccgtctgtccgcctggtggaattcaagaggtcacggtgaaccagagcttgctgacgcctctcaatctccagatcgatcccgctatccagcgcgttagagccgaggaaagagagcaaatcaagacattaaataataagttcgcatcgtttatcgataaagtgcggttccttgagcaacaaaataaggtgctagatacaaagtggacactgctgcaggaacaggggaccaagaccgtgcgccagaatcttgagcctctgttcgagcagtatattaacaacttacgccggcaacttgacagtatcgtgggagaaaggggcagactcgacagcgagctgcggaatatgcaggatttggtagaagatctcaagaacaagtacgaggacgagattaataagcgcactgcagcagaaaacgagttcgttaccctcaagaaggatgttgatgccgcatacatgaataaggtcgaactccaggcaaaggcagacaccctgaccgatgagatcaacttcctccgggcgctgtacgacgccgagctgagccagatgcagacgcacatttctgacacatctgtagtgctgagtatggataacaaccgcaacctcgacctggattccatcatagcagaggtgaaggcgcagtatgaagaaatcgcccaaagatctcgcgctgaagccgaaagctggtaccagacaaaatacgaggaacttcaggtgacagccggccggcacggggatgatcttagaaatacaaaacaggagattgctgagattaaccgcatgatacagagactgaggtcggagatagaccatgtgaaaaaacagtgtgctagcttacaagcagctatcgccgatgcagaacagaggggggaaatggctttgaaagacgcgaagaacaagctggaagggttggaggacgcacttcagaaagccaagcaggatctcgcgcgcttgctcaaggaataccaggagctgatgaatgtcaaactagccctcgacgtagaaatcgccacctataggaaattgttggaaggcgaggaatgcagactgaacggggagggggttggacaggtcaatgtttctgttgtacaatcaaccatctcttctgggtatggcggggcctcaggcgtgggctccggcctcgggctcggggggggctcctcatattcatatggaagcggcctggggatcgggggcggcttttcttctagtagcggacgggccatcggcggaggcctcagcagtgtaggcggcggaagcagcactatcaaatacaccaccacaagttcttcatctcggaagagctacaaacattag

SEQ ID NO: 192280 - DNA, 1650 bp, Artificial Sequence
  Description of Artificial Sequence: Synthetic coding sequence
atggccagcaccagcaccaccatccggagccacagcagcagccggagcggcttcagctctatttcagtgtccaggtcacgggggtctggagggctggggggggcatgtggcggggccggcttcggttctcgttccctttacggcctcggcggtagtaagcgcatctctataggtggcggaagttgcgctataagcggtggatacggatcgcgggccggcgggagttacgggtttggcggagccggcagcggcttcgggttcggagggggcgccggcatagggttcggcctgggtggcggcgcgggcttggccgggggcttcggcggccctggctttccagtgtgtcccccaggaggcattcaggaggtcaccgtgaaccagtcgctgctcaccccgttgaacctgcagattgaccccgctattcagcgggtccgggctgaggagagagaacagatcaaaacccttaacaataagttcgcgtctttcatcgataaggtgagattcttagagcaacaaaacaaggtcctggacacgaagtggacccttctgcaagagcagggcacaaagacagtgcgccagaatctcgagcctctgttcgaacaatacattaataacctgcgacgtcagctagatagcattgtcggggagcgtggtagactggatagcgagctgcgaaatatgcaggatctggtcgaagacctcaaaaataagtacgaggatgagataaataaacggactgcagccgaaaacgaatttgtgacactgaaaaaagatgtagatgccgcatatatgaataaggtcgaactccaggctaaagccgacacactaaccgatgagatcaacttcttgcgcgctctctatgacgccgagcttagccagatgcaaacccacatcagcgatacttccgtggtgttgtccatggacaataacagaaatctggacctggactccatcatcgctgaggtcaaggcacagtacgaagaaattgctcagagatcccgtgccgaagccgagtcctggtaccaaactaagtacgaagaactacaggtcacagcaggaagacacggagatgatctgagaaacaccaagcaggaaatcgcagagatcaatcgcatgattcagcgcttacggagtgagatcgaccacgtaaagaagcaatgtgcctcattacaagctgctattgccgatgctgagcagcggggagagatggccctcaaggacgctaaaaataagcttgaaggattggaggatgctctccagaaagccaaacaggacctggccaggcttctcaaggagtaccaagaactcatgaatgtcaagctggccttagatgtcgaaatcgcaacctatcggaagctcctggagggagaggaatgtcgcctgaatggagaaggtgtgggccaggtaaacgtgtctgtcgtgcagagcacaatctcatcaggatatggcggggcaagcggagtaggatccggcctagggttagggggtgggtcctcttatagctacgggtcagggctggggatcggtggcgggttctctagctcttcaggcagggcgatcgggggtgggctctcttccgtgggcggagggtcatctaccataaagtacacgacgacaagctcttcttcccgcaaatcctataagcactag

SEQ ID NO: 192281 - DNA, 1572 bp, Artificial Sequence
  Description of Artificial Sequence: Synthetic coding sequence
atgagccggcagttcacctgcaagagcggcgccgccgccaagggcggctttagcggatgcagcgccgtcctgagcggcggctcttctagcagcttcagagcaggctcaaagggcctctcaggtggctttgggagccgatcactgtactcacttggaggagtccgctctctaaacgtcgcctccggatccggcaagagcggcgggtatggcttcggacggggaagagcctcagggtttgccgggtcaatgttcggatcagtggccctgggtccagtatgtccaaccgtctgtccaccgggtgggatccatcaggtgacagtcaacgagtcactgctggccccgttaaatgtcgagctcgatcccgagattcagaaggtgcgggcgcaagaacgagaacagatcaaagctctaaataacaaatttgcctccttcatcgacaaagtgcgattcttggaacagcaaaaccaagttctcgagactaaatgggagttgctgcagcagctcgatttaaacaactgtaagaataatctggagcctatcctggagggttatatatcaaatctccgcaaacagctcgaaacactctcaggagaccgcgtgcgcctcgatagcgaattacgcaatgttcgtgatgtggtggaagactataaaaaacgatacgaggaggagatcaacaaacgcaccgccgcagaaaacgagttcgttttgttaaagaaagacgtggacgctgcatatgccaacaaggtcgagttacaggctaaagtcgagagcatggaccaggaaataaagttcttccgctgcctgttcgaggcagaaatcacacagatccagtcacacatatccgatatgtccgtgatcctgagcatggataacaataggaacctggatcttgatagtataattgacgaagtacggacccagtatgaagaaattgccttgaaatctaaggccgaagctgaggctttatatcagaccaaatttcaggagctgcaactcgcagctgggcggcacggagacgatctaaaaaataccaagaacgaaattagcgagctcaccaggctgatccagcgtattcgatctgagatcgagaatgttaagaaacaggccagcaacctggagaccgcaatcgccgatgcggagcagcgcggagataatgctctcaaggatgccagggcgaaactggacgaacttgagggcgcattacatcaggccaaggaggagctcgcccgtatgcttagagaataccaggagctcatgtcccttaagctggcactagacatggagatcgccacctaccgaaagctgctggaatccgaggaatgtcgtatgagcggtgagtttccttcaccggtttctattagtatcatctcgagcacctcaggcggctcagtgtacggcttccgaccctccatggtttccggcgggtacgttgctaacagtagcaactgcatctccggcgtgtgctctgtgagagggggtgaagggagatcaagaggtagcgccaacgactataaggacaccctaggcaaggggagctcactgtcagctccctcaaaaaaaaccagcaggtag

SEQ ID NO: 192282 - DNA, 1536 bp, Artificial Sequence
  Description of Artificial Sequence: Synthetic coding sequence
atgagccggcagctgacccacttcccccggggcgagcggctgggcttttctggctgcagcgccgtcctatctgggggaatcggctcatcatcagcaagttttcgggcaagagtcaaagggtcagctagctttgggtctaaaagcctctcttgcctgggcggctcccgcagtctggccctcagcgccgccgcacgaaggggaggagggcggctgggaggatttgtggggacggccttcggctcagctgggctgggacctaagtgcccttccgtatgtccacccggggggatccctcaggtgacagtgaataagtctctgctggctccgttgaatgtcgagatggacccagaaattcagagagtgcgcgcccaggaacgggagcagatcaaagctcttaataataagtttgcatccttcatcgataaagtccgctttctcgaacaacaaaaccaggtccttgagaccaaatggaacttgctgcagcagctggatctgaacaattgccgtaaaaatctggagcctatctatgaaggctacatcagtaacttgcagaagcagctggaaatgctgagcggcgatggggtacgcctcgactccgaacttcggaacatgcaggacttagttgaagactacaaaaaaaggtacgaagtggaaattaaccgcaggactgcggctgagaatgagtttgtggttctcaaaaaggatgtagatgcagcttacatgaataaagtggaacttcaggcaaaagtggattcattgaccgacgaaattaaatttttcaaatgtctgtacgagggcgagatcacccagattcagagtcatatttctgatacttctatcgttcttagtatggataacaaccgggacctggacttggactccatcatagccgaagttcgggctcagtacgaggaaatcgcactcaagtcgaaggcagaagctgaaactctgtatcagactaagattcaggagttacaggtaacagccggtcagcacggcgacgacctgaaattgaccaaagctgaaatctctgaactcaatcgattgattcagaggatcaggagcgagatcggcaatgtcaaaaagcagtgtgcggatctggagactgccatcgccgatgcagagcagcggggcgactgtgcccttaaggatgcgagggctaagctggatgagctggaaggggccctgcaccaggctaaggaggaactggcaaggatgctgagggaatatcaagagctggtctcactgaaactagctctggacatggagattgcaacctatagaaagttactggaatcagaggaatgcaggatgtccggcgagtatccaaattcagtgtctatcagtgtcataagctccaccaatgcgggagcgggtggagcaggcttctccatggggtttggggcctctagctcctatagttacaaaactgcggctgccgatgttaaaactaaaggatcctgcggtagcgaacttaaggatcctcttgcaaagacctcgggctcatcatgcgcaaccaaaaaggcctctcgatag

SEQ ID NO: 192283 - DNA, 1410 bp, Artificial Sequence
  Description of Artificial Sequence: Synthetic coding sequence
atgagccggcagctgacccacttcccccggggcgagcggctgggcttctcaggctgctctgctgtgctgtccgggggtatcggcagtagttcagcaagcttccgggcacgcgttaaggggtcggcatcttttggttcaaaaagtctctcctgcctgggaggctcaagaagccttgccctgtctgccgcagctcggagggggggaggacgacttggtgggtttgtaggaactgccttcgggagcgctgggcttgggcccaagtgtccaagcgtctgccctccaggaggaataccccaggtaactgttaataagtccctacttgcccccctgaatgttgagatggaccctgagatccagcgcgtgagagctcaggagcgggaacagattaaagcgcttaacaataagtttgcttcgtttatcgataaggtgcgcttcctggaacaacagaatcaggtcctcgaaactaagtggaatttattgcagcagcttgatctcaacaattgtcgcaagaatttagaacccatctatgagggatatatttcgaatttacagaagcagctggagatgctcagcggagatggagttcggctggactcagagctacggaacatgcaggatcttgtcgaagattacaaaaagcggtacgaggttgaaattaaccgcaggaccgcagcagagaatgagtttgtggtcctgaagaaagacgtggatgctgcctatatgaataaagttgagctccaggcaaaggtggactcattgactgatgagatcaagttcttcaagtgcctgtacgaaggcgaaatcacccagatacaaagccacatctctgacacatccatcgtactatccatggacaataacagggatctcgacctcgactccattatagctgaagttcgggcacagtacgaggaaatcgccctgaaatccaaagccgaagccgaaacgctctaccagacgaaatgcgctgacttagagaccgccatcgccgatgctgaacagaggggcgactgcgcattaaaggacgcgcgggctaagctggatgagctggagggcgcccttcatcaggcaaaagaagagctggccagaatgttgagagagtaccaggagctcgtgagtctcaagctggccctggatatggagatcgcgacctatcggaagctgctcgagagcgaagagtgccggatgagcggagagtatccaaactctgtctctatcagtgttatatcctcaaccaacgcaggtgcaggcggtgcaggattttcaatgggctttggagcttccagctcctactcatacaagacggcggccgcagatgttaagacaaaggggagctgcggcagcgaattgaaggatcccctcgctaaaacatctgggagttcatgcgctacgaagaaggcctcccggtag

SEQ ID NO: 192284 - DNA, 972 bp, Artificial Sequence
  Description of Artificial Sequence: Synthetic coding sequence
atgctgagcggcgacggcgtgcggctggacagcgagctgcggaacatgcaggacttggtagaggattacaaaaaaagatacgaagtggaaatcaatagaagaaccgccgcagaaaacgagttcgttgtgctgaagaaggatgttgacgctgcgtacatgaacaaggtggaactccaggccaaggtagatagtctgacggacgaaatcaagttttttaagtgcctttatgaaggggagataactcagattcagagccacatttcagacacatccatcgtgttaagcatggataataatcgggatctggatctggactctattatcgcagaagtacgcgcacaatatgaggagattgcgctgaagtctaaggccgaagcagaaaccctgtaccagactaagatccaagaactgcaggtgacggcgggtcagcatggagacgaccttaagttgaccaaggccgagattagtgagctaaaccgcttgatacagcgaattagaagcgagataggtaatgtgaagaaacagtgtgccgacctggaaaccgccattgcagatgctgaacagcgaggggattgcgcactgaaggatgctcgagccaaactagacgaattagagggggctcttcaccaggccaaagaggagctagcacgaatgttgagagagtatcaagaactcgtgagtttgaagttagccctcgacatggaaatcgccacatatcggaaacttcttgagagcgaagaatgcagaatgagcggtgaataccctaactccgtgtccatcagtgtcatctcctccacgaatgcaggtgccggaggtgccggattttcgatggggttcggcgcaagtagtagttattcctataagacagcagccgctgacgttaaaacgaagggttcgtgcggcagcgagttgaaagacccgctggcgaaaactagcggcagcagttgtgcaaccaaaaaagcctcacgctag

SEQ ID NO: 192285 - DNA, 1536 bp, Artificial Sequence
  Description of Artificial Sequence: Synthetic coding sequence
atgagccggcagctgacccacttcccccggggcgagcggctgggctttagtgggtgttctgcagtccttagtgggggtattggtagctcatcagcaagttttagagcaagagttaagggaagcgcatcttttggctcgaagtcattgagttgcttgggcgggagtcgcagcctcgccctgtccgcagccgcccggagaggtggaggccgcctgggtgggttcgttggcacggccttcggatccgctggactcgggcccaaatgcccaagtgtgtgcccgccgggtggaattccccaggtcaccgtcaacaaatcgctcttggcccctttgaacgtggagatggatcccgaaatccagagagtgcgagcccaggagagagaacagattaaagctcttaataataagttcgccagcttcattgacaaggttcgctttctcgaacagcagaatcaggttctagaaaccaagtggaatttactacagcagttggatctgaataactgcagaaagaacctggagcccatatatgaaggctacatctcaaatctgcagaagcagttggagatgctgtctggagatggcgtaaggttagacagtgaactgagaaacatgcaggatttggtggaagactacaaaaaacggtacgaggtggaaattaacagacggaccgctgccgagaacgaatttgtcgtacttaaaaaggacgtcgacgcagcctacatgaataaggttgagttgcaagcaaaggtggattctctcacggacgagataaagttttttaaatgtctttacgagggagaaattacgcaaatccaatcccacatctcagacaccagtattgttctgtcaatggacaataaccgcgacctcgacctggattctataattgcagaggttagagcccagtacgaggaaattgcacttaaaagcaaggccgaagccgagactctgtatcagaccaagatccaggagctacaagtcaccgcaggtcaacacggggacgacctcaagctgaccaaggcggaaatctcagagttgaacaggcttatccagaggataagatcagagatcggcaatgttaagaagcagtgtgctgatttggagactgcaattgcagacgcagagcaacgcggggactgcgcacttaaggatgctcgcgcaaagcttgatgagttggagggggcactgcaccaagcaaaagaagaattggctcgcatgcttcgtgagtatcaggagttagtttccctgaagttggctttggatatggagatcgccacctatcgtaaactcttggaatccgaggaatgtaggatgtccggggagtaccctaattccgtctcaatatctgtaatttcgtccactaacgctggcgctggtggggccggcttttctatgggattcggggctagctctagctactcctacaaaacggccgccgctgatgtgaagacaaaaggctcctgcggctcagagcttaaggatccactggctaagacaagcgggtcaagctgtgctactaaaaaggccagtcgctag

SEQ ID NO: 192286 - DNA, 1623 bp, Artificial Sequence
  Description of Artificial Sequence: Synthetic coding sequence
atgagccggcagttcacctacaagagcggcgccgccgccaagggcggcttttcggggtgctctgcggtcctctccggaggaagttctagcagctaccgggccggaggcaaaggcctgtccggggggtttagcagccgtagcctgtactccttaggcggagcccgctccatctctttcaacgtggccagtggaagcgggtgggccggcggatacgggtttggtagggggagggcaagcggatttgcaggatcaatgttcgggtcagttgcactcggaagcgtgtgccctagcctgtgccctcctggagggatacaccaggtgacgatcaataagtccctgctggcgcccctcaatgttgaactggaccccgagatccagaaggtgcgagctcaggagagagaacagatcaaagtgctgaacaataaatttgcatccttcatagataaagtgaggttcctcgaacaacagaaccaggtcctggaaactaagtgggaacttctgcagcagctagatttgaacaactgtaaaaataacttagaacccatcttagaagggtacattagcaatctgcgcaagcagctcgaaaccctgtcaggcgatcgggtgagattagacagtgaattgcggtccgtgcgagaagtcgtagaagactataaaaagcggtacgaggaagaaatcaacaagaggaccaccgccgagaatgaatttgtggttctgaagaaggacgtggacgctgcgtatacatcaaaagtggaactccaggctaaagtcgatgcccttgacggtgaaattaagtttttcaaatgtctgtatgaaggtgagaccgcccagattcagagccacatcagcgataccagtatcatattgtctatggataacaacaggaatctcgacctcgacagtatcatcgcagaggtgcgcgcacagtatgaagagattgcacggaagtccaaagctgaggccgaagccctgtaccagacaaagtttcaggaactccaactggcagctggccgccatggcgacgatctgaagcatacaaagaatgagatttcagagctgacacgacttatacagagactccgctctgaaattgagtccgttaaaaagcagtgtgcgaatcttgaaaccgccatcgccgacgctgaacagcgtggcgactgcgcccttaaggatgcccgagccaagctagatgagcttgagggcgccttgcagcaggcaaaagaagaattggcacgaatgttacgagagtatcaagagttgctgagcgttaagctcagtctggacattgaaattgctacctatcgcaagctcctggaaggtgaggaatgtcgaatgagcggagaatataccaacagtgtcagcattagtgttataaatagttccatggcagggatggccggtacaggcgcgggctttgggtttagcaacgctggcacctacggatattggccatccagcgtctcaggcggctatagcatgctccctggagggtgcgtgactggcagtggcaattgcagcccccggggcgaggcaaggactcgcttaggcagcgcttcagagtttcgtgattctcagggaaagactctggccctgtctagtcctactaagaagacaatgcgctag

SEQ ID NO: 192287 - DNA, 1590 bp, Artificial Sequence
  Description of Artificial Sequence: Synthetic coding sequence
atgagccggcagctgaacatcaagagcagcggcgacaagggcaacttctccgtgcacagcgctgtagtacctcgcaaagctgtcgggtccctagcttcctactgtgccgccggccggggcgccggcgccggattcgggtctcgatccctgtactcactcggcggaaatcgacggatctcttttaatgtggccgggggcggcgtaagagccggggggtacggcttcaggccagggtccggctatggcgggggtcgggctagcggcttcgcaggctctatgtttggatccgtcgccctcggccccgcatgcctgagcgtgtgtccccccggcgggatccatcaggtaaccgttaacaagtccctcctagctcccctgaacgtcgaactggatccagaaatccaaaaggtcagggcgcaggagagagagcagataaaggtcttgaacgacaagttcgcttctttcatagataaggtcagattcctcgagcagcagaatcaggtcctggaaaccaaatgggagctgctacaacaactcgatttgaacaattgcaaaaaaaaccttgagcccatcctggaggggtatatctcgaatcttcggaaacagctcgagaccctgtccggggacagagtcagactcgacagcgagctccggtcaatgcgcgatctggttgaagattacaagaagcggtacgaagtggagatcaatcgccggacaacggccgagaatgagtttgtagtgctgaagaaagacgccgatgcagcatatgcggttaaagtcgaacttcaggcaaaggtggatagtttggataaagagattaagttcttgaaatgcctctacgacgccgaaatcgcgcagattcagactcacgcgagcgagacgtctgtgattctgtcgatggataataaccgcgatttggatctagattcaattatcgccgaggtccggatgcattacgaggaaattgctctgaagtccaaagccgaggccgaggccctttatcagactaagatccaagagctgcagctagctgccagccggcacggtgacgatcttaaacacaccagatccgaaatggttgagctgaatcgtctgatccagcggattaggtgtgagatcggcaatgttaagaaacagagggcctcactggagaccgcaattgccgacgccgaacagcggggggataatgccctgaaagatgcccaagccaagctggacgagcttgaaggcgccctccatcaagccaaggaggaactcgcaagaatgctcagagagtaccaggagctgatgagcctaaaattagccctggacatggagattgctacgtaccggaaacttctggagggcgaggaatgcagaatgtccggagagaaccctagtagcgtctctatctctgtgatatcctcctcttcctacagctatcaccacccctcatctgccggtgtcgacctcggagccagcgcggtcgcaggaagcagcgggtctacacagagcggccagactaagacaaccgaggctcgggggggggacctcaaagatactcaaggcaaatcaaccccagcaagcatccctgctcgcaaagcaactaggtag

SEQ ID NO: 192288 - DNA, 1656 bp, Artificial Sequence
  Description of Artificial Sequence: Synthetic coding sequence
atgagccggcagagcagcatcaccttccagagcggcagccggcggggtttttcaaccacctcagcgattacaccagcagccggacgcagccgatttagttctgtatccgtggcacgtagcgcagccgggagcggtggactggggcgtatcagcagtgccggcgcttccttcggatcccgctctttgtacaacttagggggcgcaaagagagtgtccatcaacggctgtggctcatcctgtcgatcaggttttggaggacgggcctctaatagattcggggtgaactccggcttcggatacggcggtggtgtgggcggggggttctcagggcccagctttcctgtatgtccacctggcggtattcaggaggtcaccgttaatcaatcactgctaacaccccttcacctgcagatagatcctaccattcagagggtaagagctgaagagagagaacagatcaaaactttgaataacaaatttgccagcttcattgataaagtgcgcttcctcgaacagcaaaacaaagtgttagaaacaaagtgggccttactgcaggaacaggggagtaggaccgttagacagaatctggaaccgctgttcgattcttataccagcgagttacgtaggcagctagaaagtattacaaccgagcgcgggcggcttgaggcagaactgcgcaatatgcaggatgtggtggaagattttaaagtgaggtatgaggatgagatcaataagcggacagcggcagagaatgagttcgtagcactcaaaaaggacgttgatgccgcgtatatgaataaagtcgagctcgaagccaaggtgaagtccctgccagaagagatcaattttattcacagcgttttcgatgccgaactgagtcagctccagacccaggttggcgatacgtctgttgtgctctctatggacaacaatcgaaatctggatctggattcgataatcgcagaggttaaagctcagtacgaagatattgcaaaccgcagcagggccgaagctgagtcatggtatcagactaaatacgaagaactccaggtcacggccgggaggcatggcgatgatttgagaaacaccaagcaagaaatatctgaaatgaaccgcatgatccaacgcttgcgcgccgaaatagatagtgtgaagaaacagtgctctagcctccagaccgctatcgctgacgctgagcagcggggtgagctggctctgaaggatgctcgagccaaactggtggatctcgaagaagccctgcagaaggccaagcaggacatggcgagactgctccgcgaatatcaggaattgatgaatatcaagctggctctggatgtggaaattgccacttatcgaaaactgctggaaggggaagaatgccgcctgtcaggcgagggagtttccccagtgaatatctcagtcgtgaccagtactctgtccagtggatatggttcaggaagctccataggtggtggcaatcttgggctgggcgggggaagcggctactcttttaccacatccggcgggcactctttaggcgccggcctgggggggtcaggcttttctgcgacaagtaacagaggtctcggcgggagcgggtcgtccgttaagtttgtgagcaccacctcatctagccagaagagctacactcactag

SEQ ID NO: 192289 - DNA, 1737 bp, Artificial Sequence
  Description of Artificial Sequence: Synthetic coding sequence
atgagccaccagttcagcagccagagcgccttcagcagcatgagccgccgcgtgtacagcaccagctctagcgcaggctccggaggcgggtctcccgcagtgggatcggtctgctacgctcgggggcggtgcggtgggggggggtacggcatccacgggcgaggatttggatctagatccctgtataacctcggtggatcacgctcaatatccatcaacctaatgggtcggagtacttcgggattctgtcaggggggaggagtgggtgggttcggaggaggtcgtggcttcggcgtcggctccaccggagccggtgggtttggaggaggaggctttggaggggcaggattcggaacgtccaactttggactggggggattcggcccctattgcccccccggagggatacaggaagttactatcaaccagtctttgctggagcctctccatttagaagtggaccctgaaatccagcgaatcaaaactcaggagcgggaacaaattatggtgctgaacaataagttcgcgagcttcatcgataaggtcagattcctggaacagcaaaatcaggtgcttcaaactaagtgggaactacttcagcaggtaaacacctccacagggacaaataatctggaacctctcctggagaattacatcggggacctgcgcagacaggtcgatctgctgagtgctgaacagatgaggcaaaatgccgaggtgcgatccatgcaggatgtggttgaagattacaaatctaaatatgaggatgaaataaacaagcgcacgggctcagaaaatgactttgtcgtgctgaaaaaggacgtggacgctgcatatgtttcaaaagttgacctcgaaagcagggtggacacccttaccggtgaagtcaatttcctaaaatatttatttttgaccgaactcagtcaggtgcagacacacataagtgacacgaatgtgattctgtctatggacaacaataggagcctggatcttgatagtattatcgacgctgtgcgcacacagtatgagctgattgcacagaggtctaaagacgaagctgaggctctgtaccaaactaaatatcaggagctgcaaataactgccgggaggcatggggacgacctcaaaaattctaagatggaaattgcagagcttaaccgcaccgtacagcggctccaggcggagatttccaacgtgaaaaagcagatagaacagatgcaaagcctgataagcgatgccgaagagcggggggagcaggcactgcaggacgcctggcagaagctccaggacctggaagaagctcttcagcagtccaaggaggagctggcccgcctcttgcgtgactaccaagcaatgctgggcgtgaaactgtctctcgacgtagagatcgccacatatcgccagctgctcgagggcgaagagtcacggatgtccggcgagcttcagagtcacgtctcgatctctgtgcagaattctcaggtgtcggttaacggaggggcaggaggtgggggtagctacggcagcggcgggtatggtggtgggtcgggaggaggctatgggggtggcagatcataccgcgggggcggggctcgcggccgcagcgggggaggctatgggagcggatgtggcgggggggggggatcctatgggggcagcggccggagcgggcgcggttccagccgagttcagataatccagacgtcaaccaatacatctcatagaaggatcctcgaatag

SEQ ID NO: 192290 - DNA, 1038 bp, Artificial Sequence
  Description of Artificial Sequence: Synthetic coding sequence
atgcggcagaacgccgaggtgcggagcatgcaggacgtggtggaggactacaagtcaaaatacgaggacgagatcaataaacgaactggaagtgagaacgactttgtagtcctaaaaaaggatgtcgacgccgcgtacgtgagcaaggtcgacctggagtcaagggtggacaccttgactggggaggtgaacttcctcaagtacctgttcttgaccgagctgtctcaggttcagacacacatcagcgacactaacgtgattctcagcatggacaacaaccggtcactcgacttagactccatcatcgacgcggtgagaacccagtatgagcttatcgcacagcgctccaaggacgaagctgaggccctatatcagactaagtaccaggaacttcagattacagctggccgccatggcgatgatctcaagaatagcaagatggagatagcagaattaaatcgaaccgtgcagaggctgcaggccgagataagcaatgtcaaaaagcagattgagcagatgcagtcactgattagcgacgcagaggagcgcggagagcaagctctgcaggacgcctggcaaaaactgcaggatctcgaagaggctctgcagcagtcaaaggaggaattggccaggcttttgagggattaccaggctatgctgggggtcaaactgtccttggacgtggagatcgcaacttatagacagctgctggagggcgaagaatcaaggatgagcggtgagcttcagtcacacgttagtataagtgtgcagaactcgcaagtgtctgttaatggcggcgccgggggaggcggaagctacgggtcaggcggatatgggggcggcagcggaggtgggtacgggggcggccggtcttaccgagggggaggagcccgcggaagaagtggtggaggctatggatctggatgcggggggggcggaggctcttatggcggatctggcaggagcggccgtgggtccagccgagtgcagatcatccagacttccacaaacacatcccaccggaggatactggagtag

SEQ ID NO: 192291 - DNA, 1563 bp, Artificial Sequence
  Description of Artificial Sequence: Synthetic coding sequence
atgagcctgagcccctgccgggcccagcggggcttcagcgcccggagtgcctgctccgctcggtctagaggaaggagcagaggggggttctctagtaggggcgggttttcgtctagatccctgaattccttcgggggatgcctggaaggaagccgcgggtctacgtggggctccggcgggagactcggcgtccgttttggcgagtggagcggtggccctggtctcagcctgtgccctccggggggcattcaggaagtgactattaaccagaaccttctcacacctctgaagattgaaattgacccccagttccaggttgttcgcacccaggaaactcaggaaatacgcactctaaacaatcagttcgccagtttcattgacaaagtgaggtttctagagcagcagaacaaggtgctggagacgaaatggcatcttttacagcagcagggacttagtggttcacagcaagggttagaaccagtgtttgaggcctgcctggaccagctgcgaaaacagctcgagcagctgcagggggagcgcggagcacttgatgccgaactgaaagcctgtcgagatcaggaagaggaatataaaagtaagtacgaggaggaggcacaccggcgggctacattagaaaacgactttgtcgtgttgaagaaggacgtcgacggtgtgttcttatctaagatggagctcgaaggcaaactcgaggcgctaagggagtacctctacttccttaaacacctcaatgaggaggagctgggtcagctgcagactcaggcctccgacacaagtgtggttctgtccatggataataataggtacctagacttttcttctattatcactgaagtgagggcacggtacgaggagatagcccggtcaagtaaggcagaggccgaagctctgtaccagacgaagtatcaagagctgcaggtatctgcccagctccatggggaccgaatgcaggagacaaaggtgcagatttcacagctgcatcaggagatccagcgcctgcagtcccagacagagaacctgaaaaaacagaatgcctctcttcaggccgccatcaccgacgccgagcagcgtggtgagttagctctcaaggacgcgcaagctaaggtggacgagctcgaagcagccctacggatggctaaacaaaatctggcccgccttctttgcgaataccaggagttaacatctacgaaactttctctcgacgtagagattgcaacctaccgaaggctcctggaaggcgaggagtgtcgaatgagtggggagtgcacttcccaggtcactatatcttctgtcggaggcagcgccgtcatgtccgggggcgtcggtgggggtctcggttccacatgtggcttgggatcggggaaaggctcacccggatcctgctgtacctcaatagtaacaggcgggagcaacatcattctaggctcaggtaaggatcccgtattggatagctgtagtgtcagcgggagttctgccggtagttcatgccatacgatcttgaaaaaaaccgtcgagtctagtctgaagacttctatcacctactag

SEQ ID NO: 192292 - DNA, 1233 bp, Artificial Sequence
  Description of Artificial Sequence: Synthetic coding sequence
atggagggccacgaggccagccccgcccaggtgggccagggcgaccgtggcaaggtcagatttctcgaacagcaaaacaaagtactggagaccaaatggcatttgctacagcagcaaggcctcagtggatcccaacaaggactcgagcctgtattcgaagcctgtctggaccagttgcgcaaacagctggagcaacttcagggggagcgcggggccctcgatgccgaactcaaggcgtgcagggaccaggaagaggagtataaaagtaaatacgaggaggaagcacacaggcgagctacgctggagaacgattttgtagtgctgaagaaagatgtggatggcgttttcctttccaagatggaactggaggggaaactagaagcacttagggagtacctgtactttctgaagcatctcaacgaagaggagttaggccagctgcagacgcaagcatcagatacttctgtggtattaagtatggacaataacaggtatctggatttttccagcatcattactgaagtccgtgccaggtatgaagaaatagctcggagttcaaaagccgaagctgaagccctgtaccagactaaatatcaggaactgcaggtttcagctcagttgcatggcgaccgcatgcaggaaaccaaggtgcagatcagtcagttacatcaggagattcagagattgcaatcacaaaccgaaaaccttaagaagcaaaatgctagtcttcaggcggccatcacggacgcagagcaacgcggggagctagctcttaaggacgcacaggccaaggtagatgagcttgaggccgcgctgcgcatggccaaacagaacctggccagactgttgtgcgagtatcaagagcttactagtaccaaattgtctcttgatgtggagatcgcgacatatagacggctgctcgagggagaggagtgcagaatgtccggcgagtgcacgagtcaggtgacaatctctagcgttggggggagtgccgtcatgtccggtggggttggcggtgggcttgggtcaacatgcgggctgggctccggaaaaggctccccggggagctgttgtacctcaatcgtgacaggcggatccaacattatcctcgggtccggcaaagaccctgtcctggatagttgtagcgtgagtggcagcagtgctggatctagctgtcatacaattttaaaaaagaccgtggagagttccctcaaaacctccatcacttattag

SEQ ID NO: 192293 - DNA, 876 bp, Artificial Sequence
  Description of Artificial Sequence: Synthetic coding sequence
atggagctggagggcaagctggaggccctgcgggagtacctgtactttcttaagcatttgaacgaggaagaactggggcagctgcagactcaggcgtctgatacctcagtcgtcctgtcaatggacaacaatcggtatctggacttttcatctattataacagaggtgcgggctcgttacgaggagattgctcggagcagcaaggctgaggcggaggctctctatcagaccaagtatcaagaactgcaggtctccgcacagttgcatggggatcgaatgcaggaaacaaaggttcagatatctcagcttcaccaggagattcagcgcctgcagagccaaaccgaaaatctgaagaaacagaacgcatccctgcaggccgccattacggatgctgaacagcgcggagagctggctcttaaagacgcacaggcgaaggttgacgagctcgaggcagcacttagaatggcaaagcagaacctggcccgcttgctctgcgagtaccaagaactgacctctaccaagctctcactcgatgtggaaattgcaacctatcgccggcttctggagggcgaagagtgcaggatgtccggcgagtgtacttctcaggtgaccatttcttctgtgggagggtcagccgtgatgtccggcggcgtcggcgggggcctcggctctacctgtgggctgggaagcgggaaaggctctcctggctcctgctgcacctctatcgtgactggcggctctaatatcatccttggaagtggtaaagatccggtccttgactcctgttctgtatcggggagttccgctgggagctcatgtcatactatcttgaagaagaccgtggaaagctccctgaagaccagcattacatactag

SEQ ID NO: 192294 - DNA, 1608 bp, Artificial Sequence
  Description of Artificial Sequence: Synthetic coding sequence
atgcggagcagcgtgagccggcagacctacagcaccaagggcggcttctcttcgaattctgcctctggcgggagtggaagccaagcaaggacgtccttctcaagtgtcacagtgtctcgttcttcgggtagtggtggcggagcacactgtggtccggggaccggggggtttggcagcagatctctatataacctcggcggacacaaatccataagcgtgtcagtggccggcggggctctgctgggccgtgctttgggcggctttggatttggcagccgggctttcatgggacagggtgcaggccgccagactttcggaccagcctgtccccctggaggcattcaagaggtgacggtgaatcagtctctcctcaccccactccatgtggaaatcgatcctgagatacagcgggttcgcactcaggaaagagagcagatcaaaaccctgaacaataaatttgcctcatttatcgacaaagttcgattcttagaacaacagaataaagtgcttgagactaaatgggcgctgctccaggagcaagggcagaatctcggcgtgacaaggaataacctggaacccctctttgaagcttacctgggaagcatgagaagtacactcgatcggctccaaagcgagcggggcaggctcgattccgagctccgtaatgtgcaggacctggtcgaggactttaaaaataaatatgaagacgagatcaataaacatacggcggcagagaatgaattcgtggtactcaagaaagatgtggacgccgcatacatgggtcgcatggacctccatggaaaagtgggtacactgacccaggaaattgatttcctgcagcagctgtacgaaatggaattgtcgcaagtccaaactcatgtatctaatactaatgtggtgctgtcaatggacaataatcgtaacttagacctggattctattatcgctgaggtgaaggcccagtacgaactgattgcccagaggagccgagctgaagccgaagcctggtaccagactaagtatgaggaactgcaagtaacagccgggaaacatggagacaacttacgggatacaaaaaatgaaattgccgaactcaccagaactatccagaggctccagggagaagcagatgcggctaagaaacaatgccagcagttgcagaccgctattgcagaagccgagcaacgtggagagttggccctcaaggacgcccagaaaaagctcggcgacctggatgtggcactacaccaggccaaagaagacctcacacgtctgctcagggattaccaggagctcatgaacgtcaagctggcactggatgtcgagatcgcaacttatcgcaagctgctggagtccgaggagtccagaatgagcggggagtgtcctagtgcagtgtccatctccgtcacaggcaattctactaccgtttgtggcggaggtgccgcgtccttcggcggaggtatcagcctaggagggtctgggggggccactaagggggggtttagtactaatgtcggatacagcactgtgaagggtggacctgtgagcgccgggacctccatcctccgtaagacaacaactgtcaaaactagtagccaacgctattag

SEQ ID NO: 192295 - DNA, 1269 bp, Artificial Sequence
  Description of Artificial Sequence: Synthetic coding sequence
atggcctgccggagctgcgtggtgggcttcagcagcctgagcagctgtgaggtgactccggtcggcagtcccaggccgggcacttccgggtgggactcttgtcgggctcccggaccaggcttttcctcccgcagtttgaccggctgttggagtgccggcactatttccaaggtgacggtgaacccagggctgctggtcccactagacgtgaagctagaccctgccgtgcagcaactcaagaatcaggagaaagaagaaatgaaggccctcaatgacaagtttgctagtctgattggcaaggtgcaggcgctcgaacagcgcaaccaattgctcgaaactcgatggtcgttcctgcagggacaggactccgctatcttcgacctggggcacttgtacgaagagtatcagggccggctgcaagaggaactgcgcaaggtctcacaggaacgaggtcaactcgaagccaatctgttacaagtcctggagaaagtcgaggaattccgcatcaggtatgaagacgaaatcagtaagagaaccgatatggaatttacatttgtgcaacttaagaaagacttagatgccgagtgcctgcacagaacggagctggagactaaactgaaatctctggagagcttcgtggaacttatgaaaaccatttatgagcaggagctgaaggatctggcagcccaggtgaaagatgtatccgttaccgttgggatggactcacggtgccatatcgatctttccgggatcgtcgaggaggtgaaggcccagtatgacgctgtggccgctagatcattggaggaagcagaagcctactccaggtcacagctggaggagcaggctgctagatctgcagaatacggtagttcgctacaatctagccgttccgagattgctgatcttaatgtgcggatccagaagctacgatctcagatcctgagcgtgaaaagtcactgcttaaaactggaggaaaacattaaaacagccgaggaacaaggtgaactggcattccaggacgcaaagaccaagctggctcagttagaagccgcgctccagcaggccaaacaggatatggctcgccagcttcgcaagtaccaggagctcatgaacgtaaaattggccctggacatcgagatcgcaacctaccgcaaattagtggagggcgaggaaggccggatggattcccctagcgcaacagttgtgtccgccgtgcaatccagatgcaaaacagccccaagtctcccttaccctctgtgtagcctgtag

SEQ ID NO: 192296 - DNA, 1359 bp, Artificial Sequence
  Description of Artificial Sequence: Synthetic coding sequence
atggcctgccggagctgcgtggtgggcttcagcagcctgagcagctgcgaagttacacccgtgggctccccacgacccgggacatccggctgggattcatgtcgggccccgggccctggattcagttcacgttccctgaccggttgctggagcgctgggacgatctccaaagttacagtgaatcccggtttgctagtgcctctggacgtgaaactcgatcccgccgttcaacagctgaaaaaccaggagaaggaggaaatgaaagccctgaacgacaagtttgccagcctaataggtaaggtccaggccctggagcagcgcaaccaactcttggaaactagatggagcttcctccaggggcaggacagtgctatcttcgacctgggtcacctctatgaggaataccagggccggttacaggaagaactcaggaaggttagtcaggaacggggacaactggaggctaacctcctgcaagtgctagagaaggtagaggagttccgtatccgatatgaggatgaaatctccaaaaggactgacatggagtttaccttcgtgcagcttaaaaaagacttagacgcagaatgtcttcatagaaccgaactcgagactaaattgaaaagcttggaaagtttcgtggagctcatgaagaccatctacgagcaggagctgaaagacctagccgctcaggttaaggacgtctcagtgacagtgggtatggactccaggtgccacatagacctctccggaatcgtggaggaggttaaagctcagtatgatgccgttgcggctagatcactggaagaagcagaggcttactcccggtctcagcttgaggagcaggccgccagaagtgcagagtacgggtcctctctgcagtctagccgaagcgagattgcagacttgaacgttaggatacagaaattaaggagtcaaattctcagcgttaagtctcattgccttaaattggaggagaacatcaaaaccgctgaggaacaaggcgaactggcattccaggacgctaaaaccaagctggcccagctggaagccgcgcttcagcaggctaaacaggacatggcacggcagctcagaaaatatcaggaattgatgaacgtcaagttagccctggatattgagatagcgacctaccgtaagctagtagagggcgaggaaggtcgtatggactccccgtcggccaccgtagttagcgctgttcaatcacgctgcaaaacggctgcaagtaggtccggactctcgaaggcccccagtaggaagaaaaaaggctccaaggggccggtgatcaaaattacggagatgtctgagaaatatttctctcaggaaagcgaagtgtctgagtag

SEQ ID NO: 192297 - DNA, 1518 bp, Artificial Sequence
  Description of Artificial Sequence: Synthetic coding sequence
atgacctgcggcagcggcttcggcggccgggccttcagctgcatctcagcctgtggaccgcgccccggcagatgttgcatcactgcagcaccctatagggggatctcctgttaccggggcttgacaggggggtttggatctcactccgtttgtgggggattccgagccgggagctgcgggcgatcgtttggctaccgctcgggtggggtttgcggaccgtctcctccctgcattaccacggtgtcagtaaatgagtcattgttgactccgctcaaccttgaaattgacccaaacgctcagtgtgtaaaacaggaagaaaaagagcagatcaagtccctcaacagccgttttgccgcattcatcgataaggtccggtttcttgagcaacagaataagttactggagactaaactacagttctatcagaatagagaatgctgtcagtcaaatctcgagccgttgttcgaaggctatattgaaacattacggcgggaagcggagtgcgtggaagctgactcaggccggctcgcttcagagttgaatcatgtccaggaagtgttagaggggtataaaaagaagtacgaggaggaagtatcgcttagagccaccgctgaaaacgagtttgttgcacttaagaaagacgtcgattgcgcgtatctgcgtaaaagtgacctggaggctaatgtcgaagctctaattcaggaaatcgatttcttgagaaggctgtatgaggaagagattctgatcctgcagagccacatcagcgatacaagtgtagtggtcaagttagacaattccagagacttaaacatggactgcattattgctgaaatcaaggcccagtacgatgacatcgttacccgctcccgggccgaggccgaaagttggtatcggagtaagtgcgaagagatgaaagcaacagttattaggcatggcgaaaccttacgtagaacgaaagaagagattaatgagctgaacagaatgatccagcgcttgacagctgaggtcgagaacgctaagtgccaaaactccaagctggaggccgccgtggcccagagtgagcagcagggagaagccgcgctgagcgatgctcggtgcaagctggccgagctggagggggcgttacagaaggccaagcaagatatggcttgtctgatccgtgaatatcaagaggtaatgaattcaaaacttggcctcgacatcgaaatcgccacctaccgcaggctactggagggcgaagagcagagactgtgcgagggaattggggccgtcaatgtatgcgtctcttcgagtagagggggcgtcgtgtgcggcgatctctgtgtatcaggatctcgcccagttacaggctccgtgtgctcagctccttgtaatggcaatgttgccgtcagcaccgggctgtgcgccccgtgcgggcagctgaacacgacgtgtgggggcggcagttgcggcgttgggtcttgcggcatctccagtctcggcgtcggcagttgcggctcaagttgtcggaagtgctag

SEQ ID NO: 192298 - DNA, 1455 bp, Artificial Sequence
  Description of Artificial Sequence: Synthetic coding sequence
atgacctgcggcagcggcttcggcggccgggccttcagctgcatctccgcctgcgggcccagaccgggcagatgctgtatcaccgctgctccatataggggcatctcctgttaccggggactgactggagggttcggcagtcactccgtctgtgggggtttcagagccggcagctgtggccgtagttttggttacagaagcgggggggtgtgcggtcctagcccaccttgcatcactacggtgtccgtcaacgaatccttgcttacaccactgaacctggagattgaccccaatgcccagtgcgtgaaacaagaagagaaagagcagattaaatccttgaattcccgcttcgctgcctttatcgacaaggtcagatttctcgaacaacagaataaactgctcgaaacaaagttacaattttaccagaatagggaatgttgtcagtctaacttggaacctctgtttgaagggtacatcgagactctccggagggaggcagaatgcgtggaggccgatagtggccgactggctagcgaactaaaccacgttcaggaggtgttggaaggctataaaaagaagtatgaggaggaagtgtcccttcgcgccactgcagaaaacgagttcgtggctctcaagaaggacgttgactgtgcctatttgcgcaagtcagatctggaggccaatgtggaggccctaatccaggaaatcgacttccttcggaggctgtacgaagaggaaattcttatcctgcagtctcacatttcggacacatctgtagtggtgaaacttgataattctcgggatctgaatatggactgcattattgctgaaatcaaggcacaatacgatgacatcgtcacacgctcacgagctgaggcagagagctggtaccgctccaagtgtgaggaaatgaaagctacagttattcggcacggagagactctcagaaggacaaaggaagaaattaacgagttaaatcgcatgattcagcgattgactgctgaggtggagaacgccaagtgtcaaaatagtaagttggaggccgctgtggctcagagtgagcagcagggcgaagccgccctgtccgatgcacggtgcaagcttgccgaactggagggagccctgcaaaaagccaaacaggatatggcctgtctcattagagaatatcaggaggtgatgaattcgaaattggggctggacattgagatcgccacttaccgtagacttcttgagggtgaggagcagagactttgtgaaggaatcggggctgtcaatgtgtgcgttagcagctcacggggcggcgtcgtgtgcggcgacctgtgcgtatccgggtctcgacccgtgacaggttccgtgtgttctgctccatgtaacgggaatgtcgcagtgtccaccggcctttgtgccccttgtgggcaagtcggtagctgcgggagcagttgccggaagtgttag

SEQ ID NO: 192299 - DNA, 1482 bp, Artificial Sequence
  Description of Artificial Sequence: Synthetic coding sequence
atgacctgcggcttcaacagcatcggctgcggcttccggcccggcaatttcagctgcgtctctgcctgcgggcctaggccttcacgctgctgcataaccgctgcaccctacaggggaatttcatgctaccgcgggctaaccggcggtttcggatcccatagcgtgtgtggcggcttccgcgccggctcctgcgggcgtagcttcggctatcgaagcgggggagtttgcggacccagtcctccatgcatcacaaccgtgagtgtaaacgaaagtctcttgacgccacttaatctagagattgatccaaacgcccagtgcgtcaagcaagaagagaaggaacagataaagagtttgaactcccggtttgcagcgttcatcgacaaggtgagatttctcgagcagcaaaataagctgctggaaaccaagctccagttctaccaaaacagggaatgctgtcaatctaacttagagcctctgttcgccgggtacattgagactctgcgcagagaggcggagtgcgtggaggcggactcagggcgcctggccagcgagcttaatcatgtgcaggaagtactggagggctacaagaagaagtatgaggaagaagtcgctcttcgggctacagccgaaaacgaattcgtggctctgaagaaagacgtggattgtgcttacttgcgaaagtctgaccttgaggccaatgtggaggccttgatacaggaaatcgactttctcagacggttgtacgaggaggaaatcagaatcctccagtctcacatctctgacacctccgtagtagtcaaactggataacagccgggacttgaatatggactgtattgtggcggaaatcaaggcacagtatgacgacatcgcaacccgatctcgagctgaggccgagtcttggtacagatccaagtgtgaggagatgaaggccacagtgatacgacacggcgagacactgagacgcaccaaggaagagattaatgagctgaacaggatgatccaaaggctgactgctgaggttgagaatgccaagtgccagaattcgaaactggaagcagccgtggcgcaaagcgaacagcaaggagaagcagctctttcagacgcacgttgcaagttggccgagcttgagggagctttgcagaaagccaaacaggacatggcttgcctgatcagagagtatcaggaggtgatgaactctaagttgggcttagacatcgaaatagccacttaccggcgtctcctggaaggagaggaacagcggttatgcgagggcgtggaggctgtgaatgtgtgcgtgtcttcctcaaggggcggggtggtgtgtggagatctgtgcgtgagtggtagccggccagtgaccggtagtgtttgctctgcgccatgtaatggtaacttggtggtttcaacaggactctgtaagccatgcggccagctcaacaccacatgtggcggaggttcttgcgggcagggacggcactag

SEQ ID NO: 192300 - DNA, 1524 bp, Artificial Sequence
  Description of Artificial Sequence: Synthetic coding sequence
atgagctgccggagctaccggatcagcagcggctgcggcgtgacccgcaattttagcagttgctccgcggtggcaccgaagaccggaaaccgctgctgtataagtgcagcgccctacaggggtgtgtcttgctaccgcgggctgactggtttcggctcccggagcctttgcaacctcggaagttgcggtccacgtattgccgttggtgggttccgagcggggtcttgtggtcgaagcttcgggtaccgctccggaggcgtttgcggccccagccccccttgtattaccaccgtgagcgttaatgagtcactgctgacgccactgaatttagagattgacccaaacgcgcagtgcgtgaagcaggaggaaaaggagcaaatcaagtccctgaatagccggtttgccgcattcatagataaagtacgcttcctcgagcaacagaacaagttactcgagaccaagtggcagttttatcagaatcaacgttgttgtgaatccaatctggagcctctttttagtggctatatcgaaacactgagacgtgaggcagaatgcgtggaggccgattccggaaggctggcctccgaactgaaccacgtgcaggaggttttagaggggtataagaagaagtatgaggaagaagtggcccttcgggctaccgccgagaacgagtttgttgtcctgaagaaagatgtagactgtgcctacttacggaaaagcgatctcgaagccaatgtggaggccctggtggaagagtcgagctttctgagacgtctgtatgaggaggagatacgcgtgctgcaggcccacatctcggatactagcgtgatcgttaaaatggataattctcgcgatctcaatatggactgcatcatcgcagagatcaaagctcagtatgacgatgtagcttcgcgctcgcgggccgaagccgagagctggtatcgctccaaatgcgaggagatgaaagcaactgtgattcgccacggtgagactctgaggcgaactaaagaagagattaatgaacttaaccgtatgatccagagactcacagctgaaattgagaatgctaagtgtcaaagagcaaagctggaagccgcagttgcagaggcggagcagcaaggcgaggctgcactgtccgacgcccggtgtaaacttgctgagttagagggcgctctccagaaagctaaacaggatatggcttgtctgcttaaagaatatcaggaagtgatgaactctaaactaggattagacatcgagatcgctacttacagaaggctgctagagggagaggagcatcgcctgtgtgagggtgttggttccgtcaacgtgtgcgtgtccagttcccgcggcggcgtgagttgtggaggactgagttacagcacaacacctggccggcaaatcacctccgggccttcagccatcggcggtagcatcacggttgtggcccccgattcctgcgcaccctgtcagcctcggtcttcttcattttcctgcgggagttccaggtctgttcgtttcgcctag

SEQ ID NO: 192301 - DNA, 888 bp, Artificial Sequence
  Description of Artificial Sequence: Synthetic coding sequence
atggtgttcaaggtgcagttcctgagcagccggcccagcctgagccacacacaggacgtcgattgcgcttacttgcgcaaatctgaccttgaagccaacgtcgaagcgttggtggaagagtcatctttcctgcgtaggctttacgaggaggagatcagggtgctgcaagcccatatctctgacactagcgtgattgtcaagatggacaactcgagagacctcaatatggactgcatcatcgcagagattaaagcacagtacgacgacgtggcttcaagatctcgtgccgaggccgaaagctggtatcgatcaaaatgtgaggagatgaaggcaaccgtcattagacatggcgagaccttgagacgcacgaaggaggaaataaacgagttgaaccgtatgatccagcggctgacagctgaaatcgagaacgccaaatgccagagagctaagcttgaagccgctgttgctgaggctgaacagcagggcgaggctgccctctccgacgccagatgcaaactggccgagctggaaggggctcttcagaaggctaaacaggacatggcatgtctcttgaaggaataccaggaggtcatgaactcaaagctgggactggacatcgaaatcgccacctaccggcgtcttctggaaggagaggagcaccgcctttgtgagggggttggcagcgttaacgtgtgcgttagtagttcccgagggggggtaagctgcggtggcttgtcctattccaccaccccaggcagacagattacaagtgggcccagcgctatcggcggaagcatcacggtggtcgcaccggactcatgtgcaccttgtcagccgcggtctagtagtttttcctgtggatcttccagaagtgtgagatttgcctag

SEQ ID NO: 192302 - DNA, 1461 bp, Artificial Sequence
  Description of Artificial Sequence: Synthetic coding sequence
atgacctgcggcagctactgcggcggccgggccttcagctgcatcagcgcatgtggtccacgacccggccgctgttgtattacggctgctccctacagagggatatcctgctaccgaggactcacgggtggcttcggtagtcactccgtgtgtggcggttttagagcgggctcctgcggtagaagttttggctataggtcggggggagtgtgtggaccgagccccccctgtattaccaccgtgtccgtgaacgaatcgctgctgactccactgaatcttgagatcgaccctaatgctcaatgcgtgaaacaggaagagaaggaacagattaaaagcctcaacagcaggttcgcagctttcatcgataaggttagatttctggagcaacagaacaaactcttggaaaccaagctgcaattttatcagaacagagagtgttgtcaatccaacctcgagcccctgttcgaaggctatattgaaacactgagaagggaagccgaatgtgttgaagccgatagtggccggctggccagcgagctcaatcacgttcaggaggtgctggaagggtacaaaaaaaagtacgaggaggaagtgtctcttcgtgccacagccgaaaatgagttcgtggctctgaagaaagacgtcgactgtgcgtatctgcggaaaagtgacctggaggcgaatgtcgaggcacttatccaggaaatcgattttctgagacgtttgtatgaagaagagataagggtcctgcagtcccacatcagtgatacaagcgtggtggttaaactggacaactcaagagatctgaacatggattgtattatcgccgagattaaggcccagtacgacgatattgtgaccagaagtcgagccgaggccgagtcctggtataggtccaaatgcgaggagatgaaagcaaccgtgataagacatggggaaacattgagacgaactaaagaagagattaatgagctgaacagaatgatacaaaggctgaccgcggaagtcgaaaatgctaaatgccaaaacagcaagctcgaggccgccgtcgctcagagtgagcaacaaggcgaggccgccctgtccgatgcgagatgtaaactcgctgagctggagggggccctgcagaaagcaaagcaagatatggcttgcctcatccgagagtatcaggaagtgatgaattctaagttgggcctcgatattgagattgccacctatcgccgccttcttgaaggtgaagaacaaaggctctgcgagggcgtcggctctgtgaacgtctgcgtaagttcttcacggggcggggtagtgtgcggcgatctctgtgcatcaactacggcgcccgtggtaagcacccgagtttcttcagtcccttcgaatagcaatgtcgttgtaggcactactaacgcctgcgctcctagtgcccgcgtgggcgtgtgtggtgggagttgtaaacgctgctag

SEQ ID NO: 192303 - DNA, 1872 bp, Artificial Sequence
  Description of Artificial Sequence: Synthetic coding sequence
atgagctgccggcagttcagcagcagctacctgagccggagcggcggggggggcggtgggggcctaggatccgggggaagtattcggtcttcttatagtcggtttagctctagcgggggcggcggcgggggcggtcggtttagttcaagctcggggtatggaggaggaagttccagggtctgtgggcgggggggcggcggatctttcgggtatagttatggaggaggctctggcggcggcttctcagcatcctccctcggaggagggttcggaggcggcagtcgaggattcggaggtgcctcaggcggaggatacagcagttccggaggcttcggaggcggattcggggggggaagtggaggtgggtttggaggcggttatggaagtgggtttggaggtttcggaggattcggcggaggcgcgggtggaggcgatggtggaatcctaacagctaacgagaagagcacgatgcaagagctaaactcccggctggcttcgtatctggataaggttcaggccttggaagaagccaacaatgacctagagaacaagatacaggactggtatgataaaaaaggtccagccgccatacaaaagaattattccccctactacaacactatcgacgatctgaaggaccaaattgttgacctgactgtgggaaacaacaagacccttcttgacatcgacaacacccgcatgacactcgatgactttagaataaagttcgagatggagcagaacctgagacagggagtcgacgccgacatcaacgggctcaggcaagtcctagacaatctgaccatggaaaagtcagacctggagatgcagtacgaaaccctccaggaggagctgatggcactcaaaaagaaccacaaagaggagatgtcacaattgacagggcagaattccggagacgtgaatgtggaaatcaacgttgccccagggaaagacctgaccaagacactcaacgacatgcggcaggaatacgaacaactgattgctaagaatcgaaaggacatcgagaaccaatacgagacgcagattacacagattgagcacgaagtttcatccagcggacaggaggttcaatccagcgccaaggaagtcacccaactgaggcacggagtgcaagagctggagattgaactacagtcccagcttagcaaaaaggctgcacttgagaagagcttggaggacacaaagaatcgctattgcggtcagcttcagatgatccaggaacaaataagtaacctggaggctcaaatcaccgacgttcgtcaggagatcgaatgtcagaaccaggagtacagcctgttgctatccattaagatgcggttagagaaggaaattgagacctaccacaatttgctggaaggagggcaggaagactttgaatcatcgggcgccggaaagattggactcggaggaaggggcggctccggagggtcctacggcaggggcagcaggggtggttctggcggctcctatggcggcggcgggtcaggaggtggctatggcgggggttcgggaagtagagggggctcaggtggcagttacggaggtggttctgggtctggcgggggcagcggagggggatatggggggggcagcgggggtggccatagcggagggtctggtggcggtcactctggaggcagtgggggaaactacggcggtggcagtgggtccgggggcgggtcaggaggaggttacggcggaggctccggctccagggggggcagtgggggatctcatggcggcggctcaggctttggaggcgaatcgggggggtcgtacgggggcggagaggaagctagtggatcaggcggaggatacggagggggatctggaaagtcttcacacagttag

SEQ ID NO: 192304 - DNA, 534 bp, Artificial Sequence
  Description of Artificial Sequence: Synthetic coding sequence
atggcctgctgccagaccagcttctgcggcttccccagctgcagcactagcggcacctgcggctcctcctgctgtcagccgagttgttgcgaaaccagcagctgccaacctagatgctgcgagacgtcctgctgtcagccatcttgctgccagacttccttctgcgggttcccttcctttagcacagggggcacttgcgacagttcgtgttgccagcctagttgttgcgagaccagttgctgccagccatcatgctatcaaaccagtagctgtggtactggctgcggaattggcggagggatcggctatgggcaagaggggtcctctggcgcggtcagtacccgcattcggtggtgcaggcctgactgtcgggtggaggggacttgccttccaccctgctgcgtcgtaagctgcacaccgccgtcctgttgccagctgcatcacgccgaggcctcttgttgcaggcctagctattgcggtcagtcatgttgcaggcccgtttgctgctgttactgctcagagcccacctgctag

SEQ ID NO: 192305 - DNA, 504 bp, Artificial Sequence
  Description of Artificial Sequence: Synthetic coding sequence
atggcctgctgccagaccagcttctgcggcttccccagctgcagcacgagcggaacttgtgggtcctcttgttgccaacccaggtgttgtgagactagttgctgccaacccagttgttgccagacctccttctgtggatttccttcctttagtactgggggcacatgcgatagttcatgctgccagccttcgtgctgcgaaacaagctgttgccagccctcctgttaccaaacgtcatcatgcggtacgggctgtgggatcggtggggggatcgggtatgggcaggagggctcctcaggcgcagtgagcacaaggatccggtggtgccgccccgactgccgcgtcgaaggaacttgcctgcctccttgctgtgtggtatcttgcacccctccgtcatgttgtcagctgcatcacgccgaagcctcttgctgtcgcccttcctactgcgggcaatcctgttgccgcccagtctgttgttgttactgctccgagcccacttgctag

SEQ ID NO: 192306 - DNA, 492 bp, Artificial Sequence
  Description of Artificial Sequence: Synthetic coding sequence
atgagcttcaactgcagcacccggaactgcagcagccggcccatcggtggaagatgtattgtccccgtggcacaagtcactacgacctccacaacggatgcagactgtctcggcggtatttgcctgccatcctcttttcagaccggatcatggttgctggaccattgccaggagacctgctgcgaacccacagcatgccagccaacgtgctaccggcggacatcctgcgtgagcaatccatgccaagttacctgctcaagacagaccacctgtatttcaaacccatgcagcactacgtactcacgacctctgacttttgtgtccagcggatgtcagcctctgggaggcatctcaagtgtttgccagccagtcggcggtatcagcaccgtctgccagcccgtggggggagtgagtacagtttgccagccagcctgcggagtcagtagaacctaccagcagagctgcgtgtccagctgtaggcggacctgctag

SEQ ID NO: 192307 - DNA, 504 bp, Artificial Sequence
  Description of Artificial Sequence: Synthetic coding sequence
atgacctgctgccagaccagcttctgcggctaccccagctgcagcacctccggaacttgtgggtccagctgctgccagccatcctgctgtgagacgtcctgctgtcagccaagttgctgccagacaagcttctgcggcttcccatctttttccacgtcagggacttgcagctcaagctgctgtcagccatcttgctgtgagacaagttgctgtcagccatcctgttgtcagacttcttcatgtggaacggggtgtggtataggcggtggcatcgggtacgggcaggagggctctagcggcgccgtgtcgacacggatccgatggtgccgccctgattgcagagtagagggcacgtgcctacccccctgctgtgtggtctcttgtactcctccaacctgctgccagctccaccacgcagaggccagctgttgtcgccctagctactgtgggcagtcttgctgccggcccgtctgctgttgttactcctgtgaacctacttgctag

SEQ ID NO: 192308 - DNA, 366 bp, Artificial Sequence
  Description of Artificial Sequence: Synthetic coding sequence
atggccagctgcagcaccagcggcacctgcggcagcagctgctgccagccttcctgctgtgagacgtcctgctgccaacccagttgctgccaaactagctcatgtggtaccggatgtggaataggtggcggcatcggatatggccaggagggatccggggggtcagtgagcacccggattagatggtgccatccggactgccacgtcgagggaacgtgtcttccgccatgttacctcgttagttgtactccgccaagttgttgtcagctgcatcatgcagaagcttcctgttgccgcccgtcatattgtggtcagtcttgttgcagacctgcctgttgctgccattgttgcgagccgacctgctag

SEQ ID NO: 192309 - DNA, 837 bp, Artificial Sequence
  Description of Artificial Sequence: Synthetic coding sequence
atgggctgctgcggctgcagcggcggctgcggcagcagctgcggcgggtgtgggtctggctgcggggggtgtggaagcggatgcggtggatgtgggagcggctgcggaggatccggttcgtcatgctgtgtcccagtgtgctgttgtaagccggtctgttgccgggtccccacatgtagttgttccagttgtgggaagggcggatgcggatcctcggggggaagcaaggggggctgtgggagttgtgggggctgtaaaggtggctgcggtagttgtggaggctctaaaggtggttgtggaagttgcgggggcagcaagggtgggtgtgggagctgtggaggttctaaaggaggatgcgggagtggatgtggagggtgcgggagcagctgctgcgtccccgtatgctgttgcaagcccatgtgctgttgcgtcccagcatgcagttgttcgtcttgtgggaagggtgggtgcggatcctgcggctgtagtaagggcgcatgcggaagttgtgggggcagcaaaggcgggtgcgggagctgcggcggatgtaaagggggctgcggtagctgcggtggttcaaaaggcggctgtggctctggctgcggcggttgtgggtcaggctgcggcgtccccgtctgctgttgttcctgctcaagttgtgggtcctgtgccggatccaaggggggttgtgggtcttcgtgcagccaatgttcgtgttgtaagccttgttgctgttccagcgggtgcgggtcaagctgctgccaatcttcatgctgtaagccatgttgttcccaaagcagttgttgcgtccccgtctgttgtcagtgcaagatctag

SEQ ID NO: 192310 - DNA, 510 bp, Artificial Sequence
  Description of Artificial Sequence: Synthetic coding sequence
atgggctgctgcggctgcagcggcggctgcggcagcagctgcggcggatgtgatagtagctgtgggtcctgcggatccggctgccgcgggtgcgggccttcctgctgtgctcccgtatattgctgtaagccggtctgctgttgtgtgccagcctgttcatgctcatcttgtggcaagcggggatgtgggagctgtggggggtccaagggcggatgtgggagctgcggctgctcccagtgtagctgctgcaaaccctgttgttgctcctccggctgtggaagctcttgctgccagtgcagttgctgtaaaccctattgcagtcagtgttcttgttgtaagccatgctgcagctcctctggtagaggaagctcatgctgtcagtccagctgttgtaaaccttgctgttcctcaagcggctgcgggagctcttgttgtcaaagctcttgctgcaagccctgctgtagccagtctaggtgctgtgtccccgtgtgttaccagtgtaagatttag

SEQ ID NO: 192311 - DNA, 1740 bp, Artificial Sequence
  Description of Artificial Sequence: Synthetic coding sequence
atgtgcgaccagcagcagatccagtgccggctgcccctgcagcagtgctgcgtcaagggcccgtctttctgttccagtcaatccccttttgcccagtcgcaggtggtggtgcaggcaccttgtgagatgcagatcgtggactgtccggcaagctgtcccgtgcaggtgtgccaggtgagcgaccaagccccctgccagtctcaaactacacaggtcaaatgccagagcaagaccaagcaggtgaaaggtcaagctcaatgtcagagcaaaaccacgcaagtaaaaggacaggcggccagccagtcccagacctctagtgtgcaatctcaagccccttgccagtccgaagtgagttatgttcagtgcgaagcatcccaacctgtacagacctgttttgtggagtgtgctccagtctgttataccgaaacttgctacgtggaatgcccagtgcagaactacgttccctgtcccgccccacagccggtgcagatgtatcggggccggcctgccgtgtgtcaaccccagggccgattttcaacccagtgtcagtatcaagggagctacagcagctgcggcccccaatttcagagtagggccacttgcaataactatacgccacagttccagttgagacctagctacagctcatgttttcctcaatatcgctcccgcacctcattcagtccctgcgtcccacagtgtcagacccagggctcatacggcagcttcaccgagcagcaccgatcccggtctacctctaggtgcctgccacctcctcgccgattgcaactatttcctcggtcctgtagcccaccgcgtcgttttgagccatgttcttcctcctacttgccactgagaccatccgaaggcttcccaaactactgtacacctccccggagaagtgagcccatttacaattcgaggtgccccaggaggccaattagctcttgtagtcaaagaaggggccccaaatgccgtatagaaatctcatccccatgctgcccacggcaggtgcccccacagaggtgtcccgtggaaatcccccctattcgccgccgcagccagtcttgcgggcctcagccatcctggggcgcttcttgcccggaactaagaccccatgtcgagcctaggccattgccaagtttctgtccaccgcgccgactcgaccagtgtccggaaagtccgctccagcggtgccctccccccgccccacgaccgcggctgcggccggagccgtgcatcagtctcgagccaagacccaggcctctgcccaggcagctgagtgagccatgcttgtacccggagcctctgccggctctgcgaccaacacccaggccggtgcccctgcctcgaccagggcagtgcgaaatacccgaaccaaggccatgcctacagccctgcgagcacccggagccttgccctcggccggagcctattccgttgccagccccttgtccctcaccggagccgtgcagggagacctggagatctcccagcccctgttggggcccaaatccagtgccgtatcccggggatctaggatgccatgagtcttccccacaccggctggacactgaagctccatactgtggacctagctcctacaaccagggccaggagtctggagctggctgcgggcctggggatgtctttccggaacgcaggggacaggacggacacggagatcaaggcaatgcatttgccggagtaaagggcgaggctaagagtgcctatttttag

SEQ ID NO: 192312 - DNA, 1059 bp, Artificial Sequence
  Description of Artificial Sequence: Synthetic coding sequence
atggccggcaccatctgcttcatcatgtgggtgctgttcatcaccgacactgtgtggtctaggtctgtgaggcaggtctatgaggtacatgatagtgatgactggaccattcacgactttgagtgcccaatggaatgcttttgccctccctccttcccaactgccctgtactgtgagaatcggggactaaaggagatacctgccattccgtctaggatctggtacctgtacctgcaaaataatctgattgaaacaattcccgagaaaccattcgagaatgctactcagctgagatggattaacttgaacaaaaataaaatcacaaattacggtattgaaaagggtgccctttcacaactgaaaaagctgctgttcctgttcctggaagacaatgagctggaagaggtccctagccctctgccaaggagccttgaacagctgcagctggctagaaacaaggtgagcaggataccccaggggacattctcaaatctggaaaacctcacattgttagacttgcagaacaataaactggtcgacaatgcgtttcagagggatacgttcaagggtttaaagaacctgatgcagctgaacatggccaaaaacgccttgcgcaatatgcccccacggctgcctgccaataccatgcagttgtttctggacaataactctatcgagggaattcccgagaactattttaatgtgatcccgaaggtggccttcctacgcctgaaccataataaactctccgatgaaggtttgcccagtcgaggcttcgacgtgtcgagcattttggacctgcagttgtcacacaatcagttaaccaaggtgccccgcatcagcgcgcacctgcagcatctccatctggatcataacaagataaaatctgtcaatgttagtgtgatttgtccttcaccctcaatgctgcccgcggagagagactcattcagctacggacctcacctccgatatctcaggctggacggcaatgaaataaagcctcccataccaatggctctcatgacctgctttcgcctgttgcaggctgtgattatatag

SEQ ID NO: 192313 - DNA, 897 bp, Artificial Sequence
  Description of Artificial Sequence: Synthetic coding sequence
atggaggagaagcagatcctgtgcgtgggcctggtggtgctggacgtgatcagcctcgttgacaaatatccaaaggaggactcagagattagatgcctgtcccagaggtggcagcggggcgggaatgcatcaaatagttgtacagtgctctcactgctgggcgcaccatgtgcctttatgggctccatggcccccggtcatgtcgctgactttcttgtcgctgatttccggcgcagaggtgtagatgtatcacaggtggcatggcagagcaaaggagacaccccaagctcttgctgtattattaataattccaacggcaacaggaccattgtccttcacgacactagcctgcccgacgtctcggccaccgatttcgagaaagtggacctaacccagtttaagtggattcacatcgaggggcgcaacgcctcagagcaggtgaaaatgcttcagcggattgacgcccacaacacaagacagcctcctgagcaaaaaattagggtgtcagtggaggtcgagaaacccagagaggagctctttcaactcttcggctatggggacgtggtgtttgtgagcaaggatgtcgccaagcaccttggattccaaagtgctgaagaagctctacgcggcctctacggcagagtgcgaaagggagccgtgctggtatgcgcttgggccgaagaaggcgctgacgctctcggccccgatgggaagttgctgcatagtgatgcgttcccgcctcctcgggtggtggacacccttggcgccggtgatacttttaatgcctcagtgattttttccctgagtcaggggagatctgtgcaagaggccctgcgctttggctgtcaagtcgccggaaaaaaatgcggtttacaggggttcgatggcatcgtgtag

SEQ ID NO: 192314 - DNA, 897 bp, Artificial Sequence
  Description of Artificial Sequence: Synthetic coding sequence
atggaggagaagcagatcctgtgcgtgggcctggtggtgctggacgtgatttcactagtggacaagtacccgaaggaagattctgaaatccgctgcctgagtcagcggtggcagcgggggggtaacgccagcaactcgtgtaccgtattatctttactcggcgcgccatgcgcctttatgggtagcatggctcccggccacgttgcagatttcgtgctcgatgacctgaggcggtactccgtggacctgagatatacagtgtttcaaaccacaggaagtgtgccgatagccaccgtaatcataaatgaggccagcgggtctcggacaatactgtactatgaccgaagtctgccagatgtatctgcaaccgattttgaaaaggtggatctgacacagttcaagtggatccacatcgagggacggaatgcctccgaacaggtgaaaatgctgcagcgcattgacgcccacaacacgaggcaaccacccgagcagaaaatacgcgtgagcgtggaagtagagaagcctcgggaggagctgttccagcttttcggctacggtgacgtggtgtttgtctccaaggatgtcgctaagcacctcggtttccaaagtgcggaggaggcgctaagaggcctctatggtagggttcgcaagggcgctgtgcttgtttgcgcatgggccgaagagggggccgatgctcttggcccagatggcaagctcctgcactccgatgcatttccccctccacgtgtggttgacaccctgggggctggcgatacattcaacgcatccgtcattttcagcctctcacaggggaggtctgtgcaggaagcccttcgtttcggttgtcaggtagccggtaaaaagtgcgggctgcagggattcgacggtatagtgtag

SEQ ID NO: 192315 - DNA, 1041 bp, Artificial Sequence
  Description of Artificial Sequence: Synthetic coding sequence
atggaggagaagtacctgcccgagctgatggccgagaaggacagcctcgacccaagctttacccacgcactgcgactcgtaaaccaagagatcgaaaagttccagaagggggaaggaaaagatgaagaaaagtatattgatgtggtcatcaataagaacatgaagctgggccagaaagtgcttatacctgtcaagcaattccccaaattcaatttcgtggggaagctgctggggcctaggggtaactccttgaagcggcttcaagaggagacacttaccaagatgagtattctaggcaagggctccatgagggataaggccaaagaagaggagctaaggaagtcaggggaagctaaatacttccatttgaatgacgatctgcacgtgctcatcgaagtcttcgcccctccagcagaagcctatgcccggatgggtcacgccctggaggaaattaagaagttccttataccagactacaacgacgagattcgccaggcccagttacaagagctgacttatctaaacggaggctcagaaaacgcggatgtgccggttgtgcggggcaagcccacactgcgtactcgtggggtcccagcccccgccatcacccggggccggggtggggtgactgcccgacccgtaggcgttgtggtgccccggggtacgcctactcctagaggagtgttgagcactagagggcctgtctctagaggcagaggcttgcttacccctagggcccggggtgtccctcccaccggctatagacccccccctccacctccaacccaggaaacatatggggaatacgactacgacgatgggtacggcacagcctacgacgaacagagctacgactcgtatgacaatagttattcgactccagcccagagcggggcggactattacgattatggtcatggtctgtctgaagaaacttacgactcgtacggccaagaggagtggaccaactcccggcataaagccccctccgcccggaccgccaagggagtgtaccgcgaccagccctacggcaggtactag

SEQ ID NO: 192316 - DNA, 495 bp, Artificial Sequence
  Description of Artificial Sequence: Synthetic coding sequence
atggacatgggcaccagcgccctgagcaagaagccctggtggaccctcccgcagaatttccacgcccctatggttttccatatggaggaggaccaggaggagctgatattcggtcatggcgacacttacctccggtgcatcgaggtgcattcacacactctcattcagctggaatcttggtttaccgcaaccgggcagacacgagtgaccgtggtgggtcctcaccgtgccaggcagtggctgttgcacatgttctgttgtgtcggcagccaggactcgtaccaccatgcccgcggactggaaatgctggaacgagtgcgctcacagcccctgacgaatgatgacctcgttactagtattagtgtccccccctataccggcgatctgagtctcgcacctagaatcagcggaactgtgtgcctgtcagtgccacagccctccccataccaggtcataggctgtagtggcttccatttaagtagcctgtacccttag

SEQ ID NO: 192317 - DNA, 714 bp, Artificial Sequence
  Description of Artificial Sequence: Synthetic coding sequence
atgctgagcgccttccagcggctgttccgggtgctgttcgtgatcgaaactgtctctgaatatggcgtcctaatctttatttacgggtggccctttctgcagacactggcaatgctgttaatcggaaccgtctccttccacttatggattcggagaaatcgcgagagaaatagtagaagtggaaaaacccggtgcaggtcgaagaggtccgagcagagcatggatatgggcacttccgctctgtccaaaaaaccctggtggactctaccacagaatttccacgcacccatggtgtttcatatggaggaggaccaggaggagcttatattcggtcacggtgatacttacctgcgatgcatcgaggtgcatagccacaccctgatccagctggagtcttggtttaccgccacaggacagaccagggtgaccgtcgtcgggccgcacagagcccggcagtggctgctccatatgttctgttgtgtgggttcacaggattcatatcaccacgcacgcggattggagatgttggagagagttaggagtcagccgttgaccaatgacgatttggtgacatccatcagcgtcccaccctacactggcgacctgagcttggcgcctagaatttctggaaccgtatgcctgagtgtgccccagcccagtccataccaggtcatcgggtgtagcggattccatctatccagcctgtacccttag

SEQ ID NO: 192318 - DNA, 297 bp, Artificial Sequence
  Description of Artificial Sequence: Synthetic coding sequence
atggacatgggcaccagcgccctgagcaagaagccctggtggaccttgcctcaaaattttcacgcccctatggtttttcacatggaggaggaccaggaagagcttattttcggccacggcgacacatatttgcgatgtatcgaagtccacagtcatacactgatccagctggaatcatggtttaccgcaacgggccaaacacgggtgaccgtagtcggcccacaccgggcacgacagtggctcctgcacatgttctgctgtgtgggcagccaggatagctatcaccatgctagatag

SEQ ID NO: 192319 - DNA, 2133 bp, Artificial Sequence
  Description of Artificial Sequence: Synthetic coding sequence
atgagcgactacagcaccggcggccccccccccggcccccccccccctgccggcggcgggggtggcgctggcggggccgggggagggcctccacccggcccgccaggggccggagatagaggtggagggggacctggcggcggcggacctggtggcgggtccgcagggggacccagccaacctcctggcggcggggggcctggaattaggaaggacgcgttcgctgatgccgtccagcgagctcggcaaatcgccgccaagattgggggcgacgctgccacgaccgtgaacaatagtaccccagatttcggcttcggaggacagaaacgccagctggaagacggggaccagcccgagtctaagaagttagcttcccagggcgactctatcagtagccagctgggccccatccatcccccccctaggacctctatgacagaagaatatcgggtgcccgatggcatggtcggactcatcatcgggcgggggggggaacagataaataaaatacagcaagatagtggttgtaaagtgcaaatctcccctgattcggggggcctacccgaaagaagcgtgagcctgacaggcgccccagaatccgtgcagaaggccaaaatgatgctggatgacatcgtctctcgaggtcgaggcggtcctcctgggcagttccacgataacgccaatggcggccagaacgggactgtccaggagattatgattcctgccggaaaggccggtttagtgataggtaagggaggagagacgataaagcagctccaggagcgggctggggtgaagatgatcttaattcaggatggctcccagaacacgaatgtggacaagcccctgcgcataattggagacccctataaggtccaacaggcatgcgagatggtgatggacatcctcagagagcgagaccaagggggatttggcgatagaaacgaatatgggtctcggatcggaggagggatcgacgtgcccgtccccagacactctgtaggtgtggtaatcggacggagcggcgaaatgattaagaaaatacaaaatgatgctggggtacgtatccagttcaagcaggatgacggaaccggacccgagaaaatcgcccacattatgggtcctccagataggtgtgagcatgccgcgcggattataaacgacctcctgcagtcactgcggtccgggccccccggacctcctgggggaccggggatgcctcctgggggaagaggacgcggtcgcggccaggggaattggggtccgccaggaggcgagatgacattttcaatcccaactcataaatgtggcctagttatagggagaggcggtgaaaatgtgaaggctatcaaccagcaaactggggctttcgtggagatttcccgacagctacctcctaacggtgatcccaattttaaactcttcattattagagggagtccacagcagattgatcatgccaaacaactgatcgaggagaaaatcgaaggaccactctgtcccgtgggtcccgggcccggggggcctgggcccgctgggcctatgggaccattcaatccaggtcctttcaaccaggggcccccaggagcccctccacacgctggcggccctcccccacaccagtaccccccacaaggttgggggaacacgtatccacagtggcagcctcccgcacctcatgaccccagtaaggccgccgcagcagcagcggatcctaatgctgcctgggctgcttactacagtcattactaccagcagcctccgggccctgtgccgggacctgcacctgctcccgccgcacctccagcgcagggtgagcccccgcaacctcctcccactggccagagcgattatacgaaggcctgggaggagtattataaaaaaatcggacagcagccccagcagccgggagcccccccacaacaggactacacaaaagcgtgggaggagtactataaaaaacaggctcaggttgctactggcggcggtcctggtgcaccgcccgggtttctggcccctccgactgtgttccagcccctgcttagttctgccctggcacaactgccccgtccaaggccttctcctctccctgggctggtatgttgtctctttatctgctcccggggtgattag

SEQ ID NO: 192320 - DNA, 2136 bp, Artificial Sequence
  Description of Artificial Sequence: Synthetic coding sequence
atgagcgactacagcaccggcggccccccccccggcccccccccccctgccggggggggaggcggcgctggtggagccggagggggcccccctcccggaccacctggtgcaggggacaggggcggcgggggcccgggaggcggagggccaggcggcgggtccgccggaggccctagtcaaccgccaggagggggtggtcctgggatacgcaaggatgccttcgctgatgccgtccaaagagcccggcaaatcgccgccaagattgggggagacgccgcaacaacagtgaacaattctacccccgacttcggcttcggaggccagaagagacaactggaagatggggatcagcccgagtcaaagaaactggcatcgcagggagactcaattagtagtcaattggggcctatacatccacctcctcgaaccagtatgactgaagagtacagagttcccgacggcatggtaggactgataattggccgtggcggcgagcaaattaacaagattcagcaagacagcgggtgtaaggtccaaatcagtcctgacagcggaggcctgccagagagaagcgtgtcattgaccggggcccctgagagcgtgcagaaagcaaaaatgatgttagacgatatcgtgtccagagggagaggcgggcccccgggacagttccatgataatgccaatgggggacagaacggcacagtgcaagaaattatgatccccgcgggaaaggctggcctggtgattggcaagggcggagagacaatcaagcagctccaggaaagggccggggtaaagatgatcctgatccaagacggatcccagaatactaacgttgacaaacctctgcggataattggcgacccttacaaggtgcaacaagcatgtgagatggtcatggatattctcagagaaagggaccaaggaggattcggcgatagaaacgagtacggcagtaggattggtggaggtattgatgtacccgttcctcgccactctgtgggcgttgttataggtcgaagcggtgaaatgattaaaaagattcaaaacgacgccggcgtgaggattcaatttaagcaggacgacggcactgggccagagaagatcgcacacattatgggacctccagaccgctgcgagcacgccgcaagaattatcaatgacctactgcagagtctgagaagcggccctcccggcccgcccgggggacccgggatgccacccggtggacgcgggcgcggccgaggacagggcaactggggacctcctggaggagagatgacattctctatccctactcataagtgcggcctcgtgattgggcgaggcggagaaaacgttaaagccatcaaccagcaaacgggcgctttcgttgagatttcgcgtcagctgccacccaacggagatcccaatttcaagttgttcatcataagggggtcgcctcagcagatagaccacgcaaaacaactgattgaggaaaagatcgagggccccctgtgcccggtcggacccgggccaggcgggcctggtccagctggccccatgggcccctttaacccagggccatttaaccagggaccccccggggcccccccacatgctggggggccgccccctcaccaatacccaccacagggctggggaaacacatacccccaatggcaacccccagcccctcacgaccctagtaaggcggctgccgctgccgctgaccctaacgccgcctgggcagcctactattcccactactaccagcagcctccaggccccgtgcccggccctgctcctgcacccgcagcaccccctgcacagggggagcctccccaacctccgccaaccgggcagagtgattatacaaaagcttgggaagagtattacaagaagatcggccagcagcctcagcagcccggggctcccccacagcaagactatacaaaagcatgggaagaatactataagaagcaggcacaagtggctaccggtggaggccctggggcgcccccaggttctcaacccgactatagcgcagcatgggcagaatattatcggcaacaggcagcctattacggacagaccccaggccccggaggacctcagccaccccccacccagcaggggcaacagcaagcacagtag

SEQ ID NO: 192321 - DNA, 1095 bp, Artificial Sequence
  Description of Artificial Sequence: Synthetic coding sequence
atgagcgactacagccccggcggcggcagcgccggcggccccagccagccacccggtgggggcggcccagggatccggaaggatgccttcgccgacgccgttcaacgggccaggcagatcgctgctaagattggtggcgatgcagccacaacggtgaacaattctacaccagactttggcttcggtggccagaagcgccagctcgaagatggagaccaaccagaaagcaaaaagctggcatcccaaggagacagtatctcctcccaattaggccctatccaccctccacctcgaacatctatgaccgaggaatatcgggtgccagacggaatggtgggcctgataatcggcaggggcggggagcagataaataagatccagcaagatagtggttgcaaagttcagatttccccagattccggcgggttacctgaacgcagtgtgtccctgacaggggcacctgagtccgttcagaaggctaagatgatgctggacgatatcgtttcaagaggccggggcgggccccccggccagttccacgacaacgcaaatggtggacaaaatgggaccgtacaggagatcatgattcccgcgggcaaagctggtctggttattggcaagggaggagagacaatcaagcagcttcaggagagggctggcgttaaaatgattctaattcaggacggatcgcagaatacaaatgtggacaagcctcttcgcatcatcggagacccgtataaggtacaacaggcatgtgagatggtcatggatattcttagggagcgcgatcaggggggattcggcgaccgcaacgagtacgggagcaggatcggtggtggcatcgatgtccccgtaccccgccactccgtgggcgtggtaattggaagatctggcgaaatgatcaagaaaattcagaacgatgctggtgtgcgcatccagttcaagcaggatgacgggacagggccagagaaaattgcacacataatgggtcctcccgacagatgcgagcacgcagcgaggatcattaacgatccatcctctagttcattccttctgcccacacccggtcataggcccagttgcctgtccggctag

SEQ ID NO: 192322 - DNA, 255 bp, Artificial Sequence
  Description of Artificial Sequence: Synthetic coding sequence
atggacgacgacgccgccccccgggtggagggcgtgcccgtggccgtgcacaagcatgccctgcacgacgggctgcgccaggtggcaggccctggagctgctgctgcacacttaccccgttggccaccgccacaattggctgcaagccggcgcgaagcccccccgctgagccaacgtccacatcgcacgcaaggcgccggatctcctcccgagacaaacgaaaagctgacaaacccacaggtgaaggaaaagtag

SEQ ID NO: 192323 - DNA, 822 bp, Artificial Sequence
  Description of Artificial Sequence: Synthetic coding sequence
atgagcatgagccccaccgtgatcatcctggcctgcctgggcttcttcctggatcagtcagtatgggcccatgtgggaggtcaggacaagccgttctgctccgcctggccgtccgccgtggtaccgcaaggcgggcacgttactcttcgctgccattacagacgcggatttaacatctttaccctttataagaaagacggtgtgccagtcccagagctctataatcgcatcttttggaacagcttccttatctctcccgtcaccccggcccacgccggaacatatagatgtagagggtttcatcctcactcacctacagaatggagcgcaccttcaaacccgctggttatcatggtgacgggtctctacgaaaagcccagcttgactgccagacctggccctacggtgcgggcgggagagaatgtgactttgagctgcagctcccagtcttcattcgacatataccatctgtcaagggaaggcgaagcccatgaactgcggttacctgccgtgccgtctattaacggtacatttcaggctgactttccacttggtccagccactcacggcgaaacttacagatgttttggatcatttcatgggtcaccctacgagtggagtgatccgtcagatcctcttcccgtatcagtaacagggaatcccagtagttcctggccctcccccaccgagccctccttcaaaactggcattgctagacatctccacgccgtcatccgatacagtgtggccatcattctttttaccatccttcccttcttcctgcttcacaggtggtgtagcaagaaaaagatgctgctgtag

SEQ ID NO: 192324 - DNA, 1269 bp, Artificial Sequence
  Description of Artificial Sequence: Synthetic coding sequence
atgggcggccaggacaagcccttcctgagcgcctggcccagcgccgtggtgccccgcggcggtcacgtaacgctgagatgtcactatcgccacaggttcaacaacttcatgctctacaaagaggatagaatacacatccccatcttccacggccgcatatttcaggaatcattcaatatgagccctgtcacaacagctcatgctgggaactacacatgccgcggctcacatccgcacagtcccactgggtggtccgctccctcaaaccctgtggtgattatggtcaccggcaatcaccggaaacctagtctgctggcgcacccagggcctcttgttaagtcaggcgagcgagtaattctccagtgctggagcgacatcatgttcgaacattttttcttgcacaaagaagggatatcaaaagatccgagccggctagttgggcagattcacgacggcgtgtccaaagcaaactttagcataggtcctatgatgctcgcactggctgggacttaccggtgctacggatcagtgacccataccccatatcagcttagcgctccaagtgatccccttgacatcgtagtcactgggccttatgagaaaccttctctatccgcacaacctgggcctaaggttcaagcaggcgagtcagtgacactcagctgctccagtcgtagttcgtatgacatgtaccacctgtcaagggaaggcggcgctcatgaacgtcggctgccagctgtgcgtaaagtgaaccgaacattccaggcagacttcccattggggccagctacgcatggcggcacgtaccggtgttttggctcattcaggcattctccctacgagtggtccgatccctccgatccgctgctggtgagcgttacaggaaacccgagctccagctggccaagcccgactgagccctcatctaagtcagggaatccccgtcacttgcacatcttaatcggaacatctgtggtgattatcttatttatcttgcttctcttttttctgcttcatctttggtgtagcaacaaaaagaacgccgccgtcatggatcaggagccggcaggtaatcgaacggccaactccgaagacagtgacgagcaggacccggaggaagtgacctacgctcagttggaccactgcgtgttcacccaaaggaagatcacacggccgtcccagcgtcccaaaactcctcccacagatactattctttacaccgagcttcccaatgcgaaacctcgttctaaagtggtatcatgtccctag

SEQ ID NO: 192325 - DNA, 1050 bp, Artificial Sequence
  Description of Artificial Sequence: Synthetic coding sequence
atgagcctgatggtggtgagcatggcctgcgtgggcctgttcctggtgcagagagccggaccccacatggggaatcaccgcaaaccgtcactactggcccatcccggacccttagttaagtccggcgaacgcgtcatcctacaatgctggtctgatatcatgtttgagcacttttttctgcataaagaggggattagcaaagacccgtctcgtttggtgggacaaatccacgacggcgtgagcaaggccaacttttcaatcggtcctatgatgctggccttagccgggacctacaggtgttacggatctgtgacccatactccttatcagctatccgctccctctgaccccctggatatcgtagtgaccgggccatacgaaaaaccgagcctgtccgcgcagccaggccccaaagtgcaagccggggagtccgttactctcagctgctcaagccgctccagttatgatatgtatcacctgagccgagagggcggggcccatgagaggcggctgcctgcggtcagaaaggtgaatcgaacatttcaggccgatttccctctcggtccagccacccatggaggcacctatcgttgtttcggaagttttagacacagcccctatgaatggagcgacccatctgaccccctcctcgtctctgtgaccggcaacccttcctctagttggccttcacccaccgagccatccagtaagagcggaaaccccagacatcttcatatcctaatcgggacttccgtcgtgatcattctattcattctgctcctgttcttcctcctccacctgtggtgctccaataagaaaaacgcagcagtgatggatcaagaaccagcaggaaatcgcaccgctaattcggaggattcggatgagcaagaccctgaagaggtgacctatgctcaactggaccattgtgtgttcacacagagaaaaataaccagaccctcacaacgccccaaaacacctccaacagatacaatcctatacacagaactccctaacgctaaaccccggtctaaagtggtctcatgcccgtag

SEQ ID NO: 192326 - DNA, 1335 bp, Artificial Sequence
  Description of Artificial Sequence: Synthetic coding sequence
atgagcctgatggtggtgagcatggcctgcgtgggcctgttcctggtccagcgggccgggccacacatgggaggccaggataaaccctttttgtcggcctggccttctgcagtggtcccacgggggggacacgtcaccctgcggtgccactacagacaccgatttaataacttcatgctgtacaaggaggaccggatacacatacccatctttcatggaagaatctttcaggagtcattcaatatgagcccagtgacgacagcccacgcaggaaactatacttgtcggggctcacatccgcattctcccaccggatggagtgctccctcaaaccccgtcgtgatcatggtgactggcaatcatcgtaaacctagcctgctggcacatcccggacctttggtcaaatctggagaacgggtcatacttcagtgttggagcgatatcatgttcgagcattttttcttgcacaaggagggcatttccaaagatccttcgcgcctggtgggccaaatccatgacggcgtcagtaaagcgaatttcagtattggtcctatgatgctggccctggctggcacttaccggtgctatgggagtgttacccataccccttatcaattgagcgcaccaagcgatcccctggacatcgtggttactgggccatatgagaagcccagcctgagcgctcagccaggccccaaagtgcaagccggggaatctgtgaccctctcatgttcctctcgttccagctacgacatgtaccacctcagcagagaagggggagcccatgagaggcgcctgcctgcagtgaggaaggtaaacaggacctttcaggccgactttccgctgggacccgccacgcacgggggaacctacaggtgctttggtagttttaggcattcaccctacgagtggagcgatccttccgacccactactcgtctcggtcactggaaacccgagttcttcttggccttcccccacagagccctcctctaaaagcgggaatccacgccatttacatatcctcatcggcacctccgttgttattattctgtttattctcttattgttttttctgctgcacctgtggtgctccaacaagaagaacgctgcagtaatggaccaggagcccgctggtaacaggacggcgaattcagaagacagcgatgaacaggatcccgaagaggtgacttatgcccagctcgatcactgtgtttttacccagaggaagattacccgcccctcacaaaggccaaagacaccacccacagatactattttatacaccgagctgcctaacgccaaaccgcggtcaaaggttgtctcctgtccgtag

SEQ ID NO: 192327 - DNA, 1368 bp, Artificial Sequence
  Description of Artificial Sequence: Synthetic coding sequence
atgagcctgatggtggtgagcatggcctgcgtgggcctgttcctggtgcagcgtgctgggccacacatgggaggacaggataagcccttcctatctgcctggccttcagccgtcgtgccgcggggcggccacgtgaccttgaggtgtcattataggcacaggtttaacaattttatgctgtataaggaagatagaatccacattcccatctttcacgggagaatctttcaggaatctttcaatatgtcccccgttacaaccgcccatgccggcaactacacatgcagagggtcacacccccattccccaaccggttggagtgcacctagcaaccctgtggtcataatggtgactggcaatcaccgcaaacctagcttgcttgcccatccgggccctctggtcaagtcaggggaacgcgttatcttacagtgctggagtgacattatgtttgaacactttttcctgcataaagagggaatttctaaagatccgtctcgtctagtgggccaaattcacgatggagtgtccaaagccaatttttcaatcggccctatgatgctcgcactcgctggaacttatcgctgctatgggtccgtcacccatactccctatcagctgagcgctccatctgacccattggacatcgtagtaaccggaccctacgagaagccgtctctatccgcccagcctggccccaaagtccaagccggagagtcagtgaccctgtcttgctcgagcagatcaagttacgacatgtaccatctcagtcgcgagggcggagcccacgagcgtcgcctgcccgccgtaagaaaagttaataggacattccaggctgactttccactggggccggcgacccacgggggtacctaccggtgttttggtagtttcagacatagtccctacgagtggagtgacccttcagaccctctcttggtgtcagtgaccggaaacccaagttctagctggccatctccgacagagccctcatcgaaatcaggaatctgccgccaccttcatgtcctgataggcacgtccgtagtgatcttcctctttatacttttactcttttttcttctctatcggtggtgtagcaacaaaaagaacgcagccgtaatggatcaagagcctgcaggggaccggacagtcaaccgacaagactcagatgaacaggatccacaagaggtgacctacgcacagcttgatcattgtgtcttcatacagagaaaaattagtcggccatctcagagacctaaaacaccccttacggatacatccgtgtacaccgaattgcctaatgccgagccccgctctaaggttgttagctgccctagggcccctcagtcgggcctggagggagtcttctag

SEQ ID NO: 192328 - DNA, 1335 bp, Artificial Sequence
  Description of Artificial Sequence: Synthetic coding sequence
atgagcctgatggtggtgagcatggcctgcgtgggcctgttcctggttcagcgggccggccctcacatgggcgggcaggacaagcccttcctctccgcctggccgtccgcagtcgtaccgcggggagggcacgtcactctgagatgccactatcgccataggtttaataattttatgctgtataaagaagatagaatccatattcccatattccacgggagaattttccaagagtcatttaatatgagcccagttacgactgcccacgcaggcaactatacctgccgggggtcacatccccatagcccaaccggttggtctgctcccagcaaccctgtggtgattatggttacgggtaaccatagaaagccttcccttctggcccatccggggccactggtgaagtctggggagcgtgtgatactgcagtgttggagcgacataatgttcgagcatttcttccttcacaaagaaggaatcagtaaagatccatcaaggctggtgggacaaatccatgacggtgtctccaaagcaaacttttctatcggacctatgatgctcgctctggctggcacctaccggtgctatggaagcgtaacacatactccctaccagctcagcgcccctagtgatcctcttgacatcgtggtcacgggcccctatgaaaagccttctctcagcgcgcagcccggtcccaaagtgcaagcgggggagtcagttaccctgtcctgttcatcgcgcagttcctacgacatgtatcacctttcaagggagggaggcgcccatgagcggcggctacccgccgttcgaaaagtcaataggacttttcaggccgactttcctctggggccagccacccacggagggacttacaggtgctttggctcttttcgtcactctccctacgaatggtcggacccttctgatcccctgctggtgtcagtgactgggaatccaagttcttcttggccctcgccaacggaaccttcctctaaaagcggtaacccgagacacctccacatactgataggcaccagcgttgtgattatcctattcattctccttctgttcttcctgctgcacctttggtgttctaataagaaaaacgcagctgtcatggatcaggagcccgcgggtaaccggacagccaatagcgaggactccgatgagcaggaccctgaggaagttacctatgcgcaattagaccattgcgtatttacacagaggaaaataacaagaccaagccaacggccaaaaacaccacccaccgatacaatcctgtacacagaactgccaaatgccaagccccgaagtaaggtcgtgtcctgcccgtag

SEQ ID NO: 192329 - DNA, 1284 bp, Artificial Sequence
  Description of Artificial Sequence: Synthetic coding sequence
atgagcctgatggtggtgagcatggcctgcgtgggcctgttcctggtgcagcgtgctgggccacatatgggtggccaagataagccttttcttagcgcctggcccagtgccgtggtgccccgtggaggccacgtgacgttgcggtgccattacaggcacagatttaataacttcatgctctataaagaagacagaattcatatacccattttccacggacgcatttttcaggagtcattcaacatgagtcctgttacgactgctcatgctggtaattacacatgccggggttcgcatccccacagcccaaccggatggagtgccccaagtaatccagtcgtcatcatggtgacaggtaatcaccgaaagccctccttgttggcgcaccccgggcccctggtgaagtccggggagagagtaattttacagtgctggtcggatataatgtttgagcactttttcctgcacaaagaggggatcagtaaggacccctctagactcgtggggcagatccatgatggagtgtccaaggctaatttttcaatagggcccatgatgcttgctctcgctggcacgtaccggtgttacggaagtgtcacacacacgccctaccagctttcggcgccctctgacccattagatatcgtagttacagggccttatgaaaagccaagtctctccgcacaacctggcccgaaggtccaggcaggcgaatccgtcacactctcatgctcctcccgcagctcctatgacatgtaccatctgagtagagaaggaggcgcccacgaacgtagactcccagctgtgcgtaaagtgaaccgaaccttccaagcggacttccccctggggcctgctacacatgggggcacctacagatgttttggttcattcaggcactctccttatgagtggtcagatccttccgacccgctgctggttagcgtgactggcaaccctcgccaccttcatatcctgatagggacgtccgtagtcatcatcctgttcatcctgctcctgtttttcctcctccatttgtggtgtagtaataaaaagaatgccgccgtgatggatcaggagcccgccggtaacaggacggcgaactccgaagatagtgacgagcaggatccagaggaagtcacctacgcccagctggaccactgtgtgtttacccagcgcaagatcacacgtccatctcagaggcccaagacacctcctacagacacaattctgtacactgaactgccgaatgccaaaccgcgatccaaagtagttagctgcccttag

SEQ ID NO: 192330 - DNA, 1368 bp, Artificial Sequence
  Description of Artificial Sequence: Synthetic coding sequence
atgagcctgaccgtggtgagcatggcctgcgtgggcttcttcctgttgcagggggcctggcctctcatgggtggccaagataagccctttctcagcgcacgaccaagtaccgtagtcccaagaggagggcacgtcgcactccagtgccactaccggcgcgggtttaataactttatgctttacaaggaggaccgctctcatgtcccaatcttccacggacggatctttcaggaaagttttataatgggccccgtgaccccagcacatgccgggacctatagatgtcgagggtctcgtccccatagcctcaccggatggtccgctccaagcaaccccctggttattatggttactgggaaccatcgcaaaccgtcccttctggctcaccccggcccactactcaaatctggcgaaactgtgattctgcagtgctggtccgatgtgatgttcgagcatttcttcctccatagagaaggcatctcagaggacccgagtcgtcttgtaggccagatacacgacggtgtttctaaggcgaacttttctattgggccgctgatgcctgtactggcaggcacatatagatgttacggctccgtccctcatagcccatatcagctgagcgcaccatcagacccgctggatatcgtgatcactggactgtatgagaagccttcgctgagtgcacagcccggtcctaccgtccaggctggagagaatgtaacgctcagttgtagttcctggagttcctatgacatctatcatttatcaagagaaggggaagctcatgagcgacgcttgcgcgcggtgccaaaggtgaatcggacttttcaagctgatttccctcttgggcctgcaactcacgggggtacatatcgatgttttggtagctttagggccctgccctgtgtttggagcaactcctcagatcctctgctggtatcagtgactggcaacccgtccagctcttggccaagtcccacagagccctcctcaaaaagtggaatctgtcgtcatctgcacgtgctgatcggcacaagcgtcgttatttttctcttcatactgttactgtttttcctgctgtaccggtggtgctccaacaagaaaaacgcagccgtgatggaccaggagcctgcaggcgaccggaccgtaaaccggcaggacagcgatgagcaggacccacaagaggtaacctatgctcagttagatcattgcgttttcatccaacgcaaaatctcgcggccctctcagcgtccaaagacccccctgaccgatacctccgtatacacagaattgccaaatgctgagccacgctccaaggtagtcagctgccccagagctccacagtctggcctcgagggtgtcttctag

SEQ ID NO: 192331 - DNA, 1047 bp, Artificial Sequence
  Description of Artificial Sequence: Synthetic coding sequence
atgagcctgatggtggtgagcatggcctgcgtgggcttcttcctgctccagggcgcatggccccacgagggcgtccaccggaaaccctctctgctggcccatcccggccgtctggtaaaaagcgaggagacagttatactgcagtgctggtcagatgttcgttttgaacattttttgctccaccgtgagggcaaatttaaagataccttacacttaattggggagcaccatgacggagtgtctaaagccaatttctctattggaccaatgatgcaggacctggctgggacttatagatgttacggcagtgtgacccacagtccataccagttatccgccccaagcgatccgctcgatatcgtaatcaccggcctgtacgagaagccgtctctgtctgctcagcccgggccaaccgtgctggcaggggagtctgtcaccctgagctgctcctccaggtcatcttacgacatgtatcacctgtcacgcgagggcgaagctcacgaatgtcgcttttctgctggccccaaagtgaacggcacttttcaagcagattttcccctggggccagccacccatggcggcacctacaggtgtttcggatcttttcgcgatagtccatatgagtggtccaacagttccgatccattactcgtatctgtgactgggaaccccagcaactcatggcctagcccaaccgaacctagtagtaagacaggtaatcctaggcacctccatattctgataggaacaagcgtggtcatcatcttgttcatcttgcttttttttctgctccatcgctggtgttctaacaagaagaatgcagccgtcatggatcaggaatcagctggcaatagaacagctaactcagaagacagcgatgaacaggaccctcaagaggtgacctacactcaactgaatcattgtgtctttacacagcgcaaaatcactaggcccagtcaacggcccaagaccccacccactgatattattgtctacaccgagctgccgaatgccgaaagtaggagcaaggtggtctcctgcccttag

SEQ ID NO: 192332 - DNA, 1128 bp, Artificial Sequence
  Description of Artificial Sequence: Synthetic coding sequence
atgagcctgatggtggtgagcatggcctgcgtgggcttcttcctgctacagggcgcttggcctcatgagggaggtcaggacaagccactgctgtctgcctggccttctgccgtggtgcccaggggcggacatgtcaccttgttgtgtcgctctcggctggggttcactatcttttccttgtataaggaagatggcgtgcccgttcccgaactgtacaacaagattttctggaagagcatactcatgggtcctgtgacccctgcacatgctggcacatatagatgtcgggggagtcatccaaggtcacccattgagtggtctgctcctagtaaccctctggttatcgtggtgaccggtttgttcgggaagccgtcgcttagtgctcagccaggtcctaccgttaggaccggggaaaatgtgaccctctcctgtagctctcgcagttctttcgacatgtaccatttgtctagggagggtcgagctcacgagccaagactgccagccgtaccatcagttaatggcactttccaggcagattttcccctgggacctgccacccacggaggtacatacacttgttttggatcgctgcacgactctccctacgaatggtcagacccctcagatccactcctcgtctccgtcaccggcaactcctcctcttcatcctcgtctcccaccgagccttctagtaagacaggcatccggcgccatctacacattcttattgggacaagcgtggctatcatattgttcatcatccttttcttctttctcctccactgctgctgttcaaataagaaaaacgccgcggtaatggatcaagagccggcaggcgacagaaccgtgaatcgagaagacagcgatgatcaggatccacaagaggtaacatacgcccaactagaccactgtgtgtttactcagaccaagatcacatcaccgagccaacggcccaaaactcccccaaccgatacaacaatgtacatggaactccctaacgcaaaaccacgaagtttgtccccagcccataagcatcattcccaagcattaaggggatcatctagagagaccactgctctgtcccagaaccgggtggcctcttcacatgtccccgccgccgggatctag

SEQ ID NO: 192333 - DNA, 1128 bp, Artificial Sequence
  Description of Artificial Sequence: Synthetic coding sequence
atgagcctgatggtgatcagcatggcctgcgtgggcttcttcctgttgcagggggcctggacccacgaaggcggccaggacaagccgctgctttcagcttggccatccgccgttgtcccgaggggaggacacgtcacgctgctctgtcgttctaggctcggatttacaatattttcgctgtataaggaagacggggtgcctgtcccggaactgtacaacaaaatattttggaagagtatactaatgggacccgtaacacccgcccacgcaggaacatatcggtgtcgcggcagtcaccctagatctcctattgagtggtccgcgccatctaaccctttggtgatcgtcgtaacgggcctgttcggtaagccatctctaagcgctcagccgggcccgaccgtgagaactggcgagaacgtaaccctctcatgttcctcacgatcgtcattcgatatgtatcatttgtcacgtgagggcagggctcatgagccgcgtctgccagccgttccctccgtgaacggaacctttcaggctgacttccctttgggaccagctacccatgggggaacatacacatgctttggaagccttcatgactctccttatgagtggagcgacccttcagaccccctcttagtctctgtgacaggcaattcatcctccagttccagctcaccaactgagccatcatctaaaacagggatccgccgccacctccacatcttaataggcacgtctgtagccattatcctgttcattatcctatttttctttctgctacattgttgctgctctaacaaaaaaaatgcagccgtaatggaccaagaaccagctggcgatagaaccgttaatagggaagactcggatgaccaagacccacaggaggtgacttacgctcagttggatcattgcgtcttcacgcagaccaaaatcacgtcaccatcacagaggccaaaaactcctcctacggacacaactatgtacatggagcttcccaatgctaagcctaggagcctgtctcctgcgcataaacatcactcacaggcgcttagaggctccagccgggaaacgactgctcttagccagaacagggtggcttcgagtcatgtgcccgcagcagggatctag

SEQ ID NO: 192334 - DNA, 1164 bp, Artificial Sequence
  Description of Artificial Sequence: Synthetic coding sequence
atgagcctgatggtggtgagcatggcctgcgtgggcctgttcctggtgcagcgagccggtcctcatatgggaggacaggataaaccgttcctctccgcctggcccagtgcagtcgttccacgaggaggtcatgttaccctgcggtgtcactatcgccatcggtttaacaactttatgctctacaaggaggaccgtatccacgtgcctatctttcatgggagaatcttccaggagggatttaacatgagtcccgtcacgaccgctcatgccggaaattatacttgccgcggtagtcatccccatagtcctaccggctggtcggccccatccaaccccatggttattatggttacaggcaaccaccgcaagcccagcctcctcgcgcaccccggacccctggtcaagagcggagagcgcgtaatcttgcagtgctggtccgacatcatgtttgaacatttcttcttgcataaggagtggatttcaaaggatccatcacgactggtggggcagattcatgatggggtatcaaaagcaaactttagtatcggctcaatgatgcgcgcactggctggcacctatcggtgttacggcagtgtgacccatactccctatcaattgagcgccccaagcgaccctctcgatattgttgtgactggactctatgagaagcctagcctttcagcacagcctgggccgaaagtacaagcaggcgaatctgtcaccctgtcctgctcgtcccgttcatcctatgatatgtatcacctgtcacgcgagggaggcgctcacgagcgccggcttcccgccgtgaggaaggtcaaccgcacttttcaggctgacttcccgctgggacccgctacacacggcggaacctatcgttgtttcggctccttccgccatagcccctatgaatggtctgacccatcagaccctttgctcgtcagcgtgaccggaaatccctctagcagctggccctcccctactgagccctcctcaaaatccggtaatctgcggcacctgcacattctgataggcacttctgtcgtgaaaattccctttacaatcttactgtttttcctgctgcatagatggtgttctaataaaaagaacgccgctgttatggaccaggaacccgctggtaataggtcggagcagcgcggattttag

SEQ ID NO: 192335 - DNA, 1149 bp, Artificial Sequence
  Description of Artificial Sequence: Synthetic coding sequence
atgctgctgatggtggtgagcatggcctgcgtgggcctgttcctggtccaacgtgccggccctcatatggggggacaagacaaacctttcctgagcgcttggccgtctgctgtggtaccgagaggaggtcatgtaaccctccggtgccattataggcaccgctttaacaatttcatgctgtacaaagaagatcgcatacacgtgcccatttttcacgggcgtatcttccaagaagggttcaacatgtcacctgtaactactgcccatgcggggaattacacctgtcgcggaagtcatccacacagtcctacaggatggtcagctccctctaacccaatggtaattatggttacaggcaaccacaggaagccatctctgctagctcacccagggcccttagtgaagagcggtgagcgagtgatattgcaatgctggagtgatattatgttcgagcacttcttcctacacaaggaatggataagcaaggatcccagccgtctcgtgggccagatccatgacggtgtttccaaggccaacttctcaatcggtagtatgatgagagccctggcgggaacgtaccgctgttacgggagtgttactcatacaccatatcagctttctgcccccagcgatccgttggacatagtggttaccggattatacgagaagccttcattgagtgcgcagccaggcccaaaggtgcaagcaggcgaaagcgtgacacttagttgcagttcgcggtcaagttacgacatgtaccacctgtctcgggagggaggcgcccacgaaagaagactccctgccgtaaggaaagttaatcgcactttccaggctgatttcccactggggcctgctacacacggaggcacgtaccgctgcttcgggtccttcaggcacagcccttatgaatggagcgaccccagcgatcccctcctcgtaagcgtcacaggaaacccgtctagcagctggccctcccccaccgaaccttcgtcaaagtctgggaacttgagacatctccacatcctcatcgggacgagcgttgttaaaattccttttacaatcctactatttttccttctgcacaggtggtgctctaacaaaaaaaagtgctgttgtaatgggccgcgtgcttgtagggagcagaagtag

SEQ ID NO: 192336 - DNA, 1194 bp, Artificial Sequence
  Description of Artificial Sequence: Synthetic coding sequence
atgagcctgatggtggtgagcatggcctgcgtgggcttcttcctggatcaaagtgtgtgggctcacgtggggggccaagacaagccgttttgttctgcatggccaagtgcagtagtaccacagggcggtcacgtgacactgaggtgccattgtagaagaggattcaacattttcacactctacaaaaaggatggtgtgccagtccccgagctttacaataggattttttggaactccttcttgatttccccggtaactcctgcccacgctggtacctacagatgccgggggttccacccccattcccccactgagtggagcgctccctccaatcctctcgtgattatggttacaggattatacgagaaaccgtcactgactgctcgccctgggccgaccgtgagggccggggagaatgtgacactgtcatgtagctcacaaagttcctttgatatctaccacctgagcagggaaggcgaggcccatgaactcaggctccccgccgtgcctagcattaacggcactttccaagctgacttcccattaggaccagccacgcacggagagacctatcggtgctttggctcattccacgggtcaccttatgagtggagtgatccttcagacccccttcccgttagtgttacagggaacccaagctcatcttggccatccccgaccgagccatctttcaaaacaggcatcgcccggcacctgcatgccgtgataaggtactcagtggccatcatactgtttacaattctgcccttcttcctcctacaccggtggtgttcgaagaaaaaggtctccctgacaaagcaaagacctgagaactcaggcccgtgcgccgaagctgggtgggagcatgctgacgccgccgtaatgaaccaagagccagcaggacatagaaccgtgaatcgggaggacagcgacgaacaagatccccaggaagtaacatatgctcagctggaccattgcatcttcacacaaagaaaaatcaccggaccctcccagcggtctaagcgcccaagcactgacacttccgtttgcatcgagctgccaaatgcagagccccgagccttgtcaccagcacatgaacatcacagccaagcattgatgggctcaagtcgggagaccacagcccttagtcagactcaattagcatcctccaatgtgcccgccgcaggaatttag

SEQ ID NO: 192337 - DNA, 1029 bp, Artificial Sequence
  Description of Artificial Sequence: Synthetic coding sequence
atgagcatgagccccaccgtgatcatcctggcctgcctgggcttcttcctggaccaaagcgtgtgggcacacgttgggggacaggacaagccattttgcagtgcgtggccctccgctgtggtcccacagggcggacacgtcacactgcgttgtcattgccggagggggtttaacatttttacactgtacaagaaggacggggtgccagtgcccgaattatacaatcgcatcttctggaactctttcctaatctccccggtcactcctgcccatgccggcacttatcgatgcaggggctttcatccacactcccctacagaatggtccgctccctctaaccctctcgtgatcatggtgaccggcctatacgagaaaccatccctgaccgctaggcccggacccaccgtgcgtgctggcgagaacgtgaccctgagttgctcttctcagtcctcctttgatatctatcacttgagccgggagggggaggctcacgagctgagactgccagccgtgccctctatcaatgggacgtttcaagccgattttcccctggggcctgctacccatggagagacatatagatgctttgggtctttccatggctccccttacgagtggagcgatccctcagatccactgccggtcagtgtgactggaaacccgagctccagctggccttccccaacagaaccatccttcaaaacagacgcggccgtcatgaatcaggagcccgcagggcacaggaccgtgaaccgcgaagattccgatgagcaggatccccaggaggtgacctacgcccagttggatcattgcatttttactcagcgcaaaattaccggcccatctcaaaggagtaagcgacccagtacagatacctcagtctgcattgaacttccaaacgcagagcccagagcactgagtcccgctcacgaacaccactcccaagcactgatgggtagctcccgcgagactactgccttgagccaaacccagcttgcttcctctaacgtgcctgctgcgggcatctag

SEQ ID NO: 192338 - DNA, 1083 bp, Artificial Sequence
  Description of Artificial Sequence: Synthetic coding sequence
atgagcatgagccccaccgtgatcatcctggcctgcctgggcttctttcttgatcagtcagtgtgggcccatgtgggcggtcaggacaaaccgttctgctccgcatggcctagcgccgtggtcccccagggcgggcacgttacgctccgatgccattgtcgtagggggtttaatatctttacactttacaaaaaagacggcgtccccgttcctgagctgtacaaccgtattttttggaattccttcctgatttctcctgtgacacccgcccacgccggcacatatcgatgtaggggcttccatccccacagccccaccgaatggtcagccccctctaaccccctggttatcatggttaccggactgtatgaaaagccatcactgactgctcgacccggacctacggtgagagccggcgagaacgtgacccttagttgcagttcccagagcagcttcgacatctatcatctgtcaagagagggggaggcccacgagctgcggttgccggctgttccctccatcaacggcacatttcaggccgacttccctctgggcccagccactcacggcgagacttacaggtgcttcggctcctttcatgggagcccatacgagtggagcgacccctccgatccactaccggtctctgtgacaggtatagcccgccatctgcatgcggtgattcggtattctgtggccattattttgttcactattcttccttttttccttctccacaggtggtgcagcaagaagaagaacgccgctgttatgaaccaggaaccagctgggcacaggacagtcaatagggaagatagcgatgagcaagacccacaggaagtgacctacgcgcaactggaccactgcattttcacccagaggaaaattactggaccatcccaacggagtaagcgcccatccacagacacaagcgtatgtattgaattgcccaacgcagagccaagagctctttctccagcacacgagcaccattctcaagccttaatgggatcctctagagagactacagcattgagccagacccagctggctagtagcaatgtcccagctgccggcatatag

SEQ ID NO: 192339 - DNA, 1134 bp, Artificial Sequence
  Description of Artificial Sequence: Synthetic coding sequence
atgagcatgagccccaccgtgatcatcctggcctgcctgggcttctttctggaccaaagtgtatgggcgcacgttgggggacaggataagcctttctgttccgcttggccatcagccgtggtcccccagggtggccatgtgaccctccgctgtcattgtagaaggggctttaatattttcaccctgtacaaaaaggacggcgtacccgtacctgagctgtacaatcgtatcttttggaacagcttcctgattagtccagtgacgcctgcccacgccggtacctatcggtgtcgtggctttcacccccactcacccacagaatggtcagcaccatcaaaccctctggtgattatggtgaccggattatatgaaaaaccatccctcacggctcgccctggccctactgtgagagcaggagagaatgtgactttgtcttgctcatcccagagcagcttcgatatttaccatctgtctagggaaggagaagcccatgagctgagactcccggccgtgccttctatcaatggtactttccaggctgacttcccgctgggacccgctactcatggcgagacttaccggtgtttcggttcctttcacggatcaccctacgaatggtcagacccctccgacccacttccggtgtctgttaccggcaacccatcatcctcctggccttcacctacagagccctccttcaagacaggaattgcccgtcatctgcacgccgttatccgctacagtgtggctatcattctgtttactattctccctttctttctattgcaccgttggtgcagtaaaaagaaaaacgcggccgttatgaaccaagagccagccggacacaggactgtcaacagagaggactcggatgaacaagacccacaagaggtaacttacgcccaactggaccactgtatcttcacccagcggaagatcacaggaccatcacagcggtctaagcggcccagcacagatacctctgtttgcattgagcttcctaatgccgagccccgagccctcagcccagcacacgagcaccattcacaagccctaatgggcagcagccgcgagaccaccgccctgagtcagacgcagctggcaagtagtaacgttcccgccgccgggatttag

SEQ ID NO: 192340 - DNA, 1233 bp, Artificial Sequence
  Description of Artificial Sequence: Synthetic coding sequence
atgagcctgatggtggtgagcatggcctgcgtgggcttcttcctgttggaaggtccctggccccacgtcggtggccaggacaagcctttcttgagtgcatggcccggtactgtagtgagcgagggacaacacgtcacattgcaatgtcgatctagattgggcttcaatgaatttagtctcagtaaagaggatgggatgcctgtcccggagctatacaacaggatatttcgaaattcgttcctcatgggtcctgtgactccagcccacgccgggacttaccggtgttgtagttctcatcctcactcaccaacgggatggtctgctcctagcaatcccgtagtgattatggtaaccggcgtgcatcgaaagccttcattactggcccatccaggacctcttgtgaaatcaggcgaaaccgttatccttcagtgctggtccgatgtgaggttcgaaaggtttttgctgcatagagagggaattactgaagatcccctaagactgattggtcagttgcacgacgccggctctcaggttaattattccatggggccaatgacaccggccctagccggcacctatcgctgttttggatccgtcacgcacctgccctatgagttaagcgctccatccgatccactggacatagttgtagtgggtctgtacggtaaacccagtctgtccgcacagcccggccccactgtccaagcaggtgaaaacgtcacactttcttgcagctcacggtccctattcgatatatatcacctgagccgtgaggctgaagccggcgagctgcgcctgacggccgtgctgcgagttaatgggacattccaggccaacttcccattgggccccgtgacacatggcggtaactataggtgcttcggttccttcagagctttgccccatgcctggagcgatccaagtgacccattacccgtgtctgtcacgggaaattcccggtatcttcatgcgcttattggcacctcggtggtaataattccctttgctatcttgctgtttttcctgttgcaccgctggtgcgccaacaaaaaaaacgctgttgtgatggaccaggagcctgctggcaataggaccgttaacagagaagactctgacgagcaagatccccaggaagtgacctatgcccagcttaatcactgtgtcttcacccaaagaaagatcactcggcccagccagcggcctaaaactcccccgaccgacacttctgtatag

SEQ ID NO: 192341 - DNA, 1047 bp, Artificial Sequence
  Description of Artificial Sequence: Synthetic coding sequence
atgagcctgctggtggtgagcatggcctgcgtgggcttcttcctgcttcagggagcctggcctcacgaaggggtgcaccgtaagccaagccttctagcacatccaggcaggctggtgaagtctgaggaaaccgtcattcttcagtgttggagcgatgtgatgtttgagcattttctgctgcaccgcgagggtatgtttaatgacaccctgaggctcattggggagcaccacgatggtgtttctaaagcaaactttagcatctccagaatgacacaggatctggccggcacctaccggtgctatggttcggtgactcactccccttatcaagtgagtgctcccagcgatcccctggacatcgttattataggtttatacgaaaaaccctctctctcagctcagcttgggcccaccgtactggccggcgaaaacgttactctgtcgtgttctagtcgctcttcctatgatatgtatcacctaagtagagagggcgaagcacatgagcgtcgcctgccagcaggcccaaaggtcaacgggacctttcaggccgactttccacttggcccggccacccatgggggtacttatcgctgtttcggcagctttcacgattcaccctacgagtggagcaaaagctccgatcccctcctcgtttctgtgactgggaatcctagtaattcctggccgtccccaactgaaccttccagtaagaccggcaacccacggcacctgcatatcctgattggtacaagcgtagtgatcatcttattcattcttctgttttttctgctgcaccggtggtgttccaataagaagaacgccgctgtgatggatcaggagtcagccgggaatcgaacagctaattctgaggattctgatgaacaggatccgcaggaagtgacatacactcagctgaaccactgcgtattcacacaaaggaagatcacaaggcccagccaaaggccgaagacaccgcccacagacataatagtatatacagaactacctaacgcggagagcagatctaaagtagtctcttgtccatag

SEQ ID NO: 192342 - DNA, 1026 bp, Artificial Sequence
  Description of Artificial Sequence: Synthetic coding sequence
atgagcctgatggtggtgagcatggtgtgcgtgggcttcttcctgctgcagggagcatggccacacgagggcgtccaccgtaaaccatcccttcttgcccatcccggaccattggtgaagtcagaggaaactgtcatcctgcagtgttggtccgacgtaagattccagcactttcttctgcacagggaaggcaaatttaaagatactctccacctcatcggggagcatcacgatggcgtctctaaagccaatttttctatcggcccaatgatgcaggatctcgctggcacataccggtgttacgggagtgtgacgcattctccctaccaactgagcgctccaagcgaccctcttgatattgttatcactggcctatacgagaagccctccctgagcgcacagcccggcccgactgtactggccggtgagagtgtgactctttcgtgcagctcccgttcgagctacgatatgtaccacctgagtcgagagggggaggcacatgagaggcgatttagcgccggtcctaaggtcaatgggaccttccaggcagatttcccgctgggtcccgccacgcacggggggacctacaggtgcttcggtagcttcagagattcgccctacgagtggtccaactcctccgacccgttgctagtaagtgtaactggaaatccaagcaatagttggccttcaccaaccgagccgagctcagaaactgggaacccccggcatctgcatgtactgatcggaacttctgtggtgattattctcttcattctgttactcttttttctattacaccgttggtgttgcaacaaaaagaatgctgtggtgatggatcaagaacccgccggaaaccgtacagtgaacagggaagattccgatgagcaggatccccaggaggtcacatacgcccagttgaaccactgcgtcttcacacaacgcaaaataacacgtccaagccagagacctaagactccacctacggatatcatcgtatacacagaattgccgaacgccgagccctag

SEQ ID NO: 192343 - DNA, 1047 bp, Artificial Sequence
  Description of Artificial Sequence: Synthetic coding sequence
atgagcctgatggtggtgagcatggtgtgcgtgggcttcttcctgttgcagggcgcctggccacacgagggagtgcacaggaagccttcactgttagcacaccccggcccccttgttaagagtgaagagaccgtcattctccagtgttggagcgatgtccgcttccagcacttcttgctacatcgggaagggaagtttaaggacacactccatctaattggagagcaccacgacggggttagcaaagccaatttcagcatagggccaatgatgcaagatttagctggcacttatcggtgttatggctcagtgacacattccccgtatcaactctcagctccaagtgatcccctcgacatcgtgattaccggactgtacgaaaagccatcgcttagcgcccagcctggcccaactgtcttagccggggaatccgtgactcttagttgcagtagcaggtcctcgtacgacatgtaccatctgtcccgcgagggggaagcacacgaacggagattcagcgcgggacccaaagtaaacggtacctttcaggcagacttcccactcggaccagccactcatggcggcacatatcggtgtttcggttcttttcgggactcaccttatgagtggtccaattcttccgatcccctgctggtttcggtcacgggaaatccatccaattcatggccttcccccaccgagccctcctcaaagactggaaatccacgtcatttgcacatcctgatcggcacgtcagtagtcatcatcctcttcattctcttattttttcttttgcaccgatggtgctctaataaaaaaaatgctgccgtcatggatcaggaatctgccggaaataggaccgccaattcagaagatagtgatgagcaggacccgcaggaagttacatacacgcagttgaatcactgtgtctttacgcagcgcaagatcactcgtccatcccagcgacccaagactccacccaccgatatcattgtgtataccgagttgcctaacgctgaaagccgctcaaaggtcgtgtcctgtccttag

SEQ ID NO: 192344 - DNA, 1029 bp, Artificial Sequence
  Description of Artificial Sequence: Synthetic coding sequence
atgagcatgagccccaccgtgatcatcctggcctgcctgggcttctttttagatcaaagcgtatgggcacatgtaggcgggcaagacaaacctttttgttccgcatggccaagcgcagtcgtgcctcaggggggtcacgtgaccttaaggtgccactatcggagaggctttaacatatttactctgtataagaaagacggggtccccgttcccgagctatataatcgaattttctggaactctttcctcatctctccggtgactcctgcccatgccgggacatatagatgtcgcggtttccatccccactctcccactgagtggtccgccccgagtaaccccctcgtgattatggtcaccggtctttacgaaaagcctagtctgaccgctaggcccgggccgaccgtccgggccggcgaaaatgtgacactcagctgcagctcgcagagctccttcgatatatatcatttgtcgcgtgagggcgaagcacatgagctaaggttgccagctgtgccttctataaacggaacatttcaggcagatttccctctcggccccgccacacacggcgagacataccgatgttttggcagcttccatgggtcaccctacgaatggtcagatcccagcgaccctctgcccgtcagcgtcactggtaatccatcctcatcctggcctagtcctactgaaccatcttttaaaactgatgccgctgtcatgaaccaagaacccgccggccaccgcaccgttaacagagaggatagtgacgaacaggatccccaggaagtgacatacgcacagttggaccattgcatattcacccagcggaagatcaccggcccctcccagcggtctaagcgtccgtctacggatacaagcgtgtgcatcgagctaccaaacgctgagcctcgagctctgagccctgcccatgaacaccattctcaggcacttatgggatcttcccgcgagactactgctctcagccagacacagctggccagcagcaatgttccagcagcaggcatctag

SEQ ID NO: 192345 - DNA, 978 bp, Artificial Sequence
  Description of Artificial Sequence: Synthetic coding sequence
atgagcatgagccccaccgtgatcatcctggcctgcctgggcttctttctcgatcagagtgtgtgggcgcacgtgggcggccaggataagcccttttgttcagcgtggccgagcgcggtggtgccccaggggggccacgtgaccctcagatgccattatcgaagaggtttcaatatcttcacactgtacaagaaagatggcgtgccagtccccgagttgtataacagaatcttctggaattctttcctcataagcccagtgacccctgcccacgccggtacatatcgatgtcgggggttccaccctcactcaccgaccgaatggagtgcaccaagcaaccccctggtcatcatggttactggattgtatgagaaaccttcactgaccgcgcgtccaggcccaaccgttcgcgccggtgagaacgtaacactgagctgttccagccagagctcctttgacatctatcacctgagtcgtgaaggggaagcccacgagttaagactgcctgccgtaccatccatcaacggaactttccaggccgatttccccctgggaccagccacccacggagaaacttacaggtgttttggatctttccatggctcgccttatgaatggtcagaccctagtgacccattgcccgtgtctgtcactgacgccgccgtcatgaaccaggagcccgccggccaccgtacagtgaacagggaagactcagacgagcaggatccccaggaagtaacctacgctcaacttgaccattgcattttcacccagaggaagatcacaggcccttcacagcgctccaaacggccttccactgatactagcgtgtgcatcgagctaccgaacgcagaaccgcgagccctgagccccgctcacgagcaccactctcaggccctcatgggcagttcacgcgagaccactgcacttagccagactcagttagccagctctaacgtgccagctgcagggatctag

SEQ ID NO: 192346 - DNA, 1194 bp, Artificial Sequence
  Description of Artificial Sequence: Synthetic coding sequence
atgagcctgatggtggtgagcatggcctgcgtgggcttcttcctggaccagagcgtctgggcgcacgtgggtgggcaggataagcctttctgttcagcgtggcccagcgccgtagtccctcaaggggggcacgtgaccctcagatgccactacaggcgaggctttaacattttcactctgtataagaaggacggagttccagtccccgaactttacaacaggattttttggaactcgtttttaatcagcccagtgacacccgcccacgcaggcacctatcggtgcaggggattccacccacattcacccaccgagtggtcggcacctagtaaccccctcgtgatcatggtaactgggctttacgaaaagccctctttaaccgccagaccggggcccacggtgcgggccggggagaacgttacattgtcttgttccagccagtccagctttgatatataccatctgtcgcgtgagggtgaagcacacgagctccgcctgcccgccgtaccgagcataaacggtactttccaggcggatttcccgctcggccccgcaacacacggcgaaacctatcgatgcttcgggagctttcacggaagcccctatgagtggagtgacccctccgatccactccccgtttctgttacagggaatccatcttctagctggcccagcccgaccgagccatcttttaagactggaatcgcaaggcacctgcacgcagtcataagatacagcgtggctataattctgtttaccatcctgcccttcttcctgctgcaccggtggtgcagcaaaaaaaaggtgtcactcacgaagcagcgccccgaaaatagtggcccctgtgcggaggcaggttgggaacacgcagatgctgcagttatgaatcaggaacccgccggccaccgtaccgtcaatcgtgaagacagtgacgagcaggacccgcaggaggtaacttacgctcagttggaccactgtatttttactcagcgcaagatcacaggccccagccagagaagcaagcgcccatctacagacacctccgtgtgtatagagctgcccaatgcggagccccgcgcgttatctccagcccacgaacaccactcccaggccttgatgggttcaagcagggaaacgaccgcactgtctcagactcagttagcaagctccaacgttccggccgctggaatctag

SEQ ID NO: 192347 - DNA, 693 bp, Artificial Sequence
  Description of Artificial Sequence: Synthetic coding sequence
atgagcatgagccccaccgtgatcatcctggcctgcctgggcttctttttagaccagagcgtatgggcccacgtcggactgtacgaaaaaccttccctgaccgcgcgccccggtcccaccgtgcgggcaggggagaacgtgacactgtcctgtagctctcagtcttcctttgatatttatcatctgtcgagagaaggcgaagcacatgagctgcggttgccagccgtcccttcaatcaacgggacgttccaagcggatttcccattaggtcccgccacgcatggggagacttacagatgctttggctcattccatggctccccatatgagtggtcggatcccagtgatcccctgccagtttccgtgacggacgccgccgtgatgaaccaggaacctgctggtcatcggactgtcaatcgcgaagacagtgacgagcaggacccgcaggaggttacgtacgcccagttggaccactgcatttttactcagaggaaaattacaggacctagtcaaagatctaaaagacctagtactgacacttcggtatgcatcgagttgccaaatgctgagccccgagccctcagtccagcacacgagcaccattctcaggcactgatgggctctagcagggaaacaactgcccttagccaaacgcagctagcatcttctaatgtacctgcagctgggatttag

SEQ ID NO: 192348 - DNA, 762 bp, Artificial Sequence
  Description of Artificial Sequence: Synthetic coding sequence
atgagctgcaccatcgagaaggccctggccgacgccaaggccctggttgaacgtctgagggaccatgatgacgctgcagaatccctaatcgaacagaccacagcacttaacaaaagggtcgaggctatgaaacaataccaggaggagatccaggaactgaacgaggtggcacggcacaggcctcgctccacactggtcatggggattcagcaagagaaccgtcagattagggaattacaacaagagaataaggagctgcggacctcacttgaggaacaccagagcgcactggaattaattatgagcaagtatagggagcagatgtttaggttactcatggcctcgaaaaaagacgacccagggattatcatgaaactgaaggaacaacatagcaaaatagatatggtgcaccgcaacaaatctgaggggtttttcttggatgcctcgaggcacatcttagaagcccctcagcacggtctggaaagaagacacttagaggcaaaccagaacgagctgcaggcacatgtagatcagatcactgaaatggccgcagtaatgagaaaggcaatcgagatcgatgaacagcaggggtgtaaggaacaggagaggatctttcagctggagcaagagaataagggactgagggaaattctgcaaattacacgcgagtccttcctcaaccttcggaaggacgacgctagtgagagcaccagcctgtcggcgctagttaccaactcagacctttcgcttagaaagagctag

SEQ ID NO: 192349 - DNA, 648 bp, Artificial Sequence
  Description of Artificial Sequence: Synthetic coding sequence
atggacaaccagggcgtgatctacagcgacctgaacctgccccccaaccctaagcgccagcagcgtaaacctaaaggcaacaaaaactcgattctggcgacagagcaagagattacctatgcggaactgaatttgcaaaaagccagtcaggatttccagggcaatgacaagacatatcactgcaaggaccttccctctgctccagaaaagcttatcgtgggtattcttggcataatttgtttaattcttatggcttctgtggtgactattgtcgtgattcccagccgccattgtggccattgccctgaagagtggataacctacagcaacagctgctactatatcggcaaggaacggcgtacatgggaggaatcattgctggcctgcacatctaagaatagtagtctgctcagtattgataatgaagaggagatgaagttcctgagcattatcagcccctccagttggatcggcgtctttagaaatagttctcaccacccctgggtcacgatgaacgggctggcttttaaacatgagataaaggactctgacaatgctgaattgaattgcgccgtgcttcaagtgaaccgcctcaagagtgcccagtgcgggtccagcataatctaccattgtaagcataagctgtag

SEQ ID NO: 192350 - DNA, 702 bp, Artificial Sequence
  Description of Artificial Sequence: Synthetic coding sequence
atggacaaccagggcgtgatctacagcgacctgaacctgccccccaatccaaagcgccagcagaggaagccaaaagggaataagaattccatcctggcgaccgaacaggaaataacctatgcggagctgaacctccagaaagcatcccaggattttcaagggaatgacaaaacctaccactgcaaggatcttccgagtgccccggaaaaactaatagtaggtatcctgggaattatctgtttaatccttatggcttcagtcgtgaccattgtggttatcccttcaactctgattcagcgccataataacagcagcctgaacacgaggacacagaaggcaaggcactgtgggcattgtcccgaggaatggattacttactcaaacagctgctattacatagggaaggagcggcgcacatgggaagagtctttactcgcttgcacaagcaagaattcatccttattgtccatagataatgaagaggagatgaaattcttgagtatcattagccccagctcctggattggggtttttaggaattccagccatcatccctgggttaccatgaacggcctcgcctttaagcatgagattaaagattccgataatgcggagcttaactgtgctgtactgcaggtgaacagattgaaaagcgcccagtgtgggagctcgatcatctaccactgtaagcacaagttgtag

SEQ ID NO: 192351 - DNA, 648 bp, Artificial Sequence
  Description of Artificial Sequence: Synthetic coding sequence
atggacaaccagggcgtgatctacagcgacctgaacctgccccccaatcccaagcggcagcaacggaaacccaaaggcaacaaaaatagtatcctggccactgagcaggagatcacatacgctgaacttaatttgcagaaagcctctcaggattttcagggcaatgataagacatatcattgtaaagatctgccctccgcaccagaaaagctgattgtgggcatccttgggatcatttgcttaattttgatggcgagcgtggtcacaatcgtggtgatccctagtaggcattgcggtcactgccccgaggagtggatcacctatagtaattcatgttattacatcgggaaagagaggcgcacttgggaagagagcctgcttgcctgcaccagcaaaaacagcagcctgctatccattgacaatgaggaagaaatgaagtttttatccataatctctccttcgtcatggataggagtgttccgcaactcttcacatcacccttgggtaactatgaacggtttggcctttaagcacgaaattaaggactccgataatgctgaactgaactgcgccgttctgcaggtcaaccgtttgaagtcagcgcagtgtgggtcaagcatcatctatcactgcaaacataaactatag

SEQ ID NO: 192352 - DNA, 702 bp, Artificial Sequence
  Description of Artificial Sequence: Synthetic coding sequence
atggacaaccagggcgtgatctacagcgacctgaacctgccccccaatcccaaacgtcagcaacgcaagccgaagggcaataagaactccatcctggctacggagcaagagatcacgtatgctgagctgaacctgcaaaaagcgagccaagactttcagggtaacgacaaaacatatcactgcaaagacctcccgagtgcacctgagaaactgatcgtcggaatcctgggtataatatgtctgattctcatggcctccgttgtgaccatcgtcgttatcccttcaactctcatccaaaggcataataactctagtttaaatactcgcacacagaaagctcggcactgcgggcactgccctgaagagtggatcacctactctaattcatgctactacatcgggaaagaacggcgcacttgggaggagtcactcctggcctgtacatctaaaaattcaagtcttttatcgatcgacaacgaagaggagatgaaatttttgagtattataagcccatcatcatggataggtgtctttaggaactcaagccaccacccttgggttacaatgaatggcctggccttcaaacatgagattaaagacagtgacaatgcggaactcaactgtgcggtgctgcaagtgaataggctcaagagcgctcagtgcggaagtagcattatctatcactgcaaacacaaactatag

SEQ ID NO: 192353 - DNA, 696 bp, Artificial Sequence
  Description of Artificial Sequence: Synthetic coding sequence
atgaacaagcagcggggcaccttcagcgaggtgagcctggcccaggatccaaaacgccagcagcgcaagcctaagggaaataagagctcgatcagcggaactgaacaagaaattttccaggtggaactgaacctgcagaacccctctctgaatcatcagggcattgacaagatttacgattgtcaggggctgttaccgccacccgagaaactcaccgcagaggtgttgggtataatttgtatcgtgttgatggctacagtcctgaagacaattgtgctgatccccttcttggaacaaaataactcttcccctaatacaaggacccagaaaactcgccattgtggtcactgcccagaagaatggataacctattcgaacagctgctactatatcggcaaagaacgccggacgtgggaagagtcactcttggcctgcacttctaaaaactccagcctcctgtccatcgacaatgaggaggagatgaagtttctggcttccatccttcccagctcatggatcggagtgttccgcaattccagccaccatccatgggtgactatcaacggtctggccttcaagcataagatcaaggattcggataatgcagagctgaactgcgccgtgctccaagtgaaccgcttaaaaagcgcccagtgcggatcctcaatgatttaccactgcaaacacaagttgtag

SEQ ID NO: 192354 - DNA, 696 bp, Artificial Sequence
  Description of Artificial Sequence: Synthetic coding sequence
atgaacaagcagcggggcaccttcagcgaggtgagcctggcccaggatcccaagcgccagcagaggaagccaaagggtaataaaagcagtatctctggaaccgagcaggaaatcttccaggttgagcttaacctccagaaccctagcctcaatcatcagggcatcgacaaaatctacgactgtcagggattattgccgccccctgaaaaacttaccgctgaggtactcggaataatatgcattgttctgatggcaaccgtgctgaagacaatcgtactgataccttttcttgagcaaaataatttctcgcccaacacccgaacgcaaaaagccagacactgtggccactgtcccgaggagtggatcacctattccaacagctgttattacatcgggaaggagcgaaggacttgggaagaaagtctcctcgcctgcacctctaaaaattcttcgctgttgtcaattgataacgaggaagagatgaagttcctagcttccatcttgccaagctcctggattggagtgttccgaaattctagtcaccacccctgggtgactataaatggactcgccttcaagcacaagatcaaggactctgacaacgctgaacttaattgcgccgtgctgcaggttaaccggctcaaatcagcccagtgcggatcatccatgatttatcactgcaagcacaaactatag

SEQ ID NO: 192355 - DNA, 375 bp, Artificial Sequence
  Description of Artificial Sequence: Synthetic coding sequence
atgatccccacccggcactgcggccactgccccgaggagtggatcacctactctaactcttgttactatatcggaaaagaaagacgcacatgggaagagagtctgctagcctgtacgtctaaaaacagtagtcttctgtccattgacaacgaggaagagatgaaattccttgctagtatactcccatcctcctggattggtgtcttcaggaattcatcccaccatccgtgggtaaccattaacggcctcgccttcaaacacaaaattaaagacagtgataacgccgagcttaactgtgccgtcctgcaagtgaacaggctcaaatccgctcagtgcgggtcaagcatgatatatcattgcaagcataagctgtag

SEQ ID NO: 192356 - DNA, 774 bp, Artificial Sequence
  Description of Artificial Sequence: Synthetic coding sequence
atgagcaagcagcggggcaccttcagcgaggtgagcctggcccaggaccccaaatggcagcagcgaaagcctaaaggaaataagtcatcaatctctgggaccgagcaagaaatcttccaggttgaactcaacctgcagaacgcctcccttaatcatcaggggattgataaaatctacgactgccagggccttctgcctccacctgaaaagctgaccgcggaagtgttggggataatttgcatcgtgctgatggccacggttctgaaaacaattgtgctgattccctttctcgagcagaacaactcttcccccaacgcgaggacccaaaaagccagacactgtggccactgccccgaagaatggattacatatagtaactcctgttattatattggcaaggaacgaagaacttgggaggagtcactccaggcctgcgcaagcaagaactcttcttctctcctgtgtatcgataacgaggaggagatgaagtttctggcgagtatcttgccttcatcatggatcggggtgttcaggaactcgagccatcacccatgggtaaccatcaatggcctcgcctttaaacacgagatcaaggattccgatcatgcagaacggaattgcgctatgctgcacgtgcgcggccttatctccgaccagtgtgggtcttccaggatcattgtgagcatctcttttcgaatcaaagccctagagcttgccgtgcaccagattaagttctatatttgctcaaatcgcaacgacattatgattgcgtag

SEQ ID NO: 192357 - DNA, 723 bp, Artificial Sequence
  Description of Artificial Sequence: Synthetic coding sequence
atgagcaagcagcggggcaccttcagcgaggtgagcctggcccaggatccaaaatggcagcagcgaaagcctaagggcaataaatcctctatttcagggaccgagcaagagatttttcaggttgaactgaacctacagaacgcctccctgaatcatcagggaattgataagatttatgactgccagggcttgctccctccgcctgaaaagcttacagcagaggttctcggtattatctgtattgtgctgatggcgacagtgctgaaaacgatcgtgctgatacccttcctcgaacagaataactcttccccaaataccaggactcagaaaacacgccactgcgggcactgccctgaagaatggataacatattctaactcctgttattacatcggaaaggagaggaggacttgggaagagtccctacaggcgtgcgctagcaaaaactctagttctctgctgtgcatcgacaacgaggaagagatgaagttcctcgcctctatcttacccagctcctggataggtgtgtttcgcaactcatcacaccatccatgggttaccatcaatggactcgcctttaagcatgaaattaaggactcagatcatgccgagcggaactgcgcgatgctgcatgtaagaggcttgatttccgaccaatgcggttcaagcagaatcattcgccgaggatttataatgcttaccaggctggtcctcaatagttag

SEQ ID NO: 192358 - DNA, 723 bp, Artificial Sequence
  Description of Artificial Sequence: Synthetic coding sequence
atgagcaagcagcggggcaccttcagcgaggtgagcctggcccaggatcctaagtggcaacagaggaaacccaaaggcaataagtcctcaatctccggaaccgaacaggaaatctttcaggttgaactgaacttacaaaacgcctctctgaaccatcaaggaatcgataagatttacgattgtcagggcctcttaccccctcccgagaagctgaccgccgaggtactgggcataatctgcattgttcttatggccactgtcctgaagaccatcgtattgattcctttcctggagcagaataattcttccccaaatgcccgcactcagaaggccagacactgtggacactgtccggaggagtggattacatatagcaactcatgttattacatcgggaaggaaagaagaacctgggaggagagcctccaggcttgtgcctccaaaaactcgagctctctgctttgcatcgataatgaggaagagatgaagtttttagctagcatattaccttccagctggattggagtgttcagaaatagctctcatcacccatgggtgacaattaacgggctcgcttttaagcacgagatcaaagattccgaccatgccgagcgcaactgcgcaatgctccacgtacggggacttatcagcgaccaatgtggcagctcacgaattatccggaggggatttatcatgctgacccggttggtcttgaacagctag

SEQ ID NO: 192359 - DNA, 477 bp, Artificial Sequence
  Description of Artificial Sequence: Synthetic coding sequence
atgaacaagcagcggggcacctacagcgaggtgagcctggcccaggatcctaaaaggcagcagcgtaagctcaaaggaaacaagataagcatcagtgggaccaagcaggaaatcttccaggtcgagctaaatctgcagaacgcttcctcagaccatcaaggaaatgacaagacctaccactgtaaggggttactcccaccccccgaaaagctgacagccgaagtgttaggcattatctgtatagtgctcatggccacagtgctgaagacgatcgtcctaattccctgcataggagtgctggagcaaaacaatttctcactcaataggcggatgcaaaaggccaggcattgtgggcactgtccagaagaatggataacgtacagcaacagttgctactatattgggaaagagagacggacatgggaggaacgggtttgctggccagtgcttcggcgcaccttgatatgctttttatag

SEQ ID NO: 192360 - DNA, 540 bp, Artificial Sequence
  Description of Artificial Sequence: Synthetic coding sequence
atggccgtgttcaagaccaccctgtggcggctgatcagcggcaccctgggaatcatctgtctgagcttaatgtccactctcgggatcctgctgaagaacagctttactaaattatccatcgaaccagccttcacccccggtcccaatatcgaattacagaaagatagcgactgctgttcttgccaggagaagtgggtggggtaccggtgcaattgttatttcatcagctccgaacaaaaaacctggaacgaatcgcgccacttgtgcgccagtcaaaagagctcactgttacagttgcagaacaccgacgaactggactttatgtcctctagccaacagttttactggatcggtctgagttattctgaggagcacaccgcttggctctgggagaatggcagtgctctgagccagtacctctttccatctttcgagacatttaataccaaaaattgtatcgcttataatccaaatggcaacgctctcgatgagtcctgtgaggataagaatcggtatatttgcaagcagcagctaatctag

SEQ ID NO: 192361 - DNA, 447 bp, Artificial Sequence
  Description of Artificial Sequence: Synthetic coding sequence
atggccgccttcaccaagctgagcatcgagcccgccttcacccccggacccaatatagaacttcagaaggactccgactgctgcagctgtcaggagaagtgggtgggatacaggtgtaattgttatttcatttcttccgagcagaaaacttggaacgaaagccgacatctctgcgccagtcaaaagagtagccttttgcagctgcaaaataccgacgaactggattttatgtcatcatcccaacagttttattggataggcctcagctacagcgaggaacataccgcctggttgtgggaaaatggcagcgccctttcgcagtatttgttcccaagtttcgagacttttaacacaaaaaactgtatagcttataatccgaatggaaatgctctggatgaatcctgcgaggacaagaaccggtatatatgcaaacagcaactgatctag

SEQ ID NO: 192362 - DNA, 540 bp, Artificial Sequence
  Description of Artificial Sequence: Synthetic coding sequence
atggccgtgttcaagaccaccctgtggcggctgatcagcggcaccctcggcatcatttgcctctcattgatgtccaccctcgggatactcctcaaaaacagctttaccaaacttagcatcgagccagcattcacaccaggacctaacatcgagctccagaaggattcagactgttgtagctgtcaggagaagtgggtgggctacagatgtaactgttattttataagctccgagcagaagacctggaatgaaagtcgccacctgtgtgcgtctcagaagtcatccctgctacaactccaaaatactgacgaattggactttatgtcatcttctcagcaattttattggattgggctcagttactctgaggagcatactgcctggttatgggagaatgggtcggcgttgtcgcagtacctttttccctcgtttgaaacatttaatacaaaaaactgcatcgcttacaacccgaatggcaatgcactggacgagtcatgtgaggacaaaaatcggtatatctgtaagcagcaattaatctag

SEQ ID NO: 192363 - DNA, 543 bp, Artificial Sequence
  Description of Artificial Sequence: Synthetic coding sequence
atggccgtgttcaagaccaccctgtggcggctgatcagcggcaccctgggcatcatatgtctgtcactaatgtccacactgggaatcttactgaagaatagctttactaagctgagtatcgaacccgccttcactcccggacccaacatcgagctgcaaaaggattccgactgttgctcttgtcaggagaaatgggtcggataccgttgcaactgctacttcatcagctccgagcaaaagacatggaatgagtctaggcacctttgcgcatcgcaaaaatcctcactcttgcagcttcaaaatacggacgagctgcaggatttcatgtcaagctctcagcaattctactggatcggcttgagctacagcgaggagcacacagcctggctttgggaaaacggcagtgcactctctcagtacctttttccgagctttgagacattcaacacaaagaattgcattgcttataatcccaatggcaatgccctggatgaaagttgcgaagataagaaccggtatatctgcaagcaacagctgatttag

SEQ ID NO: 192364 - DNA, 156 bp, Artificial Sequence
  Description of Artificial Sequence: Synthetic coding sequence
agcgccctgagccagtacctgttccccagcttcgagaccttcaacaccaagaattgtattgcctacaatccgaacgggaacgcacttgacgagtcttgcgaggacaaaaaccgctatatctataaggtgttgttgtgttgccctggatggtcttag

SEQ ID NO: 192365 - DNA, 420 bp, Artificial Sequence
  Description of Artificial Sequence: Synthetic coding sequence
atggccgccttcaccaagctgagcatcgagcccgccttcacccccgggccaaatatcgagttgcaaaaggatagcgactgttgttcttgtcaggagaagtgggttgggtatcgatgcaactgctattttatctctagcgaacagaagacgtggaacgaatcacgccacctatgtgcgtcccagaagtcctctctcctgcagctccagaacacagacgagcttgactttatgtccagtagtcaacagttctactggattgggctgagctacagcgaggaacataccgcctggttgtgggaaaatggcagcgccctttcacagtatttatttccgtctttcgaaacctttaacacgaaaaactgcatcgcttataatcccaatggtaacgcccttgacgagagctgtgaagacaagaattag

SEQ ID NO: 192366 - DNA, 699 bp, Artificial Sequence
  Description of Artificial Sequence: Synthetic coding sequence
atgcaggacgaggagcggtacatgaccctgaacgtgcagagcaagaaacgcagctctgcccagacctcccaacttacttttaaagactatagcgtgaccctgcattggtataagatactgctgggtataagcggtacagtcaacgggatactgactctgacactaattagcctgatattgctggtgtcacagggcgtcctgctgaagtgtcagaaggggtcctgttctaatgccacacagtacgaggacaccggcgatctgaaagttaataacgggactagaagaaacatctccaacaaagacttgtgtgccagccggtctgcggatcagacagttctgtgccaatctgaatggctgaagtatcaggggaaatgttgttactggttcagtaatgagatgaaaagctggagcgacagctacgtctattgcctagagcggaagtcgcatctcctgattatccacgatcaactcgagatggccttcattcagaagaacctgagacagctgaactatgtctggatcggcctcaatttcacatcactgaagatgacatggacatgggtggatgggagtccaatcgacagtaaaatcttctttatcaaggggcctgcaaaggaaaacagctgtgccgccatcaaagagtccaagatcttctccgaaacctgtagctccgttttcaagtggatttgtcagtattag

SEQ ID NO: 192367 - DNA, 549 bp, Artificial Sequence
  Description of Artificial Sequence: Synthetic coding sequence
atgcaggacgaggagcggtacatgaccctgaacgtgcagagcaagaaacgctcctcagcccagaccagtcagcttacgttcaaggactattccgttaccttgcactggtacaagatcctacttgggatcagcggcactgtgaacggtattctcacactgacgctgatctcactgattctgctcgttctgtgtcaaagtgaatggttgaaataccagggcaagtgttgctactggttctctaatgaaatgaagtcttggtccgacagctatgtgtattgtctcgagcgcaagtcccatcttctgatcatccacgaccagctggagatggcttttatccagaagaatctccgtcaactgaactacgtgtggattgggctgaactttacctctctcaaaatgacctggacatgggtcgacggttctcccatagactcaaagattttctttatcaaggggcctgctaaggaaaattcttgtgcagcgattaaggaaagtaaaattttttctgaaacatgtagcagtgttttcaagtggatttgtcagtattag

SEQ ID NO: 192368 - DNA, 195 bp, Artificial Sequence
  Description of Artificial Sequence: Synthetic coding sequence
atgcaggacgaggagcggtacatgaccctgaacgtgcagagcaagaaacggtcctccgcacagacctctcagttgacctttaaggactactctgtgaccctccactggtataagattctcctcggaattagcggcacagtgaatgggatactgactctcacacttattagcctgatattgctggatagctcctag

SEQ ID NO: 192369 - DNA, 588 bp, Artificial Sequence
  Description of Artificial Sequence: Synthetic coding sequence
atgaccgacagcgtgatctacagcatgctggagctgcccaccgccacacaggctcaaaatgactatggcccccagcagaaaagcagcagcagcagaccatcctgcagctgcctagtggccatcgcgttgggcctgttgaccgccgtactgctttccgtgctgctgtaccaatggattctctgccagggctctaattatagtacctgcgcgtcatgcccctcatgccctgatcggtggatgaagtatggtaaccattgttattatttcagcgtcgaggaaaaagattggaattctagcctcgagttctgtctggcgcgcgattcacacctgctggtgatcactgataatcaagagatgtctctcttgcaggtgttcctcagtgaggctttctgctggatcgggctgagaaataatagcggatggcgctgggaagatggaagccccctaaatttctcacgcatttcatctaatagctttgttcagacttgcggtgccatcaataagaacgggctgcaggcaagctcctgcgaagtccccttgcactgggtatgcaaaaaatgcccctttgcagaccaagctctcttttag

SEQ ID NO: 192370 - DNA, 570 bp, Artificial Sequence
  Description of Artificial Sequence: Synthetic coding sequence
atgaccgacagcgtgatctacagcatgctggagctgcccaccgccacacaagcccagaacgactacggtccccagcagaaatctagctcctcaagacccagctgttcgtgtctagttgctatcgctctaggactcctgactgccgttctgttatccgtgctactgtatcagtggatcttatgccaaggcagtaactatagcacatgcgcaagttgcccgtcttgccctgataggtggatgaaatatgggaaccattgttattatttttccgtggaggaaaaagattggaattccagcctcgaattttgccttgcccgcgattcacatctgctggtcatcaccgataatcaggagatgtccctccttcaggttttcttgtcggaggccttctgctggatcggcctgcgtaataatagcggatggcgctgggaggacggtagtccactgaacttttcccgaattagtagcaacagcttcgtgcagacttgcggagctattaataaaaacggcctacaagcatcatcctgtgaggtgcctttgcactgggtgtgcaaaaaagtcaggctgtag

SEQ ID NO: 192371 - DNA, 651 bp, Artificial Sequence
  Description of Artificial Sequence: Synthetic coding sequence
atgggctggatccggggccggcggagccggcacagctgggagatgagcgagttccacaattacaatctggacctgaagaaaagtgatttctcaaccaggtggcagaagcaaaggtgtccggtggtcaagtcaaagtgcagggaaaacgcctcaccattctttttttgttgctttattgcggtcgcgatggggattagattcattatcatggttaccatctggtcggctgtgttcctgaatagtctctttaaccaggaggtgcaaattcctctgacggaaagctattgtggcccgtgccctaagaattggatctgctataagaataattgctaccagttttttgacgagtcaaagaactggtacgagtcccaagcttcctgtatgagtcagaacgcctccctgcttaaagtgtattctaaggaagatcaggacctccttaagctggtcaagtcataccactggatgggtttagtgcatattcctactaacggtagctggcagtgggaggatggctccatcctctcacccaacctcctgacgatcatagagatgcagaaaggtgattgcgctctatatgcaagctcatttaaaggatacattgaaaattgctctaccccaaacacttacatttgtatgcagcgcactgtatag

SEQ ID NO: 192372 - DNA, 243 bp, Artificial Sequence
  Description of Artificial Sequence: Synthetic coding sequence
atgggctggatccggggccggcggagccggcacagctgggagatgtcagagtttcacaattataatctggatcttaaaaaatccgattttagcactcgatggcagaaacagcggtgccccgtggttaagtctaaatgccgggaaaacgcctctccattctttttctgctgcttcatcgcagtcgctatgggcatccgcttcattattatggtgacaatttggagcgctgtgtttctgaattag

SEQ ID NO: 192373 - DNA, 651 bp, Artificial Sequence
  Description of Artificial Sequence: Synthetic coding sequence
atgggctggatccggggccggcggagccggcacagctgggagatgtcagagtttcataactacaatctcgatctcaaaaaatccgatttctcaacgcgctggcagaagcagagatgcccagtcgttaagtcaaaatgtcgcgaaaatgcatctccgttcttcttctgctgcttcatcgctgtggcaatggggattcgtttcattattatggtgaccatctggtccgcagtcttcctgaacagtttgtttaatcaggaggtccaaatcccactgacagaatcctactgtggaccctgtcctaaaaattggatttgctacaaaaacaactgttatcagttcttcgacgagagcaagaactggtatgaatcccaggcatcctgtatgtcccagaatgcctcgttgctgaaagtgtactccaaagaggaccaggacctcctgaaactggtgaagtcctatcactggatgggtctagttcacatacctactaacggtagttggcagtgggaagatggcagcatcctgtcccccaatctgctgactattatagaaatgcagaaaggagactgcgccctctacgcgagcagcttcaagggatacatcgagaattgtagcacacccaacacatacatctgcatgcaacggaccgtgtag

SEQ ID NO: 192374 - DNA, 537 bp, Artificial Sequence
  Description of Artificial Sequence: Synthetic coding sequence
atggaccggcccggccccggcagcgcccggcccggccggaccgtgcacgtgtgggggtatagagtggagtggaaagttaggaatggacgaaaactgcagccttcggagtgggcaggtaggggagacttgggaggcttcaagcgccgttggaaagatacccgagcaacagtgggtaccactttcagacgtaggagtagagtatcgttagtgggcgagctgtcgaagttccctctgccatccgattcttctggcggaaaatcatcctcgtcatttgcgcgtggcgcactcgcctggtgtagacagcgtaatcccaatccatcctgcgcagcggcagaaacgggagccagaacgtccctccctaaggaaagatgccggggctggaggctgggcaactggctgcacaagcatccacaccccaatacttgtcctcgcctacctgcctgctggctgccccctatcctgacagaacggggagaaagagtccccaagttggtacccctccttgcctgctaccccaaaagcaaaccaaaggattag

SEQ ID NO: 192375 - DNA, 1902 bp, Artificial Sequence
  Description of Artificial Sequence: Synthetic coding sequence
atgctgcggatgcgggtgcccgccctgctggtgctgctgttctgcttccgcggccgggccggcccttcgccacactttcttcagcagccagaagacctggtggtcttattgggagaggaagctaggctgccctgtgccctgggcgcatattgggggctagtgcagtggactaaaagtggcctggcccttggcggtcagcgtgatctgccaggctggtcccgatactggattagcggaaacgctgccaatggccagcacgacctccacatcagaccagttgaactcgaggacgaggctagctacgagtgccaagccacccaggccggcctacgatcccgaccggcacaattgcacgttctggtgcctccagaagcgcctcaggtgctcggaggcccctctgtctcactggtggcaggggtccccgcaaatctgacatgtcggtcccggggtgatgccaggccaacacccgaattgttgtggttcagggatggagtgctcctggacggcgccacgttccatcaaactctgctcaaagaagggacacccgggtccgtcgagtctacattgactctaacgccattttcccatgacgatggcgctaccttcgtgtgtagggccaggagccaggcccttcccaccggccgagacacagcgataactctgtccctgcagtaccctccagaggtcacactatccgcatccccccacacagtccaagaaggcgagaaggtgatctttctgtgccaggctactgctcagcccccggtgacagggtataggtgggcaaaagggggctccccggtgctgggagctagagggcctcggctggaagtagtcgcagatgcaagctttctgaccgagcccgtgagttgtgaagttagtaatgccgtcggatcagcaaataggagtacggctctggacgtgctgtttggaccaatcctgcaggccaagcccgaacctgtgagtgttgatgtgggtgaggacgcctcattcagttgcgcgtggcgggggaatccgctgccacgggtgacatggacccggcgagggggagcccaggtgctggggtcgggcgccacactgaggcttccatccgtgggcccagaagatgcaggggattatgtatgcagagctgaagccggcctgtcaggcctgagaggaggagcagctgaggcccgcctaactgttaatgcccctccagtggtcaccgcactgcactccgcccccgcttttctgcgcgggccagctcgactccagtgcctggtttttgctagccctgccccagatgcagtggtatggtcgtgggacgaagggttcttggaagctggctcccaaggaaggttcctcgtggagacctttccagcccccgaatcacgaggtggtctcggcccaggactgatttcagtgctgcatatcagtggtacacaggaatccgatttctcacgatcctttaattgttctgcacggaataggctgggcgaaggtggcgcccaggcaagcctgggacggagagacctgctccctaccgttcggattgtggctggcgttgccgctgctaccactactcttttaatggtcattactggggtggccctgtgttgctggcggcactctaaagcttctgcatccttttcagaacagaaaaacctgatgcgcatcccaggctctagtgacggatcctcttcacgtgggcccgaggaagaggagaccggatcaagagaggaccgcggtccgatcgtgcacaccgaccatagtgacttggttctggaggaaaagggcaccctcgagaccaaggatccaaccaatggctactataaggtccggggtgtaagccctcctgcctcaccggactccagggtgacttcgttccaatggaaatcccccggcatcagtaaccttccatag

SEQ ID NO: 192376 - DNA, 660 bp, Artificial Sequence
  Description of Artificial Sequence: Synthetic coding sequence
atgctgcggatgcgggtgcccgccctgctggtgctgctgttctgcttcaggggtcgcgccgggccctcaccacacttcttgcaacagccagaggacttggtagttttgctgggcgagggcggcgctcaggcgagcctgggtcgccgagcgagcgcgagctttagcgaacaaaaaaatctcatgcgcatccccggatctagcgatggatcctcctcacgtggccccgaagaggaggaaaccggctcaagggaggatcggggacctatagttcacactgatcacagcgacctggtcctggaggagaaaggaactctcgagactaaagacccaactaacgggtattacaaggtacgaggagtttcagtgtctctgagcctaggagaagcgccgggcggtgggctgttcctccccccccctagtcccctgggaccacctggcacacctactttttacgactttaatcctcatctgggcatggtgccaccatgcagactgtacagggctcgagctggatacctcacgaccccccacccaagggctttcactagttatatcaagcccacttcctttgggcctcccgatctagctcccggcacacccccctttccatacgccgcttttccgactccctcccacccaagactccagacccatgtttag

SEQ ID NO: 192377 - DNA, 2067 bp, Artificial Sequence
  Description of Artificial Sequence: Synthetic coding sequence
atgctgcggatgcgggtgcccgccctgctggtgctgctgttctgcttcagggggcgggcaggtcctagtccacactttcttcaacagccagaagatttggtggtgcttcttggagaggaggctagattgccatgcgccctgggggcttactggggcctcgtgcagtggaccaaatcgggcctggccctgggaggacaaagggatctgcctggctggtcacgctattggatctccgggaacgcggcaaacggccagcatgacctccatattagacctgtggaattggaggacgaagcctcttatgagtgccaggccacccaagccggcttacggtcccggcccgcccagctgcatgtgttggtccccccagaggccccacaggttttaggtggaccttcagtctcccttgttgccggcgtaccggccaatctgacatgtcggtcgagaggcgacgctcggcccacaccagaactgctgtggtttcgtgacggagtgctcctggacggcgccactttccaccagacactgctaaaggagggtacgcccggtagtgtggaaagcacattgacactacccaccggaagggacactgccattacactgtccctgcagtaccctccggaggtcacactctccgcttcaccgcacacagtccaagagggagagaaagtgatatttctgtgccaggcaaccgcgcagccaccagtgactggctacagatgggcgaaaggggggtctcccgtgctgggggcccgcggtccgcgattggaggtggtagcagatgcaagctttctcaccgaacccgtgtcctgcgaggtaagcaacgcagtgggttcagccaaccgatcaactgcactcgacgtgttattcggacccattctgcaggctaagcctgagcccgttagcgttgatgtaggggaggacgcttcttttagttgtgcttggaggggcaatccacttccccgcgtgacctggacccgacgcggaggggcccaggtgcttggctcaggcgcgacactccgcctcccgagtgttggtccggaagatgccggtgactatgtgtgccgggccgaggcgggacttagcggacttcgcggcggtgctgctgaagcgagattgaccgttaatgcgccacctgtggttaccgccctgcactccgcccccgccttcctccggggccccgctagactccaatgcctggtgtttgccagtcctgctcctgatgctgtggtgtggtcttgggatgagggctttctcgaggcaggctcccaggggcgctttttggtggaaaccttccctgcgcccgagagtaggggcggcctgggacctgggcttatttctgtgctgcacatctcgggaacgcaagagtccgatttctctagaagcttcaattgctcagcccggaacaggctcggcgaagggggcgcccaggctagtctggggaggcgagacctacttcccacagtgagaattgtggccggggtggctgcggcaactaccactctattaatggttattaccggtgttgctttgtgctgttggcgacactctaaagcctctgcttccttctccgaacagaagaacttgatgcgaatacccggttcatctgatggttcctccagccgtgggcctgaagaagaggagactggatcaagagaggatagaggccccatagtacacacggatcacagcgatctagtcctcgaagaaaagggaaccctggagaccaaagaccctacaaacggctattacaaggtccgtggtgtgagtgtatcactgagcctgggggaagcacctggtggtgggttgtttctccctccgccatcaccactgggcccgcccgggactccgactttctacgatttcaaccctcacctaggcatggtacctccttgtaggttgtacagggcacgcgccgggtacctcactacgccccatcctcgggctttcactagttatataaaacccacatctttcgggccccctgatctcgctccgggcacaccgcccttcccttacgcggcgttcccgactccttcacacccacgactgcagacccatgtgtag

SEQ ID NO: 192378 - DNA, 1752 bp, Artificial Sequence
  Description of Artificial Sequence: Synthetic coding sequence
atgctgcggatgcgggtgcccgccctgctggtgctgctgttctgcttccgcgggcgggcaggatggagccgatactggattagcggcaacgctgcaaatggccagcacgatttgcatatacgccctgtggagctcgaagacgaagcctcctacgaatgtcaagccacacaggccgggcttcggtcgcgccccgcacaacttcacgtgctggtccctcctgaggccccacaagtgttaggcggcccaagcgtttctttggtggccggagtgccagccaacttgacgtgtcgatcccggggcgacgcccggccgaccccagaactgctgtggttccgtgacggagtactgcttgatggggcgacattccaccagacgttgttgaaggagggcactcctggatctgtcgagtccaccctcacacttactcccttttctcacgatgatggcgcaacgttcgtgtgccgcgcccgatcacaagcactgcccactggtcgggataccgcgattacgttgagcctacagtatccaccggaggtcactctgtccgccagtccgcacaccgtacaggagggagagaaggttatatttctctgccaggctactgcacagccgcctgtcaccggatataggtgggcaaaagggggaagcccagttctcggtgcccgaggcccacgactggaggttgttgcagacgcatccttcctgactgaacccgtctcatgcgaggtgagcaacgccgtggggagtgcaaataggtctacagctctggacgtgctcttcggccccattctgcaggcaaaacctgagcccgtatccgtcgacgtcggcgaggatgcaagcttcagttgtgcctggaggggcaacccacttccgcgtgtaacctggaccagacgcggaggggctcaggtgctgggctcaggggcaactctgcgcctgccatctgtggggccagaagatgccggcgattacgtatgtcgtgctgaggccggtctgagtgggctgaggggtggcgccgccgaagctcgtctaaccgtcaacgctcctcccgtggtcaccgccctccattcggcacccgccttcctgcggggccccgcacggctgcagtgcctggtgttcgcctctcccgctccagatgctgtggtgtggtcttgggacgaagggtttcttgaggccggcagccagggtcggtttcttgtggagacattcccagctcccgaaagtagggggggcctgggcccagggcttatcagcgtgcttcatatttctggcacacaagagagtgatttctcgagatccttcaactgttctgcacggaacagactgggcgaggggggcgctcaggcatctttgggcaggcgtgatctgttgccaactgtgcggatcgtggcaggagttgcagcagccactactacacttctgatggtgattacgggagtcgccctgtgctgctggagacactccaaagctagcgcctccttttcagagcagaagaacctcatgagaatacccgggagcagcgacggctccagctcaaggggaccggaggaagaggagaccggctcccgggaagatcgcggccctatcgtacacacagaccattctgacttggtgcttgaggaaaaaggcacactggagaccaaagaccctacgaatggttattataaagtgagaggtgtgagtccaccagcctcacccgactcccgcgtcacatctttccaatggaagtcgccagggatctcaaacctcccctag

SEQ ID NO: 192379 - DNA, 2127 bp, Artificial Sequence
  Description of Artificial Sequence: Synthetic coding sequence
atgctgcggatgcgggtgcccgccctgctggtgctgctgttctgcttccgtggaagagctgggcctagtccacattttttgcaacaaccagaagacttggtggtactgctgggggaagaggccaggttgccttgcgccctcggtgcatactggggactggttcaatggacaaaatctggccttgccctgggaggacaacgggatttaccaggttggtccaggtactggattagcggtaacgccgctaacggccaacacgatttacacatcagaccagttgagctggaggacgaagcttcatatgagtgtcaggccactcaggccgggttgagaagccgacccgctcagctgcatgtcttggtgcctccagaagctccacaagtgttaggaggtccgtcggtgtcccttgtagctggggtcccagccaatttgacatgcagaagtcgcggagatgctagacccactcccgagctcctctggtttcgggatggggtgttactggacggggcgacatttcatcagaccttgttgaaggaagggactcccggcagcgtggaatccacactgacgctgaccccattcagtcatgacgacggcgccaccttcgtgtgtcgggcacgcagccaggcccttcctactggccgcgacaccgccattactttgtctctgcagtatcctcccgaggtgacgctttctgccagtccacacaccgtacaggaaggggaaaaggtcatctttctctgccaggccacggcccagcctcctgttaccggctacagatgggccaagggcggatctccggttctgggggctagaggtccacgactcgaggttgtcgccgatgcttccttcttgaccgaaccagtgtcatgcgaggtttccaacgccgtggggagcgctaatcggtctaccgccttagacgtgctgttcggtcctatcctgcaggccaagccagagcctgtaagcgtagacgttggtgaagacgctagcttcagctgtgcttggcgaggaaatcccctaccccgggttacttggacgaggagaggaggggcacaggttcttgggtccggagctactttgcggctaccttccgtcggccccgaagatgcgggggactacgtctgccgagccgaggctgggttgtcggggctcaggggaggtgccgcagaagcccggctgacggtgaacgcgccaccagtggtaacggctttacatagcgccccagcgttcttaaggggtcccgccagattgcagtgtctcgtgtttgcttctcctgctcctgacgctgtggtgtggagctgggatgagggcttccttgaggctggaagccaggggcgatttcttgttgaaacattccctgcccccgaatcccgtgggggccttgggcctggcctgatttccgtgcttcacatttcagggactcaagagtcagacttctcgcgctcctttaactgttccgcgcggaaccgattaggcgagggcggggcccaggcgtccttaggaagaagagacttgttaccaacggtccggatagtggctggggttgccgccgcgacgaccaccctgctaatggtcatcactggagtggccctgtgctgctggcgccattcgaaagccagcgcttccttctccgagcagaaaaaccttatgcgcatcccaggaagtagcgacggtagcagtagccgaggtcctgaagaagaggagacggggtccagagaggatagagggcccatagttcacacagatcactcggatctggtgttagaggagaagggcacattggagactaaggaccccaccaacggctattacaaagtcagaggagttagcgtgtctctctcactgggcgaggcacccggcgggggactgtttctgcctcctccgtccccacttggaccccccgggacacctaccttctacgacttcaacccacatttgggcatggtccccccctgccgcctctaccgcgcgagagcgggttacctgaccaccccccatccacgggccttcacttcctatatcaagcctacaagtttcggcccccctgacctcgcccccggaaccccaccctttccctatgcagccttcccaactccctctcaccctcgtcttcaaactcatgtgtag

SEQ ID NO: 192380 - DNA, 738 bp, Artificial Sequence
  Description of Artificial Sequence: Synthetic coding sequence
atggccgtgatcatcggcgtggccgtgggcgccggcgtggccttcctcgtactgatggcgaccatagtagcgttctgctgtgcacgaagtcaacgcaacttgaagggggtggtgtctgctaagaatgacatcagagtggagatagtccataaggagccagccagcggaagggagggagaggagcactctaccataaagcagctcatgatggatcggggagaatttcaacaagattcagtgctaaagcagcttgaggtattgaaagaggaggaaaaggagtttcaaaatctaaaagatcccaccaatgggtactactctgtgaacacattcaaggaacatcactccacgcctaccatttcactgtcttcttgtcagcccgacctcaggcctgcaggtaagcagagggtacccacgggaatgagctttacaaacatttattcgactctaagtggccagggacgcctctatgactacgggcaacggttcgtgcttggcatgggatcctcatctattgagttgtgcgaaagggagtttcagaggggttctttgtccgactcctctagcttcctagacacacaatgcgattcttccgttagcagcagtggcaagcaggacgggtatgtgcagttcgacaaagccagcaaggccagcgcatcatcctcacaccacagccaatcatcttcccagaactccgacccatccagaccacttcagcgacggatgcagacacacgtatag

SEQ ID NO: 192381 - DNA, 2337 bp, Artificial Sequence
  Description of Artificial Sequence: Synthetic coding sequence
atgaagcccttccagctggacctgctgttcgtgtgcttcttcctgttcagccaagagctgggactccagaagcgcgggtgttgcctagtccttgggtatatggcgaaagataaattccgaaggatgaacgagggccaggtttatagcttcagccagcagccccaggaccaggttgtggtcagtggacagccagtcacactgctctgtgcaatcccggagtatgatgggttcgtgctctggattaaggacggactggcccttggtgttggaagggacctctcttcttacccacagtatttggtcgtagggaatcatcttagcggagaacatcatcttaagatcctgagagcggaactacaagacgatgctgtgtacgagtgccaggcaatacaggccgctattcgtagtagacctgcacgactcacagtcctggtcccgcccgatgaccccgtaatcctcggggggcccgttatatcccttcgtgccggcgatcccttgaatctcacatgccacgctgataatgccaagcctgctgcaagtatcatttggttgcgtaaaggcgaggtgatcaatggtgccacctattctaagaccctgttgcgcgacggcaagagagaaagcattgtttccaccctttttattagccccggcgacgtcgaaaatggtcagtccatcgtatgccgcgccacaaacaaagctatccccgggggcaaagagacctctgtgacaatagatattcaacaccctcctctggtgaatctgagcgttgagccgcaaccagttctggaagacaatgttgtaacatttcattgctctgctaaagctaacccagctgtgacccagtataggtgggccaaacgagggcaaataatcaaggaggcttcaggggaggtctaccgaaccaccgtggattacacttatttcagtgaacctgtctcgtgcgaggtcaccaacgctctgggtagcaccaacttgtcacgcacagtcgatgtgtattttggtcctaggatgaccacagagccgcagtcacttctggtagatttgggaagtgacgctattttttcgtgtgcatggaccggaaatccgagtctgaccattgtatggatgaagagaggatccggagtcgttctttctaatgaaaagaccttaaccctgaaatcggtaaggcaggaggacgccggaaaatatgtgtgccgtgctgtggttcctcgagttggagccggcgaaagagaggtgactctgacagttaatggaccgccaatcatctctagcactcaaacccagcatgctttgcacggcgagaaaggtcagattaaatgctttattaggtcaactccgccaccggaccgtattgcctggagttggaaagagaatgtgctggagagcgggacatccggccgttacacagtcgagactataagcactgaagaaggggtcatttccactttgacaatatccaatatagttagagccgacttccagaccatttacaactgtaccgcctggaatagctttggctctgatactgaaattatccgactgaaagagcaaggttcagagatgaagtccggggccgggctggaggcagaatcagtgcctatggccgtaatcatcggagttgcagtgggggccggcgttgcctttctggtgttgatggccacaatagtggcattttgctgtgctcgaagccagaggaatctgaagggggttgtgagcgccaagaacgacatccgggtggagatcgtacacaaagagcctgcatcaggacgcgaaggggaggagcatagcacaattaaacagctgatgatggaccgaggggagttccagcaggattctgtgctgaaacaactggaggtgctgaaggaagaagaaaaggagttccaaaacctgaaagatcccaccaacggctattattccgtcaacaccttcaaagagcatcactctacacctacaatttctctgtcctcgtgccagccagatctgaggcctgccgggaagcagagggtccctaccgggatgtcttttacaaatatatattcaactctatcaggccaaggcaggctctatgattatggacagcggtttgttttgggaatgggaagttcctctatcgagttgtgcgagcgcgagttccaacgcggctccctttccgattccagcagcttcctggatacacagtgcgattcatcagttagtagcagtggaaaacaggatggctatgtgcagttcgataaagcctctaaggcttctgcttctagcagccatcacagccagagttcttcacagaactcagatccatccaggccgctgcaaaggcggatgcaaacccatgtgtag

SEQ ID NO: 192382 - DNA, 1803 bp, Artificial Sequence
  Description of Artificial Sequence: Synthetic coding sequence
atgaagcccttccagctggacctgctgttcgtgtgcttcttcctgttcagccaagaactcgggctacaaaaacgcggatgttgtttggtcctggggtacatggctaaagacaaatttcggaggatgaacgagggtcaggtgtatagcttttcccaacaacctcaggaccaggtggtggtcagtgggcagcctgtgaccctcctctgcgccatcccggaatatgacgggttcgtcctttggatcaaagacggcctggcgttgggcgtagggcgagatttatctagttaccctcagtacttggtggttgggaatcatctgtccggcgagcatcatttaaagatactgcgcgccgagctccaggacgatgcagtctacgaatgtcaggcgatccaagcagcaattaggagcagacctgcccgactgacagtcctggtaccaccagatgacccagtgattctagggggacctgtcatttccctgcgggcaggggatcctctcaatctcacgtgccatgctgataacgcaaagccagcagctagcattatttggctccgtaaaggggaggtcatcaatggagcgacctacagtaagacccttctccgagacggtaagcgggaaagtattgtctctactctgttcatcagccctggagatgtggaaaacgggcagagtatcgtatgcagggctactaacaaggccattcccggggggaaagaaaccagtgtcaccatcgacattcaacacccccctcttgttaacctctccgtggaaccacagcctgtgctcgaagacaatgtggtgactttccattgctcagccaaagcaaatcctgcagtgacccagtatcgttgggcaaaaagagggcagatcatcaaagaggctagcggggaggtgtacagaacgactgtggattatacatacttttcagagcccgtttcatgtgaagtaacaaatgctctgggatcaacaaacctgagtagaactgtcgacgtatactttgggcctcgaatgactactgagcctcagtccctccttgttgacctgggaagcgacgctatcttctcctgtgcttggacgggcaatccttctctgacgatagtgtggatgaagaggggaagcggtgtcgtcttgagcaacgagaagaccctgaccctcaaatctgtacggcaggaggacgccggcaagtatgtgtgccgagcggtagtaccgagagtgggagctggcgagcgagaggtgaccttaacggtcaacggcccacctattataagctcgacccagacgcagcacgccctgcacggtgagaaaggtcagattaaatgcttcattcgttccacacccccgcctgacaggatcgcctggagttggaaggaaaacgttctggaatcaggaacctctggacggtacacagtggagaccataagcacagaggagggcgtgatcagcaccttaaccattagtaacatagtgagagccgattttcagaccatctacaattgcaccgcatggaattcatttggctctgacacagaaatcataaggttgaaagaacaagggtccgagatgaaaagtggtgctggcctggaagctgaaagcgtccctatggctgtgattattggcgttgccgtgggggccggcgtggccttcctcgttctcatggctaccatcgtcgctttttgctgcgctcgcagtcagagatcaacaggaggaagatccggcatcagcggaagagggacagagaaaaaggctagactgagactcccacgtagggcatcgaagcaggaatgcaatgagcagggctcttag

SEQ ID NO: 192383 - DNA, 2301 bp, Artificial Sequence
  Description of Artificial Sequence: Synthetic coding sequence
atgaagcccttccagctggacctgctgttcgtgtgcttcttcctgtttagccaggaactgggactgcagaagcgaggatgttgcctagtcttaggatacatggctaaggacaaattccgacgtatgaatgagggccaagtctactccttttcccaacagccccaggaccaggtggtggtgtctggacaacctgtgaccctgctttgcgccatccctgagtatgatggcttcgtcctgtggatcaaagatggcctggctctgggagttgggagggatttgagctcctacccccagtacctcgtggtgggtaatcacctgtctggggaacatcatctgaagattttgcgtgctgagctgcaagatgatgcagtctatgaatgccaggccatccaagccgcgattcgatcacggcccgctaggctgaccgtcctagtgccccctgatgaccccgtgatcctcggggggcctgtgattagcctgcgtgccggcgacccactcaatttgacatgtcacgcagacaacgcaaagcctgcagcctccataatctggctccgcaagggtgaagtcataaatggcgccacctattctaaaactctactaagggacggcaagagagaaagtattgttagcaccctcttcatcagcccgggggatgtcgagaacgggcagtctattgtgtgcagggccaccaacaaggctatccccggcggcaaagagacgtccgtgacaattgatatacagcatccacccttggttaacctcagcgtggagcctcaacctgtgttggaagataacgtggtgaccttccactgctcagcaaaggcaaaccctgcggtgacccagtaccgatgggctaagcgtggtcagattattaaggaggccagcggtgaagtctatagaaccacggtagattatacgtacttttctgaaccagtcagctgtgaagtgactaacgctttgggctccactaatctttcccggaccgttgatgtttattttggacccagaatgactaccgaaccccaatccctgcttgtggatctgggatcggacgctattttcagttgcgcttggactggcaacccaagtctcaccattgtgtggatgaaacgcgggtccggagttgtgctcagcaacgaaaagaccttaactctaaaatctgtgagacaggaggatgcaggcaaatatgtttgtcgggcagtggtgccccgtgtgggcgcaggggagagggaggttactctgacagtgaatggcccgcccattatctctagcactcagacccaacatgccctccacggagaaaagggacaaatcaagtgttttatccggagcacccccccaccggatcgcattgcctggtcttggaaggagaacgtgcttgagtctgggacttcaggacggtacactgtggaaactatctcaactgaggagggggtcataagcaccctgactatcagcaacatagtgagagcggacttccagacgatatacaattgtaccgcctggaattccttcggctccgacactgagataattcgacttaaggaacaggagtctgtccccatggccgtcatcattggagtagcagtgggagctggggtcgcctttttggtgctgatggcgactatcgtggcattttgttgtgccaggtcacagagaaatttgaagggagtggtatccgccaagaatgatatccgggtcgagattgtgcataaggaacccgcctctggtagggagggagaggagcacagcacaatcaaacagctgatgatggataggggggaattccaacaggacagtgtactgaagcagctggaggtcctcaaggaggaggagaaggaatttcagaacctcaaggaccccacaaatgggtattatagcgtgaacaccttcaaggaacatcacagtactccgacaatttccctgtcctcttgtcagcctgacctgagacctgctgggaaacagcgagttcccactggtatgtcatttactaatatttactcgactttgtccggacaagggagactgtacgattatgggcagaggttcgttcttggcatgggttccagctcaattgaactgtgcgagcgagagtttcaacgcgggtcactgtccgactcctcctctttcctcgacacacagtgcgactcgtctgtgtccagcagcggcaagcaggacggttatgtccagtttgacaaagcctctaaagccagcgcatcctctagccatcactctcagagcagttctcagaactctgacccatcaagacccttgcagaggcgcatgcaaacacatgtgtag

SEQ ID NO: 192384 - DNA, 1182 bp, Artificial Sequence
  Description of Artificial Sequence: Synthetic coding sequence
atgggcaagagcgacttcctgacccccaaggccatcgccaaccggattaaaagtaaaggtctgcaaaagctaaggtggtactgccagatgtgccagaaacagtgcagagatgagaacggattcaagtgccactgcatgtccgaatcccatcagaggcaacttctgttagcaagcgaaaacccccagcagtttatggattacttttccgaggaattccgcaacgactttctggaactgctcaggaggcgtttcggaactaagcgggtgcataataatatcgtgtacaatgaatacatctctcatcgcgaacacatacacatgaacgccacacaatgggagaccctgaccgattttactaagtggctgggacgggagggcttgtgcaaggtcgacgaaaccccaaaaggctggtacatccagtacattgatagagaccccgagacgattcggaggcagctggaactggagaaaaagaagaagcaggacctggacgacgaggaaaagacggcaaagtttatagaggagcaggtgagaaggggactggaaggcaaggaacaggaggtacccactttcactgagctttcaagagagaatgatgaggagaaggtgactttcaaccttagtaaaggtgcctgcagtagctcgggcgccacctcttctaagtcaagcaccctgggtccctctgccctgaagaccattgggtcgagcgcatcggtaaagcggaaagaatccagccagtcttccacccagtcgaaagaaaaaaagaaaaaaaaaagcgccctcgatgaaataatggaaatagaggaagagaagaaacggaccgcgcgcactgattactggctccaacctgagatcattgtgaagattatcaccaaaaaactgggggagaaatatcataaaaaaaaggcgattgtcaaggaggtgatcgacaagtacaccgccgtagtgaagatgattgactccggggacaaattaaagttagaccagacacatctggaaacagtaataccggcgccggggaaacggattctagtcctgaacggaggatacaggggcaatgaggggacactggaatctattaacgagaagactttctctgccacaattgtcatagagaccggacccttgaagggccgcagagtcgagggcattcaatatgaggatataagcaagttagcatag

SEQ ID NO: 192385 - DNA, 1125 bp, Artificial Sequence
  Description of Artificial Sequence: Synthetic coding sequence
atgggcaagagcgacttcctgacccccaaggccatcgccaaccggatcaaatccaaagggttgcaaaagcttcgctggtactgtcagatgtgtcaaaagcaatgcagggatgaaaacggttttaagtgtcattgcatgtcagagagccaccaaaggcaattattacttgccagcgagaacccgcagcagtttatggattactttagtgaagaatttcgaaatgacttcctggaattacttcgcaggagattcggaactaaaagggtccataacaacatcgtgtataatgagtacattagccaccgggagcacatacatatgaacgccacccagtgggaaacactgacagactttaccaaatggcttgggagggaagggctctgtaaggtggacgaaacacccaagggctggtacatccagtacatagatagagatcccgaaacaatccgtcgccaattggagctcgagaagaaaaaaaaacaagatctggatgacgaagagaaaacagcaaagttcatcgaggaacaagtgcgcagagggctggaggggaaggaacaggaagtgcccactttcaccgaattgtcaagagagaatgatgaggaaaaggtgactttcaatctgtctaagggtgcatgctcatcctcaggagccacatcaagcaagagctccactctcggcccatcagcacttaagaccatcggctcttctgcatcagttaaacgaaaggaatcctctcagtcctccactcagtcaaaggagaaaaaaaaaaaaaaaagcgcactggacgagattatggagatagaagaggagaagaagcgcactgccagaactgattattggctccagcccgaaattattgtaaagataatcacaaagaaactgggcgaaaaataccataaaaaaaaagctatcgttaaagaggtgatagacaagtacaccgccgtggtcaagatgattgattccggggataaactcaaacttgaccagacgcacctcgagactgtcatacctgctccaggcaagcggatcttggtactgaacggcgggtacagaggtaacgaagggactttagaaagcatcaacgagaagaccttttccgccacaatcgtcatagagactgtatag

SEQ ID NO: 192386 - DNA, 867 bp, Artificial Sequence
  Description of Artificial Sequence: Synthetic coding sequence
atgaacgccacccagtgggagaccctgaccgacttcaccaagtggttaggacgggaagggctgtgcaaggtggatgagactcctaaaggctggtatattcagtatattgaccgcgaccctgagactattagacgccaattagagctggagaaaaagaaaaagcaggatctcgatgatgaggagaagacggcaaagtttatcgaagaacaagtgagaagagggctcgaaggaaaagaacaggaggtgcctactttcacagagttaagcagagagaatgacgaggagaaggtcacgttcaatctatctaaaggagcctgcagctcctcgggtgcaaccagttccaagtctagcacattaggaccttctgcactcaagacaataggctcttccgcaagcgtcaaacgtaaagagtcctcccagagctcaacgcagagcaaggagaaaaagaaaaaaaagtctgccctggacgagattatggagatagaagaggaaaagaagcgaactgctagaaccgactattggttgcagccagagattatagttaagattatcactaaaaaactgggggaaaaataccacaaaaagaaggccattgtgaaggaagttattgataaatataccgccgttgttaaaatgattgactccggcgataagcttaagctcgatcagacacacttggaaacagtgatccccgctccagggaaacgaatcctagttcttaacggaggctacaggggtaatgaaggtacgctggaatctattaacgagaagaccttcagtgcgacaattgtcattgaaacagtgagcctcttcacccaacggcagaaatttcagaatgctctgaaaatgtgccattcctttttttag

SEQ ID NO: 192387 - DNA, 2361 bp, Artificial Sequence
  Description of Artificial Sequence: Synthetic coding sequence
atgaacgaggccaaggtgaaggagaccctgcggcggtgcggcgcctcaggagatgaatgcggtcggctgcagtatgcactgacctgtttgaggaaggtgaccggactcggtggagaacacaaggaagactcttcgtggtcctcactcgatgcccgtcgcgaaagcgggtccggacccagcacagataccttgagtgctgccagtctaccgtggccccctgggtcatcccagttgggaagggccggcaattcagcgcagggaccaagatcgatctccgtatcggctctaccagctagtgactcgcctaccccatccttctcagagggcctgtccgacacctgtatcccactccacgcctccgggagacttactcctcgggctctgcatagctttattactcctccaaccacccctcagctccgccggcacaccaagctgaaacctccaagaactccgcctccacctagcagaaaagtatttcagctgttgccctcatttccgacgctgaccaggagtaagtcacacgaatctcaactgggaaatagaatagatgacgtctcaagcatgagatttgatctcagccacggatctcctcaaatggtgcgtcgggacataggcctgtctgtgacccaccgcttctctactaagagctggcttagccaagtgtgccacgtgtgtcagaagagtatgattttcggcgtaaagtgtaaacactgcagactgaaatgtcacaacaagtgcacgaaagaggcccctgcctgccggatctcattcctccctttgactagactcagacgaaccgaatccgttcccagcgacattaacaatcctgtagatcgggccgccgagccacactttggaacactccctaaggctctgaccaaaaaagagcacccgccagctatgaaccacctggatagttccagcaatccatcatcaacaacatctagcaccccctctagccccgcaccttttcctacgagctcaaacccttctagcgccacgactcctccgaaccccagtccaggtcagagagattctcggtttaatttcccggctgcatactttatccaccatcgccaacaattcatttttcctgtgccttcagccggccactgctggaaatgccttcttattgctgagagcctcaaagaaaatgccttcaatatctcagcctttgctcatgcggctcctctgccagaggcggctgatggcacacgactggacgatcagcctaaagctgatgtgttggaggcccacgaggctgaggcagaggagcccgaagcgggcaagtccgaagcagaggatgacgaggatgaagtcgatgacctgccatcctccaggagaccgtggcggggaccaatttccaggaaagcttcccagacctccgtgtacctccaagagtgggacattccctttgagcaggtggaactcggcgaacccattggtcagggacgatggggaagggttcatagggggcgctggcacggcgaggtagctatacgcctgctggagatggacggacacaatcaggatcacctaaagctgttcaaaaaggaggttatgaattacaggcaaacaaggcatgagaacgttgtattgtttatgggggcctgcatgaatcctccgcatctggccattattacttctttttgcaaaggaagaaccctgcatagtttcgttagagaccctaagactagcttggatatcaataaaacaaggcaaatcgctcaggaaatcattaaggggatggggtacttgcacgccaaagggatcgtgcataaggatctgaaatctaagaacgtgttctacgacaacggaaaagtggttatcacagacttcggtctgttcggaatcagcggcgtggtgcgggagggccgacgagagaatcagttaaagctgtcacacgactggctgtgttacctagctcctgagatcgttcgcgagatgacgcccggcaaagatgaggaccagcttccgttctccaaagcagctgacgtgtatgcgtttggaacagtgtggtatgaattgcaagctcgggattggccacttaaaaatcaggccgctgaagcaagtatttggcaaattggctctggggaggggatgaagcgagtgttgacctcggtttctctgggcaaggaagtgtccgaaatcctgtctgcttgttgggccttcgaccttcaggaacgtccgtctttcagccttcttatggacatgctggaaaaattgcctaaactgaacaggagactctcacatcccgggcacttctggaagtctgctgacatcaatagctcaaaagtggtgcctcgtttcgaaaggtttgggttgggcgtgctggagagcagtaaccctaaaatgtag

SEQ ID NO: 192388 - DNA, 2772 bp, Artificial Sequence
  Description of Artificial Sequence: Synthetic coding sequence
atggaccgggccgccctgcgggccgccgccatgggcgagaagaaggaaggcggggggggcggagatgccgccgcggccgagggaggtgcaggcgccgcggcttccagggcactccagcagtgcgggcagctgcagaaattaatcgatatcagtatcgggagcttgcgcggtctgaggactaaatgtgctgtgtcaaatgatctgacccaacaggagattagaaccttggaggctaagctggttcggtacatctgtaagcagagacagtgtaagctttccgtcgctcctggggagaggacacccgagctaaattcctacccccgcttttctgattggctgtacacattcaatgtacggccagaggtcgtgcaggagatccccagggatctaaccctggacgctttgctggagatgaatgaagccaaagtcaaggaaaccctgcgcagatgtggagcatctggtgacgagtgcggaaggctgcagtatgcccttacttgcttgaggaaagttaccgggttaggtggcgaacataaagaagacagcagctggtcctccctcgacgcgcgaagggagtccggatctggcccttccacagatacactttccgccgcttctctgccttggcccccaggctcttcccaacttggtagagctgggaacagcgctcagggtccccggagtatcagcgtcagtgctttgcccgcatctgactccccaactccaagcttcagcgagggtctgagtgacacgtgtattcctctgcacgcaagcggtcggctgaccccgcgggctcttcatagtttcatcactccaccaactacgccgcagctacgccgacacaccaaacttaaacctccccgcacaccacctcctccatctcgcaaggtgtttcaactcctgccttcatttcccaccttgacccgcagtaagtcacatgaatcacagctggggaaccgaattgacgacgtgtcaagtatgcggttcgatctgtctcacggctctccccagatggtgcgcagggatattggactgagcgtgacccacaggttcagcaccaagagctggctctcccaagtgtgtcatgtctgccagaagtcaatgatcttcggcgtgaaatgtaagcactgtaggctgaaatgccataacaaatgtactaaagaggcacccgcatgcagaatttctttcctgccgttgaccaggttacgaagaacagaaagcgtccctagcgatattaataaccccgtggatagagctgcggagccccatttcggaaccctccctaaagccctcacaaagaaggaacacccacctgccatgaatcatctggatagttcatctaatccatcaagcacaacgtcctccacgccttcgagcccagcgccttttcctacaagctcaaatccaagcagtgcaaccacaccacctaaccccagtcccgggcagcgcgacagccgatttaattttcctgctgcatatttcatccaccataggcagcaatttatatttccagtgccctctgccggtcactgttggaagtgcctgttgattgcagaaagcctgaaggagaacgccttcaatatttccgcatttgcccacgccgccccgctgccagaagcggccgatgggacgagactggatgaccagccaaaggccgacgtgctggaggctcatgaggcagaagcagaggagccggaggccgggaagagcgaagcagaagatgatgaggatgaagtggacgacttgccttccagtaggcggccatggcgtgggcccatctcccggaaggcatcccagacgagtgtatacctccaggaatgggatatcccgtttgaacaggtggagcttggcgagccaataggccagggacggtggggaagagttcaccgagggcggtggcacggagaagtggctattagactgctagagatggatggccacaatcaggatcatctgaagctcttcaagaaagaggtgatgaactataggcagacacggcatgaaaatgtcgtactttttatgggtgcatgcatgaacccaccccatttagccattatcacctccttctgcaaagggcggactctgcactcatttgtccgggaccccaagaccagcctggatataaacaagacccgacagatcgcacaggaaatcatcaaagggatgggttatctccatgcaaagggcattgtacataaggatctcaagtccaagaacgtgttctatgacaacggcaaagtcgtcattacagatttcgggctgtttggaatctccggtgtagtccgggagggacggagagagaatcagcttaagctgtcccatgattggctgtgctacctggctcccgaaatcgttagggagatgactccaggtaaagacgaagaccagcttccgttctctaaggccgctgacgtgtacgctttcggcacagtctggtatgaattgcaggcaagggactggcctctgaaaaaccaggctgctgaggcgagcatatggcagatcggatcaggagaagggatgaagcgggtgctcacgtccgtttcccttggcaaggaagtgagcgaaatcctgtcggcgtgctgggcctttgacctgcaagagaggccatcattctccctattaatggacatgctagagaagctgcccaagttaaaccgcaggttaagccatccaggacacttttggaaaagcgccgatatcaactcgtccaaggtcgtgccacgcttcgagagattcggtctgggcgttctggagtccagtaacccaaaaatgtag

SEQ ID NO: 192389 - DNA, 2289 bp, Artificial Sequence
  Description of Artificial Sequence: Synthetic coding sequence
atgaacgaggccaaggtgaaggagaccctgcggcggtgcggcgcctcgggcgacgaatgcgggcggctgcagtatgccttgacatgcctgaggaaggtgacggggctgggcggggaacataaagaggatagtagttggtcttcactagacgcccggcgtgaatcaggtagtggcccatcgactgatactctctccgctgcgtccctcccctggccacctggctcttcccagttgggccgggcaggaaactcagcccaaggcccccggtccattagtgtgtccgccttgccagccagcgactctccgaccccaagcttcagtgaaggactttcagacacttgtataccattgcacgcaagtgggagattgactccgcgagccttacattcatttatcacgccacccacgacaccccagctacggcgccataccaagctcaagccgcctaggaccccgccccctccctcacgcaaggtcttccagctgttaccgagcttccctacactcaccaggtccaagtcgcacgagtcccagctcggaaaccgaatagatgacgtgagcagcatgaggttcgacctgtcacacggaagcccacaaatggtccgccgtgatattggattgtcagttacccataggttcagcactaaaagttggcttagccaggtgtgccacgtctgccagaagtcgatgatatttggggtaaaatgtaaacattgtcgattaaagtgtcacaataagtgtacaaaggaagcgccagcctgcaggattagctttctgcccctgactcgccttagaaggacagaatccgtaccgtctgacatcaataatcctgtggatagagcagcggagccacacttcggtactctcccgaaggccctgacaaaaaaggagcatcctccagctatgaaccatctggatagcagcagtaacccgagtagtactaccagctccaccccctctagtcccgctccgtttcctacaagttcaaacccgagttccgcaacgacccccccaaacccgagtcctggtcaacgagactccagattcaacttcccagctgcatacttcattcatcaccgacagcaattcatatttccagtccccagtgccggccactgctggaaatgtctcttgatcgccgaaagccttaaagagaacgccttcaacatttctgcgtttgctcacgcggcacccctgccagaggccgccgatgggacgcgcctcgatgatcaacctaaagccgacgtcttggaggctcatgaggctgaggcggaagagccagaagccgggaaatccgaggccgaagacgatgaagatgaagtcgacgacctcccaagctcacggagaccctggcggggcccaatatctcgcaaggcatctcagacaagcgtttatctgcaggagtgggatattccattcgagcaggtggaacttggcgaacctatcggccagggccggtgggggcgagtgcatcgaggccggtggcacggagaagtagccatcagacttttggagatggatggacacaatcaggaccacttgaaactcttcaaaaaagaagtgatgaattacagacagacccggcacgaaaacgtagtcctctttatgggggcttgtatgaatccaccgcaccttgcgataattacctccttctgcaagggccggaccctgcacagtttcgttcgggatccaaaaacaagtctcgatattaacaaaaccagacaaatagcacaggaaattatcaaaggcatggggtacctccatgcaaaggggatcgttcacaaagatctaaaatcaaaaaacgtattctacgataatgggaaagtggtgatcacagactttggattgtttggtatttctggagtcgtgagagagggaagaagggagaatcagctgaagctatcgcatgactggctgtgctacctggcgccagaaatcgtccgagaaatgacacccggcaaggatgaagaccagttgcctttcagcaaggctgccgacgtttacgctttcggtacagtctggtacgagctgcaagctagagactggcccttaaagaaccaggcggctgaagcatcaatttggcagatagggagcggcgagggcatgaaaagggttctcacctcagtgagtctgggtaaagaggtgtccgagattctgagtgcatgttgggcttttgatctccaggaacgaccctcgtttagtttgcttatggacatgctggagaaactccctaaattgaatcggaggttaagtcatccgggccacttttggaagtccgcggaactgtag

SEQ ID NO: 192390 - DNA, 375 bp, Artificial Sequence
  Description of Artificial Sequence: Synthetic coding sequence
atgcaggccgacctggagatcccccgggacctgaccctggacgccttgctggagatgaacgaggctaaggtgaaggagacactcagaagatgtggcgcttctggggacgagtgcggcagactgcagtatgctcttacttgccttcgcaaggtaacagggctgggaacttggggacttcccccatctcctctgcccgggctggttcccctgggactatggcccagcttgtggtgggtcatggaacgggggaaaaggggccccgggtttttgggccagcctgggaaggctcgcgttgggtgctctcagcctcccgagaagctgagccagggtcctcagggttctggttcatggtgggtgtggccaggccgaatttag

SEQ ID NO: 192391 - DNA, 1842 bp, Artificial Sequence
  Description of Artificial Sequence: Synthetic coding sequence
tgacacagcttcatcaccccccccaccaccccccagctgcggcggcacactaaactgaagcctccacgcacacccccccccccatcacggaaagtgtttcagctcctgccctcttttcccaccctgacccgcagtaagagtcatgaatctcagctgggcaatcggatcgatgatgtcagtagtatgaggtttgacttgtcacacgggagcccccagatggttaggagggatatcgggctgtcagtaactcataggtttagcaccaagtcttggctgtcccaggtctgccatgtgtgccagaagtccatgatttttggagttaaatgtaaacattgccggctgaaatgccacaacaagtgcacgaaggaggcaccagcgtgtcgtattagtttcctgcctctgacgcgccttaggaggactgagagcgttccatccgacattaataatccagtggatcgcgctgcagaaccccactttggaactctgcctaaggccctaacaaagaaagagcatcctccagcaatgaaccatctggacagcagcagtaacccaagttctaccactagctcaaccccctcttcccctgcgccttttcccacctcctctaacccttcttcagccacaacaccccctaacccttcgcctggccagagggacagccgcttcaattttcctgctgcttattttatccaccatcgacagcagtttatattcccagacatttccgctttcgcgcatgccgcccctctgcctgaagccgctgatggcacaaggctggatgaccagcccaaagctgacgttctggaagcacacgaggcggaggcggaagagcctgaagcaggcaagtctgaggccgaagacgatgaggacgaagtcgacgacctgccatccagtaggaggccgtggcgagggcccatcagtaggaaggcatcacagacctcagtgtacttgcaagaatgggatataccttttgaacaggtggagcttggcgagcccattggccagggccgatggggtcgtgtacaccgggggcggtggcacggagaagtggctatccgactgctcgaaatggacgggcacaatcaggaccacctcaagctgtttaagaaagaggtcatgaattacagacaaacccggcatgagaatgtggtcttgtttatgggagcctgcatgaaccctccccacttggctatcatcactagcttctgcaaaggacgaactctgcatagcttcgtccgggatccgaagacttcgttggatatcaataagactagacagatagcccaagaaattataaaaggaatgggatatctgcacgcgaaaggtattgttcacaaagacctcaagtccaagaatgtattttacgataatggaaaagtcgtgattactgactttggactgttcggtatctctggcgtggttcgggaaggcagaagggaaaatcagctgaagctttcacatgactggttatgctaccttgctccagaaattgtacgagagatgacgccagggaaagacgaggatcagctgcccttcagcaaagccgccgacgtgtacgcatttggaacagtgtggtatgagctgcaagcacgggattggcctctgaagaaccaggccgcagaagcatccatttggcagatcggatccggtgaggggatgaaacgagtgctcacgagcgtgagcctcggtaaagaggtcagcgagattttatctgcctgctgggcttttgacctccaggagagacccagtttctcattgctgatggacatgctcgaaaaactgcctaagctcaatcgtcgactgtctcatccaggccacttttggaaatctgccgagctgtag

SEQ ID NO: 192392 - DNA, 2634 bp, Artificial Sequence
  Description of Artificial Sequence: Synthetic coding sequence
atggaccgggccgccctgcgggccgccgccatgggcgagaagaaggaaggcggtggagggggcgacgctgccgccgctgaagggggggctggtgccgcagcaagtcgcgcccttcagcagtgtgggcagctgcagaagctaatcgacatcagcatcgggtctttaagaggtctccggacaaaatgtgccgtgagcaatgacctgacgcagcaggaaatccgaaccctcgaagctaagctagtaagatacatctgcaagcaacgtcagtgtaagttatccgtggctcctggagaaagaacacccgagctgaacagctacccccggttcagcgactggctgtacacttttaatgtgcggcccgaagtggtccaagagatcccgcgcgacctgacattggacgcacttttagaaatgaacgaagcaaaagtgaaggaaacactgaggaggtgcggggcgtccggcgatgaatgtgggcgcctgcagtatgctctgacttgcctacgcaaggtgacaggacttggaggagaacacaaagaagatagttcatggagttcgctggacgctagaagagagtcaggaagcggcccctcaactgacactctgtcagctgcttcattgccctggcctcctggcagttcacagcttggcagagctggcaattctgcccaagggccccgatcaatctccgtctctgccctgcccgccagtgattctcctacgccgagtttctctgaagggctgagcgatacctgtattcccctacatgctagtgggcgattgaccccccgtgctctacatagtttcatcactccgccaacaactccccagcttagacggcacaccaagcttaagccccctagaactccaccccccccttcacgaaaagtctttcagctgctgccatcttttccaacactcacacgctctaaatcacacgagtcccagctaggaaaccgaatcgatgacgttagctccatgcgtttcgatctgtcccacggatcaccccaaatggtgcgacgggacatcggattatccgtgacccaccggttctctaccaagagttggctgagccaagtctgccacgtttgtcaaaagtccatgattttcggcgtgaagtgcaaacattgccggctcaaatgccataataagtgcactaaagaggctcctgcctgtagaatatccttcttgccactgacaaggttaaggcgaaccgaaagtgtaccttcagatattaataacccagtggaccgcgcagccgagccccacttcggtaccttacctaaagccctgacgaagaaggaacatccaccagcaatgaatcacctggacagctcaagtaacccgtcctcaacaacatccagcacgccctcatcccccgccccattcccaacatccagcaatcctagcagtgcaacgacaccacccaacccctccccaggccagcgcgacagcagattcaactttccggccgcctattttatacatcatagacaacaattcatcttcccggatatcagcgcctttgcacacgccgcaccactgccagaggccgcagatggaacccgtctggatgaccagcccaaggctgatgtgctggaagcacacgaggccgaggccgaagaaccagaagccgggaaaagcgaggctgaggatgatgaggatgaagtagacgacctgccttcctctcgacgcccttggcggggaccaattagcagaaaggcgtcacaaaccagcgtgtatttgcaggaatgggatatcccttttgagcaggtggaactaggcgagcccatcggccagggccgctggggcagggtccacagggggcggtggcacggggaggtcgcaatcaggctgctggaaatggatggccataaccaagaccatctgaaactgtttaagaaggaggtcatgaactataggcagacccgccacgaaaacgtcgtgttgtttatgggcgcatgtatgaaccctcctcacctggcgataatcacttctttttgtaagggcagaactctgcacagtttcgtgcgagatcccaagacaagcctagacatcaataaaacacgacagattgcacaagagatcatcaaaggtatgggataccttcacgcaaaaggtatcgttcacaaagacttgaaatcaaagaacgtgttttacgacaacggaaaagtggtgataaccgacttcggactgttcggtattagcggagtagtgagagaggggaggagggagaaccagctgaaactctcccacgactggctgtgctacctggccccggagatcgtacgcgaaatgacccccggcaaagacgaggaccagctgcccttctcgaaggctgccgacgtctacgcattcggaaccgtttggtacgagctgcaggcccgagactggcccctgaaaaatcaggccgctgaggcaagcatttggcagatcggatccggggaagggatgaaaagagtcctgaccagcgtttccctgggaaaagaggtttccgaaatcctcagcgcttgttgggcttttgacttgcaagagaggcccagcttttctctcctcatggatatgctagagaagctgccgaagttgaaccgccgactgtcccaccctggccacttctggaaatctgccgaactctag

SEQ ID NO: 192393 - DNA, 1311 bp, Artificial Sequence
  Description of Artificial Sequence: Synthetic coding sequence
atgtacaacaagaaggccaagatggagcccaacgccagcgagagcgcaatccccgctaggcggcagcgtcagcccagggccaagaaaaaaagcaagcctcttaatcttaagatccactcaagcgttggctcctgtgaaaatatccccagccagcaacgaagcccactcttatctgagcggagtctccgctctttctttgtgggccacgccccctttctgcccagcactcctcccgtgcatacagaggctaacttctcggctaataccctgtctgtgccacggtggtcaccgcagatcccacgcagggacctcggaaactctataaaacataggtttagtacgaagtactggatgagccaaacctgcacggtctgtgggaaaggcatgctgtttggtctcaaatgcaagaattgtaagctcaaatgtcacaataaatgtacaaaggaggctcccccctgtcacctgctgattatccacagaggcgacccagccaggcttgtgcgtactgagtctgtgccctgcgacataaataacccactgaggaagcccccccggtattccgatctacatatctctcagaccctcccgaaaacaaataagatcaacaaggatcacatacctgtgccgtatcagcccgattcatcttccaatccctcgagcaccactagttcaaccccctcttccccggcacctccactgcctccgtccgcaacccctcctagcccccttcacccatccccacagtgtacacgccagcagaagaatttcaatctgcctgccagccattactacaagtacaaacagcagtttatttttcctgacgttgttcccgtgcccgaaacccctactcgggccccgcaggttatcttgcatccagttaccagcaatccaatactggaaggcaaccctctgctacagatcgaggtagagcccaccagcgaaaatgaagaggtgcacgatgaagcagaggagtctgaggacgacttcgaagaaatgaatttaagcctcttgagtgcccggtcctttcctcggaaggcaagtcagacttccattttccttcaggagtgggacattccctttgaacaactcgagattggggagcttataggaaagggtagatttgggcaggtgtatcatggacgctggcacggcgaggtggctataaggctgatcgatatagagcgtgataatgaggaccagctgaaagctttcaaaagggaagtgatggcgtatcgacagaccagacacgagaacgtcgtgctcttcatgggcgcttgcatgtcaccgccccacctggctataatcacttag

SEQ ID NO: 192394 - DNA, 2853 bp, Artificial Sequence
  Description of Artificial Sequence: Synthetic coding sequence
atggacgaggagaacatgaccaagagcgaggagcagcagcccctgagcctgcaaaaagcgttacagcaatgcgaactcgtgcagaatatgatagatctgtccatatctaatctcgagggtctcaggactaaatgtgcaacatccaatgaccttactcagaaggagataagaaccttggaaagtaagctggtgaagtatttctccagacagttgagctgtaaaaagaaagtagcactgcaggagcggaacgcagagctggacggattccctcaactgaggcactggttccgcattgtggacgtgagaaaagaagtgctggaagaaattagccctggccagctgagcctggaagacctcctggagatgaccgacgaacaggtgtgtgaaactgtggaaaaatatggggcgaatcgtgaggagtgtgcgagattaaatgcctctctgagctgcctgcgaaatgtgcacatgtcggggggtaatctcagcaagcaggactggaccatccagtggccaaccaccgaaaccgggaaggaaaataatcctgtctgtccccctgagcctaccccttggatccggacgcatctctcccagagccctcgcgtgccaagcaagtgtgtacagcattactgtcatacatcacccaccccaggagcccctgtctatacacatgtagaccggctgaccgtggatgcctaccctggcctgtgtccacctcctcctctcgagtcaggacaccggtcacttccacccagccccagacaacgacacgccgtccggactccccctcggacgcctaacatcgtcactaccgttactcccccaggaaccccccctatgaggaaaaagaataaattgaagccgccaggcactcctccaccatcatccagaaagcttatccaccttataccgggattcaccgccctgcaccgttcaaagagccatgagtttcagcttggacatcgtgtggacgaggcccacacaccaaaagcgaagaagaagagcaaaccactcaacttgaagatccatagcagcgtggggagctgtgaaaacattccatcccagcaaagatctcccctgctgtccgaaagatcactgcggtctttttttgtggggcatgcccccttcttaccaagtacccctcccgtacacacagaagcaaattttagcgccaatactttatccgtccctcgctggagcccacagattcctcgacgagacctggggaattcaatcaagcacagattcagcactaaatactggatgtctcagacttgtacggtctgtggaaaaggtatgctcttcgggcttaagtgcaaaaattgtaagctcaaatgccacaacaaatgcacaaaagaagcacccccatgccaccttctaattatacaccggggtgaccccgctcggctggttcggaccgagagtgtcccgtgtgacataaataacccccttaggaaacctcccagatatagcgaccttcacatcagtcagaccctgcctaagacaaacaagatcaacaaggaccatatacccgtgccctaccagcccgactcctcctcaaaccccagctccaccactagcagcacaccgtcctctccagccccacctctccccccctcagccacaccacccagcccactccacccgagcccacaatgcaccagacaacagaaaaattttaatctgcccgcctcccactattataaatataagcaacagtttatattccccgatgtggtccccgtccctgagacccctacaagggcaccccaggtgattcttcacccagtgacctcaaatcccattttggaaggcaaccctcttctgcagatagaagtcgaacccacatccgaaaacgaagaggttcacgatgaggcggaagagagcgaagacgacttcgaggaaatgaatttgagccttctaagcgccaggagctttccccgtaaggcttcgcagacatctatcttcttgcaagagtgggacatcccgtttgaacagctggagatcggggagctgattggcaaggggcggttcggccaagtgtatcacggccgttggcatggcgaggtggctattaggctgattgatatagagcgcgataacgaggatcagctgaaagcttttaagcgtgaggtgatggcgtacagacagactcgacacgagaatgtggtgttgttcatgggagcttgtatgagtccccctcacctagctatcataacgtcactttgcaagggccgcaccttgtattcagtcgttcgcgacgctaagatagttctggacgtcaataaaactaggcagatagctcaggagatcgtgaagggcatgggctacctacacgcgaagggtatacttcacaaggacctaaagtcaaagaacgtcttttacgacaacggcaaggtggtgattaccgacttcggattattctctattagcggagttctccaagccgggcgccgcgaggacaagctccgtattcaaaatggatggctctgccacctggcaccggagatcattaggcagctctccccagatacagaagaagataagcttccttttagcaagcatagcgatgtcttcgcactgggtactatttggtatgaactgcacgcaagagaatggccttttaagactcaaccagcagaagctataatctggcaaatgggaacaggcatgaagcccaatctgagccagattggtatggggaaggagatcagcgatattctcctgttctgctgggcatttgaacaggaggaacgcccaaccttcactaaacttatggacatgctcgaaaagctacccaagcggaaccgaagactgtcccatcccggccacttttggaagagtgctgaattgtag

SEQ ID NO: 192395 - DNA, 2766 bp, Artificial Sequence
  Description of Artificial Sequence: Synthetic coding sequence
atgatcgacctgagcatcagcaacctggagggcctgcggaccaagtgtgctacctcgaatgatctcacccagaaagagattcggacccttgaatctaagctcgtgaaatacttctcccgacaactcagctgtaaaaagaaggtggctttacaggagagaaacgcagagcttgacggtttcccccagttacggcattggttcagaattgtagacgtccgtaaagaggtcttggaggaaatttcccccggccaactgagcctagaagatttgttggagatgaccgatgagcaggtatgcgaaaccgtggagaagtacggagccaatcgggaagagtgcgcccgtctgaacgcctccctgtcctgtcttcggaatgtgcatatgtccggcggaaatctttcaaagcaagattggaccatacagtggcccactaccgaaactggaaaagaaaacaacccagtttgcccacctgaaccaacaccgtggattagaacccatttgtcgcaaagcccaagggtgccttccaagtgtgtacagcactattgtcacacctcccccacccctggggctcccgtgtacactcatgttgatcgattgactgttgatgcgtatcccggcttgtgcccacctcccccactggagagtggccaccgcagcttgccccccagtccacggcaaagacacgctgtccgtacacctcctagaacgcctaacattgtaacaacggtcacccccccaggaaccccccctatgcggaaaaaaaacaagctgaagcctcctgggaccccccctccatctagcagaaagttaatacacctgatccctggattcacggccctgcatcgaagcaaaagccacgagtttcagctgggtcaccgcgttgacgaggctcacaccccgaaagccaaaaagaaaagtaaacccttaaaccttaagattcatagcagtgtggggagctgcgaaaatatcccatcacagcagcgtagcccactcttgagtgagcggagcctccgaagcttctttgttggccatgccccctttctgccctccacgcccccagtacataccgaagctaatttctctgcgaataccctctcagtccctcgttggtcacctcaaatccctcgtcgcgatctgggaaattctattaagcaccggttctccaccaagtactggatgtcgcagacgtgcaccgtgtgcggcaaaggaatgctgtttggcctgaagtgcaaaaattgcaaattgaagtgccacaataaatgtacgaaagaggcaccaccctgccatttgctgatcatacatcggggagatcccgctaggctcgtccgcaccgagtctgtgccctgcgatattaacaacccactgaggaaacccccacggtacagcgacctgcacatttctcagactttgcccaagacaaacaaaatcaacaaggatcacattccagttccatatcagccagattcaagttcaaacccaagctctaccaccagctctaccccatcatctcctgccccccccctgccccccagtgccaccccccccagtccactacacccgtcaccacagtgcacaagacaacagaagaacttcaatctccctgcttctcattattataagtacaagcaacagtttatctttccggatgtggtgccggtgcctgagaccccaacccgcgcgccccaagtgatcctgcaccccgttaccagtaaccccatattggagggcaacccgctgttacagattgaagtagagccaacgtccgaaaatgaggaggtccacgatgaggctgaagagtcggaggacgacttcgaagaaatgaatctgtctctgctttctgcacgctcgtttcccagaaaggcttcccagacaagcattttcctgcaagaatgggatattccctttgaacagttagaaataggggaactcattggaaaggggcggttcggtcaagtgtatcatggccggtggcatggtgaggtggcaatccggcttattgacatcgaaagagataacgaagaccaactcaaggcatttaagcgcgaggtaatggcctaccgccagacacggcacgagaatgtggtcttgttcatgggggcgtgcatgtcccctcctcatctagctataatcaccagcctctgcaaggggagaaccctttactccgttgtgagagatgccaaaattgttctggatgtgaataaaacacggcagatcgcacaagagattgttaagggaatgggctatctccacgccaaaggcatcctccataaagacttgaaaagtaaaaacgtgttctatgacaatgggaaagttgtgatcactgacttcggcctgttttctatcagtggtgtgctccaagctggtagaagagaagataagctgcggattcagaatggatggctctgccatctcgcccccgagatcatcaggcagttgagtcctgatacagaggaggataaactgcctttctccaagcattctgatgtgtttgcactcggcactatctggtatgaactacatgctcgggagtggccattcaaaacacaacctgctgaagccattatctggcagatgggcaccggaatgaagccaaatctgtcccagattggaatggggaaagagattagcgacatcctccttttctgttgggccttcgaacaggaagagcggcccacattcaccaaactgatggacatgctcgagaaacttccgaaaagaaaccgtagattgtcccatcccgggcacttttggaagtccgctgagctgtag

SEQ ID NO: 192396 - DNA, 1245 bp, Artificial Sequence
  Description of Artificial Sequence: Synthetic coding sequence
cgggccaagaagaagagcaagcccctgaacctgaagatccacagcagtgtcgggtcatgcgaaaacatccccagtcagcaacggagcccactgcttagcgaaagaagcttgagaagctttttcgtaggccacgccccgttcctgccatcaacaccacccgttcatactgaagccaatttctccgctaacactttgtcagtgccccgctggtctcctcagatcccacgccgagacttaggaaattcaattaaacacagattctcaacgaagtactggatgagtcagacctgcacggtgtgcggtaaaggtatgttatttggactcaaatgtaaaaactgtaagctcaagtgccataataagtgtacaaaggaggcgcccccctgccatctgttaataattcaccgtggggacccagccaggctggtgaggaccgaaagcgttccttgcgacataaataacccattaaggaagcctccacggtatagtgatctgcacatctcccagacattgccaaaaaccaacaagattaacaaggatcacattcctgtaccttatcagcctgactcgagctctaatcccagctcaaccacgtcttctacccccagttcccccgccccacctctgcctccctcagccactcctccttctcctctgcacccctccccgcagtgtactaggcagcagaagaatttcaacctgcctgcttctcactattacaagtataagcaacaatttatcttccctgatgtcgtcccggttcccgaaacccccacacgggcacctcaagtgatactgcaccccgttacaagtaacccaattctcgaagggaacccgttacttcagatcgaggtcgaaccaaccagtgagaacgaggaagtgcatgatgaagcggaggagtctgaggatgattttgaggaaatgaacctgtcactcctgtctgctcggagcttccctagaaaggctagccaaacgagcatcttcctccaggaatgggacattccattcgagcagctggagataggcgaactcatcggcaaagggagattcggccaggtatatcacggtcgctggcacggggaggtcgctattagattaattgacattgagcgggacaacgaagatcagctcaaggcctttaaacgggaggtgatggcctacaggcagaccagacacgagaatgtggtgctgtttatgggcgcctgcatgagccctccccacctcgccattataactcggcccgtctag

SEQ ID NO: 192397 - DNA, 3921 bp, Artificial Sequence
  Description of Artificial Sequence: Synthetic coding sequence
atggagttctacgagagcgcctacttcatcgtgctgatccccagcatcgtcataacagttatcttcctgttcttctggcttttcatgaaggagacattgtatgatgaggtgctcgccaagcagaagagagagcaaaagctcatcccaaccaagaccgataaaaagaaggcagaaaagaaaaagaacaagaagaaggaaatacaaaatgggaacctccacgaaagtgactcggagtcagtgccacgggattttaaactcagcgatgcattagccgtggaagatgatcaagtggcaccagtgccccttaatgtggtggagacatcaagcagcgttcgagagagaaaaaaaaaggaaaagaagcagaagcccgtacttgaggagcaagttatcaaagagtccgatgccagcaagattcccggaaaaaaggtggaacccgtacctgtgaccaagcagcccacccctccttccgaggccgccgcgtccaagaaaaaaccagggcagaaaaagagtaagaatggcagcgatgatcaggacaaaaaagtggagaccctgatggtgcccagcaaaagacaggaggctctcccgctgcatcaggaaaccaaacaagagagcggctctggaaagaaaaaggctagcagcaagaaacagaagacagagaacgtctttgtggacgagcccctgatacacgcaaccacatacattcccctgatggataatgccgacagttctcccgtcgtcgacaagcgtgaggtgattgacttgttgaagcctgatcaagtggaggggatccagaagtctggaactaagaagctgaaaacagagactgacaaggaaaacgctgaagttaaattcaaagatttcctgctgtccttaaagacaatgatgttctccgaggatgaagcgctgtgtgtagtggacctactgaaagagaagtccggggtgatccaagacgcactgaaaaagtcctctaagggcgaacttaccaccctgatacatcagctacaggaaaaagacaagctcctcgccgctgtgaaggaagacgcagccgccaccaaagaccgctgcaaacaactcacgcaggagatgatgactgagaaagagcgatcaaacgtcgtcatcacccggatgaaagaccgcatcggcacccttgagaaagagcacaatgtgtttcagaacaaaatccacgtgtcctatcaggaaacacagcagatgcaaatgaagtttcaacaagtgcgcgagcaaatggaggccgagatcgcccacttaaaacaggaaaatggcatcctgcgagatgctgtcagcaataccactaaccagctggaatctaaacagtctgctgagctgaataagttacgtcaggattatgcaagattggtgaatgaactaaccgagaagaccggtaagctgcagcaagaagaggtgcaaaagaagaatgccgagcaggcagctacccagctgaaggtgcagttgcaagaggccgaacggcgttgggaagaggtgcagagctacatcagaaaaagaacagctgagcacgaagcagctcagcaggatttacagtccaagtttgtggccaaagaaaacgaggtacagtccttgcacagcaaactcaccgatacgctcgtgagcaaacagcagttggagcagaggctgatgcagttaatggaatccgaacagaagcgagtgaataaagaagaaagccttcagatgcaggtacaagacatactggaacagaacgaggctttaaaagcacagatccagcagtttcactcccaaatcgctgcccagacaagtgcttccgtactcgctgaggagctacataaagtgattgcggaaaaagacaaacagattaagcagacagaggactcactggccagcgagcgggatcgcctgaccagtaaagaggaggaactgaaagatatccaaaatatgaactttctgctgaaagccgaagtacagaagctgcaagcactcgctaacgaacaggcagccgctgcgcacgagcttgaaaagatgcaacagtcagtctatgtgaaggacgacaaaattaggttgctggaagagcaattacaacacgagatttcaaataaaatggaagaatttaaaatccttaacgaccagaacaaagcactgaaatcggaagtacagaaactccaaacactggtcagtgagcagcccaacaaggacgtagtggagcagatggagaagtgcattcaggaaaaagacgaaaaactgaaaaccgtcgaggaactgttggaaactggactgatccaggtggcaacaaaagaggaagagctaaacgccattaggacagagaactccagtttaacgaaggaggtccaggacttgaaagcaaagcagaacgaccaggtgtcatttgcgtccctcgtggaggaactcaaaaaggtgatccacgaaaaggatggcaagatcaagtccgtcgaggaactgctagaagctgagctgctgaaggttgcaaataaagagaagactgtacagctctcgatcacttcgaaggtacaggagctgcaaaacttactgaagggaaaagaagaacagatgaataccatgaaagctgttttggaagagaaggaaaaggaccttgctaatacaggaaaatggctgcaagatctccaagaagaaaatgaatcacttaaggcgcacgtgcaagaggtcgcccagcataaccttaaggaggcatcttccgcctcacagttcgaagagttagagatcgtcctgaaagagaaggaaaatgagctcaaaagactcgaggctatgttgaaagagcgcgagtcagacttgagcagcaagactcagcttctccaggacgtccaggacgaaaacaagttgtttaaaagtcagatcgagcagctgaagcagcagaactatcagcaggcctcttcatttccacctcacgaagaactgcttaaagtcatctcagaaagggagaaagagatcagtggattatggaacgagcttgactcgctgaaagacgccgtggagcaccaacgaaagaaaaacaacgacctgagggaaaaaaactgggaggctatggaggccctagcgtctacagaaaagatgctgcaggacaaggtcaacaaaacctcaaaagagcggcagcagcaagtggaagcagttgaactggaggcaaaagaggttctaaaaaagcttttccccaaggtctcagtcccctccaatctctcttacggtgagtggctgcacggatttgagaaaaaggctaaggaatgtatggcaggcaccagcgggtcagaagaagtcaaagtgctcgaacacaaactgaaagaagccgatgaaatgcacactctcctgcagcttgagtgcgagaaatacaagagcgttctggcagagactgagggaattctgcagaaactacagcgctccgtggaacaggaggaaaacaaatggaaggtgaaggtggatgagagccacaagacaataaaacagatgcagagctctttcacctccagtgagcaggagctcgagagattgcgatccgaaaacaaggatatcgagaatttgagaagggagcgagagcacctggagatggagctcgagaaggccgagatggagaggtctacgtatgtgactgaagtgagagagctgaaggcccaactgaatgaaaccttaaccaagcttcggaccgagcagaacgaacggcagaaggtcgctggagacctccataaggcgcagcaaagtctggagcttattcagtctaagatcgtcaaagctgcaggagatactaccgtgatagagaactcggatgtgtctcccgaaaccgagtcttcagagaaagagaccatgagtgtcagtctgaaccaaactgtgactcaactgcagcagctccttcaggcagtcaatcagcagcttaccaaggaaaaagagcattaccaggtacttgagtag

SEQ ID NO: 192398 - DNA, 4074 bp, Artificial Sequence
  Description of Artificial Sequence: Synthetic coding sequence
atggagttctacgagagcgcctacttcatcgtgctgatccccagcatcgttataactgttatcttccttttcttctggctgttcatgaaagagaccctgtacgacgaagttctagcgaaacagaagagggagcagaagttgatccctacaaaaacagataaaaaaaaagccgaaaaaaaaaagaataagaaaaaggaaattcagaacggcaatctgcatgaatccgatagtgagtccgtcccacgcgactttaagctgtcagacgcactcgccgtcgaggatgatcaggtcgcgcccgtccctctcaacgtggtcgagaccagcagttcagtcagggaaaggaagaagaaggagaagaagcagaaacctgtgctggaggaacaggtcatcaaggagtctgatgctagcaaaatccctggcaaaaaggttgagcccgtgccagtgaccaaacaacctaccccgccctcagaagcggccgcatccaaaaagaagcctggacagaagaaatcgaagaacggctcggacgaccaggacaagaaagtggaaacacttatggttccctcgaaacgtcaggaagccctgccactccatcaggagacgaagcaggagtcaggcagcggcaaaaaaaaggcttccagcaagaagcaaaagaccgagaacgtcttcgtagatgagccgctgattcatgcaaccacgtacatccctctgatggataacgcagatagttcccccgtcgtcgataaaagggaagtaattgaccttttaaaaccagaccaggtcgagggcatccagaaaagcggcacaaagaaactcaagaccgaaaccgacaaagaaaatgctgaagtgaaattcaaagacttcctcttaagcttgaagacgatgatgttctccgaggacgaagcactgtgtgtcgtcgatttgctgaaagagaaatctggagtgatccaagatgccctcaagaagagcagcaagggcgagctgacaacgctgatacaccagctgcaagagaaggataaactgctggcagcggtcaaagaagacgccgctgctaccaaagacaggtgcaaacaactgactcaggaaatgatgaccgagaaggaacgttccaatgttgtgatcaccaggatgaaggacagaattggcactctggagaaggagcacaacgtgttccagaacaagatccacgtgtcctaccaggagacccagcaaatgcagatgaagttccaacaggtgcgagaacagatggaggctgagatcgcgcacctgaagcaggagaatggaatcctcagagatgcagtttctaacacaaccaaccaactggagagtaagcagtccgcggaactcaacaaactccgccaggactatgcaaggctggtcaatgaacttacagagaaaaccggcaagctgcagcaggaagaagtgcagaagaaaaacgccgaacaagccgcaacacaacttaaggtgcagttgcaggaggccgagaggagatgggaggaagtgcagtcttacatccgtaagagaaccgccgagcatgaagcagctcagcaagacctccagagtaagttcgtggccaaggagaacgaagttcagtctctgcactcaaagctcaccgacacactggtgtcgaaacaacagctggagcaacgcctcatgcaactaatggaaagcgagcaaaagagagtaaacaaagaagagagtctgcagatgcaagtacaggacatactcgagcagaatgaagcattaaaggctcaaatccagcaatttcatagtcagatcgctgctcagaccagcgcctccgtcctggccgaggagctgcacaaggttattgccgagaaggataagcagataaagcagacggaggattccctcgccagcgagagggatcggttgacttcaaaggaggaggaactcaaagacatccagaacatgaactttctccttaaggccgaagtgcagaaactgcaggcactggctaatgagcaggcagccgcagctcatgaattggaaaagatgcagcagagcgtttacgtgaaggacgacaagattcgtctcctggaagagcagctgcagcacgagatttctaataaaatggaggaattcaaaattctgaacgaccagaacaaagccctgaagagcgaggtgcagaaactacagactctggtgagcgagcagccaaacaaagatgtggtcgagcaaatggagaaatgcattcaggaaaaggatgaaaaactcaagactgtggaggaactcctggaaactggactgatccaggtcgccaccaaggaggaggagttgaatgccattcggacagaaaactcttcgcttacaaaggaggtccaagacttgaaggctaaacagaacgaccaggtttcattcgcatcattggtggaagagttgaagaaagtcattcatgagaaggacggaaagataaaatctgttgaagaactactagaagcagagttacttaaggtggccaacaaggaaaagacagtccaagatctcaaacaggaaatcaaagctttaaaggaagaaatcggcaatgtgcagctggaaaaagctcagcagctgtccatcactagcaaggtgcaagagctgcagaaccttctgaagggcaaagaggagcaaatgaatacgatgaaagccgtgctcgaagagaaagaaaaagatctggccaatacggggaagtggctgcaagatctccaggaggaaaacgagtccctcaaggctcatgtgcaggaagtggcacagcacaacctcaaagaggccagctcagcctcacaattcgaagagctcgaaatagtgctgaaagagaaagaaaatgagcttaagcgactcgaagctatgttgaaggaacgtgagtccgatttgtcttcaaaaacacagctgttacaagacgtgcaggatgaaaacaagctcttcaagtcacagattgaacagctcaaacagcaaaactaccagcaggcaagctcatttccccctcacgaggaactactgaaggtgatatctgagcgcgagaaagagataagcgggctctggaacgagttagattcactcaaagacgccgtcgagcaccagcgtaaaaagaacaatgacctaagagaaaagaactgggaagcaatggaagctctggccagtaccgagaaaatgcttcaggacaaggtgaacaagacgagcaaagaacggcagcagcaggtggaagccgttgagttggaagccaaagaggtcctcaaaaagctgtttcccaaggtgtcagttccatccaatctgagctatggagagtggctgcatggcttcgaaaaaaaagccaaggaatgcatggccggcacttccggcagcgaagaggtgaaagtcctggagcataagcttaaagaggcggacgagatgcatacccttcttcaattggagtgcgaaaaatacaaatcagtcctggccgagactgaaggtattctacagaaactacagaggagcgtcgagcaggaagagaacaagtggaaggtgaaggtggatgagtcgcataagacgatcaagcagatgcaaagtagcttcaccagctcagagcaggagctcgagcgcctgcggtccgaaaacaaagatatcgagaacctgaggagagagagagaacaccttgagatggagttggagaaagctgagatggaaaggtcgacatacgtaacagaggtgagggaattaaaggatctcctaaccgagctgcagaagaaactcgacgattcgtattctgaagcagtgagacaaaatgaagaattgaacctcctgaaagcccagctgaacgaaactctcacgaagctacggaccgagcaaaacgaaaggcagaaagtcgcaggggacctccataaagcacagcagtccctcgaattgatccagagtaaaattgtcaaagctgctggcgatacgacagttatagagaactctgacgtgagtccagagacagaaagcagcgagaaagagaccatgtccgtcagcttgaaccaaaccgtgacgcaactgcagcaattactccaagcagtcaaccagcaactgactaaggagaaggaacactatcaagtgctggaatag

SEQ ID NO: 192399 - DNA, 3921 bp, Artificial Sequence
  Description of Artificial Sequence: Synthetic coding sequence
atggagttctacgagagcgcctacttcatcgtgctgatccccagcatcgtgatcaccgttatatttctattcttctggctgtttatgaaggaaaccctatacgatgaggttcttgccaagcagaaaagagagcaaaaactgatccctactaagactgacaagaagaaagccgaaaagaagaaaaacaagaaaaaggaaattcagaacggtaatctccacgaaagtgacagcgagtctgtgcctcgcgactttaagctctctgatgccctcgcagtggaagacgatcaggtggcacccgtgcccctcaatgttgttgaaaccagctcgtccgtccgtgaaagaaagaagaaggaaaaaaaacagaaacccgttctcgaggaacaggttatcaaagagagtgacgcaagcaagataccaggcaagaaggtcgaacccgtaccagttacaaagcagccaactcccccctccgaagccgccgcaagcaaaaaaaaacccggacagaaaaagtccaagaacgggagtgacgaccaggacaagaaagtagaaacactgatggtcccctccaaacgtcaggaagcactccctctgcatcaggagactaaacaggagtcaggaagtggtaaaaagaaagcctcgagcaagaaacaaaagaccgagaacgtcttcgttgacgaacccctaattcatgccacaacttatattcccctcatggacaatgctgactcgtcgcccgtggtggataaaagggaggtcattgacttgttaaagcctgaccaggttgagggcatccaaaagtcgggtactaagaaactgaaaaccgagacagacaaggaaaatgccgaggttaaattcaaagatttcttactatctctcaagactatgatgttttcggaagacgaagccctgtgtgtggtcgacctgctgaaagagaagtcaggagttatacaggacgcattgaaaaaaagctcaaagggtgagctaacaacccttatccatcagctgcaggaaaaggacaagctcctggcagcagtgaaggaggatgcagccgcgaccaaggaccgttgcaagcagctgactcaggaaatgatgactgagaaggagagaagtaatgtcgtcatcacaaggatgaaggacagaatcggaacgcttgagaaagaacacaacgtcttccagaataaaattcatgtctcatatcaggagacacagcagatgcagatgaaatttcagcaggtccgagaacagatggaggccgaaattgcacatttaaaacaagagaacggaatcttgcgcgatgccgtgtccaacacaaccaaccaattggagtccaagcaaagtgctgagctgaacaagctcagacaggattatgctaggctggtgaacgagctgactgaaaaaaccggcaagctgcagcaggaggaagttcagaaaaaaaacgctgagcaagcagccacccagctaaaagtgcagctgcaggaggccgagcgaaggtgggaagaggttcagtcttacattcgcaagcggactgccgagcacgaggctgcccagcaggatctacaatcgaagtttgtcgccaaggaaaatgaagtgcagtctctccacagcaaacttactgatactttggtatccaagcagcaactggagcagagactgatgcagctgatggagtcagagcagaagagagtcaataaagaagagtccctccagatgcaggtgcaggatattttagaacagaacgaagcccttaaagcacagatccagcagtttcactcccagatcgccgctcagactagcgcaagcgtgctggctgaagaactacacaaggtcatagccgagaaagataaacagatcaagcaaactgaagactccctcgccagcgagagagaccgcctgacaagcaaggaggaggaactgaaggacatccagaatatgaatttcttactgaaggctgaagtgcagaagttacaagcattggctaatgagcaggccgccgccgcgcacgagcttgaaaagatgcaacaatcagtgtacgtgaaggatgataagattcgattgctcgaggagcagctgcaacatgaaatctctaataagatggaggagtttaagatcctgaatgaccaaaataaagcccttaaaagcgaagtgcagaagcttcagacactcgtgagcgagcagcctaacaaggacgtcgtggaacagatggaaaagtgcattcaagagaaagatgaaaagctgaaaacggtagaggagctgctggagaccggcttgattcaggtcgcgaccaaagaagaagagctcaatgcaatccgcaccgaaaattcgagcctgactaaggaggtgcaggatctgaaggccaagcagaacgatcaggtttccttcgcgtcattggtggaagagcttaagaaggtgatacatgagaaggacggcaagattaaaagcgtggaggaattgctcgaggccgagttacttaaagtcgctaataaggaaaaaacagttcagctgtctattaccagtaaggtccaggagctgcagaacttgctgaagggaaaggaagagcaaatgaataccatgaaggcagtcctggaggaaaaggagaaggatcttgccaatactggcaagtggctccaggatctccaggaagaaaacgagtccctcaaagctcatgtccaggaagtggctcagcacaaccttaaagaggcgtcgtccgcttcacagtttgaagaactagagattgtgctgaaagagaaagaaaacgagctaaagcgccttgaggctatgctgaaagagcgggagagcgatctatcgtctaagacacagttgctgcaggatgtgcaagatgaaaacaagctgtttaagtcccaaattgagcagctcaaacaacagaactatcagcaagcctcctccttccccccccacgaagaactgctcaaagtcatctctgagcgcgagaaggaaatttcaggcttatggaacgagctggatagccttaaagacgccgtcgaacaccagaggaagaagaataatgatctcagagagaagaactgggaggctatggaggctctcgcaagcaccgagaaaatgctgcaggataaagtcaataaaaccagcaaggagagacagcagcaggtcgaggctgttgagttggaagcaaaagaggtcctgaaaaaattattccctaaagtatctgttccatccaacttgtcatatggggaatggttgcatggtttcgaaaagaaggcgaaggagtgcatggccgggacatctggcagcgaggaggttaaagtcctggagcacaaactcaaagaagctgacgagatgcacactctgctgcaactggagtgcgagaaatataaaagcgtgcttgctgaaacggaaggcattctccagaagctgcagaggtcagtcgaacaggaagaaaataaatggaaggttaaagtggatgaaagccataaaaccattaagcagatgcagtcctctttcactagcagtgaacaggaactcgagagactgcgatccgagaacaaagatatagaaaatctcaggagggagagggagcacctcgagatggagctggaaaaagctgagatggagcggagtacatacgtcacagaggttagggagttgaaggcccagctcaatgaaacacttacaaaattgaggacagagcagaatgaacgtcaaaaggttgcaggggacctgcacaaggcccagcagagtctggagctcatccagtccaaaattgtaaaggcagcgggggatacaactgtcattgaaaactccgatgtgtccccagaaaccgagagcagcgagaaagagaccatgtctgtgagcctgaatcaaacagtcacacaactgcagcaactgctgcaggccgtcaaccagcagcttaccaaggagaaggaacactaccaggtgctggagtag

SEQ ID NO: 192400 - DNA, 4074 bp, Artificial Sequence
  Description of Artificial Sequence: Synthetic coding sequence
atggagttctacgagagcgcctacttcatcgtgctgatccccagcatcgtcatcactgtcatttttttattcttctggttatttatgaaagagactctctacgacgaagtacttgcaaaacagaaacgagaacagaagctgatcccgaccaagacagacaaaaagaaagccgagaagaagaaaaataaaaagaaagagattcagaatggcaatttgcacgagagtgatagcgagtctgttcctcgtgattttaagctatccgatgctctcgccgttgaggacgatcaggtggccccagtgccactaaacgtcgtggaaacaagttcatcagtccgtgagcgcaagaagaaggaaaagaagcagaaaccagtcttggaggagcaagtgattaaggaatcggatgcttccaaaattcctggcaaaaaggtggagccagtgcctgtcacaaagcagccaactccaccgtcagaggcagccgcgtctaaaaagaagcctggtcagaagaaatccaaaaacggaagcgatgatcaggataagaaggtggagaccctcatggtgccatcaaagaggcaggaggccctccctcttcatcaggagactaagcaggaaagcgggagtggcaagaagaaagcctcctccaagaagcagaagacagagaacgtcttcgttgatgaaccactaattcatgctactacatacatccctctgatggacaatgctgatagctcacccgtggttgataagcgcgaggttattgatttgctgaagcctgatcaggtggagggcattcaaaaatcgggaacaaaaaagcttaagaccgagactgataaggaaaatgctgaggttaagttcaaggactttcttttgagcttgaagacgatgatgttctccgaggacgaagccttgtgcgttgtcgatttgctgaaagaaaagtctggcgttatccaggacgctctcaaaaaaagctcaaagggcgagctaacaaccttgatccaccagctccaggagaaggataagctgttagctgcagtgaaagaggatgcggccgcaacaaaagacaggtgcaagcagttgacacaagaaatgatgacagagaaagagagatcaaatgtggtgatcacccgcatgaaagaccgcatcggcacgctggagaaagagcataatgtgttccagaacaagatccacgtgtcgtatcaggagactcagcaaatgcagatgaaatttcagcaggttagagagcagatggaggctgaaatcgctcatcttaagcaggaaaatgggatccttagagacgcagtgtccaacaccacaaaccaattggagtccaaacagtccgccgaactcaacaagttaaggcaggactacgccagactggttaacgagctcacagaaaaaacggggaagctgcagcaggaggaggtccagaaaaagaacgcagagcaagctgctacccagctgaaggtgcagctgcaagaagctgagaggcggtgggaagaggtgcagtcttatattcggaaaaggaccgctgagcatgaggcagcccagcaggaccttcagtccaagtttgtggcgaaagaaaatgaggttcagtctctgcacagtaagttaacagacacattagtgtcaaaacagcagctggagcagaggctgatgcaactgatggagtctgaacagaagcgagtcaacaaagaggagtctttgcagatgcaagtgcaggatattctcgagcagaatgaagcactgaaggcgcaaatacaacagtttcacagccagatcgcagcccaaacatctgcctcagtgctcgcagaagagctgcataaagtgattgctgagaaggacaagcagatcaaacagaccgaggactcattggccagcgagcgggatcgactcacgtcaaaagaggaagaactgaaagacatccagaacatgaattttctgttaaaggctgaggttcagaagctgcaggcactggccaatgaacaggcagccgccgcccatgagctcgaaaagatgcagcaatcagtctatgtgaaggatgataagatcaggctcctagaggaacagttgcagcatgaaataagtaataaaatggaggagttcaagatcctgaacgatcagaataaggcactaaaaagcgaagtacagaagcttcagacactcgtgagcgaacagcccaataaagatgtggtggagcagatggaaaaatgcatccaggagaaggacgagaaattaaagactgttgaggaattgctggagaccggccttatccaagtggccacgaaggaagaagagctgaacgccattcgcaccgagaattcctcgctcaccaaggaggtgcaggatctgaaggccaagcagaacgaccaagtgtcatttgcaagtctagttgaggaactgaagaaagttattcatgaaaaagacgggaaaatcaaatctgttgaagaacttcttgaggccgagctcttgaaggtggctaataaagaaaaaacagtgcaagacttaaaacaagagatcaaagccctgaaggaggagataggaaacgtacagctggagaaggcccagcagttgtcaatcacgtccaaagttcaggagttacagaacctcctcaaaggcaaggaggagcagatgaacacaatgaaagccgtgctcgaggagaaagaaaaagaccttgcaaatacaggtaagtggctccaagatctccaggaggagaatgagtcactgaaggctcatgtccaggaagttgcgcaacacaacctgaaagaagcctcatctgcatctcagtttgaagaactggaaattgttcttaaagagaaggaaaacgaacttaaacgcctggaggcgatgctaaaagagcgagagtccgatctgtcatccaagacccagctgctgcaagacgtgcaggatgagaacaagctgtttaagagccaaatagaacagctcaaacagcaaaactatcaacaggcctccagtttccccccacacgaggagctcctcaaggtgattagtgaaagggaaaaagaaattagcggcctgtggaatgagcttgattcactcaaggacgcagtagagcaccagagaaaaaagaataatgatcttcgggaaaaaaattgggaagcaatggaagcactggcttcgaccgagaagatgttacaagacaaagtgaataagacatcgaaggagcggcaacaacaggtggaggcggtggagttggaagctaaggaggtcctgaagaaactcttccccaaggtgtccgtgccgtccaacctatcttacggtgaatggctacatgggttcgaaaagaaagctaaggaatgtatggccggaacctccggatccgaagaggtgaaagtgctcgagcataagttgaaagaagctgacgaaatgcataccctactgcagctggagtgtgaaaaatataagagtgtcctcgcagagacagagggaattctccaaaagcttcagcgcagcgtcgaacaagaagaaaacaagtggaaggtgaaagttgacgagagccataagactattaaacaaatgcagagttccttcacttcatcagagcaggagcttgagcggctcagatccgagaataaggacatcgagaatctccgcagggaacgagaacacctcgagatggagcttgagaaggcagagatggaaaggagcacatatgtcacagaagtccgagagctgaaggatttacttacagagctccagaaaaaactagatgacagctattccgaagctgttcgtcaaaacgaggagctgaacctcctcaaggctcaacttaacgagactctaacgaagctccgcaccgaacagaacgagagacagaaggtagctggagacctccacaaagcccagcagagtctggagttgatacaaagcaaaatcgtcaaggctgccggcgatactaccgttatagagaacagtgacgtgtcacccgaaacggagtcttctgagaaagaaacaatgtctgtgagtctgaatcagacagtgactcagctccaacagctcctgcaggccgttaatcagcagctgactaaggagaaagagcattatcaagtgttagagtag

SEQ ID NO: 192401 - DNA, 3921 bp, Artificial Sequence
  Description of Artificial Sequence: Synthetic coding sequence
atggagttctacgagagcgcctacttcatcgtgctgatccccagcattgtgattacagtcatcttcctctttttctggctctttatgaaggagaccctatatgacgaggtgttggcaaagcagaagcgcgagcagaaattaattcctactaagactgacaaaaagaaggcagaaaaaaagaagaataaaaagaaagaaatacagaatggcaatctgcacgaaagtgactccgagagtgttcctagagactttaagttgtccgacgccctcgcagtggaggatgaccaggtggcgccagtccccttgaatgtcgtagaaacatcctctagtgtgcgagaacgcaagaaaaaagaaaaaaagcagaagccggtcctcgaggagcaagtcataaaagaaagcgacgcatccaagatacccggtaagaaagtggaacctgtgcctgttacaaagcagccgactccacctagcgaggcagctgcctcaaagaagaagcctggtcaaaagaagtcaaaaaacggatccgacgaccaagacaagaaagtggagactttgatggtgccttcaaagcgacaagaggcactgcctctgcatcaggagaccaagcaagagtccggcagtgggaaaaaaaaggcctcatcaaaaaagcagaaaacagaaaatgtatttgtcgatgaacccctgattcacgccaccacctacattccgctcatggacaacgccgacagttcacccgtggttgacaaacgcgaggtcatcgatttactcaaaccagatcaagtcgagggcattcagaaaagcgggacaaaaaaactgaagaccgaaacggacaaggagaacgcagaggtcaagtttaaggatttcctcttgtccctgaagactatgatgttcagtgaagacgaggcgctctgtgttgttgacctgctaaaagaaaaatccggcgttatacaggacgcgttgaagaaatcttctaaaggggagctcaccactcttatccaccagctgcaggaaaaagacaagttgctagccgcggtgaaagaggacgccgccgccacaaaggatcgctgtaaacaactcacacaggagatgatgactgagaaggagcgttcgaacgtggtaattactcgaatgaaagacagaattgggaccttggagaaggaacacaacgtgttccagaacaaaatacacgtcagttaccaggaaacacagcaaatgcagatgaagtttcaacaggttcgagagcagatggaggcagagatcgcccatttaaagcaggaaaacggaatcctgagggacgctgtctctaataccacgaaccagttggagtctaagcagtccgccgagctgaacaagctgcgtcaagactatgccagactggtgaatgaattgacagagaaaaccggtaagctgcagcaggaggaagtccagaagaaaaacgccgagcaggcagccacccagctgaaagtgcagcttcaagaggcggagcgtcgttgggaagaggtgcagagctatattaggaagcgcactgccgaacacgaagccgcacaacaggacctgcagtccaaattcgtggccaaagagaacgaggtgcagtcccttcactcgaagttaacagacaccctggtgagcaagcagcaactggagcagcgcctgatgcagctcatggagagcgagcagaaaagggtcaacaaagaggaatcactacaaatgcaagttcaggatatcctcgagcagaacgaggccctgaaggcacagatccagcaatttcatagccagattgccgcacaaacctcagcaagcgtacttgcggaagagttgcataaggtcatcgctgagaaagacaaacaaataaagcagaccgaagacagtctggccagcgagcgagatcggctgactagcaaggaggaagaacttaaggacatccagaacatgaacttcctcctcaaggccgaagtccagaagctacaagcgctcgccaatgagcaggcggccgctgcacatgagctcgaaaagatgcaacagtccgtgtacgtcaaggacgataaaattcggctactggaggaacagctccaacacgagattagtaataagatggaagagttcaagatcctcaatgaccaaaataaagctctgaaatccgaggtacagaaactacagacgctggtgagcgaacaacccaacaaagacgtggtggaacaaatggagaagtgtatacaggagaaggatgaaaagttgaaaacggtcgaagagcttctcgagacaggtctcatccaggtggccacgaaggaagaggagctcaacgcgattcggactgagaattcatccctcaccaaagaggtccaagacctgaaggctaaacagaatgaccaagtatcttttgcttctcttgtggaagagctgaagaaggtcatacatgagaaagacggtaaaatcaaatccgtcgaggagctgctcgaggccgaactgttgaaggttgcaaacaaggaaaagactgtgcagctttcgatcacttccaaggtgcaagagcttcaaaacctgcttaaggggaaggaagaacagatgaatacgatgaaggcggtgttggaggagaaagagaaggacctggctaacacgggtaaatggttacaggatctgcaggaggagaatgagtcactaaaggcacacgtccaggaagtggcccagcacaatttgaaagaagctagcagtgcctcccagttcgaggagctagagattgtgttgaaagagaaagaaaacgagcttaagagattggaagctatgctgaaggagcgggagagcgacctgagctctaagacacagttgctgcaggatgtgcaggacgaaaataaactctttaagagccagatcgagcagctcaaacagcaaaactatcagcaagcttcaagctttcctcctcatgaagagcttcttaaagtgataagcgagagggaaaaagaaatcagcggcctctggaatgaactggattctttgaaggacgccgtcgaacaccaacggaaaaaaaataacgacctcagggagaagaactgggaggcaatggaagcccttgccagtaccgagaaaatgctccaggataaggtcaataagacatctaaagaaaggcagcagcaggtagaagctgtggagctcgaagcgaaagaggttttgaaaaaactttttcctaaggtaagcgtgccatcaaacttatcatacggggaatggctccatggcttcgagaaaaaagcaaaggagtgcatggccgggacatcagggtctgaggaagtaaaggtgcttgaacacaaacttaaagaagcagatgagatgcatacactcctgcagctcgagtgcgaaaagtacaaatcggtgctggctgagacggagggcattctgcagaaactgcagcggagtgttgaacaagaggagaacaagtggaaggtcaaggtggacgaatcacacaagacaatcaagcagatgcaaagctctttcacctcatcggagcaggaactcgaacggctccgctccgaaaacaaagacatagaaaacttaaggagagagcgggagcatctggaaatggaactcgagaaggcggagatggagcgctcgacctatgtaacggaggtgcgggagttgaaggcgcagttgaacgaaacattgacgaagctgagaacagaacagaatgagcggcaaaaagtggccggcgacctccacaaggctcagcagtccctggagcttatccagtccaagatagtgaaagcagccggtgacacgacagtgattgagaatagcgacgtgtctccagaaactgagagttctgagaaggagacgatgtcagtcagcctcaatcagactgtcacccagctgcagcaactgttgcaggctgttaaccagcagctgaccaaagaaaaagagcactaccaagtgctagaatag

SEQ ID NO: 192402 - DNA, 4074 bp, Artificial Sequence
  Description of Artificial Sequence: Synthetic coding sequence
atggagttctacgagagcgcctacttcatcgtgctgatccccagcatcgttatcaccgtgatttttttgttcttttggctgttcatgaaggagaccctttatgacgaggtgctggccaaacagaagagagaacagaaattgatacccaccaaaactgacaagaaaaaggctgagaaaaaaaagaataaaaaaaaagaaattcagaacggaaacctccatgagagcgactcagagtccgtgccacgggacttcaagctgagcgatgctctggccgtggaagatgaccaggtcgctcccgtccccttgaacgtcgtcgagacttcatcctccgtgcgcgagagaaaaaagaaggagaaaaaacagaagcctgtcttggaggaacaagtcatcaaggaaagcgacgcctctaagatacccggcaaaaaggtggagccagtccccgtaaccaaacagcccaccccaccgtccgaagctgcagcttccaaaaagaagccaggacaaaagaagagcaaaaatgggtcagacgaccaagacaaaaaagtggagaccctgatggtcccaagcaaaaggcaggaagccctaccgctccatcaggaaacgaagcaggagtccggttcagggaaaaaaaaggccagttctaaaaaacagaaaaccgagaacgttttcgttgatgagccgctgattcatgcaacaacatatattcccttgatggataacgctgactcctcccctgtcgtagacaaacgcgaagttatcgacctattaaaaccggaccaggtagaaggtattcaaaagtcgggaaccaagaagcttaaaaccgaaaccgacaaagagaacgcagaagtcaagttcaaggacttcctgctgagtctgaaaactatgatgttttcagaggacgaagcactgtgtgtagtggacctactcaaggaaaagtctggcgttattcaggacgcactgaaaaaatcttctaaaggcgaactgaccacactgatccaccagctgcaggaaaaagacaagttgctcgcagctgtgaaagaagacgccgcagcaacgaaagaccggtgcaagcagctgacccaggaaatgatgacagagaaagaacgcagcaacgtggttatcaccaggatgaaggaccgaatcggtaccctcgaaaaggagcataacgtctttcagaacaagatccacgtatcctaccaagagacacagcagatgcagatgaagttccaacaggtgagagagcagatggaagccgaaatagcacacttgaagcaagagaacggcatcctgagggacgccgtatctaacaccaccaaccagcttgagtcaaagcagtcagcagaactgaacaaactgaggcaggattatgctcgccttgtcaacgagctaaccgagaaaacgggaaagttacagcaagaagaggtccagaagaaaaatgcggagcaagctgcaactcagttgaaggtacagctgcaggaagccgagagacgatgggaggaagtccagagctatattcgaaaacgtaccgccgaacatgaggccgcccaacaggacctgcagagcaagtttgtggcaaaggagaacgaggttcagtcactgcattccaagctgacagatacactggtgtctaagcaacagttagagcagcgattaatgcaattaatggaatccgagcagaaacgagtgaataaagaggagtcactccaaatgcaggttcaggatatcctggagcaaaatgaggccctgaaagcgcaaatccagcaattccactcccaaattgcagcccagacatctgcctcagtactggccgaggagctccataaagtgattgcagagaaagacaaacagatcaaacaaaccgaggacagtctggctagcgagcgggaccggctgacatcaaaggaggaggaacttaaggacatccaaaacatgaactttctcctaaaagctgaagttcaaaagctgcaggcgttggctaacgaacaggccgccgctgctcatgaactggaaaagatgcaacagtctgtgtacgtgaaggacgacaaaattaggctgctcgaagagcagcttcagcatgagatctccaataagatggaggagttcaagattcttaatgaccaaaacaaggccctcaagagtgaggtgcaaaagctgcagacattggttagtgagcagccaaacaaggatgtcgttgaacagatggaaaaatgtattcaggagaaagacgaaaaacttaagacagtcgaagagttgcttgagacaggccttatccaggtggctacaaaggaagaggagctgaatgccatccgcaccgagaatagcagcttgaccaaggaggtacaagacttgaaggcaaagcagaacgaccaggtcagctttgccagtctcgttgaggagctgaaaaaagtgattcatgagaaggacgggaagataaagtccgtggaagagctgttggaggcggaactcctcaaggttgcaaataaggagaagacagtgcaagaccttaagcaagaaattaaggctttgaaggaggagatagggaacgtacagctcgaaaaggcccagcagctcagtataacctctaaggtccaagaactgcagaatctgctaaaaggcaaagaggagcaaatgaacaccatgaaggcagttctggaggagaaggagaaagacctggctaacaccggaaaatggctgcaggacttacaggaggagaacgaaagtctcaaggctcacgtgcaggaagttgctcagcataacctgaaggaggcctctagtgcgagccaattcgaggaattagaaattgtgctgaaggaaaaagagaatgagctcaagaggctggaagccatgctgaaggaacgagagtccgatctgagttcgaagacacagctattacaggacgtgcaggatgagaacaaactgtttaaatcccagatagagcagctgaaacagcagaactaccaacaggcttcctcgtttcctcctcatgaagagctgctgaaagtaatttccgagcgcgaaaaagagatcagcggcctttggaacgagcttgattctttgaaggacgcagtggaacaccagcgcaaaaaaaacaatgacctacgtgagaagaactgggaggcgatggaggccctcgcatcaaccgagaaaatgttacaggacaaggttaacaagacctccaaggagcggcagcaacaggtcgaggcggtggagctggaggccaaggaggttctgaagaagcttttcccgaaggtctcagtgcctagcaatttgagctacggggagtggttacacggttttgagaaaaaagcgaaggaatgcatggcaggcacaagcggttccgaagaggtgaaggttctcgagcacaagctcaaggaggccgatgagatgcacacgcttctgcaactggagtgtgaaaagtacaagagtgtgctggctgagaccgaaggtattctgcagaagctacagcgcagcgtggagcaggaggagaacaaatggaaggtcaaagttgacgagtcacataagacgatcaagcagatgcagagctcttttacaagcagcgagcaagagctggaaaggctgagatctgagaacaaagatattgagaacttgagaagggagcgcgagcacttggaaatggagctggaaaaggccgagatggagcgctccacctatgtcaccgaggtaagagaactgaaagacctgctcactgagctgcagaagaagctcgacgactcgtacagtgaagccgtgcgtcagaacgaagaactgaaccttctgaaggcccagctcaatgaaacgctaacgaagttacgcactgaacagaatgagcgccaaaaagtggctggcgacctgcacaaagcccagcagagccttgaactgattcaatcaaagatagtgaaagcagctggcgatacaacagtgatagaaaactctgatgtatcgcctgagacagagtcatcagagaaggaaaccatgagcgtctctctaaaccagacagtgacccagctgcaacagttactccaggctgtgaaccagcagctgactaaagagaaggaacattatcaggtgttggaatag

SEQ ID NO: 192403 - DNA, 3903 bp, Artificial Sequence
  Description of Artificial Sequence: Synthetic coding sequence
atggagttctacgagagcgcctacttcatcgtgctgatccccagcatcgtgattaccgtcatcttcctgtttttttggctttttatgaaggaaaccctctacgatgaggtgcttgctaagcagaagcgggaacaaaaacttatccccaccaaaacggataaaaaaaaggctgaaaaaaagaaaaacaagaagaaagaaatccagaacgggaaccttcatgagagtgactctgagagcgtgcctcgggactttaaactgtcagacgccctggccgtggaagacgaccaggttgcaccagtcccactcaatgttgtcgaaaccagttctagcgttagggaacgcaaaaagaaagagaaaaagcagaaacctgtgctggaggagcaggtcattaaagagtcagacgcatccaaaattcctggtaaaaaagtagagccagttcctgtgactaagcagccaacccctcccagtgaagctgccgcaagcaaaaaaaagcccgggcagaaaaaaagtaaaaatggaagcgatgaccaggataagaaagtagagacactgatggtaccctcaaagcggcaagaggccctcccactgcaccaagaaacaaagcaggaatccggttccggcaagaaaaaggcctctagcaagaagcagaagacggagaatgtctttgtggatgaaccactcattcatgccacgacatacattccactgatggataacgctgatagttcacccgttgtagacaagcgggaggtgatcgacctgctgaagcctgaccaggttgagggaattcaaaaaagcgggactaaaaaactcaaaacagagacagacaaggaaaacgccgaagttaagtttaaagattttctcctgtcattaaagaccatgatgttctccgaggacgaggccctgtgtgttgttgacttgctgaaagagaagtcaggcgtaattcaggatgccctgaagaaatcaagtaagggcgagttgaccactcttatacaccagctgcaagagaaagacaaactgctcgctgcggtcaaagaagacgccgctgctacaaaagacaggtgtaagcagctaacccaggaaatgatgacggaaaaggaacgatccaacgtggtcatcactcgaatgaaggatagaattggcactctggaaaaggaacataacgtgtttcagaacaaaattcacgtgagttaccaggaaacccaacagatgcagatgaaattccagcaggtgcgcgagcagatggaagccgagatagcgcatctcaagcaggaaaacgggattctgcgggacgccgtcagtaacaccaccaaccaactggaaagcaagcaatccgcagaactcaacaagctcagacaggactacgcccgcctggtcaacgagctgactgagaaaaccgggaaactgcagcaagaggaggtccagaagaaaaacgctgaacaggcagccacccagttgaaggtgcaattgcaagaggccgaacgcagatgggaagaggtccagagttatataaggaaaaggactgccgagcatgaagccgctcagcaagacctccagtccaaattcgtggcaaaggaaaacgaggttcagtccctgcactctaagcttacagacacactcgtgtccaagcaacagctggagcagcgcctgatgcagcttatggaaagcgagcaaaagcgtgtgaataaagaagaatcgctccagatgcaggttcaggacatcctagaacagaacgaagcactcaaagcacaaattcagcaattccacagccaaatcgccgcacagaccagcgccagtgtgctcgcggaggagttacacaaggtgatcgctgaaaaagataaacagataaagcagacagaagatagcctcgcttcagaaagggatcgcctcaccagcaaagaagaggagctgaaggacatccagaatatgaatttccttttgaaagccgaggttcagaagctccaagccctcgcaaacgagcaggctgctgctgctcacgagcttgagaagatgcagcaatcagtgtacgtgaaagacgacaagatccggctcttggaagagcagcttcagcatgaaatttcgaacaagatggaagaattcaagatcctcaacgaccaaaacaaagctctgaagagtgaagtccagaaactgcagaccctggtgagcgaacagccaaacaaagatgtggtggagcagatggagaaatgtatacaagaaaaagacgaaaaactgaagacagtggaggagcttctggagactggccttatccaagtggccacaaaggaggaggaactaaacgcgatccgcacagagaattctagtttgacgaaggaggttcaggatctgaaggcgaagcagaatgatcaggtaagcttcgccagcctagtggaagaacttaagaaggtaatccacgagaaggacggaaagatcaagtccgttgaagagctgctcgaggctgaacttctcaaggttgcaaacaaagagaaaacggtccaggatctgaaacaggagattaaagcccttaaggaggagatcggcaacgtgcagctcgaaaaagcacagcagctctcgataacaagcaaagtgcaggagctgcagaacctcttaaagggaaaggaagaacaaatgaataccatgaaggccgtgttggaagagaaggagaaagacctggctaatactggaaaatggctgcaggatcttcaggaggagaacgagtctctgaaggcccatgtccaagaggtagctcagcataatttgaaggaagcctcatccgcctcgcaatttgaagaactcgaaatcgtgttaaaggaaaaagagaatgagctcaagcgtctggaggccatgctgaaagagagagagtccgatctgagctccaagacccagctcttacaggacgtccaggacgagaataaactgtttaaatcccaaattgagcagcttaaacaacaaaactaccaacaagccagtagctttcccccacacgaggagctgctaaaggtaataagcgaacgtgaaaaagaaatctctggactgtggaacgagttggatagtctgaaggacgcagtcgaacatcaacgcaagaaaaacaacgagcgacagcagcaggtggaggcggtggaactcgaggctaaggaagttttaaaaaagctgtttcccaaagttagcgttccgagcaatctttcatatggcgagtggcttcatggctttgaaaaaaaggctaaagaatgtatggccggaacttcggggtccgaggaggtcaaggtactcgagcacaagttgaaagaggcagatgagatgcatactttgctacagctggagtgtgagaagtataaatcagtgctggccgaaaccgagggcattctccagaaactgcaacggtccgtcgagcaagaagaaaacaaatggaaagtcaaagtagacgagagtcataagaccatcaaacaaatgcaaagtagctttacatccagtgagcaagagctggaacgtctcaggagcgagaacaaagatatagaaaatcttcggcgagagagggagcacctcgagatggaactcgaaaaagccgaaatggaacgaagtacatatgtgactgaggtgagagaactgaaggcgcagctgaacgagacactgacaaagctccggaccgaacagaacgagcggcagaaagttgccggagacttgcacaaggcgcagcagagcctggaactcatccaatccaaaattgtcaaggccgccggcgacaccaccgttatcgagaatagcgacgtttcgcccgagactgaaagctctgagaaagaaacaatgagcgtttcccttaaccagaccgtcacacagttacagcaactgctgcaagctgtgaatcagcagcttactaaggaaaaggaacactaccaagtattggagtag

SEQ ID NO: 192404 - DNA, 4074 bp, Artificial Sequence
  Description of Artificial Sequence: Synthetic coding sequence
atggagttctacgagagcgcctacttcatcgtgctgatccccagcattgtgattacagttatctttctgtttttttggctgttcatgaaggaaacactttatgatgaggtgttggcgaagcagaaacgggaacagaagcttatccctaccaagaccgacaagaagaaggctgaaaagaaaaaaaacaagaagaaggaaattcagaatggtaaccttcacgagagcgacagcgagagcgtgcctagagactttaagctgagcgacgcgctggccgttgaggacgaccaggtagctcccgtgcccctgaatgtggtggaaacttcaagctcagtgagggagagaaaaaaaaaggaaaagaagcagaagccggttctggaagagcaggtgatcaaggaatccgacgcctctaaaatcccaggtaagaaggtggaacccgtccccgtcacgaagcagcccacacccccttcagaggctgcagctagcaagaaaaagccaggccagaaaaagagtaaaaacgggtctgacgaccaggataaaaaagtagagacactaatggtgccaagcaaacgccaagaggctctgccactgcatcaagagactaagcaagagagcggctccggcaaaaagaaggcttcttcaaaaaagcagaaaacggagaacgtttttgttgacgaaccccttatccatgccactacttacatcccactgatggataacgctgactcatccccagtggtagataaacgcgaggtgatcgacctcctgaagccagaccaggtggaaggcatacaaaaatccgggaccaaaaagctgaagaccgagaccgataaggagaacgcagaggttaagtttaaagatttcctactgagcctgaaaactatgatgttctccgaggacgaggcgctttgcgtcgtggatctgctgaaggagaaaagtggagtaatacaggacgccctgaaaaagtcatcgaagggggagctgaccaccctcattcaccagctacaggagaaggacaaacttctcgcagctgtgaaagaagacgcagcagccaccaaggatcgctgcaaacagctcacacaggagatgatgaccgaaaaggagcgtagcaacgtggttatcactaggatgaaggaccggatcggcacactggagaaggagcataacgtgtttcaaaacaagatacatgtgtcctaccaggaaacacagcagatgcagatgaaattccagcaggtcagagagcagatggaagcagaaattgcacacctaaagcaggaaaacggcattctgagagacgcggtgagcaacacgacaaaccagctggagagtaagcaatcagctgaactcaataagctgcgtcaggactatgctaggctggtcaatgagctgactgagaaaaccggtaagctgcagcaggaagaagtgcagaagaaaaatgctgagcaggccgctacccaactgaaggttcagctgcaggaagccgagcgaaggtgggaagaggttcagtcctatatcagaaagcggacagctgagcatgaagccgcccagcaggacttgcaatcaaaatttgtggcaaaggagaatgaggtccagagcctccactcaaaactcacggatacgctggtgtctaagcaacagctcgagcagcggcttatgcagcttatggaatcggagcagaagcgtgtgaataaagaagagtcgctgcaaatgcaagttcaagacatattggagcaaaacgaggcattaaaggcccagatccagcagttccattcccagatagcagcccagacctcagcatccgtgctcgccgaggagctccacaaagttattgctgagaaggataagcaaattaaacagactgaagactcgctagcgtccgagcgcgatcgactgaccagcaaagaagaagagctgaaggacatacagaacatgaactttctcctcaaggcagaggtacagaagcttcaggccctggctaacgagcaagcggctgcagcccacgaactggagaaaatgcagcagagcgtgtacgtcaaagatgacaagatccgactgctagaggagcaattacagcacgagatctccaacaagatggaggaattcaaaatcctgaacgaccaaaacaaggctctgaagtctgaggtgcaaaaattgcagacgctcgtgagtgagcagccgaacaaggacgtcgttgagcagatggagaagtgcatccaggagaaggacgagaagctgaagacggtagaggagctcctcgagaccggtctcatccaagttgcaaccaaggaagaagagcttaacgctatccgtacggagaactcttcattgacaaaagaggttcaggaccttaaggctaagcagaatgatcaagtctcctttgcttctcttgtggaggagctgaagaaggtcatccacgagaaggatggcaagatcaaaagcgtggaagagttactggaggcagagttactcaaggtggctaacaaggagaagaccgttcaggatctcaaacaggagatcaaggctctgaaggaggagatcggaaacgtgcagctggagaaagcccagcaactgagtattacatcgaaggtgcaagagctgcagaaccttcttaagggaaaagaagagcagatgaacacaatgaaggctgtgctggaggagaaggaaaaggatctcgccaataccggaaaatggcttcaagaccttcaagaggagaatgaatcattgaaggcgcacgtgcaagaggtcgcccaacataacctcaaggaagcaagtagtgcaagtcaatttgaagaactggagattgtgcttaaggagaaagaaaatgagctgaagaggctggaagccatgctgaaggagagggaatctgatctgtcttccaagacccagctactccaggacgtgcaggacgaaaacaaactcttcaaaagtcaaatcgagcaactgaaacagcagaattatcagcaggcaagctcctttccaccacacgaagaactccttaaggtgatatcagagagggagaaggagattagcgggctctggaacgaactggattcactgaaggatgccgtggagcatcagcggaagaaaaacaacgatctcagggagaaaaactgggaagcaatggaggcacttgcctcaacagagaaaatgcttcaggataaggtgaataagacgagcaaggagaggcagcagcaggtagaggcagtggagctggaagcaaaggaggttctgaaaaaactgttcccgaaggtaagtgtcccatctaatctgtcctatggggagtggctacacgggttcgaaaaaaaggctaaggagtgcatggccggcacttccggctccgaggaagtgaaggtgctggagcacaaattgaaggaggctgacgaaatgcacacactcttacagctggagtgtgagaaatataagtcggtcctagccgagactgagggaattctacaaaagcttcagcggtctgtggagcaagaggaaaacaagtggaaggttaaagttgatgagagccacaaaacgatcaaacaaatgcagtcttctttcacgtccagcgagcaggagttagaacgtctgagatccgaaaacaaagatattgaaaacctgcggcgcgagcgagagcacctcgaaatggagctggagaaagccgagatggagcgtagtacctatgttacggaagtgcgtgaactcaaggacctcctgaccgaattacaaaaaaaactggatgatagttactccgaggcggtaagacagaatgaggagctgaatctcctgaaggcccagctcaatgagaccttgaccaaacttaggacggagcagaacgaacggcagaaggttgccggcgatctgcataaagcacagcaaagtctagaacttatccaatcaaagattgttaaggccgctggtgataccactgttatcgagaactctgatgttagtccagagactgagagttccgaaaaggagaccatgtccgtgagtttgaaccagaccgtgacccaactgcagcagttgctgcaggccgtcaatcagcaattgacaaaggaaaaggaacactaccaggtgttagaatag

SEQ ID NO: 192405 - DNA, 228 bp, Artificial Sequence
  Description of Artificial Sequence: Synthetic coding sequence
atggagttctacgagagcgcctacttcatcgtgctgatccccagcattgtgattaccgtcatctttctgttcttctggcttttcatgaaggagaccctatacgatgaggtgctggctaaacagaaacgagaacagaagctgatccccacgaagacagacaaaaagaaggctgaaaaaaaaaaaaataagaagaaagagattcagaacggaaatttacacgaaagctag

SEQ ID NO: 192406 - DNA, 183 bp, Artificial Sequence
  Description of Artificial Sequence: Synthetic coding sequence
atggagttctacgagagcgcctacttcatcgtgctgatccccagcattgtcattaccgttattttcctgttcttttggctgttcatgaaggaaactctatacgatgaggttctcgctaaacagaagcgggagcagaaactgataccaactaagaccgacaaaaaaaaagccgaaaaaaaatag

SEQ ID NO: 192407 - DNA, 3171 bp, Artificial Sequence
  Description of Artificial Sequence: Synthetic coding sequence
atggccagccagcccaacagcagcgccaagaagaaggaggagaagggaaagaatattcaggtggtcgttcggtgcaggcccttcaacctcgccgagcgtaaggcatcagcccattcaattgttgagtgcgaccctgtccggaaggaggtgagcgtgcgcactggtggcctcgcggacaagagttctaggaagacatatacctttgacatggtgttcggggcttcaaccaaacaaattgatgtgtaccgcagtgttgtctgtccgatcctcgacgaagtgataatgggctacaattgtactatttttgcatacggacagactggcacaggaaaaactttcactatggaaggcgaacgaagtcctaacgaggaatatacatgggaggaggatcccctggctggtatcattccacggacattacatcagattttcgagaaacttacagacaatggcaccgagtttagcgtcaaggtttctttgctcgaaatttataatgaggaactatttgacctgctaaaccctagctcagacgtgagcgaaagattgcagatgttcgacgacccacgaaacaagaggggcgttatcatcaaggggttagaggagatcactgtgcataataaagacgaagtgtatcagatattagaaaagggagctgcgaagaggacaacggctgccacactgatgaacgcttattccagcagatcccattctgtattctccgtgactattcacatgaaagagactactatcgatggggaagaattggtcaagatagggaaactgaacttggtggacctggcgggatctgagaatatcgggaggtctggggcagtggataaaagagctcgagaggccgggaacattaaccagtctttgttgacgttgggaagggtgattaccgccctggtggagaggacaccacacgtcccctatcgggagagtaaattaacaagaatcctgcaagattctctgggtggacgaaccagaacctctataatcgccacaatatcacccgccagcttaaacctagaagaaacgctctcgactttggagtacgcccacagagctaagaatatcctgaataagccagaggtaaaccaaaagcttacaaaaaaagccttaattaaagagtataccgaggagatcgagcgcttaaaaagggatttggccgctgctagagagaaaaacggggtctatattagcgaggaaaattttagggtcatgtctgggaagcttaccgtacaggaagagcagatcgtggagctcatagaaaagattggcgcagtcgaagaagaattgaacagagttaccgagttgtttatggacaataaaaatgagctagaccagtgtaagtcagatttgcaaaacaagacccaagaacttgagacaacccagaagcacctgcaggagacaaagctgcaactggtgaaggaagagtacattaccagcgccttggagtccacggaggagaaacttcatgacgccgccagtaagctactgaacaccgtcgaggagacaactaaggatgtgtcgggccttcactcaaaactggataggaaaaaggcagtagaccagcacaatgcagaggcgcaggacatctttggtaagaacttaaactcactgtttaacaacatggaggaactaatcaaggacggatctagcaagcagaaggccatgttagaggttcacaaaactctctttggaaatctactgtcctctagtgtgtctgccctcgatacaattactacagtggctcttggctctctgacaagcatccccgagaatgtgtcaacccacgtgagccagatctttaacatgatcctgaaggagcagagtctcgccgcagagagcaaaacagttcttcaggagctgatcaatgttctgaaaacagaccttctgagttccttggagatgattctatctccaactgtggtatccatacttaaaatcaatagccaactcaagcatattttcaagacctccctaactgttgctgataagattgaggaccagaagaaagaactggacgggtttctgtccatactctgcaacaatctgcacgaactgcaagagaacactatatgtagcctggtggagtcgcagaaacaatgtggcaacctcaccgaggacttgaagactatcaaacagactcactctcaggagctttgcaagctgatgaatctctggacagagagattctgcgccttagaagaaaagtgcgaaaacatacagaaacccctctctagtgtacaggaaaacattcagcagaagtctaaggatatcgtgaataaaatgacattccactctcaaaaattttgtgcagattctgatggcttttctcaagaacttaggaatttcaatcaggagggtactaagctggttgaggagtctgtgaagcacagcgacaagttgaacggtaacttagaaaaaatctcacaagaaacggagcagaggtgcgagtctctcaatacacgaacggtttatttttcagagcagtgggtctcctctctcaatgaacgggaacaggaactccataacctgctggaagtagtgagtcagtgctgtgaggccagttcgagcgacatcactgaaaaatcagatggaaggaaggccgcccacgaaaaacagcacaatatcttcctggaccagatgacaatcgatgaggataagctgatcgcccaaaatctcgaacttaacgaaaccatcaaaattgggctaacgaagttgaattgcttcctcgagcaagatctcaagctcgatatccccactggcacaaccccacagaggaaaagttacctgtatccttcaactcttgttcgcacagagccaagagagcatctgctcgaccagctgaaaaggaaacaacccgagcttctaatgatgctgaattgtagcgagaacaacaaggaggagacaattcctgacgtcgatgtggaagaagccgtcctggggcagtatactgaagagcccctgtcccaggagccatcagtggatgcaggggtagactgcagcagcataggtggcgtcccgttttttcagcataaaaagtctcatgggaaggacaaagagaatagaggcattaataccttggagcggtccaaggtggaggagacaactgagcatctggttacaaagtcccggttaccccttagggcacaaataaacctgtag

SEQ ID NO: 192408 - DNA, 5418 bp, Artificial Sequence
  Description of Artificial Sequence: Synthetic coding sequence
atgagcgacaccaaggtgaaggtggccgtgcgggtgcggcccatgaaccgaagagagctggagttgaacacgaagtgtgtagttgagatggagggcaaccagacggtactgcaccctcctcccagcaacactaaacagggcgagagaaaaccccccaaggtgtttgcttttgactattgtttttggtcaatggatgagagtaacactactaagtacgctgggcaggaagtggttttcaagtgtctgggagagggaattctcgaaaaggcctttcaaggctacaacgcctgtattttcgcttacgggcagaccgggtcaggcaaatcctttagcatgatgggccacgccgaacagcttggcttgatccccaggctgtgttgtgcactgttcaagcgcataagtctggaacagaatgaatcacaaactttcaaagtggaagtctcttacatggagatctacaacgaaaaagttcgagacctcttggacccaaaaggctcccgccagtccctgaaggtcagggagcataaggtattagggccatatgtagacgggttgagccagctggcagtgacgagtttcgaagatatcgagagcctgatgagtgagggtaataaatctaggactgtggcagcaaccaatatgaacgaagaatccagccggtcccacgccgtgtttaatatcatcatcacgcaaacattatacgatctccagagcggcaattccggagaaaaagtgtccaaagtttccctagttgatctggctgggagcgaacgagtgtccaagaccggggccgcaggggaacgtctgaaggaaggctccaacatcaataagtcactaaccaccttgggcttggtgataagctcactggcagatcaggctgcagggaagggcaaatccaagttcgtgccgtacagggatagtgtgctgacttggctcctgaaagataacctcggtggcaactcccagacatcaatgatcgctacgatctcccccgcggccgacaattacgaggaaacgctttctacactgaggtatgcagaccgcgccaaaagaatcgtcaaccacgctgttgtcaacgaggacccaaatgcaaaggtgatcagagagctgcgggaggaagttgaaaagttaagagaacagctgtcccaggctgaggctatgaaggctccagaactgaaggagaagctagaagagagcgagaaactgataaaagaattgactgtcacttgggaggagaagctccgaaagactgaggagatcgctcaggagcgacagaggcagctggaatcgatgggcatatcactggaaatgagcggaatcaaagtcggcgacgacaagtgttatttggtgaacttgaatgcagatccagcactgaatgagctgctggtgtactatttaaaagaccacaccagggtcggggcagataccagccaggacatccagcttttcggcatcggcattcagccgcagcattgtgagattgatattgcctccgacggcgacgtgacactgacaccaaaagagaacgcaaggagctgcgtgaacgggactttggtatgtagcactactcaactgtggcatggtgatcgaattttgtggggaaacaaccacttcttcaggataaacctgccaaagaggaagaggcgtgattggcttaaagacttcgaaaaggagacaggccctccggagcacgacttggatgcggcatcagaagcttcttctgagccagattataattacgaatttgcccagatggaggtgattatgaagactctcaattccaatgatcctgtccagaatgttgttcaggtgctagaaaagcaatatctcgaggagaaaaggagcgcattagaagagcaacggcttatgtacgagcgagagctggagcaactgcggcagcagttgtctccggatcggcaaccccagagctctggccctgatcgactggcgtacagcagtcagacggctcagcaaaaggtaacccagtgggccgaggaacgcgacgagctgttccgccaaagcctcgccaagctgcgcgagcagctggtaaaggccaacacactagtgcgagaggctaactttctggccgaagaaatgtcaaaactcaccgactaccaggtgactctgcagatcccagccgctaatctgtcagctaataggaagcgtggtgctatcgtttctgagccggccatccaggttcgaagaaagggcaaatcgacacaagtgtggacgatcgagaaactagagaacaagcttatagatatgcgcgacctataccaggagtggaaggagaaggtgcccgaggccaaacggctatatggaaagcgcggagatcccttctacgaggcacaggagaaccataatctcattggagtcgctaatgtgttcctggagtgcctgttctgtgacgtgaagctgcagtatgctgtgcctattatttcccagcaaggagaggtggccgggcgtttgcatgtcgaagtgatgagagtgaccggcgccgtcccagagcgcgtggttgaagatgatagctccgagaactcttctgaaagtggaagccttgaggtggtggatagtagtggcgaaatcattcaccgcgtgaagaagttaacctgcagagtcaagatcaaagaggctacggggcttcctctgaacctttctaacttcgttttctgtcagtacacattctgggatcagtgcgaatctactgtggccgcccctgtcgtggacccagaagtgccctcaccccaatccaaggatgcgcagtatactgtgacattcagccactgtaaggactatgtcgtcaatgtcacggaagaatttctggaattcatctccgatggcgctctagcgattgaagtgtggggccatcgttgtgcgggaaacggtagcagcatctgggaagtggactccctccatgcgaaaacacgaactttgcacgatcggtggaatgaggtcacccggcgtattgagatgtggatctccattcttgaattaaacgagctcggggagtacgcggccgtagagctgcatcaggcaaaagatgtcaacacaggtggtatattccagctaaggcagggccactcacggcgggtgcaagtgactgtgaagcccgtgcagcactctgggactctcccgctgatggtggaagccatcttatctgttagcattggctgtgttaccgccagaagtacaaagctccagagaggacttgatagctatcagagagacgacgaagatggagacgacatggactcatatcaggaggaggacttaaactgtgtacgagaaaggtggtctgatgctctcattaagcggcgcgaataccttgacgagcaaatcaaaaaagtaagtaataaaacagaaaaaacggaggatgacgtggagagagaggctcagctcgttgagcagtgggtgggacttacggaagaacgaaatgctgtgctcgttcctgctcccgggagtggcatcccaggcgcacccgccgactggattccccctccgggcatggagacacatattcctgtactctttctggacctcaatgctgacgacctgtctgccaacgaacagctggtgggaccacacgcttcaggcgttaatagtattttacctaaggagcacggtagccagtttttttacctgcccatcatcaagcacagcgacgacgaggtgtccgcgacagcttcctgggacagttctgttcatgacagcgtccacttaaaccgggttacccctcagaatgagagaatttatctgattgtaaaaactaccgtgcagctgtcacaccccgctgctatggaactagttctgcggaaacggatcgcagccaacatatacaacaaacagagtttcacacagagcctgaagcggaggattagcctgaaaaacatcttttacagctgcggagtcacttacgagattgtttcaaacatacccaaggccactgaagaaatagaagacagagaaaccctcgccctgctagccgcgcgcagcgaaaacgagggtactagtgacggagaaacctatatcgaaaagtatactcgcggcgtgcttcaggttgaaaacatcttgtccctggaacggttgcggcaagcggtgaccgtgaaggaggctctgtctacaaaggctcggcacatcagaaggtctctgtctacgcctaacgtacataacgtttcttccagtcggcctgacctgtctggcttcgatgaggacgacaaaggatggcccgaaaatcaattggacatgagtgactactcctcctcatatcaggacgtcgcttgttatgggaccttgccaagagactcacctcgacgaaacaaggaaggatgtacctcagagacgcctcacgccctgaccgtttccccattcaaggccttcagcccacaaccccccaagttttttaaacctcttatgccggtgaaggaagaacacaaaaaacgaatcgctttggaggccaggcccctactgtcacaggaaagcatgcctcccccccaggcccacaatccgggttgcatcgtccctagcggttcaaatggatcatccatgcctgtagagcacaattcaaaaagggagaagaaaatagactctgaggaggaggaaaatgagttggaggctatcaaccggaagcttatttcatctcaaccctacgtccctgttgagtttgctgacttctccgtctacaatgcatccctcgaaaacagagaatggttctccagcaaggtcgatctgtcaaacagcagagtgctggagaaagaggtgagtcgatcacccaccacttcatccatcacgagcgggtacttcagccactcagcctctaacgcgaccctgagcgatatggtggtaccctcatctgactcttctgaccagctggccatccaaacaaaggacgcagactcaactgaacattctactccctctctggtacacgactttaggccaagctccaataaggaattgacagaagtcgaaaagggactggtgaaagacaagatcatcgtggtgccattgaaggaaaattctgccttggcgaagggtagcccttcctcgcagagcattcccgaaaagaactcgaagtcgctgtgccgtaccggaagctgttccgaattggatgcctgcccatcaaaaatttcacaaccagctcggggattttgcccccgcgaggtgacagtagagcatacaaccaacatcctggaggatcattctttcacagaattcatgggggtttccgaaggtaaggacttcgacgggttaaccgattcttcagcaggcgaactttcaagcaggcggagtctgcctaataagacaggcgggaagactgtctccgacggcttgcatcatccctctcaactgcactctaaactggaaaatgatcaggtcatcattcctgaggcagctttctgggttctgtgctgccagtag

SEQ ID NO: 192409 - DNA, 5250 bp, Artificial Sequence
  Description of Artificial Sequence: Synthetic coding sequence
atgagcgacaccaaggtgaaggtggccgtgcgggtgcggcccatgaaccggagagagctggagctcaatactaaatgtgtggttgagatggagggtaatcagacagtcctgcaccccccgccttcgaatacaaaacagggggagcgcaagccacccaaagtgtttgccttcgattactgcttttggtccatggatgagtctaacactactaagtatgccggacaggaagttgtgttcaaatgcctaggggagggaatacttgagaaggctttccagggctataacgcatgtatttttgcatacggccaaaccggtagtggaaagagcttttcaatgatgggacatgctgaacagttagggctgataccacgcttatgctgtgctttgtttaaacgaatttctctggaacagaatgagtcgcagacattcaaagtagaggtgagctacatggagatatataatgaaaaggtccgcgacctcctggatcccaaagggtctcggcagtccttgaaggtcagagaacacaaggtgctgggcccatacgtggatggtttgagccagctcgctgtcacctccttcgaggatattgagtccctgatgagcgaggggaacaagagtaggacggtcgctgccaccaatatgaacgaagagagctcccggtcgcacgcagtgttcaacataataatcacacagaccctgtatgacttacagagcgggaattccggcgagaaagtgtcgaaggtcagtctggtggaccttgcaggatccgaacgagtcagcaagactggagccgctggcgaaaggttaaaggagggcagcaatataaacaagtcccttaccactcttggactcgtgattagctccttagctgaccaggcggccgggaagggaaagagcaagtttgtaccatatcgtgattcagtgttaacttggttgctcaaggacaatttaggcggcaactctcagacatctatgatcgcgacgatctcccccgctgccgacaattatgaagagacactgtcaactttgcggtacgccgacagagccaaacgcattgttaaccacgcggttgtaaacgaagatcctaacgcaaaggtcatccgagagcttagggaggaagtggagaaattgcgtgagcaattgtcccaagcagaggccatgaaggccccagagctgaaagagaagctggaagagagtgagaagctgattaaggagctcacagtgacctgggaagagaaactccgcaagaccgaagaaatcgcacaggagcgccagagacagctggaaagtatgggcatttccctggaaatgtccggcattaaggtaggcgacgataaatgctatttggtaaacctcaacgctgaccctgcactgaacgaactgctggtgtactatctcaaagaccatacacgggtgggcgctgacacatcccaggatatccagcttttcggaatcggcatccaacctcagcactgtgaaattgacattgcttcagacggggacgtgaccttgaccccaaaagagaacgcccggtcctgtgtaaatggcacactagtgtgcagcaccacgcagctgtggcatggcgaccggatcctgtggggtaacaaccacttcttccgaatcaatctgccaaagaggaagaggcgggactggctgaaggatttcgaaaaggagacaggccctcctgagcacgacctagatgctgcgtcagaagcgtcttctgaaccagattataactatgagttcgcccagatggaagtgataatgaagactctgaatagcaacgatcctgtacagaatgtggtccaggtgcttgaaaaacaatatttagaggagaagagaagcgctctcgaggagcaaaggctgatgtatgagcgggagttagaacagttgagacagcagctctcccctgacagacaaccgcaaagctccggacccgacaggctggcttacagctcacagaccgcccaacagaaagtgactcagtgggctgaagaacgcgatgaactgtttaggcagtctttggcaaagctgagagagcagctggtcaaggccaatacgttggtacgagaggcaaacttcctggccgaagagatgagcaaattgacagattatcaggtcaccctacaaataccagccgctaatctgagtgctaaccgcaaaagaggggcgatcgtgtctgagcccgccatccaggtgcgccgaaagggcaagtcgactcaggtgtggactattgagaaactcgaaaacaaattaatcgacatgagagatctgtatcaggagtggaaagagaaggtacctgaagccaagcgtctctatggtaagcgtggggatcctttttacgaagcccaggagaaccacaatcttatcggtgtggctaatgtgtttttagagtgtctcttctgtgacgtgaagctccaatacgcggtgcctataatctctcagcagggcgaggtggccggccggctgcacgtggaagttatgcgcgtgaccggagctgtcccggagcgggttgtcgaggatgactcaagcgagaattccagtgagtctggttctctggaggtcgtagactcttccggtgagataatccacagagtaaagaaactcacttgtcgggttaaaattaaggaggccacaggcctccctttaaatctctctaactttgtattctgtcaatataccttctgggatcagtgtgagtcaactgtggccgcacccgtcgtggaccccgaagttccctcaccacagtctaaggacgcgcagtacaccgtgactttctcacactgtaaggattatgtggttaacgtgaccgaagagtttctcgagttcatttctgacggcgctctggctattgaagtatgggggcatcgctgcgctgggaatggatctagcatctgggaggtggacagtctgcacgctaaaacaaggaccctccacgatcggtggaacgaggtgacccgaaggatagagatgtggatcagcatcttggagctgaatgaattaggagagtacgctgctgtcgagctacaccaagcaaaagatgtgaacaccgggggtattttccaacttcgacaggggcacagtagacgcgtacaggtcactgtgaaacccgtgcagcactcagggactctgccactcatggtagaggctattctgtctgtcagtataggctgcgtgactgcgcgcagtacaaaattacagaggggactggactcctatcaagaggaggatttgaattgcgtgcgggagcggtggtccgatgctcttatcaaaaggagggaatatctggacgagcagattaaaaaagttagcaacaagactgagaaaactgaagacgacgtggagcgggaagcgcagctggtggaacagtgggtcggacttacagaagaaaggaacgccgtgctagtgcctgcccctgggagtgggattccgggcgctcccgctgactggatacctccacctggaatggaaacccacattcccgtactatttctcgacctgaacgcagacgacctgagcgcgaacgagcagctcgttggcccacatgcaagcggggtgaattctatactgcctaaagagcacggttctcagttcttttacctccctataattaagcactcagacgacgaagtcagcgccacagcttcatgggacagcagtgtacatgattctgtacatttaaacagagtgacccctcaaaacgagcggatttacctgatagtgaagacgacagtccaactgtcacacccagctgccatggagctggtcctgcggaaacgtatcgccgcaaacatctataacaagcaaagcttcacacagagtcttaagaggcgcatctccctaaagaacatcttttactcctgtggagtaacatacgagatcgtgtccaacatacctaaggcaacagaagaaattgaggacagagaaaccctggccctgctggcagcgcgctcggagaacgagggaacctcagatggagagacttatattgaaaaatacactagaggcgtattgcaggtcgaaaatattctttcactggaaaggttgcgtcaggctgtgactgtgaaagaagccctgtcaactaaggcgcggcacatacggcggagcctgtccaccccaaacgtgcataacgtgagtagctcaagacctgacttgtccggcttcgatgaggacgataaggggtggcccgaaaatcaactggacatgtctgattactcttcctcctaccaagacgtggcctgttacggcaccctgccaagagatagtccccgacgcaacaaagaagggtgcactagcgagacgccgcatgctctaacagttagtccttttaaggcattctccccacagccaccgaagttttttaaacccctaatgcctgtgaaggaggaacacaagaagcgaatagctctcgaggctcgccctttgctgtcccaagaagattcagaggaggaggagaacgagctggaggcaattaacagaaagctgatatccagtcagccttacgtccccgtagagtttgctgacttcagcgtgtataatgcatccctggaaaaccgcgaatggttcagctctaaggtggatctatccaattcgagagtgctggaaaaggaagtgagccgatcacccacaacttcctctattacaagtggttattttagccactccgcaagcaatgctacactgtctgacatggtcgtccccagtagcgacagctcagaccagctcgctatccaaaccaaagatgcggattccacagagcactcaacgccctcgctggtccacgatttcagaccatcatccaacaaagagctgaccgaggtggagaagggcctagtgaaggacaaaatcattgttgttcccctgaaagaaaatagtgctctcgcaaagggctcaccatcctctcagtccatccccgaaaagaactcaaagtctctgtgcaggacaggaagctgttctgagctggatgcatgcccttctaaaattagccagcccgcacgcggattctgccctagagaggtgaccgtggaacacactactaacattctcgaggaccatagcttcactgaattcatgggagttagtgaaggcaaggattttgacggactcaccgattcatcagctggggaactgagctcccgcaggagccttcctaacaaaacaggcgggaaaaccgtgtctgacggactgcaccatccatcccaacttcatagcaagcttgaaaatgaccagggagggacaacttccaggtag

SEQ ID NO: 192410 - DNA, 5313 bp, Artificial Sequence
  Description of Artificial Sequence: Synthetic coding sequence
atgagcgacaccaaggtgaaggtggccgtgcgggtgcggcccatgaaccgcagagaactggagctgaacactaagtgcgttgtggaaatggagggtaatcagaccgtcctgcacccaccgccatcgaacactaagcaaggcgaacggaggccatctcaagtgttcgctttcgactactgtttctggtcgatggacgagtccaacaccacgaaatacgctggccaagaggtcgtcttcaagtgtctgggggaaggaattctcgaaaaagcctttcaagggtataatgcctgtattttcgcatatggccagactgggtctggaaagagtttctcgatgatgggccacgccgagcagttgggccttattccaagactgtgttgcgctctgtttaaacgcatcagtttagagcaaaacgaatcccaaacattcaaggtggaagtttcttatatggagatatataatgagaaggtgcgggatctattggacccgaagggatcacgccagagtctcaaagtgcgggagcacaaggtcttgggaccctacgtggacggcctgtcgcagcttgctgtgacctcattcgaggacatagagtcactgatgtcagaggggaacaaatccagaaccgtggccgcgacgaatatgaacgaagaatcttctcgctctcacgctgtgtttaatatcataattacccagacgctgtatgacctccagtcaggaaactctggcgaaaaggttagcaaggtatctctggttgatttggccgggtccgaacgggtctctaaaaccggagctgccggcgagaggctgaaagaaggtagcaatattaataaatcgcttaccacacttggtcttgttataagttctctcgccgatcaggcagcaggaaagggcaaatcaaagtttgttccttatcgggactctgtacttacctggctcctgaaggataatcttgggggaaatagtcagacgtccatgattgccaccattagccctgccgcggacaattacgaggaaaccttgtcaacactgaggtatgcagaccgggccaagcggattgtgaatcatgcagtagtaaatgaagatccaaacgccaaggtgattagggaactaagggaggaggtggagaagcttcgggagcagctatcacaagccgaggccatgaaggcccccgagctaaaggagaaactggaagagtccgagaagctcatcaaggagcttacagtgacctgggaagagaagctgcgcaagacagaggagatcgctcaggagcgccagaggcagttagagagcatgggcatcagcctggagatgagtggtataaaggtcggggatgataaatgttatcttgtcaatctgaacgcggatcccgctttgaatgagctgttggtatactaccttaaagatcatacaagagtgggcgctgatacctcccaagatattcagctgttcgggatagggatccaaccccaacattgcgaaattgatatcgcttcagatggagatgtgaccttgacccccaaagaaaatgctaggtcctgcgtcaacggaacgctggtatgttcaacaactcagctgtggcatggggacaggatcctctgggggaataaccatttctttcggatcaacctacccaagcgtaaacgcagagattggttaaaggacttcgaaaaagaaacgggtcctcccgaacatgacttggacgctgctagcgaagcctctagtgaacccgattacaattacgagtttgcgcagatggaggtcatcatgaagacattgaattcaaatgatccagtccagaacgtcgttcaggtcctggaaaagcaatacctggaagagaaacgcagcgctctggaagaacaacggctaatgtatgaacgggagctcgaacagctcaggcagcagctgtctcctgaccgccagccccagagctctggtcctgaccgcctcgcgtatagctcccagacagctcagcagaaggttacacaatgggcggaggagcgcgatgagcttttccgtcagtctttggccaagttacgggaacagctggtcaaggccaacacattagtacgggaagccaactttctcgcagaggaaatgagcaaactcaccgattatcaggttacactgcaaatccctgcagccaatctgagcgcgaataggaaacgcggagcgattgtctcagagcccgcaatccaagtgcggagaaagggcaagtcaacccaggtgtggacaattgaaaagttagagaacaagctcatagacatgagagacctgtaccaggagtggaaggagaaggtacccgaggctaaacgtttgtacggcaagaggggggatcccttttacgaggcccaggaaaaccacaacttgatcggcgtggcaaacgtgtttctggagtgtcttttctgcgacgtgaaactgcagtacgccgtgcctatcattagccagcagggcgaagtggccgggcggctgcatgtggaagtgatgcgggtcaccggagcagtgcctgaacgcgtggtggaggacgattccagcgaaaactcttccgagtcaggatccttggaggttgtggatagctccggagaaatcatccaccgggtcaaaaaactgacctgtagggtgaagatcaaagaagccaccggcctgccgcttaacttgagcaactttgttttctgtcagtataccttctgggatcagtgtgaatctaccgttgcagcgcctgtggtggatcccgaggtgcccagtccccagtctaaagacgcacagtacacagtgacttttagtcactgtaaggattatgtcgtgaatgtcaccgaagaattcctggagtttattagtgatggcgcacttgccattgaggtgtggggccacagatgcgccggaaacgggagttcaatatgggaagtggacagcctccacgccaaaacgcgcactcttcacgatagatggaatgaagtgacccggcgtatcgagatgtggattagtatactggagctgaatgaactgggggaatacgctgccgtcgagctgcatcaagccaaagatgtgaatacaggagggatctttcaactgcgccagggccacagccgacgcgtccaagttactgttaagccagtgcagcattcaggaaccttgcctctgatggtggaggctatcctgagtgtttctatcggatgcgtgaccgcccggtctaccaaactccagcgtggattggactcttaccagcgagatgatgaggacggggatgacatggatagctaccaggaggaggacctgaattgtgtgcgcgagcgctggtctgatgcgctaattaaacggagggaatatctggatgagcagatcaaaaaagtgagcaacaaaaccgagaagaccgaggatgacgtagagagggaagcccagctcgtggaacaatgggtgggccttaccgaagaaaggaatgcagtcctcgtgccggctcctggctctggtatccccggcgcgccagctgactggattccgccccccgggatggaaacccatatccctgttctcttcctcgacctgaacgctgatgatttaagtgccaacgagcagctggtgggtcctcacgctagcggcgtcaacagtattcttccaaaggaacacggtagtcaatttttctatttgcctattattaaacattctgatgacgaagtgtccgccaccgctagttgggacagcagcgtgcacgatagtgtacacctgaatagggtcacccctcagaacgaaaggatttatctgatagttaagactaccgtccagctgtctcatcccgcggccatggaactggtgctgcgcaaacgcatcgcggccaatatctataacaagcagagctttacccaaagcctgaagcggcgtatcagtctgaagaacattttctattcctgcggcgtcacctacgagatcgtctcaaacattcccaaagcaacagaggaaatagaggacagggaaacactcgccctgctcgctgccaggagcgaaaacgaaggtacctcagatggagagacctatatagagaagtacaccagaggggttctgcaggtcgaaaacattttgtcccttgaacggttgcgccaggccgtcaccgtgaaagaggcactttccacgaaagcaaggcacattcgaagaagcctaagcactccaaatgttcacaatgtctcctcttctcgccccgatctgtctggctttgatgaagatgacaagggatggccggaaaaccagctcgatatgtctgattactctagcagctaccaagacgtggcatgttatggaaccctacctcgggattccccgcgtaggaacaaagaaggctgtaccagtgaaactcctcatgcactgaccgtttcaccgtttaaggctttcagcccccagccgccaaaattcttcaaaccgctcatgccagtgaaagaggagcataagaaacggattgctctggaagccagaccactcctgtctcaggaggattctgaagaagaagagaatgaactcgaagcaatcaaccggaagttgatcagctcacaaccctacgtccctgtcgagtttgccgatttttcagtatataacgcctctcttgaaaatcgcgaatggtttagctcaaaggtagatctgtcaaactctcgagtacttgaaaaggaggtgtcccgctctcctaccaccagctccatcacctccggatattttagccacagcgcctctaacgcaacccttagtgatatggtcgtgccatcgtctgattctagtgatcagctggcaattcagacaaaagacgccgactcaacagagcactccacaccgtctctagtacacgactttaggccttcctcaaacaaagagttgactgaggtggagaaggggctggtcaaggacaagataattgtcgtacctctaaaagagaattctgccctggccaagggctcgccctctagtcagagtattcccgagaaaaattccaagtctttgtgtagaacagggagttgctcagagctggacgcttgcccctcgaagatctcgcagcccgcacgcggtttctgtcctcgcgaggtcaccgttgaacatactaccaacattcttgaagaccatagttttaccgagttcatgggagtgagcgagggcaaagatttcgatgggctcaccgattcgagcgcaggggaactgtctagccgccggtctcttcccaataaaacgggcggcaagaccgtatcagatggccttcaccatcccagccaattgcattctaagctcgagaatgatcaggtgatcataccagaggcagcattctgggtgctgtgctgtcagtag

SEQ ID NO: 192411 - DNA, 5313 bp, Artificial Sequence
  Description of Artificial Sequence: Synthetic coding sequence
atgagcgacaccaaggtgaaggtggccgtgcgggtgcggcccatgaataggagggaactcgagcttaacaccaagtgcgtggtcgagatggagggcaaccagaccgtactgcacccacccccttccaatactaaacagggcgaaaggaagcctccaaaggtgtttgcattcgactactgcttctggtctatggatgagtcaaatacaactaaatacgcgggccaggaggtggttttcaagtgcctaggcgaaggaattctggaaaaggctttccagggctacaacgcctgcatctttgcgtatgggcaaacaggatcaggtaagagcttttccatgatgggccacgccgagcagctgggactgattcccagactgtgttgcgctcttttcaagcgcataagcctggagcagaatgagtcacaaacctttaaagtagaggtgtcatacatggagatatacaatgaaaaagtgagggatcttctggacccaaaaggatcacgtcagtccctcaaggtcagggagcacaaggtcctcggcccttatgtggacggcctttcacagttggctgtgacttcattcgaggacattgagtcactgatgtcggaaggcaacaaatctcgaactgtcgccgcgaccaacatgaatgaagaatcatctcgctcccacgccgtcttcaatatcattattactcagacgttgtatgacctgcaatccggtaattcaggtgaaaaagtgtccaaggtctctttggtcgatctagcaggttctgagagggtcagtaagacaggcgccgccggtgagagactgaaggagggatcaaatatcaataagagtctaaccacactcggattagttatcagcagcctagccgaccaggcggccggcaaggggaagtccaaatttgtcccataccgtgattccgttctaacttggctcctcaaggacaatctcggggggaactcccagactagcatgatagctactataagccctgcagcagacaactatgaagaaacactgagtaccctgcggtacgccgatcgtgcaaagcgcattgtgaatcacgcggtagtaaatgaggatcctaacgcaaaagtgattagggagctgagggaggaagtggagaaactccgcgagcagttatctcaggcggaggcgatgaaagcaccagaactcaaggagaaattagaggagagcgagaagctgatcaaagagttgaccgtgacatgggaagagaagctgcgcaagacagaggagattgcacaggagcgccagcgacagctggaatccatggggatttctcttgagatgtcgggcattaaggtaggtgatgataaatgttatcttgtaaatctaaacgcagatcctgcccttaacgagcttttggtgtattatctgaaggatcatacacgtgtgggggctgacacatcacaggacatccagctgttcggtatcggaatccagccccagcattgcgagatcgacatcgcctccgatggtgatgtgaccctcactccgaaagagaacgccaggtcctgcgtgaacgggaccctcgtgtgcagtaccacgcagttatggcacggcgaccggatcctctggggcaataaccacttctttcgaataaacctccctaaacgtaagagacgcgactggctgaaggactttgagaaagaaactgggcccccagagcacgacctggatgccgctagcgaggcgagttccgagcccgattacaactacgagtttgcccagatggaggtgatcatgaagaccctgaattcgaacgacccagtacagaacgttgttcaagttctagagaagcaatacctggaggagaagcgctccgccctcgaggagcaacgccttatgtacgagagggaactagagcagttacgacagcagttgtctcccgaccgccaaccacagtcttctggaccagacaggttggcttactcctctcagacagctcagcagaaagtaacccagtgggccgaagaacgggacgagcttttcaggcagtctctcgctaaattgagagaacagctagtgaaggctaacaccttggtgagggaggccaacttcctggcggaagaaatgagcaaactgaccgactatcaagttacgctgcaaatcccagctgccaacttgagtgccaatagaaagaggggagctatcgtgtccgaacccgctattcaagtgcgacggaagggcaagtcaactcaggtgtggactattgagaaactggaaaataagctgattgacatgcgcgatctctaccaggagtggaaagagaaggtgcccgaggcaaaacgcctttacggaaagcggggggacccattttacgaagcgcaggaaaatcataaccttatcggtgtcgccaatgtgttcctggagtgtctgttttgtgacgtaaagttgcaatatgcagtccccattatttcccaacagggcgaggtggctggccggcttcatgtggaggtgatgagagttacaggagctgtgcccgagcgagtggtcgaggacgatagcagtgagaattcttccgagtccggctctttggaggtggtcgattcttccggcgagattatccatcgcgtgaaaaaactcacgtgtagagtgaaaattaaggaggctaccgggctgccactaaacctctcgaacttcgtgttctgtcagtataccttctgggaccaatgtgagtccaccgtggcagccccagtggtggaccccgaggtcccatcaccacagtcgaaagacgcccagtacactgtcacattctcacactgtaaagactacgtcgtcaatgttaccgaggaatttctggaatttatctctgacggtgccctggccattgaagtgtggggccacaggtgtgccgggaacgggagctctatttgggaagtggattctcttcacgcaaagacccgtactctgcacgacaggtggaatgaggtgacccgcaggattgagatgtggatcagtattctcgagcttaacgagctgggcgagtacgctgccgttgagttgcaccaagctaaggacgttaacaccggcggcatattccagttgcgccaagggcactctcgtagggtccaggtgaccgtgaaaccagtccagcattccggaacccttcccctgatggtggaggcgatactctccgtgagcatcggctgcgtgactgcaagatctaccaaactgcaacggggacttgactcataccagcgcgatgacgaggacggcgacgacatggatagctatcaagaagaagacctgaactgtgtgagagagcggtggagtgacgccctaatcaagagaagagaatatctggatgaacagattaaaaaggtttctaataagacagagaagaccgaagatgatgtcgagcgggaagcccagctggtggagcagtgggtggggctcaccgaagaaagaaatgctgtcctagtaccggcccccgggagtgggatccccggagcaccagccgactggattcctccccctggaatggaaacacacatcccggtgctgttcctggaccttaacgctgacgatcttagcgccaatgaacaactcgtaggccctcatgcttcgggggtgaactccatactgcctaaagagcacggaagtcagtttttctacctgcctattatcaagcattccgatgatgaagtgagcgcaacggcatcctgggattcgagtgtgcatgactcagttcatctgaaccgcgtgactccacagaacgagagaatctatctgattgtgaagacaacagtgcagctctcccaccccgctgcaatggaattggtccttaggaagcgaatcgccgccaatatctataacaagcagagttttacccagtctctcaagcggcgcatttcattaaagaatattttctactcctgcggagtgacatatgaaattgtctccaatatccccaaagccactgaagaaattgaggatcgggagactctggctttattggccgcgcgctccgaaaatgaggggaccagcgacggtgaaacttacattgaaaagtatactaggggagtgctgcaggtcgagaacatcctgtctttagaacgcttgaggcaagccgtgacggtgaaagaggccctatctacaaaagctaggcacatacgacgctcactcagtacacctaacgtccataacgtctcctcatccagacctgacctttcaggatttgacgaggacgataaaggttggccagagaatcagttggacatgtctgattatagcagctcttatcaggacgtggcttgctacggcaccctgcctcgtgactcccctaggcgcaacaaggagggctgcacgagtgagactcctcacgcattgaccgtatcgccgtttaaagcattttcaccacagccacccaagttctttaaacccctgatgccagtgaaagaggaacacaaaaagagaattgcactggaggctagacccctcctaagccaggaggattcagaagaggaggagaacgagctggaggccatcaatcggaagttgatctcaagccagccttatgttccggtcgaatttgctgatttcagtgtttacaacgccagcctggaaaatagggaatggttcagttccaaggtagatctgtccaattccagagttttggagaaggaggtcagcaggtctcctaccacatcgagcataacaagtggatatttctcccacagtgcttcaaatgctacgttatcagacatggtcgtgcccagctcagattcgagtgaccagctggctatacagacaaaagatgctgattccacagagcactccaccccatctttggtgcacgatttccgcccttcaagcaataaggagctcacagaggtcgagaaaggtctggtgaaagataaaatcatcgttgttccgctgaaggaaaattccgcccttgctaaaggatcccctagttctcaatctattcctgaaaagaatagcaagtccctgtgtagaaccgggtcttgctccgagctggacgcatgccccagcaagatctcacagccagctaggggtttctgtcctcgggaggtgaccgtcgagcatacaaccaacatactggaggaccacagcttcaccgaatttatgggtgtcagcgaggggaaagactttgacggcctcacagatagcagcgctggagaattgtctagcagaagatctctacctaataagactgggggaaagacagtctctgacggtcttcaccacccctcacagttgcatagtaagcttgaaaacgaccaggtgatcattccagaagccgccttctgggtgttatgctgccaatag

SEQ ID NO: 192412 - DNA, 5274 bp, Artificial Sequence
  Description of Artificial Sequence: Synthetic coding sequence
atgagcgacaccaaggtgaaggtggccgtgcgggtgcggcccatgaatagaagggagctcgagctcaatactaaatgcgtagtggaaatggagggaaatcagaccgtgctccatccccctccatccaacactaagcaaggagagaggaaaccccctaaagtgttcgcgtttgattattgtttctggagcatggatgagagcaacaccaccaagtacgccgggcaggaagtcgtttttaaatgcttgggcgagggaatattagaaaaggcctttcagggatataacgcctgtatcttcgcatacggacagacaggtagtggcaagtccttcagtatgatgggtcacgcagagcagctggggctaatcccaaggctctgttgtgccctgttcaaaagaatctccctggaacagaatgagagccaaaccttcaaagttgaggtgagctacatggagatctacaatgagaaagttcgtgatctcttggaccccaagggctcccgacagagccttaaggttcgcgaacataaggtgttaggcccctatgtggacggtcttagccagcttgcagtcacctcctttgaagacatcgaaagtctgatgtcagagggcaataaaagtcgcaccgtggcagccactaacatgaacgaggagagcagccggtcccatgccgtgtttaacattattataacccagaccttatatgaccttcaatccggcaacagcggagaaaaggtgtccaaggtgtccctagtggacctggccgggtcagaacgagtgagtaagaccggcgcagcaggagagcgcctgaaggaggggagcaatatcaataagagccttacaactctggggttggtcatttctagtttggccgatcaggccgccggcaagggcaaatctaagtttgtgccgtatagggacagtgtgttaacctggctcctgaaggataacttgggcggcaactcgcaaacatcaatgatcgctacaatcagcccagctgcagacaattatgaggaaaccttgtctacgctccgctacgccgatcgggccaaacgcattgtaaaccacgctgtagtcaacgaggatccgaatgctaaggtaatccgcgagctgcgcgaagaagtggagaagcttcgtgaacagctgtcgcaggctgaagcgatgaaggcccctgaacttaaggaaaagctggaggaaagcgagaagctcattaaggaactaaccgtaacatgggaagagaagctgagaaagactgaagagattgctcaggaacgccagcgccagttggagagtatgggtataagtcttgagatgtccgggattaaggttggcgacgacaagtgctacttagtgaacctgaacgccgaccccgcattgaatgagctcctcgtatactatttaaaagaccatactcgagtaggagcagataccagtcaggatattcaacttttcggtattggtatccagccacagcactgcgagattgatatagcttctgatggggacgttaccctgacccccaaagagaacgctcgcagctgcgtcaacggcaccctcgtttgtagtacaacacagctgtggcatggtgatcgaatcctctggggcaataatcactttttccggatcaacctcccgaaacgcaagaggcgtgattggctgaaggacttcgaaaaggagacaggccctcctgaacacgacctggatgctgctagtgaggccagcagcgagcccgattacaattatgaattcgcccagatggaagtaataatgaaaacgctgaactctaacgatccagtccagaacgtggtgcaggtgctggagaaacagtacctggaggagaaacgcagcgcgttggaggaacagcggttaatgtacgagcgggagttagagcaacttcggcagcagctcagccctgacaggcaaccccagtcatccggtccagaccgcctagcgtatagtagtcagaccgcccagcagaaggtgacccagtgggccgaagagagggacgagctatttcgccagagcctggctaaactccgggaacagctagttaaggccaatactttggtcagagaagcaaattttctggccgaggagatgagtaaactaaccgactaccaggtcacattacagataccagccgcaaacctcagcgcaaacagaaagcggggtgctatcgtaagcgaacctgccatccaggtgaggaggaaaggcaaatctacccaggtgtggacgatcgagaagctcgaaaacaagctgatagacatgagggacctctatcaagaatggaaggagaaggttcctgaagcgaagaggctgtacggtaaacgaggagatcctttctacgaggcccaggagaatcataatcttatcggcgtcgccaatgtttttttggaatgtctattttgcgacgtgaagctgcagtatgccgtgccaatcatctcccaacagggggaggtggccggcagattacatgtggaagtgatgcgggttaccggcgccgtccctgagcgggtggttgaggatgactccagcgaaaactcgtctgagagcggatctttggaggttgtggattcctcaggcgagataatacaccgggtgaaaaaattgacatgccgagtaaagattaaagaggcaaccggactgcccctgaatctttctaacttcgtgttttgtcagtatactttttgggaccaatgcgaatctaccgtggctgcacctgtcgtcgaccccgaagtcccatcccctcagtccaaggacgcgcagtacacagtgacttttagccactgtaaggactatgtggtcaatgtaaccgaggagttcttggagttcatatctgatggggctcttgcaattgaggtgtggggtcaccggtgtgctggcaacggcagttctatttgggaggtggactcacttcacgccaagactcggaccttacacgaccgttggaacgaagtgaccagacggattgagatgtggatctccatactggaactgaatgagctgggcgaatacgccgcagtcgaactgcaccaggcaaaggacgtcaatactgggggcatcttccaattaagacaaggacactctaggagagtccaagtgacagtgaaaccggtacagcatagcggcaccctgccgttaatggttgaggccatcctctcagtgagcatcggctgtgttacggcgaggagcacaaagttgcaaagagggttggactcctatcaggaagaagacctcaattgtgtcagagagaggtggtccgacgcgctcataaagcgtcgggagtacctcgacgaacagataaaaaaagtctccaacaagaccgagaagacggaggacgacgtcgagagagaggcgcaacttgtggagcagtgggtgggattgactgaagagaggaatgcagtgctcgtaccagctcctggctctgggataccaggggcacccgccgactggatccctcctccaggcatggaaacacacatacccgtgctttttctagatctcaacgctgatgacctgtctgccaacgagcagctggtgggtccgcatgcttccggagtgaattcaattctccctaaggaacatgggtctcaatttttctacctgccaattattaagcacagcgacgacgaggtgtccgccacagcctcgtgggattcatccgttcatgattccgttcatttaaacagggtgaccccccagaacgagcgaatctatttgatagtaaagactaccgtacagctttcccaccctgcggcgatggagctggtgctgcggaagcgaatcgcggccaacatctataacaagcaatcgttcacacaaagcctcaagcgtcggattagcttgaagaacatcttctattcttgcggtgttacttacgaaatcgtgtctaatataccaaaggccacagaggaaatcgaggaccgggagacccttgctctgctggccgctcggagcgagaatgagggcacatcagacggggaaacatacatcgaaaagtacactcggggggtgcttcaggtagaaaacatactgagtctcgaacggttacgtcaggctgttactgtcaaggaggccctcagcactaaggcccgccatattcgaagatctctcagcactccgaacgtacataacgtaagcagcagccggcccgacctgtcaggcttcgatgaggatgataaagggtggcctgaaaatcagttagacatgtctgattattccagcagttaccaagacgtcgcctgctacgggaccttaccaagagattcccctagacggaacaaggagggttgcacctccgaaacccctcatgctctaacagtgtctccgtttaaggcattctctccccagccccccaagttcttcaaacccttaatgcccgttaaagaggaacacaagaaacgcatcgccctggaggcacgaccactgctctcccaggaagattcagaagaggaggaaaacgagttagaggccatcaataggaaactgatcagctctcaaccgtatgttccggttgaatttgccgatttttcagtgtacaatgcatcattggaaaacagggaatggttctcgtcaaaagtggacctgtctaatagcagagtcctggagaaagaagtgtccaggtcccctaccactagtagcattacatctggctatttttcccactcagcttccaatgcaacactttcagatatggttgtccccagtagtgactcctcagatcagcttgccatccagacaaaagatgccgatagtacagagcatagtacccctagcctggtgcatgatttccgccccagctctaacaaggaacttactgaggtggagaagggcctagttaaagacaagatcatcgtggttccgctcaaagaaaattcagccttggctaagggttctccctccagtcagagcattccagaaaagaactctaaatcactgtgcaggacgggcagttgctctgagttggatgcttgcccctccaaaattagtcaaccggcgcgaggattctgtccgcgtgaagttaccgtcgagcacacgaccaatatcctggaggaccactcctttaccgagttcatgggtgtctctgagggcaaagatttcgatggtctgacggattcttccgctggcgagttaagttctaggagatccctaccaaataagaccggaggaaagacagtgtccgatggcttgcatcacccatctcagctccacagcaaactggagaatgatcaagtgatcattccggaagccgctttctgggttttatgctgtcagtag

SEQ ID NO: 192413 - DNA, 213 bp, Artificial Sequence
  Description of Artificial Sequence: Synthetic coding sequence
atgagcgacaccaaggtgaaggtggccgtgcgggtgcggcccatgaatcgcagagagcttgagctgaacacaaaatgtgttgtggaaatggagggcaatcaaacagtgcttcacccgcccccatcaaacaccaagcagggtgaaagattagtgacagtggcacacatctcgaactcctccaccctcggcgggcaaggtaagagaatcacttag

SEQ ID NO: 192414 - DNA, 1038 bp, Artificial Sequence
  Description of Artificial Sequence: Synthetic coding sequence
atgcccaagctgctgaagagcctgttccccgtgcgggacgagaagagaggaaagcggccaagccccctggcccaccaggcccaacccgagatgggccccgatgtccttgtccagacaatgggcgcaccagctttgaagatctgcgacaagccagccaaggtaccctcgccgcctcccgtgatcgccgtgacagccgttacgcccgcgcccgaagctcaggacggaccaccgtcgcccctgtcagaagccagttctggctatttcagccactccgtttccacagccacgctatcagatgccctgggacccggcctcgacgccgcagccccaccaggttcaatgcctacagcccccgaggctgaaccggaagcgcccatctcccatccccctcccccaacagctgttcccgcggaagaaccaccggggccgcaacagctggtttccccaggcagagagagacctgacctcgaagctcccgcccccgggtcacccttccgcgtacggcgcgtgcgtgcctcagaactgcgaagcttttctaggatgctggccggcgaccctggatgttcacccggggccgaaggtaatgcaccagcacctggggccgggggacaagcactggcaagtgactctgaagaagctgatgaggtccccgaatggttgcgcgaaggcgaattcgtgactgttggggcccacaagacaggggtagtgaggtacgttgggcccgccgactttcaggagggaacctgggtgggagtcgagttagacctgccttcgggcaaaaatgacggctccatcggaggaaagcaatacttccggtgcaaccctggctacgggctgcttgtgagacctagcagagtgcgcagggcaactggcccagttaggaggaggtcgacaggtctgcgcttgggggctccggaagccaggcggtcagcgacacttagcggatctgccactaatctggcttcactcaccgcggccctggctaaagcggacagatcccacaaaaaccccgaaaaccgtaaatcttgggcatcttag

SEQ ID NO: 192415 - DNA, 5481 bp, Artificial Sequence
  Description of Artificial Sequence: Synthetic coding sequence
atgggcgacagcaaggtgaaggtggccgtgcggatccggcccatgaaccgcagggaaactgacctgcacacaaagtgcgtagtggatgtcgacgctaacaaagtgatactgaacccagtgaacacgaatctgtccaaaggcgatgccaggggccagccaaaagtgttcgcctatgaccactgcttctggtctatggacgagagcgtgaaagagaagtacgcaggccaggacatcgtgttcaagtgccttggtgagaatatactgcagaacgccttcgatggatacaatgcttgcattttcgcctatggacaaaccggtagcggcaagtcatatactatgatgggaaccgctgaccagcctggcctcatcccccggctatgttcaggcctgttcgagcgaacacaaaaggaggagaatgaggaacagtcctttaaggttgaggtcagctatatggaaatctacaatgagaaggtgagggatctcctggaccccaagggcagtaggcagacacttaaagtacgggagcactccgtcctggggccttacgtggatggattgtccaaactggccgtaacaagctacaaggacattgagtctcttatgtccgaaggtaacaaaagtcgtacagttgcggcgactaacatgaatgaagagagttccaggtcacacgctgtgtttaagattaccttgacccataccctctacgatgtgaagagcggcactagtggcgaaaaggttgggaaactgtctctggtggatctggcgggaagcgagagggccacaaagacaggcgcagcaggagatcggttaaaggaaggaagtaatattaataagtctctcaccactctaggcttggttatatctgctctcgccgatcagtccgcaggaaagaataagaacaaatttgtgccctaccgtgattcagtcctgacatggcttctgaaagactccctgggcggaaacagcaaaaccgctatggttgcaactgtttcccccgccgctgacaattatgacgagacgcttagcacactgaggtacgccgatagagcaaaacatatcgtcaaccatgccgtggtgaacgaggatcctaacgctagaatcataagagacctccgggaggaggtcgagaagctgagagagcagttgaccaaggcggaggctatgaagtccccagagctgaaagatcgcctggaagaatccgaaaaactgattcaagagatgaccgtgacctgggaggagaagctgagaaaaaccgaagaaattgcacaggaacgccagaaacagctggaaagccttggcataagcctgcagtctagcggtattaaggtgggtgacgacaaatgcttcctcgtgaatttgaacgcagatccagccttgaacgaactactggtttactacttgaaggagcataccctcatagggagtgcaaacagccaagacatccagctttgcgggatgggtatcttgcctgagcattgcattatcgacattacatcagaggggcaggttatgctcaccccccagaagaatacacggactttcgtgaatggctcctccgtgagctcgcccattcagctgcatcacggcgaccgtatcctttgggggaacaatcacttctttcggctaaacctgccaaagaagaagaaaaaggctgagagggaagacgaagatcaagaccctagcatgaagaatgaaaactcttccgaacaattagatgtcgatggagactcaagctctgaggtctcatctgaggtcaacttcaattatgaatacgcccaaatggaggtgaccatgaaggcattgggatccaacgatccaatgcagtctatactgaattcactggagcagcagcatgaagaggagaagcgtagtgctcttgagaggcagcgattgatgtacgaacacgaactggagcaactccgcagacggctgtcacccgaaaagcagaactgccggtcaatggatcggtttagcttccattccccatccgctcaacagcggctgcggcaatgggcagaagagagggaggccacactgaataactccctgatgaggctgagggagcagatcgtgaaggccaacctgctggtgcgggaggccaattacatcgctgaagaacttgataagcgcaccgaatacaaagttaccttgcagatacccgcctctagtctggatgctaacagaaagcgcggatcccttctgtcggagccggcaatccaggttaggcggaaagggaagggtaagcagatctggagcctcgaaaagctcgacaatcgcctgcttgatatgcgcgacctgtatcaagaatggaaagaatgtgaggaggataaccccgttatccgctcttattttaagagggccgaccccttctatgacgagcaagagaatcactctttaataggagtggccaatgtgttcctggaatcactcttttacgacgtcaaattgcagtacgcagtgcctatcataaaccagaaaggggaggtggccggtaggctacacgtggaagtcatgaggttgagtggcgatgtgggggagcggattgccgggggagacgaagtcgccgaagtgtccttcgagaaggaaactcaggaaaacaagctcgtgtgcatggtaaagatcctgcaagctacgggcctaccacaacacttgtcccacttcgtgttttgtaaatattctttttgggaccagcaggagccggtgattgttgctcccgaagtagatacaagcagttcttccgtctctaaagaaccccactgtatggtggtgtttgatcattgcaatgaattctcagtcaatatcacggaagatttcatcgaacatttaagcgagggggccctagccatcgaagtctacgggcacaaaataaatgaccccaggaagaacccagccttgtgggacttgggaataatccaggcaaaaactaggtccttgcgcgaccggtggtctgaagtcacccgcaagcttgagttttgggtgcagatcctggaacagaacgaaaatggagagtactgccctgtagaagtcatctctgctaaggatgtgcctactggaggcatctttcagttgaggcaggggcaatccagaagagtgcaggtcgaagtgaaatctgttcaagaaagcgggacgctgccactcatggaggagtgtatactgagtgttgggattggatgtgtgaaggtgaggcctcttcgtgcacctagaactcacgagacattccatgaagaggaagaagatatggatagttaccaggatagagatctagagcgcttacggagaaaatggttgaatgccctgacaaaacggcaggagtacctggaccagcagcttcaaaaattggttagcaagcgcgataaaacagaggacgacgctgaccgggaggcacagctgctggagatgcggctgaccttaaccgaagaaagaaatgccgtgatggtgccgtccgcaggtagtggtatcccaggtgctcctgccgagtggactcctgtgcctggtatggagactcatattccagtgatcttcctggacctgaatgctgatgattttagtagtcaggacaacttggatgatcctgaggcaggggggtgggacgcaacgcttactggggaggaggaagaggaattttttgaactgcaaatcgtgaagcaacacgatggcgaagttaaggcagaggccagctgggattcggctgtgcacggttgcccccaattgtcgagaggtacacccgtggacgagagattatttcttattgttagggtcaccgttcagttgtcccaccctgcagatatgcagcttgtcttgaggaagaggatttgtgtcaatgtgcatggaagacagggattcgcacaaagcctgctaaaaaagatgagtcaccggagctctattccgggttgcggggtgacatttgaaatcgtctctaatatacctgaggacgcccagggtgtcgaggaacgagaggccttggcccgaatggctgccaatgtggagaaccccgcctccgcagattccgaggcctacattgagaaatacctgaggtccgtgctggctgttgagaacctcctgaccctggacagattgcgccaagaggtggcagtaaaggagcaattgaccggaaaaggtaaacttagccggaggtccatcagcagcccaaatgtcaataggctgtccggttcacggcaggatttgattccaagttactccctcggaagtaataaagggcgctgggagtctcagcaggatgtgagtcagactacagtgtcccgtgggattgcccccgctcccgccctgtccgtcagtcctcagaacaatcattctcctgatccgggcctgagcaatcttgccgcatcatatctcaatcccgttaaatctttcgtcccacaaatgcctaagctactgaaatcgctgttcccagtgagggacgaaaagaggggaaagcggccatctcccctcgcccaccagcccgttccccggatcatggtgcagagcgcctcaccagatatccgtgtgacccgcatggaagaagcccagcccgaaatggggcccgacgtgctcgtgcagaccatgggcgcccctgcactcaaaatctgtgataagcccgcaaaagtcccaagtccgcctccagttattgccgttactgctgtgacacctgcacctgaagcccaggatggtccacccagtcctcttagcgaagcatcatctggatacttctcacattccgtaagtacggcgacactgtcagatgctctgggtccggggctggatgccgcagctccacccggaagcatgcccacggcacctgaggccgaacccgaagctcctatctctcatccacctccaccgacggccgttccagcagaggaaccacccgggccccagcagttagtgtctccgggacgcgaacgtcccgacctggaagctcctgcacccgggtcccctttccgagtgcggagagtcagagcctccgagctgaggtccttttctcgtatgctcgcaggcgaccctggctgctctcctggagcagagggcaatgcccccgctccaggcgctggagggcaggccctcgcttctgactccgaggaagcggatgaggtgcccgagtggttgcgggaaggggaatttgtgactgtcggggcacataagaccggtgtagtgcgctatgtcgggccagccgatttccaggaaggcacgtgggtgggtgtcgagttggacttgccaagtggcaaaaatgacggtagcatagggggcaagcagtatttcagatgtaaccctggatatgggctgctggtgagacctagccgcgtgagaagggccacagggccagtgaggcgccggtcgactggactgcgccttggtgcacccgaagcacggcggagcgccaccctctccggcagtgctaccaatctcgcaagcctgacagccgccctagccaaagccgaccggagccataaaaatcctgaaaacagaaagagctgggcctcctag

SEQ ID NO: 192416 - DNA, 4947 bp, Artificial Sequence
  Description of Artificial Sequence: Synthetic coding sequence
atgagcctgcacagcacccacaaccggaacaacagcggcgacatcctggacatccctagcagccagaactctagcagcttgaatgctttgacacactcctcccgcctcaaactccacctgaagtctgacatgagtgaatgtgagaacgatgacccactgctgagaagcgctggtaaggttcgggatattaaccgtacatatgtgatctctgcctcccgcaagacagcagacatgccgctgacaccaaaccccgtgggacgccttgctctgcaaagacgaacaacacggaacaaagaatcctctctgctcgttagcgaactggaagacaccaccgagaagaccgccgagacacgtctgaccctacagcgacgcgccaaaaccgactcagccgagaagtggaagaccgccgagattgatagcgtgaaaatgacactcaacgtcggcggtgagacggagaacaatggggtcagtaaggaaagcaggactaacgtgcgaattgtgaacaacgctaaaaatagcttcgtggcaagctctgtacctctagatgaagacccacaagtcatcgagatgatggctgataaaaaatacaaggagacttttagcgcacccagccgagcgaatgaaaatgtggctctgaaatattctagcaatcgccctcctatagcctcactctctcagacggaggtggtaagaagcggccatctgactactaagcccactcagtccaagctggacattaaagtccttgggactggaaacctttaccaccggtctatcggcaaagagattgctaagaccagtaataagtttggtagcttggaaaaacgaacccctaccaagtgtaccaccgaacacaagctgaccacaaaatgctcactaccacaactgaaaagccctgccccctccattctgaagaatcggatgtccaacctccaggttaagcagcgcccaaagtcgagctttctggccaacaaacaggaacgctctgcagagaatactatccttcccgaggaggaaactgtggtccagaacaccagcgcaggcaaagatcccctgaaagtggaaaattcccaggtcactgtggccgtgagggttaggcctttcactaagagagagaaaattgaaaaggccagtcaagtagtttttatgagcgggaaggagatcaccgtggaacaccccgatacgaagcaggtgtacaatttcatttacgacgtatctttctggtccttcgacgaatgccaccctcactatgccagtcaaactaccgtctacgagaagctggccgcaccactcctcgagcgggcattcgaaggatttaatacatgtctcttcgcatatgggcagacgggctccggcaagagttacactatgatgggtttttctgaggaacctggaattattccccggttttgcgaagatctgttttctcaggtcgcacggaagcagacccaggaagtgtcttatcatattgagatgagtttctttgaggtgtacaatgaaaaaatacacgatctgctggtatgcaaggacgaaaacggccagcgaaaacagccactgcgggtgagggaacaccctgtatacggaccctatgtggaagctctttcaatgaacatagtctcatcttatgctgatatccagagttggctcgagctcggcaacaagcagcgcgcaactgccgctacagggatgaatgacaaaagcagccggtcacatagcgtgttcactctagttatgacacaaacgaaaacagagttcgtggaaggagaagaacatgatcaccggatcacatcgaggattaacttgatcgatctggcaggatccgaaaggtgcagtactgcccacacgaatggagatcgcctcaaagaaggtgtctctatcaataaatctctgctgaccctcggcaaggttattagcgccctaagcgaacaggcaaaccagagatcagtgttcattccttaccgggagagcgtcttgacttggcttctgaaggagtctcttggtgggaacagtaaaacggctatgatagccacaatatccccagcagcgtcaaacatcgaagagaccctctctactctcagatatgctaatcaggccaggcttatcgtcaatattgcaaaggttaatgaagatatgaatgcgaaactgattcgggagttgaaggcagagatcgcaaaattaaaagcagcccaacggaattctaggaacatcgatccagagcgctaccgactttgtcggcaagagataacctctctcagaatgaagctgcaccagcaggagagggatatggcagagatgcagcgggtgtggaaggaaaagtttgaacaggccgagaagagaaagctacaagagaccaaagaacttcagaaagccggaatcatgttccaaatggataaccatctgcccaacctggtcaatctgaatgaagatccccagctcagcgagatgctgttatatatgatcaaggaaggcactacaaccgtcggcaagtacaaacctaactccagccacgatatccagttgagcggggtgttgattgcggatgaccattgtacgattaaaaacttcggtggcaccgttagcatcatcccagtgggagaggctaagacatatgtcaacggaaaacatatcctggagatcactgtcctacgtcacggcgatagggtcattcttggaggggaccactactttcggtttaaccatcctgtcgaagtgcagaaggggaagcgccctagtggacgggacacaccaatatctgagggccctaaagacttcgaatttgctaagaacgaactcctgatggcgcaacgcagccagctggaggccgagatcaaagaagcacaattgaaggcgaaggaggagatgatgcagggcatacagatcgcgaaagagatggctcagcaggaactatcttcacagaaggcggcttatgaatccaagatcaaagccctggaagcggaactcagagaggaaagtcaacgtaagaagatgcaggagatcaataatcaaaaagcgaaccacaaaattgaggagttagaaaaggccaagcaacatctggagcaggaaatatatgttaataaaaaaaggctcgaaatggaaacgcttgctaccaagcaagccctggaggatcattctatccgacacgccagaattctggaggctctggaaacggaaaagcagaaaatagcgaaggaagtccagatcttgcaacagaacagaaacaatagagacaagacgttcacagtgcaaaccacctggagctcaatgaagctgtctatgatgattcaggaagccaatgccatcagtagtaagctgaagacatactacgtctttgggcgccacgacatttcagataagtcttctagcgatacttccattagagtccgaaacctgaaactgggcatctcaaccttttggtccctcgaaaagtttgagtccaagcttgctgccatgaaggagttgtacgagtccaatgggagcaaccgtggtgaggatgctttttgcgaccccgaggacgagtgggagcccgacattaccgacgcccccgtttcaagcctgagccggaggcgctccaggtccttaatgaagaatcgcagaatctcaggctgtctgcatgatatacaagtacatccaatcaagaatctgcactcctctcatagctcaggccttatggataagtcttccacgatttattctaacagcgccgagtctttcctgcctggcatttgcaaggaacttatcgggagtagcctcgactttttcggccagtcatacgatgaggaacgcacaatagccgactccctgatcaatagctttttaaagatttacaatggactgttcgctatctcgaaggcgcacgaggaacaagacgaggagtcccaagataacctcttctctagtgaccgtgctatccagtcactcacaattcagaccgcatgcgctttcgagcaactggttgtgctaatgaagcattggttatcggatctcctcccatgcaccaacatcgccaggcttgaagatgagctgcgccaggaagtaaagaagttgggtggctatctccagttgtttctgcagggatgctgcctggatatcagctcaatgataaaagaagctcaaaagaatgccattcagatcgtgcagcaggccgttaagtatgtcggacaactggcagtgttaaagggcagtaaactgcactttctggagaacggtaataacaaggctgctagcgtacaggaggaattcatggacgcagtatgcgatggagtgggccttgggatgaaaatcctgcttgactctggactggagaaagccaaggagctgcagcatgagctcttccgccagtgcactaaaaacgaagttacaaaagaaatgaagacgaatgctatggggcttatacggagcctggagaacatcttcgctgaatctaaaatcaagagcttcaggcgtcaagtccaggaagaaaacttcgaatatcaagatttcaaacggatggtcaacagggcaccagaattccttaaactaaaacattgcctggagaaagcaattgagattatcatcagtgcccttaagggttgtcacagtgacatcaatttgttgcaaacctgcgtggagtcgatacgcaacctcgcttcagatttttatagtgacttcagtgtgccaagcacttcggtgggtagttatgagagccgggtgacacatatcgttcaccaggagctcgaaagcctggccaagtctttgttattttgtttcgagtcagaggagtcacccgatctgctcaagccttgggagacctataaccaaaacaccaaggaagagcaccagcagtccaaaagcagcgggatagacggcagcaagaataagggcgttcccaaacgggtgtatgagctacacggttctagcccagctgtgtcctcggaggagtgcaccccatctaggatccagtgggtttag

SEQ ID NO: 192417 - DNA, 5073 bp, Artificial Sequence
  Description of Artificial Sequence: Synthetic coding sequence
atggccggcgccagcgtgaaggtggccgtgcgggtgcggcccttcaatagccgcgaaatgtctcgcgactccaaatgtatcatccagatgtctggctctaccactaccatcgttaatccaaaacagcccaaagaaacgccaaaatctttctcctttgattactcctactggtcccacactagtccggaggatatcaattacgcctcacaaaaacaagtgtacagagacattggcgaagaaatgctccaacacgcattcgagggttacaacgtgtgcatatttgcctatggccagacaggagccggaaaaagctacaccatgatgggcaaacaggagaaggaccagcaaggaataatcccacagctgtgcgaggatctcttctcgagaatcaacgacaccacaaatgataacatgtcttactccgtggaggtctcctatatggagatttattgtgagcgtgtgcgtgatctcttgaatcctaagaacaaagggaatctcagggtgcgggagcaccccttactagggccctatgtggaggatctgtctaagttagccgtgacatcttacaatgatatccaagacttaatggattccggaaataaggccagaacagttgctgccacgaatatgaatgaaaccagcagtaggtcacatgccgtgttcaacataatctttactcaaaaaaggcacgatgccgagaccaacatcacaaccgagaaggtatcgaagatttcccttgtggatctggccggcagcgaaagagctgattcgaccggtgcgaaaggaacacgcttgaaggagggcgccaatattaataagagcctgaccaccctggggaaggtcattagcgccctggccgagatggattccgggccgaacaaaaacaaaaaaaaaaagaagacagactttatcccctatcgcgactccgtgctgacttggctacttagagagaacctgggtgggaacagccggacagccatggtagcagctctgagccccgccgacattaattacgatgaaactctgagcacactgcgctacgccgaccgggccaagcaaatcagatgcaatgctgtgataaacgaggatccaaacaataaacttatacgcgagttaaaagatgaggtgacccggcttcgggacttactgtacgctcagggcctgggggatatcacggatatgacaaacgccctcgtaggtatgtcaccctcatcctcactgagcgccctctctagccgcgctgccagtgtcagttctctccacgaaagaatcctgtttgcacctggatccgaagaagccatcgagcgcctcaaggagacagagaagattattgctgaactgaatgagacatgggaggagaagctacgaagaactgaggctataagaatggagcgtgaagcgctcctggctgagatgggggttgccatgcgggaagacggagggaccctcggcgtattctccccaaagaagacaccccacttagtcaacctgaacgaggatcctctgatgtctgagtgtctgctctactatattaaagatggcattacccgcgtgggtagggaagatggggaaagaaggcaggacatagttttgtctggtcacttcatcaaagaggaacattgtgtttttaggtcagactcccgcggaggcagtgaggcggtggtaaccttggagccatgtgaaggggctgacacgtatgtgaatggtaagaaagttacagagccctcaatcctccggagtggaaatagaatcattatgggcaagagccacgtgtttcgcttcaaccatccagagcaggcccggcaggagcgcgaacgcaccccctgcgccgagacacctgccgaaccggtcgactgggcattcgcccagagagagctcctggaaaaacagggaatagatatgaaacaagagatggaacagagactgcaggaactggaggaccaatataggcgcgagcgagaggaggctacctacctgctggaacagcagcggttggactacgagagcaaactggaggcactgcaaaaacaaatggacagcaggtactatccagaggttaatgaggaggaagaggagccagaggatgaggtgcagtggactgaaagggaatgtgaattggcactttgggcctttcggaagtggaaatggtatcagtttacatctctgagagatcttttatggggcaacgccatctttcttaaagaagccaacgctatttctgtggagcttaaaaaaaaggtgcagtttcaattcgtgttacttactgatacgctatactccccacttcctcctgatcttttaccccccgaagccgctaaggatagggaaacgcggccttttcccaggaccatcgtggccgttgaagtgcaggaccagaagaacggagcaactcattattggactctggaaaagttaaggcaaaggctagatcttatgagagagatgtacgacagagcagctgaggtgcccagctctgttatcgaggattgtgacaacgtcgtgactggaggcgaccccttttacgatcggttcccttggttccgactggtcgggcgtgcctttgtatacctctctaatctgttatacccagtgcccctggtccaccgtgtggctattgtgagcgagaagggggaggtgaagggctttctgcgcgtggccgtgcaggcaataagcgctgatgaggaggcacccgattatggtagtggcgttcggcagtctggtacagccaaaatctctttcgacgaccagcattttgaaaagtttcaatctgaaagctgtcccgtcgttggaatgtcacggtccggcacatctcaggaagagttgcggattgtcgaaggccaggggcaaggtgccgatgttggcccatcggccgatgaagtgaacaacaatacctgctctgcagtacccccagagggtcttctgctggactctagcgagaaggcagctttagacgggcccctagacgcagcactggatcatctccgcctcggaaatacttttaccttccgggtgactgtcctacaggccagctcaattagcgcggagtatgctgatattttttgtcagtttaacttcatccaccgacacgatgaagcgttctcgaccgaaccactaaagaacacgggcaggggtcctccattggggttctaccatgtccaaaatattgctgtcgaggtgaccaaatcttttatcgaatatatcaagtcgcagccaatagtatttgaggtcttcggtcattatcagcaacacccgttcccccctctttgcaaagacgtgctcagtcccttgagaccaagtcgaagacactttccccgggtgatgccgcttagcaagccggtgccggcaaccaagttgagtaccctgacaagaccatgccccgggccctgccactgcaagtacgacctcctggtttatttcgagatctgtgagcttgaggccaacggtgattacatccctgctgttgtggaccaccgcggaggcatgccatgcatgggtacctttctcctccaccaaggaatacagaggagaatcaccgttaccttactgcacgagactggatcacatattcgctggaaggaagtgcgtgaactagtcgtggggcgcatcagaaatacacccgaaacagacgagtctctgatcgatccaaacatcctgtctcttaatattctatcctctggttacattcacccagctcaggatgatcgcactttctaccagttcgaagctgcgtgggactcttcaatgcataactcgcttctgttaaacagggtgaccccttatcgcgagaagatctacatgaccctttcagcctatatcgagatggagaactgtacacagcccgccgtcgtcacgaaagacttctgcatggtgttttattctagggatgccaagctccccgcatctcgctccattaggaacctgttcggcagcggctccctgcgggccagtgaatcgaaccgcgtgactggcgtttacgagctttctctgtgtcacgtggccgacgcggggagcccaggaatgcaacgcaggagacgacgagtgctggacactagtgtggcctatgtgcgcggagaagagaacttagccgggtggaggccccgcagtgactctttaattctggatcaccagtgggagctcgaaaaactgagccttctccaagaggtcgagaaaactcgtcattacctgcttcttcgggaaaagctggaaaccgcccagaggcctgttccagaagcattgtcccctgcgttctctgaagattccgagtctcacggatctagtagtgcctcatcccctttgtccgcggaaggaagaccgtccccacttgaggccccaaatgaacgccagcgagagctggctgtgaaatgcctgaggctgttaacacatacatttaatcgtgagtacacgcattcccatgtctgtgtgtctgcatctgagtctaagctatcggaaatgtctgtcactttgctgcgggaccccagcatgtcccccctaggcgtcgccactctcaccccctccagcacatgtcccagccttgtcgaagggcggtatggcgccacagatctgcggactccccagccatgctctcgccctgcaagccccgagcccgagcttctgcccgaagccgactctaagaaattgcccagtcctgcccgtgctacagagaccgacaaggaaccacaacgcctgctggtgcccgacattcaggaaataagggtgagtcctattgtttcaaagaagggctacctccatttcctggagcctcacacgtccggctgggcgagaagattcgtggtggtgcgccggccatacgcctacatgtacaattctgataaggatactgtggagcggtttgtactgaacttagcgaccgcccaggtggagtactctgaggaccagcaggcaatgttgaagacacccaacacatttgcagtctgtactgagcaccggggcatccttcttcaggctgcttcagataaagacatgcacgattggctgtatgcctttaatcccctgctcgctggtacaattaggagtaaactctcacgccgccggagcgcacagatgagggtctag

SEQ ID NO: 192418 - DNA, 5400 bp, Artificial Sequence
  Description of Artificial Sequence: Synthetic coding sequence
atggccggcgccagcgtgaaggtggccgtgcgggtgcggcccttcaacagcagagagatgagccgagacagcaagtgtattatccagatgagtgggtctaccacaactattgtcaaccccaaacagcctaaggaaacgcccaaatcttttagttttgattattcttactggtcacacacttcccccgaggacatcaactacgcaagtcagaagcaggtgtacagagatatcggcgaagagatgctgcagcacgctttcgagggctacaacgtgtgcatcttcgcttacggacaaactggggctggcaaatcctatacaatgatgggcaaacaggagaaggaccaacagggcattatccctcagttgtgcgaggatctgttcagtcgtatcaacgatacaacaaacgacaacatgtcttacagtgtggaagtgtcctacatggaaatttattgcgaaagggttagggatctgctcaacccaaagaacaaggggaacctgagggtgcgtgaacacccgcttcttgggccatatgtggaagaccttagtaaactagcagtgacctcctacaacgatatccaggatctgatggattctggcaacaaggctagaacagtggctgctacaaatatgaatgagacttcctcacggtctcacgccgttttcaacatcatctttacgcagaagcgccatgatgctgagacaaatattacaactgagaaggtgtccaagatcagtctagtcgatctggccggaagcgaacgcgccgattctacgggcgctaagggtacacgactgaaggaaggtgctaacattaacaagtcactcactactcttggaaaggtcatcagcgcgttggctgagatggttagcggccctgccagaaacaagaaaaagaaaaaaaccgatttcatcccttacagggactctgttctaacctggctgcttagggagaatttgggtggcaacagcaggaccgctatggtggccgccctttctcctgccgacattaattacgacgagactttatcaacactccgatatgctgatcgggccaagcagatccggtgtaatgcggttatcaatgaggatcctaataacaaactaatccgcgagctgaaggacgaggtaacaagactccgggaccttctgtacgcccaggggctgggcgacatcacagacacaaatactgtgccgggcggccccaagcttaccaacgctctggtggggatgagtccttcctcctcactctcggcgttgtccagtcgtgcggccagtgtctcatcactgcacgaacgcatcctgttcgcccccggctctgaggaggccattgaaaggctaaaggagacagaaaaaatcatagcggaactcaacgaaacatgggaggagaaacttcgtcggacagaggcaatcaggatggagcgagaggccctgctggccgaaatgggcgtcgccatgcgagaggacggaggaaccctgggagttttcagtcctaaaaaaacacctcacttagtcaacttgaacgaggatccactaatgagcgagtgtcttctgtactatatcaaagacggcatcacacgggttggtagggaggacggcgaacgccgccaggatattgtgctgtctggacattttatcaaggaggagcactgtgtcttcagatcggatagcaggggtggatctgaggctgttgttacattagagccctgcgagggcgcagacacatatgtaaacggcaaaaaggtcactgagcccagcatcctgcgatcaggcaacaggatcatcatgggcaagtcccacgtcttccgatttaatcatcccgagcaggcgagacaagaacgtgaaaggaccccttgcgccgaaaccccggcggagcctgtggactgggccttcgcacagcgtgaactgctggaaaaacagggcatcgacatgaaacaggagatggaacagaggctccaagagctggaggaccagtaccgccgcgagcgtgaagaggcaacttatctcctggagcagcagagactggactatgaaagcaaattggaggctctgcagaagcagatggactcacgttactatcccgaggtgaatgaggaagaagaggaacctgaagacgaggttcaatggacagaaagagaatgtgaacttgcgctgtgggcctttaggaagtggaaatggtatcagttcacctctctgagagacctactgtggggtaatgccatttttctaaaagaagccaatgctatctccgtggagctgaagaagaaagtccagtttcaattcgtcctgctgacggatactttatatagccctttgccacctgatttactgccccctgaagccgccaaagatcgggaaactcggccatttccaaggactatcgtcgcagtggaggttcaggaccagaagaacggcgctacgcactactggactttggagaaattgcgccaaagattagatctcatgcgagagatgtacgatcgtgctgcagaggtgccttcaagtgtgattgaggattgtgataatgtagtgaccgggggtgatcctttctacgaccggttcccctggtttcggctggtcggctcctctgctatatcaggatgtaattcatacccccttctgaacacctgcatgtcagagagaatggctgcactgaccccgtctcccaccttcagctcccctgactcagatgccaccgagcccgcggaggaacaaagtgttggagaggaggaagaggaggaggaagaggaggaagatgaagaggaagaagacctcgaagacgatgtcttcccggagcacgcactgtgcgacggaagggatccattctacgatagaccaccactcttcagtctcgtgggaagagcgtttgtgtacctaagcaatctgctttacccggtgccactggtgcaccgagtggcgatcgtgtccgagaagggggaggtcaagggatttttgcgcgtcgcggtacaggctattagcgccgatgaggaggctcctgactacgggagcggtgtacgacaaagcggaaccgccaagatcagcttcgatgatcagcactttgaaaaatttcagtctgagagttgccccgtcgtggggatgagcagatccggcacctctcaggaagaactccgcatcgtggagggccagggacagggtgcagacgtgggcccatccgctgacgaggtgaataacaatacctgctcagcagttcccccagagggcctgcttcttgactctagcgaaaaggctgccttggacggacccttggatgcagctctggatcatctgcgcctgggcaacacctttacatttagagtcacagttttacaggccagctccatttccgccgagtacgccgatattttttgccagttcaacttcattcatcggcacgatgaagccttctccaccgagcctctcaagaatacaggacggggacccccactggggttctatcacgtgcagaatatcgcagtggaggttactaaatccttcatagagtacatcaaatcgcagcccatagtgtttgaagtctttggccactaccagcaacacccatttccacccctatgtaaggacgtccttagccccttgagaccgtcaaggcgacacttcccaagagttatgccactgtctaagcctgttccagctacaaaactgtctaccctcacacggccgtgccctgggccttgccattgtaaatacgatctgctcgtgtacttcgaaatttgtgagctggaggctaatggagactatatacctgctgtggtagatcataggggcggcatgccctgtatgggaacttttctgctacaccagggaatacagagacgtattacagtgaccctcctgcatgaaacagggtctcacattcggtggaaagaggtgcgcgagcttgtggtaggccgaatcagaaacactcctgagactgatgaatctctcatcgacccaaatatcctgtcacttaacatcttatctagcggctacatccacccggctcaggacgacagagtatccttgggcaacgacacccgtacattttatcagtttgaggctgcctgggacagctcgatgcacaactctctactgctgaaccgcgtcaccccctaccgagagaaaatctatatgactctctcagcatacatagaaatggagaactgtacgcagccggccgtggttacgaaggatttttgcatggtgttctatagcagggacgctaagctaccggcctcccggtccatcaggaacttgtttgggagcggatctctgcgcgcaagcgagtcaaatagagtgactggcgtctatgaactgagcctgtgtcatgtggccgatgcaggaagcccaggtatgcagaggcggagacgcagggttttggatacaagtgttgcgtacgttcggggagaagaaaatctggccggctggcgccctcgaagcgacagcctcattttagatcaccagtgggagctagagaaactctctctcctgcaggaagtcgaaaaaacccgtcactaccttctgttgagggagaagctagaaaccgcccagagaccagttcctgaggcgctgtcgccagcattctctgaagactcagaatcacatggatcaagttctgcctcatcgcccttgagtgccgaaggtagaccctcgcctctggaagctcccaacgaaaggcagagagaacttgcagttaaatgcctacggcttctgacacacacgttcaatcgagagtacacacactcccacgtgtgtgtgtcagcttcggaatccaaactctccgagatgagcgtaaccctgctgcgggatccctccatgtctcctctgggtgttgccactctgactcctagcagcacttgccctagtctggtggaggggcgttatggcgcaactgacctcaggacaccccagccatgtagccggcctgcgtctccagagcccgaattgctgcctgaggctgattctaagaagcttcccagcccagctcgcgccactgagactgacaaggaacctcagagattgctggtgcccgatatccaggaaatacgggtgagtccgatagtatccaagaaaggctacctccacttcttagagccacatacaagtgggtgggccaggaggttcgtggttgttcgtcggccttatgcttatatgtataattctgacaaagacaccgtggagcgctttgtccttaatctggccacagcgcaggtcgaatactccgaggaccaacaggcaatgttgaagacccctaacaccttcgccgtgtgtacggaacaccgcggaattcttctgcaggcagcttccgacaaggatatgcacgactggctgtacgcttttaatccactgctggcagggaccatccggagtaagctgtctaggaggcggtctgcacagatgcgtgtctag

SEQ ID NO: 192419 - DNA, 117 bp, Artificial Sequence
  Description of Artificial Sequence: Synthetic coding sequence
atggccggcgccagcgtgaaggtggccgtgcgggtgcggcccttcaattctagagaaatgtctcgcgatagcaagtgtatcatccagatgtccggttctaccaccactatcgtgtag

SEQ ID NO: 192420 - DNA, 5376 bp, Artificial Sequence
  Description of Artificial Sequence: Synthetic coding sequence
atggccggcgccagcgtgaaggtggccgtgcgggtgcggcccttcaacagtagagaaatgagccgcgactctaagtgcatcattcagatgtctgggagcacaacgactatcgttaatcccaagcagcctaaagaaacaccaaaatccttcagctttgattactcatattggtcccacacctcccctgaggatattaattacgctagccaaaagcaggtgtatagggacatcggtgaggagatgctacagcatgcgtttgaggggtataacgtgtgtattttcgcgtacgggcagactggcgctggtaagtcctatactatgatggggaaacaggaaaaggatcaacagggaatcattccacagctgtgtgaggacctgttcagcaggatcaacgatacgacaaacgacaacatgtcttactctgttgaggtatcgtatatggagatttactgtgaaagggtgagagacctcctgaatcctaaaaacaagggtaatctgcgggtgagggaacatcccctgcttggcccttatgtcgaagatttgtccaaactggcggtgacgagctataatgacattcaggacctcatggactctggcaacaaagcccgaacggtggcagccaccaacatgaatgagacctccagcagaagccacgccgtgttcaatataattttcactcagaaacgccacgatgctgagacgaatataacaaccgagaaagtttcaaaaatctcccttgtggacctcgctgggagtgagagagctgactctacaggggcaaaaggcactcgcttgaaagaaggcgcaaacattaacaagagcctgaccacactggggaaagtgatctcggctctcgccgaaatggacagtgggccgaacaagaataagaaaaagaaaaaaacggattttatcccatatagagattccgtgctgacctggctcctgcgcgagaacctgggtggtaattcccgcaccgctatggttgccgcattatctccagcagatatcaattacgacgaaacccttagcacactcaggtatgcagatcgcgccaagcagattagatgcaatgcagtaattaacgaggatccaaacaacaagctaatacgcgaactgaaggacgaggtgacgcgcttgagagatcttctgtatgctcaggggttgggcgatatcaccgatactaacaccgtgcctgggggaccgaaactcacgaatgctctcgtcggcatgtcacccagcagctcattgagtgccctcagctcccgcgccgcatccgtgtcctctctccatgagcggattctgttcgcacccggcagcgaagaagctatcgagagactcaaagaaaccgagaagatcattgcggagttgaatgagacttgggaggagaagttgcgacggacagaggcgattcgcatggagcgggaggccctgcttgccgagatgggcgtggccatgagagaggacgggggaacattgggcgtcttctctccaaaaaagacacctcacctcgtcaacctcaatgaagacccgttaatgtctgaatgtctcctgtactatatcaaggacggcattacccgggttggcagggaggacggcgaacggcgccaggatatagtcctctccggtcacttcatcaaagaagaacattgtgttttccgcagcgacagccgcgggggaagcgaggccgtcgtaactctcgagccgtgtgaaggggcggacacctatgtgaacggtaaaaaagtcactgaaccttccatactgaggtccggcaatcgaatcataatgggaaagtctcatgttttccgctttaaccaccccgagcaggcccggcaggagcgcgagcgtaccccatgcgcagagaccccagcagagcccgtggactgggcttttgctcagcgggagctcctcgagaaacaaggaatcgatatgaaacaggagatggaacagcggctgcaggaactggaggaccaatacaggcgtgaacgagaggaggccacgtaccttcttgagcagcagcggctcgactacgagtctaagcttgaagctctgcagaaacagatggacagccggtattacccagaagtgaacgaagaggaggaagagccagaggacgaggtgcagtggacagagagggagtgtgaattagctctatgggctttcaggaaatggaaatggtatcagtttacctctctacgcgatctgttgtggggcaatgccattttcttaaaagaggccaacgccatctccgtggaactgaagaagaaggtgcagtttcagtttgtcctcctaacagatacactgtacagcccactgccacccgacttgctgccccctgaggctgccaaggatagggagactaggccctttccgaggacaattgttgctgtcgaggtgcaagatcagaagaacggggctacacactattggaccctggaaaaattacgccagcggctggatctcatgcgagaaatgtacgatcgagccgcagaggtgccctcgagcgttatcgaagattgcgataacgtggtaacgggtggtgatccattttatgatcggttcccctggtttagattggtggggagtagcgccatttctggttgtaactcttacccattgctcaacacctgtatgagcgagagaatggcggctctgaccccgagtccaactttcagcagcccagatagcgatgccactgagcccgccgaggagcagagtgttggagaggaagaggaggaggaggaagaggaggaggatgaggaagaggaggatctggaggatgatgtttttccagagcatgctctctgtgatgggagagacccattctatgaccgcccgccactgttcagtctggttggcagggcctttgtctatctcagcaatttactctacccggttccccttgtgcaccgtgtggcaattgtgagcgagaagggtgaggtaaaagggttcctgagagtggccgttcaggctatatctgccgatgaagaggctcctgattatggtagtggtgtgcggcagtccgggacggctaaaatttcctttgacgatcaacacttcgagaagtttcagtccgaatcctgccccgtggtgggaatgagccggtccggcacgagccaggaggaactgagaatagtggaaggacagggccagggcgcagatgtaggcccctctgccgacgaagtgaacaataacacctgctcggcagttccccccgaaggcttgcttttagactccagcgagaaggcggccctggatggtcccctggacgccgccctggatcacctaagactggggaatacatttacatttagagtgaccgtcctccaggcatcaagcatcagtgccgagtatgccgacattttctgtcagttcaatttcatccaccgccatgacgaggcttttagtacagagccattaaaaaacactggccgcggacccccgctcggtttctatcatgttcagaacattgctgttgaagtcacaaaatcattcatagagtatattaagagtcagcctatcgtattcgaagtgttcggccactatcagcaacacccgttccctcccctctgcaaagacgttctgtccccgctgaggccgagtagacgccacttccccagagtgatgccgctgagcaagcccgtccccgcaacgaagctttctactctgacaaggccatgccccggaccatgccattgtaaatacgacctgttagtttactttgaaatctgtgagctggaggcaaacggggattacatcccggctgtggttgatcatagggggggtatgccatgcatggggacattcttgctacaccaggggatccagcgcaggatcaccgtgactctgctccacgaaactggcagccacattaggtggaaggaggtgcgtgagctagtggttgggcgaatacgaaacacgcccgagactgacgagagtttaatagaccctaacatcctctcactgaacattctgtcttctggctacatacacccagcccaagatgatagaactttctaccagttcgaggcggcctgggatagcagcatgcacaactctttactgctgaaccgcgtcacgccttaccgcgagaaaatttacatgaccctgtccgcttatatcgaaatggaaaattgtactcagcctgcggtagtgactaaggatttttgcatggttttctacagccgggacgccaagctgccagctagtcgctccatccggaacctcttcggcagcggttctttgcgggcgtctgaaagcaatcgcgtaaccggagtttacgagttgtctctttgccatgtggccgatgccggcagccccggaatgcaaagacgcagaagacgcgtgcttgacacctctgtggcttatgtgaggggtgaggaaaacctggccggctggagacctcggagcgactcccttattctggaccatcaatgggagctggagaagctaagtctcttgcaagaggtggaaaagaccagacactatctcttgctccgcgagaaactggaaaccgctcaaaggcccgtacctgaagcactcagtcccgcattctctgaagactctgaatcccacggctcatcctcagcaagcagccccctgtctgctgagggccgccctagcccgttggaagctcccaatgaaaggcagagggagctagccgtgaaatgcctccgacttttaacacacacttttaatagagagtatacccatagtcacgtatgcgtgagcgccagcgagagcaagctttccgagatgtccgttaccctattgcgcgacccttcaatgtcaccccttggtgttgccactctgaccccttctagcacatgtccttctctggtggagggacgctatggtgcaactgatctgcggactcctcagccgtgtagtaggccggcctcccccgagccagagctgctccctgaggcagacagcaaaaaactgcctagccccgcccgagccactgagaccgataaagagcctcagcgcctgttagttcctgacatacaggagattcgggtaagccctattgttagtaaaaaggggtacctgcatttcctagagcctcacacctcggggtgggcacgccgcttcgtggtggttcgacgtccttatgcatatatgtacaactctgataaggatacggtcgagagattcgtgttgaacctggcgactgcgcaggtggaatactcagaagaccaacaagccatgttgaagacacctaacactttcgctgtctgcactgaacaccggggcattctgctccaggctgccagcgataaggacatgcacgactggctgtacgcattcaaccccctgctggctggtacaatcaggtctaagctcagcaggcggcggtctgcccaaatgcgggtctag

SEQ ID NO: 192421 - DNA, 5313 bp, Artificial Sequence
  Description of Artificial Sequence: Synthetic coding sequence
atgagcggcgccagcgtgaaggtggccgtgcgggtgcggcccttcaactcccgtgagacctctaaagagagcaaatgtatcatccagatgcaggggaatagcacatctattattaatcccaagaacccaaaagaggcaccgaagagctttagtttcgattacagctactggtctcatacctcaccagaggacccatgcttcgcttcccagaacagggtctacaacgacattggaaaggaaatgcttctgcatgcgttcgagggttacaatgtttgtatattcgcctatggccagaccggcgccgggaagtcctacacaatgatgggtaaacaggaagaatctcaggctggaattatcccccagctgtgcgaggaactgtttgaaaagattaacgacaactgtaatgaggagatgagctattccgtggaggtgagctatatggaaatatattgtgagcgagtgagagacttactcaacccaaaaaacaaagggaaccttcgcgtgagagaacacccactgctcggcccctacgtagaagacctgtctaagctggctgttacttcctatactgacattgcagaccttatggatgctggtaacaaggcgcggactgtggccgcaactaacatgaacgaaactagctcgcgtagccacgcagtatttaccattgtattcacacaaaaaaagcacgataacgagaccaatttaagcacggaaaaagtttcgaagatctctctggtggacttagcgggatcagaaagggccgattctacaggcgctaagggaacccggttaaaggagggcgcgaacattaacaaaagcctgacaacactgggaaaggtcatatccgccctggcagaggtgagtaagaagaaaaaaaaaaccgactttattccttacagggattcggttttgacttggctcctgagagagaacctaggcggaaattccaggactgcaatggtggccgcactgagccctgcagacatcaactacgatgaaacactctcaaccttgcggtatgccgatcgggccaaacagatcaaatgtaacgcagtgattaatgaggaccctaacgccaaactggtccgcgaactcaaggaagaggtgacgaggctgaaggacctgctgcgcgcacagggcctcggtgacatcattgacaccagcatgggctctcttacgagctctcccagcagctgcagcctgtcttctcaggtcgggctgactagtgttactagtatccaggaacgaatcatgtccacccctggtggggaggaagctattgagaggctcaaggaatccgagaaaattatcgctgagctgaatgagacctgggaagagaaattaagaaagactgaggcaataagaatggaacgggaagctctgttggctgaaatgggggttgcgattcgagaggacggggggacacttggggtttttagtcccaagaaaaccccacacttggtcaacctgaatgaagacccattaatgtcggaatgtttgctttactacattaaggacggaatcactagagtggggcaggccgacgccgagaggagacaagatatagttctatccggagcccatattaaggaggagcactgcatctttagatctgaacgaagcaattcgggcgaggttatcgtcacactggagccatgtgaaagatctgagacttacgtgaatggtaagagagttagccagcccgtgcagttaaggagcggaaacaggatcattatgggcaaaaatcatgtttttcgctttaatcaccctgaacaggctagagcagagcgggaaaagaccccgtctgccgagacaccgtcagagcctgtggactggacattcgcccagcgagaattgctggaaaagcagggaattgacatgaaacaagaaatggaaaaacgccttcaagagatggagattttgtataagaaagaaaaagaagaagctgatcttctgttagagcaacagcggttggactacgagagcaagctccaggccctgcagaaacaggtggaaacacgctccctggccgcagaaacgacggaagaagaggaggaggaagaagaagtgccctggactcagcacgagttcgagctagcccaatgggcttttaggaagtggaaaagccatcaatttacttctcttcgcgatctcctttggggcaacgcagtgtatctgaaagaggctaacgccatcagcgtggagctgaaaaaaaaagtacagttccagttcgtgctattgaccgacacactctatagccccttgccccccgaactcctcccaactgaaatggaaaagactcacgaagaccggcctttcccaaggaccgtagtggctgtggaggtgcaggaccttaaaaatggggccacacattattggtctcttgagaaacttaaacagcggctcgaccttatgcgcgaaatgtatgacagggccggggaaatggcttccagcgcccaagacgaatctgagacaacagttactggctccgaccccttctacgaccgtttccactggttcaagcttgtcggcagtagtcccatcttccacggttgcgttaacgagaggctcgccgatcgaaccccctccccaacattcagtaccgccgacagcgatattacggagctggccgatgagcagcaggatgagatggaagacttcgacgacgaggcctttgttgacgacgctggcagcgatgctggcaccgaggagggctctgatctattctctgacggacatgatcccttctacgatagatcaccgtggtttatcttagtcggcagagccttcgtgtacctgtctaatctcttatatcccgtcccattgatccatagagtggccatcgtgagcgaaaagggagaggtgaggggcttcctgagggtggccgtgcaggccattgcggctgacgaagaagccccagactatggatctggcatccgacagagtggcaccgcaaaaatctctttcgacaacgaatacttcaaccagtccgacttctcgtcagtggctatgacccggtcaggcctgtctctcgaagaactccgtatcgtcgaaggtcagggccaaagctccgaggtgattaccccgccagaggagatttctcgcatcaatgacctcgatctgaaaagttcaaccctactcgatgggaaaatggtgatggagggattttcagaggagattggcaatcacctgaaactggggagtgcttttacgtttagagtgaccgtgctgcaagccagtggcatcctgcctgagtacgcagacatcttctgccagtttaacttcctgcatcgccatgatgaagctttcagcaccgagcccttgaaaaataatggccgggggtcccctctggccttttatcatgtacagaacatagcagtggagattaccgaaagcttcgttgactacatcaagacaaagccaattgtgtttgaagtgttcggccactaccagcagcatccactgcatctgcaaggccaggagctgaactcgcccccacagccctgccgcagattcttcccaccccccatgccactttcgaagccggtacctgcgaccaaattaaatactatgagtaagaccagtctggggcagtccatgagcaagtatgatctcctcgtgtggttcgagattagcgaactggaacccacgggcgagtatataccagcagtggtggaccatacagcgggcctgccttgtcaaggcacgttcctgctccaccagggcatccagaggcgcataactgtgaccatcatccacgagaagggctcagaattacattggaaggacgtgcgcgaactcgtagtcggccggatacgcaataagcctgaagtggatgaagcggcagtcgacgctatcctgtcactgaatattatctcagccaagtacttaaagagttcgcataattcaagcagaacgttctacaggtttgaggctgtgtgggactcctcccttcacaattctctcctgctgaatcgggtgaccccatacggcgagaaaatctacatgactttgtcggcctacctcgaactcgaccactgcatccaacctgcagtgataactaaggacgtgtgcatggtgttttacagcagagacgcaaaaatctctccaccgaggtccctcagatccttgttcggctctggatactcaaaaagcccagacagtaaccgcgtcacaggaatctacgagctcagcctgtgcaagatgtccgacaccgggagccctggtatgcaacggaggagacggaaaatccttgatacgagtgtcgcctacgttagaggggaggagaatttggccggttggcgacctaggggtgattcactaattctcgaacaccagtgggagctcgagaaattggaacttttgcacgaggtggagaaaacacggcatttcctcctccttcgagaacgactgggcgacagtatccctaagtccctctcggactcactgtctcctagcctatcctccggcacactcagcacctcaaccagcatctcatcacagatcagtactactacattcgagtctgcaattactccttcagagtcaagcggttatgattctggtgatatcgaatcactggtggaccgagaaaaagaactggctaccaaatgcctgcagctattgacacacacttttaatcgagaattcagtcaagtgcatggctccgtgagcgactgcaaactgtccgacataagtcccataggccgagatccaagtgaatcatccttctcatccgcgaccctgaccccatcaagtacatgtccctcactcgtggacagcagatctaactccctcgaccagaaaacacccgaagctaattccagggctagcagtccctgccctgagtttgagcaattccagattgttcccgcagtggaaaccccttacctagcccgggcgggcaaaaacgagttcttgaatctagttcctgacattgaagagatccgtccctcgtctgtcgtttccaaaaaagggtatctccatttcaaagaacccctctactccaactgggcaaagcacttcgtagtggtccgccgtccctatgtatttatctataacagtgataaggatccagtcgaacgtggtattatcaacctgagcacggctcaggttgaatattccgaggatcaacaggccatggttaagacccccaacacttttgcggtatgcactaaacaccgtggcgtgctgcttcaagcattaaacgacaaagacatgaacgattggttgtacgccttcaacccgctgttggccggaacaattcggtctaagctctccagaaggtgccccagccagtctaaatactag

SEQ ID NO: 192422 - DNA, 5472 bp, Artificial Sequence
  Description of Artificial Sequence: Synthetic coding sequence
atgagcggcgccagcgtgaaggtggccgtgcgggtgcggcccttcaactcgagggagacatccaaagagagcaagtgtattattcagatgcaaggtaactctacatccatcattaaccctaaaaatccaaaagaagcccccaaaagcttttctttcgattactcctattggagccacacttctccagaggatccctgcttcgcctctcagaatcgtgtctataatgacatcggaaaagagatgctcttacacgcctttgagggctataatgtctgcatctttgcatacggccagaccggagcaggaaaaagctatacaatgatggggaaacaggaagagtcccaggcaggtattataccgcaactgtgtgaggagttattcgaaaagatcaacgataattgcaatgaggaaatgtcatactccgttgaggtgtcctatatggagatctactgtgaaagggttagggacctgctaaatcctaaaaacaagggcaatctgcgggtgcgtgaacaccctttgctgggcccttatgtagaggatctgagcaagctggccgttacttcctatactgacatcgcagatcttatggacgcgggtaataaagcccgaacagttgctgccacaaacatgaacgagacaagctccagatctcatgccgtgtttacgatcgtgttcacccagaaaaaacacgataatgaaaccaatttaagcaccgaaaaggttagcaaaataagcctcgtggatctcgccggaagcgagcgtgccgattctacaggcgcgaaggggaccaggctgaaggaaggagctaatattaataaaagcctgaccaccctcggaaaagtgatctccgccctggcggaagtggataccagcaaaaaaaagagcaagaaaaagaaaaaaactgacttcattccttatagagactcagttctgacatggctgctacgggagaatcttggcggcaactctcggacagccatggttgctgcactgtccccagccgatatcaattacgacgaaacattatccactctgcgatatgctgacagggccaagcagatcaagtgtaatgcagtgatcaatgaggatcccaacgcgaagctggtgcgagaacttaaagaagaggtcacccgtctgaaagaccttcttagggcacaagggctgggagatatcattgacatcgaccctctgattgacgactatagcggcagcggatcaaaatatctcaaggacttccaaaacaataaacataggtatttgttagcatccgagaaccagagacccgggcactttagcactgcatccatggggtccttgacttcaagcccatcttcttgcagcctgagttcccaagttggtctaacctcagtaacaagtatacaggagcgcatcatgtcgacaccaggcggcgaggaagctatcgaaaggctcaaagaatccgagaaaattatcgccgagttgaatgaaacatgggaggagaagttgagaaagaccgaggcgatcagaatggagcgggaagctctcctggccgaaatgggagtggccattcgtgaagacgggggcaccctcggggtattctcccccaaaaaaacaccacatcttgtcaacctgaacgaggaccctctgatgtccgaatgcttactttattacatcaaagacggcattactagggtgggccaagctgacgctgagcggaggcaggacattgtcctatcgggagcccacattaaagaggaacactgtattttcaggtccgagcggtctaacagcggagaggtcatcgtgactctagaaccctgtgagcgaagtgaaacctacgtgaacggtaaacgggtttcccagccggtgcagctgagaagcggcaaccgcatcatcatgggaaaaaaccacgtcttccgcttcaaccacccagaacaggccagggccgagcgtgaaaagaccccttccgctgagaccccctctgagccagtggactggaccttcgcccaacgggagctcttggaaaaacaaggaatcgatatgaagcaagagatggagaagcgcctgcaagagatggagatactgtataagaaagagaaggaggaggctgacctccttctcgaacagcagaggttggattatgagagcaagttgcaagcccttcaaaaacaggtggagacacgttcactggcagcggaaactacggaagaagaggaagaggaggaggaagtgccctggacccagcacgagtttgagctagcccagtgggcatttcgcaagtggaaatcccaccaattcacctccctgagggacctactctgggggaatgccgtttacctgaaggaggcaaatgcaatttcagtagaattaaaaaaaaaggtgcaatttcagttcgtacttcttacagatactctgtacagtccattgccgcccgagctgctgcccaccgaaatggagaagactcacgaggacagaccgtttccgcgcacagtcgttgccgttgaagtgcaggatttgaaaaatggggccactcactactggtcactggaaaaactgaaacagagactcgaccttatgagagagatgtatgatagagccggggagatggctagtagcgctcaggatgaatccgaaaccacggtgacaggcagcgaccctttttacgatcgcttccattggttcaaactcgtgggctcctcgcccatcttccacggttgtgttaacgaaaggttggcagaccgcacacctagcccaaccttctctactgcagatagcgacatcaccgagctcgccgacgaacaacaggatgaaatggaagacttcgacgatgaggccttcgtcgatgacgccggttctgatgctggaacagaggagggctcagacttgtttagtgatggacacgacccattttacgatcggagcccttggttcattctcgtggggcgcgccttcgtgtacctgtccaacttactctaccccgtcccgctgatacatcgcgtggctattgtgagtgagaagggcgaagtccgaggtttcctccgtgtcgccgtgcaagcaatcgccgccgatgaagaagcgcctgattacgggtctggcattagacaatcgggaacagctaagatttcgttcgacaatgagtatttcaaccagtccgacttcagttccgttgccatgactaggtctgggctgtccttggaggagctgcgcattgtggagggccaaggccaatctagtgaagtaatcacccccccagaggagataagtcgcattaatgacttggacctgaaatccagtactttgctggatggcaagatggttatggaggggttctctgaagagattgggaaccacttgaaacttggctctgccttcacattccgggttaccgtgctgcaggccagtgggatactccccgaatacgccgatatattctgccagtttaattttctccatcgtcatgatgaagccttttccaccgagccactgaaaaataatggtagaggatcccccctggccttctatcacgtgcaaaacattgctgtcgagatcaccgaaagctttgtggactacatcaagacaaaacccattgttttcgaagtgtttggtcattaccagcagcaccctcttcacctgcaggggcaggaactgaatagccctccccagccctgccgaagattctttccaccacccatgccactgtctaaacctgtgcctgccacaaagttgaatacaatgtccaagaccagccttggacaatccatgtctaaatacgatctccttgtgtggttcgagatttccgagttagagcccactggcgaatacatccccgccgtcgtcgaccatactgccggtttgccatgtcagggcacatttctactgcaccaagggatccagcggcgcatcactgtgacaatcatccacgaaaaaggttccgagcttcattggaaggatgtgcgtgaactagtggtgggccggattagaaataaacccgaggtggatgaagctgcagtcgatgccattctgagcctgaatataatctcagccaagtatttgaagtctagccataacagcagtcggacattctaccggtttgaagccgtgtgggattcaagtttgcacaacagcttactgttaaacagggtaaccccttacggtgagaagatctacatgactctgtccgcttatctggaactagatcattgcatccaacctgcagtaattactaaggacgtctgtatggtgttctatagcagagatgctaaaatctctcctccccggtctctccggtctctattcggctccggctattctaaatctcctgactccaacagggtgaccgggatctatgagctttctctctgcaaaatgtcagataccgggtcacccggaatgcaacgcagaaggcggaagatacttgataccagcgtggcttacgtgcgcggagaggaaaacctggctggttggcggccaagaggggatagtctgatactggaacaccagtgggagctcgagaaactggaactccttcatgaagttgaaaagacacgacacttcctgctgttacgggagagactgggagacagcatacccaagtccctgtccgactctctgtcaccgtctctgtccagtggaaccctctctacgagtacaagcatttcctctcagatctctactaccacctttgagtctgccatcaccccctcagaatccagtggatatgattccggggacatcgaatcactcgtagacagagagaaagaactggcaacaaaatgccttcaactcctgactcacacctttaaccgcgaattcagccaggtgcatggaagtgtctctgattgcaagctatctgacatctcacctattggccgagatcctagcgagtccagtttttcttccgctacactcaccccttctagcacttgtccctctcttgtagattcacggtcaaatagcctggaccagaagactccggaggcaaacagtcgtgccagcagtccctgccctgagtttgaacaatttcaaattgtcccagcagttgagactccataccttgcccgggcgggcaagaatgaatttcttaacttagttccagacatagaggagatacggccctcttcagttgtctccaagaagggctacttacacttcaaggagccactgtacagcaattgggccaagcatttcgtcgtggtgcgtagaccatacgtgtttatctacaattccgataaagatcctgtcgaacgtggcatcatcaacctttccacggcgcaggtcgagtattccgaggaccagcaggcgatggttaaaactcccaacacatttgcggtgtgtacaaagcaccgcggggtgctgcttcaggccctgaacgacaaggatatgaacgattggttgtatgcctttaacccactcttagccggcacaatccggccaggtcacctggcttcagaaatcatacgggaggataagagcgtgagtttttcttgtcagtag

SEQ ID NO: 192423 - DNA, 5472 bp, Artificial Sequence
  Description of Artificial Sequence: Synthetic coding sequence
atgagcggcgccagcgtgaaggtggccgtgcgggtgcggcccttcaattcccgggagacatctaaagagtccaagtgcattattcagatgcaggggaatagtacgtcaatcataaatcccaagaaccctaaagaggcccctaagagcttttcttttgattactcctactggtcgcatacaagccccgaggatccctgttttgcttctcagaaccgcgtttacaatgatattggtaaagagatgctgcttcatgcctttgaaggctataacgtctgcatttttgcatatggccaaacaggagccgggaaatcttatactatgatggggaaacaagaggagtcccaggccgggatcattccacagctctgcgaggaactgttcgagaagatcaatgacaactgcaacgaagagatgagctactcagtagaagtgtcatatatggagatctattgcgagcgtgtgagagacctgctgaatcctaagaacaaggggaacctgcgcgtcagagagcatccactgctgggtccctacgtggaggacttatcgaagctggctgtcaccagctacactgacatcgctgatttgatggacgctgggaacaaggccagaactgtcgctgccacaaacatgaacgagacctcttcacgctcccacgccgtgtttaccattgtgttcactcagaagaagcacgacaacgagacaaatctctccacagagaaggttagtaagattagtctggtggatctggccgggagcgaaagagccgatagcactggcgctaaaggcactcggctgaaagagggggccaacatcaataaatctctcaccacactgggaaaagtcatctctgctctggccgaagtggacaactgcacctcaaagagtaaaaagaaaaagaaaacggattttatcccgtatcgtgactccgtcttaacctggctcctgagagagaatcttggtgggaactcccgcactgccatggtagccgcactgtctccggcagatatcaactatgacgagaccctctcgactctgcggtacgccgaccgggcgaagcaaatcaagtgtaacgcagtcatcaacgaggacccaaacgctaagctcgtgcgagagctgaaagaggaagtaaccagactgaaagacctgcttagagcccagggactgggcgacatcatagacatcgacccattgatcgacgactactcaggttctggatcaaagtatctgaaggactttcagaataataaacaccggtaccttcttgcctctgagaatcaacgacccgggcacttctctaccgcgagtatgggttccctgacgtcctctccaagcagttgtagtttgtcctctcaggtaggtctgactagcgtgaccagcatccaggagaggattatgtctacacctggcggcgaagaggccattgagcggctgaaggagtcagaaaagatcatcgccgagcttaatgagacatgggaggagaagctgagaaaaactgaggccatccggatggagagagaagccctcttggctgaaatgggcgtggccatccgtgaggacggggggaccctcggagtattctctccaaaaaagacaccacacctggtgaacttgaatgaggacccccttatgtctgagtgcttgctgtactatattaaggatggcataactagagtaggccaagccgatgccgagagaagacaggacatagttctgtctggtgcacatattaaggaagagcactgtatttttagaagcgaacgatccaacagtggagaggtgatcgtgaccctggaaccctgcgagcgcagcgaaacttacgtcaatggaaagcgtgtgagtcagcctgtccagttgaggtctggtaatcgtatcatcatggggaaaaatcacgtattccgcttcaatcatcccgaacaggcgcgcgctgagagagaaaaaacgccctcagctgaaacacccagcgagcctgtcgattggacattcgcccaacgggaattgcttgaaaagcaaggcattgacatgaagcaggagatggagaaaagattgcaagaaatggaaatcctgtacaagaaggaaaaggaggaagccgaccttctactcgagcaacaacgccttgactatgagagcaaacttcaggcccttcaaaagcaggttgagactcggtccctcgccgcagagacaaccgaggaggaggaggaagaagaagaagtgccttggacacagcatgaattcgagctcgctcaatgggcatttcggaagtggaaatctcaccagtttacctcgctccgagacctcctctgggggaacgcagtgtatttaaaggaagcgaacgccataagtgtggaactcaagaagaaggtgcaattccaattcgtgctgctgaccgacaccctgtactcgcctctgcctcctgagctcttgcctacagaaatggagaaaacacacgaagaccgaccttttcctcgaacagtcgtcgccgtagaggtgcaggatctgaagaatggcgctacccattactggtctctagaaaagcttaaacaaaggctggatctgatgagggaaatgtatgaccgcgctggtgagatggccagctccgcccaagatgaaagcgaaaccacagttacagggtcagaccctttctacgatcgcttccattggtttaaactcgtaggcagctctccgattttccacgggtgtgttaacgagcgactggcggaccgcaccccttcacctacattttctacagcggactcggatattactgagttggccgatgaacaacaggacgaaatggaagacttcgatgacgaagcgttcgttgacgatgccgggtccgatgccgggaccgaggagggttccgatcttttcagtgacggccatgacccattttacgaccgttcaccttggtttatcttggtaggtagggctttcgtatatctgagcaacctgctctatcctgtgccactcatacacagggtggccattgtctccgagaagggggaggtccggggatttctaagagttgccgtccaagctatcgccgcagatgaggaggcccctgattatgggtccggaattaggcagagtgggaccgcaaaaatcagcttcgataatgagtacttcaatcaaagtgatttttcatctgtcgctatgacgcgttctggtctcagcctggaagagctacgcattgtggagggacaagggcagtcttccgaggtgattactcccccagaggaaataagccgcattaatgacctagacttgaaatctagcactctgttagacgggaaaatggtgatggagggcttcagcgaggagataggaaaccatcttaaactgggcagtgccttcaccttcagggtgaccgttctgcaggccagcggcatcttgcccgagtatgcagacattttctgccagtttaattttttgcatcgacatgacgaggccttttcaacagagcctctgaaaaataatggaagagggtcacctctggccttttatcatgttcagaacattgctgtggagataacagaaagctttgttgattatatcaagacaaagccaatcgttttcgaagttttcggtcactaccagcagcaccctctccaccttcagggtcaagagctgaatagtcccccgcaaccctgtcggaggtttttcccaccaccaatgccactgtcaaaacctgtgcctgccacaaagcttaatactatgagcaagacctctcttgggcagtcaatgtctaagtacgatttgttggtatggtttgagatatctgagcttgaaccaacgggcgaatatattccagctgtcgttgatcacacagctggtctgccctgccaggggacttttctgctgcaccaggggatacaaagaagaatcacagtgacgatcatccatgaaaaggggtctgaactccactggaaagacgtgcgggagttggttgtgggccgcatacgaaataagcctgaagtcgacgaggccgccgtcgatgcaatcctcagtctcaacatcatctcagccaaatacctgaagagcagccataattcttcacggaccttctataggtttgaggcagtatgggatagctccctccataatagcctgctcctgaaccgtgtgactccctatggtgaaaagatctacatgacactttccgcatatctcgagctcgatcactgcattcagccagccgtgatcactaaagacgtttgcatggtattctacagccgagatgctaaaatctcacctcctagatcactgcggagcctgtttggttccgggtactcaaaaagccctgacagcaatagggtgactggcatctatgaattatcgctctgcaagatgtcagacacgggaagcccaggcatgcagaggagacggcggaagattctggatacgtctgtcgcctacgtccgaggcgaagagaatctggctgggtggcgcccacggggagattccctgatcttagaacaccagtgggagttggaaaaactcgagttgctccacgaagttgagaaaacacgtcacttcttgctgctgcgagagcgacttggcgatagtattccaaagtcgttgtctgactctctgagcccttccctctcatccggtacactgtcaacatctacatcaattagttctcagatcagtactacaacctttgagagtgccatcacccccagcgagagttcgggatacgactctggagatatcgaaagcctcgtggatagagaaaaagaactcgccaccaagtgcctgcagcttctgacgcatacattcaaccgggagttcagccaggtgcacgggtcggtctccgactgtaaactctcagatatcagccccatcggacgcgatccaagcgagtcctcatttagctccgctacactcacaccatcatcaacgtgcccgtcgttggtggattcccgctcaaattccttggaccagaagactccggaggccaacagccgagcttcgtccccttgtccagaatttgagcaattccagattgtgccagcagtcgagaccccgtacctcgcacgcgccggtaaaaatgaatttttgaacctagtccctgatatcgaggagattagacccagcagcgtagtgtccaagaagggttatttacactttaaggaaccgctctacagcaactgggctaaacatttcgtggtagtacggagaccttacgtctttatctacaactccgataaggaccctgttgagcgggggattattaacttgtcgacagcccaggtggagtactctgaggatcagcaggcaatggtgaaaacccccaatacgttcgccgtttgcacaaaacatcggggcgtcctgctgcaagccctaaatgacaaggacatgaacgattggctgtacgcatttaacccactgctcgcaggaacgattcgtcccggacatttggcctctgagataatcagggaggacaagtcagtttctttttcttgccagtag

SEQ ID NO: 192424 - DNA, 3462 bp, Artificial Sequence
  Description of Artificial Sequence: Synthetic coding sequence
atgagcggcgccagcgtgaaggtggccgtgcgggtgcggcccttcaacagcagggagactagtaaggagagcaaatgcattatacagatgcaaggcaactctacttcaatcataaatccaaaaaaccccaaggaggctcccaagagcttcagcttcgactattcttattggtcacatacaagccccgaggacccctgcttcgcgtctcaaaacagagtgtacaacgacataggcaaggaaatgctgctccacgctttcgagggatacaatgtgtgtatcttcgcatacggccaaacaggggccggcaaaagctacactatgatgggcaagcaggaagaatctcaggcaggaatcataccccagctgtgcgaggaactgtttgaaaagataaatgacaactgtaatgaggagatgagttacagcgttgaagtgagctacatggagatctattgcgagagagtccgagaccttctgaatcccaaaaacaaaggcaacctgagagttcgagagcatcccctacttggtccttacgtggaggatctcagcaaactggcagtgacaagctacaccgacatcgcagacctaatggacgcaggcaacaaggcaagaaccgtcgccgctactaacatgaacgagacctcctcccgctctcacgcagtgttcaccattgtgttcacacaaaagaagcacgacaacgagacaaatttgtccacagaaaaggtcagcaagatctccctagtggacctggccggcagtgaacgggcggattcaaccggcgcaaaaggaacccgtttgaaggagggagcaaacatcaataaatcattgaccaccctcggtaaagttattagcgctcttgcagaggtgagcaaaaagaaaaaaaaaaccgacttcattccctatcgggatagtgttctgacgtggttgctgcgagaaaatttaggcgggaatagtcggaccgccatggtggccgcgttatcaccagccgacattaactatgacgagacactgtccactctccggtatgccgatcgggccaagcaaatcaagtgtaacgctgttattaacgaagatcccaatgcaaaacttgtccgggaactgaaggaggaagtaacgagactgaaagacttgctgagggcgcagggcctcggtgatataatagacactagtatggggtcactgactagctctcccagttcctgctcactctcttcccaggtgggtctgacatctgtcaccagtattcaagaacgtatcatgagcactcctggcggcgaggaagccatagagcgcttgaaagaaagtgaaaaaatcatcgcagagctcaacgagacgtgggaggaaaaactgaggaagactgaagctattaggatggagagggaagctctattggctgagatgggggtggcaattcgagaggatgggggtacgctgggggtgttctcacccaaaaaaaccccccacctcgtgaatctgaatgaggatcctctcatgtctgagtgcctcctctattatattaaggatggcattaccagagtgggacaagcggatgcagagcgaagacaagatatcgttttaagtggtgcccacattaaggaggagcactgtatctttaggagtgagaggagcaactccggggaggtgatagtgacgctagaaccttgtgagcgatccgaaacctatgtgaatggcaaaagagtcagccagcccgtgcagctccggtcaggtaaccgcattatcatgggcaagaatcacgtgtttcgcttcaaccacccagagcaagctagagccgagagagaaaagaccccatccgcagaaaccccgagtgagccggttgactggacctttgctcagcgggagctcctggaaaaacagggtatagatatgaaacaagagatggagaagcggctgcaggagatggaaatcctatacaagaaagagaaggaggaggcagacctcctcctagagcagcagcgtttggatgccgactcggattccggtgacgactccgataagagatcatgcgaggaatcttggaagctgatcacctcattgagggagaagctcccaccatctaagctgcagacaatagtgaagaagtgtggtttgccttcaagcggcaagaaacgggaacctatcaaaatgtaccagattccacagagacgacggctgagtaaagactcaaaatgggtgacaatcagtgacttgaaaattcaagccgtcaaggagatttgctacgaagtcgccttgaacgatttccgtcattctcgccaggagattgaagctctcgctattgtaaagatgaaagagttatgcgccatgtacggaaagaaggacccaaacgaaagagacagttggcgagcggttgctcgagatgtttgggacactgttggggtgggtgacgaaaagattgaggacgttatggccaccggtaagggctccaccgacgtggacgatctgaaggtgcatatcgacaaactggaggacattttgcaagaggtgaaaaagcagaataatatgaaggatgaggagatcaaggtcctgcgcaacaagatgctaaaaatggaaaaggtgctgcctctcatagggagccaagagcagaaatctccaggcagccacaaggcaaaagaacctgtgggggctggcgtgagcagcaccagcgagaacaatgtctcgaaaggcgacaatggggaattggccaaagaagagcgagtatctcagttgatgaatggggatccggcctttcggagaggtcgcctcaggtggatgcggcaggaacagatccgattcaaaaatctgcagcagcaggagattaccaaacagctgagacgccagaacgtgcctcacaggtttatcccaccagagaacaggaaaccaaggtttcctttcaaatctaatcccaaacacagaaacagctggtctcccggcactcacatcatcataacagaggacgaggttatcgagctgagaattccgaaggacgacgaggcgcgcaaaggcaacaaggaggagagtcaggaaaaggggggcaagggcgccttcaaggatccccagttcccatggggctcccaggggatgcgatcccaggaccacatccaggtgtctaagcagcatatcaacaaccagcagcaacctccccagcttcggtggaggagcaacagcttgaataacggacaacctaaatccacaaggtgccaggcatctgctagtgcggaatctttaaattcacattctggccacccgacagccgatgtgcagacatttcaagctaagagacatatccaccaacatagacaatcgtattgcaattacaacactggcggtcagctggagggcaatgctgccacgtcctaccagaagcagactgacaagccttcgcattgcagccagttcgttacacctccaagaatgcgtcgacaattcagcgcccccaacctcaaagccggaagagagactacggtatag

SEQ ID NO: 192425 - DNA, 5451 bp, Artificial Sequence
  Description of Artificial Sequence: Synthetic coding sequence
atgagcggcgccagcgtgaaggtggccgtgcgggtgcggcccttcaattcacgcgaaacatccaaggagtcaaaatgcatcattcagatgcaggggaatagtacttcaattatcaatccgaaaaacccgaaagaagctccaaagagcttttcttttgattacagttactggagtcacactagccccgaggacccttgtttcgcctctcaaaaccgcgtgtataacgatattggtaaagagatgctcctacatgcgttcgagggctataacgtgtgcatatttgcatatggacagactggagccggcaaaagctatacaatgatgggcaaacaagaggagagtcaagctggcatcatcccacagctatgcgaggagctcttcgagaagattaatgataactgcaatgaggagatgtcatatagcgtggaggttagctacatggagatttactgcgagagagtacgcgatctcctgaatccaaaaaataaaggaaacctgcgggtccgtgaacatcccttgttgggtccttatgtggaagatttgtccaagctggcagtgacctcttacactgacatcgcagacctgatggacgccggcaacaaggcacgcaccgtggcagctactaacatgaacgagacatcctctcgctcccacgccgtcttcacgattgtattcacacagaagaaacacgataatgagacgaatctgagtaccgagaaggtctcaaagattagcttggtggacctggcaggaagcgagagagctgattcaaccggagccaagggcacccgattgaaggagggagctaatatcaacaagagtctgacgaccctcggaaaggtgatttccgcactggcggaagtcgataattgtacatccaagtccaaaaaaaagaagaaaactgacttcatcccatatcgtgattccgtcctcacgtggctgttgcgagagaatctcgggggaaatagcaggaccgcgatggtggccgccttaagccctgccgatattaattacgacgaaaccctgtcgacactgagatatgctgatagagcaaagcaaatcaaatgcaatgctgtcattaacgaagacccgaatgctaaattggtgcgggaactgaaagaagaagtgactaggttgaaggatctactccgggctcaggggctgggagacatcatagatatcgatcctttgatagacgactacagcgggtctggaagcaaatacctcaaggatttccaaaataacaaacaccggtacttgctcgcatctgagaaccaacgtcctggacacttcagtaccgctagcatgggcagcctgacctctagtccaagcagttgctccctgtcatctcaagttggtttgactagtgttacctccattcaggaacggataatgtctacgcctggaggggaagaggcgatagaacgtctgaaagaaagcgaaaagatcatcgctgagttaaatgagacctgggaagaaaagctgaggaaaacggaggcaatccggatggaaagagaagcccttttggcagagatgggtgtcgctatccgagaggatggtggaacccttggggtgttctctccaaagaagaccccacatctagttaatttgaacgaggaccctttgatgagcgaatgtcttctgtactacatcaaagatggcatcactcgtgttggacaggcggatgcagaacgccgccaggatattgtgctgagcggggcccatataaaggaagaacattgcatcttccgctctgaacggtccaacagcggagaagtgatcgtgacgctggaaccttgtgagcggtccgagacctatgtgaatgggaaaagagtttcccagcctgttcagctccggtcaggtaaccgtattattatgggcaagaaccatgtctttcgctttaatcaccctgagcaggcccgagctgagagggaaaagaccccatccgccgagactccaagtgagcccgtggattggacattcgctcagcgggaactcctcgagaagcaagggattgatatgaagcaggaaatggagaagagactccaagagatggaaatcttgtacaagaaggagaaggaggaagctgacctcctattggagcaacagcgcttagactacgaatccaaactgcaggcactgcagaaacaggtagaaacaagatcactggctgccgaaacgactgaggaggaggaggaggaggaggaggtcccttggactcagcacgagtttgaacttgctcagtgggcatttaggaaatggaagtctcatcagtttacttctttaagagatctgttgtggggcaacgccgtttacttgaaggaagctaatgctatatccgtggaattgaagaaaaaagtgcagttccagttcgttctgctcacagacaccctgtactccccattgccccctgagcttttgccgacagagatggagaagactcatgaagaccgaccttttcctcggaccgtcgtggcggtggaggttcaagacctgaagaacggtgctacgcattattggtcactcgagaaattgaagcagcgcttagatctgatgcgcgagatgtacgaccgggctggggaaatggcatcctctgctcaggacgagtccgaaactactgtgaccggcagcgatcctttttacgaccggtttcattggtttaaactcgtcggcagtagtcctatcttccacggctgcgtgaacgagcggcttgccgatcggacaccttcccccaccttcagcacagcggattccgacattaccgaactggcagacgaacagcaggacgaaatggaggattttgatgacgaagcctttgtcgatgacgccggcagcgatgcaggcacagaggaaggctccgacctattctccgacggtcatgatccattctacgacaggtctccctggtttatcctcgtgggccgggcatttgtctacctgtctaaccttctctacccagttcccttgattcaccgcgtcgctatcgtgagtgagaaaggagaggtgcggggtttcctcagagtcgctgttcaggcgattgccgctgacgaggaggctcctgattatgggagtggaattcggcagtccggaaccgcaaagattagttttgacaatgaatatttcaatcagtcagacttcagtagcgtcgccatgaccaggtcagggctatctcttgaggagctgagaatagtagagggacaagggcagtcgtcagaagtcattactccgccagaggagatttctcgaattaacgacctagacctaaaaagtagcacccttttagatggcaaaatggtcatggaaggtttcagcgaagaaatagggaatcatctcaagctgggcagcgcctttactttcagagtaactgtgctccaggcctctggcatactaccggagtacgcagatatcttttgccaatttaatttccttcacaggcacgacgaggccttctctacggagccgttgaagaacaacggtcgcggctccccactggctttctaccacgtccagaacatcgcagtagaaatcacggagagctttgtggactatattaagacaaaacccatcgttttcgaagtcttcgggcactatcagcagcaccccctccaccttcagggacaggagctcaatagcccaccccagccttgccgaagattctttccaccccccatgccgctaagcaagccggtccccgcaacgaagcttaataccatgtccaagacttcattggggcagtctatgagcaaatatgacctgttggtgtggttcgagatctccgaacttgaacccactggggaatatataccagccgtggtggaccatactgcaggcctgccctgccagggtacgttcttactgcatcagggcatccaaaggcgtattacagtcacaataatccatgagaagggaagcgagttacactggaaggacgttcgcgaactcgtggtgggtcgaatccgaaacaaacccgaagtggatgaggcagctgttgacgccatcctaagcctgaacattatcagtgccaagtatctgaagagcagccataactcctcacgcactttctatagatttgaggccgtttgggactcttccctgcacaatagcctgctgctgaatagagttaccccatacggagaaaagatctacatgacactctcagcgtatctcgaactggaccactgtattcagcccgctgtcataaccaaggacgtgtgtatggttttctattcccgggacgccaagatcagtccaccccgcagcctgaggtccctgtttgggtctggatactccaagagcccggactcgaatcgagtcaccgggatatatgagctctcactttgtaagatgagtgatactggatccccaggaatgcagcgtaggcggcgtaaaattttggacacttccgtggcttatgtcagaggtgaggaaaacctcgccggatggcgcccacggggggactcattaattctcgaacatcagtgggagctcgagaagctggaactactgcacgaagtggagaagaccaggcatttcttattactgagggagcgcctgggcgattcgattcctaagtccctatcagatagcctatcgccctccttgtcttcaggcacactctcaacttcgacaagcatctcaagccaaattagcaccacgaccttcgaatccgccatcactcctagtgagtcgtccggctatgactcaggagacattgaatctctggtggacagagaaaaggagttggctactaaatgcctccagttactgacacatactttcaaccgggaattttcacaggtgcatgggtcagtgagtgactgtaaactcagtgatatctctcctattgggagggacccatccgagtctagctttagtagcgcaacactgactccttcatcaacgtgcccatccctcgttgatagtaggtctaattcgctggatcagaagacaccggaggccaactcgcgcgcaagtagcccctgcccagagtttgagcaattccagattgtcccagctgtggaaaccccttacctggcacgggccggaaaaaatgagtttctgaatctcgtccccgacatcgaggagataagaccatcatctgtcgtgtccaagaaaggatacctgcatttcaaagaacccctgtattcaaactgggctaagcactttgtggttgtgaggaggccctacgtgttcatctacaacagcgacaaggacccagtggagcgagggatcattaacttaagtacagcccaagttgaatattccgaggatcagcaggccatggtcaaaactccaaacaccttcgccgtatgcactaaacatcggggagttctgctgcaggctctcaacgataaagacatgaatgattggctgtatgcgtttaaccctctgctcgccggtacaatcagatctaagttgagcaggcgctgcccttctcagtccaaatactag

SEQ ID NO: 192426 - DNA, 3462 bp, Artificial Sequence
  Description of Artificial Sequence: Synthetic coding sequence
atgagcggcgccagcgtgaaggtggccgtgcgggtgcggcccttcaattcccgcgaaaccagcaaggagtcaaagtgcatcattcagatgcaaggcaactcgacgtccataattaaccccaagaatcccaaggaggcccccaagagcttcagctttgattactcttattggtcacacacatctcccgaagacccctgcttcgctagtcagaacagggtctataacgacatcggcaaagagatgctgctgcatgcatttgaagggtataacgtatgcatctttgcctacggtcaaaccggagctggcaagtcatacacgatgatgggaaaacaggaagagtcacaagcgggcatcataccacagctctgcgaggagctgttcgaaaaaatcaatgataattgcaacgaagagatgtcttactcagtagaggttagctatatggagatctactgtgaacgggtgagggatcttctgaatccaaaaaataagggcaaccttcgagttagggagcatcctctgttggggccttacgttgaagacttgtcaaaactggcagtcacctcttatacagatatagcagatctaatggacgctggaaacaaagctcgaacagtcgcagctacgaatatgaacgaaactagcagtaggagtcatgcggttttcacaatagtattcacacagaaaaaacatgacaacgagactaatctgtcgaccgagaaagtctccaagatttcattagtcgatctggccggctctgaacgagccgactctaccggtgccaaggggacaaggctgaaagagggagccaatattaacaaaagccttaccacgctgggtaaggtgatctcagcgttggccgaagtgagcaaaaaaaagaaaaaaactgactttattccttatagagatagcgtcctgacctggctgctaagagaaaatctggggggaaactctcggacggccatggtagccgcactgagtccagctgatattaattatgatgagacactcagcactttacgttatgccgatagggccaagcagattaagtgtaatgccgtaatcaacgaagatccaaatgccaaattggtaagggagcttaaagaagaggtcaccaggttgaaggacctgctgcgggcccagggcttgggcgatatcatcgacacttctatggggagtctcaccagttcaccttcaagctgctctctatcctcccaggtaggactgacgtctgtgacttccatccaggaaagaatcatgagcacccctggaggagaggaagcaatcgagcgactgaaggaatcagagaagattattgcagagttgaatgagacatgggaagagaaactaaggaagaccgaggctatccgcatggagagagaggcactcctggccgagatgggggtcgcgatccgcgaggacggaggcaccctgggcgtgttctctccgaaaaaaacacctcacctggtgaatctgaatgaggaccccctgatgtctgaatgtcttctgtattatatcaaggatggcatcacccgggtcgggcaagctgatgcagagaggcgccaggacatcgtactttctggagcacatataaaggaagaacactgtatcttcaggtcagagcgcagcaactctggcgaagtcattgtcacattggaaccatgcgagagatccgaaacttatgtgaatgggaaacgcgttagccagcctgtccagctcaggagcggaaatcgcatcatcatgggaaagaatcatgtatttcggttcaatcacccagagcaagccagggctgaaagagagaagacccccagcgcagagacgccttccgaacccgttgattggacgtttgcacagcgggaactgctggaaaaacagggtatcgacatgaaacaagagatggaaaaaaggctgcaggagatggaaatactgtacaagaaggagaaagaagaagcagacttgctgctcgagcagcaacgcctggacgctgactctgacagcggtgatgacagcgataagaggtcctgcgaagaaagctggaaactaattacatctctgcgcgagaaactccccccaagcaaactacagacaattgtgaagaaatgtggactgccttcaagcggcaagaagcgggaacctattaaaatgtatcagattccccagcgccgccggctttctaaagatagcaaatgggtaacaatctcagatttaaaaatccaagccgtgaaagagatatgttacgaagtggctttaaatgatttccgccacagccgtcaggagatcgaagcactggcaattgtgaagatgaaggaactgtgtgctatgtatggcaaaaaggaccctaacgagagggatagctggagggcagtcgctagagacgtgtgggacacagttggtgtgggcgatgagaaaatcgaggatgtgatggccaccggcaagggatcaacagacgttgatgacctcaaggtgcacattgataagttggaagatattctccaggaggtcaaaaagcagaacaatatgaaagacgaggaaatcaaagttctacggaataagatgctcaagatggagaaagtcctgcctctgattggctctcaggagcaaaaatcacccgggagccacaaggctaaggaacccgtaggggcaggtgtgagtagtacgtcagaaaacaacgtttcaaaaggggacaacggcgagctagccaaggaggaacgcgtgtcccaactgatgaacggagatccggcgttccgtcgcggtagattaagatggatgaggcaagagcagatccgctttaagaatttacagcagcaggaaatcaccaagcagctgcggcgccagaacgtccctcataggtttatcccaccagagaataggaagccccgattcccttttaaaagtaaccccaaacacagaaacagctggtcccccgggacgcacatcattattacagaggatgaggtgatcgagctgcggatcccaaaggatgatgaagcccggaaggggaacaaagaggagagccaagagaagggtgggaagggtgcgttcaaggacccgcagttcccttgggggagccagggcatgaggtctcaggatcacatacaagtctctaagcagcatattaacaaccagcagcaacccccccagctgcggtggcgctctaatagcctgaacaatggacagccgaagagcacacggtgtcaggccagcgcgagcgcagaaagtctgaattctcactcggggcatccaaccgctgatgttcagacgttccaggcaaagcgtcacatacatcagcaccgccagtcctactgcaactataatacagggggtcaattggagggcaatgccgctacttcataccagaaacaaactgacaagccctcccattgttcacagtttgtaacgcccccgagaatgcgccggcagttctcagccccaaatttgaaagccgggagagagacaaccgtgtag

SEQ ID NO: 192427 - DNA, 2673 bp, Artificial Sequence
  Description of Artificial Sequence: Synthetic coding sequence
atgagccagggcatcctgagcccccccgccggcctgctgagcgacgacgacgtggttgtgagtcctatgtttgaatcaaccgccgcggacctggggagcgtggttcgcaaaaatttgctctccgattgttccgtagttagtacatccctggaggataagcaacaggtgccctcggaggactccatggagaaggtaaaggtgtacctgagagtccgaccgcttctaccttccgagctcgaacgtcaggaggatcagggatgtgtgagaattgaaaatgtagagaccctggtgctgcaggcacctaaggattcttttgctttaaagagcaatgagcggggcataggtcaggctacacataggttcacattttcacaaatctttggccctgaagtggggcaggcttcattttttaatcttactgtcaaggagatggtgaaagacgtccttaagggtcagaattggctgatttatacctatggagtaactaatagtgggaaaacacataccatccagggcacaatcaaagatggggggattctccccaggtcactggccctgatatttaactcactgcagggacagctgcaccctacacccgacctgaaaccgctgctctccaatgaagtgatctggctcgatagcaagcagatccggcaggaagaaatgaaaaagctgagtctgctgaacggcggcctgcaggaagaagagcttagcacatccctcaagcggagcgtttacatcgagagccggatcggcacctccacttccttcgactctggcattgccggattaagtagtatatcccagtgcacatcatcttcgcaactggatgagacttcacacaggtgggcccagcccgataccgctcccctccccgttccagctaatatcaggttctctatatggatcagtttcttcgaaatttataacgagttgttgtatgacctcctggaacccccctcacaacaacggaagcgccagacacttcggctctgcgaggaccagaatggaaacccctacgtgaaagacttaaattggatccatgtgcaggacgccgaagaggcttggaagctccttaaggtgggaagaaagaaccaaagctttgcgtccacacacctgaatcagaattcaagccgatcccacagtatcttcagcatccgtatccttcacctacagggtgagggcgatatcgtgcctaaaatcagcgagcttagcctgtgcgacctggcaggatctgagaggtgcaaggaccaaaaaagtggagagcggctgaaggaagcgggaaatataaatactagcttgcatactttaggtagatgtattgccgcgttaagacagaatcagcaaaaccgctccaaacagaatctggtgccgtttcgcgattctaaactgacccgggtctttcaaggatttttcacaggccggggaaggtcgtgcatgatcgtgaatgttaacccctgtgccagcacttacgacgaaaccctccatgtggctaaattttctgcgatcgcatctcagttggtgcatgcaccacccatgcagttgggatttccgtccctacactcctttatcaaagaacactcactgcaggtaagtccgtctcttgagaaaggtgccaaggccgataccggcctggatgacgatattgagaacgaggctgatatcagcatgtatggcaaagaggagcttctgcaggtggttgaggctatgaagactctgcttctaaaggaaagacaggagaagctgcagctcgagatgcacctgagggatgaaatctgtaacgaaatggtggagcagatgcagcagagagagcagtggtgcagcgagcacttagacacccagaaggaactgcttgaagaaatgtatgaggagaagctgaatattctgaaggaatcactgacaagcttttaccaggaagagatccaggaacgggacgagaaaatagaagaactcgaggcgcttttgcaggaagctagacagcaatctgtcgctcatcagcagtctggatcagagctcgccttacgcagatcacaacggctggcagcctcagcttccacacagcagctccaggaggtgaaagccaagctgcagcagtgcaaagctgagctgaatagcaccacagaagagctacacaagtaccagaaaatgctggagccacccccctctgccaaaccgttcaccattgatgtggacaagaagctggaagaggggcaaaagaatatccgtttactgaggacagagctccagaaacttggggagtctctccagtccgcggaacgagcatgctgccactctaccggagcaggaaaactgaggcaagccttgactacttgcgatgacatcctcattaaacaggatcagacactggcagagctgcagaataacatggtgcttgtgaaacttgacctgaggaagaaagccgcgtgcatagccgaacaataccataccgttctgaagttgcagggccaggtctctgccaagaaacgcttgggcactaaccaggagaaccagcagcctaatcaacagccacctgggaaaaaaccctttctgcgcaatctcttgccgaggacccctacctgtcagagttccactgattgctcaccttacgcacggattctgaggtctcggcgctctccgctgctgaagtccggccctttcggaaaaaaatactag

SEQ ID NO: 192428 - DNA, 678 bp, Artificial Sequence
  Description of Artificial Sequence: Synthetic coding sequence
atgagccagggcatcctgagcccccccgccggcctgctgagcgacgacgatgtggttgtctctcccatgtttgaaagcactgcagccgacctaggatctgtagttcggaagaacctgctttctgactgctcagtggtaagcacatctctcgaagataagcaacaggttccctctgaagatagtatggaaaaggtcaaggtctatctgagagttagacctctcctcccctcagagctggagagacaggaggatcagggttgtgtgaggattgagaacgtcgagaccctggtcctgcaagcaccaaaagacagctttgccttgaagagcaatgagaggggtattggacaggcaacacaccgcttcaccttctctcagattttcggacctgaagtgggtcaggctagctttttcaatctgaccgtgaaagagatggttaaagacgtgctgaaggggcagaattggctcatatatacctacggagttaccaactctggaaaaactcacacaatccagggaaccatcaaagacggtgggattcttccccgatctctcgctctgatcttcaattccttgcagggccagctgcacccaacaccggatctgaagcctctgttatccaacgaggtgatttggctggatagcaaacagataagacaggaagaaatgaaaaagctgtag

SEQ ID NO: 192429 - DNA, 2619 bp, Artificial Sequence
  Description of Artificial Sequence: Synthetic coding sequence
atgagccagggcatcctgagcccccccgccggcctgctgagcgacgacgacgtagtagtctctccaatgttcgaatctactgccgccgatctggggagcgtggtccgaaagaatttgcttagtgattgctcagtggtgtcaacctcattggaagacaaacagcaggtcccaagcgaggattcaatggaaaaggaggatcaggggtgtgtgcggatcgaaaacgttgaaaccctcgtccttcaagcccctaaggactcatttgcccttaagagcaatgagcgaggaatcggacaggccacacatagattcactttttcacagatatttggtcctgaagtgggccaggcctcttttttcaatctgactgtcaaggaaatggtaaaggatgtgctgaaaggacagaactggctgatttacacatatggggtgacaaactccgggaaaacacacacaattcagggcactatcaaagatggcggtatcctgcccagatctctcgcgctgattttcaattctctgcagggtcagctccaccccactccagatcttaaacctctcctttctaacgaggttatatggctggactccaaacagatcaggcaggaagagatgaaaaaattgtctttattaaacggcggccttcaggaggaggagctgagcacttccctcaagcgcagcgtttacatcgagagtaggatcggaacttctactagtttcgattctggcatcgcagggctctcgtctatatcccagtgtacaagtagctcacagctagatgaaacatcccatcggtgggctcagccagacacagcaccactgccagtgccagctaacatccggttttcgatttggatttcattttttgaaatctataatgagctgctgtatgaccttcttgagcccccctcacaacagaggaagcgtcagaccttgaggctgtgtgaggaccagaacggaaatccctacgtgaaggacctgaactggattcacgtccaggacgccgaggaggcttggaagttgttaaaggtggggagaaaaaatcagtcctttgcttctacacacctcaaccagaactcatcaagatcccactccattttttcaatacgcatactgcatcttcagggagagggggatattgttcctaaaatcagcgaactgagcctttgcgacctggctggatcagagcgatgtaaggaccagaaatccggcgagcggctaaaagaggccggcaacatcaatacctcgctgcacactcttggaaggtgcatagccgcactgagacagaatcagcaaaaccgatctaaacagaatttggtgccctttagagactcaaagctgactagagttttccagggattctttacaggccgggggagaagctgcatgatagtgaacgtgaatccttgtgccagtacatacgacgagactcttcacgtggctaaattttccgccatcgcgagtcagttagtgcacgctcctcccatgcaacttggatttccttccctccattccttcataaaagagcacagcctgcaggtgtctccatccctggaaaaaggggccaaagcagatacggggctggatgatgatatagagaacgaggccgacatttcaatgtatggtaaagaggagctcttgcaggttgtcgaagcaatgaaaacccttctcttaaaagaaaggcaggagaagctccaactggaaatgcacttacgcgacgagatctgtaatgaaatggtggaacagatgcagcaacgcgaacaatggtgtagtgagcacttagacactcagaaagagctcctggaagagatgtacgaagagaaacttaatattcttaaggagtcacttacctccttttatcaggaggagatccaggaaagagatgaaaagattgaggaactggaagcccttttacaggaagcccgacaacagagtgttgctcaccagcagagtggatcagagctggcccttcgaagatcgcaaaggctggcagccagtgccagcacccagcagttacaagaagtcaaagcgaagttgcagcagtgcaaggctgagcttaactccacaaccgaagaactccataagtaccaaaagatgctggagcccccgcctagcgctaaacctttcaccattgacgtggataagaaattggaagaagggcagaagaatataagactacttcggactgagctgcagaaactaggcgaatcactgcaatccgccgagagagcgtgctgccactccacgggcgcgggaaaactgcgccaggccttgactacatgcgatgacatcctcatcaaacaggatcagacactggcagaacttcagaataatatggtgcttgtgaagctggatctccgtaagaaggccgcctgcattgccgagcagtatcatacggtcctgaagttacaagggcaagtgtcagccaaaaagagattgggaactaatcaggagaatcagcagcctaaccagcaacctccaggtaaaaaaccattcttaagaaacttgctgcctaggactcctacgtgccagtcatcaacagactgttctccatacgcacggatcctcagatcacggcgctcaccactgctgaagtcaggcccctttggaaagaaatactag

SEQ ID NO: 192430 - DNA, 480 bp, Artificial Sequence
  Description of Artificial Sequence: Synthetic coding sequence
atgagccagggcatcctgagcccccccgccggcctgctgagcgacgacgacgtcgtcgtaagccctatgttcgagagcactgcggccgatcttggatcagtggttcgtaagaatctattatctgactgcagtgttgtaagtacatccctcgaggataaacagcaggtgccctccgaagacagcatggagaaggtcaaggtatacctgcgtgtgcggcccttgctgccttcagaactcgaaaggcaggaggaccaggggtgcgtccggatagagaacgtggagacactggtgctgcaggctcccaaagatagctttgcccttaagagcaatgaaagaggcatcggccaggcaactcaccggtttaccttctcacagatttttggtcccgaagtgggacaggcttccttttttaacctcaccgttaaagagatggtgaaggatgtcttaaaagggcaaaattggctgatatacacttactag

SEQ ID NO: 192431 - DNA, 4884 bp, Artificial Sequence
  Description of Artificial Sequence: Synthetic coding sequence
atgctgggcgcccccgacgagagcagcgtgcgggtggccgtgcggatccggccacagcttgctaaagagaagatagagggttgccacatatgtacttcagtgacacccggcgagccgcaagtgtttcttgggaaagataaagcattcacattcgactacgtctttgacatcgattctcagcaagaacagatctatatacaatgcattgaaaaattgatagagggctgctttgaaggatacaatgcaacagttttcgcatatggacagaccggtgccggaaagacttacaccatgggtacggggttcgacgtgaacattgtcgaagaagaactcggtattatctcgagagcagtgaaacacctcttcaaatcaattgaggagaagaaacacatcgccattaaaaacggcttgcctgccccagacttcaaggtcaatgcgcagtttttggagctgtataacgaggaggttctggatttgttcgatacaacacgcgatatcgacgcaaaatccaagaagtcaaacattcgtatccacgaggacagcaccggcggaatttatacggtaggtgtgaccacaaggactgtaaacaccgagtctgaaatgatgcagtgtctgaagttgggagctctgagcaggacaaccgcctcaacgcagatgaacgtgcagagttcgagaagtcacgcgatcttcacaatacatgtttgtcagactcgggtctgcccacagattgacgctgacaacgcaactgataataagatcatttctgagtccgcccagatgaatgagtttgaaaccctgactgccaaatttcacttcgtagaccttgctggctctgaaaggttaaaaagaacgggtgccaccggcgaacgcgctaaagagggaatttctatcaattgcgggttgcttgccctgggcaatgtgatttctgcactaggcgacaaatcaaagcgcgccacacacgtgccctaccgggatagcaagctgaccagactgctccaggactccctgggcggaaacagtcagacaatcatgattgcatgtgtctccccttccgaccgcgatttcatggagaccctcaacacccttaagtacgcgaaccgagcacggaatattaagaacaaggtgatggtcaaccaggacagagctagtcaacagataaacgctctgcgcagcgagatcacccgacttcaaatggaattgatggaatataaaaccgggaagagaatcattgatgaggaaggagtcgaaagtattaacgacatgtttcacgagaatgccatgctgcagacagaaaataataatctgagggtaagaattaaagccatgcaagagacggtcgatgccctcaggtctcgcatcacacagctggtcagtgaccaggcgaaccatgtactggcgcgcgcgggggaagggaacgaagagatctccaacatgattcactcgtatatcaaggaaatcgaggacctcagagcgaaactgttagagtccgaggcagtcaacgagaacctgcgcaaaaatctgactagggctactgcgcgtgcaccatacttttctgggtcctctacatttagccctacaatcctgtcctctgacaaggaaaccatcgagatcattgacctggccaagaaggacctcgaaaaactcaaacggaaggaaaagcggaagaagaagcggttacagaagcttgaggaaagtaatcgagaggagcggtccgtcgccggcaaagaggacaacacagacactgatcaagagaagaaagaagagaagggcgtctccgagcgcgaaaacaatgagcttgaagtggaagagagccaagaggtctcagaccacgaagatgaggaagaggaggaggaggaagaagaagacgacattgatgggggggagtcctcagatgagtctgattccgagagcgacgagaaggcgaattaccaggcagacttggccaatattacctgcgaaattgccatcaagcagaagctcattgatgagctggagaacagccaaaagcgactgcagaccctgaaaaagcagtatgaggagaaactgatgatgctgcagcataaaattcgtgatacgcagttggaaagggatcaggtattacaaaacctcggctccgtcgaatcctattctgaagaaaaggctaagaaggtaagatccgagtacgaaaaaaaactgcaggctatgaacaaggagctccagcggctgcaggccgcacagaaggaacacgccaggttgctcaaaaatcaaagccagtatgagaaacagctcaaaaaattgcagcaggatgtgatggagatgaaaaagacaaaggtacgcctcatgaagcagatgaaggaggagcaggagaaggcacgactgacagaaagccgtcggaacagggaaattgcccagctaaagaaggatcagcgcaaaagagaccaccagctccggcttcttgaggcccagaaaaggaaccaggaggttgtcttgagacgtaagactgaagaggtgaccgctcttcgccgacaggtcagaccaatgtctgacaaggtcgcggggaaggtgacacgaaaactgtcttcttccgacgctcctgctcaggataccggcagttcagctgcagcagtggaaactgatgcgagcaggaccggcgcacagcagaaaatgcgcatccctgtggcccgtgtccaggccctgcccacccccgctacgaacgggaataggaagaagtaccaacggaaaggcctgaccggtagagtgttcatttctaaaaccgctcgaatgaagtggcaactgctcgaacgacgtgtaaccgatattataatgcagaagatgactatcagcaatatggaggcagatatgaatcggctgttaaagcagcgggaggaactgactaaacgtagagagaaactgtcaaaacggagggagaagattgtgaaagaaaacggtgaaggggataagaacgtggctaacattaacgaggagatggaatctctaacggccaatattgattacattaacgatagcatatctgactgtcaagccaacattatgcagatggaagaggccaaagaagaaggggagaccctggatgtgacagctgtcattaacgcttgcaccctcactgaggctaggtatctacttgaccactttctgagcatgggaatcaacaaggggttgcaggctgcacagaaagaagcacagatcaaggttctggagggcaggctcaaacagaccgagatcacttctgctacacagaatcagcttctgttccatatgcttaaagagaaggccgagctaaacccagagctcgatgcgctacttggacatgctctccaagacttcaagcacttcttcgtagaaaatgtggaggactcaacggatgaagacgcacctttgaattctcccgggtctgagggcagcaccctgagttccgatctaatgaaactgtgtggggaagtgaagccaaaaaataaggcccggcggaggacgactacacagatggagcttctgtacgccgatagttccgagcttgcttcagatacttccaccggcgacgcctctctccccggcccactgacccccgtagccgaggggcaagaaatcggaatgaacaccgaaacctctggtacctccgccagagaaaaagagctgtcaccgcccccagggctcccctccaagatcggtagtatctccaggcagtctagtctcagcgaaaaaaaaattcccgaacccagccctgtgacgaggcgcaaagcttatgagaaggccgagaaaagcaaggccaaggaacaaaaacagtcagatgaatccgattcaagcctttcagaggtacaccggggcatcattaaccccttccctgcaagcaaggggattcgggcatttcctttacaatgcatacatatcgcagaaggtcacactaaagctgttctgtgcgtggactctacagacgaccttctcttcacgggctccaaagatcggacatgcaaggtctggaacctggtgacaggtcaggaaatcatgtctcttggtgggcatccaaacaatgtcgtgtcggtcaaatactgtaattacacaagccttgtttttacagtgtcaacctcatatattaaggtgtgggacataagggacagtgccaagtgcattcgaacactgacaagcagcggtcaggtgaccttgggggatgcatgttccgcaagtacctcaaggacagttgctatcccttcaggagagaaccaaattaaccagattgctctcaatcctaccggcacattcctatacgctgcctccggcaatgctgttcgcatgtgggatctgaagcgtttccagagcacaggcaagctgacaggccacctggggcccgttatgtgcctgaccgtggatcagatcagttcgggacaggatctgattataaccggcagcaaggaccattatatcaaaatgtttgacgtgacagagggggccctggggacagtgtcccccactcacaacttcgagccaccccactacgacggaattgaagccctgacgattcagggagacaatctattttcagggtcacgtgataacggcatcaaaaaatgggacttaacacaaaaggatctcctgcaacaggtgcctaatgcccataaagattgggtgtgcgctctcggagtcgtgccagaccatcctgtgctgctctcaggttgccggggcggcatcttaaaagtatggaatatggacacatttatgccagtgggggaaatgaaaggccatgactccccaatcaacgccatctgcgttaacagcactcacatctttactgccgcagatgatcgtactgtgcgtatctggaaagcccgcaacttgcaggatggtcagatctctgatactggggaccttggcgaagacatagcctccaactag

SEQ ID NO: 192432 - DNA, 5025 bp, Artificial Sequence
  Description of Artificial Sequence: Synthetic coding sequence
atgctgggcgcccccgacgagagcagcgtgcgggtggccgtgcggatcaggccacaattggctaaagagaagattgagggctgccatatctgtacgagtgtcacccccggggagccccaggtctttctcggcaaggacaaggccttcaccttcgactatgtctttgatattgactcacagcaggaacaaatatacatccagtgtattgagaaattgattgagggttgtttcgaaggctacaacgccacagtgttcgcctatgggcagactggcgcaggaaagacctatacgatggggactgggttcgacgtgaatattgtcgaagaagaacttgggattattagtagagcagtcaaacacctgtttaagtctatcgaggagaaaaagcacatcgccatcaagaacggcctccccgcacctgattttaaggtgaacgctcaatttctcgagctgtacaacgaagaagtcctcgatctgttcgacacaacccgcgacattgacgcgaaatcgaagaagagcaatattcgcatccacgaggacagcaccgggggcatttatacagtgggcgtcaccactagaacggttaataccgagtccgagatgatgcagtgccttaagctgggcgctctctcacgcaccactgcgtcaacccagatgaatgtccaaagttcacgcagtcacgctatttttaccatccacgtatgccagaccagagtttgtccccaaatcgatgccgataatgcgaccgataataaaattatttccgagagcgcgcagatgaatgagtttgaaacactgacagcaaagtttcactttgttgatcttgcagggagcgaaagactgaagagaaccggagccaccggcgaacgcgccaaggaaggcatctcgattaactgcggtctcctggcactggggaacgtgataagcgccctcggcgacaagtcgaagcgtgccacccatgtgccctatagggactctaagcttacccgtctcctgcaggatagcctgggtggcaacagccaaaccatcatgatcgcttgcgttagtccatccgaccgggatttcatggagacactaaatacgttgaagtatgctaacagggcacggaacatcaaaaacaaggttatggtgaaccaggaccgggccagtcaacaaatcaacgccctgaggtctgagattacacgcctccagatggagcttatggaatataagacgggaaagcgtataatcgacgaagaaggtgttgagtctataaacgacatgtttcacgaaaacgcgatgcttcagaccgaaaacaacaacctgagggtccgaatcaaggcaatgcaggagacagtggatgcgctgcgatcccgcatcactcagttagttagtgaccaggccaatcatgtgcttgcaagagcgggcgagggcaatgaagagatttcaaatatgattcattcatacattaaggaaattgaggaccttcgcgccaagctcctggaatctgaagcggtgaacgagaacctgcgtaagaacctcactcgggctaccgcgcgcgctccatattttagtggttcctcgaccttctcacctactattttgagctccgacaaagaaacaattgagattatagatcttgctaaaaaggatctggagaaattgaaaagaaaggagaagaggaagaaaaaacgactgcagaaactggaagagtcgaatagagaggagagaagtgtggcaggcaaagaagacaacacagatacagatcaggagaaaaaggaagaaaaaggagtcagcgagagggaaaataatgagctggaagtcgaggagtcgcaagaggtttctgatcatgaagacgaggaagaggaggaagaggaggaggaggacgatatagacggcggtgagtcatcagatgaatcagactctgagagtgacgaaaaagcaaattatcaggcagatcttgctaatattacttgtgaaatcgccataaagcaaaagctgatcgacgaactcgagaatagccagaaaaggctccagacgctcaaaaaacagtacgaagagaaactgatgatgctgcaacataagatcagagacacacagctggaacgggatcaggtactccagaacctgggatcagtagagagctactctgaagagaaagcaaaaaaggtacgctccgagtatgagaagaagctgcaagctatgaacaaggaactgcagcggctgcaggccgcccaaaaagagcatgcacgactgctgaagaatcagtctcagtacgaaaagcagttaaaaaaattgcaacaagatgtaatggagatgaaaaagacaaaagtcagactgatgaaacagatgaaggaagaacaggaaaaggcacgcctcactgagagccggaggaaccgggaaatcgcacaactgaagaaggaccagagaaagcgggaccatcagcttcggctactcgaagctcaaaaacgcaatcaagaggtcgtgttaagacgcaagacggaagaggtcactgctctgcggaggcaggtgcggcctatgtccgataaagttgctggaaaggtgacccggaagctgagtagttctgacgccccagcccaagacacaggaagcagcgccgcagctgttgagacggatgcaagccggacaggcgcacagcagaaaatgcgaatccctgtggccagggtgcaggccttacctacacctgctactaatgggaacagaaaaaagtaccagagaaagggcctgacgggtagggtttttatctcaaaaaccgccagaatgaagtggcagctgctggagcgtagagtgacagatatcatcatgcagaagatgaccatctctaacatggaagctgatatgaaccgtctgctgaagcagcgagaagagttgactaagcgtcgagaaaagctatccaaacgaagagaaaaaattgttaaggagaatggcgagggtgataagaatgttgcaaacatcaatgaggagatggaatcgctgaccgcaaatattgactacataaacgattccatctctgattgtcaggcaaatattatgcagatggaggaagcgaaggaagagggcgaaacactcgatgttaccgcagtgattaacgcctgcacactgactgaggcacgttaccttctggaccactttctgagcatggggatcaacaaggggcttcaggctgcgcagaaggaagcccagattaaggtcttggagggaaggttgaagcagacagagatcactagcgccacccagaatcaactgctctttcatatgttaaaggaaaaggcggagttaaaccctgaactggatgcgctcttggggcacgctcttcaggacttggactctgtaccgttagaaaatgtggaggacagcaccgacgaggacgctccattgaacagccctgggtccgagggttcaactttgagctctgacctcatgaagttatgcggcgaggtgaaacccaagaacaaagcccggaggcgtactactacacagatggagctgctctacgcagattcttctgagctggcaagcgatactagtactggcgatgccagcctcccggggcctttgaccccagtcgctgaaggccaagaaatcggaatgaataccgagacatctggcacttcagctagggaaaaggagcttagtcccccaccagggttgccttctaaaattggctctattagcaggcagtccagtctgtctgagaagaaaatacccgagccaagccctgtcacccggagaaaggcctacgagaaagccgaaaaatctaaggctaaagaacagaagcatagcgactccggtacctctgaagcctctttatcccctccctcgtcaccgccttccaggcccagaaacgagctgaacgttttcaacaggttgacagtgtcacaaggcaatacttcagtgcagcaggacaagtctgatgagtccgactcgagcttgtcagaggtgcatcgcagctcaaggagaggaattattaatccgtttccggcaagtaaggggatccgggcttttcctcttcagtgtatccacatcgccgaagggcacacaaaggcagtgctgtgcgtggacagcactgacgacctgctctttacaggctccaaagatcgcacatgcaaagtctggaatttggtgactggtcaggagattatgtccctcggaggacatccaaataacgttgtgtccgtgaagtattgcaactatacgtctttggtgttcactgtatccacgtcttatatcaaggtgtgggatatccgcgatagtgccaaatgcattaggaccctgaccagttctgggcaggtgacccttggtgacgcatgttctgccagtaccagccggaccgtggcaatccctagtggggagaaccagatcaaccaaatcgctcttaatccaacgggtacttttctgtacgctgcatcgggtaacgcagtgagaatgtgggacctgaagcgattccagtcaacagggaaacttacaggtcatctggggcctgtgatgtgccttacagttgaccagataagcagtgggcaagatctgataattactggttccaaggaccactacatcaagatgtttgatgtgacggagggcgccctaggtacggtttctcccacacataactttgagccacctcactatgacggaatcgaggccctgaccattcaaggcgataatctttttagtgggtctcgggacaatggcatcaaaaaatgggaccttacccagaaagacttgttgcagcaggttcccaacgcccataaagactgggtctgtgctctgggtgtggtccctgatcatccagtactgttgtcaggctgcagaggggggatccttaaggtctggaacatggatacgttcatgccggtgggggagatgaaggggcacgattcccccattaatgcgatctgcgtgaatagcacccacatcttcaccgcagctgacgaccgaaccgttcgaatatggaaagccagaaatctgcaggatggccaaatctccgacacgggcgacttgggagaggacatcgccagcaattag

SEQ ID NO: 192433 - DNA, 4986 bp, Artificial Sequence
  Description of Artificial Sequence: Synthetic coding sequence
atgctgggcgcccccgacgagagcagcgtgcgggtggccgtgcggatccgtccccaacttgccaaggagaagatcgaaggatgtcatatctgcacctctgtaactcctggcgagccgcaggtgttcctaggcaaagacaaggcttttaccttcgattacgtgttcgatatcgacagtcagcaagagcagatctatatccagtgtatcgagaaactaatcgaagggtgttttgaagggtataacgcaaccgtgtttgcgtacggacagacgggtgcggggaaaacttatacgatgggcacaggattcgacgttaacatcgttgaggaagaactgggaatcatctctagggccgtaaaacatctgtttaaaagcatcgaagaaaagaagcatattgcaataaagaacgggctccccgctcctgattttaaagttaacgcccagttcttggagctgtacaacgaagaagtgcttgatctttttgacacaacccgcgacattgacgccaagtctaaaaaatcaaatatacggattcacgaggactctactggagggatctacacagtcggagtcaccactaggacggtgaataccgagtcagaaatgatgcagtgtctgaagctgggtgctctgagcagaacaactgctagcactcagatgaacgtccaaagcagccgcagtcatgccatcttcaccattcatgtctgccaaactcgggtctgtccgcagatcgacgctgataatgcgacggacaacaaaattatcagcgagtccgcacagatgaatgaatttgagactctaaccgcaaagtttcattttgttgacctggccggcagtgagcgactaaaaagaacaggcgccactggggaacgggcaaaggagggaatcagcatcaattgcggcctgttggccctcggtaatgtaatctccgccctcggcgacaaaagcaagagggccactcacgtcccatatagagactccaagctcacacgtctgctgcaagattcattaggaggaaactcacagaccatcatgatagcctgtgtctcgcccagcgatcgcgatttcatggagaccctcaataccctgaagtacgctaaccgggcacggaacatcaaaaataaggttatggtgaatcaggaccgggccagccagcaaattaatgcacttcgatctgaaattaccaggttgcaaatggagctgatggagtataagactggaaaacggatcattgatgaggaaggagtcgagtctatcaacgacatgtttcatgagaacgcaatgctccagaccgaaaacaataatcttcgggttagaatcaaggcaatgcaggagacagtggatgccctaaggtccagaattacacagctggtcagcgatcaggccaaccatgttctggcgagggcaggggaaggcaatgaagagatcagtaacatgatccactcctacattaaggaaattgaggacctgagagccaaacttctggaatctgaggcagtgaacgaaaacctacgaaagaacctgacccgtgctactgcaagagctccctacttctctggatcctcaactttcagccccacaatcctgagcagcgacaaggaaaccatcgagattattgacctggcaaagaaagacctggaaaagcttaaaagaaaagaaaaaagaaagaaaaagagcgtggctggaaaggaggacaacaccgacaccgatcaagagaaaaaggaagagaagggggttagtgagagggaaaataacgaattggaagttgaggagagccaggaagttagcgaccatgaagacgaagaagaggaggaggaggaggaggaagatgacatcgacggaggggaatcaagtgacgagtctgattctgaatctgacgagaaggccaattatcaggcagacctcgctaatatcacttgcgaaattgcaatcaagcagaagctaatcgatgaactcgaaaattctcagaaacggctgcagaccctgaaaaaacaatatgaggaaaagctgatgatgcttcagcacaaaataagggacacccagctggaacgagaccaggtgctccagaatctggggagtgtggagagctactccgaagagaaggctaaaaaggtgcgctccgaatacgagaagaaattacaggctatgaataaggaactgcaaagattgcaggcagcacagaaagaacacgctaggcttcttaagaatcaatcacagtatgaaaagcagctgaaaaagctacaacaggacgttatggaaatgaagaagaccaaagttcggttgatgaagcaaatgaaggaagaacaggaaaaggcgaggctgacagaaagccgtcggaaccgagagatcgctcaattaaaaaaggatcagaggaagcgggaccaccagctccggctgctggaagcacagaagcggaaccaggaggtagtgctaaggcgcaagacggaggaagtgactgctcttaggagacaggtccgcccaatgtccgacaaggtggctggaaaggtgactaggaaattgagctcctctgatgcccccgcgcaggacacaggaagttccgccgctgctgtggaaacagatgcatcccgaaccggcgctcagcagaaaatgaggattcctgttgctcgcgttcaggccctcccaactcctgcaacgaatggtaatcgcaaaaagtaccagagaaaggggctaacagggcgcgtgttcatctccaagaccgctaggatgaagtggcagttgctggaaaggagagttactgacattatcatgcaaaagatgacaatctcaaacatggaggctgacatgaatagactgcttaaacagcgcgaggaattgaccaagcgccgggaaaagctgtctaagagacgagaaaagattgtgaaggaaaacggggagggcgacaagaatgtcgcgaatattaatgaagaaatggaatccttgactgcaaatatcgactacattaatgatagcatctcagattgccaggccaacattatgcagatggaggaggcaaaggaagaaggagagactctggacgtcaccgccgttatcaatgcctgtaccctgacggaggctcgatatctcttagatcactttctctctatgggcattaacaaggggcttcaggcagctcaaaaagaagcccagattaaggttctcgagggacgcttgaagcagactgagattacaagtgctacccagaaccagctgctttttcacatgctgaaagagaaggctgagttgaaccctgaactggacgcccttctaggccatgcattgcaagacttagacagcgtgccactggaaaacgtagaggacagtacggacgaagatgcccctctgaactctcccggctccgaaggttcgaccctgtcgagtgatctgatgaaactgtgcggcgaagtgaagcccaagaacaaggccaggagacggacaactacccagatggagctgttatatgccgactctagcgaactcgcctcagacacctcaacaggcgatgcctcactcccaggacctctcactccagtggctgaaggccaggagattggaatgaacacagagacaagtgggaccagcgccagggagaaagaattgtctccccctccgggtctccctagcaagatcggttcgattagccggcagagcagtttatctgaaaagaaaatacccgaacccagtccagtgactcggcggaaggcttatgagaaagccgagaaatctaaggccaaggaacagaaacactctgattccggcacttccgaagcttccctgtccccacccagctcaccgccaagcaggccacggaacgaactgaatgtgtttaatcgtctcacagtctcacagggtaatacctctgtccagcaggataaatcagatgaatctgatagctccctatcagaggtacaccgctcgagccgccgaggaattatcaatcctttccctgcatcgaaaggcatcagagcttttcctctacagtgtattcatatcgctgagggtcataccaaggccgtcctctgtgtggacagcaccgacgatttgttgttcacagggtcaaaggacagaacatgtaaggtctggaacctggtaactggacaggagataatgtccttgggaggtcaccccaacaacgtcgtgtccgtgaagtactgcaactacacgtccctggttttcacagtttcaacttcgtatatcaaagtgtgggacatccgagactctgctaaatgtattcggacactgacgtctagtgggcaagtgacattgggggatgcctgcagcgcgtcaacctcacgtaccgttgccattcctagcggtgagaaccagattaaccagattgccttgaaccctacaggtactttcctttatgctgctagcggcaatgccgtgcgcatgtgggacctcaagcggtttcagtccactggtaagctaaccggacacctgggtcctgtcatgtgtctgacagtggatcaaatctcatccggacaggatcttattattacagggtccaaagaccactatattaagatgttcgatgtgacagagggagcactgggcactgtctccccaacccataatttcgagcctccccattacgatggaatagaggctctgaccattcagggcgacaacctattttctggctcccgcgacaacggcattaagaaatgggacctgacccagaaagacctcctccagcaggttcccaatgcccataaagattgggtgtgcgcactgggggtggttcctgatcatccagtactgctgagcgggtgtcgcgggggaattctgaaagtatggaacatggacacatttatgcccgtgggcgagatgaaaggccatgatagcccgattaacgcaatctgtgttaactccacccacatatttacagccgctgacgaccgcacggtccggatctggaaggcgagaaatctccaggatgggcaaatctctgacaccggtgatctgggggaggacatagcctcgaactag

SEQ ID NO: 192434 - DNA, 5028 bp, Artificial Sequence
  Description of Artificial Sequence: Synthetic coding sequence
atgctgggcgcccccgacgagagcagcgtgcgggtggccgtgcggatccggccccaactcgccaaagaaaaaatcgaagggtgtcacatttgtacgtccgttactccaggcgagccacaggtgttcctgggtaaagacaaggccttcaccttcgactatgttttcgacattgacagtcaacaagagcaaatctatatccaatgcattgagaagcttatcgaaggctgtttcgagggctataacgccaccgtgtttgcctacggacagaccggagccggaaagacatacaccatgggaacaggatttgacgtcaatattgtcgaagaagagctcgggatcattagcagggcagttaagcacctcttcaagtcgatagaggagaagaaacatatcgcgattaaaaacggtcttcctgctccggactttaaggtgaacgctcagttcctcgagctctacaacgaggaggttctcgacctcttcgataccaccagagatatcgatgcaaagtcaaaaaagtccaatatcagaatccatgaggatagtacaggtgggatctacaccgtgggtgtgacgacacggactgtgaataccgagtccgaaatgatgcagtgcctaaagctaggcgccttgtctaggacaactgcctccacacagatgaatgtccaaagttctcggtcccacgcgatcttcaccattcatgtatgtcagacccgagtctgcccccaaatagacgcagataatgcgactgataacaaaattattagcgaatccgcccaaatgaacgaattcgagacactgacagccaaatttcacttcgtggacctggccgggtccgaacggttgaaacgcacaggagcgacgggggagagagccaaagaggggatctctataaattgcggactgctggctctaggaaacgtgatctcagccctcggagacaaatccaaacgggccacgcatgtaccctaccgcgactctaagttgaccaggcttctgcaggacagcttgggagggaattcacagaccattatgatcgcctgtgtgagcccgtccgatagagattttatggaaactctcaatactctgaagtatgctaaccgcgccaggaacatcaagaataaggtgatggtcaatcaggatagagctagtcagcagattaacgccctaaggtccgaaatcaccagactgcagatggaactcatggaatacaagaccggcaaacgcataattgacgaagagggcgtcgagagcatcaacgatatgtttcacgagaatgccatgctccagacagaaaataataatctgagggtgcgtatcaaagcaatgcaggaaaccgtcgatgctctgcgtagccgaataacccagctggtgagtgaccaggcgaatcatgtgctggcacgggctggagagggaaatgaggaaatctctaacatgatacatagttacatcaaagaaattgaggatctccgggccaagctgctggaaagcgaagcggtcaatgaaaacctacgcaaaaatttgacaagagcaactgcccgtgctccgtatttctcgggctcgagcaccttttccccaaccattttgtcttccgataaagaaaccatcgagatcatagacctggccaagaaagatctggagaagttgaaaagaaaagagaaacgaaaaaaaaaacgcttgcagaaacttgaggagtcgaacagagaagagcgttcggttgctggaaaggaagacaacaccgacactgatcaggagaagaaggaagagaaaggtgtgtctgaaagagagaataacgagctcgaggtcgaggaatcacaggaggtgagtgaccatgaagacgaggaagaagaggaggaggaggaggaagatgatatcgacggcggtgagtcgtccgacgaatcggattccgaatcggacgagaaagcgaactatcaagcggatctggcgaatatcacctgtgagattgctatcaaacaaaagctgattgacgaacttgagaattcccaaaagaggctgcaaacattgaaaaagcagtacgaggaaaagcttatgatgctccagcacaagattcgtgacacccagctggaaagggatcaggtgttgcagaacctgggatccgtcgagtcctacagtgaagaaaaggctaagaaagttagaagcgaatacgagaagaagttacaggccatgaataaagagctgcagcggctccaggcagcgcagaaagagcacgctcggctcctcaagaatcagtcacagtacgagaagcagctgaagaaattacaacaagatgtaatggagatgaaaaagaccaaggtgaggctgatgaaacagatgaaagaagaacaggagaaagcacgactgactgagtctcgtcgaaatagggagattgcccagctaaagaaggaccagcggaagcgcgatcaccagctgcggctgttagaggcccagaagagaaatcaggaggtggtccttcgccggaaaaccgaggaagttacagcattgcgcagacaagtgagaccaatgtccgacaaggttgctgggaaggtcaccaggaagctgtcaagcagtgatgcgccggcgcaggacaccggctcctccgctgcagcagtggaaacagacgcctctcggaccggggcccaacaaaagatgcggattcctgtggccagagttcaggctttacccacacccgccaccaacggaaaccggaaaaagtatcagcgaaagggtctgaccgggcgggtgttcatctctaaaactgccaggatgaagtggcagctcctggagaggagagttaccgatatcatcatgcaaaagatgactatttcaaatatggaagctgacatgaaccgattactgaaacagagagaggagctgaccaagcgacgggagaagctgtccaagcgccgggaaaagatcgttaaggagaatggcgaaggagataagaatgtggcaaacatcaacgaagaaatggagagtctcacagctaacattgactacattaatgactccattagcgattgtcaggccaatatcatgcaaatggaagaggcaaaggaagagggggaaacactcgacgtaactgctgtgattaatgcctgcacacttactgaggcccgctatcttctcgaccacttcctgtccatgggaatcaataaaggcctgcaggcagcacagaaagaagcccagatcaaagtacttgaaggacgactgaaacaaaccgagatcacgtcagccacccagaaccaactcctgtttcacatgttgaaagagaaggctgagctgaaccccgagctcgacgctctgcttgggcatgctcttcaggatttcaagcatttcttcgtggagaacgttgaagactccacggacgaggatgccccactgaactctcccgggagcgagggctccactctgtcctctgatctgatgaagctgtgtggagaagtcaagcccaagaataaagcgcggcggcgcaccactacgcagatggagctgctgtatgccgacagtagcgaattagcatccgatacttccacaggcgacgcgagcctccctggccctctgacgccagtagccgagggtcaagaaattggcatgaatacagaaacttctggcactagcgcccgcgagaaagagctgagtcctccgcctggtctgcctagcaaaatcggcagcatttcacggcagtcttcactgtccgagaaaaagataccagaaccttcacctgtcaccagacgaaaggcctacgagaaggccgaaaagagtaaagccaaagagcagaagcactcagatagcggaaccagcgaagcttccctgtctccacccagcagcccaccgtcacggccccggaatgagctcaatgttttcaaccggctgacagtttcccagggaaacacgtccgtgcagcaggataaatctgacgagagcgactccagtctgtccgaggtgcaccggaatagtaatctcagaggtattatcaaccctttccccgcttctaagggaatccgggcgtttccgctccagtgtatccacattgcggaaggacacaccaaggctgtgctgtgtgtggattctacagatgatctgctctttaccggctctaaggacagaacgtgtaaggtgtggaacctggttacgggccaagaaataatgtctttgggaggtcacccaaacaacgtcgtttctgtcaagtactgcaattacacatccctcgtcttcacagtatcaacttcctacataaaggtgtgggatatccgggatagcgccaagtgcatccgtacattaacaagctccggccaggtgaccctcggtgacgcctgctccgcaagcacgtcacggaccgtggcaattccatcaggggaaaaccagattaaccagattgccttaaatccaaccggaacgttcctctacgccgcgagtggaaatgcggtcagaatgtgggatctaaagcgctttcaatccacggggaagctcactggccatctgggcccagtaatgtgtctcactgtagaccagatttcctccgggcaggacttgatcattaccggtagcaaggaccactatattaagatgttcgacgtcacggagggcgcactgggtaccgtctcgcccactcataactttgaaccccctcattacgatggtattgaagccctgacgatccagggggacaacttgtttagcggcagtcgagataacgggatcaaaaaatgggacctaactcagaaggatcttctgcagcaagtacctaacgcacacaaagattgggtgtgtgcgctcggcgtagtgccagatcatccggttctcctcagcgggtgcaggggagggattctcaaggtgtggaatatggacaccttcatgcccgtgggggagatgaaagggcacgatagccctatcaacgcaatttgtgtaaactccacccacatctttactgccgccgatgatcgcacagtgagaatctggaaggcgaggaatcttcaagacgggcaaatctcagatacgggagatttaggagaagatattgctagtaactag

SEQ ID NO: 192435 - DNA, 4866 bp, Artificial Sequence
  Description of Artificial Sequence: Synthetic coding sequence
atgctgggcgcccccgacgagagcagcgtgcgggtggccgtgcggatccgtcctcagctggctaaggagaagattgaaggatgtcacatctgcacttcagtcacgccaggagagccccaggtcttcctcgggaaggataaagcttttacctttgactatgtgtttgacattgacagtcagcaggagcagatttacatccaatgtattgagaagctcatcgaggggtgtttcgagggatataatgcaactgtgttcgcctatggacaaaccggggccggtaaaacttataccatggggaccggcttcgatgtcaacatagtggaagaggagttaggaattatttctcgggctgtaaaacatctgttcaagtccatagaggagaaaaagcacatcgcaatcaaaaatggcctgccagccccagactttaaggtgaacgcacaatttctggagctctataacgaagaagttctggatttgtttgataccacacgcgacattgacgcaaagagcaaaaaaagtaacattaggatccacgaagattccacaggcggaatatacactgtgggcgtcaccacccgaaccgtgaacacagaaagcgagatgatgcaatgcctgaaactgggtgcactgagcagaaccacagctagtactcagatgaatgtgcagtcttctcggtcccacgctattttcacgatccacgtatgccagacgagagtttgtccccaaatcgatgccgataatgcaacggacaataaaattatctccgaatctgcccagatgaatgaattcgagacactcaccgcaaagtttcacttcgtggacctcgcaggctcagagcgactgaaaaggacaggtgccactggagaaagagcaaaggaaggaatctcgatcaattgcggtctcctagcgctggggaatgttatttccgcactcggagataagagtaaacgagcaacacatgtgccttatcgggatagtaaactgaccaggttactccaggatagtcttggtggaaattctcagacgataatgattgcctgcgtgtccccatccgatagggacttcatggagaccttaaatacactcaaatacgccaatcgcgccagaaatataaaaaacaaggtaatggttaaccaagatcgagcctcccagcagatcaacgctcttaggtctgagataacccgcttgcaaatggagctcatggagtataaaacggggaagagaatcattgacgaggaaggcgttgaaagtattaatgacatgtttcacgagaacgctatgctgcaaactgaaaacaataacttgagagtgcgaatcaaggctatgcaagagaccgtggatgctcttaggtctaggattactcagttagtgtccgatcaggccaaccacgtgcttgctagagccggagaggggaatgaagaaatcagcaatatgatccacagctatattaaggagatcgaggacttgcgtgcaaagttactggagagtgaggccgtgaacgagaatctgcggaaaaacctaacgcgggcgacagcgagggccccgtacttctccgggtcttcaacttttagccccactattctatccagtgacaaagagacaattgaaattatcgaccttgcaaagaaagacttggagaaactcaagcgcaaggaaaagaggaagaagaagagtgttgcaggcaaggaggacaataccgataccgaccaagaaaaaaaggaggagaagggcgtctccgaaagagaaaataatgagttggaggtggaagagagtcaggaagtctctgaccacgaagatgaggaggaagaggaggaagaagaagaagacgatattgacggcggcgaaagctctgacgagtccgattctgaatccgacgaaaaggcaaactatcaggcagatctggccaatattacatgcgaaatcgctatcaagcagaagctgatcgacgagctcgagaattcacagaagcggctgcaaaccctgaagaaacagtatgaggagaagctcatgatgttgcagcataaaattagggatacccagcttgagcgcgatcaggtgttacaaaatcttggctccgttgagtcctacagcgaggagaaggcgaaaaaagtaagatccgagtacgaaaagaaactgcaagccatgaacaaggagttgcagagattgcaggccgcgcagaaagaacacgccaggttactcaaaaatcaaagtcagtatgaaaaacagctgaaaaagctccaacaggacgtaatggagatgaagaagactaaagttagactcatgaagcagatgaaggaagagcaggaaaaggcccgcctgacagagtccaggcgcaaccgcgagatcgcccaactgaaaaaagatcaacgcaagcgtgatgtgacggctttaagaagacaggtccgtcccatgtccgataaggtcgccggaaaagtgacccgcaaactcagctcctcagacgcacctgcccaggacaccggtagttctgccgcggcagtagagacggatgcctctcggaccggtgcgcagcagaaaatgcgcatccccgtggctcgggtgcaggcccttcccacacctgccacaaacgggaaccggaagaagtatcaacggaagggactcactggacgtgttttcattagcaaaactgcacgcatgaagtggcagcttctggagcgccgtgttactgatattataatgcaaaagatgacaatctcaaacatggaagctgatatgaaccggctcctgaagcaacgggaggaattaacgaagcggagggagaagctttcgaaaagaagggagaaaatcgtgaaggaaaatggagaaggggacaaaaacgtcgccaacattaatgaggaaatggagagcctgaccgcaaacattgattatataaatgattccattagtgactgtcaagctaatatcatgcagatggaagaggcaaaagaggaaggggaaactctcgatgttaccgcagtaatcaatgcttgtacgctcacagaagcgcgatacttacttgatcatttcctgagcatggggattaataaaggactccaggccgcacagaaagaagcccagataaaagtactggaaggccggttgaaacagacagaaatcacaagcgcaacgcagaaccagttgttgtttcatatgctgaaggagaaggctgagcttaatccggagttggacgcactgctgggccacgctctgcaagacctcgactccgtgccactggagaacgtggaggactccaccgatgaagatgcgccgctcaatagtcccggcagtgagggaagtacactctcctcagatctcatgaagctctgcggcgaggtaaaaccaaaaaataaagcaaggagaagaaccaccacccaaatggaactgttatacgctgactcaagtgagttagccagtgatacctccactggagacgccagtcttccaggtcctctgaccccagtggcagagggccaggagattggaatgaacacagagactagcgggacgagtgcaagagaaaaagagcttagtcccccacctggcttgcctagtaaaatcggttcgattagcaggcagagttcacttagcgaaaaaaagatcccagagcctagcccggtcacacgccgaaaggcctacgagaaggctgagaagtccaaggcaaaggaacagaaacactccgattcaggcacctctgaggcttcgctgtcccctccaagttccccaccaagtagaccccggaacgaattaaatgttttcaacagactaaccgtctctcaagggaacacgtcagtgcagcaagataagggaatcataaacccgtttcctgcaagcaagggaatacgcgcatttccattacagtgtattcacatcgccgaggggcatacgaaagccgttctctgtgtagattccacagatgatttgctcttcactggctccaaagaccgcacttgcaaggtctggaatttggtgacaggccaggaaattatgagcttaggtggacatcccaacaacgtcgtgagtgtaaaatattgcaattatacgtccttagttttcacagtatctacttcctatatcaaagtgtgggatatccgcgacagcgctaagtgcattcggacccttacatctagcggccaggtcacactgggcgacgcctgcagcgctagtaccagtcgcaccgttgctatcccatccggcgaaaaccagataaatcagatagctctgaatcccactgggacatttctgtatgcagcttcaggtaatgccgtgcggatgtgggacctgaaaagattccagtctaccggcaagctcacagggcatctgggccccgtcatgtgtcttaccgtagatcagataagctctggccaggatctcattattactggaagtaaggaccattatatcaaaatgtttgatgtgaccgagggcgctctgggcacagtgtctccaactcataatttcgagccaccccactatgatggcattgaggctctaacaattcaaggcgacaatctgttcagtgggtcacgtgataacggaataaagaagtgggacctcacccagaaagatctgctacagcaggtgcccaatgctcacaaagactgggtgtgcgccctgggtgttgtgccagaccaccccgtgctcctgtcgggttgcaggggcggtattctgaaagtttggaatatggatacttttatgccagtcggggaaatgaaaggtcacgacagtcccattaatgctatctgcgtcaattcaacccatatttttaccgcagccgatgatcggaccgtacgaatctggaaggcgcgcaacttgcaggacggacaaattagcgatacgggagacctgggagaggacatcgcctcaaattag

SEQ ID NO: 192436 - DNA, 4914 bp, Artificial Sequence
  Description of Artificial Sequence: Synthetic coding sequence
atgctgggcgcccccgacgagagcagcgtgcgggtggccgtgcggattcggccccagctggccaaagagaagattgaggggtgccatatatgtaccagcgtcactcctggagaaccccaggtattcctgggcaaggataaagctttcactttcgactatgtcttcgatatcgatagccagcaagagcagatttacatccagtgtatcgagaagctgatcgaaggatgctttgaaggctacaacgccacggttttcgcttacgggcaaacaggagccggaaagacctacaccatggggaccggctttgacgtgaatattgttgaggaggaactgggcattattagtcgggccgtgaagcatctgtttaaatcaatcgaggagaagaagcacatcgccatcaagaatggcttgcccgcgcctgatttcaaagtaaatgcccagtttcttgagctttataacgaggaggtcctggacctcttcgatacaacccgggacattgacgcaaagtctaaaaagtctaacattcgcatacacgaggattcaacagggggaatctatactgtgggggtgacaacacggactgtgaatactgagtcagagatgatgcagtgtctgaagttgggggctctatcccggacaactgcttctacacaaatgaatgttcagagctcgcgtagtcacgcaatcttcacaattcacgtgtgtcagacacgggtttgcccacaaatagacgcagacaatgccacagataacaaaatcatttcagagagcgcccagatgaacgaattcgaaacgctgacagccaaattccattttgtggacctggccggatcagagaggctcaaaaggacaggtgcgactggagagagagcgaaggaaggaattagcattaactgtggtctgctagccctcgggaatgtgatttctgctctgggggacaaatccaagcgcgctacacacgtgccttatcgagatagcaaactgacgcgactcttacaggactccctgggtggcaacagccaaactatcatgatcgcttgcgtgtctccgtctgatagagatttcatggagaccttgaacacgcttaaatatgccaaccgggctcgtaatattaagaacaaggtgatggtgaatcaggaccgcgccagccagcaaatcaacgccctgcgatccgagataacgagactccagatggaactgatggaatataaaacaggtaagaggatcatcgacgaagaaggcgtggaaagcatcaacgatatgtttcacgaaaacgcgatgctgcagacagaaaacaataatctgcgggtcaggatcaaggcaatgcaggaaaccgtggatgcacttaggtctcgtatcacacagctcgtgtcagaccaggctaatcacgtgttagcgcgcgcgggagagggtaacgaagagattagcaatatgatccactcttatatcaaggagattgaagacctaagagccaaattgctggagagcgaggcagtaaatgagaatcttagaaagaacctcacacgggccactgccagagcgccgtacttctcgggctctagtaccttctcacccaccatactctcatcggacaaggagaccatcgagatcatagatctcgccaagaaggatctcgaaaagctgaagcgcaaggagaagagaaaaaagaaaagtgtagccggtaaagaggacaacactgacactgaccaggagaaaaaagaggagaagggcgtatcagaaagggagaacaacgagctcgaggtcgaggaaagccaggaagtgtcggatcatgaggatgaagaggaagaggaggaggaagaggaggacgacatcgatggcggagaatcctcagacgaaagtgactccgaatctgatgagaaggcaaattatcaggccgaccttgctaatattacttgcgaaatagctatcaaacagaaactcattgacgaattggagaattcccagaagcgcctacagacattgaaaaaacagtacgaggaaaaacttatgatgctgcagcacaagatccgggatacacagctggagagggatcaggtattgcagaacctgggcagtgtggaaagttacagcgaagaaaaggctaaaaaggtgcgttccgaatacgagaaaaaactgcaggcgatgaataaagagctgcaacggcttcaagcagcccaaaaggaacacgcacgcctgctcaagaatcagagccagtatgaaaaacaactgaaaaaactgcagcaggacgttatggaaatgaagaagacaaaggtgaggcttatgaaacagatgaaggaggaacaggaaaaagccaggcttactgagagccgacggaaccgcgagatcgcccagcttaaaaaagaccagagaaaacgcgaccaccaattgagacttttagaggcccagaaacgcaaccaggaggttgtcctgcgaagaaaaactgaggaggtgactgcactgaggcggcaagttcggccaatgagtgataaagtcgctggtaaagtaaccaggaaattgtcctccagtgacgctccggctcaggacacaggctcttcggccgcagccgtggaaaccgatgcatcacggacaggtgctcagcagaagatgcggatacccgttgctcgggtgcaggcgctgccaacccccgccacgaacgggaaccgaaaaaaatatcagagaaaaggccttaccggaagagtcttcattagcaagacagctaggatgaaatggcagcttctggaaagaagggtaactgatatcatcatgcaaaagatgactatttccaatatggaagccgacatgaaccggctgctgaaacagcgagaggagctgacaaagcggcgcgagaaactgagtaaaagaagagaaaagatcgtgaaagaaaatggcgaaggcgataagaacgtggctaacataaacgaagagatggagtccctaacggctaacatcgactacatcaacgactccatcagcgattgccaggctaatatcatgcagatggaggaggctaaagaagaaggtgagacgcttgatgttactgcggttatcaatgcgtgtacactgactgaggcgcggtacctcttagaccatttcctctctatgggaatcaacaaagggttgcaggccgcccagaaggaagcgcagattaaggtgttggaggggcgcctcaaacaaaccgagatcactagtgcaacccagaatcagttactcttccatatgctcaaggaaaaagctgaacttaaccctgagctggacgcgcttcttggccacgcactgcaggagaatgtggaagattctaccgacgaagacgcccccttgaattcacccgggagcgaaggctccaccttgtcttctgatcttatgaaactgtgcggagaggtgaaaccgaaaaataaggctaggcgccgcacaacaacgcagatggaattgctatatgcagactcttcggagctcgcgtctgacacaagtacaggtgatgcttcccttcctggacccctgactcccgttgcagaggggcaggaaatcggcatgaacactgagacatcagggacgagtgcccgtgaaaaggaactgtcaccgccaccaggccttccctccaagatcgggtctatctcgcgccagtctagcctgtccgaaaagaaaatcccggaaccctccccagtgacccgacgcaaagcttacgagaaagctgaaaaaagtaaagctaaggagcagaagcactccgactctgggactagcgaggcttctctgtccccgccatcatccccgccttccagacctaggaacgagttgaacgtctttaacaggctcacagtatcccaggggaacacatctgttcaacaggacaaaggcattattaatcccttccccgccagtaagggcattagagcttttcccttacagtgcatccacattgctgaggggcacactaaggccgtgctgtgtgtggacagcacagacgacctgctctttacgggaagcaaggatagaacctgcaaggtgtggaacctggtaacaggccaagagataatgtccctgggaggccaccccaataatgtggtgtccgtcaagtactgtaattatacaagcctggtgtttacggtgagcacctcctacatcaaagtctgggacatccgggattctgccaaatgcatccgcacccttacatcctctggacaagtgaccttgggcgacgcctgtagcgcaagcactagccgcacggtcgccatcccgagcggcgagaatcagatcaatcagatagccctgaacccaactggcaccttcctatatgctgcaagcgggaatgctgtccgaatgtgggacctgaagcgttttcagagcaccggcaaactcaccggacacctgggacctgtcatgtgtctgacagtagatcagatctcttcaggtcaagacctcataattaccgggtccaaggatcactacattaaaatgttcgacgttaccgagggagccttaggcaccgtcagccctacccataactttgagccccctcattatgacgggattgaggccctcaccattcagggcgataatctcttcagcggtagtagggataacgggatcaaaaagtgggacctgacgcagaaagacctcctccagcaagtaccaaacgcccataaggactgggtgtgtgcattgggggtggtgccagaccatccagttttgctgtctggatgccgcggaggaattctcaaggtgtggaatatggacacttttatgcccgtaggcgagatgaaaggccatgatagtccgatcaatgcaatatgtgtcaatagtacccatattttcaccgctgctgacgacagaacagtgcggatttggaaggcacggaacctgcaggatggacaaatttccgacacgggcgatcttggtgaggatatcgccagtaactag

SEQ ID NO: 192437 - DNA, 1986 bp, Artificial Sequence
  Description of Artificial Sequence: Synthetic coding sequence
atgaaccggctgctgaagcagcgggaggagctgaccaagcggcgggaaaagctgtcaaagcgccgggaaaagattgtgaaggagaatggtgagggggacaaaaacgtggcaaatatcaacgaggaaatggaatctcttaccgccaacattgattacataaatgattctatctccgattgccaggccaacatcatgcagatggaggaagcaaaggaggagggggaaactctggacgtcaccgctgtcataaacgcctgtaccctgacagaggcccggtatctccttgatcactttctgagcatgggcattaataaaggcctccaggcagctcagaaggaggctcagatcaaggtgctcgaggggcgcctgaaacagaccgagataacttctgccacccagaaccagctgctctttcacatgttaaaggaaaaggccgaacttaatcctgagctagacgctctgcttggccacgccttgcaagagaacgtcgaagatagtacggatgaggatgctcccctgaactctcctggttccgaagggtcgaccttgagcagcgatctgatgaagctgtgtggggaggttaaaccaaagaacaaggctaggcggcgcaccactacccagatggaacttctctatgcagacagctcagaactggcgtctgacacctccacaggggacgcttctttacctggcccgcttacccccgtcgccgaagggcaagaaatcggaatgaatactgagacatccgggacctccgcaagagaaaaggagctctccccccctcccggcctgccatctaaaatcggtagtatttcacggcagagtagtttgagtgaaaagaagatccctgaaccaagccctgtgactaggcgaaaagcatatgagaaggcagaaaaaagcaaggccaaggaacaaaagcaagggatcatcaaccccttccccgcctctaaaggaatccgcgcctttccactccagtgcattcacatcgcagaaggacacaccaaggcagttttatgcgtcgacagcacagacgacctgttattcaccggatcaaaagacaggacctgtaaggtgtggaacctcgtcaccgggcaagagatcatgagtcttggcgggcatcccaacaatgttgtgagcgtgaaatactgcaattatacgtctctggtcttcacggtgtcgaccagttacatcaaggtgtgggacattcgtgatagcgccaagtgtattcgaacattgacatcttccggacaggtgaccctaggggatgcctgttcagctagcacgtctaggaccgtcgccatcccctccggtgagaaccaaatcaatcagattgctctcaatcctactggaacgttcctgtacgctgccagtggaaacgccgtgcggatgtgggatctaaagagattccagagcaccggaaagctaacaggtcatctcgggcccgtgatgtgtctcaccgtcgatcagataagctctggtcaggacctgataattaccggtagcaaggaccactatatcaaaatgttcgatgtcaccgaaggcgcactgggaactgtgtcaccaactcataacttcgagcctccccattacgatggcatcgaagcattaaccatccagggggataatctattcagtggctcacgcgacaacggcattaaaaagtgggacctgacacagaaagaccttctccagcaagtgccgaatgctcataaagattgggtgtgtgccctgggtgtggtccctgatcacccggtgttactgtcaggatgtcggggaggcatactcaaggtgtggaacatggatactttcatgccagtcggagaaatgaaaggccacgatagcccaatcaacgcaatttgcgtgaattcgacccatatctttactgccgcagatgatcggacagtgaggatctggaaagctagaaatctgcaggacgggcagatcagcgacaccggtgacttgggagaggatatcgcttctaactag

SEQ ID NO: 192438 - DNA, 4875 bp, Artificial Sequence
  Description of Artificial Sequence: Synthetic coding sequence
atggccggccagggcgactgctgcgtgaaggtggccgtgcggatccgcccccagctaagcaaagaaaagattgaaggctgtcacatttgcaccagcgtaaccccaggcgagcctcaggtccttttggggaaggataaggcctttacttacgattttgtatttgacttggatacctggcaagaacagatctatagcacatgtgtgagtaagctaatagaaggttgctttgaggggtacaacgccactgtcctcgcttacgggcagaccggcgctggtaaaacttataccatgggcacaggcttcgatatggcgacatccgaagaggaacagggcatcatccccagggccatcgcacacctcttcggaggaatcgcggagcgcaagagacgggcccaagaacaaggagttgcaggacctgaattcaaggtgtccgcacagttcttagaactgtacaatgaagaaatcttggacttatttgactcgacaagggatcccgacacacgccataggcgctccaacatcaaaattcacgaggatgccaacggtggaatttacaccacaggagtaaccagtcgcctgattcattcacaagaggagctgatccagtgtcttaagcaaggcgccctgtcccgcacgactgcgagcacccagatgaatgtgcaaagctccagaagccacgctatttttaccattcacttatgccagatgcgtatgtgtactcagcccgatctagtgaacgaggcagttacaggtctcccagatggcacaccaccgtcctcagaatacgaaactcttactgctaagtttcattttgtcgatctggcgggctcagaaagattgaagagaacaggtgctacgggggagagagctaaagagggcattagcataaattgcggcctactagccctgggaaatgttatatctgccttaggtgaccagtccaaaaaggtggtccatgttccttatagagacagtaagctgacccggttacttcaggactctctcggcggaaacagtcaaaccattatgatcgcctgcgtgagcccctctgaccgggatttcatggaaacgctgaatacactaaagtacgctaatagggcaaggaacatcaagaataaagtcgtagtgaatcaggacaaaacatctcaacagatttctgcactgcgcgccgaaattgctcgcttgcagatggaactgatggaatacaaagccgggaagagggtcatcggcgaggatggggctgaggggtactccgatctctttagagagaacgcaatgctccagaaagagaatggggccctgaggctccgcgtgaaggctatgcaggaggcaatcgacgcaattaataaccgggtgacccaactaatgtcccaggaagccaacttgctcttagccaaagcgggggacggtaacgaggcgatcggcgcgctgatccagaactacattcgcgagatcgaagaattaagaaccaaacttctcgagagtgaagccatgaacgagtcacttcggcggagcctctcaagagcttctgcaagaagcccatatagcctgggcgccagcccagccgctcctgcgtttgggggcagtccagcttcatcgatggaggacgcgagcgaggtgatccgtcgagctaaacaggacctggagcggctgaaaaagaaagaggtacggcagcgccggaaaagtcctgagaaggaggcattcaagaagagggccaaactccaacaggaaaacagtgaggagaccgatgaaaatgaagccgaagaggaggaggaagagagggacgagtcaggatgcgaagaggaagaggggagagaggatgaggacgaggattcaggcagtgaggagtcgcttgtcgactctgatagcgacccagaagagaaggaagtaaactttcaagcagacctggcagacctgacctgtgagatcgagattaaacaaaaattgatcgatgaactggagaacagccagcgcaggttgcagacacttaaacaccaatatgaggagaagcttattctattgcaaaacaagatcagagacacgcagctggaaagggatcgggtactgcaaaacctttccacaatggagtgttacacggaagagaaggctaacaaaataaaggccgactatgagaagagactgcgcgagatgaaccgcgatctgcagaaattacaagctgcccagaaggaacacgcacgcttattaaaaaatcagtccaggtacgagagagagctgaagaaacttcaggctgaagttgccgaaatgaagaaggctaaggtggccctgatgaaacaaatgagagaggagcagcagcgtcgccgtctcgtggagacaaagaggaatagagaaattgctcagctgaagaaagagcagagacgacaggagttccagatacgagcccttgaatcccaaaagagacagcaggaaatggttctgcggaggaaaacccaggaggtatcagccctacgcaggttagcgaaacccatgagcgaaagggtagctggacgagctggattgaagccaccaatgcttgattccggtgctgaagtttctgccagtaccacctcgagtgaagcagagtctggtgcccggtcagtgtctagtattgtccggcagtggaaccgcaagatcaatcatttcctgggagaccaccctgcaccaactgtgaatgggacccggccggcacggaagaaatttcagaaaaaaggggcaagccagagctttagtaaggctgctagactgaaatggcagtctctcgaaagaagaataatcgatatcgtgatgcaacgcatgaccatcgtgaatctggaggccgatatggaacgactaataaaaaaacgggaggagctttttttgctccaggaggccctgcgccgcaagagagagaggcttcaggccgagtcccccgaagaagagaaggggctgcaggaactggcagaggagattgaggttctggcagccaacatcgactatattaatgacggcattacagattgccaggccaccattgtccagctggaagagacaaaggaggagctggactccaccgatacctcggtggtcatttcatcctgctctctcgctgaggccagactgcttctggataacttcctgaaggcctccatcgataaaggacttcaggtggcgcagaaagaggctcagatcaggttacttgaggggcggctacgacagactgatatggcaggatcgagccaaaatcaccttctcttagatgcactgcgtgaaaaagcagaggcacaccccgagctgcaggctctcatctataacgtccaacaagagaatggctatgcctctactgacgaagagatctccgagtttagcgagggcagcttctcccaaagctttactatgaagggttctacgtcacacgatgatttcaaattcaaaagtgaacccaagctttctgcacagatgaaggcagtgagtgctgagtgcctgggcccccctttagacatctccaccaagaacatcacaaagtccctggcaagtttagttgagatcaaagaagacggagttgggtttagcgtgagagatccgtactaccgcgatcgggtgtctagaaccgtcagtctgccgacacgcgggtccacctttccgaggcagtctagggccacggaaacaagtcctttgacccggcgtaaaagttacgatagaggccagccaatccgaagtacggatgtgggattcactcctccatcatccccccctactagacccagaaacgaccggaacgtcttctctagactgactagcaatcagtcacagggctccgccctcgacaaaggaattatcagtccggttggcggtgctaaaggagctcgtactgcgcctttacagtgcgttagcatggctgagggacacaccaagcccatactgtgtctcgacgccaccgatgagctcttgttcaccggatctaaagaccggtcgtgcaagatgtggaatctggtgaccggacaggagatagcagccttgaagggccacccgaataatgttgtctctattaagtattgttcccactctggcctagtgttctctgtatccacctcgtacattaaggtctgggacattagagactcggcgaaatgcattaggaccctcacgtcaagcggacaagtcattagcggcgacgcttgtgccgctacaagcaccagagccatcacgagcgcccagggggagcaccagattaatcagatcgctctgagtccgtctggcactatgctgtacgcagcatcaggaaatgcggtccgcatctgggagctaagtaggttccagcccgttggcaagctcacaggacatattggacctgttatgtgcctgaccgttacacagacagcctcccagcatgatttagtggttaccgggtccaaggatcattacgtgaaaatgtttgaactgggcgagtgtgtcactgggacgatcgggccaacccacaactttgagccccctcactacgatggaatagaatgcctggctattcagggcgacatcctgttcagtggctcacgagacaacgggatcaagaaatgggatctagaccagcaggaactgattcagcaaatacccaatgcacacaaagattgggtctgcgccctggccttcatacccggcaggccaatgctgctgtctgcttgccgtgccggggtaatcaaagtatggaacgtggacaatttcactcccatcggagaaatcaaggggcacgactctcctatcaatgccatctgtactaacgcgaaacatattttcactgcatcctcagattgccgagtcaagctttggaactacgtgcctggattgaccccatgcctgcctcgtcgcgtgctggcaatcaaaggcagagccaccactctgccatag

SEQ ID NO: 192439 - DNA, 4833 bp, Artificial Sequence
  Description of Artificial Sequence: Synthetic coding sequence
atggccggccagggcgactgctgcgtgaaggtggccgtgcggatccgccctcaactgtctaaggagaagatcgaaggctgtcatatctgtaccagcgtgaccccaggcgaaccccaagtgctgctggggaaagataaggcgttcacatacgacttcgtatttgatcttgatacatggcaggagcaaatctatagcacctgtgtgagtaagctgattgaaggctgctttgagggatataacgcaaccgtgctggcctatggtcagaccggagctggaaagacttacaccatgggcacgggcttcgacatggcaacaagtgaggaggaacagggcatcattccccgtgccatcgcacacctgttcggggggattgccgagaggaaaagacgggctcaggagcagggagtcgccggccccgaattcaaagtatcagcccaatttcttgagctgtataatgaagaaattctggatctgttcgacagtacgcgtgatcccgataccagacacaggcgcagtaatatcaagattcatgaggacgcaaatggcggtatttacactacaggggtgacttcccgccttatccatagtcaggaggagctgatccagtgcctgaagcagggcgcattgagcagaaccactgcctcaacccagatgaacgtgcagagcagcaggtcacacgccatctttaccattcacttgtgccagatgagaatgtgcacacagcccgacctcgtgaacgaggccgttactggactccctgacggcactcccccatcaagcgagtacgagacccttacagcaaagtttcactttgtggatctggccgggagcgaaagactgaaacggacaggggctactggcgaaagggcaaaggagggtatatctattaattgtggtctattagcactcggcaacgttatcagtgctctgggcgaccaaagtaaaaaggtcgtgcacgtgccatatagagattccaagctcactaggctactgcaggatagtcttgggggcaattcccagacgatcatgatcgcctgcgtctctcccagcgacagggattttatggagactttgaatacacttaaatacgccaaccgggcccgcaatataaagaataaggtggtggtgaatcaggataaaaccagccagcagatctctgctctgcgcgccgagattgcgcggctgcagatggagctcatggaatacaaggccggaaagcgggtgatcggagaggacggcgcggaaggttacagcgacctgttcagggagaacgccatgctccagaaagagaacggcgctttacgactcagggtcaaagccatgcaggaggcaattgatgccatcaacaaccgtgtgacacagcttatgtcacaagaggccaatctcctgctggccaaggccggcgacggaaatgaggcgatcggggctctgatccagaactatatcagagagattgaggagctcaggaccaaactgctcgaatccgaagctatgaatgaatccttaaggcggtcattgtctcgagcaagtgcacgctctccctattctctcggcgcctccccagccgccccggcctttggcgggtcacccgcgtcctcgatggaagacgcatcagaggtcattaggcgagctaaacaggacctggaacgcctgaagaagaaagaggtgaggcagagaaggaagagcccagagaaagaggcttttaaaaagcgagccaagctgcagcaggagaacagcgaggagaccgacgaaaacgaagctgaagaagaagaggaggaaagagacgagagcggctgcgaagaggaagaagggcgtgaggatgaggatgaagattccggcagcgaggaaagtttggtggacagcgatagcgatcccgaagaaaaggaagtgaattttcaggctgacctggccgacctcacctgtgagatcgagatcaaacagaagctgatagatgaactggaaaattcacagcgcaggttacagaccttgaagcaccagtacgaagaaaagctgatccttctgcagaacaaaatacgcgacacgcagctggagcgcgaccgcgttctgcagaatctgagcacaatggagtgctacactgaggagaaggcaaataagattaaagcagattacgaaaaaagactgcgggaaatgaaccgagaccttcagaagttacaagctgcgcaaaaggagcatgcgcggctgctcaaaaatcagagcagatatgaaagagagctaaagaaacttcaggccgaggtggctgaaatgaagaaggcaaaggtggcactgatgaaacagatgcgagaagaacaacagcgtcggcggctcgtggagaccaaaaggaatcgcgagatagctcagcttaaaaaagaacagcgtaggcaggaattccagatccgggccctggagagccagaagcgacagcaggaaatggtcttacggagaaaaacccaggaggtttccgctctgcgtaggctggccaaaccaatgtccgaaagggtggcggggagggctgggctcaaaccaccaatgctcgattccggcgccgaggtgtcagcttcaacgacttcttctgaggccgaaagcggggctcggtctgtgtccagcattgtgcgccagtggaatagaaagataaatcacttcttgggagatcaccctgcccctacggtgaatgggactcggcctgcccgcaaaaaatttcagaagaaaggcgcctcccagtcgttctcaaaggcggcccgcttaaaatggcaatccctggaacggcgtattatcgacatcgtcatgcaacggatgactattgtgaatctggaggctgatatggaacgtcttattaagaagagagaggagcttttcctcctacaggaagccctgcggcgtaagcgggagagactgcaggcagagagcccagaggaggaaaaaggactccaagaactggccgaggagatagaagtgcttgcagcaaatattgattacatcaacgatggaatcaccgactgtcaggccacaattgtgcagttggaagaaacgaaggaggaactggatagtaccgacacctccgttgtgattagcagctgctccttagccgaggcgagattgttgctagacaacttcttgaaggcttccatcgataagggcttgcaggtggcccagaaggaagcccaaatcaggttactggaaggccgactgaggcagacggacatggctggtagctctcagaaccacttgctgcttgatgcccttcgggaaaaagcagaggcccaccccgaactacaggctctaatttacaacgtacagcaagagaacgggtacgccagcaccgatgaagagattagcgagtttagtgaagggtctttctcacaatctttcacaatgaagggctccacctctcacgatgattttaaatttaagagtgagcccaaacttagcgctcagatgaaagctgttagcgccgagtgtctagggcctcctttagacatttctacaaaaaatattactaagtcccttgcgtcactcgtggagattaaggaggatggagtcggcttcagtgtccgagatccgtactatagggacagagtgtccagaaccgtgtcccttccgacacggggatccacgttcccacggcaatcaagggctaccgaaacatccccccttacccgcaggaagagctatgaccgcggtcagccaatccgctctactgacgtaggtttcaccccgccaagttcaccgcccacgcgccctagaaacgatcgaaatgtcttctcccgattaacaagcaaccagagtcagggctcagctctggacaagggaataatcagccccgtcggtggggctaaaggcgcccggaccgcccctttgcagtgcgtaagcatggcagagggtcacacaaagccaattctttgcctggatgctacagatgagctgctgttcactgggtccaaggatcgctcctgcaagatgtggaatctggtgaccggccaagaaatcgcagctctgaagggacatcctaacaatgtggtgtccatcaagtattgcagccactcaggtttggtattcagcgtgagcacatcttacattaaagtttgggacattcgcgatagcgctaagtgcatccgtactttaacatcatccggacaggtgatcagcggcgatgcatgtgcagccactagcacacgagccatcacaagtgctcaaggggagcatcagataaatcaaatcgccctttctcccagcggtacgatgctgtatgccgcatctggcaatgctgtgcgtatttgggagctgtccaggtttcaacccgttggcaaactcacaggacatatcggtccagtgatgtgcctgaccgtgacacagaccgcatcacaacatgacctcgtggtgaccggatcaaaagaccattatgttaaaatgtttgagctcggagaatgcgtcacaggcacaataggccccacacacaatttcgagcccccgcactacgatggcatcgaatgcctggctatccagggcgacatattattctcaggaagcagagacaatgggatcaaaaaatgggatctcgaccagcaagagttgatacagcagatccctaatgctcataaggattgggtgtgcgctctggccttcatcccaggccgacccatgctccttagtgcatgccgagctggcgtgatcaaggtgtggaacgttgacaactttactcccatcggcgagatcaagggccatgatagccctatcaacgccatctgtaccaacgcaaaacatatctttaccgcctctagcgatctgacagttaaattttggtccgttcggaggcttccacactctggcccgccatag

SEQ ID NO: 192440 - DNA, 4914 bp, Artificial Sequence
  Description of Artificial Sequence: Synthetic coding sequence
atggccggccagggcgactgctgcgtgaaggtggccgtgcggatcaggccccagcttagcaaagaaaagatagagggatgtcatatctgtacaagcgtcactcctggggaaccacaggtacttctgggaaaagataaagcctttacatacgacttcgtttttgatctggacacgtggcaagaacagatctactctacctgtgtgtccaagctcattgaagggtgcttcgaggggtataacgcaactgtcctcgcttacggacagacgggtgccggcaaaacatacactatgggtaccggcttcgacatggccacaagcgaagaggaacagggtattatcccccgcgccatcgctcatctcttcggcggcatcgctgagcgtaaaagaagggcgcaggaacagggggtggccggcccagagttcaaagtgagtgcacagttccttgagctctacaatgaggaaattctagacctgtttgatagcacacgcgacccagacacacgacaccggcggagcaatattaagatccatgaagacgccaacggagggatatatacaacaggagtgacaagtagactgatccacagccaggaagagttgatccagtgtttgaagcagggggctctgtcacggacaaccgccagtacacagatgaacgtgcaatcctcaagatctcacgcaatcttcaccattcatctgtgtcagatgcggatgtgcacgcagccggatctagtcaacgaagcggtgactggcctgcccgatggaactcccccaagcagtgagtatgaaaccctgaccgcaaaatttcactttgtagaccttgcaggctctgagcgactgaaaaggacgggtgcaactggcgagcgagccaaagaggggattagcattaattgtggcctgcttgcattgggaaacgtgatctccgccctgggggaccagagtaagaaggtagtgcacgttccctatagagattcaaaactgaccaggctactacaagacagcctgggcggtaattcccagaccatcatgatagcttgcgtgagcccctcagaccgagatttcatggagaccctcaatactctaaagtacgctaatcgggctaggaatataaagaataaggtagttgtgaatcaggacaagacgtcccagcagatcagcgctctgcgggccgaaatagcccgtcttcagatggagctgatggagtataaggccggcaaacgggtcattggggaagacggtgccgaaggctatagtgacctgttccgggaaaatgcaatgctccagaaggaaaatggcgccctgcggctgagggtcaaagccatgcaggaagccattgatgctatcaataaccgagtaacccagctaatgagccaagaggctaacctgcttttggccaaagccggtgacggaaatgaggcaatcggggcattgatccagaattatatacgcgagattgaggagctgaggaccaaattgctcgaatccgaagccatgaatgagtctctccggaggtctctgtcccgcgcttctgctagaagtccctatagtcttggggcaagcccggcagctccggcctttggagggagcccggcttcttcaatggaagatgcatccgaagtaataaggcgcgccaagcaggatctggaacgtctgaaaaagaaggaagtcaggcagagaaggaaaagtccagagaaggaagcctttaaaaaacgtgctaagctgcagcaggagaactcagaggagacagacgaaaacgaagctgaggaggaggaggaggaaagagacgaatcgggctgtgaggaagaggagggacgggaggatgaagacgaggactccggttcagaagagagtttggtggactctgactccgaccccgaggagaaggaagtgaatttccaggcagatcttgcagacctgacctgtgagatcgagatcaaacagaaactgatcgacgaattagaaaactcccagaggagactgcagacccttaagcatcagtacgaggaaaaattaatcctcctccagaataaaatcagagatacccaactcgagcgcgatcgggtgctgcagaatctcagtacgatggaatgttatacggaggaaaaggctaacaaaatcaaagctgactatgagaaacggctgcgggagatgaaccgcgatcttcagaaattacaagcagctcagaaggagcacgcgcgcttgctaaagaatcagtctagatacgaacgggagctcaagaagctgcaggcggaagtggcagaaatgaaaaaagcgaaggtcgccctgatgaaacagatgcgagaggagcagcagcgcagacgattagtggaaactaagaggaatagagagatcgcccaacttaaaaaagagcaacgcagacaggaatttcaaataagagccctcgaatcccagaaacggcagcaagagatggttctccgccgtaaaacacaggaagttagcgcacttcggcgactggctaagcccatgtccgagagggtggctggcagagcagggctgaagccccccatgctcgactccggggccgaagtgagtgccagtacaacctccagtgaagctgagagcggggctcggagcgtgagcagcatcgtccggcagtggaaccggaaaatcaaccattttcttggagaccatcctgccccaactgtgaacggcactagacccgctaggaaaaagttccagaagaagggcgccagtcaaagtttctctaaagctgcacggctgaagtggcagtccctggaaagaagaatcatagacattgtgatgcagaggatgaccatagtgaatctggaggccgacatggaaaggctgatcaagaagcgggaagagctttttctgctccaggaagccttgcgcaggaaaagggagcgccttcaagctgagtccccagaggaggaaaaaggactccaggagctggcagaggagatcgaagtgctggccgcgaatatcgattacatcaatgacgggatcaccgactgccaagccacaatcgtgcaactcgaagagacaaaggaggagttggattccaccgatacttctgtggtcatcagttcttgttcactggcagaagctcgcttgctcttagacaattttctcaaggctagcattgataagggactgcaggttgctcagaaggaagctcagatccgattattggagggccgactgagacaaacagatatggctgggagcagccagaaccatctgctgctcgacgctctgcgggagaaggccgaggcgcaccccgagctgcaggctctcatatataatgtccagcaggagaacggctatgcgtctacagatgaggagatatcagagtttagcgaaggcagcttcagtcaatcttttacaatgaagggtagtacttcccatgatgatttcaaattcaaatcagaaccaaaactatcagctcaaatgaaggcagtttctgctgagtgtctcggcccgcctctcgacatctctacgaagaacataacaaaatcgttggccagccttgttgagattaaagaggacggagtgggattttccgtgcgcgatccttactatcgagaccgcgttagccgtactgtgagccttcctacacgcggcagcacattccccagacagtcccgggctaccgaaactagccccctcaccaggcgcaagtcctatgacaggggacagcccattagaagtactgacgttggatttactcccccatcctctcctcccaccaggcctaggaacgacaggaatgtattttcacggctgactagcaaccagtctcagggtagcgcactcgacaagtcagacgattctgactcaagcctgtctgaggtactgcgtggcattatatcacctgtgggaggtgctaaaggagcccgcacagctcccctgcagtgtgtttccatggctgagggtcataccaagccaatactgtgcctggacgccaccgatgagctcctgttcacagggagcaaagaccgtagctgtaaaatgtggaatctagtgaccggtcaggaaatcgccgctctcaagggccacccaaacaatgtggtctccatcaaatactgtagccatagtggcctggttttctcagtctctacctcctacataaaggtttgggacattcgggattcagcaaaatgtatcagaacactgacctcatcagggcaagtcatcagcggagacgcctgcgccgctacatcaacacgggcgattacctcagcccagggagagcaccaaatcaaccagattgcactgtcaccttccggaaccatgctctatgccgcttctggaaatgctgtgagaatctgggaactgtcgagatttcagcccgtgggaaagctgacaggtcacatcgggcctgtgatgtgtttaaccgtcactcagaccgcctcccaacacgatctcgtcgtaactggttccaaggaccactacgtgaagatgtttgagctcggcgaatgcgtgactgggaccattggaccaacccacaattttgaacctccacactacgacggcatcgaatgtctggcaatccagggtgatattttattttctgggagcagagataacggcatcaagaaatgggacctcgaccagcaggagctgatacagcagattcccaatgcacataaagattgggtctgtgcccttgcttttattccaggccggcctatgcttctatctgcttgtagagccggtgtcattaaggtgtggaacgttgacaacttcacccccatcggtgaaattaagggacatgactctcccattaacgccatttgcacaaacgccaaacatattttcactgcaagctcggattgtagagtgaagctgtggaattatgtgccgggactaacaccctgtttgccccggagagtactggccatcaaaggtcgggccactaccctgccgtag

SEQ ID NO: 192441 - DNA, 4872 bp, Artificial Sequence
  Description of Artificial Sequence: Synthetic coding sequence
atggccggccagggcgactgctgcgtgaaggtggccgtgcggatccgcccccaactcagtaaagagaaaattgagggctgccacatttgtacatccgtgactccaggggagccacaggtgctacttggtaaggacaaagcatttacttatgatttcgtgtttgatctggacacttggcaggagcagatctattctacttgcgtgagtaagcttatagagggatgctttgagggctacaatgcgaccgtgctggcatatggccagaccggggcaggtaagacctacacgatgggcacaggattcgatatggccactagcgaggaagagcaagggatcattccaagagcaatagctcatctgttcggaggcatcgccgaaagaaaacggagagctcaggaacaaggcgtcgccgggcctgagtttaaggtctctgcccaatttttagaactgtataatgaggagatcctggatcttttcgacagcacccgggaccccgatactcgccatcgccgatcaaacatcaaaatacacgaggatgccaacggaggcatttatacaactggcgtgacctcacggcttatccactcccaggaggaactgattcagtgcctaaagcagggggccctgagccgtacaacggcatccacacaaatgaacgtgcagtcctcgcgaagtcatgccatctttacgatacatctttgtcagatgagaatgtgcacacagccagaccttgtgaatgaagcggtgacaggcctgccagacggcacaccgcctagctctgaatatgaaacacttactgccaaattccactttgttgacctggccggctctgagcggctaaagagaaccggggcgactggagagcgggctaaggagggaatttccatcaactgcggcttgttggcgttgggcaacgtcatcagtgccctgggtgaccagagtaagaaggtcgtgcatgtcccatatagagattccaagctgacacgtttgcttcaggacagcttaggaggcaatagccagactattatgattgcttgtgtttcaccctccgaccgtgacttcatggaaactcttaatactctgaaatatgcaaacagagcgcgcaatatcaaaaacaaggttgtggtcaatcaggataaaacctctcagcaaatatctgctctgcgtgctgagattgctagattgcagatggaactcatggagtataaggcaggtaaacgggtgatcggcgaggatggcgccgaaggctacagtgacttgtttagagaaaacgccatgttacagaaggagaacggggccctcagattacgggttaaagctatgcaagaagctatcgatgctatcaacaatcgggtcacacagctgatgtctcaggaggctaacctgctcctggctaaggctggggatggcaacgaggccatcggggctctcattcagaactatattagggaaatcgaggaattgcgaacaaagctcctggaaagcgaagctatgaatgagagcctacgcagaagcctgtcccgcgcaagtgcgaggtcaccttacagcttgggtgcatctcctgcagctcctgctttcggtggctcaccggctagtagtatggaagatgcatccgaggtgatccggagagcaaaacaagacctagaaagactcaagaaaaaagaagttagacagcggagaaaaagtcctgaaaaagaagcgtttaagaaaagggccaagttgcagcaggagaactcagaggagacggatgaaaatgaggctgaagaagaggaagaggaacgggacgagagcggttgcgaggaagaggaaggccgagaggatgaagatgaggatagtggcagcgaagaaagtctggtggatagtgactcggatcctgaagaaaaggaagtaaatttccaggcagacttggctgacctcacttgtgagattgagatcaaacagaagttgatcgatgagctggaaaactcccagcgccgcctgcagaccctcaagcatcagtatgaggaaaaactcatattactccaaaataaaattagggatactcaacttgaacgagatagagttcttcaaaacttatcaacaatggagtgctatactgaggaaaaggcaaacaagataaaagccgattacgaaaagcgactgcgagagatgaatagagacctccagaagctgcaggcagcccagaaagagcatgcacggctgctgaagaatcagtcccgttatgagagagagctgaagaaactgcaagctgaggtcgccgagatgaagaaagcaaaggtagcgctcatgaaacaaatgagggaggagcagcagcgacgacggctggtggagacaaagcgtaacagagaaatcgcccaactgaagaaggagcagcgccgacaggaattccaaatccgggctctggaatctcagaagcgtcaacaggagatggtgctacgccggaagacccaggaagtttctgccctgcgccgattggctaagccaatgagcgaacgggtagctggtagggcagggttgaagccaccgatgttagactctggtgctgaggtctccgcctccaccacctcatctgaagctgagagcggcgctcggtctgtcagctctatcgtgagacagtggaaccggaaaatcaatcactttttgggggaccaccccgcgccgaccgtgaatggcaccaggcctgcgcggaagaaattccagaaaaagggtgcttcacagtccttcagcaaagcagcacgactaaagtggcagtctttagagcgcaggattattgatattgtaatgcaaaggatgactattgttaacttggaggcagacatggaacgactcattaagaaacgcgaggagctgttcctactgcaggaggccctgcgcagaaagagagagcgcctccaggccgagagccccgaagaggaaaaaggcctacaggagctggccgaggagatagaagtcctcgctgctaatatcgactacatcaacgatggaatcacagattgccaggcaacaatcgtgcagctcgaggaaaccaaagaggaacttgattccacagacacaagcgtggttatttcatcgtgcagtctggccgaagcccgccttctcctcgacaacttcctcaaagccagcatcgacaaagggctgcaagtggcccagaaggaggcccagatccgcctcctagagggccgcctgcgccagacggatatggccggaagttcccagaaccatctactcctagatgcactcagagagaaggctgaggcacacccagaactgcaggcgcttatctacaacgttcagcaagagaatggatacgcctcaaccgacgaggagatttctgaattttccgaaggttcgttttcccagtccttcactatgaaagggtctacttcacatgatgactttaaattcaaaagcgagccaaaactctcagcccagatgaaagccgtttccgcggagtgtttaggcccacctctggatatctctacgaagaatatcactaagagcctcgctagtctggttgagatcaaagaagatggagtggggtttagtgtgagggatccttactacagggatagggtctctcggactgtgagtctaccaacccgaggaagcacattccctcgtcagtctagggctacggagacgtccccactcacccgacggaagtcttacgatcgtggtcagccaatcaggagcaccgacgtggggtttactccaccctcatccccccccacacggcctagaaacgatcgaaatgtctttagccggctgacatccaaccagagtcaaggctcagcgctagacaaaagcgacgattctgacagttcattgtcagaggtgctccggggtattatcagccccgtggggggcgccaagggggctcgcacagcgcccttgcagtgcgtgagcatggcggaagggcatacgaagccgattctatgcctagacgccaccgatgaacttctgttcacaggctcaaaggaccgcagctgtaagatgtggaatttggtgactgggcaggaaattgctgccctcaaggggcatcctaacaatgtggtcagcattaaatattgttcccacagtggacttgtgttcagtgtaagtacaagctacataaaggtgtgggacattcgggactccgcaaaatgtataaggacactgacttcatccggacaagtaatctccggcgatgcctgcgcggctaccagcacgcgggctatcacctctgcgcagggcgaacaccaaataaatcaaatcgccttgagccccagcggaaccatgttatacgccgccagcggtaatgccgtgagaatctgggagctctcaagatttcagcctgtcggcaagcttactggccatatagggcccgtcatgtgtctgactgtaacacagactgcttctcagcatgacctggtcgtgaccggtagcaaggaccactatgtgaagatgtttgaactaggggagtgcgtgacaggcacaattggtccaacccacaacttcgagcctccacactacgatgggatcgagtgtcttgctatccagggcgacatcttattcagtggcagcagggacaacggaattaaaaagtgggatctggaccagcaggaactgatccagcagatcccgaatgcacataaagattgggtgtgtgcgctggcctttattccagggaggcctatgttgcttagcgcttgtagagccggtgtcatcaaggtctggaacgttgataacttcacaccgatcggagagataaaggggcatgattctccaatcaatgcaatctgcactaacgccaagcatatcttcactgctagctcagatcttactgtgaaattctggtcagttcggaggctgccccacagtggcccgccctag

SEQ ID NO: 192442 - DNA, 5007 bp, Artificial Sequence
  Description of Artificial Sequence: Synthetic coding sequence
atggccggccagggcgactgctgcgtgaaggtggccgtgcggatcagaccacagctcagcaaagagaaaatcgaggggtgccatatatgtaccagcgtaacccctggggagcctcaagtactacttggtaaagataaagccttcacgtatgattttgtgtttgatctcgatacatggcaggaacaaatttattctacatgcgtctcaaagctgatcgaagggtgctttgaagggtataacgcgactgtattagcctacggccagacgggagctggtaaaacgtacacgatgggcacaggcttcgatatggctacctcagaggaagagcaaggcatcattccacgcgccatcgcacacttattcggggggatcgccgagcggaagaggagagcacaggaacagggcgtggctggccccgaatttaaagtgagcgcccaattcctcgaactgtacaatgaggaaatcctcgacctgttcgatagcacaagggacccagatacacgacatagaaggtctaacatcaagatccacgaagacgccaacggtggcatctataccactggtgtcactagccgactgatccacagccaggaggaactgatacagtgtctaaaacagggagccctcagtagaaccaccgcttcgacacagatgaacgttcagtccagccgctcacacgccatttttacgatacacctgtgccagatgcggatgtgtacccaacccgacctcgtgaacgaagccgtgaccgggctaccagatggtacaccaccttctagtgagtacgaaacactcactgctaagtttcacttcgttgatctggcgggcagtgagcgcctgaaacgcacaggagctaccggtgaacgggccaaagaaggaataagcatcaattgtggtcttctagccctagggaacgtgatttccgcgctgggggatcagagcaagaaggtagtgcatgtaccttatagagactcaaaactcaccaggctcctgcaggactcacttggcggcaactcacagacaatcatgatcgcttgcgtctccccatctgatcgcgatttcatggaaaccctgaacaccttgaaatatgctaacagagccagaaacataaaaaacaaggtcgtggtgaatcaagataagactagtcagcagatcagcgccctgcgggccgagatcgcacgcctgcagatggagttaatggagtataaagccggaaaaagggtcattggggaggatggagcggaaggctactcagacttgttccgggaaaacgcgatgctccaaaaggaaaacggggctctgcgcctgagagtcaaagcaatgcaggaggctattgacgccataaacaatagagtcactcagctgatgagccaagaagccaacctgttattggcaaaggccggagatggcaatgaggcaatcggggcccttatccagaactacatcagggagatcgaagaactgaggacaaagcttcttgaaagtgaggccatgaacgaatctcttcggagatctctgtcccgtgccagcgctaggtccccatacagcctgggcgcctcacctgcagccccggccttcggggggtccccagccagttcaatggaagatgcgagtgaggtgatcagacgggccaagcaggacctggagagactgaagaagaaggaggtgcggcaaaggaggaagtcgcctgagaaggaggcttttaagaagagagcaaagctacagcaggagaatagtgaggaaactgacgagaacgaagccgaggaggaggaggaagaacgcgatgagtccggatgcgaggaggaggaagggcgggaagacgaggacgaagactcaggctcagaagaatcactggttgactcggactccgatccagaggagaaggaagtgaacttccaggctgatctggcagacctgacttgcgaaattgaaattaagcagaagctgattgatgagctagaaaactcgcaaagacggttacagacccttaagcaccagtacgaagagaaactgatactcctgcagaataagatcagagacacccagctggaacgcgaccgagtactacagaatttgtcaacaatggagtgctatacagaggagaaagccaataaaatcaaggctgactatgagaaaagactgcgagaaatgaatagagacctgcagaagctgcaggcggcacagaaggagcacgcccgactcttaaagaatcagtccaggtatgagcgagaactaaaaaagctgcaggctgaagttgccgagatgaagaaagccaaagtagcccttatgaagcagatgcgggaggaacagcaacgcaggaggcttgtggaaactaaaagaaatagagagatcgcccagttgaagaaggagcagagaaggcaagaatttcagatcagagctctggagtctcagaaaaggcagcaggagatggtccttcgacgaaagacacaggaagtatccgctctgcgtcgactggcaaaacctatgagtgagagagttgctggtagggccggactgaagcctcccatgctcgactctggtgctgaagtgagtgcatctacaacctcatctgaggcggaaagcggagcccgctctgtgtcatcaatagtgagacaatggaaccgtaaaattaatcactttttgggcgatcaccccgcaccgactgttaacggcacacggccagcccggaaaaagttccaaaagaagggggcatcccaaagtttcagtaaagccgctcgactcaaatggcagtccctcgagaggcgcattattgacattgtaatgcagaggatgactatcgttaacctggaggctgacatggagcggctgatcaagaagcgggaggagttgtttttgctgcaggaggccctgaggcgcaaaagggaacgtcttcaggcagagtcccctgaggaggaaaaaggcctgcaggaactggcagaagagatagaggtccttgctgccaacattgactatatcaatgacgggatcacagactgtcaggcaaccatcgttcaacttgaagagaccaaagaagaattggactctacagacaccagcgtcgtgatctcatcctgttcactggcagaggccagattgctgcttgacaattttttgaaggccagcatagataaaggcctgcaggtggcacagaaagaagctcagattagactcctagaaggaagactccggcagaccgatatggccggatcttcacagaatcacctgctcctcgatgccctcagggagaaagctgaggctcatccagagctccaggcccttatctacaatgtgcaacaggagaatggctatgcctctactgatgaggagattagtgagttcagcgaggggagcttttcccagtcgttcaccatgaaaggtagtacaagtcatgacgactttaagtttaaaagcgagcctaaactgtctgcgcagatgaaagcagtgtcagccgagtgcttggggcctccactggatatatccactaaaaacatcaccaagagtctggcgagtctcgtcgaaattaaagaagatggggtaggattctcagtgcgcgatccttactaccgggaccgggtttcacgcacagtctccttgccgacaaggggtagcacattcccccgccagtctagagcaacagaaacaagcccactgactcgacgtaaaagttacgacaggggccagcccatcaggagtaccgatgtgggctttacaccccctagtagtcccccaactagacccaggaatgaccggaatgtcttcagtaggctcacatccaaccagtcccagggcagtgcgcttgataagagcgatgacagtgactcctcactcagcgaggtcctgcggggaatcatttcgcctgttggtggggccaagggagcaaggactgctccactgcagtgcgtaagcatggcagagggacatactaaaccaatcttatgtctggacgcaacagatgagctcctatttaccgggagcaaggaccggtcgtgtaagatgtggaatctggtgaccggacaagagattgctgcactgaaggggcatcccaacaacgtagtttctatcaaatattgctctcattcagggctggtcttctccgtttcgactagctatattaaggtctgggatatccgcgattctgctaagtgcattcgaacccttacatccagcgggcaggtgatatccggtgacgcctgcgccgcaaccagtacacgggccataacatcggctcagggcgagcatcaaattaatcaaatcgccctcagccctagcgggactatgctctacgccgcctccggcaacgctgtccgaatctgggaactgtctaggttccagcctgtcggtaaacttactgggcacatcggaccagtgatgtgcctgactgtaacccagacggcatcacagcacgatctggtcgtaacagggtcgaaggatcactacgtcaaaatgttcgagctcggcgaatgtgtgactggaactattggcccgacccacaacttcgagccccctcactatgacggaatcgagtgcctggccattcagggagatatcctatttagcggctccagagacaacggtatcaagaaatgggatctggatcagcaggagcttatacagcagatcccaaacgcgcacaaggactgggtctgcgccctcgccttcatccctggtaggcctatgctgctgagtgcgtgtagggctggggttataaaagtgtggaacgtggataatttcacaccaatcggagagatcaagggccatgactcgccaatcaacgccatatgtaccaacgcaaaacatatcttcactgcctcgtcagactgtcgggtgaagctgtggaattacgtgcccggcctcaccccatgtctgccacgccgagtcttagctatcaagggccgggcaacaacttgccccgacccaccacaactgtctctaagcccgctctcttttttccctagtttcctgttcccgctctttccccactttgatctttcttgcttcctgacatag

SEQ ID NO: 192443 - DNA, 1998 bp, Artificial Sequence
  Description of Artificial Sequence: Synthetic coding sequence
atggccgccggcggcagcacccagcagcggcggcgggagatggccgcagcaagtgcggctgccatctccggcgctgggcggtgccgtctatcgaaaataggagccacccggcgccccccgccagctagagtccgggtagccgttaggcttcggcctttcgtggacggtactgcaggggcaagcgaccccccctgcgtccgcggaatggatagctgttctttagagatcgcaaactggcgcaaccaccaggagacactgaaataccagttcgacgctttttacggcgaaagatccacacagcaggatatttatgcagggtcggttcagccaatcctccggcacctgttggagggtcagaacgcctcggttctggcctacggaccaactggcgctggtaagacgcatacaatgctcggctcccccgagcagcctggagtcattccccgcgccctcatggacctcctccagctgacacgggaagagggcgccgagggacgaccctgggctctttcagtgacaatgagttacttggagatttaccaggagaaagtattggacttgctggatccggcatcaggtgatctcgtcatcagagaggattgtagggggaacatcctgattcccggactgtcccaaaagccaatatcatcctttgcagactttgagaggcactttttgccagctagccgcaatcgcaccgttggagccactcggctaaatcagcggtccagtcgcagccatgcagtcttgctcgtgaaagtggaccagcgcgagcgactcgcaccattccggcagagagagggcaagctatacctcatcgacctggcagggagtgaagacaaccgcagaaccggcaataaagggctgcggcttaaagagtccggtgccattaataccagcctgttcgtgctgggcaaagtggtggatgcgcttaatcaaggactgcctagagtaccataccgggacagtaaactgactagactgctccaggattcactgggcggttccgcccactctatcctaatcgcaaacatcgctcctgaacgaaggttttatctggataccgtgtcagcgttgaattttgcggctagatcgaaagaggtgattaatcggcccttcactaatgaatccctccaaccgcacgccctggggcccgttaagctcagtcagaaggaactgctggggcctcccgaggcgaaaagggccaggggaccggaagaagaggaaattggatccccagaaccgatggctgccccagcttcggcatcccagaagctctcgcccctccaaaagttgagctcaatggacccagccatgttggagcgattgctatccctagatcggctgttggctagtcagggctcccagggggcccctctgctgtctaccccaaagagagaaagaatggttctgatgaagaccgtggaggagaaagacctcgaaattgagagactcaagacaaaacagaaagaactggaagccaagatgcttgcccaaaaagcggaagaaaaagagaaccattgtcccacgatgctgaggcctctgagccataggacggttacaggcgccaagcctcttaagaaggccgtagttatgccacttcagctgattcaggaacaggccgcttctcctaatgccgagatccacattctgaaaaataaaggccgtaagcgcaaattggagtccttggacgcgctggagcctgaggaaaaagctgaagactgctgggagttgcagatttcaccggaattactagctcatggccggcagaaaatccttgacctgcttaacgaaggcagcgccagggacctccggtcactacagcgcatcgggcccaagaaggcccagctgatagtcggatggagggaattacacggtcccttcagccaagtagaggatttggagagggttgagggtataactggaaagcagatggaaagctttctgaaggccaacattttgggcctagctgccggacagaggtgcggcgccagttag

SEQ ID NO: 192444 - DNA, 219 bp, Artificial Sequence
  Description of Artificial Sequence: Synthetic coding sequence
atgctggcccagaaggccgaggagaaggagaaccactgccccaccatgctccgacctctctctcatagaacagtcactggagccaaacctcttaaaaaagcagtggtcatgcccctgcagctgatacaagagcaagccgcatctccaaacgcagaaatccatatcttgaagaataagggacgaaaaaggaaaggggccaacatcactaccggttattag

SEQ ID NO: 192445 - DNA, 1794 bp, Artificial Sequence
  Description of Artificial Sequence: Synthetic coding sequence
atggacagctgcagcctggagatcgccaactggcggaaccaccaggagacacttaagtatcagttcgacgccttttacggcgagagatccacccaacaggacatttatgccggatcagttcagcccattctccgccatcttcttgaaggccaaaacgcgtcggtgctggcttatggaccaactggcgccgggaaaacacacacaatgctggggagccctgagcagcccggggtgatccctagggcactcatggacctgctccaactgactagggaagagggcgctgaaggaagaccatgggcccttagtgtaaccatgtcatacctggagatctatcaggagaaggttctggacctgttggaccccgcttctggagacctggtgatcagggaagactgtcgtggcaatatcctgattccgggcttatcacaaaagccaataagttcatttgcagactttgagcggcatttcttaccggcatctcgtaataggaccgtgggcgctacacgcctgaatcaaaggagctcacggagtcacgcggttctcctggtaaaagtcgaccagagggagcgactcgctccttttcgacagcgggaaggaaaattgtacctcatagatctagccggctctgaagataatcgcagaaccggcaataagggactcaggctgaaagaatccggcgcgattaacacgtccctctttgtgcttgggaaggtggtagacgctcttaaccaaggactgcctagagttccctacagggactccaaactgacaaggctgttacaggattccttaggggggagtgcacactccatcctgattgccaacattgctccggagcggaggttctacctggataccgtcagcgcgctaaattttgccgcccgctctaaagaagttatcaatcgccctttcaccaacgaatccctgcaaccccacgccctagggcccgtgaagctgtctcagaaggagttgttaggtcctcccgaggcaaagagggcccgcggacctgaagaggaggagatcggctcgcccgaaccaatggccgcacctgcaagtgccagtcagaagcttagtcccctgcaaaaacttagctctatggaccccgccatgctggagcggctgctttcgctcgatagactgctcgcctcccaaggtagccagggagcaccactcctgtcaactcccaaaagagaacgtatggtcctgatgaagaccgtcgaggagaaggatctagaaatcgagcggctgaaaaccaagcaaaaagagcttgaggctaaaatgctcgcccagaaggccgaagaaaaagagaatcattgccctaccatgctgagacccctgagtcaccgcacagttaccggggccaagcccctcaaaaaagctgtagtcatgcccctgcagctgattcaggaacaggccgcaagcccaaacgctgaaattcacatattgaagaacaaggggcggaaaaggaagctggaaagtctggatgcgctggaacctgaggaaaaggcagaagactgctgggagctgcaaattagccccgagctcctcgcccacgggcgccagaaaatccttgacttactgaacgaaggtagtgctcgggatctgagaagtctccagcggattgggccaaaaaaagctcagctcattgttggatggagggagcttcacggtccattttcccaagtcgaggacctcgaacgggtggaaggtataacaggaaaacagatggagagctttcttaaagctaatatactcggtcttgccgccggccaacgctgtggtgcttcctag

SEQ ID NO: 192446 - DNA, 1794 bp, Artificial Sequence
  Description of Artificial Sequence: Synthetic coding sequence
atggacagctgcagcctggagatcgccaactggcggaaccaccaggagaccctcaagtaccagtttgacgccttttacggagaacgttccacccaacaagacatttatgcaggctctgtacaacccatactacgtcatttactggagggccagaatgccagtgtattggcttacggcccaacaggagccgggaagacccatacaatgctagggtcacctgagcagcccggggtgatccctcgcgcccttatggatctccttcaactcacccgcgaggaaggagccgaggggcggccatgggcactatccgtcactatgtcatatctcgagatctatcaggaaaaggtactagacctgctggaccccgcctccggggatctggtgattcgcgaggattgtcggggcaacatcttgattcccggtctctctcagaaacccatcagcagcttcgcggactttgagcgccattttctcccggcatctagaaataggactgttggagcaacccgtctgaaccaaagatcgtccaggtcacatgccgttttactcgtgaaagttgatcagagggagcggctggcccctttcagacaaagggagggcaaattgtatctgatcgacctggcaggctccgaggacaaccgccggaccggcaacaaagggcttagactgaaggagagtggagctataaatacgagcctgttcgtacttggcaaagttgttgacgccctcaaccagggactgcctcgtgttccctaccgcgatagcaaattgacacggcttctgcaggacagtcttggtggttccgcccatagcatacttatcgctaacatcgctccagagagacgcttctacctggatacagtctcggccctcaactttgctgctagatctaaagaggtgataaatcggcctttcacgaatgagagcctgcagccccacgccctgggccctgtcaaattaagtcagaaagaactcctcggccctcccgaagccaagcgggctcgggggccagaagaggaggaaatcggcagccctgaaccaatggccgcgcctgctagcgcatcacagaagctttcccccctgcaaaaactgagctctatggaccccgcgatgctggagagactgctgagtctggacaggttacttgcatcacagggatcgcagggcgcaccactcctgagcacccccaaacgagaaagaatggttctgatgaaaactgtcgaggaaaaagatcttgagattgagcggctaaaaacgaagcaaaaagagctggaggcaaagatgctggcccagaaggccgaagaaaaagagaaccattgtcccaccatgttacggccactctcccacaggacggtaacaggagcaaagccattaaaaaaggcggttgtgatgcctctgcagttgatacaggagcaagccgccagccctaacgcggaaattcatattcttaagaataaggggagaaaacgaaaacttgaatctcttgacgccctcgaacccgaggaaaaagccgaggactgctgggaattacagattagccctgagttgttagctcatggacgccagaaaatcttagacctgctcaatgaggggtctgctagagaccttagatcacttcagaggattggccctaaaaaagcccaactcatagttggatggcgggagctacacggccctttttctcaagtcgaagacttagaacgcgtagagggcatcacgggcaagcaaatggaatcctttcttaaagctaacattctggggttggcggcagggcagcggtgcggagcttcttag

SEQ ID NO: 192447 - DNA, 2883 bp, Artificial Sequence
  Description of Artificial Sequence: Synthetic coding sequence
atgaagagcgcccgggccaagaccccccggaagcccaccgtgaagaagggcagccagacaaacctgaaggaccctgtaggcgtctattgtagggttcgcccgttgggattccccgatcaagagtgctgtatcgaagtgattaacaacaccacagtccaactacatacacccgaaggatatcggctgaaccgcaatggagattataaagagacccagtatagtttcaagcaggtattcgggacccatacaacacaaaaagagctgtttgacgtggttgcaaatcccttagttaacgacctgattcacggaaagaacgggcttttgtttacatatggagtgacaggttccgggaagacccacaccatgactggtagtcccggcgagggaggcttactgccccgctgcctggatatgattttcaacagtattggttctttccaggcaaagcgttatgtgttcaaaagtaatgatcgcaactcaatggatattcagtgcgaggtggacgcattgctggagagacagaagagggaagcaatgcccaacccaaaaacgtcctctagcaagcgtcaggtggaccccgaatttgctgacatgatcacagttcaggagttctgtaaggcagaggaggttgacgaggacagcgtgtacggagtcttcgtgtcttatatcgagatttataacaattacatctatgatctcttagaagaagtgccattcgatcccattaagccaaagcccccgcaaagtaagctattgcgagaagacaaaaatcacaatatgtatgtggcggggtgtacggaagtggaagtgaaaagtacggaagaggcatttgaagttttttggcgtgggcagaaaaaacggaggatagcaaacacacacctcaatcgagaatcttctcgatcccactccgtgttcaacattaaattagtacaggcaccgctcgatgccgatggagacaacgtgcttcaggaaaaagagcagattaccatctcacagctctctctggtcgacctggccgggtcagaacgaacaaatcgaaccagagcagaaggaaatcggcttcgcgaggcggggaatatcaaccagtcccttatgaccctgagaacttgtatggatgttttgcgtgagaaccagatgtatggcaccaataaaatggtcccctaccgtgacagtaagctgacccacctcttcaagaattattttgatggagagggaaaggtgcgcatgatcgtctgcgtcaacccgaaggccgaagactatgaggagaacctgcaggtgatgagattcgccgaagtgactcaagaggtggaggtggcacgcccagtggataaagctatttgcggcctgacacctggccgccgttacaggaaccagccacgcgggccagtcggcaacgagcctctggtgacagacgtggtgcttcagtcatttccgcccctgccgtcctgcgaaatcctggatataaacgatgagcagaccttgcctagattgattgaggccctcgaaaagaggcataacttaaggcagatgatgatcgacgaatttaacaaacagagcaatgcattcaaggctttactgcaggagttcgataacgccgtgttgtctaaggagaaccacatgcagggaaaactgaatgagaaggagaaaatgattagtgggcagaaattggaaatcgagcgcctcgaaaagaaaaacaagaccctcgagtataagatcgaaattctcgagaagacaacaacaatttacgaggaggataagaggaacctgcaacaggagctggaaacccagaatcagaagctgcaacgacagttctccgacaagcgaagactcgaggctagattgcaaggcatggtcacagaaacgaccatgaagtgggaaaaagaatgtgagcggcgggtggccgcaaagcaacttgagatgcaaaacaaactctgggtgaaggacgaaaagctgaaacagttgaaggccattgtgaccgaacctaaaaccgaaaaaccagagcgtccctctcgggaaagggatcgggagaaggtcacacagaggtctgtcagcccctctcccgtgccactatcctcaaactacatagcccaaatttcaaacgggcagcagctgatgtcacaaccacagctgcatcgacgatctaattcatgttcttctataagtgtggcctcatgcatcagtgaatgggaacagaagatccccacatataacactcctctgaaagttacgtcaatcgcaaggagacggcagcaggagcctgggcagtccaaaacctgtattgtttctgacaggcgacggggcatgtattggacagagggacgggaggtcgtgccaaccttccggaatgagatcgagattgaagaggatcattgcggcagactcttatttcagccagaccaaaatgcccctcccattcgtctcaggcacaggaggtctcgatcagccggagaccgttgggtggaccacaagccggcatctaacatgcagaccgaaacagtaatgcaaccccacgttccccacgctatcacggttagcgtcgccaacgagaaggccctggcgaagtgcgagaaatatatgttaacccatcaggaattagccagcgacggggagattgaaacaaagctgattaagggcgacatctacaagactaggggaggtggacagagtgtgcagttcaccgacattgagactcttaagcaggagtcaccaaacggaagtcgaaagagaagatcgtcaaccgttgctcctgcacagcctgacggcgctgaatccgagtggacggacgttgagaccaggtgtagtgtggccgtggaaatgcgcgcaggttcccaactcggcccaggctaccagcaccacgcacagcctaaaagaaagaagccctag

SEQ ID NO: 192448 - DNA, 2022 bp, Artificial Sequence
  Description of Artificial Sequence: Synthetic coding sequence
atgatcaccgtgcaggagttctgcaaggccgaggaggtggacgaggatagcgtctatggagtctttgtgagctatatcgaaatatacaataactatatctacgaccttctggaagaagtacccttcgacccaataaagcccaagtggaacagttgcagtacccccatgcgaaacaccgacttcgtcccaccccagtccaaactgctgagagaggataaaaatcacaatatgtacgttgctggatgtaccgaagtcgaagtgaaatcaacagaggaggcgttcgaagtgttttggcgcggacagaaaaagcgcagaattgctaacacccatctgaacagggaatccagcaggtcccacagcgtcttcaacattaagctcgtgcaagcgcccctcgacgccgacggggacaatgtgctgcaggagaaagagcagataaccatctctcagttatcactggttgatctggcgggttccgagcgcacgaatagaacaagggccgagggcaatagactgcgtgaggcgggaaatattaatcaatcactgatgacgctgaggacatgcatggatgtcctgagggagaaccagatgtacggtaccaataaaatggttccctaccgggacagcaagcttacccacctctttaagaattatttcgacggggagggcaaagtccgtatgattgtgtgcgtgaacccaaaggcagaggattatgaggaaaatctgcaggtgatgcggttcgcagaagttacacaggaggtcgaggtagcccgtccagtggacaaggcaatatgcggcctgacccctggaagacgttaccggaaccagccgagggggccggtcgggaacgaacccctggtgacggatgtggtgctccaaagcttccctcctctgccctcatgcgagatcctggatataaacgatgagcagaccctgcctcggcttatagaggcccttgaaaaaaggcataatttgagacagatgatgatcgatgaatttaataagcagtcaaatgccttcaaagctttattacaagagtttgacaacgctgtgctgtctaaggagaaccatatgcaggggaaactgaatgaaaaggagaagatgatctctggccaaaagctagagatcgagcggctcgagaagaagaacaagactttggagtataagatagagatcctagaaaaaacgaccaccatttatgaagaggacaaacgaaatctgcagcaggagctggaaactcagaatcagaagttacagcgccagttctctgataaaagaaggctggaggccaggctgcagggaatggtcacagagacaacgatgaagtgggaaaaagaatgcgaacgaagagtggcagcgaagcagctggagatgcagaataaactgtgggtcaaagatgagaaactcaagcaactcaaagctattgtaacggaacctaagaccgaaaagcccgaaagacctagcagggaaagagatagggagaaagttacacagagatcagtttccccaagtcctgtaccacttctgtttcagcccgatcaaaacgcccccccaattcgcctgcgccacaggaggtcccggtccgcaggcgatagatgggtggaccacaaaccagccagtaatatgcagaccgagaccgttatgcaaccccacgtgccgcatgccatcaccgtgtctgttgccaacgagaaggctctcgcaaaatgtgaaaaatacatgctcacccatcaggaattggcttctgatggagaaattgaaactaaacttattaaaggagatatttacaagacccgcggcggaggccaatccgtgcagttcaccgatatcgaaacattgaagcaggagtcgcccaacggctcacgaaaaaggaggtccagcactgtcgcacctgctcaaccagatggcgccgaaagtgagtggaccgacgtagagacacgctgtagcgtggccgtcgagatgagagcaggcagtcagctcggtcccggatatcagcaccacgcgcagcctaaacgcaagaagccctag

SEQ ID NO: 192449 - DNA, 2022 bp, Artificial Sequence
  Description of Artificial Sequence: Synthetic coding sequence
atgatcaccgtgcaggagttctgcaaggccgaggaggtggacgaggatagcgtgtatggcgtatttgtgagttacatcgaaatttacaataactatatttatgatttattggaagaggtgcccttcgacccaatcaaacctaagtggaatagctgttcaacccccatgcgcaatacagactttgtccccccacagagcaagttgcttcgcgaagataaaaaccacaatatgtacgtggctgggtgcacagaagtcgaggtgaagtctacggaggaggcgttcgaggttttttggcgggggcagaagaagaggcggatcgctaacacacacctgaacagagagtcctctcgctctcacagcgtcttcaacatcaagctcgtgcaggccccactcgatgctgatggagacaacgtcttacaagaaaaggaacagatcaccatttctcagttgtcactggtggacctggccggttccgaaagaacaaatcgtaccagagcggagggaaaccgactacgcgaggcgggcaacataaaccagtctttaatgaccctccggacctgcatggacgttctgagggaaaaccagatgtatgggaccaataagatggtgccgtacagggattctaagctcacacatcttttcaaaaattatttcgacggcgaggggaaagtgcgaatgatcgtgtgcgtgaatccaaaagccgaagactacgaagagaatctccaggtcatgcgctttgctgaggttactcaagaagtggaggttgcccggcctgtggataaggccatttgcgggctgaccccaggacggaggtatcgcaaccagccccgtggcccagtgggtaacgaacctctggtcacagatgtggtcctgcagtctttcccccctttgccatcttgcgagattcttgatatcaacgacgagcagacactgccccgcctgattgaagcgctggagaagcggcacaacctcagacagatgatgattgacgagttcaataagcaatccaacgcattcaaggccctgctgcaggagttcgataatgctgtcctatctaaagagaaccatatgcaaggcaagctcaacgagaaagaaaagatgatctcaggccagaaactagagatcgaacgcttggagaagaaaaataaaaccctagagtataagattgaaatcctcgaaaaaacgaccacaatctatgaggaggacaaaagaaacctacaacaagagcttgaaacgcaaaaccagaaattgcagagacagttttccgacaagaggcgacttgaggctcggctgcaggggatggtaactgagaccactatgaagtgggagaaggagtgcgagaggcgagtcgctgctaagcagttagaaatgcagaataaactgtgggttaaagacgagaaactgaagcagctcaaggccatcgtgactgagcctaagaccgaaaagccggaaagaccctcccgggagagggatcgagagaaggtcactcagcggtctgtttcgccatcaccagtgcccctgctgttccagcctgatcagaatgctcccccgattcgcctgcgacacaggaggagcagatccgccggcgatagatgggttgaccataagccggccagtaatatgcagacagagaccgtgatgcagcctcacgttccccacgcaatcacagtgtctgtcgccaatgaaaaagcactagccaagtgtgagaaatacatgctgacccaccaagagctagcctcagatggggaaatcgagactaaactaattaagggggatatatataaaaccagaggaggcgggcaaagcgtgcagtttacggacattgagacactcaaacaagaatcacctaatggatcccgaaaaaggaggtcgtccactgtggccccggctcagccagacggcgcagagagtgagtggactgatgttgagacccgctgcagtgtggcagtggagatgcgggcaggaagtcagctggggcccggatatcagcaccacgcacaacctaagaggaaaaagccttag

SEQ ID NO: 192450 - DNA, 2571 bp, Artificial Sequence
  Description of Artificial Sequence: Synthetic coding sequence
atgaagagcgcccgggccaagaccccccggaagcccaccgtgaagaagggctcccagaccaaccttaaggacccggtaggagtgtactgtcgtgtaagacccttgggattccccgaccaagagtgctgcatagaagtgattaacaacactactgtgcagttacacacccctgagggctacagactgaatcgaaatggcgattacaaggagactcaatactccttcaaacaggtgtttgggacccacacgactcagaaagagttattcgacgtcgtagctaacccactcgtgaacgatctcatccacggcaagaacggactcctattcacttacggggtgacagggtcggggaaaacacatactatgaccggatctcccggcgaaggtggactcctccccagatgcttagacatgatattcaacagcatcggctcattccaggcgaagcgctacgtgttcaagagcaatgatcgaaacagtatggacatccagtgtgaggtcgacgcccttctggagaggcagaagagagaggccatgcccaatccaaagacatccagtagcaaaagacaggtcgatcccgaatttgcagacatgatcacagtgcaggaattctgtaaggcagaagaagtggatgaggattccgtgtatggcgtattcgtgtcgtacattgagatttataataactacatctatgacttactggaggaagtaccatttgatcctatcaagccaaaacctcctcagagtaagctactgcgagaggataagaaccacaacatgtacgtggcaggttgcaccgaagtcgaggttaagagtacggaggaagcatttgaagttttctggaggggtcagaagaagagacgaatcgctaacactcacctgaaccgggagtcctctcgttctcatagtgtattcaatataaagctggtgcaggcccccctggatgcagatggcgacaatgttcttcaggaaaaggagcagataacaatcagccagttgagcctcgtcgacctcgcagggagtgagaggacaaatcgtacccgggctgagggtaatagattaagagaagccggaaacataaaccagtctcttatgaccctgaggacctgtatggacgtcctgcgggaaaatcaaatgtacggcaccaataagatggtgccttatagggactctaagctcactcacctctttaagaattattttgatggggaagggaaagtgcggatgatagtctgtgttaatcccaaggccgaggattatgaggagaatttacaagtcatgaggttcgctgaggtgacccaggaagtcgaggtggcacgcccggtcgataaggcgatttgtggcctgacgcctggtcgtaggtataggaatcaaccaaggggtcccgttgggaacgaaccactggtgaccgacgtggtgctgcagtccttcccacccctgccgagctgtgagatcttggatattaatgacgagcagactctgccccgcctcattgaagctttggaaaaacggcacaatctacggcagatgatgatcgacgaatttaacaagcagagcaatgcctttaaggccttgctgcaggaattcgacaacgctgtcctttctaaagagaaccatatgcagggcaagttaaacgaaaaagagaagatgatctcgggtcaaaagttggagattgagcgcttagagaagaaaaacaaaaccctggagtataagatcgagatattggaaaaaactactaccatctatgaagaggacaagcgaaaccttcagcaagagttggagacccagaatcaaaagttgcagcgacagttctcagataaacgacggctcgaagcacgcctccagggtatggtgactgaaactacgatgaagtgggagaaggagtgtgaacgacgggtggcagccaaacagctggaaatgcaaaataagttgtgggtcaaagatgagaagctgaagcaattgaaagccatcgtcactgaacccaagaccgagaaaccagagaggccttcacgtgagcgggaccgggaaaaggtgacccagcgcagcgtgagtccctcaccagtgccgctgcttttccagccagatcaaaacgcaccgcccatccgactgcgacatagacggtctcggagcgccggcgaccggtgggtcgaccacaagccagccagcaatatgcaaacagaaaccgtgatgcagccccatgttcctcacgcaataacagtgtctgttgcaaacgaaaaggcccttgcaaagtgcgaaaaatacatgctgacccatcaggagctagcatccgatggcgaaattgaaaccaagctcatcaagggcgacatctacaaaacaaggggcggaggacagagcgtccagtttacagatattgagaccctcaagcaagaatcccctaatgggtcgaggaagcgaaggagtagcaccgtggccccggcgcagcctgatggggctgagtcggaatggacagatgtggaaactcgttgttcagtcgccgtggagatgcgcgccggcagccaactgggccctggataccagcaccacgctcagcccaagcgtaagaaaccttag

SEQ ID NO: 192451 - DNA, 2520 bp, Artificial Sequence
  Description of Artificial Sequence: Synthetic coding sequence
atgaccggcagccccggcgagggcggcctgctgccccggtgcctggacatgatatttaactccataggctctttccaagcaaagagatacgtatttaagagcaacgataggaactctatggatatccagtgtgaggtcgacgctctgctcgagcgccagaagagggaggcgatgcctaacccaaagaccagttcgagcaaacgtcaggtggatccagagttcgccgacatgataaccgtgcaggagttctgcaaggcagaagaggtggacgaggactctgtgtacggtgttttcgtatcctacatcgaaatctacaataactacatttacgatctactcgaagaggttcctttcgaccccattaagcctaaaccacctcaaagcaaactgctgcgggaggacaaaaaccacaatatgtacgttgccggttgcacggaggttgaggtgaaatccactgaggaggctttcgaggtgttctggcgtggccaaaagaagaggcggatcgcaaatacgcacctcaatcgcgagtctagtcgctcacacagcgtgttcaacattaagctcgtgcaggctcccctagatgctgatggcgacaatgtacttcaggaaaaagaacaaatcacaatctctcagctttctctggttgaccttgcgggaagcgagcgcaccaaccgcacacgcgccgagggcaatagactgagggaggcaggcaacataaaccagtctctgatgacccttcgtacttgcatggacgttctcagggaaaaccaaatgtacggcactaacaagatggttccatacagggacagtaagttgacacacctattcaaaaattatttcgacggtgaaggcaaagtccgtatgatcgtgtgcgtgaatcccaaggctgaagactacgaggagaatctgcaggtcatgcgcttcgcagaagtgacgcaagaggtcgaagtggccaggccagtcgataaggccatctgcggcctaacacctggacgtcgataccgaaatcagcctagggggcccgtaggcaatgaacctctggttaccgacgttgtgcttcagagctttcctcccttgccctcctgtgagatactggatattaacgatgagcaaaccctccctagactaatcgaggccctcgagaaacgtcataatcttcgacaaatgatgatcgacgaattcaacaaacaaagcaacgctttcaaagctttacttcaggaatttgacaacgcggtcctgagcaaggagaaccatatgcagggcaaactgaatgagaaggagaaaatgattagcggacagaaactcgaaatagaaagactggagaagaagaacaaaacactggaatataagatcgagatactggagaagacaaccacgatttacgaggaggacaaacgcaacttgcagcaggagctggagacacagaatcagaaattacagcgccagttttctgataagcggcgtctggaagcaagactgcagggcatggttacggagaccactatgaagtgggagaaagagtgtgagcgccgcgtggccgccaaacagctggaaatgcagaacaaactatgggtcaaagatgaaaagctgaaacagttaaaagcaatcgtcactgagcctaaaactgagaaacccgagcggcccagccgcgagagggaccgggaaaaagtgactcaaagatcagtgtctccctcacctgtccctctgagcagcaattacattgcccaaatttctaatgggcaacagctgatgagccagcctcagttacaccgccggtctaattcctgcagcagtatcagtgtagcctcttgtatttccgagtgggagcaaaagatacctacatacaacaccccgctaaaggtgaccagcatcgcacggagaagacagcaagagcctggccaaagtaagacatgcatcgtcagcgaccgtcgcagaggtatgtattggactgaaggccgggaggttgtgccaacattccgcaatgagattgaaatcgaagaggaccactgtggcaggctgctctttcagcctgaccagaatgccccacctattaggctccgtcatcggagaagtaggtccgctggcgatagatgggttgatcacaagcccgcttccaacatgcagaccgagaccgtcatgcagccacatgtcccacatgctatcacggtatctgtggcgaatgaaaaagccctagcaaagtgtgaaaaatatatgctgactcatcaggaattagccagtgacggcgagattgagacaaagcttatcaagggggatatctacaagacccgagggggcggacagagcgtacagttcactgacatcgagactcttaagcaagaatctcccaacggctcaagaaagcggcgcagctctacagtggcgccagcccagccagatggggccgaatcagagtggactgacgtggaaaccaggtgcagcgtggcagtagagatgcgagccggctcccagttaggtcccggctaccagcaccacgcacagcctaagcgtaaaaaaccttag

SEQ ID NO: 192452 - DNA, 3705 bp, Artificial Sequence
  Description of Artificial Sequence: Synthetic coding sequence
atggccagctggctgtacgagtgcctgtgcgaggccgagctggcccaatattacagccactttaccgcactgggcctgcagaagatcgatgagctggccaagattacgatgaaggactatagtaagctgggcgtgcatgatatgaatgatcggaagcggctgtttcagctcattaaaatcatcaaaattatgcaggaagaggacaaggccgtgtctatccctgagagacacctccagacatcctccctgaggatcaagagtcaggagctgcgaagcggccctagacgacagctcaactttgattctcctgctgacaacaaagaccgaaacgcaagtaacgacggcttcgagatgtgttctttaagcgacttctccgcgaacgaacagaagtccacatatctgaaggttctggagcacatgctccctgacgattcgcaataccacactaaaaccggcatcctgaacgctacagccggggattcatacgttcaaacagagatctccactagcttgttttcacccaactatctctctgcaatccttggggactgtgacatcccaatcattcagagaatatcacacgtgtccgggtacaactatgggatcccccactcctgtatccgccagaatacgtctgagaaacagaatccctggaccgagatggagaaaatccgagtctgtgtacggaagaggcccctgggcatgcgcgaagtgagacgaggggaaatcaacatcattacggtcgaggataaagagacgctgttagttcatgagaaaaaggaagcagttgatttaacccagtacatcctacaagtgatcctcaaggggtccaaagagcggtcaacaggcgcaacaggcgtcaatgctgattcctctaggtctcatgccgtgatacagatacagatcaaagattcagccaagaggacttttggtcggattagcttcatcgatttggcaggttcggaaagggccgccgacgcaagagacagtgaccggcagacaaagatggagggcgccgagatcaatcaaagcctcctggccctcaaggagtgtatacgcgctctggatcaggagcatacgcacacaccctttcgccagtcaaagttgacacaggttttgaaagacagcttcatcggaaacgccaagacctgtatgatcgccaacatcagcccgagtcacgtagccacagagcatacactgaacaccctgagatacgctgacagagtcaaagaacttaagaaaggaattaagtgctgcacaagtgtgacatccagaaatcggacaagcgggaattcttcaccgaagcgcatccagtccagcccgggtgcactgtctgaagataagtgctctcctaagaaagtgaagctcgggtttcagcagtcactgaccgtggcagccccggggagtactagagggaaggtacatccacttacttctcaccctcctaacatcccattcacctctgcccctaaagtaagtggtaagcgaggggggtccagaggcagtccgtcacaggagtgggttatacacgcttctccagttaaaggaactgtgaggtctggacatgttgccaagaaaaaacccgaagagagtgctcccctgtgcagtgagaagaatcgcatgggcaataagacggtgctgggctgggaaagccgtgcctcaggcccgggtgaagggctcgtgaggggcaaactctcaacaaagtgtaagaaagtgcagactgtgcaacccgtgcaaaagcagctagtgtctcgtgtcgaactgtcattcggtaacgcccaccatcgggccgagtatagccaggactcccagagaggcacccctgcacgcccagcatccgaggcgtggacaaacattccaccccatcaaaaagagagggaggagcatcttcggttctaccaccagcagttccagcagccaccattattacagcagaaattgaagtaccagcccttaaagcgctctttgaggcagtatagaccaccagaagggcaactcaccaacgaaacacctccactgtttcacagctactcggagaaccacgacggagcccaggtggaggagctggacgactctgatttttctgaagactccttttctcatatcagctcccagcgggctactaaacaacgcaacacactagagaattcggaggatagcttctttttgcatcaaacgtgggggcaggggccagaaaaacaagtggctgaaaggcaacaaagcctgttcagttctcccaggacaggcgacaagaaagatctcactaaatcctgggtggactcacgggacccaattaaccataggcgggccgcgctcgaccactcctgctctccctccaaaggacctgtggattggtcaagagaaaacagcacatcgagcggtccgtccccgagggactccctagccgaaaagccttattgtagtcaagtagactttatctatcgccaggaacggggtggagggtcttcatttgacctgcgcaaggatgcctcccagtccgaggtctcaggggaaaacgagggcaatttaccatctcccgaagaagacggctttactatttctctgtcgcacgtggccgtccctggatcgcccgaccagcgcgacactgtgaccacgcccctcagagaggtgagcgccgacggaccaatacaggtaacatccaccgtcaagaatggtcacgccgtcccaggcgaggaccctaggggacagttgggaacccacgctgagtacgcttccggcttgatgtctccacttacaatgtccctgttagagaatcccgacaatgagggtagcccaccctccgagcagttagttcaggacggagcaacccattccctggtcgctgagtctacaggagggcctgttgtatctcataccgtcccatctggcgaccaagaggctgcactgcctgtttcttccgctaccagacacctgtggctgagctcatcccctcccgacaacaaacctggcggcgacctgccagctctgtctccgtctcccattcggcagcatccagccgataagctgccttccagggaggcagacttgggggaggcttgtcaatcaagggagaccgtcctcttcagtcacgaacacatggggagtgaacagtatgacgccgacgccgaggagactggtctcgacggctcatggggcttcccagggaagcccttcactactatccatatgggggtacctcacagtggaccaactctgactcctaggaccgggtcctccgacgtagccgatcaattgtgggcccaggaaaggaaacatcccacgagactgggctggcaggaattcgggctcagtaccgaccccataaaattaccctgcaatagcgaaaatgtcacctggcttaaaccacgccccatttcccggtgcctggcaagaccctcgtctcccctggtcccctcgtgctcacctaagactgcggggaccctgagacaaccaacacttgaacaggcccagcaggtcgtgatccgggcccatcaggaacagcttgatgaaatggctgagctcggctttaaagaagagactctgatgagccagctagcatctaacgactttgaggacttcgtgactcagttagatgaaatcatggtgctgaagtcgaaatgcatccagtcgctccgatcccagctccagctttaccttacctgtcacggccctactgccgcacccgaagggactgttccttcatag

SEQ ID NO: 192453 - DNA, 4107 bp, Artificial Sequence
  Description of Artificial Sequence: Synthetic coding sequence
atggccagctggctgtacgagtgcctgtgcgaggccgagctggcccagtactattctcattttacagcgttgggtctgcagaaaattgacgagttggcaaagatcaccatgaaagactactctaagcttggcgtgcatgatatgaacgacaggaaacgactgtttcagttgattaagattattaagatcatgcaagaggaagacaaggccgtatctatccctgaacgtcacttacagacttctagtctccggatcaagtcccaagaattgcgatccggtcctagacggcagctgaatttcgattcacctgccgataataaggaccggaatgcctctaacgacggtttcgaaatgtgctctctgtctgacttcagcgctaatgagcagaaatctacttacctaaaagttctggaacatatgctgcccgacgactcacaatatcacaccaagacagggatattgaatgcaaccgcgggggactcgtatgtgcagactgagattagcacctctctcttttcaccaaactacctcagtgctatactgggagactgtgacattcctataattcagagaatttctcatgtcagcggatacaattacgggattcctcacagctgtatacgacagaacactagtgagaagcagaatccatggactgaaatggaaaaaattagggtctgcgtacggaagcgaccccttggaatgagggaagtccgacggggggagattaacattatcacagtggaagataaagaaacactcttggttcacgaaaagaaggaggccgtggacctgactcagtacatcttgcagcatgttttctatttcgatgaagtgttcggcgaggcctgcactaaccaggacgtttatatgaaaactacacatcctctcattcagcatatctttaacggcggcaatgccacctgcttcgcttacggccaaaccggcgccggcaagacctatacaatgataggaacccatgagaaccctggactgtatgccctcgccgccaaggacatcttccgccagctggaagtaagccagccacgtaaacacctgtttgtatggattagcttctacgaaatttactgtggacaattgtatgatttactaaacagacgcaagcggctcttcgcgcgtgaggacagcaaacacatggtgcaaatagtcggcctgcaggaactccaggtggactcggtggagcttctgctcgaagtaattttgaaaggatccaaggaaagatctacaggggcgaccggtgttaatgccgattcaagcaggagccacgcagtcattcaaatacagataaaagactcagcgaagaggacattcggacggatatcttttatcgacctcgccggcagcgaacgtgccgcagacgctcgggatagcgaccgtcagacaaagatggagggagcggagatcaatcaatcgctgctagcgctgaaagaatgcatcagggccctcgaccaagagcacacgcatacaccctttcggcagagtaaactcactcaggtgttgaaggattcattcattggcaatgcaaagacttgcatgattgcaaacatctctccctcccatgttgcaacagagcacactctcaatactttaaggtacgctgacagagttaaggaacttaagaaaggcataaagtgctgcacctctgtgacatcacgtaaccggacctctgggaattcttccccgaagagaatccaatcttcccctggtgcgctgtccgaggataagtgttcgcccaagaaagtgaaactgggctttcagcagtccctgaccgtggctgccccaggctctacccggggcaaggtccacccattgacatcacatccccccaatatcccctttacatccgcccccaaagtatctgggaaacgtggaggctctaggggcagcccctcccaggaatgggtgattcacgcaagtcctgttaagggtactgtgaggtctgggcatgtggccaagaaaaagccggaggaaagtgcaccactctgttcagaaaagaacagaatgggcaataaaactgtcttaggttgggaaagtcgcgcatctggaccaggagagggcctcgtccgggggaaactatctaccaagtgtaaaaaagttcaaacagtccagcctgtacagaagcagctggtctctagagttgaactttcttttggaaatgcacaccacagggcagagtattcgcaggactcacagcggggcacacccgcccgccctgccagcgaggcttggactaacatcccccctcaccagaaggagcgagaggagcatttgcggttctaccatcaacagtttcagcaacctcccctgctgcaacaaaagcttaagtaccagcctctgaagagaagccttcggcagtaccggccccccgagggtcagcttacaaacgagactccccccttatttcactcttacagcgaaaatcacgatggcgctcaggtggaagagctggacgacagcgacttttctgaggatagctttagccacatttctagccagagggccacaaagcaaaggaatactctggaaaactcagaggacagtttcttcctgcatcagacttgggggcaaggtccggagaaacaggtagccgagcgtcagcaatcgcttttctcctcaccgcgcactggcgataagaaggacttgactaaatcctgggttgactctcgtgatcctatcaatcacaggcgagctgccttggatcattcctgttcgccctctaaggggcccgtggattggtcgcgagaaaactcgaccagtagcggaccatccccacgcgattcactcgcagagaaaccctattgcagccaggtggatttcatatacagacaggaacgtggaggcggatcatccttcgacctgagaaaagacgcgtctcagtcagaagtgtccggagaaaatgaaggcaacttgccatcacccgaggaagatgggttcaccataagtttaagccacgtggccgtgcctggctctcctgaccaaagagacaccgtgacaacacccctgcgggaggtctccgctgacggcccaatacaggtgacgtccacagtaaaaaatggccatgctgtgcctggagaggatcctcgcggacagctcggcactcatgcggaatacgccagcggactcatgagccctctcacgatgtctctgctggagaacccagataatgaaggtagtcccccatcagagcagctggtgcaggatggcgccacccacagcctcgtggctgagtctaccgggggtccagttgtgagccacaccgtaccatctggggaccaggaggcagctctacccgtgagctccgccactcgccacttatggctgtcttcctccccacccgataacaagcctggcggggatttgcctgctctcagtccctctcctattcggcagcatccggccgataagctgcccagtcgggaagccgacttaggggaagcatgtcagtcacgtgaaaccgtgctgttctcgcatgagcatatgggctccgagcaatacgacgccgacgcagaggagaccggccttgacggctcttggggatttcctggtaagccttttacgacgatccacatgggcgtgccacattctgggcccacgcttacaccacgaactgggagctctgacgtggcagatcagctgtgggcgcaggagagaaagcatcccacacggcttggatggcaggaatttggcctgtccactgaccctattaagcttccctgtaactcagagaacgtgacgtggctcaaacctcgacccatctccagatgcctggctaggccttcctccccactcgtgccgagttgttcccccaagacggccggcacacttagacagcccaccttggaacaggcccaacaggtcgtgatcagagcccaccaggaacagcttgacgaaatggctgagctggggtttaaagaagagacattgatgtcccaattggcttcaaatgatttcgaggattttgttactcagctagatgaaatcatggtgctcaaaagcaaatgcatccagtctcttcgatcgcagttacagctgtatctgacctgtcatggtcctactgccgctcctgaagggactgtgccttcatag

SEQ ID NO: 192454 - DNA, 4107 bp, Artificial Sequence
  Description of Artificial Sequence: Synthetic coding sequence
atggccagctggctgtacgagtgcctgtgcgaggccgagctggcccagtattactcccacttcacagctctaggtcttcagaagattgatgaacttgcaaagatcaccatgaaagactacagtaagctgggcgtccacgatatgaacgacaggaaaaggctcttccagctcattaagataattaaaatcatgcaggaagaggacaaggcagtgagcattccggaacggcatctacagaccagctccctgcggatcaaaagccaggaactccgtagtgggccaagacgccagctgaattttgactctcctgcggacaacaaggatcgcaacgcctccaatgatggattcgagatgtgctcattgagcgatttttccgctaatgagcagaagagcacatatcttaaagtattagaacacatgctgccagacgattcacagtatcacaccaaaaccgggattctaaacgccaccgccggagacagttacgtccagaccgagatatctacatccctgtttagtcccaactacctctctgcaatcttgggagactgtgacatccctatcattcaacggatatctcatgtgtcagggtacaattatggcatacctcatagttgcatacgccagaacaccagtgagaaacagaacccctggactgagatggagaagattagggtctgcgttcggaaacgtccactcggaatgcgcgaggtgcggaggggggaaatcaacatcatcaccgtcgaggacaaggagactctcctggtccatgaaaagaaagaggccgtcgacctaacccagtacattcttcagcacgtgttttacttcgatgaagtgttcggagaggcatgcaccaatcaagacgtctacatgaaaactacacaccccctcattcaacacattttcaacggcgggaacgccacctgcttcgcatacggccagacaggagctggcaaaacttacaccatgattgggactcacgaaaatcccggcctctatgctctggccgctaaggacatcttcaggcagttagaggtgagtcagccgagaaagcacttattcgtatggatatcattctatgagatttattgcggacagctctacgatcttctaaaccggcggaaaaggttgttcgcccgggaggattccaaacacatggtacaaattgtcggactgcaggagttgcaggttgacagcgttgagctgctcttggaggtaattcttaagggaagcaaagagaggagtaccggggccacaggggtcaatgccgattcttcacgatctcacgcagtgattcagattcaaatcaaagattctgccaaacgaacgtttggcagaattagtttcatagatctggctggatctgagagggctgcagacgctcgtgattccgataggcagacaaagatggaaggcgctgaaattaaccagtctcttctcgccctgaaggagtgcatccgagccctcgaccaggagcatacacacacacctttccggcagtccaagctaacccaagtgttgaaagactctttcattggaaacgctaagacttgtatgatcgcaaacatcagtccatctcacgttgccaccgagcatactctcaataccctgaggtatgccgaccgggttaaagaactgaagaaaggtataaaatgctgcacaagtgtgacaagtagaaaccgaacttctggcaattctagccctaaacgcatccagtcgagtccaggcgctctgagcgaggataagtgttcccccaagaaggttaaactaggtttccagcaatccctgaccgtggcggccccaggcagtactcggggcaaggtgcatccactcacgtctcatccccctaatatccccttcacatctgcaccaaaggtgagtgggaagcgcggaggcagccggggatcaccatctcaggagtgggttatccacgcctctcccgttaagggcaccgtaagatccggacatgttgccaaaaaaaaaccagaggaaagtgccccactatgctcggagaaaaacagaatggggaacaagaccgtgttggggtgggaatctcgggctagcgggcccggagagggcctggttcgagggaaactgagcaccaagtgtaaaaaggtgcagaccgtccaacctgtccagaaacagctggtgtcccgcgtcgaactgtctttcggtaacgcccaccacagggccgagtactctcaagacagtcagcggggcactccggcccgccccgcatcagaggcttggaccaacatacccccccaccagaaagagcgcgaagaacacctgcggttttatcaccaacaattccagcaacccccactgcttcaacagaaacttaagtaccagcctcttaaacgatccttgcggcagtatcgaccccctgaaggtcagctgaccaatgagacacctcctctctttcattcatactcagagaaccatgacggagcccaggtggaagaactggatgactctgatttctcagaggatagtttcagtcacatttcatcgcaacgagcaactaaacagcgaaatactctcgaaaactctgaggatagcttctttctgcatcagacttggggtcagggacctgaaaagcaggtggcagagcgacaacagtctctgttctcgagccctaggactggcgacaagaaggatctcactaagagctgggttgacagccgcgacccaattaaccaccgcagggccgctttggaccatagttgcagtccctcaaaagggcctgtagactggagccgcgaaaactccactagttctggcccatcaccaagggacagtcttgccgaaaagccttactgctctcaggtcgatttcatctacaggcaggaacgcggaggaggatcctcattcgacctaaggaaagacgcctcacagagcgaagtgagcggggagaatgagggcaatctgccttcccccgaagaagacggcttcaccattagtctttcccatgttgcagtgccaggttcgccagatcagcgtgacacagttactacacctctgcgcgaagtgtctgcagacgggcctatccaagttacttctacagtgaagaacggccacgctgttcccggggaagatccacgtggccagctcggcacacacgcagaatacgcttcgggcttgatgtcaccccttaccatgagtttactggagaacccagataatgaaggcagccctccatccgaacagctcgtacaggatggagccacacactcactggttgctgagagcacaggtggcccagtggtgtctcacaccgtccccagtggagatcaggaagccgctcttcccgtgagttctgctacacgccacttatggctgagttcctcgcccccagacaacaagcctgggggggatctgcctgccctgagcccgtcgcccataagacagcacccagccgataagttgcccagtcgagaagccgacctcggggaggcttgccagtccagagagacagtgctcttctcacacgagcacatggggagtgaacaatatgacgccgacgccgaggaaactggcctggatgggtcctggggttttcctggaaaaccctttactaccatccacatgggcgtgccccactctggtcccacccttaccccgcgaacaggaagtagcgacgtggcggaccagctgtgggctcaggaacggaaacacccgaccagactaggttggcaggagtttgggctgagcacagatccaatcaagttgccctgtaactcagaaaacgtgacgtggctcaaaccccgtccaatcagtcggtgcctcgctcggccatcgagcccactcgtaccttcttgctcacccaaaaccgcaggtaccctccgacagccaacactggaacaagcccagcaagtagtgatccgggctcaccaagagcaactggacgaaatggctgagctgggatttaaggaagaaactcttatgtctcaactggcgtcaaacgattttgaagactttgttacacaactggacgaaataatggttctcaagtccaaatgcatccagagtctcagaagccaactgcaactgtacctcacatgccatggacccacagcggctccagaggggaccgtacccagttag

SEQ ID NO: 192455 - DNA, 3477 bp, Artificial Sequence
  Description of Artificial Sequence: Synthetic coding sequence
atggccagctggctgtacgagtgcctgtgcgaggccgagctggcccagtattacagtcacttcaccgctctggggctgcagaagattgacgagctcgcaaagatcaccatgaaagactattcaaagttgggcgtgcatgatatgaacgaccgcaaacgtctgttccagctgattaagatcatcaaaatcatgcaggaagaggataaagctgtctccattcccgagagacacctgcagacgtcatcactccgcattaagagtcaagagcttcggagcggacccagacgccagctcaactttgactctcctgccgataataaggatcggaatgctagcaatgacggttttgaaatgtgttccctgtccgacttctccgcaaatgagcagaaaagcacctatcttaaagttctggaacacatgttgcctgacgactctcagtatcataccaagaccggaattcttaatgcgactgcgggcgactcttacgtgcagactgagatctccacatccctgtttagccctaactatctctccgccatcctgggcgactgcgacatcccaataatacagcgaatctctcacgtgtccggctacaactacgggatcccacactcatgtatccggcaaaacacatcagagaaacagaacccatggactgaaatggaaaaaatccgcgtttgcgtccgaaagagacctttggggatgagggaggtccgcagaggcgaaattaacataattacggtagaggataaggaaaccctgctcgtgcacgagaagaaggaagctgtggatctgacacaatatattttgcagcatgtgttttacttcgatgaggtgtttggcgaggcatgtactaaccaggatgtgtacatgaaaaccacacacccactaattcagcatatctttaacggaggaaatgccacatgcttcgcttatggccagacaggagcggggaagacttacactatgatcgggacacacgaaaatcctggactttatgccttggccgccaaggatatcttcagacagctggaggtctcccagcccagaaagcatctgttcgtttggatctcattctatgaaatatattgcggacagctttacgatctcctaaaccgaagaaagcgcttatttgcccgtgaggactcaaagcacatggtccagatcgtggggctccaggaactgcaagtggactcggtggaactactgcttgaagtgatcctgaaaggcagtaaagagcgtagtacgggggcaaccggagtgaacgctgattcaagccggtcccacgcagtgatacagatccagattaaggacagtgcaaaacggacctttggtaggatcagcttcatcgaccttgctgggtctgagcgagcagccgatgctcgggactcagataggcaaaccaaaatggaaggtgctgaaatcaaccagagcctcctagccttgaaagaatgcatacgtgccctggaccaggagcacacccacacgccctttcgacagtccaaattaacacaggttctcaaagattcatttatcggaaatgctaaaacatgcatgatcgcaaatatctctcccagtcacgtggccaccgagcatacactgaatactctccgatacgccgaccgcgtgaaagagctcaaaaagggaataaagtgttgcacatccgtaacctcacgcaacaggacatcaggtaattcttcacctaagcgcatccagagttccccgggggcactgtcagaggacaagtgtagtcccaagaaggtcaaactcggttttcagcagagcttaactgtagccgctcctgggagtacaagggggaaggtgcatccattgacaagccatccacctaacattccttttacctctgcccctaaagtgtccggtaagcgaggtggaagtcgagggtccccatcacaagagtgggtcattcatgcttcacctgtgaaaggcactgtccgtagcgggcatgtggccaagaagaaacctgaggaatccgcgccgctgtgttccgagaagaaccgtatggggaataagactgtgttggggtgggagagccgggcttcagggcccggagaagggcttgtccgcggcaagcttagcaccaagtgtaaaaaagtccaaacggtccaacccgtccaaaaacaactggtgagccgagttgagcttagctttggtaacgcccatcatcgggctgagtatagccaggacagtcagcgcggcacccccgctcgacccgcttctgaagcatggaccaatatcccccctcaccagaaagagcgggaagagcacctacggttttaccaccaacagttccagcaaccaccgctgttacagcaaaagctgaagtaccaacctctcaaacgctcccttcgtcagtatcgcccacctgagggacagctgaccaacgaaactccgcctctcttccactcctactctgagaatcatgacggcgcacaggtggaggaactggacgactccgatttttctgaggacagtttctcacatatcagcagccaaagagcgaccaagcagcggaacacccttgagaattccgaggactcattctttctccaccagacctggggccaggggccagaaaagcaggtcgccgagagacaacagtcactcttcagcagcccaagaaccggcgataagaaggatttaaccaaaagctgggtcgattctagagacccaataaatcatcggagggctgcacttgaccactcttgcagcccatctaaaggccccgtggactggagcagagaaaactcaacaagcagtggacctagcccacgggattcactagctgagaagccctattgctcgcaggttgactttatctatagacaggagagaggcggcgggagttcgtttgacctcagaaaggatgcatctcagtcagaggtctcaggtgagaacgaaggaaacttgccttctcctgaagaggacgggttcaccatctcattgtcccacgtggctgttcccggcagtcctgaccagcgcgacactgttacaacccctctcagggaggtctcagctgacggccctattcaggttactagcacggtgaagaatggacacgcagtgcctggagaggaccctcgtggacagcttggcacacacgccgaatatgcttcaggcctcatgagtcctctgactatgtcactgttggaaaaccctgataacgagggctctccacccagtgagcaactggtgcaggatggagccacccacagtctggtggccgaatctacggggggacctgtggtgtcccatacagtgcctagcggagaccaagaagctgccctgcccgtctcctccgcgacgcgtcacctgtggctgtcttcaagcccaccagacaacaaacccggtggagaccttcccgcacttggaccaggtgaaaagacctcttacaaagcctggctcgcaggagtctggtttgttcacaggccccaccaggtggctctccagcagtag

SEQ ID NO: 192456 - DNA, 999 bp, Artificial Sequence
  Description of Artificial Sequence: Synthetic coding sequence
atgacctggaccagcggccagctgcagcgggagaagcaggcccggcccggctccggcgccgtgttagcctttccagacgacaaagatctgcgcgtatacggtccagcagagtcacagagcgcagtgtttggcgatgtgtgccctttactgactagccttttggatggatacaatgtctgtgtgatggcatacggccaaacagggagcggtaaatcctacactatgctgggtagacacagcgacgatggccctgtgttgccacttgatccccaatccgatcttgggatcattcctcgggtggctgaggaactcttccggctgattctggagaacacctcccggtcaccgaaggtggaagtttctatcgttgaggtctacaacaatgatatctttgatctactcgcaaaggattccatcgcggcagtatcaggggtgaaacgggaagtggtgaccgctaaggacggaaggacagaagtggccttactcgcttcagaggcagtggggtccgcctccaaattaatggagctggttcacggagggctccagctccgagctaagcacccaaccttagtccatgcagattcttcgaggtctcacctgataatcactgtgactttgaccacggcgtcatgtagcgattccacagccgatcaagcgtgcagcgcgactctgccacgcgagcagactgaagccggacgtgcagggcggagcagacgggcctctcagggagccctggctccccagcttgtgcccgggaatcctgccggccacgctgagcaggttcaagcccgactccagctggtggactctgcagggtccgagtgtgtgggaggtgacgcaaagctcctggtgatcctttgtatttctccgagccagaggcacttagctcagacactgcagggcttgggcttcggcatcagagcacggcaggttcagaggggtcctgctcgaaagaaacccccttccagtcagaccgagggaaagcggagacctgattag

SEQ ID NO: 192457 - DNA, 1155 bp, Artificial Sequence
  Description of Artificial Sequence: Synthetic coding sequence
atgacctggaccagcggccagctgcagcgggagaagcaggcccggccggggtccggggccgtactggctttccctgatgataaggatctgagagtgtacggacctgccgagagtcagtcagctgtgttcggcgatgtgtgcccactcttgaccagtttgctggacggctacaacgtctgtgtgatggcgtatggccagaccgggtcaggaaagtcttataccatgctgggtagacattcagacgacggcccagtgcttcctctcgacccccagagcgatctgggaatcattcctagagtggcagaggaattattcagactgattttagaaaacacctcacgtagtccaaaagttgaagtgtccattgtcgaggtttacaacaacgacatctttgatctgctggccaaagacagcatcgcggccgtgtccggggtcaagagagaagtggtgaccgccaaggacggtcggaccgaggtggctttattggcgagcgaagcagttggctctgcttctaaactgatggagctggtgcatggagggctgcagcttcgcgccaagcaccccacactcgtccatgcagattcttccaggagccacctcatcattactgttacacttacaactgcaagctgcagcgacagcactgctgaccaggcatgctccgcaactctccctcgtgagcagaccgaggctggacgtgctgggcgctctcgccgcgcaagccaaggagccttagccccacagctggttcccggtaatcccgctggccacgcagaacaggtccaggcccggctgcagttagtcgattccgctggctctgaatgcgtgggagtgtctggtgttactggcctggccttacgggaaatggcatgcatctctagatctctggcagcgctcgccggcgtgctgggagccctgctcgaacaccgtggtcacgccccatatcgaaactccaggcttacacacttactccaagactgcctgggcggtgatgcaaaactgctggttatcctttgtatctccccttcgcaaagacacctcgcgcagacgctccagggcctcgggtttggcatccgtgccaggcaagtccaacgcggccccgcccgcaaaaagccaccgtcctcccagacagaggggaaaaggaggcccgactag

SEQ ID NO: 192458 - DNA, 1155 bp, Artificial Sequence
  Description of Artificial Sequence: Synthetic coding sequence
atgacctggaccagcggccagctgcagcgggagaagcaggcccggcccggatccggagccgtcctcgcttttcctgatgacaaagatcttagggtatacggtccagctgagagccaatcagccgtattcggtgatgtgtgtcctctgctcacctcactgcttgatggatataacgtttgcgtgatggcttatggacagactgggtctggaaagtcctatactatgctgggcagacacagcgacgatggccctgtgctgccactggacccacaatcagatctgggaatcatcccccgggttgcagaggagctcttcagactgatcttggaaaacaccagccggagcccaaaggtagaggtgtccatcgttgaagtgtacaacaacgacatcttcgacctactggcaaaggactcaatcgctgccgttagtggagtgaaaagagaagttgtgactgcgaaggatgggagaactgaggtcgcccttctggcctctgaagccgtcggcagcgcctccaagctgatggagttggtgcatggtggattgcaattgcgcgctaaacaccctactcttgtacatgcagatagcagtcgaagccatctcatcattactgtcaccctgaccactgcctcctgttctgattctacagcggatcaagcctgtagcgccacattgccacgggagcagactgaggcgggccgcgccgggagaagtcggcgggcctcccagggtgctttagcaccacagctggtacctgggaaccctgccggacatgcagaacaggtgcaggctcggctgcagctggtggactcagccggcagtgaatgcgtgggcgtgagtggagtaaccgggctagcacttagagaaatggcttgtatatcccggtcgctggcagcgctggccggggtcttgggcgctctgcttgagcatcggggacacgcaccttatcgaaactctaggctgacgcatctcctgcaggactgtctagggggtgatgcaaagctcctcgtgattttgtgtatctctccgtcacagcggcacctggcacagacactgcagggcctggggtttggcataagagcccgccaagtccaacgcggccctgcccgaaaaaagccgccttcctcccagactgaggggaagcggcgaccagactag

SEQ ID NO: 192459 - DNA, 5649 bp, Artificial Sequence
  Description of Artificial Sequence: Synthetic coding sequence
atggtgggccggggcgtgcccctgtgcgccgcccagcccgccgtggctgagggcgggcctgctcgtgagcctccgccactgctagaggtatctccgaggaagcgtcttccagccggacctgaccaggatccttgtggcagcaggccagcacctgaaggagctggagccggtccagaacaagggcacagtgccggcggaggtgggtggtgtagacactgccatacaaaactggtagaactgaagagacaggcttggaaactggttagcggcccagggactactctgcgggacccttgcctaagcgctctgcttctcgataagctgccagcccccggcgccttgcccgcttgcaggccagaggcagagcggcgctgtgatgtgtgtgccacacacctgcagcagctcactagagaggctatgcatctcttgcaagctccagccagccatgaggacctggatgcccctcatggcggcccaagcctggccccaccttcaaccacaaccagttcaagagatacacctgggccagcagggcctgctggacgtcagcccggaagagcgggaccggacaggactaaaggcctggcatggtctccgggaccaagcgttcaggtatccgtggcacctgccgggttgggcggcgccctgtccacagtgaccatccaggcacaacagtgtctggaagggatgtggtccgtgagcagggtgaactcgttcctgcctcccgcttgcctagcagaggccgccgtcgctgccgttgcagtggcagacactgttcgcgaatgccctccggtggcaggtcccgatggacttagcaaagcctgggggaggggtggagtctgtacctctgccctggtgacccctacacctgggtccgtgggcgggtctacgggaccctctgcggccgcatccttcttcatccgagcaatgcaaaagctgtcccttgcttctaagaggaagaagccccatccccccccaccccctgctacaaggggaaccagtacctatccgaccgatttcagcggagtgctgcagctgtggcccccccctgcacctccctgtctcctgcgggccgccagtaaaaccaaggacaaccccgggtccattgggaaagtcaaagtgatgctgaggatctggccagctcagggcgcccaacggtccgccgaagctatgtccttcctgaaagtggatccacggaagaaacaggtgatcctgtatgaccccgctgcgggcccgcccggctcagctggccctagacgggcagctacggcggctgtgccgaagatgttcgccttcgatgccgtcttccctcaggactctgagcaggccgaagtctgttccggaacggtggcagacgtgctgcagagcgttgtctcaggagcagatggctgcatcttcagcttcgggcacatgagcctcgggaagtcctacacaatgattggcaaggatagcagcccacagagcctggggattgtgccctgcgccatctcatggctattccgcctgattgaggagcgtcgcgaaaggacgggaacccgtttttcggttcgcgtctcggccgtggaagtttgtggtagagaccagtccctcagagacctgctagctgaagtggctccaggtagcttacaggatacccaatcccctggagtgtaccttcgcgaagaccctgtgtgcggcgcccagctccagaaccagagcgaactgcgcgcccccaccgctgagaaagctgcgttctacctcgatgccgcgctagccgcgcgaagcaccagccgggctggctgtggtgaagatgcaaggcggagctcacatatgctgttcaccctgcatgtataccagtaccgaatggaaaaatgcggaagagggggaatgtcaggtgggaggtcacggttgcatctgatcgatctgggcagctgcgaggctgccgcgggtcgggccggggaagcagctggaggccccttatgcctcagcctgagcgcattgggatccgtcatactggcgttggtcaacggcgctaagcatgtgccctatagagaccacagactgacaatgctgttgcgggaatctctggctaccgccggttgccggacaacaatgatcgcccatgtatccgacgccccagcgcagcatgcagagacactgagtactgtccaactggccgccaggatccataggttgagaagaaagaaggctaaatacgctagttctagtagcgggggagagtccagctgcgaggaaggcagagcccgacgccccccacacttgaggcccttccatccacgaactgtagctctggatcctgatcggactcctccctgcctgccgggggatccggattactcgtcatcttctgagcaaagttgtgacacagtgatctatgtgggtcccggcggagcagccctgtccgatcgcgagctgacagacaatgaaggtccccctgattttgtgccaatcattccagccctgagccgacatcgcccctcgaagggacccagagatgctgaccactttcgttgcagcacgttcgctgaactccaggagcggctcgaatgtatggacggtaacgagggcccatcggggggacctggcggcacggatggggctcaggcatcccctgccaggggcgggaggaagccatcaccccctgaggcggcctctccacgaaaagccgtaggcacgccgatggctgccagcacccccagaggatcatctgggcccgacacccaccagggcacaccagagccctgcaaggctatcgtgtggggtgatcagcgcgaggactcatctgcttggcccgagttgctcgtcccagaaaaggccgccgtgtccggggggcgccgtccactgccaagtccagccccacccccacctcagttactggaggcctgtcgagctcctgaagagcctgggggtgggggcactgatggggtggctcggacaccaccagtgggaatgagcggccaggtggccggctcacccatgctccccggagctacctgcccacggcttgccgcagggagccggtgccctgaaaggggtttgttgaccacaacagtaactctccagcgcccagtggagctgaacggagaagacgagttggtgttcaccgtagttgaagagctgtctcttggggctctggctggcgccggaagacctacctcccttgcaagctttgatagcgactgctccctccgagcgctcgcttctggctcaagacctgtgagtataataagctccattaatgatgagtttgacgcttacaccagtcaggcacctgagggcgggcccctggagggagccgcttgggcggggagctcgcatggttcctcaatatcttcttggctgtccgaagtttctgtatgcaccgctgattcccgagaccccacgccacaacctaggttcagtcctgatagcttggcaggactggatcccgggggacccccagctctggatgggtccttgggagatggaagcagtggcttcttaggcccagaccgcccagatagcccagggccaacatggggcccctgtccaggtgaggtagccgctgtcgccccctccagacccggcagggagcctcaggccggaccttccagatgggcgagtgcagcacagaccattcacagcagcttgcctcgaaaaccacgcacggcttccgccacaacacgtgtggggtgtgcacgtctgggacagtccccgcccggacggggtggccttttcgaggatccctggctgctgagggttggggaatgtgacactcaagctgcctcagccgggcgggcgccctctcctactttgggaagccctagactccctgaggcacaggttatgctcgcgtgcgcacaaagagtggtcgatgggtgtgaggttgccgcccgcgccgcaaggcgtcctgaagcagtagcgcgtatcccgccactgaggcggggagcaactaccctgggtgttaccactccggctgtgtcctggggcgacgcccccacagaggtggtggcgtgctccggttcactgaaagcaagcccgacttcaaagaaaggtcttgcacccaaggcaggattcctcccaaggccctcaggagccgccccccccgctcctcctacgcgaaaaagtagcctggagcaaagaagctcccctgcttctgctccgccacacgccgtgaaccccgccagagtgggcgccgccgccgtgctcaggggcgaagaagaaccacgaccgagtagccgagctgatcactccgtgcctagggccacctcgtcactcaaggcaagggctagcaaggtggaggctgcccacaggctcgctgggcacgcctctctggaacgttatgagggcctggcccatagctcgagtaaagggcgggaggcgcctgggaggcccccccgagcggttcctaaactgggagttccccccagcagtccgacccatgggccagcacctgcttgtaggtcaggagctgctaaggcagtcggagccccaaagcccccagtgggtggcggcaaagggagagggcttgttgccggtggctcccgggctctcggcccttctgttaaactctccacagcatcagtgactggacgctctccagggggacctgtggccggtccacgcgccgcccctcgggcgggcccctccgtcggcgctaaagccggccgtggtacagtcatgggcacaaagcaggccctaagggctgcgcatagccgtgtgcacgagttgtctgcttcgggagcacccggaaggggagggagctcatggggatccgcggatagcgacagcggccatgactccggagtgaatgtgggggaagagcgacccccaaccggccccgcacttccctccccttacagtaaggtaactgccccaagaaggccacagcggtactcctccggccatggatcagataattccagtgtgttaagtggagaattaccaccagcgatggggcggactgccctctttcatcactctggcggcagcagcggatatgagtccctcaggcgcgattctgaggccaccgggtcagcttccagcgcacccgatagtatgagcgaaagcggcgccgctagccctggtgcaagaactcgctcactcaagtccccgaaaaaaagagccacaggcttacagagaagaagactaattccggcccccttaccagatacaacggccctggggaggaagccgtcactaccaggacagtgggtcgacctgccgcctcccctggcagggtccctgaaagaacccttcgagattaaggtgtacgagattgacgacgtggagcgtctgcagcgcccaagacccaccccgcgggaagcaccgacccagggcctggcatgcgtctccaccaggctcaggcttgctgaaaggcgacagcagcgcctccgggaagtccaggctaagcacaagcacctatgcgaagaactggccgaaacccaggggcgactcatgctcgaacccggtaggtggctggaacagtttgaagtcgatcctgagctggagcccgagagtgcagaatatctggctgccctggagagggccacggccgccctggaacagtgcgtgaacctgtgcaaagctcacgtcatgatggttacctgttttgacatcagcgtggccgcttccgctgccattccaggtccccaggaggtcgatgtgtag

SEQ ID NO: 192460 - DNA, 5184 bp, Artificial Sequence
  Description of Artificial Sequence: Synthetic coding sequence
atgatgatggactggaaggccgtggccgcccagaagctgaacctgagcagcaaaaaaaaaaaacaccggcctagcaccagctccgccgctgagccaccactctttgccacaagtttttccgggatcctgcagacgtcgccacctccagcccccccatgtctcctgcgcgctgtgaataaggtgaaggatactcccgggcttggcaaggtgaaagtcatgttaaggatttgctccacgttggctcgcgatacttctgagagttccagcttcctcaaggtggatccaagaaagaagcagatcacactctatgatcctttgacatgcggtggccagaatgcttttcaaaagcgaggtaatcaggtacccccgaaaatgtttgctttcgacgccgtgtttccacaggatgcaagtcaggccgaggtttgcgcgggtacagtcgcagaggtcattcaatccgtcgtcaacggggccgatggatgcgttttctgtttcggacacgctaagcttgggaagtcgtataccatgataggcaaggacgactccatgcagaacctgggcatcataccctgcgccatatcttggctttttaagttgatcaatgagagaaaggagaagaccggcgccaggttttctgtccgggtaagtgctgttgaggtatgggggaaagaagaaaatcttcgtgatctcctgtctgaggtggctaccggatctctgcaggacggacagtcgcccggagtctatctgtgtgaggaccccatctgcggaactcagctgcagaatcagtccgaactacgggctcctactgctgagaaagcagccttcttccttgacgccgccatcgcgagcagacggtctcaccagcaggattgcgatgaagacgatcacaggaacagccacgtgttcttcacccttcacatctaccagtacaggatggaaaagtctggaaagggaggcatgagtggagggcgatcccggctccacctgatcgacctcggatcatgtgtaaaggctctgagcaagaaccgggaaggggggagtggtctctgtctaagcctgagcgcactaggtaatgttattctcgcgttggtgaatgggtcaaaacacattccatataaggaatctaagctggccatgctgttgcgagagtctctggggaatatgaactgcagaaccaccatgatcgctcacattagtgcagctgtaggaagctatgcagaaaccctgtctacaattcaaatcgccagccgagtcctcaggatgaaaaagaagaagacgaagtatacctcctcttcctctggaggcgaatcctcttgcgaagaaggaaggatgcggcgccccacccagctgcgcccttttcatacccgcgctactgtcgacccagactttccaatagcgcacttgagttccgaccctgattacagttcatcttcagagcagtcttgtgacaccgtcatatatattgggcctaacggtacagccctaagtgacaaggaactcactgacaacgaaggccctccagactttgtcccaatcgtcccggccttacagaagacacgaggggactccaggcctgctgaggccggagaagcagctgcaggcaagtctgagcgggattgtctgaagtgtaatacattcgccgagctccaggaacgcctcgattgcatcgatggcagcgaggagccctcgagtttcccctttgaagagttacccgcgcagttcgggcccgagcaagcatccagaggccccagactttctcaggcggcgggggcatctcctctgagtgagtcggataaagaagataatggctccgaagggcagttgaccaatagagagggtcccgagcttcctgcttccaagatgcagcgctcccattctccagtcccagccgcagcccctgcccattcacctagcccagctagcccacggtcagtgccgggaagcagcagtcagcattctgcatcacccctcgtccagtccccttccttacagtccagcagagagtccttgaattcttgcggtttcgtggagggtaaaccaagacctatgggaagcccacgtttgggaatcgcctctttgagcaaaacttctgagtataaacccccgtcgtcacctagccagagatgcaaggtttatacacagaaaggagtgttaccatccccggcacctctgccaccatcatccaaggattctggtgtagcctcccgtgagagcctgttacagccagaggtccggaccccacctgtgggtatgagccctcaggtgctgaaaaagtcgatgtcagccggatctgaaggtttccctgagacgcctgtggatgatgagcagcaggccgcaaccccgagtgagtctaagaaagagattctgagtaccacaatggtgaccgtccagcagccactggagttgaatggtgaagatgaactggtcttcaccctcgtggaagagctgacgatcagtggcgtgctagactcaggtcggccaacgtcaatcatctcttttaatagtgactgctctgctcgagcattggcgtctggttccagaccagtcagcattatttcaagtatcagtgaggatctggagtgttattctagcacagccccggtgtcagaagtttccattacacagtttttacctctgccaaagatgtccttggacgagaaggcccaggatgcaggaagccgacgcagcagcatttcatcctggctgagtgaaatgtccgccgggtccgagggcgagcagtcttgtcatagcttcatcgcccaaacctgttttggccatggggaggccatggccgaaccagttgccagtgagttcgttagctcacttcagaacaccgccgtggtgtgccgtgagaagcccaaggcgtcccctgataacctgttgatcctgtctgagatgggggacgactcattcaacaaggctgccccaattaagggttgcaaaatcagcacagtttctaaagccatggtcacgatctccaacacagccaatctcagcagttgcgaggggtacatacctatgaaaacaaatatcaccgtctatccttgtattgccatgagccccagaaacatccaagagcctgaggcacctactgccactccaaaggccgggccaacactagctcagtcacgggaaagtaaagagaattccgccaaaaaagaaatgaagttcgaggacccctggctgaaaagggaggaagaagtgaaaaaagaaacggctcacccaaatgaggaaggcatgatgcgatgtgagacagcgacaggaccgagcaacgcggaaacgagagctgaacaggaacaggacggcaaacctagtccaggagatcggctgtcctcttcttctggtgaggtttccgcttcccctgtcaccgataatttccgtagagtagtggacggatgtgaaatggctctgcctgggctcgccacacaaagtcctgtgcacccaaacaaaagtgtcaagagttctagcctgcctagggccttccagaaggcatcccggcaggaagaacctgacagcttgagctattattgcgcagctgaaacaaatggtgtcggcgcggctagtggaacccctccctctaaggcaactcttgaaggcaaagtggcttccccaaagcattgcgtcctcgccaggcctaagggtacgccccctctgcccccggtgagaaaaagttctttagatcagaaaaaccgagccagcccacagcatagtgcctccggtagcgggacaagcagcccgctgaaccaacccgcagctttccctgctggcctcccagatgagcctagtggcaagacaaaggatgcatcgtcctcatccaaactcttctccgccaagcttgagcagctggcctccaggtccaactccctcggccgggccactgtttctcactacgagtgtctgagcttggagcgcgctgaatccttgtcgtctgtttctagtcgactacatgccggaaaggatgggacaatgccccgcgccggacgctcactgggtaggtcagcaggcacctcccctcccagtagcggggcctcacctaaggcgggtcagagtaagatcagtgccgtgtcaagactcctgctggccagccctagggcccgagggcccagtgcctcaacaactaagaccctctctttctctacaaagagtctgcctcaggctgttggacagggctcttcctctccccctgggggcaagcatacgccttggagcacacagtccttgagccggaaccgcagctcaggcctggcttcaaaactccctttgcgggctgtgagcggccgaatttctgagttactgcagggcggcgctggggcaagaggcctgcagctgcgcgctggcccagaggctgaggcacgcggcggcgctcttgcggaggacgagccagcggcagctcatttgctgccatccccgtatagtaagattactcctccacgcaggccccacaggtgctcgagcggacatgggtccgataactcatctgtgttatctggcgagctcccaccggcaatgggcaagactgcacttttctatcactctggaggcagcagcggctatgaatccgtgatgcgggactctgaagctacaggctctgcaagctctgctcaagatagtacaagtgagaattcgtcttccgtcgggggcaggtgccggtcactcaaaacgcctaagaaaagaagtaaccctgggtcccaacggcggcggctcatcccagcgctgagccttgatacttctagtcctgtcaggaaacctccaaacagcacgggggttcgttgggtcgacggtcccctgagatcctcccctagaggtctgggagagcccttcgagataaaagtgtatgagattgacgatgtggagagattgcagagacggaggggcggagcctccaaggaggccatgtgcttcaacgccaaattaaaaatactggagcataggcagcagagaattgccgaggtgagggccaaatacgaatggctgatgaaggagttagaggcgactaagcagtatctgatgctggaccctaacaagtggctgtctgagttcgacctcgagcaggtgtgggaactcgattcactggagtacctggaggcactcgagtgcgtaacagagcgattggaatcccgcgttaatttttgcaaagcccatctgatgatgataacttgctttgacataacctccaggcgcaggtag

SEQ ID NO: 192461 - DNA, 6327 bp, Artificial Sequence
  Description of Artificial Sequence: Synthetic coding sequence
atgaacagcgtggccggcaacaaggagcggctggccgtgagcacccgcggcaaaaagtatggtgtgaatgaagtctgctcacctacaaagcctgcagcaccattctcaccagagagctggtacagaaaagcctacgaggaaagcagagccgggtcgcgcccaacaccagagggtgccggatccgctctcgggtcctccggtactcccagccccggctccgggacatcatctccctctagtttcaccggcagtccagggcccgcttcccccggaataggcacgtcttcccctggctctctgggaggctcgccaggcttcgggaccgggagccctggaagtgggagcggcggtggttcctctcctggctcagacaggggcgtttggtgcgagaactgtaatgctagactggtcgaactgaaacgtcaagcccttcgactgcttctgccgggcccctttccgggcaaggaccctgcgtttagcgcggtcatccatgataagcttcaggtacctaacacaattaggaaggcttggaacgaccgcgacaacaggtgcgatatctgtgccacacatcttaaccaactgaagcaagaagccatccaaatggtgctgacactggaacaagccgcggggagcgagcattacgatgctagtccttgttcacccccccctctgtcaaatatacccactctggttggcagtcgacacgtcggcggcctacaacaaccccgggactgggcattcgtgccggccccatgcgcaaccagcaactatactggctttgcgaacaaacacggctcgaaacccagctcactcggggtgtcaaatggagccgagaagaaatccgggagcccaacgcaccaggcaaaggtaagcctgcagatggccactagtccctctaatggtaacatcctgaacagcgttgccatccaggcacaccagtacctggacggcacatggtctctttcccgcaccaacggtgttaccctttacccctaccagatttcccagctgatgaccgagtcaagtcgagagggcctgacggaagcagtgttaaacaggtacaatgccgataaaccctcggcttgctccgtccccgcctcccagggcagctgcgttgcaagtgagacatcgacaggcacaagtgttgctgcttccttttttgctcgcgctgcccagaaactcaatcttagcagcaagaagaagaagcataggccgtctacatcaagtgccgccgagcccccattgttcgccacctctttcagtgggattctgcagacctcacccccccctgcccctccttgtctcctacgggccgtcaacaaagttaaggatactcctggcctgggtaaggttaaagtgatgctccgaatttgctccacactcgcccgggacacaagtgaatctagtagttttctgaaagtggacccccggaaaaaacaaatcacactgtacgatcctttaacatgtggcggccagaacgcattccagaagagaggaaatcaggttccacctaaaatgttcgcttttgatgcggtgtttccccaagacgcaagtcaggccgaagtttgcgccggtactgttgccgaagtaattcagtccgtggtgaacggggcagatggctgcgtcttctgttttggccacgcgaagttgggcaaatcctacacaatgattggcaaggacgactctatgcagaatttgggaattatcccttgcgctattagttggctcttcaagcttattaatgaacgaaaggagaagaccggtgctagattcagcgtacgcgtgtccgcagtcgaagtttggggtaaagaggagaatctgagagatctgctgtctgaagttgccaccggaagcttacaggatggacaaagccccggtgtctacctttgtgaggacccaatctgtggtactcagcttcagaatcaatccgaacttagggcaccaaccgccgaaaaagccgcattcttcttggatgcggctattgcttctcgacggagccatcagcaggactgcgacgaggacgaccaccggaactcgcacgtgtttttcacattgcacatttaccagtaccgtatggaaaagtccggcaaaggcggtatgtccggcggacggtctagattacaccttatcgatctgggcagttgtgtgaaggctctaagtaaaaaccgggaaggagggtcgggcctgtgcttatccctctctgcactgggcaacgtcattctggccttggtgaacgggtccaagcatattccctacaaggagtcaaagctggccatgctactcagagagtcccttggaaatatgaactgcagaaccactatgattgcgcacatatccgctgccgtggggtcttacgctgagacacttagtaccattcaaatcgccagtcgagtgctacgaatgaaaaaaaagaaaaccaaatacaccagctcttcgtcagggggtgagtcaagctgtgaagaggggcgcatgcgcaggcctacacagctgaggcctttccacacacgggccaccgtggatcccgacttccccatcgcccacctcagctcagacccagattattcctcatcttccgagcagtcttgtgataccgttatatacattggtccgaatgggaccgcattatcagacaaagaattaacagataacgagggtccccccgattttgtgcccattgtgcctgccctgcagaagacgcgaggagatagcagacccgctgaggccggggaagcagccgccgggaaaagcgaacgggattgtcttaagtgcaatacttttgcggagctacaagagagattggattgcattgacggttccgaagaaccctccagtttcccatttgaggagctccctgcccagttcggcccagagcaggcgagtcggggtcctcgtttatctcaggccgcaggggcctcccctctgtccgagagcgataaggaggataatgggtcagaaggccagctgacaaatcgggaaggtcccgagttgccagcctctaagatgcagcgaagtcactcccccgtacctgccgcagcacccgcccacagtccttctcccgcaagtcccagatctgttcctggcagttcaagccagcatagcgcatcacctctcgttcaaagcccctccctccagtcttcaagggagagcctgaatagttgtggttttgtggaggggaaacctagacctatggggtcccctaggctgggcatcgctagtctttccaaaacaagcgagtataagcccccttctagtcctagtcaacggtgcaaggtgtatacacaaaaaggtgttctgcctagtcccgctcctctgcccccaagttcaaaggactctggagttgcttctagggaaagccttctccagcctgaagtccgcacgccccctgtgggaatgtctccgcaggtactcaaaaagtccatgagcgctgggtctgaggggttccccgagactcccgtcgatgatgaacaacaggcagccacaccctcagagtcgaagaaggaaattctgtcaactaccatggtgaccgtgcagcagcccctcgagctcaacggtgaagacgaactggtttttactctggtggaggagctgactatctctggcgttctggactcaggacgccctacctctattatcagcttcaacagcgactgcagcgcccgcgcactggcctcaggcagccgtcccgtgtctataatttcaagcatttccgaagatctcgagtgttactccagcaccgctccagtgagcgaagtaagcattacccaattcctccccctgcctaagatgtccctcgacgagaaagctcaggatgccggaagcagaaggtcatcgattagtagttggctgtctgagatgagcgcgggctctgagggcgaacagtcctgccacagtttcatcgcccagacctgtttcggacatggggaggctatggccgagccagtggctagcgagtttgtcagttctctccaaaacacagccgtggtctgtagggagaagcccaaagcatcacccgataacctgctgattttgtccgagatgggggacgactcattcaataaggcagctcctatcaaggggtgtaaaattagtacggtgtctaaagccatggtgacaatttcaaatacggcgaacttaagttcgtgcgaaggctatatcccaatgaaaactaacatcaccgtctatccctgtatcgctatgagccccaggaacattcaggaacccgaggccccaacagccacacccaaggccggacccacattggctcagtctcgggagagtaaggagaactcagccaagaaagagatgaaatttgaagacccatggctcaagcgcgaggaggaagtgaaaaaggagaccgcccatcctaatgaggagggaatgatgagatgcgagacagcaaccggtccctctaatgcagaaaccagagccgagcaggaacaagacggtaagccctctccaggcgaccggttgtcgtcgtcctctggcgaggtaagcgcctccccggtcactgacaacttccgacgcgtggtggacggctgtgaaatggcgttgccaggcctggcaacgcagtccccagtgcaccccaataaaagtgtcaagtctagcagcctgccccgagctttccagaaagccagtcgccaggaagaaccagactcactgagttattattgcgccgctgaaaccaatggggtcggggcagcaagcggcactcccccctctaaagctacacttgagggaaaagtagcctcccctaagcattgcgtcttggcacgccccaaagggactcccccccttcctcccgtccgcaagagttcactggaccagaagaatcgtgcttctccacagcactcggcatcaggcagtgggacatcatcccccctgaatcagccggccgcttttcccgccggtctgccagatgaacccagcggtaagacaaaggatgcctcttcttcttctaagcttttttcagctaagctcgagcaactggcttcccggtccaattctctgggccgcgcaactgtgagtcactacgaatgtctttccctggagcgagcagaaagcctaagttctgtgagttccaggttgcacgccggcaaggatggcacaatgcccagggccggacggagcctgggacgcagtgcaggaaccagcccccctagttctggagcaagccctaaggcaggacagtccaagatttccgcagtttctagactgctgttggcatcgcctcgggccagaggacccagtgcatcaaccactaaaacacttagctttagtacaaaatcattgccacaggcggtcggtcaaggcagctcctcacctcccggcggtaagcataccccttggtctacccagagcctttctcgtaacaggtcaagcgggctggccagcaaactgcccctgcgagctgtaagcggccgaatatccgaactccttcaagggggggccggagcgcggggactgcaactgagggctggccccgaggccgaggcccgtgggggtgccttagccgaagatgagccagccgctgcccacttgctcccctcaccttattccaaaattacgcctcctaggaggccacatcggtgcagctctggtcacggatctgataactcaagcgtgctctcaggggagctgcctccggctatggggaagacagcacttttctaccacagtggtggcagttctggttatgagtccgtgatgcgcgactcagaggcaaccgggtccgcctcctccgcacaagatagcaccagcgaaaactcttcaagcgtgggtgggcggtgcagatcccttaagacccccaaaaagcggtcgaacccaggcagtcagagacgacggctgattcccgccttaagcctggacacaagtagcccagtaagaaaaccacctaatagcacgggggtgagatgggtggacgggcccttgagaagttcccctcggggattgggcgagccctttgaaattaaagtgtacgaaattgatgacgtagagcgcctgcaacgcaggcgtggtggcgcctctaaagaggccatgtgctttaatgccaagctgaagatcctagaacaccgacaacagaggatagcggaagtgagggctaagtacgagtggctgatgaaggagctagaggccaccaaacagtacctaatgcttgaccctaataagtggttaagcgagttcgacctagagcaggtctgggagttagattcactcgaatatctggaggctctggaatgcgtcacagaacgactagaatctcgcgttaatttttgcaaagcccatctaatgatgattacatgtttcgatataacatctcgccggcgctag

SEQ ID NO: 192462 - DNA, 5175 bp, Artificial Sequence
  Description of Artificial Sequence: Synthetic coding sequence
gactggaagaccaaggccgcccagaagctgaacctgagcagcaagaagaaaaaacatcggccctctacctcctccgccgccgagccacccctttttgccacctctttttcaggtatcctgcagacgagtccacctccggccccaccctgtttgctccgcgccgtgaataaagtgaaggatactccagggctggggaaggtaaaagtaatgcttagaatttgttcgaccctagcccgcgatacctcagagtcttccagctttctgaaagtagacccaagaaagaagcagattaccctgtacgatccattgacttgcggcggccagaacgcttttcagaagagaggcaatcaggtcccccccaaaatgtttgcctttgacgctgtcttccctcaggacgcttcccaggcggaagtctgcgccggtactgtggcggaagtgattcagtccgttgtgaatggcgccgacggctgcgtcttctgcttcggccacgcaaagttgggtaaatcctatacaatgatcgggaaagatgatagcatgcaaaaccttggcattatcccatgcgcaatttcgtggctgtttaagctcatcaatgagcgaaaagagaagacaggggcccggttctctgtgagagtgtctgccgtcgaggtttgggggaaggaggagaatttgcgtgacctgctgtccgaagtggcaacaggtagcctgcaggacggccagtcacctggcgtctacctgtgcgaggatccaatatgcggcacccagcttcagaaccagagtgaactgcgggctccgaccgccgaaaaggcagctttttttctggacgccgccatagcctccaggcggtcacaccagcaggactgtgacgaggacgatcataggaactcacacgtgttttttacactgcacatataccagtaccgcatggaaaagagcggcaagggggggatgtccgggggtaggagccggctacacttaatagatctggggtcctgtgtcaaggccttgagtaagaatagggaaggcggatcaggactctgcctcagcctgtctgcgttgggcaacgttatcctagcactagtgaacggctccaagcatatcccttacaaggagtctaagctggccatgctgcttagagagtcactggggaatatgaattgcagaaccaccatgatcgcccatatctccgcagccgtcggtagctacgctgagacactgagcacaattcagattgcttctagagtgctcaggatgaagaagaaaaagacgaagtatacgtcttctagttctggaggcgaatcttcctgtgaagaaggtcgcatgaggcggcccacccagctgagacccttccatacaagagctaccgtagaccctgactttcccatagcacatctctcaagtgacccagactactcttcatcgtctgagcagagctgcgacacggtaatatatattggcccaaacgggacggctctgtccgacaaagaactcacagacaatgaggggcctcctgacttcgttccaattgtgccagcccttcagaaaacacgcggtgacagccggcctgcagaagcgggtgaggccgccgccgggaagagtgaaagggactgccttaagtgtaataccttcgccgaacttcaggaacgcttagattgcatcgacggctccgaagagcctagctcttttcccttcgaagaactgcccgctcagtttgggcccgaacaggcgtcccggggaccccgcctttcccaggcggctggggcttcacctctgtctgagagcgataaagaggacaatggttccgaaggtcagctaacgaaccgcgagggccccgaactacctgcaagcaagatgcagcgtagtcacagccctgtgccagcagccgccccagcacacagcccgagtcccgccagcccacgctctgtgcctgggtcatcatctcagcacagtgcctcccctctagtccaatccccttccttacagtccagcagggagagtctgaactcttgcggttttgtggagggaaagcctcgcccgatggggagccccaggttggggattgctagtctgtcaaagaccagcgaatacaaacctccaagcagccctagccaaagatgcaaagtttatacgcagaagggagtgttaccttcaccggcaccactacctcccagcagcaaagattcgggggtcgcatctcgggaaagtttgttgcagccagaggtcaggactccaccagtggggatgtcgcctcaagtgcttaagaagtctatgagcgccgggagtgaggggtttccagaaacgcccgtggacgatgagcaacaggctgcaacaccatctgagtctaagaaagagatcctgtccaccacaatggtcactgtgcaacaaccccttgaactgaacggtgaggacgagcttgtgtttaccctcgttgaggaattaaccattagcggcgtcctcgacagtggtcgacctacctcaattatcagctttaacagtgactgttccgcgcgagcactcgcttcgggttccagacccgtgtcgataatctcaagcatctcagaggatttggagtgttatagctcgacagcacctgtttctgaggtgtcaataactcagtttcttccgctcccaaagatgagcctggatgaaaaggctcaagatgcagggtcccggcgatcctcgatctcaagttggctctctgagatgtcggcaggcagtgagggagagcagtcttgtcacagtttcattgcgcagacatgttttggacatggagaagctatggctgaaccggtggcctcagagttcgttagcagcttgcagaacacagccgtggtttgccgagagaaaccaaaggcttccccggataacctactcatcctgtctgaaatgggcgatgattcctttaacaaggccgccccaatcaagggatgtaagataagtaccgtcagtaaagcaatggtgactatttctaacacagcaaatctgtcatcctgtgaagggtacatccctatgaagacaaacatcactgtatacccatgcatagcgatgagccctagaaatatccaggagccagaggcgcctacagccactccgaaggcaggcccaaccctggcccagagcagagagtccaaggaaaacagcgctaaaaaagagatgaagtttgaggacccatggctgaaacgcgaggaggaagttaaaaaggagactgctcacccaaacgaagaaggcatgatgcggtgcgagacagcgacagggccctccaacgcagaaacgcgcgctgagcaggagcaggatggtaaaccttctccgggagaccgcctgtcgagcagtagcggagaagtttcagccagtcctgtgactgataacttccggagagttgtcgatgggtgtgaaatggccttaccaggactggcaactcagagtccagtccaccctaataaaagcgtgaagtcttccagcctcccaagagcctttcagaaggcctctagacaagaggaacctgatagtttgtcctattactgcgcggccgagaccaacggcgtcggggccgcttcaggcacacctccgtctaaggcaactctcgaaggcaaggtggccagccctaagcactgcgtgctggcacgccccaagggcacgccccctttaccccctgttagaaaatcatccttggatcagaaaaatcgagcttctcctcaacacagtgcctcaggctcaggaacatccagtcctcttaaccaacccgctgctttcccggccgggctccccgatgaaccctccggcaagaccaaggatgcctcaagctcatctaaattgttcagtgccaagctcgaacagttggcctcacggtcaaacagcctcggccgggccacagtgagtcattatgaatgtttaagcctggaacgcgcggagagcctgagctccgtatcatcccggctgcacgccggcaaggatggtaccatgccacgcgccggccggagcctgggacgatccgcaggtacgtcacccccctcctctggcgcatccccgaaagctggtcagtcaaaaatcagcgcagtttctcggttattgttggcctccccaagagcaagaggcccttcggcctctacaaccaaaaccttgtcattttcaactaagtctcttccgcaggccgtgggacagggctcatcatctcctcccggcggtaagcacacaccgtggtccacacagagtcttagtcggaataggtcatcaggcctggcctccaagctaccactgcgggccgtgtcgggcaggatttcagagctcctccaggggggcgctggtgcccgagggctccagctaagggcaggcccagaggccgaggcccgaggtggagccctggcggaggatgaaccagcagccgcacacctgctaccatctccttacagtaagattactccccctcgccgcccccatcgatgttcctctggccacggatcagacaattccagcgtgctcagcggggaactcccaccagccatgggaaaaacggcattgttctaccattccggagggagttcgggctatgagagcgttatgcgggacagcgaggccaccggtagcgcgagctctgcccaggattccaccagcgagaattctagtagcgttggtggtcgatgcagaagcctcaagacccccaaaaaaaggagcaacccaggttcacaaaggaggagactgatcccggccttatccctggatacgtcaagtccggttcgaaagcctcctaattccaccggagttagatgggtggatgggccgttaaggagtagtcccaggggcctgggggaaccctttgaaatcaaagtttatgagattgatgatgtggaacggttgcagagaagaaggggcggggcgtccaaagaggcgatgtgtttcaatgccaaattaaaaatcctggaacaccggcagcaacgcattgctgaggtgcgtgccaagtacgagtggctcatgaaagagctggaagccactaaacagtatcttatgctggatccaaacaagtggcttagcgagttcgatcttgaacaggtgtgggagctcgacagcctggagtatctggaggctctggaatgcgtaactgaacgcctcgagtctcgcgtgaatttctgcaaagcccacctgatgatgattacctgcttcgacatcacgtctcgcagacggtag

SEQ ID NO: 192463 - DNA, 2016 bp, Artificial Sequence
  Description of Artificial Sequence: Synthetic coding sequence
atgatcgacttcgacgacgtggccgccatcaaccccgagctgctgcagttactacccctgcatccaaaggacaacctccctctgcaggagaacgtcactatacaaaaacagaagcgccggtccgtaaactctaagattccagcgcccaaggagtcgttgcgcagcagaagcacccggatgagtactgtcagtgagcttcggatcacagctcaagaaaatgacatggaagtggagctcccagcggccgcaaattccaggaaacaattttcggtccctccggctccaacccggccgtcctgccctgcagtcgctgaaatacccctgagaatggtctctgaggaaatggaggagcaggttcactctattcgcgggtcatcctcagctaatcccgtcaacagcgtccgacggaagtcttgcctggtgaaggaggtcgaaaagatgaaaaacaaaagagaggagaaaaaggcccaaaattccgagatgcggatgaagcgggcccaagagtatgattcttccttccccaactgggagttcgcaaggatgattaaagagtttcgggccacactcgagtgtcatcccctcaccatgactgatcccattgaggagcaccgcatttgtgtatgcgtgcggaagaggccactgaataagcaggagctggcaaaaaaggagatcgacgtcatatccatcccatccaagtgcttgcttttagttcatgagccaaagctgaaggtggacctgaccaagtatcttgagaaccaggctttttgcttcgacttcgcctttgacgagacagcatctaatgaggtggtctaccgatttacggcaaggcccctcgtgcagacaattttcgaaggcgggaaggccacatgctttgcctatggccagaccggttcaggcaagacgcatactatgggcggtgatcttagcgggaaggctcagaatgcaagtaaaggcatatacgcaatggcgagcagagacgttttcctgctgaagaatcagccctgttacagaaaactcgggcttgaagtgtatgtgacctttttcgagatttataacgggaaactgttcgacctgctgaataagaaagcgaaactaagggtcctggaagacggcaagcaacaggttcaggtcgtaggactgcaggaacatcttgtcaattcagccgacgacgtcatcaaaatgattgacatgggatccgcatgccggacctcaggccagacatttgccaatagcaatagcagccgaagccacgcatgttttcagatcatccttagagcaaaagggcgaatgcatggaaagttctctctggtcgaccttgccgggaacgagcgcggcgccgacactagtagcgctgataggcagaccagaatggagggtgccgaaatcaacaaaagtctgttggccctcaaggagtgtatccgtgctcttggacagaacaaagcacacacgccatttagggaatccaaacttacccaggtactcagagactctttcattggcgaaaacagcaggacttgtatgatcgcaacaatttcgcccgggattagctcctgcgaatacaccctgaacacacttcgctacgccgatcgagtgaaggaattgagccctcacagtggcccatctggtgagcaactcatccagatggagaccgaggagatggaggcctgctcaaacggggcgttgatcccaggaaacttatctaaggaggaggaggagctctccagccaaatgtcaagctttaacgaggcaatgacccagatccgcgaactcgaggaaaaagctatggaggagctgaaagaaattatccagcaggggcctgactggctggaactatcagaaatgactgagcagccagattacgacctggagactttcgtgaacaaagcggagagtgccctggcacagcaggccaaacacttctccgcactgagagatgtcatcaaggccctcagactcgcaatgcaactcgaagagcaggcctcacgacagatcagctccaagaaacgcccacagtag

SEQ ID NO: 192464 - DNA, 2055 bp, Artificial Sequence
  Description of Artificial Sequence: Synthetic coding sequence
atggccatggacagcagcctgcaggcccggctgttccccggcctggctataaaaattcagcggtccaacgggttgattcacagcgcgaacgtaaggactgttaatctcgagaagagctgcgtgtctgttgagtgggccgagggcggggccacaaagggcaaagaaatagactttgacgatgtagcagcaatcaaccccgaattactccaactgctcccgctacacccaaaggacaacctgcctctccaggagaacgttaccatccagaagcagaaacgcaggagcgtgaactctaagattcccgcccccaaggaatcacttcgctctcgtagcacaagaatgtctaccgttagcgagctgcggattaccgcccaggagaacgatatggaggtggagctgccagccgctgcaaattcccggaaacagttttcagtgccactcaggcggaagagctgcctggttaaagaagtggaaaaaatgaagaataagagggaggagaagaaggctcagaactcggagatgcggatgaagcgcgcccaagaatacgactcctcctttccaaattgggaatttgctagaatgatcaaagaattccgtgctaccctggaatgccacccactgacgatgacggatccaattgaagagcataggatatgcgtatgtgtacgaaagaggccactgaacaaacaagaactggccaaaaaagaaatagatgtgatcagcattccctcgaaatgcctgttactggtgcatgagcctaaactgaaagtggacctcacgaaatacctggagaaccaggcattctgcttcgattttgcattcgatgagaccgccagcaatgaggtggtgtacagattcaccgcccggcctcttgtacagacaatatttgaaggaggcaaggccacctgcttcgcctacggacagacaggtagtgggaagacacataccatgggaggggacctctctggtaaagctcaaaacgcaagcaagggcatttatgcaatggccagccgcgacgtgttcctcctaaagaaccaaccctgctacagaaagcttggactggaggtatacgtgacgtttttcgaaatttataacggaaagctgttcgacctcctgaacaagaaggccaaactgagggtgttggaagatgggaaacaacaggtacaggtggtgggtctccaggagcacctggtgaacagtgccgatgacgtgataaagatgattgacatggggagcgcttgtagaacttctggccagacctttgccaactctaacagcagcaggagccacgcctgttttcagattatcttgcgcgccaaagggaggatgcatggcaaattttctcttgtcgacctggccgggaacgaacgtggcgcggacaccagctctgccgacaggcagactagaatggagggcgcagagatcaacaagtccctgttggcgttgaaggaatgcattcgggctctgggtcagaacaaagctcacacccccttccgcgagtctaaactgacccaagtcctgagagattccttcattggcgagaattcgagaacctgcatgattgccactatcagccctggcatctcatcatgcgagtacactctgaatacgttaaggtacgcagacagagttaaggaactctcaccgcacagcggaccctcaggcgagcagttaatccaaatggagaccgaagagatggaagcctgttctaacggggctttaataccagggaacctgtccaaagaggaggaggagctgagcagtcagatgtcatccttcaacgaagctatgacacagataagagaactggaggaaaaggcaatggaggagctcaaggagatcattcagcagggccctgattggctcgagttgtctgaaatgactgaacagcctgactatgatttggaaaccttcgtcaataaagctgagtccgcattggcccagcaggcaaagcacttctcagccttgcgtgatgtgatcaaggccctaaggctggccatgcagctggaggagcaggctagcaggcagatttcaagcaagaagcgccctcagtag

SEQ ID NO: 192465 - DNA, 1839 bp, Artificial Sequence
  Description of Artificial Sequence: Synthetic coding sequence
atgagcaccgtgagcgagctgcggatcaccgcccaggagaacgacatggaggtagaactccccgccgcagcaaactcccggaaacaattcagtgtccccccagccccaactagaccctcttgcccagctgtagccgagataccccttcggatggtctctgaggagatggaggaacaagtgcacagcatccgcgggtcctcgagtgctaatcctgtaaacagtgtgagacgtaagtcttgcctggtgaaggaggtggaaaaaatgaagaacaagagggaggaaaagaaggcacaaaacagcgagatgcgcatgaaaagggcgcaggaatacgactctagttttccaaactgggaattcgctagaatgataaaagaatttcgggcaactctggagtgtcaccccctgacaatgactgatccaatcgaggagcacaggatctgcgtttgcgtgcgcaagcgaccgctgaataagcaggaactcgctaagaaagaaattgacgtcatatcaataccttctaagtgcctgttactggtccacgaaccaaaacttaaggtcgacctgacgaaatacctcgaaaatcaggctttctgtttcgatttcgccttcgatgaaactgcctcaaacgaagtagtgtaccgctttaccgcaaggcctctggtgcagactatcttcgagggggggaaggccacgtgttttgcatatggccaaaccgggtccgggaagactcataccatgggtggcgatctgtccgggaaggctcaaaatgcctcaaagggaatctatgccatggcaagtcgcgacgtcttcctgttaaagaaccaaccctgctacaggaagctcggcctcgaggtgtatgtaacttttttcgagatctacaatggcaaattgtttgacttgctgaacaagaaggccaagctccgggtcctggaagatggaaaacagcaggttcaggtggtgggcctccaagaacacctcgtgaattctgccgatgatgtgatcaagatgatcgacatggggtccgcctgtcggacatcaggccaaaccttcgcaaacagcaactcaagcaggagccacgcatgctttcaaattatcctgcgtgctaaagggcgtatgcacggaaagttttcattagtggatctcgcgggtaatgaacgtggcgctgataccagcagcgccgatcggcagaccagaatggagggcgcagaaataaataagagcttactcgcgcttaaggagtgtataagggctctgggtcagaacaaggctcacacgcctttccgggaaagcaagctgacgcaggtgttaagggacagttttatcggcgagaactcccgcacttgcatgattgccacaattagcccaggcattagctcttgtgaatacaccctcaataccctcagatatgcagatcgtgtgaaggagcttagccctcactctggcccctccggtgagcagctcatccagatggaaactgaagagatggaagcctgcagtaacggagcactgatacctggcaatcttagtaaggaggaggaagagctgtcttcccagatgtcatctttcaatgaggccatgacccagatcagagagcttgaagaaaaagccatggaagaacttaaggagatcattcagcagggtcccgattggctggagctgagtgagatgacggaacaacccgattacgacctggaaacgtttgtcaacaaagctgagagtgcattggcccagcaggctaagcactttagtgccttgcgagacgttatcaaggccctgcggttggctatgcagctagaagagcaggcctcgcgccagattagctccaaaaaacgcccacaatag

SEQ ID NO: 192466 - DNA, 2178 bp, Artificial Sequence
  Description of Artificial Sequence: Synthetic coding sequence
atggccatggacagcagcctgcaggcccggctgttccccggcctggctatcaagattcagagaagcaacggcctaattcactccgcaaacgtgaggacagtgaatctggaaaaatcatgcgtcagcgtggagtgggccgaagggggagccacaaaggggaaggagatcgacttcgatgacgtagccgcgatcaatcctgaattgctccagctgctgcctctccaccccaaagacaaccttccattgcaggaaaacgtgaccatacagaagcagaagagaagatcagtcaattctaagatcccggccccaaaagaatcactgaggtcgcgctccactcggatgtcaactgtgagtgagctccgcataaccgcccaagaaaatgatatggaagtcgagctgccggcggccgccaactccaggaagcaattcagtgtacctcctgcgccaacacggccatcctgtcccgccgtagcagaaatccctttgcgcatggtgtctgaggagatggaagaacaggtccatagtatccggggttctagttcagctaacccggtgaattctgtgagacgcaagagctgtctggtcaaagaagtagagaagatgaagaataagagagaggaaaaaaaggcacagaattccgagatgaggatgaaaagagcccaggagtacgattcctcattccctaactgggaattcgcgcgaatgataaaggaatttcgcgcaacactggagtgtcatcccctgacaatgaccgacccgattgaggagcatagaatctgcgtgtgtgttcgaaaacgccccctgaataaacaggagctcgccaagaaggaaattgacgtaatttcaatcccttccaaatgcctgctgcttgtgcacgaacccaagctaaaggtggacttaactaagtacctggagaatcaagcattttgctttgactttgcatttgacgagaccgcatccaacgaagtggtttacaggtttaccgcccgcccccttgttcaaacaatctttgagggcggcaaggccacctgttttgcatatggtcagacagggtccggcaagacacataccatgggtggcgatctgagtggaaaggcccaaaatgccagtaaaggaatatacgccatggcctccagagacgtatttctgcttaagaatcagccctgctaccgaaagctcggccttgaagtctacgttaccttctttgaaatctacaatggaaaactcttcgacttgctcaataagaaagccaagctcagagtccttgaggacgggaaacagcaggtccaggtggtcggactgcaagagcatttagttaacagtgccgatgatgtcattaagatgattgatatgggtagcgcttgtagaacaagtgggcagacattcgctaacagcaattccagccgttcacacgcctgcttccagataatacttcgagccaaaggacgcatgcacggtaaattctctctggttgatttggccgggaatgaaaggggcgccgacacctcatctgcagatcgccagacacgcatggagggagccgagattaataagtccctcctggcactgaaggagtgcattcgcgcactcggacaaaataaggcacacacgcccttcagagaaagcaagctgactcaggtactgcgagattcatttatcggggagaatagccggacttgcatgattgcaacaatctcgcctggaatcagcagctgtgaatataccctcaatactcttagatacgcagatagggttaaggaactatctccccattccggaccctcgggggaacaactcattcagatggaaaccgaagagatggaagcctgtagtaacggcgccttaatcccaggcaatctttccaaggaggaagaagaactgagttcccagatgtcttccttcaatgaggctatgactcaaattcgtgaacttgaagaaaaagccatggaagaactgaaggagattatacaacagggtcccgactggctcgagctgtccgaaatgaccgaacagccagattacgatttagagacattcgtaaataaagcagaatctgccctggctcagcaagcaaagcacttcagtgctttgagggatgtgattaaagccctgcgactcgctatgcagcttgaggagcaagcatcaagacaaatatctagcaagaaacggcctcagtag

SEQ ID NO: 192467 - DNA, 324 bp, Artificial Sequence
  Description of Artificial Sequence: Synthetic coding sequence
tgaaaggagtgcatccgggccctgggccagaacaaggcccacacccccttccgggagtctaaactgacacaggtgttgagggactccttcattggcgaaaatagccgtacctgcatgattgccacgattagcccaggcatctcttcatgtgagtacaccctgaataccctgagatacgccgacagacagggttgccattccatccccttagagccacaggccagtaaacctgggcggtgccacatacctcttttgtccaaggaggaagaggagttgtcatcacagatgagttcctttaacgaagcaatgacgcagatcagatag

SEQ ID NO: 192468 - DNA, 1011 bp, Artificial Sequence
  Description of Artificial Sequence: Synthetic coding sequence
atggccatggacagcagcctgcaggcccggctgttccccggcctggccatcaaaattcagaggtcaaatggcctgattcactccgcaaatgtgaggacagtgaatcttgaaaagtcctgcgtgagtgtggagtgggcagaaggtggcgcaacaaagggaaaagagatcgacttcgacgatgtagctgccattaaccccgaactgctccagctgctgcccctgcatccgaaggataatctgcctctccaggagaatgttaccatacagaaacaaaaaaggcgaagtgttaacagtaagattcccgcgccaaaagaaagtctgcggagcaggtccactagaatgtccactgtcagcgaactccgaattacagcccaggagaacgacatggaggtggagctgccagccgcagcaaactccaggaaacaattttcagttcctttacgaaggaagtcctgcttggtaaaagaagtggaaaaaatgaagaataagcgtgaggaaaagaaagctcagaactcagaaatgagaatgaaacgagcccaagagtacgattcaagcttccccaattgggagtttgcgcggatgataaaggagttcagggctaccttagagtgccatccactcacaatgactgatcctatagaagagcacagaatttgtgtctgcgtgagaaagagaccccttaacaagcaagaactggcgaaaaaggaaatcgacgtgatttcaataccaagtaagtgtcttctgttggtgcatgaacccaagctgaaggttgaccttacaaaatatctagagaatcaggccttttgctttgacttcgcctttgacgaaacagctagcaatgaggttgtctaccgtttcaccgcccggccccttgtgcagacgatctttgaaggtggaaaagcaacgtgttttgcctacggccagactggcagcgggaaaacgcatacaatgggcggagatctttccggaaaggcccagaatgcgagtaagggtatctacgcaatggcttag

SEQ ID NO: 192469 - DNA, 864 bp, Artificial Sequence
  Description of Artificial Sequence: Synthetic coding sequence
atggtgcggagcggcgtgccccggagccggggcctggtgagcggcctcattcattccgccaacgtaaggaccgtgaatttggagaagtcttgtgtgagtgtggagtgggccgaaggcggcgctaccaaggggaaggagatcgatttcgacgacgtggccgcaataaaccccgagctgcttcagttacttccactgcacccaaaagacaatttacctttgcaggagaatgtcacaatccagaaacaaaaaagacggtccgtcaacagtaagatcccagcacctaaggagagtcttcggtccaggtctacacgtatgtcaaccgtcagcgaactcaggattacagcgcaggagaatgacatggaagttgagctgccagccgccgccaactcacggaaacagttctccgtacctcccgctcccactcggccttcctgccctgccgtcgccgaaatcccactgaggatggtgtccgaagaaatggaggaacaggttcattccatcagaggcagctccagcgccaacccagtgaactctgtgagaaggaagtcctgcctggtgaaagaggtggagaagatgaagaataagcgagaagaaaagaaggcgcaaaactctgaaatgcgcatgaaaagggctcaggaatacgattcaagttttcccaactgggagttcgctcggatgattaaggaatttcgcgcgaccctggaatgccaccctctgacaatgaccgaccctatagaggaacaccgaatctgcgtctgcgtgagaaaacggcccctaaacaagcaggagctggccaaaaaggaaatcgatgtaatctctattccctcaaagtgtcttctgctggtgcacgaacccaagctctag

SEQ ID NO: 192470 - DNA, 2244 bp, Artificial Sequence
  Description of Artificial Sequence: Synthetic coding sequence
atgagcaagctgaagagcagcgagagcgtgcgggtggtggtgcggtgcaggccgatgaatggtaaagagaaggccgccagctacgacaaggttgtggatgtggacgtgaagttgggccaggtttccgtgaaaaatccaaagggcacggcccacgagatgccgaaaactttcacttttgacgcggtttatgattggaatgcaaaacagtttgaactctatgacgaaacgtttaggcctcttgtggactctgttctacaagggttcaacgggactatttttgcctatggccagacaggtaccggcaagacctataccatggagggaatccgcggtgaccccgagaaacgaggggtgatccccaactcctttgatcatatctttacacatattagccgatcccagaaccagcagtatctggtgcgggcgtcctatctcgagatttaccaggaggagattagggacctcctatctaaagatcagaccaaaaggcttgagttaaaggaacggcctgacacgggggtctatgttaaggacttgagctctttcgtgaccaagagtgtaaaagagattgaacatgtcatgaacgtgggtaaccagaaccgtagcgtcggtgctaccaatatgaatgagcattcgtctagatctcatgctatattcgtgataacgatagagtgcagcgaggtgggactggatggagaaaaccatattcgagttgggaagctgaacctcgtggatttggctggttcagaacgacaggcaaagacgggcgcccagggagagaggctcaaggaggccactaaaattaacctgtcattatctgctctgggcaacgtgatttccgcccttgtggacgggaaaagcacacacatcccttaccgggattctaagttgactcgcctgctccaagacagcctcggagggaacgccaaaacagtgatggtggctaacgtaggccctgcgtcatacaatgtggaggaaacacttaccacccttcggtacgctaaccgagccaaaaatattaagaacaagcctcgtgtaaacgaggatcctaaagacgcattgctgcgcgagttccaggaagaaattgccaggctgaaggcccagctggaaaaacgctctatcggacgtagaaaacggcgagagaaacgccgggagggtggaggatctggcggcggaggcgaggaagaagaagaagagggtgaggagggggaggaggaaggcgacgacaaagacgactattggagggagcaacaagagaagcttgagatagagaaacgcgccattgtggaagatcatagccttgtggccgaggaaaagatgcgcttgctaaaagagaaggagaagaagatggaggatctacggcgggagaaagacgcagcagaaatgctgggcgccaaaattaaggctatggagtcaaagctcttggtgggaggcaaaaatattgtggaccatactaacgagcagcagaaaatcttggagcagaaacggcaggagatcgccgagcagaaacgacgcgaaagggaaattcagcagcagatggaatctcgggacgaagaaacgttggagctgaaggagacttacagttcgctgcaacaggaggtggacataaagactaaaaaactgaagaaactcttttcaaaactgcaggccgtcaaggccgaaatccatgatctgcaggaggagcacattaaggagaggcaggaactggagcaaacccagaatgagctgacacgggagttaaagcttaagcacctcatcattgagaattttattcctctggaagaaaaatccaaaatcatgaacagggccttttttgacgaggaggaagatcactggaagctgcacccaatcaccaggcttgagaaccagcaaatgatgaaacgccctgtatctgcggtcggatacaagcggccactgtcccagcatgcaaggatgtctatgatgatccgccccgaagccagatatagggcagagaatatcgtcttgttggaactggacatgccgagccgcactacccgggattacgagggccctgccattgcccctaaagtgcaggctgctctggacgctgccctgcaggacgaagatgaaattcaagtggatgcctcctctttcgagagtacagcaaataaaaaaagcaaagctcgcccaaagagcggtcgcaaatccggatcatcgagcagctcatccggcacacctgcatcacaattgtacccacagagtcggggcctggttcctaagtag

SEQ ID NO: 192471 - DNA, 1122 bp, Artificial Sequence
  Description of Artificial Sequence: Synthetic coding sequence
atggtggccaacgtgggccccgccagctacaacgtggaggagaccttgactactctcaggtatgctaatagggccaagaatataaaaaataaacccagagtgaacgaggatccaaaagatgcattgctcagggagttccaggaagagatcgcacggctgaaagcacagctagaaaaacgctccattgaagaaaaaatgcgcctgcttaaagaaaaagagaagaaaatggaggacttgcgcagagagaaggacgccgctgaaatgcttggggcaaaaatcaaggctatggagtctaagttgctggtgggcggaaagaatattgtggaccacaccaatgaacagcaaaagatccttgaacagaagcggcaagagattgccgagcagaagaggagagagcgggaaatccagcagcaaatggaatctcgggacgaggagacgctggaactgaaagaaacatacagttccctccaacaggaagtcgatataaagaccaaaaagttaaagaagttgttttctaaactccaggcagtgaaagcagagattcatgaccttcaggaagagcatattaaggagcggcaggaattagaacagacacagaatgaattgacccgcgagttaaagctgaaacatctcatcatcgagaattttattccactcgaggagaagtccaaaataatgaatagggcctttttcgacgaggaagaagatcactggaagttgcatcccatcacgcgactggagaatcagcaaatgatgaagaggcctgttagcgccgtgggatataaaaggcctctgtcacagcacgcccgtatgagtatgatgatcaggccagaagcaagatatagggccgaaaatatcgtgctgctggagctggatatgccatctcgcaccacacgggactatgagggcccagctatcgctccaaaggtccaggccgctctagacgccgccttgcaggatgaggatgaaatccaggtagacgctagttcgtttgagagcaccgctaacaaaaaaagtaaggcacgcccaaaaagcggacggaagagtggaagctccagcagctcgtccggcacccccgcatcgcagctctacccccaaagtcggggattggtcccaaagtag

SEQ ID NO: 192472 - DNA, 2382 bp, Artificial Sequence
  Description of Artificial Sequence: Synthetic coding sequence
atggccagcaagaccaaggccagcgaggccctgaaggtggtggcccggtgtagacccctgtctaggaaagaggaagctgccggtcatgagcagatccttaccatggacgtcaagttaggccaggtgaccctgcggaacccgagggctgcaccgggtgagttacctaaaacattcacctttgacgcggtgtatgacgcatcctccaaacaggcagatttgtatgatgaaaccgtgcgaccacttatcgatagcgtccttcaggggtttaatgggactgttttcgcatatggacaaactggaacagggaagacttataccatgcagggtacatgggttgagccggaacttcgaggggtgattcccaacgcgtttgagcatatcttcacgcatatctcccggtcacagaaccagcagtacctggtgcgtgcttcctatctagaaatctaccaggaggagatccgggatctgctctcaaaagagccaggaaagcggctcgagctgaaagagaacccagaaaccggagtgtatattaaggacctctcttctttcgtaaccaagaatgtgaaagaaattgagcacgtgatgaaccttggcaaccagacaagggccgtgggctctacccacatgaatgaagtttccagccggtcgcatgctatcttcatcattacagttgaatgctctgagcggggcagcgacggacaagaccacatccgcgtagggaaactgaacctggtcgacctggctggttctgaaaggcaaaataaagccgggcctaacacggcaggaggcgccgctaccccatcatccgggggcggtggtggaggcggtggaagcggtgggggcgccgggggcgagagaccgaaggaggctagcaagattaaccttagcctcagtgctctgggtaatgttattgctgccttggccggtaatcggtccacacacattccttatagggatagcaagttgacccggctgctgcaggattccctcggtgggaatgcaaagaccatcatggtggccactctgggaccagcttctcattcctatgacgagtccttgagcactcttcgcttcgccaatcgagccaagaacatcaagaacaaacctcaggtgaacgaagatcccaaggatactctgctcagagagttccaggaggaaattgcccgcttaaaggctcagctcgagaaaagagggatgttgggaaagcggccacggcggaaaagcagcaggcgaaagaaggcagtgagcgcgccacccgggtatccagaaggccccgtcattgaggcgtgggttgcggaagaagaagacgataacaacaataaccaccggcccccacagccaatccttgaaagtgcgctggagaaaaacatggagaactacctgcaggaacagaaagagagactggaggaggaaaaggctgctattcaggacgatcgatctctggtgtcggaggagaaacagaaattacttgaggaaaaggaaaagatgctggaagatcttaggcgggagcagcaagccaccgaactgttggcagccaagtataaagccatggagtctaagctactgattggggggaggaacatcatggaccatacaaacgagcagcagaagatgctggaattgaagcggcaggagattgcggagcagaagagacgggagagagagatgcaacaggagatgatgctgagagatgaggagactatggaactcaggggcacctacacttccctacagcaggaagtggaggtaaaaactaaaaagctgaaaaaactgtatgccaaactgcaggccgtcaaggctgaaatccaggaccagcatgatgaatatatcagggtccgccaggacctggaagaagcccagaacgagcaaacaagggagctcaaattgaagtacctaattatcgagaattttatccctccagaggaaaagaataaaatcatgaaccgactgtttctggactgcgaggaagagcagtggaagttccagcctctcgttccagccggagttagtagcagccagatgaagaaacgccctacatccgctgtgggatacaagagaccaatctcacagtacgctcgcgtggcgatggctatgggatcgcatccacgctatcgcgcagagaatatcatgttcctggagctggacgtcagcccccctgcggtttttgagatggagttcagtcatgatcaggagcaagatcctcgagccctgcacatggaacgcctgatgcgtttggattcattcctagagcggccctctacctccaaagtgagaaagtcacgcagctggtgccaaagtccacagagaccgcctccctctacaacccacgcttcccttgctagtgcatccttgagaccagccacggttgccgaccatgagtag

SEQ ID NO: 192473 - DNA, 2382 bp, Artificial Sequence
  Description of Artificial Sequence: Synthetic coding sequence
atggccagcaagaccaaggccagcgaggccctgaaggtggtggcccggtgtcgccccctgtctcggaaggaagaagcggcaggtcacgaacagattttaacaatggacgtgaaactgggacaggttaccctgcggaaccctcgcgcggcacctggtgagttacccaaaaccttcacttttgatgccgtgtacgatgctagtagcaagcaggcagatctctacgatgagacggtgaggcctttaattgacagtgtgctgcagggtttcaatgggacagtgtttgcttatggacagacaggaactggaaagacatatacaatgcagggaacctgggtcgagcccgagctgaggggtgttattcctaacgcttttgaacatatttttacacatatctcacggtcccagaaccagcagtatctggtgcgcgcatcttatctggaaatataccaggaagaaatcagggaccttctttcaaaagagcccggaaaaagacttgagttgaaggaaaaccctgagaccggcgtgtatattaaagacttaagttcctttgtgactaaaaatgtgaaggagatcgaacatgtcatgaaccttggtaatcagacgagagccgtgggttctacgcacatgaacgaagtcagttcaagatcacatgcgattttcataatcacagtggaatgcagcgaacgagggtcagatggccaggaccacatcagagtgggaaagctgaacctcgtggatctggcgggcagtgaacgccagaataaagccggtcccaacacggccggaggggccgccactcccagctctggcggcggcgggggcggcggaggaagtggaggcggagcaggaggagagagacccaaagaagcctctaagatcaacctgagcctttccgcattaggaaacgtgatcgccgcactggcggggaaccggagcacccatattccctatcgcgattctaagctcacccgtctcctccaggacagcctgggcggcaatgccaagactatcatggttgccactttaggcccagcctcacattcctatgacgaatccctttctaccctccgcttcgctaatagagctaaaaacattaagaacaagccacaagtcaatgaggatccaaaggacaccctactgagggagtttcaggaagagatcgctcgactgaaagctcaactggagaaacggggaatgctgggaaaaaggcctcggaggaagagcagcagacgcaagaaagctgtgagcgctcctccagggtatccagaagggcccgttatcgaagcctgggtggcggaggaagaagacgacaataacaacaatcaccggcccccacagccaatcttggagtccgccttagaaaagaacatggaaaactacctgcaagagcagaaggaacgcctggaagaggaaaaagcggccattcaagacgacaggtccctggtgagcgaagagaaacagaagcttctggaggaaaaggaaaagatgcttgaagacttacggagagaacagcaggccacggagctgcttgctgcgaagtacaaggccatggagtcaaaactcttgataggtggtcgcaacattatggatcacactaacgagcaacagaagatgcttgagcttaaaaggcaggagatcgccgagcagaagaggcgcgaacgagaaatgcagcaagagatgatgctacgggatgaggagacaatggagctcagggggacgtacacctccttacaacaggaggtcgaagtgaagaccaagaagttaaaaaaactctatgctaagctgcaggccgttaaagccgaaatccaagaccaacatgatgagtacatacgagtgcgccaggacctcgaggaagcccagaacgaacagacacgcgagctgaaattaaagtacctgatcattgaaaatttcattcctccggaagaaaagaataagattatgaaccggctgtttctggactgtgaagaggagcagtggaagtttcaacctctggtgcctgcaggtgtaagcagcagtcagatgaagaaaaggccaactagcgcggtaggatacaaaaggcctatcagccagtacgcgagagtggcaatggcaatgggctctcatccgcgctatcgggcagagaacattatgttcctcgaactcgatgtgtcccctccagccgtctttgagatggagtttagccatgatcaggaacaggatccacgggccctgcacatggagagattaatgaggcttgatagttttctggagcgtccatccacatcaaaagtgcgcaagagtagaagctggtgccagtcacctcaacggccacctcccagcaccacgcacgctagtcttgctagcgccagcctccgcccggctacagtagccgatcatgagtag

SEQ ID NO: 192474 - DNA, 1800 bp, Artificial Sequence
  Description of Artificial Sequence: Synthetic coding sequence
atgaacctgggcaaccagacccgggccgtgggcagcacccacatgaacgaagtttcctctcggtcgcacgccatctttataataacagttgagtgttccgagcgtggctccgatgggcaggaccacattcgcgtggggaagctgaacttggtggatctggccgggtccgagaggcagaacaaagctgggccaaacactgctggtggtgccgctacccccagtagcggaggaggtggaggcggcggcggttccggtggcggcgcgggtggtgaaagacctaaggaggcttctaaaattaacttgagcctcagcgccctgggcaatgttatagccgcccttgccgggaacagatcaacccatattccctacagggactccaagttgactagactgctccaagatagccttggcgggaatgccaaaaccataatggtggctacacttgggccagctagccactcatatgatgaaagcttatctaccctgagattcgcgaatagagccaaaaacattaaaaacaagccccaagtcaatgaggatcctaaagatactctgcttcgtgagttccaggaggagatcgcacgcctcaaggcacagctcgaaaagagaggcatgttgggaaaacgccctcgccgcaaatcctcccggagaaagaaggcagtctccgctcctcccgggtatcctgaaggtccggtgatagaggcatgggtcgccgaggaggaggatgacaataataacaatcaccgcccaccccaacctatactcgaaagcgccctggagaagaatatggaaaactacctccaggaacagaaagagcggctggaggaggaaaaagcagccatccaggatgaccgttctctggttagtgaggaaaagcaaaagttattagaagaaaaagagaaaatgctggaggatctgagaagggaacagcaggcgaccgagttactggcggccaaatacaaagccatggagtcaaaactccttatcggaggaagaaacatcatggaccatacgaacgaacagcaaaagatgcttgaattgaaaagacaggagatcgccgaacagaagagaagggaaagggagatgcagcaagaaatgatgctgagggatgaggagactatggaacttaggggcacatacacaagtttgcaacaagaagttgaggtcaagacaaagaagctgaaaaaactatatgctaaacttcaggcggtgaaggctgaaatacaggaccagcatgacgaatacataagagtcagacaggatctcgaggaggcccagaacgaacagacgagagaactaaaattaaagtacctcatcatcgagaacttcattcccccggaggaaaagaataagatcatgaatcgactttttttggactgtgaggaagaacagtggaaatttcagccactggtccctgccggcgttagtagttcccagatgaagaagcgacctacatcagcagttggatataaaagacctatcagccagtacgcaagagtggcaatggctatggggtcccacccccgatatcgcgccgagaatataatgttcctggaattggacgtgtcccccccagcagtgttcgaaatggagttttcacacgaccaagaacaggatccccgtgccctgcatatggagagacttatgcggcttgattcctttcttgagcggccttcgacttctaaggtgcgcaaatctcggtcctggtgccaatctcctcaacgcccccctccatcgactactcatgcttcattggctagcgcatccctccgccctgccactgtggccgaccacgagtag

SEQ ID NO: 192475 - DNA, 3384 bp, Artificial Sequence
  Description of Artificial Sequence: Synthetic coding sequence
atgaaggaggaggtgaagggcatccccgtgcgggtggccctgcggtgtcgccccctggtgcctaaagagatcagcgagggctgccagatgtgtctgagtttcgtaccgggcgaaccccaagttgttgtgggaactgacaaaagtttcacttacgacttcgtgttcgatcccagcacggaacaggaggaagtgtttaacactgctgtagcaccactgatcaaaggtgtctttaagggatacaatgcaaccgtactagcctatggacaaacaggctccgggaaaacttattcgatgggtggagcctataccgcagagcaggaaaacgagcccactgtcggagtgatcccccgggtcatccaactgctcttcaaagaaatcgacaagaaaagcgacttcgagtttacactcaaagtttcttatctggagatctataacgaagagattctcgacctgctctgcccgagcagagaaaaggcccaaattaacatccgggaggatccaaaagagggtatcaagattgtgggtttaacagaaaagaccgtgctggttgccctggataccgtgagttgcctcgagcaaggcaataactctcgaactgtggcctcgacagcaatgaactcacagtcctccagatctcacgccattttcacaatcagcctagagcagcgaaagaagtcagataagaattcatcatttaggtcaaaactccacctagtcgacctggccggatcagagaggcagaaaaaaaccaaggccgaaggtgatagactaaaagaaggcattaacataaatagaggactcctttgtctgggaaacgttatcagtgccctcggagatgataaaaaagggggatttgtgccctaccgggacagtaagctcaccaggctgctccaggacagcctagggggtaattcacatactctgatgatcgcatgcgtgtcacctgccgattctaaccttgaagagacattaaatactctcagatatgctgacagggcgagaaagataaagaacaagccaatcgtgaacattgaccctcagaccgctgaacttaatcacttgaaacagcaagtgcagcagctgcaagtactcctgcttcaagcacatggtggaactctgccaggatccattaccgtcgaaccatcagaaaatctgcaaagcttgatggaaaagaatcagtccttagtggaagaaaatgaaaaactgagccgcggactgtcagaggccgccggtcagacagctcagatgctggagcgcattattctgactgaacaggccaacgagaaaatgaacgccaaattggaagaactacgacaacatgctgcgtgtaaactggatctgcagaaacttgtggagacactggaggaccaggagttaaaagagaacgtggagatcatctgtaacttgcagcagttaatcacacagcttagcgacgaaacagttgcctgtatggctgccgccatagacacagctgtggagcaggaggcgcaggtggaaacatcaccggaaacaagtcgcagctctgatgctttcaccacacaacacgctttgaggcaggcacaaatgtcgaaggaacttgtggagctcaacaaggccctcgctctgaaagaggcactggcaagaaagatgacccaaaacgacagccagctgcagccgattcagtaccagtatcaggacaatatcaaggaactggagctcgaggtgatcaacctccaaaaggaaaaggaggaactcgtactggagctccagaccgctaaaaaagacgctaatcaggctaaactgagcgagaggaggaggaagcgtttgcaggaattagaggggcagatcgcagatcttaagaagaagttaaacgaacagtccaagctacttaaactgaaggaatctaccgagaggaccgtctccaagctgaaccaggaaattaggatgatgaagaatcaaagggtccagctgatgcgtcagatgaaggaagacgcagagaaatttcgccaatggaagcagaaaaaagataaggaggtcatccagcttaaagagagagaccggaaaaggcagtacgaattgctgaaactggaacggaatttccagaaacagtctaatgtcttacgcagaaaaaccgaggaggccgccgccgccaacaaacggctcaaagacgccttgcagaagcagagggaggtagccgacaaacgaaaggagacacagagccgagggatggaaggcactgctgcacgagtgaagaattggctgggcaatgaaattgaggtgatggtgtccaccgaggaggctaagcggcatcttaacgacctacttgaagaccgtaagatcctggctcaggacgtggctcaacttaaagagaagaaggagagcggggagaacccaccaccaaagctgagaaggcggacattcagtctcacagaggtgcgcggccaagtgtcagaatctgaagacagcatcactaagcaaatcgaatcgctcgaaactgagatggagtttcgatccgcccagatcgccgacctgcagcaaaagttactcgatgcagagtcagaggacaggcccaagcagcgatgggagaatatagccacgattctggaagccaagtgtgcgctgaagtatctgatcggggagttggtttctagcaagatacaggtctcaaagctcgagtccagtctgaaacagtcgaaaacaagttgtgccgatatgcaaaaaatgttgtttgaggaacggaaccattttgctgaaatagagactgagcttcaggcagaattggtaaggatggaacagcagcatcaggagaaggtcctgtatctgctgagccaactgcagcagagtcaaatggctgagaagcaactggaggagagcgtcagtgaaaaggagcagcagctcctgtccaccctgaaatgccaagacgaagagttggagaagatgcgtgaggtgtgtgagcaaaatcagcagttgctgagggagaacgaaatcatcaaacaaaaactcacgctgcttcaggtagcctctagacagaagcacctgccaaaggacacacttctgtccccagatagctcctttgagtatgtcccccccaaacccaaacccagtcgcgtgaaggagaaatttttggagcagagcatggacatagaagatctgaagtattgcagcgagcactcagtcaacgaacacgaagatggtgatggcgacgatgatgaaggagacgatgaagagtggaaacccacgaaactagtcaaagtgtctagaaagaacattcaaggggtcctgctcctaactcccgttatcagcgctctgtgggaagctgaggcaagaggcctgttggaggcgaggtcctcacgtcctgcctgggccacttggcgtgaccccgtgtctacaaaacccaaaaattag

SEQ ID NO: 192476 - DNA, 3699 bp, Artificial Sequence
  Description of Artificial Sequence: Synthetic coding sequence
atgaaggaggaggtgaagggcatccccgtgcgggtggccctgcggtgccgtccgctggtgcccaaggagattagcgagggctgccagatgtgcctgtcattcgtaccaggggaaccccaggtagtggttggaaccgacaaatcttttacttacgatttcgttttcgacccctctacggagcaagaagaggtgtttaacaccgctgtcgcccccctgataaaaggagtgtttaagggctacaatgccacagtgctcgcgtacggacaaacaggctccggcaagacatacagtatgggcggagcatatacggccgaacaggagaacgaaccaacggtgggcgtgatcccgcgagtgattcagctgctgttcaaagagatcgacaagaaatcagattttgaattcacccttaaagtgtcgtatctagagatttacaacgaagaaatcctggatctgctctgcccatcacgagagaaggcgcagatcaacattagagaggacccgaaggagggaatcaaaatcgtcggcctcacagagaaaacagtactggtggctctggacactgtgtcctgtttggagcaggggaacaattctaggacagttgccagcaccgccatgaactctcaatcttctcgaagccacgccatatttacgattagcctggagcagcgcaagaagagtgacaaaaattccagttttaggtccaagctgcacctggtcgacttggctgggtcagagcgacagaaaaagaccaaggccgaaggggaccgacttaaggaagggatcaacattaacaggggcctcctgtgtctgggaaacgttatcagtgctctgggggatgacaaaaagggcggtttcgtgccgtaccgcgacagcaaactaactagattgctgcaagatagcctgggggggaacagtcacactctcatgatcgcctgcgtcagtccagccgatagcaacctggaggagaccctaaacacccttcgatacgcagacagagctcgtaaaatcaagaacaagcctattgtcaacatcgatcctcaaactgcagagctaaatcacctgaaacagcaagtgcaacagctgcaggtgcttctcctgcaggcgcacggcgggaccttgccggggagcattactgtcgaaccaagcgaaaacctgcagagcctcatggaaaaaaaccaaagtttagtcgaggaaaacgaaaagttgtctcgcggtctaagcgaggccgctgggcagaccgcccagatgcttgaacgaataatcctcacagaacaggcaaacgagaagatgaacgcaaaattggaggagctacggcaacacgctgcttgcaaacttgacctgcaaaagctggtggagactctcgaggaccaagaactgaaggagaacgttgagatcatttgcaacctgcaacagttgattacccagctatccgacgagaccgtggcctgtatggccgccgcaattgatactgcggtggagcaggaagcacaagtcgaaaccagccccgagacctctcgctccagcgatgcgttcaccacacagcacgccttgagacaggcgcagatgtccaaagaactggtggaattaaataaggcacttgcactgaaggaggcactggcacggaaaatgacccagaacgactcccaattgcaacccatccagtatcagtaccaggacaacatcaaggagcttgaactggaagtaattaatctgcagaaagagaaagaggagcttgtgctcgaactccagacagctaagaaagatgctaatcaggcgaaactctctgaaaggcgccgtaagaggctgcaggagctggaaggacagattgccgacctaaagaagaagctgaatgaacagtcaaagctgctcaagctgaaagaatcgaccgagcggaccgtgagcaaactgaaccaggagattcgcatgatgaagaatcagagagtgcagctcatgcggcagatgaaagaggacgctgagaagtttcgccagtggaagcagaaaaaggacaaggaggtgatccaacttaaagaacgggacagaaaacggcagtatgagctcttgaaactggaaaggaattttcagaaacagagtaacgttctgaggaggaagaccgaagaagccgccgccgctaataagcggttaaaggatgccctgcagaagcagcgcgaggtggcagacaaacgcaaagagacacagagcaggggcatggagggcacggccgccagagtgaagaattggctgggcaatgagattgaggttatggtgtccaccgaggaagctaaaaggcatctcaatgatctgctggaagaccggaaaatactagcccaggatgtcgcacagctgaaagaaaaaaaagagtcaggggaaaatccaccaccgaagcttcggagaaggaccttttcacttacagaggtgcggggccaggtgagcgagagtgaggattctattactaagcagattgagtccctggaaacagagatggaattcagaagcgcccagatcgctgatctgcagcaaaagctgctggatgccgaaagcgaggaccgcccaaaacagaggtgggaaaacattgcgacaatattagaagcaaaatgtgcacttaaatacttgattggagagctggtgtcgagcaaaattcaggttagcaaactggagtcttccctgaagcagtccaaaacctcctgcgcagatatgcaaaagatgctgtttgaggaaagaaaccacttcgctgagatcgagactgaactgcaggccgagttggtgagaatggaacagcaacaccaggaaaaggtactttatctcctgtctcagctccaacagagccagatggcagagaagcagctcgaagagtccgtcagcgagaaggaacagcagcttctcagcacgcttaaatgtcaggacgaggagctcgaaaaaatgcgggaagtgtgtgagcagaatcagcagctgctgagagaaaacgagattatcaaacagaaattaacactgttacaggtagcctcacgccaaaagcacttgcccaaagacacactgctttccccagattcttcatttgagtatgtgccacccaagccaaagccttctcgcgtcaaggagaagtttctggaacagtccatggacattgaggatctgaaatactgtagcgaacactcagtcaacgagcatgaggacggagatggcgacgatgatgagggcgacgatgaggaatggaagcccactaaactcgtcaaagtctcaaggaagaacatccaggggtgttcttgcaaaggatggtgtggtaacaagcagtgcggttgccgtaaacagaaatcagactgcggcgttgactgctgttgtgaccccacaaagtgtcgtaaccgccagcaggggaaggactcactgggcacagtggagagaacccaggactccgaaggctcctttaaacttgaggatccaacggaagtgaccccaggtctgagtttcttcaaccccgtatgcgccactccaaacagtaaaatcctcaaagagatgtgtgatgtggaacaagtcttgtctaagaaaacacccccggcgccatccccatttgaccttcccgagctgaagcatgtcgcaactgaataccaggagaataaagctcccgggaagaaaaagaagcgcgcgctggcttcaaacacctcattcttctcaggctgtagcccgatcgaggaggaagctcattag

SEQ ID NO: 192477 - DNA, 1605 bp, Artificial Sequence
  Description of Artificial Sequence: Synthetic coding sequence
atgtgcagcgacgtgaagcgggaggccgccgccgccaacaagcggctgaaagacgcacttcagaaacaaagagaagtcgccgataagcgcaaagaaacgcaaagtagaggtatggaaggcaccgcagccagagtgaagaactggctgggcaatgaaatcgaagtgatggttagtacagaggaggcgaagcgccatctcaacgatctgctcgaagataggaagatcttggcccaagatgtcgcgcagttgaaggaaaagaaggaaagcggtgaaaaccctcccccaaagctgcgaagaaggaccttctcactcacggaggtgaggggccaggtgagtgagtccgaggactccatcaccaaacaaatcgagagtcttgaaaccgagatggagttccggagtgctcagatcgcagacctgcaacagaagctgttagacgctgagagcgaagataggcccaagcagagatgggaaaacattgctactatccttgaggcaaaatgtgccttgaaatatctcataggcgagttggtgtctagcaagatccaagttagcaagctagagagcagcctcaaacagtccaaaacttcgtgtgctgacatgcagaagatgctgttcgaggagcggaatcatttcgcagagatcgaaacggaactgcaggcagagctcgtaaggatggaacagcagcaccaggagaaggtattgtatctcctctcgcagttgcagcagtcgcagatggctgagaagcagcttgaagagtccgtgagtgaaaaagaacaacagctgctgagcaccctaaagtgccaggacgaggagcttgagaagatgcgagaagtgtgtgagcaaaaccagcagttgttgcgcgagaacgagattatcaaacaaaaactgacactgctgcaagtggcatccagacaaaaacacctgccaaaagataccctgttgtccccagacagtagcttcgagtatgtgcctccgaaacccaagcctagtcgggtgaaagagaaattcctagaacagtctatggacatcgaggacctcaagtactgtagcgaacacagcgtgaatgaacacgaagatggcgacggtgacgatgacgagggcgacgatgaagagtggaagcccacgaagctggtgaaggtcagcaggaagaatattcaagggtgtagctgcaagggctggtgcggtaataaacagtgcggatgccgcaaacagaaatctgactgcggcgtggattgttgttgcgatcctaccaagtgcagaaacaggcaacaaggcaaggacagtttaggaaccgtggaacggacccaggactccgagggatcttttaaactggaggatcccactgaggttactcccgggctgtctttctttaatccagtttgcgctacaccaaactcaaaaatcctgaaggaaatgtgcgatgttgaacaggttctcagcaagaaaacaccccccgcccctagccccttcgacctcccggagctgaaacacgttgccacagaataccaagaaaataaggccccagggaaaaagaagaagagggccctggcgtcaaacacttcgttcttctcaggctgtagccctattgaggaggaagctcactag

SEQ ID NO: 192478 - DNA, 3705 bp, Artificial Sequence
  Description of Artificial Sequence: Synthetic coding sequence
atgaaggaggaggtgaagggcatccccgtgcgggtggccctgcggtgccggccactcgtgcccaaggagatcagtgagggctgtcagatgtgtctgtcttttgtgcctggcgaaactcaagtcgttgtcggaacggacaaatccttcacgtacgattttgtctttgacccctgcacggagcaggaggaagtatttaacaaagcagttgccccgctgatcaaaggaatattcaagggatacaacgctactgtgttagcatacggacagactggctcaggtaaaacttacagtatgggaggcgcgtatactgccgagcaggagaatgaaccgacagtcggtatcattccccgcgtcattcagctgttatttaaggagattgataagaagtcagattttgagtttaccctgaaagtgtcctacctcgaaatttacaatgaggaaatcctcgacctcttatgtccttcccgggagaaagcacaaattaatattagagaggaccccaaggaagggatcaagattgtgggcttgaccgagaaaaccgtgctggtggctctggacacggtttcttgcttggagcaaggcaataattcaagaaccgttgcgtcaacagccatgaactcccagtccagccgctcacacgcgatcttcacaatcagtattgaacagcggaaaaaatcagataaaaactgtagctttcgatccaagctgcaccttgtagacttggccgggagcgagcgccagaaaaagactaaagctgagggcgatcggctaaaagagggaattaacatcaaccgcggcctgctttgcctgggcaatgtgatatcagcactgggcgatgataaaaagggaagctttgtgccttatcgcgactcaaagcttactcgtttgctacaggattctctgggcggcaattcccacactctgatgatcgcttgtgtaagtccagcagatagcaacctggaagaaacactgagtacgctgcgctacgcagacagggcccgcaaaatcaaaaacaagcccatcgtaaacatcgaccctcatacagctgagctgaaccatttaaagcaacaggtgcagcaactgcaggttctcctgctccaagcacacgggggcacactgcctggctctatcaatgccgaaccttctgagaacctacaaagcttgatggaaaaaaaccagagtctcgtggaagaaaatgaaaaattgtcacggtgcctttccaaggccgccggacagactgctcagatgctagagagaattatcctgacggagcaagttaatgaaaagctaaatgccaagctggaggaactgcgtcaacacgtggcctgtaagctcgacctccagaagctggtggaaaccttggaagaccaagagctgaaggaaaatgtcgagataatctgtaacttacagcagttaattacccaactgtccgatgaaaccgtcgcctgtactgcagcagcgatcgacacggcggtagaggaagaagcccaggtagagacttctccggagaccagtcgaagtagtgatgcctttacaacacagcacgcccttcaccaagcgcaaatgagcaaagaagtggtggagctgaacaatgctttggcactgaaggaggcacttgttcgaaaaatgacacagaatgacaatcagctacagcctatccagtttcagtatcaggacaacatcaaaaaccttgagcttgaggttataaatctccagaaggagaaagaagagttagttagggagctgcaaacagctaaaaagaatgtgaatcaggctaagctgagcgagcaccggcacaagctcctacaggaactagaagggcagatcgcggacctgaagaaaaagctcaacgaacaatccaagctcttgaagctgaaggaaagtacagaacgcaccgtgtcaaaactgaatcaagagatctggatgatgaaaaaccagcgtgtgcagctaatgcggcagatgaaggaagatgcagagaaattcaggcaatggaaacagaaaaaggacaaggaagtgatccagctgaaggaaagagaccgcaaacgccagtatgagctgctcaaattagaaaggaacttccaaaagcaatccagtgtcctgaggcggaaaacggaggaggccgccgcagccaataagcggcttaaggatgccctgcagaagcaacgggaagttactgacaagcggaaggagactcagtctcatggcaaagaaggaattgccgctcgggtgcgaaattggctagggaatgagattgaagttatggtgagtacagaggaggcgaagagacacctgaacgacttgctggaagatcgaaagattctcgcccaggatgttgtgcagctgaaggagaaaaaggagtcccgggaaaacccacctcctaagctgcgcaagtgtactttttctctgtctgaggtccatggccaggtcctcgaaagcgaagattgcatcacgaaacagatcgaatctcttgagacagaaatggaacttcgcagtgcacagatagccgacctccagcagaaactgcttgacgctgagagcgaggatcggccaaaacagtgctgggagaatatcgctaccattctggaggcaaaatgcgcccttaaatatttaattggagaactagtctctagtaaaatccatgttactaagcttgaaaattcactgcgccaatcaaaggcttcatgtgcagatatgcaaaagatgctattcgaggagcagaatcatttcagcgagatcgaaacagagctgcaggctgaattggtccgaatggagcagcagcatcaggagaaagtactgtatctggttagtcaacttcaagagtcacagatggctgagaagcagctcgaaaaatctgcctctgagaaggagcagcaactcgtcagtactcttcagtgccaggatgaggagctggaaaagatgagagaagtatgcgaacagaatcagcagctgctgcaggaaaacgaaatcataaagcagaaactgatcctgttacaggtggcatccagacagaagcacctgcctaatgatacactgcttagccccgatagctccttcgagtacatccccccaaagccaaaacctagtagagtcaaagaaaagtttcttgagcagtcaatggatattgaagatctcaagtattgcagtgagcactcagttaatgaacatgaggatggcgacggggatggcgatagcgacgagggagacgatgaggaatggaagccaacaaaactggtgaaagtgagtcggaagaacattcagggttgtagctgtaagggatggtgcggcaacaagcagtgcgggtgccgcaaacagaaatctgattgcggcgttgattgcagctgcgaccccacaaaatgcaggaatcggcagcagggcaaggattcattgggcaccgtggaacagacacaggatagtgaaggatcattcaagctagaagaccctactgaagttaccccgggccttagcttcttcaatccagtttgtgccacacccaacagcaagatcctgaaggagatgtgcgacatggagcaggtcttatccaagaagacagctccagcaccctcaccattcgacctgccggaatccaagcatggggcaacagagtaccagcagaataaaccccctggcaagaagaaaaagcgggccctcgccagtaataccagtttctttagcggatgttctcctattgaagaagaagctcattag

SEQ ID NO: 192479 - DNA, 3099 bp, Artificial Sequence
  Description of Artificial Sequence: Synthetic coding sequence
atggccgagaccaacaacgagtgcagcatcaaggtgctgtgccggtttcgccctctaaatcaggctgagattctacgcggcgataagttcattccaatatttcagggtgacgattccgtagtcatcggaggaaagccgtacgtttttgatcgcgtctttcctcccaataccactcaggagcaagtgtatcacgcctgtgcaatgcagatagtgaaagatgtccttgccggttacaatggtaccatctttgcctacggtcaaacctcaagcggcaaaacgcataccatggaggggaaattgcacgacccccaattgatgggaattatcccaagaatagcgcgcgacattttcaatcatatatacagcatggacgaaaacctcgagttccatattaaggtcagctattttgaaatatacctggataaaattcgggacctcttagatgtgaccaagaccaaccttagcgtgcatgaggacaaaaaccgggtccccttcgttaagggctgcacagagcgcttcgtctcgtctcctgaggaaatcctcgacgttattgatgagggaaagagtaatcgccacgtcgcggtcacaaacatgaacgaacacagctcgaggtctcacagcatcttcctcattaatattaagcaggaaaatatggagacagaacaaaaacttagcggaaagctgtatctggtggatctagctggttctgaaaaggtctctaagacaggcgcagagggagccgttttggatgaggcaaagaatattaacaagagtcttagtgccctgggaaatgtcatctctgcactggcagaaggtacgaagtcctacgttccatatagagattctaagatgactaggattctccaagattccctcggtggtaactgtaggactacaatgttcatttgttgtagccctagctcctacaatgacgccgagactaagagtactttgatgttcggccagagggccaagactattaagaatacagcttccgtgaatctcgaactaactgcagaacagtggaaaaaaaagtacgagaaagagaaggaaaagacaaaggcacaaaaggagaccatcgccaagctggaagccgagcttagcagatggagaaacggcgaaaacgttcctgagactgagcgacttgctggcgaagaagccgcactaggcgcagagctgtgtgaagaaacacccgtgaacgacaactccagcatcgttgttagaatcgccccggaagagaggcagaagtatgaggaagaaattcgcagactgtacaaacagctggacgataaagacgacgaaattaaccagcagagccagctcattgagaagcttaagcagcaaatgctcgaccaagaggagttactggtgagcacacggggcgacaacgaaaaagtccagcgggagttgagtcatctccagtccgagaatgatgcagccaaggacgaggtgaaggaagtgctgcaggccctggaggagttggcagtgaactacgaccagaagtcacaggaggtggaggagaagtctcagcagaaccaattgctggttgacgaactgtctcagaaggttgctacaatgcttagcctagaatctgagctgcaaaggctccaggaggtgagcggccaccagcggaagaggatcgctgaagttctgaacgggctgatgaaggatctcagtgagtttagtgtaatagtcggcaatggggagatcaaactaccagtggagatatccggcgccattgaggaagagtttaccgtagcaaggctctatataagcaagataaaatccgaagtgaagagcgttgtcaaacgctgccggcagcttgaaaatttgcaggtcgaatgtcacaggaaaatggaggtgaccgggcgggaactttccagctgccaactcctcatctcccagcacgaggcaaagatccgatcgctgactgagtacatgcagagcgtggagctcaaaaaaaggcacctcgaggaaagctacgattccctctctgatgagcttgcaaagctccaggctcaggagaccgtccatgaagttgcgctcaaggacaaggagcctgacactcaggacgctgacgaggtgaagaaggccctggaattgcagatggaaagtcatcgggaagcacatcataggcagctggccaggcttagggacgagattaatgaaaagcagaaaactatagatgaattgaaggatctgaatcagaaattgcagttggagcttgaaaaactgcaagccgattatgagaaactcaagtcggaggagcatgaaaaaagtacaaaacttcaggagctcacatttctgtatgaacgacatgaacagagcaagcaggatctgaaaggcctggaggagactgtcgcccgtgaattacagacattgcataacttgcgaaaactgttcgtgcaggatgtcacaactagagtgaagaagagcgcggagatggaaccagaagactccggggggatacacagccagaagcagaaaatcagctttctggaaaacaacttggaacagcttactaaagtgcacaaacagctggtccgcgataacgccgacctgcgttgcgagttgccgaagttagaaaagcgactgcgtgcaaccgcagagagagtgaaggctctggaaggggcacttaaggaggccaaagagggggccatgaaagacaaaagacggtatcagcaggaagtcgacagaatcaaagaggccgtgcggtataagtcttctggcaagcgtggccactccgctcagattgcgaaaccagttaggccaggccattatccagcttccagtcccacgaatccatatggaactaggagccctgaatgcattagctacactaatagcctattccagaactaccaaaacctgtacctccaggccactccgagctcaacctctgatatgtactttgctaattcttgcactagcagcggagccacaagtagcggagggccgttagcttcctaccagaaagcaaacatggataatggtaacgccacagatatcaatgacaaccgcagcgacctgccttgtggatacgaagcagaagaccaggctaaactgtttccattgcatcaggaaaccgctgcctcgtag

SEQ ID NO: 192480 - DNA, 381 bp, Artificial Sequence
  Description of Artificial Sequence: Synthetic coding sequence
aagagcagcggcaagcggggccacagcgcccagatcgccaagcccgtgagacctggacactaccccgcttcctcccctaccaatccttacggcacacgatcaccggagtgcatcagctacaccaatagcctgttccaaaactaccaaaatctctatctgcaagcgacccctagcagcactagcgatatgtattttgccaatagctgtactagctccggggccacctcgtctgggggccctctggcctcataccagaaggcaaacatggataatggaaatgcaacagacattaacgacaataggagtgatctgccgtgcggctacgaggcggaggatcaggccaaactctttccgctacatcaagaaaccgccgcgtcttag

SEQ ID NO: 192481 - DNA, 2892 bp, Artificial Sequence
  Description of Artificial Sequence: Synthetic coding sequence
atggccgacctggccgagtgcaacatcaaggtgatgtgccggttccggccgctgaacgagtccgaagtgaatcgaggagataaatatatcgccaaattccagggagaagatacggtcgtgatcgcttctaagccctatgctttcgacagagtgtttcagagctccacttcacaggaacaagtgtataacgattgcgccaaaaaaatcgttaaggatgtattggaaggttataatgggaccattttcgcttatggccagacgagctctgggaagactcatactatggaaggcaagctgcacgatcctgaaggcatgggaatcatacctagaatcgtacaggacatttttaactacatttatagcatggacgagaatctggaattccatattaaagtgtcctatttcgaaatttatctggacaagattagggacctgctggacgtctcaaagaccaacctgtccgtgcacgaggataagaatcgagttccctacgtcaaaggttgtacggagaggttcgtttgttcacccgacgaagtgatggatactatagacgaagggaaatccaaccggcatgtggcagtaaccaatatgaacgagcactctagccgctcccactcaatttttttaatcaacgtcaagcaggagaacacccagaccgagcagaagctgagtggcaaactctacctagtggatctcgctgggtctgagaaagtcagcaaaactggcgccgaaggcgccgtattggacgaggccaaaaacattaataaatcactctccgcattagggaatgtgattagcgcactggctgaggggagcacctacgttccatatcgggattccaagatgacgagaatacttcaggatagcctagggggcaactgcaggacaacaatcgtcatctgttgctccccgtcctcttataacgagtcagaaacgaaatctaccctgctgttcggtcagagagcaaaaacaataaaaaacacagtttgtgtcaatgtcgaactgacggccgagcagtggaaaaaaaagtacgaaaaggagaaggagaagaacaagatcttacgcaacacaattcaatggctcgaaaatgaacttaaccgatggcggaacggggagactgttcccattgatgaacaatttgataaggaaaaagccaacctggaagcctttaccgtggataaggatataactctcacgaacgataagcctgcaactgcgataggcgttattgggaatttcaccgacgcggagagacgtaagtgcgaggaggagatcgctaaactgtataagcagctcgatgataaggatgaagagattaaccagcaatctcagctggtcgagaagctgaagacacagatgttggatcaggaggaactgcttgcgtccacccgccgcgatcaggacaatatgcaggccgagctgaaccgcctgcaggcagagaatgacgccagcaaggaagaagtcaaagaggtgttacaggcgctcgaggaactagcagtgaactacgatcaaaaatcccaagaggtagaggataaaacgaaagaatatgagctcctgtccgacgagttaaatcagaaaagcgcaaccttggcatccatcgatgcagaacttcaaaagctgaaggagatgactaaccatcagaagaagcgggctgccgaaatgatggcctctttgctcaaagacctggctgaaatcggaatcgctgttggtaacaatgacgtgaaacagcccgaaggcaccggcatgatcgacgaggaatttacagtcgctaggctgtacatatccaagatgaaaagtgaggtgaaaaccatggtgaagaggtgtaagcagctggagtcgacccagacagaatccaataaaaagatggaggagaacgagaaggaactggccgcatgtcagctgaggatttcccaacatgaggccaagatcaaatcattaaccgaataccttcaaaatgtggagcagaagaagagacagctggaggaaagcgtagacgccttgtcagaagagctcgtacagctccgagcgcaggagaaggttcatgaaatggagaaagagcacctcaacaaggtccagactgccaacgaggtgaaacaggccgttgagcagcaaattcagagtcatagggagacacatcagaagcaaatctcctcgctgagggacgaagtggaggccaaggcaaagctgataactgacctgcaggatcaaaaccagaagatgatgctggaacaggagagactgcgggtggaacatgaaaaactcaaggccacagaccaggagaaatccagaaaactccacgaactcaccgtgatgcaggacagacgtgaacaggcccgccaagacttaaagggcctggaggagaccgtggccaaggagctgcagaccctgcacaacctgaggaaactgttcgtccaagatctcgccacacgggtgaagaagtccgcagagattgactctgacgatactggcggctcggccgcccagaaacagaaaatttccttcttggaaaacaacctggaacagctgaccaaagtccataaacagctggtgagggataacgccgatcttcggtgtgaattacctaagttagaaaaacgccttcgtgccactgccgagagggtcaaggcactcgagtcagccctgaaggaggccaaggagaatgctagccgagacaggaaacgctaccagcaggaggtcgatcgtataaaagaagcggtgcggagcaaaaacatggcccgcagaggccattcggcacagattgcaaagccaatacgcccaggacagcaccccgcagccagccccactcacccgtccgccatccgcgggggaggggcttttgtccaaaattcccagccagtggccgtacgaggcggaggtggaaagcaggtatag

SEQ ID NO: 192482 - DNA, 2583 bp, Artificial Sequence
  Description of Artificial Sequence: Synthetic coding sequence
ggcaagctgcacgacccccagctgatgggcatcatcccccggatcgcgcatgatatattcgatcacatttactcgatggacgagaatttagaatttcatattaaggtgtcctacttcgaaatttacttggacaagatacgagaccttcttgatgtgtccaaaaccaatctcgcagttcatgaagacaagaatcgcgttccttacgttaagggatgtacagagagatttgttagctcacccgaggaggtgatggacgtgattgacgaagggaaagcaaacaggcacgtggcggtcacaaatatgaacgagcacagcagcagatctcattcaatcttcttgatcaatataaaacaagaaaacgttgaaaccgagaaaaagcttagcggcaagctctacctggtagatctagccggctcggagaaagtaagtaagacaggtgccgagggagccgtgctggatgaagctaagaatatcaacaaaagtctgagtgctctcgggaacgtgatctccgccctagcagaaggcacaaagactcacgtcccttatcgcgatagtaaaatgaccagaatcctacaggactccctcggaggaaactgtcgcaccacgatcgtgatctgctgctctcctagcgttttcaatgaagccgaaacgaagtccactcttatgtttggtcagcgggcaaagactatcaagaatactgtgagcgtgaatctagagctgactgccgaggagtggaagaagaagtatgaaaaggaaaaggagaagaacaaaaccttgaaaaatgtgattcaacacctggagatggagctcaaccggtggcgcaatggagaggcagtccctgaggacgaacagatttctgctaaagatcagaagaatcttgaaccctgtgacaacactcctattatcgacaacattgccccagtggtggccggaatcagcacagaggaaaaagaaaagtatgatgaagagatctcttctctgtacagacagctagacgacaaggacgacgaaattaaccaacagtcgcagcttgcggagaagttaaagcaacagatgctggatcaggatgagctcctggcttcaaccagacgcgattacgaaaagatccaggaagagctgacaaggttgcagatagagaatgaggcagctaaagatgaagttaaagaggtgctgcaagcgctggaggaattagcagtcaactatgaccagaagtctcaggaggtggaggacaagacaagggcgaatgaacaactgaccgacgagctggcacagaagacgaccacgctgacaaccacccaacgcgagcttagtcagcttcaggaactcagcaaccatcagaagaaaagagctaccgaaattcttaacctcctgctgaaagatctgggagagatcggtggcatcatagggaccaacgacgtgaaaactttggcagacgttaacggcgttatagaggaagaattcacaatggccaggctgtacatatctaagatgaaaagcgaagttaagtctttggtcaataggagcaaacagctggagtccgcccagatggactcgaatcgaaagatgaacgccagtgaacgtgagttagcagcgtgtcaactcctaattagccagcacgaagcaaagattaagtccctgactgactacatgcagaatatggagcagaagcggaggcagctggaggagtcccaggattctctgagtgaggaactggccaagcttcgtgcccaggaaaaaatgcatgaggtttccttccaggataaagagaaggagcatctgactaggctgcaggatgccgaggagatgaaaaaggccctggagcaacagatggaaagccacagagaagctcatcagaagcaattgtctagactgagagatgaaattgaagagaaacagaagatcatcgatgagattcgagacttgaaccagaagctacaactggaacaggagaagttatctagtgactacaacaaactaaaaatagaggatcaggagcgcgagatgaagctggagaaattgctgttacttaatgacaagagagagcaggccagggaggatctgaaaggactggaggagacggtctccagagaactccagactctgcacaacctgcgtaaactatttgtccaagacttgacaacgagggtgaagaaaagtgtggagcttgataatgatgacgggggcggaagtgcagcgcaaaagcaaaagatttcctttctagaaaataacctcgaacagctgaccaaagtccacaagcagctggtgcgggacaatgccgatctgaggtgtgagctgcctaagttggagaagcgactccgggccactgctgaacgggtgaaagccctagagagtgctctgaaggaggccaaggaaaacgcaatgagagatcgaaaaagatatcagcaggaggttgaccggattaaagaggccgtgcgcgccaagaatatggcaaggagagctcactcagcccagatcgcaaagccaatcaggccaggacattatccagcctctagtcccaccgccgtgcacgctattcggggtgggggaggatcgtcctccaatagcacacattatcagaaatag

SEQ ID NO: 192483 - DNA, 2178 bp, Artificial Sequence
  Description of Artificial Sequence: Synthetic coding sequence
atggccacctacatccacgtgagcaagaccggcgccgagggcgccgtcctcgacgaggccaagaatatcaacaaaagcctttcggccctcggcaatgtgatctcagcattagctgagggcacaaagacgcacgtcccctaccgagacagcaaaatgacacggatcttgcaagattctttgggcggtaattgtcggaccactatagtgatttgttgctccccttctgtgttcaatgaggcggagactaaaagcacgctgatgtttgggcagcgagccaagacaatcaaaaacaccgtgtccgtgaatctggagctgacagctgaggaatggaagaagaagtatgaaaaggagaaggagaaaaataagacgttgaagaacgtgatccagcacctggagatggagttaaatagatggaggaacggggaggctgtcccagaggacgaacagatctccgctaaggaccagaaaaacctcgagccatgcgacaataccccaatcattgacaatatcgcccctgtagtagccgggattagcacagaggagaaggaaaagtacgatgaggaaatcagcagcctttaccggcagctcgacgacaaagatgatgagattaatcagcagtctcagctcgccgagaagctgaagcaacagatgcttgaccaggatgaactgctggctagcactaggcgcgactatgagaaaatccaggaagagctgacccggctgcaaattgagaatgaagccgctaaagatgaggtgaaagaagtcctccaggcgctggaggagctggcagtgaactatgatcagaaatcgcaggaggtggaagataagactagggcaaacgaacagctgacagacgagttggctcagaaaactactaccctaaccactacacaaagggaactctctcagcttcaggagctctcaaatcatcagaagaagagggctactgaaatactaaacctattgctaaaagatctgggggaaatcggcggcataattgggaccaatgacgtcaaaaccctcgctgatgtcaacggggtaatcgaggaagaatttacgatggcccggctgtacatctcgaaaatgaaaagtgaggtaaagtcactcgtgaatagatccaagcagctcgagtcagcccagatggactcaaaccggaaaatgaacgcctccgagagagaactcgcggcctgtcaacttctgattagccagcatgaggccaaaatcaagtcattgacagattacatgcaaaatatggagcagaaacggcgacagctggaggagagtcaagattccctgagcgaggagctcgcaaaacttagagcccaagaaaagatgcatgaggtgtcattccaagataaagagaaagagcatctcaccaggctacaagatgctgaagaaatgaaaaaagccctggagcagcagatggagagtcatcgggaggcacatcaaaagcagttaagccggttaagggatgagatcgaggagaaacagaagatcatcgacgagatccgcgacctcaaccaaaagcttcagctggagcaggagaagttgtcttctgattacaacaaacttaaaatcgaggaccaggagcgagaaatgaaactggagaaactcctcttgttgaacgataagagggaacaagcgagagaggacctgaaaggactggaagagacagtgtccagagagctccaaactctccataatctgcgtaaactgtttgtgcaggacttgaccactcgcgtcaaaaagtcggtggaacttgacaacgacgacgggggaggatctgcagcgcagaagcagaagatttcattccttgagaataacctggaacagcttaccaaagtgcacaagcagctggtgcgggataacgccgatcttcggtgtgaactaccaaaactggaaaaacggctccgcgctactgctgaacgcgtcaaagcattggaatctgcactgaaggaagccaaggagaacgccatgagagaccgcaaacgctaccaacaagaggttgatcggattaaagaggcggtgagggctaagaatatggccaggcgagcccacagcgcccaaatcgcaaagcccattaggccagggcactacccggcatcctcccctaccgccgttcacgcaatcaggggaggcgggggatccagctctaattccacccactaccaaaagtag

SEQ ID NO: 192484 - DNA, 2589 bp, Artificial Sequence
  Description of Artificial Sequence: Synthetic coding sequence
atgtggggcaagctgcacgacccccagctgatgggcatcatccccagaatcgcacacgacatatttgaccacatttattctatggatgagaatttggagtttcacattaaggtttcttacttcgaaatataccttgataagataagggatctgctcgatgtcagcaagactaacttggcagtccacgaggacaaaaatagagtcccttacgtcaagggctgtactgagcggtttgtgagcagtccagaagaggttatggatgttatagatgaaggaaaagctaaccgacacgtcgccgttacaaacatgaatgaacactcctctcgtagccacagcattttcctcattaatatcaagcaggagaacgtggaaaccgaaaagaaactcagcggaaaactatatcttgtggatttggctggaagtgaaaaagtctcaaagacaggggccgaaggcgctgtcctggacgaagcgaagaatatcaacaagagcctgtcggctctcggcaatgtaattagcgctttggccgaggggacaaagactcacgtcccttacagagattcaaaaatgactcgcattcttcaagactcccttgggggcaattgccggacgacaatcgtcatctgctgtagtccaagcgtgtttaatgaagctgagacaaaatcaacactcatgtttggtcagcgggccaaaaccatcaaaaatacagtgtctgttaacctcgagttgacagctgaagaatggaaaaagaaatacgaaaaggagaaggagaagaacaaaacattgaagaacgttattcagcacctggaaatggaactgaaccggtggcgtaatggtgaggccgttcccgaggacgaacaaatttcagctaaggaccagaagaacctggagccatgcgacaacactccaattattgacaacatcgccccagtcgtggcgggcatcagtaccgaagaaaaggaaaagtatgatgaggaaattagctcgttgtacaggcaactggatgataaggacgacgaaatcaaccaacaatcgcagctcgccgaaaagctcaagcagcaaatgcttgatcaagatgaactcctggccagtacaaggagggattatgagaagatccaggaagagttgactagactccagatcgagaacgaggcagcaaaggacgaggttaaagaggttctgcaggccctggaagagttagccgttaactacgaccagaagagccaggaagtggaggacaagacccgggcaaacgaacaacttacagatgagctcgcccagaagacgaccacactgacaaccacacagagggaactcagccaactccaagaactctccaaccaccagaaaaaacgtgccactgagatcttaaacctccttctgaaagacctcggagaaatcggggggattattgggaccaatgacgtgaaaacgctcgccgatgtcaatggtgtgattgaagaggaattcacaatggcccgcctctatatcagcaagatgaagtctgaggttaagtccctggtcaatcgcagtaaacagttggaaagcgcgcagatggactcaaatcggaagatgaatgccagtgaaagggaactcgctgcatgtcagctgctgatctcccagcacgaagcaaagattaagagtctgacggattacatgcaaaacatggagcagaagagaagacaacttgaggagagtcaagactcactgagcgaggagctcgcaaagttgagagcccaagaaaaaatgcatgaggtatctttccaagacaaagagaaagaacacctgactcgtctgcaggatgcagaagaaatgaaaaaggcgctggagcagcagatggaaagccaccgagaggctcaccaaaagcagctctccaggcttagggacgagattgaggagaagcagaaaatcatagacgagattagggatctcaatcagaagctgcagttagagcaggagaagctctctagtgactacaacaagctcaagatagaagatcaggagagagagatgaagctcgagaagctactccttctgaacgataaaagggagcaggcaagagaagatctgaaggggcttgaggaaaccgtgtccagggaactccagactctgcacaatctgagaaagctattcgttcaagacctgaccacccgcgtaaaaaaaagcgtcgagctggataatgacgacggcggaggcagtgctgcacagaagcagaagatctctttcttagaaaacaatctcgaacagctgactaaagtgcacaagcaactggtgagggacaatgcagacctgcgctgcgagctgcccaaattggagaagagactgagagccaccgctgagagagttaaagcacttgagtctgcactcaaggaggctaaagaaaacgccatgagggaccgcaagcggtaccaacaggaggtggatcggatcaaggaagccgtgcgggcaaaaaatatggcccgccgtgcacacagcgcacagatcgctaagccaatccgtcccggtcactaccctgcgagttctcccaccgcagtacacgctatcaggggcgggggggggagctccagcaatagcacccactaccaaaaatag

SEQ ID NO: 192485 - DNA, 2874 bp, Artificial Sequence
  Description of Artificial Sequence: Synthetic coding sequence
atggccgaccccgccgagtgcagcatcaaggtgatgtgccggttcagaccactaaacgaggcagaaattcttaggggggacaagtttatcccgaagttcaagggagatgagacagtggtgattggtcaggggaaaccttatgtgtttgaccgggtgcttcctccgaataccacgcaggagcaggtgtacaacgcctgcgctaagcagattgtcaaagacgtacttgagggttataacgggaccattttcgcctacgggcagaccagctctggcaagactcacaccatggagggcaagttacacgacccgcagctgatgggcatcataccccgtatcgcccacgatatctttgaccatatttattctatggacgaaaacttggagttccacataaaggtatcctactttgagatatacctcgacaagatcagagatctgttggacgtcagcaagacaaacctggccgtgcacgaagacaaaaatagagtgccatacgtaaagggctgtaccgaaagatttgtaagttcacccgaagaggttatggacgtgattgatgagggtaaggcgaacagacacgtcgccgtgactaatatgaacgaacacagcagccgctcacactctatatttctgataaacattaaacaggaaaacgtagaaacagaaaaaaaactcagtggcaagctctacttggtggaccttgcgggctccgaaaaagtctcaaagaccggtgccgaaggggctgtcctcgacgaggcaaagaatatcaataagagccttagcgctcttggtaatgtgattagtgctttggcggaaggaactaaaacacatgttccctatcgcgattccaagatgacccgcatattgcaggatagcctcggggggaactgcagaacgacaatcgttatatgttgctcacctagtgtgtttaacgaggcagaaaccaaaagcacgctaatgttcgggcagcgcgctaagacaatcaaaaacaccgtctcagttaacctggaactcacagctgaagagtggaaaaagaagtacgagaaggagaaggagaagaacaagactctgaagaacgtgatccagcacctggagatggagctgaacagatggcgcaacggtgaggccgtacctgaagacgagcaaatttccgctaaagatcaaaagaacttggaaccatgtgataacacaccaatcattgacaacatagcaccagtcgtagcaggaatttccacagaagaaaaggaaaagtatgatgaggaaatttcctcactttacagacagttagatgataaagatgacgagattaatcaacagtcccagttggccgagaagctcaagcagcagatgttagaccaggacgagctgttagcttcaactcggagggactatgagaaaatccaggaggagctcacacgtttgcagatagagaacgaagccgccaaggacgaagtcaaagaggttctacaggccctggaagaactcgctgtgaattatgaccagaaaagccaagaagtggaagacaaaacccgagcaaatgaacagctcacagacgagttggctcagaaaaccaccaccttaaccactacccagagagaattaagccagctgcaggagctcagtaatcaccagaaaaaacgggccaccgagatactgaacctgctcctgaaagatttaggggagattggcggaatcatcggcactaacgacgtaaaaacacttgctgacgtaaatggagtaatcgaagaggaatttaccatggcccggctctacatctctaagatgaagtctgaagtgaaaagcctggtcaatagatccaagcaactcgagagcgcccaaatggattctaaccgcaagatgaacgccagcgagcgcgaactggcagcgtgccagctgctgatctcacaacatgaagcaaagatcaagagcctcaccgattacatgcaaaatatggaacagaaacgtagacaactcgaggagtcacaagacagtctatctgaagagctagccaagctccgggcccaagagaaaatgcacgaggtgagtttccaggataaggaaaaagagcatctaacaaggctccaggatgctgaggaaatgaaaaaggcactagaacagcagatggagtcacatagagaagcacatcaaaagcagcttagccggctgagggatgaaatagaggaaaagcaaaagattatcgatgaaatccgggacttaaaccaaaagcttcagttagagcaggaaaagctaagcagcgactataataagctgaagattgaggaccaggagagagagatgaaacttgagaagctgcttttgttgaacgacaaaagggagcaggcacgggaggatttgaaggggctggaagagaccgtgtctcgggaactgcagactttacacaatctacggaagctgtttgtgcaagatttaacaacaagagtcaaaaaatcagtcgagctggataacgacgatggaggcggctccgctgcccaaaagcagaagatctccttcctggagaacaatctagagcaactgaccaaagtacataagcagctagtacgcgataacgcagatctccgctgtgaacttcccaagttggaaaaaagactacgcgctacagcagagcgggtgaaagccctggagtctgccttgaaggaagctaaagagaacgctatgcgggaccggaaaagatatcaacaggaagtcgacagaatcaaagaagccgtccgcgcaaaaaacatggcccgccgcgcccactcggcacagatagcaaagccgatcaggcccggccactatccagcttcctccccaacggctgtacatgcaatccgcggcggcggtggctcaagttctaatagtacccattaccaaaaatag

SEQ ID NO: 192486 - DNA, 219 bp, Artificial Sequence
  Description of Artificial Sequence: Synthetic coding sequence
atggccgaccccgccgagtgcagcatcaaggtgatgtgccggttcagacctttgaatgaggccgaaatcctacgcggcgacaaattcatccccaagttcaaaggcgatgagacagttgtgattggccagggcaagccctacgtctttgaccgcgtcttaccacccaacacaacccaggagcaggtgtataatgcctgcgccaaacagatagtcaaatag

SEQ ID NO: 192487 - DNA, 552 bp, Artificial Sequence
  Description of Artificial Sequence: Synthetic coding sequence
atggagcagcggctggccgagttccgggccgcccggaagcgggccgggctggccgctcagccacccgctgcgtctcaaggagcacagactcccggagagaaagctgaagccgccgcaactctcaaagcggctcctgggtggctcaaacgattcctggtgtggaaaccacgtcccgcgtccgcccgggctcagccagggctggtacaggaggcagctcagccacagggttcgacaagcgaaaccccatggaacacagcaattcctctgccctcctgctgggaccagagttttttgacaaatatcacattcctcaaggtcctgctctggttggttctgttgggcctgtttgtggaactcgaattcggcctcgcctactttgtattatcgttattctactggatgtatgtgggtacacggggcccggaagaaaaaaaagaaggcgagaagtctgcatatagcgtgtttaatccagggtgcgaggctattcaggggaccctgactgcagaacagctcgaaagggaacttcagctcagacccctggcgggcaggtag

SEQ ID NO: 192488 - DNA, 2445 bp, Artificial Sequence
  Description of Artificial Sequence: Synthetic coding sequence
atggtgaagcagaccatccagatcttcgcccgggtgaagccccccgtccgaaaacatcagcaggggatttactctatagacgaagacgaaaagttgataccatcacttgagattattctaccgagggacttagcggatggcttcgtgaacaacaagcgcgaatcctacaaatttaagtttcagcgtatctttgaccaagacgctaatcaggaaactgtctttgaaaacattgccaagccagtagctggatctgtgctcgctggctataatggcaccattttcgcttatggtcaaaccggcagtggcaagacttttacaattaccggcggtgccgagcggtattccgacagaggaattatccctaggactttatcgtatatcttcgaacagctgcagaaagactctagcaagatttacacgacacacatctcatatttggaaatttacaatgagtgtggctatgatttactcgatccccggcacgaggcttcaagcctggaagaccttccaaaggtgacgattcttgaggatcccgaccagaatattcatctaaagaatctaactctgcaccaggcaacaactgaggaagaagctctgaacttactgttcctcggggacaccaatagaatgatagcagagacaccaatgaatcaggcgtctacccgcagccattgtatcttcactattcatctgagctctaaggagcccgggagcgccacagtcaggcatgccaagttgcatctcgtggacctggcggggtctgagagggtcgctaaaaccggtgtggggggccacctgctcaccgaggccaaatacatcaacttgagtctgcactacttggagcaggtgataatcgctctctccgaaaagcaccggtcccacattccatacaggaatagcatgatgacttccgtgcttagggattctttgggaggcaactgcatgaccactatgattgctaccctcagcctggagaaacgcaacttagacgagtccattagcacatgtaggttcgcccagagggtggccttgattaaaaatgaggccgtgttgaacgaggagataaacccccggcttgtgattaaacgcctacaaaaggaaatccaagaactcaaggacgagttggccatggttacaggcgaacagagaactgaagctctcacagaagcagagctgttgcaacttgagaagttaattacttccttcctggaagatcaggattcagacagtagactagaggttggggcagacatgaggaaagtacatcattgcttccatcacttgaaaaaactcctgaatgacaagaaaattctagagaacaataccgtgagctctgagtctaaggaccaagactgtcaggagccgcttaaggaagaggagtatagaaaactgagggatatcctcaagcagagagataatgaaattaacatcttagtgaacatgctgaaaaaagaaaaaaagaaggctcaggaagcacttcaccttgccggtatggaccgacgcgaattccgccagtcccagagccccccattcagattgggaaatcctgaggagggtcagcgaatgcgactgtccagcgctccatcacaggcacaggacttttccatcttaggcaaacgtagtagcctcctccacaagaagatagggatgagggaggaaatgagcctgggttgtcaggaggctttcgagatttttaagcgggaccatgccgatagtgtcactattgacgataataagcagattttgaagcaaagattcagtgaagccaaggctttgggagagtctataaatgaggccaggtcaaagatcggccatctcaaagaggagataactcagaggcatatccagcaggtggccctggggatttctgaaaatatggctgtgcctctgatgccagatcagcaggaggagaagctgagatcacagctagaggaggaaaagcggcggtacaagaccatgtttacccggttgaaggctctgaaggtggagatcgagcatctccagctcttgatggataaggctaaggttaagctgcaaaaggaattcgaagtgtggtgggccgaggaagccaccaacttacaggtcaatagccctgctgtgaattccctggaccacactaaaccatttctgcagacctctgattcccagcatgaatggtctcagctccttagtaacaagtcctctggcggctgggaggtgcaagatcagggtaccggccggtttgacgtttgtgatgtgaacgcgcgcaaaatcctcccatctccctgcccatccccacactctcaaaagcagtcatctacctctacacctctagaagattctatccccaagcgcccggtttcatcgatccctctcacaggtgattctcagaccgattccgacattatcgctttcataaaagctcggcaatccatcctgcagaagcaatgtctgggatccaactag

SEQ ID NO: 192489 - DNA, 498 bp, Artificial Sequence
  Description of Artificial Sequence: Synthetic coding sequence
atgatcgccgagacccccatgaaccaggccagcacccggagccactgtattttcaccattcatttaagctcaaaggaaccaggaagtgcaaccgtaaggcacgccaagttacacctagtggatctagccggctcagaaagagttgccaaaaccggagtgggagggcatctgctgaccgaagcaaagtatatcaacctgtccttacattacctcgagcaggtcattattgcactgtctgagaagcaccgttcacacatcccttaccgtaatagtatgatgacatccgttcttcgtgattccctcggcggtaactgtatgactactatgattgctacattatccctggagaagcggaatctggacgagtccatctccacctgcagattcgcacagagggtcgctctgattaagaacgaggcagtactcaacgaggaaataaacccgcgactgaaggccccctcctcttccgatggtgtacttttttgtcggaaccaatag

SEQ ID NO: 192490 - DNA, 1962 bp, Artificial Sequence
  Description of Artificial Sequence: Synthetic coding sequence
atggccagcagcctgtacgacctgaagaaggtgaccatcctggaggaccctgatcaaaacattcatctgaagaatctgaccctgcaccaagccacaactgaagaagaggcgctcaatctcctgttcctgggggacaccaatagaatgatcgccgaaacacctatgaatcaggcatcgacccggtcccattgcatctttactatccatctgtcctcaaaggagcccggatccgccaccgttcggcatgccaagcttcatctagtggacttggctggaagcgagcgcgtggccaaaacgggagtgggagggcacctactgacggaagcaaagtatataaatcttagtctccactacctggaacaagttattatcgctctgtctgagaagcaccgcagccacatcccttaccggaacagcatgatgacgtcagtgctgcgcgactcgttaggtggaaactgtatgaccactatgattgcaaccctatcgctggaaaagcggaacctagatgagagcatatctacatgcaggttcgcacagagggtcgctcttattaaaaatgaggcagttctcaacgaggaaatcaatccccgcttagtgattaagcgtctccaaaaagagattcaggagttgaaggatgaactcgcaatggtgactggggagcagcgcaccgaagcactgacggaggcagaactattgcagctggagaagctgataacgagcttcctggaagaccaggattctgactccagactggaggtgggggctgatatgaggaaagtgcatcactgttttcaccatctgaagaagttactcaatgataagaaaatcttggaaaataataccgtatcatccgaatcaaaggaccaagattgccaggagccactgaaggaagaggagtatcgaaaactgagagatatactaaaacagagagacaatgaaatcaacattttagtgaacatgctgaagaaagagaaaaaaaaggctcaggaggccctccacttggccggcatggatagacgtgagtttcggcagagccagtccccgccctttcgactgggtaatccagaggagggacagcggatgcgcctgtccagcgccccgtcacaggcacaagacttttccattttggggaagcggagctcactgctccataagaagatcggtatgcgcgaagaaatgagcctggggtgccaggaagctttcgagatctttaaacgtgaccatgccgactccgtcaccattgacgacaacaagcaaatcctgaaacagcgctttagcgaggccaaagccctgggtgaaagcattaatgaggccagatccaagataggtcacttgaaagaggaaattactcagagacacattcagcaggtcgccctggggatctcagagaatatggcagttcccctgatgccagaccaacaggaagaaaagctcagaagccagctcgaagaagagaaaagaagatataaaacaatgtttactagacttaaggccctcaaagtggaaatcgaacaccttcagctgcttatggacaaagctaaagtaaaactgcagaaggagttcgaggtatggtgggctgaagaggctacaaacctgcaggtcaacagcccagcagtgaacagtctggaccataccaaaccattcttgcagactagtgactctcagcacgaatggtcccagttgctgtccaacaagagtagcggaggctgggaagttcaggatcagggtaccggccggttcgatgtgtgcgacgtgaacgcccggaaaatcctccccagcccgtgtccaagtccccatagccagaaacagtcttctactagcactcccctggaggatagcatcccaaagcggcccgtctcttccattcccttgacaggagacagccagaccgatagcgacattatcgcctttatcaaagctagacagagcatcctacagaagcagtgcttgggttcaaactag

SEQ ID NO: 192491 - DNA, 2394 bp, Artificial Sequence
  Description of Artificial Sequence: Synthetic coding sequence
atggtgaagcagaccatccagatcttcgcccgggtgaagccccccgttcggaagcatcagcaaggaatctatagcatcgacgaggacgaaaagctgatcccatccctcgaaatcattttgcctcgcgacctcgccgatggattcgtaaacaataagcgcgagtcgtataaattcaagtttcaaagaatcttcgaccaagacgccaaccaggaaacagtcttcgaaaacattgctaagcccgtcgcagggagcgtactggccggttacaacggtaccatttttgcttatggccagacgggctccggaaagacttttacaattaccggcggggcggagaggtactcagaccgcggcattatcccgagaaccttgagctatatattcgagcagctccagaaagactcatcaaaaatatatacgacgcacatcagctacttagagatctataacgagtgtggttatgatctgctcgacccgcgtcacgaggctagttcccttgaagatctgcctaaagttacaattctggaagatcccgaccagaatatccaccttaaaaacttaaccctgcaccaggctacgacagaggaggaagctctgaatttgctcttcctgggcgacactaatcgcatgattgccgagactcccatgaatcaggcctcaactcggtctcactgcatctttactatccacctctcaagtaaggaacctggctcagcgacagtgaggcatgccaagctgcatttagttgatttagccggatccgaaagagtagccaagactggggtggggggccatctcctgactgaggctaagtatatcaacttaagtttgcattacctggaacaggtgattatcgccctgagcgagaagcacaggtctcatattccttaccgaaacagcatgatgactagtgtgcttcgagactcacttggtgggaactgcatgactacaatgatagccacgctttctctggaaaaaaggaatctggatgagtctattagcacttgtcgcttcgctcagagggttgctttaatcaagaacgaagccgtccttaacgaggagataaaccccagattggtaataaagcgcctgcagaaggaaatccaggagctcaaggatgaactggccatggtgactggcgagcaacgaacagaggcgctcaccgaagctgagctcctgcaactcgagaagctgataacctcctttctggaagatcaggattcagattctcggctagaggtaggagccgatatgaggaaagttcatcactgctttcatcatctgaagaagctgctgaacgacaagaaaattcttgagaataacacagttagctccgagagcaaggatcaagactgccaggaaccactgaaggaggaagagtaccggaagttgagagacatcttaaagcagagggacaacgaaatcaacatactggtgaatatgttgaaaaaagagaagaagaaggcacaggaagcattacatctcgctggaatggaccggagggagttcagacagtctcagtctcctccctttagactgggcaatcccgaggaaggacagcgcatgcgtctcagctctgccccctcccaggcacaggatttctctatactgggaaagaggtcgagccttctgcataagaagattgggatgagggaagaaatgtctctaggttgtcaggaggcctttgagatttttaagcgggaccatgcagattctgtcactatcgatgacaataagcaaattttgaaacagcgattttcagaagccaaagccttgggcgaatccattaatgaagcgagatccaagattggcattagcgaaaacatggccgtgcccttaatgcctgaccagcaagaggagaagctgcgttctcagcttgaggaagagaagagacgctataagacaatgttcacacgtctcaaggccctaaaggtggaaattgagcacctccagctgctgatggataaggcaaaggtgaaactccagaaagagttcgaagtgtggtgggcagaggaagccacgaatcttcaggtaaattctccggccgtaaattcgcttgaccacactaagccgttcctccagaccagtgattctcagcacgagtggagccagctgctgtctaacaaatcgtcgggagggtgggaggttcaggaccagggcactggtcggttcgatgtttgtgatgtgaacgcacgcaaaatcctgccctccccttgcccatccccgcacagccagaaacagtcgagcacttctacaccactggaagacagtatccctaagcgacctgtgagtagtatacccctgactggggacagtcagactgattctgatatcatagcttttatcaaagcaaggcagtcaattcttcagaaacagtgtctcggctcaaactag

SEQ ID NO: 192492 - DNA, 2394 bp, Artificial Sequence
  Description of Artificial Sequence: Synthetic coding sequence
atggtgaagcagaccatccagatcttcgcccgggtgaagccccccgtaaggaaacatcaacagggcatttactccatagacgaggatgagaaactgatcccttcactcgaaatcatcttgccacgggatctggctgatggctttgttaataacaaaagggaatcctataagttcaaattccagcggatctttgatcaggacgctaatcaagaaaccgtattcgagaacatcgctaaacccgtcgctgggagcgtgctggctgggtataatggtacaatttttgcatatggacaaactggatcaggtaaaacttttaccatcactggtggtgcagagagatactcagatcgtggcatcatcccacgaaccctgtcctacatttttgagcagctccaaaaggattcatctaaaatctacacaacgcacataagctatctggaaatctataatgaatgcggctacgatcttctcgaccctcgccatgaagcctcctctttggaggacctgccaaaagtgactatcctggaggacccagaccagaacattcatctgaagaatctaacactacaccaagccacgacagaagaagaggcactcaatctgctattcctgggcgacactaacaggatgatcgcagaaacacctatgaaccaagcctcgactagatcacattgcatctttaccatccacctctcatcaaaagaaccagggtccgcaaccgtgaggcatgcaaagcttcacctggtcgacctggccggatcagaacgtgtcgcgaaaacaggagtgggcggtcatttgttaaccgaagctaagtacatcaacttaagcctccattatttagagcaggtcatcattgcccttagcgaaaagcaccggtcccacattccatatcggaacagtatgatgacatctgtactccgagacagtctcggtggcaactgcatgacaacaatgattgcaacgctttcattggaaaagcggaacttggatgagtctatctctacatgtcggtttgctcagcgggttgccctaatcaagaatgaggctgtgcttaatgaagaaatcaacccacgattagtcattaaaaggctgcagaaagaaatccaggaactgaaagacgagctcgcgatggtgacaggtgagcaacggaccgaggcgctcacagaggccgagttactccagctggagaaactgattacaagtttcctggaggaccaggactccgattctcgcctcgaagtgggcgcggacatgcgcaaagttcaccattgctttcaccatctgaaaaagctactgaacgataagaagatactcgagaataacactgtgagtagcgaaagcaaagatcaggactgccaggagccacttaaggaagaggagtataggaagctgagagatatccttaagcaacgcgataacgaaattaacatcctggtgaatatgttgaaaaaagagaagaaaaaggcccaggaggccctgcacctggccgggatggataggcgcgagttccggcagagtcaaagtccaccatttcgcttaggaaatcccgaggaaggccaaaggatgaggctgtcctccgccccatcccaggcacaggatttttccatactcggcaaaagaagctccctgctgcacaaaaagatcggaatgcgagaagagatgtccctcggttgtcaggaggcgttcgaaatctttaaaagagaccacgctgacagcgtgacaatagacgataacaaacagattctgaagcagcggttttccgaagcaaaggccctaggagagtccattaatgaggcccgctcaaaaattgggcatctgaaggaagagataacccagcgacacatacaacaggtggccctgggtataagtgagaacatggcggttcccctgatgccagatcagcaagaggagaagctgcgcagccagctggaggaggaaaaaagacgctataagaccatgtttactcgcctcaaggcccttaaggtggagattgagcaccttcagttactaatggacaaggctaaggtcaagctccagaaagaatttgaagtgtggtgggccgaggaggccactaaccttcaggttaattcacccgcagttaacagcctggaccacaccaaacccttcctgcaaacttccgactcccaacacgagtggtcccagctgctgtcaaataaatccgacgtgaatgctcgaaaaatcctgccaagcccctgtccttcaccacactcacaaaagcaatcatctacatctaccccacttgaggatagcatcccgaaaaggcccgtgagctcaatcccgttgacaggggacagtcagaccgatagcgacataatcgcattcataaaggctaggcagtctatactacagaagcagtgcctaggcagcaactag

SEQ ID NO: 192493 - DNA, 747 bp, Artificial Sequence
  Description of Artificial Sequence: Synthetic coding sequence
atgcgggaggagatgagcctgggctgccaggaggccttcgagatcttcaagcgggaccatgcggattctgttaccatcgacgataacaagcagattctgaagcagaggttttcagaggctaaggctctaggagaatctatcaatgaggcgagatcgaaaatcggacacttaaaggaggagatcacacaaaggcacatacagcaggtggctttagggatttcagagaatatggcagttccattgatgcccgaccagcaggaggaaaagctgaggagtcagttggaggaagagaaacgtcgttataaaacaatgttcactcgattaaaagcactgaaagtggaaattgagcatctgcagcttctcatggacaaggccaaagttaagctgcaaaaggaatttgaggtttggtgggctgaagaagcaaccaaccttcaagtaaacagtcctgcggttaactcccttgatcataccaagccctttcttcagacatccgactcccagcacgaatggtcccagttactgagtaacaaaagcgacgttaacgcgcgcaaaatcctcccatctccttgcccatcaccacattcccagaaacagagctctacgtcaactcccctggaggatagcattccaaagcgccccgtgtcctccatcccactcacaggtgacagccagactgacagcgacatcatcgcgtttattaaagctcgtcagagtattctgcagaaacaatgtctcgggagcaattag

SEQ ID NO: 192494 - DNA, 486 bp, Artificial Sequence
  Description of Artificial Sequence: Synthetic coding sequence
acccccatgaaccaggccagcacccggagccactgcatcttcaccatccatttatctagcaaggagcccggcagcgccacggtccgacacgccaagctgcaccttgttgatctagcgggctccgagagagtcgccaaaacgggggtgggaggacatctgcttaccgaggccaaatatataaatctcagtctccactacttagaacaggtgattatagccctgagcgaaaagcatcgaagccacattccgtacaggaatagcatgatgacctctgttctccgcgatagtctgggtggaaattgcatgaccaccatgattgcgacactttcactggagaagcggaatttagatgagtctatctcaacctgcagatttgcccagcgcgtggcactgatcaagaacgaagcagtcctaaacgaagaaattaacccacgcttaaaggcccccagctcctcagacggcgtcctgttttgccgaaatcaatag

SEQ ID NO: 192495 - DNA, 2070 bp, Artificial Sequence
  Description of Artificial Sequence: Synthetic coding sequence
tgaggcgccgagcggtacagcgaccggggcatcatcccccggaccttaagttacatctttgaacagcttcagaaagactcctcaaagatttacaccacacatatctcctatctcgaaatatataacgaatgcggatatgatctgctggatcctcgccacgaggcttcttcgctggaggacctacccaaagtgactattctcgaggaccctgatcagaatatacatctaaaaaatttgacgctgcaccaagcaacaaccgaggaggaagcccttaacctgttgttcctgggcgacactaacagaatgatagctgagactcccatgaaccaggcctcaacaagatcacattgtatcttcaccattcatctgagcagtaaagaaccagggtcagctacagtccgacatgctaaattgcacctggtggacctagcaggctctgaacgggtagctaaaactggagtgggcggacatctgctcaccgaagcaaagtatattaacctgtcgctgcactacttggaacaagtgataatcgccttatcagaaaagcatcgcagccacataccctatcggaactctatgatgacctctgtcttacgagattcccttggggggaactgtatgacaactatgatcgctaccctctcactggaaaagagaaatctggacgaaagcatctccacttgtcggtttgcccagcgtgttgctctgatcaaaaacgaagctgttctcaatgaagagatcaatccacgactcgtgataaagcgcctgcagaaagagattcaagaactgaaggatgagttggccatggtcacgggcgagcagcgtactgaagcgttgacagaggctgaactgctccaattagagaagcttatcacgagtttccttgaggaccaggacagtgattcccgcctggaggtgggggccgacatgagaaaggtccaccactgctttcaccatttaaagaaactacttaacgataaaaagattctggagaataacaccgtcagctccgagagtaaggaccaggactgccaggaacccctgaaggaggaagagtacagaaagctccgggatattttaaagcagcgcgacaacgaaatcaatatactggtgaatatgctcaagaaggagaaaaagaaggcacaggaagcactgcatcttgccggtatggacaggcgcgagtttaggcagagtcagagtccaccgttccggctgggcaatccagaagaggggcagcggatgaggctcagtagcgccccaagccaggcccaggacttcagcattctgggcaaaagaagttctctacttcataagaagataggtatgagagaagagatgtcactcggctgccaagaagctttcgagatctttaagagagaccatgccgatagcgtgacaatcgatgataataagcagattctgaaacaaaggtttagcgaggccaaagccctgggggagagcattaatgaagcacgcagcaagattggacacctgaaggaagagatcacccagcgccatattcaacaggtggcactcgggatctccgaaaacatggccgtgcccctgatgccagaccagcaagaagaaaaactgcgatcgcagctggaagaagaaaagagaaggtacaaaaccatgttcacacgccttaaggcacttaaggtagagattgaacatttgcaattgctcatggataaagctaaagtaaaattgcagaaggaattcgaggtctggtgggctgaggaagctactaatctgcaggtgaatagtcctgccgtgaattccttggatcacaccaaaccatttttgcaaacatccgacagtcagcacgaatggtcgcagttactgtctaacaagtccgatgtcaatgcaagaaagattctgccgagtccatgcccaagcccccactcgcagaaacagtcaagcacatcaacacccctggaggattccatacctaaacgtcctgtgagttcaatccccctcacaggggattcccaaaccgacagcgacatcatagcctttattaaggcccgccagtccatcctccaaaagcagtgtctggggtcaaattag

SEQ ID NO: 192496 - DNA, 2277 bp, Artificial Sequence
  Description of Artificial Sequence: Synthetic coding sequence
atggtgaagcagaccatccagatcttcgcccgggtgaagccccccgtcaggaagcaccaacagggaatttattcgatagacgaggacgaaaagttaatcccctcactggagattatcttaccccgagacctcgccgatggatttgtaaacaacaagcgggagagttacaagttcaagttccagcggatcttcgatcaagatgcaaatcaggaaaccgtgtttgaaaatatcgccaaacccgtggcggggtcggtgcttgcagggtacaatggcacaatcttcgcgtacggtcaaaccggcagcggcaagacattcacaataaccggcggggcagagaggtactccgatcgaggaataattccgagaaccctgtcttacattttcgaacagctacagaaagacagttctaagatctatactacccacattagctatctggagatctacaatgagtgcgggtatgatctgctggatcctaggcatgaggctagcagtctcgaggacttgcccaaggtaaccattctggaagatcccgatcagaatattcacttaaagaatctgacattgcatcaggctacgaccgaggaagaggccttaaaccttctctttctgggggatactaacaggatgattgccgaaaccccgatgaaccaggccagcactcgctcccattgcatctttaccattcatctgtcgtctaaagagccgggctcagccaccgtcagacacgccaagttacatctggttgatctagctggcagcgagagggtcgccaagacaggtgtcggaggccacctgctgacagaagctaaatatatcaatctgtccctccactacctggagcaggtcataattgcccttagtgaaaaacatcggtcacacatcccctatcgcaacagcatgatgacttcggtgctccgagattctttgggcggtaactgtatgacaacaatgatagccaccttatccctggagaaacgaaatctggacgagagcatctcaacttgcagattcgcacaaagggtcgccctgatcaagaatgaagcagttctcaatgaagaaattaatccacggctggtaatcaaacgtctacaaaaggaaattcaggagctaaaagacgagttggccatggtaaccggtgaacagcgcaccgaagctctcaccgaggccgaactgctgcagcttgagaagctaattacgagctttcttgaagatcaggactctgattcaagactggaggtgggtgctgatatgcgcaaggtgcaccactgctttcatcacctcaagaagctgcttaacgacaagaagatcctcgagaacaataccgtttcttcggaaagcaaagaccaggactgccaagagccactcaaggaagaggagtatcgaaagctcagagatatcctgaagcagagggataatgagatatcaattctctcggaagtgatgaagaagttgccactgagttggtttgagaggggaatgcgcgaggaaatgtctctcggctgtcaggaagccttcgagatcttcaaaagagaccacgcggactcagtgactattgacgataacaagcagattctgaaacagagattttctgaagccaaagccttaggcgagagtattaacgaagcaagatctaagatcgggcacttgaaagaagaaataacacaaaggcacatccagcaggtggcccttggcatctccgagaacatggcggttccattgatgccagaccagcaggaggagaagctccggtcgcagctggaggaggaaaaaagacgttacaagactatgtttacacggttaaaggcattgaaggttgagattgaacacctgcaactgcttatggacaaagctaaagtgaagctccaaaaggagttcgaggtctggtgggcagaagaggctaccaatctgcaggtgaactctcctgcagtgaactctttggaccataccaagccattcctgcagaccagcgacagccagcatgagtggtcacagcttttaagtaataaatcaagcggaggctgggaggtccaggatcaaggcacggggcggtttgatgtttgcgatgtgaatgcgcgcaaaatccttccctccccttgcccctctccccactctcaaaaacagagtagcacctccacacctctggaggatagtattcctaaacgacctgtgagttccattccgctcactggcgattctcagactgatagtgacatcattgcttttatcaaggcccggcaaagcattcttcagaaacagtgtctgggaagcaattag

SEQ ID NO: 192497 - DNA, 516 bp, Artificial Sequence
  Description of Artificial Sequence: Synthetic coding sequence
atgcgggaggagatgagcctgggctgccaggaggccttcgagatcttcaagagggaccacgccgacagtgtgacaatcgatgataacaagcagatactgaaacagcgattctccgaggcgaaggcgcttggtgagtctatcaatgaggcaaggagtaaaattggtcatctgaaggaagagataacccaacggcatattcagcaggtagccctggggatttcagaaaatatggctgttccgctcatgcctgatcagcaggaggagaaactccggtctcaactcgaagaggagaagagacgctataaaactatgttcacaagactgaaagcgcttaaggtggaaatcgagcacctgcaactcttgatggacaaagccaaagtgaaacttcagaaggagtttgaggtgtggtgggccgaggaggccacaaacctccaggtgaattctccagcagtcaactcgttagatcacaccaagagcaagattaaggctttagccgactccatgtctggtctgtag

SEQ ID NO: 192498 - DNA, 882 bp, Artificial Sequence
  Description of Artificial Sequence: Synthetic coding sequence
atgcgggaggagatgagcctgggctgccaggaggccttcgagatctttaagagggaccatgctgacagcgttaccatagatgataataagcagatcctcaaacaaagattctcagaggccaaggccctcggggaaagcatcaatgaagcacgcagcaagatcggccacctcaaggaagaaataacacagagacacattcagcaggtggccttgggcatctctgaaaatatggccgtccctctgatgcccgaccagcaagaagagaagctgcgctctcagctggaggaagaaaagcgtaggtataaaaccatgttcactaggttgaaagctcttaaagtggaaatcgagcaccttcagctgctgatggacaaggctaaggttaagctgcaaaaagagtttgaagtctggtgggcagaagaggctacaaacttacaagtgaactctccagcagttaactccttagaccacacaaaacccttcctccagacttcagatagccagcacgagtggtcgcagcttctgagtaataagtcaagtggaggctgggaggtgcaggatcagggtacgggtaggttcgacgtttgcgacgtgaatgcaaggaagatcttaccaagcccttgccctagccctcattcccagaagcagagttcaacgagcaccccgctggaagactcaatcccaaaaaggccggttagttctatccccctcactggggattctcaaaccgatagtgacattatcgcatttatcaaggccagacagtctatcttgcagaagcaatacctccagctcctttgctctttatttccgaagagcgctgtatcatcagcccaggcgtccactaacagaaagggcttatcggacgtactcgtgacacggtag

SEQ ID NO: 192499 - DNA, 4032 bp, Artificial Sequence
  Description of Artificial Sequence: Synthetic coding sequence
atgggcctggaggcccagcggctgcccggcgccgaggaggcccccgttagggtggccctgagggtgcgtccgctcctcccaaaagagctcctccacgggcaccagagttgcctgcaggtggaaccagggctcgggagagtcacactaggacgtgacagacactttgggtttcacgtggtgctggcagaagatgctgggcaggaggctgtgtatcaggcctgcgttcagcccctgctagaggcattctttgagggtttcaatgccacagtttttgcttacggccagaccggaagcgggaagacgtataccatgggtgaagcctcagttgccagcttgttggaggacgagcagggtatagttcctagggccatggcggaggcttttaaactgatagacgagaatgatctgctcgattgcttggtgcatgtgagttaccttgaggtatataaggaggaatttcgtgacttattagaggtgggcaccgcaagccgggacatacaactccgggaggacgagcggggtaacgtggttctgtgcggcgtgaaagaagtcgacgttgaagggctggatgaagttttgagcctgctggagatggggaacgccgcacggcataccggcgcgactcatcttaaccacctgtcctcccgcagtcacaccgttttcacggtcacattagagcagcgggggcgcgctcctagccgtctccctcggccggcgccaggccagttgttagtctctaaattccatttcgtggatctcgctggttccgagcgagtgttgaaaaccggcagtaccggcgagcggctgaaagaatctatccagattaactcatctctgctagccctgggaaatgttatctccgcgctgggcgatcctcaacgcagaggctcacacatcccatacagggactccaagatcacccggattctcaaagacagtctgggtggcaatgccaagacggttatgattgcctgcgtgtccccatcctcatctgactttgacgagaccctcaatacattgaattacgcatctcgcgcccagaatatcaggaacagagcaactgtgaactggcgacccgaggccgagcggcccccagaggagacggcttcaggggcccgtggaccgccgcgccaccggagtgagaccaggataattcatcgagggcgaagagccccaggccccgccaccgcttccgctgctgctgcaatgcgcttgggcgcggagtgtgcccgctatagagcatgcactgatgcagcttactcactgttgcgagagctccaagcggaaccgggactgccaggcgccgcagccaggaaggtgcgggattggctctgcgctgtggagggggaaagatccgccctcagctcagcttccggacccgacagtggaatcgagtcagcctctgtggaagatcaggcagcccagggagccggcggccgcaaggaagacgagggcgcccaacagctgttaacccttcagaatcaggtggctaggcttgaggaagaaaatagagacttcctagcggcactggaagacgcaatggaacagtacaagttgcagtcagacagactgcgagagcagcaagaagagatggtagagctgagactcagattagagcttgtaaggcctggatggggtgggccgaggctgcttaatggattgcccccgggatctttcgtgccacgccctcataccgcccccctggggggcgctcacgcccacgtcctggggatggtgcctcctgcatgcttgcctggtgacgaggttggttctgagcaaagaggcgagcaagtgacgaacgggagggaagctggcgccgagcttctgacagaagttaaccgcctgggttcaggttcctccgctgcaagcgaggaagaagaagaggaagaggagcctccaagacggactttgcacttgcgacgaaacagaatcagcaactgttcgcaaagggcaggggctaggcccggctccctgcccgaacgcaagggtcctgagttatgtctggaggagctggacgctgctatccctggatcacgggccgttggaggctcgaaagcccgcgtgcaggccaggcaggtgcccccagctacagcctctgaatggaggttagcacaggcccagcagaagattcgagaactcgccataaacattcggatgaaagaagaattgataggggagctcgtgaggactgggaaagccgctcaggccttaaaccgccagcactcacagagaattcgcgagttggagcaggaagcagagcaggtgagggcagaacttagcgaaggacagaggcagttgcgcgagttagagggaaaggaactgcaggacgccggcgagcgctcacgtctccaggagttcagaagaagggtcgctgccgctcagagtcaggtacaagtcctcaaagagaagaagcaggccaccgaacgccttgtttctctttctgcacagtccgagaaaaggcttcaagagttggagaggaacgtccagctcatgcgccagcaacagggccagctgcagagacggttgcgcgaagagacggagcagaaaaggcgcttggaggctgagatgagcaaaagacagcaccgggttaaagaacttgaactgaagcatgaacagcaacaaaaaattctgaaaattaagactgaagaaatcgctgcctttcagcggaaacgtcggagtgggagcaatggaagcgtggttagtctagagcaacagcagaagattgaggaacaaaagaagtggttggaccaggaaatggaaaaagtcttacagcaaaggcgagcgctggaggaactcggggaagaactgcacaaacgcgaggcaatattggccaagaaagaggcgctgatgcaggagaagaccgggctggaaagcaagcggctccgctcttcacaggctctcaacgaagacattgttagagtgtcatcccgactggagcacttagaaaaggaactatccgaaaaatccggccagcttcggcaggggtccgctcagtcacagcagcaaatacgaggcgaaattgatagcctgagacaagagaaagattcactgctgaaacagcggcttgagatcgacggcaagcttaggcagggatcactgctgtctcctgaagaggaacgaacccttttccagcttgatgaggccattgaagcgctcgatgcagcaatcgagtataagaatgaggcgattacgtgccgccaacgggtactacgcgcatcagcaagcctactgagccaatgcgaaatgaacctcatggccaagctgagctacctgtcaagcagcgagactcgggccctcttatgcaagtattttgacaaggtggtcacgttgcgggaggagcagcaccagcagcagatagctttctctgaattggaaatgcagctcgaggagcaacagagacttgtttattggttagaagtggcactagagcgtcagagattagagatggaccggcagttgacccttcagcaaaaagaacacgaacaaaacatgcaactccttctccaacagagtagagaccatctgggagaaggcttagccgatagccgacgccaatacgaggctaggattcaggccttggaaaaagagcttggccgatacatgtggattaaccaagaactgaagcaaaaacttgggggagtaaatgcagtcggtcacagtaggggaggagaaaagaggagcttgtgtagcgagggacgccaagcccctggcaacgaggacgagttgcacctggcccccgaacttctgtggctcagccctttgacagaaggagcccctcgaactcgggaagagactcgagacctcgtacatgcgcccttaccgctgacttggaaaagatcgtctctttgcggtgaggagcaaggctccccagaagagttgcgacagcgcgaggcggcagagcccctcgtggggagggttctgcccgtcggagaagccggactgccctggaactttgggccacttagtaaaccgcgtagggaactgaggagagccagccccggcatgatagacgtgcgaaagaatccattgtag

SEQ ID NO: 192500 - DNA, 2022 bp, Artificial Sequence
  Description of Artificial Sequence: Synthetic coding sequence
atggacccccagcggagccccctgctggaggtgaagggcaacatcgaactgaagcgccctctcatcaaagcccccagccagttgcccctaagtggtagccggttgaagcggagacctgaccagatggaagatggtcttgagcctgagaagaaacggactcggggccttggtgctactactaagatcacaacctctcaccctagagtgccttctctgacaaccgttcctcaaacacagggacaaaccacagcacaaaaggtcagcaagaaaaccgggccgaggtgctctaccgccatcgccacagggctcaagaatcagaaaccagtgcctgccgtccccgtacagaagtccggcaccagcggagtaccccctatggccgggggcaagaagccctcaaagaggcccgcttgggatctgaagggccagttgtgtgatcttaatgccgaacttaaacgttgcagagagcgaactcagactctggaccaggaaaaccaacagctacaggatcaactgcgggacgctcaacagcaggtcaaagccctcggaactgaaagaacaactcttgaggggcacctcgccaaggtccaggcacaagctgagcaggggcagcaagaactcaaaaaccttcgcgcctgcgtgctggagctggaggaaaggttgtctacacaggagggccttgtgcaggagttacaaaaaaaacaggttgagctacaggaggaaaggcggggacttatgtcccagctcgaggaaaaggagaggcgcctacaaacctctgaagctgccctctcctcatcccaagcagaggtcgcttctctgcgacaggagacagttgcacaagccgccctcctcacagagagggaggagagactgcacggactggaaatggagcgccgtcgcctccacaatcagctgcaggagctgaaaggcaacattagggtgttctgtagagtcagaccagtccttcccggagagcctacacccccaccgggactgctactgttccctagtgggcctggtggcccctcggacccacccacacgactgtccttgtccaggtccgatgagcgtagagggacactgtctggagctcccgcgccgcccacccgccatgacttttcttttgaccgcgtattcccacctggcagtggtcaggatgaggtgtttgaggagatcgctatgctggtccagagtgccctagacggataccctgtgtgcatctttgcctacggacaaaccggatctggaaaaacttttacgatggaaggcggcccgggcggcgaccctcagctggagggtcttattccccgggctctccggcacttgttttcagtagcacaggagctgagtggccaaggttggacctactccttcgtcgccagctatgtcgaaatttacaacgaaactgttcgggatctgctggccacaggaacccgaaaaggacagggcggggaatgtgagatcaggagagcaggtcccgggtcagaagagctcacggtgaccaatgcccgttacgtacctgtatcatgcgagaaggaagtggacgccctgctgcatctggctagacagaatcgagcagtggccagaacagcacagaatgaaagaagctcgcggagtcatagcgtcttccaactgcagataagcggtgagcattcatctcggggcctgcagtgcggagcacctctgtctttagtcgatctggccggcagcgaacgactggatccaggcctcgctctcggtcccggtgaaagagagaggctgcgcgagacacaggcaatcaattcgtccctgagtacactgggattggtgattatggccctgagcaacaaggagagccatgtaccctaccgcaactctaagctgacttatctcttgcagaacagtctgggaggttccgccaagatgcttatgttcgtcaatattagcccactcgaagaaaacgtgagcgaatccctgaactccctacgctttgcttctaaggttaaccagtgcgtgattggcactgctcaagctaatagaaaatag

SEQ ID NO: 192501 - DNA, 612 bp, Artificial Sequence
  Description of Artificial Sequence: Synthetic coding sequence
atggacccccagcggagccccctgctggaggtgaagggcaacatcgagctgaagagacccctaattaaagccccttcgcagcttcccctgagcggcagtaggctaaagcgtaggcccgatcaaatggaagatggcctggaacctgaaaagaaaaggactagagggctcggtgcgactactaaaattacgacatcacacccaagggtgccttctctaaccactgtccctcaaactcagggccaaaccacagggccaagctctcatccgctgccctggcaatgtcatcaccagccctttctggtgactgaccctggggggcggtcatgggggccgggtcaaaagtggcacaggttacatctgtggtgcacttctgctcagaaggtgagcaagaagactggccctcgctgtagcaccgcaatagctaccgggttgaagaatcagaaaccagtgccagccgtccctgttcaaaagtccggaacttctggggtaccccctatggcagggggtaagaaaccctcaaaacgccctgcctgggatctcaaaggccagctttgtgatctgaacgccgagttgaagagatgccgggaacggacacaaaccttggaccagtag

SEQ ID NO: 192502 - DNA, 612 bp, Artificial Sequence
  Description of Artificial Sequence: Synthetic coding sequence
atggacccccagcggagccccctgctggaggtgaagggcaacatcgaactgaaacggcccctcattaaggctcccagccagcttccgctgtccggctcccggctgaagcgtagacccgaccagatggaggacgggctggaaccggagaaaaaacgcacgagaggtttgggggccacaacgaaaatcacgaccagccaccctagggtaccttcccttactaccgtgcctcagacccaaggtcagacaactggccctagctctcatcctctgccctggcagtgccatcaccagccttttctagagaccgaccctggaggccgctcttggggacccgggcaaaagtggcatcgactgcacctgtggtgcactagcgctcagaaagttagcaaaaaaaccggtccaagatgctccaccgcaatcgccactgggttgaagaaccagaagcccgtgcccgcggtacccgtgcaaaagtcaggaacaagcggggtacctcctatggccggtggtaaaaagccaagtaaacgtcctgcctgggacctgaaagggcagttatgtgatctaaacgctgagttgaagaggtgcagagagcgcactcagacactcgatcagtag

SEQ ID NO: 192503 - DNA, 2022 bp, Artificial Sequence
  Description of Artificial Sequence: Synthetic coding sequence
atggacccccagcggagccccctgctggaggtgaagggcaacatcgagctaaagcgtcctttaatcaaagccccatctcagctgccccttagtggttctagactcaaaaggaggcccgaccagatggaggatggcttagagcccgaaaagaagcgtacaagggggctaggcgctaccaccaagatcacaacttcgcatcctagagtgccctcgctcaccacagttcctcagacacaaggccagacaacagcccaaaaagtctcaaagaaaaccggccctcgctgtagcacggcaatcgcaaccggattaaagaaccagaagccagtgcctgcagtccctgtccaaaagagcgggacgtctggtgtaccccctatggccggcgggaagaagcccagcaaaaggccagcttgggacttgaaaggccagctctgtgatcttaacgctgagctgaagagatgccgcgaaaggacccagaccctggatcaggaaaaccaacagctgcaggaccagctgagggacgcccaacagcaggttaaggctctgggaacggaacgcactacactggagggccatcttgcaaaagtccaggctcaggccgagcagggacagcaggagttgaagaacctcagagcctgcgtgttggaactggaggaaaggctttccacccaggaaggattggtacaggaactacagaaaaagcaggttgagctgcaggaggagcgaaggggtttgatgagccaacttgaggaaaaggaacggcgactccagacttcagaggccgctctaagctccagtcaggcagaggttgcaagtctccggcaggagacagtggctcaggcagcactgctgacggagcgcgaggagcggctgcatggactggagatggagcgacgccgcttgcataatcaattgcaggaactaaaggggaacatccgggttttctgcagagttagaccagtgctccccggagagccaaccccgccacctggactgctgctgttcccgagcgggcctggcgggcctagtgacccacccactagactgagcctgtccaggtccgacgagcggcgtggcaccctcagtggtgctcccgcacccccaacacgtcacgatttctcgtttgaccgggtgtttccacccggatctggccaggacgaggtctttgaggaaattgcaatgctggttcaaagcgcattggatggttacccagtctgcatttttgcttacggacaaacaggcagcggcaagacattcaccatggagggcggcccggggggagatccccagctggaagggctgattccccgtgctctccggcacctcttcagcgttgctcaagagttgtccggacaggggtggacatacagtttcgtggcaagctatgtcgagatctacaatgagactgtgcgagacctccttgcaaccgggacacgcaagggtcaggggggcgaatgcgagatcagaagagccgggcccggatccgaagagctgacggttactaacgctcgctatgtgcctgtttcttgtgagaaagaagtcgacgccctcctccacttggccaggcagaacagagcagtggcacgtactgcacagaacgaaagatcatcacgctctcatagcgtgtttcagctacagattagcggtgagcactcctcccggggtctgcagtgtggcgcaccgctgtcgctggtggaccttgccggatcagagagattggatcccgggctggcactcgggcctggggaacgcgaacggctgagagaaacgcaggctattaactctagcctctccacattgggcctcgtgatcatggccctgagcaacaaagagtcgcatgtcccctaccgaaactccaagttaacttacttactgcagaattctctcggaggatccgctaagatgctgatgtttgttaacatctccccccttgaagagaacgtgtcagagtcccttaactctctgcgttttgcctctaaagtcaaccagtgcgtcataggtaccgctcaggctaaccgcaagtag

SEQ ID NO: 192504 - DNA, 2022 bp, Artificial Sequence
  Description of Artificial Sequence: Synthetic coding sequence
atggacccccagcggagccccctgctggaggtgaagggcaacatcgagctcaaaagacctctgattaaagccccctcacagctgccactgtccggctcccggcttaagagaaggcctgaccaaatggaagacgggcttgagccggaaaagaagagaactagaggcctgggggcaactactaaaataacaaccagtcatcccagggtcccaagtctcaccaccgtaccgcagacacaaggacaaacaaccgcccagaaggtttctaagaagacgggtcctcggtgctccacagccatcgcgactgggttaaaaaatcagaagcccgtgccagcggtcccagtgcagaaaagtgggacgagtggcgttccaccaatggccggcggtaaaaagccttcgaaaagacccgcttgggatctaaagggccagctctgtgacctgaacgccgaactgaagcgctgtagggagaggacccagacactggatcaagaaaaccagcagttacaggatcagttaagggacgctcagcagcaggtgaaagctctaggaacggaaagaaccaccctggaggggcatctcgctaaggtgcaggctcaggctgagcagggccagcaagagttaaaaaacctgagggcctgcgtcttggagctggaagagagactgtctacacaggaaggactcgtacaggagctccagaagaaacaggtggagctccaggaggagaggcggggactgatgtcccagctggaagagaaagagagaaggctccagacaagtgaggcggcactgagctccagccaggccgaggtggctagtcttcgtcaagaaacagtagcccaagcagccctcctaactgaacgcgaagaacggcttcatggtttagagatggaacgcagaaggttacataatcagcttcaggagctgaaagggaatatccgtgtcttctgtcgcgttaggccggtcctgcccggggagccaacgccgccccctggcctgcttctcttccccagtggtccgggaggacctagcgaccccccgactcggctgagtctgtctaggtctgacgaacggcgaggtaccctatctggggctcccgctccgccgacccggcatgactttagttttgatcgggtgttcccgcctggcagcggacaggacgaagtgtttgaagagatagccatgttagtccagagcgccttggatggttacccagtgtgcatttttgcttatggccagaccggctccgggaagacgtttactatggagggaggtccaggaggtgatcctcaattagaaggactcatccctcgcgccctgagacatctgttttccgtggcgcaggaactgtctggccagggatggacatattccttcgtcgccagttacgtagaaatctataacgaaactgtgcgggaccttctcgctaccggcacccggaaaggtcagggaggggaatgcgagattaggcgcgccggccccgggtccgaagagctgaccgtcaccaacgcccgctacgtccccgtgtcctgcgaaaaagaggtcgatgcgctgctgcacctcgcgcgtcagaatcgggccgttgcccggaccgcccagaatgagcggtccagccgcagtcattctgtcttccagttacagatttctggcgaacatagttcaagggggctgcagtgcggggcccccctcagcctcgtggacctggcgggatccgaaaggcttgatccagggttggcgctgggacccggcgagcgggagcgcctgcgggagacacaagctataaatagctccctctccaccctgggccttgtgatcatggccctttccaataaggagtcacatgtgccttataggaatagcaagcttacatacctgttacagaattctctggggggcagcgccaaaatgctgatgtttgtgaatatcagccctcttgaggagaatgtctctgaaagtctgaacagcttgcgattcgcgagtaaggtcaaccagtgtgtgataggtaccgcccaggccaataggaagtag

SEQ ID NO: 192505 - DNA, 612 bp, Artificial Sequence
  Description of Artificial Sequence: Synthetic coding sequence
atggacccccagcggagccccctgctggaggtgaagggcaacatcgaactcaagcgtccactcatcaaggccccttcccaactgcctctctcgggctcacgacttaaaagaaggcccgaccagatggaagacggactggaaccagagaaaaagaggacgcgggggttgggtgccactacaaagatcaccacctcccacccccgagtgccatcgctaaccactgttccccagactcaaggccagactactggtccttctagccaccccctcccctggcagtgccatcatcagccattccttgaaacagaccccgggggacggtcctggggaccaggccaaaaatggcaccgcttgcatttatggtgcacctctgcacagaaagtgtctaaaaaaaccggcccccgctgtagtactgccattgcaacaggactcaagaaccagaaacccgtgcctgccgtcccagttcagaaatccggcacctctggcgtccctcctatggccggcggtaagaaaccttcaaaacgtcccgcctgggatttaaagggccaattgtgcgatctgaacgccgagttaaaacgctgtcgtgaaaggacccagaccctggaccagtag

SEQ ID NO: 192506 - DNA, 2502 bp, Artificial Sequence
  Description of Artificial Sequence: Synthetic coding sequence
atggtgcccagccggcggacctggaacctgggcgccacccccagcctgcggggtctgtggagggtggggagggcaccggagcctgaaccaggaatggcccgccccgctcctgccccggcgtctcccgccgctcgcccttttcctcatacaggtcctggcagattgcgaaccggaaggggcaaggatacccctgtatgcggagacgaggacagctcagccaggtcagccgcacggcctgccttagcacaatgtagggccctcagcgtcgactgggcagggcctggctccccacatggactgtacctgaccctccaggttgagcaccttaaagaaaagctcattagccaagcccaagaggtcagccgcctgcgttcggaacttggcggcacagatttagaaaaacaccgggatttgctgatggtggagaacgaaaggttacgccaggagatgagaagatgcgaagctgaactacaagagttgcggactaaacctgctggcccttgccccggctgtgaacattcccaggagtccgcacagctgcgcgataaactgagccaacttcagttggaaatggcggagagtaaggggatgttaagtgagctgaatttagaagtacaacaaaaaacggatcgcctcgcagaagttgaactccggttgaaggactgcctcgcagaaaaagcccaggaagaggagaggctcagccgccggcttagagacagccatgagactatagcgagtctgcgtgcacagtcccccccagtaaagtacgtgattaaaactgtcgaagttgagtcttctaagacaaaacaggcgctgtctgaatctcaggcaaggaaccagcacctacaagaacaggtggccatgcagcggcaagtgcttaaagagatggagcagcagctgcaaagttcacaccagcttactgcccgcctccgggcacagattgctatgtacgaaagtgaactcgagagagcccacggccagatgctggaggagatgcagagccttgaagaagacaaaaatagagccattgaagaagctttcgctcgggcgcaggtggagatgaaggcagtacatgagaatctggctggagttagaaccaatctgcttacgttacagccggcacttagaactctgacaaacgactataacgggctgaaacgacaggtccggggatttcccctgttgctgcaggaggccctgcgctctgtgaaggccgagattggtcaggctatcgaagaggtgaattctaacaaccaggagctgctccggaaatatcgcagggaactccaactgaggaaaaaatgccataacgaacttgtccggctgaaaggtaacataagggtgatcgctagagtgaggccagtgaccaaggaagatggtgagggccctgaggcaacaaacgcagtgactttcgatgcagatgatgattctattattcatctgctgcataagggtaaacccgtctcgttcgagcttgacaaagtgttcagcccacaggctagtcagcaggacgtattccaggaagtacaggccctggtcacctcatgcatcgatggatttaacgtgtgtatctttgcgtacggacaaaccggtgccggcaaaacttatactatggagggaacggctgaaaatccgggcatcaaccaacgagcactgcagctgctgttttccgaagtgcaggagaaggcgagtgattgggaatataccatcaccgtatcagcagcagaaatctataacgaggtcttgcgggacctgttgggcaaagagcctcaggaaaagttggaaataagactgtgtccggacggcagtgggcagctctacgtacctggattaacagagtttcaggtgcagagcgttgacgacataaataaggtgttcgagttcggacacacgaatcggactactgaattcaccaacttaaatgagcactcatctcgttctcacgccctccttattgttacagtacgtggcgttgattgcagcactgggctcagaacaacgggaaagctgaatttagtggatttagcgggttcagaaagagtgggaaagtctggagctgaaggatcccgcctacgcgaggctcagcacattaataaatcgttgagcgccttgggagatgttattgcggcgctacgctctagacaaggccacgtgcctttcaggaactcaaagctgacctatctgctccaggattctctttcgggagacagcaaaaccctgatggtcgtgcaggtttcccctgtcgagaagaacacctccgagactttgtactcactgaaattcgctgagcgcgttagatcagtggaactagggcccggtctgcggagagccgagctgggctcctggtctagtcaggagcatttagagtgggaacctgcctgtcaaacgccacaaccttctgcccgtgcccatagcgcccccagcagcggtacctcttcccggccggggtcaatcaggcgcaagttgcagccaagtggcaaatctcggccattaccagtctag

SEQ ID NO: 192507 - DNA, 2064 bp, Artificial Sequence
  Description of Artificial Sequence: Synthetic coding sequence
atggtggagaacgagcggctgcggcaggagatgcggcggtgcgaggcggagctgcaggagttaaggacaaaacccgccggcccatgtcctggttgcgagcatagccaggaatcagctcagctccgtgataagttaagtcaattacaattggagatggcggagtctaaagggatgttgtcagagcttaacttggaggtgcagcagaagaccgatcgcttggcagaagtcgagctgaggctgaaagactgccttgctgaaaaggcccaggaggaggaacgcctgtctaggcggttacgggacagtcacgagacaatagcttccttgagggctcagagtccacctgtgaaatacgtgattaaaactgttgaggtagagtcaagtaagactaaacaagccctgtctgaatctcaggcgagaaaccagcacctccaggagcaagtggcgatgcaaagacaggtcctcaaagagatggaacaacagttacagagctcgcaccagctgacagcccgactgagggcacaaatcgcgatgtacgagagtgaattagagagggcccacggccagatgctagaggaaatgcaaagtctagaggaggataagaaccgagctatcgaggaggccttcgcaagggcccaagttgagatgaaagccgtccatgagaaccttgcgggcgtgaggaccaaccttcttactcttcagcctgcacttagaacactgactaacgactacaatggactgaagaggcaggttaggggcttccctctacttcttcaagaggctctgcgtagtgtgaaggccgagatcggtcaggccatagaggaagtgaattccaataatcaggagctcctaaggaaatatcgcagagagttacaactgcgaaagaagtgccacaacgagctggtgcgacttaaaggtaatatccgggtaatagctagggtgcgaccagtcaccaaagaggacggcgaaggtcccgaggccactaatgcagtcacctttgacgcagacgacgattctataatacacctgttgcataaggggaagcctgtgtctttcgaactagacaaagtgttctccccccaggcaagtcagcaggatgtgtttcaggaagtgcaggccctcgtcacatcctgtatagacgggttcaacgtatgtatcttcgcatatgggcagacaggcgctggcaagacctacaccatggaggggacagcagagaatccagggattaaccagcgtgcccttcaactactgtttagtgaggtccaagagaaggcctcggactgggaatatacaatcacagtgtcagcagcagaaatatacaatgaagttctgcgcgatttactgggaaaagagccacaggagaagctcgagattagactctgcccagatgggtctgggcagttgtacgtaccaggactcacagagtttcaggtgcagtccgtggacgatataaacaaggttttcgaattcggccatacgaaccgcaccaccgagttcaccaatctcaacgaacattcctcaaggagccacgcactgctgattgtaacggtacgaggtgttgactgttcaactgggctgcgaaccaccgggaagctgaacttagttgacctggctgggagtgagcgagtgggcaaatccggtgccgagggttcgcggctccgggaagcacagcatatcaacaagtcactgagtgccctgggtgatgtgatcgctgccctgcgctccaggcagggacacgtcccgttccggaactccaagctgacgtatctgctgcaggactctctcagtggtgattctaagactctcatggtcgtacaggtctccccagtggagaagaatacgagcgaaacactttattccctgaaatttgccgaaagagtgcggtccgtagaactggggcccggccttcgccgcgcagagctcgggtcttggtcgtcccaagagcatctggagtgggagcccgcctgccaaacaccccagccttcagctcgtgcccattccgcaccatcgagcggcacatcttctcggcctggcagtatccgacgcaagcttcagccctccgcatag

SEQ ID NO: 192508 - DNA, 2481 bp, Artificial Sequence
  Description of Artificial Sequence: Synthetic coding sequence
atggtgcccagccggcggacctggaacctgggcgccacccccagcctcagaggtttatggcgagttggcagagccccagaaccagaacctggtatggctagacccgcccccgccccggcctcacccgcggccaggcccttcccacataccggccctggtaggctccgtacaggccgcggcaaagacacccctgtgtgtggcgacgaggattccagcgccagatctgctgcccgtcccgctttagcacaatgcagggcactgagtgttgactgggctgggccaggctcacctcacgggctgtaccttactcttcaggtggagcacctgaaagagaaactgatttcgcaagcacaggaagtgtcgaggctgagaagtgagctcggaggtacagacctcgagaaacatagggatctgctcatggttgaaaatgaaaggttgcgtcaggaaatgagacggtgtgaggctgagcttcaggagcttcgcactaaacctgcgggcccctgccctggatgcgaacatagccaagaatctgcacagctgagagacaagcttagtcagctccaactcgaaatggctgaaagcaaaggcatgctatccgagctgaacttagaagtacagcagaaaactgatcgcctcgccgaggtagagctgaggttgaaggactgtctcgctgaaaaggcccaggaggaagaacgcctgagccgccggcttagggattcacacgagaccatcgccagtctgcgcgcccagtcacctcctgtaaaatacgtcatcaagactgtggaggttgagagtagcaagactaagcaggctctcagcgaatctcaagctagaaaccagcacctgcaagagcaggtggccatgcagcgccaggtgctaaaggaaatggagcagcagctgcagagtagccaccaactaaccgcacgcctgagagctcagatagcaatgtacgaatccgagttagagcgtgcccatgggcagatgttagaagagatgcagtcattggaagaagataaaaaccgggcaatcgaggaggcttttgcacgggcccaggtcgagatgaaggccgtccacgagaacctcgctggggtaaggactaacttgctgaccttacagccagcccttagaacactcaccaatgactacaacggcctcaaaagacaggtgaggggcttcccattgctgcttcaggaagcactccgatcggtaaaagctgaaatagggcaagctattgaagaagtaaactctaataaccaggaactgctccggaaatacaggagggagttacaactccggaagaagtgccataatgagcttgtgcgtctgaaaggaaatatccgcgttatcgccagagtccgcccagttacgaaagaagatggggaaggtccagaggccactaatgcggtgacattcgatgcagatgatgactcaattatccacctactgcataaaggtaaacctgtatcatttgaattggacaaagtgttttcacctcaggcgagtcagcaggatgtctttcaagaggtccaggctctggtcacctcctgtatcgatggcttcaacgtgtgcatcttcgcctatggacaaaccggcgccgggaaaacatacaccatggaaggaacagccgaaaatccaggcattaaccagagagctctgcagctgctcttctccgaagtgcaggagaaagcctccgattgggaatatacaattacggtctccgccgcggagatttataacgaggtgctccgagatctgctggggaaagaaccccaggagaagctggagatacgtctctgccctgatgggagtggccagctgtatgtcccggggttaacagaattccaggtgcaatcagtggacgatatcaataaagtgttcgagtttgggcacaccaaccgcaccaccgaatttaccaacctcaacgagcactcctccaggagccacgcactgctcatagtaaccgttcgcggagtggactgttcaacaggcctccgaactactggaaagctcaacttggtggacctggcaggaagtgagagggtcggtaaaagcggcgccgaaggtagcagactgagggaggctcagcatataaataagagcctgtctgccttaggagacgtaatcgcagcactgagaagccgccagggtcacgtgcctttccggaattctaaattgacgtatctgctgcaagacagcctctctggagattctaagaccctcatggtggttcaagtatctcccgtggagaagaatacctcagagaccctatattcactgaaatttgccgaaagagttaggtccgtggaactcgggcctggtttaagacgcgcagaactgggctcatggtcctctcaggagcaccttgagtgggagcctgcctgtcagactccccaaccctccgcacgtgcacacagcgcgccttctagtggcacaagcagccgacccggctccatcagacggaagctgcagcctagtgcatag

SEQ ID NO: 192509 - DNA, 2307 bp, Artificial Sequence
  Description of Artificial Sequence: Synthetic coding sequence
atggtgctgcggatggtggaggccatgagccagctgcaggacgagaagacccagttgcaggaggaactggttgtgctgcaggaaaggctcgccctgagagactctgatcagcaggccaccagcacccaactccagaatcaggttgaacatttgaaggagaagcttattagccaagcccaggaggtgtccaggctaaggtcagagctcgggggaaccgatctggaaaagcaccgggacctgttgatggttgagaacgagcgcctgaggcaagagatgcgacgctgcgaggctgagctccaggaattgcgcacaaagcctgctgggccgtgtcccggctgtgagcactcacaggagtcggcccagcttagggacaagctgtcacagcttcaattggagatggccgaatccaaaggaatgctcagtgagcttaacctcgaggtgcagcagaagacagatcgattagcagaggtagagctgagactcaaggactgcctagccgaaaaggcccaggaagaggagcggctgagcaggcggcttagggactcccacgaaactattgcatccttgcgcgcccagagtccaccagtaaagtacgtcataaagacagtcgaagtcgaatccagcaagaccaagcaagccctgagcgagtctcaggcaaggaatcagcacttgcaggaacaagtggccatgcaaagacaggtgttgaaggagatggagcagcaactgcaaagctcacatcagctgaccgctcggcttcgagcccagatcgcaatgtacgaatctgaattggaaagagcgcatggacagatgttagaggagatgcagagcctcgaagaagacaagaatcgggcgatcgaagaggcctttgcccgtgctcaggtggagatgaaagctgtgcacgaaaacttagccggggtgaggacaaacctactgaccctacagccggctctgaggacactcaccaatgactataatgggctcaaacggcaggtgcgagggttccctttgctgcttcaagaagccctgcgtagcgtgaaggccgagattggacaggcaattgaggaggtcaatagcaataatcaggaactactaagaaaatatcgacgtgagctgcagcttaggaagaagtgccataacgagttagtgagacttaaagggaatatacgcgtgattgccagagtgcgtcctgtgaccaaggaggacggggagggccctgaggccactaatgcggtgacttttgacgccgatgacgactccattatacatctcctgcacaagggaaagccagtatcctttgaactggataaagtttttagccctcaagcttcacagcaggacgtcttccaggaggtccaagctctagtaacatcatgcattgatggcttcaatgtgtgcatcttcgcctacgggcagaccggggccggtaaaacttacacgatggaaggtactgccgaaaaccctggaattaaccagagggcactgcagctgttgttctccgaggtgcaggaaaaggcaagcgactgggagtatacaattaccgtaagcgccgccgaaatttataatgaagttctgcgcgacctgctcggcaaggaaccgcaagagaagctcgagatacgcttatgcccagacggcagcggccaactctatgtccccgggctgacagagtttcaggttcaatccgttgacgacatcaacaaagtctttgagtttggacatacaaaccgcactacagagtttacaaatctgaacgaacatagtagcagatctcacgccctacttatcgtgactgttagaggcgtggattgcagcaccgggcttcgcactacaggtaagctgaacctggtagatctggctggaagcgaacgggtgggcaagtctggtgccgagggcagcagattaagggaagcacagcacatcaataaaagcctgtccgccctcggggacgtgattgctgcactacgcagtcggcaagggcatgtgccctttcgcaactctaagctaacctaccttttacaggactctctctcgggtgacagtaagaccctcatggttgttcaggtgagtccagtggaaaagaatacgtccgagaccctatacagcttaaaatttgccgaaagagttagaagtgtagaactgggtcccgggctgcgtcgcgcagagttggggtcctggtcatctcaggagcatctagagtgggagccagcctgccagacaccgcagccctccgcccgcgctcattccgcaccatctagtggtacaagctccagaccagggagcattcgaagaaagctgcaaccatccgcctag

SEQ ID NO: 192510 - DNA, 2175 bp, Artificial Sequence
  Description of Artificial Sequence: Synthetic coding sequence
atgatcaaggtggagcacctgaaggagaagctgatcagccaggcccaagaggtgtctagattgagatcagaattgggaggaaccgacctggagaaacaccgcgatctcctcatggttgagaatgagcgattgcgtcaggaaatgcgcaggtgtgaggcggaactccaggagctgagaactaaacctgcagggccttgcccaggctgcgagcactcacaggaatctgcccagttacgcgacaagctatcccaactgcagctggagatggccgaaagtaaggggatgctctctgagctcaatcttgaggtacagcagaagacggatcgcctggccgaggtagagctgaggctaaaggattgtctggcagagaaggctcaggaagaagagaggctctccaggcgccttagggattctcatgaaactatcgcctcgctgcgagcgcaatcaccaccagtgaagtatgtcatcaaaaccgtggaggttgagtctagcaaaacgaaacaggcacttagcgagtctcaagccaggaaccagcacctgcaagagcaagtggccatgcaacgtcaagtgctgaaagaaatggagcagcagttacaaagtagtcaccagctgacggcacgcttgagagcccagattgctatgtatgagtccgagttggagcgtgcccacgggcagatgttagaagagatgcagtctcttgaagaagacaaaaatcgagctatcgaggaggccttcgcaagggctcaagttgagatgaaggccgtccacgaaaacctggccggggtgcggaccaatctccttacccttcagcccgccctgagaacattgaccaacgactataacggtctgaaaaggcaagtaagaggtttccccctcctccttcaggaagcattaagatcagtgaaggctgagattggccaggcaattgaggaggtcaattccaacaaccaggaactcttacgaaagtacagaagagaactgcagttaaggaaaaaatgccataacgagctagttaggctgaagggaaatatccgcgtgatcgcccgggtgagaccggttaccaaagaagatggagagggtccagaagccactaatgccgtgacattcgacgccgatgacgatagtatcatccatctcctgcacaaaggtaaaccggtttcttttgagctggacaaggtgttcagcccacaagcatctcagcaggacgtattccaagaagtacaggccctggtcaccagttgcatagacggtttcaacgtgtgtatctttgcttacggccaaactggcgctggcaaaacgtatactatggaggggaccgccgaaaatcctggcatcaaccagcgggcgctacagttactgttctccgaagtacaggaaaaagcatccgactgggaatacactatcactgtgtccgctgccgagatctataacgaggtcctgcgagacctgctgggaaaggagcctcaggaaaaactggagatcaggctgtgtcctgatgggtctggccagctgtatgtgccaggcctgacggagtttcaggtccaaagcgtggacgatatcaataaggttttcgagttcggtcacacaaataggacaacagagtttactaacttgaacgagcactcctcccggagtcacgcactgctgatcgtgaccgtgaggggcgtagattgctcaaccggtttgcgaacaaccggaaagttgaacctcgtcgatttggcagggagcgagagggtcggaaagtctggagccgaaggtagtaggttgagagaagcacagcacattaacaagtcgttatccgccctcggtgacgtgattgctgcgctccgaagccgtcagggacacgtgccattccgaaatagtaagcttacctacctgctgcaggattcgctgtccggggactccaaaacgcttatggtggtccaggtttccccagttgagaaaaacacctcggagaccctttactctttgaaattcgctgagcgagtgcgcagcgtagaactcggccctggtcttcgtagggcagaattaggctcatggagttcacaagagcacctggaatgggaaccggcctgtcagactcctcagccctctgctcgtgcgcattccgccccttcttccggaactagcagccggcctgggagcattagaaggaagctgcagccatctgcttag

SEQ ID NO: 192511 - DNA, 2547 bp, Artificial Sequence
  Description of Artificial Sequence: Synthetic coding sequence
atgtgcgccagcgcctgcaaggacaccgccgcctggtgccccgaggaggctgccgagccacaggccatggtccccagcaggaggacctggaacttgggtgccaccccaagcctccggggcctgtggcgtgtaggcagggccccggagcctgagcccggaatggccagacccgctccggcccccgcctcgcctgccgctcggccttttccacatactggcccaggcagactccgtaccggccgcgggaaagacactcctgtgtgtggggacgaagattcatcagccaggtccgcggctcgtcccgccctggctcagtgccgcgcactgagtgttgactgggccggccctgggagtccacatgggctctacctgactctgcaggtagagcatctcaaagaaaaacttattagccaggcgcaggaggtatccaggctgaggagtgagctgggcgggactgatcttgagaagcaccgggacttgctcatggtggaaaacgaacgactgaggcaggagatgcggcgctgcgaagcggagttacaggaattacgtacaaagcctgctggtccttgcccagggtgtgaacactcccaggagagcgctcaactgcgggacaagctgtctcaactccagcttgaaatggcagagagcaaggggatgctctccgagctcaatttggaagtgcagcagaagactgatcgactggctgaagtcgaacttaggctcaaagattgcctcgcggagaaggcgcaggaagaggagcgtttgtcacgtcggctccgcgactctcatgaaactattgccagcctcagggcacaatcacctcccgtcaagtatgtgattaagaccgtggaggtggagtcctccaagacaaaacaggcgctcagcgagtcccaggctcggaaccaacacttacaggagcaggtagcgatgcaacggcaggtgctgaaagagatggaacagcaactccagtctagtcaccagctgacggctaggttgagggcccagattgcaatgtatgagtccgagctagagcgagctcatgggcaaatgctagaggaaatgcaaagccttgaggaggacaagaatcgggcaattgaggaggcgttcgcccgcgcccaggttgagatgaaagcagtgcatgaaaacttagctggagtccgcactaaccttctcactttgcaacccgccttacgtacactgaccaacgactacaacgggcttaagcggcaggtgaggggattccccctgctgctccaggaggctttaaggagtgtgaaggcagagattggtcaggccatcgaggaagtgaactccaacaaccaggagctgctgagaaagtaccggcgcgaattgcagttaaggaagaagtgtcacaacgagctggtgagactgaagggcaacataagagttatcgcccgtgttaggcccgtgacgaaggaagacggtgaaggaccagaagccactaacgccgttacctttgatgccgatgacgacagtataatacatctcctgcataaaggcaaacctgtgagtttcgagctcgataaagtcttcagcccccaagcatctcagcaggacgtgtttcaggaagtgcaggctctggttaccagttgtatcgatggattcaatgtctgtatcttcgcgtacgggcaaaccggcgctggaaagacttataccatggagggcacagccgagaacccagggattaatcagagggctctacaactcctcttttccgaggttcaggagaaagcctccgactgggaatacacaataaccgtaagcgcagccgaaatttacaacgaggtgctcagagacctacttggcaaggaaccccaggagaagcttgaaattagactctgccccgacgggtcaggtcagctgtatgtccccggattgaccgagtttcaagtgcagtctgttgatgacataaacaaggtgttcgaatttggacacacaaatagaaccacggaatttactaacctcaatgagcactcctcccggagtcatgccctcctaattgtgaccgtccggggcgtggactgtagtacaggcctccgcacaactggaaagctgaacctggttgatctagctggcagtgaacgtgtaggcaagagtggagctgaggggtcccgtctacgcgaggcgcagcacatcaacaaatcactgtcagccctgggtgatgtgatcgctgccctacgatcaagacagggtcacgtgccattcaggaatagtaagctgacgtacctcttacaggatagcctgagtggggactcgaagaccttaatggtggtacaagtctcacctgtggagaaaaatacatcagagaccttgtatagcctgaagttcgccgaacgggtacggagcgtcgagttaggacccgggttgcggagggccgagttaggcagttggtcctctcaagaacatctggaatgggaacctgcttgtcagacccctcagccctcagccagggcccattctgccccttcaagcggtacctcctcccgccctggtagcattaggcgaaaattgcagccttctgcctag

SEQ ID NO: 192512 - DNA, 2055 bp, Artificial Sequence
  Description of Artificial Sequence: Synthetic coding sequence
atggtggagaacgagcggctgcggcaggagatgcggcggtgcgaggctgagttgcaagagctgagaacgaagccagcaggtccttgtcctggttgtgagcacagccaggaaagtgctcagctccgggacaagctttcgcagctgcaactcgaaatggctgaaagcaaggggatgctgtccgaactcaatctggaagtacagcagaagacagatagattagcagaggtggagctccgactgaaggattgcttagctgaaaaagcccaagaggaagaaaggctctcccgccggctgagagatagtcacgagaccatagccagccttagggctcaatcccctccagtcaagtatgttattaaaaccgtggaggtcgagagttccaagaccaagcaagccctgtcagaatcacaggctagaaatcagcacttgcaggagcaggtggctatgcagcgccaggttcttaaggagatggagcagcagctgcagtcttctcaccagctgactgcccgccttagagcccaaattgcgatgtacgaatccgaactggagcgggctcatggccaaatgctggaagaaatgcaatctttagaggaagacaagaaccgcgccatcgaagaggcttttgcccgggcacaggtggagatgaaggcagtccacgagaatctggcgggggtccgtacaaatctcctgacgctgcagccagccttgcgtacactcacgaatgactacaacggcctgaagaggcaggtgcgcggatttcctctgttgctacaggaagctctccggtccgtgaaagccgaaatcggccaagcgattgaggaggtgaactcgaacaaccaggagttgctccgcaagtaccgccgggaactccagttgaggaagaagtgccataacgagctggtcagactcaagggcaacattagagtgatagcacgcgtgcgtcccgtaaccaaggaagacggggaaggtcctgaggcaactaacgccgtgacctttgatgccgacgacgattcgatcatccacctgctccacaaaggcaagcctgttagctttgaactggataaagtcttcagtccacaagctagccagcaggacgaggtccaagccctggtcacctcttgcattgacgggttcaatgtctgcatattcgcctacgggcagaccggagccgggaagacatacaccatggaggggacagccgagaaccccgggatcaaccaacgcgccttgcaactcctcttctccgaggttcaggagaaggcaagcgactgggagtatacaattactgtgtccgctgctgagatctacaacgaagtgctgcgggaccttttgggtaaggagccccaagaaaagctcgagattaggctatgcccggatggctctgggcagctgtacgtgccagggctgacagagtttcaggtacagtccgtcgatgacataaataaagtgttcgaattcgggcatacgaatcgaacgacggagttcactaacctgaacgagcactcaagtaggtcccacgcactgcttattgtcaccgtcagaggggtggattgctcaactggactgcggacgactgggaaacttaatctggttgatctagctggatccgaacgtgtgggcaagagcggggcagagggatcccgactgagggaggcgcagcatatcaataaatctttatcagcattgggtgatgttattgcagcactgcgatcgcgacaaggtcatgtgccgttccgcaactcaaaactgacctacttgttacaggactcactaagcggggatagtaagacactgatggtggtgcaggtgagcccagtggaaaagaatacctccgagacgctctacagtttgaaattcgcggaacgcgttcgcagtgtggagctggggcccgggttgcgccgggccgaactgggctcttggtcttctcaggagcatctggagtgggagcctgcctgccaaactccacaacctagcgcacgtgcccactcagctccaagttcagggacaagctccagaccaggctcaatacgcaggaagctccaaccatccgcttag

SEQ ID NO: 192513 - DNA, 1914 bp, Artificial Sequence
  Description of Artificial Sequence: Synthetic coding sequence
atgtacgacaacatgagcaccatggtgtacatcaaggaggacaagttagagaagctgacacaggacgaaattatttcaaaaaccaagcaggtcatccagggactggaggcattgaaaaatgagcacaatagtattctgcagtctctattagagacactcaaatgtctgaagaaagatgatgagagtaatctggtggaggaaaagagtaatatgatcagaaagagcctggaaatgttggagctgggactcagtgaagctcaagtcatgatggcactgagcaatcatctcaacgcagttgagagcgaaaagcagaagctgagggctcaggtgaggagactttgccaggaaaaccagtggctgcgcgacgagctggccaacacccagcagaaacttcaaaaatctgagcagagcgtggcccaactggaagaggagaaaaagcacttagaatttatgaaccagcttaagaagtatgacgacgatatttcacccagcgaagataaagacacagactccaccaaggagcctctggacgatttatttcccaacgatgaggacgaccctggccaaggcatccagcaacagcatagttccgcagccgccgccgcacaacaaggcggttatgaaattccggcacggctgagaacactgcataatctcgtgattcagtacgcttcccaggggcggtacgaggtcgccgtgcctctgtgcaaacaggccctcgaggatttagagaagacctctgggcatgatcatccggatgttgcaaccatgttaaacattttagcattagtatacagggaccagaacaaatataaggacgcggctaatctacttaacgatgcactggctattagggagaagaccctgggcaaagatcaccccgctgtcgccgccaccctgaacaacctggccgtcctatacgggaagcgaggtaagtataaggaggctgagcccttgtgcaagcgagcattagaaatacgcgagaaggtgctgggcaaagaccatcctgacgtcgccaaacagttaaacaacctcgctctgctttgccaaaaccaaggtaagtacgaggaagtggaatattactatcaacgagcactcgagatctaccaaacgaagctgggcccggacgaccccaacgtggccaaaaccaaaaacaatctggccagctgttaccttaaacaaggaaagttcaaacaggcagagaccttgtacaaagagatattgacaagagctcatgaaagagagttcggctctgtggacgacgaaaataaacccatctggatgcacgccgaggaacgggaggagtgcaagggcaaacagaaggatggaaccagtttcggggagtacgggggctggtacaaggcatgtaaagtggactcaccgacagtcaccaccacgctgaaaaacttaggcgcactgtacagacgccagggtaaatttgaggccgctgagactcttgaggaggccgccatgcggtctcggaagcaggggcttgacaatgtccacaagcaacgcgtagctgaagtgctgaacgatccagagaacatggaaaagaggcgctccagggagagtctgaacgtggacgtggtcaaatatgaaagcggccctgacgggggggaagaagtatcgatgagtgtcgagtggaacggcgacgggactgggtcgcttaaaagaagcgggtccttcagtaagcttcgggcctcaatccggcgatcctccgaaaagttagtgcgtaaattaaagggcggaagttctcgagaatccgaaccaaagaatcctggaatgaaaagggcttcctccctgaacgtgctaaacgttggaggaaaagccgccgaagaccggttccaagaaagaaacaactgcctggctgacagtcgtgcccttagtgccagccatactgacttagctcattag

SEQ ID NO: 192514 - DNA, 1920 bp, Artificial Sequence
  Description of Artificial Sequence: Synthetic coding sequence
atgtacgacaacatgagcaccatggtgtacatcaaggaggacaagttggaaaagctgacacaggacgagattatcagcaagaccaagcaggttattcagggcctggaggcgctgaaaaacgagcataattccatcttacagtcccttcttgaaactctgaaatgtttgaagaaggacgatgaaagcaacctggttgaggagaagtctaatatgatcagaaaaagcctcgagatgctggagctcggactttctgaggctcaggtgatgatggcgctaagcaatcatcttaatgcagtggagtctgagaaacagaagttgcgcgcgcaggtccgtaggctgtgccaggaaaatcaatggctcagggacgaactcgctaacacgcagcagaagctacagaagagcgagcagtctgtggcccagttagaagaagagaagaaacacttggagttcatgaaccagctgaaaaagtacgatgacgacatcagcccttccgaggataaagacacagattctaccaaagagcctctggatgatctattccccaacgacgaggacgaccccggccagggaatccagcagcagcactcatctgctgccgctgctgcccagcagggtggctatgagatcccagccagactacgcaccctgcataatctagtgatccagtacgcctcgcagggaaggtatgaagtggctgtgcccctctgcaagcaggctcttgaagatttggagaagaccagcgggcatgatcatccagacgtggcaacgatgctgaatattcttgcactggtctaccgcgatcagaataaatacaaagacgcagcgaatctgcttaatgatgcactggcgattcgcgagaaaaccttagggaaggatcatccagccgtggcggcgaccctgaataaccttgccgtcctttatgggaaaagagggaagtacaaggaggctgaacctttgtgtaaacgggccctggagatcagagagaaggtcctgggcaaggaccatccggacgtggccaagcaacttaacaacctcgcgttactgtgccagaaccagggcaagtacgaggaagtcgagtattattatcagagggctctggaaatctatcagactaaattgggccctgacgatccgaacgtggctaaaacgaaaaataacctagcatcttgctaccttaagcaaggaaaattcaagcaggcagagactctgtacaaggaaattctgacccgggctcatgaacgggagttcggtagtgtagatgacgagaataagcctatctggatgcatgccgaggagagagaggaatgtaaagggaagcaaaaggatgggacgtccttcggggaatacggcggctggtacaaggcttgcaaggttgatagccccacggttacgacgaccctcaagaacctgggagccctgtataggaggcaaggcaagttcgaggctgccgagacactagaagaagctgcaatgcgatctcgcaagcaaggcctggataatgtccacaagcagcgtgtggccgaggtactcaatgatccagagaatatggagaaacgtaggagccgcgaatctctcaatgtagacgtggtgaaatacgagagtggccctgacggaggtgaagaggtatctatgagtgtggaatggaacggagatggtacaggatcactgaaacgcagtgggtcctttagtaagcttcgagcctccattcgacggtcatcggagaagctagtgaggaagctgaaaggaggatccagccgagaaagcgagccgaaaaatccaggaatgaagagagcatcttctctgaacgttttaaatgttgggggtaaagcagccgaggacagatttcagggtgtcagcggacgcgcctctttttgtggaaaacggcagcagcaacaatggccaggaagaaggcataggtag

SEQ ID NO: 192515 - DNA, 1887 bp, Artificial Sequence
  Description of Artificial Sequence: Synthetic coding sequence
atgtacgacaacatgagcaccatggtgtacatcaaggaggacaagctagagaaactgacacaagatgaaattattagcaagacaaaacaagtgatccagggtcttgaagcacttaaaaacgagcacaacagtatcctccaatccctgctcgagactctgaagtgtctcaagaaggacgacgaatcaaacttagtagaggagaagtccaacatgatcaggaaaagcctagagatgctggaactgggtctatctgaggcacaagtgatgatggcactttccaatcatctaaatgccgtcgaaagtgaaaagcagaagttgcgagcccaggtacgccggttatgccaggaaaatcaatggctgcgtgacgaactggccaacacccagcagaaacttcagaaaagcgaacaatcggtcgcccaactggaggaagaaaagaaacatctagagtttatgaaccagttaaagaagtacgatgatgacatctccccttcagaggataaggataccgacagtactaaagagccgctggacgacctgtttcccaatgatgaggacgatcctgggcaggggatccagcaacaacactctagcgcagcagcagctgcacagcagggcggatatgaaatccctgcaaggctgcgcactctgcataacttggtcatccagtacgcttcacaaggacggtacgaggtcgccgtgcccctgtgtaagcaggccctggaagatttggagaaaacctccggtcacgaccatccagacgtggcaactatgctgaatatcttggcccttgtgtacagggatcagaacaagtacaaggacgcagcaaaccttcttaatgacgccctcgcgattcgagaaaaaacacttggaaaagaccaccccgctgttgcagcgaccttgaataacctggctgtgttgtacggcaaacgtggaaaatacaaggaggcagagccactttgcaagagagcactcgaaatcagggaaaaggtgctgggaaaagaccatccagatgtggccaagcagctcaacaacctggcccttctttgccaaaatcaggggaagtacgaggaggtggagtactactatcagcgagctctagagatttatcagacaaaactggggcctgacgatcccaacgttgccaagacgaagaacaatctggcctcttgctaccttaaacagggaaagttcaaacaggctgaaactctctacaaggaaatccttacccgcgctcatgagcgcgaatttggctccgtggacgacgaaaacaagcccatatggatgcacgccgaggagcgcgaggagtgcaagggcaagcagaaggacggcacatctttcggcgagtatggtggctggtacaaagcctgtaaggtggatagtcccactgttacaactaccctcaaaaatcttggcgccctgtacaggagacaaggtaaattcgaggcagcggagacactggaagaggccgcaatgcggtctcgaaagcagggtctggacaacgtgcacaagcaacgcgttgccgaagtgttgaatgacccagaaaatatggagaagaggaggagccgcgagagcctgaacgtggacgtagttaagtacgaaagcggtcccgatggcggcgaggaagatgggactggatcgctcaaacgctctggaagctttagcaagctgagggcgtctatacgtcgtagcagcgaaaagctagttcggaagcttaagggtggctcatcccgggagtcggagcccaaaaatccgggcatgaaaagagcaagcagcctgaatgtgctgaacgtgggtgggaaagccgccgaggacaggttccaggaacgtaataattgcctggcagactctagggcgctctctgcgtcgcatactgacttagctcactag

SEQ ID NO: 192516 - DNA, 1722 bp, Artificial Sequence
  Description of Artificial Sequence: Synthetic coding sequence
atgtacgacaacatgagcaccatggtgtacatcaaggaggacaagctagaaaagctcacgcaagatgagattatcagcaagacaaaacaagtgatccagggcctggaagctctgaagaatgaacacaactctattctgcaaagcctacttgaaacccttaagtgcctaaaaaaagacgatgagtccaatctggtggaggagaagtccaatatgattcgtaaatcccttgagatgctcgaactgggactgagtgaggcccaggtgatgatggcactgagtaaccacctgaacgccgtcgaaagtgagaaacaaaagcttcgggcacaggtgaggcggctgtgccaggaaaaccagtggctgcgcgacgaactggccaacactcaacaaaagctgcagaagagcgaacagtcagtggcacagctggaagaagagaaaaagcatcttgagttcatgaatcagttgaagaaatatgatgatgacatctcaccaagcgaagataaggacaccgatagcacgaaagagcctctggacgacctttttcctaatgatgaagacgacccggggcaggggatacagcaacaacattcttccgccgctgccgccgcccagcaaggcggatatgaaatccctgctaggttacgcacactgcacaatctggtgatccagtatgcaagccaaggtcgatacgaggtagccgtacccctctgtaaacaggcactggaggatctggagaagacctcaggccacgatcacccagatgtcgcgaccatgctcaacattttggcactcgtctaccgtgatcaaaacaagtacaaggacgctgccaacctgttgaatgatgcactggctatccgcgagaagaccctggggaaagatcaccccgctgttgccgcaactctcaataaccttgccgtgttgtatggaaaaagagggaagtacaaggaagcagaacccttgtgtaagagagctctagaaatcagggagaaggtactcgggaaggaccaccctgatgttgcaaaacagctaaacaatctcgctctcctgtgccagaatcagggaaaatatgaagaagtggagtactattatcagagggccctggagatttatcaaactaagctgggcccagacgatcctaacgttgccaaaactaagaataatctcgccagctgttacctgaaacagggaaaattcaagcaggccgaaactctgtataaggagatcctcacccgggcgcatgagagggaatttggctctgtcgacgatgaaaacaaaccaatttggatgcacgctgaggaaagggaggaatgcaagggcaagcagaaggatggaacctcctttggggaatatggtggctggtataaggcatgcaaagtagactctcccacagtcaccactacccttaaaaatttaggcgctctgtaccgtcggcagggcaaatttgaagcagccgagaccttggaggaggctgcaatgcgctcacgtaagcagggactggacaatgtgcacaaacagcgagtggccgaggttttgaacgacccagagaacatggaaaagcgcagaagcagggagtccctgaacgtggacgtcgttaagtacgaatcaggtccagatggaggtgaagaggtgtccatgtccgtcgaatggaatgggggtgtctctggacgcgcctccttctgtgggaaaagacagcagcagcagtggccagggcgccggcataggtag

SEQ ID NO: 192517 - DNA, 1731 bp, Artificial Sequence
  Description of Artificial Sequence: Synthetic coding sequence
atgtacgacaacatgagcaccatggtgtacatcaaggaggacaagctagaaaagcttacacaagacgaaatcataagcaaaaccaaacaggttatccagggtctggaagcactcaagaatgagcataatagcattctgcaaagtctgctggagacactgaaatgcttaaagaaggatgatgagagcaacctggtcgaggaaaaaagcaatatgataaggaagtccctcgaaatgttggagctggggctctcagaggcacaagtgatgatggcactgtcaaaccacttgaatgcggtggaaagcgagaagcagaagctgagagctcaagtcagaaggctgtgccaggaaaatcaatggttgcgtgacgagctagccaacacccagcagaagctgcagaagtctgaacagagcgtggcccagctcgaggaagagaagaagcacctggagtttatgaaccagctgaagaagtatgatgacgacatctcgccatcggaggacaaagatacggactcaacaaaggagcctttagacgatctgtttcccaacgatgaagatgatcccgggcagggtatccagcagcagcatagcagcgctgcagccgccgcccagcagggcggctacgaaatcccagcacgactgcgcactctgcataatctggtaatccagtacgcatctcagggtagatacgaagtggctgtgccattatgtaaacaggccctcgaggatcttgagaagactagcgggcatgatcatccggatgttgctacaatgctgaatatccttgcccttgtttacagggaccaaaacaagtataaagacgcagcgaacctcctgaacgatgcactggctataagagagaaaaccttaggaaaagatcaccccgctgtggcagctactctcaataacttagccgtcctctatgggaaaagggggaagtataaggaggcggagcccctatgcaaaagggccttggagattcgtgagaaggtgctgggcaaagatcacccagacgtcgctaagcaactgaacaacctggcactgttgtgccaaaaccaaggcaagtacgaggaggtggagtattattaccagcgtgccctcgaaatctaccagactaagcttggacccgacgatcccaacgtagctaagaccaagaataaccttgccagctgttacctaaagcagggaaagttcaagcaggccgagactctttataaggaaattctgacccgcgcgcacgaacgggaatttggatctgtggacgacgagaacaaacctatttggatgcacgctgaggagagggaagaatgcaaaggaaagcaaaaagacggaacaagcttcggtgaatatgggggctggtacaaagcgtgcaaggtcgacagtcccaccgtgaccaccaccctgaaaaacctgggggcactctatcgcagacaaggtaagttcgaggcggcagaaacactcgaggaagccgccatgcgatcgagaaaacaacgtagcatatccgagatccctaagaagatattaagcgcgaacgggagtaaccatttcccccttccaggtagtcaaggcctggataatgttcacaaacagcgggttgccgaggtcttaaacgatcctgagaacatggagaaaaggagaagccgggagtccctcaacgtcgatgttgtcaaatatgaatctggaccagacgggggagaggaaatgaggaagatgaagctcgggctcgtcaactag

SEQ ID NO: 192518 - DNA, 1683 bp, Artificial Sequence
  Description of Artificial Sequence: Synthetic coding sequence
atgtacgacaacatgagcaccatggtgtacatcaaggaggacaagctcgagaaactcactcaggacgaaataataagtaaaacgaagcaggttatccagggactggaggcactcaagaacgagcataattctattttgcagagcctgctggaaactttgaagtgccttaagaaggatgacgagtctaatctggtggaagaaaagagcaacatgatcagaaaatctttggaaatgctcgaattgggactatctgaagcgcaggtaatgatggcattaagtaatcacttgaatgccgttgaaagcgagaagcagaagctccgggctcaggtgcgccgtctctgccaagaaaaccagtggctccgcgatgagttggccaatacccagcaaaaactacaaaaatcagaacaatccgtcgcccagctggaagaagaaaagaaacacctagaattcatgaaccagctgaagaagtatgacgacgacatatcgcccagcgaggacaaggacacggactcaacaaaagagccgctggacgacctgtttcccaacgacgaggatgatcccgggcagggaattcagcagcaacactccagcgctgccgcagctgcacagcaggggggctacgagatccctgcaagactgaggactcttcacaaccttgtgatccagtatgccagtcagggccgctacgaggttgcagtaccactctgcaaacaggccctcgaagatctggagaagacttctggccatgaccatcccgacgtggctactatgctgaacatcctcgccctggtctatagagatcagaataagtacaaagacgctgcgaacttacttaatgacgcacttgcaatcagagagaaaaccttgggaaaggatcatccagcagttgccgcaaccttaaataacctggccgttctgtatggcaaacgcggcaaatataaagaagccgaacccttatgcaaaagggcgctcgaaattcgggagaaagtacttggcaaagatcaccccgacgtggccaagcagctaaataacttggccctcctgtgtcagaaccaaggaaagtatgaagaagtagaatactactaccagcgggcacttgagatctatcagacaaaactaggcccagacgaccctaacgtggcgaagaccaagaacaatctggccagctgctacctgaagcagggcaagttcaagcaggcagaaaccctgtacaaagaaatactaactagggctcatgaaagagagtttggctctgtggacgacgagaataagcctatatggatgcacgcagaagaaagagaggaatgcaaaggaaagcaaaaggatgggacgtcgtttggtgagtatggcgggtggtacaaggcctgcaaggtggattcaccaacggtgactaccaccctgaagaaccttggcgccctatacagacgccagggcaagtttgaggccgccgagacactggaagaggcagcgatgcgatcgcggaagcagggtcttgacaacgttcacaagcagcgtgtggcggaggtattaaatgatcccgaaaacatggaaaagaggcggtccagggagtcattaaacgtggatgtcgtgaaatacgagagcggacccgatggcggagaagaggtttctatgtctgtggaatggaatggcatgcgtaaaatgaagctaggtctggtaaactag

SEQ ID NO: 192519 - DNA, 1755 bp, Artificial Sequence
  Description of Artificial Sequence: Synthetic coding sequence
atgtacgacaacatgagcaccatggtgtacatcaaggaggacaagctcgaaaaacttacacaagatgagatcatttccaagaccaaacaggtcatacagggcctcgaggcccttaagaatgaacataactcaattcttcagagcctcctcgagacccttaaatgcctaaagaaagacgacgagagcaacttggtggaggagaaatctaacatgataagaaaaagcttagaaatgctggaactaggtctgtcagaagcacaggtgatgatggcactgagcaaccaccttaacgcagtcgagagcgaaaagcaaaaactgagggcacaagtgcgtcgcctgtgccaggaaaatcaatggctgagagatgagctggccaatacacagcagaaacttcaaaagtccgaacagagtgtggcccagctagaggaggaaaagaagcaccttgaattcatgaatcagcttaagaagtacgacgatgacatctcgcctagtgaggacaaagatactgactcgacaaaggagccactcgacgatctcttccccaacgatgaagacgaccccggtcaaggaattcagcagcagcactctagtgccgcggcagccgcccaacagggcggctatgagattcctgcacgcctgcgcactttgcacaatttggttattcagtatgcaagccaaggacgctacgaagtggctgtccccctgtgcaagcaggccctggaagatctggaaaagaccagcggtcatgatcaccctgatgtggcgactatgttgaacattctcgcgctggtgtaccgcgatcagaacaaatataaagatgctgccaatcttctcaatgatgcgctggctatacgcgagaaaaccctgggaaaggatcatccagccgtggctgccacactgaacaacttagccgttctttacggtaaaaggggaaagtataaagaggcagaacccttatgtaagagggctctggagatacgagagaaagtgctgggcaaggatcaccccgacgtcgcaaaacagttaaataaccttgccctgttgtgccagaaccagggcaaatatgaggaggtggaatactactatcagagagccctcgagatttatcagactaaacttggtcctgatgatccaaatgtggctaagaccaagaacaacctcgcctcatgctatctcaagcagggcaagtttaaacaagcagaaaccttgtacaaagagatcctgacacgagcacacgagcgggagttcggatcggtcgacgacgagaacaagcctatttggatgcacgccgaagagagagaagaatgcaagggaaagcagaaggatggtacttcctttggcgaatacggggggtggtacaaagcatgtaaggttgacagtccaaccgtaactacgactctcaagaatctgggagccttgtacagacgccaggggaagttcgaggccgctgagaccctagaggaagctgcgatgcgctcccggaagcaggggctggacaatgtgcacaaacagcgggtcgcagaggtactcaatgatcctgagaatatggaaaagagaagatccagggaaagcctcaatgtggatgttgtgaaatatgaatctggtcctgatggcggtgaggagatgaagagagcgagtagcctcaacgtactgaatgttggcggcaaggccgctgaggaccggtttcaggaacggaacaactgcttggccgactcccgcgctctttctgcgagtcatacagacttagcgcactag

SEQ ID NO: 192520 - DNA, 1857 bp, Artificial Sequence
  Description of Artificial Sequence: Synthetic coding sequence
atgtacgacaacatgagcaccatggtgtacatcaaggaggacaagctagaaaaactcacccaggatgagatcatatcaaagaccaaacaggtgattcagggactggaagccttgaaaaatgagcacaactcgatcctccagtccctgctggagacactcaagtgtctcaaaaaagatgatgagagcaatttggtcgaggaaaaatcgaacatgatcagaaaatctctggagatgctcgagctgggtctgagcgaggcgcaggtgatgatggcactatccaatcatctgaatgccgtggaatcagagaagcagaagctgagggcacaagtcagacgcctgtgtcaggaaaatcaatggttacgcgacgagctcgccaacacccagcagaagttacagaagtcagaacagtcagtggcacaactcgaagaggaaaaaaagcaccttgagtttatgaatcaattgaagaagtatgatgacgacatctcaccctctgaagataaggacacggattcgactaaggaaccgctggacgacctgtttcctaatgacgaagatgatcccggtcagggtatacagcagcagcactcatctgccgccgccgcggctcagcagggggggtacgaaatccccgcgcgactacggacccttcataatttggtaatacagtatgcttcccagggtcgttatgaggtggctgtgcctctgtgtaagcaagctctggaggatctcgaaaagaccagcggccacgaccatcccgatgttgccacaatgctcaacattcttgcgctggtgtacagagaccagaacaagtacaaggacgccgccaatttgctgaacgatgcgctagccatccgtgagaaaacactaggtaaggatcaccctgccgtggctgccactcttaacaatcttgcggtgttatacggtaagcgaggaaaatacaaggaagctgagcccctgtgcaagagggcacttgaaattcgggagaaagtcttaggtaaggatcaccctgacgtagcgaagcaacttaacaacttagccctactgtgtcagaatcagggtaagtacgaggaagtggagtactattatcagagggccttggagatctaccagacgaagctcgggcctgatgatcccaacgttgcaaagacgaaaaataatttagcatcctgttatttaaaacaagggaaattcaagcaagctgaaactctgtacaaggaaattctcacacgagctcacgagagagagttcggctctgtcgacgatgaaaataaaccaatctggatgcacgctgaagagagagaagagtgtaagggaaaacagaaggatgggacaagtttcggggagtatgggggctggtacaaggcatgtaaggtcgactctcctacagtgaccaccaccttgaagaatctgggggcactctaccgcagacaggggaagtttgaggctgccgagactctcgaggaagctgccatgcgctctaggaaacaagggctagataacgtgcataaacagcgcgtggccgaagttctcaatgatccagagaatatggaaaagagacgttccagggaaagtctgaatgtcgacgtagtaaagtacgagagcggacccgatggcggagaagaagtttcaatgagcgtggaatggaatggcgacgggaccgggtcgctcaagagaagtggaagtttcagcaagttaagggcatcaatcagacggtcctccgagaaactggtgcgtaaactgaaaggcgggagctctcgcgaatccgagcctaaaaaccccggggcaagcctggccgagccgttgtttgtggaaaatgattcgtccagctccgggttagaagatgcgacagccaattag

SEQ ID NO: 192521 - DNA, 1683 bp, Artificial Sequence
  Description of Artificial Sequence: Synthetic coding sequence
atgtacgacaacatgagcaccatggtgtacatcaaggaggacaagctggaaaagttaacacaggacgaaattatttcaaaaaccaagcaggtaattcaaggccttgaagccctgaagaacgaacacaactctatcctgcagagcctcctggagaccctcaaatgcctgaagaaggacgacgagtccaacctcgtggaagaaaaaagcaatatgatccgaaaatcactggaaatgctagagcttgggctctcagaagcccaggtaatgatggccctctctaatcacttgaatgctgttgagtctgagaagcaaaaactgcgggcacaggtgcggcgactctgtcaggagaatcagtggttgagagatgaactggctaacacgcagcaaaagctccagaagagcgaacagagtgtggcccagctcgaggaggagaagaaacacctagaattcatgaatcagctcaagaagtatgacgacgacattagtccatcagaggacaaagatacagacagcactaaggagcctttggatgacttattccctaatgatgaggatgaccccggccagggcatacagcagcagcatagctccgccgctgccgcggcacagcagggtggatatgagattcccgcccgcctgaggaccctgcataatctcgtcatccaatatgcctcacagggacgatacgaggtggccgtgccactttgtaagcaggcactggaagacctcgagaaaacatcagggcacgaccaccctgatgtggccactatgctaaacatcctggcactggtgtaccgggatcagaacaaatataaggacgccgcaaacctgctcaatgacgccctggctattcgcgaaaaaactctcggcaaggaccacccggccgtcgccgctactctgaataatctggcagtcttgtatgggaaacgcggcaagtacaaggaggcagagcccttgtgcaagagggcattagaaattcgggaaaaggtgctaggcaaagaccaccctgacgttgcaaagcagctgaacaacctggcgctcctgtgccagaatcagggtaaatacgaagaggtcgagtactactatcaacgagcactggaaatctaccagactaagctcggcccagatgatccaaatgtggctaagaccaaaaataatcttgcttcttgttatctgaagcagggaaaattcaaacaagccgagacactgtacaaggaaatactaactagggcccacgagcgcgaatttggatccgtcgacgacgaaaacaagccaatttggatgcatgctgaagaacgggaagagtgcaaagggaagcagaaggatggcacctcctttggagagtatggtggatggtataaagcctgtaaagtcgactccccaacagttaccaccacactgaaaaatttgggggcactgtaccgcaggcaggggaaattcgaagccgccgaaacccttgaggaggccgctatgcgaagtaggaagcaagggctagataatgtgcacaagcagcgcgtggccgaggttctcaacgatcctgaaaacatggagaaacggcgaagtcgtgaatcgctgaacgtcgacgtggttaagtacgaatccggacccgatggcggagaggaggtgtccatgagtgtggagtggaacggtatgagaaaaatgaagcttggcctggtgaactag

SEQ ID NO: 192522 - DNA, 396 bp, Artificial Sequence
  Description of Artificial Sequence: Synthetic coding sequence
tgagagaacaagcccatctggatgcacgccgaggagcgggaggagtgcaagggcaagcagaaggacgggactagttttggtgaatatgggggatggtataaggcgtgcaaagtcgactcacctaccgtgacaacaacgctgaaaaacttaggagctttatacaggcgccaaggcaagtttgaagccgccgagactctggaggaggccgcaatgaggagtcgcaagcaggggttagacaatgtgcacaaacaaagggtagcggaagtgctcaacgatcccgagaatatggagaagcggaggtccagagagagcctgaacgttgatgttgtcaaatatgagtccggccctgacggcggagaagagatgcgtaaaatgaagctgggactggtcaactag

SEQ ID NO: 192523 - DNA, 1893 bp, Artificial Sequence
  Description of Artificial Sequence: Synthetic coding sequence
atgtacgacaacatgagcaccatggtgtacatcaaggaggacaagctggagaaactgacacaggacgaaatcattagtaagaccaaacaggtaatccaggggcttgaggcactgaagaatgaacacaacagcattctgcaaagtctcctagagactcttaaatgcctaaagaaggatgacgaatcaaacctcgtggaagagaagagcaatatgattaggaagtctttggaaatgctggagctcgggctcagcgaggcacaggtcatgatggctctcagcaaccatttgaacgcagttgagagcgagaaacaaaagttacgagcgcaagtccgccggctttgccaggagaatcagtggcttagagatgagcttgctaacacacagcaaaagctgcaaaaatctgagcagtctgtcgcccagcttgaggaggagaagaagcatctggagttcatgaaccagctgaagaaatacgatgatgacatatctcctagtgaggataaggatacagattcaacaaaagagcccctcgatgatctgtttcctaacgatgaagatgaccctggacagggtatacagcagcagcattcatcggcagccgcagcagctcaacagggcgggtatgagatccctgcccgtttacggaccttgcacaatttggtaatccaatatgctagccagggtagatatgaggttgccgtgcccctctgcaagcaggccctcgaagatttggagaaaacatccggacatgatcacccagatgtggctactatgcttaacattctggccctagtctatagggaccaaaacaagtacaaggatgcggccaatcttctgaatgatgctctggccattagggagaagaccctcggtaaagaccaccctgctgtggccgccacactcaacaatctggctgtattgtacggaaaacgggggaagtataaggaggcagaacctttgtgcaagcgggctctggaaatccgcgagaaagtcctgggaaaagaccaccctgacgttgccaaacagcttaacaatctggctctgttgtgccagaaccagggaaagtacgaagaagtcgagtattattaccagagagccctggagatttatcaaaccaagctgggtcctgacgacccaaatgtggccaaaacaaaaaacaatttggcaagctgttacctgaaacagggaaagtttaagcaggccgagactttgtacaaggagattttaacacgcgcccatgaacgagaatttggctcggtggacgacgagaataagcctatctggatgcacgccgaagagcgcgaggagtgcaagggcaagcagaaggacggaacatcatttggtgagtacgggggttggtacaaagcgtgtaaggtcgattccccaactgtaaccaccactctgaagaatcttggtgcactttacagacgccaggggaagttcgaggctgctgaaactctggaggaggccgctatgcggtctcgcaagcagggactggataacgtgcacaaacagagggtagctgaggttctcaatgatcctgagaacatggagaagcgaaggtcgcgggaaagtctgaacgtcgacgttgtcaaatacgaatctggcccagacggaggggaagaagatggcacgggctctctgaagagatctggatccttttcaaagctacgggcttctatccggagatcaagcgagaaattggtgcgcaaactgaagggcggcagcagtagggaatctgaacctaaaaaccccgggatgaaacgtgctagctctctcaacgttcttaatgtgggcggcaaagctgctgaggaccgcttccagggagtgtccggcagggcctcattctgtgggaagcgccagcaacagcagtggcccggccgtcgtcatcgctag

SEQ ID NO: 192524 - DNA, 453 bp, Artificial Sequence
  Description of Artificial Sequence: Synthetic coding sequence
atgtacgacaacatgagcaccatggtgtacatcaaggaggacaagcttgaaaagctcacacaggacgagatcatctctaagacaaaacaggtcattcaggggctggaggcgctgaaaaacgagcacaactctatactccagtctctcctggaaacccttaaatgcctgaaaaaggacgatgagtctaatctcgtggaagaaaaatctaacatgatacgaaagtctctggaaatgttggaacttgggctttccgaggcccaggttatgatggcgctctcaaatcacctcaacgccgttgagtcagagaaacagaaactgcgcgcacaggtgaggcgcctttgccaagagaaccagtggctgcgggatgagctggcgaacactcagcagaagcttcagaagagcgaacagagcgtcgcacagctggaagaggaaaagaaacacctggaattctag

SEQ ID NO: 192525 - DNA, 1695 bp, Artificial Sequence
  Description of Artificial Sequence: Synthetic coding sequence
atgtacgacaacatgagcaccatggtgtacatcaaggaggacaagctggagaagcttacacaggacgaaattatttcaaaaacaaagcaggtgatccaagggctggaagctctcaagaacgaacataattccatcctccagtctctcctggagactttgaaatgtctgaaaaaagacgatgagtctaacttggtcgaggaaaaatcaaatatgatccgcaagtccctggagatgttggaacttggcttaagcgaagctcaggtgatgatggcattgagcaaccacctgaatgcggtggaaagtgagaagcagaaattgagggctcaagtgaggcggctctgtcaggaaaaccaatggctgcgagatgagttagcaaatacccaacagaagttgcagaagtcagagcagtccgtggcccagttagaggaagagaaaaaacaccttgagttcatgaatcagctcaagaagtatgatgacgatatatccccaagcgaagataaagacacagattctaccaaagaaccattggatgatttgttccccaatgatgaagatgacccgggacaggggatccagcagcaacactcatctgctgccgctgcagcccagcagggagggtatgagataccggctaggctgcgcacacttcacaaccttgtgattcagtatgcaagccaaggcaggtacgaggtggcagttcccttgtgcaagcaggcccttgaagatctggaaaaaacgagcggtcatgaccacccagacgtggcaactatgctcaatatccttgctctggtgtacagggatcagaacaagtataaagacgcagcaaatctcctgaatgatgcactcgcgataagagagaagacattgggaaaggaccaccccgccgtagccgcaaccctgaataatttggctgtattgtacggaaagagaggaaaatataaagaggccgaacctctctgcaagagagctcttgagatccgcgaaaaagtcctgggcaaggaccaccccgatgtggccaaacagctaaataacctggccttactgtgccaaaaccaaggcaagtacgaggaggtggaatactattaccaacgtgccctggagatttatcagacgaagctagggcctgacgaccccaatgttgccaaaactaagaacaacctagcatcctgctacctgaagcaaggtaagttcaagcaggctgagacactttacaaggagattctcacccgagctcacgaaagagagttcggcagtgtggacgacgagaacaagcccatttggatgcatgctgaggagagagaagagtgcaaaggtaagcagaaggacggaaccagtttcggggagtacggaggctggtacaaagcatgcaaagtcgactcccctaccgtgacaactaccctgaagaatttgggggcactgtatagaagacaggggaaattcgaagccgctgaaacattagaggaggcagccatgagatcgcggaagcagggtttggataatgttcacaagcaacgtgtcgccgaggtcttgaatgatcccgagaatatggagaaaaggcggtcccgcgaaagtctgaatgttgatgtggtgaagtatgagtcaggcccggacgggggagaagagggagttagtggccgtgcgtccttctgcggaaagaggcagcagcaacagtggcctggtaggaggcaccgatag

SEQ ID NO: 192526 - DNA, 1869 bp, Artificial Sequence
  Description of Artificial Sequence: Synthetic coding sequence
atggccatgatggtgttcccccgggaggagaagctgagccaggacgaaatcgtgctgggtactaaggccgtaatacagggactcgaaaccctgcgtggcgaacacagagccctcctcgctcctcttgtggcccctgaagcaggcgaggcagagccaggaagccaggaaaggtgcatattgctgagacgttccctcgaggcaatagagctcggactcggtgaggcacaggtgatcttggcgctctcgtcccatcttggcgccgtagaatctgagaagcagaaactacgagctcaagtccgaagacttgtgcaggaaaaccagtggctacgggaagagctggctggcactcagcagaagttgcagcgatcggagcaggctgtcgctcagctggaggaggaaaagcagcatctactattcatgtcccaaataagaaagttagacgaggatgccagtcctaatgaagaaaagggagacgtcccaaaggatacacttgacgatctttttcccaacgaggacgagcaatctcctgccccaagcccaggcgggggcgacgtgtccggacagcatggcgggtacgagattcccgccagattgcgcactctgcacaatctcgtgattcagtacgcctcccaggggcggtacgaagtcgcagttccgctgtgcaagcaggccctcgaggacctggagaagaccagcgggcatgatcaccccgacgtcgcaacaatgcttaacatcctggcattagtttaccgggaccagaacaagtataaagaagctgcacatttgctgaatgacgctctggccatacgtgaaaaaaccctagggaaggaccatccagctgtggcagcaacgctcaataatttagccgtcctttacggtaaacggggaaaatacaaggaagcagaacctttatgcaaaagagccttagaaattagagaaaaggttctcgggaaattccacccagacgttgccaaacaactgagtaacctggccctgctctgccaaaatcagggcaaggccgaagaagttgaatactattaccgtagagcgttggagatttacgctacccgattaggccctgacgaccctaacgtggccaagacaaagaataatctggccagctgctacctgaagcagggcaaatatcaggacgccgagaccctgtataaggagatcctgacccgcgctcacgagaaggaattcgggagtgtgaatggagacaacaaaccgatttggatgcacgcagaggagagggaagaatctaaagacaaaaggcgcgattccgccccatacggcgaatacggatcgtggtacaaggcttgcaaggtggacagccctaccgtcaacaccaccctccggagcctcggagcactttaccggcgccaggggaaattggaggctgcccataccctagaggattgtgcgagtcggaacagaaaacagggcctggaccctgcgtctcagacaaaggtcgtcgaactcttaaaagatgggtccggacgaagaggtgatcgccggtccagtagagatatggccggaggcgctgggcctcgtagcgagtctgacctggaggatgtgggccctactgctgagtggaacggtgacgggagcggcagcctgaggcgatctggatccttcggcaagctccgcgacgctctgcggcgatcttcagaaatgcttgtgaaaaaacttcaggggggaacaccacaggaacctcccaacccccgcatgaaacgggcaagctcactcaactttttaaataagagcgtagaggaacccactcaacctggtggcacagggttaagcgacagcagaacactgagttctagctccatggacctttcccgccgctccagtcttgtgggttag

SEQ ID NO: 192527 - DNA, 1638 bp, Artificial Sequence
  Description of Artificial Sequence: Synthetic coding sequence
atggccatgatggtgttcccccgggaggagaagctgagccaggacgaaatcgtcctgggcaccaaggcggtcattcagggcctggaaaccctgagaggggaacatagggcacttctggcccccttagtagcccccgaagccggggaggcggagcctggcagccaggaacgttgcattttgctgcgacgatctctcgaagcaattgagctgggtctgggtgaagcccaggaggagaaaggcgatgtcccgaaagacaccctggatgacttattccctaacgaagacgagcagagtccagccccctcccccggcggtggagatgttagtggccagcatgggggatatgagattccggccagactccgaacactgcataacctagttatacagtacgcctctcaggggagatacgaggtcgctgtcccgctttgcaagcaggcattggaggacctggagaaaacctccggccacgatcaccccgatgtagccaccatgctcaatatcctggcgctcgtgtatcgggatcaaaacaaatacaaggaggccgcgcacctcctgaacgacgcccttgcgatcagggagaagactctggggaaggaccatcccgcagttgcagcaaccctgaataatctggcggtcttgtatggtaagagaggcaagtataaggaggcagagccattgtgtaagagggcattggagatccgcgaaaaggtccttgggaaatttcaccctgacgtggcgaagcagctgtctaatttggcactgctatgtcagaaccaggggaaagctgaggaagtcgagtactactatcgtcgtgcgctggagatctacgccacccgcctcggcccagacgatccaaatgtggcgaagacaaagaataatttggcctcctgctacctcaagcagggcaagtaccaggatgcagaaacactgtacaaggagatcctcacccgggcacatgagaaagagtttggttctgtaaatggtgacaataaacccatttggatgcatgcagaggagagggaggaatctaaggataaacgcagagacagcgctccttacggggaatacggttcatggtacaaagcgtgtaaggtggactcccctaccgtgaacaccacccttcgctcattgggggctctttacaggaggcaggggaagctagaggccgcccacacacttgaggattgtgccagcaggaacagaaagcagggccttgaccccgcctcccagactaaggtggtggaacttctcaaggacggaagtgggcgtcgcggtgacaggcggtcaagtcgagatatggcgggtggtgcagggccacgctccgaaagcgacctcgaggacgtcggccctacagctgaatggaacggcgatgggagcggttcccttaggcggtctggatcctttggtaagctgagagacgcacttcgcagatcatctgaaatgctcgtgaagaaactacagggaggaacccctcaggagcctccaaaccccagaatgaagagggcttcctccctcaatttcttaaataagagcgtcgaggagcctactcaaccaggaggaacagggcttagcgacagtcgtaccttgtcatccagctcaatggacctcagtcggcgatcatccctcgttggttag

SEQ ID NO: 192528 - DNA, 1869 bp, Artificial Sequence
  Description of Artificial Sequence: Synthetic coding sequence
atggccatgatggtgttcccccgggaggagaagctgagccaggacgagatcgtgttaggtacaaaagctgtgatccaggggttagagaccctgcggggcgagcatagagcccttctggctcccctggtagcccctgaggctggtgaagctgaaccggggagtcaggaacggtgtatccttctgagacgcagtctggaggctatcgagctggggctcggcgaagcccaagtcatcctcgcccttagctctcacttgggggctgtagagtccgagaaacagaagctcagggcccaggttcgccgcctcgtgcaggagaatcagtggctccgggaagagcttgccgggacacagcaaaagctacagcggtccgagcaggctgttgctcagttagaggaggagaagcagcacctgctgttcatgtctcagattaggaaactggatgaggacgcctccccaaatgaggagaagggagacgtgccaaaggacacgctggacgacctttttcctaacgaggacgagcagtcgcccgctccatcacccggtggcggggacgttagcgggcagcacggcggatatgagatccctgcccgcttgcgaacactgcacaatctggtgatacagtatgctagtcagggaagatatgaagtggccgtgcctctgtgtaagcaggctctggaagacttggaaaaaacctcagggcacgatcaccccgatgtagcaactatgctgaacatccttgcactggtataccgagaccagaataaatataaggaggccgcccacctactcaacgacgcacttgcgatcagagaaaagacactagggaaggatcaccctgctgtagctgctactttgaacaacctggccgtgctgtacgggaagcgcggaaaatacaaagaagccgaacccctgtgtaaacgagctctggaaattcgagagaaggtactagggaagttccaccctgatgtggctaaacagctgtctaacctcgccttactctgtcaaaatcagggcaaggctgaagaggtagagtactattatcgaagagccctggagatctatgccaccagacttgggccggatgaccctaatgtggcaaagaccaaaaataacctcgcttcttgttatctgaaacaggggaagtatcaggatgcggagacgttatacaaggaaattcttactcgggcccacgagaaggaattcggctcggtgaacggcgataacaagcctatctggatgcatgctgaagaacgcgaggagtccaaggacaagaggcgggacagtgctccttacggggaatatggttcctggtataaggcatgtaaggtggatagccctaccgtaaatacgaccctccgcagcttgggggcactgtatagacgacagggcaaactggaagcagcacataccttggaggattgtgcttctcggaataggaagcagggacttgacccggctagccagacaaaagtcgtggagctactgaaggatgggtccggcaggaggggagatagacgtagcagcagggacatggccgggggagctggacctcggtctgagtcagatttggaggacgttggcccaactgccgagtggaacggtgatggtagcggctcgttgaggcggtcaggatcctttggcaaactgagggatgcacttagacgatcttcagaaatgcttgtgaagaaactccagggaggcactccacaggagcctccaaacccaagaatgaagagggctagttccctgaacttcttgaacaagtccgtggaagaaccaacacagcctggcggcacgggcctttcagactctagaactctctcttctagttcaatggatctgagtcgtcggtcttctctcgtgggctag

SEQ ID NO: 192529 - DNA, 1869 bp, Artificial Sequence
  Description of Artificial Sequence: Synthetic coding sequence
atggccatgatggtgttcccccgggaggagaagctgagccaggacgaaattgtgctcggcaccaaagctgtgatccaaggattggagacactgcggggggaacatcgcgccctgttagcaccactagttgctcctgaagctggcgaggccgaacccggatcgcaggagcgttgtattctgttacgccggagcttggaagccattgagctcggtctgggcgaggcacaagtgattcttgctctgagcagtcaccttggcgccgtggaatctgagaagcagaagctgagagcccaggttaggcgtctcgtccaggagaaccaatggctgcgggaggagctggctggcacccagcaaaagctgcagaggagtgagcaggctgtcgcacagctggaggaggaaaagcagcacctactcttcatgtcccagatcagaaagttagatgaagacgcatctccgaatgaggaaaaaggtgacgtccccaaagacaccctggacgatctgttcccaaatgaggatgagcaatcaccagcccctagtccagggggcggggatgtaagcgggcagcacggcgggtacgaaatacctgctaggctgaggacactccataatctggtaattcagtatgccagtcaagggcggtatgaagtggctgtgcctctgtgcaaacaggcactggaggaccttgaaaagacatctggacacgaccaccccgatgtggccaccatgctaaacattctcgcgctggtttatagagaccagaataagtataaagaggctgcccatctcctgaatgacgcactggcaattcgcgagaaaacgttaggcaaggaccaccctgccgtggcagcgactctgaacaatttagctgtgctgtacggcaagcgcgggaagtataaagaggcggaacccctatgcaaacgcgccctcgagatccgggaaaaagtactggggaagttccatcctgatgtggccaagcagctgtctaatttggcgctgctttgccagaatcaaggaaaggccgaagaggtcgagtattactacagacgcgccctggagatctacgccaccaggctgggccccgacgatcccaacgtagccaaaacaaaaaacaatcttgcctcatgttacttgaagcaaggcaaataccaggatgctgaaaccctgtacaaggaaatccttacccgagctcacgagaaggaattcgggtcagtgaatggggacaacaagccgatttggatgcacgctgaagagagagaggagtctaaggataagcgtcgggattctgccccatatggagagtacggcagttggtacaaggcttgtaaggtcgactctcccactgtcaacaccaccctacggtccctcggcgccttatatcggcgccagggcaaacttgaagccgcacacaccctggaagactgtgcttcaaggaataggaagcagggtcttgatcccgcgagtcagaccaaggtggtagaattactgaaagatggctcagggcgacgcggagacagacgctccagcagggatatggcaggcggggccgggccccggtcagaaagtgatctggaggacgtagggcctactgccgagtggaacggggacggtagcggctctcttagaaggagtgggagcttcggaaaactgcgagacgctctgcggaggtcttccgagatgttggtgaaaaaacttcagggaggtaccccacaggaaccaccaaacccgaggatgaaacgggcttccagtctaaatttcctgaataagagcgtagaggaaccgactcaacctggcggaactggccttagcgactctcggaccttgagcagttcatctatggatctgtccaggcggagttcactcgtgggctag

SEQ ID NO: 192530 - DNA, 1638 bp, Artificial Sequence
  Description of Artificial Sequence: Synthetic coding sequence
atggccatgatggtgttcccccgggaggagaagctgagccaggacgagatcgtgctgggtacgaaggccgttatccagggtctggagaccctgcggggagaacatcgggctctgctagcgcctcttgtcgctccagaggcaggggaggctgaacccggctcccaagagagatgtatactgctgcggcgaagccttgaagccatcgagcttgggctgggagaagcacaagaagagaaaggcgatgtaccaaaagacaccctggatgacttattcccaaatgaggatgaacagtcccccgcaccttcccctggtggaggcgatgtgtcaggccagcacggcggctacgaaatcccagcccgccttcggacactgcacaatctcgtgatccagtatgcatcgcaggggcggtacgaagtcgccgtgccactctgcaaacaggcattggaagatctggaaaaaaccagtggtcatgaccaccccgacgttgccacaatgttaaatatcctggcactggtatacagggaccagaataaatacaaggaagctgcacaccttcttaacgacgcccttgccattcgcgagaaaacccttggtaaggatcatcccgctgtggctgccacccttaacaacctggctgtgttatacggcaagaggggtaaatataaagaagcggagccgctgtgtaaacgggctctcgaaatccgcgagaaagtgcttggcaaatttcacccagacgtggccaagcagcttagcaacctcgcattgctctgtcagaaccagggaaaggccgaagaggtagaatattattatcgacgggccctggagatctacgcgacccgcctggggccagatgatccgaatgtcgctaaaacaaaaaacaacctagctagttgttacctaaagcagggcaagtaccaggatgccgaaacactctacaaggaaatcttaaccagggcccacgagaaggagttcggtagcgtgaacggcgacaataaacctatctggatgcacgctgaagagcgcgaggaaagcaaagataaaaggcgagactcagcaccatacggagagtacggctcttggtacaaggcctgtaaagtagatagtcctacagttaacactaccctgcgatcacttggggcattgtatcggcgccaagggaaacttgaggccgcgcatactcttgaagactgtgcttctaggaaccggaagcaggggttagatccggcaagtcaaaccaaggttgttgaactgctgaaggacggtagcggaagaaggggtgacagacgatcgtcaagagatatggctgggggagcaggaccaaggtccgagagtgacctagaggatgttggacctaccgcagagtggaacggggacggcagcggttcactccgacgctctggctcatttggtaagctccgagatgcactccgcagatcttcggaaatgctcgtgaaaaagcttcaaggaggtacacctcaggagccccctaacccaaggatgaaaagggcttcatctcttaactttttgaataaatccgttgaggaacctacccagccaggcgggacaggacttagcgactcaaggaccttgtcttcttcttctatggacctctctaggcgctcttcactggtggggtag

SEQ ID NO: 192531 - DNA, 501 bp, Artificial Sequence
  Description of Artificial Sequence: Synthetic coding sequence
atggccatgatggtgttcccccgggaggagaagctgagccaggacgagatcgtgctggggacaaaagccgtgatacagggattagaaaccctccgaggcgagcacagagcactgctggcaccacttgtagctccagaggccggtgaagcggaaccaggaagccaggaacgatgcatactgctcagaaggtcccttgaagctattgaattgggactgggggaggcgcaggtcatactggccctgtcctcccacctcggagcggttgagtctgagaagcagaaactacgggcacaggtaaggcgtctggtgcaggaaaaccagtggctgagggaggagctggccgggacgcagcaaaagctgcagagaagtgagcaggccgtcgctcagcttgaggaggaaaaacagcacttactctttatgtcccagattcgcaagttggacgaggatgcatcgcctaatgaagagaagggtgacgtccccaaggacaccctagacgattag

SEQ ID NO: 192532 - DNA, 570 bp, Artificial Sequence
  Description of Artificial Sequence: Synthetic coding sequence
atggccatgatggtgttcccccgggaggagaagctgagccaggacgagatcgtgctcggaacaaaagcggtgatccaggggctggagacactgcgaggggagcacagagccctactggcgccgttggttgccccagaagccggcgaggctgagccaggttcccaagaacgatgcatcctgcttcggcgttctttggaggctattgagctgggcctcggagaagcccaggaggagaagggcgatgtgcctaaagatactctcgacgatctttttcccaatgaggatgagcaaagcccagctcccagtccaggcggaggagatgtcagcggacaacacgggggctacgaaatccctgcccggttgcgcacactacacaacttggtgattcaatacgccagtcagggtaggtacgaggtcgccgtgccactctgtaagcaggccttggaagaccttgaaaagacgtctggacacgaccatcctgacgtcgccaccatgctgaacatccttgcactggtgtacagggaccagaacaaatacaaagaggctgcacatctactgaacgatgcctag

SEQ ID NO: 192533 - DNA, 516 bp, Artificial Sequence
  Description of Artificial Sequence: Synthetic coding sequence
atggccatgatggtgttcccccgggaggagaagctgagccaggacgagatcgtcctagggaccaaggctgtcattcaaggactggaaacgctgaggggtgagcaccgggccctcctggccccccttgtggcgccagaagcgggcgaagcagagcctgggagccaggaaaggtgtatcttgctgcgacggtcactggaggccatagagctcggactgggcgaggctcaggttatcttggctttgagttcacatctgggcgctgtcgaatctgaaaaacaaaaactccgagcccaggtgcgacgcctggtccaggaaaatcagtggttacgggaagagctggccggtacacaacagaaactccagcgttccgagcaggccgtagcccaacttgaggaggagaagcagcacttgctgtttatgtctcagatccggaagctggatgaagatgcatctcctaacgaagaaaaaggagacgtccctaaggataccctcgacgacttgtttcccaatgaatag

SEQ ID NO: 192534 - DNA, 438 bp, Artificial Sequence
  Description of Artificial Sequence: Synthetic coding sequence
atggccatgatggtgttcccccgggaggagaagctgagccaggacgagatcgtgctgggaaccaaggccgtgattcagggactggagacactccgaggagaacacagggctctgttggccccccttgtcgcaccagaagccggcgaggccgagccggggagtcaggaacgttgtatcttactgcgaaggagtttagaagccattgagttgggcctcggggaagcccaggtaattcttgccctcagctcccatcttggtgccgtcgaatccgagaagcagaagctgagggcccaggttaggcgacttgtccaagagaaccagtggctccgggaggaactcgcgggcacacagcagaaattacagagaagcgagcaggccgtggcccagcttgaagaggaaaaacagcacttacttttcatgagccagattagaaagtag

SEQ ID NO: 192535 - DNA, 318 bp, Artificial Sequence
  Description of Artificial Sequence: Synthetic coding sequence
atggccatgatggtgttcccccgggaggagaagctgagccaggacgagatagtcctggggacaaaggccgtaatccagggactagaaacattgcgcggagagcatcgcgccctgttggcgccccttgtggcacccgaagcgggtgaagctgagccgggttcgcaggagcgatgtattctcttgcgccggtccctggaggcaatagagctgggcttgggggaggcgcaggtaatcctagctctcagtagtcatctgggggccgtagagtctgagaagcaaaaactgcgcgcccaggtgcgccggcttgttcaggagtag

SEQ ID NO: 192536 - DNA, 1515 bp, Artificial Sequence
  Description of Artificial Sequence: Synthetic coding sequence
atgagcgtgcaggtggccgcccccggcagcgccggcctgggccccgagagactgagtcccgaggagcttgtccgccagactaggcaagtagtgcagggtctggaagccttgcgcgccgaacatcatggcttagccgggcatctggcagaggccctagcaggtcagggaccagctgccggacttgaaatgcttgaagaaaaacagcaggtcgtatcccactcactggaagcaatcgagctgggcctcggcgaggctcaagttctgttggcgctaagcgctcatgttggagcactggaagccgagaagcagaggttaaggagccaggcacgtcgcctcgctcaggaaaatgtttggctccgggaggaactcgaagagacacagcgcaggctccgagcttccgaagagagtgtggcccagcttgaggaggagaagcggcacctcgaatttctgggacagctgagacagtacgatccacccgccgaaagtcagcaaagtgagtctccaccaagacgagattctctcgccagcctgttcccctcggaggaggaggaaagaaagggcccagaggcagctggagcggcagccgctcagcagggaggttacgagattcctgcgagacttagaacactgcataacttggtgatccagtatgcaggtcaaggacgctacgaggtggccgtacctctgtgcaggcaggcccttgaggacctggagcggtcctccggtcactgtcatcccgatgtagcgaccatgcttaacattcttgcgctggtctaccgcgatcaaaataagtacaaggaagccacagaccttttgcacgacgccctgcagattagagaacagaccctgggtccagaacaccctgcagtggccgctaccctgaacaatttggccgtcctgtacgggaaacgggggagatatagagaggccgagccactgtgccagagagcgctggagattagagagaaggtgttgggggccgatcatcctgatgtagcgaagcagctaaataatctcgctctgctatgccaaaaccagggaaaatttgaggatgtagagcggcactacgcccgggccctttcaatatacgaggccctgggtgggccccacgatccgaacgtggccaagacaaagaataatctggcctcagcatacctcaagcagaacaagtatcagcaggccgaggagctgtataaggaaattctccacaaggaggatcttcctgccccgctcggagccccaaacacaggtactgccggtgacgctgagcaggcacttagacgatccagcagcctgtcaaaaattcgggaaagcatccgtcgggggagcgagaagctggtctcacgactcagaggcgaggccgccgctggagcagccgggatgaagcgcgccatgtctctgaacacacttaatgtagacgcgccccgggcccctggcactcagttcccatcatggcatctggacaaggcacctcggacactgtcagcctcaacgcaggatctgtcacctcattag

SEQ ID NO: 192537 - DNA, 1557 bp, Artificial Sequence
  Description of Artificial Sequence: Synthetic coding sequence
atgatcccccagaccccccaccactgcagccccggcgccgccatgagcgtccaggtggccgctccaggatctgctggccttgggcccgagcgactgtcacccgaagaattggttcgacaaacacgtcaggttgtgcaggggctcgaggccctacgcgctgaacatcacggccttgccggccacctagctgaagccctggccggccaggggccagctgccgggctcgagatgttagaggaaaaacagcaagtggtgtcacacagtctggaggcaatcgaattggggctgggcgaggcccaggtgctccttgctcttagcgcccacgtaggtgcccttgaggccgaaaaacaacggctgagaagccaggccagaagactcgctcaggagaatgtgtggctgagagaagagctcgaggagactcagcgcaggctccgggccagtgaggaaagcgtagctcaacttgaagaggaaaagcgtcaccttgagtttctgggccagctgcggcagtatgatccaccagccgaatcccaacaatccgaatctcctcctagacgcgattctctcgctagcttattcccctccgaagaggaggagcgcaaaggcccggaggctgccggagcggccgctgcacagcaaggcggctacgaaattccagccaggttacgaactctgcacaacctggtgattcagtatgctggacagggccgttacgaggtcgccgtgcccctttgtcggcaggccttagaggatttagagcgatctagcggccactgccatcccgatgttgcgactatgttgaacatcctggctctggtctaccgcgaccaaaataagtataaagaggcaacagatctcctgcacgacgccctgcaaattcgggaacagactcttggccctgagcaccccgcagtagccgcaaccctgaacaacttggcggtgttgtacggcaagcgcgggagataccgggaagctgagcctctgtgccaaagagcgctagaaatcagagaaaaggtgctgggcgctgatcaccccgacgtcgccaagcagctgaacaacctggcccttctctgtcagaaccaaggaaagttcgaggacgtcgaaagacattatgcccgcgctctttctatctacgaagcccttggaggcccacacgatccaaatgtggccaagaccaagaataacctggcctcagcctacctcaagcagaacaaataccagcaggccgaagaactgtacaaggagatcttgcacaaagaggatcttcccgcacccctgggcgccccaaacacaggaacggcaggcgatgccgagcaggcgctccgccgttcatccagcctgagtaaaatccgcgaatccattcgtcgaggaagtgagaagctggtgtccaggctgagaggagaggctgctgctggagctgctgggatgaaacgcgccatgtcactgaacactctgaacgtggacgcgccccgcgctcccggtacacagtttcctagctggcatctcgacaaagcgccacgtacccttagcgcatctactcaagaccttagcccccactag

SEQ ID NO: 192538 - DNA, 2379 bp, Artificial Sequence
  Description of Artificial Sequence: Synthetic coding sequence
atgcagggcgaggacgcccggtacctgaagcggaaggtgaagggcggaaacatcgacgtccacccttcagagaaggccttgatagtgcattacgaggtggaggccactatattgggcgaaatgggagatccaatgctaggggaacggaaggaatgccaaaaaatcatccgtctaaaaagcctgaatgctaacaccgacatcacttccctcgccagaaaagtagtcgaggagtgcaaattgatccacccatcaaaattgaacgaggtcgaacagctcctgtattatctgcaaaacaggcgagatagcctgtccggaaaagagaagaaagagaaatcatcaaaacccaaagaccctccaccctttgagggaatggaaattgatgaggtggctaacatcaacgacatggatgagtacatagaacttctttacgaagacattcccgacaaagtgagggggagtgccttgatcctgcaactggctcggaatcccgacaacctggaagaacttctactgaatgaaacagcactgggagccttggcccgcgtgttaagagaggactggaaacagtcggttgagctcgcaacaaacatcatttacatattcttctgcttctcgtcttttagccagtttcacggcctcattacacactacaaaatcggggcattgtgtatgaacataatcgaccatgagctcaagcggcatgaactctggcaagaggagctgagtaagaaaaaaaaggcagtcgatgaagatccagagaatcagaccttacggaaggattacgagaagacgttcaagaagtatcagggacttgtggttaaacaggaacagctccttcgcgtcgccctctacctgttgttgaacttggccgaggacacccggactgagttgaaaatgcgcaacaaaaacattgtccatatgctcgtgaaagctctggatagagataatttcgaactgctgattctcgtggtgagcttcctcaagaagttgtccattttcatggaaaacaagaatgacatggtggaaatggatatagtggaaaaactggtgaaaatgataccatgtgaacacgaggacctcctgaacatcaccctgaggctgttacttaatctttccttcgataccggcctgcgcaataaaatggtgcaagtgggtttactgcccaagctcacagccctcctgggtaatgataattataagcaaatcgccatgtgcgtactgtaccacatttcaatggacgatcgctttaagtctatgttcgcgtacaccgattgcataccgcagctgatgaaaatgttgtttgaatgctccgacgaacgaatcgaccttgagttaattagtttttgcatcaaccttgccgccaataagcgaaacgtccaactgatctgtgaaggaaatggactcaaaatgctgatgaaaagagcgctgaaatttaaggatcccttgctgatgaaaatgatccggaacatatctcagcatgatggcccgactaagaatctttttatcgactacgtgggagacctggctgctcagatctccaacgacgaggaagaggagtttgtcatcgagtgcttaggaacactcgctaatttaaccattcctgatttggattgggagctggtactgaaggagtacaagctggtgccctacctgaaagataagcttaaacccggagcggctgaggacgatttggtgttggaggtcgtcataatgatcggtaccgtgtcgatggacgatagttgcgcagcactgcttgccaaatccggaataatacctgctctgatcgagctgctgaacgcacagcaagaggacgatgagttcgtgtgccagattatctatgtgttctaccagatggttttccaccaggcgacccgcgacgtgatcataaaggaaacccaagccccagcatatttaattgatctgatgcacgacaagaacaacgagatacggaaagtgtgtgataataccttagacatcattgccgaatatgatgaagagtgggccaagaaaatacaaagcgagaaatttcggtggcacaacagccaatggctggagatggtcgagagccgccaaatggacgaaagtgaacaatacctgtacggggacgacagaatcgagccgtacattcacgaaggcgatattcttgaacgcccggacttgttttataatagcgatggcctcatcgctagcgagggtgccatcagccccgattttttcaacgactaccacctgcaaaacggagacgtagttggacaacacagcttcccgggcagcctgggaatggacgggttcggacagcccgtcgggatcctgggtaggccggcgacagcttacggttttaggccagacgaaccttattattacgggtatggaagttag

SEQ ID NO: 192539 - DNA, 2259 bp, Artificial Sequence
  Description of Artificial Sequence: Synthetic coding sequence
atgggcgaccccatgctgggcgagcggaaggagtgccagaagatcatcaggctcaaaagcctcaacgcaaataccgatattacttccttggctcgtaaggtggtcgaggagtgtaaactgatccatccatctaagctgaatgaagtggagcaattgctgtattacctgcagaatcgacgggattctctctctgggaaggaaaaaaaagaaaagtcctccaagcccaaagatccaccccccttcgagggcatggagatcgacgaggtcgccaatattaacgatatggatgagtacatcgaacttttgtacgaagacatcccagacaaggtacgcggctcagcgctaattctgcagttggccaggaacccagacaacctggaagagctcttgctcaacgaaacagcactaggggccctggcaagagttctgagggaggactggaaacagtcagtggaattggccacaaacataatttacatcttcttctgtttctcttcattctctcagttccatggattgattacacactataagatcggtgcgctatgcatgaatatcatcgaccacgagctcaagaggcacgagctgtggcaggaggaactttctaagaaaaagaaggcagtagacgaggatcctgaaaatcaaaccttaagaaaagattacgagaaaactttcaagaagtatcagggcttagtggtgaaacaggaacagctcctaagagtggcactgtacttactgttgaacctggctgaagacacacgaacagagctcaagatgaggaataagaacatcgtccacatgcttgttaaggctctcgaccgggacaatttcgaacttcttatccttgttgtctcgtttctcaagaaactgagcatattcatggaaaacaaaaatgacatggtcgaaatggacatcgtggagaagctcgtaaagatgataccttgcgagcacgaggacctcttgaatatcacgttgaggttgcttcttaacttgtccttcgacaccggcctccggaataaaatggtgcaagttggacttctgcctaagctgacagccctgttgggaaacgacaactacaagcagattgccatgtgcgtgctctaccatatcagcatggatgatagattcaaatcgatgtttgcttacacagactgcatccctcagcttatgaagatgctgtttgaatgcagcgacgaacgcatagatctagagcttataagcttctgcattaacctggctgcaaacaaacggaatgtccagcttatatgtgaaggaaacggcctgaagatgttgatgaagagggctttgaagttcaaagaccccctgctcatgaaaatgatccgcaacatttctcagcatgatggaccgactaagaacctgttcattgattacgtgggggatctggccgcccagatctccaatgatgaggaggaagagtttgtgattgaatgcctgggtaccttggccaatcttacaattccggatctggactgggagctcgtgctgaaggagtacaagctcgttccatacctcaaggacaaacttaaaccaggcgcagcagaggacgaccttgtgttggaagtagtgataatgatcggtactgtgagcatggatgattcctgcgcagccctcctggccaaaagtgggataattcctgcacttatagagctgttgaatgcccaacaggaggacgacgaatttgtgtgccagataatttacgtcttctatcagatggtttttcaccaggccacgcgcgatgtgatcattaaggagacgcaggcacctgcctatctcattgacctgatgcatgataaaaacaatgagatacgaaaggtctgtgacaacaccctggatatcatcgcagaatacgatgaggaatgggcaaaaaagatccaatctgagaagtttaggtggcataactcccaatggctggagatggttgagtcacggcagatggatgaaagcgagcagtatctctacggcgacgatcgcatcgaaccctatatccatgagggggacatactggaaaggccggatctgttctacaattctgatggacttattgcgtccgagggcgccatctcacccgacttttttaatgattatcacctgcaaaacggcgacgtcgtcgggcagcactcttttccgggatctctcggcatggacggcttcggccaaccagtgggcatccttgggcgacccgctaccgcgtacggcttccggcctgacgagccttactactacgggtatggtagctag

SEQ ID NO: 192540 - DNA, 2247 bp, Artificial Sequence
  Description of Artificial Sequence: Synthetic coding sequence
atgcagggcgaggacgcccggtacctgaagagcatccggctgaagtcgcttaacgccaacaccgatatcacttccctggcaaggaaagtggtggaagagtgcaagctgatccacccaagtaagctcaacgaagtcgagcagctgctctactatctgcaaaatcgcagagacagtcttagcggaaaagaaaagaaggaaaagagttctaaacctaaggaccccccccccttcgagggaatggagatcgatgaagttgcaaacatcaacgacatggatgagtacattgaactgctctatgaggatattccagataaagtgagaggtagcgcactcatattacagctggctaggaacccagataaccttgaggagctgctgttgaatgagacagcgctgggggcattggccagagtgctgagggaagattggaaacagagcgtggaactagccacgaatatcatttacatcttcttctgcttctcctccttctcccagttccatggactgataacccattacaagatcggcgctctctgcatgaacatcattgatcacgagctgaagcggcacgagctgtggcaggaagaactgtccaagaagaagaaggctgtagacgaggaccccgagaatcagactctgcggaaggactatgagaaaacattcaaaaagtatcaggggttagtggtgaaacaggagcagctcctgagggtggctctctacctgcttttgaacctggccgaggacacacgaacggagctcaaaatgagaaacaaaaacatcgtacacatgctagtgaaagctctggatcgtgataatttcgagctgctcatcctcgtggttagtttcctgaaaaagttgagcatctttatggagaataaaaacgacatggtagaaatggatattgttgaaaagctggtgaaaatgatcccatgcgagcatgaggacctattgaatatcacactcagactgctgcttaacctgtcttttgacacaggtctccggaacaaaatggtccaagttgggttactgccaaagctcacggccctgctgggaaacgataattacaagcagattgccatgtgcgtcctgtaccacatttcaatggacgatcgtttcaagtcaatgtttgcctatacagactgcataccccagctcatgaagatgctgttcgagtgtagcgacgaaagaatagacctggagcttatctccttctgcattaacctggctgcgaataagcggaacgtccagttaatctgtgaggggaatggcctgaagatgctgatgaagcgggccctgaagtttaaagaccccctccttatgaagatgatcagaaatatatcacagcatgatggccccacaaaaaatctgttcatcgattatgttggggatctggcggcgcaaatctctaacgacgaggaggaggagtttgttatcgagtgtctcgggaccctggcaaacttgacgattcctgacctggactgggagttagtacttaaggagtataagcttgtgccttacctgaaagataagctgaaacccggcgctgccgaagatgacctagtgttggaggtggtgataatgataggcaccgtgtcaatggatgactcatgtgcggccctgctggcgaagagcgggattatcccagctctgattgagctcctgaacgcccagcaggaggacgatgagttcgtctgccaaatcatctatgttttttatcagatggtcttccatcaggctactagagatgttattatcaaggagacacaggctccagcgtatcttatcgacctcatgcacgataagaataatgagatccgcaaagtgtgcgacaatacactggacatcatcgcggagtacgatgaggagtgggcgaagaagattcagtccgagaaatttaggtggcacaatagccagtggctcgaaatggttgagtctaggcaaatggacgaatctgagcagtatctctacggagacgatcgcattgagccatacattcacgagggagatatcctggagcggcccgatctcttttataattctgatggtctgattgcttcggagggcgcaatcagcccggatttctttaacgactaccacctccagaacggggacgtggttggccagcacagcttcccgggaagtctcggcatggatgggtttggccaaccagtcggaatcttgggcagaccggccacagcctacggcttccggccagacgagccttactattatgggtatggcagttag

SEQ ID NO: 192541 - DNA, 2145 bp, Artificial Sequence
  Description of Artificial Sequence: Synthetic coding sequence
atgagcatcgccctgggcaacacctaccggcggagcctgagcgacagtgaaacagtgagcgttctacaagcctcgctgtgcgaggaaaaaaaggaaaagagtagtaaacctaaggatccccctccttttgaaggtatggagatagacgaggtggcaaatattaatgacatggacgaatatatcgaactgctctatgaggacatccccgacaaagtcagagggtccgcacttatcctgcaattggccaggaatcccgacaacctggaggagctgttgctcaacgagacagcactgggggcattagcgagagtgctcagagaagactggaaacagtccgtagaactggccacgaacatcatctatatcttcttctgtttttcttcattttcacagttccacggcttgatcacccattacaagattggagccttgtgtatgaacatcatcgatcatgaactgaagcgtcacgagctgtggcaagaagaactgtctaagaaaaagaaggccgtggacgaagaccctgaaaaccaaacactgcgcaaggattatgaaaaaacctttaaaaagtaccagggcctcgtagttaaacaagagcagctactccgcgttgccctgtacctgcttctaaacctggcggaggatactcggaccgaacttaaaatgcgaaacaagaacatcgtgcatatgctcgtgaaagcattggaccgggataactttgagctcctgatattagtggtgtcattcctaaagaagttgagtatttttatggagaataagaatgatatggtcgaaatggacattgtggagaaactggttaaaatgatcccttgcgagcatgaggatctgctgaacatcacgctgcgcctgttgctcaatctttcgttcgatactggcctcaggaataaaatggttcaggtgggcctcttacctaagctgaccgctctgcttggcaacgataactacaagcaaatagctatgtgtgtactttatcatatttcaatggacgatagatttaaaagcatgttcgcgtatactgactgtattccccagctgatgaagatgctctttgaatgctctgatgaaaggattgacctggaattgatttcattctgcattaacctagcagcaaataaacgcaatgtacagcttatctgcgagggtaacgggctgaaaatgcttatgaaacgggccctgaaattcaaggatcctcttctgatgaaaatgatccgtaacatcagccagcatgacggtcccactaaaaacctatttattgactatgtgggtgatctcgccgcacagatttccaatgatgaagaagaggagttcgtcatcgagtgtctaggaaccctagcaaatctgacaattcctgatttggattgggagttggtactgaaggagtacaagctggtcccatacttgaaagataaattaaaaccgggcgcggccgaggatgatctggtgctggaggtggttatcatgatcggcaccgttagtatggatgattcatgcgcagccctattagcaaagagtggcattatcccagctctaatagagctgctaaacgctcagcaggaggacgatgaattcgtctgccaaataatttatgtgttttatcagatggtgttccaccaggcgacacgcgacgtcattattaaagagactcaggccccggcctacctgatcgaccttatgcacgacaagaataatgagatccggaaagtgtgcgataatacgctcgatattattgccgaatacgacgaggaatgggccaaaaagatccagtcggagaaatttagatggcacaactcacaatggctggagatggtcgagtccagacaaatggacgagagcgaacagtatctctacggcgatgacagaatagaaccttatattcatgaaggcgacatacttgagcggcccgatttgttctataactctgacgggctgatcgccagtgagggagccatctcccccgacttttttaacgactatcacctccagaacggcgacgtggtgggccagcatagcttcccaggatcacttggaatggacggatttggccagcccgtcggaatcctgggccgtcctgccaccgcatacggttttcgcccagatgagccctactactatggctacggctcatag

SEQ ID NO: 192542 - DNA, 1485 bp, Artificial Sequence
  Description of Artificial Sequence: Synthetic coding sequence
atgcggaacaagaacatcgtgcacatgctggtgaaggccctggaccgggacaatttcgaactccttattctcgttgtgtcttttctgaagaaactctccatttttatggagaacaaaaacgatatggtggagatggatattgttgaaaaattagttaagatgatcccatgcgaacacgaagatctgctgaatatcactctgcgcctgctactgaacttatccttcgatactggcctgcgcaataaaatggtgcaggtaggactcctccctaaattgaccgccctactggggaatgacaactataagcagattgcaatgtgcgtcttgtaccatatttccatggacgatcgtttcaaaagtatgtttgcttacaccgattgtataccacagctcatgaaaatgctgttcgaatgttccgacgaacggatcgacctagagctcatctctttctgcataaatctggcggccaataaacgcaatgtgcaactaatttgcgagggaaatggcctgaaaatgctcatgaagagggcacttaagttcaaagatcctttgctaatgaagatgatccggaatatcagccagcatgacgggcctaccaagaacttatttatagactacgttggagacctggccgcacagatatccaatgacgaggaggaggagtttgtgatcgagtgcctcggaaccctggccaacctgaccattccagacctggactgggaactggtgttgaaggagtacaagttagtaccctatctgaaggacaaattaaaaccaggcgctgccgaagacgacttagtgctagaagtggtaatcatgattggtacagtgagcatggacgattcctgtgccgccctgctggctaaatccggcatcattcctgcgttgatagaactgcttaacgcccaacaggaggatgacgaatttgtgtgtcagataatatatgtgttttaccagatggtcttccatcaggctacacgtgatgtcataatcaaggaaacacaggccccggcctacctgatcgacctcatgcacgacaagaataacgaaatacgaaaggtgtgcgataacaccttagacatcattgccgagtacgacgaggagtgggctaaaaaaatacaaagcgaaaaatttagatggcacaattctcagtggctagagatggtggaatcccgtcagatggatgagagtgagcagtacctatacggagatgaccgaattgagccatatattcatgaaggcgatatcctggagcgccctgatctgttttataactccgatgggctgattgctagtgagggtgccatttctccagatttttttaacgactaccatctccaaaacggtgatgtggtggggcagcatagttttccggggagcctcggaatggatggcttcgggcagcccgtggggatcttagggcgacctgccaccgcttacggcttcaggcctgatgaaccgtattactatgggtatggaagctag

SEQ ID NO: 192543 - DNA, 1935 bp, Artificial Sequence
  Description of Artificial Sequence: Synthetic coding sequence
atgaagctgatcaccatcctgttcctgtgcagccggctgctgctgtcccttacacaggaatcacagagcgaggagatcgattgcaatgacaaagacctgtttaaagctgtagatgccgcattaaaaaagtataactcgcagaaccagtccaataaccagttcgtgctgtacagaatcaccgaagccactaagacagtgggttcggacacgttctattccttcaaatacgagatcaaggaaggagattgtcctgtgcaatctggaaagacatggcaggattgtgagtacaaggatgcagcaaaggcagcgacgggcgagtgtaccgccacagtgggcaagaggtcatccaccaaattcagcgtggctacccaaacgtgccaaatcacaccagctgaggggcccgtagtgacagcacaatacgactgcttaggctgcgtccaccctatttcgacacagagccccgacctcgaaccaatactgcggcacgggatccaatacttcaataacaatacccagcatagcagcctgtttatgctcaatgaggtgaagagagcacagcgccaagtggtcgctggtttaaacttccgtataacctacagcatcgttcagactaattgcagcaaggaaaacttcctctttctcacgcctgattgcaaatcactctggaacggggacacaggtgagtgtactgacaacgcctatatagatatacagctgcgcattgctagcttttcccaaaattgcgacatataccctggcaaagacttcgtgcagcccccaactaagatttgtgtgggctgtccacgggatatacccaccaattccccagagctggaggaaacgctgacccacaccattaccaagctgaatgcggagaacaacgctaccttttactttaagatcgacaacgtgaaaaaggccagggtgcaggttgtcgcaggcaaaaaatacttcatcgattttgtggcccgagagactacttgctctaaggaatcaaacgaggaactcaccgaatcctgtgagactaagaaactgggtcagagcctggactgtaacgctgaggtttacgtggttccttgggagaaaaaaatctacccaaccgttaattgccagcccctcggaatgatctccttgatgaagcgcccccccggatttagcccttttaggagcagtagaataggggagattaaggaagagacaaccgtaagtcccccacacacatccatggctccggctcaagacgaggaacgggactctgggaaagaacaagggcatactagacggcacgactggggtcatgaaaagcagcgtaagcacaacctgggacacggtcataagcacgagcgcgatcagggccacggccaccaaagaggtcacggactcgggcacgggcacgagcagcaacacggactgggacatgggcacaaattcaaactggacgatgatctagagcaccagggcggtcatgtcctggatcacggtcacaaacacaagcacggccacggacacggcaaacacaagaataagggaaagaaaaacggaaagcataacggatggaagactgaacatctagcctcatcatctgaagattcgacaaccccctcagctcagactcaggagaagaccgaaggccccactccaatcccaagcctcgccaaacctggcgtcacagtgacattcagcgatttccaggacagcgacctgatcgccaccatgatgcccccgatctcccctgcaccgatccagtctgacgacgattggattcccgacattcagattgaccctaatggtctctcttttaacccgatcagcgactttcctgatacaaccagccctaagtgtcctgggcggccatggaaatcagtttccgaaatcaatcccacaacccaaatgaaagagtcatactattttgacctcacggacggcttatcatag

SEQ ID NO: 192544 - DNA, 1284 bp, Artificial Sequence
  Description of Artificial Sequence: Synthetic coding sequence
atgaagctgatcaccatcctgttcctgtgcagccggctgctgctgtccctgacacaggagtctcaatcagaggagattgattgcaacgataaggacctctttaaagctgtggacgccgcgttgaagaagtataattcccaaaaccagtccaacaaccagttcgtgttgtataggatcaccgaggcaaccaagacagtggggagcgacacattttattcattcaaatacgagatcaaggaaggggattgtcccgttcagtccggaaagacttggcaggactgtgaatacaaggatgccgctaaagcggccaccggcgagtgcacagccacggtcggcaaacgtagcagcacaaagtttagtgtggccactcagacctgtcaaatcacgcctgcggagggccccgtcgtgacggcccagtacgattgcttgggatgcgtccatccaattagtacgcagagtcctgatctcgaaccaatcctgcggcacggcatccagtattttaataacaatacacagcacagttctctctttatgctgaatgaggttaagcgagcccaaaggcaggttgtagccggcctgaactttcgtatcacatatagcatcgttcagacaaactgctccaaggaaaactttctcttcctgacgcctgactgcaagtctttgtggaatggtgataccggcgagtgtactgataatgcatacatcgacatccagctccggatcgccagcttcagtcagaactgtgatatctacccggggaaggattttgtgcaaccaccgaccaaaatctgcgtcggctgccctcgggatattccgacaaatagccctgagctcgaggaaacattaacccatacaatcaccaagcttaatgccgaaaacaacgccactttttacttcaagattgataatgttaaaaaggcccgggtgcaggtcgtggcaggtaaaaagtatttcatcgatttcgtcgcccgagagacgacttgtagtaaggagagcaatgaagaactgaccgagagctgtgagactaaaaagctcgggcaatccttggactgcaacgcggaagtttatgtggtaccttgggagaagaagatttaccctacagtgaactgccaaccacttggcatgatctctctgatgaaaagaccacccgggttctccccttttaggtcctcgcgcatcggtgagatcaaggaggagactacctcccacttgcgtagttgtgagtataaggggagacctccaaaggcaggcgctgagcctgcctcagaacgcgaagtctcttag

SEQ ID NO: 192545 - DNA, 1248 bp, Artificial Sequence
  Description of Artificial Sequence: Synthetic coding sequence
atgaagctgagcctgacccaggagagccagagcgaggagatcgactgcaacgataaggacctgttcaaggcagtagacgccgctctgaagaaatataactcccagaaccaatctaacaatcaattcgtcctgtatcgcattacggaggcaacaaaaactgtgggcagcgataccttctatagcttcaaatatgaaattaaggaaggtgactgtcctgtccagtcaggaaagacctggcaagactgcgagtataaagatgcggctaaagccgctacgggagaatgcacagccacagtagggaagcggtccagtacaaaattttccgtggccacgcagacttgtcaaatcacgcctgccgaagggccagtagttaccgcacagtacgactgcttggggtgcgtccacccaatttccactcagtcacccgacttggagcccatcctacgtcacggaatccagtacttcaacaacaatacacagcactctagcttattcatgttaaacgaagtgaagcgtgcacaaaggcaagttgtggccggactgaactttaggataacctattccatcgttcagaccaattgctcaaaagagaactttttgttcttgactcccgattgtaagagtctgtggaacggggacacgggtgaatgcacagacaacgcttacatcgatatacagctgcgcatcgcgtcattttcacagaactgcgatatttatccaggtaaggattttgtacagccaccgacgaaaatctgcgttggatgccccagggacatccccactaactctcctgagttagaagaaaccttaactcatactattacaaaactgaacgctgaaaacaatgctaccttctactttaagatagataatgtgaaaaaggcccgggtgcaggtggttgcagggaaaaaatactttatcgatttcgtggccagggagactacttgttccaaggagagcaacgaggagttaacggagtcctgcgagaccaaaaagttagggcagtcattggactgcaacgccgaggtgtatgtcgtgccatgggaaaaaaaaatctacccaaccgttaactgtcagcccctgggcatgatatctctgatgaagagaccgcctggattctctccttttaggagcagtcgtattggcgaaattaaggaggagaccacctctcatctccgatcttgtgaatataaagggcgcccaccaaaggctggagccgagcctgcaagcgagcgtgaggtcagctag

SEQ ID NO: 192546 - DNA, 1176 bp, Artificial Sequence
  Description of Artificial Sequence: Synthetic coding sequence
atgaagctgatcaccatcctgttcctgtgcagccggctgctgctgagccttacacaagagtctcagagtgaggagattgattgtaatgacaaagacctgtttaaagccgtagatgcagctctgaagaaatacaactcccagaaccagtccaacaatcagttcgttctgtaccggatcacggaagcgacgaagacagtgggtagtgacactttctactcgttcaagtacgagattaaggagggcgactgcccagttcagtccggcaagacttggcaagactgtgagtacaaagatgctgcaaaggctgccactggtgaatgcaccgcaacagttggtaaacgaagctccaccaaattttcagtggccactcagacgtgtcagataactccagcagaaggccctgtcgttacggcccagtacgactgtcttgggtgcgtgcacccaatcagtactcaaagccctgatctcgagcctatcttgcggcatgggatccagtactttaacaataatacacagcattccagccttttcatgctgaatgaggttaagcgagcccaaaggcaggacacaggtgagtgcaccgacaacgcctatattgacattcagttaagaatcgcctcttttagccagaattgcgacatctatcctggcaaggatttcgtgcagccccccactaaaatttgtgtcgggtgtccacgcgacattccaacgaatagccctgagctggaggaaactttgactcacacaataacaaaactgaacgcagagaacaatgcaacgttttacttcaagatcgataacgtcaaaaaggcgagggtgcaggtggtggcgggtaagaaatacttcattgatttcgtcgcccgcgagaccacatgctccaaggagtctaatgaggaattgaccgaaagctgcgagacaaagaagctcggccaatctctcgattgcaatgccgaggtttatgtggtaccttgggagaagaagatctacccgacagtaaattgtcaacccctgggaatgatttccctaatgaagcgccctccgggattttcaccctttagatcctcaagaatcggtgagattaaagaagagacaacctcccatcttcggtcttgcgaatataaaggccggcccccaaaggccggcgctgaacctgcgagcgaaagagaagtctcctag

SEQ ID NO: 192547 - DNA, 306 bp, Artificial Sequence
  Description of Artificial Sequence: Synthetic coding sequence
atggacatccccatcagcagccgggacttccggggcctgcagctggcctgcgtcgcactcggcttagtagccggaagcatcatcattggcatttctgtgagcaaagccgccgccgcaatgggtggcgtgttcatcggcgctgctgtcctcggttctttgaggatccatccccaccctggcgctgatcacggcgaaggaagatcatctacgaacggtaacaaggaaggagcgagatcttctttaagcacagtctctcggacactggaaaaactgaagccggggacccggggcgcagaggagtgctag

SEQ ID NO: 192548 - DNA, 375 bp, Artificial Sequence
  Description of Artificial Sequence: Synthetic coding sequence
atggacatccccatcagcagccgggacttccggggcctgcagctggcttgtgtggccctgggccttgttgccgggtcaattattattgggatctcagttagcaaagctgctgcagctatggggggggtttttattggcgccgccgtgcttggactgctgattcttgcttatccttttctgaaagcccggtttaacctcgatcatatactccccaccatcgggtctctccgcattcacccccatccaggcgccgaccacggtgaaggccgatcttccactaacgggaacaaggaaggcgcccggtccagtcttagcactgtgtctcgtaccctggaaaaactaaagccaggaactagaggtgccgaagaatgctag

SEQ ID NO: 192549 - DNA, 3135 bp, Artificial Sequence
  Description of Artificial Sequence: Synthetic coding sequence
atgaagcccggctgcgccgccggcagccccggcaacgagtggatcttcttctccactgacgaaatcaccacaaggtaccggaataccatgtccaacgggggcctgcagaggagtgttatcttgagtgccttaatcctgctgagagctgtaaccgggttcagcggtgacggcagggccatttggtccaaaaatcctaactttaccccggttaacgagtctcagctgttcctatatgatacttttccaaagaatttcttttgggggatcggcaccggggcccttcaggtggaaggctcttggaagaaagatgggaagggaccatcgatctgggaccattttattcatactcaccttaagaatgtgtcaagcactaacggcagctcggattcctacatcttcctggaaaaagacctcagcgccctggactttatcggagtgtccttttatcagttctcaattagctggccacggctgtttccagacgggattgtgaccgtggcaaacgcaaagggcctccaatattactcaacgctgctcgacgctctggtcctgagaaatatcgagccaatagtgactctctaccattgggatctcccccttgccctgcaggagaaatacggcggttggaagaacgatacaattatcgatattttcaatgattatgcaacatattgtttccagatgttcggagacagggtaaaatactggattacaattcataacccctaccttgtggcttggcatggctacggcaccggtatgcacgcccctggcgagaaaggcaacctggcggcggtttatactgttgggcataacctcatcaaggcacactcaaaagtgtggcacaactacaacactcatttccggcctcaccagaagggatggctgtcaattaccctgggctcccattggattgagcctaaccggtcagaaaacaccatggacatcttcaaatgtcagcagtccatggttagcgtactcggctggtttgccaatccaatccatggggacggcgactatccagaaggcatgaggaagaagctgttcagcgtcctgcccatcttctctgaggccgagaaacatgaaatgcgaggtactgctgacttcttcgcgttctcttttggaccaaataactttaaacctttgaacactatggccaaaatggggcagaatgttagtctgaatttaagagaagcactgaattggattaagctggagtacaataatccccgcattttaattgccgagaacggatggttcaccgacagtagggttaaaaccgaggacacgacagccatctacatgatgaagaatttcctcagccaggtcttacaggcaatcaggttagatgaaattagggtgtttgggtacactgcctggtctttactggatgggtttgagtggcaagacgcatacacaatccgtagagggctgttctacgtcgatttcaacagtaagcagaaagagcgtaagcctaagtcatctgcccactactataagcagattattagggaaaatggtttcagcctcaaagagagtacacccgacgtgcagggacagtttccctgcgacttctcttggggcgttacagagagcgtgttgaagcccgagtcagtggctagttcccctcagttttccgacccccatctgtacgtgtggaatgctaccgggaacagactccttcacagagtggagggcgtccgcctcaagactcgccctgctcaatgtactgactttgtgaacataaagaagcaactcgaaatgttagcccgaatgaaagtgacacattaccggttcgcactcgactgggctagcgtgctacccaccggcaacttatctgcagtgaaccgacaagccttgcgctactaccgctgtgtcgtatccgaggggctaaagttgggcatcagtgcaatggtgacactttattacccgacacacgcacaccttggcctgcccgaacccctccttcacgccgatggatggcttaatcctagcaccgctgaggctttccaggcctatgccggcctgtgttttcaagagctgggagaccttgtgaagctgtggatcacgatcaacgaacccaaccggcttagtgacatttacaataggtcgggcaatgacacgtatggagcagcgcacaacctgctggtggcacatgcgctggcatggcgcctgtacgaccgacaatttcggcccagccagagaggggcggtgtccctgtcattacacgctgattgggccgagccagccaacccttatgctgattcgcactggagagctgccgagcgctttcttcaattcgaaattgcctggtttgccgagccattattcaagaccggggattatcccgctgctatgcgcgagtacatagccagcaagcataggcgcggcctcagcagtagtgccctgccgaggctgacagaggctgaacggcgcctgctgaaggggaccgttgacttttgcgccctcaatcatttcacaacaaggttcgtgatgcatgagcagttagcagggagccgatacgactccgaccgtgatatccaattcctgcaggacataactaggctctctagccccacacgtttagccgtcattccctggggagttcgcaagctgctcaggtgggtgcgccggaactacggggatatggacatctatatcactgcatctgggatagatgaccaggctctggaggacgaccggcttcgcaagtattatttgggcaagtacctccaagaggtactgaaggcttacctgatcgacaaggtgagaattaaaggatactatgcgttcaagttagctgaggagaaaagtaagcccagatttgggttctttacttctgacttcaaagccaaatctagcattcagttctacaacaaagtgatttcgtccagggggttccctttcgaaaattcaagcagccggtgctctcagacccaggaaaatactgagtgcactgtctgcctctttctggtgcagaaaaagcccttaatcttccttggatgttgttttttcagtacactcgtcttgctcctgagcatagcaatcttccagaggcagaagcgccgaaaattctggaaggctaagaacctgcagcacatcccactcaagaagggtaagcgcgtggtgtcctag

SEQ ID NO: 192550 - DNA, 1389 bp, Artificial Sequence
  Description of Artificial Sequence: Synthetic coding sequence
atgggcacccaggccctgcagggcttcctgttcctgctgttcctgcctttattgcagcctagaggggcttctgcagggagcctccactcacccggactctcagagtgttttcaagtgaacggcgccgactatcgcggccaccagaaccggacaggcccgcgcggcgccggtcgtccttgcctgttctgggaccagactcaacagcactcctactcttcagcaagtgatccccacggacgctgggggctgggcgcccataacttctgtcggaaccctgacggcgacgtgcagccttggtgttacgtggccgaaacggaagaaggtatctactggcgctactgcgatatccctagctgccacatgcctggctaccttgggtgcttcgtggactcaggagccccgccggcattgagcggaccatctggtacctccacgaaactgaccgtacaggtgtgcctcaggttctgccgaatgaagggatatcagctcgctggcgtggaggccggttacgcctgcttttgtgggtccgagagtgacttagctaggggtagactggcgccagctaccgactgcgaccagatttgcttcggccacccaggtcaactctgtgggggggacggcagattaggcgtgtatgaagtgagtgtggggtcctgccaggggaactggacggctccccagggcgtcatttacagtcctgactttccggatgaatacgggccagaccggaattgctcgtgggccctgggcccgccaggtgccgcccttgaactgaccttcagactgtttgagctggccgacccgcgagatcgcctagagctgagggacgcagcctccggcagcttattgcgggccttcgatggggccaggccaccacccagcgggcccctgcgtctaggtacagctgcactcctgcttacttttcgcagtgatgccagagggcatgcccagggattcgccttgacataccgagggctccaggacgcggccgaggatcctgaagcccccgaggggagcgcgcagactcccgcagctcctctggacggggccaacgtttcatgcagtcctaggcctggagcgcctccggccgcaatcggtgctagagtgttttctaccgttacagctgtgtccgtgctgctcctattactcctggggctattgcggccccttaggagaagaagctgtttgttggcaccaggcaagggccctcccgctctcggagcctcaaggggtcctagaagatcctgggccgtgtggtatcagcagcctcgcggcgtggctctgccatgcagcccaggggacccccaagccgagggctccgctgctggctaccgacccctgagcgcgtcctctcaaagtagcctgcggtctctaataagcgccctctag

SEQ ID NO: 192551 - DNA, 1263 bp, Artificial Sequence
  Description of Artificial Sequence: Synthetic coding sequence
atgggcacccaggccctgcagggcttcctgttcctgctgttcctgcctctgctccagcccaggggggcctcagctggaagcttacattcgcccggtttaagcgaatgtttccaagtgaacggcgccgactacagaggacaccaaaatcgaacagggcctcgcggcgccggacgaccttgcctcttctgggatcagacgcagcaacattcttactcaagtgcatccgatcctcatgggagatggggtctgggtgcacataacttctgtagaaatcccgacggggatgttcagccttggtgctatgttgccgagacagaagagggaatttactggaggtactgcgacattccatcctgccacatgcctgggtatctcggctgttttgtggattccggggccccccccgcactgtctgggcccagcggcaccagcacgaagctcacggtgcaagtatgccttcggttttgtagaatgaagggctaccagctggccggtgtcgaggccggttatgcttgcttttgtggtagtgagagcgatttggctcggggacggcttgcgcccgctaccgattgtgatcaaatttgtttcggtcacccgggtcagctgtgtggcggggatggtcgccttggcgtgtacgaagtttcagtgggatcatgtcagggcaactggaccgcaccgcagggggtaatttacagtcctgacttccctgacgaatacggtccggaccgcaactgctcttgggccttgggaccccctggcgctgccctcgaactcaccttccgattattcgaactagctgatcccagggatcgcctagagcttcgggatgcggccagtggatccctactgcgcgcttttgatggcgccagaccccctcccagtggccccttacggctgggcaccgcagccctgctcctcacctttcgatcagatgctcgggggcacgcccaaggatttgcgctgacttatcgggggctacaggacgctgccgaggatcccgaggcaccagaaggtagcgcccaaactcccgcggcaccactcgatggggccaacgtatcttgctcacccaggcccggagccccacctgcggccataggcggagcggtgtgctggctgcgcgagaagggccctaggcggtggggcctgcccggcgccccgggagaggccggcctctgcgggaccaactccccagagggctggccatgtcctgcaccccccgggacaccccgtttgcgagttctgccacgcgccacgggcctttag

SEQ ID NO: 192552 - DNA, 1272 bp, Artificial Sequence
  Description of Artificial Sequence: Synthetic coding sequence
atgggcacccaggccctgcagggcttcctgttcctgctgttcctgccattgctgcaaccacgcggagcgtccgctgggagcctgcattcacccggtttatcggagtgttttcaagtgaatggcgctgactaccgggggcatcagaaccgcacgggcccgcgcggtgctggtaggccgtgcctgttctgggatcagacacagcagcacagctattcttcagctagcgaccctcacgggcgttggggactgggcgcacacaacttttgtcgaaacccagatggcgatgtacagccctggtgctacgtcgctgaaactgaagaggggatctactggcgctactgcgacatcccatcgtgccacatgcctggctatctcggctgctttgtcgactccggagctcctcccgctctttcaggcccttctggcacaagcacgaaattgactgtccaggtttgtttgcgcttctgccggatgaagggctaccagctttgtggcggcgatggtcggctgggcgtgtacgaggtgtctgtcggtagttgccagggtaactggaccgcgccacaaggtgtgatctactccccggacttcccggatgaatacggtcctgaccgaaattgcagttgggcattggggcccccaggcgccgcactggaacttacctttcggctatttgaacttgcagacccccgagacaggctcgaactcagggatgcggcaagtggatccttgctgagggcatttgacggggctcgcccccctccctccggcccccttagactcggaactgcagccttgctgctgacgtttcgtagcgacgctcgtggccacgcgcagggctttgcgttaacctatagaggattacaagacgctgctgaggatccagaagcacctgaagggagcgcccaaactccagccgctcccctggacggcgctaatgtgtcctgctcgcctaggcccggggcaccacctgcggctataggcgcccgagtgttctctaccgtaaccgctgtgtctgtgctcctcctgctgctactgggactgttgaggcctctgaggagacgaagctgtctgctggcaccaggcaaagggccgcccgccctcggcgcttctcgcggcccgcgccgcagctgggccgtgtggtaccaacagccacggggcgtcgctctcccctgtagtcccggtgatccacaggccgagggctccgccgctggatatagaccgctgtcggctagctcacagagttccctgcgtagcctgataagcgccctttag

SEQ ID NO: 192553 - DNA, 1146 bp, Artificial Sequence
  Description of Artificial Sequence: Synthetic coding sequence
atgggcacccaggccctgcagggcttcctgttcctgctgttcctgccacttctgcaacctcggggcgcttctgcagggtccctgcacagtcccgggttgagtgaatgttttcaggtcaacggagccgactatcgcggtcaccagaataggaccgggccaagaggcgcaggcaggccctgcttattctgggatcagacccagcagcacagctactcctccgcctcagacccccacggacgttggggtctgggcgctcataatttctgccgaaaccccgacggggacgtgcagccctggtgctatgtcgccgaaacagaggagggcatctattggaggtactgtgatataccatcatgtcacatgccaggctacctcggctgtttcgtggactcaggcgcacccccagcgctgtctggaccttcaggtacctctacaaagctgacagttcaagtgtgcctgcggttctgccgtatgaaaggataccagctctgtggtggggacggcaggctcggcgtgtatgaagtgagcgtcgggtcctgtcaaggcaattggacagcgccccagggggtcatctatagccccgactttcccgatgagtacggacccgatagaaattgctcttgggccctgggccctcctggcgctgccctcgaattgacgttcaggttgtttgaactggcagacccccgagatagattggagctccgcgatgccgcgagcggctccctgctgagagctttcgacggagcccgtccacctccgtcaggaccacttagactcgggaccgcagcactcctccttacctttcggagcgatgcccggggacatgctcagggattcgcgctgacgtaccgcggccttcaggatgctgcagaagacccagaagccccagaaggctctgcccagaccccagctgctcctctcgacggggctaacgtttcttgttctccgagacctggtgcacccccagctgcgatcggaggtgctgtgtgctggcttagagagaagggacctaggaggtggggactccctggtgcacccggtgaagctggactgtgcggcacgaatagccctgaggggtggccctgtcctgctccacccggcacgcccaggcttagagttctcccgcgagccaccggtttgtag

SEQ ID NO: 192554 - DNA, 2211 bp, Artificial Sequence
  Description of Artificial Sequence: Synthetic coding sequence
atgggcaaccccgagaacatcgaggacgcctacgtggccgtgatcagacccaaaaacactgcatccctgaactccagagaatatcgcgctaagagttatgagattctgttgcatgaggttcctatagaaggccagaaaaaaaaacgcaagaaggttttgctggagactaagctgcaagggaactctgaaattacccagggcatactcgactacgtggtcgagacaacgaaacccatctctccagccaaccaaggcatcagaggcaagagggttgtgctgatgaaaaaattcccattagatggcgaaaaaatgggccgcgaggccagcttatttatcgtgccctccgtagtaaaggacaacaccaagtatacctacacacccggatgcccgatcttttactgtctgcaggacatcatgcgcgtgtgtagtgaaagctccactcatttcgcaacacttaccgcccgcatgctaatcgccctagacaagtggctggatgaaagacatgcgcaatcccatttcattccggctctgttcagaccttcaccgctcgagcggatcaaaaccaacgtgatcaatccggcttacgcaaccgaaagtgggcagaccgagaatagtctgcacatgggctattccgctctggaaatcaagtctaagatgctggctttagaaaaagcggacacctgtatatataaccccctgtttgggagcgatttgcaatatacaaatagagttgataaagtcgtgatcaacccgtacttcggcctcggggccccagactacagcaagattcagatccctaaacaggagaaatggcagcgcagcatgagctctgtgaccgaagataaggaacggcagtgggtggacgacttcccgttgcatcggtcagcctgcgagggagatagcgagctgctgtcgaggctgctgtccgagagattctccgttaatcagctagattctgaccattgggcaccaattcattacgcttgttggtacgggaaggtagaagccacccgcatcctactggagaaaggcaaatgcaacccaaacctgctgaacggccagctgagctcgcctttgcatttcgctgctggaggaggccacgccgagatagtgcaaattctgctgaatcatcctgaaactgatagacacattacagatcagcagggacggtcccccttgaacatttgcgaagagaataagcagaataattgggaagaggccgcaaagttactcaaggaagccattaacaaaccctacgagaaggttcggatatatcgaatggacggcagctaccgcagtgtggagctaaagcacggcaataacaccaccgtccagcaaatcatggagggaatgcggctgtctcaggaaactcagcagtactttactatctggatctgctctgagaatttatcactgcaactaaagccttatcacaaaccattgcagcacgtacgggactggcccgaaattctggcagagctgacaaatctggacccacagcgagaaactcctcaattgtttctgaggcgggacgtgcgactccctctggaggtggagaaacagattgaagatccacttgccatcttgatcttgttcgacgaagctcgctataatctattgaaggggttctataccgccccagatgcgaagctaattactctggcctctttgttattgcagatcgtatatggtaactacgagtcaaagaaacacaaacaggggttcttgaacgaggaaaacctgaaaagcattgtcccagtgacaaaactcaagagcaaggcgccgcattggactaatcggatacttcatgaatacaaaaacttaagcacaagcgagggggtgtccaaggaaatgcaccacctccagcggatgtttctacaaaattgttgggagattcctacatatggagcagccttcttcacgggccagattttcacaaaagcatcccccagtaatcacaaggttatcccagtttatgtcggcgtcaacattaaagggctgcacttattgaacatggagacaaaggcactgctgatcagcctcaagtatgggtgttttatgtggcagcttggagatacagacacatgtttccaaattcactcaatggagaacaagatgagcttcatcgtgcatacgaaacaggcagggctggtcgttaaactcctgatgaaactgaacggccagcttatgcccacggagcggaattcctag

SEQ ID NO: 192555 - DNA, 3624 bp, Artificial Sequence
  Description of Artificial Sequence: Synthetic coding sequence
atggacctgcacatgatgaactgcgagctgctggccacctgcagcgccctgggatacctggagggcgatacgtaccacaaagagcccgactgtttagaatccgttaaggacctgatcagatacctcaggcacgaggacgagacacgggatgtgcgccagcagctgggtgctgctcagatcctccagtccgatctactaccaatccttacccagcaccatcaggacaaacccctgttcgacgccgtgattcggttgatggtgaacctgacgcagccagcattactttgttttggcaacttgcctaaagaaccatcatttaggcaccacttcctgcaggtgctgacttatctgcaggcatacaaggaagccttcgccagcgagaaagctttcggggtcttatcagaaacactttacgagctgctgcagctgggctgggaagaacgccaggaggaggataatctcctgattgaacgcatcctgctactcgtccggaatatcttacatgtccctgccgatctcgatcaggagaaaatcgacgacgacgctagtgcccatgaccagttactgtgggcaatacaccttagcggcctggatgaccttctgctcttcttagctagcagcagcgctgaagaacagtggagcctgcacgtgctggaaattgtgtccctgatgtttagagaccagaatcccgaacagctagcaggggtcggacagggtagactggcacaggagcggtctgcagactttgctgagctcgaagtccttcggcaacgagagatggctgagaaaaagaccagggcactccagaggggaaaccgacactctaggttcggaggaagctacatagtgcagggactgaaatctatcggagaacgggatctcatatttcataagggactccacaacctaaggaactattcatccgatctgggtaaacagcccaaaaaagtccccaaacgtaggcaggccgcaagagagttgagcattcagcgcagaagtgctctgaatgttaggctctttctcagggacttttgctctgagtttctagagaattgttacaaccggttaatggggagtgttaaggatcacctacttcgggaaaaagcccagcagcatgacgaaacatattacatgtgggcactcgccttctttatggcattcaatcgggccgcatccttcaggcccggcttggtctcagagacgctctctgtgcgtacgttccactttatcgagcagaacctgacaaattattatgaaatgatgctcaccgacagaaaggaagcggccagctgggcgcgtagaatgcatctggcactcaaggcttatcaggagctgctggctactgttaatgagatggacattagcccggacgaggctgtgagggagtcatctagaattattaaaaataacatcttttacgttatggaatatagggaactgtttcttgccctttttaggaaattcgatgagagatgtcagcccaggagttttcttcgggacttggttgagactacacacttattccttaaaatgctggaacgattttgtcggtcacgtggaaacctcgtggttcagaacaaacagaagaagcgccggaaaaagaagaagaaagttctcgaccaggccatagtgtcggggaatgtaccatctagccccgaggaagtcgaggctgtgtggcctgcccttgcagaacagctgcagtgctgcgcccaaaactccgagctatccatggacagcgtagtccctttcgatgctgcttctgaggtgcctgttgaggagcagcgagccgaagccatggttcggatccaggattgcctcctcgcgggacaggctccacaggctcttacactgctgcggtcagcccgcgaggtgtggcccgagggcgacgtattcggcagtcaggatatctcacctgaggaggagattcagctcctcaagcagatactgagtgcacctctgcctaggcagcagggtccagaggagcgcggagccgaagaagaggaagaggaagaggaggaggaggaggaggagttgcaagtcgttcaggtctccgaaaaggaattcaactttttggattacttgaaacgcttcgcctgctcaaccgtcgtgcgtgcatatgttcttctcctgcggagttatcagcagaactccgcccataccaaccattgtattgttaaaatgctacacagacttgcacacgatctgaagatggaggcgctccttttccagctgtctgtcttttgtctgttcaataggctcctgagcgatccagcagcaggagcatacaaggaactggtaacgttcgctaaatacatcctcggcaaattcttcgctctggcggccgtgaatcaaaaagccttcgtggagctgctgttttggaaaaatactgcagtcgttagggaaatgacagagggatacggctctctggacgacagatccagcagtaggcgcgcccctacgtggagccctgaagaagaagcacacctcagagaactctatctggccaacaaggatgttgagggccaggatgtggtggaggctatccttgcccatttgaacaccgtgccacggacaaggaaacaaattattcaccatctggtgcagatgggcttggccgattccgttaaagacttccagcgcaaaggaactcacatcgtactgtggaccggcgaccaagagctggagctgcagcgactcttcgaagagtttagagatagtgacgacgtgctcggtcacatcatgaagaacattactgccaagagatctagggcccgcattgttgacaaacttttggctctcggcctggtggcggagaggcgcgagctctataaaaaacggcagaagaaactcgcctcatcaattctgcccaatggggcagagtcattaaaagacttttgccaggaggatttggaggaggaagagaatttgcccgaggaagattcagaggaagaggaggagggggggtcagaggcagagcaggtgcaggggtcactggtgctcagcaatgagaacctcggccagagcttgcaccaggaaggcttttccatcccactgttatggctccagaattgtctgatccgtgcggccgatgatcgagaagaggacggttgttcacaggctgtccctttggtgcccctgacagaagagaacgaagaggctatggagaacgaacagttccaacagctactccgcaaattaggcgtacgtccacccgcttcagggcaggaaaccttttggaggattccagcgaagctcagcccaactcagctgcgaagagctgctgcctctttgtctcagcctgaagaagagcagaagttacagcctgagctgcaacccaaggtgcctggcgagcagggatccgatgaggaacattgtaaagagcacagggcccaggctctgcgagctttattgctggcacataagaaaaaggcaggtctcgcctctcccgaggaggaagatgctgttggaaaagagcctttaaaagcagcacccaagaaaagacaactactggactccgacgaggagcaggaagaggacgagggtcggaaccgcgctcccgagcttggagccccaggtattcaaaagaagaagcgctatcaaattgaggacgatgaagacgactag

SEQ ID NO: 192556 - DNA, 1539 bp, Artificial Sequence
  Description of Artificial Sequence: Synthetic coding sequence
atgcacacccccgacttcgccggccccgacgacgcccgggccgtggacattatggacatctgtgagagtatcctcgagcggaaacggcatgatagcgaaagatctacctgctccattttggagcagaccgacatggaggctgtcgaggcactcgtgtgcatgtcaagttggggtcaacggtcccaaaagggggatcttctgaggattcgaccactcacccctgtatccgactctggtgacgtgaccaccaccgtgcacatggacgccgcaacccctgagcttcccaaggattttcattccttgtccacactatgcatcacgcctccgcagagccccgatctggtggagccgagcacccgtactcctgtttcacctcaggtcacagatagcaaagcatgcacagccaccgacgtactgcaatctagtgccgtggtggctcgggccttgagtgggggagcagagagagggcttcttggcctcgagcctgtgccgagtagcccctgcagagcgaagggcacctcagtgattcgccacaccggagagtctccagctgcctgcttccccacaatccagaccccggattgtcggctgtccgattcccgtgagggcgaggagcagctgcttggccacttcgaaactctccaggacacccatctgactgatagtctgctgtcaacgaatctcgtgtcttgccagccttgtcttcacaagagtgggggcctgctgctgaccgacaaagggcagcaggccggatggcctggcgcagtacaaacttgtagcccaaagaactatgagaacgatctcccaagaaagacaaccccgctaatcagtgtgtccgtaccagcccctccggttctgtgtcaaatgatcccagtgacgggccaatctagtatgctgcctgcattcctgaaaccacctccacagttaagcgtagggacagtgcggcctatactggctcaggccgcgcctgctccacagcccgtcttcgttggcccggctgtcccccaaggcgcagtgatgctggtgctccctcagggggctctgcctccacccgcaccatgcgccgcgaacgtgatggcagctgggaatacgaaactgctgcccctggcacctgcaccggtgtttattactagcagccagaactgtgtccctcaggtggacttcagccgccgaaggaactacgtttgttccttccccggttgccgaaaaacctattttaagtcgagccacctgaaagcacatctgcgcacacacactggggaaaagccatttaattgcagctgggacggatgcgacaagaaattcgctaggagtgacgagctctcgcggcatcggcgcacgcacaccggagaaaagaaattcgtgtgccccgtgtgtgacagaaggttcatgcggtcggaccacctcaccaaacatgctagaagacacatgacaacaaagaaaattcccggctggcaggctgaagtgggtaagcttaatcggatcgcgtctgccgagtcacccggatctcctctagttagtatgcctgcgagcgcctag

SEQ ID NO: 192557 - DNA, 1488 bp, Artificial Sequence
  Description of Artificial Sequence: Synthetic coding sequence
atggacatctgcgagagcatcctggagcggaagcggcacgacagcgagcgtagcacttgtagtattttggaacagactgacatggaagccgttgaggctttagtctgcatgagttcatgggggcagcgcagccagaagggcgacctactgaggattagacctcttacaccggttagcgactcgggggatgtgacaacaaccgtacacatggacgctgccacccccgagctgcccaaagattttcacagtctcagcacactgtgtatcactcctccacagagccccgacctggtggaaccgtccacccggacaccggtgtcccctcaggtgaccgacagtaaagcctgcaccgccactgatgtgcttcagtccagtgccgtggtcgcacgggcattgagtggaggggccgaacgcgggctccttggcctggaacccgttccctcaagcccatgtagggctaagggcacgagcgtcattaggcacaccggcgaatctccagctgcttgttttcctaccatccagaccccagactgccggttgtcagactcgagagaaggtgaagagcagttgctagggcactttgaaactctgcaggacacccacttaacagactccctgctgtccaccaacttggtctcttgccagccatgtctgcataagtccgggggcctgctcctgacggataaagggcagcaggcgggttggcccggagccgttcagacatgttctccgaagaactatgagaacgatcttccacgcaagacaacacccctgatatcagtctccgttcctgctcctcccgttctatgtcaaatgatccctgtgaccgggcagtcctcaatgcttcccgccttcctcaagccccccccccagctctctgtgggcactgtaaggccaatcctcgcccaagccgcacccgcccctcagcctgtctttgtgggtcccgccgtgcctcaaggtgcggtcatgctggttcttcctcagggtgcgttgcccccccctgccccatgtgctgccaacgtcatggccgcagggaacacaaagctccttccccttgcaccggctcccgtgtttattactagttcccagaactgcgtgccccaggtcgacttctcccggaggcgcaattacgtctgcagtttcccggggtgtaggaagacgtattttaaaagcagtcatttaaaggcacacttaaggacacacacaggagagaagcctttcaactgctcctgggatggttgcgataagaagttcgcccggagcgacgaactgagccgacacaggcggactcatacaggtgaaaagaagttcgtgtgtcctgtttgcgacaggcggtttatgagatcagatcacctcacaaagcacgcacgacgacacatgaccacaaagaaaatacctggatggcaggcagaagtggggaaactgaatcgaatcgcctctgctgagagcccaggaagtccactcgtgtctatgccagcctcagcctag

SEQ ID NO: 192558 - DNA, 1488 bp, Artificial Sequence
  Description of Artificial Sequence: Synthetic coding sequence
atggacatctgcgagagcatcctggagcggaagcggcacgacagcgagaggtccacgtgctccatcttagaacagaccgatatggaggcagtggaggcgcttgtttgcatgtcatcctggggccagcggtcacaaaaaggcgatctgttaagaattagacccctgacacccgtgtctgacagcggagacgtcacaactactgtacatatggacgccgctacccccgagcttcctaaggatttccatagtctcagtacattgtgtatcacacctccacagtcacctgatttagtggaaccatccactaggaccccagtgtcccctcaagtaacggacagtaaagcttgcaccgccacagacgtcctccagtcgagcgcagttgtggcccgcgccttgagcggaggcgccgagcgcggtttgctgggcctagagcctgtcccatcgagcccctgcagagccaagggcacatccgttattcgccacacaggtgaatcgcccgccgcgtgcttcccgactattcagaccccagattgtaggctaagcgacagtagagaaggggaagaacagctgctggggcatttcgagactctgcaggatacccatctcactgactccctcctctcaacaaaccttgttagctgtcaaccttgcctccacaagagtggcggactgttacttaccgacaaaggtcagcaagccggttggccaggagcagtgcagacttgctctcctaagaactacgaaaatgaccttccacggaaaactaccccactgatctcggtgtccgtacccgctcctccggtcctctgtcaaatgatcccagtgaccggccagagctccatgctcccagccttccttaaacctcctccgcagctcagcgtgggcactgttcgcccaattctcgcccaggcagcccctgcaccacagcccgtatttgtgggccccgctgtccctcaaggcgcggtgatgctcgtactgccacagggggccctcccgccaccagctccttgtgctgccaacgtgatggcagccggtaatacaaagttgttaccccttgctcctgcacccgtgtttatcacgagctcccaaaattgcgtgccccaagtcgatttctcccgcaggcgtaactacgtgtgtagcttccccggctgcaggaaaacctatttcaagtccagtcacctgaaagctcatctcagaacccacaccggggagaaacctttcaattgctcttgggacggctgcgataaaaagttcgcaaggtctgatgagctctctagacaccgccgaactcacactggggaaaaaaagttcgtgtgcccagtgtgtgataggcgttttatgcgctctgatcacctaaccaagcacgctaggcgccatatgaccaccaaaaagatccccggatggcaggcagaggtgggcaagctcaataggatcgcctcggcagaatccccgggcagtccattagtgagtatgcccgcgtccgcctag

SEQ ID NO: 192559 - DNA, 1209 bp, Artificial Sequence
  Description of Artificial Sequence: Synthetic coding sequence
atcagcgtgcacctgatgcggaagcacgtgaagaacatcaacacctttgagaacaggatgcttatgctcgacggaatgccagctgttcgcgtgaagacggaactgttggaatcagagcaaggctctcctaatgtccacaattaccctgacatggaagcagtgcctctgctcttaaacaatgttaaaggcgaaccacctgaggattctctgagcgttgaccactttcagacccagactgagccagtcgacctgtcaatcaataaggcaagaacttcacctactgccgtaagttcttcacccgtcagcatgacagcttccgccagctcaccatcgagcacgtcaacatcttctagcagctctagtcgcctggcctcctcacctaccgttataacctcggtgtctagcgcctcatcctccagtactgtcttaacacccggccccctcgttgcgtccgcttccggcgtgggtggacagcaattcttgcacatcatccaccctgtccctccttctagtccaatgaacctacagtcaaataaactgagccacgtgcataggatacctgtcgtggtacagtctgttcctgtggtgtatacagcagtgaggagtccgggaaatgtgaataatacaattgtcgtgcccctcctggaggacggcaggggacatgggaaagctcagatggatccaagagggctgtcaccgcgacagtcaaaatcggatagcgatgacgatgatctccccaacgttactctcgactccgttaatgagactggaagcaccgcattgtcaatcgccagagccgtgcaagaggtccatccctccccggtgagtcgggtaagagggaataggatgaacaaccagaagtttccctgctcaatttcacctttcagcattgagtccactaggcggcagagacgatctgagtcccccgactctagaaagaggcgtatccaccgatgcgactttgagggctgcaacaaagtgtacactaaaagcagtcatctaaaggcccatcggagaacccacacgggcgaaaagccttacaaatgcacatgggaaggatgcacctggaagttcgcccggagcgacgaactgactcggcattaccggaagcacactggcgttaagcccttcaagtgtgccgattgcgaccggtctttctccagatccgaccatctcgcactgcatagaagaagacacatgctggtgtag

SEQ ID NO: 192560 - DNA, 1209 bp, Artificial Sequence
  Description of Artificial Sequence: Synthetic coding sequence
atgaacatccacatgaagcggaagaccatcaagaacatcaacacctttgaaaaccgaatgctgatgttagacggcatgccagccgtacgtgtgaagacagagctccttgaatcggaacaaggttctccgaacgtgcacaattacccagatatggaggccgtccctctcttgttaaacaatgtcaaaggggagcccccagaggactctctaagtgtcgaccatttccagacacagaccgaacccgtggacttgagcattaataaagcccgaactagccctaccgccgtttcctcttcccctgtgtcaatgacagcttccgccagcagtcccagctctactagtacaagttcctcctcatcaagccggcttgcttctagtcctaccgtgatcacaagcgtaagctccgcgagttcatcctcaacagttctgacacccggccccctggttgcatccgcctctggtgtcggcggacagcagttcctccacatcatccatcctgtacccccatcaagccctatgaacttgcagtctaacaaactttcacatgtgcaccggatccccgtggttgttcagagtgttcctgttgtttacaccgcggtacggtcccctgggaatgtgaacaatacaattgtggtgcctcttctggaggacggacggggacacggaaaagcacagatggaccccaggggccttagtcctcgccaatctaagagcgattccgatgacgatgacctccccaacgttactttggacagtgtgaatgagactggatcgactgcgctctcgatcgcaagggctgtccaggaagtccatcccagccctgtaagcagggtcagaggtaaccgcatgaataaccagaaatttccctgttctatttccccattcagcatcgagtcgacaaggagacagcgcagatccgaatcccccgatagccgcaagcggcgcatccatcgctgcgacttcgaaggttgcaacaaagtgtataccaaatctagccacctcaaagcacaccgtcgaacccataccggagagaagccttataagtgtacttgggaaggctgtacttggaaattcgcccgcagcgatgagctgactcgacattatcgtaaacacaccggagtgaagccatttaagtgtgccgactgcgaccggagcttttctaggtccgaccacctggctctccaccggcgaaggcacatgctcgtttag

SEQ ID NO: 192561 - DNA, 1209 bp, Artificial Sequence
  Description of Artificial Sequence: Synthetic coding sequence
atgaacatccacatgaagcggaagaccatcaagaacatcaacacctttgagaacaggatgctgatgctggatggaatgcctgcggtgcgagtgaagaccgaactgctggaatccgaacaaggttccccgaacgtccataattaccccgatatggaagccgttccactgcttctgaacaacgttaaaggagagcccccggaagatagcctaagcgtggaccatttccagacacaaacggagcccgtcgatctgtcaatcaataaggcccggaccagcccaactgccgttagttcctcacctgttagtatgaccgcctctgccagctccccaagttccaccagtaccagttccagttcatcctccagattggcaagttccccgaccgttattaccagcgtctccagcgcaagctctagcagtaccgtgctaactcctggtcctctcgtggcctcagcttctggcgtgggaggtcagcagttccttcatataattcacccagttccccccagctcccccatgaatctgcagagcaataagctgtcacacgtgcaccgtattcccgttgtggtccaaagcgtccctgtggtatatacagcagtgaggagtcccggtaacgtcaataacacgatcgttgtgccactgctggaagacgggagaggccatgggaaagcccagatggaccccagggggttatcaccacgacagtccaagtcagatagtgacgatgacgacttgcctaacgtgaccttggatagcgtgaatgaaacaggctcgacggctttgagcatagctcgagccgttcaagaagtccaccccagtccagtctcgcgtgtccgtggaaaccggatgaataatcagaagttcccttgctccatatccccgttctcaattgaaagtacacgcaggcagcggaggtctgaatctccagattcccggaaaagacgcatccatcggtgtgactttgaaggttgcaataaggtctacacgaaatcgtcccacttaaaagcccaccgtcggactcataccggggagaagccctataaatgtacttgggaaggctgcacgtggaagtttgcccggtccgacgagctaaccaggcactaccgtaagcataccggagtgaaacccttcaagtgcgctgactgtgatcggtctttctccaggagtgaccatctggcactccatcggagaaggcacatgctcgtgtag

SEQ ID NO: 192562 - DNA, 867 bp, Artificial Sequence
  Description of Artificial Sequence: Synthetic coding sequence
atggccgccgccgcctacgtggaccacttcgccgccgagtgcctggtcagcatgtcctccagagcagtggtacacgggccaagggaagggcccgaaagccggcccgaaggcgccgcagtggcagccacgcctacgctcccgagggtcgaagagagacgggacggtaaggacagcgcgagcctctttgtggtcgctcgaatactcgctgatcttaaccaacaagcaccagcccctgctcccgcagagcgacgcgagggcgccgccgctaggaaggcccgcactccctgtagacttcctccccctgctcctgagccaacctccccaggtgctgaaggcgcagcagctgcaccgccttctcccgcctggtcagaacctgagcccgaagccggcctggagcccgaaagggagccgggccctgcgggatccggcgaaccgggactcaggcagagagtgcggcgcggcaggagcagggccgacctcgaaagcccccagcggaaacataagtgtcactatgcagggtgtgagaaagtgtatgggaaatcgtctcacttgaaagctcatctgaggacccacaccggggaaaggccgtttgcctgctcctggcaggactgcaataaaaaattcgcgcggtctgatgagctagctcgccactatcggacccacacaggggagaagaagttcagctgccctatctgtgagaagcgcttcatgcgctccgatcacttgaccaaacatgcacggcggcatgcgaatttccacccaggcatgcttcaaaggcggggcgggggttcgcgcaccggctctctgtcagattacagcagatcagacgctagtagcccaactatcagccccgccagcagcccttag

SEQ ID NO: 192563 - DNA, 1251 bp, Artificial Sequence
  Description of Artificial Sequence: Synthetic coding sequence
atggtggaccacctgctgcccgtggacgagaacttcagcagccccaaatgtcctgtaggttatcttggagatcggcttgttggacggagagcctaccatatgctgccatccccagtaagcgaagacgacagtgatgcatcctccccctgttcttgctcttctcctgattcacaggcattgtgttcctgctacgggggaggtctgggtactgaatcacaggattcaatcttggattttctgctgtcacaggccacactcggaagcggaggggggtctggctctagtatcggggcttcttccggccccgttgcgtggggcccatggcggcgcgctgcggccccggtgaagggagagcacttttgtctcccagagttcccactcggagaccccgacgacgttccacgcccattccaacctacgctggaggagatcgaagaatttctggaagaaaatatggaacctggcgtgaaggaggtgcctgaaggaaactccaaggatctggacgcttgctcccagctgtctgcaggaccccacaagtctcacctgcatcctggctcctcgggccgggagcgctgctctccacccccagggggcgccagcgctggcggtgcccagggccccggaggtggcccaactccagatggccccatccctgtcctccttcaaattcagcccgtcccagtaaaacaagagtcaggcactggcccagctagccccgggcaagcaccagagaatgtgaaggtcgctcagttgctcgtcaatattcagggccagaccttcgccttggtgcctcaggtggtcccctcttccaacctcaacctgccttcaaaatttgtcagaatcgctcccgtgccaattgccgccaagccagtggggtcggggcctctgggtccaggccctgctggcctattgatgggccaaaagtttcctaagaatcctgccgccgagctgatcaagatgcataaatgtactttcccaggatgcagcaaaatgtataccaagagttcccacttgaaagcgcatctgcgacgacacacaggcgagaagccctttgcctgtacctggccaggctgcggttggcgattctccagatctgacgaactgtctcgccacaggcggtcccactccggcgtaaagccctaccagtgtcctgtctgcgagaagaaattcgctcgatccgatcatctgtcgaagcacatcaaggtgcatcggtttccacggagctctaggagtgtgagaagcgttaactag

SEQ ID NO: 192564 - DNA, 1068 bp, Artificial Sequence
  Description of Artificial Sequence: Synthetic coding sequence
atggccctgagcgagcccatcctgcccagcttcagcaccttcgcctctccgtgcagggagagagggctgcaggagaggtggccacgagcagaacctgaatccggaggcaccgatgatgaccttaactctgtactggatttcatactgtccatgggattagacgggcttggcgcggaggccgcccctgagccacctccccccccaccaccccctgccttttactacccagaacccggggctccacctccgtactcagccccagctggcggcctggtgagtgagcttctaagacccgagctggacgccccccttggtcccgcactccatggaagattcttgctggccccccccggacgccttgtcaaagccgagccccccgaggcagatggtggggggggctatggctgcgcccccggcctgactcgcggtccgcgggggctgaagagggaaggagcccctgggcccgcggccagctgcatgcgcggtcccggaggtaggccaccacctcctcccgacacgcctccactttccccagacggtcccgccaggctgccagctccaggaccgcgggctagtttccctccccctttcggcggaccgggattcggcgcacctggtcctggacttcattacgctcctcccgccccccccgcttttgggctgtttgatgatgccgcggctgcagcagccgccctgggactggctccaccagctgccagaggccttcttaccccacctgcctctccactggagctgctggaggccaagcctaaacggggacggcggtcctggccccggaagcgaacagcaacccatacatgcagctacgccggatgtggaaagacctacacaaagagcagccatctcaaggcacatctgcggacacatacaggagagaagccttatcactgtaactgggacgggtgcggttggaagttcgcccgcagcgacgagttaacacggcactataggaaacataccggccaccgccccttccagtgtcatctttgtgatcgggcattctcgagatccgatcatctcgcgctgcacatgaagcgccatatgtag

SEQ ID NO: 192565 - DNA, 234 bp, Artificial Sequence
  Description of Artificial Sequence: Synthetic coding sequence
atggacgtgctgcccatgtgcagcatcttccaggagctgcagatcgtccacgaaaccggctacttcagcgcactgccgagcctagaagaatactggcagcagacctgcctcgagcttgagagatatttacagtctgaaccttgttacgtctccgcctctgagatcaaatttgatagccaagagtccgtcgaccaaaaccactggttaggaagaaaacgccgcaatcctaactag

SEQ ID NO: 192566 - DNA, 846 bp, Artificial Sequence
  Description of Artificial Sequence: Synthetic coding sequence
atggacgtgctgcccatgtgcagcatcttccaggagctgcagatcgtacacgagacaggatacttctccgccttaccctccttagaggaatactggcagcagacctgcttggaactcgaaaggtacttacagtccgaaccctgttacgttagcgcgtccgagataaagtttgatagccaagaggatctctggacaaagatcattctggcgcgtgagaaaaaggaggaatctgagctgaagattagctctagtcctccggaagatacgctgatctctccctcattttgctacaatctagaaaccaattcactgaattcagacgtatcttccgaatccagcgactcctccgaagaattatcaccaacagccaaatttacttctgatcctatcggtgaagttttggtgagcagtgggaagctgagctccagcgtcacctccaccccaccaagcagccctgagctatctagagagccgtctcagctctgggggtgcgtgccaggagaactacctagtcctgggaaagtgcgaagcggtacttcaggaaagcctggagacaaaggaaacggtgatgcatcgcccgacgggcgccgccgggtgcatagatgtcactttaatgggtgtaggaaagtgtatacaaaaagttcccacctgaaggcacaccagaggactcatactggacagtgcccgcgcgggccccgcagagccgcagccggcggaaggcattgcatagctcccgctttagagggcgcagggccgggatgcactggctgcggtcagggccgacagattctgacatcatccgatgtctttcaccagtcgatccgctctttctggagcagcgagtag

SEQ ID NO: 192567 - DNA, 852 bp, Artificial Sequence
  Description of Artificial Sequence: Synthetic coding sequence
atggacgtgctgcccatgtgcagcatcttccaggagctgcagatcgtccacgaaacaggctattttagtgctttgccctctctggaagagtattggcagcaaacctgtctggagctggagcgttacctgcagtcagagccatgttacgtttcagcctcagaaataaagtttgattcacaagaggacctgtggaccaagattattcttgccagagaaaagaaagaggagtcagagctgaaaatctcatcttccccccctgaggataccttgatcagtccatcgttttgttataacctggaaactaatagcctgaatagcgatgtatcttccgagagctctgattcaagcgaggagctcagtcccactgccaaattcacctctgaccctattggagaggtgctcgtgtcatccgggaaactctcatccagtgtgacctctacccccccttcgagccctgaactgtctagagagcccagccagctctggggatgtgtgcctggagagttaccatctccaggcaaggtaagatccggcacctctggaaagccaggggataaagggaacggcgatgcttcacccgatggccggagaagagtccatcgctgtcattttaatggatgcaggaaagtttacaccaaatcctcgcatctgaaagcacatcagcgcactcataccggagagaaaccttatcgctgttcttgggagggctgcgaatggcgtttcgcccggtcagacgagcttacgagacacttccgtaagcataccggcgcgaaacctttcaagtgctcacactgcgaccgctgtttctcccgttcagaccacctcgccttgcatatgaagaggcacctgtag

SEQ ID NO: 192568 - DNA, 714 bp, Artificial Sequence
  Description of Artificial Sequence: Synthetic coding sequence
atggacgtgctgcccatgtgcagcatcttccaggagctgcagatcgtccacgagacaggatacttttccgcccttcccagccttgaggaatattggcaacagacatgcttggagctcgagaggtatctgcaatcagagccctgctatgtcagcgcatctgagatcaaattcgactcacaagaggatctgtggaccaagatcatattggctagggagaagaaggaggagtctgaactgaaaatcagctcttccccacctgaggataccctgattagcccatccttttgctataacctggagacgaacagtttgaatagtgacgtctcatccgaatcctcagactcctctgaagaactctccccaacagccaagttcacgagcgatcccataggagaggtcctggtctccagcggcaagttatccagcagtgtgacctccacaccaccatccagtcccgagttatctcgcgagccatcccaactttggggatgcgtgcccggggaattacccagtcctgggaaggtccggtccgggacgtcaggaaaaccaggcgataaaggaaacggggacgccagcccagatgggcgcagaagggtccatcgctgccattttaatggttgcaggaaagtctacacaaaatccagccacctgaaggcccatcagagaacacacacaggggtgttccccggtctgaccacatggccctgtacttag

SEQ ID NO: 192569 - DNA, 909 bp, Artificial Sequence
  Description of Artificial Sequence: Synthetic coding sequence
atggacgtgctggccagctacagcatcttccaggagctgcagctggttcacgacaccgggtatttctccgcattgccttccctggaagaaacatggcagcagacatgcctcgagctggaacgctacctgcagaccgagccccgtcggatatctgagacattcggggaggacttagattgcttcctacatgcctccccccccccctgcatcgaagaatcgtttcgccgacttgatccactgctcttacctgtcgaggctgcgatctgcgagaagtcaagcgccgtcgacatcctgctctcccgagataaacttctttcggaaacctgtttatctctgcagccggccagctcctctctcgacagctatacagccgtaaatcaggcacagctgaacgccgtcaccagtctcacacctcccagctcgcctgagctgagtcggcacctggtcaaaacatcgcagactctctccgccgtagatggcactgtgaccctgaaactggttgcgaagaaagctgctcttagttccgtgaaagtcgggggagtggcaacagctgcggcagctgtgaccgctgcgggagcggttaagtcagggcaaagcgattctgatcagggaggactcggggcggaagcttgccccgagaacaaaaagagggttcaccgatgccagtttaacggatgtcgaaaggtatatactaagtccagccacctgaaagcacaccagcggacccacaccggggagaaaccatacaagtgttcttgggagggatgtgaatggagatttgccaggagtgacgagctgacgaggcattaccgtaaacatacaggggctaaaccgttcaagtgcaaccactgtgaccggtgcttctctcgtagcgaccacctggctcttcacatgaagcgccacatttag

SEQ ID NO: 192570 - DNA, 825 bp, Artificial Sequence
  Description of Artificial Sequence: Synthetic coding sequence
atgttccccagctggcccacctgcctggagctggagcggtacctgcagacagaacccaggagaatctcagaaacatttggtgaggatttggattgttttctccacgccagtccccccccctgtattgaagaatcctttcgcagacttgaccccttgctgctacctgtggaagccgccatatgtgagaagtcatccgctgtcgacattcttctgtcaagggacaagctgttgtcagagacgtgtctgagcctgcagccggcctctagctcactggacagctacactgcggtgaaccaggcccagctgaatgccgtgacaagcttgacccctccgtcgtctcctgagctctcccgccacctagtaaagacgtcccagactctgtctgctgtcgacggtacggtgacattgaaacttgtggcaaagaaagctgcattgtccagtgttaaagtaggtggcgtggctactgccgccgccgcagttaccgctgcaggcgcggtcaaatccggtcagtcagatagtgaccagggcggtcttggcgcagaggcctgccccgaaaacaagaagcgggttcatagatgtcagtttaacggctgccgaaaggtgtacaccaagagtagtcatttgaaggcccatcagcgtacccataccggcgaaaaaccttacaagtgttcgtgggaggggtgtgaatggcggttcgctaggtctgacgaacttacccggcactacaggaagcacacgggtgctaaaccttttaaatgtaatcattgcgacaggtgcttttccagaagcgatcacctggcactacatatgaagaggcacatctag

SEQ ID NO: 192571 - DNA, 810 bp, Artificial Sequence
  Description of Artificial Sequence: Synthetic coding sequence
atgacctgcctggagctggagcggtacctgcagaccgagccccggcgaattagcgagacgtttggagaagatttggactgcttcttacatgcatcaccaccaccttgcattgaggagtcatttcggcggctggacccgctgctcctgccggtggaagctgctatatgtgaaaaatcaagtgccgtggacattcttctctcccgcgataagttgctgtccgagacatgtctatccctccagccagcatcttctagcctggactcctacactgcagtcaaccaggctcagctcaacgccgtgacctccttgactcccccctcctcccctgagctttcccggcatttggtcaagacaagtcagacattaagcgcagtcgacggcacagtcaccctgaaacttgtggccaagaaagcagccctgtcgtccgtcaaggttgggggcgtcgccaccgccgcagcggctgtcacagccgcgggagccgtaaaatctgggcagagcgactcagatcagggcggcctcggcgcggaagcttgcccagaaaataagaaacgcgtgcatcgctgccagtttaacggatgccgcaaagtgtacactaagtctagtcatctgaaggctcatcagaggactcacaccggggagaaaccctacaagtgctcctgggaaggatgtgaatggagattcgctcgctccgacgagcttacaagacattaccgtaaacacacaggtgcaaagccctttaaatgtaatcactgcgaccggtgtttttctcgatctgatcacctggcattacacatgaagagacacatatag

SEQ ID NO: 192572 - DNA, 339 bp, Artificial Sequence
  Description of Artificial Sequence: Synthetic coding sequence
atggacgtgctggccagctacagcatcttccaggagctgcagctggttcacgacaccggttattttagcgccctgccgagtctggaggagacctggcagcagacgtgtttagaactcgagagatacttgcaaactgagccgcggcgcatcagtgagacttttggcgaagatctagactgtttcttgcacgcctcccccccgccttgcattgaggaatccttcagaaggctagatccgctgttgctgccagtggaggccgctatctgcgaaaagtccagtgcggtcgacattttactgtccagagacaaacttctatcggagacttgcctgagtttgtag

SEQ ID NO: 192573 - DNA, 183 bp, Artificial Sequence
  Description of Artificial Sequence: Synthetic coding sequence
atggacgtgctggccagctacagcatcttccaggagctgcagctggtgcatgatacaggttatttctctgctctcccatctttggaagaaacttggcaacagacctgtctcgaactggagaggtatctgcagacagagccacgccgaatcagcgaaaccttcggggaagacttggactgctag

SEQ ID NO: 192574 - DNA, 339 bp, Artificial Sequence
  Description of Artificial Sequence: Synthetic coding sequence
atggacgtgctggccagctacagcatcttccaggagctgcagctggttcatgacacagggtatttcagcgcactgccgagcctggaagaaacctggcagcagacatgtctcgagctggagagatacttgcagaccgaaccacggcggataagcgagaccttcggtgagaaaccttacaagtgcagttgggaagggtgtgaatggcggtttgctagatccgatgagctcactagacactaccggaagcacaccggcgcaaagcccttcaaatgcaatcattgtgataggtgcttttctaggtccgaccatctggccctgcatatgaagcgccatatttag

SEQ ID NO: 192575 - DNA, 774 bp, Artificial Sequence
  Description of Artificial Sequence: Synthetic coding sequence
atggtggacatggacaagctgatcaacaacctggaggtgcagctgaactccgaaggtggctcaatgcaggtctttaagcaagtgaccgccagtgtgagaaatagggatccgcccgagatcgagtaccgctctaacatgacatctccaacactgcttgacgcaaaccctatggagaatccggctctgtttaacgacatcaagatcgagcctcctgaagagctcctcgcttcagatttcagcctcccgcaggtggagcccgtcgacctgtcttttcacaaacccaaagcccccttacagccggcttcaatgttacaggcgcccatccgaccccccaaaccacaatcctccccccaaactctcgtggtctccacatctacgagtgacatgagcacaagcgccaacattcctactgtcctgacaccagggagcgtgctgaccagctctcagtcaactggctctcagcaaatcctgcatgtaatccacactataccatctgtgtctttgcccaataagatgggcggtttaaagactatacccgtcgttgtccaatcactccctatggtctacactactctccccgctgatgggggccccgctgccatcaccgtgccactcataggaggcgatggcaagaacgcaggcagcgtcaaggtagaccccacgagcatgagccccctcgagattccttccgattcggaggagtcgactatcgagtcgggcagcagtgctctccagtccttacagggtttgcaacaggagagagaagctctgtag

SEQ ID NO: 192576 - DNA, 1080 bp, Artificial Sequence
  Description of Artificial Sequence: Synthetic coding sequence
atggtggacatggacaagctgatcaacaacctggaggtgcagctgaactcggaggggggttcgatgcaggtatttaagcaagtgacagcgtccgtgagaaatcgcgatcccccagagatcgaataccgatccaacatgacatcacctacattactggacgctaatccgatggagaatccggctttgtttaacgacatcaaaatcgaaccaccggaagaactccttgcgtcagacttctcgctgccccaagtggagccggttgatttgtcgttccacaagcctaaggctcctctccagcctgcctcaatgcttcaggcaccaattaggccgcccaaaccccaatcaagcccccaaactctggtggtgtcaacaagcacaagcgacatgtccacttccgctaacatccccaccgtactcacacctggttctgtcctgacttcctcacaatcaacgggttcccaacagattctgcatgtgatccacactatcccttcagttagcctcccaaacaaaatgggcggcctgaaaacgatcccggttgtggtgcagtctttaccaatggtgtatacaaccctgcctgcagacggagggcctgcagccataaccgtgcctctcatcgggggcgacgggaagaacgctggatccgtgaaggtagacccgactagcatgagtcctctagagatcccatccgactccgaggagagcacgatagaatccggcagctccgccctgcagagtttacagggtctgcagcaggagcctgctgccatggcccagatgcagggtgaggagtcacttgacctgaagagacggagaattcatcagtgcgacttcgcaggttgcagcaaggtttacacgaaaagtagtcatttaaaggcccatcgaaggatccacacaggagagaaaccctataaatgtacctgggatggctgctcctggaagtttgccagaagcgatgaactgaccagacacttccgcaagcatactggaataaagcctttcaggtgtaccgattgtaacaggtctttctctagaagtgaccacctgagccttcacagacgacggcatgatacgatgtag

SEQ ID NO: 192577 - DNA, 771 bp, Artificial Sequence
  Description of Artificial Sequence: Synthetic coding sequence
atgcagcccgccaaggaggtgaccaaggccagcgacggcagcctgcttggcgatctcggccatactcccctaagcaaaaaggaaggtattaaatggcagcggccaaggctctcacgccaagcactgatgcgctgctgcctcgtgaaatggatcttgtcatccaccgctccacaaggcagtgattctagcgacagcgagctggaattgtcaacagtgcggcaccagccggagggcctggatcagctgcaggcccaaacaaaatttacgaagaaggagctccagtccctctacagagggtttaagaacgagtgtcctaccgggcttgtcgacgaggataccttcaaacttatatatgctcaattcttcccacagggcgatgccacaacatatgcacactttctgttcaacgcctttgatgccgatgggaacggtgccatccactttgaagacttcgtagttggcctctcaatactgctacgcggaacggtgcatgaaaaactgaagtgggccttcaacctctacgacatcaacaaagatgggtacatcacaaaggaggagatgctcgcgatcatgaagtcgatatatgacatgatgggccggcacacttaccctatcctgagagaagatgccccggctgaacacgtggaaaggttttttgagaagatggaccggaatcaggacggggtcgtgaccattgaggagttcctggaggcttgccaaaaggacgagaatatcatgtcatctatgcagttgtttgagaacgtcatctag

SEQ ID NO: 192578 - DNA, 705 bp, Artificial Sequence
  Description of Artificial Sequence: Synthetic coding sequence
atgcagccccggaaggaggtgaccaaggccagcgacggcagcctgctgggggacctgggccacactccgctctcaaagaaagagggcatcaagtggcagcggccaaggctgagtcgccaagcccttatgcggtgttgtctagtgaagtggatactgtcatccaccgcaccacaggggtccgatagtagtgatagcgagctggagttgagcacagtgcgacatcagcctgaaggcctggaccaactccaggctcagaccaagtttacgaagaaagaacttcagtccctgtacagaggatttaagaatggcgatgctaccacttacgctcactttcttttcaatgcattcgatgctgacgggaatggcgcgatacacttcgaggactttgtggtgggcttgagcattctcctgaggggcactgtacatgagaagctgaaatgggccttcaacctctacgacatcaataaggacgggtacataaccaaggaggaaatgctggccatcatgaagtctatctacgatatgatggggaggcacacctatcccatcctccgcgaggacgcgccggccgagcatgttgagcgcttctttgaaaaaatggaccggaatcaggacggcgtagtgaccattgaggaattcctggaggcctgccagaaggatgaaaacatcatgagcagcatgcagctcttcgaaaacgtgatttag

SEQ ID NO: 192579 - DNA, 693 bp, Artificial Sequence
  Description of Artificial Sequence: Synthetic coding sequence
atgggcatccagggcatggagctgtgcgccatggccgtggtggtgctactgttcatagccgttttgaaacagttcggaatcttggaaccgatctcaatggaggatagcagcgatagcgagttggaactgagcactgttcggcaccagcccgagggactcgaccaactccaggcccagacaaagttcaccaagaaagaactgcaaagcctgtacaggggctttaagaacgagtgccctacaggcctcgtagacgaggatactttcaaactgatatacgctcaattcttcccacagggcgacgcgacaacttacgctcattttctattcaatgcttttgacgctgacgggaacggggcaatccatttcgaagatttcgtggtgggcctttcgatcctgctgcggggaactgttcacgaaaagctaaaatgggcttttaacctctatgacattaacaaggacggctacataactaaagaggaaatgcttgcgatcatgaaatccatatatgacatgatgggaaggcacacttaccccatcctccgtgaagatgcacctgccgagcacgtcgaacggttttttgagaaaatggatagaaaccaagacggagtggtaacgattgaagagttcctcgaggcttgccaaaaggacgagaacatcatgagcagtatgcaactcttcgaaaacgtgatttag

SEQ ID NO: 192580 - DNA, 567 bp, Artificial Sequence
  Description of Artificial Sequence: Synthetic coding sequence
atggccaccgtgcggcaccggcccgaggccctggagctgctggaggctcaaagtaagtttactaagaaggagctgcaaattttgtacagaggcttcaagaatgagtgcccatcgggagtcgtaaatgaagaaacgttcaaggagatttattcccagtttttccctcagggggattctacaacctatgcccattttttgttcaatgctttcgacacagatcacaacggtgccgtttcttttgaagatttcatcaagggtctcagtatccttctgcgggggacggtccaagaaaagctgaattgggctttcaacctgtacgacatcaataaggatgggtacatcacaaaagaggaaatgctagatattatgaaggcaatctacgatatgatgggaaaatgcacgtacccagttttaaaggaagatgcccccagacagcatgtcgagactttcttccagaaaatggataagaataaggacggtgtcgtcactatcgacgagtttatcgagtcctgccagaaagatgagaatataatgcgttctatgcagctgttcgaaaatgtgatatag

SEQ ID NO: 192581 - DNA, 678 bp, Artificial Sequence
  Description of Artificial Sequence: Synthetic coding sequence
atgagcggctgccggaagcggtgcaagcgggagatcctgaagttcgcccagtatctgttgcggctgctgactggttctctgcatacagactcagtggaggatgaactcgagatggcaactgtacgccaccggcctgaagccctggagctgcttgaagcccagtccaaattcaccaaaaaagagctacaaattttgtacagggggtttaagaatgagtgtccttcaggcgttgtgaacgaagaaacatttaaggagatctatagtcagttctttccacagggggactcaaccacctacgcccattttctgtttaatgctttcgacacagatcataacggggccgtctcattcgaagatttcatcaagggcttatcgattttactgcggggcaccgtgcaagaaaaactcaattgggcttttaatctgtacgacatcaacaaggatggttatattaccaaggaggagatgttggatatcatgaaggcaatctacgatatgatgggcaaatgtacctaccccgttctcaaggaggatgcgcctagacagcatgtggagaccttcttccagaaaatggataaaaataaggatggagtggtgacaatcgatgaatttatcgagtcctgccagaaggacgagaatatcatgcggtctatgcagctctttgagaatgtcatttag

SEQ ID NO: 192582 - DNA, 690 bp, Artificial Sequence
  Description of Artificial Sequence: Synthetic coding sequence
atgaacctggagggcctggagatgatcgccgtgctgatcgtgatcgtgctgttcgttaagcttctggagcaatttggactgatcgaagccgggctggaagatagcgtggaggacgaactggaaatggccactgtcagacatcgccccgaagctcttgagctcttagaagcacagtctaaatttaccaagaaggagctccagattctctacagagggttcaaaaacgaatgccccagtggggtggtgaacgaagaaacgtttaaagagatctatagccagttttttccacaaggggactccacgacctacgcccactttctgttcaatgcctttgataccgaccataacggggcagtttcattcgaagatttcataaagggcctcagtatcttacttagaggtacggtccaggagaagttgaactgggcctttaacctgtatgacattaacaaggatggatacatcaccaaagaggaaatgctggatattatgaaggccatctacgatatgatggggaagtgcacctatcccgtgctgaaagaagatgcacctcgccagcatgtggagacattcttccagaagatggacaagaataaggacggcgtggtcactatcgacgagtttattgagagctgtcagaaggatgaaaacataatgcgaagtatgcagttgttcgagaatgttatatag

SEQ ID NO: 192583 - DNA, 753 bp, Artificial Sequence
  Description of Artificial Sequence: Synthetic coding sequence
atgaacgtgcggcgggtggagagcatcagcgcccagctggaggaggcgtcttcgactggggggttcctgtatgcacagaactcaaccaagagaagcatcaaggaaagactgatgaaactgctgccatgcagtgccgccaaaaccagttcccccgccatccagaatagtgtggaggacgaactggaaatggcgaccgtgcgacaccggccggaagctctggagttactggaagcgcagagcaaatttactaagaaggagcttcagatcctttaccgcgggttcaagaacgaatgtccttccggagtagttaatgaagaaacttttaaggagatctactcacaattcttcccacagggcgatagcactacttatgcacattttctctttaatgcctttgacactgaccataatggggccgtgtcctttgaggattttataaagggcctatccattctgcttcgaggcaccgtgcaggagaagttgaattgggcctttaatctgtacgacattaataaagacggatacataaccaaggaggagatgctggacatcatgaaggccatctatgacatgatggggaaatgcacctatccagttctgaaggaagacgcgccccggcagcatgtggagaccttttttcagaagatggacaaaaacaaggacggggttgtcaccatcgacgagtttattgaaagctgccaaaaggatgagaacattatgaggtccatgcaactttttgagaacgtcatttag

SEQ ID NO: 192584 - DNA, 567 bp, Artificial Sequence
  Description of Artificial Sequence: Synthetic coding sequence
atggccaccgtgcggcaccggcccgaggccctggagctgctggaggcccagtctaaattcacgaaaaaggagcttcagattctgtacaggggatttaagaacgaatgcccaagtggcgtcgttaacgaggaaaccttcaaggaaatctactctcagtttttccctcagggggattccactacatacgctcacttcctcttcaatgcctttgacacggatcacaacggtgcagttagctttgaggactttattaagggcctatctatcctgttgcgcggtaccgttcaggaaaaattgaattgggcattcaacctctatgacatcaataaggacggttatatcaccaaggaggaaatgttagacattatgaaggctatctacgacatgatgggaaagtgtacatacccagtgctaaaggaggacgcccctcgccagcatgtagagaccttctttcagaagatggataagaataaagacggggtggtgacaatagacgaatttatcgagagttgccaaaaggatgagaacatcatgcggagcatgcaacttttcgaaaatgtaatctag

SEQ ID NO: 192585 - DNA, 651 bp, Artificial Sequence
  Description of Artificial Sequence: Synthetic coding sequence
atgaacgtgcggcgggtggagagcatcagcgcccagctggaggaggccagcagcaccggagacagcgtagaagacgaattggaaatggcaaccgttagacataggcccgaagctctcgaactgctggaggcacagtcaaagttcaccaagaaggaacttcagatcttgtacaggggcttcaagaatgagtgcccgtctggcgtggtgaacgaggagacatttaaagagatttatagtcagttttttcctcagggcgactcgactacctatgcgcacttcctgttcaatgcatttgataccgatcacaacggagccgtgtcttttgaagatttcattaagggcctgtcaattctcttgcgtggcactgtgcaggagaagctcaactgggctttcaacctctacgatattaacaaggatggatacataacaaaggaggagatgctcgacattatgaaagccatctatgatatgatgggcaaatgtacatacccagtgcttaaggaggatgcccctcgccaacatgtagagacattttttcagaagatggacaagaacaaggacggagtcgtgaccatcgacgagtttattgaatcatgtcagaaagacgaaaacattatgagatccatgcagttattcgagaacgtgatttag

SEQ ID NO: 192586 - DNA, 567 bp, Artificial Sequence
  Description of Artificial Sequence: Synthetic coding sequence
atggccaccgtgcggcaccggcccgaggccctggagctgctggaggcccagagtaaattcactaaaaaagaactgcagattctctatagagggttcaagaacgagtgcccctccggggtcgtgaatgaggagacctttaaagaaatttattctcagtttttccctcagggggattcgacaacctatgcccacttccttttcaatgccttcgatacagaccataatggagccgtgagctttgaggatttcatcaagggcctttctattctcctgaggggcaccgtgcaagagaaactcaattgggcctttaacctgtacgatataaataaagatgggtatatcactaaggaagagatgctagacataatgaaggccatttatgatatgatggggaagtgcacctacccggtgttaaaagaggacgcgccccggcaacatgtagagactttttttcagaaaatggacaagaataaggatggtgtagtgaccatcgacgaattcatcgaaagttgtcaaaaagatgagaatattatgcgttccatgcagttgttcgagaacgttatctag

SEQ ID NO: 192587 - DNA, 549 bp, Artificial Sequence
  Description of Artificial Sequence: Synthetic coding sequence
tgaggcatgaacgccggcttcgaggactgcctggtgttcgacgagctgatggataaattcagcaacgatctgagtctgtgcctgccagtatttagccgcctgcgcatacccgacgatcacgccatctccgatctgagcatgtataactacattgagatgagagcccacgttaatagtagctggtttattttccaaaaaaacatggagcgcttcttgcacgcaatcatgccatccaccttcatacctctgtacactatggtcacattctcgcggatccgttaccacgaggctgtgcaacggtggcactggcagaagaaggtgattaacaaggggttgttctttctgggctctctcatcgccatttcaagtacctatctcttaatccactacatgagccctaggagcttcctccggctgcgccggccctggaattggatcgctcactttaggaacaccacttgctttcctgctaaggctgtagactctctagaacagatctctaatctcatcagcagattgctaagccactccgaaatcctgcagacatag

SEQ ID NO: 192588 - DNA, 1359 bp, Artificial Sequence
  Description of Artificial Sequence: Synthetic coding sequence
atggacagcagcgtgatccagcggaagaaggtggccgtgatcggcggtggactggtcggttcactgcaggcttgtttccttgctaaaaggaacttccagattgacgtgtatgaggcaagggaggacactcgggtcgccacattcacccggggtcgaagcattaacctggcactcagtcatcgcgggaggcaggcacttaaagccgtaggcttggaggatcagatcgtttcacagggcattccaatgagagcacgtatgatccacagcctgagtggcaaaaagagtgccatcccctatggcaccaaaagccagtatatactctctgtttccagggaaaatctgaacaaagacttgcttacagctgcagagaaatatcccaatgttaagatgcattttaaccacagactgctgaagtgtaatccagaagagggtatgattaccgtactgggcagtgacaaggtgcctaaagacgtaacttgcgacctaattgttggctgcgatggagcttactccacagttaggagccacctcatgaagaagcctcgattcgattacagccagcagtatattcctcatggctacatggaactgacaatcccccccaagaacggagactacgcaatggagcctaactacctgcacatctggccaaggaatacgttcatgatgattgctttgccaaacatgaacaagagtttcacatgcacgttgtttatgccattcgaggagtttgaaaaacttttaacctctaatgacgtggttgatttttttcagaaatacttcccagacgctattccactaataggggaaaagctgctcgtccaggatttctttcttctgcccgctcagcctatgatttcagtgaaatgcagctcgtttcatttcaaatcccactgtgtgctccttggagatgctgcccatgccatcgtgcctttttttgggcaggggatgaatgcgggttttgaagattgcttggtgtttgacgaattgatggataagttcagcaacgacctaagcttgtgtcttccggtgttctctaggctccgcatcccagacgaccacgcaatatcagatctctcaatgtacaactacatcgaggttacattctcccgaattcgctaccacgaagcagtgcaacggtggcattggcagaagaaggtaattaataagggtctcttctttctgggatctcttattgcgatcagctccacttacctactgatacattatatgtcaccccgctcttttctgaggttacggcgtccctggaattggatcgcacattttaggaataccacttgttttccggcaaaagctgtggacagcttggagcagatttccaacctgataagcagatag

SEQ ID NO: 192589 - DNA, 1422 bp, Artificial Sequence
  Description of Artificial Sequence: Synthetic coding sequence
atggacagcagcgtgatccagcggaagaaggtggccgtgatcggcggcggtttagtgggctccttacaggcatgctttctagccaagaggaacttccagattgacgtgtacgaggcccgagaagacacaagggtcgccacctttacaaggggccgatccattaatctcgcactgagtcatcgcgggcgtcaagctctgaaggccgtgggccttgaagatcagattgtgtcccagggcatccccatgcgggcccggatgatccactccctgagcggaaagaagtcggcgatcccgtatggaacaaagagtcagtacatactgtctgtgtctcgcgagaacctgaacaaagacttactgaccgccgcagagaagtatccgaatgtgaaaatgcactttaatcatcgcttgttgaaatgtaaccctgaggaaggcatgattacggttctgggctcggacaaggtccctaaggacgtcacttgcgaccttattgtggggtgcgatggcgcctattccacagtcagatcacacctgatgaagaagcctaggtttgactattctcagcagtacattccgcatggctatatggagctgactatacccccaaagaacggcgattatgctatggaaccgaactatctgcacatctggcctcgtaacaccttcatgatgattgcattaccaaatatgaacaagagctttacctgcacacttttcatgccattcgaggagttcgagaaattactcacctccaatgacgtcgtggacttctttcagaagtattttcctgatgctatccctctaatcggggagaaactcctagtgcaggacttttttctgctcccggcccagccaatgatcagtgtaaagtgcagcagctttcacttcaaatctcattgcgttctgctgggcgacgccgcccatgccattgtacccttcttcgggcagggcatgaatgccgggttcgaagattgcctggtatttgacgagctcatggacaagttcagtaatgacctttctctgtgcttgccagttttcagccggttgagaatccctgatgaccatgcaattagcgatctctcgatgtataactacatcgagaaaaatatggaacggttcctccacgctattatgcccagtacttttatccccttatacaccatggtcactttttctagaatcaggtaccacgaggctgttcagagatggcattggcagaagaaggtgattaataagggccttttcttcctaggcagcttaattgcgattagctccacttatctccttattcattacatgtctccaaggtccttcttgagattgcggcgaccttggaattggatagcgcactttaggaataccacctgttttcctgccaaggccgtggacagcctcgagcagatctccaatctcataagcagatag

SEQ ID NO: 192590 - DNA, 1461 bp, Artificial Sequence
  Description of Artificial Sequence: Synthetic coding sequence
atggacagcagcgtgatccagcggaagaaggtggccgtgatcggcggaggactggtcggctctctgcaggcctgtttcctcgccaaacgaaattttcaaattgatgtgtatgaggctcgggaggatacgagggtagctactttcactcgggggcggtcgattaatctggcgttgagccaccggggccgccaggcgctcaaagctgtaggtctagaggatcagatcgtttcacaggggatcccaatgcgggctcgcatgatccattccttgtccgggaagaagtccgctattccctacgggactaagtcccagtacatcctgtccgtgagcagggaaaacctcaataaagatttgctgactgcagcagaaaaataccccaacgtcaagatgcacttcaaccatcggttgttaaagtgtaacccagaagaaggtatgatcacagtcctgggcagtgataaagtcccaaaagacgtgacttgtgatctcattgttggttgcgatggcgcctattccactgtgcggagtcaccttatgaaaaaaccccgctttgactactctcagcagtatattccccatggttatatggaactcaccatcccaccaaaaaacggcgattatgccatggagcccaattatctccatatctggccccgcaacacgtttatgatgattgcactcccgaacatgaacaagtccttcacgtgtactcttttcatgccattcgaagaatttgaaaagcttctcacctccaatgatgttgttgacttctttcaaaaatactttcctgatgcaataccactcatcggtgaaaagctgctggtccaggatttctttctcctgcccgcacagcccatgattagcgtgaagtgcagctcctttcacttcaaatctcattgtgtgctgcttggcgatgccgcacatgccatcgtccccttcttcggccaaggcatgaatgcgggattcgaggattgccttgtgttcgatgagctgatggacaagttttcaaatgatctttcgttatgtctgcccgtgttcagcagactcagaatacccgacgatcacgctatttctgacctcagcatgtataattacatcgaaatgcgggctcatgttaattcaagttggtttatctttcagaagaacatggagagatttctgcatgccattatgccaagtacattcatccccctttacaccatggtgaccttctcaaggataagatatcacgaagcagttcagaggtggcattggcagaagaaagtcatcaacaaggggctgttcttccttggctcactcattgccatcagctccacttatcttctgattcactacatgtccccccggagcttcctgaggctgaggcggccatggaactggatcgcgcacttccgcaataccacatgctttcccgctaaagcggttgattcactagaacagatctctaacctgatcagtaggtag

SEQ ID NO: 192591 - DNA, 1689 bp, Artificial Sequence
  Description of Artificial Sequence: Synthetic coding sequence
atggagctgaagaaggacatcaacgccgtgagcatcgacatgctgctgatcgtccactccgagaaaaggcgagccgcccaggggaccctcagcgatcagcaggcaaatccaagtagcctactgcagaggggtggcggcttccaaggtgtgggtaacggcgtcagacgttggcagaagctggagggaaacgatttccacgaaaacctggttgagaaacaacacccccaacaaccacaagtaattacttcctataatagtcaggggactcagctcactgtggaagtgcacccccgggatgccatgcctcaattattgaagaaatttagtttggccaaacgtctgcaaggagacaagaacggcaatacgcgaccccggcagcccggagggaaggacgcccacgcctatccctgggatcgaagttctttaaaaagcatgagcctcgacctgcagcagttcgaaaagttggatatttatgcatcacaggtcacagccaagtccggactggatgaactcgtctccgatctgctccaggaagcgcacacagatctggagcgagtgcgggccatttggatctggatttgtcatcatatcgagtatgatatcgctgccgcacaggagaaggaccggcaggctttcaagcctactgacattctgagaacacagaagactaactgcgatggctatgctggcctgtttgagcgaatgtgtcgcttggccggggtgcagtgtatgacagtacccggctactccaaaggattcggctaccaaactggacagtctttttcaggcgagttcgatcacgcatggaacgctgtgtacctagagggaagatggcatttggtggatagcacatggggatctggacttgtggatactataacgtccaagttcacatttttgtataatgagttctacttcctcacgcaccctgccctcttcatcgaggaccactttccggataacaagaactggcagctgctaaagcccccccagagcttacgtcagttcgagaataacatgtatcataagtccgagttctataacaaaggaatgctcagtgcccatcccgagaccagcatgatccggacagtaaacggaaaagccactgtcacaatagagtcctgtgctcccaccctgtttatgttcatgctcaacgggaaacaggagcatggactgctatccctccggaaaaatgggatgaagttggaagtgtatccgccaactatgggaacccataaactgcagatcttcgcaaaaggaaattctgacatatactctagtgtgcttgaatacacactcaaatgtaactacgtagacatgggcgtgcagctacccgccgagcttcatcagcctgtgggacctagttggttcagtgagcagatgggaattatgaagccgtctcaccccgatcctatcatccatacatctgatggacggtgtagcatttctttctctgtcgaggagggcataaacgtgctcgcttcacttcacggagacgatggccccatcacggaggagacacagagacgttacatatttcaacttcacagagagaagcagacggaactgaaggtgcaactgccccacgcaggaaagtttgccctcaaggaggtctacgtcatggtgctggaaaatgctaatcacaatttctactcttacatcttaaagtacaaggtcaacgcccaatag

SEQ ID NO: 192592 - DNA, 1986 bp, Artificial Sequence
  Description of Artificial Sequence: Synthetic coding sequence
atggagctgaagaaggacatcaacgccgtgagcatcgacatgctgctgatagtgcactcagaaaaaaggcgggctgcccagggcaccctctccgaccagcaggctaacccctcatctctcctgcagcgtggcgggggttttcagggggtgggaaatggggttcgccgctggcagaaattagaaggcaacgacttccatgagaatctggtggagaagcagcatccccagcagccacaggtgattacaagctacaactcccagggcacccagcttactgtcgaggtgcatccccgagacgctatgcctcagctgctcaaaaagttctcactggccaaacgcttgcaaggtgacaagaacgggaatacccgcccgagacagcctgggggaaaagatgcacatgcctacccgtgggatcgcagctcgctaaagtctatgtctcttgatctgcaacagtttgagaaactggatatctacgcatcccaggtgacggctaagtccggcctcgatgagcttgtgtccgatctcctgcaggaggcccatacggatttggaaagagtgagggccatctggatctggatctgtcatcacattgagtacgatatcgccgcggcccaggaaaaagaccgtcaggctttcaaaccgactgatattctgcggacccaaaagactaattgtgacggctacgccggactctttgaacgaatgtgcaggctggctggcgtgcaatgcatgactgtgccaggctattcgaaggggtttggatatcagaccggccaatctttctccggtgaattcgaccacgcatggaacgccgtatatcttgaaggcagatggcacttggtggattctacatggggatctgggcttgtagacaccatcacttccaaattcacgttcctctataatgagttctactttctcacgcaccccgcgctctttattgaagaccatttcccggataataagaattggcagttgctgaaacctccgcagagtcttagacaattcgagaacaatatgtaccacaaatctgagttctacaataaggggatgctgagtgctcaccctgagacaagtatgatccgtacagtcaatgggaaggccaccgttactatcgaatcgtgtgcgccaaccctctttatgtttatgttgaacggtaagcaggagcacggcctgttgagcctgcgtaaaaacggcatgaaactggaagtgtatcccccaacgatggggactcacaaactgcagatttttgccaagggaaattctgatatctacagtagcgttctggaatacaccctgaaatgtaactacgttgacatgggcgtccagttacctgctgagctgcatcagcccgtgggaccctcatggttttctgaacagatgggaatcatgaaaccctcacaccctgatcccataattcacactagtgatggccgatgctcgatctctttcagcgttgaggagggtataaatgtgctggcttctctgcatggtgatgatggaccaattacagaggagacacagaggcggtatatctttcagttgcacagggaaaaacagactgaactcaaggtgcagcttccccacgcaggcaaatttgccctgaaaattttcgtcaaaaaaaggcaggagcctggcaattacatctttgtttttaactacctggtctgctgcgccaacactaaagtcaactggccaatgttccctgagagcttcgggaactgggggcaagataatgaactccttgaacccctttctggcgtgctaccggccaatagaaacgtacccttcaagctgaaacttcacgggatagctaaggttctcgttaaggggcaggacacctggcctttaaccctcaatcacgaaggatattgggaagggagctgctctactgccggttgtcaagaggtgtatgtcatggtgctggagaacgccaatcacaacttttatagctatattcttaaatataaagtgaacgcccagtag

SEQ ID NO: 192593 - DNA, 1173 bp, Artificial Sequence
  Description of Artificial Sequence: Synthetic coding sequence
atgaagctggaggccgtggaccggatgaaccccagcctggtgtgcgtggcctccgtgacagacgtggtggactcgagattcctagttcatttcgacaactgggatgacacttacgattattggtgtgacccaagcagcccctacattcaccccgtcggttggtgccagaaacaggggaagcccttgacaccccctcaagattatcctgaccccgacaacttttgttgggagaaatacctggaggagacaggtgcctccgcagtaccgacatgggcattcaaggtgcgcccgcctcacagttttctggtaaacatgaaactggaggcagtggaccgccgtaaccctgcccttatcagggttgcctccgtagaggacgttgaagatcaccggatcaaaattcactttgacgggtggtctcacggctacgacttctggatagatgcagatcatcccgacatccaccccgctggctggtgctccaagaccggtcacccgttgcagccaccactgggtccccgcgagccatcctccgcgagtcccggggggtgtcctccattgagttaccggtcactcccccacactcggacaagtaaatactcattccaccacaggaaatgccctaccccggggtgtgacggaagcggtcatgttactggaaaattcaccgcacatcactgcttgtctggctgtcctttggccgaacgtaatcagtcacgactgaaggcagagttgagcgactccgaagcctcagcccgaaagaagaacctgtccggcttctctcctcgcaaaaaacccagacatcacggaaggatcggccggcctccaaaatatcgcaaaattccacaggaggacttccagacactcacccctgatgtggttcaccagagcctctttatgtcagctctgagtgcccatccagaccgcagtctttcagtgtgctgggagcagcattgcaagctgttgcccggcgtcgctggcattagcgcatcaaccgtcgccaagtggacgatagacgaggtgtttggatttgttcagactcttaccggctgcgaagatcaagcaagacttttcaaggatgaggtgcggtgtaagtgccgcgtcggcgaccgggcgggtgtaacagtactcaaaaccgccgggtcccgatgtccacctcagcgccacttttgctag

SEQ ID NO: 192594 - DNA, 2232 bp, Artificial Sequence
  Description of Artificial Sequence: Synthetic coding sequence
atgcggcggcgggagggccacggcaccgacagcgagatgggccagggacctgtccgagagagtcagtcctcagaccctcccgccctccagtttcgaatcagcgagtataagccccttaatatggcaggcgtggagcagccaccgagccccgaattacgacaggaaggggtcacagaatacgaggacggcggcgctccagcgggagatggcgaggcaggaccccagcaggccgaggatcacccccagaaccccccagaagatccaaaccaggacccacctgaagatgattctacgtgtcaatgccaggcctgcggtccccaccaagctgctggacccgatttagggtcctccaatgatggttgcccccagctattccaagagcggtcggttatcgtcgagaactcatccggcagcacctcggcaagcgagctgctcaagcctatgaagaaacggaaaagaagggaataccagagtccgagcgaagaggaatccgaacctgaagccatggaaaaacaagaagagggcaaggatcctgagggccagcccaccgcatcaactcccgaatctgaggagtggtcctcctctcagcccgctacaggggaaaagaaggagtgttggagctgggaatcatacctcgaagagcagaaagccatcaccgcccctgtgtctctcttccaggactcccaagcggtcacccacaataagaatggttttaagctgggcatgaagctggaaggcattgacccacagcacccctctatgtacttcattttaactgtggcagaggtgtgcggctacaggctgcggctacattttgatggctatagcgagtgccacgatttttgggtgaacgctaactccccggacatccatcccgcagggtggttcgagaagacaggccataagttgcagcccccaaagggatacaaagaagaagaattcagctggtctcagtacctcagaagcaccagagcccaagccgcccccaaacacctgttcgtctcgcagagccacagccctccccccctgggctttcaggtggggatgaaactggaggcggtggatcgcatgaatccttccctcgtctgcgtggccagcgtcactgacgtggtggacagtcgatttctagtgcacttcgacaattgggatgacacatacgattactggtgcgacccttcaagtccatatatccaccccgtcggatggtgtcagaaacaggggaagccgttaaccccaccacaggactatccagatccggacaacttttgctgggaaaagtatctcgaggagaccggcgcatcagctgtgccaacatgggcctttaaggtgcgccctccccattcctttctcgttaacatgaaattggaggccgtcgacaggagaaaccctgccctgatccgcgtcgcctcagttgaggacgtggaagaccataggattaagattcactttgatggttggagccacgggtatgatttttggattgatgccgatcatcccgacatccatcccgctggctggtgctcaaaaactggccaccccctgcagcctcctttagggccccgggaaccttcaagcgcatcccctggcgggtgtccgcccctctcttaccgcagtctcccccacacacggacgtccaaatacagttttcatcacaggctgttcttccctaggaaatgcccaaccccaggctgcgatggctccggacatgtcactggaaagttcaccgcccaccattgtttgagtgggtgcccccttgctgaaaggaaccaatccaggctgaaggcagagctgtccgactccgaggcatctgccagaaaaaagaacctgtctgggttcagtcccaggaaaaaaccccgtcatcacggcagaatcggtcggccgcctaagtatcgaaagatcccccaggaggatttccagaccttgacccccgatgtagttcaccaatctctgtttatgagcgccctatccgctcacccagaccgctccttgtccgtgtgctgggaacagcattgtaagctccttccaggggtggcgggcatttctgcctcaacagtggctaagtggactattgacgaagtcttcggcttcgtgcagactctcactggctgcgaggaccaggccagactttttaaagatgaggtgagatgtaagtgccgggtgggcgacagagcaggagtgaccgttctgaaaacggccgggtctagatgtccaccacagcggcatttctgttag

SEQ ID NO: 192595 - DNA, 2319 bp, Artificial Sequence
  Description of Artificial Sequence: Synthetic coding sequence
atgcggcggcgggagggccacggcaccgacagcgagatgggccagggcccagtacgggagagccagagttcagaccctcccgccttgcaattccgtatcagcgagtacaagcccctgaacatggcaggggtagagcagcccccctctccagagttgagacaggagggtgtaaccgagtacgaggacgggggtgcacccgctggcgatggcgaagccggaccccagcaggctgaggaccacccacagaacccgccggaagacccaaatcaggaccccccagaggatgatagtacctgccaatgccaggcctgtggacctcatcaagccgctgggcccgacctagggtcatccaacgatggctgcccacagctcttccaagagagatcagttatcgtggagaattcatccggaagcacaagcgctagcgaactccttaaaccaatgaaaaaacgcaagcgccgggagtaccagtctccatctgaagaggaatccgagccggaggccatggaaaaacaggaagaagggaaggaccctgagggccagcccaccgcgtccacccccgaatccgaagaatggtcctccagccagccagccacaggggaaaagaaagagtgttggtcctgggagagttacctcgaggagcagaaggcaatcaccgcccctgtgagtttgttccaggactctcaggccgtgacacacaacaagaatggtttcaagctgggcatgaaactcgaggggatcgatcctcagcatcctagcatgtattttatactgaccgttgcagaggtttgcggctataggctccggctgcacttcgacggctattcagagtgtcatgacttttgggtgaacgccaactccccagacatccaccccgctggctggtttgagaagaccggacataagctccagcctcccaagggctataaagaagaggagttctcatggtcccagtatttacggtcaacccgggcacaggcagctcccaagcacctgttcgtatcacagtcacactcccccccacccctgggctttcaggtcgggatgaagcttgaggctgttgaccgaatgaatccatccctagtttgcgtcgcgagtgtgaccgatgtcgtcgacagccgcttccttgtccatttcgataactgggatgatacatacgattattggtgtgaccccagctccccctacattcaccccgtcgggtggtgtcagaagcaagggaagcccttaaccccgccacaggattacccagatcccgacaatttttgctgggagaagtatctggaggagacaggagcaagcgcggtgcctacctgggcctttaaggtgagacccccgcactccttcctagtgaacatgaagctggaagccgtggaccgacgaaaccccgctcttatcagggtggcgtctgtcgaagacgtggaggatcacagaatcaagatccactttgatgggtggagccatgggtatgatttctggatagatgctgatcacccagatattcatcccgcaggctggtgttccaagacagggcaccccctgcagccaccactgggcccccgggagcccagttccgcatctcccggaggatgtccacccctgagttatcgcagcctccctcacacacgcacaagcaaatactctttccatcatagaaaatgcccaacgccaggctgtgatggctcagggcacgtgactgggaagtttacagcgcaccactgcttgtctggttgtcctcttgctgaacggaatcaaagtcgcctgaaggcagagctcagcgatagtgaagcctccgcacgcaaaaagaatttgtctggcttttccccacgcaagaagccacgccatcatggccgaatcggtagaccgcctaagtaccgaaaaattccgcaggaggactttcagaccctgacaccagatgtggttcatcagagcctgttcatgtctgccttgtccgctcaccccgatagatccctgtcagtgtgctgggagcagcactgtaaactgttgcctggggtggccggtatttccgcaagtactgtggcgaagtggacaatcgatgaggtgttcggcttcgtacagactctcactggctgcgaggatcaggcgcgtctgttcaaagacgaggcaagaatcgtgagggtaacgcatgtgtcaggcaaaaccctggtttggacagttgcacagctcggtgatctcgtatgctcagatcacttacaggaaggaaaggggattttagagacaggagtgcacagcctgctttgttcactccccactcatctgctagccaaactttcgtttgcatctgacagtcagtactag

SEQ ID NO: 192596 - DNA, 2523 bp, Artificial Sequence
  Description of Artificial Sequence: Synthetic coding sequence
atgcacctggtggccggcgacagccccggcagcggcccccacctgcctgctaccgccttcataatcccggcaagctccgccactctgggactgccctcttctgccctcgacgttagctgttttcctcgcgagcctatacacgtcggagctcctgaacaagttgcgggctgcgagcctgttagtgcaactgttctgccacagctcagcgcgggcccagcaagcagcagtacaagtactgtgcgactgttggaatggacggaagcagccgcgccgcctcccggaggcggcctgaggtttagaatttccgaatacaaaccactaaatatggctggcgtggagcagcctcctagcccagagctgcgtcaggagggcgtgaccgaatatgaggacggaggggcacctgccggggacggagaggctggcccacagcaggctgaggatcaccctcagaatcctcctgaggaccctaatcaagaccccccagaggacgattcaacgtgtcagtgtcaagcttgcggcccacaccaggcagctggacccgacttggggtcaagtaacgacggatgcccgcaattgtttcaggaacgttctgtcattgtggaaaactcttccggctccacgagcgccagtgaactcctcaagcccatgaagaagcgcaagcgacgggaatatcagagcccgtctgaggaagaatcggaacctgaagccatggaaaagcaggaggaaggcaaggatccggaggggcagcccactgcttccaccccggaaagcgaggaatggagctcttctcagcctgccacaggcgagaaaaaggagtgctggagttgggaatcctacttggaggagcagaaagccattaccgctcctgtctcattgttccaggatagccaggccgtgactcacaataaaaacggtttcaagctggggatgaagttggaagggatcgacccacagcatccaagtatgtactttatcttgacggtggccgaagtgtgcggatatcgacttcgtctccacttcgacggctattccgagtgtcacgacttctgggtgaatgctaactcacctgatatacaccccgctgggtggttcgaaaaaacaggtcataagctacagcctcccaaggggtataaggaagaagagttttcatggtcccaatatctgcggtctaccagggctcaggctgcacccaaacatctgtttgtttcccagagccacagcccccctccgctgggttttcaggttggcatgaaactggaggccgtggatcgtatgaatcccagcctggtgtgcgtggcatctgtaaccgacgtcgttgatagtcggtttctggtgcacttcgacaattgggacgacacatatgactattggtgtgaccctagctctccgtacattcatcctgtcggctggtgtcaaaaacagggaaagcctttgacaccgccccaggattaccccgaccctgacaacttctgttgggagaaatatttggaggaaacaggggccagcgcagtccctacttgggccttcaaggttcgcccgcctcacagctttttagttaatatgaaacttgaggcggtagatcggaggaaccctgccctgatccgtgtggccagcgtggaggacgtggaagaccataggattaagatccactttgacggctggagccacggatacgatttttggatcgacgccgaccatccagacatccaccccgccggatggtgtagcaaaacaggccaccccctgcagccaccgttagggcctagagaaccctcttccgcatcccccggtggctgtccaccactctcttatcgcagtcttccgcatacaagaacctccaaatatagcttccaccaccgaaaatgtccaacacctggctgtgacggctctggccatgttactgggaaattcacagctcatcattgtctgtccgggtgtcccttggctgagaggaatcaatctcggctaaaagcagagctgagcgattctgaagcatctgctcggaaaaagaatctgtcgggcttctcaccccgcaaaaagcccagacaccatggccgcatcgggcggccgcccaagtacaggaaaataccacaggaggacttccagacactgacacctgacgtagtgcaccagtctctattcatgtcagccctgagcgcccaccccgaccggtctctcagtgtttgctgggaacagcattgtaagcttttgcccggcgtggctggcataagtgcttctacagtcgctaaatggacgatcgacgaggtgttcgggtttgttcagactctgactggctgcgaagaccaggcacggctctttaaggatgaggctcgtatcgtgagagtcactcacgtcagcggcaagactctcgtttggacagtcgcccagctcggggatcttgtttgctctgatcatctgcaggaaggcaagggcatccttgagaccggagtccactcactgctatgttctctcccgacacatttacttgcaaaattgtcattcgcctccgacagccagtattag

SEQ ID NO: 192597 - DNA, 1617 bp, Artificial Sequence
  Description of Artificial Sequence: Synthetic coding sequence
cagaaggccatcaccgcccccgtgagcctgttccaggacagccaggccgtgacccacaataagaacgggttcaaattgggcatgaagctggaggggatcgaccctcaacatcccagcatgtatttcattctgactgttgctgaagtgtgcgggtacaggctgcggctacatttcgatgggtacagcgagtgtcacgacttctgggtgaacgctaactccccagatatccacccagctgggtggttcgaaaaaacaggtcacaaactgcagcctcctaagggctataaggaggaagagttcagttggagtcagtatctgagatccactagagcccaagccgctccaaagcatctattcgtttcacagtcgcactccccaccacccctgggattccaggtggggatgaagttggaggcagtggacaggatgaaccccagtcttgtatgcgtggcttccgtcactgacgtagtggactctcgattcctggtgcactttgacaattgggatgacacatatgattactggtgtgacccctcctccccgtatattcatccagtgggctggtgccagaaacaaggcaagccactgacccccccccaggattaccctgaccccgataacttttgttgggaaaagtacctggaggagactggcgccagcgcggtcccaacttgggcctttaaggtgcgcccaccccattcatttctggtgaatatgaaactcgaggcagtcgatcggcggaatcccgcactgatccgcgttgccagtgtcgaggatgtggaggatcatcgaatcaagatacatttcgacgggtggtcccacggctacgatttctggattgatgcggatcatccagatattcacccagccggctggtgctccaaaacagggcacccgctccagcctccattgggccctagggagcccagtagcgcgtctccagggggctgtcccccactgagttacagatccctgccacacaccagaacaagtaagtactctttccatcaccgtaagtgtccaacccccgggtgcgacggtagcggtcacgtgaccggaaaatttaccgcccaccactgcctcagtggttgtccattggcagagcgcaatcagtcgaggcttaaagcagaattgagtgattcagaagcgagcgccaggaagaagaacctgtctgggttttcgccccggaagaagccacgccatcacggtagaattggacgccctcccaagtaccgcaagattccacaggaggactttcagaccctcacccccgacgtggtgcaccagtccctgttcatgagcgccctgtccgcccacccagacaggtccctttcagtgtgctgggaacaacattgtaagctgctgcccggcgtggcaggcatctccgcctctacagttgcgaagtggacaatagatgaggtgtttggcttcgtgcaaacactaacggggtgcgaagaccaagcaagactattcaaagacgagatgattgacggcgaagcttttctgctcctgacacaggccgacattgtgaaaatcatgagcgtgaaactcggccccgccctgaaaatttataatgcgatcctgatgttcaaaaatgcagatgatacactgaaatag

SEQ ID NO: 192598 - DNA, 2523 bp, Artificial Sequence
  Description of Artificial Sequence: Synthetic coding sequence
atgcacctggtggccggcgacagccccggcagcggcccccacctgcctgctaccgcgtttatcatccctgcctcaagtgccaccctcgggctgccgtctagtgccctcgacgtatcctgttttcctagggagcccatccatgttggcgctccggaacaagtagccggatgcgagcctgtgagcgccaccgttctgcctcagttgtctgccgggccagcctctagttcaacgagcaccgtgcggctgctggaatggaccgaagctgcagccccacccccaggtggtggtctgaggttccgaatctctgaatacaaacctttgaatatggcgggtgtagaacagccaccttctcccgaactgaggcaggagggcgtgaccgagtacgaggatggaggagctccagccggagacggcgaagctggaccccagcaagcagaagaccaccctcaaaatccaccagaagacccaaaccaggaccctcccgaagatgacagcacatgtcaatgccaggcctgtggaccccaccaggctgccgggcctgaccttggctcaagcaatgacggctgtccacaattatttcaggagcggtctgtgatcgtcgagaacagttctggctccacctcagcttcagaactgttgaagcccatgaagaagaggaaacgaagagaataccagtctccttctgaggaagaatctgaaccagaggccatggaaaaacaggaggagggtaaggacccagagggccagccaaccgcctctactccggaaagcgaagaatggtcttcttcccagcctgcgactggcgagaagaaggagtgctggtcatgggaatcgtacctggaagagcagaaagccatcacggctccagtttctttgtttcaggattctcaggccgtgacacataacaaaaacgggtttaaattgggtatgaagctggaggggatcgacccacagcacccgtcaatgtactttatcttaaccgtggcggaagtctgcggctaccgcctcagactacacttcgacggctacagcgaatgtcacgacttctgggttaacgctaactccccagatatccaccctgccgggtggtttgagaagactgggcacaagctccagccccctaagggctacaaagaagaggaattctcttggtcgcagtatcttcggtcaaccagagcgcaggcagctcctaagcatttgtttgtgagtcaaagccacagtcctcccccgttgggattccaggtcggaatgaaactggaggcagtcgaccgcatgaatccctctctggtgtgtgtagcatctgtcaccgatgtggtggactctaggttcctggtgcattttgacaattgggacgacacctatgactattggtgcgatccatcctctccatatatccacccggtcggatggtgtcagaaacaggggaagcccctcacaccacctcaggattacccagaccctgacaatttttgttgggagaagtatttggaggaaacaggcgccagcgcggtgcccacctgggcctttaaagtgcgccctcctcatagctttctcgtgaacatgaaacttgaggctgtcgataggcgcaatcccgcactgatccgggtggcctcagtggaggatgtggaggaccacaggataaaaattcattttgatggttggtctcacggctacgacttctggatcgacgccgatcacccagacatccaccccgcgggttggtgctctaagaccgggcaccctttacagccgccgctgggacctcgcgaaccctcctccgcctctcccggaggctgcccccctcttagctacagatccctgcctcacacaagaacgtctaaatattccttccaccacagaaagtgtcccactcccggttgtgacggatcaggtcacgtaactggtaaattcactgcgcaccactgtctgtcaggatgtcctctggcggaacgaaatcagtctcggttgaaggctgaactctctgactccgaagcttctgcccggaaaaaaaacttgtcaggtttttccccacgtaaaaagccgaggcatcacggcaggattgggagaccacccaagtatcgaaagattccacaagaggactttcaaacgctgacacccgacgtggtgcaccaatcgctcttcatgtcagccctgtctgcacacccggacagatccctctcagtgtgttgggagcagcactgcaagttgctgcctggtgtggccggaattagcgccagtacggtggctaagtggactatcgacgaagtctttgggtttgtacagacgctcacaggctgcgaagaccaggcaaggctcttcaaagatgaagccagaatcgtcagagtaacacatgtatcgggaaaaactctggtttggacagtcgcgcagctcggggacctggtgtgcagcgatcatctccaggaagggaaagggatactggagacaggcgtgcattctctgctgtgctctcttcctacacacctcctcgccaagcttagctttgccagcgattcccagtattag

SEQ ID NO: 192599 - DNA, 255 bp, Artificial Sequence
  Description of Artificial Sequence: Synthetic coding sequence
atggccggcgtggagcagccccccagccccgagctgcggcaggagggcgttacagaatacgaggacggcggagccccagcgggcgacggggaggcgggaccacagcaggccgaggaccatccccaaaatccccccgaagatcctaaccaggatccccccgaggacgattccacctgtcagtgccaggcttgtgggccccaccaggcggccggtcctgatttgggcagcagtaacgatggctgccctcaactgtag

SEQ ID NO: 192600 - DNA, 417 bp, Artificial Sequence
  Description of Artificial Sequence: Synthetic coding sequence
atgcacctggtggccggcgacagccccggcagcggcccccacctgccagccaccgcctttattatccccgcaagttcggccacgctgggtctaccgtccagcgctttggacgtgtcctgttttccccgcgaacccatccatgtgggagctcctgagcaggtggccggctgtgaacctgttagcgcgactgtcctgccacagcttagtgccggtcccgctagttctagtacatccacagtgaggcttttggagtggacggaagcggccgccccaccaccgggagggggcctgcgattccgtatttccgagtataagccccttaatatggccggcgttgaacagcctcctagccctgaattgaggcaggagggcgttaccgaatacgaggatggcggtgcccctgcaggagatggttag

SEQ ID NO: 192601 - DNA, 2217 bp, Artificial Sequence
  Description of Artificial Sequence: Synthetic coding sequence
atgcggcggcgggagggccacggcaccgacagcgagatgggccagggccccgtgcgggagtcccaatcgtccgatccacctgccctgcagttccggatcagcgaatacaagccactaaatatggctggagtcgagcaacctccttcccctgaactgcgtcaggagggcgtgactgagtatgaagacggaggagcccccgcgggagatggcgaggcaggcccccaacaggctgaggaccatccccagaatcccccggaggatcccaatcaagaccctccagaggacgattctacctgtcaatgccaggcttgtggtccccaccaagccgccggccccgatctaggaagctcaaatgacggttgccctcagttgtttcaggagcggtctgtgatcgtggagaacagtagcgggagcacgagcgcctccgagctccttaaaccaatgaagaaacgcaaacggagggaataccagagccccagtgaggaggagtccgagcctgaggcgatggagaagcaggaggagggtaaagaccctgaggggcagccgacagctagcacccccgagagcgaggaatggtcatctagtcaaccggctaccggtgaaaaaaaagagtgttggtcatgggaatcctacttggaggagcagaaggccatcactgcaccagtttctctattccaagatagtcaggccgtcacccataataaaaatgggtttaagcttggtatgaaactggagggcattgatcctcagcacccgtcaatgtattttattctgaccgtggccgaagtctgtggatacaggctgagactgcatttcgatggctattcagaatgtcacgacttttgggtgaacgccaactctcccgacatccaccccgcaggctggttcgaaaaaaccggtcacaagctgcagcccccaaagggctataaggaagaggaattcagctggtcacagtacctgaggagcactagggcgcaggccgcaccaaagcacctctttgtgtcgcagagccactcgcctccacctctggggttccaggtgggcatgaagcttgaggctgtcgaccgcatgaatcccagcttggtgtgtgtcgcatccgtcactgacgtggtggattccaggttcttggttcacttcgacaactgggacgatacatacgactattggtgtgacccaagttctccttatatacaccctgtgggttggtgccagaaacaggggaagccactgacccctccccaagattatcccgacccggataatttctgttgggaaaagtatttagaggagactggagccagcgccgttcctacctgggcttttaaagttaggcccccacactcattcctggttaacatgaaactcgaagcagtggatagaaggaatcctgccctaattcgtgtcgctagtgtagaagacgtggaagaccatagaatcaagattcatttcgacggatggagccacggctatgatttctggatcgacgccgatcatcctgacatccatcctgccggctggtgctccaagacagggcacccattacagcctcctctgggacctcgtgaaccatcatcagctagcccagggggatgccctccgcttagttatcggagtttgccacacactcgtacttcaaagtactccttccaccatcgaaaatgccccactcccggttgtgacggtagcgggcatgtcactggaaagtttaccgctcaccactgcctctccggatgccctctggctgagagaaatcagagccgcttgaaagccgaactctcagacagcgaagctagcgcccgcaagaagaatctatctgggttctccccacgcaaaaagccaagacatcacgggcggattggcagacctcctaaataccgcaagataccccaggaggatttccagacgttaactccagacgtcgtgcaccaatcgctgtttatgtctgcactttccgcccaccctgaccggtctctgtccgtctgctgggagcagcattgtaaactgctgccaggtgtggctggtatctccgccagcaccgtggcaaaatggactattgacgaagtgttcggctttgtgcagacactgaccggctgcgaggaccaagccaggctcttcaaggatgaagtgagatgtaagtgccgcgtgggtgaccgggctggggtaaccgttctgaagaccgccgggagcaggtgcccccctcagcggcacttctgttag

SEQ ID NO: 192602 - DNA, 870 bp, Artificial Sequence
  Description of Artificial Sequence: Synthetic coding sequence
tgaaccagcggcagcatgcccacccccctgaccttcaccctgctggcgggctcacggcggcgcgccaccagctgttctctgcccaagtctccccctcccttgggcttccaggtcggaatgaaactcgaagctgtggaccggatgaacccaagcctcgtctgtgtagcctccgtgacagatgtggttgatagtcgattcttagtgcatttcgacaactgggacgatacgtatgattactggtgtgatccctcctctccatacatccaccccgtggggtggtgccagaagcagggtaagccactgaccccccctcaagactacccagatccggataacttctgttgggagaaatatctagaagaaaccggtgccagcgccgtcccaacttgggcctttaaagttcggcccccccactcttttcttgtgaatatgaaactggaggccgttgaccggcgcaatcccgccctgattcgggtggcaagtgtcgaagacgtagaagaccatcggatcaagattcacttcgatggatggtctcatggctacgacttctggatcgacgctgatcaccccgatatacaccccgcaggttggtgctctaagacaggccacccactgcagccaccactcggcccaagggaaccatcttctgccagccctgggggctgtccacctttaagctataggagccttccacacacccgcacatccaagtacagtttccaccacaggaaatgccctacacccggatgcgatgggtccggccatgtgacaggcaaatttaccgctcaccactgtctttccggatgtccattagcagaaaggaaccagagtcgactgaaggcagagctgagtgacagcgaggcatcttag

SEQ ID NO: 192603 - DNA, 327 bp, Artificial Sequence
  Description of Artificial Sequence: Synthetic coding sequence
atggccgccgccatggacgtggacacccccagcggcaccaacagcggggccgggaaaaaaaggttcgaagtgaaaaagtggaatgcggttgctctgtgggcctgggatattgtcgtcgataactgcgccatctgccggaaccacattatggatctctgcatcgagtgccaggccaatcaggcatctgcgacctccgaggaatgcacagtggcctggggagtctgcaatcacgccttccatttccattgcatctcaaggtggttgaaaactcgccaggtttgcccactcgataatcgtgaatgggaatttcagaagtatggacactag

SEQ ID NO: 192604 - DNA, 867 bp, Artificial Sequence
  Description of Artificial Sequence: Synthetic coding sequence
tgacggccccacctgcagaaccagtggcggaagcggaagatgaccacctggagttgtctcgtggcaatgatcgtgtccggcgtaatcaccgctgtgtgggccgtgagagcagctccaatttggcgctctcaagtcaagcagaagatgaggatcggcaaacagggaaactgtagaccaccgcgatgtatttgtagtgctctgggtcttctggcgccctggatggctgtggtgttgagccagggcaagcctcctacaaaaaaagccaaagttttgcacaaggccgcctggtcagccaagatcggggccttcctccacagccaggggacaggccagctggccgacggcactccgacagggcaggatgccctggtcttaggattcgattggggaaagttcctcaaggaccattcatataaggccgcccctgtgtcttgtttcaagcacgtgcccctgtacgaccagtgggaggacgttatgaaaggtatgaaagtggaggtgttgaactcggatgccgtgcttccttcacgggtgtactggattgcgtcagtgatacagactgcaggctatagggtattgttaaggtacgaaggctttgaaaacgatgcttctcatgacttttggtgtaacctgggcacagttgatgtccatcccataggctggtgcgcaatcaattcaaagatccttgttcccccccgcaccatccatgccaaattcactgattggaagggttatctgatgaagcgactcgtgggcagcagaacgctccccgtggacttccacatcaaggtcggcagcgagcccctcaccgacgttcctcctagtgctttgccctttttttgtatcttacacgccacgcattggtcctag

SEQ ID NO: 192605 - DNA, 3762 bp, Artificial Sequence
  Description of Artificial Sequence: Synthetic coding sequence
atggtggtggccctgcggtacgtgtggcccctgctgctgtgcagcccctgcttgctcatccagatacccgaagaatatgagggacaccatgtcatggaaccccctgtgattactgaacaaagcccccgaagactggttgtgtttccaacagatgatattagcctgaaatgtgaagcttcaggcaagcctgaggtgcagtttcggtggactcgggacggcgtgcacttcaagcctaaggaagagctgggagtgacagtgtatcagtctcctcactccggatctttcacaatcactggcaataattctaactttgcacagagattccaggggatataccggtgtttcgctagtaacaaactggggaccgccatgtctcacgaaattcgcctgatggctgagggagccccaaaatggcctaaggaaaccgtgaagcctgtggaggttgaggagggtgagagtgtggtcttgccatgcaaccccccacccagtgctgagcctcttaggatttactggatgaactccaaaatcctgcacatcaagcaggatgagcgagtgacaatgggacagaatggcaatctgtactttgccaatgtcctcacgtccgacaatcactctgactatatttgccacgctcattttccagggaccagaaccataatccaaaaggagcctatcgacctgcgggttaaggccaccaactccatgattgatcgcaaaccaaggctcctgttccccacaaatagctcctcccatctggtcgcccttcagggtcagccactggtcctcgagtgtattgccgaaggtttccctacccctactattaagtggctccgaccctctggcccaatgccagccgatagagtcacttatcaaaatcacaacaaaactttacagctgctcaaggttggagaggaagacgatggagagtaccggtgcttggccgaaaatagtttgggatccgcacggcacgcttattatgtgaccgttgaggcggccccctattggctgcacaagccgcagtcccacctgtatgggcctggagagacggctcgccttgattgtcaggtgcagggacgccctcagccagaggtgacgtggcgtatcaatggaattccagtagaagagctcgcaaaagaccaaaaatataggatacagagaggcgccctcatcctttctaatgtacagccttccgacaccatggtcactcaatgtgaggcacgcaacaggcatggattgctgcttgcgaacgcatatatctacgttgtccagctgccagccaaaatactgactgcagataatcagacatatatggcggtgcaggggagtacggcctaccttctgtgtaaagccttcggcgctcccgtgccatctgtgcaatggctggacgaagatggcactactgttctacaggacgaaagattttttccctacgcaaatggcacattgggaattagggatctccaggcaaatgacactggtcgatacttttgtcttgccgcgaacgaccagaataacgtaaccataatggccaatctgaaagtgaaggacgccacacagatcacacagggcccacggtccaccatcgaaaagaagggctcccgtgtgacattcacatgccaggccagcttcgatccctcattacagccatcaatcacttggagaggtgatgggagggatctccaagagctcggcgattctgacaaatacttcatcgaggatggcaggctggtcatccatagtctggattactccgatcaggggaactattcctgcgtggcaagtaccgaattagacgttgtggaatctcgggcacaattgctcgttgtgggttccccgggacctgttcctcgcctagtgttgtccgatttgcatctgttaacccagagccaagtacgggtcagctggtcacctgctgaggaccacaacgcccccattgaaaagtatgacatagagtttgaagacaaggagatggccccagagaaatggtattctttaggtaaggttccaggcaaccagacatccaccactctgaagctctccccatatgtgcattatacattccgcgtcactgccatcaacaagtacgggccaggggaaccttcccccgtgtccgagacagtggtaaccccagaagccgcgcccgaaaagaaccccgtcgacgtcaagggtgaggggaacgagaccacaaatatggtgatcacctggaaacctctgaggtggatggactggaatgccccgcaggtgcaatatagagttcagtggagaccgcaggggaccagaggtccctggcaagagcagatcgtgtccgatccttttttggttgtgtccaatacctccacctttgtgccctacgagatcaaggtgcaggctgtaaattcgcagggaaaaggtcccgagccacaggtaacgattggctacagcggggaggactatccacaggcaatcccagagctagaaggcatagagatccttaacagttcagccgtattggtgaagtggcggcctgttgacctggcacaggttaagggacacctgcgtggttacaacgtcacctactggcgggagggctcgcagagaaaacactcaaagaggcatattcacaaagatcacgtggttgtgccagctaacactacgagcgtgatcttgagcggactgcgtccgtacagctcgtatcacctggaggtccaagcattcaacggcagaggctccgggcctgctagtgagtttacgttttcaaccccagaaggagtgccgggccacccagaggcactccatctggaatgccaatccaacacttccctgttgctacggtggcagccgcctctcagccataacggagtgctgactggctacgtgcttagctaccacccactggacgaagggggtaagggccagctgtcctttaaccttcgcgatccggagctccggacccacaatctcacagacctgtcaccccatctgagataccggtttcagctccaggcaaccactaaagaaggacccggcgaagccatcgtccgggagggagggacaatggcattgtccgggattagcgattttggaaacattagcgccacagctggcgagaattactcagtggtttcatgggtaccaaaggaaggacagtgcaatttccggtttcatatcctcttcaaggccctcggagaggagaagggtggcgcgtccctgtccccacaatatgtgagctataatcaatcttcatacacacagtgggatctgcagccagacaccgattacgaaatccacttgtttaaagaaaggatgttcagacaccagatggccgtcaagacaaatgggaccgggcgcgtgagactgcctccagccgggtttgccacggagggctggtttatcggcttcgtatctgcgattatactgctgctactggttcttttaattctgtgttttatcaagcgaagtaagggtggaaagtactccgtgaaagataaggaggacactcaggtggatagcgaagcccgcccgatgaaggatgagacctttggagaatactccgataatgaagagaaagctttcggatcctcacagccatccctgaacggcgacataaaacctctgggaagcgacgactcattggctgattatgggggctcagtggatgtgcagttcaatgaagacggaagctttatcggacagtactccgggaaaaaagagaaggaggccgcaggcggaaatgattccagcggagcaacaagccctatcaatcctgccgtggcactggagtag

SEQ ID NO: 192606 - DNA, 3747 bp, Artificial Sequence
  Description of Artificial Sequence: Synthetic coding sequence
atggtggtggccctgcggtacgtgtggcccctgctgctgtgcagcccttgtcttcttatacagatcccggaagaactcatggaaccacccgtgataactgaacagtcccccaggcggttggttgtgttcccaacagacgacatatccctcaagtgtgaggcttccgggaaacctgaggtgcagttccgctggacccgggatggagtgcactttaaacccaaagaggaactcggcgtgactgtctaccaatcaccccatagtggctcctttacgatcacgggaaataactcgaattttgctcagcgtttccagggcatctaccgttgctttgcgagcaataagttagggaccgcaatgtcgcacgagattcggctcatggctgagggggcgcctaagtggcccaaagagacagtaaagcctgttgaggtggaggagggggagagtgtagtactgccctgtaatccaccccctagcgcagaacctctgagaatctactggatgaattcaaaaatcctgcatatcaagcaggatgagcgagtgactatggggcaaaacggcaacctttactttgccaacgtcctgacatctgataaccattctgactatatctgtcacgctcatttccccggcactcgtacaattatccagaaggagcctatagatctgagggtcaaggctaccaatagcatgatcgataggaagcccagactcctctttccgaccaactcttcctcgcacctcgtggccttacaaggacagcccctggtgttggagtgcatcgccgagggcttccctacacctacaattaagtggctacgcccctcaggacctatgcctgccgacagggttacctaccaaaaccacaataagacactgcagctgcttaaggtcggggaagaagatgacggtgaataccgctgcttggccgagaacagcctgggcagcgcccgccatgcctactatgtgacagtcgaggcggccccttattggcttcataaaccgcagtctcatctgtatggtccaggggaaactgccagactcgattgtcaggtgcaagggaggccacagcccgaggtgacttggcgcataaatgggatccccgtcgaagaactggcaaaggatcagaaatatagaattcaacgaggtgccctcatcctgagcaacgttcaacccagcgacacaatggtgacccagtgcgaggcccgaaatcggcacggcctgctcttggctaatgcctacatttatgttgtccagttacccgctaagatactgaccgcggacaatcagacatacatggctgtgcagggctctactgcctatctgctgtgcaaagcattcggagcccccgtgcctagcgttcagtggttggacgaagatgggaccaccgtgctccaggacgagagatttttcccttatgccaatgggacacttggtattcgagatttacaggcaaatgacactggcaggtacttctgcctggctgctaatgatcagaataacgtgacaatcatggcaaatcttaaggtcaaggacgcaacccagattactcaggggccaaggagtacgatagaaaagaaagggtctagagtgacctttacttgccaggcgtctttcgatcccagcctccagcccagcatcacctggcgcggggatggccgggacttgcaagagcttggcgactctgataagtatttcatcgaagacgggcgcctcgttattcactccctcgattattctgaccaagggaattatagttgtgtggccagtaccgaattggatgtggttgagtcaagggcgcagttgctagtggtgggatcgcccggaccagtgccccgactggtcttaagcgatctacacctgctgacccaaagccaggttagagtgtcttggagcccggcagaggaccataacgccccaatcgagaagtacgatatcgagttcgaggataaggagatggcacccgagaaatggtattcgctagggaaggtgcctggaaatcagacctcaaccactctgaaactcagcccttacgtgcactatactttccgggtaacggccattaacaagtacggtcccggagagcctagccccgtgtccgagactgtggtgacccctgaagccgctcccgaaaagaatccagtggacgtaaagggtgagggcaacgaaacaactaatatggtgatcacttggaaacccctcaggtggatggattggaatgccccacaggtgcagtatagagtacagtggagacctcaagggacaagagggccctggcaggagcagatagtctctgatccgtttctcgtggtgagtaatactagcacgttcgtgccgtacgagattaaagtccaggccgtgaatagccagggcaagggccccgagccgcaagtgacgatcggatactcaggcgaggattatcctcaggcgatcccagagctggagggaatcgagatcctcaattcaagtgctgtgctcgttaagtggcggcccgtcgatctggctcaagtgaaaggccatcttagaggttataacgtgacttattggcgagagggaagccagcggaagcattccaagaggcatatccataaagaccatgtggtcgtccccgccaatacaacctctgttattctgtctgggctgcgtccctactcctcataccatttagaggtgcaggcatttaacggcagaggatctgggccagcatcagagttcacattctctaccccagagggggtacctggacacccagaggccctgcatctggagtgccagagtaatacgtccctgctcttaaggtggcagccgcccctgtcacacaatggcgttctgacagggtatgtgctttcctatcatcccctggatgaagggggcaaaggacaactctcattcaaccttcgggacccagagctcagaacgcacaacctgacagacctgagccctcacctgcgctatagatttcagctgcaggcgacgaccaaggaagggcctggagaagcaatagtaagggaagggggcacaatggccctctctggcattagtgacttcgggaatatctctgcaaccgccggggaaaattattctgtggtgtcctgggttcctaaggaaggtcagtgtaacttccggtttcacattctatttaaagcactgggcgaggagaaaggaggagcgagtttgtctccccaatacgtgagttataatcaaagcagctatacccagtgggatctgcagcccgatacagactacgagatccacctctttaaggagcggatgttcagacaccaaatggcagtgaaaactaatggcaccgggagagtaagactccctcccgcagggttcgctaccgagggctggttcattggttttgtgtctgcaatcatcctgctgctgttggtactgctcatcttgtgtttcatcaaacgcagcaagggtgggaaatactcagtgaaagataaagaggatacccaggttgattccgaagctcggcccatgaaagacgaaacttttggagagtacagcgacaacgaggagaaagcctttggcagctctcagcccagcctgaacggtgacattaagccattaggcagtgacgactccctcgcagattacggcggtagtgtagatgtgcagtttaacgaggacgggagcttcatcggacaatacagcggaaaaaaagagaaggaggctgccggaggcaacgatagttcaggagctacatcccccattaatcccgcagtggctctcgagtag

SEQ ID NO: 192607 - DNA, 3747 bp, Artificial Sequence
  Description of Artificial Sequence: Synthetic coding sequence
atggtggtggccctgcggtacgtgtggcccctgctgctgtgcagcccttgtcttctgatccagatccccgaggagttaatggaaccacccgtgataacagagcagtctccacgacgactggttgtgttccctaccgacgacatcagcctgaaatgcgaggcgagcggtaagcccgaggtgcagttccgatggactcgcgatggtgtccacttcaaacccaaagaggagctgggggttaccgtttatcagtcccctcattccggctcctttacgattacaggaaataactccaattttgctcagaggttccaaggcatttacagatgtttcgcctccaataagctgggcactgcaatgtcgcacgagatcagattgatggcagagggcgcacccaagtggcccaaagagacagtcaaacccgtggaagtggaagagggggaatccgtggtgctcccgtgtaatcctccccccagcgcagaaccactccgaatctactggatgaactctaaaatcctgcatatcaagcaggacgagagagtcaccatggggcagaacggaaacctctatttcgctaatgtgttaactagtgacaaccactcagactatatctgtcatgcgcatttcccgggaaccaggacgataattcaaaaagagcccatcgacctccgcgtgaaggctaccaattctatgatagatcgcaagccacgcctcttgttccctaccaactcgtcttctcatcttgtggccctgcagggacaacccttagtgctagagtgtattgccgagggatttcctacccctactatcaaatggttgcgcccatccgggcctatgcccgccgaccgtgtgacctatcagaaccacaataagacactgcaactgctgaaggtgggcgaagaagacgatggcgagtaccggtgcttagccgagaattcgctgggcagtgcccggcacgcttattatgttactgtagaggccgccccgtattggctgcacaaaccccaatcacacctttacggtccgggcgagactgcaagactcgactgtcaagtgcaggggcggcctcagccagaggtgacctggcgaataaatgggatccctgtcgaggagctcgctaaggatcaaaagtacaggatccaacggggagctcttatcctgagtaacgttcagccaagtgacacaatggtcactcagtgcgaggctaggaatcggcacggactcttactggctaacgcatacatttatgtggttcaactgccagcaaaaattttaaccgccgacaaccagacctacatggccgtccagggaagcacagcatacttgttgtgcaaggccttcggcgctccagtcccctccgtccagtggctggacgaagatggaaccacagtgttgcaggacgaacggttcttcccctatgctaacgggacactgggaattcgtgatctgcaggctaacgatacagggaggtacttctgtctggctgccaacgaccagaacaacgtcaccatcatggccaatcttaaggtaaaggatgctactcagataacccagggaccccgatccactattgaaaaaaagggcagtcgggttacgtttacgtgccaggcaagcttcgatcctagcctccagccaagcataacgtggcgaggggatgggagagacctccaagaactgggcgattctgacaagtatttcatagaagatggaagactggtaatacattctctggactattctgaccagggcaactactcgtgcgtagcctcaactgagcttgatgtcgtggaatcccgtgctcagttgctggttgtggggagtccaggaccagtgccacgcttagtactgagtgacctccacctgctgacgcaaagtcaggtgagggttagctggagcccagcagaagatcacaacgctccaatcgaaaagtacgacatagagttcgaggacaaagaaatggctcccgagaaatggtactctctgggtaaagtgccaggaaaccagaccagcaccacgctgaagctgagcccttatgtccactacacttttcgggttacagctatcaacaaatatggccccggcgaaccgtcacccgtgtcagagacagtggtcacgccagaagccgcccccgaaaaaaacccggttgatgttaagggagagggtaatgagactacgaatatggtgatcacctggaagccactgcggtggatggactggaacgctcctcaggtgcaataccgggttcagtggaggcctcagggcactcgggggccttggcaggagcagatcgtctctgacccattcctggtcgtttccaacacatcaacgtttgtcccttacgaaatcaaagtgcaggcagtcaactcgcagggtaagggccccgagcctcaggttaccattgggtactcaggcgaggattacccccaggcaatcccagagctggagggaatcgagatcctaaattccagcgccgtcctagtgaagtggcggcctgtcgacctggcacaggtaaaagggcacttgagggggtacaacgtcacctattggcgggaaggctctcagaggaaacatagtaagcgccacattcataaggaccatgtcgtggtgccggcaaataccaccagcgtcatacttagcggactgaggccctattccagttatcatttagaagtgcaagcattcaacgggaggggtagcggacccgcaagcgaattcacgttttcaacaccggagggggtgcccggccatcctgaagccctgcacctggagtgccagagcaacactagccttctgctcaggtggcaaccgccactcagccataacggcgtcctaaccggttatgtcctgagctatcacccacttgatgagggcggaaagggtcagctgtctttcaatttaagggacccagaactgcggacccacaacttgaccgatttgtcccctcacctaaggtatcgattccaactgcaggccactacaaaggaaggtcctggtgaggcaattgtaagggaagggggcactatggctttgtccggaatatccgatttcgggaatatttctgctacagcaggcgagaactacagtgttgtcagctgggttcccaaggaaggccaatgcaactttaggttccatatcctgttcaaggcactgggggaagagaagggaggcgcatcattgtcccctcaatacgtatcgtacaaccagtcctcttacacccagtgggacctgcaacctgataccgattatgagatccatcttttcaaggaacgcatgtttaggcaccagatggccgtaaagacaaacggcacgggacgggttaggctaccgccggcagggtttgccaccgagggatggttcatcggcttcgtgtcggctatcatacttctcctactggttctgctgattctctgctttatcaaacgaagcaagggagggaagtatagtgtaaaggataaagaggacactcaggtagacagcgaggctcggcctatgaaagatgaaacatttggagaatattccgacaacgaggaaaaggcttttgggtccagtcaacctagcctgaatggagacattaaacctctcgggtccgatgactcactggcagattacggcgggtctgtggacgtgcagttcaacgaggacgggagttttattgggcagtatagcgggaagaaggaaaaagaagcggccggaggcaacgactcgagcggtgccacttcacctattaatcctgcagtggcacttgaatag

SEQ ID NO: 192608 - DNA, 3774 bp, Artificial Sequence
  Description of Artificial Sequence: Synthetic coding sequence
atggtggtggccctgcggtacgtgtggcccctgctgctgtgcagcccttgcctgctgatacagattccagaggagtacgaaggacaccatgtgatggaaccaccggtcattacagagcagagccctcgccgtctagtcgtctttcccaccgacgacatttccctaaagtgcgaagcaagcggcaagcctgaggtacaattccggtggacccgagacggagtgcacttcaagcccaaagaagaactaggcgtcacagtctatcaaagcccacactctggcagcttcaccatcaccggaaacaatagcaacttcgctcaacgtttccagggaatctacaggtgcttcgcttccaataaactcgggaccgccatgagtcacgaaatcaggttaatggccgagggggcaccaaagtggcccaaagaaacagtgaagcccgtcgaggtggaggaaggggagagcgtggtcttgccatgcaatccacccccttccgccgagcccctgcggatttattggatgaactccaaaattcttcatatcaaacaggacgaacgcgtaactatggggcagaacggcaacctgtatttcgccaacgtgctgacctctgataaccactccgactacatttgccatgctcatttcccaggaacccgcacaatcatccaaaaagaaccgattgatctccgtgtgaaggccacaaatagcatgattgaccgcaagcctcgcctgctatttccgactaactccagttcccacctcgtcgcccttcagggacagcctctggtactggagtgcatcgccgaaggatttcctacacccacgatcaagtggctgcggccctctggccctatgcctgctgatcgggtcacctaccagaatcataataaaaccttgcaactcctcaaggtgggggaggaggatgatggagagtatcgatgcctagccgaaaacagcctgggaagcgcccgccacgcatactatgtcactgtggaggcggccccttactggctgcacaaaccccagtcccacctgtacgggcccggcgaaacagccagattggactgccaggtccaaggacggccgcaacccgaggtcacttggaggataaatggtatccctgtggaggagcttgctaaggaccagaaataccgcatccagagaggcgctctcatcctgagtaacgtgcaaccctctgatacgatggtgactcagtgcgaggccaggaatagacacggcctcctattagccaatgcctatatttacgtcgtacagctaccagctaagattctgacagcagacaatcagacttacatggcggtccagggctcaaccgcctatctcctatgcaaggccttcggagccccagtgccctcagtccagtggctcgacgaagatggcaccaccgtgctccaggatgagcgctttttcccctacgcaaatgggaccttgggaatccgggacctccaagccaacgacaccggtaggtatttttgtctggccgccaacgaccagaacaacgtaactattatggccaatctgaaggtgaaggacgccacgcaaatcactcagggaccgcggagtactatcgagaaaaagggaagtcgcgtgacgttcacctgccaggccagttttgatcctagtctgcagcctagcataacatggcgaggtgacggacgggatctacaagagttgggcgactctgacaaatattttatcgaggatggaagactcgtgattcacagcctggactactccgatcaaggaaactactcttgtgtggcctcaaccgagctcgacgtggtcgagagccgggcacagcttttagtcgtgggcagccccggaccggtgccgaggctagtcctgagtgacctccatctgctcacccaatctcaggtgagagttagttggagccctgcagaggatcacaatgcgcctatcgaaaagtacgacattgaattcgaagacaaagagatggcgccagaaaagtggtatagtttagggaaggtgccaggaaatcagacctcaaccaccctaaaattgtcaccttatgtgcattacacattcagggtgacggcgatcaacaagtacggccccggagaaccttcccccgtgtccgaaaccgtggtgactcccgaggctgctcccgaaaagaatcccgtggacgtgaagggagagggaaatgaaactaccaatatggtgatcacatggaagcccctgaggtggatggactggaatgccccacaggtgcagtacagggtgcagtggcggccacagggcacacgaggaccctggcaagaacaaattgtctctgaccccttcttggtggttagcaacacaagcacatttgtaccgtacgaaatcaaggtgcaggctgttaactctcagggtaagggccctgagccccaggtgaccattggatatagtggcgaagattatcctcaggcaatccccgagctggagggcatagagatcctgaactcctctgcagtgctggtcaagtggaggcccgtggatctagcccaagtaaaaggtcacctgcgcggatataatgtgacctattggcgggagggcagtcagcgaaagcattcgaaacggcatattcacaaggatcacgtagtcgtgccagcaaataccaccagtgtgattctgtcaggattgagaccatactcttcttatcatttggaggttcaagcctttaacggtagaggctcgggccccgcgtctgaatttacgttttcaacccctgagggcgtgccaggacaccctgaagctctacatctggagtgccagagcaatacgtcacttctgctccgctggcaaccacccttgagtcataatggtgtactcacggggtatgttctgtcctaccaccccctggacgagggtgggaaggggcaactgtctttcaacctacgtgatcccgagctcaggacacacaacctcacggacctgtccccgcacctgcggtacaggtttcagctccaggccacaacaaaggagggcccaggcgaggcaattgtgcgcgagggcggaacaatggccttgtccggcattagtgacttcggaaatatcagcgctaccgccggcgagaattattcagtagtgtcttgggtccctaaagagggccagtgcaattttcgctttcacatactatttaaggccctgggcgaggagaagggcggtgctagtttatctcctcagtacgtgagctacaaccagagttcttacacccagtgggacctccagcccgatacagactatgagattcaccttttcaaggagaggatgtttcgccaccagatggctgttaagacgaacggcaccggcagggtgcggttacctccagctggcttcgcaaccgagggatggtttattgggttcgttagcgccatcatcctgctcctgctcgtactactcatactgtgctttatcaaacgctccaaaggcggcaaatactcagttaaagataaggaggacacacaggtagattccgaggcgcgtcctatgaaagatgagacattcggcgagtatagaagcctagaatccgacaacgaagaaaaggcctttggttctagccagccctccctgaacggagatatcaaacctttaggatccgacgactctctggctgactacggcggatcagtggatgtgcagtttaatgaagacggaagtttcatcggccaatatagtggtaagaaggagaaggaagccgctggaggcaatgattcttccggtgccacctctcccataaacccggccgtggcactcgaatag

SEQ ID NO: 192609 - DNA, 3774 bp, Artificial Sequence
  Description of Artificial Sequence: Synthetic coding sequence
atggtggtggccctgcggtacgtgtggcccctgctgctgtgcagcccctgtctgttgatccagatacctgaggaatatgaggggcaccacgttatggagccacccgtcatcacagagcaaagcccccgacgcctggtggttttccctactgatgatatcagcctcaaatgtgaggcttctggcaagccagaggtgcaattccgctggactagggatggggtccatttcaaaccgaaggaagagctcggcgttactgtctatcagtcaccccatagtggatcattcactataactggaaataacagtaatttcgcccaaaggttccagggcatctatcggtgctttgccagcaacaagcttggaactgctatgtcacacgaaatacggttgatggctgagggagcccccaaatggcctaaagaaactgtgaaacccgtagaagtggaagagggagagtccgtggtgctgccttgcaacccgccaccttctgcagaaccactgcgcatctactggatgaactccaagatcttgcacattaagcaggacgaacgcgttacgatgggtcagaacgggaacctttacttcgcaaatgtactgactagtgataaccattccgattatatttgtcacgcccacttcccagggaccagaacaatcatccaaaaagagcccatcgacctacgcgttaaagcaacaaattccatgatcgatcgtaaaccaaggctgcttttcccaacgaatagcagctcccatctggtggctcttcaggggcagcctctagtcctagagtgtatagcagagggcttccccacaccaacgatcaagtggctgcgaccatctggcccgatgcctgctgatcgagtaacttaccagaatcacaataagaccctgcagctcctgaaggtgggagaggaggacgacggagagtaccgctgtctggctgagaactcccttggctctgcccgccacgcttattacgtcacagtggaagcagctccctactggctacacaagccgcagagccatttatacggccccggagagaccgcccgcctggactgtcaggtccagggccggccacagcctgaagtcacgtggaggatcaatggcattccagttgaagaattggctaaggatcagaagtataggatccagcgcggagctctcattctctcaaacgtgcagccgagcgacaccatggtgacacagtgcgaagccaggaaccgccacgggctccttctcgccaatgcgtacatttatgtcgtgcagttgccagccaaaattttaaccgccgataaccagacttatatggctgtgcagggcagcacagcctacctcctgtgcaaggcttttggtgctcccgtcccttctgtccagtggctggacgaagatgggaccaccgtactgcaggacgagcgattttttccttacgcaaatgggaccttgggaattcgcgatctacaagcaaatgacacgggccggtatttttgcctagctgcaaacgaccagaacaacgtgacaatcatggctaacttaaaggtaaaggacgccacccagatcactcaggggccccggtcaaccatcgagaagaaaggatcccgggttactttcacgtgccaggcaagcttcgatcccagcctgcagccatccattacctggaggggcgatggaagggatcttcaggagcttggagattccgacaagtattttatagaagacgggaggttagttatccattccctcgattattccgaccaaggaaactacagttgcgtcgcatcaacagagctcgatgttgtggagtctcgtgctcagttgctggtggtcggaagccccggccccgtgccacggttagtgctgtccgacctccatcttctgacccaatcgcaggttagggtgtcttggagcccagcagaggaccacaacgctccgatagaaaagtacgatattgagttcgaggataaagagatggccccagagaaatggtactctttagggaaagtgccaggcaaccagacatcgacgactctcaagctttcaccttatgtgcattatacattccgtgtgacggctattaacaagtatgggcccggggaaccctcgcccgtaagcgagaccgttgttactcccgaggccgctccagaaaagaaccccgtggacgtgaagggtgagggcaacgagaccactaatatggtaattacttggaagccgctccgttggatggactggaatgcacctcaggtgcagtatcgcgtacaatggcgtcctcaggggaccagaggcccttggcaggaacaaattgtgagcgatccctttctggttgttagtaatactagcacatttgtcccgtacgaaatcaaagtgcaggccgtaaatagtcaaggaaaaggtcctgaaccccaggtgactattggctattctggagaagattatccccaggctatcccagagctggagggcatcgaaatccttaactcctccgccgtgctggtgaaatggcgccctgtggatttggcacaggttaaaggccatctccggggatacaacgtgacatactggcgcgagggtagtcagcggaagcactcaaagcgtcacatccacaaagaccacgttgtggtgcctgcaaatacgacctcagtcatcctgtcgggcttaagaccttacagttcatatcacctggaagtgcaagctttcaatggccggggatctggtccagccagcgagttcacatttagtacacccgagggcgtgccgggccaccctgaggcactgcacctggaatgccagagcaatacttccctgcttttaaggtggcaaccaccactcagccacaacggcgtccttaccggctacgtactcagttatcacccccttgacgaggggggtaaaggtcaactcagttttaacttgcgagacccggagttacgcacacataacttgaccgatctgtcgccccacctacgatacaggtttcaactacaggccacaactaaggagggcccaggagaggccattgtcagggagggcggaacaatggctctgagcgggatctcggattttgggaacatttcagcaaccgcaggagagaactactcagtggtgagctgggtccccaaggagggacaatgcaacttcagatttcatattctgtttaaggcactgggggaggagaagggcggcgcttcattatccccgcagtatgtgagttacaatcagtcttcatacacccagtgggacctgcagccggacacagattatgagatccatctgtttaaggagcggatgttccgtcaccagatggcagtcaagacaaacggtacaggcagagtcagacttcctccagcgggattcgccactgagggctggttcattggcttcgttagcgccattatcctcctgctgctcgtgttgctgattctgtgcttcattaaaaggagcaaaggaggaaagtactcagttaaggataaagaggacacccaggtggactctgaagctaggcccatgaaagacgagactttcggcgagtatcgaagcctcgagtctgacaacgaggaaaaagcattcgggtcctcacagccgtccctgaacggagatattaagcccctggggagcgacgacagcctcgccgattatggaggaagcgttgacgtgcagttcaatgaggatggctcttttatcgggcagtatagcggtaagaaagagaaagaggcagccggcgggaacgactcttctggagccacgagtcctattaacccggccgtggctttggagtag

SEQ ID NO: 192610 - DNA, 456 bp, Artificial Sequence
  Description of Artificial Sequence: Synthetic coding sequence
atggtggtggccctgcggtacgtgtggcccctgctgctgtgcagcccatgtttgctgatccagattccagaagagtacgaaggccatcacgtcatggagccacctgtaattacagaacagtccccccggaggctggtggtcttccctactgatgacattagcctcaagtgcgaagcctccggcaagccagaggtacagtttagatggacccgagacggagtgcacttcaagcccaaagaggagctgggcgtgaccgtttaccagtcaccacacagtgggtcatttacgattacgggcaacaacagcaatttcgcacaacggtttcagggcatttatagatgcttcgcatccaataagctcggtactgcaatgtcccacgagattaggctcatggccgaaggcgcaccgaagtggcccaaggaaactgtcaaacctgtggaggtggaagaaggatag

SEQ ID NO: 192611 - DNA, 255 bp, Artificial Sequence
  Description of Artificial Sequence: Synthetic coding sequence
atggtggtggccctgcggtacgtgtggcccctgctgctgtgcagcccctgcctgctcatccagatccctgaggaatacgaaggacaccacgtgatggaaccaccggtgatcacggaacagagtccgcgccggctcgtcgttttcccaactgatgacatcagcttgaagtgtgaggcttcaggcaaacccgaagtacaattcaggtggacgagagatggcgtgcacttcaagccaaaggaagagttaggggtttag

SEQ ID NO: 192612 - DNA, 3768 bp, Artificial Sequence
  Description of Artificial Sequence: Synthetic coding sequence
atggtggtggccctgcggtacgtgtggcccctgctgctgtgcagcccctgcctcctgattcagatccctgaagaaagtttcccagggcacagggttgttatggaacccccagttataaccgagcagtcaccaaggcggctggtcgtatttcccaccgacgacatcagcctgaaatgcgaagcttcaggcaaacctgaggtgcagttcagatggactagggacggtgtgcatttcaagcctaaggaagaattaggcgtgaccgtgtaccagagtccccactccggtagcttcactattacaggcaacaactctaactttgctcagcgattccagggcatctaccgttgcttcgccagcaacaagctgggcactgcaatgagccatgaaatacggttgatggcagagggcgcaccgaaatggccaaaggagacagtaaaacctgtggaggtggaggagggtgaaagcgtcgtattaccgtgtaaccccccaccgtccgccgagcccctgagaatttactggatgaactccaagatcctgcatattaaacaagacgaaagagtgaccatggggcaaaacggcaacctgtacttcgcaaatgtcttaacaagtgacaaccacagcgattacatctgccacgcccactttcctgggacgcgaactataattcagaaagaacctatcgatttacgggtcaaagccacaaacagcatgatcgaccggaaaccaagactgctgttcccaactaatagctccagccatctggtggccctccagggccagccactggtcctggaatgcatagctgagggattccccactccgaccattaagtggctgagaccatctggccctatgcccgctgaccgtgtcacatatcagaaccacaataagaccctccaattgctgaaagttggggaggaggatgacggcgagtacaggtgcttggcggagaactctctcggcagtgccagacacgcatattacgtaacagtggaagcagctccatactggctgcataaaccccaatctcatttgtatggcccaggggagactgcgcggctggactgccaagtccaaggccggcctcagcccgaagttacgtggcgtatcaatggtatcccagttgaggagctggctaaagatcaaaagtatagaatccagagaggagctttaatcttgagcaacgttcagccctcagatacgatggtcacccagtgcgaggcccggaatagacacggactcctactagcaaacgcctacatttacgtagtgcagctcccagctaagattctcaccgccgataatcagacgtatatggccgttcaagggagtacagcatacctgctttgcaaagccttcggcgccccagtgccctcagtacagtggctggacgaggatggcactaccgtgctgcaagacgagcgatttttcccgtacgcaaatggaacactaggtatcagggaccttcaggcaaatgacaccggtaggtacttctgtttagccgctaatgaccagaataatgtcacaatcatggccaatctgaaagtcaaggacgcaacccagattactcaagggcctaggtcaacaatcgaaaagaaagggtcccgggttacttttacttgccaggccagctttgatcctagcttacagccttccatcacatggcgcggcgatggccgcgatctgcaggaattgggggacagcgacaaatattttattgaggatggccgccttgtgattcactctctggattacagtgaccagggcaactacagttgtgtcgccagcaccgagttggatgtggtggaatcacgcgctcagctcctggtcgtggggtcaccggggccggttccaagactggttctgtccgatttacacctcctgactcagtctcaggtccgtgtctcttggtcccctgctgaggaccacaatgcccctatcgaaaagtacgatatagaattcgaggacaaagaaatggccccagaaaaatggtactctctgggcaaggttcccggcaaccaaacctccactactcttaaactcagtccctacgtacattatactttcagagtgaccgctataaacaaatacggccctggtgaaccatctcctgtgagtgagacggtagtgacacccgaggccgctcctgagaagaatcccgttgacgtgaaaggagagggcaatgagactactaatatggtgataacctggaagcctttgaggtggatggattggaatgcaccgcaggtgcagtatcgtgtacagtggagaccacaggggactaggggtccatggcaggaacagattgtaagtgatccatttctggttgtatctaacacatccactttcgtgccatatgaaatcaaagtgcaggcagttaatagtcagggaaaaggtccggagccccaggtaactattggttatagcggagaggactatcctcaggccatcccggagctggaaggcatagaaatacttaattcaagcgcagtgctggtcaaatggcgtcccgtcgacctcgcccaagtgaaaggccaccttagagggtacaatgtgacttattggagagaggggtcccagcggaagcattccaaacgccacattcataaggaccacgtagtggtcccagcgaacaccacaagcgtgatcctctccgggcttcggccatattccagctatcaccttgaggtgcaggcttttaatggccgcggttccgggcctgcatcagaattcactttctccacccccgagggtgtacctggccatcctgaggctcttcacctggaatgccaatccaacacaagcctgctccttcggtggcagcctcctctgagccacaatggagtgctcaccggatacgtgctgagttaccacccactagacgaggggggcaaaggccaactcagcttcaatttgcgggaccctgagcttcgaacacataacctcacagacctgtccccgcatctgcgctacaggtttcaactgcaggcgacgacgaaggagggtcccggggaggcgatagtccgggagggcggcaccatggctctctcgggcattagcgactttggaaacatctcagcgacagccggagaaaattattctgtggtctcttgggtgcccaaggaaggacagtgtaactttcggttccacatactgtttaaggcactgggggaagaaaaagggggcgccagcctatctcctcagtatgtgtcgtataaccagtcttcttatacccagtgggacctgcaacccgataccgattatgaaattcatctgttcaaggaacggatgttccgccatcagatggctgtcaaaacgaatgggaccgggcgcgttcgcctacctccagctggtttcgccaccgagggatggttcattggttttgtcagtgccataatattacttctgctggtcctactgatactgtgcttcatcaagcggagtaagggcggcaagtactctgttaaagacaaagaggatacacaggtggactccgaggcgcgcccgatgaaggatgagacattcggggaatactccgacaacgaagagaaggcctttggcagctctcaaccttctctgaatggagatatcaaacctctcgggtctgacgattctcttgcagattatggcggtagtgtggatgtgcagttcaacgaagacgggtccttcattgggcagtattccggcaaaaaagaaaaggaagccgctggcggaaacgacagctcaggagctacaagccctatcaatcccgctgtcgccctcgagtag

SEQ ID NO: 192613 - DNA, 351 bp, Artificial Sequence
  Description of Artificial Sequence: Synthetic coding sequence
atggccgagggcgcccccaagtggcccaaggagaccgtgaagcccgttgaagtggaggagggtgagtctgtagtcctgccctgtaatcctcctccctcagccgaaccactccgcatctactggatgaacagcaaaatcctccacatcaaacaagacgagcgtgtgaccatggggcagaatgggaacctatacttcgccaatgtactgactagtgataatcattctgattatatctgtcacgcacacttccccggaactcggaccatcatacagaaagagcccattgatcttagagttaaagcgacaaattccatgatcgatcggaagcctagacttctgtttcccacatag

SEQ ID NO: 192614 - DNA, 3780 bp, Artificial Sequence
  Description of Artificial Sequence: Synthetic coding sequence
atggtggtggccctgcggtacgtgtggcccctgctgctgtgcagcccatgccttctcattcaaataccagaggagagttttcctggccacagggtcgtcatggaacctccagtaatcacggaacaatctcctagaaggctcgtggtcttccccacggacgatatatctcttaaatgtgaggcctctggcaagcccgaagtgcagtttagatggaccagagacggcgttcactttaaaccaaaggaggagctaggagtcacagtctatcagtctccccatagcggatctttcaccattactggtaataactccaacttcgcacagcgattccaaggtatttatagatgtttcgcgagcaacaaattgggaactgccatgtcgcatgagataaggctgatggctgagggggcccctaaatggcctaaggagacggtgaagcccgtagaggtagaagagggggaatccgtggtgttgccttgcaatccccccccctccgcggagcctctcaggatctactggatgaacagtaaaattctgcacatcaaacaggatgagagggttacaatggggcagaacgggaatctgtactttgctaacgtgctgacgagtgataaccatagtgattacatctgccacgcccattttccgggaacccggactattattcagaaagagcccatcgatttgcgcgtgaaagctacaaattccatgatcgatcgcaagcctcgactcctgttccctaccaattcttccagccacctggtggctctgcagggacagccattagtcctcgagtgtattgccgaaggattccccactcccacgatcaaatggctaagaccaagcggacctatgcccgcagaccgcgtgacctaccagaatcacaataagactctgcagctcctgaaggtgggcgaagaagatgatggcgagtatcggtgccttgctgagaattctctcggttctgcccggcatgcctactatgtgaccgtggaggccgctccatactggctccacaaaccacaatcccatctttacggccctggagagactgcccgactggattgtcaggtccagggtaggccgcagcccgaagtgacttggcggatcaatgggattcccgtggaggaacttgcaaaggatcagaagtaccggatccagagaggggctcttatcctaagcaacgttcaaccaagcgacactatggtcactcaatgtgaggctcgtaatagacatggtctccttctggccaacgcttatatttatgtggtgcagctccctgctaagatactcactgccgacaaccagacctatatggcagtgcaggggtcaactgcctatctgctctgcaaggcatttggggcacctgtaccatccgtgcagtggcttgacgaggatggtaccactgtgctgcaggacgagaggttttttccttacgcaaatggcaccttaggtatacgagacctgcaggcgaatgatacaggtcggtacttttgcctggctgctaacgaccagaacaacgttactatcatggctaacctgaaagtcaaggacgcgacccagattacccagggtccccgtagtactatcgagaagaaggggtcacgcgtaacctttacctgtcaggcctcgttcgacccctcactgcagccaagcatcacttggcggggcgacggaagggacctgcaagagctgggcgattcagacaagtattttatcgaggatggaagactggtgattcattcccttgattattcagatcaggggaactactcttgtgttgcttccactgaattagatgtcgtcgaaagcagagcccaactactggtggtgggatccccggggccagtacctcgcctcgtactttcagacctgcatttgttgacgcaaagtcaggtccgtgtcagttggagccctgctgaagatcacaacgcccccatcgaaaaatacgatattgagttcgaggacaaggagatggcgcctgaaaagtggtacagcttggggaaggtgcctggcaaccagacctccacaacgctgaagctgtcgccctatgtgcactacacattcagagtcacagcaatcaataaatacggcccaggagagccgagtcctgtatccgagactgtcgtcacaccggaagcagccccagagaagaaccctgttgatgtgaagggagagggaaacgagacaactaatatggttatcacatggaagcctttgcgatggatggattggaacgctccgcaggttcagtaccgggtccagtggcgacctcagggaacccgaggaccttggcaggagcagatagtgtctgatccatttcttgtggtcagcaatacctccacattcgtgccgtatgaaattaaagttcaggcggtcaactcccagggcaaagggccggagccgcaggtgaccattggatatagcggcgaagattatccccaagccatcccagagctcgaaggaattgagatactgaacagctcggccgttctcgtgaagtggaggccagttgacctggcccaggtgaaaggccacctcagaggctataatgttacatactggagggaagggtcacaaaggaaacattctaagagacacattcacaaagatcacgtggtggttcctgccaacacgacctccgtgattctatctggcctccgcccctattcaagctaccatctcgaggtgcaagcatttaacggccgcgggagtggccccgccagcgagtttacgttctcgacccccgagggagtgcccggtcaccccgaagcccttcatctagagtgtcagagtaatacgtctctgctgctgcgatggcaaccgccactcagccacaacggcgtcctgacagggtacgtgctgtcttatcatccgcttgatgagggcggcaagggccaacttagcttcaacctgagagaccctgagctcaggacccataatctaactgacctgagtcctcacctgaggtacagattccagctccaggctacaacaaaggagggcccgggtgaggccatcgtccgggaaggcggcactatggcgttaagcggcatttcagattttgggaacattagcgccactgcaggggaaaactactcggtggtgtcttgggtccccaaagaggggcagtgtaattttaggttccacatcctgtttaaggccctcggagaggagaaaggtggcgctagcttgagcccacagtacgtctcctataaccagagttcctacacgcagtgggatctacaacccgataccgactacgaaatccatctgtttaaggagcgcatgttccggcaccagatggccgtcaagacgaatggaactggccgagtacgtttaccacccgctggatttgctactgaaggatggttcattggcttcgtctcggccattattctgcttttattagtgctgctgatcctctgtttcataaagcggagtaaggggggcaaatattccgtgaaggataaagaagacacgcaggtggattccgaagccagaccgatgaaagatgagacgttcggagaatacagatcactggagtccgataacgaggagaaggcgtttggaagctcgcaaccatcactgaacggggatatcaagccactggggagtgatgattctctggcagattatggaggaagtgtagacgtccagtttaacgaagacggatcttttatcgggcaatattctggtaaaaaggaaaaggaggccgcaggaggcaacgattcaagtggtgccacgtcccctattaaccccgctgtagctttggagtag

SEQ ID NO: 192615 - DNA, 1326 bp, Artificial Sequence
  Description of Artificial Sequence: Synthetic coding sequence
atggtgcccgccctgcggtacctggtgggcgcctgcggccgggcccgtggcctgtttgcaggtgggagtcccggagcctgcggcttcgctagcggacgccccaggcctctgtgtggtgggtctcgatcggcctcaacttcgtccttcgatatagttattgtaggaggtggcatcgtggggcttgcctcagcacgtgccctgatactgcgtcaccccagtctctcaatcggggtgcttgagaaggaaaaagacctcgctgttcaccaaacgggccataacagcggcgtaattcactctgggatatactataaacccgaatccttaaaggcaaaactgtgtgtccagggtgccgccctgctgtacgagtactgtcagcaaaagggcatctcttataaacagtgcgggaaactgatcgtcgctgtggagcaagaagaaattcccaggttgcaagccctgtacgaaaagggactccaaaatggcgttcctgggctgcgtctgattcagcaggaagacatcaagaaaaaagaaccatattgcagaggtctcatggcaattgattgtcctcataccggcatcgtggattacagacaggtggccctgagttttgctcaggattttcaggaagctggcggaagcgtgctaactaactttgaagttaagggaattgaaatggccaaagaaagccctagtagatcaatcgacggtatgcagtatccaatcgttataaagaacactaaaggcgaagaaattcgatgtcagtatgtcgtcacgtgcgccggactctactcggaccgtatttccgagctctctggctgtactcctgatccaagaatagtgccattcagaggcgattatctgcttcttaagccggagaagtgttacctagtcaaaggtaacatttaccccgtccccgattctaggttccccttcttgggggtacactttacaccccgcatggatggctccatttggttggggccaaacgccgttttagctttcaaaagggagggatatcggccgttcgacttctcagcaactgacgtgatggatattattatcaattctggattaattaagctcgcctcgcagaattttagctatggagttaccgagatgtacaaagcatgctttttgggggcgaccgtcaagtatctgcagaagtttattcctgaaatcacgatttctgacattcttcgccaggtcgctgtgcggggtccctcatggctgtggcagcaacctatgaaggtctccgataataatatatattgcttcctctggcgttgttttgccttgcttctaaccggctccgcctgttcttttaagtag

SEQ ID NO: 192616 - DNA, 1392 bp, Artificial Sequence
  Description of Artificial Sequence: Synthetic coding sequence
atggtgcccgccctgcggtacctggtgggcgcctgcggccgggcccggggtctgtttgcaggcggttcaccaggcgcttgtggattcgcatccggacgtccgcgtcccctgtgcggaggatcgcgttctgctagtacaagttcctttgacattgtcattgtcgggggcggcattgtgggacttgcatcagctcgtgccttaatcctgcggcacccctctctctctatcggtgtactggagaaggaaaaggacttggccgtgcatcagaccggtcacaattccggcgttattcactctggtatctactataagcccgagagcctgaaggccaagttatgcgtgcagggtgccgctctgttgtacgaatactgccagcagaaagggatttcgtacaaacagtgtggcaaactgatagtggccgtcgaacaggaagagatccccagactccaagccttatatgagaaaggcttacagaacggcgtccctgggctcaggttaattcaacaggaggacattaagaagaaagaaccgtattgccgtggacttatggccatcgactgcccccacacaggcatagtcgactaccggcaagtggctctttcctttgctcaggatttccaagaggccggcggctcagtcctaactaacttcgaggtgaaaggcatcgagatggctaaagaaagcccgtctaggtccatcgacggcatgcagtatcccatcgtgataaaaaacacaaaaggtgaagaaatcaggtgtcagtacgtggtcacttgcgcagggctgtactcggatagaattagcgagctgtccggctgtacaccagatccccggatagtgcctttcaggggcgactacctgctcctcaagcccgaaaagtgttacctcgtgaaagggaacatttaccccgtccctgatagccgatttcctttcctgggtgtccacttcacgccccgaatggatggctcaatctggctgggccctaacgctgtcctggcttttaaacgtgaagggtaccggcctttcgacttttcggctacagacgtaatggatatcatcatcaattcgggcctgatcaagctcgcaagtcaaaactttagctacggtgtgacagagatgtacaaggcttgttttctgggcgccacagtgaagtacctgcagaaatttattcctgaaattaccatatcagatatcttgagaggacctgcgggggtcagggcccaggcactggatagggacggaaatctggtggaggactttgtttttgatgccggtgttggtgatattggtaataggattctccacgtcaggaacgcaccttctcctgccgcgacatcctccatcgcgatcagtgggatgattgccgacgaagtgcagcagcgtttcgaattgtag

SEQ ID NO: 192617 - DNA, 1392 bp, Artificial Sequence
  Description of Artificial Sequence: Synthetic coding sequence
atggtgcccgccctgcggtacctggtgggcgcctgcggccgggccagaggcctgtttgccggtggctcccctggcgcctgcggatttgccagcggtcggccacgaccactatgtgggggctctaggagtgcctccacctcctctttcgatattgtaatagttgggggtggtatcgttgggttagccagtgcgcgcgcactgatcttgcggcacccctccctgagcatcggggtgctcgagaaggaaaaagaccttgccgttcaccagactggccataactccggggtaattcactccgggatctactacaaacctgaatctctcaaagccaaactttgtgtgcagggcgcggccttgctttatgagtactgccaacagaaagggatcagctataaacagtgcggtaagctcatcgtggctgtggagcaagaagagatacctcgattgcaagccctctatgagaaaggcctgcagaacggagtgccaggattgcgcttgattcagcaggaggatatcaaaaaaaaggagccttactgtagaggactcatggctattgactgtccacacaccggtatcgtcgattatcgccaagtagccctgtcatttgcccaggacttccaggaagcaggagggtctgtgcttaccaatttcgaagtgaagggaattgaaatggccaaggaaagcccctctaggtccatcgacggaatgcagtaccctattgtcatcaagaatacaaagggtgaagagattcggtgtcagtacgtggtgacctgcgccggtctctacagcgacaggatctcagaactgtctggttgtacgcccgatccgcgaattgtgccattccgaggggactacctgctcctcaaacccgagaagtgttatttggtcaagggtaacatctaccccgtcccagattctaggtttccgttcttgggcgtgcacttcacccctcgaatggacggctcaatctggcttgggccgaacgctgtgcttgctttcaagcgggagggctatagacccttcgacttttccgccaccgatgtcatggatattatcatcaactctggcctcatcaaactggcttctcagaactttagttacggtgtaaccgagatgtacaaagcttgtttcctaggagccaccgttaaatacttacaaaaattcataccagagataactatcagcgacatcctcaggggccctgctggtgtcagagctcaagcgctggatcgggacggtaaccttgtggaagactttgtgtttgacgcaggcgttggagacatagggaatcggattctgcacgttcgcaacgcaccgtcccctgccgccacgagttctatcgccatctcaggcatgattgctgacgaagtacaacagcggtttgagctgtag

SEQ ID NO: 192618 - DNA, 3060 bp, Artificial Sequence
  Description of Artificial Sequence: Synthetic coding sequence
atgctgtggcgggtgctgctgagcaagcggccccccttcccccaccctgaactggacttccaggaagcccccataccatcatgtccgggcaggctgcctgggaggaagaactcggtggctcttgcagccgcacctcgcaaggaacctactggcgacagggagaagcctctgccatttccagtgttggcaccgttcagcaatcccgagcattcggcccccgctaaggttgtgagggcagccgtgcctaagcaacggaagggcagcaaagtaggagactttggagacgctattaattggcctactccaggcgaaattgctcataagtcagtgcaaccccagtctcacaagccacagcccactcggaagttgcctcctaaaaaggatatgaaagaacaagagaaaggcgaaggcagcgattccaaggagtcccccaaaactaagagtgatgagagcggcgaggagaagaacggcgatgaggattgccagcgcggtgggcagaagaagaaaggcaacaagcacaaatgggtccctctccagattgatatgaagccagaagtgccgcgcgaaaaactcgcttccaggcctacaagacctccagagccacggcacattcctgctaataggggggaaatcaaaggaagtgaatccgccacctacgttcccgtcgcgccacccacgccagcttggcagccagaaattaagcccgagcccgcttggcacgatcaggatgagacaagtagcgtgaagtccgacggcgccggaggggcccgggcgtcgtttagaggccggggacggggccgcggcaggggcaggggaaggggaagaggtggcacccgtactcacttcgactatcagtttgggtatcgaaagtttgacggagtcgagggtcctagaacacccaagtatatgaataacattacatattattttgataatgtgagctcgactgagctctacagcgtggaccaagagctgctgaaggactatattaagcgccagattgagtattatttcagtgtcgacaacttggaaagagacttctttcttcgccggaaaatggacgctgatgggttcctacctatcactctgatagcaagcttccaccgggtacaggctctcactactgacatatcactgatttttgcagctttaaaggattccaaagtggttgaaatcgtggacgagaaggtgaggaggcgcgaggagcccgaaaaatggcctctgccccctatcgttgattattcccagacggatttttcccagcttctaaactgtccagagtttgtaccacgtcagcattaccaaaaagagactgagagtgcaccaggatctccacgcgctgtgacaccagtgccaaccaaaaccgaagaggtgtcaaatcttaagaccctgcccaagggcctctctgcttccctgcccgacctggactctgagaattggatcgaggtgaaaaagagaccaaggcccagcccagctcggcccaagaagtcagaggagagccgcttttcccacttgacctctttacctcagcagctccccagccagcagctcatgtccaaagatcaagatgaacaggaggaactggactttttgttcgacgaagaaatggaacagatggacggaagaaaaaacaccttcaccgcgtggtctgacgaggagtctgactacgaaatagacgatcgcgatgtaaataaaatactcattgtcacccaaactccacactatatgaggagacaccctggtggagaccggacgggaaaccacacgagccgggctaagatgtccgccgaattggccaaggtcattaacgacggattattctattacgaacaggatctatgggccgagaaatttgagcccgagtactcccagataaagcaggaggtcgagaatttcaaaaaagtaaacatgatatctcgggagcagttcgacactctgactccagagccacccgtcgatccaaaccaggaggtgcctccaggacccccaaggttccagcaggtgcccaccgacgccctggcaaacaaactgtttggggcccccgagccatctaccattgcaaggagcctgcctactaccgtgcccgagtcccccaactacaggaatacccggacccctcgcacccccagaaccccccagcttaaagactccagccagacatctcggttctaccccgtcgtcaaggaaggacgtacactcgatgccaaaatgcctaggaagcgtaagacccgccattcatcgaatccccccctcgagagtcacgtggggtgggtcatggacagcagagagcatcggcctagaacagcatcgatatctagctccccttcggagggaacccccacggtggggagttacgggtgcacgccgcagagtctaccaaaattccagcatccttcccatgaactgttgaaggagaatggcttcacccaacatgtgtaccataagtaccgcagacgttgtctgaatgagcgaaaacggcttggtattggacagtctcaggagatgaatacactgtttaggttttggagttttttcctccgtgatcacttcaataagaaaatgtatgaagagtttaagcagctggctttggaagatgcaaaggagggctaccgctacggtctggagtgcctctttcgctactacagttacggactcgaaaagaaattcagactggacatatttaaagatttccaggaggagacagttaaagattacgaggctggacagctgtatggattagaaaagttttgggccttcttgaagtactctaaggctaagaatctggacatcgatcctaagcttcaggaatacttgggtaagttccgccgtcttgaggatttcagggttgatccacccatgggagaggaaggtaaccacaaaagacactccgttgtggcaggaggaggcgggggggaaggaaggaaacgctgcccctcccagtcatccagccgccccgctgccatgatatcacagcctcccactcctccaaccggacagcccgtgcgagaagacgccaaatggacttcacagcactcaaacacccagacgctgggcaaatag

SEQ ID NO: 192619 - DNA, 2451 bp, Artificial Sequence
  Description of Artificial Sequence: Synthetic coding sequence
atggccacccaggtggagcccctgctgcccggcggcgccaccctgttgcaagccgaagaacacggcggcttagtgaggaagaaacccccgcctgcccccgaaggaaagggggagccaggtcctaacgacgttagagggggtgagcccgacggctccgctagacgtcctagaccgccttgtgccaagccgcataaggaggggacaggacagcaggagcgggaatctcctcgcccactgcaactgccaggcgcggaaggacctgctatcagcgacggagaggagggcggaggggagccaggcgccggagggggggccgcaggagccgccggcgctggaaggagggactttgtggaagcccctccgcctaaagtgaacccttggacaaagaatgctctaccaccagtgctgaccaccgtgaacggccagtctcctcccgaacacagcgcacccgctaaggtggttagagccgctgtccccaagcagcgaaagggtagcaaggtgggcgatttcggagatgcaattaattggcctactccaggggagattgctcacaagtcagtccagcctcagtcacacaaaccccagccaacacgcaagctgccaccaaagaaggatatgaaggaacaagaaaaaggagagggaagcgattcgaaagagtcacctaagactaagtctgacgagagtggagaagaaaagaatggagacgaggactgccagcgcgggggccagaaaaaaaaagggaataagcataaatgggttcctttacagatcgacatgaaaccagaggtgccaagggaaaaattagcatctagacccactcggcccccagagccaagacacataccagcaaaccgcggagaaataaagggcagcgagagtgccacctatgtgcctgtcgcgcctccgacgccagcctggcaaccagaaatcaaacctgagcccgcttggcacgaccaggacgaaacctcaagcgtcaaatccgatggcgctggaggagcccgagcaagctttaggggacgcggacgcggacgcggcagaggaagaggacggggcagggggggcacacggacccacttcgactaccagtttggctataggaagtttgacggcgtcgaaggccctcggaccccaaagtacatgaataatattacatactatttcgataacgtatcaagtacagaactctatagcgttgatcaagagctgcttaaggattatattaaaagacagattgagtactacttctccgtcgacaacttagaacgagatttctttttacgcaggaagatggacgcggacgggtttcttccaataacactcatagcatcctttcaccgcgtgcaggcattaacaaccgacatctccttgattttcgcagcactgaaagactccaaagtggttgagatcgttgacgagaaggtccggcgacgcgaggagcccgaaaaatggcccttgccgccaatcgtagactattctcagacagatttctctcagttactgaattgccctgaatttgtgcccagacaacattatcaaaaggaaacagagtccgcccctggctctccaagggccgtaacgcctgtccctaccaagaccgaggaagtctccaatctaaaaacactccccaaaggactgagcgcgagcctcccggatctggatagtgaaaactggatcgaagtgaaaaagagacctaggccaagccctgcccggcctaagaaaagcgaggaatcaagattttcacacttaactagtctaccgcaacaactcccttcacagcagttgatgtccaaagaccaggacgagcaggaggagttggacttcttgttcgacgaggaaatggagcagatggacggacgcaagaatactttcaccgcctggtccgatgaggagagcgactacgagatcgatgacagggatgttaacaagatcttgattgtcacccagactccacattatatgcggcggcaccctggtggcgacaggactggcaatcatactagccgggccaagatgtccgctgagctggcaaaagttataaatgacggtctattctattacgaacaggatctgtgggccgaaaaattcgaacctgagtactcccaaattaagcaggaagtcgagaacttcaagaaagtgaacatgataagccgggaacaatttgatacgctgacgcccgaacctcccgtggacccgaaccaggaggtacctccaggccctcctagattccagcaggtccccactgatgccttagctaataaattgttcggggcccctgagccaagcactatcgccagatctttaccaaccaccgtccctgagagtccgaattacaggaatacccgcacaccccgcactcccaggactccacagctcaaggactccagccagacctcccgattctatcccgtggtgaaagaaggccgcactttggatgctaagatgccacgatag

SEQ ID NO: 192620 - DNA, 282 bp, Artificial Sequence
  Description of Artificial Sequence: Synthetic coding sequence
atgaaggagcaggagaagggcgagggcagcgacagcaaggagagccccaagactaaaagtgacgagtcaggagaggagaagaatggggacgaggactgtcagcgcgggggtcaaaaaaaaaaaggcaacaaacacaaatgggtgcccctccagatcgatatgaagcccgaggttcccagagagaaactggcttctcggcctacacgccctcctgagcccaggcacatcccagcaaatagaggggaaattaaaggaagtgaaagcgccacctatgtcccgtag

SEQ ID NO: 192621 - DNA, 1836 bp, Artificial Sequence
  Description of Artificial Sequence: Synthetic coding sequence
atgaaggagcaggagaagggcgagggcagcgacagcaaggagagcccaaagacaaagtccgatgaaagcggcgaggagaagaacggcgacgaggactgtcaaaggggcggccagaagaagaaaggaaacaagcacaagtgggttcccctccaaattgatatgaaacccgaggtcccacgcgaaaagctggcgtcaaggccgactcggccccctgagccccgtcatatcccagccaacaggggcgaaatcaagggaagcgagtccgcaacatacgttccagtggcgcccccaacccccgcgtggcagcctgaaattaagcccgagcctgcctggcacgatcaggacgaaacttccagcgtgaagtcggacggtgctgggggagcaagggcttcttttcgggggaggggtagaggaaggggccggggccggggacgaggcagagggggtacccgcacgcacttcgattaccagtttggctatcgcaagtttgacggagtcgaagggccgaggacacccaagtatatgaataatattacatattacttcgacaacgtgtcctctacagaactgtactcagttgaccaagagcttttgaaggactacattaaacggcaaattgaatattacttcagtgtagataacctggaacgcgattttttcctaaggcgaaaaatggacgctgatggcttcctgccaattactctgatagccagtttccatagggtgcaggccctgaccaccgacatctccttgatttttgcagccttgaaagattctaaggtggtggagatcgtggacgaaaaagtaaggcggcgcgaggaacccgaaaagtggccattacccccaatcgtggattactcccaaactgacttctcacagctgttgaactgccctgagtttgttcctcgacagcactaccagaaggagactgagagcgcgcccggcagccctagagcagttacgccggtacccacaaagacagaagaagtgtccaatttaaagacacttccgaaaggactctcagcgtcactcccagacctggattcagaaaactggatagaagttaagaagcgcccgcggcccagtcctgcaagaccaaagaaaagtgaagaatctcgctttagtcatctgacaagcttgccgcagcagttgccttcccagcaactgatgagcaaggaccaggatgagcaagaggagctggattttttgttcgatgaggagatggagcagatggacgggaggaaaaatactttcacagcgtggagcgatgaggaaagcgattacgagattgacgacagggatgtcaataaaatcctcattgtaacacaaaccccccattacatgcgccggcacccaggcggtgataggactggcaatcacacaagtagggccaagatgagtgccgaactcgctaaggtcatcaatgacggcctgttctattatgagcaggacttgtgggccgagaagttcgagccagagtactctcaaatcaaacaggaggtggagaactttaagaaagtgaacatgatcagccgtgagcaatttgacactcttaccccagaaccccctgttgaccctaatcaggaggtgccacccgggccccccaggttccagcaagtccccaccgatgccctggctaataagctttttggcgccccggagccatcaaccattgctcggtctctgcctacaactgtccccgagtcacccaactatcggaatacgcgcactccaaggacgccacggactcctcagctcaaggattcgtctcagaccagccggttctatcctgtggtcaaagagggtcggacactggatgcaaagatgcctcggtag

SEQ ID NO: 192622 - DNA, 1749 bp, Artificial Sequence
  Description of Artificial Sequence: Synthetic coding sequence
atggagaccgagagcggcaaccaggagaaggtgatggaggaggagtctaccgagaagaaaaaagaggtggagaagaaaaaaagaagtcgagtgaagcaagtactggcggatatcgccaaacaggtcgatttctggtttggagacgccaacctgcataaggatcgtttcctcagggaacagattgagaaatcgcgcgacggctatgtagacatctctctgctggtctctttcaataagatgaaaaagctgaccacagacggtaagttgattgccagagcactgagatcctccgcggtcgtcgaacttgatctcgagggaacaagaatcagacggaaaaaaccactgggcgaacggcctaaggacgaggacgaacggacagtgtacgttgagctacttcctaaaaacgtgaatcatagttggattgagcgtgtatttggaaagtgcggcaatgtggtctatatctcgatcccccactacaagagtaccggcgacccaaaaggtttcgccttcgtggagttcgagactaaagaacaggcagccaaggccatagagtttctgaacaatcctcccgaagaggccccacgtaagcccggaatatttccaaagaccgtaaagaataaaccaatccctgctctccgggtcgtcgaggaaaaaaaaaaaaagaaaaagaaaaagggacgcatgaaaaaggaggataacatccaagctaaggaggagaacatggatacatctaacacaagtatcagcaagatgaagcggtcaaggccgactagcgaggggtccgatatagaatccacagagccccaaaagcagtgctctaagaagaagaagaaacgtgatagagtagaggcatcctctctgccagaagtacgcacgggcaaacggaagaggagctcctccgaagacgccgagtcccttgccccgcggagtaaggtcaagaagatcatccagaaagatatcataaaggaggcctccgaagcaagcaaggagaatcgggatattgagatcagtacagaggaggagaaggacacaggtgacttaaaggactcatccttgctgaaaactaaacgtaaacataaaaaaaagcacaaggaacgccataagatgggagaagaagtgattccccttcgcgtactatcgaagagcgagtggatggacttgaaaaaagagtacctggccctgcaaaaagcttccatggccagccttaaaaagacaatctcacaaataaagagcgagtctgagatggagaccgattcaggtgtcccacagaacactggaatgaaaaacgagaaaacagcaaatagggaagaatgccggacccaggaaaaggtgaacgcaaccgggccacagtttgtgtcaggcgtgatcgtgaaaataataagtactgaacctctgcccggcaggaagcaggtccgcgataccttggccgctatctctgaagtattgtatgttgatctcctggagggagacaccgaatgccatgctcgattcaagacaccagaggatgctcaggccgtgatcaacgcatataccgaaatcaataaaaaacactgttggaaattagaaattctttctggagatcacgagcagcgctattggcagaaaatcctggtggacagacaggcaaagttaaaccagccgagagagaagaaacggggaacagaaaagctgattacaaaggctgaaaaaatccgcttggcaaaaactcagcaggctagtaagcacatacgcttctctgagtacgactag

SEQ ID NO: 192623 - DNA, 1749 bp, Artificial Sequence
  Description of Artificial Sequence: Synthetic coding sequence
atggagaccgagagcggcaaccaggagaaggtgatggaggaggagagcactgagaagaaaaaggaggtggagaaaaagaaacgatcaagagtgaagcaagtactcgccgatatcgcaaagcaggtcgacttttggttcggggacgccaatcttcataaagaccgcttcttaagggaacagatcgaaaagtccagagacggctacgtggatatatcactgctagtctctttcaacaagatgaaaaagctgactaccgatggcaagctcatagcccgggcattgcgctcctccgctgtcgtcgaactggacctggaggggacgcgcatccggcgtaaaaaacctcttggtgagcggcccaaggatgaggatgagcgaacggtgtacgtcgagttgctgcctaaaaatgttaaccacagctggatcgagcgtgtgttcggaaagtgcggcaatgttgtctatatttctatcccgcattataagagcacaggggatccgaaaggatttgcttttgtagagtttgagaccaaggaacaggctgcaaaagccatagagttcctgaataaccctcccgaagaggccccccggaaaccaggtatcttcccaaaaaccgtgaagaataagcctatacctgctctgagggtcgtggaggaaaaaaagaagaagaagaaaaagaagggccgcatgaagaaggaggataatatccaggctaaggaggaaaatatggatacgagcaacacctccatatcaaaaatgaagcgcagccgcccaacatctgaggggagcgacatagaatccaccgagcctcaaaagcagtgttctaaaaaaaaaaagaagcgcgaccgagtagaggcgtcttccttgcccgaggtcagaactgggaagcgcaaacggtcctcatcagaagatgccgaatccttagcaccacgctccaaggttaagaaaatcatccaaaaggacattattaaagaggcttccgaggcgtctaaggaaaatagagatattgagatctcgaccgaggaagagaaagacacgggcgatctgaaagatagtagtttgttaaaaaccaagagaaaacacaagaaaaagcacaaagaacgccacaaaatgggcgaagaggtaatccccttgagagttcttagcaagtctgaatggatggatttgaaaaaggaatacctcgccctccaaaaggcctctatggccagtcttaaaaaaaccatcagtcagatcaaatccgagtcagagatggagactgacagtggcgtaccacagaataccggaatgaagaacgaaaaaacagctaatcgagaagaatgccggacacaagaaaaagttaatgcaactggaccacagttcgtgagtggcgttattgtgaaaattatttcaactgagccgttaccaggaagaaaacaagtgagagataccctcgcagctatctctgaagtgctatatgtcgatctgcttgagggggacaccgaatgtcacgctcgatttaagacacccgaggacgcccaggcagtgatcaatgcctacacagagataaataaaaagcactgttggaaactggagattctgtcaggcgaccacgaacagcgctactggcagaagatattagtggatcgtcaggccaagctgaatcagcccagagaaaaaaagcgcgggaccgagaagttgattacaaaggctgagaagattcgcctagccaagacccagcaagcgtctaagcacatccgttttagtgagtacgattag

SEQ ID NO: 192624 - DNA, 900 bp, Artificial Sequence
  Description of Artificial Sequence: Synthetic coding sequence
atggagaccgagagcggcaaccaggagaaggtgatggaggaggagtcaaccgaaaaaaagaaggaggtggagaagaagaaaagaagcagggtaaaacaggtgttagccgacatcgctaagcaggtggatttctggttcggtgacgccaatctgcacaaagacagattcctgcgggagcagatcgagaagagccgagacggctacgtggatatttcccttctggtaagttttaacaagatgaagaagctcacgacagacggcaaactgatcgccagagcactgcgatcctctgcggtcgtcgagcttgacctggagggcactcgaatcagacgcaaaaagccccttggggagcgaccgaaggatgaggatgaacggacagtatacgttgagctgcttcccaaaaacgtgaatcactcctggattgagcgggtttttggcaagtgtgggaatgtggtgtatatctcaatccctcattataagagcacaggtgacccaaagggcttcgccttcgtggaattcgagaccaaggaacaggctgccaaagccatcgagttcctaaataatcctcccgaggaagctcctaggaaaccagggatctttcccaagaccgtgaagaataagccgatcccagccctacgggtggtggaagagaaaaaaaagaaaaagaagaaaaaaggcagaatgaaaaaggaagataacattcaggctaaggaggaaaacatggatactagtaacacatcaatcagtaaaatgaaacggtcaagaccgacttcagagggctcagatatcgaatcgaccgaaccccagaagcagtgttctaagaagaagaaaaagcgggatagggtggaagcttcctctctacccgaggtacgtacagggaagaggaaaagaagtagctag

SEQ ID NO: 192625 - DNA, 390 bp, Artificial Sequence
  Description of Artificial Sequence: Synthetic coding sequence
atggagaccgagagcggcaaccaggagaaggtgatggaggaggagtcaactgagaagaaaaaggaggtagaaaagaagaagagaagccgcgttaaacaggtgctggcagacattgccaagcaagtggacttttggtttggcgatgctaacctgcacaaagatagattcctgagggaacagatcgagaagtctagggatgggtatgtcgatatcagcctccttgtaagttttaacaagatgaaaaaattgacaacggacgggaaactcattgctcgcgcgctgcgttcatctgctgtagttgagctcgatcttgaggggacgcggatcagaaggaagaaacctctcggggagcggcccaaggacgaggacgaaagaacagtctacgtatag

SEQ ID NO: 192626 - DNA, 360 bp, Artificial Sequence
  Description of Artificial Sequence: Synthetic coding sequence
atggagaccgagagcggcaaccaggagaaggtgatggaggaggagagcaccgagaaaaaaaaggaagttgaaaaaaagaagagaagtcgggtaaagcaggttctcgccgacattgctaagcaagtcgacttctggtttggcgacgcaaacctccacaaggaccgcttcctgagggaacagattgaaaaatctcgagacggctacgtggacatttcactgctggtgagcttcaacaagatgaaaaagttgaccacagacgggaagctcattgcccgtgccttgcggtcgtctgcagttgtcgaattggacctggaaggtacacgaattcgacgaaaaaaaccccttggcgagcgcccctag

SEQ ID NO: 192627 - DNA, 1770 bp, Artificial Sequence
  Description of Artificial Sequence: Synthetic coding sequence
atgatccccaacatcgagggcatggagaccgagagcggcaaccaggagaaggtcatggaagaagaatccactgagaagaaaaaagaggtcgaaaagaaaaagaggagcagagtgaaacaagtgctcgccgatatagccaagcaggtagatttctggtttggagacgcaaatttgcataaagacagattcctgcgggaacaaattgagaaaagcagggacgggtatgtcgatatcagtttactcgtcagctttaacaagatgaagaagctgacaacggacggtaaattgatcgcaagggcattgcgcagttccgccgtggtggaattagatctggaagggactcgcataagaagaaaaaaacccctgggagagcgcccgaaggacgaggacgaacgaacagtttacgtggaactgcttccgaagaacgtgaaccactcatggattgagcgtgtttttggcaagtgcggaaacgtagtctatataagtattccccactataagagtaccggcgatcccaaaggattcgcctttgtggaattcgagacaaaggaacaggctgccaaggcaatcgaatttttgaataatcctccagaggaggcgccacggaaaccagggatttttcctaaaaccgtgaagaacaaacctatccctgcactgagggtggtcgaggagaaaaagaaaaaaaaaaagaagaaagggagaatgaagaaagaggacaatattcaagcaaaagaagagaacatggatacttccaatacatctatcagtaaaatgaagcgaagccggccgacctctgaaggatccgacatcgagagcacagaacctcagaaacagtgctcaaaaaaaaagaagaaaagggatagggtggaagcgtcatcactgccagaggtccgaaccgggaaacgaaagcgaagtagttcggaggatgcggagtcattagcacctcgctcaaaagtcaagaagataattcaaaaggacatcataaaggaggcctccgaggcaagcaaggaaaacagggatattgagattagcacagaagaggagaaggatactggcgacctgaaagactcttctttgctcaagaccaagcgcaaacacaaaaagaagcataaggagcggcataagatgggagaggaagtgattcccctaagggtcttgtctaagagcgagtggatggacctgaagaaagagtatctcgccctgcaaaaagcgagtatggcctcacttaaaaaaacaatatcccaaatcaaatccgagtcagaaatggagaccgattctggggtgccccaaaatacagggatgaagaatgaaaagacagccaacagggaagaatgtcgtactcaggaaaaggtgaacgccaccggacctcagttcgtcagtggcgtgatcgtgaaaattatcagcacagagcccctgcctggcaggaagcaggtccgtgatactctggccgcaattagtgaggttttgtatgtagatctgctggaaggcgacacggaatgccacgcccggttcaaaacccctgaggacgcccaggccgttataaacgcctacacagaaattaacaaaaaacactgctggaagctggagattctcagcggtgatcatgaacagcgatattggcagaagattctcgtggacaggcaggccaaactcaatcagccacgggaaaagaagaggggcactgagaagctcatcaccaaggccgaaaagatacgcttggctaagacccaacaggcttccaagcacataaggttctctgagtacgactag

SEQ ID NO: 192628 - DNA, 417 bp, Artificial Sequence
  Description of Artificial Sequence: Synthetic coding sequence
atgaagttcaccaccctgctgttcctggccgccgtggccggcgccctagtatacgctgaagatgcttccagtgatagcactggcgccgaccccgcacaggaggcggggacttccaaaccaaacgaggaaatcagcggccccgctgagcccgcatcaccccccgagactaccacaacggcccaagagaccagcgctgctgcagttcaaggcacagcaaaagtcacatccagtagacaggagcttaacccccttaaatcaatagtggagaagagcatcctgctcacggaacaagccctggcaaaggctggaaagggtatgcacggcggcgtgcccggtgggaagcagttcatagagaatggctctgagttcgcgcaaaagttactgaagaaattctctctgctgaaaccttgggcctag

SEQ ID NO: 192629 - DNA, 429 bp, Artificial Sequence
  Description of Artificial Sequence: Synthetic coding sequence
atgcggttcttcgtgcccctgttcctggtgggcatcctgttccccgcgatcctcgctaagcaattcacgaagtgtgagctgtcccagctcctgaaggatattgacggctacggaggcatcgcactgcccgagttaatatgtacaatgtttcacactagtggatatgacacccaggctatcgttgagaataatgaaagcacagagtacgggctgttccagattagtaacaagctgtggtgcaagtcatcccaggtgccccagagtagaaacatttgcgacatcagctgtgataaatttcttgacgatgatattaccgatgatattatgtgcgctaaaaagatcctggacatcaagggcattgattactggctcgcccacaaggctctctgtaccgagaagttggaacaatggctgtgcgagaagctttag

SEQ ID NO: 192630 - DNA, 1644 bp, Artificial Sequence
  Description of Artificial Sequence: Synthetic coding sequence
atgtaccggctgatgagcgccgtgaccgcccgggccgccgcccccggaggcttggcctctagctgtgggcgcagaggtgtgcatcagagagccggtttgcctcctctgggacatgggtgggtgggcggacttggattggggcttgggctggcccttggggtgaaattggctggtgggctccgaggcgcggcccccgctcagtctccggctgctcctgacccagaagcctctcctctggccgaacctccacaggagcagtccctggccccctggagtccacaaacccccgcccctccatgttcgcgttgttttgcgcgtgccatcgaatcctcgagagacttgctgcacagaattaaggacgaggtcggggccccggggatagtcgtaggggtttccgtagacggaaaagaagtctggtctgagggtctcgggtatgcggatgtcgaaaatcgcgtgccttgtaaacccgagaccgtgatgaggattgcgtccatctcgaaatctttgaccatggtggccttggccaaactttgggaggcggggaagctggacctggatatacccgtgcagcactacgtgcctgagttccctgagaaagaatatgaaggagagaaggtgtccgtgacaacaagattgctgatctcccatctgtcagggatccggcattacgaaaaggacataaaaaaggtgaaggaggagaaggcgtacaaggctctcaagatgatgaaagaaaacgtcgccttcgagcaagaaaaagaggggaaaagcaatgaaaagaatgactttacaaaatttaaaactgagcaggaaaatgaggctaaatgtagaaactcgaagccaggcaagaagaagaatgacttcgaacagggcgagctgtacctgcgggaaaagtttgaaaacagtatcgaaagtctgcgactcttcaaaaatgaccccttattctttaagccagggtcccagtttctgtactctacatttgggtatactctgctggctgccatcgtcgagagggcgagcgggtgtaagtacctcgactacatgcagaagatctttcacgacctggacatgctgaccacggtgcaggaggaaaatgagcctgttatttacaatcgggcacgcttctacgtttacaataaaaaaaagcggttggtgaacactccatatgtcgacaactcttataagtgggccggtggtggtttcttatctacggtgggagatctgctgaagtttggaaacgctatgctgtacgggtatcaagtcgggctgtttaaaaattcaaatgaaaatctcctcccgggatacctgaaacctgaaaccatggtgatgatgtggactccagttcctaacaccgaaatgtcatgggataaggagggaaagtacgccatggcctggggtgttgtggaaaggaaacagacttacggctcatgtagaaagcagagacactacgcaagccatacggggggagcagtaggagcctccagcgtgcttctggtactaccagaggaactcgataccgagactatcaataataaggtgccccctcgcggaatcattgttagtattatttgtaacatgcagagcgtgggcctgaactctactgctctgaagattgccctcgagtttgacaaagatcgttcagattag

SEQ ID NO: 192631 - DNA, 1122 bp, Artificial Sequence
  Description of Artificial Sequence: Synthetic coding sequence
atgtaccggctgatgagcgccgtgaccgcccgggccgccgcccccggaggtctcgccagtagttgtgggcggcgaggggtgcatcaacgggccggactaccaccactgggtcatggatgggttggcggcctggggcttggattgggcctcgctctgggggtaaagctggccggcggtctgagaggtgccgccccagcgcagtcccccgccgccccggatcctgaggccagcccactggccgaacctcctcaagaacaaagtcttgctccgtggagcccccagacgcctgctccaccatgttccaggtgtttcgcaagggctatcgagtccagtagagacttactccatcgcattaaagatgaagttggggcacccggtattgtcgtaggcgtgtcagtcgatggtaaggaagtgtggagcgagggcctgggatatgcagacgttgaaaaccgagtcccatgcaaacctgagactgtcatgcggatcgccagcatcagcaaaagtctcaccatggtggctttagcaaaactatgggaggcagggaagctagatctagatatacctgttcagcattacgttcccgagttcccagaaaaggaatatgagggggaaaaggtgtcggtgaccactaggctactgattagccacctctctggtatcagacattatgaaaaggatatcaagaaggtgaaggaggaaaaagcttataaggctctcaaaatgatgaaagagaatgtggcgttcgagcaggaaaaggagggcaaaagcaacgagaagaacgattttacaaagttcaagactgaacaggagaatgaagcaaaatgccgcaattcaaagcccggaaagaaaaaaaacgactttgaacagggggagctgtatttgagggagaagttcgagaactcaatagaaagcctccgcttgttcaagaatgaccccctcttcttcaagccaggctcccagttcctgtattccacattcggctatactctcctagctgccatcgttgagcgggcctcaggctgcaaatacttggactatatgcagaaaatcttccacgacctcgacatgttgaccaccgtccaggaggagaatgaacctgtgatctataaccgcgcccggtag

SEQ ID NO: 192632 - DNA, 5784 bp, Artificial Sequence
  Description of Artificial Sequence: Synthetic coding sequence
atggagctgagctggcacgtggtgttcatcgccctgctgagcttctcctgttggggctccgattgggagtctgatcgtaacttcatcagtaccgcaggccccctgaccaacgacctgcttcacaacttgtccggactcctgggtgaccagtctagcaacttcgtcgcaggcgataaagatatgtacgtgtgccaccagcccctccccaccttcctgcctgagtatttctcatctctccatgctagccagattacccactataaggtgttcctttcctgggcacaactgctcccagcgggtagtacccagaacccagacgaaaaaaccgtgcagtgttatagacgcttattgaaagccttaaagaccgcccgacttcagcccatggtgatcctacaccatcagaccttgcctgcaagcaccctacgtcgcactgaagcttttgccgacctctttgccgactatgccactttcgctttccactctttcggggatttagtcggcatttggttcaccttctcagacctggaagaagttatcaaagagcttccacaccaagagagtcgggcctctcagctgcaaactctgtctgacgcccatcgaaaggcatacgagatttaccacgaaagttacgccttccagggaggaaaactcagtgtggtcctgagagcggaggacattcccgagttgttgctggagccaccgatttcagcattggcccaggataccgtcgattttctgagccttgacctgtcttacgaatgtcagaatgaggccagcctcagacaaaaattgagtaagttgcagaccattgagcctaaggtgaaggtctttatttttaatttgaaactgcctgattgccctagcacaatgaagaatcctgcttcgctcctgttttccctctttgaggcaatcaataaggaccaggtgctcactatcggcttcgacattaatgaattcctgtcgtgctcttcatccagtaagaagtctatgtcttgtagcctgacaggctccttagcactgcaacccgaccagcagcaggaccacgagacaactgacagctcacccgcctcagcataccagagaatctgggaggcctttgccaaccagagtcgtgctgagagagacgcatttttacaggataccttccccgagggcttcctttggggggcatccactggcgcctttaacgtcgaaggaggatgggctgaaggtggtcgaggtgtgtccatctgggatcccagacggcctctgaacactacggaagggcaggccacactggaagtggctagtgactcatatcataaagtagcaagcgatgtagccctgctgtgcgggctccgggcccaggtgtacaaattcagtattagctggagtagaatctttcctatgggacacggctcttctcctagcctgccgggagttgcctactataataaactgatcgataggctgcaggacgcagggatcgagccaatggccacattatttcactgggacctgccccaggccttacaggatcacggaggttggcagaatgagagtgtggtggatgccttcttagattatgccgccttttgtttcagcacatttggagatagggtgaaactgtgggtgactttccatgagccatgggtgatgtcatacgcgggctatggaacaggccagcaccctcctggtatcagcgatccgggagtcgcatccttcaaagttgctcatctcgttctcaaggctcatgcccggacatggcatcattataatagccaccatcgcccccagcaacaaggacacgtcggaatcgtgctcaactctgattgggccgaaccactgagcccagagcgaccagaggacctgcgggccagcgagagatttctgcactttatgcttggatggttcgcccacccagtgtttgtggatggcgactacccggccaccctgcggactcagatccagcagatgaacagacagtgcagccaccccgttgcccagctgccagagttcacagaggcggagaaacaactgctgaaaggtagcgccgattttctgggactgtctcattacacctctcggttgataagcaatgctccccagaacacctgtattccttcgtatgatactatcgggggattcagccagcacgttaaccacgtgtggccacagacctcctctagctggatccgcgtagtgccttggggtataaggcgcctgctacaatttgtgtccctggagtataccaggggtaaggtccctatttatttggccggaaatgggatgccgatcggggaatcagaaaacctgtttgatgattcactgagggttgattactttaaccagtacattaacgaggtattgaaggccatcaaggaggattcggtggatgtacgctcatatattgcccggtctctgattgatggtttcgagggtccatccgggtacagtcagcggttcggcttgcatcatgtgaacttcagcgattcttccaagagtaggaccccgcgcaagagtgcctatttttttacatccattatcgaaaagaacggcttcctgacgaaaggcgcgaagcgactgctccctccgaataccgtcaacttgcctagcaaggtgcgtgcttttaccttccccagcgaggtgcccagcaaggccaaggtggtctgggaaaagttcagctcacaacctaaattcgagcgcgatctgttttaccatggcacttttcgcgatgacttcctgtggggggtttcatcttctgcctatcaaatcgagggagcgtgggacgctgacggaaagggcccgtccatatgggataacttcacccacacccccgggtcaaatgttaaggacaacgcaacgggagacatcgcctgcgactcgtaccaccagcttgacgcagatctgaatatgctccgggcattgaaagttaaggcctatagatttagtatatcttggagccggatcttccctacagggcggaattcatccattaatagccatggagtggattactacaatcgactcatcaacgggttagttgcgtccaatatcttccccatggtcactctcttccattgggatctgccccaggccctgcaggatataggcgggtgggaaaaccccgcgttgattgatctctttgattcatatgccgacttttgcttccagactttcggcgacagagtgaaattctggatgacattcaacgagccaatgtatctggcttggctgggctatgggagtggagagtttcctcccggagtgaaagaccctggttgggctccatatcggattgcgcacgccgtcattaaagcccacgcaagagtataccatacatatgacgagaagtaccgtcaggagcagaagggcgtgatcagtttaagtctgagcacacattgggccgagccaaaatcgcctggggtccctcgtgatgtggaagcagcagaccgcatgttgcagtttagtctgggctggtttgctcatccaatcttccgaaatggcgactaccccgacacgatgaaatggaaggtaggaaaccggagcgagttgcaacatcttgctactagtagactcccgagcttcacggaggaggagaaacggtttatacgtgccactgccgatgtcttttgcctcaatacgtactattctaggatcgtgcagcataaaaccccccgtctgaatccaccgtcctatgaagatgatcaggagatggccgaagaagaggacccatcctggccctcaacagcaatgaaccgggccgcaccttggggtacccgtcgactgctcaactggataaaagaagaatacggcgatattccgatttacataaccgagaatggggttggcttgaccaatcctaataccgaggacaccgatagaatcttttaccacaaaacatacattaacgaggcccttaaggcctaccgcctggacggcattgatctcagaggatacgtggcctggtcacttatggacaacttcgaatggctaaacggctacacagtgaagttcgggctgtaccacgtcgacttcaataacactaatagacccagaaccgccagggcttctgccagatattacaccgaggttattaccaacaacggtatgccgttggcccgagaagatgaattcctttacggaagatttcctgagggctttatctggagcgcagcttctgccgcttaccagatcgagggcgcatggagggccgacggaaagggtttgagtatttgggacactttctcccacacccccttgcgggtcgagaatgatgctattggggacgtggcctgcgatagttatcacaagatcgcagaagacttggttactctgcaaaatttaggtgtaagtcactaccgttttagtatcagctggagcagaatcctccccgatggcacaactcgctacatcaacgaggctggcctaaactactacgtaagactcattgacaccctgttggcagcttcaatccagccccaggtgacaatctatcactgggatttaccccagaccctgcaggacgttggcggctgggagaacgaaaccattgttcagcgatttaaggaatacgccgacgtgttgttccaacggctaggcgataaggtgaagttctggattacactaaatgagcccttcgtgatagcttatcagggttatggctatggaactgccgcacctggcgtatcaaatcggccaggtaccgccccgtacatcgtggggcataatctcatcaaggctcacgcagaggcgtggcatttgtataatgatgtgtatagggcgagccagggtggggttatatcaataactatcagctctgactgggcagagccacgcgatccgagtaatcaggaagatgttgaggccgcccgcagatacgtgcaattcatgggtggctggtttgcacaccccattttcaaaaacggggactacaatgaagttatgaaaacacgcattagagaccgcagtcttgctgcaggccttaacaaaagccgcctgccagagttcacagaatctgaaaagcgacggataaacgggacatacgacttctttggattcaatcactacaccaccgtgctggcatataacttgaattatgccacggctattagctccttcgatgcagacaggggtgtggccagcattgctgaccgatcgtggccagacagcggctctttctggctgaagatgacaccatttgggttccgccgcattctgaactggctgaaagaagagtataatgacccaccaatttacgtaacggaaaatggcgtttcgcagcgcgaggagaccgacctgaatgatacagctagaatatactatcttaggacctatatcaacgaagctctgaaggccgttcaggacaaggtcgacctgcgggggtatacagtctggtctgctatggataactttgaatgggcaaccggcttttctgagagatttggccttcactttgtaaactactctgacccctcgcttccccgcatacccaaagccagcgccaagttctacgcttctgtcgttcgctgtaatgggttccctgaccccgccacaggacctcatgcttgcttacaccagcccgacgctggtcccaccatatctcctgtgcgacaggaggaggtgcagtttctaggccttatgttaggcactaccgaggctcagacagccctctacgttcttttcagcctggtgctcctgggagtgtgcggtctggcctttttaagttataaatattgcaagaggtccaaacagggaaagacccagcgcagccagcaggaactgtctcctgtgtcctccttctag

SEQ ID NO: 192633 - DNA, 3012 bp, Artificial Sequence
  Description of Artificial Sequence: Synthetic coding sequence
aaggtggcccacctggtgctgaaggcccacgcccggacctggcaccactataatagccaccacagacctcagcagcaggggcacgtggggattgtgctgaatagcgattgggccgaaccactgtcaccagaaaggcctgaggatctccgtgctagtgagaggttcttgcactttatgctcggatggttcgcccatcctgtattcgttgacggagattaccccgccaccctcagaacacagattcaacaaatgaaccggcagtgcagccatccagtggcccaactgccagagttcactgaagcagagaagcagctcctcaagggatcagcggactttttgggcctgtcacattacacttcgcgattaatatcaaacgccccacagaatacgtgtattccaagctatgatacgattgggggcttctcccagcacgtcaatcacgtgtggccgcagacatcaagctcttggatccgcgtggttccatggggcattcgacgccttctgcagtttgtcagtctggaatatactagggggaaggtaccaatttacttagccggcaatggtatgcccattggtgagtctgagaatcttttcgacgactcactccgtgtggactacttcaatcaatatattaatgaggtgctcaaggccatcaaggaagacagcgtagatgtgcgctcctatatagcacggagtctgatagatggattcgaagggccgtcagggtattcccagcgttttggactgcaccatgtaaattttagcgactcatcaaaatccagaactcccaggaagtctgcctatttttttacctcaattatcgaaaaaaatggtttcctgacgaaaggcgccaagagattgctgccacccaacactgttaatctgcccagcaaagttcgcgcattcacctttccgagcgaggtcccctccaaagctaaagtcgtctgggaaaaattctcgagtcaacccaagtttgagagagacctgttttatcatggcactttccgtgatgacttcctttggggcgtgtcatcgtccgcataccagatcgagggcgcctgggacgccgacggtaagggaccatctatatgggacaattttactcacactccgggctcaaatgtgaaggataatgccactggcgatattgcttgtgacagctatcaccagcttgacgccgacctcaatatgctgagggccttaaaggtgaaggcatacaggttcagtatatcgtggtcccgcatattcccaactgggagaaactcttctatcaattcccatggagtcgattattataatcgcctgattaatgggttagtggcatcaaatattttcccaatggtaaccctgttccactgggatttgcctcaggctctgcaggatatcggcggatgggagaacccagcccttattgacctattcgacagctacgcagatttctgctttcagacctttggagacagagttaaattctggatgaccttcaatgagcccatgtacttggcttggctaggatacgggagcggcgagttcccgcctggagtcaaggatccaggctgggccccttatcgcatcgcacacgcagtcattaaggcccacgctcgtgtgtaccatacgtatgacgaaaagtataggcaggagcagaaaggggtgatttcacttagcctctcaacccactgggcggaaccaaagtcacccggtgtaccacgggatgtagaagctgccgatcggatgctgcagttctccctcgggtggttcgcccaccctatcttccggaacggcgactatcctgacactatgaaatggaaggtggggaatagaagtgagttgcaacacctggccacatctaggcttccatcattcactgaggaggagaaaaggttcatccgcgccaccgcagacgtcttctgtttgaacacttattactccaggatagtgcagcacaaaacccctaggctcaatcccccgagttacgaggacgaccaggagatggcagaggaagaagatccaagctggccgtcgacagctatgaaccgcgccgccccttggggtaccagaagactgctcaattggattaaagaagaatacggcgatataccaatctatataaccgagaatggggttgggttaacgaatccaaacaccgaggatacagaccgcatattctatcacaaaacctacattaatgaagccttgaaggcctatcgccttgacgggattgacttgcgagggtacgtggcgtggtcccttatggacaatttcgagtggctgaacggttacactgtgaaatttggcctgtaccacgtcgatttcaataacacaaataggcctcgcacagctagagcctccgcaagatactacacagaggttatcaccaataacggtatgccccttgcgcgtgaggacgaattcctctacggtcgctttcctgagggattcatttggtcagccgccagtgctgcataccagatcgaaggagcctggcgggcagatggaaagggattgagcatatgggatacattttctcacactcctcttagagtggaaaacgatgccataggcgatgtagcctgcgattcataccataagatcgcagaagatcttgttactcttcaaaacctgggggtgtcccactatcgcttcagcattagctggtctagaattctccctgatggcaccacccgttatataaatgaggctgggctcaactactacgtgagattaatcgacacacttctcgccgccagtatccaaccgcaagtcaccatctaccactgggacctcccacaaaccttgcaagatgttggggggtgggaaaatgagacaattgtccagcgtttcaaggaatatgcagacgtgctgtttcaacggcttggggacaaggtcaaattctggatcaccctcaatgagccatttgtcatcgcctatcaaggatacgggtacggaacagccgcccccgtgcacggaagattggtctgtacatcatattttcaggagtggcgtctgcaatag

SEQ ID NO: 192634 - DNA, 1005 bp, Artificial Sequence
  Description of Artificial Sequence: Synthetic coding sequence
atggccaccctgaaggagaagctgatcgcccccgtggccgaggaggaggctacggttcccaataacaaaatcacggtcgttggcgtagggcaggtcggcatggcatgcgctatctcaatcctcggaaagtctctggccgacgagctggctctggtcgacgttctcgaggacaagctcaagggcgagatgatggatctgcagcacggcagcctgtttctgcagactccaaagatagtggctgacaaggattacagtgtgactgccaatagcaaaatagtggtcgttaccgcaggggtgaggcagcaggagggtgagagccgcctcaatctcgtccaacgaaacgtcaacgtgttcaagtttattatccctcagatcgtgaaatatagcccggactgtatcatcattgtggtgtcgaatcctgttgatatcctcacctatgtaacctggaaattgagcggcttgcctaagcaccgggtgataggaagcgggtgtaacctggattccgcacggttcagatacctgatggccgagaagttagggatacacccatcttcctgtcatggatggatattgggcgaacacggcgacagtagcgtcgcagtttggagtggggtaaacgtggcaggcgtaagcctgcaggaactaaatccagagatggggactgataacgactctgagaattggaaagaggtgcataagatggtagttgagtctgcatatgaagtgatcaaactgaaaggttacacgaactgggccatcggattgagcgtcgctgatttgatcgagtcgatgctgaaaaacctttcccgaattcaccccgtgagcacgatggtgaaagggatgtacggcatcgagaacgaggtgtttctctccctgccatgtatccttaacgctcgcgggctaacctctgtgatcaaccagaagctgaaggacgacgaagtagcccagcttaagaagtcagctgacacactatgggatatccaaaaagatctgaaggacttgtag

SEQ ID NO: 192635 - DNA, 699 bp, Artificial Sequence
  Description of Artificial Sequence: Synthetic coding sequence
atggccaccctgaaggagaagctgatcgcccccgtggccgaggaggaggctacggtgccaaataataagatcaccgtagtcggtgtaggacaagtcggaatggcgtgtgctataagcatccttggaaagtccctggccgatgagctagccctcgtcgatgtgctggaagacaagttaaaaggtgagatgatggatctccagcacggtagcctgtttcttcagacccccaagattgtggcagataaggattacagtgtgacagctaacagtaaaatcgtggtggtgactgccggggtgaggcagcaggagggcgaaagcagactcaacctagtccaacgcaacgtcaatgtgttcaagtttattatcccacagatcgtgaagtattctcccgactgcataataatagttgtatcaaacccagttgacattctcacatatgtgacatggaagctctccggattaccaaagcacagggtcataggctctggctgcaaccttgattcagccaggttccgttatctaatggccgaaaaactcggaatccatcctagctcctgtcatggttggatcctgggagagcatggcgattctagtgtagccgtgtggtctggggtaaacgttgccggagtgtctctgcaggagcttaatcccgagatgggtaccgacaatgactccgaaaactggaaagaggtacactag

SEQ ID NO: 192636 - DNA, 1005 bp, Artificial Sequence
  Description of Artificial Sequence: Synthetic coding sequence
atggccaccctgaaggagaagctgatcgcccccgtggccgaggaggaggccaccgttccaaataataagatcacagtcgtgggagtgggccaggtgggcatggcctgtgcaatcagtattttagggaagtcgctggcagacgaactggctcttgtggatgtcttggaggacaagctcaagggcgaaatgatggatctgcagcatgggtctctgttcttgcaaaccccaaaaatagttgctgacaaggactattccgtcacagcgaattcgaagatcgtggtagttaccgccggtgttcgccaacaggaaggggaaagccggctgaacctggtgcagcgaaatgtgaatgtgttcaagttcattatcccacagatcgtgaagtacagcccggactgcataataatcgtagtgtccaatccagtggatatcctcacttatgtcacttggaagctaagcggtctgcccaagcacagggtgatcgggagcggatgtaacctggacagcgctcgcttccgatacctaatggctgagaaactaggaatccacccatcttcctgtcatgggtggatattaggagagcacggtgactcaagcgtagccgtgtggagcggggtaaatgtggctggggttagcctgcaggagctaaatccagaaatggggacagacaatgacagtgagaactggaaagaggtgcacaaaatggtggtcgagtctgcctacgaggtgatcaagctgaaagggtatacgaactgggcaataggtctgtccgttgcagacctgatagaatcgatgttgaagaatctgtcacgcattcaccccgtgtcaacaatggttaaaggaatgtatggaattgagaacgaggtgtttctgtctcttccctgtatcctgaacgcccgaggacttacatctgtgatcaaccaaaagcttaaggatgacgaggtagcacagttgaagaaatcagcagacacgctgtgggacatccagaaagacctgaaagatctttag

SEQ ID NO: 192637 - DNA, 414 bp, Artificial Sequence
  Description of Artificial Sequence: Synthetic coding sequence
atggccaccctgaaggagaagctgatcgcccccgtggccgaggaggaagccactgtgcccaacaacaaaattacggtggtaggcgtcggacaggtgggaatggcctgtgctatcagtatccttggcaaatcactagccgatgaactcgcgcttgtcgacgtcctggaggataaattaaagggagaaatgatggatctgcagcacggtagtctgtttctgcaaactccgaagatcgtggcggataaggattatagcgtaacagctaactcgaaaatcgtggtagtcacagcaggagtgaggcagcaggagggagaatcaagactgaacctcgtgcagcgcaatgttaacgtctttaagttcatcatcccccagatcgtcaagtacagtcctgattgcatcatcatcgtggtgtag

SEQ ID NO: 192638 - DNA, 309 bp, Artificial Sequence
  Description of Artificial Sequence: Synthetic coding sequence
atggccaccctgaaggagaagctgatcgcccccgtggccgaggaggaagccactgttcctaacaacaagataacagttgtaggcgtgggccaagtgggcatggcgtgcgctatctccatactgggaaaaagcctcgcggatgagcttgcactggtggatgtgctggaggacaagctcaaaggagaaatgatggacctgcaacacggctctctgttcctgcagacacctaaaatcgtggccgacaaggactactcagtcacagcaaacagtaagattgtcgttgtgacagcaggtgtccgtcagcagtag

SEQ ID NO: 192639 - DNA, 999 bp, Artificial Sequence
  Description of Artificial Sequence: Synthetic coding sequence
atgagcaccgtgaaggagcagctgatcgagaagctgatcgaggacgatgagaatagccagtgcaaaatcactatagttggcacgggcgccgttggcatggcctgcgcaatctctattctgctgaaggacctggcggacgagttggccttggtagacgtggcactcgacaaactgaagggagaaatgatggacctgcaacatggatctctctttttcagcacatccaaaataacctccggtaaagactattcagtcagtgccaattcacgaattgtgatagtgaccgctggtgcaagacaacaggagggcgagacacgcctcgcactggtacagagaaacgtggcaataatgaagagcatcattccggccatcgtgcactacagtccagattgtaaaatcctcgttgttagcaatccagtggacattctgacatatatagtgtggaaaatatctggccttcccgttacaagagtcattggatccgggtgtaacttggattcagcacgcttccgatacctcatcggcgagaagctgggcgttcaccctaccagctgtcacgggtggattatcggtgaacatggagatagcagtgtgcctctgtggtcaggagtcaatgtcgccggcgtggctctgaaaaccctggaccccaaattaggaactgattctgataaagagcactggaagaatatccacaagcaagtgatacagtccgcctacgagatcattaaactcaagggttacacatcctgggctatcggattgagcgtgatggacctggtaggctctatattgaagaacctccgccgtgtgcatcccgtgagtaccatggtcaaaggtctgtacggcatcaaggaggaactgtttctgagtattccttgcgtgctcggtcggaatggtgtctccgacgtggttaaaatcaaccttaattctgaggaggaggctctgtttaagaaaagcgccgagactctgtggaacatccagaaagacttgatcttttag

SEQ ID NO: 192640 - DNA, 999 bp, Artificial Sequence
  Description of Artificial Sequence: Synthetic coding sequence
atgagcaccgtgaaggagcagctgatcgagaagctgatcgaggacgacgagaattcccagtgcaaaatcaccatcgtgggtacaggagctgtggggatggcctgcgcaatatccatccttttaaaagacttggctgatgaattggccctggtggatgtagcacttgacaaacttaagggggagatgatggatttgcagcacggcagcctcttcttctcaaccagcaaaataaccagtgggaaagactacagtgtgagcgctaacagccgaattgttatcgtaaccgccggagctcgtcagcaggaaggggagacccgacttgctctagtgcagagaaatgttgccattatgaagtccatcattcccgccatcgtgcactattcccccgactgcaaaatcctggtcgtatccaacccggtggacattctgacatacatagtgtggaaaattagtggcttgcccgtgactagggttatcggttccggttgtaacctggacagtgccaggtttagatatttaatcggagagaagctcggcgtgcacccgacgtcttgccatggctggatcatcggtgagcacggggactcctctgtgccactctggagcggcgttaatgttgcaggcgtggccctgaaaacactcgatcccaagctgggcacagattccgataaagagcactggaaaaacattcacaagcaagttatccaaagcgcatatgaaatcatcaagctgaaaggctacacaagttgggcaatcggcctgtcagtcatggacctcgtcgggtctatcctgaagaacctcagacgggttcaccctgtgtctaccatggtgaagggactgtacgggattaaggaagagctattcttgtccataccgtgcgtcctgggaagaaatggggtgagcgacgtggtcaaaatcaacctcaattctgaggaggaggccctattcaaaaagtcagctgaaactctgtggaatattcagaaggacctaatattttag

SEQ ID NO: 192641 - DNA, 1524 bp, Artificial Sequence
  Description of Artificial Sequence: Synthetic coding sequence
atggcccggctgctgcggagcgccacctgggagctgttcccctggagagggtactgctcccagaaagccaagggagagttatgccgagatttcgtggaagcgctcaaggctgttgtgggtggttctcacgtaagcactgcagccgtcgttcgcgagcaacacgggcgggacgagagcgtccacagatgcgagccccctgacgcagtcgtatggcctcaaaacgtcgaacaggtgagtaggcttgccgctctttgctataggcaaggagtgcccattataccattcgggacgggcacaggcctggagggcggggtatgtgcagtacaaggcggcgtctgtgttaacctcactcatatggataggatcttggagctgaaccaggaagacttttctgttgtggtggagccgggcgtgactagaaaagcactgaatgctcacctgagagactcaggactgtggtttcccgtggaccccggagcggatgcatcgctgtgtggaatggcagcgaccggcgccagcggcaccaatgccgtgcggtacggcaccatgcgcgataacgtcctgaatttggaagtggtgctgcctgatgggcggctgctccatactgccggtagaggtaggcattttagatttgggttctggcctgagataccccatcacacagcctggtattccccctgtgtgtctctgggccgtcgtaaatccgcagcaggatacaaccttacaggcttatttgttggttctgagggcacactgggtctgatcactgcaacaaccctgaggctccacccagcacctgaagcgacagtggcggcgacttgcgcgtttccatccgtgcaggccgccgtggacagcactgtgcatatcttgcaggcagccgtccccgtggcgcggatcgaatttctggatgaggtcatgatggacgcctgtaacagatactcgaagctcaactgtctggtcgcccccactctcttcttagaatttcatggcagccagcaagcgctcgaggaacagctccagaggaccgaagaaattgtgcagcagaatggggcctcggatttttcatgggctaaggaggcggaggaacgaagcaggctgtggacagcgagacacaatgcttggtacgctgcactggcaactcgccctggctgtaagggttactcgaccgacgtatgcgtgcctatcagcaggctgccagagatcgtagtgcagaccaaagaggacctaaacgcatcaggtttaacagggtccatcgtcggacacgttggcgacggaaatttccactgtattctgttggtaaatcctgacgacgccgaggagttgggtagggtgaaggcattcgccgagcagctgggccgcagggccctggcgctgcacggcacttgcactggcgagcatgggattggaatgggcaaacggcaactattgcaggaagaagtaggagctgtcggggtggagacaatgagacagctcaaagcagttttagatccgcagggtcttatgaaccctggaaaggtgctctag

SEQ ID NO: 192642 - DNA, 1455 bp, Artificial Sequence
  Description of Artificial Sequence: Synthetic coding sequence
atggcccggctgctgcggagcgccacctgggagctgttcccctggcggggctattgtagtcagaaggcaaaaggggaactttgtcgggactttgtcgaggccctcaaagctgtggtgggcggcagtcacgtctcaacggcggcagttgttagagagcagcatggacgcgacgagagcgtccataggtgtgagccgcctgacgctgtcgtgtggcctcagaacgtagagcaggtgagcaggctggccgcactgtgttacagacaaggagttccgattatccctttcggcactgggaccgggctcgaggggggggtatgtgcagtgcagggcggggtgtgcgtgaacctgacgcatatggaccggatccttgagttaaaccaggaagatttcagcgttgttgtagaacctggcgtaacacggaaagcgttgaatgcccacctgcgggacagcggtctgtggttccccgtcgatcccggtgcagacgccagcttgtgcggtatggccgcaacaggagccagcgggacaaatgccgtacgttatggaaccatgagggacaacgtcctaaacctggaggtcgtcctccccgacggcaggctgctccacaccgccgggcggggacgacatttcagaaagtcagcagctggctataacttgacagggctattcgtggggtctgaaggaacactgggattgatcaccgctacaacattacgcctgcaccccgcgcccgaggccacagtggccgctacatgcgctttccccagcgtgcaagccgctgtggacagcaccgtccatatcctgcaagccgctgtccccgtcgcccggatcgaattcttggatgaggttatgatggacgcatgcaacaggtactccaaactgaactgtctggtcgcccctaccctgtttctcgaattccatgggtcacagcaggccctggaggagcagctccagagaaccgaggaaattgtgcaacagaatggggcttccgatttcagttgggcaaaagaggccgaggaacgaagccggctgtggacggcccggcacaatgcttggtacgccgcgctggcaacccgccccggttgcaaaggctacagcactgacgtgtgcgtgccaatctcccgtctcccagagatcgtagtacaaacaaaagaggatctgaatgcatcaggactgacaggaagtatagtcggacacgttggagatggaaacttccattgcattctgctggtcaaccctgatgacgccgaggaattggggcgggtgaaagcatttgccgagcaattaggaagacgcgccttagctcttcatggaacttgcactggcgaacacggcatcggcatgggcaagaggcagctgcttcaggaggaggtgggtgctgtgggcgtggaaaccatgcgtcagttgaaagccgtattggatcctcaaggcctgatgaatccaggcaaggtgctgtag

SEQ ID NO: 192643 - DNA, 2139 bp, Artificial Sequence
  Description of Artificial Sequence: Synthetic coding sequence
atgcgggtgctgctgcacctgcccgccctgctggccagcctgatccttctccaagccgccgcatctacgacaagagcccagacgacacgcacctccgccatatccgacactgtgtcgcaggcaaaagtgcaagtgaacaaggcctttctggattccaggactcggctgaagacagctatgtccagcgaaacgcccacgtcgcggcagttgagcgaatacctcaagcatgcaaagggacgcacacgtacagctattagaaacggacaggtgtgggaggagtcactaaagaggcttagacagaaggcttccctgactaatgtgactgatcccagtctcgacttgacctcgctttcactggaggtgggatgcggtgcgccagctcctgtagtccgctgcgacccctgctctccttacaggactatcacaggagattgcaacaaccgccgcaaaccagctcttggcgccgcgaaccgggcgcttgcccggtggctgcccgccgagtatgaggacggcttgtccctccctttcgggtggaccccaggcaagacacggaatggatttccactgcccctggccagagaggtgagcaataagatcgtgggctacctgaacgaagaaggagttcttgatcaaaatagatcactcctgtttatgcaatggggtcaaatagtggatcacgatcttgattttgcacccgacaccgagctcggaagctctgaatacagcaaagcccagtgcgatgagtactgcattcagggcgacaattgctttcctatcatgtttccgcccaacgacccaaaggcgggaacccaggggaaatgcatgccattcttccgtgctgggtttgtgtgtccgactccgccatacaagagtctggcaagagagcagatcaacgccctgacctccttccttgacgcgtcatttgtatactcgtcagaaccaagcctggcaagccggctcaggaatctatcatcacctcttggcctgatggccgtaaatcaggaagtctctgatcacggcctcccttacctcccttacgacagcaagaagccttcaccctgtgaattcataaacacaacagccagggtgccatgctttttggcaggggatagtcgcgcctccgagcacatcctacttgcaacttcccataccctgtttctccgggaacataatagactggcacgggagctcaagcggctgaatccacaatgggacggcgagaaactgtatcaggaagcacgaaaaatactcggagcatttgtacaaatcataacttttcgggactatctgccgatcctgcttggggatcatatgcaaaaatggatcccaccataccaggggtattccgaaagcgtagatcctaggatctcaaacgtgttcacatttgcattccggttcggtcatctggaggtgccaagtagcatgttcaggctggacgagaattaccagccctggggtcccgagcctgaattacctttacataccctttttttcaacacttggagaatggtcaaggacgggggtatcgatcccctcgtccgtggacttctggccaagaagtccaagctcatgaaacaaaataagatgatgaccggagagcttaggaataaactctttcagcctacgcatcgcatccacggctttgatctggccgctataaatactcagcgttgccgggatcacggacagcccggttataactcctggcgggccttttgtgatttgtcccagccccaaaccctggaagaactcaacactgtgctgaagtccaagatgttggccaagaagttactgggcctgtatggcactcccgacaacatcgatatatggattggggctattgcagagcctttagtggagcgaggtcgtgtgggtcccctcctggcctgtttattaggtaaacagttccagcaaattagggacggcgatcgcttctggtgggaaaatcccggagtgttcacaaatgagcagaaggattccctgcaaaagatgtcattctcacggctcgtttgtgataacacacggataaccaaagtccctagggaccccttctgggcaaactcctacccctacgactttgtggattgcagcgcaatagacaaactggatctgagcccttgggcctcagtcaagaactag

SEQ ID NO: 192644 - DNA, 1374 bp, Artificial Sequence
  Description of Artificial Sequence: Synthetic coding sequence
tgcttccccgtgcagttcccccccaacgaccccaaggccggcacccaggggaaatgtatgcccttcttccgcgcagggttcgtctgtcccaccccaccatataaaagtctcgctagagagcagattaatgctttgacctcttttcttgatgctagcttcgtgtacagtagcgagcccagtttagcttcccgcctgcgaaatctgtcttcccccctcggtctgatggcagtgaatcaagaggtgtcagatcatggactcccatatctgccctacgatagtaaaaaaccaagtccttgtgagttcatcaacactaccgcgcgagtcccttgcttccttgcgggtgacagccgggcgtctgagcatatcctccttgccacatcccacacgctgttcctcagggaacacaaccgcttggctcgggaactgaagcggctgaatccccagtgggacggagaaaagctgtaccaggaggcccggaaaatccttggtgcgtttgtgcagattatcaccttcagagattacctgccaatactactaggggatcatatgcagaaatggatccctccataccagggctacagcgagtctgtggaccccaggattagcaacgtgtttacttttgccttccggtttggtcatctggaggtgccatcttcaatgttccgtcttgacgaaaattaccagccatgggggccagagccagagcttccgctgcacaccctctttttcaatacctggcgcatggtgaaggacggcggcatagacccgctcgtgagggggcttcttgctaaaaagtccaaactcatgaagcagaataagatgatgacaggcgagttacggaacaagttattccaaccgacgcatcggatacatggtttcgacctggcagctattaacacccagcgctgtcgagaccatggacaacctggctataacagctggagagccttctgcgatctcagccagcctcaaacgctggaagagttgaacaccgtcttgaaatccaaaatgctggccaaaaagctcctaggactctacggaacacccgacaatatcgacatttggattggagccattgctgaacctctcgtcgaaagaggacgggtggggccattactcgcctgcctcctcggcaaacagttccaacagatcagggacggcgaccgattctggtgggagaaccccggggtgttcaccaatgaacagaaagattcgctacagaaaatgagctttagccgcctcgtttgcgacaatactcggatcacgaaagttccaagagatcccttctgggccaactcctacccttacgacttcgtcgattgctctgcgatcgacaaactggacttaagcccctgggcatccgtgaagaactag

SEQ ID NO: 192645 - DNA, 1890 bp, Artificial Sequence
  Description of Artificial Sequence: Synthetic coding sequence
atgcgggtgctgctgcacctgcccgccctgctggccagcctgatcctgctacaggcagccgctagtaccacccgtgacccttcactagacctaactagcctaagtctggaagttggttgtggcgcccctgcgcctgtcgtgagatgcgatccatgctcaccttaccggacaatcacaggggactgcaataatcgccggaagccggctctgggtgcagccaatcgcgcactggcgcggtggttgcctgcagaatacgaggatggtctgtctcttccctttggctggacacctgggaaaacccgaaatggcttccccttgcccctggctagagaggtgagcaacaagattgtcggctatctgaatgaagagggcgtacttgatcaaaataggtccctcctattcatgcaatggggacagatcgttgaccacgacctggattttgctcccgacacagagctagggagctccgagtactcaaaagcccaatgtgacgagtattgcatccagggagacaactgctttcctataatgttcccccctaatgatcctaaagcgggcacacagggaaaatgtatgccatttttcagggctggcttcgtttgcccaactccgccttacaagtccctagcaagggagcagattaatgccctcaccagttttctagatgccagttttgtgtactcaagtgagccgtctcttgcttcacgtctacgtaacctgagtagcccgctggggctcatggctgtgaaccaggaagtctcggatcacggtttgccatatctgccctacgattcaaagaaaccctctccatgtgaatttatcaacacaactgcacgcgtgccgtgttttctagcaggagattcaagagcatccgagcatatcctattagccacatcacacactctgtttttgagagagcataaccgactggctagagagctgaagagactaaacccccaatgggacggagagaagctgtaccaggaggcgcgcaagatacttggcgcctttgtccagattatcacattccgagactatttaccaattctcctgggcgatcacatgcagaaatggattccgccatatcagggctattccgagtctgtggatccccgtatcagtaacgtgttcaccttcgcttttcgtttcggtcatttggaagtgccatcctctatgttccgcttagacgaaaactaccagccctggggtcccgaacccgagttaccgctgcacaccctcttctttaacacctggcgtatggtgaaggatggtggcattgaccctctcgtccgcgggctgctcgctaagaagtccaaattgatgaaacagaataagatgatgactggcgaactcaggaataagctcttccaaccgactcatcggatacacggttttgacctggccgcgatcaacacccaaagatgcagggaccacgggcagccaggatacaactcctggagagccttttgtgaccttagtcagcctcagacattggaggagctgaataccgtcctcaaatctaaaatgctggccaagaaactgctggggctatatggcacccccgataacatcgacatctggataggcgcaatagctgagcccctcgtggaacgaggacgtgtgggccccctgctcgcctgtctcttgggtaagcaatttcagcagatccgggacggggatcggttttggtgggagaatcctggtgtgtttacgaacgagcagaaggattccctgcaaaagatgtcgttttctaggttggtttgcgacaatactcgcatcactaaagtccctagagatcccttttgggctaacagctatccctatgatttcgtggattgcagtgcgatcgataagctggacctgagcccttgggctagtgtcaagaattag

SEQ ID NO: 192646 - DNA, 1962 bp, Artificial Sequence
  Description of Artificial Sequence: Synthetic coding sequence
atgagcagcgagacccccaccagccggcagctgagcgagtacctgaagcatgcaaagggccgcacacggaccgcaatccgtaatgggcaagtatgggaggagtctctgaagcggctccggcagaaagcctcactcacgaatgtcaccgatcccagtcttgatctgacatctctttcactggaagttgggtgtggcgctcctgcgcccgtagtgcgctgtgacccatgttccccttacagaacaatcaccggagattgcaataacagacgcaaaccagccctgggcgctgcgaaccgggctctagcccgctggttgccagccgaatacgaagatggacttagtctgcccttcgggtggaccccggggaagactcggaatggatttcccctgccactggccagagaagtcagcaataagatcgttgggtacctgaatgaggagggggtgctcgaccagaatcgctcactgcttttcatgcagtggggacagatcgtagatcatgacttagatttcgctccagacacagaactggggtcttcagagtacagcaaagcacaatgtgacgagtattgtattcagggggacaactgtttccccatcatgtttcctcccaacgatcccaaggccgggacacagggcaaatgcatgcccttctttcgggccgggttcgtgtgtccgacccccccttataagagtctcgcccgcgaacagatcaacgccctgacctcgttcctggatgctagctttgtctactcatcagagccatcacttgcatcacgcctgaggaatctctcatcccccctgggattaatggctgtcaaccaagaggtatccgaccatggactgccctacttaccatacgactctaagaaaccatccccttgtgaattcattaataccaccgctcgcgtgccttgtttcctggccggagacagccgggcaagtgagcatattctgttggctacctctcataccctgttcctgagagaacataatcgcctagcaagagagctcaagaggctcaacccacaatgggacggggagaagctatatcaggaagctcgcaagatcttgggagcctttgtgcaaattattacatttcgagattacttgccgatccttctcggagaccatatgcagaagtggatcccaccttatcagggctattccgaaagtgtagaccctagaattagcaacgtgtttacctttgccttcagatttgggcatctagaggtcccatcttctatgttccggctggatgagaattatcagccctggggccctgagccagaactgcctctgcacacactatttttcaatacttggcggatggtgaaagacgggggtatcgatccccttgtgaggggcctgttagccaagaagtctaaattaatgaagcagaataagatgatgacaggagagctaaggaataagctgttccagccaacacacagaatccacggatttgacctcgccgcaatcaacacacagcgatgtcgagaccacgggcagcccggatacaactcatggcgcgccttttgcgatctgagccagccccagacattggaagaattaaacacagtgctaaaaagcaaaatgctggccaagaagctgcttggtctatatgggacacctgataacatcgacatatggatcggagctattgctgaaccactagtggagagaggccgagtggggccacttctggcttgcctattgggaaagcaattccagcagattagggatggcgataggttttggtgggagaacccaggtgtgtttacaaatgagcagaaggatagtcttcagaagatgtcattttctcgattggtctgtgataacacacggatcaccaaggtccctagagaccccttttgggccaattcatacccatacgattttgtcgactgttccgcaatcgataagctggaccttagcccttgggcttctgtcaagaactag

SEQ ID NO: 192647 - DNA, 1323 bp, Artificial Sequence
  Description of Artificial Sequence: Synthetic coding sequence
atgggcgacctggagctgctgctgcccggcgaggccgaggtgctggtgcgggggcttagaagcttcccattaagggagatgggatctgaaggctggaatcaacagcacgagaatctcgagaaactcaacatgcaggcaatcctagacgccacagtctctcagggggagcccatacaggagcttctggttacacatggcaaggtgccgaccctggtggaggagttaatcgcagtggaaatgtggaaacagaaggtctttccagtcttctgtagggtggaggatttcaagcctcaaaatacatttcccatctatatggtcgtacatcacgaagcgagcatcatcaacctgctggagaccgtgttcttccataaagaagtgtgcgaatctgcggaagataccgtactggacctcgttgattactgtcacagaaaattaactttgctagtcgcgcaaagcggttgcggggggcccccagagggcgagggcagtcaggactctaatccaatgcaggagctgcagaagcaggctgagctgatggagtttgaaatagcgctgaaggcactgagcgtactgcggtacatcactgattgcgtcgacagcctgagtttatcgactctttctcggatgctttcgacccacaatctgccttgtctgttggtggagctacttgagcactcaccttggtcaagacgggaaggcgggaagctgcaacagttcgaagggtctcggtggcacaccgtggctcctagcgagcagcagaaactctcgaagctcgatggtcaggtctggatcgccttatacaatttactgctgagtcccgaggcacaagcacggtactgcctgacctcatttgctaagggccggttgctaaagttaagagcatttctcacggacaccctcttagatcagcttcccaatttggctcacctgcaatccttcttggcgcacctgacccttaccgagacccagcccccaaaaaaggatcttgtcttggagcagattccagaaatctgggaaagacttgaacgcgagaatagaggcaaatggcaagcaatagctaagcaccagttacagcacgtcttcagcccttccgagcaggatctccggttacaggctcgcagatgggctgaaacctatcgtctcgacgttctcgaggcggtggcaccggagcggcctaggtgcgcttactgctccgcagaagccagcaaacgatgttccaggtgccagaatgagtggtactgttgcagagaatgtcaagtgaagcattgggaaaaacatggcaaaacctgcgtgctggccgctcaaggtgacagggcaaaatag

SEQ ID NO: 192648 - DNA, 2001 bp, Artificial Sequence
  Description of Artificial Sequence: Synthetic coding sequence
atgcggaaggtgcggggcccccccgtgagctgcatcaagcgggactcacccatccagtgcattcaggccatcgccgagaaccgcgcagacgctgtaactcttgacggcgggttcatctacgaagctggattggccccctacaagcttcggcccgtcgccgccgaagtgtatggaacagaaagacagccaagaacacactattacgccgtagccgtcgtgaagaagggcggaagctttcaactgaatgagctccagggcttgaaatcatgccacactggccttcggcgcacagctggttggaacgtgccaattggaactctacggcccttcctaaattggacaggccctccggagcccatcgaggcagccgtagcaaggttcttttcagcatcatgtgttcctggggccgataaagggcagtttcctaacctctgtagactttgtgctgggacaggagaaaataagtgtgcatttagctcccaggaaccttactttagttactctggtgcctttaaatgcctcagagatggggccggcgatgtggcctttatacgggagtccaccgtttttgaggatctctccgatgaggccgagcgtgatgagtatgaattgctctgtcccgataatacaagaaaacctgtggacaagtttaaagactgccatttagccagggttccctcacacgccgttgtcgcgagaagcgtaaacgggaaagaggacgcgatttggaatctgctgcgacaggcccaggaaaaattcggtaaggacaagtcacccaagtttcaactgttcggctctccctcaggccagaaggacttgcttttcaaggactccgccatcgggttttctcgggttccacccaggatcgacagcggcctgtatctcgggagcggctattttacagctattcaaaacctgaggaagagcgaggaggaagtcgccgcccgaagagcacgtgttgtttggtgtgccgtcggcgaacaggagctccgaaagtgcaaccagtggagtggactgtccgaaggcagcgtgacttgcagctcagcctctaccacggaagattgtatcgctttagttctcaaaggggaggcagatgccatgagcctggacggtggttatgtgtacactgcaggcaagtgcggactggtgccagtactcgctgaaaactacaaatcccaacaatcttcggatcctgaccccaattgcgtggacagaccagttgaaggatacctcgctgtggccgttgtgaggcggtccgatacaagtttgacctggaactctgtcaaaggcaagaagtcatgtcacactgctgtggatcgtaccgccgggtggaatattcccatgggcttgctattcaaccagacaggttcctgtaagtttgacgagtacttttctcagtcatgtgctcccggcagcgaccccaggtcaaacctgtgcgccctttgtatcggggacgaacaaggggaaaataaatgtgtgccaaactccaacgaaagatattatggatacactggcgcattccgttgcttggctgaaaacgctggagatgtggcatttgtgaaagatgttacagtccttcagaacaccgatggcaacaataatgaagcttgggcaaaggatttaaagctggccgacttcgccttgctgtgcctagacgggaagcgcaagccggttactgaagcacgatcctgtcatcttgcaatggcgcctaaccacgccgtagtgtcacggatggataaggtcgagagattaaagcaggtgttactgcaccaacaggctaagtttgggaggaacggctctgactgtcctgacaaattttgcttatttcagagtgaaacaaagaacttgctgtttaacgataataccgaatgcctggcccggctacatggcaaaaccacttacgaaaagtatctgggtccgcaatatgtcgccggaattacgaatctgaagaagtgctccacatctcccttgctcgaggcctgcgaatttctacgtaagtag

SEQ ID NO: 192649 - DNA, 453 bp, Artificial Sequence
  Description of Artificial Sequence: Synthetic coding sequence
atgaagctggtgttcctggtgctgctgttcctgggcgccctgggcctgtgtttggccggccggcggcggtctgtccagtggtgcgcagtctcacagcccgaggcaacaaaatgcttccagtggcaacgtaatatgcgcaaagtgagagggcctccagtgtcatgcatcaaacgcgactccccaatccaatgcatccaagcaatcgccgaaaatcgcgcagacgccgtgactctggacggcggattcatctatgaggcgggactggctccttacaagcttcgaccggttgccgcagaggtgtatggaactgagagacagcccgctgtgtttcccgtgcaaataaaagactcatcacctacctgcgtggcatgcgttcggggtcaggggaagacaaatgttccgtctccaccccggaatcgtacttccgcaactctggttccatctagcgtgtag

SEQ ID NO: 192650 - DNA, 846 bp, Artificial Sequence
  Description of Artificial Sequence: Synthetic coding sequence
atgaccagcaaggaggacggcaaggccgcccccggcgaggagcggcggcgatccccgctagaccatctgcccccacctgctaacagtaataagcccttaacccctttctctattgaggacattctaaacaaaccaagcgtgagacggagttacagcctgtgcggtgctgcccacctgctcgccgccgcggacaagcatgcccaaggaggactgcctctggccggccgggccttgctgagccagaccagcccactctgtgctctagaagagttggcctccaagacctttaagggactggaagtatccgtgctgcaggcagccgagggaagagatggaatgacaatatttggtcagcgccagacacctaagaaacggagaaagtcccggacagcattcacgaaccaccaaatttacgagctcgaaaagcgtttcctttaccagaaatatctctcaccggccgatcgcgatcaaattgcccagcagctgggtctcacaaatgctcaggtgatcacgtggtttcagaaccgccgcgccaagctgaaacgggatctagaggagatgaaggccgatgtggaaagcgccaaaaagctcggcccgagcggccagatggacatcgtggcgttggctgagctagaacaaaacagcgaagccacggcaggaggagggggcggttgtggccgcgctaaaagtcgccctgggtcccctgttctccctccaggcgccccaaaggcgcccggagcaggcgccctgcagctgagcccagccagcccactgacggaccagcccgcctcttctcaggattgctctgaagatgaagaagatgaggaaattgatgtagacgattag

SEQ ID NO: 192651 - DNA, 597 bp, Artificial Sequence
  Description of Artificial Sequence: Synthetic coding sequence
atgaacagcggccgggagccccggaccccccggaccctgctgagcattgcggatatcctggctccacggatggtgcctcgagcaccctctgcacctcagcttccagagtccgggcccgggccaacttcccctctatgtgcgctggaggagctgacttctaagactttccgggggttagatgctcgagccctacagccgtcagagggcagggctgggcccgacgccctgggaccaggtccatttggccggaagagacgaaagtcgcgaacggcctttaccgcccaacaggtgttggagctcgaaagacgctttgtgtttcaaaaatatctggcacctagcgaacgggacggcctggctacacgtcttgggctggccaacgctcaagtagttacctggtttcagaataggagagccaagctcaaaagagatgtggaggaaatgcgcgctgacgtggcctccctgagagctctgagtcccgaggttttgtgttcgctggctcttccagagggtgctcctgacccaggcctgtgcttaggccctgccggaccagattcgcgcccacacctgagtgacgaagagatccaggtggacgattag

SEQ ID NO: 192652 - DNA, 585 bp, Artificial Sequence
  Description of Artificial Sequence: Synthetic coding sequence
atgggcaagcggaccagcctggaggtgagcctgggcgagctgggcggcgagaagtgccgcggtggacggagatcgtttccccccctcgccgcttcacgcccagctcgacctggcgggtggcgctgggcccgtagggatctgtgcaaaactgcaagccgggcggaaaacaatagccaggcctgtcggccacaacgccgcgctggacccgatgctctggggccggggccattcggaaggaagaggaggaaatcgcgaacagcattcacagctcagcaagtactggaattggaacggcggttcgtattccaaaagtacctggccccctctgaacgcgacggacttgctactagactcggactcgccaatgcacaggtggtaacatggttccaaaacagaagggcgaagctgaagcgagacgtggaagagatgagggcggatgtcgcctcacttcgtgcgctgtcccctgaagtgctgtgctccctggccttacccgagggagctcccgatcccggtctctgcctaggccccgccgggcctgacagtagacctcacctttcagacgaggagatacaggtggacgactag

SEQ ID NO: 192653 - DNA, 1398 bp, Artificial Sequence
  Description of Artificial Sequence: Synthetic coding sequence
atggagacccccagccagcggcgggccacccggagcggcgcccaggccagctctacgcccctatcccctaccaggatcacccgcctacaagagaaggaggacttgcaggaactgaacgaccggctggcagtgtacatcgacagggttaggagcctggaaaccgaaaatgccggactgcgtctgcggatcaccgaaagtgaggaagtagtctctcgcgaggtgtccggaattaaagcagcctatgaggctgaactgggagatgcccgaaagaccctggattcagtcgcaaaggagagggcaagactccaactggaattgtccaaggtgagagaggagtttaaggaacttaaagcacgcaatacaaaaaaagaaggggacctcatcgctgcccaggcccggcttaaagatctggaggctctgctcaattcaaaagaagccgccttaagtactgctttgtccgaaaagagaactctagagggcgagctgcacgacctcagaggacaggtggccaagctcgaggccgcattaggggaggccaagaagcagctgcaggacgaaatgctgaggagggttgacgctgaaaaccgactgcagacgatgaaggaggaactggacttccagaagaacatctattccgaggaactaagagagacgaaaaggcgacacgaaactcggcttgtggagattgacaacgggaagcaacgggagttcgaaagccgactggccgacgctctacaagagctccgcgctcagcacgaggaccaagtggagcagtataagaaagaactcgagaaaacttacagtgcaaagttagacaacgcgcggcaatccgcggagcggaatagcaatcttgtgggtgctgctcatgaggagcttcagcagtcgcgtatccgtatcgattcattgtcagcgcagttatcccagctccagaagcaactcgccgccaaggaggcgaaactgcgcgatttggaagacagcttggcgagggaaagggatacgagccggagattactggccgagaaggagagagagatggctgagatgcgggcccggatgcagcagcagctcgatgaatatcaggaacttcttgacatcaagctcgcactggatatggagatccacgcttaccggaagctcctcgagggcgaagaggagagactgaggctttcgccgagccctaccagccagcggagtcgcggcagggcatcaagccatagctcccagactcaaggtggcgggtccgtgacgaagaagagaaagttggaaagtactgaaagtagatccagcttcagccagcatgcccggacttctggccgcgtcgctgttgaggaagttgatgaagatgaagacggggatgatcttctgcatcaccatcatgtgtccggcagtcgcaggtag

SEQ ID NO: 192654 - DNA, 1905 bp, Artificial Sequence
  Description of Artificial Sequence: Synthetic coding sequence
atggagacccccagccagcggcgggccacccggagcggcgcccaggcgtccagtacacccctgagtccaactagaatcacccggctccaggaaaaggaggacctgcaagagctcaacgacagactggcagtttacatagatcgggtgcgcagtctcgagactgagaacgccgggttgcggctgagaataactgagagtgaggaagtagtgtcaagagaggtgtccgggatcaaggctgcctacgaagccgagcttggagatgcgcgtaaaaccctggattccgtcgccaaagaacgagccagactgcagttggaattgagcaaagtgagagaagagttcaaggaactaaaggcccggaacacaaaaaaggaaggggatttaatcgctgcccaggcgcggctcaaagacctggaagccttactcaactccaaggaggctgccctgtctaccgccttgtctgagaagcgcaccttggaaggggagctgcacgaccttcgaggccaggtagctaagttagaagccgctctgggcgaggccaaaaagcagctgcaggacgagatgctcagacgcgtcgacgcggagaatcgcttgcagaccatgaaggaggagttggactttcagaaaaacatctatagcgaggaactgagagagactaaacggcggcacgagactcggttggtcgagatcgacaacggcaaacaaagagagtttgaatccaggctggccgacgctttacaggaactcagagcccagcacgaggaccaggttgaacagtacaagaaggaactggaaaagacctattccgcaaagctggataacgcaaggcagtccgccgaaagaaacagtaacctcgtgggcgcggcccacgaagaactccaacagtctaggatacggatagattcgttgtcggcccagttgagccagctgcagaagcaactcgccgccaaggaagccaaactccgcgacctcgaggattccctcgccagagaaagggatacctctcgtagactcctcgctgagaaggagcgggagatggctgaaatgcgggcccggatgcaacagcagcttgacgagtatcaggaactgctggatatcaagctcgcccttgatatggagattcatgcgtacaggaagctgctggaaggtgaagaagagcgcctgcgtctgtcaccctctcccacttcccagagatcacggggccgagcttcctcccactcatctcagacccaaggcgggggttctgtcaccaagaagcggaagttagaatccaccgagtccagaagtagcttttcacagcatgcacggacctctggacgcgtcgcagtggaggaagtcgatgaagagggcaagtttgttagactgaggaataaatcaaatgaagatcagagtatgggcaattggcagataaagagacagaacggtgacgatcccctgcttacctatcggttcccccccaagtttactctgaaggctggccaggtcgtcactatatgggctgccggggccggcgcaacccattcgcccccgacggacttggtgtggaaagcgcagaatacctgggggtgtggaaacagcctgcggaccgcgctgatcaactcgacaggagaaggctcacactgctcctcctcgggtgaccccgcggaatacaacctgcgatcaagaacagtactatgcggtacctgcgggcaacctgcagataaagcctccgcttccgggtctggtgcccaggtgggtgggccaatctcctctggaagtagcgcctcaagcgtaaccgtgaccagaagttacagaagcgttggcggcagcgggggtgggtccttcggcgataacctcgtcacaagatcctacctcctcgggaattcttccccccgcacccagagcccacagaactgttcaataatgtag

SEQ ID NO: 192655 - DNA, 1719 bp, Artificial Sequence
  Description of Artificial Sequence: Synthetic coding sequence
atggagacccccagccagcggcgggccacccggagcggcgcccaggccagttctacgcccctctccccgacacggataacgagactgcaggagaaagaagacctgcaggaattaaatgaccgcctggccgtgtatatcgaccgcgtgcgctccttagaaacggagaacgctgggcttaggctacgcattacagaaagcgaagaagtggtgtcgagggaagtttcggggataaaggcggcatatgaggccgaactcggagatgcccggaagacacttgacagtgtcgctaaagaacgggcgcgcctccaactcgagcttagtaaagtgagagaagagttcaaggagctgaaagcccggaataccaagaaggagggggaccttattgccgcccaggcccggctcaaggacttggaggcacttctcaacagcaaggaggctgctctgtcaaccgcgttgtccgagaagaggactttggaaggcgagctgcacgatctgagaggccaagtggccaaattagaagcagccctgggggaagccaaaaagcagttgcaggatgagatgttacggcgtgtggatgccgagaaccgcttacagacaatgaaggaagaattggacttccagaagaacatatactcagaagaacttcgcgagacaaagcgcaggcacgagacgcggttagtagaaattgacaacggaaagcaaagagaattcgaaagtagactggccgacgctttgcaggagctccgggcgcaacacgaagatcaggtcgaacaatacaaaaaggagctggagaagacttatagcgccaagctggataacgctcgccagagtgccgagcgaaactctaatctagtaggagcggcccatgaagaactgcaacaatcacggatacgtattgattctctctccgcccagctgtctcagcttcagaaacagcttgccgcaaaggaagcaaaactgcgcgatcttgaagactcactggcacgggaacgagatactagtcgccgcctgcttgctgagaaagaaagggagatggcagagatgcgagctcggatgcagcagcagcttgacgaataccaggagttgctcgatataaaactggcgcttgacatggaaatacatgcctatcggaagctgctggagggagaagaggagcgtctgagactgtctccatctccaacctctcagcgatcccgaggccgggcctcaagccacagctcccagacccagggcggaggttccgtgaccaagaagaggaagctcgaatcaactgaatctaggagttctttcagtcagcatgcacggacatcaggtcgggtagcagtcgaagaagtcgacgaggaggggaagtttgtacgcttgcgaaacaagtctaatgaagaccagtcgatgggcaattggcagattaaacggcagaatggagacgatcccctgctgacgtaccgcttcccacccaaatttaccctgaaggcaggccaagtggtgaccatctgggccgctggagctggagccacccacagcccgccgactgatctggtctggaaggcacagaatacgtggggatgtggcaatagtctgagaaccgctctaattaactctaccggggaagaggtggctatgcgcaaacttgtgcggtccgtgacagttgttgaagacgacgaagacgaggacggtgatgaccttttacaccaccaccacgtgagcggatcgcgacgatag

SEQ ID NO: 192656 - DNA, 1476 bp, Artificial Sequence
  Description of Artificial Sequence: Synthetic coding sequence
atgcagcccctgctgtgcctgggcaacctggaggacgcccgggagcggacagggacattgctggcacagcatcccgcatggggccggactcgtgctaaacctggatcacctctcaatacaaagaaggagggcgatctgatagctgcacaggcccgcctcaaggatctggaagctttgttgaatagtaaagaggccgccctgtccaccgctcttagcgaaaagcggacactagagggcgagctgcatgacctgcgcggacaggtggcaaagctcgaagcagccttgggcgaagctaaaaagcagcttcaggacgaaatgttacggcgcgttgacgcagagaatcggttacagaccatgaaagaggagctagacttccagaagaacatctattcagaggaactgagagaaaccaagagaagacacgaaacccggctagtcgagattgacaatgggaaacagcgagagttcgaaagcaggttggctgacgcccttcaagaactgagagcccagcacgaagaccaggtggaacaatacaaaaaggagctggagaaaacatattccgctaagctggacaacgctcgacagagcgctgaacggaattcgaaccttgtcggggctgcccatgaggagcttcagcagtcaaggataaggatcgattcactaagcgcgcagctcagtcagctacaaaaacaactggcagccaaggaggctaaactgcgtgatttggaagactccctggcaagagagcgagatacctcccggaggttactggccgagaaagagagagaaatggcagaaatgcgggcccgcatgcagcaacaattggacgagtaccaagagctcctggatatcaaactcgctctggacatggagatccacgcctataggaagctcctcgagggcgaggaggaaagacttaggctctccccctctccgaccagccagcggtcccgcggcagggccagtagtcatagctcacagactcagggcggaggcagtgtaaccaaaaagagaaagttggagagcactgagtctcgttcatcattcagtcagcacgccagaacatctggaagggtggccgtcgaagaagtggatgaggaaggaaagttcgttcggctccgcaacaagagtaacgaagatcagtctatgggtaattggcaaatcaaaagacagaacggggacgatccccttcttacctaccgattccccccaaagttcactctcaaagcagggcaggtggtcaccatttgggccgctggcgctggggctacacacagccctcctaccgatcttgtttggaaggcccagaatacctggggatgtggcaacagtctccgaacggccctcataaacagcacgggagaggaggtggcgatgaggaaacttgtcagaagtgtgactgtggtagaagatgatgaagatgaggatggggatgaccttctccaccaccaccacgtgtccggcagccgccgctag

SEQ ID NO: 192657 - DNA, 1845 bp, Artificial Sequence
  Description of Artificial Sequence: Synthetic coding sequence
atggagacccccagccagcggcgggccacccggagcggcgcccaggcttcatctactcccctttctccaacgagaattacgaggctccaagaaaaagaggatctgcaggaactcaatgaccgcctcgccgtttatatcgatagagttcgctccctggaaaccgaaaacgcaggcttgaggctgaggatcacagagtctgaagaagtcgtctcccgcgaagtctcagggatcaaagccgcatatgaggcggagctaggcgatgcccgcaaaacattggacagcgtcgctaaagaacgtgccagactgcaattggagctcagcaaagtcagagaggagtttaaggaacttaaggctcggaacaccaagaaggaaggcgatctgatcgcggcccaggccaggctgaaggatctggaggccctattaaactctaaggaggcagcgctgtcgacggcactatctgagaagaggacactcgagggtgagctgcacgatctgcgcggacaggtagccaagctcgaagcagcactcggcgaggccaaaaagcagctgcaggatgagatgctccggagggtggacgctgagaacaggctgcagaccatgaaagaggaactggatttccagaaaaatatctacagtgaggagctccgggaaactaaaaggcgtcatgaaactaggcttgtggagatcgacaacggaaaacagcgcgaattcgaaagtaggctggccgatgccctgcaggagcttcgggcccagcacgaggaccaagtggagcagtacaaaaaagagctggaaaagacctatagcgccaagctagacaatgccaggcagagcgccgaaagaaacagcaatttagttggcgcagcccacgaagaacttcagcagtcacgtatcaggatagactcgctgtctgcacagctctcccaactgcagaagcagcttgccgctaaggaggccaaactgagagacctagaggacagcttagcacgcgagagggacacctctagacgactcctcgctgagaaggagagagagatggcagagatgcgcgcccgaatgcagcaacagctggacgaataccaggagctgttggacattaagctggccctggatatggagatacacgcgtaccgcaaattgcttgagggagaggaagagagacttcgcttgtcgccctctcccacatctcagcgttcacgaggcagggcttcgagccattcatctcaaactcaaggcggaggaagtgtgactaaaaaacggaaactcgagtcaacagagagcagatcttctttcagtcaacacgccagaacgtccggcagagtcgcagtggaggaagtggacgaggagggcaaatttgtgagactccgcaataagtccaacgaagatcagtccatgggaaactggcagatcaaaagacagaatggggacgatccattacttacttaccggtttcccccaaaattcaccctaaaggctggccaagtcgtgactatatgggcagccggggcgggcgccactcattctccgcctacagatttggtatggaaggcccagaatacatggggctgcgggaattccctacgaacagccctgatcaactcaacaggcgaggaagtggccatgcgcaaactggtacggtcagtcacagtggtagaagacgacgaggacgaagacggcgacgatttgctgcatcatcaccacggctcacactgttcctcttccggagatcctgcagagtacaacctccgcagcaggaccgtgttgtgcggtacttgcggacaacccgcagataaggccagtgcgtctggctcaggggcacaaagtccccaaaattgtagcattatgtag

SEQ ID NO: 192658 - DNA, 1995 bp, Artificial Sequence
  Description of Artificial Sequence: Synthetic coding sequence
atggagacccccagccagcggcgggccacccggagcggcgcccaggcttcaagtacccccctctcacccactcgcataacccgcctacaagaaaaagaagatctgcaggaactgaatgatcggctggcagtctacattgatagagtaagatcactggagactgaaaatgctggactccgtttacggattactgagtcagaagaggtcgtgtcacgggaggtatccggcatcaaggcagcctatgaggcagagcttggcgacgctcggaaaacattggattctgtggccaaggagagggccagattgcagcttgaactgagcaaggttcgagaagagttcaaagagctaaaagctcggaacaccaagaaagagggggatcttatagccgctcaagctcggctgaaagatctggaagctctgctgaattccaaggaagcggccttatccaccgccttgagcgaaaagagaacactggaaggagagctgcatgacctccgggggcaggtagcaaagctcgaggctgcgctgggagaggccaagaagcagcttcaggacgaaatgctgagaagggtggacgcggagaaccgattacagaccatgaaggaagaactcgacttccagaagaatatttacagcgaagagctccgagaaaccaaaagaagacacgagacacgtcttgtggaaatcgataacggcaaacagcgggagttcgaatctcggctcgccgacgcgctccaggagctgagggctcagcacgaggaccaagttgagcaatataaaaaagagttggagaaaacctactccgcaaagttggacaatgccagacagtccgccgagagaaatagtaatctggttggcgcggcccatgaggaattgcagcaaagccgtatccggatcgacagcctgagcgcacagctttcgcaactgcagaagcagctcgccgccaaggaagctaagctcagagatcttgaagatagcttggcccgtgagcgagatacctcaagacgcctgttagcagagaaggaacgggaaatggccgaaatgcgggctaggatgcagcagcaactagacgagtaccaggagctgctcgacattaagctggctttagacatggagatacacgcctatagaaagttgctggagggggaggaggagagactgagactgagcccctcacccacctcccagcgctcacgaggaagagctagctctcacagctcacagacccagggcggagggtctgtgacaaagaagcggaaactagagtctactgagtccaggtcctcatttagccagcacgccagaaccagcggtagggtcgcagtggaggaggttgacgaggagggaaagttcgtgcgactccgcaataaatctaacgaggaccaaagcatggggaactggcagatcaagcgccagaatggtgatgaccctctcctaacgtacagatttcccccaaaattcacactcaaggccggccaagtggtgaccatctgggctgctggcgccggggccacccattcaccccctacagatctggtatggaaagcccaaaacacctgggggtgtggaaatagcctgcgcacagctctgatcaatagcacgggggaagaggtggcgatgagaaagctagtgcgcagcgtaacagtggttgaagatgacgaggacgaggatggagacgacttgctgcatcaccaccacggctcccactgcagcagttcgggcgatcctgcagaatataatctccggtcccgtaccgtcctctgcggtacatgcggacaacctgctgataaagcatcagcttccggaagtggtgcacaggtgggcgggcccatcagtagtggttcctccgcatctagcgtgacagtcaccagatcctatcggagcgtcggggggtctgggggaggatcctttggagacaatttagttacacggagctatttactgggaaactccagcccgcgcacacagagcccacagaattgcagcattatgtag

SEQ ID NO: 192659 - DNA, 1719 bp, Artificial Sequence
  Description of Artificial Sequence: Synthetic coding sequence
atggagacccccagccagcggcgggccacccggagcggcgcccaggcctcttcgacgccgctgtccccaactcggattacacgcctccaagaaaaggaggacttgcaggaactcaatgataggttggcagtctatatcgaccgtgtccgaagtctggagactgaaaatgccggcctgcggttgaggatcaccgaatctgaggaggtggtgtcaagagaggtatcgggtattaaagcagcctacgaagcagaacttggggatgcccggaagaccctagattcagttgcaaaggaaagagcccgactgcaactcgagcttagcaaagtgagggaggagtttaaagaactgaaggcaagaaatacgaagaaggaaggtgatttaatcgctgctcaggcccgcttaaaggacctggaagcgctgcttaacagcaaggaggccgctctgagtaccgctctgagcgaaaagaggactctggagggtgaacttcatgacctcagaggccaggtcgcaaagctagaagcagcccttggggaagccaaaaagcagctgcaagacgaaatgttacgacgggtggacgcggaaaacagattgcagaccatgaaagaagagttggacttccagaaaaacatctatagtgaagaactcagggaaacaaagcgccgacatgagactaggttggtagaaatagacaacggcaaacaacgtgagtttgaaagcagactggccgatgcactgcaagagttgcgcgcccagcatgaagaccaagtggaacaatacaaaaaagagttagaaaagacgtattctgccaaactcgataatgcccggcaaagtgctgagagaaactccaaccttgtgggcgctgcccatgaagaacttcagcaatccaggataaggatagacagcctatcggctcagctatcacagctgcaaaagcagctcgccgcaaaggaggcgaagctgcgggatcttgaggattctctggctcgcgaacgagacactagtcggcggctcctcgccgagaaagagcgcgaaatggctgagatgagagcccgcatgcagcagcaactcgacgaataccaggagctgctcgatataaagctggctttagatatggaaatccatgcatatagaaagctcctcgagggggaggaggagcgcctgaggcttagcccaagccccacttctcaacggagtaggggtcgagcgtccagtcacagttcccagacacagggcggagggtccgtaacgaaaaaaaggaagctggagtcaactgagagccgctccagtttctctcagcacgctaggacaagcgggcgagtggcggtggaggaggtggatgaggaggggaaatttgtccgtctaaggaacaaatctaatgaggaccagtcaatggggaactggcagattaaacgccagaatggcgatgaccccctcctgacatacaggttccctccaaaatttaccctgaaggcaggccaggttgttactatctgggcagcaggggctggggccacccattccccccctactgatctcgtttggaaagcccagaacacatgggggtgtgggaacagcctgaggacagccctgattaattccacaggagaggaagtcgctatgagaaagctggtgagatcagttaccgtggtcgaggatgacgaggatgaagacggagacgacctgcttcaccatcaccatgtgtccgggagtcgcaggtag

SEQ ID NO: 192660 - DNA, 1476 bp, Artificial Sequence
  Description of Artificial Sequence: Synthetic coding sequence
atgcagcccctgctgtgcctgggcaacctggaggacgcccgggagcgtacaggcactctactcgcccaacacccagcttggggcaggactcgagccaagcccggtagccctctcaacacaaaaaaggagggggacctgattgctgcccaggctcgcctgaaggatctcgaggcgctgctgaactccaaagaggccgccttgagcaccgccttgagcgagaaacggaccctagaaggcgagctgcacgatcttcgggggcaggtggccaaactagaagcagctctgggggaggcgaagaaacagctgcaggacgagatgctgcgacgggttgacgccgagaatcgcctgcagacaatgaaggaagagcttgatttccagaagaatatctacagcgaggaactgagagaaactaaaagaaggcacgagacgcgcctggttgagatcgataacggtaagcaaagggaatttgaatcccggctagccgatgccttgcaggaactccgagcacaacatgaagaccaggtcgagcagtacaaaaaagagctcgaaaagacatacagcgcaaaattagacaacgctaggcaaagtgctgaacggaactcaaaccttgtcggcgccgcccacgaggagctgcagcagtccagaattcgtattgatagcctgtccgcacagctcagccagctccagaagcagttagccgccaaagaggccaagttacgagatttggaggacagcttagctcgagagcgtgacactagccgaagattgctggccgaaaaggagcgcgaaatggcagagatgagagcgagaatgcaacaacagctagatgagtatcaggagttgttagatatcaaattagctctcgatatggagattcacgcttatcgtaagttattagaaggggaggaggagagactgcggcttagcccgagccccacatctcagaggtctcgcggcagggcgtcctcccatagctcacagacacaaggtggagggagcgtgacaaagaagagaaagctggagtcaactgaatcgcgctcatccttctcccagcatgccagaacatctggacgcgttgcagtggaggaggtcgacgaggagggcaaattcgtccgcttaaggaacaagtcaaatgaggaccagtccatgggcaactggcagatcaagcgacaaaacggcgatgaccccctcctcacttatagattccctcctaaatttaccctgaaagcaggccaggtcgtgaccatatgggcagccggagcaggtgccactcattctccccccaccgaccttgtgtggaaggcccagaatacctggggctgcgggaactcactgcgcaccgccctgataaattccacgggcgaagaggtggccatgcggaaattagttaggtcagttactgtagtcgaggacgatgaagacgaggatggagatgatctactacaccaccatcacgtcagcggaagccggaggtag

SEQ ID NO: 192661 - DNA, 1464 bp, Artificial Sequence
  Description of Artificial Sequence: Synthetic coding sequence
atggagacccccagccagcggcgggccacccggagcggcgcccaggcatcaagcacacccctcagccctacacgaattacgagattgcaagaaaaagaagacttacaagagctgaatgatcggcttgccgtgtacatcgacagggtgagatctttggagactgagaatgccggtctacggctgagaattaccgaatcagaagaagttgtgagccgggaggtaagcggcatcaaggcggcctatgaagcagagctgggcgatgcaagaaagaccttagacagcgtcgccaaggaaagggcccgcctccagctggagctgtctaaagtacgcgaagaattcaaagaactgaaggcgaggaacacaaaaaaggaaggtgatctgatcgcagcccaggctaggctcaaggatttagaggcgctgctgaattccaaggaggccgccctatctacagcactctccgagaagagaaccctcgagggagaactccacgatttgcgcggccaggtggcgaaactggaagcagcccttggcgaggccaaaaagcagctgcaggacgaaatgcttagacgagtcgacgcagagaatagactgcagacgatgaaggaggaactcgatttccagaagaacatatatagcgaagaattgcgcgaaaccaaaagacggcacgagacacgtctggtggaaatagacaacgggaagcaaagggagttcgagtcacggttggccgacgcgcttcaggagttacgggcccaacatgaagatcaggtcgagcagtacaagaaagagttggagaaaacttacagtgcgaagctcgacaacgctcggcagtctgccgaaaggaattcaaaccttgttggggccgcccatgaagagttgcagcagagtcgtatccgcatagacagcctgtctgcccagctcagccaattacagaagcaactggctgctaaagaagcaaaactccgagacctggaggactccttagcgcgcgagagggatacatctagacggcttctggccgaaaaggagagagaaatggctgagatgcgtgcccgtatgcagcagcaactggacgagtatcaagagttgttggatatcaagctggccttggacatggagattcacgcctatcgcaaactgctcgagggcgaggaagaaagattgcgtctgtcaccaagcccaacttcccaacgaagcagggggagggcaagttctcactctagtcagactcagggtgggggcagcgttacaaagaaacgcaaactggagtcaacggagtcccgctcgtccttctctcagcatgcaagaaccagcggtaatagcctgcgaacagctttaatcaactctacaggggaggaagtggcgatgaggaagctggtgagatccgtcactgtcgtggaagatgacgaagacgaggacggagacgacttacttcaccaccatcacgtcagtgggagtcgaaggtag

SEQ ID NO: 192662 - DNA, 1725 bp, Artificial Sequence
  Description of Artificial Sequence: Synthetic coding sequence
atgggcaacagcgagggctgcaacaccaagaaggagggcgacctgattgctgcacaggcacgtctgaaggacctggaagccctgttaaactccaaagaggccgcactgagcacagctctgtccgaaaaacgaaccctggagggcgaactgcacgacctgcgaggccaggtcgcgaagctggaagcggctctcggcgaggcaaaaaaacagctgcaggatgaaatgctgcgccgcgtcgatgcagaaaaccgcctgcagacaatgaaagaggaacttgactttcaaaaaaacatctacagcgaagagctgcgcgagacaaaaagacggcatgagacaagactggttgagatagataatggaaagcaacgcgagttcgaatctcggcttgccgatgccctgcaggaactgcgagcccagcatgaagaccaggtggagcagtacaaaaaagagttggagaaaacttatagcgccaagcttgacaacgccaggcagagcgccgagcgcaacagcaatctggtcggagctgcccacgaagagcttcagcagtctaggatacggattgactctctgagcgcccagttgtctcaactccagaagcaacttgccgctaaagaggcaaagctgagggacctggaggatagtcttgccagagagcgggacacaagcaggcggctgctcgctgaaaaagagagagaaatggccgaaatgcgagcgcggatgcagcagcagctcgacgaataccaagagctgttggacattaaactagccctcgacatggagattcatgcttaccgcaagttgttggagggcgaggaggaaaggctgcggctgtctccatccccaacctcgcagcgctcccgcggcagggcctcaagccattcctcccagacccaaggcggaggcagcgtcacaaagaaacgaaagctcgaaagcactgagtcgcggtcctctttctctcagcacgcacgaacgagtgggcgcgtcgccgtcgaggaggttgacgaagagggcaaattcgttcgcctgaggaataaatccaacgaagatcagagcatgggtaattggcagatcaagcgccagaatggagacgatcctctcctgacatacaggtttcccccaaagttcactctgaaggctggacaggtggtgactatatgggccgccggtgccggcgctacccactctcctccaactgacctggtgtggaaggcccagaatacctggggttgcggaaactccctgcgaacagcccttatcaactccaccggcgaagaagtggccatgcgaaagctcgtccggagtgtaacggtcgtggaggatgatgaggatgaagacggggatgatttgttacatcatcaccatgggtcgcattgtagttctagcggtgaccccgctgagtacaacctgcggagcaggaccgtgttatgtgggacatgcggccaacccgccgataaggctagcgcgagcggatccggcgcccaggtcggtggacccatcagctccggctcgtcagcgagcagcgtgactgtgacccggagctatagaagtgtgggggggagcgggggcggatcgtttggggacaacctggtgactagaagttacttgctcgggaatagctcacctcggacccaatcgccccaaaattgctccattatccaggagatgggaatgcgctgggaggtcgaggagggcagacgtaaagtttcactaagttgtctgccgtag

SEQ ID NO: 192663 - DNA, 1848 bp, Artificial Sequence
  Description of Artificial Sequence: Synthetic coding sequence
atgcccagccggaagttcgccgacggcgaggtggtgcggggccggtggcccggcagctcgttgtattatgaagtcgagatactctcgcacgattccacttcccagttgtacacggtcaaatataaagatgggactgagctggaactcaaagagaatgatattaagcctttaaccagcttccggcaacgaaagggagggagcacatcctccagtccgagcagacgccgtggaagtagatccagaagccggagcaggagccctgggagacccccaaaatccgctagacgctccgcctctgcatcccatcaagcagatattaaagaagcgcgccgtgaagttgaggtcaaattaaccccccttatcctgaagcctttcggcaattctatttcacggtataacggagagccggagcatattgagcgcaatgatgctccccacaagaatacacaggaaaagttctctctgtctcaggagtcgtcttatatagccacacagtattccctgaggcccagacgcgaggaggtgaaactgaaagagattgactcgaaagaggaaaaatacgtggcaaaagaactcgccgtgcggacctttgaggtgaccccgattcgcgccaaggacctggagttcggaggggttcccggggtttttctgataatgtttggacttccagtcttcctgttcttgctgctccttatgtgtaaacagaaagacccttccctgttaaacttcccccctcctcttcctgctctgtacgaactctgggagacgcgggtcttcggggtatacctgctgtggttcttgattcaagttctgttctacctgttgcctattggtaaggtggtggaaggaactccccttatcgacggaaggagattaaagtataggctaaatggattttacgcatttatcctgaccagcgccgtgattggaaccagcctctttcaaggtgttgaatttcattatgtttattcacacttcctccaatttgcacttgccgccactgtgttctgtgtggtgttatcagtgtacctgtatatgcggtccctgaaggcaccccggaacgatttaagcccagcctccagcggcaacgccgtatacgacttctttataggacgggagctcaaccctcgcatcggaacgtttgatttaaaatatttttgcgaactgcggccaggcctgataggttgggtggtcattaatcttgtcatgctgctcgctgagatgaagattcaggacagggcagtcccatccctggctatgatcctcgtaaatagtttccagctgctgtacgtggttgatgccctgtggaacgaagaagctctgctcacaaccatggacataatccacgacggcttcggttttatgctggccttcggcgatcttgtctgggtccccttcatttacagtttccaagcattttatcttgtatcccaccctaatgaggtgagctggcctatggcctctctcattatcgtgctcaaactctgcggttatgtcatctttaggggagcgaacagccagaagaatgcgtttcggaaaaaccccagcgacccaaagctggcccatctgaagacgattcatacttccactggaaaaaacctgcttgtatctggctggtgggggtttgtgcgccaccccaattacctgggggatctgataatggcgctggcctggagcctgccttgtggcttcaatcacattctgccttacttttacatcatctacttcacaatgcttctcgtacaccgagaagccagagatgagtaccactgcaagaagaaatatggcgtcgcatgggagaaatattgccagcgggttccttacagaatttttccttatatctactag

SEQ ID NO: 192664 - DNA, 1848 bp, Artificial Sequence
  Description of Artificial Sequence: Synthetic coding sequence
atgcccagccggaagttcgccgacggcgaggtggtgcggggccggtggcccggcagctccctgtattacgaggtggaaatcttgagccacgacagtacatcccaactgtataccgtgaagtataaggacggaaccgagttggaacttaaagagaatgatatcaagcctctgacttcctttagacagagaaagggcggatccactagttcttcaccctctcgccggagaggctcaagaagcaggagtagatctcggagcccaggtcgcccgcctaagtccgcgagacggtcggcatctgctagccatcaagcagacatcaaggaggcccgaagggaagtagaggtgaaactgacccccctgatccttaagcctttcgggaatagcatttccaggtataacggcgagcccgagcacattgagcgcaatgacgccccacacaaaaacacacaggaaaaattctcactgtcacaggagagctcttacatagccacacagtactcgcttcgaccaaggcgggaggaggttaaacttaaggaaatcgacagcaaagaagagaagtatgtggcgaaagagctcgcagtccgaacattcgaagtaactcctattcgggctaaagacctcgagttcgggggagttccgggcgtctttctcataatgtttggactgccagtctttctcttcctgttgttactgatgtgcaagcaaaaagatccttctctgctcaacttccctccacctctccctgcattatacgaactgtgggaaacccgcgtgttcggagtgtacttgctgtggttcctcatccaggtgctcttttatctactgcccatcgggaaggtcgtcgaggggactcctttaatcgacgggagacggctgaaataccggctaaacggattctatgcctttatccttacaagcgccgtgattggcacatctttattccagggcgtggagttccattacgtgtactctcatttcctgcaatttgcgctagcagccacggtcttttgcgtggttctgtcagtgtatctttatatgagatctctgaaagcacccagaaatgacctctcacccgcatctagcggcaacgcggtctacgacttcttcattggcagagaacttaacccccggatcggcacctttgacctgaaatacttttgtgaattgagacctgggttgattggttgggtggtcatcaacctggttatgttgctagctgagatgaagattcaggaccgcgctgttccctctctcgccatgatactggtgaattcttttcagctcctttatgtggtagacgccctctggaacgaagaggccctgctgacgacgatggatattatccatgatgggttcggattcatgctggccttcggtgatctggtgtgggtgccctttatatattcttttcaagccttttatctcgtgagtcatccaaacgaggtgagttggcccatggcctccctaatcattgtccttaagctgtgcggatatgtgatctttaggggcgctaattctcaaaaaaacgcttttcggaaaaatcccagcgatcctaagctcgctcacttgaaaactattcacacaagcaccggcaagaacctcctcgtttccggctggtggggcttcgtgagacaccccaactaccttggagacttgatcatggcactcgcctggtccctcccgtgcggttttaatcacatattgccatacttttacatcatctattttactatgcttctcgtccaccgtgaagctagagatgagtatcactgtaagaaaaaatacggcgtggcttgggagaagtactgtcaacgtgtgccctatagaatatttccctacatatactag

SEQ ID NO: 192665 - DNA, 156 bp, Artificial Sequence
  Description of Artificial Sequence: Synthetic coding sequence
atgcccagccggaagttcgccgacggcgaggtggtgcggggccggtggcctggcagctccctttattatgaggtggagatcctgagccatgactccaccagccaactgtacacggttaaatacaaagacgggaccgagctggaattaaaggagtag

SEQ ID NO: 192666 - DNA, 387 bp, Artificial Sequence
  Description of Artificial Sequence: Synthetic coding sequence
atcggccgggagctgaacccccggatcggcaccttcgacctgaagtacttttgtgaactgcgccccggcctgattggatgggtcgtcattaatcttgtgatgctgctggccgagatgaagattcaggaccgtgcggtcccatccttggccatgatcctggtgaacagctttcagctcctatatgtagtggacgcactttggaacgaggaggccttgctcaccacaatggatataatccacgatgggtttggatttatgctggcgttcggcgatctggtgtgggtccctttcatttactcatttcaggcattctacttagtatctcaccctaacgaagtcagttggcccatggccagtctgataattgtgctaaaacgcgaatattag

SEQ ID NO: 192667 - DNA, 642 bp, Artificial Sequence
  Description of Artificial Sequence: Synthetic coding sequence
atgcccagccggaagttcgccgacggcgaggtggtgcggggccggtggcccggaagttcattatattatgaagtggaaatactatcccacgattcaacaagtcagctgtatacggtcaaatacaaagacggtaccgagctggagttaaaagagaacgatattaagcctttgacttcattccggcagcgcaaggggggctcaacatcaagtagtccctctcggcggcgaggctctaggtcgagatcacgctcacgcagcccaggacggccccctaagagtgccaggaggagcgcgtccgctagccaccaagctgacattaaggaagccaggcgtgaagtggaagtgaagcttacaccactcatcctgaagcccttcgggaacagcatctctagatacaacggagaaccagagcacatagagcggaatgatgctccacataaaaatacacaagaaaagtttagtttgagtcaggagagcagctacatagcaactcaatactcactgcgacccagaagagaggaagtgaagttgaaggagatcgattccaaagaggagaagtacgtcgctaaggagttagccgtccgcacctttgaggtgactcctatcagggcaaaagatttagagtttggtggcgtgccttag

SEQ ID NO: 192668 - DNA, 324 bp, Artificial Sequence
  Description of Artificial Sequence: Synthetic coding sequence
tgaagcaccagcctgaagatgtacttctacttctacatcgacctgaagaccatccacacttcaacaggcaagaacctcttagtcagtggctggtgggggtttgtacgtcacccaaattatctcggggacctgataatggcactcgcttggagcctgccgtgtggctttaatcatatcctcccttacttttatataatctactttacaatgcttctggtccaccgcgaggcccgggacgaataccactgcaagaaaaagtacggggtggcttgggagaagtattgccagagagttccctaccgaatattcccatatatatattag

SEQ ID NO: 192669 - DNA, 1761 bp, Artificial Sequence
  Description of Artificial Sequence: Synthetic coding sequence
atggccaccgccacccccgtgcccccccggatgggcagccgggccggcgggcccacaacgcccctgtccccaacaaggctgtctcgcttacaggagaaggaggagctgcgtgagctcaacgaccggttggcggtttatatcgacaaagttcggagtcttgaaacggaaaactctgccctgcagctgcaagtgacagagcgggaggaagtgaggggacgcgagctgactggtttgaaggcgttgtacgaaaccgaactggctgacgcccgacgggctttggatgacacagcacgcgagagggctaaacttcagatagagctggggaaatgcaaagcagaacatgatcaactgctcctgaattatgcaaagaaggagtcagacctgaacggggcccaaatcaaattaagggagtacgaagcagccctgaattcaaaggacgcagcattggctacagcgttgggggacaaaaagagcttggagggcgacttggaggatctgaaagatcagattgctcagctagaggcgagcctggcagctgcaaaaaagcaactggccgatgagaccctgctcaaggtcgacctggagaatcgctgtcagagtctgaccgaggatctagaatttcggaagtctatgtacgaggaggagatcaatgagacccgtcgaaaacacgagactcgtcttgtggaggtggattccggccggcaaatcgagtatgaatacaaactggctcaggccctacatgagatgagggagcaacacgatgcccaagtgagactttataaggaagagttggagcaaacttatcacgctaaattggaaaacgcacggctttccagcgagatgaacacatctaccgtcaactctgcaagagaagaattaatggagagccgcatgcggatagagagcctgagctcgcagctgtcaaatcttcaaaaagaaagccgggcgtgcttagaacggatccaagaactggaagacctcctggccaaggaaaaggacaattcccgtaggatgttgacggataaagaaagagaaatggctgagatacgggatcagatgcaacagcagcttaatgattatgagcagcttctggatgtgaagttggccctggacatggaaatatcagcttaccgcaaattactggaaggggaggaggagcgactgaaactcagcccttctccatcgtctagggtgacggtgagcagagcctccagttctcgctccgttcgtacaacaagggggaagcgcaagcgcgtggatgttgaagagagcgaagctagctcttctgtgtctatttcccattctgcaagcgccacgggcaacgtttgtattgaagagatcgatgtggacggcaagttcatccggctgaagaacactagtgagcaggaccagccgatggggggatgggagatgattagaaagattggtgacacttctgtgtcatataagtatacctcaagatatgtgctgaaggcaggccaaaccgtgaccatttgggccgctaacgcaggagtcactgcctcgccgccaacggacctcatttggaagaaccagaacagttgggggactggtgaggatgtgaaggttattttaaaaaattctcaaggcgaggaggtcgcacagaggagtactgtcttcaaaacaactatcccagaagaggaagaggaggaagaggaggccgcaggcgtggtggtggaggaggagctcttccatcaacagggaacaccacgggcaagtaatagaagctgcgctatcatgtag

SEQ ID NO: 192670 - DNA, 1803 bp, Artificial Sequence
  Description of Artificial Sequence: Synthetic coding sequence
atggccacccccctgcccggccgggccggcggccccgccacccccctatccccaacccgtctaagccggctgcaagagaaagaagagctaagagaattaaatgataggcttgcacactacatagacagagtaagagcgctggagctggagaatgaccgtctgttgctgaaaatttctgaaaaagaagaggtcactaccagggaggtctctgggataaaggcgctgtacgagtctgagctcgccgatgcccgccgggtgctagatgaaacggcccgtgagagggctcgcctgcagatcgaaataggcaagctgcgtgccgagcttgacgaagttaacaaatcagccaaaaaaagggagggcgaactgactgtcgcccagggacgggtcaaggaccttgagtccttgttccacaggtcggaggtggagttggcagctgctctctcagataaacggggcctggaatcagacgttgctgaactacgcgcccagttagcaaaggccgaagatggacatgccgtagcaaagaagcagttggagaaggagacattaatgagggtcgacctggagaaccgctgccaaagcctccaggaggaactggacttcagaaagagtgtcttcgaagaggaagtgagggaaactagaagacggcatgagaggagattagtagaggtcgatagctctaggcagcaagagtacgactttaagatggcacaggccctcgaggagctgaggtcccagcatgatgaacaagtgagactctataagctggagcttgagcagacgtatcaggccaaacttgactctgcaaagctctcgagtgatcagaatgacaaagcagccagtgcagctcgcgaagaactgaaggaggcccgaatgcgactcgaatctctgagctaccagctgagcggtctgcagaagcaagctagcgcggcggaggatcgcatccgcgaactagaagaggcaatggcaggtgaaagggacaagttcaggaagatgctagacgctaaagaacaagaaatgactgagatgcgggacgtgatgcagcaacagctcgccgaataccaagagctgctcgacgtgaaacttgcactcgatatggagatcaacgcctatcgcaagctgctagagggggaggaggagcgcctgaagttatctccaagcccaagcagtcgggtaaccgtctctagggccacctccagctcaagcggctccctctcagcaacaggccgcctggggcggtcaaagcgtaagcggctcgaggttgaggaaccgctgggctctgggccgtccgttttagggaccggtacagggggctctggaggcttccatctggctcagcaggccagtgccagtggctccgttagcattgaggagattgatctggaaggtaagttcgtccagttgaaaaacaatagcgacaaagatcaatccttaggtaattggcggatcaagagacaggtgttagagggtgaagaaattgcatataagttcaccccaaagtacatcctgcgggcggggcagatggtcaccgtgtgggcggcaggagccggtgttgcacactctcccccatccacactggtgtggaagggccagtcaagctggggtactggagaatcctttcggacggtcctcgttaacgcagatggagaggaggtcgccatgcggacagttaaaaagagcagtgtaatgagagaaaatgaaaacggggaggaggaggaagaggaggctgaatttggggaggaggatctgtttcaccaacagggggatccgagaactacctcccgggggtgctacgtcatgtag

SEQ ID NO: 192671 - DNA, 1803 bp, Artificial Sequence
  Description of Artificial Sequence: Synthetic coding sequence
atggccacccccctgcccggccgggccggcggccccgccacccccctcagtcccaccaggcttagccggctccaagaaaaggaggaactccgcgaactgaatgacagattggcccactacatcgatcgggtgcgggctctggaacttgagaatgatagactccttctaaagatttctgaaaaggaggaagttactaccagggaggtgagcggcatcaaggcgctctatgaaagcgagctcgccgatgcaagaagggttctggacgagacagcccgcgagagggcccgtcttcagattgagatagggaagctccgtgcagaacttgacgaagtaaataagagcgcaaaaaagagagagggcgagctgacagtagcgcaggggcgcgtgaaggatttggagagtctgttccaccgttccgaagtggagctggcggctgctctgagcgataagcgcgggttggagtccgatgttgcagaattacgggcacaattggccaaggcggaggacggccacgccgtcgctaagaagcagctggaaaaagagaccctcatgcgagtggacctcgaaaatcggtgccagtccttgcaggaggaactcgacttcagaaagagtgtctttgaagaagaagtcagagagacccgcagaaggcacgagaggaggttggtggaggtcgactcctcccggcaacaggagtacgacttcaagatggcacaggccctggaggaacttaggagccagcacgacgaacaagtgcggctctataaactcgagctagaacaaacctaccaagccaagctggatagtgcgaaactatcaagtgaccagaatgacaaagccgcaagcgcagcccgggaggaactgaaggaagctcgaatgagactcgagtcactgagctatcaactgagcggcttacagaagcaggctagtgcagccgaagatcgcataagagagttggaagaggctatggctggagaaagggacaagtttcgcaaaatgctggatgcaaaagagcaggagatgaccgaaatgagagatgtgatgcagcaacagctcgcagagtaccaagagctgttagatgtcaagctggccctcgatatggagatcaacgcttatcgaaagctcctggagggtgaggaggagcgactgaaactgtccccatcaccatcatctcgcgtgaccgtcagtagagcgaccagttccagctcgggctctctgtcagccaccggcaggctcggacggtccaaaaggaagagattagaggtcgaagaacccctggggtcgggtccatccgtactcggtaccggcacaggcgggagcgggggcttccatctggcccagcaggccagtgctagcgggagcgtcagcattgaggagattgacctcgagggcaaattcgtgcaactaaagaataattccgataaggatcagtcactgggcaactggaggattaagcgccaggtcctggagggagaggagatagcctacaaatttacaccaaagtatatcctgcgtgcaggccagatggtcacagtgtgggcggctggtgccggagtggctcactcaccccctagcactctggtgtggaaagggcaatcaagttgggggaccggagaatcattccgtacagtgctggtgaacgctgatggtgaggaggtggccatgcggaccgtgaagaaatcctccgttatgagagaaaacgagaatggagaagaggaggaggaggaagcagagtttggggaggaggacttgttccaccagcagggggatccaagaacaacatcaaggggatgttacgtgatgtag

SEQ ID NO: 192672 - DNA, 651 bp, Artificial Sequence
  Description of Artificial Sequence: Synthetic coding sequence
atgctgatcggcggcaacatcgaggtgcacgtgaaccccggcgacggcacgggcctgaggaaggctcttctccacgcccctaccgggacttgctcggacgggcaggcacactcaatatcgctggtgaggaacagacgtatcatcaccgtgcagctggatgaaaacaatccggtggagatgaaactggggaccctggtggagagccggacgattaacgtttctaatttatacgtaggcggcatcccggaaggcgagggcactagcctgctgacgatgaggaggagcttccatggctgtattaaaaatctcattttcaatctggaactgttggattttaacagcgccgtcatgtctaagtctacctggacaccagccggctgtcagaaagggttgtcttggcttccgatgcagcgtactaaactgctccccgagcctcgggccttccctgtaggcgccgccagtttcactatcagccaggtgcagtctgcaaaagagggtctaggccaaagagaattaaaatggggattagcagtcaaggtgccagcaaaggctggcgccggcgctggggcaggcgcagtactaaagattcgagccggcaccggcagggaacgcgtgccacaggctactcaaatgacacgcccaaatccctag

SEQ ID NO: 192673 - DNA, 9228 bp, Artificial Sequence
  Description of Artificial Sequence: Synthetic coding sequence
atgcggggcggcgtgctgctggtgctgctgctgtgcgtggccgcccagtgcagacagcgtgggttgttccccgcaatcctaaacttggcgtcaaacgctcacatcagcacgaacgcgacatgcggggaaaaaggccccgaaatgttctgcaaactggtggagcacgttcctggtcgacctgtgcgcaatccacaatgtcgaatctgtgacgggaatagcgcaaatccgcgcgagcggcaccccatttctcatgctatcgatggcactaataattggtggcaaagcccttcaatacagaatggaagagaataccattgggttaccattaccttggacctgagacaggtgttccaggtcgcctacgttattatcaaagcagccaatgcccccaggccaggtaactggatcctagagcggtcactcgacggcaccaccttctccccctggcaatattatgcagtgagcgactctgagtgtctttcccggtacaacattacaccccgccggggacctcctacgtaccgggccgatgatgaggttatttgtacgtcttattattctcgcctggttcccctggagcatggcgaaatccatacctcacttatcaatggcagacctagtgccgatgatttgtcccctaaactcctggagtttacctctgccagatacattcgactccggctccaacgaatacgtactctaaatgccgatttgatgactttaagccatcgggaacctaaggagctggatccaatcgttactcggcgctactattactcaatcaaggatatatctgtcggaggcatgtgtatctgctacggccacgcatccagttgcccctgggatgagaccaccaagaaactacagtgccagtgcgaacataacacctgtggggagtcctgtaatcgctgctgccccggctaccatcaacagccgtggcggcctggaacggtttcctctgggaatacgtgtgaggcgtgcaattgccacaacaaggccaaggactgctattatgatgagagcgtggccaaacagaagaagtccctgaacacagcaggacagttcagaggggggggcgtctgcatcaattgtcttcagaacacgatgggcatcaactgtgagacctgtattgatggttattaccgcccccataaagtctcaccttacgaagatgaaccttgtcgcccatgcaactgcgacccagtgggttcactatctagtgtctgtattaaagatgatctgcatagcgacctgcacaatggaaagcaaccaggtcagtgcccatgtaaagaaggatacaccggcgagaagtgtgatagatgccagctgggatacaaggactaccccacctgtgtcagttgcggatgtaatcccgtaggatcagcaagtgatgaaccctgtacaggaccctgcgtatgcaaggagaatgtggagggtaaagcttgcgatcgatgcaagccagggttctataatttaaaagagaagaatccgcgggggtgctccgagtgtttttgctttggcgtctccgatgtctgcagctccttaagttggccagtgggacaggtgaacagcatgagtgggtggctagtgaccgaccttatttcacctaggaagatacccagtcagcaggacgctctcggggggaggcaccaggtgtcaatcaacaatactgccgtcatgcagaggctggcacccaagtactattgggcagctcctgaagcctatcttggcaataaacttaccgcatttggcgggtttctgaaatacacagtctcttacgatatccctgtggagacggtggacagcaatcttatgagccatgcagacgtgattattaaagggaacggtcttaccctgtcgacacaggccgagggtctgagtctgcagccgtacgaagaatacctgaacgtcgtgagactcgtcccagagaattttcaggactttcacagcaagaggcagatagaccgcgaccagctgatgacggtgctcgcgaatgttacgcacctgctgattcgggccaactacaattccgctaagatggccctttacagactcgaaagcgtgagtctcgatattgccagcagcaatgcaattgacctcgtggtggccgcagatgtggagcactgcgaatgcccccaagggtacacgggcacaagttgtgaaagctgtctaagtggatactaccgcgtggatggcattctcttcggggggatctgtcaaccatgcgagtgtcacgggcacgcagccgaatgtaacgtgcatggggtttgtattgcctgcgctcacaacacgactggggtgcactgcgaacagtgcctgcccggattctacggagaaccatcccgaggcaccccaggcgactgtcagccttgcgcgtgccccttaacaattgcctcgaataactttagtccaacgtgtcacctcaatgacggggacgaggtggtctgcgactggtgtgcccccggctactctggcgcctggtgtgagcgctgtgctgacggatattacgggaatcccactgtcccaggcgaaagttgcgtaccatgcgattgctccggtaatgtcgacccatccgaggcggggcactgcgattccgttacaggggagtgtctgaagtgccttgggaacaccgatggggcacattgcgaacgctgtgcagacgggttttatggcgatgcggtaacagccaaaaattgtcgggcctgtgaatgtcatgtcaaggggagccactccgccgtatgtcaccttgaaacggggctctgtgactgcaagccaaacgtcacgggacaacagtgcgaccaatgtcttcatggctactatggattggactcgggacacgggtgccgcccctgcaactgttccgtggcgggctctgtgagtgacggctgtaccgacgaagggcagtgccactgcgtgcccggagtcgcaggcaagagatgcgataggtgtgcccatggattctacgcttaccaagatggatcttgtaccccatgtgactgtcctcatactcaaaatacgtgtgaccccgagaccggggagtgtgtgtgtccgcctcacactcagggggtgaaatgcgaggaatgtgaagacgggcactggggctacgacgccgaagtggggtgccaggcgtgtaattgctccctcgtggggtccacccatcatcgctgcgacgtcgtgaccgggcactgccagtgcaagtctaaattcggcgggagggcctgtgaccaatgcagcttgggctatcgggacttccccgattgtgtcccatgcgactgtgacctccggggaacatctggggacgcatgtaatctcgagcaggggctgtgtggttgcgttgaggagaccggcgcttgcccttgcaaagaaaatgttttcgggccccaatgcaatgaatgtcgggaggggaccttcgcactccgtgctgataacccgctgggctgctccccatgtttctgtagtggcctatcccacttgtgctcagaactagaagattacgtgcggactcctgtcactctaggatccgatcagcccctgcttcgggtggtcagccagtcaaatctgaggggtactactgaaggagtgtactatcaggcgccagatttcctgctcgatgccgccacagtaagacagcatataagggccgagccattctactggcggctgcctcagcaattccagggggatcagctgatggcctacgggggcaaactgaagtactctgtggctttctactctctggacggggtagggaccagcaattttgaaccgcaggtgctgatcaagggcggcagaattaggaagcaggtgatctatatggacgcaccagcgccggagaacggggtgcggcaggagcaggaggtggctatgcgtgagaacttttggaagtacttcaactctgtgtcggagaagccggtgacaagggaagatttcatgtccgtgctctctgacatagagtatattctcatcaaagccagctacggccagggactacagcagagcaggatctccgatatctccatggaagtgggaagaaaagccgaaaagttgcaccccgaagaggaggtggcctctctgttggaaaactgcgtgtgccctccaggaactgtggggttttcatgccaggattgcgcccctgggtatcaccgaggaaagctgcctgccggctcggaccgtgggcctaggcctctggttgccccctgcgtgccttgcagttgcaataaccatagcgacacgtgcgatccaaacacaggaaaatgcctgaactgcggggataacaccgccggcgatcactgcgatgtgtgtacaagtggctactacggaaaagtcactggctccgcctctgattgcgccctgtgcgcgtgcccgcattcaccccccgccagcttcagccctacctgtgtgcttgaaggcgaccatgattttcgctgcgacgcctgtctgctcggatacgaaggaaaacattgtgagaggtgttcgtcaagctattacggtaatcctcagaccccaggcggtagttgccagaaatgtgattgcaaccctcacggcagtgtgcatggagactgtgataggacctccgggcagtgtgtgtgccgacttggcgctagcgggcttaggtgcgatgagtgtgagcccagacacatccttatggagaccgattgcgtctcatgcgacgacgaatgcgttggtgtgttgctgaatgaccttgacgagattggcgatgccgttttatccttaaaccttactggcatcattccagtgccttacggaatactgtcaaatctcgaaaacaccactaagtacctccaggagtcgctgctgaaggaaaacatgcaaaaggacttaggcaagatcaaacttgagggcgtggccgaagaaacagataatctgcaaaaaaaactcacacggatgctggcatctacacaaaaggtgaaccgcgcaaccgagcggatcttcaaggagagccaggacttggccatagccatcgagaggctgcaaatgagcattaccgaaattatggaaaagacaaccctgaatcaaactctagatgaagactttctgctgcctaatagcacattacagaatatgcagcaaaatggtacttcactgcttgagattatgcaaatccgagatttcacacagctgcaccagaacgcgacactggaactcaaagcagcagaggaccttctgtctcagatccaagagaactatcaaaaaccactcgaagaactggaggtgctaaaagaggccgcaagtcatgtactgagtaagcataataacgagctaaaggctgccgaggcgctggtgagagaagccgaagccaaaatgcaggaaagcaatcacctgctgctgatggtgaacgccaatcttagagagttctcagacaagaagttgcatgttcaagaggaacagaatctgaccagcgagctaatcgtccagggtagagggctgatcgacgcagcagcggcccagacagacgctgtacaggacgcccttgagcacctggaggaccatcaggataaactgctactgtggagtgccaagatcagacaccatattgacgacctcgtaatgcatatgagccaaagaaatgctgtggatctcgtgtacagggcggaggatcatgcagccgagttccagaggctcgcagacgtgctgtactctggcctggaaaacatccgcaatgtgagcttgaatgcaacctcagccgcttacgtacactacaacatccagagtctaatcgaagagagcgaggagcttgcccgggatgctcacagaactgtgactgagactagcctcctaagcgaatcgctggtctcaaacggcaaagccgccgtccagcggagttctaggtttctgaaagagggtaataatctgtccaggaaactcccaggaattgcccttgaactgtcggaactcagaaacaaaaccaatcggttccaggagaatgctgtcgaaatcacccgtcagaccaacgaatcattgctgatacttagagcaattccaaaaggtataagagacaagggcgccaagaccaaagagttagccacctcggcttcacaatctgccgtgtctacgttaagggatgtcgccggcctctctcaggagcttcttaatacgagcgcatccctaagcagagtgaataccactctccgcgagacccatcagctcctgcaggattcaaccatggctacactgctggccggtagaaaggtcaaagacgtggagatccaggcaaacctactgttcgacaggctcaaaccccttaagatgttggaggaaaatctctcccggaatctgagtgagataaaacttctcatatctcaggccaggaagcaggctgctagcatcaaggtggccgtgtctgctgaccgggattgtatacgagcataccagccacagatttcgagtactaattacaacacgctgactctgaacgtgaagacccaagagcctgacaacttactcttctatctggggagtagcacggcgagcgacttcctggcggtggagatgcgccggggccgggtagccttcctctgggacctggggtctgggtccactcgcctggagtttccggatttcccgatcgacgataatcgctggcacagtattcacgttgctcgctttggtaacatcggttccctctcagttaaggagatgtcaagtaatcagaagtctccgactaagacatctaaatcccctggcactgccaatgtgctggacgtcaacaattctacactgatgttcgttggcggtctgggcggacagataaagaaaagtccagctgtgaaagtaacccatttcaaggggtgtttaggagaagcatttttaaatgggaaaagtattggtctttggaattatatagagcgtgaggggaaatgtagagggtgttttggctcttctcagaacgaagatccttcctttcattttgacggaagcggatactccgtcgttgagaagtctctgccggccacagtgactcagattatcatgctgttcaatacatttagccctaatggattactcttgtacctgggttcctacggtacaaaggacttcctgagcattgagctcttcagagggcgagtaaaagtgatgacggatctgggaagcggacctatcacactgctcacagatcggcggtataacaatggaacttggtataaaattgccttccagaggaatcggaaacagggtgtcctcgctgtgatcgatgcctataacacttccaacaaagagaccaagcagggggagactccaggtgcttccagtgacctgaatagactggacaaagatccaatatacgtcgggggcctaccaagaagtcgagtggtgcggagaggagtgaccaccaagtcttttgtgggttgcataaagaacctagagatcagcagatccaccttcgacctccttaggaacagttatggagtgcggaaggggtgtctgctggagcccatcaggagtgtctcatttctgaaaggcggctacatagagctgccccctaaaagtctttcaccagagtcagagtggcttgtgacctttgctaccacaaactccagcggaattatcttggccgccctcgggggcgatgttgagaaaagaggagaccgagaggaagcccacgtgccctttttcagcgtcatgctcatcgggggcaacattgaagtccacgttaatcccggagacgggaccggccttcgcaaggcactgctccacgcgcccacaggcacctgttccgatgggcaggcgcactcgatctctctggtacgaaataggaggattattacagtgcagctggatgaaaacaatcctgtggagatgaaactggggactctggtggagagccggacaataaatgtctctaatctatacgtgggcggaatccccgagggtgaggggaccagtctgttaaccatgaggcgaagctttcatggctgtattaaaaacctgatcttcaacctagaactgcttgacttcaatagcgctgttggccacgagcaggtcgacctcgacacctgctggcttagcgaaagacccaagctggccccggacgccgaagatagtaagttgctgcccgagccccgagccttcccagagcagtgtgtggtggatgctgcattggagtacgttccaggggcccaccagttcggccttacccagaatagccactttatcctgcccttcaaccaatcagcggttcggaaaaagctgtcagttgagctgtccattaggacctttgcatccagcggtctcatctattatatggcacatcagaatcaggctgattacgctgtcctgcaattacatgggggcaggctccatttcatgtttgacctggggaagggcagaactaaagtcagtcaccctgccttactgtccgatgggaaatggcatacagtgaaaaccgattatgtgaaacgcaagggtttcatcaccgtggacggccgggaaagtccaatggtcactgtggtgggtgacggtaccatgctcgatgtcgaaggtctgttttacctgggagggctgccatctcagtaccaagccaggaagatcggcaacataacgcacagcatccctgcctgtatcggagacgtgaccgtcaactcaaagcaactagataaagattcgcccgttagcgcatttacggtgaataggtgctatgcagtcgcacaggagggcacttattttgatgggtccgggtacgccgccttagtcaaggaggggtacaaggtgcagtccgacgtaaatattactctcgaatttagaacatcttcacagaatggggtcctcctcgggattagtaccgctaaggtggatgccattggcctggaattggtcgacggcaaggtgctgtttcatgtcaataacggagcggggcgcattacagccgcttatgaaccgaaaacagccaccgtgttatgcgacggaaagtggcatacactgcaggctaataaatccaagcacaggattactctcatcgtcgatggcaatgccgttggggccgaatctccacacacccagtcaacgtccgtggacactaacaacccaatatatgtgggcggttaccctgcgggggtcaaacagaaatgtctccgctctcagacaagcttccgcggctgcctgagaaaactggccctcatcaaatccccgcaagttcagagctttgatttctctagagcctttgaattacacggagtgtttctgcactcatgcccgggcaccgagagctag

SEQ ID NO: 192674 - DNA, 9366 bp, Artificial Sequence
  Description of Artificial Sequence: Synthetic coding sequence
atgcccggcgccgccggcgtgctgctgctgctgctgctgagcggcggcttagggggcgtacaagcccagcgaccacaacagcagcgccagagtcaggcacaccagcagaggggcctcttccccgcggtgctgaatctcgcctctaacgcgcttatcaccaccaatgccacatgtggagagaagggccctgagatgtattgcaaactggtggagcacgtgcccggtcagccggtacgaaacccccagtgccggatttgtaaccagaactcttctaatccaaatcagaggcaccctatcactaacgccattgacggaaaaaatacttggtggcagagccccagtatcaaaaacggtattgaataccattacgtaactataacactggatttgcagcaggtcttccagatcgcctacgtgattgtgaaagccgccaacagtccacggcccgggaactggatcctggaaaggtcgttagatgatgtcgaatacaagccttggcagtaccatgccgtgacagacacagagtgcttgacactctacaacatataccctagaacagggccaccgagttacgcaaaagacgacgaggtcatatgtacctccttttactccaagatccatcctcttgagaacggagagatccacatcagcctgattaatggccgcccgtccgctgatgatccctccccagagctgctcgagttcacatctgctcgatacatccgactcaggttccagagaatcaggactcttaacgcagatctgatgatgtttgctcacaaggatccgagagagatcgaccccattgttactaggcgatattattatagcgtaaaagacatctctgtggggggtatgtgtatttgttacggccatgcccgtgcttgtcccctggatcccgctacgaataagagcagatgcgagtgcgagcacaatacatgtggagattcatgtgatcaatgttgccccggcttccaccagaagccatggagagcgggcaccttcttgacaaagaccgaatgcgaggcgtgtaactgccatgggaaagctgaggagtgctattacgatgagaacgtggcaagacggaacctgagcctgaatatacgggggaaatacattggagggggtgtctgtattaattgtacacaaaatacggcaggcatcaattgcgagacatgcaccgatggctttttccggcctaagggcgttagccctaattaccctcgcccatgccagccttgccactgtgacccaattggatctctgaatgaagtgtgcgtcaaggatgaaaaacacgcccggcgaggactggctccaggctcctgccattgtaagaccgggtttggcggcgtaagctgcgacagatgcgctcgtggctacacgggctatcccgattgtaaagcctgtaactgctctgggctaggctccaagaacgaagacccatgttttggcccttgtatatgcaaggagaatgtggaggggggcgattgctcacggtgtaagagcggcttcttcaacctgcaggaggataattggaagggatgtgatgagtgtttctgcagcggcgtttctaatagatgtcagtcctcttactggacatacggcaagattcaggacatgtctgggtggtacttgacagacttgcccggtcgcatccgggtagcaccccagcaggacgatttggatagtccacagcagattagcatcagcaatgctgaggctcggcaggcactgccccacagttactattggtctgcccctgcgccttacctggggaataagctgcctgcggtcggggggcagctgactttcaccattagctatgatctcgaggaagaggaggaagatacagagcgagtcctccagctcatgatcattctggaaggaaacgatctcagcatcagcactgcccaggatgaggtgtatcttcatccatccgaggagcacactaatgtgctgttgttgaaggaggagagctttaccatccatggaacacacttccccgtccggcggaaagagtttatgaccgtactggcaaatctcaaaagggtacttctgcagatcacctattcattcgggatggacgccattttccgtctctctagtgtcaatctcgagagcgccgtcagttaccccacagatggttcaatagcagccgcagtggaagtttgccagtgtccacctggctatacaggaagcagctgcgagagctgttggccacgtcaccgaagagtgaatggtaccatctttgggggaatatgtgaaccctgtcagtgcttcggacatgccgagtcttgcgacgacgtgactggcgaatgccttaactgtaaggatcacacaggaggcccctattgcgataaatgcctcccaggattctacggtgaaccaaccaagggcacttctgaagattgtcaaccgtgcgcttgtccgcttaacattcccagcaataacttcagccctacgtgccacctggacagatctttgggactgatttgcgatgggtgccccgtgggatacacggggcccagatgcgagcgctgtgctgagggatacttcggccagccgtccgtgcccggtggtagctgccagccatgtcagtgtaacgataatcttgacttttcgattcccggatcatgcgactccctttcaggctcctgtctgatctgtaaaccaggcacaaccggccgatattgcgaactttgcgccgacggctactttggtgatgctgtagacgctaaaaattgccagccctgtcgctgcaatgcaggtggtagtttctcagaggtatgtcactcccagacaggacaatgcgagtgcagagctaacgttcaaggacaaagatgtgacaagtgcaaagccggtacattcggcttgcagtctgctcgaggctgtgtgccatgtaactgcaattcctttggctccaagtcctttgattgcgaagaaagtggccagtgttggtgtcagccaggggttactggcaaaaaatgcgatagatgtgcccacggctactttaatttccaagagggcggctgcaccgcatgtgagtgtagtcacctaggtaataactgcgacccgaagactggtagatgtatctgccctccgaacaccattggtgaaaaatgcagcaagtgtgcgcccaacacatgggggcatagcattacaactgggtgtaaagcatgcaattgcagtaccgtgggctccctggattttcagtgcaacgtgaataccggacagtgcaattgtcaccccaaatttagcggagccaagtgcactgagtgtagcagaggccattggaactacccgaggtgcaatttatgtgattgcttcctgccagggactgacgccaccacctgcgactccgagacaaagaagtgctcttgttctgatcagaccgggcagtgtacctgcaaggttaacgtcgaggggatacattgcgacagatgcaggcctgggaagttcggtctggacgccaaaaatcccctgggatgttccagctgttactgctttggcaccactacccagtgcagtgaggccaaaggccttatcagaacatgggtcacccttaaagccgaacaaactattctccccctggtggatgaggcactgcagcatacgaccaccaaagggatcgtgttccagcatccagagattgtggcccacatggaccttatgcgagaagatcttcatttagagcctttctattggaaactgccagagcaattcgagggcaagaagctgatggcctacggaggcaagttgaaatacgcgatttatttcgaagctcgcgaagagaccgggttctcaacgtacaaccctcaggtgatcatccggggtggtacgcccacacacgcccgcattatcgtgcgccatatggccgctccactcatcggacagttgacccgccacgaaattgagatgactgaaaaagagtggaagtactacggagatgatccccgcgtgcacaggaccgtgacacgagaagacttcctcgacatactttatgacattcattacattctgataaaggctacctacggcaacttcatgcgacagtctcgaatttctgagatttccatggaggtcgcggagcaaggccgagggacaaccatgacccctcccgcggatttgatagagaaatgcgactgtccacttgggtattcaggactgtcctgtgaggcctgcctgcctggcttctatagactgagatctcagccagggggccggacgcccggcccaacattaggtacctgtgtgccgtgtcaatgtaatggacacagttccttatgtgacccagagacgagcatctgtcagaactgtcagcaccatacagccggagacttttgtgagagatgcgctctgggctattatggcatcgtcaaaggtttgcccaacgactgtcagcagtgtgcttgccctctgattagctcaagcaataatttctcccccagctgtgttgccgagggactggacgactaccgctgcacagcatgtccccgcggttacgagggtcagtattgcgagaggtgtgcccccggctacactggatctccagggaaccctggaggtagttgtcaggagtgcgaatgtgacccctatggttcactcccagttccatgtgaccccgtcacggggttctgcacctgtaggcccggcgccaccggtcggaaatgtgacggatgcaaacactggcatgcccgtgaaggctgggaatgcgtcttctgcggagatgaatgtaccggcttgttgctaggtgatcttgcacggctcgaacaaatggtgatgtcaattaatctgactgggcctttgccagctccctataagatgctatacggtttagagaacatgacccaagagctgaagcacctacttagtccgcagcgggcccccgagagactaatccagcttgcagaggggaacctgaatacactggtcactgagatgaatgagttgctcacaagagcaacaaaggtgaccgcggatggtgaacagacggggcaggatgctgaacgcaccaatacaagagctaagagcctcggcgaatttattaaagagcttgccagagacgcagaggccgtcaacgaaaaagcaatcaagctcaatgagacgcttggaaccagagatgaagcattcgagagaaatctcgaaggactccagaaagaaatcgatcaaatgatcaaagagctccgccggaaaaacttggagacgcagaaggagatcgccgaagatgaattggtcgctgccgaagcactgctgaagaaagtaaaaaaactgtttggggagagccgaggggaaaacgaggagatggagaaggatctgagggagaaactggccgattacaagaacaaagtggacgacgcatgggaccttctcagggaggccactgacaagatcagagaggctaataggttgtttgctgtgaatcaaaagaatatgacagcacttgagaaaaagaaagaggccgtggagtcaggtaaaaggcaaattgagaatacgctaaaggaaggaaacgatatcctcgacgaggccaaccggcttgcagacgaaattaattcaattatagactatgtggaagacatacagaccaagctccccccgatgtcagaagaattgaacgataagatcgatgatttgtctcaggagatcaaagacaggaagctcgctgaaaaagtttcacaggccgaatcccacgccgcccaactgaacgatagtagtgctgttctggatggtatcctggatgaggccaaaaatatttctttcaacgcgacagctgcattcaaagcttactccaacattaaagactacatcgacgaggccgaaaaagtggccaaggaagctaaggatcttgcgcatgaggccacgaagttggctactgggccccgcggactcttgaaagaagatgcaaaaggctgcctccagaagtccttcagaattctcaatgaggctaagaaactggcaaacgacgtgaaagagaatgaagatcatctcaacggcctcaaaactaggatcgagaacgccgatgccagaaatggagacctgctgcggactttgaatgatacactcggcaaattgtccgctatccccaacgatacagcagccaagctccaagcggtgaaagataaagcccgtcaggctaacgacacggccaaagacgtgctagctcagatcactgagctgcaccagaatctggatggcctgaaaaagaattacaacaagctggctgactccgttgcgaaaactaatgctgtggtaaaggatcccagcaagaatacagtggccgatgccgacgctacggttaagaacctcgaacaggaggccgacagactcattgacaagctgaagcccattaaggaactcgaggacaacctcaagaaaaacataagtgagatcaaagagttaatcaaccaggctaggaaacaggccaattctataaaggtcagcgtgagttccggcggagactgtataaggacgtacaagcctgaaattaagaaaggaagctataataacatagttgtcaacgttaaaaccgctgtggctgacaacctgctgttttatttagggtccgcgaaattcattgactttctcgcgatcgaaatgcggaagggaaaggtgtcattcttatgggacgtgggatccggagtgggacgagtggaataccccgaccttactatcgatgacagttactggtatagaattgtggcttcaaggacgggtaggaacggcaccatctctgttagggctctggacggacctaaagcttcgattgtacccagtactcaccatagcacaagcccacccggatatactatactagatgtagatgccaatgcaatgctgttcgtgggtgggttgaccggaaagctcaaaaaggccgatgctgtgcgggtgataactttcactggatgtatgggcgaaacctatttcgataataaacccatcggcctttggaattttcgggagaaagaaggcgactgtaaagggtgcacagtgagcccacaggtagaggactctgagggaacaattcagtttgatggcgaagggtatgccctcgtcagcagacccataaggtggtatcccaatatctcaacagtgatgtttaaattcaggacgttctctagttccgctctcctgatgtatctggccacccgagatctccgggatttcatgtctgtggaattgaccgacggccacatcaaagtgtcctacgacttagggagtggaatggcatccgtagtgagtaaccagaatcataacgacgggaagtggaagtctttcacgctgagccgcatccagaaacaggcaaatattagtattgtcgacattgacacgaaccaggaggagaatattgcaacatcttcctctggcaataacttcggcttggatttgaaggcagacgacaaaatttatttcggcgggctacctacccttcggaacctcagtatgaaggccagacccgaggtgaatctgaaaaagtactccggctgccttaaggatatcgagataagccgaacaccatacaacatcctatcctcccccgattatgtaggcgtgactaaagggtgctctctggagaatgtgtatactgtctcattcccaaagcctgggtttgtagagctcagccccgtcccaatcgatgtgggaacagaaatcaacctttcgttttccactaaaaacgaaagcggcatcatcctgcttggatctggcggaactcccgcccctccacggcgcaagcggagacagactgggcaggcctattatgccattcttttgaacagaggtcgattagaagtgcatctcagcacaggggcacggacaatgagaaagatagtcatccgtcccgaacctaacctgttccatgacgggcgcgaacacagcgtccatgtagagcgaaccaggggtatctttacagtacaggttgatgagaataggcgttatatgcagaatctgactgttgaacagccaattgaggtaaagaaattatttgtaggtggagccccaccggagtttcagcccagcccccttcgcaatataccaccctttgagggatgcatctggaacctcgtgattaactcagttcctatggactttgcacgccctgtgtccttcaagaacgctgatatcggccggtgcgcacaccagaagctccgcgaggatgaggatggcgcagcccccgccgaaatagttatacagcctgagccagtgccgacacccgcttttcccacccccacgcccgtcctcactcatggcccctgcgccgcagagtcagagccagccctgctcataggtagcaaacagttcgggctgtctcgaaactctcacattgccatcgcatttgacgacacaaaggtgaagaacaggctcaccattgagctggaagtcagaaccgaagccgaatccgggctgctcttctacatggcgagaatcaaccacgccgactttgcaactgtccagctacggaatggactcccctattttagttatgatctgggatctggtgatacgcacactatgatacccacaaagataaacgacggccaatggcataagatcaaaattatgcgttctaagcaggagggtatcttatacgtggatggagcgtctaataggacgatttctcctaagaaggcagatattctggacgtggtcggcatgctttatgtggggggactgcccataaattacacgactcgacgcatcgggcccgtgacttatagtatagatggctgtgttcggaatctgcacatggcagaggctcctgccgatctggaacagccgacttcctccttccatgtcggtacatgctttgcaaatgctcagcgaggaacgtactttgatggaactggctttgcaaaggccgtaggcggttttaaggtcggcctggacctgcttgtggaattcgagttcaggaccaccacaactacgggtgtccttctgggaatcagttcacagaagatggacggaatgggcattgaaatgatagacgagaaattgatgttccacgtcgacaatggggccgggcggttcactgctgtgtacgatgctggcgtgccgggacacttgtgcgacggtcagtggcacaaagttaccgctaataagattaagcatagaattgagctcaccgtcgacgggaaccaagtggaagctcagtcccctaatcccgccagtacaagtgccgacaccaacgacccggtgtttgtgggagggtttcccgacgacctgaagcaatttggacttactacgagtatccctttccgagggtgcatcaggagcctgaagttaaccaagggcacgggcaagccactggaagtcaattttgctaaagctcttgaactgagaggagtccagccagtatcttgccccgctaactag

SEQ ID NO: 192675 - DNA, 9369 bp, Artificial Sequence
  Description of Artificial Sequence: Synthetic coding sequence
atgcccggcgccgccggcgtgctgctgctgctgctgctgagcggcggtttaggtggcgtgcaggcacagaggccccagcaacagcgccagagccaagctcatcagcagcgcggccttttcccagccgtgttgaacctggcatccaacgctctcattaccactaacgctacatgcggggagaagggaccagagatgtactgcaaacttgttgagcacgtaccaggacagccggttaggaacccacaatgccggatatgcaatcagaacagctccaatcctaatcaacgacatcccattaccaacgcgattgacgggaaaaatacatggtggcagtcaccttcaattaaaaacggcatcgaataccattacgtgactataacgctggaccttcagcaagtttttcagatcgcctacgtgattgttaaagcggctaactctccaagacctggtaactggatcctggagcggtccctggatgacgtagagtacaaaccatggcaataccatgccgtgacagacacagagtgcctcactctttataatatctatccgcgcacaggcccacccagttacgcgaaggacgacgaggtcatttgcacaagtttctactcaaagatccatcctcttgagaatggagaaatacacatttcactgattaacggtagacccagcgccgacgacccgagcccagaactgctagagtttacttcggctagatacatccgccttcggtttcagagaatccgcacattaaatgccgatcttatgatgtttgcccacaaggacccacgggaaatcgaccctattgtgaccagacgctactactacagtgtcaaggatatcagcgtcggcggcatgtgtatttgctatggccacgctagagcatgcccactggatcctgcgacaaataagagtcgctgtgagtgcgagcataacacctgtggggacagctgcgaccagtgttgcccaggctttcatcagaagccatggagagcagggaccttcttgaccaagactgagtgtgaggcatgtaactgtcacggaaaagcggaggagtgctattatgatgaaaatgtcgcccggaggaacctctccctcaatattcggggcaaatacatcggaggcggtgtttgtatcaactgcacccaaaacaccgcgggcattaattgtgagacctgtacagacggctttttcagacctaaaggagtctctccaaactaccctcgaccctgccagccctgtcattgcgacccaatcggctcccttaacgaagtgtgcgttaaggatgagaaacatgcccgacgaggattggcgcccggttcatgtcactgcaagaccggtttcggtggcgtcagttgcgaccggtgtgctcgcggatatactggatatcctgactgtaaagcctgcaactgcagtggattgggtagcaagaatgaagacccctgttttggcccttgtatctgcaaagagaatgttgagggcggggattgtagcaggtgtaagtcaggatttttcaatctgcaggaggacaattggaagggttgcgacgagtgcttctgcagcggagtgtcgaatcgttgccagtccagctattggacttacggcaagattcaggatatgtcgggatggtacttgacagaccttcccggacgtatccgcgtcgcaccacagcaggatgatctggattctcctcagcagatctcaatttcaaacgctgaggcaagacaagccctgcctcattcctattactggtctgcacccgccccttatttgggcaacaaacttcctgcagtcggagggcagttaacctttaccattagctacgacctggaggaagaggaagaagatactgagcgggtcctacaactcatgatcatcttggaggggaacgacctgagtatctctacagctcaggatgaggtctacctacatccgtcggaagaacatactaatgtactgcttctgaaagaagagagttttacgatccacggcacacattttcctgtgcggagaaaggaattcatgaccgtgctcgcgaacctgaagagagtcctgctgcagatcacctattctttcggtatggatgccatatttcggctaagctcagtcaacctggagagtgccgtctcataccctacagatggcagcattgctgctgctgtcgaggtttgccaatgccctccaggctacacgggctccagttgtgagtcatgttggccaagacaccgcagggtgaacgggaccattttcggtggcatctgcgagccatgccagtgtttcgggcatgccgagagttgtgacgacgttaccggggaatgcttgaactgcaaagatcatactggaggcccatattgcgataaatgcctccccggattctacggagagcccacaaaggggacatccgaagactgccaaccatgtgcttgccccctcaatatacctagcaacaatttcagtcccacctgtcacctcgatagatcattgggactgatttgcgacggctgccccgtgggatacaccggaccaaggtgcgagcgctgtgctgaaggctactttggtcagccgtctgtcccaggcgggagctgccagccctgtcagtgcaacgataacttggacttttccatacctggctcttgcgactctctgtcaggatcatgcctgatctgtaagccgggaactacaggacgctattgtgagctgtgtgcagacggttatttcggagacgccgtggacgcaaagaattgccagccctgcagatgtaacgctggcgggtctttttccgaggtctgccactctcaaactggtcagtgtgaatgtagggccaatgttcagggccagagatgtgataagtgtaaagccggtaccttcgggctccaatctgctagaggctgcgtcccttgcaattgcaactcctttggttccaagtcatttgattgtgaggaaagcggacagtgctggtgtcagcccggtgtgactgggaagaagtgtgataggtgtgcccatgggtactttaatttccaggagggcggatgtactgcctgtgagtgctctcaccttgggaataactgcgacccaaagactggtagatgcatatgccctcctaacacaattggagaaaagtgttccaaatgcgcaccgaacacgtgggggcacagtatcaccaccggctgtaaggcatgcaactgcagtaccgttgggagtctagattttcagtgcaatgttaacactgggcagtgcaattgccatcccaagtttagcggcgccaaatgtaccgagtgctccaggggtcactggaactatccaagatgcaatctgtgtgattgttttttgccaggcactgatgccaccacttgcgactctgaaaccaagaagtgctcatgctctgaccagaccggacagtgtacctgcaaagtgaacgttgagggcattcactgcgaccgatgtcggcctggaaaatttggcctggacgccaaaaatcccctggggtgcagctcatgttactgcttcgggactaccacccagtgtagtgaggcaaagggtctgattcgaacctgggtcacgctcaaggccgaacagaccatcctgcccttggtagacgaagcgctccaacataccaccaccaaagggattgtcttccagcaccccgaaatcgtggcccatatggatctgatgcgagaagatctccatctggagccattctattggaagctgccagaacagtttgagggaaaaaaactgatggcctacggcggcaaactgaaatatgctatttactttgaggcccgggaggagacaggatttagcacctacaatcctcaggtaatcatccggggtggaacccctacacacgctaggattatagttagacacatggcggcgccgctgattggtcagttgacaaggcatgagatcgaaatgacagaaaaggaatggaagtactacggggatgatccacgagtccatagaacagtaactcgtgaagactttctcgacattttgtacgacatccattatatactgataaaggccacatatggaaattttatgcgtcaatctcgtatctccgagatctcgatggaggtggcagagcagggtaggggcacaacaatgaccccccccgccgacctgattgaaaagtgcgattgccctctgggctacagcggtctgtcctgtgaggcttgtctgcctggcttttatcgccttagatctcagcctggaggccggacacctgggcccacactcggaacctgcgtaccttgccaatgcaatgggcattcttcgctttgtgacccggagaccagtatctgccaaaattgccagcatcatactgctggcgatttttgcgaaaggtgcgccctcggatattacggaatcgtcaaaggactgccaaacgattgccagcagtgtgcatgcccactgatatcatccagcaacaactttagcccctcgtgcgtggccgagggactggatgattatcggtgtacggcgtgcccgagggggtacgaggggcagtactgtgaacgctgcgctccagggtacacaggttctcctggcaatccgggcggtagttgtcaggaatgtgagtgcgacccatatggctcactccccgtgccctgcgatccagtgacggggttttgtacttgccgaccaggcgctaccggccgaaaatgtgacggctgcaagcactggcatgcgcgggaagggtgggagtgtgtattctgcggggatgagtgtacaggactgctgctgggcgacttagccagacttgagcagatggtaatgagcattaatctgaccgggcctctgccagcaccgtacaaaatgctgtacggcctggaaaatatgactcaggaattgaagcatttgctgtctcctcagcgtgctccagaaaggctcatacagctggctgagggaaatttaaacaccttggtgactgagatgaatgaactgcttacgagggcaacaaaggtcaccgcagacggtgagcaaacagggcaggatgcagagcgcactaatactcgtgctaagtccctgggggaattcataaaggagttggcccgggatgcggaggccgtgaacgagaaggcaatcaagcttaatgaaacccttggcacaagagacgaagcgttcgagcggaacctggagggtttacagaaggagatagatcagatgattaaggaacttcggcgcaagaacctcgaaacccagaaagagatagccgaggatgagctggtcgcagctgaagccctgctgaagaaggtgaagaagctgtttggggagtcacggggcgagaatgaagaaatggaaaaggatctgagagaaaagctcgccgactataaaaataaagtcgatgatgcatgggatctgctgagagaagctactgataagatacgcgaggcgaatcgactgttcgctgtgaaccagaagaacatgacagccctggaaaaaaaaaaagaggcagtggagtccggaaaacgccaaatcgagaacacactgaaagagggaaacgatatcctggacgaggctaatagactcgcggacgagattaactcaatcattgattacgtggaagacattcagactaaactgccacccatgtccgaagagctgaatgataagatagacgatctatctcaggagattaaggatcgaaagctggccgaaaaagtgtcacaggccgaatcccacgcagctcaactgaacgactcctccgctgtgctagacggtattttagacgaagccaaaaacatatcattcaacgcaaccgccgcctttaaagcatactcgaacataaaagattacattgacgaggctgagaaggttgccaaggaagcaaaggatctagcacacgaggccaccaagctggccacagggccacgagggttactgaaggaggacgccaaaggctgtctgcagaaaagttttcgcatcctcaatgaagccaaaaaactggccaacgacgttaaggagaatgaggaccacctaaacggactaaaaacaagaatcgagaacgccgatgcccggaacggagatctgctgagaactctcaatgacacccttgggaagctgtccgccatccccaatgataccgccgccaaactgcaggccgtgaaagacaaggctcggcaggcaaatgacacagctaaggatgtgctcgcacagatcacagagctccatcagaatctcgatggactaaagaagaattacaataagctggcagatagcgtggccaaaaccaacgccgtggtaaaggacccttctaaaaataagatagttgctgacgccgatgcaacggtgaaaaatctcgaacaggaggcagaccggttaatcgacaagttgaagccaattaaagagctggaagacaacttgaagaaaaatatctccgagatcaaagaacttataaaccaggccaggaagcaagccaattcgattaaggttagcgtctcctcaggcggggactgcattagaacctacaaacctgaaataaaaaagggctcctacaataatatcgtggtcaatgtcaaaaccgcagtggccgacaatctgctgttttatctgggctcagccaaattcattgatttcctggctattgaaatgagaaagggaaaggtcagctttctttgggacgtcgggtccggtgtgggccgtgtcgaataccctgacctcaccatagacgattcatactggtatcggatcgtggcctctagaacgggtcgcaatggaaccataagcgtgcgggcccttgacgggccaaaggccagcatagttccctccactcatcacagcaccagccctcccgggtataccatcctggacgtagacgccaatgcaatgctatttgtcggcggactgacaggcaagctgaaaaaggccgacgctgtcagggtcatcacctttaccggttgcatgggagaaacatacttcgacaataagcccatagggctgtggaattttcgtgaaaaggagggcgactgcaaggggtgcacggtgtctccgcaggtggaagattccgaaggcacaatccaattcgatggggaaggctatgcccttgtaagccgacctatcagatggtatccgaacattagcactgtgatgttcaaattccgcaccttcagctcctccgccctgctgatgtaccttgcaactagagacctccgggactttatgagcgtggagctaactgatggacatattaaggtaagctatgatcttgggagtggcatggcctccgtcgtatcgaaccagaatcacaacgacggcaagtggaaatcattcactttgagccggatacagaaacaagcaaatattagcattgtggatatcgatactaatcaagaggagaacattgctaccagctcaagtggcaataactttggactggacctgaaggccgacgataaaatctacttcggaggcctccccacccttagaaatctccgcctattcaacaggcccgaagtcaacctgaaaaagtactctggttgtctgaaagacatcgagatctctcgaaccccttacaacattctttcttcacctgactacgtgggggtgaccaagggttgctctttagagaacgtgtatacggtctccttcccaaagcctggtttcgttgaactgtcgcctgtcccgatcgacgtcgggaccgaaatcaacctttctttcagcactaagaacgaaagcggtatcatcctgctgggctccggcggtacacctgctcccccccggcggaagaggcgacagacaggacaggcatactatgctattctgctgaatcgggggcgcttggaagtgcatctctccacaggagcgaggacaatgaggaagatcgttatccgacccgaacctaacttatttcacgatggacgcgagcatagcgtacatgttgagcgtacgaggggcatctttacagtgcaagtggacgagaacaggaggtatatgcaaaatctgaccgtcgaacagcctatcgaagtcaaaaaactcttcgtgggtggagcaccacccgagtttcagccctctcctttgcgcaacattcctccctttgagggttgtatttggaatctggttattaattccgtgcccatggattttgctcgccccgttagctttaaaaatgctgacatcggtagatgtgcacaccagaaattgcgggaggacgaggacggggccgcacctgcagagatcgtgatacagcctgagcccgtacccacccctgcttttcctactccgaccccagtattaacccacggcccatgtgctgccgaatctgaacccgcactcctaatcggaagtaaacagttcggcttgtcgcggaactcccatatcgccattgccttcgacgacacaaaagtaaagaacaggttgacaattgaactggaagtgcgcacggaagcagaatctggcctgctgttctacatggccagaatcaaccacgccgacttcgcaactgttcaactacgcaacggattgccgtattttagttacgaccttgggtcaggtgatactcacaccatgattcccacgaagatcaatgatgggcaatggcacaaaattaaaatcatgcggtctaaacaagagggtatcttgtatgtggatggcgcttcaaaccggaccatttcacccaagaaggccgacattctggacgtcgtggggatgctctacgtgggcggcctgcccataaattacacgacgaggcgcattggacctgtcacttactcaatagatgggtgcgttagaaacttacacatggcggaggccccagctgatctcgagcagcctacatctagctttcacgttggtacatgtttcgctaatgcacagaggggaacctatttcgacggcacaggcttcgctaaggcagtcggcggctttaaggtgggattagatctgctggttgaatttgagttccgcaccacgactactactggagtccttctcggcatatcatcccagaagatggatggcatgggcattgagatgattgatgagaaactgatgttccatgtggacaacggcgcaggcagattcacggctgtgtacgacgccggggttccaggccacctgtgcgacggacagtggcacaaggtaacagccaacaaaatcaagcaccgcatcgagctgactgtggatggtaatcaggtagaggcccagagcccaaaccccgcttccacaagtgccgacaccaatgaccccgtgttcgtcggaggcttccctgacgatttaaaacagttcggattgaccactagtattccatttcgtgggtgtattcgcagtctgaaactgaccaaagggaccgggaagcccctcgaagtgaactttgcaaaagccctggaactacgcggggtgcagccggtctcgtgccctgctaattag

SEQ ID NO: 192676 - DNA, 9369 bp, Artificial Sequence
  Description of Artificial Sequence: Synthetic coding sequence
atgcccggcgccgccggcgtgctgctgctgctgctgctgagcggcggcctgggcggggttcaggcgcaaaggccacagcagcagcgtcagagccaagcacatcagcagcgaggtctgttcccagccgttcttaatctggcctctaatgctctgattaccactaatgcaacatgcggagagaagggcccagagatgtattgcaagctcgtcgagcatgtgcctggacagccagtgagaaatccacagtgccgcatctgcaaccagaactcctcaaacccgaatcagcgccatccaattaccaatgcgatagacggaaagaatacctggtggcagagtccctcaatcaagaatgggatcgagtaccactatgtaactatcaccttggaccttcagcaggtgttccagattgcttacgttatagtcaaggcagccaactcgcctagaccaggtaactggattctggaacgttcacttgatgatgtggaatacaagccttggcagtaccacgctgttacagacacagaatgcctgactttgtataatatttatccacgcactggacccccaagttacgccaaagatgacgaggttatttgcacgtcattctatagcaaaatccaccctctggagaatggggagatccatattagtctgattaatggtagaccatcagccgacgatccttctcctgagttacttgagtttacctcagcccgctacatacggttacgcttccaacgcattagaacactgaatgcggacctgatgatgtttgcccacaaggacccacgcgagattgaccctattgtgacccgccgctattactattctgttaaagatatcagtgtggggggaatgtgtatctgctatggccacgcccgcgcatgtccactcgatcccgcaaccaataaatccagatgcgaatgtgaacacaatacttgtggtgatagttgcgatcagtgttgcccagggtttcaccaaaagccctggagggcgggaaccttcctaacaaagaccgaatgtgaagcttgcaattgccacggtaaggctgaagagtgctattatgatgaaaacgtggcaagaaggaatctgagtctgaatatccgcggtaaatatattggtggtggtgtgtgtataaattgcacccagaatactgctggcatcaactgtgagacttgcacggatggcttcttcaggccaaaaggtgtgtcccctaattaccctagaccatgccagccctgccattgtgaccctattggttccctaaatgaagtgtgcgtcaaggacgagaaacatgcacgaagagggctcgcacctgggagctgccattgtaagacgggttttgggggcgtgagctgtgaccgatgtgccaggggatacaccggctaccctgattgcaaggcatgtaactgttcagggctcggtagtaaaaatgaggatccatgctttggtccctgcatttgcaaagagaacgtggagggaggggattgctcgaggtgtaaatcaggctttttcaatcttcaagaggacaactggaaagggtgcgacgaatgcttctgcagtggcgtcagtaatagatgccagagttcgtactggacctatggaaaaatccaagatatgtcaggatggtacctgaccgaccttccaggcagaatccgagtggcccctcagcaggacgatcttgattctccccagcagattagtatctccaatgccgaagctagacaggcgcttcctcacagctactactggagtgcacctgcaccttacctcggaaataagctgcccgctgtcggcgggcaactcacgtttacaatctcttatgacctcgaggaggaggaggaagatactgagcgcgtcttgcagctgatgattatcctcgaagggaatgacctgtctatctcaaccgcccaggatgaagtttacttgcacccatcggaagagcacacgaatgtgcttcttctcaaggaagaaagttttacaattcacggcacgcatttccctgtccgtcggaaggagttcatgaccgtcttggcaaaccttaagagggtgctgttgcagataacctattcctttggaatggacgccattttccggctgtcatcagttaatctggaatcggccgtgtcgtacccaacagatgggagtatcgctgcagctgtcgaagtgtgccagtgtcctccagggtacacgggaagtagctgcgagtcctgttggccacgtcatagacgcgtgaatggtacgatcttcggaggaatctgcgaaccctgtcagtgtttcgggcatgctgagtcttgcgatgacgtcaccggagagtgcctaaattgcaaggatcataccggtggtccgtattgtgataagtgtctgcctggattttacggcgagcctacaaaagggacttccgaggattgccagccctgcgcctgccccctcaatatcccaagcaataacttctctcctacgtgccacctagatcggtctttaggtctgatttgcgatggatgtcccgtaggctacactggcccccgttgcgagcgatgcgcagagggttacttcggacaaccttctgttccaggaggcagctgccaaccatgccagtgcaatgataatctggactttagcattcctggcagctgcgattctctctctggcagttgtctgatatgtaaaccagggactacaggccggtactgcgaattgtgtgcggatggttatttcggagatgcagtggacgcgaaaaactgccagccttgtaggtgtaacgctggcggaagctttagcgaggtctgtcactcccagactgggcagtgcgaatgcagggcgaatgtccaggggcagcggtgtgacaaatgtaaagctggtacttttggtcttcagtccgctcgcggatgtgtcccttgcaactgtaattccttcggtagtaaatcctttgactgcgaggaatcgggtcagtgctggtgccagcctggagtgacaggaaagaaatgtgatagatgcgcccatggatacttcaatttccaagagggggggtgcaccgcttgtgagtgctcccatctaggcaacaactgtgacccaaagaccggacgatgtatctgcccaccaaatacaataggagaaaagtgtagtaaatgcgcccccaacacttggggccacagtatcactacgggatgcaaagcctgtaactgttccaccgtcgggagcctcgactttcagtgtaacgtgaataccgggcagtgcaactgtcacccaaagttttctggagctaagtgtacggagtgcagccgtggtcattggaactaccctaggtgcaacctgtgcgactgctttctcccgggtaccgacgcaacaacatgcgactctgaaactaaaaagtgtagctgctctgaccaaaccggccaatgcacctgcaaggtgaacgtggagggaattcattgtgaccgctgccggcctggcaagttcggacttgacgccaagaatccgctcggttgcagctcgtgctattgcttcggaacgacaacacagtgttcagaagctaaaggactcattaggacttgggtgaccttaaaagccgaacagacgatcctcccgctcgtcgacgaggctctccagcacacaacaactaagggtatagtcttccaacaccctgaaattgtggctcacatggatctgatgcgggaagatctccacttggaaccgttctattggaagttaccggaacagttcgaaggaaagaagctaatggcatatggggggaagctgaagtatgctatatactttgaggcgcgcgaggagacagggttctcaacctacaaccctcaggtcattattagggggggcaccccaacccatgctagaatcattgtgcggcatatggctgcccccctgatcggccagttgacacggcatgaaattgagatgaccgaaaaagagtggaaatactacggcgatgaccccagagtccaccgtacggtcacccgcgaagattttttggacatcttatacgacattcattacattcttatcaaggcaacgtacggcaacttcatgagacaatctcgcatttctgagatttctatggaggtggcagaacaggggcgcggcaccacaatgacaccacctgcagacttaatcgagaagtgtgactgtccattaggctatagtggcttaagttgcgaggcttgcttgcctggattttaccgactgaggtcgcagccgggtggcagaacgcccggccctactctggggacctgtgtgccttgccagtgcaacggccactctagtctgtgcgaccccgaaacctctatttgtcagaattgtcagcaccacaccgcgggagatttctgcgaaaggtgtgccctgggttattacggtattgtgaaaggccttccaaatgattgccagcaatgtgcttgtcctctgatctcaagcagtaataatttttcaccatcctgcgttgccgaggggctagacgactacagatgtactgcctgcccccgaggatatgaaggccaatattgcgagaggtgtgcaccaggttacacaggttcccccggtaatccaggaggatcctgccaggagtgtgagtgtgatccctatgggtctttaccagtcccctgtgaccctgtgacggggttctgcacctgtagacctggggctactggtcggaagtgtgacggttgtaaacactggcatgcgcgggaagggtgggagtgcgtgttttgcggggacgaatgcactgggttactcctgggtgaccttgctcggctggagcagatggtgatgtccatcaatttaaccggacccttgcccgccccatacaaaatgctctacggccttgaaaacatgacacaggaacttaagcatctactctctccccagcgggcgcccgaacgtttgattcagctggccgaaggaaatctgaatactttggtgaccgaaatgaacgaacttctgacaagggccactaaagttacggcggatggagaacagacaggtcaagacgccgaacgcacaaatacaagggccaagtctttaggtgagttcataaaagaactggcgcgcgacgccgaggcagtgaatgagaaggccatcaaattaaacgagactctaggaactagagacgaggccttcgagagaaatctggaaggattacagaaggaaatagaccaaatgattaaggaactgaggagaaaaaatctcgagacccagaaggagatagcagaagacgagctggtggctgcagaggctctgctgaagaaagttaagaagctgttcggcgaatcccgaggggaaaacgaggagatggagaaggatttaagagaaaaactcgctgattacaaaaacaaggtggatgatgcctgggacctgcttagagaagccactgacaagattagggaagcgaacaggctgttcgctgttaatcagaaaaatatgaccgctctggagaagaagaaggaagctgtcgaaagcggtaaaaggcagatcgaaaacaccctaaaagagggtaatgacatcctggatgaggccaacaggctcgccgacgagattaatagtattattgattacgtggaggacattcagaccaaactgcctcccatgtcagaggaactcaatgacaaaatcgacgatttgtcacaggagattaaggaccggaagctggccgaaaaggtgtcacaggccgagagtcacgctgcccagctcaatgattcttccgcggtgctggacggaatactcgatgaggcgaagaatatcagtttcaacgctacggccgcatttaaggcttattccaatatcaaagactacatcgacgaggccgaaaaagtggcaaaggaagcaaaggatctagctcacgaagctaccaagctcgccacgggtcctcgggggttgctgaaggaggacgctaagggctgtctgcagaagtcctttcgtatcctgaatgaggctaagaaactcgccaacgatgtaaaggaaaacgaggaccacttgaatggactgaaaacaaggatcgagaatgcagatgctaggaacggggatctgctgcggacactcaatgacacccttgggaagctctctgccataccaaacgataccgcagcaaagctgcaagctgtgaaggataaggccaggcaggctaacgataccgctaaagacgtgctcgcgcagatcactgagctgcaccagaacctggatggacttaaaaagaattacaataaactcgcggactctgttgcgaaaaccaacgccgtcgtgaaggatcccagtaagaacaaaataattgcggatgccgacgccactgtcaaaaaccttgaacaggaggcggaccgactcattgacaaactcaagcccataaaggagctggaggacaatcttaagaaaaatatttccgagattaaggagctcatcaaccaggccagaaagcaggccaattctattaaggtttcagtttcctccggcggagattgcattcgcacctataagcctgagattaagaagggcagctataataacattgtggtgaatgtgaaaacagccgtagccgacaacttgttattctacctggggtctgcgaagttcattgatttcctcgccatcgagatgcgcaagggcaaagtcagctttctgtgggatgtcgggagcggagtgggaagggtggaataccccgacctcaccattgatgactcttactggtatcggattgtggccagtaggacaggaagaaatggaactatctccgtgcgggctttggatggtccgaaagcctcaattgttcccagcacacaccattcaacctctcctccagggtacacaattcttgacgtagacgcaaacgcaatgctgttcgtcggcggcttgacaggtaaactgaagaaggcagatgctgtacgggttattactttcaccggatgtatgggcgagacgtactttgataacaagccaatcggactctggaacttcagagaaaaagagggggactgtaagggatgtaccgtaagtccacaggtcgaggattctgagggcaccatccagtttgatggggagggctatgcactggtgagcagacctatccgttggtatcccaacattagcaccgttatgttcaagttccgtaccttcagctcttccgcgttactgatgtacctggccaccagagacctcagggatttcatgtctgtcgaactcacagacggtcacattaaggtctcctatgacctcggatctggcatggcctccgtggtgagcaatcagaaccacaatgacgggaaatggaaatcctttacactctcccggattcaaaaacaggccaatatcagcatcgtggacatcgataccaatcaggaagagaatattgcaacctcaagctccgggaacaatttcggactggacctgaaagccgatgataagatttacttcggcggcctccctacactcagaaatctgagtatgaaggccagacctgaagtcaacctgaaaaagtactctggttgtctcaaagatatcgaaatttcccgcaccccatacaacatactgtcttcacccgactatgtaggggtcactaaaggatgtagcttggaaaacgtgtataccgtctccttcccaaaacccggtttcgtggaattgtcccccgtaccaattgacgtgggcaccgagatcaatctctctttttccacaaaaaatgagtccggcattattctgctcggctctgggggcacccccgcacctcctagacggaagcgacggcagactggacaagcctattacgctattctgctgaaccgcggcaggctcgaggtacatctctccaccggagcccgcactatgcgcaagatcgtgatccgaccggaaccgaatctatttcacgatgggcgagaacactcagtgcacgtggaaaggacccggggcatattcaccgtccaggtagacgaaaaccgcagatatatgcagaatctcactgtggaacagcccattgaagttaagaagttgttcgtgggaggcgccccacccgaattccagccatctccactgagaaacatccctccttttgagggatgcatttggaatctcgtgatcaactctgtgcccatggactttgcaagacccgtctctttcaaaaatgccgatatagggaggtgcgcccaccagaaattgcgagaagatgaagatggagccgcgccagccgaaattgtgatccaacctgagccagtgccaacacccgccttccccactcctactcctgtgttgacccatgggccatgcgccgctgagtccgagccagccctgctgatcgggtccaagcagttcggcttgtctcggaacagtcatattgccatagcatttgacgatacaaaggtgaaaaaccggctgaccatcgagcttgaggtgcggaccgaagccgagtccggactgctcttttacatggctaggattaatcatgccgatttcgccactgtgcaacttcggaacggactgccgtattttagctacgacctcggctctggagatactcatacgatgatcccaactaagatcaacgacggccagtggcacaaaattaaaatcatgagaagcaagcaggaggggattctctacgtagacggggcttcaaacagaactattagtccaaagaaggcggatatcttagacgtggtgggtatgctctacgttggaggactgccaataaattacaccacccggcggattgggcctgtgacctatagtatagatggctgcgtgagaaacctccacatggccgaggctcccgccgacctcgagcagccaacctcctccttccatgttgggacttgcttcgccaacgcacagcgaggtacatactttgacggcaccggttttgctaaagccgtgggcgggtttaaagtgggactggacctcttggtggagttcgaatttcggactaccacgactactggggtccttctcggcatctcctcccagaaaatggacggcatgggaatcgagatgatcgatgagaagctgatgttccatgttgacaatggagctggccgcttcacagcagtgtacgacgcgggcgtacctgggcacctgtgtgatggacagtggcataaggtcaccgcgaacaagataaaacacagaattgagcttacggttgatggtaatcaagtcgaagcccagagtcccaatccagcgagcacatcagctgatacaaacgaccctgtgttcgtgggggggttccccgacgacctaaaacagtttggcttgaccacaagtattcctttccggggatgcatcagaagtctgaagctgacaaagggtaccgggaaaccgctggaggtgaactttgctaaggcactcgagctgaggggagtgcagcctgtcagttgtcccgctaattag

SEQ ID NO: 192677 - DNA, 3387 bp, Artificial Sequence
  Description of Artificial Sequence: Synthetic coding sequence
aagaagctggccaacgacgtgaaggagaacgaggaccacctgaacggcctcaagactcgcatagagaacgccgacgcacggaacggtgacctgctgcgcaccctcaacgacacactgggtaagctatctgctatcccaaatgacaccgcagccaaacttcaggctgttaaggacaaggccaggcaggccaacgacaccgcaaaagacgtcctcgctcagatcaccgaactccaccagaacttggatggtctgaaaaagaattataacaaactggctgactctgtagccaaaaccaacgccgtggtgaaggatccctctaagaacactgtggcagacgcagatgccactgtgaagaatctggaacaggaagctgacagactgatcgacaaactcaagcctattaaggagctcgaggataatctgaagaaaaatatttccgagattaaggaactaataaaccaggcccggaagcaggccaactctattaaggtctctgtgagcagtggcggcgactgcatacgaacatataagccagagattaagaaaggaagctacaacaacatcgtggttaacgtgaagaccgccgtggccgataaccttttgttctatctgggctcggcgaagtttatcgattttcttgccatcgagatgaggaagggcaaagtatcattcttgtgggacgtggggtccggagtcgggagagtcgaatacccggacctaactatcgacgacagctactggtaccggattgtggctagccgaactggtcgaaacggcactattagcgtgcgcgcactggacggccctaaagctagtatcgtgcctagcacccatcacagcacgtctccaccaggctacacaatcctggatgtcgatgccaatgcgatgctgtttgtgggaggcctcacggggaagttgaaaaaagcagatgccgtccgggtgattacatttaccggatgcatgggtgaaacctacttcgataacaaacctatcggcctatggaactttagagagaaagagggagactgcaagggctgcacagtatcaccccaagtcgaagacagtgaaggcaccatccagttcgacggcgaaggctacgctctcgtatcccgacccattcgctggtatcctaacattagtaccgttatgtttaagttccgcactttctcctccagcgctctgctaatgtatctggccaccagggatctccgcgatttcatgagcgtggaactgaccgacggccacatcaaagtgtcttacgatctcggctccggtatggcctccgtggtatcaaatcagaatcacaacgacggtaagtggaagtccttcaccctgagccgaatccagaaacaggcaaacattagcatagttgacatagataccaatcaggaggagaacattgcaaccagttcctccggaaacaacttcggtctggacttaaaagccgatgacaaaatatacttcgggggattgcccaccctcaggaacctgtcaatgaaggctcgaccagaagtgaacctgaagaaatattctggctgcctgaaggatatcgaaatctctaggaccccctataacatcctctcaagtccagactatgtgggagtgacgaaggggtgttctttggagaatgtctataccgttagttttccgaagcctggatttgtcgaactgagtcctgtcccaatagatgtgggcacagagatcaacctgagttttagtacaaagaacgaaagcggcatcatcctccttgggagcggaggtactccagcccctccacgccggaaacgtcggcagaccggacaggcctattacgccatcctattgaatcgcggaagattagaagtgcaccttagtaccggtgcacggactatgagaaagatcgtcatacggccagaacctaacctctttcatgacgggagggagcatagcgtgcacgtggagagaacgcggggcatcttcacagtgcaggtggatgaaaatcgcaggtatatgcagaatctcaccgtagagcaacctattgaggtcaagaagctatttgtcggcggtgcgccccccgaattccagccaagtcccctgcggaacatcccgccttttgaagggtgtatttggaatctggttattaatagtgtacccatggactttgcacggcctgtcagctttaagaacgctgatatcggtagatgcgcgcaccaaaagctgcgcgaggacgaggatggagccgcccccgccgagatcgtgatccagcccgaacctgttccaacccccgcctttccaacacccacccctgtccttactcacgggccctgcgcagctgaatctgagccagctcttctaatcggcagcaaacagtttggactgagtcgaaacagccatattgctatagctttcgatgataccaaagttaagaaccgcttgaccatcgagttagaagttagaacagaagcggagtccggcctgttattttacatggctcgcattaatcacgccgattttgcaaccgtgcagctgaggaacggtctgccttatttcagctacgatcttggatctggcgacacacatacaatgattcccactaagattaatgacgggcagtggcacaagatcaaaattatgcgaagtaagcaggaaggcattctctacgtggatggagcctctaatcggacaattagccctaagaaggccgacattctcgacgtggtcggcatgttatatgtgggcgggctacctattaactataccacaagacgaatcggtccagtgacctacagcattgacggctgtgtacgcaacttgcatatggccgaggcccctgcagacctggaacagccgacttcgtctttccacgtggggacctgtttcgccaatgcccagcgggggacttatttcgatggtaccgggtttgcaaaagccgttggaggttttaaagtgggtctcgatctgctagtggagtttgaattccggacgaccactacgaccggtgtgctgctgggaatctccagccagaagatggacgggatgggaatcgaaatgattgatgagaaacttatgtttcacgtagacaatggcgccggaaggtttacagctgtctatgatgccggcgtacccgggcacttatgcgatggccagtggcataaagtgactgccaataagataaagcatcggatagagcttaccgtagatggaaaccaagtagaggctcagagtcctaatcccgcctccacctccgcagataccaatgacccggtgtttgtgggaggcttccccgatgatctaaagcagtttggtctaaccacttctatcccattccgcgggtgtatccgcagcctgaagcttaccaagggaacagcttcacactggaggctgatattacctagaccctggaactag

SEQ ID NO: 192678 - DNA, 5175 bp, Artificial Sequence
  Description of Artificial Sequence: Synthetic coding sequence
atgccccccgccgtgcggcggagcgcctgcagcatgggctggctgtggatatttggagcagccttgggtcagtgtctggggtattcgagccagcagcagcgggtgccattccttcagccccccggccagagccagctgcaggcctcttacgtggagtttcgacccagccaaggatgtagcccaggttactaccgggatcacaaaggcctatataccggcagatgcgtaccatgcaactgcaatggacattccaaccaatgtcaggatggatcggggatctgtgtgaattgtcagcataataccgctggcgagcactgtgagagatgccaggagggctactacggcaatgccgtgcacggatcttgtagggcctgcccttgccctcacactaacagtttcgctactggctgcgtcgttaacgggggagatgtgcgctgctcatgcaaggcaggatacaccggcacacagtgcgagcggtgcgctcccggttacttcggcaacccccaaaaattcggtggaagctgccagccctgctcgtgtaacagcaatggccagctgggtagctgtcaccctctgaccggggactgcatcaaccaggaacctaaagactcgagccctgccgaggagtgtgatgactgcgactcctgcgtgatgaccctactcaatgacttggcaacaatgggcgaacagcttcggctggtcaaaagccagctccagggactctcggcttcagcggggctcctggaacagatgcgacatatggagactcaagcgaaagacttaagaaatcagttgctgaactatagaagcgcaatctcaaatcatggatccaagatagagggcctcgaacgggaattgacggatttgaatcaagaatttgagaccctccaggagaaagcgcaggtaaactccagaaaggctcaaactcttaacaacaacgtgaatagggccacccagtcagcaaaagaactggatgttaagattaagaatgttatcagaaacgtgcacatcctgctgaaacagatctctggaactgacggtgaaggaaataatgtcccatccggtgattttagccgggagtgggcggaagcgcagcggatgatgagggaactcaggaatcgaaatttcggcaaacatctgcgggaagccgaggcagataagcgcgagtcccagctcctgctaaatagaatccgcacttggcagaaaacacaccaaggtgaaaacaatggacttgcaaatagcatccgagattcactgaatgaatatgaagcgaagctctccgaccttagagcaaggctgcaggaggcagccgcccaggccaaacaggctaacggcctaaaccaggagaacgagcgagccttaggagccattcagagacaggtgaaagagataaactccctgcagagcgattttacaaagtacttaaccaccgccgactcgagcttgctccagacaaatatcgctcttcaacttatggagaaatcccagaaggagtacgagaagcttgccgcttccctcaatgaagcccgtcaagaactgtctgacaaagtgcgggagctcagtagaagtgccggcaaaacttcgttggtggaagaagccgagaagcatgctcggagcttgcaggagcttgctaagcaacttgaggagattaaacgtaatgcaagcggggacgagctagtcagatgtgccgtggatgctgcaacggcctatgaaaatatcctgaatgcgatcaaagcagcagaggacgctgccaatcgcgctgcatctgcctcggaaagcgctctgcaaactgtcatcaaggaggatttgcctaggaaagctaaaaccctgtccagcaatagcgacaaactactcaacgaagccaagatgacccagaagaaactgaagcaagaggtctctcccgctcttaataacctacagcagaccctgaatatcgtgaccgtgcaaaaagaagtgatcgatacaaatctaaccactctaagagatggcttgcatggaatccagcgcggcgatatcgatgctatgatctctagcgcgaaatcaatggtacggaaagcaaacgatataacagacgaagtcctggatggactaaatcccattcagactgatgtggagcggatcaaagacacatatggacgaacccagaacgaggatttcaaaaaggcactgaccgatgcggacaattctgtaaacaagctaacaaataaactgcccgatctatggcgcaagatagagagcatcaatcagcagcttttacctctgggaaacatcagcgacaatatggaccgaatcagagagctcattcagcaggcccgagatgctgcaagcaaagttgctgtgcccatgcggtttaacggaaagtcaggagtggaggtccggctgcctaatgatttggaggacttgaaaggatacactagcctgagtctgtttttgcagagaccgaactcgagagaaaacggcgggactgaaaacatgttcgtgatgtacttaggcaacaaggacgcctcccgcgactacatcggaatggctgtggtggacgggcaacttacatgcgtatacaatctcggtgaccgggaggctgagctgcaggtggaccagattttaacaaaaagcgagactaaagaagccgtcatggaccgggtaaagtttcagaggatctaccagttcgccagattgaactatacaaagggcgccacgtcatccaaaccagaaaccccgggcgtgtacgatatggacggcagaaactctaacactctgctgaatctcgaccctgaaaacgtagtcttttacgtaggaggctatccccccgactttaaactgccctcaagattgagcttccctccgtataaggggtgtatcgagctggatgacctgaacgaaaacgtgctgagcctctataatttcaaaaagacgttcaaccttaacactactgaagtagaaccctgtcggcggcggaaggaggagtcagacaaaaattacttcgagggaacaggctatgcgcgggttccaacccaaccccatgccccaatcccgacattcggccagaccattcagacgactgtggaccggggcctgctattctttgccgaaaatggcgatagattcatctctctaaacatcgaggacggaaaactgatggtgaggtacaaactgaactcagaacttcccaaagagcggggagttggagatgccataaataatggcagagaccacagtatccagatcaagattggcaaattacagaaaaggatgtggataaacgtggatgttcagaatactatcatcgacggggaggtatttgatttttccacgtactatctgggcgggattccgatcgccatccgagagaggtttaatatctcaactcccgctttccgggggtgcatgaagaacctgaaaaagaccagcggagtcgtgaggctcaacgatactgttggagtgactaagaagtgcagcgaagactggaaattggtccgctccgccagtttttccagggggggacagctgtcatttaccgatttaggactacctccgaccgaccacctccaggcctcttttggcttccagacgtttcagcctagcggcatcttattggatcaccagacttggacccgcaatttgcaagtgactttagaggatggttatatcgagctgagtaccagcgactcaggatctcctatctttaaaagtccccagacctacatggatggacttcttcattatgtctcagtgatttctgacaacagcgggcttaggctgcttattgacgaccaactgctccggaattcgaagcgcctgaagcatataagctcaagcaggcagtccctgcggttgggcggcagcaactttgaggggtgtatatccaatgtatttgtacaacgactgtccctgtccccggaagtcctggacttgaccagtaatagcctcaaacgcgatgtgtcccttggcggatgcagcctcaacaaacctccttttttgatgttacttaaaggctctacacgattcaacaaaacaaagacctttagaatcaatcagttactgcaagatacccctgtggcctccccgagatctgtgaaagtgtggcaggatgcctgttcgccgctaccaaaaacccaggccaatcatggggctcttcagttcggtgatatccccacctcacacttgcttttcaaacttccccaggagctgcttaagcccaggagccagtttgctgttgatatgcagacaacaagttccagggggctggtgttccacaccgggactaagaatagcttcatggcgctttacctcagtaagggcaggcttgtgtttgccctgggtacagacggtaagaaactgcgaatcaagagcaaagagaagtgtaacgatggaaagtggcatacagtcgtctttggccacgacggagaaaaggggagattagtcgttgacggactgcgagctagagaggggagtttacccggaaacagtaccattagtataagagcaccggtttacctgggttctcctcccagtgggaaacctaaatcactccctaccaattccttcgttggctgcctcaaaaacttccaattagattctaaacctctctataccccatcatctagctttggggtatcctcctgcctcggaggccccctggagaaaggaatatacttctctgaggagggaggacatgtagttttagcccacagcgtcctgctgggacctgagttcaaactcgtgttcagcattcggcctcgctcgctgaccggcatcctgattcatatcggttctcagcctggtaaacatctatgcgtgtatctcgaagccgggaaagtgactgcttcaatggacagtggcgcaggcgggacttcgacctccgttacaccaaaacaatcactttgtgacggtcagtggcactcagttgcggtgaccattaagcaacacattctccacctggagctggacaccgacagttcatacacagcagggcagatcccattcccaccagccagcacccaagagccgctccacctgggcggggcgcccgcaaacctgacaaccttaagaattcctgtgtggaagagcttttttggttgcctgcggaacattcatgttaaccatattccagtcccagtgaccgaggccttggaggtacaggggcctgtgagtctgaacggttgccccgaccagtag

SEQ ID NO: 192679 - DNA, 10002 bp, Artificial Sequence
  Description of Artificial Sequence: Synthetic coding sequence
atggccgccgccgcccggccccggggccgggccctgggccccgtgctcccaccgactccgctgctgctgttggtcctgagagtgttacccgcttgcggagcaacggcccgcgaccccggggcagctgcgggactgtcactgcacccgacgtacttcaatttggccgaagcagccagaatttgggccaccgctacgtgtggcgagcgtggtcccggggagggtcgaccgcagccagaactgtattgtaaattggtcggtgggcccactgccccggggtctgggcatacaatccagggtcaattctgcgactattgcaacagcgaagacccccgtaaggcccaccctgttaccaacgctatagatgggtcagaacgctggtggcagtcccctccactctcgagtgggactcagtacaatcgggtgaatctcaccttagacctcggacaactgtttcatgttgcttacatcttgataaagttcgctaatagcccgcggcctgatctatgggtcctggaaaggtctgtggactttggaagcacttatagcccctggcagtattttgctcactctaaggtagattgtctgaaagagttcgggcgggaagccaatatggctgttactagggacgatgacgtcctgtgtgttaccgaatatagtcggattgtgcctctcgagaacggagaggttgtggtctcgcttatcaacggtcggcccggggcaaagaacttcacattctcgcataccttgcgcgaattcacaaaagctaccaatataaggcttcgctttctgcggacaaacaccttgctggggcacctgatttcaaaggcccagagagatcccacggtgacacggcgctattattacagcatcaaggatatcagcatcgggggacaatgcgtgtgtaatgggcacgctgaggtttgcaatattaacaacccagagaagctgtttcggtgtgagtgccagcaccacacctgcggagagacttgtgacaggtgctgtacaggctacaaccagaggaggtggaggccagccgcttgggagcagagccacgagtgcgaggcctgcaattgtcacggccacgcgagcaattgttactacgatcctgacgttgagcggcagcaagcctccctgaatacccagggtatatacgccggaggaggagtgtgtatcaattgtcagcataatacagccggggtaaattgtgagcagtgcgccaagggatactatcgtccatacggggtccccgtcgacgctcccgacggctgtattccttgcagttgcgatcctgaacatgctgatggatgcgaacaaggttctgggcgttgccattgcaaacccaactttcacggcgacaactgcgagaaatgcgctattgggtattacaactttccattttgcctgcggatccccattttcccagtgagcactccctccagcgaggaccccgtcgccggtgacattaagggatgtgattgcaatttggaaggagtgctgccagaaatctgtgatgcccacggccggtgcttatgtcgccctggggtagagggaccacggtgcgatacgtgtcgttccggcttctacagctttcccatctgccaggcttgctggtgtagtgcacttggcagttatcaaatgccttgctcctcagtcacagggcagtgtgaatgcagacctggcgtgacaggccagagatgcgatcgctgcctgagtggagcttacgatttccctcactgccagggttcgtcgtccgcctgtgaccctgccggaacaattaactcaaacttgggttattgccaatgtaagctgcatgttgaaggccccacttgctccaggtgcaaattattgtactggaatttggataaagaaaatccatcaggctgttcagagtgcaagtgtcacaaagccgggacagtttctgggactggagagtgcaggcagggagatggagactgccactgcaagtcgcatgtaggcggagattcttgcgacacatgtgaagacggctactttgcactggagaagagtaactattttgggtgccaaggctgccaatgtgatataggaggagccctctcaagcatgtgctctgggccctccggcgtgtgccagtgtcgggaacacgtagtggggaaagtttgccagcgccctgagaataattattattttccggacctgcatcatatgaagtacgagattgaggatggatctacccccaatgggagggacctcaggttcgggttcgatcctctagcatttccagagtttagttggagaggctatgcgcaaatgaccagcgtgcagaacgacgtccgcatcaccctgaacgtcggtaagtcctctggatcgctgttccgggttatattgcgatacgtcaaccccgggactgaggcggtgagtgggcacataacaatttacccttcatggggtgctgcgcaaagcaaggaaataatcttccttccctcaaaggaaccagctttcgtgacagtgccaggtaacggctttgccgatccgtttagcattaccccaggtatctgggtggcctgtatcaaggctgagggcgtcttactggactacctggtgctgctgccacgggactactacgaggcgagtgtgttgcaattgcctgtgactgagccttgtgcatatgccgggcccccccaggaaaactgcctcttataccagcatctgcccgtcacacgattcccatgtacactggcttgtgaagcgcggcatttcctgctggacggagagccccggccagttgccgtccgtcaacctacccccgctcaccctgtgatggtcgacctgtcggggcgcgaagtcgagctgcacctgcggctaagaatcccccaggtgggacattacgttgtggtagtggagtattctacagaggcggcacaactgtttgtcgtggatgttaacgtgaagtccagcggctcagttctggcaggccaggtcaatatctactcttgtaattactctgttctgtgcaggtccgctgtgatcgatcatatgtcccgcatcgccatgtacgagctccttgcagatgccgatatccagctcaaaggacatatggcccgatttcttctgcatcaggtttgcatcatcccaatcgaggagttttcggcggaatacgtccgaccgcaagtgcactgtatagcctcatatggcaggtttgtgaaccagtcggcaacctgtgtctctctggcacacgaaactccgcccactgctctgatcctcgatgtgctcagtgggaggccttttccgcatctgccccagcagagtagcccttccgtcgacgttcttcccggggttaccctgaaagcccctcaaaatcaggtcacactacggggccgggtgccacatctgggtcggtacgtcttcgtgattcatttttaccaagccgctcacccaactttccctgctcaggtgagcgtggatggggggtggccccgagctggaagttttcacgctagcttttgtcctcatgtgctgggctgtagggatcaagtcattgcggagggacaaatagaattcgatatttctgaacccgaagtcgcagccaccgtcaaggttcccgaaggtaagtctctcgtcctcgttcgtgtcctggtcgttcccgcggagaattacgactaccaaattctacacaaaaagagtatggataaaagcctagaattcattactaattgtggcaaaaattcattttacctggaccctcagacggcctccagattttgtaagaacagtgctcgttcattagtggcattctaccataagggagcactgccatgcgagtgccaccctaccggcgccaccggaccacactgtagcccggaaggcgggcagtgcccctgccaaccaaatgtgattggccgtcagtgcacgagatgcgccacaggacattatggattccccaggtgcaaaccctgctcatgcggacgcaggctgtgtgaggaaatgactggccagtgtaggtgcccgccaagaaccgtccggccacagtgcgaagtgtgtgaaacacactctttcagcttccacccaatggccgggtgtgagggatgcaactgttctcggcgcggtaccattgaggcggcaatgcctgaatgcgacagagattcagggcaatgccgttgcaagccacgtatcacaggtcgccaatgtgaccggtgcgccagcggtttctatagattccctgagtgcgttccatgcaactgtaatagggatggtacagaacctggagtttgcgacccaggaaccggcgcgtgtttgtgtaaggaaaatgtcgaagggaccgaatgtaatgtctgtcgcgaaggcagttttcatctggaccccgccaacttgaagggttgcacatcatgcttctgcttcggggttaataatcaatgtcactcatcccacaaaagaaggactaaattcgtggacatgctcggatggcacctggagaccgccgacagagtagatattcccgtatcgtttaatccagggtcaaacagcatggtggccgatcttcaagaattgccagccacaatacattcagcgtcttgggtggcccccacgtcatatttaggggataaggtctccagctacggggggtaccttacgtaccaggccaagtcattcgggctgcctggggatatggtactactggagaagaaaccagatgtgcaacttactgggcaacacatgagcatcatttacgaggagaccaacacacccaggccagataggctgcaccatggccgggttcatgtggtggagggaaacttccgccatgcctcatcccgggcccctgtctctcgggaggaactgatgacggtgctgtcccggctggccgacgtccgtattcaaggtttatatttcacagaaacacaaaggctgactctgtcggaggtcggactggaagaagcctcagacactggatccggcagaatagctttagccgttgaaatttgtgcctgtccgcccgcatacgccggggactcctgccaaggttgcagcccagggtactatagggaccataagggtctgtacacagggcggtgcgtaccctgcaattgcaatggacactctaatcaatgccaggacggatcaggcatctgtgtgaactgtcagcataataccgcaggcgaacactgtgaacggtgccaagaggggtattacggtaacgctgtgcacggctcatgtagagcctgtccatgcccgcacaccaacagtttcgcgacagggtgtgtggtaaatgggggcgacgtgcggtgtagctgcaaagccggctacacaggcacccagtgcgaacgctgtgccccagggtacttcgggaacccccagaaatttggagggagttgccaaccttgctcatgtaactctaacgggcaattagggtcctgccatcctcttacaggcgactgcataaaccaggagccaaaggattcgagccctgcagaggagtgcgacgactgcgacagctgtgtcatgacactcctgaatgatcttgcaacaatgggagaacagctgcgtctcgtgaagtcccagctgcagggactgtctgcatcagcgggacttctcgagcaaatgaggcacatggagacccaggccaaagaccttaggaatcagttgttgaactatagaagcgcgatctcgaaccatggctccaagatcgaaggactcgagagagagttgacggaccttaaccaggagttcgagactctccaggagaaagcccaggtgaattcccgcaaggcccagaccctgaataataatgttaaccgggcaactcagtcggccaaggaacttgacgttaaaattaagaatgtgattaggaacgtccacatccttctgaaacagatcagcgggactgatggtgaaggcaataacgtccctagtggtgactttagccgtgaatgggcagaggcccaaaggatgatgagagaactcagaaaccggaatttcgggaagcatctgcgcgaagccgaagccgacaagcgcgaatcacagctgctgctcaatagaattagaacatggcagaaaacgcaccagggcgagaacaacggcctcgccaattcaatccgcgactcgttaaatgagtacgaggcaaagctgtctgatttaagagctcgattgcaggaggcggcagctcaggccaagcaggccaacgggttgaatcaggaaaatgagcgcgcacttggagccatccagcgccaggttaaagagataaacagcctgcaatccgacttcaccaaataccttaccacggcggactcaagccttctgcagaccaacattgccctacaacttatggaaaaaagtcaaaaagagtatgagaaattggccgcatctctgaacgaggcccgacaggagctctcggacaaagttagggaactttcacggagtgccggtaagactagccttgtagaggaggctgagaagcacgcccgcagcctgcaggaattggcgaagcagctggaagagataaagcggaacgctagcggggatgaattagttagatgtgcagtcgatgctgcgactgcgtacgagaatattctgaacgctatcaaagcggccgaggacgccgccaatcgagctgcgtcggcttctgagagcgccttacagaccgtcattaaggaagatctccctaggaaagctaagaccttgagtagtaactcagataagcttcttaatgaggcaaagatgacccagaagaaattaaaacaagaggtgagtccagctttaaacaacttacagcagactttgaacatcgtgacggtgcagaaagaagtgatagataccaacctgacaaccctcagggacggtctgcacggcatccagaggggcgatattgacgcaatgatcagttctgctaaatctatggtgaggaaagccaatgacataacagatgaggttctcgacggtctgaatcctatccagacagacgttgaaaggataaaagatacctatggtcgcactcagaacgaagatttcaagaaagcactgactgacgctgataacagcgtgaacaaattgacgaacaaactcccagacctttggcggaagattgagagtatcaatcagcagctgctccctctcggaaatatatccgataacatggataggatccgcgagctgatccagcaggccagggatgccgcttctaaggttgcagtgcctatgaggtttaacgggaaatctggcgtggaggtccgcctgccaaacgatttggaagatttgaagggttatactagtctctctttgttccttcagaggcctaatagtagggaaaatggaggcaccgagaacatgttcgtgatgtacctcgggaacaaggatgcaagcagggattatattggcatggccgtggtggacggtcaactcacatgcgtgtataatttgggcgatcgagaggctgagctccaagtggatcagattctcactaagtctgaaaccaaggaggccgtgatggacagagtgaagttccagcggatataccaattcgcccgcctcaactacaccaaaggcgcgacctcctcaaagcctgagacaccaggggtgtacgatatggacggaaggaacagtaatacactgttgaacttggaccctgagaacgttgtgttttacgtgggaggataccctccggactttaagctgccctcacggttatccttcccgccctacaagggttgtatcgaactggacgatctcaatgagaatgtgttgtccctctataatttcaagaaaacatttaacctgaacacaactgaggtggagccatgccgacgcagaaaggaggaatcagacaaaaactacttcgagggcaccggatacgctcgtgtgcccacccagccccatgcccctatcccgaccttcggccagaccatccaaacaactgtggatcgtgggctgttgttctttgctgagaacggtgacaggttcatctcacttaacatcgaggatggcaagttaatggtgcggtataagctgaattcagagttgcccaaggagcggggcgtcggagatgcgatcaataacgggagagaccatagcattcaaattaagatcggcaagctacagaaaaggatgtggattaacgttgacgtccaaaatacaatcattgacggcgaggtctttgacttttctacctattatctgggaggaattcccattgccatccgggagcggttcaatattagcacccctgcatttaggggctgcatgaagaatctgaaaaagacgagcggagtcgtgagactaaatgatacggtcggggttaccaagaagtgctccgaagactggaagctagttcgctcagccagtttctcacggggagggcagttgtcattcacagatctgggcctgcctcccacggaccacttacaggcgtcctttggattccagacctttcagccgagcggaatcctgttggaccatcagacatggaccagaaatcttcaggtcactcttgaggacggttatattgaactgtctactagcgatagcgggtcaccaatcttcaagtctccccagacttacatggatggactactccactacgtttcggtaattagcgacaacagcgggctgcgcttgctgatagatgaccagctgttgaggaacagtaagaggttaaagcacatctctagcagccgacagagcctacgcctgggcggttctaacttcgagggctgcatttctaacgtcttcgttcaaaggctgtctcttagccccgaggttttagacctgacttcaaatagtttgaaaagggacgtgtcactcggcggttgctccttgaacaagccccctttcctgatgctgctcaaagggtccactagattcaacaagaccaaaactttcagaataaaccagcttctacaggacactccggtggcctccccacgttccgtgaaggtttggcaggacgcctgcagtcctcttcccaaaactcaagccaaccacggtgccttgcagtttggagatatccctacctcacacctcctctttaagttgccgcaggagctgctgaaaccaagaagtcagtttgccgtggatatgcagaccacatctagtaggggcctggtattccatacaggcactaaaaatagctttatggcgttatatctctctaagggcaggctcgttttcgctctgggcactgacggtaagaagctgagaatcaagtccaaggaaaagtgcaatgacgggaagtggcacaccgtcgtgtttggccatgatggggagaagggcagactggttgtggacggcctgcgagcacgggaggggagtctccctggaaactcaaccatttctattagggccccggtatacctggggtccccacccagcgggaaacctaaatcactgccaaccaactccttcgtgggctgcctgaagaacttccaattagattcgaagcccttgtacactccttcaagtagcttcggcgtaagcagctgtctgggaggccctcttgagaaaggcatttatttctctgaggaaggaggacacgtggtactggctcattcagtcctgttgggccccgagttcaaactggtgttttccatccgaccccgttccctgaccggaatcctgattcatatcgggtctcagcccggcaagcacctatgcgtgtaccttgaggccggaaaggttaccgcctccatggacagcggggctggagggacaagtacctccgttactcccaaacagagcctatgtgatggccagtggcattctgtggctgtgactataaaacaacatatcctgcacttggaactagacacagattcctcctatactgcaggccagatcccatttccaccggcctccactcaggaacccctacatctgggcggtgcacctgccaacctgaccaccctgcggatccccgtatggaagtcgtttttcggatgtctgaggaatatccacgttaatcacatccccgtcccagtaactgaagccctggaggtgcaaggccctgtgtcgctgaatggatgcccggatcagtag

SEQ ID NO: 192680 - DNA, 9834 bp, Artificial Sequence
  Description of Artificial Sequence: Synthetic coding sequence
atggccgccgccgcccggccccggggccgggccctgggccccgtgctgcctcccacacctttgctattgctcgtccttcgcgtgcttcccgcctgtggcgccacagcccgcgatccaggagctgctgctggtttgtcactccaccctacgtatttcaatctcgcagaggcagctaggatctgggccacggctacatgcggtgaacgaggacccggtgagggccgtccccaaccggaattatactgcaagctcgttggcgggccaacagcgcctggctcaggccacacgattcaaggacagttctgtgactattgcaactctgaagatccccgcaaagcgcacccggtgactaatgcaatcgatggttcggaaagatggtggcaatctccccctctgtctagcgggacacagtacaaccgggtgaatctgactcttgatttgggtcagctgtttcatgtcgcctacattctgatcaaattcgccaattctccacgccccgacctgtgggtgctcgaaagaagcgtggacttcggttctacatacagcccctggcagtattttgcccactcaaaagtggattgcctcaaggagttcgggagggaggccaacatggccgtgacaagagacgacgatgtgttgtgcgtgactgaatacagccgcatcgtgccactggaaaatggcgaagtggtggtgtcgttgatcaacggacggcctggcgcaaaaaacttcactttctcacacacactacgcgaatttacgaaggcaactaacatacggctgcgctttctgagaaccaacaccctactgggccacctgatttccaaagcacagagagaccctaccgtcacacgccgctactactacagcatcaaggacatctccatcggaggtcagtgtgtttgcaacggccatgccgaggtttgcaacatcaacaatcctgagaagcttttcagatgtgagtgtcagcatcacacatgcggggagacctgtgaccggtgctgcactggatataaccaaagacgttggcggcccgccgcttgggaacaatctcatgaatgcgaggcctgtaactgccatggccatgcaagtaactgctattacgacccagacgtggaacgacagcaggcatccttaaatacccaaggtatctatgctggtggcggggtttgtattaactgtcagcataacactgcaggagtaaactgcgaacagtgcgcaaagggatactatcgaccttacggggttcctgtagacgcccctgacggatgtatcccttgcagctgtgatcccgagcatgcggatggatgcgagcaggggtcggggagatgccattgtaagcctaactttcacggggataactgtgaaaagtgtgcaatagggtactacaattttccgttctgtctaagaatccccatcttccccgtgtccacgccctcttcggaggatccagtagctggcgacatcaaaggttgcgattgtaatctggaaggcgtcctgcccgaaatctgcgatgcccatggccgatgcctgtgcagacctggggtcgaggggccgaggtgtgatacttgtcgatctggcttctatagttttccgatttgccaggcctgctggtgttctgccttgggaagttatcagatgccatgcagctctgtgaccggccagtgtgaatgtagaccaggcgtgacgggccagcgctgcgacaggtgcttgtcaggagcatacgacttccctcattgccagggctcatcctcagcctgtgatcctgcaggcaccattaactctaatttagggtattgccagtgcaaacttcacgtcgagggccctacctgctcccgctgcaagcttttgtactggaatctcgacaaggaaaacccatcaggctgctcagagtgtaagtgccataaggcaggaaccgtgagtggcactggtgagtgcagacagggcgacggagactgtcattgtaaatctcacgtgggcggtgacagctgtgacacctgcgaagacgggtattttgctcttgagaaatcaaattattttggttgccagggatgtcaatgcgatatcggaggtgccctgagcagtatgtgttctgggccgtctggcgtttgccagtgtcgcgagcatgttgtcgggaaggtgtgccagagaccggagaacaactactatttcccagatctgcaccatatgaaatatgagattgaggacgggagcacaccaaacggtagagacctgcgtttcggattcgatcccttggcttttccagaattcagttggagggggtacgcccaaatgaccagcgtgcagaacgacgtgcgaatcactctgaacgtgggcaaatcttcagggtcactctttagggttattctcagatacgtcaaccccggcaccgaggctgtgagcgggcacattaccatctatccaagttggggcgcagcacagagtaaagagatcattttcctaccatcgaaggagccagcgttcgtaaccgtccccgggaatggattcgccgacccattcagtatcacaccaggaatctgggtggcatgcatcaaagcagagggcgttctactcgactacttagtgcttctgccccgcgattactatgaggcctctgtgcttcagctgccagtcaccgagccatgtgcctacgcgggcccccctcaggagaattgtctgctgtaccagcatttgcctgtcacccgatttccctgcaccctggcatgcgaggcacggcactttctcctcgatggcgagccgcgccccgtcgctgtgagacaacctacacccgcgcaccctgtcatggtggacttgagcgggcgtgaggtagagttacacctcaggctacgaatacctcaggtgggccactacgtggttgtggtggagtatagtacagaggccgcccagctgttcgtggtggatgtgaacgtgaaatcttcggggtcagtgttagcgggacaggtgaatatctactcctgcaattatagtgtgctgtgccggagtgccgtcattgatcatatgagccgaatcgcaatgtacgagttgctggctgacgctgatattcagttgaaaggacacatggcacgatttcttctccaccaggtctgcatcattcctattgaggaattttctgccgaatacgtgaggccacaggtccactgtatcgcatcttacggcaggtttgtgaatcagtcagctacctgtgtgagcctagctcacgagacgccccccacagcgctgattcttgacgtgctgagcggtcgcccgtttccccacctcccgcagcaaagttcccctagcgttgacgtcctgcccggggtgacactgaaggcacctcagaatcaggtgactttacggggccgggtcccccacctcggccggtacgtattcgtgattcacttctaccaggctgcacatccaaccttcccagcacaggtgagcgtggacggcgggtggccaagggcgggctcgttccatgccagcttctgcccacatgttctgggttgtagagaccaagtaatcgcagagggtcagatcgagttcgatatctctgaacctgaagtagccgctacagtgaaagtaccagagggcaaaagtctggtgctggtgagagtgctggttgtacccgccgaaaactacgactatcagatcctccataaaaagagcatggacaagagccttgagttcataaccaactgcggaaaaaatagcttctatctcgacccgcagacagcctcaagattttgtaagaatagcgctcgctctctggtggcattttatcacaagggagccctgccgtgcgaatgccacccgacaggcgccacaggtccccactgctctccagagggtggccagtgcccctgccagcccaacgttatcggcaggcagtgcacacggtgtgctacaggacactatggtttccctcgatgtaagccttgttcttgcggaaggagactgtgtgaggaaatgaccggtcagtgcaggtgtccgcctcggactgtgcggccccagtgcgaggtgtgtgagactcactcattttcatttcaccccatggccggatgtgaaggctgcaattgttcacgtaggggcacaatcgaggccgccatgcctgaatgcgatagagattcgggtcagtgccgttgtaaacccagaatcacaggcagacagtgtgataggtgtgcctccggcttctataggtttcctgagtgtgtcccatgtaactgtaatcgggacggcacagagcccggcgtctgcgatccgggaaccggagcttgtctgtgtaaggaaaatgtcgaagggaccgaatgtaacgtttgtagggaggggtctttccacttggatcccgcaaatctgaaaggatgcacgtcctgtttctgcttcggggttaataaccaatgtcacagcagtcataagagacgtaccaaattcgtggacatgctaggttggcacttggaaactgcggatcgggtagatatccctgtgagttttaatccaggcagcaactctatggtcgcagatcttcaggagcttcccgctaccatacacagcgcctcctgggtcgcaccaacgtcatacttgggagacaaagtctcttcttacggtggttatctgacctatcaagcaaagtcgttcggtctgcccggtgatatggtgctcttggaaaagaagcccgacgtgcaattgactgggcagcacatgtcaattatttatgaagaaaccaacactcctcggcccgacagactgcaccatggccgggttcacgtcgtagagggaaattttcgacacgcaagcagcagagcccccgtctctcgcgaggaactgatgacggtgctgtcgcgcctggcagacgtgaggattcagggtctgtacttcaccgagacccagcgattgacccttagcgaagtgggcctggaagaagcatcagatactgggtcaggccgcatcgcactggcagttgagatttgcgcatgccctccagcctacgccggcgactcatgtcagggatgtagccccggatactaccgggatcacaagggactgtacacgggcagatgcgtaccatgtaactgtaacggccattctaaccagtgccaggacggatcaggcatttgtgtcaattgccagcacaacaccgcaggagagcattgtgaacgatgccaggagggctattatggtaacgccgtccacggatcatgtagggcctgcccatgtccgcacacaaattcctttgctaccggctgcgtcgttaacggtggcgacgtgaggtgctcatgtaaagctgggtacaccggcactcagtgtgagcgatgcgctcctgggtattttggaaacccccaaaaattcggtggttcctgtcaaccttgttcatgtaactctaatggacaactaggctcatgccatccgctgactggcgattgtatcaaccaggaacccaaggattctagcccagccgaagaatgtgatgattgtgacagctgcgtgatgactctcttgaacgacctggctaccatgggagaacagctccggttagttaaaagccagcttcaggggctatcagcctcggccggactgctggaacagatgaggcatatggaaacacaagccaaagacttgagaaaccagctgttgaactacagatcagctatctcaaatcacggatctaagatcgagggattggaacgcgagctcactgacctgaatcaggagtttgagacacttcaagagaaagcacaagtgaacagcaggaaagctcagacgctgaacaacaatgtcaatagagccactcagtccgccaaggaactggatgtcaaaattaagaacgttatccggaacgtgcacatgcttaaccgtatacgtacctggcagaaaacccatcagggagaaaacaacggtctggcaaattctatacgcgatagcttgaacgaatacgaagccaagttgagtgatctgagggcaagacttcaggaggctgccgctcaggccaaacaagctaacgggctgaatcaggaaaatgaacgcgctttgggcgcaatccagcgacaggtgaaagaaattaatagtctgcagtccgatttcaccaagtaccttacaactgcagactctagcctgcttcaaacaaacatcgccctccagctcatggaaaagtctcagaaggaatacgaaaaacttgccgcctcactaaacgaagccaggcaggagctctccgataaggtgagggagctatctaggtctgcaggcaaaacaagcctcgtggaagaagccgagaaacacgccagaagcctgcaggaactggccaaacaattagaggaaatcaagcggaacgcttcaggcgatgagctcgtgaggtgtgcagtggacgccgctactgcttacgagaacattctgaacgccatcaaggccgcggaagacgccgcgaatcgcgctgctagcgcctcagagagcgctctccagacagttataaaagaggatctcccacgaaaagcaaagacactgtctagcaactcagataaactattgaacgaagccaagatgacacagaaaaagctgaagcaggaagtatcccctgctttgaacaatttgcagcagactctcaatattgtgacagtgcaaaaagaggtgatcgataccaatctgaccaccctgagagatggtctgcacggaattcagagaggagacattgatgccatgattagtagtgctaaatccatggttcggaaggccaacgacatcactgacgaagtcttggatggcctgaatccgatccagacagatgtggaacgaatcaaggatacttacggtcggacacaaaatgaagattttaaaaaagccctgaccgatgccgataatagtgtgaataaactcaccaacaagctccctgacctttggcgcaaaatcgaatcaatcaaccagcagctcctgcccctcggcaacatcagcgataatatggaccgcatccgtgaattgatccaacaggctagagacgctgctagcaaagtggcggtcccaatgcgtttcaacggcaaatccggagtcgaagtgaggttaccaaatgacctggaggatttaaagggatatacctccttgtcccttttcctgcagcgccctaattctcgcgagaatggggggactgaaaacatgtttgttatgtatcttggaaacaaagatgccagtcgtgactatattggtatggccgtcgtcgatggccagctcacctgtgtgtacaaccttggagatagagaggccgagctgcaagtggaccagatcttaactaagtcagagacaaaagaagcggtcatggacagagtgaaatttcagcggatctatcaattcgcacggctgaattacacaaagggcgccacctcttcaaaaccagagactcccggagtgtacgacatggatggtcgcaattctaacaccctgctgaacttggatccagagaatgtcgtgttctatgtgggcggttacccaccagacttcaagctgcctagccggttgagctttcccccttataaagggtgcattgaactggatgaccttaacgagaatgtgctttctctctacaactttaaaaaaaccttcaatctgaacacgactgaggtggagccttgtaggcggaggaaggaggaaagtgacaaaaactattttgaagggactggctacgcgcgcgtaccaacccagccacacgcaccgattcctaccttcggccagaccatacagacgactgtggatagaggcctcctgttttttgccgaaaatggggatagatttatctccctgaacatcgaagacgggaagttaatggtccggtataagctgaattcagagctgcccaaggaaagaggcgtgggtgacgcaatcaataacggcagggaccacagtattcagattaagattggaaaattgcagaagcggatgtggataaatgtagatgtgcaaaacacgattatcgatggtgaggttttcgattttagtacgtattacctcggggggattcctatcgcaatcagagagcggtttaacataagcacacccgcgttccggggatgcatgaagaacttgaagaagacctctggggtggtgcggctgaacgatacagtaggggtgacaaagaagtgttctgaggattggaaactggttagatccgccagctttagtcgagggggacaactgagcttcaccgacctgggactgccgcccaccgaccatcttcaggcatccttcggcttccagacgttccagccgtccggcatcttgttggaccaccaaacatggactcgaaatttgcaggtcacactggaagatggctacatcgagctatctacaagcgattctggaagcccgatttttaagagtccccagacgtacatggatggcttgctgcattacgtttccgtgatctctgataacagcggtttgcggcttctgattgatgatcagctgttgcgcaattctaagcgactcaagcatatttctagtagtcggcaaagtctcagacttggaggctccaatttcgaggggtgcataagcaacgtgtttgtgcaaagactgagcctgagtcccgaggtgctggatctcactagtaactctcttaagagagacgtcagcctgggcggatgctctctgaacaaaccaccctttctgatgctgctgaaaggctccacgcggttcaataaaactaagaccttcaggatcaaccagttgctccaggacacgccagtggcctctcctagaagcgtgaaagtctggcaggacgcttgttctccgctgcccaaaacccaggctaaccatggcgcgctacaatttggcgacatccccacctctcatcttctgtttaaacttcctcaggagctgctgaagcctaggagtcagttcgcagtagatatgcaaaccacttcatccagggggctggtgtttcacacagggaccaaaaactccttcatggcactttatctttcaaagggtcgcctggtgtttgccttgggaaccgatggaaagaagctgagaatcaaaagcaaggaaaagtgcaatgacggtaaatggcataccgtggtgttcggtcacgatggagagaagggacgcctagttgtggacggtctgagagccagagagggttccctgcccggaaactcgactattagtattcgggcacctgtttatctgggaagtcccccttcggggaaaccgaagtcattgcctaccaatagttttgtgggatgcttgaaaaatttccagctcgattctaagccactatatactccatccagcagcttcggcgtttctagctgtctgggaggtccactggaaaaaggaatctacttcagcgaggaagggggacatgtggtgctagcccattcagtgttactaggacccgaattcaaattggttttcagtattcgcccccgtagcctcaccggaatcttgatccacatcggatctcagcccggaaagcacttgtgcgtttatctggaggccggaaaagtcacggcaagtatggactcaggggctgggggtacatccacaagtgtaacacctaaacagagcctgtgtgatggccagtggcatagcgtggccgtgaccattaagcaacacatcctccacttggagcttgacactgactcttcctacaccgcggggcagattcccttcccccccgcatctacgcaagaaccgcttcacttaggcggggccccagcaaacctgaccactctccgtatccctgtgtggaaatccttcttcggctgtcttcggaacatccacgtcaatcatatccctgtcccagtaacagaggcccttgaggtccaggggccagtgtccctaaacggatgccccgaccagtag

SEQ ID NO: 192681 - DNA, 4560 bp, Artificial Sequence
  Description of Artificial Sequence: Synthetic coding sequence
atggccgccgccgcccggccccggggccgggccctgggccccgtgctccctccaacacctctgctactcctggttctgagagttttacccgcctgcggcgctaccgctagagatccgggggcggccgccggactcagtctgcatcctacttacttcaatctcgccgaagcagcaaggatatgggctaccgctacctgtggagaacgcggaccaggcgagggtcggccccagccagaactgtactgtaaattagtgggtggaccaactgcacccggttccgggcatacaatccaggggcagttctgcgactattgtaactctgaggacccgaggaaagcccatccagttacaaacgccattgacgggtctgaacgttggtggcaatctccaccgttgagctcaggcactcaatacaaccgagtgaacctcaccctggatctgggccagctgttccacgtggcttatatattgatcaaatttgccaatagcccacggccggatctgtgggtcttggagcggtccgtagactttggatccacttacagtccttggcaatattttgcccactcaaaagttgactgcctcaaagaattcggccgggaggccaatatggctgtgacacgggatgatgatgtgctctgtgtcacggagtacagtaggatcgtgcctctagagaatggagaggtggtggttagcctgatcaatgggcggcccggggccaagaacttcacttttagccatactctcagggtgtatcaaggtaataagcatccactgttcctgaggacaaacactctcttagggcatctgatttccaaagctcaacgggatcccaccgtaacacgccgctactattattccatcaaggatatatcaattggcgggcaatgcgtctgtaacggccacgccgaggtctgcaatataaacaatcccgagaaactgttcaggtgtgagtgtcaacaccatacatgcggggaaacatgcgatcgatgctgcaccgggtataatcagagaaggtggagacccgccgcctgggaacagtcccacgagtgtgaagcttgtaattgccatgggcatgccagcaattgttactacgacccagatgtcgagaggcagcaggcttccctgaacactcagggaatttatgcaggcggcggagtgtgtattaattgtcagcataacaccgccggagtgaactgcgaacaatgcgcaaaaggttattatagaccgtacggggtcccagtcgacgccccggacggctgtattccatgctcatgtgatcccgaacacgcagacggttgcgagcagggatcggggaggtgccattgtaaacccaatttccacggggacaattgcgaaaagtgcgcgattggctactataatttccccttttgtctcaggatcccaatcttccctgtgagtacgccctctagcgaagacccggttgcaggagacataaagggttgtgactgtaatctcgagggcgtactgcccgaaatctgtgacgcacatggtcgttgtctctgtagacctggagtggagggtcccagatgcgatacatgccgcagtggcttctactcctttccaatttgccaggcgtgttggtgttccgcgctagggagctaccagatgccctgcagctccgtgaccggtcaatgcgagtgcaggcccggcgtaaccgggcagcgctgcgatcgatgcctctctggagcctatgactttccgcactgtcaaggcagttcatctgcttgcgacccagccggcaccatcaactctaatcttggctactgtcagtgtaaacttcacgtcgaggggcctacctgcagccggtgcaagcttctgtactggaatcttgacaaagaaaaccccagcgggtgcagtgagtgtaagtgtcacaaggccggtacagtatcaggaactggcgagtgtcgccagggcgatggagactgtcactgcaaatcacatgtcggcggggattcttgtgacacatgtgaggacgggtacttcgccctggaaaagtcaaattatttcggatgccaaggatgccagtgtgatattggcggcgccctgtcctcaatgtgtagtgggccgagcggcgtctgtcagtgtagggaacacgtcgtcggcaaagtgtgccaacgaccggagaacaattattacttcccggacctgcaccacatgaagtacgaaatagaagacggatcaactcctaatggccgtgacctgcggttcggatttgatcccctagccttccccgaattctcttggcgagggtacgcgcagatgaccagtgtgcagaatgacgtgagaatcaccttgaacgttgggaaatcaagcggatcgcttttccgggtgatactccgctacgttaaccctgggaccgaggccgtgtcagggcatatcacaatctacccatcatggggcgcagcccaaagtaaagaaatcatcttcctgcccagtaaggagcctgccttcgtgacagtgcctggcaacggcttcgccgatccattctcaatcactcctggcatctgggtagcctgcattaaggcggaaggcgtattgctcgattacttggtcctgttgccaagggattactacgaagcaagcgtattgcagttacccgtgacagaaccatgtgcctacgctggaccacctcaggagaactgcctgctgtatcagcatctgcctgtgactcgtttcccctgcaccctcgcatgtgaggcgcgccattttctgcttgacggggagcccagaccagtagccgtgaggcagcccactcctgctcatcccgtgatggtggatctgtctggaagggaagtcgagctgcacctgaggctgagaattccccaggtgggccattatgttgtggtggttgaatattcaaccgaggccgcacagcttttcgtagtcgatgtcaatgtgaaatcctccggttccgttctggcggggcaggtgaatatctactcttgcaattattcagtgctttgtagatccgctgtgattgatcacatgtcacgcattgctatgtacgagctcctagccgacgctgatattcagctcaagggccacatggcccgctttctactgcaccaggtgtgcataatcccaatagaggaattcagcgccgaatatgttaggccccaggttcactgcatcgcaagctatgggaggttcgtgaatcagtcagcgacgtgcgtgtccttagcccacgaaactcctcctaccgcactcattttggacgttttgtctggccgcccgtttcctcatctgccgcagcagagctcaccttccgtggacgtgctgccaggtgtgacacttaaggccccgcagaaccaagtgacactcaggggtcgcgtgccacatctggggagatatgtgttcgtcatacatttctatcaggcagcccacccaacctttcctgctcaagtgtccgtcgacggcgggtggccacgcgctggctcctttcatgcttcattctgcccacatgtcctggggtgcagggatcaggttatagcggaaggccagattgagtttgacatttctgagcctgaggtggctgcgaccgtcaaggttcctgagggcaagagcttagtgctggtcagagtgctggtggtgcccgccgagaactatgactatcagatactgcacaaaaagtccatggacaagtccctagaatttataactaactgtggaaaaaactcattctatctagatccccagaccgccagccggttttgcaagaactccgctaggagcttggtggccttttaccacaagggagcactgccgtgcgaatgtcatcccacaggggctacagggccccattgtagccccgaaggcggtgcccacgctagcccgacatctagcgggggctcagcccctgccgtacaacaggcttacggcttccccagatgcaagcggaagagctgctcatgcggcaggcggctgtgcgaggagatgaccggacagtgcaggtgcccaccaaggaccgtccggccacagtgtgaagtgtgtgaaacacatagtttcagctttcatcctatggccggttgcgaagggtgcaattgctcacggaggggcacaatcgaagctgccatgcctgaatgcgatagagatagcgggcagtgtagatgcaagcccagaataaccgggcggcagtgtgaccgatgcgcctccgggttttatcgtttccccgagtgtgtgccttgcaactgcaaccgggacgggacagaacccggcgtttgcgacccaggtactggagcatgtctgtgcaaggagaacgtagaaggaaccgagtgcaatgtgtgccgcgagggatcctttcatcttgatcccgctaacctcaagggatgtactagctgcttctgctttggagtgaacaaccaatgtcatagtagccacaagcgcaggaccaaatttgtcgatatgctgggctggcatcttgaaactgcagacagggtggacatccccgtgtcgtttaatccagggagtaatagcatggtggccgacttgcaagagttgccagccacgatccacagcgcctcatgggtggccccatag

SEQ ID NO: 192682 - DNA, 1743 bp, Artificial Sequence
  Description of Artificial Sequence: Synthetic coding sequence
atggccgccgccgcccggccccggggccgggccctgggccccgtgctgccaccaacacccctgttgctgctggtgctcagggtgctgccagcatgcggtgcaactgccagggatccaggagccgcggcgggattgtccctgcaccccacatattttaaccttgccgaggccgccaggatttgggcgacagcaacatgtggcgagcggggcccaggagaaggtcggccgcaaccagagttatattgcaaattagtggggggacctaccgctcctggaagcgggcacacaattcagggtcagttctgtgattactgcaatagtgaggaccctcgtaaggcccatcctgtgacaaatgctatcgatggctctgagcggtggtggcagagccctccattatccagtggcacccaatacaacagggttaacctgacactggacttggggcagctgtttcatgtagcctatatacttatcaaatttgcgaactctcccagacccgacctgtgggtcctggaaagaagcgttgactttggatcaacatatagtccatggcaatacttcgcacattctaaggtcgactgtctgaaggagttcggcagagaggcgaacatggcagtcaccagagacgatgatgtgttgtgcgtcacggagtattctagaattgtgccgctggaaaacggcgaggtggtagtgtctctgatcaacgggagacctggtgccaagaactttacatttagccataccttaagagagtttacaaaggcaactaacataagactccgctttttgcgaactaacactctcctcggacatttaatttctaaggctcagcgggacccgactgtgacccggaggtactactacagcatcaaggatatctcgatcggaggtcagtgcgtttgcaatgggcatgccgaagtttgtaacattaacaaccctgaaaagctgtttaggtgcgaatgtcagcaccatacatgcggcgaaacgtgcgacagatgttgcacaggctacaaccagcgtaggtggcggcctgctgcatgggaacaaagccacgagtgtgaagcctgtaattgtcatggccatgcgtctaattgctattacgatcccgatgttgagaggcagcaggcatcattgaacacacagggtatatacgcaggaggaggtgtgtgcattaactgtcagcataacacagcaggcgttaactgtgaacaatgtgccaagggttactataggccttacggtgtcccagttgacgcccccgacggatgcattccttgctcgtgcgaccctgaacacgctgacgggtgcgagcaaggtagtgggagatgtcactgcaagcccaacttccacggtgacaactgcgaaaagtgcgcaattggctactataacttccctttttgtttgagaattcctatctttcccgtgtccaccccttcctcagaggatcctgtggctggagatatcaaaggcaactggtgcgactgcaatctggagggtgtgctacctgaaatttgcgacgctcatggacggtgcctgtgcagacccggcgtcgagggaccacgatgtgatacctgccgaagcggcttctactcattccctatatgccaaggcccttccgaaaaggtggccatatataaaccagaatccagaccctcagccgaaacggaacccgcctcgacgtggatccttgattttcccgcatctagaacaggagagatcaacttttattgtctatcaccatag

SEQ ID NO: 192683 - DNA, 5007 bp, Artificial Sequence
  Description of Artificial Sequence: Synthetic coding sequence
atgccccccgccgtgcggcggagcgcctgcagcatgggctggctgtggattttcggcgctgccctcgggcagtgcctggggtacagcagccaacagcagcgtgtacccttcttgcagccgccggggcaaagtcagctgcaggcttcatacgtcgagttccgaccttcgcagggttgcagtcccggctattatcgggatcacaaaggattatatactggacgctgtgttccatgtaactgcaacggtcactcaaatcagtgccaggatggcagcggcatttgcgtgaattgccagcacaacaccgccggcgaacattgtgaacggtgccaagaaggttactatggaaatgctgtgcacggcagttgcagagcctgtccttgcccacatactaatagcttcgccactggctgtgtggtgaacggaggcgatgtgagatgcagttgcaaggccggttacacagggacacagtgtgaaagatgtgcacctggctacttcggcaatccgcagaagtttggcggtagctgccagccttgcagctgtaacagcaacgggcagctgggctcttgtcatccacttactggagactgcatcaatcaagagccaaaggacagctctcccgctgaggagtgcgatgattgtgatagttgtgtgatgacactgctgaatgatctcgcaacgatgggagagcagctgagacttgtgaaatcccagctgcagggactgagtgccagtgcggggctgttagaacagatgcgtcatatggagacacaggctaaggatttaaggaaccagctactaaactacaggagcgctatatctaaccacgggagcaaaatcgaaggtcttgaacgggagcttaccgatctcaatcaggagtttgagactctccaggaaaaagcccaggttaactcacggaaagcacaaacattgaacaacaatgtgaatagggctacacaatccgcaaaggaactggacgtcaaaattaaaaatgtgatccgtaacgtgcatatgctgaaccggattagaacatggcaaaagacccaccaaggcgagaataacggcctggccaattcaatccgcgattctctcaatgaatacgaggctaaactttctgatctccgcgcccgactccaggaggcagccgcccaggccaaacaggctaacggactcaaccaggagaacgagagagctctcggcgccatccagcggcaggtcaaggagattaattctctgcaatctgattttactaagtacctcacaaccgcggatagcagcctgctgcagacaaatattgctttacaattgatggaaaagtctcaaaaagagtacgaaaagcttgctgcgtccctgaacgaggctcgccaggagctttcagataaggttagggagttgtcaagatctgccggtaagactagcctggtggaggaggctgagaagcatgctcggtcattgcaagagcttgccaaacagctggaagaaatcaaaagaaacgccagcggcgacgaactggttagatgcgctgtggatgccgccaccgcttatgagaacattctgaatgccatcaaggcagccgaagacgcggctaaccgggccgctagtgcgtctgaaagtgctctgcagactgttatcaaagaggatctgcctcggaaagccaagactctgagttcaaattcggataaactgctgaatgaggctaagatgactcagaagaagctcaagcaagaggtgtctccagcactgaataaccttcagcagactctcaatatcgtcaccgtgcaaaaggaggtgatcgacacgaacctgaccaccctacgtgatggactccatgggatccagaggggtgatattgatgccatgatctcctccgcaaagtctatggtgcgcaaggccaacgatattaccgatgaagtgctggatggtctgaatccaatccagaccgacgtagaaaggataaaagatacttatggtaggacgcaaaacgaagatttcaagaaggcactaaccgacgctgataattctgttaacaaactcaccaacaagctgccagacctgtggagaaaaatcgagagcatcaatcagcagttgctgccgctcgggaacatttccgataacatggatcggatcagagaactgattcaacaagcaagagacgcggcctcgaaagtcgctgtccctatgcgtttcaatgggaaaagtggagtggaggtccgcttaccaaatgacctcgaggatctgaagggttatacatcactgtcactgtttttgcaacgaccaaactccagggaaaatggcggcaccgaaaatatgtttgttatgtatctcggaaataaagatgcatcccgggactatattggcatggccgtggtggacgggcagctaacgtgcgtctacaacctgggtgacagggaagctgagctgcaggtcgaccagatacttactaagtctgaaactaaggaagccgtgatggatagggtgaaattccaacgcatctatcagttcgcacgactcaattacacaaagggagctacttccagcaagcccgagaccccaggagtatacgacatggatggacgcaacagcaacacgttgcttaacttggaccctgagaacgtcgtgttctacgtcgggggatatccccctgatttcaagctaccttcacggctctcctttcccccttataaaggctgtatcgagctggacgacttgaatgagaatgtgctgtctctttataatttcaagaagacctttaatctcaatacgaccgaggtggagccttgtagaaggaggaaagaagagtctgacaaaaactacttcgaaggcaccgggtacgcaagagtccctacgcagccgcatgctcctatacccaccttcgggcagacaattcagactaccgtggacagaggcctgctcttctttgccgaaaacggcgatcgatttatctctttaaacatagaagacggtaagctgatggtacggtacaaacttaacagtgaactgccaaaggagagaggcgtgggcgatgcgattaacaatgggagggaccatagtatccaaattaaaattggaaagctgcagaaacgcatgtggatcaacgtggacgtgcagaacaccataatcgacggagaagtattcgattttagcacatactacctaggcggcatcccaattgccattcgtgagaggttcaacatctccacccctgctttccgtggatgcatgaagaatctgaaaaagaccagtggcgtggtccggctgaatgatactgtgggggtgaccaaaaagtgttccgaggactggaaactggtccggtctgcttccttttcccgcgggggccagctctctttcaccgatctgggactccctccgacggaccacctgcaggcctcctttggctttcagaccttccagcctagtggtatcctgcttgatcaccagacctggactaggaacctgcaggtgacactggaagatggctatatcgagctttccaccagcgatagtggatcaccgatttttaagtctccgcaaacttacatggacggcctattgcactatgtgagcgtaattagcgataatagcggccttcgcctccttattgacgaccagctcctcagaaactccaagcggttgaaacacatttcctctagccggcagtccttgagactcggcggcagcaactttgaaggttgtatttccaacgtctttgtacaacgcctatcgctgtctcctgaggtcctcgacctaacctcaaacagtttgaaaagagacgtgagccttggcgggtgttctctgaataagcccccctttctgatgttgctcaagggcagcacgcgattcaataagaccaaaacctttcggatcaaccaactgctgcaagacactccggttgcgtctcctcgctcggtaaaagtctggcaagacgcctgcagcccactaccgaagacccaggcaaatcacggcgctctgcaattcggcgatataccaacctcacacttactctttaagctacctcaagagctgctcaagccccgctctcagtttgccgttgacatgcagaccaccagtagccggggattagttttccatacgggaacaaagaatagctttatggccctctacctctccaagggtaggctggtgtttgcactgggaactgatgggaagaagctccgcatcaaatccaaagagaagtgtaatgatgggaaatggcataccgtcgtgttcgggcatgacggcgagaaaggcagactggtagttgatggtctcagagctagggaagggtccctcccggggaattcaactatctctatcagggccccagtgtatctcggctccccgccctccggcaagcccaaatccctgcctaccaatagcttcgtcgggtgtctgaagaacttccaactggacagcaagcccctctatactccaagctcatctttcggggtctcaagctgtctgggaggcccactcgaaaaagggatttactttagtgaggaaggaggacacgtagtcctagcgcactccgttctcctgggtccagaattcaagctggtctttagtatccgtcctcgctctttaactggcattctgatccacatcggctcccagccagggaaacacctatgcgtgtatctggaggccggaaaggtaacggcatctatggacagcggagccggaggcacatcgacaagcgtgacccctaagcagtctctttgtgatgggcagtggcatagtgtggcagtcactattaagcagcatatccttcatttagaactggataccgactcttcctacactgccggtcaaattccatttcctcccgccagcacacaggaacccctgcacctgggaggcgcacccgctaatctgaccacactgaggattccagtctggaaatcatttttcggctgcctgaggaacattcatgtgaaccatattccggtccccgtaacggaggcactcgaagtccaaggcccagtcagtctgaacggttgtccggaccagtag

SEQ ID NO: 192684 - DNA, 1065 bp, Artificial Sequence
  Description of Artificial Sequence: Synthetic coding sequence
atgcagggcctgctgttcagcaccctgctgctggccggcctggcccagttttgttgcagagtgcagggtacaggaccgctcgacacaacgcccgagggaaggccaggggaagtgagcgacgctccgcagagaaaacagttttgccactggccatgcaagtgtcctcagcaaaaacctcgttgcccacctggcgtctctctggtaagagacggatgcggatgctgtaagatctgcgcgaagcagccaggtgaaatttgcaacgaagccgacttatgtgacccacacaaggggctgtattgcgattattctgtagataggcccagatacgagactggagtgtgtgcttatctggtggccgttggatgcgaatttaatcaagtccactaccataatggccaggtgtttcagcctaatcccctattcagttgtttatgtgtgagtggtgctatcggatgtaccccactgtttattccaaaactcgccggatcccactgtagcggtgccaagggcggtaagaagtccgaccagagtaattgtagtctggagcccctgttacaacagctgtcgacctcatataagacaatgccagcttatagaaacctcccgctaatctggaagaagaagtgcctcgtccaggccaccaagtggaccccgtgctcccgcacctgtgggatggggatctcaaatagggtcactaacgaaaactcaaactgtgagatgcgcaaagagaaaagattgtgttacatccagccttgcgatagcaatattttgaagactattaaaattcccaagggcaaaacctgtcagcccacgttccagttatccaaagccgaaaagtttgtcttcagtggctgttcaagtacacagtcgtacaagcctacattttgcggtatctgtctggacaagcggtgttgcatccccaataaatctaaaatgatcaccatccagtttgactgccccaacgagggcagttttaagtggaagatgttatggataactagttgtgtgtgtcagcgcaactgtagagaaccaggtgacattttcagcgaactaaagatcctatag

SEQ ID NO: 192685 - DNA, 267 bp, Artificial Sequence
  Description of Artificial Sequence: Synthetic coding sequence
atggccctgagcagcgcctggcggagcgtgctgcccctgtggctgctgtggtccgccgcctgctctcgcgccgcttccggcgacgacaacgcctttccattcgacatcgaaggatcctcagccgttggtagacaggacccaccggagacctcagagccgagagtcgccctgggcaggctgccgcctgcagcagagaagtgcaatgctggattttttcataccttgagtggcgagtgtgttccatgcgactgtaacggtaatagctag

SEQ ID NO: 192686 - DNA, 363 bp, Artificial Sequence
  Description of Artificial Sequence: Synthetic coding sequence
atggccctgagcagcgcctggcggagcgtgctgcccctgtggctgctctggtccgccgcctgtagtcgtgctgctagtggggatgataacgcttttccttttgacattgaaggatctagcgccgtggggcgccaagatcccccagagactagtgaaccacgtgttgctttaggccgtctgccacctgccgctgaagtacagtgtccatgccattgccaccccgcaggggcccccgcgccgcccagagctgtaccgcacagcagcttttcgctgtcccctccacttagcagcccacaatgtcttgagtcgtttacatgggctcggtctgtgcggaagttagaaataaaatccttcccactctag

SEQ ID NO: 192687 - DNA, 549 bp, Artificial Sequence
  Description of Artificial Sequence: Synthetic coding sequence
atggccctgagcagcgcctggcggagcgtgctgcccctgtggctgctctggtccgccgcttgcagtcgcgccgccagcggagatgacaacgcgttcccatttgatatagagggctcgtccgccgtaggacgacaggaccccccggagacctctgagccacgggtcgcactcggaaggctcccccctgcagcagagaagtgtaacgcggggttttttcacacactttctggagagtgcgtgccttgtgactgcaacgggaatagcaacgagtgcctggatggtagtgggtactgtgttcattgtcaacgcaacacgaccggggagcactgcgagaagtgtctagatggttacattggagacagcatcagaggggctcctcaattttgccagccctgcccttgtcctttgcctcatctggccaattttgcggaaagctgctacaggaagaacggtgccgtaagatgcatatgcaacgaaaactacgccggtcccaattgcgagagaccatctccccaatcaacaaggggctttcccctgaacgacagctag

SEQ ID NO: 192688 - DNA, 537 bp, Artificial Sequence
  Description of Artificial Sequence: Synthetic coding sequence
tgaatcttcgaggactgcgacgaggtgaccggccagtgccggaactgcctgcggaatacgaccggcttcaagtgtgaaaggtgtgctccaggttattacggcgatgccagaatagctaaaaattgcgccgtctgtaactgtggaggagggccttgcgatagcgtgactggcgagtgcctcgaggaaggattcgaaccccctacgggtatggattgtcccaccatcagttgcgataaatgcgtctgggacttgacagacgccctcagacttgcagccctgtccatcgaggaagggaagagcggcgtgctcagtgtaagctctggtgccgccgcccacaggcacgtaaacgagatcaatgccactatctatctcctaaaaacgaagttgagtgagagagagaaccaatatgctctccgaaagattcagattaataatgccgagaataccatgaaatcgctactgtcagacgttgaagagttggtggagaaacattggaataaaccacgccgtcgcctggaactccaggagggggtctag

SEQ ID NO: 192689 - DNA, 5451 bp, Artificial Sequence
  Description of Artificial Sequence: Synthetic coding sequence
atggccctgagcagcgcctggcggagcgtgctgcccctgtggctgttatggagcgctgcttgctcgcgggccgcatccggtgatgacaacgcattcccctttgacatcgaaggcagctccgcagtgggcaggcaggacccgcctgagacaagcgagcctcgcgtcgcacttgggcggctacccccagccgccgagaagtgtaatgctggatttttccacaccctttctggagagtgtgtgccctgtgactgtaatggcaacagcaacgaatgcttggacggttcaggctactgtgtccactgccaaagaaacaccaccggagagcattgtgagaaatgtttagacggatacataggcgattcgattaggggtgcaccacagttttgccagccctgcccttgtccgctgccacacctcgcaaatttcgctgagagctgttaccggaaaaacggggccgtaaggtgcatctgtaatgagaattacgcgggcccaaattgtgagagatgtgccccaggatactatggcaaccctttgctaatcgggtctacatgtaaaaagtgtgactgttcagggaatagcgatcccaacttgatattcgaggactgcgatgaagttactggacagtgcaggaactgtctgcgcaacacaaccgggttcaaatgtgagaggtgcgctccgggctactacggcgacgctaggatcgctaaaaactgtgcagtgtgtaattgcgggggcgggccttgcgactctgtcacgggcgagtgcttggaagagggttttgagccccccaccgggtgtgacaagtgtgtttgggacttaactgatgcactccgccttgcggccttgtccattgaggaaggaaagagcggggttctgagcgtatccagcggcgctgctgcacacagacacgtcaacgaaatcaacgccaccatatacttgttgaagaccaaactatccgagcgcgaaaatcagtatgccctgcgtaaaatccagataaataacgctgagaatacgatgaagtccctgttgtctgacgtcgaggaactcgtcgaaaaggaaaaccaggccagtcggaaggggcagttagtacagaaagaaagtatggacaccataaaccatgcaagccagctagtggagcaagcccacgacatgcgcgacaagatccaggagatcaacaataagatgctgtactatggagaagagcatgaactgagtcccaaggagattagcgagaagttggtattggctcagaaaatgttggaggaaatccggtcaaggcagccattttttacccagcgggagctggtagatgaggaggctgatgaagcctatgaactgctgtcgcaggcagaaagctggcagaggctccataatgagactcgcaccctctttcccgttgtgcttgagcagctggacgattacaacgccaagctgagcgacctgcaggaagccctggatcaggcattaaactatgtcagggatgccgaggacatgaacagggcaaccgcagcccggcagcgagatcacgaaaaacagcaggaaagggttcgggagcagatggaggtggtcaacatgagtttgtcaacaagtgccgactccctgaccactcctagattgacgctctcagagctggacgatatcattaagaacgcctcaggtatttatgccgagattgatggggccaaatccgagctccaggtaaagctcagtaatctaagcaacctttcccacgatttggtgcaggaggctattgatcatgcacaggacctccaacaggaggcaaacgagcttagtcgcaagctccattcatctgacatgaatggcctagtgcaaaaggccctggatgcttctaatgtgtatgaaaacatagtaaactatgtttctgaagcaaacgagacagcagagttcgctctcaacaccactgaccggatttatgatgctgtctccgggatcgacacacagatcatctaccacaaggatgaatccgaaaatctgctgaaccaggcacgtgagttgcaggcaaaggcggagtcgtcatctgatgaggccgttgccgacaccagccgcagggtgggtggagccttagctcgcaagagcgccctgaaaactcgcctctccgatgccgttaaacaactgcaggccgccgagcgtggcgacgcccaacagcgactcggccagtcccgtctcatcaccgaggaggccaaccgaaccacaatggaagttcaacaggccaccgctccgatggctaataatctaacaaattggtcacagaatttgcagcacttcgactccagtgcctataatacagctgtgaactctgcgcgtgatgccgtccggaatctcacggaggtggtcccacaactgctagaccagctccggaccgtggaacaaaagaggcctgcaagtaacgtatccgcttccatccagagaatcagggaattgatcgcccagacacggtccgtggcgagcaagatccaggtctctatgatgtttgatggtcaatccgctgtggaggtgcattccagaacaagcatggatgatctcaaagccttcacttcacttagcttatacatgaaaccacctgtaaagcgcccagaactgacagagacggccgaccagttcatcttgtatctggggagcaagaacgccaagaaggagtatatggggcttgcaatcaagaacgacaaccttgtttacgtttataatctaggaaccaaggatgtggaaattcccctggattctaaacccgtgtcaagctggcctgcgtatttctcgattgtgaaaatcgagagagttggcaagcacggaaaggtgtttctaaccgtccccagtttgagcagcacagctgaagaaaagtttataaagaaaggagaattttcaggcgatgactccctgcttgacctagatcccgaggacactgttttctatgtgggtggagtcccaagtaactttaaactgcctacatccctaaatttgccgggattcgtaggctgcctcgaactcgctactctgaacaacgacgtcatatccctgtataatttcaagcacatctacaacatggatccgagcaccagcgtgccatgcgcacgtgacaagttggcatttactcagagtagagcagccagctactttttcgacgggagtggctatgcagtcgttcgggacattacaaggaggggtaaattcggacaggttactcgctttgatatcgaggtgcgcactcccgccgacaatggtctgatattgctcatggtgaacggctctatgttctttagactagagatgcgaaatggataccttcacgttttctatgatttcgggttttccggaggcccggtgcacttggaagatactctcaagaaagctcagattaacgacgctaagtaccacgagatttctatcatctatcacaacgacaaaaagatgatcctagtcgtcgatcgacgtcacgtcaagagtatggacaacgaaaagatgaagattccattcacagatatttacatcgggggagccccaccagagatattacagtcccgcgctctgagagctcacttacctttggacattaacttcagaggttgcatgaagggtttccaattccaaaagaaagactttaacctactagaacagactgaaacactgggggttgggtacggctgtccagaggattctctgatctctagacgcgcctatttcaacgggcagagcttcatcgcttccatccagaagatctcgtttttcgacggctttgaaggtgggttcaatttcagaacgctacaacccaacggcctgctgttctactacgctagtggttctgatgtcttcagcatttccctggacaacgggacagtgattatggacgtgaaggggatcaaggtgcaaagcgtggacaaacaatacaacgacggcctatcgcattttgtaatttcttcagtgtcccccacaaggtatgaattaatcgttgataagtccagagttggaagcaagaaccccacaaaggggaaaatagagcaaacccaagcttcggagaagaaattttactttggaggtagtccaattagcgcgcagtacgctaatttcacgggttgtataagtaatgcttattttacccgtgtcgatcgagatgtggaggtagaggatttccagaggtacacagagaaagtccacacctctctgtatgagtgcccgatcgagagctcaccactctttttgctgcacaaaaaggggaagaacttatcaaagccaaaagccagccagaataaaaaaggcgggaagtcaaaggacgcaccaagctgggacccggttgccctgaagctgcccgaacgcaacactcccaggaatagtcactgtcacctgtccaacagtcctagggcaattgagcatgcctaccagtacggcgggacagccaactcccgccaggagttcgagcatttaaaaggcgatttcggcgctaaaagccagttctctattcgcctacgcactaggtcttctcatggtatgatcttttatgtttccgaccaggaggagaacgatttcatgacgctgttcctggcacacggcaggttagtgtacatgtttaatgtggggcacaaaaagctcaagatccgtagccaggaaaagtataacgatgggctgtggcatgatgtcattttcattcgtgagaggtctagcggtagactggttatcgacgggctaagggttctcgaggagtcccttcccccgacggaagctacctggaaaattaaagggcctatttacctgggtggagttgccccaggcaaggcagtgaagaatgtacaaatcaactccatttatagcttcagtggatgcctgtcgaatctgcaactgaatggagcttcaattacttcagcgtcccaaaccttctccgtcacaccctgttttgagggccccatggagactgggacatactttagtaccgaaggcggatatgtggtgctcgatgagagtttcaatatagggctcaaatttgaaatcgcattcgaggtgaggccccgcagcagtagcggaacactcgtccacggccattcggtgaatggcgaatatctgaatgtgcacatgaagaatgggcaagttattgtgaaagtgaataatgggattagggacttcagcacttcagttacccccaaacagagtctttgtgacggccggtggcaccggattacagtaattcgcgacagcaatgtggtgcagctcgatgtcgactctgaggtgaatcacgtggtgggacctcttaacccaaagccaatcgatcacagagaacctgtttttgtcgggggggtgcctgagtccctccttactccgagactagcgccttccaaacccttcactggatgtatacgccatttcgttatcgacgggcatcctgtgagcttttccaaggccgcactggtcagcggagcagtgtctattaacagttgtcccgcagcatag

SEQ ID NO: 192690 - DNA, 5451 bp, Artificial Sequence
  Description of Artificial Sequence: Synthetic coding sequence
atggccctgagcagcgcctggcggagcgtgctgcccctgtggctgctgtggtcagcagcctgctcgcgagccgcatctggagatgataatgcattcccgtttgatatagagggcagttctgccgtcggccggcaagatccccccgaaacctccgagcctagagttgcactgggccgcctgccaccggccgctgagaaatgcaacgccggattcttccatacactttccggtgaatgcgtgccttgtgattgtaacggaaatagtaatgaatgcctggatgggagtgggtactgcgtgcactgtcagcgaaacactacaggagagcattgcgaaaagtgtttggacgggtacatcggagactcaattaggggcgcccctcagttctgtcaaccctgtccttgccccctgccacatctagccaactttgcagaaagctgttaccgtaagaacggggccgtgcgctgtatttgcaacgagaactacgccggacccaattgcgaacgctgtgcccctggctattatggcaacccccttctcatcgggtcaacatgcaaaaagtgcgattgttccggtaatagtgaccctaatcttatcttcgaggactgtgacgaagttaccggtcagtgtcgcaactgccttaggaataccacaggttttaaatgtgagcgatgcgccccaggttactacggcgacgctaggattgccaagaattgtgcagtgtgcaactgtggcggcggcccctgtgattcagtaactggggaatgcctggaagaaggcttcgaaccacccaccggatgtgataagtgtgtctgggatctgacagatgctctgaggctcgctgcattatccatcgaagaagggaagtcaggagtcttatcagtgtcttccggtgccgccgcccatcggcatgtgaatgaaatcaacgccactatctaccttctgaagacaaaactgagcgagagagagaatcagtacgctttacggaaaatacagatcaacaatgcagagaacacaatgaagagtctgctgtctgacgtggaagaactcgtggagaaggagaatcaagcttcccggaagggacaactcgtccaaaaagaaagtatggataccattaatcatgcatcccaactggttgaacaagcacatgacatgagagacaagatccaggagataaacaacaagatgctttactatggggaagaacacgagctctcgccaaaagagattagtgaaaagttggtgctggctcaaaagatgctggaggagatccggtcgaggcagccgtttttcacacagcgggagctggtcgatgaagaggcagacgaagcctacgagctcctctcccaggcggagtcttggcagcgcctccataacgagactaggacccttttcccagttgttttagagcagctggatgactacaacgccaaattatccgaccttcaagaggcactggaccaagccctgaactatgtgcgcgacgcagaggatatgaatcgcgccacggccgcacgccaacgggaccacgagaagcagcaggaacgcgtccgagaacaaatggaggtggtcaacatgagcctaagtacttctgccgatagcctcacaacaccccgcctgaccttgtctgaactcgatgatatcataaagaatgcaagcgggatttacgcggagattgatggggctaagtcagaactccaggttaagctttccaacctctctaatctctcccatgacctggtgcaggaggctattgatcatgcccaggacctacagcaggaggccaacgaactgtcccgcaagctgcattctagtgatatgaatggattggtgcagaaagccttagacgctagtaatgtctacgaaaacattgtcaactacgtttcagaggccaacgaaaccgccgaattcgcactgaacacgactgataggatctacgacgctgtgtcaggcatagatactcagatcatctatcacaaagatgagtcagaaaacctcctcaaccaagctcgcgaacttcaggccaaggctgaatcatccagtgatgaagctgtggccgatacgtcccgcagagttgggggcgccttggcaaggaagtccgccttaaagactcgcctcagcgatgctgtgaaacagttgcaggccgccgaacgaggggacgcacagcagagactcgggcagagccggttaatcacagaggaagcaaacaggaccaccatggaggtccagcaagccaccgcccccatggctaataatcttaccaattggagccagaatcttcagcattttgattcctctgcttataacacagccgtcaacagcgctcgtgatgctgtgcgaaacctgactgaggtcgtacctcagcttttggatcagctgcggaccgtcgaacagaagcgtccagcctccaatgtgtcagccagcatccagcggatcagggaactcattgcccaaaccaggtcagttgcaagcaaaattcaggtttcaatgatgttcgatgggcagtctgccgtcgaagtgcactcccgtacatccatggacgaccttaaggctttcaccagcctgtccctgtatatgaagcctcctgtgaaaaggcccgagctgactgagaccgccgatcaattcattttgtatttaggcagcaaaaacgctaagaaggagtacatggggcttgcgattaaaaacgataacctagtgtacgtctacaatctggggacaaaggatgtggagatacctctggactccaaaccagtttctagctggccggcatatttttccatcgtcaaaattgagagagtgggcaaacacggtaaggtctttctcaccgtgccatcactctcatctaccgcggaagagaagtttattaaaaaaggagagttcagcggtgatgactccctgctggaccttgaccccgaggacacagttttttacgtgggcggcgtgccctcaaatttcaaactgcctacctccttgaatctgccaggcttcgttggctgtctggaactcgccactctgaataacgatgtgatttccctttacaattttaaacatatatacaatatggacccctccacctctgtcccatgcgcacgcgataagctggcgttcacacagtcccgagcagccagctatttctttgacggcagtggctacgctgtggttcgggacattaccagacggggcaaattcggccaggtgacaaggttcgatatcgaggtcaggaccccagcagataatggccttattctcttgatggtgaatgggagcatgttctttcggctggagatgcgcaacgggtatctgcacgtgttctacgactttgggtttagcggtggcccagtccatttagaggacaccctgaagaaagcgcagatcaacgacgcaaagtaccatgagatcagcattatctatcacaatgataagaagatgatcctggtagttgacaggcgacacgtgaaaagtatggacaatgaaaaaatgaagatcccatttacagatatttatatcggaggggcaccgccagaaattcttcagagcagagctctgagggcgcatctccccttggatataaatttccgtggatgcatgaaaggcttccaattccagaagaaggatttcaatctgttggaacaaactgagactctcggagttggatacgggtgccccgaggacagcctcatttcgaggagagcctattttaacgggcagtcctttattgccagtattcagaagataagcttttttgatggcttcgagggcggtttcaacttccgcactctgcagccaaacggccttctcttctattacgcttccgggagcgacgttttcagcatctcccttgacaacggcaccgttatcatggatgtcaaaggaatcaaggtgcagtccgtggacaagcagtacaacgatggactttctcatttcgttatatcatctgtttcccccaccagatatgagctgatagtcgacaagagtcgtgtcggatctaagaaccccacgaaaggcaaaatagaacaaacgcaggcctccgaaaagaagttctactttggcggcagtccaatttccgctcaatatgctaacttcacagggtgcattagcaacgcctactttaccagagtggatcgggacgtggaggtcgaggacttccaacggtacaccgagaaggtccacactagcctgtatgaatgccctatcgagagtagccctttatttctgctgcataagaagggcaagaaccttagcaagcctaaagcttcccagaataagaaaggggggaaatctaaggacgcaccatcctgggatccagtcgccctgaagctccccgaaaggaatactccaaggaatagtcactgtcatttgtcaaattctccacgtgccattgaacacgcataccagtatggaggaactgccaactctcgtcaggagtttgaacaccttaaaggtgactttggagctaaatcccagtttagcatcaggctgcggaccaggtctagccatgggatgatcttctacgtgagtgatcaggaggaaaacgatttcatgacactcttcttggcgcacggcaggctagtatacatgttcaacgtaggtcacaagaaattgaaaatccgcagtcaggagaagtataacgatgggctgtggcacgacgtcatattcatccgcgagagatcctcaggccggctcgtgatcgacggactccgcgtattggaggaaagcctcccacccacggaggccacatggaagataaaggggccaatttacctggggggagtcgctcccggaaaagctgtaaaaaacgttcagattaattccatatattccttctcaggctgtctctccaacctccagctgaacggtgcctcaatcacgagtgcatcgcagaccttcagtgtgacgccctgtttcgaggggcctatggagacgggaacttatttttcgaccgagggcggttacgtggtgctcgacgaatccttcaacatcggcctcaagttcgagatagcgttcgaagtgagaccgcggtcctcttcaggcaccttagtccatgggcatagcgtgaacggagagtacttaaacgttcatatgaaaaatggacaggtgatcgtgaaggtgaataacggcatccgagattttagcacgagtgtcacccccaagcagtcattatgtgatggaagatggcacagaattaccgtgatccgggattcaaacgtagttcagcttgacgtggactccgaggttaatcatgtcgttgggcctctcaacccaaagccaatcgaccatagggagcctgtatttgtgggcggtgtgccggaatcactgctcacacctcgactggctcctagcaagccttttacaggatgtattagacatttcgtgattgacggacatcctgtcagctttagcaaggcagcgctcgtgtctggagccgtctcaattaattcctgtcctgctgcctag

SEQ ID NO: 192691 - DNA, 390 bp, Artificial Sequence
  Description of Artificial Sequence: Synthetic coding sequence
atggccctgagcagcgcctggcggagcgtgctgcccctgtggctgctatggagcgccgcttgcagtagggccgctagtggcgatgataatgctttcccctttgatatagagggatccagcgccgtgggtaggcaggaccctcctgaaacaagtgaaccacgggtggcactgggacgcctgcctccagctgcagagaagtgtaatgctgggttcttccacaccctgtcaggcgaatgtgtcccttgcgattgtaatggtaactctaatgaatgtttggacggcagcgggtactgtgtcacaaccgatggcgaggaccctggattttctgcaagtgcgttaagttttatcctgtcctcacaaggcgcacgggaagcccgcgctccgacctag

SEQ ID NO: 192692 - DNA, 363 bp, Artificial Sequence
  Description of Artificial Sequence: Synthetic coding sequence
atggccctgagcagcgcctggcggagcgtgctgcccctgtggctgctgtggtccgcggcatgctcacgggccgcctctggtgatgataacgcctttccattcgacatcgagggatcttctgccgtagggaggcaggaccccccggagacgtcggagccccgggtagccctggggagattgcccccagccgctgaagtccaatgcccatgccactgtcaccctgctggagctccggcgcccccccgggcagtgcctcacagttcattctccctaagcccgcccctcagtagccctcaatgtctggagtcttttacctgggcccgatccgtgcggaaacttgagataaagtcattccccctgtag

SEQ ID NO: 192693 - DNA, 1125 bp, Artificial Sequence
  Description of Artificial Sequence: Synthetic coding sequence
atggccctgagcagcgcctggcggagcgtgctgcccctgtggctgctgtggtccgccgcctgtagtagagccgctagcggcgatgataatgccttcccgttcgacatcgaaggttcctccgccgtagggcgacaagacccacctgagacaagcgagcccagagtggcgctggggcgcttacccccagccgccgaaaaatgtaacgccgggttcttccataccttatccggggagtgcgtgccttgcgactgcaatggaaattcaaacgagtgcctggatgggtccggttactgtgtacactgtcagcggaatacaacaggggaacattgcgaaaagtgcctggatggatacattggtgactctataaggggcgcccctcagttctgtcagccatgtccatgtcccttgccacacctggccaacttcgctgaatcatgctataggaaaaatggcgcggtccgatgcatctgcaacgagaattacgccggccccaattgtgagcggtgcgccccaggatactacgggaatcctctgctcataggctcaacttgcaagaagtgcgactgttccggcaactctgatccaaatctgatctttgaggattgcgacgaggtgaccggccaatgtcgcaattgcctcagaaacaccacaggcttcaaatgcgagaggtgtgccccgggttattacggagacgcacggatcgccaaaaattgcgctgtgtgcaattgtgggggaggcccttgcgacagtgtgactggcgagtgcctggaggagggctttgagccccccacaggcatggactgtccgacgatatcctgcgataagtgcgtttgggacctcaccgatgcactccgcttagccgccttatcgatagaagaagggaagagcggagtgctatcagtaagctccggcgcagccgctcatcgccatgtcaatgagattaatgccaccatctacctgcttaaaactaaactgagtgaacgggagaatcaatacgcactccggaagatacagataaacaacgctgagaatacaatgaaaagtctattgtccgatgtagaggaactcgttgagaagcattggaacaaaccgcgcagaaggctggagttgcaggagggggtttag

SEQ ID NO: 192694 - DNA, 363 bp, Artificial Sequence
  Description of Artificial Sequence: Synthetic coding sequence
atggccctgagcagcgcctggcggagcgtgctgcccctgtggctgctgtggagcgctgcctgtagccgggcggcgtcgggcgacgataacgccttcccctttgatatcgagggctcaagtgcagtggggcgacaagatcccccagaaacatcagaacctagagttgccttgggccgtttgccacctgccgcagaagttcaatgcccttgtcactgccaccctgcaggtgcccctgctccacccagggcagtgcctcactcgagcttcagcctttcacctccccttagcagcccccaatgccttgaaagttttacttgggcccggtccgtgaggaagctcgaaatcaaatcctttccactgtag

SEQ ID NO: 192695 - DNA, 324 bp, Artificial Sequence
  Description of Artificial Sequence: Synthetic coding sequence
atggccctgagcagcgcctggcggagcgtgctgcccctgtggctgctatggagcgctgcctgcagtcgtgctgcgagcggagatgacaatgcttttccatttgatatcgagggcagctccgcagttggcagacaggatccccccgagacatcggagcctagggtggcactggggcgactgcctccagccgcagagaagtgtaatgccggttttttccacacactgagtggcgagtgtgtcccatgcgattgtaacgggaactcaaacgagtgtttagatggttccgggtattgtgtgcattgccagaggaataccacagggtag

SEQ ID NO: 192696 - DNA, 996 bp, Artificial Sequence
  Description of Artificial Sequence: Synthetic coding sequence
atggccctgagcagcgcctggcggagcgtgctgcccctgtggctgttgtggagcgcggcctgcagcagggctgctagcggcgacgacaatgcctttccatttgatatagaggggtccagcgctgtcggaaggcaagatcctcctgagacaagcgaaccccgggtggctctggggagactgccccccgccgcagagaaatgtaacgcaggtttcttccatactctgtcaggggaatgcgttccgtgcgactgcaatggcaattccaacgaatgtcttgatggatctgggtattgtgttcactgccaacggaacacgactggcgagcactgtgaaaagtgcctggacggctatattggtgatagcattcgtggcgcaccccagttttgccagccatgtccctgccctctgccgcatctggccaactttgctgagagttgttaccgcaagaacggagccgtgaggtgcatttgtaatgagaactatgccggccccaactgtgagcgctgcgctccaggttactatggaaaccccttactgatcgggtctacatgcaagaagtgcgactgctccggtaatagtgatcctaatttgatctttgaagactgcgatgaagtcacaggccagtgtagaaactgtttgcggaacactacagggtttaaatgtgagagatgcgcacccggctactacggagacgcccgtattgcaaagaactgtgccgtttgcaactgtgggggaggcccatgcgactcggtcactggagaatgcctggaggaagggttcgagccacctaccggaatggactgccctacaataagctgtgacaagtgtgtgtgggacctcaccgatgccctacggctcgcggcgctatcaattgaggaaggcaagtccggcgtcctcagcgtgtcatccggggccgccgcgcacagacacgtgaatgaaatcaacgccacaatctatctcttaaagacaaaactgagcgagagggagaatcagtag

SEQ ID NO: 192697 - DNA, 246 bp, Artificial Sequence
  Description of Artificial Sequence: Synthetic coding sequence
atggccctgagcagcgcctggcggagcgtgctgcccctgtggctgctgtggtccgctgcttgcagtcgtgctgcttctggtgacgataatgcctttcccttcgacatcgagggctcgtccgccgtggggcgacaggatccccctgaaaccagtgagccgcgcgtggccctagggcgcctgcccccagccgccgagaaatgcaatgctggcttcttccacacgttgtctggagagtgcgtcccgtag

SEQ ID NO: 192698 - DNA, 5451 bp, Artificial Sequence
  Description of Artificial Sequence: Synthetic coding sequence
atggccctgagcagcgcctggcggagcgtgctgcccctgtggctgctttggagcgcggcctgttctagggcagcatctggggacgacaacgcattcccgttcgacatagagggctcttcagctgttggtcggcaggaccctccagagacatccgagccccgtgttgccctaggaagacttccacccgccgccgagaagtgcaacgcggggttttttcataccctttccggtgaatgtgttccctgcgattgcaacgggaatagtaatgaatgtctggacgggtccggatactgtgttcattgccagcggaacacaaccggcgaacattgtgagaagtgcttggacgggtatataggcgacagcattagaggagctccacagttttgccagccatgcccttgtccgcttccccacctggcaaacttcgccgagtcatgttaccgcaaaaatggcgcagtgagatgcatttgcaacgagaactatgcaggccccaactgcgaacggtgtgcacccggctattatggaaacccccttctcatcggttccacatgtaagaaatgtgattgctccgggaattcagatccaaacctaattttcgaagactgcgacgaggttaccgggcagtgtcgcaactgtctgcgtaacaccaccggatttaaatgcgaaaggtgcgcacctggatactatggcgatgcacgtatcgcgaagaattgtgcggtgtgtaattgtggtggcggcccttgcgactctgtaacgggtgagtgtctggaggaaggatttgaaccccccaccggctgtgataaatgtgtgtgggacttgacggatgcgctcagactcgctgccctcagcatagaggaggggaagtctggcgtgctctcagtgtcgtccggcgcagcagcccacagacacgtcaacgaaatcaatgcaaccatatatctgctgaaaacaaaactcagcgaacgggagaatcaatatgctctcaggaaaatccagatcaacaacgccgaaaacaccatgaagtcactgcttagcgacgtcgaggagctcgttgaaaaggagaatcaggctagccgcaaaggccagctggttcagaaagagagcatggacactatcaaccacgcatctcagctggtcgaacaggcacacgacatgcgcgataagatacaggaaattaacaacaaaatgctctactatggcgaggagcatgaactatctccaaaagagatcagcgagaaattggttttggcccagaagatgcttgaggagatccgctcgagacagccttttttcacgcaacgcgagctcgtcgatgaagaagctgacgaggcgtatgaactgctctcccaggctgagtcctggcagaggcttcacaacgaaactcgcacgctttttcctgtggtcctcgaacaactcgacgactataatgctaaactgtccgacctgcaggaggcgctggaccaggcactcaattatgttagagacgctgaagatatgaaccgcgcaaccgctgccagacagcgcgaccacgaaaagcagcaggaaagagtgagggagcagatggaggtagtgaatatgtcattgtccacttccgcagactctctgaccacccctagactcaccctttctgagctcgacgacataatcaagaacgcttcaggcatctacgctgagatcgacggggctaagtctgagctacaggttaagcttagtaatttatcaaatctgtcccacgaccttgtccaggaggctattgatcacgcacaggatctacagcaagaagcaaacgaactgtctaggaagctccattcctcagacatgaatggcctcgtgcagaaggccttagacgcctccaacgtctatgaaaatattgtcaactatgtcagcgaggctaacgagactgcagagttcgcgctgaacactacagaccgtatatacgacgccgtatccggaatcgatacacagattatctatcataaagacgaaagcgaaaatctccttaatcaggccagggagctccaagccaaggccgaaagcagctccgacgaggccgtagccgatacctcccgtagggttggtggcgccctcgcacgaaagtctgcgctgaaaacccgattgtctgacgccgttaaacagctgcaggctgctgaacgcggagacgcccagcagcggctagggcagagccgtctaatcacagaggaggcaaatcgaacgacaatggaagtacagcaagctactgctccgatggctaataacttaacaaattggtctcagaacctgcagcatttcgattcctctgcctacaacaccgccgtcaattctgcccgcgacgcagtccgcaatcttacagaagtcgtgccacaactcctagatcagttgcgtaccgtggagcaaaagcgtcccgcctccaacgtgagtgcatcaattcagcggatcagagaattgatcgctcagaccagatctgtggcaagcaaaatccaggtgagtatgatgtttgacggccaatccgcagtggaggtgcactcacgcacaagtatggatgacctcaaagcttttacaagcctgagcctatacatgaagccacctgttaagcgccccgaattgacggagacagctgatcagttcattctgtaccttggctctaagaacgccaagaaggagtacatggggctggctattaaaaacgataacctcgtgtacgtgtacaacctggggacaaaggacgtcgagatcccgcttgattccaagccagttagttcttggcctgcctacttcagtatcgtgaagattgagagggtggggaagcacggcaaggtgttcctaactgtgccctcactgtcttcgaccgctgaagaaaaatttattaaaaagggagaattctccggtgacgattccttattagacctcgacccagaagatacagtgttctatgttggtggtgtaccgagtaacttcaagctcccaacctccctgaacctgccagggtttgtaggctgcctggaactggctacacttaacaatgatgttatttccctgtacaatttcaagcatatctacaatatggacccaagcacaagtgtgccgtgtgcgagagacaagctggcttttacacaatcaagggccgcgtcttatttcttcgatggctccggatacgcagtggtgagagacataacaaggcggggcaagtttggccaagtgactcggtttgacatcgaagtgaggacacccgcggataacggcctgattctactgatggttaatggttccatgttctttaggcttgaaatgcgcaatggttatcttcatgtcttctacgactttggcttctcaggcggaccagtgcatctggaggataccctgaaaaaggcacaaattaacgacgcgaagtaccacgaaatctctattatataccacaacgataagaaaatgattctcgtcgtggatcgtcgccacgtcaaatcaatggacaatgagaagatgaaaataccatttactgatatttacataggaggtgccccgcctgaaatcctccagagccgagctctccgggcccatctccccctggacatcaatttcaggggttgcatgaagggcttccagtttcagaagaaggatttcaaccttctggagcaaacagagaccttaggcgtgggctatgggtgccctgaggactctctgatttcgagacgcgcgtattttaacgggcagagctttatcgcctctatccagaagatcagtttctttgatggctttgagggcggcttcaactttcggactctacaaccgaacggcctgttgttttattacgccagcgggtccgatgttttctctataagcctggataatgggacggtcatcatggatgtcaagggcattaaggtccagtctgtggataagcagtataatgacggcctgtcccattttgtgatcagcagtgtgtctccaaccagatacgaacttattgtggacaaatcaagagtggggagcaaaaaccccaccaaaggcaaaattgagcaaactcaggcttccgagaagaagttttatttcggaggaagcccaatcagcgctcagtatgcaaactttacaggatgtatctctaacgcctattttacgcgtgtggatcgggatgtggaagtggaggactttcagaggtatactgagaaagtgcacaccagtttgtatgaatgtccaattgaatccagccctttgtttttgctccataaaaaagggaagaaccttagcaaacctaaggcatcacagaataaaaaaggaggtaaatccaaggatgctccctcgtgggaccccgtggccctgaaactgccagaacgcaatacgccgaggaatagccactgtcatctaagtaattccccccgcgctatcgagcatgcctaccagtatggcggcaccgccaattcccgccaggagtttgagcaccttaagggggatttcggcgccaagagccagttctcaatccggctacgcactcgttcctcacacggaatgattttttacgtttctgatcaagaggaaaacgatttcatgaccctcttcttggcacatgggcggcttgtttacatgtttaacgttggacataagaagttgaaaatccgtagccaagaaaaatataacgacggactgtggcacgacgtcatattcattagagaacgctcctcaggcaggcttgtgattgatgggctgagggtccttgaggaatccctgccaccaacggaggctacttggaagatcaagggaccaatttacctcgggggtgttgccccgggtaaagcggtcaagaatgttcaaatcaatagcatctactctttcagcgggtgcttgtcgaatttacagctaaacggtgcatccatcacatctgcgagccaaactttttcagtgactccctgtttcgaaggacccatggagacgggcacctacttttctacagagggtggctatgtggtcctggacgagtcattcaatatagggctcaaattcgaaatagcatttgaggtgcggcccaggtcatcatctggcacccttgtacatggtcactcagttaatggagaatatctgaacgtgcacatgaaaaatggtcaggtcatcgtcaaggtgaataatggcatacgcgacttctcaacatccgtgacacccaaacagtcattgtgtgacgggcggtggcatcgcatcacggttataagagattcgaacgtggtgcagctggacgtggactcagaagtaaaccacgtggtcggaccacttaaccccaaaccaattgaccaccgcgaaccagtatttgttggaggcgtcccagaaagccttttgactccgcgtcttgcccctagcaagccctttacgggctgcatccgccatttcgtgattgatggccatcccgtgtcattttccaaggccgcgctcgtttcaggggctgtatcaataaattcatgccccgcagcatag

SEQ ID NO: 192699 - DNA, 975 bp, Artificial Sequence
  Description of Artificial Sequence: Synthetic coding sequence
atggccctgagcagcgcctggcggagcgtgctgcccctgtggctgctctggtcggcggcctgcagtagggccgcctcaggcgacgataatgcctttccattcgatatagaggggagcagtgcagtcggtaggcaggatccaccagagacttctgagccacgggtggccctgggacgtctcccaccggccgccgaaaagtgcaacgccggttttttccacaccctgtcaggtgaatgtgtgccatgcgattgtaatggtaattcgaacgaatgcttggacgggagtggatattgcgttcactgccagcggaacaccaccggggagcactgtgagaagtgtctcgacggatatatcggggatagcattcgcggggctcctcaattttgccagccttgtccctgtccgctacctcaccttgctaacttcgctgagtcctgctataggaagaatggcgccgttcgatgtatctgtaatgaaaattacgcagggccaaactgcgagaggtgcgctcccggatactatgggaaccccctgctgattgggtccacttgcaagaaatgtgattgttcgggcaacagcgacccaaacctgattttcgaggactgcgacgaggttactgggcaatgtaggaactgtctgcggaataccacaggcttcaagtgtgaacggtgcgcccctggatactacggggacgccagaatcgctaagaattgtgctgtctgcaactgcgggggcggcccatgcgacagcgttaccggtgaatgtctggaagaggggttcgagccaccaactggatgcgataagtgtgtgtgggatttaactgacgccctgcgtctagcagctttgtctatcgaggaaggaaagtctggagtgctttccgtatcctccggcgccgctgcccacaggcatgtcaatgagatcaacgcgaccatttacttgctgaaaaaaaccaaacagaaaaataacaaaaagtag

SEQ ID NO: 192700 - DNA, 11088 bp, Artificial Sequence
  Description of Artificial Sequence: Synthetic coding sequence
atggccaagcggctgtgcgccggcagcgccctgtgcgtgcggggcccccgcggacctgcccccctgctgctggtgggactcgcgcttcttggtgctgcccgcgcccgagaagaggctggcgggggtttctcgttgcaccccccatatttcaacctcgcagagggcgctaggatcgccgccagcgccacctgcggggaagaggcacctgccaggggcagcccacggcctacagaggacctatactgtaagttggtgggaggaccagttgctggcggtgatcctaatcagacaattcgcggtcagtattgcgatatttgcaccgcagccaacagcaataaagcgcatcccgcatccaacgctatcgacgggactgagagatggtggcaaagcccccctcttagtcgcgggctcgagtataacgaagtgaacgtgaccctagatcttggccaggtgttccatgtcgcttacgtcctcatcaaattcgcaaattctcctcggcccgatctgtgggtgctggaacggagcatggactttggcaggacatatcagccctggcaattcttcgccagctccaaaagagactgcctggagaggttcggccctcagaccctggagaggatcacacgagacgatgctgccatttgcaccaccgagtattccaggatcgtcccgttagagaatggcgagattgtggtttctctggtaaatgggagacccggggctatgaatttcagctattctcccctgctgcgcgagtttacaaaagctaccaatgtgcgattgagattcctgcgaacaaacacgttactgggtcacctaatgggaaaagccctgagggatccaacagtcaccagaaggtactactactcgatcaaggacatctcaattggtggccgctgtgtgtgtcatggacatgccgacgcctgtgatgctaaggaccctacagacccctttagacttcagtgtacttgccagcacaacacttgcgggggcacctgtgataggtgttgtcctgggtttaaccaacagccttggaaacccgctacggctaactcagctaacgagtgtcagtcatgtaattgttacggacatgccacggactgctactacgacccagaggtggacaggaggagagcatcccagagcctggacggaacataccagggcggaggagtgtgtattgattgccagcaccacactactggggttaactgtgagagatgcttgcctggattttataggtctccgaatcaccctctcgactcaccacatgtgtgcagacgctgtaactgcgagtctgatttcacagatggaacatgcgaggacctgacaggtaggtgctactgtcggccaaacttttctggcgagcgctgcgacgtttgcgccgaagggttcaccggcttccccagctgctacccaacaccgtcgtcatctaacgacactcgggagcaggtcctccctgcggggcaaatagtgaactgcgattgcagcgccgccggtacgcaggggaacgcatgtagaaaagacccccgagtgggaagatgcctctgcaaacccaattttcaaggaacccattgtgaactttgcgctccaggcttctacgggcccggctgccagccttgccaatgctcttccccaggggtggcagatgaccgctgtgaccctgatacagggcaatgtaggtgccgagtgggctttgagggggcgacctgcgaccgatgtgcacctggatacttccatttccccctgtgtcagttgtgcggatgctcaccagccgggacgttgccagagggatgtgatgaggcaggacgctgtctgtgtcagcccgagtttgccgggccccactgcgatagatgccgaccaggctaccatggcttcccaaattgccaggcttgcacttgcgatccacggggcgctctcgatcagttgtgcggcgccggaggcctgtgccgttgcaggccgggatataccgggaccgcatgccaggagtgcagccctggtttccatggattcccttcctgcgtgccatgtcattgctctgctgaagggtccttacatgccgcatgtgaccctaggagcggacaatgtagttgccggcctagggtgaccggactcaggtgtgatacctgcgtgcccggcgcctacaacttcccctattgtgaggctggaagttgccaccccgcaggattagccccagtagacccggcgctgcccgaagcccaggtgccctgcatgtgtagagctcacgtagaggggcccagttgtgacagatgcaagcccggattttgggggcttagtccctcaaaccccgagggatgtacccgttgttcgtgcgacctacggggtactctggggggtgtggccgagtgccagcccgggacaggccagtgcttttgtaaaccacacgtttgtggtcaggcgtgtgcatcgtgtaaggacggttttttcggtcttgatcaggcagactactttggatgtcggagctgtcgatgtgatattggcggtgcccttgggcagtcatgcgaaccaaggaccggtgtatgtaggtgtcgccctaatacccagggccccacatgctcagagcccgcacgggatcattacttacctgacctccaccacttgcgcttagagcttgaggaagctgcgacaccagaagggcacgccgtgcgattcgggttcaaccccctagagttcgaaaatttcagttggcgaggctacgcacaaatggctcccgttcagccacgaatcgtggccaggctgaatcttactagccccgatctgttctggctggttttcaggtatgttaacaggggagccatgtccgtgtccggtcgagtctccgtaagggaggaaggacggagtgctacctgcgctaactgcaccgcccaaagtcagccagtagcgttcccccctagtactgagccagcatttatcacagtgccacagagaggtttcggggagccgttcgtgctgaatcccggcacttgggccctgcgggtggaggctgaaggcgtcctgctggattatgtcgtgctccttcccagcgcgtactatgaggcagccctactccagctgagggtgaccgaagcttgcacgtacaggccatctgctcagcaatctggggataactgtctactgtacactcaccttccactggatggctttccctctgcagcagggctggaggccctttgccggcaagataacagcttaccaaggccttgtccaaccgagcagctgagcccaagtcacccaccattgataacctgcaccgggtccgacgttgacgtgcagctccaggtggctgtcccccaacccggaaggtacgccctggtggttgagtacgccaacgaagacgctaggcaggaggttggcgtggcggtgcatactccccaacgggccccgcagcaggggctgctttccctccacccatgcctgtattccacgctgtgtaggggtactgccagggacactcaagatcaccttgcagttttccatctggactcagaggcaagcgtccgcctcaccgccgagcaggctcgattctttctgcatggagtcacgcttgtgcctattgaggaattcagcccagagtttgtggagccgagggtgagctgtatctcaagccacggcgcttttgggcccaactctgccgcatgtctgccgagccgattccccaagcctccacagcctattattttaagggattgtcaggtgattccacttcctccaggactgccgctgacgcacgctcaggacctcactcctgcaatgtccccagccggtcccagacctagacctcctactgccgtcgaccctgacgccgaaccgacgctcttgcgggaacctcaggccacagtggtgtttaccacccacgtgcctactctgggaagatatgccttcctgttgcatggttaccaacctgctcaccctacctttccagtggaggtgttgatcaatgccggcagggtgtggcaaggccacgctaatgcaagtttctgtccacacggatacggttgtcgcacattagtggtctgcgaagggcaggccctcctagacgtgacacacagtgaactgacggttaccgtgagagtgcctaaggggcggtggctctggctggattacgtccttgtcgtgcccgagaacgtgtattctttcgggtatttgagagaggagccactcgacaagtcttatgatttcatttcccactgtgccgcccagggataccatatatcgcccagttcctcttcactgttttgcaggaatgcagcagctagcttgtcattgttctacaacaatggagctaggccatgcggctgccatgaggtgggtgcaaccgggccaacttgcgagccctttggagggcaatgtccatgtcatgcccacgtcattggcagagactgtagccggtgtgctacaggctactggggattcccaaactgtcgaccttgtgactgtggtgctcgactctgcgatgaactcacaggtcagtgtatatgtccacctcggacaatcccacccgattgtctgctctgccagccccaaacttttgggtgccatccgttggtagggtgcgaggagtgcaattgctctgggcctggaatccaggaacttaccgaccccacttgtgataccgactctggacagtgcaagtgcagacctaatgtgacagggagaaggtgtgatacatgcagtcctgggttccatggatacccccggtgtcgaccttgtgattgtcatgaggcagggaccgcccctggcgtgtgcgatcctttaacggggcaatgttattgcaaagagaatgtgcagggtcctaaatgcgaccaatgctccctgggtacattctcgctggacgcggccaaccctaaaggctgtactagatgcttttgttttggagcaacagagcgttgcaggtcaagtagctatacccggcaagagtttgtggacatggagggctgggtcctcctttcgaccgaccgtcaagtagtgcctcacgagcggcaacccggcactgaaatgctcagggccgaccttcgacacgtgcccgaggctgtcccagaagcttttcctgaactgtattggcaagcccccccctcttacctcggagaccgggttagctcatacggtgggactctacgctatgaactacactccgagacacagaggggcgacgtctttgtcccaatggagtcgcgcccagacgttgtactgcagggaaaccagatgagcattacctttttggaaccagcttacccaacacctggacacgtccatcgcggccagcttcagcttgtcgaggggaacttccggcacaccgagacgagaaacaccgtgagtcgtgaggagctgatgatggtgcttgcatccttggaacagctgcaaatcagagcccttttcagccagatatcctccgcagtgttcttgaggagagtggctttggaggtggcttcacctgctggccaaggagcactggcctccaacgtggagctgtgcctctgcccagctagctacagaggcgattcttgccaggagtgcgcccccgggttttacagagacgtgaaaggtctgttcttaggaagatgtgtcccatgtcagtgccatggtcactccgatcgatgccttccagggagcggggtttgcgttgactgccagcacaacaccgagggcgcccactgtgaacggtgtcaggccgggttcgtgtcttcgagagacgaccccagcgcaccatgcgtatcttgtccttgtcccctctccgtaccctccaataactttgccgaagggtgcgtgctcagaggcggccgcacccagtgtctgtgtaagcctggttacgccggcgcaagctgcgagagatgtgcaccaggattctttgggaatccgcttgttttaggaagttcttgccagccttgtgattgttcggggaatggcgatcctaacctgctgttctctgactgcgatcccctgacaggcgcatgccgagggtgtctgagacatacaacggggccccggtgcgagatctgtgcaccgggcttttatggaaacgccctcctcccagggaattgtaccagatgcgattgtactccctgtggaacggaagcgtgtgaccctcatagcggacactgcctttgtaaagctggagtcaccgggcggagatgtgataggtgtcaggaaggccatttcgggttcgacggatgtggcggctgtcggccctgtgcttgtggacctgctgctgaaggctccgagtgccacccacaatccggtcaatgtcactgccggcccggtaccatgggaccacagtgtcgtgaatgtgccccaggttattgggggttgcccgagcagggatgccgaagatgccaatgcccagggggccggtgtgacccccataccggaagatgcaactgcccccctgggctaagcggtgagcgctgtgatacatgtagtcagcagcaccaggtccccgttccaggtggccccgtgggccactctattcactgtgaagtgtgcgatcattgtgtggttctacttttggatgatctggagcgcgctggcgccctgctcccggcaatacacgaacagctcaggggcatcaatgcctcttctatggcatgggctcggctgcatagactgaatgccagcatcgccgacctgcagtctcagctccgatcacccctagggcctagacacgagaccgcacagcagctggaagttttagagcaacaatcaactagcctgggccaggacgcacgtaggctaggcggacaggctgttgggacaagagaccaggcaagccagctgctggcgggaaccgaagccaccctgggccacgcaaagactctcctggcagcaattcgggccgtggatagaaccctctccgagttgatgagccagacgggccacctcggcttggcaaatgccagcgctcctagcggcgaacagcttctgcgaacattggccgaagtcgagcgcctgctgtgggaaatgcgggctcgggatcttggggctcctcaggccgctgccgaagccgaacttgctgccgcacagcgcctcttggcacgcgttcaggaacagctgtctagcttgtgggaagaaaatcaggctcttgctacccaaactcgggacagactcgctcagcacgaggccggtctgatggatttgcgtgaagccctcaacagggctgtcgacgccacgcgggaggcacaggagctaaactcaagaaatcaagaacgcctggaggaggctctgcagagaaaacaagagctcagccgggacaacgcaacccttcaggcaacactccatgctgcacgcgacacacttgcaagcgtatttaggctgctgcacagtttagatcaggctaaggaggagctggagcggctggcggcgtccctggatggggcacggacccctctgctgcaaaggatgcagacattctcccccgccggatccaaactgcgccttgtggaagcggcagaagcccatgcccagcaactcggccagctggctcttaacctcagctctattatccttgacgtgaatcaagaccgccttacacagcgcgccattgaggctagcaatgcttattcccgaattttgcaagccgtacaagccgcagaggatgccgctggccaggctctgcaacaggccgatcacacctgggccacagtggttaggcaggggctggtggatagagcacagcagctcctggcaaattctacagcgctggaggaggcgatgctgcaggagcaacaaaggctgggtctcgtgtgggcagctcttcaaggcgcccggacacagctgcgagacgtgcgcgcgaagaaggaccagcttgaggctcacatccaggcagcacaggccatgctcgcaatggatacggacgaaacctccaaaaaaattgcccacgccaaagccgtggcagcagaggcccaggacacagccacacgtgtccagagccagctgcaggctatgcaggagaatgtggagcggtggcagggccagtacgaagggttaaggggccaggatctggggcaggccgtcctcgatgcagggcactctgtctctactctggagaagacacttccgcaactgctcgcaaagctttccatcctggagaaccggggagtacacaatgcaagtttggccctgtcagcaagtatcgggagggtgagggaattgatcgctcaggcacgtggggcagcaagtaaggtgaaagtgccaatgaagttcaatggtagatccggcgtgcagttacggacgcctcgggatttagccgacttggccgcgtataccgccttgaagttttacctgcagggcccagaaccagagcctggccagggaaccgaagaccgttttgttatgtatatgggctctagacaggcaacaggtgattacatgggcgttagtcttagagataagaaagtccactgggtttaccaactcggggaggcagggcctgccgtcctctcaattgatgaggatatcggggaacaattcgccgcggtgagtttagacagaacactccagtttggacatatgtccgtgactgtggagcgccaaatgatccaggagactaagggcgatacagtggccccaggggcagagggactgctgaacctcaggcccgatgacttcgtgttctacgtcggcggctaccccagtaccttcactccaccaccacttttgaggtttccgggctacaggggctgcatcgaaatggatacactcaatgaggaagtggtctctctgtacaacttcgaacggacatttcagctggacacagctgtcgataggccctgcgcgaggtcaaaatcaaccggggatccctggcttaccgatggttcttacctagatggcaccggtttcgcccgaataagtttcgattctcagatcagcactactaagaggttcgaacaggagctgcggctggtctcctactccggcgtgctcttttttctgaagcagcaatcccagttcctgtgcctggccgtgcaggagggatccttagttctgctatacgatttcggggcaggactgaaaaaggccgttcccctgcaacccccgccacctctgacctccgcctccaaggcaattcaggtcttcctgttggggggcagcaggaaacgcgtgttagtgcgggtagaacgagcaactgtgtactccgtggagcaggataacgaccttgaactagcggatgcctactaccttggcggggtccctccggatcagctcccgccgtcactgaggcgcttgtttcccactggggggagtgtgcgggggtgtgtaaagggcattaaggctctgggcaaatatgtcgaccttaagagactgaatacaacaggcgtttccgctgggtgtaccgccgatctgttggtgggcagggccatgacattccatggtcatgggttcttgagactggcattatcgaacgttgctccactcactggcaatgtctattctggttttggtttccattctgcgcaagacagtgcgctcctgtactaccgagcctctcccgatggactgtgccaagttagtcttcaacagggccgcgtttcactccagctcctcaggactgaggtgaaaacccaagctggattcgcagatggtgccccccactatgtagctttctattcaaacgccactggagtttggctgtacgtcgatgaccagctgcagcaaatgaagcctcatcgagggccacccccggagttgcaaccacagcccgaaggtccccctaggttgttactgggaggtttgccagagtcaggcacaatctataacttttcaggatgcataagcaatgtcttcgttcaacgcctcctggggccccagcgcgtgttcgatcttcagcagaatctgggctctgtaaatgttagcaccgggtgcgcccccgccctacaagctcagactcctggcttgggcccacggggtctacaggctaccgcaaggaaggctagtagacgttctagacagcccgctagacacccagcgtgcatgctaccgccacacctgcggactacacgcgattcctatcaattcggcggaagtctaagtagccacctggaatttgtaggcattctggctcggcacagaaattggccatctttaagcatgcacgtccttccgcggtcttctcgcggtctactcctgttcactgctcggctgagacccggcagcccctcacttgctctgttcctgtccaacgggcatttcgtggctcagatggagggacttggtactcgcctgcgtgcccagagccggcagaggagcaggcccggccgctggcacaaagtaagcgtgagatgggagaagaaccgcatactgctggtgacggacggggctcgcgcgtggtctcaggagggacctcatcgccagcaccagggggccgagcacccgcagccccacacattatttgtaggcggattgcccgcaagctcgcattctagcaaactaccggtaaccgttggtttctccgggtgcgtcaaaaggcttaggctgcatgggcgcccattaggggccccaactcggatggccggggtgacaccatgtatcttgggacccttggaagcaggtctgttctttcctggctcagggggcgtcatcaccttggatctgccaggtgcaactcttccagacgtcggtctcgaacttgaggtgcgccccctcgccgtgaccggtctgatatttcatctcggtcaggcacgcacacccccgtacctgcagctgcaggtgaccgaaaagcaggtactgttgagagctgatgacggagcaggcgagtttagcacgtctgttacgagacccagtgtgctttgtgacggacagtggcaccgattagccgttatgaaaagtggcaacgtcctgcgccttgaggtggacgcacagtctaaccacacagtcggacccctgctagccgcggcggccggagccccggcaccattgtacctgggcggcctcccagagcccatggctgtgcagccatggccacccgcttactgtgggtgcatgaggcgccttgccgtaaatcggtcacctgtggccatgactcgatccgttgaggtgcacggcgcagtgggcgcctctgggtgcccagcagcatag

SEQ ID NO: 192701 - DNA, 1503 bp, Artificial Sequence
  Description of Artificial Sequence: Synthetic coding sequence
atggccaagcggctgtgcgccggcagcgccctgtgcgtgcggggccctcggggtcccgcaccactgttgttggtaggcctcgcgctgctgggggctgcaagggctcgagaggaggctggagggggctttagcctgcacccaccttatttcaaccttgccgagggcgcacgcatcgccgctagcgccacatgcggggaggaagcacctgcacgggggagtccccgacctaccgaggacctttattgcaagctggttggggggccggttgctggtggcgatcctaaccagacaatcagaggtcagtattgtgatatatgcacagccgccaattccaacaaagctcacccagcgtctaacgcaattgacgggaccgaaaggtggtggcagagccctccactgagtcgggggctggagtataatgaggtgaatgtcacattggacctcggccaagttttccatgttgcatacgtgctgatcaaatttgctaactcgccacgtcccgacctatgggtactggagcgctctatggactttgggagaacgtatcagccatggcaattctttgcgtcatcgaaacgggactgtctcgagcgtttcggtccgcagacactcgaaagaatcacgagagacgatgctgcaatttgcaccactgagtacagtcgcatcgtgccactcgagaacggggaaatcgtcgtcagcttggtcaacggtagacctggcgctatgaatttttcttattccccgctgctgcgggaattcacaaaagccacaaatgtgcggctccgcttcttgcggactaacactctcctaggccatttgatgggtaaggctcttagggacccgacagtaaccaggagatactactacagtatcaaggacatctctattggtggaagatgcgtttgtcatggccacgctgatgcctgcgacgcaaaggaccctaccgacccattcaggctgcaatgcacatgtcaacataacacatgcggaggaacctgtgacaggtgctgtccgggatttaatcaacagccttggaagcccgccactgccaactctgccaacgagtgtcagtcttgcaactgctacggtcatgctactgattgctactacgacccagaggttgaccggaggagagcaagtcagagtctggacggcacatatcaaggaggtggtgtgtgtatcgactgccagcaccacacaactggagtcaattgtgaacggtgtctgcccggattctatcggtcgcctaatcacccactcgacagtccgcatgtgtgtaggaggtgcaattgcgagtctgatttcaccgatggcacctgcgaggatctgacaggcaggtgttactgtaggcccaacttcagtggagagcggtgcgacgtttgcgctgagggctttacaggattcccttcctgttacccgacgcctagctcatccaacgacacgagagagcaagtgctgcccgcgggccagattgtgaccaacaccaagatctcctgggtctag

SEQ ID NO: 192702 - DNA, 1587 bp, Artificial Sequence
  Description of Artificial Sequence: Synthetic coding sequence
atggccaagcggctgtgcgccggcagcgccctgtgcgtgcggggccccagaggccctgcccccctgttgctggtggggctcgccctcctgggagccgcccgggcccgcgaagaagccggcgggggcttcagcctccacccaccttactttaacttagctgagggagctcgtatagcagcgtccgccacctgcggcgaagaagcccccgccaggggctccccccggcctactgaagatctttactgtaagctggtgggtgggccagtcgctggcggggatcccaatcaaacaatccgagggcagtactgcgacatatgcactgcggctaattccaataaggcacacccagcatccaatgctatcgatggcacagaaagatggtggcaaagccctcccctgtcaagaggacttgagtacaatgaagtgaacgttacactggatctgggccaggtgtttcatgtagcttatgttcttatcaagttcgctaactctccacgtcccgatttgtgggtgctggaacggtctatggactttggaaggacttatcagccgtggcagttcttcgcatcctcgaagcgggactgcctagaaaggttcgggccacagacgttggagcggatcacacgtgacgacgccgccatctgcactacggagtattctcgaattgtcccactcgaaaacggagaaatagtggtgtctctggtaaatggcagacctggcgcaatgaacttctcctactctcctctgcttcgggagtttaccaaagctacaaatgttcgactgcgctttctccgaactaataccctgcttggccatctgatggggaaggcgctgagggatcccaccgtcaccagacggtattactactctataaaggatataagtatcggcgggcgctgtgtgtgccacgggcacgctgatgcgtgcgacgccaaggatcccacagatccttttcgcctgcagtgtacctgtcagcataacacgtgtggagggacgtgcgaccgatgttgccctggatttaaccaacagccctggaagcccgccactgccaactcagcaaacgagtgtcagtcttgcaactgctacggtcacgcgaccgactgctactacgatccagaggtggatcgcaggcgagcttctcagagtctggacggaacctaccagggtggaggagtgtgtatcgattgtcagcatcacacaacaggcgtgaattgtgaaaggtgtctcccagggttttacaggagccccaaccaccctctggattctccacatgtgtgcagaagatgcaattgtgaaagtgatttcactgatggcacctgtgaggacttgactggtagatgctactgtcggcctaacttcagtggtgagcgttgcgatgtttgtgctgagggattcaccggctttcctagttgttacccgacaccttcgtcaagtaatgatacccgcgaacaggttctgcctgcaggacaaatagtgaatggcgtgtcgttatgtcgtccagggtggtctgccgttgcccgttcacgcctgacttcaacaagcgcctcctgggttcaagctatactcctcccacagagtccagagtag

SEQ ID NO: 192703 - DNA, 2187 bp, Artificial Sequence
  Description of Artificial Sequence: Synthetic coding sequence
atgtgggtgaccaagctgctgcccgccctgctgctgcagcacgtgctcttgcatctgctgctgctccctattgctataccatacgccgagggccagcggaagaggcgcaacacaatccacgaattcaagaaatccgccaagaccactctgattaagatagatcccgccctcaagatcaaaacaaagaaagtgaacaccgccgaccaatgtgcaaatagatgtacaaggaacaaggggctaccctttacctgcaaagcctttgtgtttgacaaggcaagaaagcagtgtctgtggttccccttcaattcaatgagttctggcgtgaaaaaagagtttggccacgaatttgatctgtacgaaaacaaagactacataaggaattgcatcatagggaaaggccggagttataaagggacagtgagtattaccaaatcagggatcaagtgtcagccttggagcagtatgatccctcatgagcacagtttcctgcccagcagctaccgggggaaagacctccaggagaactattgtcgtaacccgagaggggaggagggagggccttggtgtttcacatccaaccctgaggtccgctacgaagtgtgcgacatccctcagtgtagtgaggtggaatgtatgacctgtaacggcgaaagctaccgcggattaatggatcataccgaaagcggtaagatttgtcagcggtgggaccaccaaacacctcaccgccacaagtttttaccggaacgctaccccgataaggggttcgatgacaattactgccgtaatcctgatggccagcctcgcccttggtgctacaccctcgatccacacacgcgctgggaatattgcgccattaagacttgcgcggacaacaccatgaacgacacagatgtgccccttgagactacagagtgcattcagggacagggcgaggggtaccgggggaccgtgaataccatctggaatgggatcccttgtcagaggtgggattctcaataccctcacgagcatgatatgacgccagagaatttcaagtgcaaggacttacgtgaaaattactgcaggaaccccgacggctccgaaagcccttggtgttttactacggaccccaacatacgcgtcgggtactgtagccagattccaaattgtgacatgtcgcatggacaagattgctacagagggaatgggaaaaactacatggggaacctcagtcagacccgcagcggcttgacctgtagcatgtgggataaaaacatggaggatttacatagacacatcttttgggagcccgatgccagtaagctcaatgagaattactgtaggaatcccgacgatgatgcccacgggccatggtgctacaccggcaatccacttatcccctgggactattgtcctatatcgcgctgcgaaggcgacacaaccccaacaatcgttaatctggaccatcctgtgatcagctgtgctaaaactaaacagctgcgagttgtaaatgggattcccactagaaccaacattgggtggatggtgtcactgcggtatcgtaacaagcatatctgtggagggtccctgattaaagaatcttgggtacttacagcacgacagtgtttccccagtagggacctcaaggactatgaggcatggttgggcattcacgacgtgcatggcaggggcgacgagaaatgcaaacaggtgctgaacgtctcccagcttgtgtacgggcctgagggcagtgacctggtcttaatgaagctggcaagaccggctgtcctggacgacttcgtctccacaatagacctgcccaactacgggtgcacaatcccagaaaaaacctcctgctcagtatatggctggggatataccgggctgatcaattacgatgggcttttgcgggtggctcatttatatatcatggggaatgaaaagtgcagtcaacaccatcgtggcaaagtgactctaaatgagtcagagatctgcgctggtgccgaaaagatcgggtctggaccttgcgaaggtgattacggtgggccgttggtgtgcgaacagcataagatgagaatggtgctcggcgtcattgtcccaggtcgcggttgtgcaatcccaaacaggcccgggatcttcgtgagagtggcctattacgctaagtggatccacaagattatactgacatataaggtgccccaatcctag

SEQ ID NO: 192704 - DNA, 276 bp, Artificial Sequence
  Description of Artificial Sequence: Synthetic coding sequence
atgggcctgctgcagctgctggccttcagcttcctggccctgtgcagggcccgggtgagggctcaggagcctgagttttcctacgggtgcgcagaggggtcttgctaccccgcaacaggagatctgttgatcgggagagcccaaaaactcagtgttacatcaacatgcggactgcataagcctgaaccctactgtatcgtgagccatctgcaggaggacaagaagtgcttcatctgcaactcacaggacccataccatgagactctgaatccatag

SEQ ID NO: 192705 - DNA, 2553 bp, Artificial Sequence
  Description of Artificial Sequence: Synthetic coding sequence
atgggcctgctgcagctgctggccttcagcttcctggccctgtgccgggcccgggtaagggcccaggaaccggagtttagctacgggtgtgcggaggggtcctgctatccagccacaggcgatttgctcattggcagagcccaaaagctgagtgttacttccacgtgtggcctgcataaacccgagccctattgcatcgtgagccaccttcaggaggacaaaaaatgctttatatgtaactcacaggacccttatcacgagacgctaaacccagatagccacctgatcgagaacgtggtgacgacctttgctcctaaccgactgaagatttggtggcagtcagaaaatggcgtggagaatgtgaccattcaactggatttggaagcagaattccatttcacgcacttaattatgaccttcaagacttttcggccagctgccatgctgatcgagcgcagctcagatttcggaaagacctggggagtgtacagatactttgcatacgactgtgaagctagcttcccgggcatctctacagggccaatgaagaaagttgacgacatcatttgtgattcgcgatattctgacattgagccgtcaaccgagggcgaagtgatctttagagcactggatccagcgttcaagattgaagacccatactccccccgcatccaaaacttactgaaaattactaatcttcgaattaagttcgtgaagctgcacacgctgggcgacaatctcctggactcgcggatggagatccgcgagaaatactattacgcggtgtacgatatggttgtaaggggtaattgcttttgttacggccatgcttcagagtgtgctcccgtggatgggttcaacgaagaagtcgaggggatggtgcatggacactgcatgtgtaggcataacacgaaggggctaaattgtgaactctgcatggacttttaccacgatctgccttggcgtcctgccgaaggccgtaattctaacgcctgcaaaaaatgtaattgcaatgaacactccatctcctgccatttcgacatggccgtttacctggccacagggaacgtgagcgggggcgtgtgcgacgactgccagcataacactatgggtagaaactgtgaacaatgcaagccgttttattaccagcaccccgaaagagacatcagggatcccaatttctgcgaacgctgtacttgcgaccctgccgggtcacagaacgaaggcatctgcgactcatacaccgatttttctacgggcctgattgccgggcagtgtcgatgcaagctgaacgtagagggcgaacattgcgatgtatgcaaggaaggcttctacgacctgtctagcgaggacccttttgggtgcaagtcttgcgcctgtaacccgcttggcaccattcccggcggcaacccatgtgactcggaaaccggccattgctactgtaaacgcctggtgactgggcagcactgcgatcagtgcttgcctgagcactggggtctctctaatgacctggacgggtgcaggccctgtgactgtgacttgggtggcgccctcaacaattcctgtttcgctgaatcaggccaatgttcgtgccgcccccatatgataggcagacagtgtaatgaagtggagccaggctattactttgcgacccttgaccactacctgtatgaggccgaggaagcgaacctcggacccggggtgagcatagtagagcggcagtatatccaagacaggatcccctcgtggaccggggccggttttgtccgggtgcctgagggagcatacctggaattttttatagataacatcccgtactctatggaatatgatattctgatccgctatgagccacagctcccagaccactgggagaaagctgttatcacagttcagcggcctggccggattcccacctcatcacgctgcggaaatactatccctgacgatgacaaccaggtggttagccttagccctggctcccgctacgtagtattgcctaggcctgtctgttttgagaaaggcactaattatacagttagactggagctgccacagtacacaagttcagatagcgatgtcgagtctccatacaccctaatcgatagccttgtattgatgccatattgtaagagcctggatatcttcaccgtcggaggttcaggggacggtgtggtgactaactcagcttgggaaacgtttcagcgatatcgctgcttggagaactcccgctccgttgttaaaacacctatgactgatgtctgccgcaacattatattttccatcagtgccctcctgcaccagacaggtctggcctgtgagtgcgacccccagggctccttgagcagtgtgtgtgatccaaacggcgggcaatgtcaatgcaggcccaacgtcgtaggccgaacttgcaataggtgcgctcccgggaccttcggctttgggccgagcggctgtaagagaagatttttgaaatcgatagtgatgcatagttttcggctaacccagcccctgtggcaaggaagtattgccgcagaaccaatgttgccatcttag

SEQ ID NO: 192706 - DNA, 5397 bp, Artificial Sequence
  Description of Artificial Sequence: Synthetic coding sequence
atggagctgaccagccgggagcggggccggggccagcccctgccctgggagctgcggttgggcctgcttctgtccgtgctggccgccacactggctcaggcccccgcccctgacgtgccaggatgcagtagaggctcttgctaccctgccacaggcgatttactggtcggaagagctgatcgtctcactgctagctctacttgtgggctgaacggcccccaaccctactgcatcgtcagccatctacaggacgaaaagaagtgcttcctgtgcgactctcgtaggcccttctcagccagagataatccgcactcccatcgaatacagaatgtggtaacaagctttgcaccacagagaagagctgcctggtggcagagcgagaatggaatacccgccgtcaccattcagctcgaccttgaagctgagtttcacttcacccatttgatcatgaccttcaaaaccttcagacccgctgcaatgttagtggaacggtcagccgatttcggccggacttggcacgtgtatcggtatttttcgtacgactgtggggccgatttccctggcgtccctcttgcaccaccgaggcactgggacgacgtggtttgtgaatcgcgttatagtgagattgagccctcaacagagggtgaagtgatctatagggtgctcgaccctgcaattccgatcccagacccttactcttctcgcattcagaatctgttgaagattacaaacttgagagtgaatctgactaggctgcacacgctaggggataaccttctggatcctcggcgcgaaatacgcgagaagtactattacgctctgtacgagcttgtggtgcgcgggaattgtttctgttacggtcacgctagtgagtgtgctcccgccccaggggctcctgctcacgcagagggcatggtccacggcgcgtgtatctgcaagcacaacactagggggctgaattgtgagcaatgccaagatttctacagagatctcccttggcgccctgctgaagatggacatagccatgcatgcagaaagtgtgagtgccatgggcacacacactcctgtcacttcgatatggcggtttatctcgctagcggcaatgtcagcggaggagtctgcgacgggtgtcagcataataccgcgggacggcactgtgaactgtgccggccttttttttacagagatccaacaaaagacctgcgcgatccagccgtttgtcgcagttgtgactgtgaccccatgggctcccaggatggaggcaggtgtgactcccacgatgaccctgcgctcggtttggtctcagggcagtgccggtgcaaggagcacgtcgtcggaacgcgttgtcaacaatgtcgcgatggtttctttggtctgtctatctccgacagattgggctgccgcagatgtcagtgtaacgccagaggaacagtgccagggtcgacgccttgtgacccgaacagcggatcttgttactgtaagcgactggtgaccggccggggatgtgacaggtgcctccccggtcactggggactcagccacgacttgctgggctgccgcccctgcgactgcgatgtcggcggggccctggatccacagtgtgacgaggggactgggcagtgtcactgtcgtcagcacatggtgggtcggagatgcgagcaagttcaacccggctattttcgcccgttcttggatcatctgatctgggaagcagaggacacacgcggacaggtgctcgacgtcgtggagcgcctggtcacccccggagagaccccatcatggactggcagcggctttgtgcgcctccaagaaggtcaaactttggaattcctcgttgccagtgtgccaaaagcaatggattatgatctattgcttaggctagagccccaggtgcctgaacagtgggctgaattggagttaattgtacagcgccccgggcctgtgccagcgcattcgctgtgcgggcatcttgtgcccaaggatgatagaattcaaggcacactccagcctcatgcccgctatttaatcttccctaaccctgtgtgccttgaaccgggcattagttataaactgcacttaaaactagtgcgcaccggcggaagcgctcagcccgagaccccctattctggacctggcttattgattgactccctcgtcctgctgccacgtgtcttggtgttagagatgttctccgggggggacgctgctgcactagaacgccaggctacctttgaaagatatcaatgccatgaggagggcctcgtcccgtctaagaccagtcctagcgaagcctgcgcccccctgctgatctccctgtctacactgatatacaatggcgccctaccgtgccagtgcaatcctcaagggtctctgtcatcagaatgcaatccacacggcggccagtgtttgtgtaagcctggggtcgtgggaagaaggtgcgatctgtgcgcccctggttactatggctttggcccaacagggtgccaggcatgtcagtgtagccacgaaggtgcattaagctctctgtgcgaaaaaacctcggggcagtgcctgtgtcgtacaggagcctttggccttcggtgtgaccgctgccagcggggccagtggggcttcccttcttgtagaccttgcgtgtgtaatggccatgccgatgaatgcaacactcatacaggggcttgcctcgggtgccgggatcatacaggaggagagcactgcgaaagatgtatagctggcttccacggcgatcctagactgccctatggcggtcaatgccggccctgtccctgcccggaaggaccagggtcacagcggcacttcgcaacctcatgccatcaggacgagtactctcagcagattgtgtgccactgtcgggccgggtacacaggcctgaggtgtgaggcatgtgctccagggcacttcggggacccgtccaggccaggaggcaggtgccagctgtgcgaatgctcgggaaatattgatcccatggatccagatgcttgcgaccctcacacgggccagtgcctgcgatgtctccatcatactgaggggcctcactgtgcccattgtaaacctggcttccatggccaggctgcgcgccaaagctgccaccgctgtacgtgtaacctgctgggcaccaatccccaacagtgtcccagtcccgatcagtgccactgcgatccgtcatcgggccagtgtccatgccttccaaatgtacaaggcccaagctgcgaccgatgtgcccccaatttttggaatctcacttccgggcacgggtgtcagccatgcgcatgccaccctagccgtgctaggggccctacctgcaacgaattcaccgggcagtgccattgtcgagccggattcggtggacggacctgttctgagtgccaggaactgcactggggagatcctggactccagtgtcacgcatgcgattgcgattcgcgaggcatcgatacaccacagtgccacaggttcaccgggcactgctcctgtcggcctggagtaagtggcgtgaggtgcgaccaatgtgcgaggggcttcagcgggatttttccggcatgtcacccttgccacgcctgctttggtgactgggacagagttgttcaggacctggctgctaggactcagagacttgaacagcgtgcccaggagctgcagcagactggggtgctgggagcattcgaatcttctttttggcacatgcaagaaaagttggggattgtgcaaggtatagtgggagctcggaacactagcgccgctagcacagcccagctggtcgaagcaactgaagagctgcgcagggaaattggcgaggcaactgagcatttgacacagttagaggctgatctcacagatgtccaggacgagaattttaatgccaaccacgccctgagcggactggaaagagacaggttagccctgaatttaactctgcgccaactggaccagcacctggatctgctgaagcactcaaactttctcggcgcctacgactctatccgtcatgctcattcccagtctgcagaggccgagagaagggcgaatacatcagcgctggccgttccatcccccgtgagcaatagtgcctcagcaagacatagaacagaagccttgatggacgcccaaaaagaggattttaactctaaacacatggctaatcagcgggccctcgggaaattaagcgctcacacacacaccctgtccctcactgacattaacgaattagtgtgcggggccccaggggacgcaccttgcgccacgagcccgtgcgggggcgccgggtgcagagacgaggacggccagccccgatgcggaggtctttcctgcaatggcgctgccgcaactgccgatctggcactaggccgggcaaggcatactcaggcagagctccagcgagccttggccgaagggggatccatccttagccgagtggcagaaaccagaaggcaggcctccgaagcccaacaacgagcccaggcagccctcgacaaggcaaatgccagcagaggccaagttgaacaggcaaatcaggagctgcaagaactgatacaatctgtcaaggatttccttaaccaagagggtgcggatcctgattcaatcgagatggtcgccacgcgggtcctggagttgtccatcccagctagcgccgagcagatacagcatctggcaggcgccatcgcggagagagtgaggagtctggctgatgtggacgccatattggcccgcacagtcggagacgtccgaagggctgaacagttgttacaggatgctcggcgcgcccgcagttgggcagaagatgaaaagcagaaggctgaaacagtacaagccgctctcgaagaagcacagcgggcccagggcatagcccagggcgccatccgcggagcggtggccgatacgagagataccgagcagacactgtaccaggtgcaggagcggatggcaggggcagagagagcactgtcctccgcaggggaaagggctcgtcagctcgacgcactactggaagccctaaagctgaagagagctggcaattcgctggccgccagcacagccgaggagaccgcaggatccgcccaggggcgcgcacaggaggccgagcagctgctcagggggccactaggcgaccagtaccagaccgtgaaggccttggcagagcgcaaggcacagggggtgcttgcagcccaggcccgcgccgaacagttacgtgacgaggcccgagatttattgcaggccgcccaggataagctgcaacggctgcaggagcttgagggaacatatgaggagaatgaacgggcactggagagtaaggcagctcaactggatgggcttgaggcgcgaatgagatccgttctccaggccatcaacctgcaagtgcagatttataatacatgtcagtag

SEQ ID NO: 192707 - DNA, 1143 bp, Artificial Sequence
  Description of Artificial Sequence: Synthetic coding sequence
atgcaggagaagctgggcatcgtgcagggcatcgtgggcgcccggaacacttctgcagcgagcacggcgcagttggtggaagctaccgaagagctgcgtcgagagataggcgaggctaccgagcacctgacacagctggaagctgacctcactgatgtccaagacgagaacttcaacgcaaatcatgctctgtccggactggagagggataggctcgctctcaatctcaccctccggcaactggatcaacacttggatttgctgaaacacagtaactttctcggcgcatacgattctatcaggcacgcgcactcacaatccgccgaggccgagcgaagagccaatactagtgctctggcagtaccttctcccgtgagcaacagcgcgtctgctagacaccggaccgaggcactcatggacgcccagaaggaggacttcaattctaagcatatggccaatcaaagagcattgggtaaacttagtgctcacactcatacactcagcctgacagatattaatgagctcgtgtgtggcgcacctggcgatgccccatgcgccacgtccccctgtggaggggccgggtgcagggacgaagacgggcagccacggtgcgggggccttagctgtaacggggcagccgcgacagcagatcttgccctgggaagagcccgtcacactcaagccgagctgcagcgggccctggccgaagggggaagcatcctgagcagagtggccgaaacgcggcgtcaggcttcagaggctcaacagcgagcacaagcagcattggataaagcaaacgcgtctcggggtcaggtcgagcaggctaaccaggagctccaggagttgattcaatccgtgaaggatttcttaaaccaagagggcgcagatccagatagcatcgaaatggtggccacccgcgtactggagctgagcatacctgccagtgccgagcagattcagcatctagcaggcgcgatcgccgaaagagtgcgctccctggcagatgtggatgccatcttggctcaaggaattgcccagggcgcgattaggggagccgtggcagacacacgggataccgaacagcccgtgcccgggactggagaggacggacgatgcagagccggcacagagctttgtcggtag

SEQ ID NO: 192708 - DNA, 5397 bp, Artificial Sequence
  Description of Artificial Sequence: Synthetic coding sequence
atggagctgaccagccgggagcggggccggggccagcccctgccctgggaactccgcctgggcctgcttctctccgtactagcggcaaccctggcgcaggcccccgctcctgacgtgcctggttgctctaggggatcctgctatcctgccaccggcgacctactagtcggaagggctgacaggctcaccgcaagcagcacatgcggactgaacgggccacagccctattgtattgtgagtcatctgcaggacgagaagaagtgcttcctgtgcgactccaggcgaccattctcagcccgtgataatccccactcacatagaatccagaatgtggtgactagtttcgcccctcagcgtcgcgcagcctggtggcagagtgagaacggaatccctgcagttactatacagctggacctcgaggcggaatttcactttacgcatttgatcatgacatttaaaacctttaggcccgctgctatgttagtggagcgatccgctgatttcggaagaacgtggcacgtctatcgatattttagttatgactgcggcgcggattttcctggagtgccgcttgcaccaccccgtcactgggatgatgtcgtctgtgagtcgaggtactctgaaattgagcctagtacggagggagaggtgatttacagagttttggaccctgcgattccgatacctgacccatactcctctcggatacagaatctgttgaaaataaccaatttaagggttaatctaaccagactgcacacactgggagacaacctcttagatcctcgacgtgaaatcagggagaagtactactatgcactctatgaacttgtggtacgggggaactgtttctgctatggccacgcaagtgaatgtgctcccgcccctggggccccagctcacgccgaaggcatggtccatggcgcctgcatttgcaaacacaatacgcgaggtctgaattgcgaacaatgccaggatttctatagggatttaccatggcgtcccgcagaagacggacatagccacgcttgccgcaaatgcgagtgtcatggccacacacattcctgtcattttgacatggccgtttacctcgcgtcagggaatgtgtccggaggagtttgtgacgggtgccaacacaataccgctgggcgccattgtgagctgtgccgcccatttttttacagagacccgaccaaggatttgagggatcctgcagtgtgccgctcttgcgactgcgatcccatggggtcccaagatggtggtcggtgtgactctcatgatgaccccgctctcgggctcgtgagtggccaatgccgatgcaaggagcatgtagtgggtacacgatgccagcagtgtcgcgacggttttttcggcttgtccatcagtgacagactcggatgtcgccggtgtcagtgcaatgccagaggaactgttccaggcagtaccccatgcgacccgaacagcggcagctgctactgtaagcgcctcgttaccggacgcggctgtgatcggtgcctgcccggtcattggggcttgtctcacgatttactaggctgtagaccctgtgactgtgatgtgggaggagctctggacccccagtgtgatgaaggtactggccagtgccactgtaggcaacatatggttggccgacgctgtgagcaggtgcaacctggatacttccgccctttcttggaccacctcatctgggaggcagaagacacgagggggcaagtgctcgacgtggtggaacgacttgtgacccccggagagactccttcttggactgggtccggctttgtcagattgcaggaggggcagacgctggaattcttggtggcatctgttcctaaggccatggattacgacctgttattacggctggagccgcaggtgcctgaacagtgggctgagctcgaactgattgtacaacgacccggccccgtccccgctcacagcctctgtggccacctggtgcctaaggacgatcggatccagggtactctgcagccacatgctcgttaccttatcttccccaaccctgtgtgcctggagccggggatctcctacaaacttcacttgaaattggtgaggaccggcggaagtgcacagccagaaacaccctacagcgggcctggactgctgattgactctctggtactgctcccccgggtgctggttttagagatgtttagcggcggtgacgctgcggctctggaacggcaagctactttcgagcgataccaatgtcacgaggaaggcttggtcccctcgaagacctcaccaagcgaggcttgtgcaccgcttctaattagcctctcgaccttgatctataatggtgcgctcccatgtcaatgtaatcctcaaggtagccttagcagcgagtgtaacccccatggaggacaatgcctatgcaagccaggtgtcgtgggtaggcggtgtgatctgtgtgctcccgggtactacggctttggtccaactgggtgtcaggcttgtcagtgctcacacgaaggagcattgtcatcgctctgcgagaagacctccggccagtgcctctgtcgaacaggggccttcggcctgaggtgtgaccgatgccagaggggacagtggggcttccctagttgccgcccttgcgtgtgcaacggccatgcagacgagtgtaatacccacactggtgcttgcttgggatgtcgggaccacactggcggtgagcactgtgagagatgtattgccgggttccacggggatccaaggctcccatacgggggccaatgcaggccctgtccatgtcctgagggccctggttcccagcggcattttgcaacctcatgtcatcaggatgaatattcccagcagatcgtctgtcattgccgtgccgggtataccggcctgcggtgcgaggcctgtgccccggggcattttggcgatccttcccgacccggcggcagatgccagctgtgcgagtgttctgggaacatcgatcccatggaccccgatgcgtgtgacccacataccggacagtgcctgagatgtctgcatcacactgagggcccacactgcgctcattgcaagccaggctttcatgggcaggctgctaggcaaagttgccatagatgcacatgcaatctgctcggaactaatccacagcagtgtccaagccccgatcagtgccattgtgatcccagctcaggacagtgcccttgtctgccaaatgtgcagggtccctcctgcgaccgatgtgccccaaatttttggaacttgacctctggccacggatgtcagccttgcgcctgccatcccagtagggcccgcggtcccacatgcaatgagtttacaggccaatgccattgcagagcgggcttcggcggccgcacctgcagcgagtgtcaggagctccactggggggaccccggcctccagtgtcatgcttgcgattgtgacagtcgcggaatcgatacaccccaatgtcaccgcttcacggggcattgctcctgtcgacctggcgtctctggtgtgagatgtgatcagtgtgcccggggcttcagcggcatcttcccagcatgccacccctgtcacgcctgtttcggagactgggaccgtgtggtgcaggatctcgcagcccggacccagcgcctcgagcagcgggcacaggagttgcagcagaccggcgtcctgggcgccttcgagtcctccttctggcatatgcaagagaagctcggcatagtgcagggtatcgtaggagcccgcaatacttccgctgcatctactgcccaactggtggaagccacagaggagttacgcagggaaatcggcgaggccacagagcacctcacccagttggaggctgatctgaccgacgttcaggatgagaactttaacgcaaaccatgcgctgtccgggctcgagcgggacaggttggcgttgaacctgactctgagacagttggaccagcaccttgatctactgaagcacagcaactttttgggagcctacgactctatacgtcacgcgcattcccagagcgcagaagcagagcggagggcaaacacttcagcacttgccgtgccatctccggtgtccaactcagctagtgcacggcacaggacggaggcactgatggacgcacagaaagaagacttcaatagcaaacacatggctaaccagcgggcccttgggaagctgagcgcacatacacataccctctcacttacagacatcaacgaactggtgtgcggagctcctggcgacgctccgtgcgctacatctccgtgcggcggcgctggctgcagagacgaggatggacagccaaggtgtggcggccttagctgcaacggggctgccgccacagctgatctggccctaggccgcgctcggcacactcaggccgaattacaacgagctctggcagaagggggatctatcctgtctagagtggccgaaaccagaaggcaggccagcgaggcccagcaaagagctcaggcggcactggataaggctaacgcttctaggggacaggtggagcaagcaaaccaagaacttcaggaactgatccagagtgtcaaagactttttgaaccaggaaggtgccgatcctgattccatcgagatggtggcaaccagggtactggaactatcgatccctgctagcgctgagcagattcaacacctggctggcgcaatcgccgaacgggtacggtccctggccgacgtggacgctatcctggctaggacggtgggggatgtgcgtcgcgcagaacagttgctgcaggacgcaagacgagccaggtcttgggcagaggacgagaaacagaaagccgagacagtgcaggcggccttagaggaagcgcagcgggcacagggcattgcgcagggagccatccgtggagccgttgccgataccagagatacggagcagaccctctaccaggtccaagagcgtatggctggggccgaacgggccctgagttcggccggtgagcgggctcgccagttggacgccctgcttgaagcgttaaaactcaaaagagcaggcaattctctcgcagctagcacagccgaggaaaccgccggctcggcccaaggtcgggcacaggaagcagagcagctactcagggggcccctgggtgatcagtaccaaaccgtaaaagctctggctgaaaggaaggctcagggggtcctagcagctcaagccagggcagagcagctgagagatgaagccagggatctattgcaagctgctcaggacaagctgcagaggctccaagaacttgagggcacctacgaagaaaacgagagagccctggaaagtaaggcagcccagctggacgggctggaggcccggatgcgcagcgtacttcaggctatcaacctccaggtgcaaatctacaatacttgtcagtag

SEQ ID NO: 192709 - DNA, 3519 bp, Artificial Sequence
  Description of Artificial Sequence: Synthetic coding sequence
atgcggcccttcttcctgctgtgcttcgccctgcccggcctgctgcacgcccagcaggcgtgctctagaggcgcctgttacccaccagttggggatctcctggtaggccgtacccggtttttgcgggcctcgagcacatgtggactcaccaagccagagacctattgcacacaatacggggagtggcagatgaaatgctgtaagtgcgacagtcgtcagccccataactactattcccaccgagtcgagaacgtcgccagctcctcaggacccatgcgctggtggcagtcgcagaatgacgtaaacccagtctccctccagctcgatctcgataggagatttcagctgcaagaggtcatgatggagttccaggggccaatgcccgctgggatgctgatcgaacgctctagtgatttcgggaagacctggcgtgtctaccagtatctggccgctgattgtacatcgaccttcccccgtgtccgccagggcaggcctcaatcttggcaggacgtccgctgtcaaagcctcccccagcgccccaatgccagactgaacggtgggaaggttcagctcaacctgatggatttggtgagtggaattcctgctacccaatctcagaagatccaggaggttggcgagattaccaacctgcgcgtcaattttacaagactggctccagtgccgcaaagaggatatcatcctccttctgcgtactacgcagtcagccagttgaggttgcaagggtcctgcttttgccacggacatgccgacaggtgcgcccccaaacccggcgctagcgccggccccagtactgcggtgcaggtgcacgatgtgtgtgtgtgtcagcataatacggccggccctaactgcgagaggtgtgctcccttttacaacaacaggccctggcgacccgccgaaggccaggacgcccatgagtgccaaagatgcgattgtaacggccactccgagacatgccactttgatccagctgtgttcgccgcatcacagggggcctatgggggagtgtgcgacaattgcagggatcacaccgaggggaaaaattgcgagaggtgccaactccactacttcagaaacaggcgacctggggcaagcatccaagagacatgcatctcatgcgagtgcgatcctgatggtgctgtgcctggcgctccttgcgacccggttacgggccagtgtgtctgtaaagaacacgtccagggtgagcgctgtgatctttgcaagcctggattcacaggcttaacttatgctaaccctcagggctgtcatcgttgtgactgcaacattctgggaagcaggcgagatatgccgtgtgacgaggaatcgggaagatgcttatgcctgccaaacgtcgtaggcccgaaatgtgatcagtgcgcgccgtaccattggaaactcgcctcgggccaggggtgtgagccttgcgcatgcgaccctcacaattcacttagcccccaatgcaatcagttcactggccagtgtccctgtcgcgagggattcggaggcctgatgtgttctgctgctgcgatccggcagtgtccagaccgtacgtatggcgacgtcgctactggctgcagagcctgtgactgcgattttcgtgggaccgaagggccggggtgtgacaaggccagcgggcgatgtctgtgccgtcccggtctcacaggcccacggtgcgatcagtgtcagcgggggtattgcaatcgctaccccgtgtgcgtggcctgccacccgtgcttccaaacttatgacgccgacttgcgtgaacaagccctgcgattcggccgtctgaggaatgccacggcctccctgtggagcggccccggcctagaagatagaggcctggcctccaggatcctcgacgctaagagcaagattgaacagatcagggccgttctttcctctcctgcagtgaccgagcaagaggtggcccaggtggcttctgcaatactctccctgcggcgcactctgcagggacttcaactcgatctaccactcgaggaagagaccctctcccttcctagggatctcgagtcactcgacagatccttcaacggactgttaactatgtatcaaagaaaacgcgagcagtttgagaaaatcagcagcgccgacccttccggggccttcagaatgctgagcactgcatatgagcaatccgcacaggcagctcagcaggtgtccgacagcagtaggcttttagatcagttgcgcgacagtcgtcgcgaggcagaacgccttgttcgacaggcagggggcggcgggggcactggctctccaaagctggtggccctgagattagagatgtcttcactgcctgatcttacccccacatttaataaactttgcgggaattcgagacaaatggcgtgtactccaatcagctgtccgggtgaactctgcccccaggacaatggtaccgcatgcggcagccgctgtcggggcgtattacccagggctggcggtgcatttcttatggctggccaggtggccgaacaactgcgcggattcaacgcccaacttcagagaacacgccagatgattagagctgcagaagaatccgccagccagatccaatcgtccgcacagagactggagacacaggtgtccgcctctcgttctcaaatggaagaggacgtcaggagaaccaggctactgatccagcaagttagagactttctcacagacccagataccgacgccgctacaatacaggaagtttccgaggctgtgttggccctgtggttgcctaccgatagcgctaccgtgctccaaaaaatgaatgagattcaggccatcgccgccaggctccccaatgtagatctcgtgctcagccagactaagcaagatattgcgcgcgctcgccgcctgcaggcggaggctgaggaggctcggtccagggcacatgcagtggaagggcaggtagaggatgttgtaggaaatctaaggcagggtactgtcgccctgcaggaagcccaggacacgatgcaaggcacatccagaagtctgcgactcatccaggacagagtcgctgaagtccagcaggtgctcagacctgcagaaaagctggttacctctatgaccaaacagctgggtgatttttggacccgaatggaagagttaagacaccaagcccgacagcagggcgccgaagcagttcaagcccagcagctggccgagggcgcatcagagcaggctctgtcagcccaggaaggatttgagcggatcaaacagaagtatgccgagctgaaggacagacttgggcagtcatcgatgctcggagagcagggtgcgaggatacaatcggtcaagactgaggccgaagagctctttggtgagaccatggagatgatggacagaatgaaggatatggaacttgagcttctgagagggtcccaggctatcatgctgcgaagcgctgatctgaccgggctagagaagcgtgtggaacagattcgcgatcatataaacggacgcgtgctgtattatgccacctgtaagtag

SEQ ID NO: 192710 - DNA, 3519 bp, Artificial Sequence
  Description of Artificial Sequence: Synthetic coding sequence
atgcggcccttcttcctgctgtgcttcgccctgcccggcctgctgcacgcccagcaggcatgctcacgaggagcatgctatccccccgtaggagatctgttagtggggaggactcgcttcctgcgcgcatcctcaacttgtggattaaccaaaccggaaacatactgcacacagtatggcgaatggcaaatgaaatgttgtaagtgtgatagcaggcagcctcacaactactactctcatcgggttgagaacgtggcttcatcttccggccccatgcgctggtggcagagccagaatgacgtaaatcccgtctccctccagctggatctcgacagacgttttcagttgcaagaggtaatgatggagtttcaagggcccatgccggctggaatgctgattgaaagatctagtgacttcggaaagacttggcgcgtgtatcaatacttggccgccgattgtacctcaacttttcctcgtgttcgccaggggaggccgcagtcttggcaggatgtccgctgccaatccttaccacaaagacccaacgcaagactgaatggggggaaggtgcagctgaatctcatggatctcgtgagcgggattcctgcgacccagtctcagaagattcaggaggtcggagagattaccaacctgagggtcaactttactcgactggcgccggttccccagcgcggttaccacccaccctcggcatattatgctgtgagccaacttagacttcaaggatcatgtttctgccacgggcacgcagaccgctgtgccccaaagcccggagcctctgcaggaccatctactgctgtgcaggtgcatgacgtttgtgtatgccagcataacacagcgggcccaaattgtgaaaggtgtgctccattctacaataaccgtccgtggcgccccgcagaagggcaggatgctcacgagtgtcagcggtgtgattgtaatggccattctgaaacatgtcatttcgatcccgccgttttcgcagcttcccagggggcttatgggggcgtgtgcgataattgtagagatcatacagaagggaaaaactgtgagcgttgtcagctgcactatttccgtaacaggaggccaggggcttctattcaggagacctgcattagttgcgagtgtgatccagacggagcggtgcctggagctccctgcgatcctgtgactggccagtgtgtttgtaaggaacatgtgcagggcgaacggtgtgatctttgtaaaccaggattcacaggcctcacctatgccaacccacaaggctgtcatagatgtgactgcaatatcttgggttctcgcagggatatgccttgtgatgaggagagcggcaggtgtctatgcctacctaatgtcgttggacccaagtgcgaccagtgtgccccataccactggaaactcgcgagcggtcaaggatgcgagccttgcgcctgcgacccccataattcacttagtcctcagtgcaatcagttcactggtcagtgtccttgtagagagggatttggtggactcatgtgcagcgccgccgctattcgccagtgtccagaccgcacatatggcgatgtggctacggggtgccgagcctgtgactgcgacttcaggggaacagaagggccgggttgtgataaggcttctgggaggtgcctctgccgacctggccttacaggcccacgttgcgatcagtgtcaaagaggttattgtaataggtatcctgtgtgtgtcgcttgccatccttgtttccagacatatgacgctgacctgcgagaacaggccttaagatttggaagactgcgcaatgccactgcctccctctggtcagggcccggtctggaggatcgtggtcttgcttcgaggattctggatgctaagtccaagatcgaacagatccgggcggttctcagttcccccgcggtgactgaacaggaagtggcccaagtggctagcgccattctgagcctgcggaggacactgcagggactgcagctggacttaccactggaagaggagaccctcagcctcccgcgcgatctggagtccctcgaccgaagcttcaacgggctgctgacaatgtaccaacgtaagcgggaacagttcgagaagatatcctctgccgacccctcaggggctttccggatgctctccaccgcctacgagcagtcagcccaggccgcacagcaggtgtccgactcatcacgcctcttggatcaattacgagacagccggcgcgaagccgagagactcgtgagacaggccgggggggggggtggcaccggatctccgaagctcgtcgctctgcggctggaaatgagttctctgcccgatctaacaccaactttcaacaaactgtgtggcaactcaaggcagatggcatgcactccaatctcctgcccaggagaactctgcccccaggacaatggtaccgcttgcggcagcagatgtagaggagtcttgccaagggccgggggcgcctttcttatggccggtcaggtcgcagagcaattgcgaggatttaatgctcagctgcagcgtacccgtcagatgatccgagccgctgaggaatccgccagccagatccagtccagtgctcagaggctcgaaacgcaggtaagtgcttcaagatcccaaatggaggaagacgtgagaagaactcgtctccttatccagcaggtgcgcgactttttgaccgatccggatactgacgccgccactatccaggaagtttccgaggctgtgctcgcattgtggttgccaaccgattcggcaaccgtgcttcagaaaatgaatgagatccaggccattgcagcccggctgcccaatgtggacttggtgctgtcacagacaaaacaggatatcgctcgagcaagaaggctccaggcagaggcggaggaagctcgctctcgggctcacgcagtagaagggcaggtggaagatgtggtgggcaacctgcgccagggtaccgtcgctctgcaggaagcccaagatacaatgcagggcacttctagaagcttacggctgattcaggatcgggtggctgaagttcagcaggttcttcggccagctgaaaagctagtgacctcgatgactaagcagcttggtgatttttggacacggatggaggagctccggcatcaggccagacaacaaggcgctgaggctgtgcaggctcaacagcttgctgaaggggctagcgaacaagccttaagcgcgcaggaaggttttgaaagaattaaacaaaagtatgccgagcttaaggataggctggggcagagcagcatgctgggagaacaaggagctcgtattcaatccgtgaaaactgaagccgaggaattatttggcgaaaccatggagatgatggaccggatgaaggacatggagctggaactgctgagaggttcccaggctattatgctgcgaagtgccgacctaaccgggctggaaaagagggtggagcagattcgagatcatatcaatgggagggtgctgtactatgctacgtgtaagtag

SEQ ID NO: 192711 - DNA, 3519 bp, Artificial Sequence
  Description of Artificial Sequence: Synthetic coding sequence
atgcggcccttcttcctgctgtgcttcgccctgcccggcctgctgcacgcccagcaggcgtgcagccgtggagcttgctacccaccggtgggcgatctgctcgtaggacggacccggttcctgagagcttccagcacgtgcgggttgactaaacctgaaacctactgcacgcagtatggagagtggcagatgaaatgctgtaagtgcgattccagacaaccccacaattactactcccatagagtcgagaacgtcgcctccagcagcggccccatgcggtggtggcagagccagaacgacgtgaaccccgtctctctgcaactcgacctcgaccgtagattccagcttcaagaagtgatgatggagtttcaaggccctatgcccgccgggatgctgatcgagcgttctagtgacttcggaaaaacctggcgtgtctatcagtacttagctgccgattgtaccagcaccttcccacgcgtgagacagggaagaccccagagttggcaggacgtgcgctgccagtctctgccacagcgcccaaacgccaggttgaatggtggcaaagtgcagctcaatctcatggatctggtgagcggaatccccgctacacagtctcaaaaaattcaggaagttggggaaataaccaatctcagggtgaacttcactaggctggcccccgtgcctcaacgaggctatcatccgccatccgcgtactatgcagtctcgcagttacgcctccaaggtagctgtttctgccatgggcacgcggacagatgcgcacccaaacccggtgcctccgcaggcccctcaactgccgtccaagtccacgatgtgtgcgtgtgtcagcacaataccgcaggtccaaattgtgagcgttgtgctcctttctacaacaatcggccatggcgccctgccgaggggcaggatgcccatgagtgtcagcgttgcgactgtaacggccacagcgagacctgccacttcgatcccgccgtgttcgcagcttcacagggggcttacggaggagtgtgcgacaattgcagagatcacactgaaggcaaaaattgcgagcgatgccagctccattactttcgcaacaggagacctggtgccagcatccaggagacatgtatatcatgcgagtgtgaccctgacggagccgttccaggcgccccttgcgacccggtgacaggccagtgcgtgtgtaaggagcatgtacagggtgagcgatgtgacttatgtaagcctggtttcacgggcttaacttatgctaacccacaaggatgccatagatgtgattgtaatatcctggggagccggcgcgacatgccgtgcgatgaggaatcgggtagatgtctgtgtctccctaatgtcgtcggcccaaaatgcgaccagtgtgctccttaccattggaagctcgcatccggccaaggctgcgaaccctgtgcttgtgacccgcacaacagtttgagtccacaatgtaaccaattcactggccagtgtccctgccgcgaggggttcggtggcttgatgtgctctgccgcagccattcgtcagtgccccgaccgcacctatggagacgtcgctaccggctgccgagcttgtgattgtgatttccgaggcacagagggtccgggatgtgataaagctagcgggcggtgtttgtgcagacctggcctaaccggccctcgatgtgaccaatgtcaaagaggatactgtaatagatatcccgtgtgcgtggcatgtcacccttgctttcagacctacgatgctgacctccgcgagcaggcactccggttcggcaggctcaggaacgccactgccagcctgtggagtgggccggggctcgaggacaggggattggccagccggatactcgacgcaaagagcaagattgagcagatacgtgccgtgctgagttcgccagctgtgaccgagcaagaggtggcccaggtggcctccgccatccttagcctacgaagaacactccagggcctgcagcttgatctgcccctggaagaggaaacactgtcattgccacgggatcttgaatcactcgaccgaagctttaacggcctcctcaccatgtaccagaggaagcgagaacagtttgagaaaatcagttctgccgacccttccggcgcattccgaatgctatccacggcttatgagcaatcggcacaagccgcccagcaagtctccgatagtagtagactgttggaccaattgagagatagccgaagggaggcagagaggctagtgcgacaggcaggcggcggcgggggcacaggaagccccaaacttgtggccctcaggctggagatgtcctcgctgccagacctgaccccaacctttaataagctgtgtggtaactccaggcagatggcatgtactccgatctcctgtcccggcgaactatgtccccaggacaacggcacggcctgtggttcccgctgccggggagtactgcctagggcaggcggtgcgtttctaatggcaggtcaggtggccgaacagctgcgcggcttcaacgctcagcttcagcggacaaggcagatgatccgagccgcagaagagagcgcatcacagatccagtcctcagcacagcggcttgagactcaggtgagcgcctcgcggagccagatggaagaagatgtgagaaggacccgcttgctcatccagcaagtgagagacttcctcaccgatcctgataccgatgccgccaccattcaagaagtctcagaagctgttctggccctgtggctgcccaccgattctgccactgtattgcagaaaatgaatgagatacaggccatcgcagcccggttgcccaatgtggacctcgttctgtctcagactaaacaagacatcgctagagctcgccgcttgcaggctgaagctgaagaggcccgctccagagcgcatgccgtggaggggcaggtagaagacgtagtgggaaatctacgtcagggcaccgttgccctgcaggaagctcaggatacgatgcaaggcacaagccgtagcttgcgactcatacaagatagggtcgcggaagtgcaacaagtgctgcgtcctgccgagaaactggttacctccatgacaaagcagctgggagatttttggaccagaatggaggaactgagacatcaggcacggcagcagggggccgaagctgtacaggcacagcagcttgcggagggggcatccgaacaagctctgtcagcgcaggagggatttgaacgcattaagcagaagtatgctgaactgaaggatcggctgggccagtcatccatgttgggcgagcagggcgctaggattcagagtgttaaaaccgaagctgaagaattgttcggggagacaatggaaatgatggacaggatgaaggacatggagttggagctacttcggggatcacaggctattatgcttcggtccgctgatttgactggtctggagaagagagtggaacagatccgggaccacatcaacggcagggtgttgtattatgcaacctgcaagtag

SEQ ID NO: 192712 - DNA, 567 bp, Artificial Sequence
  Description of Artificial Sequence: Synthetic coding sequence
atgcggcccttcttcctgctgtgcttcgccctgcccggcctgctgcacgcgcagcaagcctgcagcaggggagcttgctatcctccagtcggagatcttttggtaggccggacccgcttccttagagcctccagcacatgtggtctcactaaaccagaaacatattgcactcagtacggcgaatggcagatgaagtgttgcaaatgcgactcaaggcagccccataactattattcacacagggtcgaaaacgtggcctcaagcagcggtccaatgagatggtggcagagccagaatgacgtgaaccctgtgtccctgcagctggatcttgaccggcgtttccaactgcaggaggtgatgatggagttccaaggcccaatgccagcaggaatgctgattgagcgctcctcagactttgggaaaacctggagagtttatcaatacttggcagctgactgcacttccacgttcccccgggtaagacagggccgcccacagagctggcaagacgtcagatgtcagtcactgcctcagcggcccaacgccaggttgaatggaggtaagtag

SEQ ID NO: 192713 - DNA, 483 bp, Artificial Sequence
  Description of Artificial Sequence: Synthetic coding sequence
atgaacgagatccaggccatcgccgcccggctgcccaacgtggacctggtgctctcccagactaagcaggatatcgcaagagcgcgccgactgcaggctgaagctgaggaggcccgctcccgcgcgcacgccgttgagggccaggtggaggatgtggtgggcaacctccgtcagggaactgtggctctccaggaagctcaagataccatgcagggaacttcccgaagcctcaggttaatacaggacagggtggccgaggttcagcaggtattgcggcctgcagagaagctcgtcacaagtatgacaaaacaattgggtgacttctggactcggatggaggaactgcgccatcaagccaggcaacagggagccgaagccgtgcaagcccagcaactggccgagggggctagcgagcaggcactgtccgcccaggagggcttcgaaagaataaagcaaaaatatgccgaacttaaagacaggtag

SEQ ID NO: 192714 - DNA, 4830 bp, Artificial Sequence
  Description of Artificial Sequence: Synthetic coding sequence
atgcggggcagccaccgggccgcccccgccctgcggccccggggccgtctctggccagtccttgccgtccttgccgccgccgcagccgctggatgtgctcaggccgccatggatgaatgcactgacgagggaggtaggcctcagaggtgcatgcccgagtttgttaacgccgcatttaatgtaaccgtggtcgccacgaatacttgcggcactcctcctgaagaatattgcgtacagacaggcgtgaccggggtgaccaaatcctgccacctctgtgatgccggccaaccacatttgcagcacggcgccgcttttttgacagattataataaccaggcggatacaacctggtggcagtctcagactatgcttgccggtgtgcagtaccctagttctattaatctcactctgcatctgggaaaagccttcgatattacctacgtcaggctgaagttccatacctctcggcctgagtcatttgcaatctataagagaacaagagaagatgggccttggattccgtaccaatactattctgggtcctgcgaaaacacctactctaaagcgaatcgtggcttcattcgtacaggtggtgatgagcaacaggctttgtgtactgacgagtttagcgacattagccccctgaccggcggcaacgtcgctttttctacgctcgagggacgaccatctgcgtacaatttcgataatagtcccgtgttgcaggagtgggtcactgccacggatattcgggtaaccttaaataggctgaacacattcggcgacgaggtattcaacgaccctaaggtattgaagtcctactattatgccatttccgactttgccgtgggaggccgttgcaagtgcaatggacacgcttcagaatgtatgaagaacgaatttgacaaacttgtgtgtaactgtaaacacaatacgtatggggtggattgcgaaaagtgtctgccatttttcaacgacaggccttggcggagggcaaccgcagaaagcgccagcgagtgtcttccctgtgactgcaacggacgatctcaggaatgctattttgacccagaactgtatcgatccaccggtcatggaggacattgtacaaattgtcaggacaacacagacggtgcacattgtgaaagatgccgggaaaatttcttcagactgggcaataatgaagcttgctcaagctgtcactgttctcctgtcggatcacttagtacgcagtgcgactcctacgggaggtgcagctgtaagcctggtgtcatgggcgacaagtgtgaccgatgtcagccaggcttccactcccttaccgaagctggctgcagaccctgctcttgtgatccaagcggaagcattgacgagtgcaacatcgaaacaggtcggtgcgtgtgcaaggacaatgtagaaggatttaattgtgagcgctgcaagccgggttttttcaacctcgaaagctccaaccctcgcgggtgcacaccctgcttttgttttggccacagctccgtgtgtacgaacgccgtcggctacagcgtctactctatatcctctaccttccaaatcgatgaagacggatggcgcgctgaacagcgggatgggtcggaagccagtttagaatggagtagcgaacgccaagatatcgccgtgatatctgattcgtacttccccagatatttcatcgctcccgcgaaattcttggggaagcaggtgctttcttacggacagaatctgtcatttagctttcgagtcgaccggcgggatactagactgagcgccgaagatctcgttttagaaggagctggcctccgagtgagcgtaccgctgatagcccaaggtaactcctatccttctgaaactaccgtaaagtacgtgttccggctgcacgaagcaacagattacccgtggaggcccgccctcacaccgtttgagttccagaagctcctgaataatctcacgagtatcaagatcagaggaacatatagtgagagaagcgccggttaccttgatgacgtcacactggccagcgcccggccgggcccaggcgtccccgctacttgggttgagtcttgcacctgccccgtcggctacggaggacaattttgcgaaatgtgcttatctggctaccgccgggagaccccaaatctggggccatatagtccgtgtgttctctgcgcatgcaacggccatagtgagacctgtgaccccgagacaggggtctgcaactgcagagacaataccgctgggccgcactgtgaaaaatgttcagatgggtattatggtgactctacagcgggtaccagtagtgactgtcaaccttgtccttgtcctggtggcagttcatgcgcggtggtgcctaaaacaaaggaggtagtctgcactaattgcccgactggcacaactggcaagagatgtgaactgtgtgatgacgggtatttcggcgatcccctgggccggaacggccccgtgcggctgtgccggttgtgtcagtgctctgacaatattgaccccaacgctgtgggcaattgcaatcgcttaaccggcgaatgcctcaaatgcatttacaatacagctgggttttattgtgacaggtgcaaagatggctttttcgggaaccctcttgctcccaacccagccgataagtgcaaagcctgcaactgcaatctgtatgggaccatgaagcaacaatcatcgtgtaaccctgttacagggcagtgtgagtgcttaccacatgttaccggacaggactgtggcgcctgcgaccctggcttctataatctgcaaagtgggcagggatgtgagcgctgcgattgccatgctctgggatccacgaacgggcaatgcgacataagaacgggacagtgtgaatgccagcccgggatcactggtcaacactgtgagcgctgcgaagtgaaccacttcggcttcggcccagaaggatgcaagccgtgcgattgccacccagaggggtcactgtctttacaatgtaaagatgacgggcgatgtgagtgtcgcgaaggatttgtggggaaccgctgtgaccaatgtgaggagaactacttttacaatcgtagctggccaggctgtcaggaatgccctgcctgctaccgattggtcaaggacaaggtggccgaccatagggtgaagctgcaggagttggagagtctgatcgctaatctcggaaccggtgatgagatggtgaccgatcaggcatttgaggataggttaaaagaggctgaacgtgaggtaatggatttgttgcgggaggcccaagacgtgaaggacgtggaccagaatttgatggatcgcctgcagagggtaaataacactctctcttctcaaatctccaggctgcagaatataaggaatacgatcgaagaaactgggaatctggctgaacaggccagggcgcatgtcgagaatactgaacggctgattgagatcgcatctagagagttggagaaagcgaaggtggcagctgccaatgtcagcgtgacccaaccagagtccaccggggacccgaacaacatgacattattagcggaagaggccaggaagctggctgagaggcacaagcaggaagccgacgatattgttcgggtcgccaagacagccaatgatacctctacagaggcctataatctgctccttcgtaccttagccggcgaaaaccagaccgctttcgaaattgaagaactgaaccggaaatacgagcaagctaaaaacatctctcaggatcttgagaaacaggccgcccgtgttcacgaggaggccaagcgagcaggcgacaaagccgtggaaatttatgcaagcgtcgctcagctatcgcctctcgatagtgagactctggaaaacgaggctaataacattaaaatggaggcagagaacttggagcaactgatcgaccagaagctgaaggattatgaggatctgagagaggatatgcgtggtaaggagctcgaagttaagaatctcttggaaaaagggaagaccgagcagcagacggccgatcaattgctggcccgggctgatgccgccaaggcattagctgaagaggctgcaaagaagggccgggatactttgcaggaggcaaacgacatcttgaacaatttaaaagatttcgatagaagagtgaatgacaacaaaaccgctgccgaggaagccctgagaaagatccccgcgatcaaccagacgataacggaggcgaatgagaaaacccgggaagcacagcaggctcttggaagtgctgcggcagatgcaaccgaagccaaaaacaaagcacatgaagccgaacggatcgcctcagctgtgcagaagaatgctaccagcacgaaggccgaggcagaacgtacattcgcagaggtgaccgatctggacaacgaggttaacaacatgctgaaacagctccaggaggctgagaaagagctgaaacgcaaacaggacgatgccgaccaggacatgatgatggccgggatggcgtcgcaggctgcccaggaggctgagatcaacgcacggaaagccaaaaactctgtgacaagcctgctgtcaatcatcaacgacctcctcgagcagctggggcaacttgacactgttgacctcaataaattgaatgaaattgaggggactttaaataaggcaaaggacgagatgaaggtgtcggacctggaccgcaaggtttctgatttagaaaacgaggctaaaaagcaagaggcagcaatcatggattataatcgagacattgaggagattatgaaagacatccgcaacctggaggatattcggaaaaccttaccctccggatgctttaataccccctcaatcgagaagccctag

SEQ ID NO: 192715 - DNA, 3582 bp, Artificial Sequence
  Description of Artificial Sequence: Synthetic coding sequence
atgcccgccctgtggctgggctgctgcctgtgcttcagcctgctgctccccgccgctcgcgcgacttcccgtcgcgaggtctgtgattgtaatgggaaaagtcggcagtgtattttcgaccgtgagctccatagacagactgggaatgggtttcggtgtctgaattgtaacgataatacggatggtatccattgtgaaaagtgtaagaatggtttctaccgacatagggagagggatagatgtctgccttgcaactgcaactcaaaaggatcactgtcagcgcgctgtgacaatagcggtcgatgctcatgtaagccaggcgtcaccggggcccgctgtgaccgctgtctgccgggtttccacatgctcaccgacgccggctgtacacaagatcaacgtttgctggacagtaagtgtgactgcgaccccgccggtattgcgggaccttgtgacgcaggacgatgtgtatgcaagccagccgtaaccggtgaacgatgcgatcggtgccggagcgggtactataatttggacggcggaaatcccgagggttgtacccagtgcttctgctatgggcacagtgcgtcatgtcgctctagcgccgaatattcagtacataagataacaagtacattccaccaggacgtcgacgggtggaaggctgtgcaacggaacggttcacccgctaagttacagtggagccagcgccaccaggacgtgttttcctcagcccagcggctcgatccggtgtacttcgtggccccagccaagttcctcggcaatcagcaggtgtcttacggccaatctctaagttttgattaccgagtggaccgtggcggccgccatccttctgcacacgacgtgatcctggaaggggcaggtctaaggatcacggctccgctgatgccactcgggaaaaccttgccctgcggcttgaccaagacatatacttttagactgaatgaacacccatccaataactggtcccctcaactctcatacttcgagtatcggaggctcctccgcaacttaacagcccttaggattcgggccacctacggtgagtattctaccggttatatagacaacgtgacactcatttctgccaggccggtgagcggcgcccctgctccatgggtcgaacagtgtatttgtcccgtcgggtacaaagggcaattttgccaagactgcgctagcggatacaagcgtgattcagcccggctgggaccgtttggcacatgtattccatgtaactgccaagggggaggggcctgcgatcctgatactggagactgctattccggggacgagaacccagatattgagtgcgcagactgtcctattggcttctacaacgatcctcacgatcccaggtcttgtaaaccctgcccctgccacaacggtttctcgtgttccgtcatgccagaaaccgaggaagttgtgtgtaataactgcccacccggagtgacaggggctcgctgcgagctctgtgctgatggctattttggggacccattcggcgagcacggccccgtacggccatgccagccctgccagtgtaacaacaatgtagatccgagtgcgtccggtaattgcgatcgcctcactggccgatgtctgaagtgcatccataacaccgcaggaatctattgtgaccaatgcaaggcagggtacttcggtgatcccctcgctccaaatcctgctgacaaatgcagagcctgcaactgtaaccctatgggaagcgagccagtcggatgccggagcgatggcacgtgcgtctgcaagcccggcttcggtgggccaaattgtgaacatggcgctttcagctgtcccgcatgctacaaccaagtgaaaatccaaatggaccagttcatgcagcagctccagaggatggaggcgttgattagcaaggcgcaggggggcgatggggttgtccccgatactgagctggaggggcgaatgcaacaggcggagcaagcactccaggacatcctgagggacgctcagattagcgagggcgcatcccggtctctggggctccagttggccaaagtgaggagccaggagaactcataccagtctcgactggatgatctcaagatgaccgtggaaagagttagagcactggggagccagtatcagaatagggtcagggatacccaccgcctgatcactcagatgcagctgagccttgccgagtctgaggcctctctgggaaataccaatattcccgctagcgatcactatgttggccccaatggcttcaaaagtctcgcgcaggaggcgacaagattggcggaatctcacgtggaaagcgccagcaacatggagcagttaacccgggaaaccgaagattacagcaaacaggctctctcccttgtccgcaaggcactccatgaaggtgtcgggagcggcagtggttcccctgatggcgccgttgttcaggggctcgtggagaagctggagaaaaccaaatcgttggctcaacaactgaccagggaagcaacacaggccgaaatcgaagcagatcggagttaccagcactcccttcgcctcctggacagtgtctcacgtctccaaggagtaagcgatcagtcattccaagtcgaggaggccaagcgaatcaaacagaaggctgactccctgtccagcttagtgacgagacatatggacgagttcaaacggacccaaaaaaacttaggcaactggaaagaagaggcccagcaattattgcagaacggaaaaagcggaagggaaaagtccgatcagctgctgtccagagccaatctggcaaaatccagagcccaagaggctctgtccatgggtaacgcaacgttctatgaggtagaatccatccttaaaaacctccgcgagtttgacttgcaggtggataacagaaaagctgaagctgaagaagccatgaagcgacttagctatatttctcagaaggtatccgatgcaagtgacaagacccagcaagcagaacgcgctctgggttccgccgcagcagacgctcaacgcgctaagaatggcgcaggagaagctctggaaatatcctctgagatcgaacaagagataggctccttaaatctggaagccaatgtcaccgctgacggtgctctggctatggagaaagggttagcctccctaaagagcgaaatgcgagaggtggagggcgagcttgagcgcaaggagttggagttcgacaccaatatggatgctgtccagatggtcatcacggaagctcagaaggtggatacgcgtgctaagaatgccggggtgactatccaggatacccttaatacgctcgacggtctccttcacctaatggatcaacctctcagcgtagacgaggaaggactggttttactggagcagaaactgtctagagccaaaacacagattaattctcagctccgtcccatgatgtccgagttggaagagagagcgagacaacaacggggtcaccttcacctgctcgaaacctctatcgacggtatcctggcggacgtgaagaatctcgaaaacattcgcgacaatctcccaccaggctgttacaatactcaggcgttggagcaacagtag

SEQ ID NO: 192716 - DNA, 3336 bp, Artificial Sequence
  Description of Artificial Sequence: Synthetic coding sequence
atgcccgccctgtggctgggctgctgcctgtgcttcagcctgctgcttccggccgctagggccacgtcacggcgcgaagtgtgcgactgcaacggcaagtcaagacagtgcatctttgacagagagctgcaccgccaaactgggaacggcttcaggtgcctcaactgcaacgataataccgatgggattcactgtgaaaagtgcaagaacggcttttatagacacagagagagagacagatgcctaccctgtaattgtaactcaaaaggtagcttaagcgccaggtgtgacaactctggcaggtgctcatgtaaacctggagtcactggcgcccgatgcgaccggtgtctcccgggtttccacatgttgacagatgcaggctgtactcaagaccagcgcttgctggattccaagtgtgactgcgaccctgccggcatcgccggtccttgcgatgctggtaggtgcgtttgcaagccagccgtgacaggagagcgatgtgatcggtgtcggtccggttattacaacctggatggaggtaatccagaaggctgcacacaatgtttttgttacggccattccgcaagctgccgttcaagcgccgagtatagcgttcacaaaattacctctaccttccatcaggacgtggacggttggaaggctgtgcagcgaaatggatcccctgccaagcttcaatggtcccagaggcaccaggatgtgttttctagtgctcagcgattggaccctgtctacttcgttgcgcccgccaaattcctgggcaatcagcaagtcagttatggacagtcgttgtccttcgactaccgcgtcgaccgggggggaaggcatcctagcgcgcacgacgtcatcttagagggggctggactgaggatcaccgctcctctgatgccactgggaaaaacacttccatgcggcttgacgaaaacttacacattccgcctgaatgagcatcctagtaataattggtctccgcagctgtcttatttcgagtaccgaagactgctgagaaatctgaccgcactaaggatccgtgccacctacggagaatactctactggatacattgataacgttacactgatcagtgctcgaccagtgtcaggagctccggctccttgggtggaacagtgtatatgtcctgtgggctataagggtcagttctgccaggattgtgcttctgggtataagcgcgactccgcccgtttgggaccttttggcacttgcattccttgcaattgccaaggtggcggagcatgtgacccagatactggggactgttatagtggcgacgaaaatccagacatagagtgtgcagactgtccaatcggattttacaatgatccccacgaccccagatcctgtaagccttgtccttgccataacggcttcagctgctccgtgatgcccgagaccgaggaggttgtttgtaataactgcccaccaggcgtaactggcgccagatgtgagctttgcgcggacggttacttcggtgaccctttcggcgagcacgggcctgtgagaccctgtcagccgtgccagtgcaataacaacgttgacccctccgcttcagggaactgcgatcggctgaccggccggtgtctgaagtgcattcataacacagcaggaatatactgcgatcaatgcaaagccggatacttcggtgaccctctggctcccaaccccgcggataaatgtagggcctgcaattgtaaccctatggggagcgagcctgtgggctgcagaagcgacggaacatgcgtttgcaagccaggttttggcggtcccaattgcgaacacggagccttttcctgccccgcttgctataatcaagtcaagatacagatggaccaatttatgcagcaacttcagaggatggaagccctgatctccaaagcacagggtggggacggcgtagtgccagacaccgaactggagggaaggatgcaacaggccgaacaggctctccaggacattctcagggatgcccagatctcagaaggagctagcagaagcctagggctgcagctagccaaagtgcgaagtcaggaaaactcttatcagtcacggctcgatgacctgaaaatgaccgtggaacgggtccgcgccttgggatctcaataccagaatagagttcgtgacactcaccgcctgattacccagatgcagctgtcacttgccgagtcagaggcttccctgggcaatacaaatattccagcttctgatcactatgtaggcccaaatggctttaaatctcttgcccaggaggccacacgacttgcagagagtcacgtggagtccgccagtaatatggagcagttaacccgtgagaccgaagattacagcaagcaggccctgtcccttgtgcggaaagctctgcatgaaggagtagggtctggttccggaagtccagacggggcagttgttcaaggcttggtggagaaattggagaaaactaaatcattagcacaacagttaaccagggaggccacccaggctgaaatcgaggccgatagatcctatcagcatagcctccggcttctggactctgtgagcaggttacagggagtaagcgatcagtcttttcaggtggaggaagccaagagaatcaaacagaaggcagactctctgagtagcctggtgactcgccacatggacgaatttaagcggacccagaagaaccttggtaattggaaggaggaagcccagcaactgctccagaatggtaagagcgggcgcgagaagtccgatcagttgttgagtagagctaacttggctaagtcccgggcccaggaagccctctctatggggaacgcaacgttctatgaggttgaaagtatcctcaaaaatttaagagagttcgatttacaggtggacaataggaaggctgaagcagaagaggccatgaagaggctcagctatatctctcagaaagtatcagacgcatcagataaaactcagcaggccgagagagccctgggctccgcagccgcagatgcacaacgggccaagaacggggctggtgaggcgctggaaatctcaagcgagatcgagcaggaaataggttccctgaacctggaagctaacgtgacagcggacggtgctctggctatggaaaaaggattggcatctctcaagagcgagatgcgcgaggtagaaggcgagcttgagagaaaagagcttgagttcgatactaatatggatgcggtgcaaatggtcattactgaggcccaaaaggtggacacccgggccaagaatgcaggagtgactattcaagatactttaaacactctggacggactcctacacctgatgggcatgtag

SEQ ID NO: 192717 - DNA, 3033 bp, Artificial Sequence
  Description of Artificial Sequence: Synthetic coding sequence
atgcccgccctgtggctgggctgctgcctgtgcttcagcctgctgcttccagcggctagggcaaccagcaggagagaagtgtgtgactgtaatggtaagtcgcggcaatgcatttttgatagagaactgcatcgacagaccgggaacggtttccgatgccttaattgtaacgacaataccgatggaatacattgcgagaaatgcaagaacgggttttatcgccaccgggagagggatagatgtctaccatgtaattgtaattcgaagggaagtctttcagctcggtgcgacaactccgggcgctgttcttgcaaaccaggggtcactggtgcacgctgcgacagatgcctgcctgggtttcacatgttgacagacgctggctgcacacaggaccaaaggctcctcgattcaaaatgcgattgcgatcccgcaggtatcgccgggccctgtgacgctggacgctgcgtgtgcaagcctgcggtcacaggtgagcgatgtgaccgttgccggtcaggatactataatttggacggcggcaacccagagggctgtactcagtgcttttgctatgggcatagtgcctcatgtcgtagctctgccgagtacagtgtgcataaaatcacctctacctttcaccaggacgtggatgggtggaaagccgtgcagaggaacggttccccagccaagctgcagtggtctcagagacaccaagatgtatttagctcggctcagcggctggacccagtgtatttcgttgctcctgctaaatttctgggaaaccagcaagtctcttacggtcagtctctctcattcgactatcgcgttgaccgcggcgggaggcaccccagcgcccatgacgttatcctggaaggagccggacttagaatcacagctcctctgatgcctctcggtaagacgcttccatgtggcctaacgaaaacatatacattccgcctgaacgagcatccctctaacaactggtctccccagctcagttatttcgagtataggaggttactgcgtaatctgactgctctgaggattagagccacctatggggagtatagtaccgggtatatcgacaatgttaccctaatctcagcccgccctgtttccggtgctccggcgccatgggtagagcagtgcatatgtccggtcggttataagggtcagttctgtcaggactgcgcctcgggatataaacgggactccgcccgattgggcccattcggaacatgcatcccctgtaactgtcagggcggtggagcgtgcgacccggataccggagattgctatagcggtgacgagaatcccgacatcgaatgcgctgattgtcccataggattctataatgatcctcatgacccccgctcctgtaaaccatgtccctgtcacaatggctttagttgtagcgtcatgccagagacagaggaagtggtttgcaataattgtccacccggggtaactggcgcccgctgcgagttatgtgctgacgggtacttcggcgacccttttggggaacacggccctgtgagaccctgccaaccctgccagtgtaataataatgtggatccatctgcgtcgggtaactgcgaccggttgaccggacgatgtctgaaatgcatccacaacacggccggcatctactgtgaccagtgcaaagccgggtattttggggatccgcttgctcccaaccctgccgacaagtgccgggcttgtaactgtaacccaatgggctctgagcccgttggttgcagatctgacggtacatgcgtctgcaagccaggattcggagggccaaattgcgagcacggagccttctcctgcccggcttgctacaaccaggttaagatccagatggatcagttcatgcagcagctgcaaagaatggaggcattgattagtaaagcgcagggaggcgacggtgtggtgcctgacacagaactggaggggaggatgcaacaggccgaacaagccttgcaggacatcctccgtgatgctcagataagcgaaggcgcttcgaggtcattaggactgcaactcgcgaaggtcagatcccaggaaaattcctaccagtcgagactcgatgatctcaagatgacagtggagagggtacgggccctgggatctcagtaccagaacagagtgcgcgacactcacaggttgattacccagatgcagctctcattggccgaaagtgaggcaagcctgggtaacaccaacattcctgccagcgatcattatgtggggcccaatgggtttaagtctctcgcgcaagaggctacacggctggcagaatcacacgtcgaatccgcaagtaatatggaacagcttacacgtgagactgaggactattccaaacaagcactatctctggtgaggaaagctctccacgagggcgtgggttccgggtccggtagccctgatggcgcagtggttcagggcctcgtggagaagctcgagaagaccaagtccttagcgcagcagctgacacgcgaagctacccaggctgagattgaggcggatagatcctaccagcacagcttacgcctgttagacagcgtctcccgcctgcagggcgtgtctgaccagtcatttcaggtggaggaggctaaaaggattaaacaaaaggccgattccctgtcctcgctggtgacaaggcatatggacgagtttaaacgtactcagaaaaacctggggaattggaaggaagaggctcagcagctgctccagaacggtaagagcgggcgtgagaagagcgatcaattgctgagccgggctaacctagcaaagagccgggctcaggaagccttatcgatgggcaacgcgaccttctatgaggtggaatcgatccttaaaaatcttcgggaatttgacctgcaggtcgacaatagaaaagctgaagcctttccttctcaggaccctgatcaacagccaactgcggcacatgacgtgagagccggccgcgagggtacctctgcagaaggtccccctccctttgctggtgataagcacagatgggatagtggatag

SEQ ID NO: 192718 - DNA, 1590 bp, Artificial Sequence
  Description of Artificial Sequence: Synthetic coding sequence
atggccgccgccgccctgctgctgggcctggccctgctggccccccgcgcggcaggtgccggcatgggagcttgctacgacggagccggacgcccccagcgttgtctgccagtttttgaaaacgccgcattcggccgtctggcacaggcttctcacacctgtggttcccctccagaggatttttgtccacatgttggtgcagcaggtgcaggcgctcattgccaaaggtgtgacgctgcagatccgcagaggcatcacaacgcatcataccttacagactttcacagtcaggatgagagcacctggtggcagagcccaagtatggcttttggtgttcagtaccctacaagtgtgaacatcacacttcggcttggaaaggcctatgagattacgtatgtgagattaaaattccatacttcacgaccagagtccttcgccatatataagagaagtcgagctgatggaccctgggaaccgtatcagttctactcagcctcctgccagaagacctatggtaggcccgaaggccaatacctgcggccaggtgaggacgagagagttgccttctgtacatcagaattttccgacatatcgcccctgagtggcgggaatgtcgccttcagcacactggaaggcaggccgagcgcatataacttcgaggaatcccccggactgcaagagtgggtaacctctacagagttactgattagcctggacaggctgaacacgtttggcgatgacatttttaaggatccaaaggtgctccaaagctactattatgccgtgtcagattttagtgttggaggcagatgcaaatgcaatggccacgcctctgagtgcgggcctgatgtggccggccaactcgcttgcaggtgtcaacacaacacaactggcactgactgtgagcgctgcttgcctttttttcaagatcgcccctgggcacgcggaactgccgaggccgcgcacgagtgcctgccttgcaactgttcaggcagatccgaggaatgcactttcgaccgtgaactgtttagatcaactggtcatggaggccggtgccatcattgcagggaccacacggccggaccacactgtgagcggtgtcaggaaaatttctaccactgggacccgcggatgccttgccagccgtgtgattgtcagtctgccggtagtctccacctgcagtgtgatgataccggtacctgcgcttgcaaacctaccgtgacgggatggaaatgtgacagatgcctcccaggttttcactcccttagtgagggaggatgccggccatgcacatgcaacccagctggatcacttgacacctgtgatccccgctcgggccgatgtccctgcaaggagaacgtcgagggcaacctctgcgaccggtgcaggcctggcaccttcaatctccaacctcacaaccccgccggccggagttgcaggtcccgggcatcccgagtcacaagtccccgctccgccccgaccaaccgaacctggaggccgttctgcaccgcttgcccgaggactgtacccgcaggctctgaagggtgcccggacccacggcacactttaccccacttacttttcacgtag

SEQ ID NO: 192719 - DNA, 4728 bp, Artificial Sequence
  Description of Artificial Sequence: Synthetic coding sequence
atggccgccgccgccctgctgctgggcctggccctgctggccccccgcgctgcgggcgccggtatgggtgcttgctatgacggagcaggcagacctcagagatgcctgccagtgttcgagaatgcggccttcggtcgccttgcccaggcctcccacacttgcgggagccctcctgaagacttctgcccccacgtcggcgccgccggggcaggcgcccactgccagaggtgcgacgctgctgacccacaaaggcaccataacgctagttatctgaccgattttcacagccaggatgagagtacctggtggcagagccctagcatggccttcggggttcagtaccccacatctgttaacataacgctgaggctgggcaaggcgtacgagatcacctacgtgaggctgaagttccatacatctagacctgagtcgttcgccatctacaaacgcagtagagcagatggtccgtgggagccctaccagttctactcagccagctgccagaaaacttacggacgtcctgagggacaatacctgaggccaggcgaggatgaacgagtggccttttgtacttccgaattctccgacatctccccacttagcggagggaacgtggctttctcaacacttgaaggccgccctagcgcctataatttcgaggaaagtcctggattgcaggagtgggtgacatctacagagctgttaatcagcctcgataggctcaacactttcggcgatgatatttttaaggatccaaaggtgctgcagagctactactacgcagtgtccgacttctctgtcggtggaaggtgcaaatgcaacggccacgcatccgagtgcggacctgacgtcgccggtcagctagcttgtaggtgccagcacaatacgacaggaaccgactgcgaacggtgtctgcctttctttcaagatcgaccctgggccaggggcaccgcagaagctgcccatgagtgtttaccctgcaattgctcagggcgctctgaagaatgcacatttgaccgggaacttttcaggagcacagggcacggcggacgctgccatcattgcagggatcacaccgcagggccacactgcgaacggtgtcaggagaatttctaccattgggacccccggatgccatgccagccatgtgattgccaaagtgcaggctccctgcacctgcagtgcgatgatacgggaacatgtgcttgtaagcccacggtgactggctggaagtgcgatagatgcctacctggatttcacagtttgagcgaagggggttgccgaccctgcacctgtaatcccgccgggtcgcttgatacctgcgacccgcggtcggggagatgcccatgtaaggagaatgtggaaggcaatctttgtgataggtgtagaccgggcaccttcaatttgcagcctcacaaccccgccggatgctcttcttgtttttgctatggccacagcaaggtatgcgcatccactgcacagtttcaggtgcatcacatcctcagcgactttcaccagggcgccgagggctggtgggccagaagtgtgggtggcagcgagcatccaccccagtggtcccccaatggcgtgttgcttagcccagaggatgaggaggagctgaccgctcccgaaaagttcttaggggaccagcgtttcagttacgggcagccccttattctgacgttccgtgtcccgcccggcgatagcccgctgccggtccagctgcggctggagggcacaggcttggccctgtcgcttaggcacagctccctatcagggccccaggatgccggacatccaagggaggtggaactgcgtttccacctgcaggaaactagcgaggacgttgcgcccccattgccaccattccacttccagcggcttctggcaaacctgacctctcttcgcttgagggtgtcaccgggcccatcccccgctggaccagtatttctgacagaagtccggctgacaagcgctcggcccggcctgtcccctccggccagctgggttgagatctgtagttgtccgaccggatacactgggcaattctgcgagtcttgtgcgcccggctacaagcgagaaatgccgcagggaggcccttatgcttcttgtgtcccctgcacttgtaatcagcacggaacttgcgaccccaatacaggaatttgcgtgtgttcacaccatacagagggaccctcatgtgagcggtgtctccccggtttttacggaaacccattcgccggtcaggctgacgactgtcagccatgcccgtgtccagggcagtctgcttgtaccacaatccccgagtcccgggaagtcgtgtgtacacactgtccccccgggcaacggggccgccgatgcgaagtgtgcgatgatggctttttcggagaccccctgggccttttcggccacccacaaccttgtcaccagtgccagtgttctgggaatgtggaccccaacgccgtcgggaattgcgacccgctcagtggacattgtctcaggtgcctgcacaacacaaccggcgatcactgcgaacattgtcaagaaggcttctacggctcagccttagcacctaggcccgcagacaagtgcatgccttgttcttgtcacccgcagggaagcgtttctgaacaaatgccgtgtgaccccgtcaccgggcagtgctcctgtctccctcacgttaccgcccgagattgttcccgctgctatcccggtttctttgacctgcagcccgggaggggttgtcgttcatgtaaatgtcatccactaggtagtcaggaggaccagtgtcatcccaaaaccggccagtgtacctgtagacctggcgttaccggccaggcctgcgaccggtgccaactgggtttcttcggattctcaataaaagggtgcagagcatgccggtgctcacccctcggcgctgcaagcgcacagtgccatgagaatggaacgtgcgtgtgccgaccaggctttgagggctacaaatgtgaccggtgccacgataacttctttctgaccgctgacgggactcactgccagcagtgcccgtcttgctatgctctggtcaaggaagaggccgcgaaactcaaagcccggctgactcttacggaaggctggcttcagggctccgactgcggctccccctggggtcctctggatatcctgctgggcgaagctcccaggggggatgtgtatcaagggcaccatctgctgccaggtgctagagaggcctttttagagcaaatgatgtcgcttgaaggagcggtgaaggctgcacgggaacagctccaacgactcaacaagggtgcacgctgcgcccaagctggatcacagaagacatgcacccaactcgctgacctggaagccgtgctggagagttctgaggaagaaattctgcatgccgccgctattttggcaagcctcgaaattccgcaggaggggcctagccagcctaccaaatggagtcatctggccactgaggccagggctctcgcacgttcacatcgggatacggccactaagatcgccgccacggcctggagggcccttcttgcttcgaatacctcctatgcactgttatggaatctgcttgagggccgcgtcgctctggagacacagcgagacctggaagacaggtaccaggaagtacaggctgcccagaaggctcttcggacagccgtcgcagaagtgcttccagaagctgagagcgttctggctaccgtgcaacaggtaggcgccgatactgctccatacttggctttgcttgcatcccctggagccctgcctcagaaatcccgagcagaagatctcggccttaaggcaaaggctttggagaagaccgttgcctcctggcagcatatggctacagaggccgcacgcacgttacaaacggcagcccaggccaccctgcgacagacagagccactgacgaaattgcaccaggaagctcgagctgctctaacacaagccagcagctctgtccaagcagctactgtcactgtgatgggcgctagaacccttctggccgatcttgagggaatgaagcttcagtttccccgccccaaggaccaggctgcactgcagcggaaggccgacagcgtgagtgacaggctgctggcagataccaggaaaaagacaaagcaggctgagcgcatgctgggcaatgccgctcccctcagttcttctgccaaaaagaaaggacgcgaggccgaagtgttggctaaggactcagctaagctggctaaagcactgttaagggaaagaaagcaggcgcaccgtcgggccagcagacttacttcccagactcaggccacacttcagcaggcatcccagcaggtgctggccagtgaagcccgtaggcaggagctcgaagaggctgagcgcgttggagctggcctgagcgaaatggagcagcagattagggaaagcagaatctcccttgagaaagacatcgagacactttccgaattacttgcgcggttagggagcctggatacacaccaggcccccgcgcaggccctgaacgaaacccagtgggccttggaaagactgcgattacagttgggcagccctggctcgctacaaagaaaactgtctctcctcgagcaggagtcgcagcagcaggagttgcagatccagggattcgaatccgacttggctgagatcagagctgacaaacagaatttagaggctatcctgcatagtctcccagagaattgcgctagctggcagtag

SEQ ID NO: 192720 - DNA, 459 bp, Artificial Sequence
  Description of Artificial Sequence: Synthetic coding sequence
atgcggctgcccctgagccacagccccgagcacgtggagatggccctcctgagtaatatcctggcagcatatagctttgtctccgaaaacccggagagggcggctctgtacttcgtctccggcgtctgcatcggcctggtattaaccctggcagcattggtcatacgtatttcttgtcacaccgattgccgccggaggccgggcaagaagtttctgcaagatagggaatcctcaagcgactctagcgacagtgaagatggatccgaggataccgtttccgacctctctgtgcggcgacatcgtcggttcgagcgcacactgaacaaaaatgtttttacttccgccgaggagttagagcgggcccaaagacttgaggagagggagcgcattatcagagaaatctggatgaatggtcaacctgaagtgcccgggaccagatcgcttaacaggtactactag

SEQ ID NO: 192721 - DNA, 1200 bp, Artificial Sequence
  Description of Artificial Sequence: Synthetic coding sequence
atggcccagcgggccttccccaacccctacgccgactacaacaagagcttggcagaaggctactttgacgcagccggcagactgaccccagagttcagccagcgcctcaccaataaaattcgagagctattgcaacagatggagagagggctcaagagcgcggaccctcgggatgggacaggctacaccggttgggccggtatcgctgtgctgtatctccatctgtacgatgtgttcggtgacccggcgtacctccagctcgcacacggatacgttaagcagtcactgaactgtttgactaagaggagtatcacctttctgtgcggagatgctggtcctcttgccgtcgcagcggtactctaccataagatgaataacgaaaagcaggccgaagactgcatcactcggttgatacacttgaacaaaatagacccacatgcgcccaatgagatgttatacgggaggatcggctacatttatgcactgctattcgttaacaaaaatttcggcgtagaaaagataccccaatcccacattcagcagatttgcgaaaccattctcacaagcggtgaaaacctcgctcgcaagcgtaactttactgccaagagtcccctaatgtatgagtggtaccaggaatactacgtcggggctgcccacggattggccggcatctattactacctcatgcagccaagcctgcaagtgtcccaaggaaagctccacagccttgtaaaaccctccgttgattacgtgtgtcagctgaaattcccatccggcaattaccccccttgtattggggacaatagggatctcctggtccactggtgtcacggggcccctggcgttatctacatgctgatacaagcttacaaagtcttcagagaggagaagtacctgtgtgatgcgtatcaatgcgcggacgtcatatggcaatacggactccttaaaaaagggtatggcctatgccacgggtccgcaggtaacgcttatgcttttctgaccttgtacaatttgacacaagatatgaaatacctctacagagcgtgtaagtttgccgagtggtgtttggagtacggtgagcatggatgtcgtacccctgacacaccattttccctcttcgagggcatggccggaactatttactttctcgccgacctgctggttccaaccaaagcgaggttccctgcctttgagctgtag

SEQ ID NO: 192722 - DNA, 1200 bp, Artificial Sequence
  Description of Artificial Sequence: Synthetic coding sequence
atggcccagcgggccttccccaacccctacgccgactacaacaagtcattggcagaaggttacttcgacgccgcaggaaggttgacccccgagttctcgcagaggcttaccaacaaaatccgggagcttctgcagcagatggaacgggggcttaaatccgccgaccccagagacggcactgggtacacaggctgggctggtatcgcggttctgtacttgcacctctatgatgtgtttggagaccctgcatacctgcagcttgctcacggctatgtcaagcaatccctgaattgcctaactaaaagatccatcacctttttgtgcggtgacgctgggcctctagccgtggctgcggtcttataccacaaaatgaataacgagaagcaggccgaagactgtattactagacttatccatcttaataaaattgatccccacgcccctaacgagatgttgtacggaagaatcggatacatctatgcgcttctttttgtgaataagaactttggcgtggagaagatccctcaaagccacatccagcagatttgcgagacgatactcactagcggagagaatctagctcgcaagcgcaatttcaccgctaagagcccattaatgtacgagtggtaccaggagtactacgtgggagccgcacacggactcgctggcatctattactacctcatgcagccttctctccaagtatcccaggggaagttgcatagcctggtgaaacccagtgtcgactacgtttgccagcttaagttcccttcgggcaactaccccccgtgtattggcgataacagagacctgctggtgcactggtgccacggcgctccgggtgtgatttacatgttgatacaggcatacaaagtgttccgggaagagaaatatctgtgtgacgcctaccagtgtgccgatgttatctggcagtatggtcttctcaagaaggggtacggtctgtgccatggttccgccgggaatgcgtacgcatttcttacactctataacctgacacaggacatgaagtatctgtacagggcctgcaaatttgccgagtggtgtttggaatatggagagcatggctgccgaactcctgatacacccttcagtctctttgaggggatggcaggtacaatctattttctagcagaccttctagtccccactaaggcaagattccccgcctttgagttatag

SEQ ID NO: 192723 - DNA, 1200 bp, Artificial Sequence
  Description of Artificial Sequence: Synthetic coding sequence
atggcccagcgggccttccccaacccctacgccgactacaacaagtcattagccgagggctatttcgacgccgctgggagactaacgccagagttttcccagaggctgacgaataagatccgggaactgctccagcagatggagcgaggtctgaaatcagcagatccgagagacgggacaggctacaccggctgggctggaatagcagtcctctacctgcatctctacgatgttttcggagatcccgcatatctccaactggcccacggatacgtcaagcagagcctcaattgtctgaccaagcgatccatcacctttttatgcggtgatgccgggcccctggccgttgccgccgtcctgtaccacaagatgaacaatgaaaagcaagccgaagattgcataacccgactcatccatctgaataagattgacccccatgctccaaatgagatgttatatgggcggattggatatatctacgccctgctgttcgtgaacaagaattttggtgtcgaaaaaatcccccaaagtcacatacaacagatctgtgagaccattctaacgtctggtgagaatctagcacgtaaacggaacttcactgctaaaagcccgcttatgtatgagtggtatcaggaatattatgtcggagcggcgcacggactagctggaatctattactacctcatgcagccaagcttacaggtctcccagggaaagctgcactccttggtgaagccatccgtggattacgtgtgtcaattgaagttccctagcggtaactacccaccttgtatcggggacaacagggacctgttggtgcactggtgccatggcgctcccggcgtgatttatatgcttattcaagcatacaaggtgttcagagaggaaaagtacctgtgtgacgcgtaccagtgtgcggacgtgatctggcagtacgggctcttgaagaagggttatggactgtgtcatggctcagccgggaatgcctatgccttcctgactctctacaatctgacacaagatatgaaatatctgtatagggcttgtaagttcgccgagtggtgcctggaatacggcgagcacgggtgtaggacaccagacacacctttcagcttattcgagggaatggctggaaccatttactttcttgccgatttgttggtgccaaccaaggctaggtttccggcgttcgagctgtag

SEQ ID NO: 192724 - DNA, 591 bp, Artificial Sequence
  Description of Artificial Sequence: Synthetic coding sequence
atggcccagcgggccttccccaacccctacgccgactacaacaagagccttgcggaagggtattttgacgccgctggacgactcacccctgagttcagccagaggctgactaacaagatccgcgagctgctacaacaaatggagagagggctgaagtccgctgacccacgcgatggtacggggtacaccgggtgggctgggatcgccgttctctatctgcatctatacgatgtgttcggcgacccggcatatctccagctcgcacatgggtacgttaaacaatcgctgaattgcctgaccaaaaggtcgattacctttctgtgcggggatgccgggcctctggcggttgctgcagtgttgtaccacaagatgaataacgagaagcaggctgaggattgtatcacgagacttatccatcttaataaaatcgatccccacgcccctaacgagatgttgtatggcaggatcgggtacatatacgccctgctgttcgtgaataaaaacttcggggtggagaaaattccccagagtcatattcagcagatttgtgaaaccatcttgacctccggcgaaaatctggcccgaaaatag

SEQ ID NO: 192725 - DNA, 1200 bp, Artificial Sequence
  Description of Artificial Sequence: Synthetic coding sequence
atggcccagcgggccttccccaacccctacgccgactacaacaagtccctggccgaaggatatttcgatgccgccggcaggcttactcccgagttctcacagcgcctcacgaacaagattcgtgaactactccaacagatggagcggggcctcaagtcagctgatcccagagacggcacagggtacactgggtgggctggaatagccgtgctgtacctgcacctgtacgacgtgtttggcgatccggcatacctccagctcgcgcacggatacgttaaacagagtcttaactgtctgacgaaaaggtctattaccttcctttgtggtgacgctggacctctggctgtcgccgctgtgctttatcacaagatgaataacgaaaagcaggcagaggattgtatcacccgcttaatccacctgaataagatcgacccgcatgccccgaacgagatgctttacgggcggattggctatatctatgccctgttatttgtaaacaagaatttcggtgtggaaaagattccccagagtcacattcagcagatctgcgaaaccatacttacatcgggcgagaatctggcaagaaaacggaacttcacagccaaaagccccctgatgtatgagtggtaccaggaatattatgttggcgcagctcacggtcttgccggcatttactattacctgatgcagccttccctgcaggtgagccagggcaaactgcattcactggtaaagccgtcagtcgactacgtgtgtcagctgaagtttccatcagggaactacccaccgtgcatcggcgataaccgggatctcttggttcattggtgccacggggcccccggcgtaatatatatgctgatccaggcatataaggtctttcgagaggagaaatacttatgcgacgcatatcagtgcgcagacgtgatatggcagtatggcttgctgaagaaaggatacggcctgtgccacggatcagctgggaacgcctatgcttttctgactctgtataacctcacacaggatatgaaatatctctatcgcgcctgtaaatttgccgaatggtgtctcgagtacggagaacatggctgccgaacccctgacaccccttttagcctgttcgaaggcatggctggaactatttacttcctggccgaccttcttgtgccgaccaaagctcgattccccgccttcgaactgtag

SEQ ID NO: 192726 - DNA, 1353 bp, Artificial Sequence
  Description of Artificial Sequence: Synthetic coding sequence
atgggcgagaccatgagcaagcggctgaagctgcacctgggcggcgaagccgagatggaggagcgagcgtttgtgaatccatttccagactacgaggccgcagctggagctctactggcctccggcgcggctgaggaaaccggctgcgtgaggccccccgccaccaccgacgaacctggccttccgtttcatcaggatggaaaaataattcataactttattagacgaatccagactaagatcaaggatctgctgcagcagatggaggagggactgaagaccgcagatcctcatgactgctcagcctacacgggctggaccggaatcgccctgctttatctacagctgtaccgagtaacatgcgatcaaacatacctactgcgctctctcgactacgtgaaacgaacactgcgaaatctgaacggcaggcgtgtcacatttctgtgcggggatgcaggtcccctggccgtgggtgcggtaatttaccacaaactgagatcagattgcgagtcgcaggagtgcgtaacaaagctactgcagcttcagcgctctgttgtgtgccaggagtccgaccttccagatgagctgctgtacggaagagccggatacctctatgcattgctgtacctgaataccgaaattggtcccggtacagtgtgcgagtccgcaattaaggaagtggtcaacgcaattatagagtccggcaaaaccctgtcaagggaggaacgaaaaacagagaggtgcccactcttgtaccaatggcatagaaaacagtatgtgggggctgcccacggaatggcaggtatttattacatgctgatgcagccagctgcgaaagttgatcaggagacactgacagagatggttaaaccatctatcgactatgttcggcacaagaagttccggtcaggcaattatccctcgtcgttatccaatgagacagacagattagttcattggtgccacggagcccctggcgttatccacatgctcatgcaggcttacaaggtgtttaaagaggaaaagtatctgaaggaggctatggagtgttctgacgtgatctggcagagagggctcttgcgcaaaggttacggcatatgccacggcaccgccgggaacggatattcctttctgagcctgtaccggctgacccaggataagaaatacctgtatagagcatgcaagttcgctgagtggtgccttgattatggggcgcatggctgccggattccagacaggccatacagcctctttgaagggatggccggggcgatccatttcctcagcgatgtgctgggacctgaaacctcacgttttccggcttttgagttggattcctcaaaaagagactag

SEQ ID NO: 192727 - DNA, 2199 bp, Artificial Sequence
  Description of Artificial Sequence: Synthetic coding sequence
atgaccgagggcacctgcctgcggcggcggggcggcccctacaagactgaacctgccactgacctgggaaggtggagactcaactgcgaaaggggaaggcaaacctggacatatctacaggacgagagggccggtcgggaacaaaccggcctcgaggcctatgctctggggttggataccaagaactactttaaggatcttcccaaggcccacactgccttcgagggtgctttgaacggaatgactttctacgtgggtctccaagcagaggatggacattggactggcgactacgggggtcctctatttctgttgccagggctacttattacctgccacgtggcacgtatccctctgcctgcaggctaccgcgaagaaatagtcaggtaccttagaagcgttcagctgccagatggggggtggggccttcatattgaagataaatctacagtctttgggaccgcactgaactacgtgtccctgcggatcctaggggtaggaccggatgatcccgatctggtgcgggcacgcaacattctccacaagaagggaggagccgtggccatcccaagctggggaaagttttggttagctgtactgaatgtttatagttgggaggggctcaacaccctgtttccagagatgtggttatttccagattgggcacctgcacatccaagcactctgtggtgtcactgtagacaagtttatttgcctatgtcctactgttacgccgtgcgactgtctgccgccgaagacccgctggtgcagagcctaaggcaggagctgtatgtcgaggatttcgcatctatagactggcttgcgcagcgaaacaatgtggcacccgacgaactttacaccccgcatagctggctgctccgagttgtgtacgcgctgctcaatttatatgaacaccatcatagtgctcacctcaggcagcgggctgttcagaaactgtacgaacatatcgtcgctgatgacagattcaccaagtccatctctattgggccaatctccaaaaccatcaatatgctcgtgaggtggtatgtggacggtccagctagtactgcttttcaggaacatgtgtccaggatcccggactatctgtggatgggattggatggtatgaagatgcagggaactaacggcagccaaatttgggatactgctttcgccatccaagcacttttggaggctggcggccatcatcgtcctgagtttagtagctgcctgcagaaggcacacgagtttctgagactaagtcaggtccctgataaccccccagattaccaaaaatactatcggcagatgcgtaaaggcgggttttcgttcagtaccttggattgcggttggatcgtgagtgactgtacagcagaagcgttgaaggccgtactactgctccaagagaaatgcccccacgtgacggaacatatcccacgagagagactgtgtgacgcagtcgcggtcctgctcaatatgcggaatcctgatggagggttcgccacctacgagacaaagcgaggcggccatttgctggagttgctaaaccctagcgaagtgtttggagacattatgatcgactatacatatgtggagtgcacgagtgcagtaatgcaggctttgaaatattttcacaagcgtttcccagaacatcgcgccgcagaaattagagagactctcacacaagggctggagttctgtcggcgtcagcaaagggctgatggttcctgggagggatcctggggggtatgctttacatatggcacatggtttggactagaagccttcgcatgtatgggacagacctacagggacggcaccgcttgcgcggaagtaagccgcgcatgtgacttcctgctaagcagacagatggcggatggtgggtggggcgaagacttcgaatcatgcgaggagcgtagatacttacagtccgcccagtcccaaattcataacacttgctgggctatgatggggttgatggccgtgcgtcaccctgatattgaggcccaggaaagaggcgtgcgttgtctgctggagaagcagctgccaaatggcgattggccccaggagaatatagccggagtctttaacaagagttgtgcaataagctatacatcttacaggaacatattccctatttgggccctcggtcgttttagccagctataccctgagagagcgctcgccggtcatccttag

SEQ ID NO: 192728 - DNA, 2199 bp, Artificial Sequence
  Description of Artificial Sequence: Synthetic coding sequence
atgaccgagggcacctgcctgcggcggcggggcggcccctacaagactgaacccgcaaccgacttgggccgctggcgtctgaattgtgagagagggcgccagacttggacttatcttcaggacgagcgagcgggacgggaacagacaggactggaagcgtacgccctgggcctggacactaaaaattactttaaggatctgccgaaggcccacaccgcgtttgagggggcactgaatggaatgaccttttacgtgggacttcaggctgaggacggccactggactggagactatggcggccctctgtttttgttgcccggcttactcatcacctgccacgtcgcccggattccactccccgccggctaccgcgaggaaatcgtgaggtatcttcgtagtgtgcaattaccggatggcggctggggactgcatattgaagacaaaagcacggtcttcggaacagccttgaactatgtgtcgcttaggatcttaggagtcgggcctgatgacccggatctggtcagagcccgcaatattttacataagaaggggggagcagtcgccattccttcttggggaaagttttggctggccgttctgaacgtgtatagttgggagggcctgaatactcttttccccgagatgtggctgttcccagattgggccccagcccatcctagcaccttgtggtgtcactgtcggcaggtgtacctcccaatgtcatattgttatgccgtgaggctcagcgccgcagaagaccctttagtgcagagccttagacaggaactctatgtcgaggactttgctagtatagactggctggcccaacggaacaatgtcgcgccagatgaactatataccccccatagctggcttcttcgagtggtgtatgcactcctcaatctatatgaacaccatcatagcgctcacttgcggcaaagggccgtgcagaagttatacgaacacatcgttgcagatgacaggttcacgaagagtatctctattggccctatatctaaaactatcaacatgctggtccggtggtacgtggacggtccagccagtaccgcttttcaggaacatgtcagccggattcctgactatctgtggatgggcctggatggaatgaaaatgcagggaaccaacggatcacagatttgggatacagccttcgctatccaggccttattggaggctgggggccatcacagaccagaattctcttcatgcctgcagaaagctcacgagtttcttcgattgagtcaggtgcccgataatcctccggattaccagaagtattaccggcagatgcgcaaaggcggcttttcattctcaacattggactgtggatggatcgtctctgactgcacagccgaggccttgaaagctgtgttgctgctgcaagagaagtgcccccatgtcactgaacacatccctcgggaacgcctgtgtgacgcggtggccgttttgctgaacatgcgcaaccctgacggtgggttcgccacatacgagacgaagcggggcggccacctactcgaactgctgaacccatcggaggtgtttggtgacatcatgatcgactatacgtatgttgagtgcacatccgcagttatgcaagctctaaagtactttcataagcgcttcccagagcatcgcgccgccgagattagggaaactcttacacagggactggaattttgcaggcgccaacaaagggccgatggcagttgggagggctcttggggcgtctgctttacatacgggacctggttcggtcttgaggccttcgcctgcatggggcaaacgtatagagacggcaccgcatgtgccgaagtgagcagggcctgcgactttctgctatctcgccagatggctgacggaggatggggggaggactttgagtcttgtgaggaaaggagatatctccagagtgcccagtcacaaatccacaacacatgctgggcaatgatgggtcttatggctgtacggcaccctgacatcgaggcccaggaacgcggcgtccggtgcttattagaaaaacaactcccaaacggggactggccacaagagaatatcgccggggtgttcaataagagctgcgctataagctacacatcttaccggaacatcttcccaatctgggccctgggccggttcagtcagctgtaccccgagcgagccttggctggtcatccctag

SEQ ID NO: 192729 - DNA, 1959 bp, Artificial Sequence
  Description of Artificial Sequence: Synthetic coding sequence
atgaccttctacgtgggcctgcaggccgaggacggccactggaccggagactatggcggccccctgttcctgctgccagggctcctgataacatgccacgtcgcccgaattcctctgcctgccgggtatcgagaagagattgtgcgctaccttcggagcgtgcagttaccggatggggggtggggactgcacattgaagataagagcactgtgttcggcaccgctttgaactatgtgagtctgcggatcttgggcgtcggccccgacgatcctgatctcgtgcgcgccaggaatattttgcataaaaagggcggcgccgtggcaataccatcctggggaaagttctggctcgcggttttgaatgtgtattcctgggagggcctcaacaccctgttccccgaaatgtggctctttccagattgggcacccgcccatccatctacgttgtggtgccattgtagacaggtctatttgcctatgagctattgttatgccgtgcggctaagtgccgccgaggatcctttggtgcaaagcctgagacaggaactgtacgtggaagattttgctagcattgattggctggcccagcgtaacaacgtcgcacccgacgagttatatacaccccactcttggctcttgcgagtggtgtatgcattactgaacctgtacgagcaccaccacagcgcccatctacggcagcgtgcagttcagaaactgtatgagcacatagtggcggatgaccgattcacgaagtcaatctcaataggacctatttcaaagacgataaacatgctggtgcggtggtacgtggacggacccgctagtaccgcatttcaagaacacgtgagccgaattcccgactatctctggatgggcctggacggtatgaagatgcaggggacgaacggtagtcagatctgggacacagccttcgctatccaggcactgctggaggccggtggtcaccataggcctgaattcagtagctgtttgcagaaagctcatgagttcttaaggctaagtcaagtccccgacaatcctcctgactaccagaagtattaccgtcagatgcggaaaggtgggtttagtttctctactctagattgcgggtggattgtttctgactgtactgccgaagcactgaaagcggtcttgctgctacaggaaaagtgcccacacgtgaccgaacacatcccacgcgagcggctttgtgatgccgtggccgtgcttcttaatatgcgcaatcctgacgggggttttgctacatatgaaaccaaacggggcggacatttactggagctgctcaacccctcagaggtgttcggcgatatcatgatcgactatacgtatgtcgaatgtactagtgccgtgatgcaggcactgaagtatttccataagcgctttccagaacacagggccgccgagattagggaaacactcactcagggtttggaattttgccgacgccagcaacgagccgatggcagttgggagggctcctggggtgtctgttttacatatgggacttggtttgggctagaggctttcgcttgtatgggacagacctaccgcgatggtacagcctgtgcggaagtttctagggcttgtgattttctgctgagcagacaaatggccgatggcgggtggggcgaagactttgagtcttgcgaggagcgcaggtacttgcagagtgcacagagtcagatccacaacacttgctgggcaatgatgggtctgatggcagtccgacacccagatattgaagcacaggagagaggagtgagatgcctgctagaaaaacagcttccaaatggagactggcctcaggaaaatattgctggagtttttaataagagctgcgccatctcctatacatcttatcggaatatttttccgatttgggcacttggacgattcagccagctgtatccagagcgggcattagcaggccatccttag

SEQ ID NO: 192730 - DNA, 2166 bp, Artificial Sequence
  Description of Artificial Sequence: Synthetic coding sequence
atgaccgagggcacctgcctgcggcggcggggcggcccctacaagacggaaccggccacagacctgggtcgttggaggctgaattgtgaacggggcaggcagacctggacctacctgcaggatgaacgagccggccgagaacagaccggccttgaggcatacgcgcttggtctagatacaaagaactacttcaaggacctgcctaaggctcacaccgcatttgagggggctcttaatggcatgacattctacgttggccttcaggctgaggatggccattggacgggtgactacgggggccccctatttctcttgcctggcctgctcattacatgccatgtggcccggattcccctccccgccggataccgagaggagattgtcaggtacctgaggcacattgaagacaagtcaactgtattcggcactgcgctgaactacgtctctctcaggattttgggcgtcggcccggacgaccccgaccttgtgagggccaggaacatcctgcacaaaaaaggcggtgcggtagcaattccgtcatggggcaaattctggctcgcagtgttgaacgtgtatagctgggaaggtttaaatactctgtttccggaaatgtggctgttccccgattgggcaccagcccacccgagcaccctgtggtgccactgcaggcaggtctacttgcccatgagctactgctacgccgtaagactcagtgccgccgaagacccattagtacaatctttgagacaggaattgtacgtggaagacttcgcttccatcgattggcttgcccagcgtaacaacgtggcacccgacgagctatacactcctcattcctggctgctgcgggtagtgtacgccctgcttaacttgtacgagcatcaccattctgcccatctaaggcaacgggcggtgcagaagctttacgagcacatcgtcgctgatgacagattcactaagagtatctcaatcggacctattagcaagaccattaacatgttggtccgctggtacgtggacgggcctgcatcaaccgcatttcaggagcatgtcagcagaataccggactacctatggatgggtctcgacggaatgaaaatgcagggtacaaatggttctcaaatctgggatacagcctttgccatccaggcgcttctcgaagctgggggccaccacagacccgagtttagcagttgtctgcaaaaggcccatgagtttctgcgcctgtctcaagtacccgataacccaccggactatcagaagtattacaggcagatgagaaagggagggttttctttcagtactctggattgtggctggattgtttctgattgtaccgccgaggcgcttaaggcggtcctgttgctccaggaaaagtgcccacacgtgacagagcacatccctcgagagagactgtgcgatgcggtggcagtcctcttaaatatgcgcaatcccgacggcgggtttgcaacttacgaaacaaagcggggcggccacctgctggagcttctcaatccatccgaagttttcggcgatataatgattgactatacttacgtagagtgcacttcggcagtcatgcaagccctcaagtacttccacaagagattccctgagcaccgtgcagccgagattagagaaacattgacgcagggtctcgagttctgtcgacgccagcaaagagctgatgggtcttgggaagggtcatggggcgtctgttttacatacggaacatggttcgggctggaggcttttgcatgcatggggcagacctaccgcgacgggacagcatgcgccgaagtgagcagagcttgcgattttctgctaagccgccagatggctgatggggggtggggggaggatttcgagtcctgtgaggagaggcggtaccttcagagtgcacagtcacagatacacaacacctgctgggcaatgatggggctgatggcagtgaggcacccagacattgaagcgcaggaaagaggcgtaaggtgtctgttggagaagcagctgcccaacggagattggccacaggaaaatatagcaggggtttttaataaatcctgtgccattagttatacttcctaccgaaacattttcccaatttgggcccttggaagattctcccagctgtaccccgaaagggccctggcaggccatccctag

SEQ ID NO: 192731 - DNA, 1977 bp, Artificial Sequence
  Description of Artificial Sequence: Synthetic coding sequence
atgggccggcggcgggcccccgccggcggcagcctgggccgggccctgatgcgccaccaaacacaacgttccaggtcccaccggcacaccgatagttggttgcatacatccgagttgaacgacggatatgactggggccgactaaacctgcagtccgtgacagaacaatctagccttgatgacttcttagccactgcagagctggccggcactgagtttgtggccgagaaattgaacattaaattcgtgcccgcggaggcccgaacaggactactctcctttgaagagtctcaacgtattaaaaagcttcatgaagagaacaaacagtttttgtgtattcccaggcgacccaactggaaccagaacacaacgcctgaagaactgaaacaggctgagaaagataatttcctggaatggaggagacagttggttaggctggaggaggaacagaaactgatccttacaccgttcgagaggaatctggacttctggaggcaactgtggcgggttattgaacggagcgatatcgtggtgcaaatcgtggatgcgagaaaccccttgctcttcaggtgcgaggatctggagtgctacgtgaaggagatggacgcaaataaagagaatgttatcctaattaataaggcagacctgctgaccgccgaacaacgatcagcgtgggctatgtactttgagaaggaggacgttaaggtgatcttttggtcagccttggcaggtgccataccccttaacggagacagcgaggaagaagcaaacagagacgaccggcaatccaatactacaaaatttgggcacagttcctttgatcaggcagaaatatcacatagcgaatccgagcatctgccagcacgagattccccatcattgtccgaaaaccccaccactgacgaggatgacagcgagtacgaagattgccctgaagaagaggaggacgactggcaaacctgttctgaagaggatgggcccaaagaagaagactgcagccaagactggaaggagtcatccaccgcagacagtgaggctaggagccggaagacccctcagaaacgccaaattcacaactttagtcacctcgtgtccaagcaggagctactagagctgtttaaagaactccacaccgggcgcaaggtcaaggatggccagcttacagtcggacttgtgggctacccgaatgtcggtaagagcagtacgattaacaccattatggggaacaagaaggtttctgtttcagctacaccaggacacactaaacattttcagacactgtatgtcgagcccggactctgcctctgcgattgtcctgggttggtgatgccatcctttgtcagcaccaaggccgagatgacctgcagcgggatccttccaattgaccaaatgcgcgaccacgtcccccccgtctcactcgtgtgtcagaacatccctcggcacgtattggaggcaacttacggcatcaacataatcaccccacgcgaggatgaagatccacaccgcccgcctacatctgaagagctgctgacagcctacgggtacatgcgaggctttatgaccgcacacggtcagccagatcagcctagatctgcccggtacattttgaaagattacgtctcaggcaaactgctgtactgccaccctccccccggacgggacccggtgacctttcagcatcagcaccagaggctgcttgagaacaagatgaattcagacgagatcaagatgcaactcggacgcaacaagaaagccaagcagattgaaaacatcgtggacaagacttttttccatcaagagaacgtgcgggctctgactaaaggagtccaggccgtgatgggctacaagcccgggagtggggttgtgaccgcctcaaccgctagttccgagaacggtgcaggcaaaccgtggaagaagcacggtaatagaaataaaaaagaaaagtcgcggcgattatacaaacacctagacatgtag

SEQ ID NO: 192732 - DNA, 333 bp, Artificial Sequence
  Description of Artificial Sequence: Synthetic coding sequence
atgagctgccagcagagccagcagcagtgccagcccccccccaagtgcaccccaaaatgtccccctaaatgccccaccccaaaatgccctcccaagtgccctcccaaatgtccacctgttagctcctgctgcagcgtaagctcaggcggttgctgtggctcctctagcggcggcggctgtagcagcggaggcgggggttgttgtctgtcacatcacaggcgccatcgcagtcaccgccacaggttgcaatcctcgggttgttgctcccaaccatctggcggatcaagctgctgcggaggggattctggccaacacagcggcgggtgctgttag

SEQ ID NO: 192733 - DNA, 333 bp, Artificial Sequence
  Description of Artificial Sequence: Synthetic coding sequence
atgagctgccagcagagccagcagcagtgccagcccccccccaagtgcactccaaagtgcccccctaagtgtccaacaccgaaatgccctccaaaatgcccacccaaatgccccccagtgtcctcatgttgcagtgtttcttccggggggtgttgtggatcatcttcgggagggggatgctcttcaggcgggggcggctgctgcctgtcacatcatcgccgacatcggtcccaccggcaccggctgcagtctagcgggtgctgtagtcaaccttctggcggcagctcctgctgtgggggagactctggacagcattccggaggatgttgctag

SEQ ID NO: 192734 - DNA, 357 bp, Artificial Sequence
  Description of Artificial Sequence: Synthetic coding sequence
atgagctgccagcagaaccagcagcagtgccagcccccccccaagtgcatccccaaatgccccccgaagtgccttacgccacgctgcccaccgaagtgtcctcccaaatgcccgcccgtctcaagctgctgcagtgtctcatcagggggatgttgtggctctagtagcggtggctcctgtgggagtagttcaggggggtgctgtagctcagggggcggaggatgttgtcttagtcaccacagaagacgtcgtagtcattgtcatagaccccagtcctctggctgttgttcccagccctccggcggatccagttgttgtgggggcggaagtggtcagcactccgggggctgttgctag

SEQ ID NO: 192735 - DNA, 333 bp, Artificial Sequence
  Description of Artificial Sequence: Synthetic coding sequence
atgagctgccagcagaaccagcagcagtgccagcccccccccaagtgcatacctaaatgcccccctaagtgcctgacacccaggtgtccgccaaaatgtccaccgaaatgtcctccagttagcagctgctgctccgtcagctctggcggttgttgcggttcttctagcggtggctgctgctcttctgggggagggggttgctgcctgagccatcataggcggcgccgatcacactgccaccgtccacagagttccggatgctgtagccaacccagtggcgggtcatcttgctgtggtggcggaagcgggcagcatagcggaggctgctgctag

SEQ ID NO: 192736 - DNA, 357 bp, Artificial Sequence
  Description of Artificial Sequence: Synthetic coding sequence
atgagctgccagcagagccagcagcagtgccagcccccccccaagtgtactcccaagtgccccccaaaatgccccactcccaagtgtcccccaaaatgccccccgaagtgcccccccgtaagctcctgctgtagtgtcagcagcggtgggtgctgcggctcctccagcggcggaagttgtggaagctcgtcaggtgggtgctgctctagtggcggcggaggctgctgcctctcccaccaccggaggcgccgttcacattgccaccggccacaaagctctgggtgctgcagtcagcccagcgggggctccagttgctgcgggggagggtccgggcaacattctggagggtgttgttag

SEQ ID NO: 192737 - DNA, 345 bp, Artificial Sequence
  Description of Artificial Sequence: Synthetic coding sequence
atgagctgccagcagagccagcagcagtgccagcccccccccaagtgcacccctaagtgtactcccaaatgtccagccccaaagtgtccccccaaatgcccgcccgtgagcagttgttgcagcgtgtcctcgggcggttgttgtggatcatccagcggggggggatgtgggtctaattccggcggttgctgcagctctggcggtggcgggtgttgtttgagtcaccatcggcggcacagatcacataggaggcggcctcagtcctctgactgctgcagccagccgagtggagggagctcctgctgcggcgggggttcaagccagcattctggcggctgctgttag

SEQ ID NO: 192738 - DNA, 357 bp, Artificial Sequence
  Description of Artificial Sequence: Synthetic coding sequence
atgagctgccagcagagccagcagcagtgccagcccccccccaagtgtacccctaaatgtccaccgaaatgccccactccaaagtgcccccccaagtgtcctccaaagtgtccaccagtctcttcctgttgttctgttagctctggagggtgctgtggcagcagctccggaggctcttgtgggtcctcaagtggtggctgttgctcatccggcggtggcgggtgttgcctatcacaccaccgccaccacaggagccacagacacagacctcagtcttctgactgctgttcccagcctagcgggggaagtagctgctgtggcggtggaagcggacagcattctggtggatgctgctag

SEQ ID NO: 192739 - DNA, 357 bp, Artificial Sequence
  Description of Artificial Sequence: Synthetic coding sequence
atgagctgccagcagagccagcagcagtgccagcccccccccaagtgcactcctaagtgtcctccgaaatgtccaacaccaaaatgtcctccaaagtgtccccccaaatgtcccccagtctcctcttgttgtagtgtgtcaagtggaggatgctgcggctcatcatcaggtgggtcttgtggctcttcgagcggtgggtgttgctcttctggcggaggcgggtgctgcttgagtcaccatcgtcaccaccgatctcaccgccatagaccacagtccagcgactgctgttcccagcccagcggcggcagttcctgctgcggaggggggagcggccagcattcaggcggatgctgctag

SEQ ID NO: 192740 - DNA, 357 bp, Artificial Sequence
  Description of Artificial Sequence: Synthetic coding sequence
atgagctgccagcagagccagcagcagtgccagcccccccccaagtgtacacctaaatgcccacctaaatgtcctacaccaaaatgtccgcccaaatgccccccaaagtgtccccctgtttcctcatgctgctctgtttcctcaggtggctgctgcgggtccagctccggaggctgttgctcatccggcggcggtgggtgttgttcctctggcgggggggggtgttgtcttagtcaccacaggcggcgccgctcccaccgccatagaccacagtcatctgattgctgcagtcagcctagcgcgggttcgtcttgttgtggtggagggtcagggcagcatagcggaggttgttgttag

SEQ ID NO: 192741 - DNA, 321 bp, Artificial Sequence
  Description of Artificial Sequence: Synthetic coding sequence
atgagctgccagcagaaccagcagcagtgccagcccccccccaagtgtcctcctaaatgccccccaaagtgtccacccaagtgtaggccacagtgtccggccccatgcccgccccctgtctccagttgctgcggtccttccagtgggggttgctgtggatcgtctagcggaggatgctgctccagtggtggcggaggctgctgcctgtctcatcaccgccccaggctgtttcatcgccatcggcatcagagcccagattgctgcgagtgcgagcctagtggaggctctgggtgctgccacagttcgggtgattgttgctag

SEQ ID NO: 192742 - DNA, 333 bp, Artificial Sequence
  Description of Artificial Sequence: Synthetic coding sequence
atgagctgccagcagaaccagcagcagtgccagcccccccccaagtgtccgcctaagtgcacccctaagtgcccgcccaagtgccctcccaaatgtttgccccagtgcccggccccttgtagtccagccgtgtccagttgctgcggtcctatcagtggggggtgttgtggaccaagctcaggtggatgttgcaactcaggggccggtggatgctgtctctcacaccaccgacctcgtctgttccacagacgcagacaccagagccccgactgttgtgagagcgagccaagtggtggttccgggtgttgtcatagctctggaggatgctgttag

SEQ ID NO: 192743 - DNA, 333 bp, Artificial Sequence
  Description of Artificial Sequence: Synthetic coding sequence
atgagctgccagcagaaccagcagcagtgccagcccccccccaagtgtccacctaaatgtacccccaaatgtcctcctaaatgtccaccaaaatgtctaccacaatgcccagcaccatgctcaccggctgtgagctcatgttgtggaccaatttcaggcggatgttgcggcccatcatccggtggctgctgcaacagtggggccggagggtgctgtttgtcacaccacagacccaggctgtttcacagacgccggcatcagtctccagattgctgtgagtccgagccctctggggggtccggctgctgtcattcttctggcggatgttgctag

SEQ ID NO: 192744 - DNA, 333 bp, Artificial Sequence
  Description of Artificial Sequence: Synthetic coding sequence
atgagctgccagcagaaccagcagcagtgccagcccccccccaagtgtccccccaaatgcaccccgaagtgtcccccaaaatgtccccccaagtgccccccacagtgcccagccccatgcttcccagccgtttcaagttgttgtggaccaagctccggatcatgctgcggcccttcgtccggaggatgctgtagcagcggcgccggtggctgttcccttagccatcaccgcccccgactctttcatcgaagaaggcaccaatctccagactgctgtgagtccgagcccagcggaggctctggctgttgccactcctccggtgggtgttgttag

SEQ ID NO: 192745 - DNA, 333 bp, Artificial Sequence
  Description of Artificial Sequence: Synthetic coding sequence
atgagctgccagcagaaccagcagcagtgccagcccccccccaagtgtcctcctaagtgtaccccgaaatgcccacctaagtgtccccccaaatgtccacctcagtgccccgcgccgtgctctcccgcagttagttcctgctgcggcccttcttctgggtcttgttgtggcccaagctcagggggctgttgctcttctggtggcggaggttgctgtctctcccatcaccgccccaggctttttcaccgaagaagacaccagtcaccggactgctgtgagtccgagcctagtggagcttccggctgttgccacagttctggagggtgctgctag

SEQ ID NO: 192746 - DNA, 270 bp, Artificial Sequence
  Description of Artificial Sequence: Synthetic coding sequence
atgagctgccagcagaaccagcagcagtgccagcccccccccaagtgcccagccaagagccccgcccagtgtctacctcccgcttcctcctcttgcgcacccagttcaggaggatgcggtccctcctccgaaagatcctgctgtctctcacaccaccgttgtcgtagatcgcatagatgcagatgtcagtcgtctaatagctgcgaccgcgggtcaggtcagcagggtggctccagcagttgtgggcactcttccgctggctgctgttag

SEQ ID NO: 192747 - DNA, 288 bp, Artificial Sequence
  Description of Artificial Sequence: Synthetic coding sequence
atgagctgccagcagaaccagcagcagtgccagcccctgcccaagtgtcccagccccaagtgcccacccaagagctcagctcagtgtcttccccccgcttcctcctgctgcgccccacgccctggatgttgcggaggcccttcctctgagggaggttgctgcctttcccatcaccggtgctgcaggagccaccgctgcaggcgccaatctagcaactcatgtgatcgaggctcgggtcaacaggacggggccagcgattgtggatacggcagcggaggatgctgctag

SEQ ID NO: 192748 - DNA, 285 bp, Artificial Sequence
  Description of Artificial Sequence: Synthetic coding sequence
atgagctgccagcagaaccagcagcagtgccagcccccccccagctgcccctctcccaagtgtccaccaaaaagtccagcccaatgtctcccgcccccgagcagcgactgtgccctgtcatctggtgggtgtggaccatctagtgaaagcgggtgctgtctgtcccatcatcggcacttcaggagccaccagtgcaggcgacagcggtcaaattcctgcgatcgaggctctggccagcaaggggggggctcgtgcaggggacacggctccggaggttgttgctag

SEQ ID NO: 192749 - DNA, 279 bp, Artificial Sequence
  Description of Artificial Sequence: Synthetic coding sequence
atgagctgccagcagaaccagcagcagtgccagcccccccccaagtgccctagtccaaaatgtccacccaaatcccccgttcagtgcttacctcccgccagctccggttgtgccccttccagcgggggctgcggcccctccagcgaaggaggctgtttcctgaatcaccaccggcggcaccatcgctgccgaagacagaggcccaacagttgcgaccgcggaagcggccagcaggggggaggaagcgggtgtggccacggctccggcggctgttgctag

SEQ ID NO: 192750 - DNA, 279 bp, Artificial Sequence
  Description of Artificial Sequence: Synthetic coding sequence
atgagctgccagcagaaccagaagcagtgccagcccccccccaagtgccctagccctaagtgtccccctaaaaaccctgtgcaatgtctgcccccagcgtctagcggctgtgctccctccagtggtggttgcggtccgagttctgagggaggctgttttcttaaccatcatcggcgacaccaccgctgccgaagacaaagatccaattcatgcgaccgaggaagtggccagcaagggggaggctctggctgttgtcatggatccggtggctgttgctag

SEQ ID NO: 192751 - DNA, 300 bp, Artificial Sequence
  Description of Artificial Sequence: Synthetic coding sequence
atgagctgccagcagaaccagcagcagtgccagcccccccccaagtgtcctatcccgaaatatccacctaagtgtccttcgaaatgcgccagtagttgcccaccacctatctcgagctgctgcggctcctcaagcggtggctgcggatgttgttccagcgagggcggcggatgttgtctgagccaccaccggcatcacaggtcccattgccatcgcccaaagtcgagcaactgttacgggagtggcagcggccagcagtccggcgggtcggggtgctgttccggcgggggatgctgttag

SEQ ID NO: 192752 - DNA, 300 bp, Artificial Sequence
  Description of Artificial Sequence: Synthetic coding sequence
atgagctgccagcagaaccagcagcagtgccagcccccccccaagtgccccattccaaaatatcctcccaaatgcccttccaagtgtgcctcttcttgccccccacccatttcctcctgctgtggaagctcaagcgggggctgcggttgttgttcctcagaaggaggaggctgttgtctctctcatcaccggcatcatcgctcgcattgtcatcgcccaaagtcttccaactgttatggttcggggtcaggacaacagtccggaggttccggttgttgttctggtggcggatgctgctag

SEQ ID NO: 192753 - DNA, 357 bp, Artificial Sequence
  Description of Artificial Sequence: Synthetic coding sequence
atgagctgccagcagagccagcagcagtgccagcccccccccaagtgtaccccgaagtgcccacccaagtgtacccccaaatgccctcccaagtgtcctcccaaatgtcccccccagtgctccgcaccctgcccaccccccgtaagcagctgctgtggcagttcgtccggcggatgctgttcttctgagggtggtggatgttgtttgagtcaccatagaccaaggcaatccctgcgccgaaggcctcaatcatcatcttgctgtgggagcgggagcggacaacagtccggcggcagttcatgttgccatagtagcggagggtccggttgctgtcacagcagcggcggctgctgctag

SEQ ID NO: 192754 - DNA, 297 bp, Artificial Sequence
  Description of Artificial Sequence: Synthetic coding sequence
atgagcagcgacgacaagagcaagagcaacgaccccaagaccgagcctaaaaactgcgatcccaaatgtgagcagaagtgcgaatcgaagtgtcaaccctcctgccttaagaagttgctacagaggtgctttgaaaagtgtccatgggaaaaatgccctgctccaccaaagtgcctgccatgcccttcccagtcgccgtctagttgccctccccaaccatgcacaaaaccatgtccaccaaaatgtccaagctcctgtcctcacgcatgtccaccaccatgtccccctcccgaatag

SEQ ID NO: 192755 - DNA, 1860 bp, Artificial Sequence
  Description of Artificial Sequence: Synthetic coding sequence
atgtgcagctgccacaagggctacacccggacccccgaccacaagcactgtagggacattgatgaatgccaacaagggaacctgtgcgtgaacggacaatgcaagaatacggagggttcttttcgctgcacctgcggtcagggttaccaactatccgctgcgaaggaccaatgcgaggatatcgatgaatgccagcaccgacatctgtgtgcgcatggacagtgccggaacacagaaggcagtttccagtgtgtttgtgaccaggggtacagagcttcagggctgggagaccactgtgaggacattaatgagtgtctggaagacaaatccgtatgccagcgaggagattgtatcaacaccgcgggatcctacgattgcacttgtcccgatggattccagcttgacgataacaaaacgtgtcaggacatcaacgagtgcgagcatcccggcctctgtggcccccagggggagtgtttgaatacggagggttctttccattgcgtttgtcagcagggattcagtatatcagcggacggcaggacttgtgaagatgtcaatgagtgcgagctcttgtcaggagtgtgcggggaggctttttgtgaaaacgttgagggctcattcctgtgtgtctgcgccgacgagaatcaagaatacagccctatgaccggtcagtgtcgatcacgcacttctacagacctagacgtggacgtggatcagccaaaagaagagaaaaaagaatgctactataatttgaatgatgcaagcttgtgtgacaacgtgttggcacctaacgtgaccaagcaggaatgttgttgcacatctggggttggctggggagataactgcgagattttcccctgccccgtgttaggtaccgctgagtttacggagatgtgccccaagggcaaaggatttgtccccgcaggagaaagctcatcagaggccgggggtgaaaactacaaggatgctgatgaatgcttactctttggacaggagatctgcaagaatgggttctgcctcaatactcgacctgggtatgagtgttattgcaaacagggaacctactacgatcctgttaagctccagtgctttgacatggatgaatgccaagaccctagctcctgtatcgatggacagtgcgtcaatactgagggcagctacaactgcttttgcacacaccccatggtcctggacgcatctgagaagagatgcatccggcccgccgaatcaaacgagcagatcgaggaaactgatgtgtaccaggatttatgttgggaacacctgtcagatgagtacgtgtgtagtcgtcctcttgtcgggaaacaaacgacctacacagagtgttgttgtctgtatggggaggcttggggcatgcaatgcgcactctgccccctgaaagactctgatgattacgctcagctctgcaatataccagttactggaagacgacagccttatggacgtgatgccttagtcgacttcagcgagcagtacacccctgaggcagacccttatttcatacaggataggttcctgaatagcttcgaagagttgcaagccgaagaatgtggaatccttaatggatgcgagaatggcagatgcgtccgtgtccaggagggctacacctgtgattgcttcgatgggtaccatctcgacacggcgaagatgacatgcgtggacgtgaacgaatgtgatgagctcaacaatcgaatgtccctatgtaaaaatgccaaatgtatcaacacagatggaagctacaaatgcttatgcctgcctggctacgtgccctcggataaaccgaactactgcaccccactaaatactgccctcaatctggagaaggatagtgacctcgagtag

SEQ ID NO: 192756 - DNA, 5169 bp, Artificial Sequence
  Description of Artificial Sequence: Synthetic coding sequence
atggccggcgcctggctgcggtggggcctgctgctgtgggccggccttcttgctagctcagcacacggcaggctccggcgcataacctacgttgtacatcccgggcccggactcgcagcgggcgctctgcccttgagcggtcctcctcgatcaagaacttttaatgtggccctcaacgccaggtactccagatccagtgccgccgcaggagcgcccagccgtgcctctcctggtgttccgagcgagagaacgcggagaacttctaagcccggtggagctgccctgcaggggctcagaccacctcctcccccaccacccgagccagctcggcccgcagtcccaggcggtcagttacatcccaatccgggtgggcatcctgcagccgcccctttcacaaagcagggccggcaggtggttaggagcaaggtccctcaggagacccagtcgggtggcgggtcacgcctgcaggtacaccagaaacagcaactgcagggtgtcaatgtctgtgggggcaggtgctgccatggctggtccaaggcccccggctcccagcggtgtacaaagcccagctgtgttcccccatgccagaacggaggcatgtgcctgcgcccacaactgtgcgtgtgtaaaccgggcacaaagggcaaggcgtgcgagactatcgctgctcaggatacctcctctcctgtattcggcggccagagccctggtgccgccagctcctggggcccccctgagcaggccgctaagcacaccagttctaagaaagccgacaccctgcctcgggtgtcccctgtcgcccagatgacacttacactgaaacccaagccttccgtgggactgccccaacaaattcacagccaggtcactccgctctcatcgcagagtgtggtcattcaccacggccagacacaggagtacgtgctcaagccaaagtactttccggcccaaaagggaatctccggtgaacaatccaccgaggggagtttcccactgcgctacgtgcaagaccaggtagctgcacctttccaactgagtaatcatactggacgaataaaggtggttttcacccccagtatttgtaaagtaacatgcacaaaaggctcatgccagaatagttgcgaaaagggcaatactaccaccctcatctccgaaaatggccacgcggcagacacattgaccgccactaatttccgggtcgtgatttgtcacctgccatgcatgaacggcggccagtgcagcagtcgcgataagtgccagtgcccgccaaacttcacaggaaaactgtgtcagataccagttcacggggcctcggtaccaaagctgtaccagcatagtcaacagcctgggaaggcgcttggaacccacgtgatccactctactcacacactaccacttaccgtgacgtctcaacagggagtgaaagtgaaatttccacctaatatcgttaatatccacgttaaacaccctcccgaggcctctgtgcaaattcatcaagtctcgcgcattgacggcccaaccggccagaaaaccaaagaggcacagcctggacagtctcaggtctcctatcagggcctccccgttcagaagacgcaaaccattcactcaacttactcccatcagcaggttataccacacgtgtaccctgtggcagctaaaactcagcttggcaggtgcttccaggaaactatcgggtcacagtgtgggaaggctctgccgggactgagcaaacaggaagattgctgcggaactgtggggacatcatggggattcaataaatgccagaaatgccccaaaaagccctcttatcatggttacaaccagatgatggaatgtctgcctggctacaaacgcgtgaacaatactttttgccaagatatcaacgagtgtcagctgcagggggtctgtcccaacggagaatgtttgaacacgatgggttcttaccgttgcacctgcaagatcggttttggccccgaccctactttttcctcttgtgtccccgatccccctgtgatttccgaagagaagggaccttgttatcgcttggtgtccagcggcaggcagtgcatgcacccccttagcgtgcatctgactaaacagctttgctgttgctctgttggtaaggcatggggccctcattgcgagaaatgccctctacctggaacagccgccttcaaggaaatttgtccaggtggtatgggttacacagtgtccggggtgcaccgacgcaggcctatccaccaccacgtgggcaagggccctgtcttcgtgaagcccaagaacactcagcccgtcgccaagtccacacaccctccacctctaccagccaaagaggagccagtggaagccctgacattctctagagagcatggcccaggtgtagccgaaccagaagtcgcaacagcccctccagaaaaggagatccccagcttagaccaagagaagacgaaactggagccagggcagccgcagctatccccaggcatttccaccatccacctgcatccccagtttcctggcattgtcatcgagaagacctcgccaccagttcccgtcgaagttgccccggaagcgagcacttcctctgcgagtcaggtaattgcacccacccaggttactgagattaacgagtgcactgtgaacccagatatctgtggcgccggccattgtatcaacctccccgttagatatacctgtatctgttacgaaggatatagattctcagagcaacagcggaagtgcgtagatatcgatgagtgtacgcaggtacaacacctttgctcacaggggcggtgtgagaacacagagggatcattcctgtgcatctgccccgcagggtttatggcatctgaagagggcaccaactgcatcgatgtcgatgaatgcctgcgaccagatgtgtgtggcgaggggcactgcgtaaacactgtgggggccttcagatgtgagtattgtgattcagggtaccggatgacacagcgcggcagatgtgaggatatcgatgagtgcttgaaccccagcacctgccctgacgaacagtgcgtgaactctccaggctcgtatcagtgtgtgccctgtaccgagggcttcagagggtggaacggtcagtgcttggacgtggacgagtgccttgaaccaaacgtttgcgccaacggggactgcagcaatctggagggatcttatatgtgtagctgccacaaggggtacaccagaacccctgatcacaagcactgtcgcgatatcgatgagtgccagcagggcaacctgtgtgtgaacggacagtgtaagaatacagaagggtcctttcggtgtacctgcggccaaggctaccagctcagcgctgcgaaagaccagtgtgaggatatagacgagtgtcagcatcgccacctctgcgctcacgggcaatgcagaaatacagaaggctccttccagtgtgtatgtgaccaggggtaccgagcctctggtctgggggaccattgtgaggacattaacgaatgtctcgaggacaagagcgtctgccagagaggcgattgcataaacacagcaggatcatacgactgtacatgcccggatggctttcaacttgacgacaataagacttgccaagacatcaatgaatgcgaacacccagggctttgcggtccccaaggcgagtgtcttaacactgaaggctcctttcattgcgtgtgtcagcagggtttcagcatttcggccgatgggagaacttgcgaagatatagacgaatgtgttaataacaccgtgtgtgatagccacggcttctgtgataatacagcaggctcatttcgctgcttatgttaccagggattccaggctccccaggacgggcaaggatgcgttgacgtcaatgagtgcgaactgctgagcggagtgtgcggggaggcattctgtgagaatgttgagggatcctttctgtgtgtgtgtgcggacgagaaccaggaatattcgccaatgactggtcaatgccggagccgcacctctacagatctggatgtcgacgtagaccaacccaaggaagagaaaaaggaatgctactataatctgaatgacgcctccctgtgcgacaacgtgctggcaccgaatgtcacaaaacaggagtgctgctgcacaagtggcgtcgggtggggggataattgcgaaatcttcccttgcccagtgcttggtactgccgagtttaccgagatgtgccctaagggaaagggcttcgtgcctgctggcgagtctagcagtgaagccgggggagaaaactacaaagatgctgacgagtgtctccttttcggtcaggaaatttgcaagaacggattctgtctcaatactcgccctggctacgagtgctactgcaagcaagggacctactatgatcccgttaagctgcagtgtttcgacatggatgagtgccaggatcccagtagttgcatcgacggacagtgtgtgaacaccgagggtagctacaattgtttctgcacgcatcctatggtcctggatgcatccgagaagaggtgcatccgccccgctgaatccaacgaacagatcgaggagaccgacgtttaccaggatctttgctgggagcacctgagcgatgaatacgtctgtagcaggccacttgtcggtaagcaaaccacctacactgagtgctgctgtttgtacggcgaggcttggggaatgcagtgtgcgctgtgtcctttaaaagactctgacgattacgcccagctgtgtaacattccagtgacgggtagacggcagccttatggccgcgacgctctcgttgacttttctgagcagtataccccggaagccgatccttattttattcaggataggtttttaaacagctttgaggagctgcaggctgaagaatgtggcattctcaacggctgcgaaaatggaaggtgcgttcgtgtgcaggagggttatacatgcgattgctttgatgggtatcacctcgacacagcgaagatgacatgcgttgatgtgaatgagtgcgatgaactcaataatcgcatgtctctgtgcaagaacgccaagtgcattaatacggatgggtcctataagtgcctatgcctgccaggatacgtgccctccgataagccgaattactgtacgcccctgaataccgctttaaatctagagaaagactctgatctggagtag

SEQ ID NO: 192757 - DNA, 4191 bp, Artificial Sequence
  Description of Artificial Sequence: Synthetic coding sequence
atggacaccaagctgatgtgcctgctgttcttcttcagcctgcccccactgctggtgtcaaatcacaccggtagaattaaagtcgtattcacgccatcgatctgtaaagtcacttgtaccaagggttcctgccagaactcttgtgaaaagggcaatactacaaccctgatttccgaaaacggccacgctgctgacacattgacggcaacaaacttccgtgtggtaatttgccacctcccctgtatgaacggtgggcagtgcagttcacgcgataagtgtcaatgccctccgaatttcacgggaaagctctgccaaatacccgtgcacggggcaagtgtcccaaagctctatcaacatagtcaacagcccgggaaagccctcggcacgcatgtcatacacagtactcatacgctcccacttaccgtaacctctcaacagggagtcaaggtaaagtttcccccaaacatcgtaaatattcatgtgaagcatcccccagaagctagcgtccaaattcatcaagtgtcccgcatagatggccctaccggacagaaaaccaaagaagcgcagcccggacaaagtcaggtgagctaccagggcctgccagtgcagaaaactcaaactatccatagcacatatagtcaccagcaggttatccctcacgtgtatcccgtggccgcaaaaactcaacttggtcgatgcttccaggaaacaattggttcgcagtgcgggaaagcactccctggcttgagtaagcaagaggattgctgtggcacggtgggcacatcatgggggttcaacaagtgccagaaatgcccaaaaaaaccctcctatcacggatacaaccaaatgatggaatgtctaccgggctataaaagggtgaacaacacattctgccaggacattaacgagtgtcagctgcagggtgtgtgtcccaacggtgagtgcctaaacaccatgggctcctaccgctgtacttgtaaaattggcttcggacccgatccaactttttcaagctgtgtccccgatccccctgtgatctccgaagagaagggcccctgttaccgcctagtcagctcaggacggcaatgcatgcatccattaagtgtgcacttaacgaaacagctgtgttgttgtagcgttggaaaggcctggggaccacactgtgagaaatgtcccctgccgggtaccgctgccttcaaggaaatttgccctggagggatgggctatactgtcagtggcgttcaccggcggaggccaattcaccatcatgtgggaaagggaccagttttcgtcaaaccgaagaatacacagcccgtggccaagtccactcacccgcctcctctaccagcgaaggaagaacccgtggaagctctaacttttagtcgggagcatggcccgggcgtcgctgaaccagaggtagccactgctcctccggagaaggagattccctccctcgaccaagaaaagacgaaactcgagccaggacagccacagctgagccctggtatcagtacaattcacctgcaccctcaatttccggggattgtaattgaaaaaacaagtcctccggtaccggtagaggttgcccctgaagcatctacaagctccgctagccaggtgatcgccccgacccaggttacagaaattaacgagtgtactgtcaatcccgacatttgcggcgcaggacactgtatcaacctcccggtacggtacacctgcatttgctacgaaggctataggttctctgaacagcagaggaagtgcgtggatattgacgagtgcacacaggtgcagcacctgtgcagccagggccgatgtgagaatacagaagggtcttttctctgcatctgccctgccggctttatggcctcagaggagggcacaaattgcattgatgtagatgagtgtctgcggccggatgtttgtggagaaggtcactgcgtgaatactgtaggggccttcaggtgtgagtattgtgactcaggctatagaatgacacaacgcggcaggtgcgaagacattgatgaatgtctaaatccctccacttgccccgacgagcagtgcgtcaattctcccgggtcctaccagtgcgtcccatgtacagaggggttcagaggttggaacggtcagtgcctggatgtggatgaatgcctggaacccaatgtgtgcgccaacggcgactgctcaaacctggagggaagttacatgtgtagctgccacaagggttataccagaaccccagatcataaacactgtagagatattgacgagtgccagcagggaaatctttgcgtgaatgggcaatgtaaaaacacagagggttctttccgttgtacttgcggccagggttaccagctgtcagcagctaaggaccagtgcgaagatattgacgaatgtcaacatagacacctgtgcgcacacggccagtgtcgtaataccgaaggctcattccagtgcgtgtgtgaccagggctatagagcctcaggccttggcgaccactgtgaagatattaacgagtgcctggaggacaagtcagtctgccagcggggtgactgcattaataccgcagggtcgtatgattgcacttgtccagacggatttcagttagacgataacaaaacctgccaggacataaacgagtgtgaacacccagggctctgcggccctcagggcgagtgcctcaacactgagggctcgttccattgtgtttgtcaacaggggtttagcatctcggctgatggccggacctgtgaagatatcgatgagtgtgtaaacaacacggtgtgcgacagccatggcttttgtgataatacggcaggcagttttaggtgcctgtgctatcaaggttttcaggccccccaggatggccaaggctgcgtggacgtaaatgaatgcgaactcctgtccggcgtgtgcggggaagcgttctgcgagaacgtcgagggcagtttcctgtgtgtgtgcgctgacgaaaaccaagaatactctccaatgaccggacaatgcaggagcaggacatccaccgacctcgatgtggacgtggaccaacctaaggaagagaagaaggaatgctactacaacctcaacgatgcatctctgtgtgataacgtgttggctccaaacgtgacaaagcaagaatgctgttgcacgtccggcgtgggatggggagacaattgtgagatattcccatgtccggtactgggcacagccgagttcacggagatgtgccccaaaggtaaaggcttcgtgccagcaggagaatcttcatcagaagccgggggtgaaaactacaaggatgcggacgagtgtctgcttttcggacaggagatttgtaaaaacggcttttgcctgaatacaaggcctggttacgaatgttattgtaagcagggcacatattatgaccctgtgaagttgcaatgttttgatatggatgaatgtcaggatccttccagctgtattgacggtcagtgtgtgaacactgagggatcctacaactgcttctgtactcacccaatggtgcttgatgcatcagagaagcggtgtattcgccccgcagaatctaacgagcagatcgaggagactgacgtataccaagatctgtgctgggaacatctgagtgatgagtatgtctgttctcggcctctggtggggaaacagacgacatatactgaatgctgttgcctctacggcgaggcttggggtatgcaatgcgcgctatgtccacttaaggacagcgacgactacgcacagctttgcaacatacccgtgacaggtcgcaggcagccttacggtcgtgacgccctggtggatttctccgaacagtacacgcctgaggcagatccatatttcattcaggatcggttcctgaactccttcgaggagcttcaggccgaggagtgcggaatcctgaatggatgtgagaacgggcggtgcgttagggtacaggaagggtatacctgtgactgtttcgatggttaccacttggatacagctaagatgacttgcgttgacgtgaatgaatgtgacgagttgaataacagaatgtctctctgtaaaaatgccaagtgcattaatactgatggctcctacaaatgcctctgtctgccaggctatgtcccatccgataaacctaactactgtacccctctgaataccgctctgaacctagagaaagacagtgatctggaatag

SEQ ID NO: 192758 - DNA, 5166 bp, Artificial Sequence
  Description of Artificial Sequence: Synthetic coding sequence
atggccggcgcctggctgcggtggggcctgctgctgtgggccggccttttagctagtagcgcacacggaagactacggcggatcacctacgtggtgcaccccgggcctggcctggcagccggagctcttccactgtccggtcctccccgcagccgcacatttaatgtggcactcaacgccagatattccaggtcgagtgcagcggcgggtgcccccagccgggcatcgcctggggtgccgtcggagcggacgaggagaaccagcaagccgggcggcgctgctctgcagggcctgagacccccacctccccctcctcctgagccggcccggccagcagtcccaggcggccaacttcaccccaaccccggagggcatccagccgctgccccttttaccaaacagggaaggcaagtggtgcgctctaaagtcccacaagaaacccagagtggcggcggatcgagactccaggtacatcaaaaacaacagctgcagggtgtgaacgtttgcggcggacgctgttgccatggttggtcaaaagcaccgggtagccagaggtgtacaaagccttcatgtgtgcccccctgccagaatgggggtatgtgcctccggcctcagttgtgtgtttgcaagcccggaaccaaaggaaaggcttgtgagaccatcgcagcccaggacacatccagccccgtgttcggtgggcagagtcctggcgcagcgtcctcctggggtcctccagagcaggccgccaagcatacaagcagcaaaaaagccgacaccctccctagagtgtctcctgtcgcccagatgacactcacgttaaaacctaagccaagcgttggcctgcctcaacagatccactcacaagtgacccccctatcttctcagagcgtagtgatacatcacggccagacacaggaatacgtgctgaaacctaagtacttcccggcccagaaggggatctctggagaacaatctaccgaaggtagtttccctctgcggtacgtacaggatcaagttgcagcgccctttcagctcagcaatcacaccggaagaatcaaagtcgtattcaccccctccatatgtaaagtgacctgcaccaagggctcgtgccaaaatagctgtgagaaaggtaatacaactacattgatctcagagaacgggcatgctgccgatacactaactgccaccaatttccgtgttgtcatatgccacctgccctgtatgaatggagggcaatgctctagcagagataaatgccagtgcccccctaactttactgggaagctgtgccagattcctgtgcacggagcgtctgtgccaaagctgtatcaacattcacaacagcccggaaaagcacttggtacccatgtgattcacagcacccatacgctgcccctaacggttacgtcacagcaaggcgtgaaagtaaaattcccaccaaatatcgttaacatacatgtgaaacatcctccagaggcctcagtacagatccaccaggtgtccagaattgatggtcccacaggacagaaaacaaaggaagcacagccaggacaaagtcaagtgtcgtatcagggtctacctgtgcaaaagacgcagacaatccacagtacgtacagccatcagcaggtcattccacacgtttatcctgtggcagcaaaaactcagctggggcggtgctttcaagagactatcggttcacagtgcggcaaggccctgcctggactgtccaaacaggaggactgttgcggcacggtggggaccagctggggttttaacaagtgtcagaagtgccccaagaaacccagctatcacggatataaccaaatgatggaatgcctgcctggctacaaacgagtgaacaacacgttctgtcaggacattaatgagtgccagcttcagggggtgtgtccaaacggggagtgcctaaataccatggggtcttaccgctgcacctgtaagatcgggtttggcccagacccgactttctcctcctgcgtgccagatccaccagtcatttcagaagagaaaggtccttgttatcggcttgtgtcctcaggccggcagtgtatgcatcccctttccgtgcacctgacgaaacaactatgctgctgttcagtagggaaagcatggggccctcattgcgagaagtgccccctgcccggaaccgctgcattcaaggaaatctgtcctggtggcatgggctataccgtgtccggagtacaccgtagacgccccattcatcatcacgtcggcaagggacccgtcttcgtcaagccaaagaacactcagcccgtcgctaagtcaacgcaccctcctccccttcccgcgaaggaggaacccgttgaggcgctgaccttttccagggaacacgggccaggggtggccgaacccgaggttgccaccgcgccacccgaaaaggaaatcccatccctggaccaggagaagaccaagctggagcccgggcagccgcaactcagtccaggcatcagcacaatccatctgcacccacagtttcctgtggtgatcgagaaaacctcacctcccgttcccgtcgaggtggcgcccgaagcatccacctccagtgcaagtcaagtaattgccccaacccaggtcacagaaatcaatgagtgtacggtaaatcctgatatttgtggcgccggtcactgtattaatttgcccgtgcgctacacctgcatttgctatgaggggtacagattttccgaacaacagcgcaaatgcgtggatatcgacgagtgtacacaggttcagcacctctgttcccaggggaggtgcgaaaacactgaggggagttttctttgcatctgcccagctgggttcatggcatccgaggagggcactaattgtatcgatgtggatgagtgtctgcggcctgatgtgtgtggcgagggacactgtgtgaacacagtcggcgctttccgatgcgagtattgcgacagcggctataggatgactcaaagaggacgctgcgaagacatagatgagtgcctgaatccctctacatgccccgacgaacagtgtgtgaacagtccagggtcatatcagtgcgttccttgtaccgaaggtttcagaggttggaacggtcagtgcctcgacgtagacgaatgtctcgaacccaatgtgtgcgcgaacggtgattgttccaatcttgagggctcatacatgtgtagctgtcataaaggatacacacggacacctgatcataagcactgtcgagatatcgatgagtgtcagcaaggcaatttgtgtgttaacggccagtgcaagaacaccgagggctcctttagatgcacctgtgggcaggggtaccaactgtccgcagctaaagatcaatgtgaggacatcgacgagtgtcaacacaggcatctgtgtgcgcatgggcagtgccggaacacagagggttcattccagtgcgtgtgcgaccagggctatcgtgcaagcggactcggggaccactgcgaagacataaacgaatgcttagaagacaaatctgtctgtcaaagaggcgactgcatcaacacagcgggatcatatgactgcacttgtccagacggtttccagttggatgataacaagacatgtcaggatattaacgaatgcgaacaccccggtttatgtggaccacaaggcgagtgcctgaacactgaaggtagcttccactgtgtatgccagcaggggttttctatctccgctgatggtaggacatgtgaggacatcgacgaatgcgtcaacaatacagtttgcgacagccacggtttttgcgacaacacagctggaagctttaggtgtctctgttatcagggcttccaggcaccacaggacggacagggatgtgtcgacgtaaatgagtgtgaacttctcagtggagtttgcggggaagccttctgcgagaatgtcgaggggtcattcttatgcgtgtgcgccgatgagaatcaggagtatagccctatgacaggccagtgtcgcagtcgtaccagtacagacttagatgttgacgtggaccagcccaaagaggagaagaaagaatgttattataacttgaatgatgcatccctttgtgacaatgtactggccccgaacgtaacgaagcaggaatgttgctgtacatccggggtgggctggggcgacaattgtgagattttcccgtgtcccgtgctcggcacagccgaattcaccgagatgtgcccaaagggcaaagggttcgtccccgctggagaatcttcctccgaggccggcggagagaactacaaggacgctgatgagtgtctgctcttcggacaagaaatctgcaagaacggattctgtttgaacacccgtcccggttacgagtgctactgtaagcagggcacttactatgacccagtaaaactgcagtgcttcgacatggacgaatgccaggatccttccagctgtatagatggtcagtgcgtaaatacggaaggaagctataactgcttctgtactcaccctatggttttggatgcaagcgaaaaacggtgtatccggcccgcagaaagcaacgaacagatcgaggaaactgatgtgtatcaggacttgtgctgggagcacctttctgacgagtatgtgtgttctaggccactggtcggcaagcagacaacctacaccgagtgctgttgtctgtatggagaggcatgggggatgcagtgcgcgctgtgccctcttaaagactcggatgactatgcccagctgtgtaatattcccgtgaccgggcggcgccagccatatggccgcgatgcgctggtcgatttttctgagcagtatacgccagaggcggacccatactttatccaggacagattcctcaacagcttcgaggagctgcaagcagaggaatgcggaatcttgaacggctgcgaaaacggccgctgcgtgcgagtacaggaaggctatacatgcgattgtttcgacggttatcaccttgatacggcgaagatgacctgtgtggatgtgaatgagtgcgatgagctcaataacaggatgtcgctatgcaagaacgcaaaatgcatcaatactgacgggagctacaagtgcctctgcctgcctggatatgttccttctgacaagcctaattactgtacccctctcaataccgcactcaatctggagaaagactccgacttggaatag

SEQ ID NO: 192759 - DNA, 4188 bp, Artificial Sequence
  Description of Artificial Sequence: Synthetic coding sequence
atggacaccaagctgatgtgcctgctgttcttcttcagcctgcccccactgctagtgagcaaccacactggccggataaaagtagtatttaccccctctatctgcaaggtgacctgcaccaaaggaagttgtcagaactcctgcgagaaaggcaatacaactacactcatcagcgagaacggacatgctgccgacacattaacagccaccaattttcgggtggtgatttgccacctgccttgtatgaacggtggacagtgttccagcagggataagtgtcagtgcccccctaatttcactggcaaactgtgtcagatccccgtccacggtgcgagcgtcccaaaactgtaccaacacagccaacagccaggaaaagcgcttgggactcatgtcatccattccacccacacactgcccctgactgtcaccagtcagcaaggagtaaaggtgaaatttccccccaacatcgtgaatatccacgtgaaacaccctcccgaggcttccgttcagattcatcaagtttcacgcatcgatggaccaaccgggcagaaaaccaaagaggcgcagcccggacagtcacaagtgtcctaccaaggactgcctgttcagaagacacagactatacattcaacatacagtcaccagcaggtgatccctcacgtgtaccccgtggccgccaaaacacagctgggacgttgcttccaggaaactataggctcacagtgtggaaaagctctgcctggcctgagtaaacaggaagattgttgcgggaccgttgggacctcctggggcttcaataagtgtcagaagtgtcccaagaagccaagctaccacggctataaccaaatgatggagtgtctgccaggctacaaacgggtcaacaacacattctgccaggatattaatgagtgccagctgcagggagtgtgtcccaacggcgagtgcctgaataccatgggttcttatcggtgcacgtgtaaaattggcttcgggccggacccaactttcagctcttgtgtgccggacccccctgtcatctctgaagagaaaggaccctgttaccgtcttgttagcagcggccgccaatgtatgcatccgctgtccgtccacttaactaagcagctgtgttgctgttcggtggggaaagcctggggacctcattgcgagaaatgtcctctgccaggtactgccgcatttaaagaaatctgtcctggcgggatgggctacacagtcagcggtgtccatagaagacgtcctatccaccatcacgttggaaaaggaccagtgttcgtgaaacctaaaaacacccagcctgtggctaaatcaacccaccccccacccctgccagctaaggaggagcccgtggaagctcttacattttccagggagcacggacccggtgtggctgagccagaagtggcaactgcaccgccagagaaggaaatcccctccttagaccaggaaaagaccaagctggaaccaggacaacctcaacttagccccggaatttctaccatccatctccatccccagtttcctgtcgtcatcgagaaaacatctcctcccgtaccagtggaagtggcccccgaagcctcgacgtctagcgcaagccaggtcattgccccgacacaagtgactgagatcaacgagtgtaccgtgaatcccgacatatgcggggccgggcattgcatcaatttacccgttcggtatacctgcatttgctatgagggataccgtttctccgaacagcagcggaagtgcgtggacattgacgagtgtactcaggtgcagcatctttgcagccaaggacggtgtgaaaacaccgagggttcatttctgtgcatctgtccagctggttttatggcttccgaggaaggcaccaattgcattgatgtggatgaatgcctcagaccagacgtatgtggggaaggtcattgcgtgaatacagtgggcgctttccgctgtgagtactgcgactcagggtaccgaatgacccagcgcgggcgatgcgaagacattgatgaatgcctaaaccccagcacctgtcctgacgaacagtgtgtcaacagcccaggatcctaccaatgtgttccttgcaccgaagggttccgcggatggaacggacagtgcctggacgtcgacgagtgtctagaaccaaatgtctgtgccaacggcgactgctccaacctggagggcagttatatgtgttcctgtcacaaaggatatacacggacccctgaccacaaacactgccgtgatattgatgagtgtcaacagggaaacctgtgcgttaacggtcagtgtaaaaacactgagggaagctttaggtgcacgtgtgggcagggctaccagttaagcgcagctaaagatcagtgtgaggatatcgacgagtgtcaacacagacatctgtgtgcccacggacagtgccgcaacacagaagggagtttccagtgtgtttgcgaccagggttacagggcatctggactcggtgatcactgcgaagacatcaacgagtgtttagaggataagtccgtgtgccagcggggcgactgtattaacacggctggatcttatgattgtacctgccccgatggcttccaactggacgataataaaacgtgtcaggatatcaacgaatgtgagcatccaggactgtgtggtccacagggggaatgtcttaatacggagggctccttccattgcgtgtgtcagcagggcttctcgatctcggccgatggacggacctgcgaggacatcgacgaatgtgttaacaacacagtatgcgattctcacggcttctgcgacaacacagccgggagttttaggtgtctttgctaccaagggttccaggctcctcaggatggccaagggtgcgtggatgttaacgagtgcgaactgctatcaggcgtttgcggcgaggccttttgcgaaaatgtggaagggtccttcctttgcgtctgtgcagatgagaatcaagagtatagcccgatgactgggcagtgccggtctcgtacttctactgaccttgatgttgacgtagatcagccgaaggaagagaaaaaagaatgctactataatttaaatgacgcatctctgtgcgacaacgtgttggcaccaaacgtaaccaagcaggaatgttgttgcacatctggggtgggatggggtgacaattgcgaaatttttccctgccccgtgctgggcacagccgagttcacagagatgtgtcccaaggggaaaggctttgttcctgcgggtgagtcctcaagcgaggccggcggagagaattataaggacgccgacgagtgcttgctcttcgggcaggagatttgtaagaacggcttctgcctgaataccagaccaggatatgagtgctactgcaaacagggcacttactatgaccctgttaagctccagtgcttcgacatggatgagtgtcaagaccctagcagttgtattgatggccaatgtgtaaacactgaaggatcgtacaattgtttctgcacacaccccatggttctcgacgcctcggaaaagcgatgtattcggcctgctgagtctaacgagcaaatagaagaaacggatgtgtaccaggatctgtgttgggagcacttaagtgatgaatatgtgtgttcaaggcccctagtgggcaagcaaacaacgtatacagagtgctgttgtttgtatggggaggcctggggtatgcagtgtgctctatgccccctgaaagattcagatgattacgctcaactgtgcaatatccctgtaacaggccgacggcagccctatggtcgagatgcgctggtcgacttctcagagcagtatacgcctgaggccgatccttatttcatccaagatcgctttctgaactcattcgaggagcttcaggctgaggagtgcggcatcctgaacggctgcgagaatggtaggtgcgttcgcgtgcaggagggctacacttgcgactgtttcgacggttaccatctggataccgccaagatgacatgcgtggacgtcaacgagtgtgatgagctgaacaatagaatgtccctctgtaagaatgccaagtgcatcaataccgacggttcctacaagtgcctgtgcctaccaggctatgtccccagtgacaagccaaattattgtaccccactaaatacggctctaaacctggagaaagattcggatctggagtag

SEQ ID NO: 192760 - DNA, 4062 bp, Artificial Sequence
  Description of Artificial Sequence: Synthetic coding sequence
atggacaccaagctgatgtgcctgctgttcttcttcagcctgccccctctactagtaagcaaccatacagggcgaattaaagtggtattcaccccgtccatctgcaaagtcacctgtaccaagggctcttgtcagaattcatgtgagaaggggaacactaccacgctgatatccgaaaatgggcacgctgcagatactctgacggcgaccaatttccgagtggtcatctgccacctcccctgcatgaatggcggccaatgttctagcagagataaatgccaatgccctcctaacttcactggcaagctctgccagatcccagttcacggtgcttcggtccccaagctgtatcagcactcacagcaacccggaaaggctctaggtactcacgttatccacagcacccacaccttgccattgacggttacctctcaacagggtgtgaaagtgaaattccctccaaacatagtcaatatacacgtcaagcacccccctgaggcctcggtgcaaattcatcaggtctcccgtattgatggccctaccgggcaaaagactaaggaggcgcagccaggacagagtcaggtcagctaccagggactgcctgtccaaaaaacccagacaatccatagcacgtattctcaccagcaggtcatcccacatgtatatcctgtagcagcaaaaacccagctgggcagatgctttcaggagaccattggatcacagtgcggtaaggctcttccggggctgtcaaagcaagaagattgttgcggcacagtagggacgtcgtggggtttcaataagtgccagaagtgccccaaaaaaccgtcctatcatggttacaatcaaatgatggagtgcctgcccggctacaaacgggtgaacaacacgttctgccaggatatcaatgaatgtcagctccagggcgtgtgtcctaatggagaatgtctcaacacaatgggatcttaccgctgtacctgcaagatcggcttcgggcctgacccaacattcagcagttgtgttcccgatccacccgtcatctccgaggagaagggtccatgctacaggctggtttcttcgggacgccagtgtatgcatccattgagcgttcacctgacaaagcagttatgctgctgcagcgtcggtaaagcctggggcccacattgtgagaaatgtcctttacccggtaccgctgcattcaaagagatttgtcccggcgggatgggatacactgtgtccggcgtgcaccgtagaaggccgatccaccaccatgtcggcaagggcccagtgttcgtgaagcctaaaaatactcaacccgtagccaaatccactcaccctcctccgctccccgcaaaggaggagcctgtcgaggcccttacattctcgagagaacacggacctggggtagccgaacctgaagtggccactgcaccccccgagaaagagatccctagcttggaccaggagaagacaaagttagagccgggacaaccgcagctgtcccctggcattagtactatacatcttcacccacagttccctgttgttatcgagaagacctcaccacccgtcccggtggaggtggctccagaagcctccactagcagtgcctctcaggtgattgcccccacccaggtgactgagataaacgaatgcacagtgaaccctgacatatgcggggccggccattgcattaacctgccagtccgctacacatgcatctgctatgagggctatcgcttttccgagcagcagcggaagtgcgttgatatcgacgagtgcactcaagtgcagcatctttgtagccaaggacgctgcgaaaacactgaaggatcttttctgtgcatctgccccgccggcttcatggcatcggaggaaggcactaattgtatcgacgttgacgaatgcttgaggccagatgtgtgtggagagggccactgcgttaataccgttggtgcttttcgctgtgagtattgtgactcggggtaccgcatgactcagcgcggccgctgtgaggacattgacgagtgcctcaatccaagtacctgccccgatgagcagtgcgttaactcgcctgggagctatcagtgcgttccttgtactgaaggatttcggggctggaatggccagtgtctcgatgtggacgagtgcctggaaccaaacgtttgtgcaaacggagattgctccaacctggaaggttcctacatgtgtagctgccacaaaggctacacccggacacctgatcacaaacactgccgcgatatcgacgagtgtcagcagggaaacttgtgcgtcaatgggcaatgcaagaacacagaaggcagctttcgttgcacatgcggccagggatatcaactgtccgccgccaaagaccagtgcgaagacatcgacgagtgtcagcacaggcacctgtgcgctcacggccaatgtcgtaacactgaagggtcctttcagtgtgtttgtgaccaagggtatagagcgagtggcttgggggatcattgtgaagatatcaatgaatgcctggaggataagtctgtatgccagaggggcgattgcatcaatacagcgggaagttacgattgtacttgtcccgacggattccagctagacgacaacaagacgtgtcaggatatcaatgagtgcgaacaccccggactgtgtggcccacagggagagtgtcttaacactgaggggtcattccattgcgtgtgccagcaggggttctctatctccgccgacggacggacgtgcgaggatgtgaacgagtgcgagctgctgtccggagtatgtggggaagctttttgcgaaaatgtggagggaagtttcctgtgtgtttgcgccgacgaaaaccaagaatatagtccaatgacagggcagtgcaggtcgcgaacatccacggaccttgatgtagacgttgatcaacccaaggaggagaagaaggaatgttattataacctgaatgacgcctcgctatgcgacaacgttctcgcacctaatgtaaccaagcaggaatgctgttgcacctcaggcgtgggctggggcgataactgtgagatcttcccttgcccagtgctgggcactgccgagtttacagaaatgtgcccaaagggcaagggatttgtgcctgcgggagaatctagctccgaggcaggcggcgagaattacaaagacgcagatgaatgcttgttgtttggccaggagatctgtaaaaacggattttgtctcaacactaggcctgggtacgagtgctactgcaagcaggggacctactatgacccggttaaactgcaatgcttcgacatggacgaatgccaagatcctagcagttgcatcgacggtcagtgcgtaaatacagaagggagctataactgtttttgtacacacccaatggtgctggatgccagtgaaaagcgctgcatccggccagcggaatcgaatgagcagatagaggagacggatgtgtatcaagatctatgttgggagcacctctccgacgaatatgtatgcagtaggcctttggtcggaaaacagaccacttataccgagtgttgttgtttgtacggcgaagcctgggggatgcaatgcgcgctctgtcccctgaaggactcagacgattatgctcagctctgcaatatccctgttactggtcgcagacagccttacggtagggacgcactggtcgacttttccgagcaatacacccccgaggccgacccatactttattcaagaccgcttcctgaatagtttcgaggaactacaggctgaggagtgcgggatcttgaacgggtgcgaaaatgggagatgtgtcagggtgcaggagggatatacctgcgactgctttgatggatatcacctagatacagcaaagatgacctgtgtggacgtgaacgagtgcgatgaactgaataaccgcatgtcgctctgtaaaaatgcaaaatgtattaacactgacggaagttacaagtgcttgtgtctccccggttatgtcccatctgacaagccgaattactgcactcccctgaacaccgcgctgaacctggaaaaagactcggatctcgagtag

SEQ ID NO: 192761 - DNA, 4029 bp, Artificial Sequence
  Description of Artificial Sequence: Synthetic coding sequence
atggacaccaagctgatgtgcctgctgttcttcttcagcctgcccccgctactcgtgtccaatcataccgggcggatcaaggtggtgttcaccccctcaatctgcaaggtcacctgcaccaagggaagctgtcagaattcgtgcgagaaaggcaacactacaactctgatatccgaaaatgggcacgctgccgacacactgacggctactaatttccgagtggtgatatgccacttaccctgcatgaacggggggcagtgcagcagccgagacaaatgtcaatgccccccaaacttcaccggtaagttatgccagataccagtgcatggcgcttcggtcccaaaactctaccagcactctcagcagccggggaaggcactaggtactcacgttattcattcaacccataccctacccctgacagtaacgagccagcaaggggtgaaggtcaagttcccccccaatattgtaaatattcacgtgaaacatccccccgaggcctcagtgcagatccaccaggtctcccggatcgacggtccaactgggcagaagaccaaggaggcgcagcccggacagtcgcaggtttcttaccagggtctccccgtccaaaagacgcagacgatacattcaacttactcgcaccaacaggtcattccgcatgtttaccctgttgcagctaagactcagctggggaggtgtttccaggagacaatcggctcccaatgcggaaaagccctacccgggttaagtaaacaagaggattgttgtgggaccgttgggactagctggggatttaacaagtgccaaaagtgtcctaagaagccgagctatcacggctataaccagatgatggagtgcctaccggggtacaaaagagtgaataacactttctgtcaggacatcaatgaatgtcagctgcaaggcgtttgtccaaacggggagtgcctgaatacaatgggaagctacaggtgcacgtgcaagattggattcggacccgaccctactttttcttcctgcgtgccagacccaccagtgattagtgaggaaaagggcccgtgttatcgtctggtgtcctccggtaggcagtgtatgcaccccttaagtgttcatttgactaaacaactgtgctgttgctccgtaggcaaggcctggggacctcattgtgaaaagtgccccctgcccggaacagccaaggaggaacccgttgaggccctgacttttagcagggagcacggtccgggcgtagctgaacctgaggtggccaccgcaccaccagagaaggaaatcccaagtctagatcaggagaaaacgaaactggagccgggacagccgcagcttagcccagggatatccaccatccacttacacccacagtttcctgttgtgattgaaaagactagcccacccgtgccagttgaagtcgcgcctgaagccagcaccagtagtgcctcacaggttatcgctcccacacaggtcactgaaatcaacgagtgtacagtgaaccctgacatttgtggagctggccattgcatcaatctcccagtgcggtacacttgtatttgttatgaaggctacaggttcagcgagcagcagcgcaagtgcgtcgatatagacgaatgtacgcaggtccagcacttgtgctctcagggccgctgtgagaacactgaaggctcctttctgtgtatttgtcccgcaggatttatggcatctgaggagggtaccaattgtattgatgtagatgaatgcctacgcccagatgtttgtggcgagggccactgtgtcaacactgtgggagctttcaggtgtgaatattgcgactctggctacaggatgacacagcgcgggagatgtgaagacatagatgaatgccttaatccatcgacatgcccggatgagcagtgcgtcaatagtccgggatcttatcagtgcgtgccctgtactgagggctttaggggatggaacggacagtgtctggacgtagatgagtgcctggagcccaatgtatgtgcaaatggagactgttccaacctcgaaggttcctacatgtgttcatgccacaaagggtataccagaacaccggaccataagcattgtcgcgacatcgacgagtgtcagcaaggcaacttgtgcgttaatggacagtgcaagaacacagaagggagcttccgctgcacctgcggccagggataccagttgagcgccgccaaagatcaatgcgaggacattgatgaatgtcagcatcgccatctttgtgcccatggtcagtgccggaatactgaaggtagctttcaatgcgtgtgcgaccagggctaccgtgcttcagggctcggcgatcactgcgaagacattaatgaatgtcttgaggataaaagcgtatgccagagaggtgactgcataaataccgccggctcttacgactgcacctgccctgacgggtttcagctggacgacaacaaaacatgtcaggatataaatgagtgcgagcatcctggtctgtgtggccctcaaggtgagtgcctcaacacagagggctcctttcactgcgtgtgtcagcagggcttcagtataagtgccgatggtagaacatgtgaggatatagatgagtgtgtgaacaacacagtttgcgactctcatggcttctgcgataacacagccggatccttccgctgcttatgttaccagggctttcaagcccctcaggatggtcaggggtgcgtggatgtgaacgaatgcgagttacttagtggagtgtgtggtgaggcgttctgcgagaacgttgaaggctctttcctgtgcgtgtgtgctgatgagaaccaggaatatagtccgatgaccggccagtgcaggtcccgaaccagtacggacctagacgtcgatgtggatcaacctaaggaggagaagaaagagtgttactataacctcaacgatgcatccctgtgcgacaatgtcctggcaccaaatgttaccaagcaggaatgctgttgtacgagcggagtggggtggggagataattgcgagatcttcccatgtccagtattaggcacggctgagttcactgaaatgtgccccaaaggcaagggatttgttcccgccggcgagtcgtcatcagaggccggcggagaaaactacaaggacgctgacgagtgtcttctttttgggcaagaaatctgtaaaaatggcttctgtctcaacacccgacccggatatgagtgctactgcaagcaaggaacgtattacgaccctgtgaagctccaatgtttcgacatggacgagtgccaggatccctcctcatgtatcgatgggcagtgcgtcaataccgaagggagttacaattgcttttgtactcaccccatggttcttgatgcgtctgagaagcgatgtatcaggcccgccgagtcaaatgagcagatcgaagagactgatgtttatcaggatctgtgttgggagcacctgtccgacgagtacgtgtgcagccgcccgctggttgggaagcagactacctacaccgaatgttgttgcctctatggcgaagcctgggggatgcagtgcgctctgtgccctctcaaggattctgatgactacgctcagctctgcaacataccagtcactgggcgcagacaaccatacggaagagatgctctggttgactttagtgagcagtatactccagaggcagacccatactttattcaggacagattcctgaacagcttcgaagaactccaggctgaagaatgtggaatccttaacggttgcgagaatggcagatgcgtgcgtgtccaggaagggtatacatgtgactgtttcgacggttaccatctggacacagccaaaatgacgtgcgttgatgtaaatgaatgcgacgaactcaataaccgcatgagtctctgcaagaatgccaaatgcattaacaccgacggatcttataagtgtctgtgtctgcctggatacgtaccctccgataaacctaattattgcacacctctcaatacagcactgaacttggaaaaggacagcgacctggaatag

SEQ ID NO: 192762 - DNA, 5466 bp, Artificial Sequence
  Description of Artificial Sequence: Synthetic coding sequence
atgcggccccggaccaaggcccggagccccggccgggccctgcggaatccttggcgcggcttcttgcctctcacgcttgcgctcttcgtgggtgccggtcatgctcagcgcgatcccgtcggccgctacgaacctgccggtggggatgcaaatcggctgagaagacctgggggatcctatcccgcagccgctgccgccaaggtgtactccctgttcagggagcaagatgcccccgttgccggtttgcagcccgtggagcgggcccagccaggttggggatctcctcggaggcctaccgaggccgaggctaggagaccttcgagggcacaacaatcaagacgcgtgcagccacctgctcagaccaggagatctacacccttaggccaacagcagccagccccaagaacacgggctgcaccagccctccccagactcggcactccacaaaggtcgggcgccgcccccccaactccgccccggggtcggctaaccggaagaaatgtctgtggggggcagtgctgccccgggtggactactgccaatagcaccaaccattgtataaaacctgtttgcgagccgccgtgccagaaccgtggctcttgttcccgcccgcaactctgcgtatgccgatccggcttccgcggggcgcgatgtgaagaggtgattcccgacgaggagtttgacccgcagaactctcgcctggccccccggaggtgggcagaacggagcccgaatctgaggcgctcctctgcagccggggaagggacccttgccagggcccagccacccgcgccccagtcacctcccgctcctcagtctccacccgctggcacgctgtccggactgtcacagactcatcctagtcagcagcatgtgggtctgagtcgaacggtcagattgcatcccaccgcaaccgcgagcagccaactttcttcaaacgctctcccacccggccccggtctggagcagagagacggcactcaacaggctgttcccctagagcacccctcgtcaccatggggcctgaacctgacagagaagattaagaagattaaaatcgtattcacaccgaccatatgcaagcagacatgtgcacggggtcattgcgcaaactcctgtgaaaggggcgatacaacgaccctctactcccagggaggccacggtcacgaccccaagtccggtttccgtatctacttttgtcaaatcccttgtctgaacggggggcgttgcattggtagggacgaatgctggtgccccgcgaactcaaccggcaagttttgccacctacctatcccccaaccagacagggagccgcccggacgcggaagcagaccacgcgcactgctcgaagccccgctgaagcagtctaccttcactctcccactcagcaatcagctggcgtccgtaaatcccagtctcgtcaaggtgcatatccaccaccctccggaggccagtgtgcaaatacaccaggtggcacaggtgagagggggggtcgaggaagccctggtagaaaactcagtcgagacccggcctccaccatggctccccgcgtcacccgggcactctctatgggactcgaacaatattccggctaggtccggagaaccaccacgccccctccccccagctgcgccaagaccgcgcggcctgctcgggcgatgttatttaaacacggtcaacggtcaatgcgccaatcctctgcttgagctgacaactcaagaagactgttgcggctcggtgggggccttttggggggtcaccttgtgcgcgccctgtcctcccaggcccgcaagcccagttatcgaaaatgggcagctcgaatgcccccaggggtacaagcggctgaatctaacacattgtcaggatatcaacgagtgccttacactcgggttgtgtaaggacgcagagtgcgtcaatacaagaggatcttatttgtgcacctgtcgccccggcctgatgctggatcccagtaggtctagatgcgtctccgacaaagctatctcaatgctgcaagggctatgttatcggtccttggggcctggaacctgcactctgccgctcgcgcagagaattacaaaacagatatgttgctgctctcgagtgggcaaagcgtggggctctgaatgtgagaagtgccccttacccggaacagaagccttcagagagatttgcccagcaggacatggctatacgtacgcctcaagtgacattcggctcagcatgcggaaagctgaggaggaggaactggcccgcccacctagggagcagggtcagagatcgagcggagccttaccaggccccgctgaacggcaaccactgagggtggttacggatacctggcttgaggccggcactattccagataaaggagattcacaggctgggcaggttaccacaagcgtgactcacgcacccgcctgggtgactggcaacgccactactccgcccatgcctgaacagggcattgccgagatccaggaagagcaggttacaccatccactgatgtgcttgtcacactgagcacacccggtatcgacagatgcgctgcaggggccaccaatgtctgcggtcccggaacatgtgtcaacttaccggatggatacagatgcgtctgctcgccaggctatcagctgcatccgagtcaggcttattgcacagacgacaatgaatgcctgagagatccctgtaaaggcaagggcaggtgtattaaccgggtgggatcatattcatgcttctgctatcccggttacacactggctaccagtggagcaacacaagaatgtcaggacattaatgaatgcgagcaacctggcgtgtgtagtggcggtcagtgcaccaacaccgaaggaagttatcactgtgagtgtgatcaaggttacattatggtgaggaagggacattgccaggacatcaacgaatgccgtcaccctgggacctgtccagatggacgctgcgtgaactctcccggctcgtacacttgtttggcgtgcgaagagggttatcgcgggcagagcgggagctgtgtggacgtgaatgagtgcctgacgcctggcgtgtgcgcccatggtaaatgcactaaccttgagggatctttcagatgctcctgcgagcagggctacgaagtcacaagtgatgaaaaaggctgccaggatgtggacgagtgtgcctcccgggcctcctgcccaacaggtttatgtttaaacactgagggctcattcgcttgcagtgcttgcgagaacggctattgggttaatgaggacgggaccgcgtgtgaggacttagacgagtgtgctttccccggagtgtgtccaagtggggtgtgtaccaacaccgccggatctttttcatgtaaagactgtgacggcggttatcgcccatcccctcttggtgactcttgtgaggatgtggatgaatgtgaggatccacagagtagttgcctaggcggcgagtgcaagaacacagttggaagttatcagtgcctgtgcccacagggctttcaacttgccaatggtactgtctgtgaggacgttaacgagtgcatgggggaggaacactgtgctcctcacggggagtgcctgaatagtcacggaagctttttctgcctgtgcgcgccaggattcgtgtccgcggagggaggaactagctgccaggacgtggatgaatgcgccactaccgacccttgtgtgggagggcactgtgtaaacacagagggctccttcaactgcttgtgcgaaactgggtttcagccctcacctgagtccggcgaatgtgttgatatcgatgaatgcgaagattacggagatcctgtgtgtgggacctggaaatgtgaaaattctccaggctcctataggtgtgtcctgggctgccaacccggcttccacatggctcccaatggggactgtatagacattgatgagtgcgccaacgacaccatgtgtggatcccacggcttctgcgacaacactgatggctcatttcgctgtttgtgtgaccagggatttgagatctcaccttctgggtgggattgtgtcgatgtcaacgaatgtgaattgatgctagcagtgtgcggcgcagccctgtgtgaaaacgttgaggggtctttcctgtgcctctgcgcatctgatttggaggagtacgacgctcaggaaggtcactgtcgtccgcggggcgctggcggacagagcatgtcagaggctccaacaggggaccacgctccagcacctaccaggatggattgctactccgggcagaaggggcacgctccttgcagcagcgtgctcggacgtaacacaactcaggcagagtgctgttgtacccagggtgcgagctggggggacgcatgtgacttatgccctagcgaggattccgcggagtttagcgaaatctgcccttccgggaagggctatatacccgtcgaaggtgcctggacctttggccaaaccatgtatactgacgcggacgagtgcgtcattttcggcccaggcctgtgtcccaacgggcgctgcttgaatactgtacccggctatgtatgtttgtgtaaccctggattccattacgacgccagtcacaaaaaatgtgaagaccacgacgaatgtcaagatttggcctgcgagaatggggaatgcgttaatactgagggctctttccattgtttctgtagcccgcctctgaccctagacctttcacaacagcggtgcatgaactccaccagttccactgaggacctccccgaccatgacatacacatggacatatgctggaagaaggttaccaatgatgtgtgttcagagcccctgcgtgggcatagaacaacatacaccgagtgctgctgtcaggacggggaagcgtggtcacagcagtgcgcactctgcccacccagatctagcgaggtctacgctcagctctgcaacgtagccagaatcgaagcagaacgagaggcaggggtacattttagacctggctatgaatacggccccggccccgatgatctgcattactctatttatggacctgacggggcgcctttttacaactatctggggccagaggatacagtgcctgaacccgccttcccgaacactgcgggccattccgcagaccgaactcctatacttgagtccccactacagccctccgagttacagccacactacgtagcaagccaccccgagcccccggccggcttcgaaggcctccaggctgaggagtgtgggatattaaatggctgtgagaatggaagatgcgttcgagtgcgggagggctatacatgcgattgctttgaagggttccagctcgatgccgcccacatggcttgcgtggacgtgaacgaatgcgacgatcttaatggtcctgcagtgttgtgcgtccacggatactgcgaaaatacagaggggtcttataggtgccactgttcccctggctatgtggccgaagctgggccacctcactgcacagctaaggaatag

SEQ ID NO: 192763 - DNA, 3912 bp, Artificial Sequence
  Description of Artificial Sequence: Synthetic coding sequence
atgcccggcccccggggcgccgccggcggcctggcccccgagatgagaggagccggggcggctggactactcgccctcttgctcttgttgctccttctcctgttaggcctcggtggccgggtcgagggtgggccagcgggtgagcggggagcagggggcggaggagcactggctagagaaaggttcaaagtcgttttcgcccccgtcatttgcaagagaacttgcttaaaggggcagtgtcgagactcctgtcagcaagggtctaacatgacgcttatcggggagaacggccattccaccgataccctgacaggtagtggattcagggttgtggtttgtccactgccttgtatgaacggcggacaatgtagttcacggaatcagtgcctgtgtcctcccgatttcacaggtagattttgccaagtgcccgccggaggagcaggaggagggacgggaggcagcggccccggcctgagtcggactggagctttgtccactggagccctcccacccctggcgcctgagggtgactccgtggccagcaagcacgccatttacgctgtgcaggtgatcgctgaccctccaggtcctggagaaggccctccagctcagcatgctgctttcctagtaccgctgggaccgggtcagataagcgcagaggtgcaggctccccctcctgtcgttaacgtgcgcgtgcatcacccacccgaggcttccgtccaggtgcacaggatcgagagcagcaacgccgaaagtgccgctccaagtcaacatctcctgccacatccgaagccatcccaccctcggcctccaacccaaaaacccctcgggcggtgtttccaggatacactacccaagcagccttgcgggtcaaacccactccctggcctcaccaaacaggaggattgttgtggatccatcgggactgcgtggggccagagcaaatgccacaaatgtccccagctacagtacaccggggttcaaaagcccggaccagtgagaggcgaagttggcgctgactgtccgcagggctacaaacgcctgaactccacccattgccaggatattaacgaatgcgctatgccaggcgtttgcagacatggcgactgcctaaacaatcctggctcatacaggtgtgtgtgtccccctggacactccctgggccccagcaggacgcagtgtatcgccgataaaccagaagagaagagtctgtgcttccgattggttagtcctgaacaccaatgccagcatccactcacaaccaggcttacaagacaactgtgctgttgttccgtgggcaaagcttggggcgccagatgtcagcggtgcccgaccgatggcacagcagctttcaaagaaatctgtccggccggcaaagggtatcacatccttacctcgcaccaaacccttacgattcaaggagagagcgattttagcctatttctgcatcctgacggaccgcccaaaccacagcaactgccagaatccccctcgcaggctccaccacctgaggacacagaggaggagcgcggggtgactacagactctccagtttccgaggagcggagcgtgcaacaatctcatcctactgccaccacaacacccgctagaccataccctgaacttatctcccgaccatcaccacctacgatgcgctggtttctcccagacctaccaccatcccgctccgctgtcgaaatcgctcccactcaggtcaccgaaacggatgaatgtagattaaatcaaaacatttgcgggcatggggaatgtgtgccaggcccaccggattactcatgtcactgtaatccaggataccgaagtcacccacagcataggtactgtgttgacgttaacgaatgcgaggccgaaccttgtggtccgggcagagggatctgtatgaacactggagggtcttacaattgtcattgcaacagagggtatcgcctgcatgtaggagcgggtgggagatcttgcgtcgacctgaatgaatgcgcaaagccccacctgtgtggtgacggtggcttttgcattaacttccccggacattacaagtgtaactgttatcccggataccgacttaaggccagccggccaccagtgtgcgaggatattgatgaatgccgcgacccttcttcctgccctgacggcaagtgcgagaataagcccggcagttttaagtgcatcgcttgccagccaggctatcgctctcaaggaggtggtgcttgcagggatgtgaatgagtgcgccgagggtagcccctgttctccagggtggtgcgagaatctgcccgggtcttttaggtgcacatgcgcccaagggtacgcccctgcccccgacggtcgcagctgcctcgatgtggatgagtgcgaggctggggacgtgtgcgacaacgggatctgttcgaacactccaggatcgtttcagtgtcagtgtcttagtgggtatcatctctcacgggaccgcagccattgtgaggatatcgacgagtgcgacttccccgcggcctgcattggcggcgactgcattaacacgaatgggtcttacaggtgcctttgtccgcaaggccaccggctggttggcggaaggaagtgtcaagatatcgacgagtgtagccaggatcccagcctatgccttccccatggcgcctgtaaaaacctgcagggctcctacgtttgtgtatgtgacgagggttttacccctactcaggaccaacacggttgcgaggaggttgagcagccccaccataagaaggaatgttatctgaacttcgacgatacggtgttctgcgactcagtgctcgccaccaacgtgacgcagcaagaatgctgctgttccctcggtgcagggtggggagatcactgcgagatctacccctgccccgtttatagtagtgccgagttccattccttgtgcccagatggcaaagggtatactcaggacaataacattgtgaactacgggattcctgcccaccgggacatcgacgagtgtatgctctttggttctgaaatctgtaaagagggcaagtgcgtcaacacacagccaggttatgagtgctactgcaaacagggcttctactatgacgggaacttactggagtgcgttgatgtggacgaatgccttgacgaaagcaactgtcggaacggggtgtgtgagaatacacgcggaggttaccggtgtgcctgtaccccccccgccgagtattcaccagcccaaaggcaatgtctctctccagaagaaatggacgtcgatgagtgccaggatcccgcagcttgccgcccaggcaggtgtgtgaatctaccgggttcataccgatgcgagtgtagacctccgtgggtgccaggtccttccggacgggactgccagctgccagaatccccggccgagagggcaccagaacgccgagatgtttgttggtctcagcggggcgaggatggcatgtgcgcaggtcctctagccggtcccgctctaacttttgatgattgttgttgtaggcagggtaggggttggggggctcagtgcagaccgtgccctccacgcggagccggcagccactgtcccactagccaatcagagagcaattccttctgggacacttcgcctctgctattagggaaacccccaagggatgaggactcttcagaggaggattctgatgagtgtcggtgtgtttctggaagatgcgtccccaggccaggcggcgccgtgtgtgaatgtcccggcggttttcaattggacgcctcaagagctcgctgtgtcgacatcgacgagtgtagggaattaaaccagcggggcctgctgtgtaagtcggagcgttgcgtcaatacatctggatcatttcgatgcgtttgcaaagccggatttgcaagatcccgcccccacggagcgtgtgtccctcagaggaggcggtag

SEQ ID NO: 192764 - DNA, 792 bp, Artificial Sequence
  Description of Artificial Sequence: Synthetic coding sequence
atgctgttcggcagcgagatctgcaaggagggcaagtgcgtgaacactcagccagggtatgaatgttactgtaaacagggcttctactacgacggaaatctgctggagtgtgtcgacgtcgacgagtgtctcgatgagtctaactgtaggaacggtgtctgcgagaacactcgcgggggttataggtgcgcatgtactccaccagctgagtattcaccagcccagcggcagtgtctctccccagaggaaatggacgtagacgaatgccaagatcctgccgcttgcaggcctgggcgctgcgtgaaccttccggggagctatcggtgcgagtgccggcctccctgggtacctggcccttccggtcgggattgccagcttcctgagtcccccgcagagagagcccccgaaaggcgcgacgtctgctggtctcaacgcggcgaagatggtatgtgcgcaggccctctggcaggtcctgctcttactttcgacgactgttgttgtcgccaggggcggggctggggagctcaatgtaggccttgtcctccaagaggcgccggctcacactgtccaacatctcaaagcgagtccaactcattttgggacacctccccactgctcctgggcaagccccctcgcgacgaagactcatccgaagaggatagcgacgagtgccgctgcgtttctgctgcagcctgtagagggagggctgcaccctgcgcctcagtcccagccgcctccagctctacaccacctgcaccagcagcctggatctccacatcagcagagtcttag

SEQ ID NO: 192765 - DNA, 3771 bp, Artificial Sequence
  Description of Artificial Sequence: Synthetic coding sequence
atgcccggcccccggggcgccgccggcggcctggcccccgagatgaggggtgcaggcgccgccggtctcctggctttgttattactgctgctcctgctgctacttggattagggggaagggttgagggcggaccggccggcgagcgtggcgcaggcggggggggcgccctggcaagggaacgctttaaagtggtattcgctcctgtaatctgtaagcgcacttgcctaaaggggcaatgccgcgactcgtgtcagcagggctccaacatgacattaatcggagaaaatggtcacagcacagatacactgacaggttcagggtttcgcgtggtggtgtgccccctgccgtgcatgaatggtggccagtgttcttctaggaaccaatgtctctgcccacccgatttcaccggccggttctgccaggtccctgctggaggagccggtggcggcacgggcgggtcagggcccgggttgtccaggacaggtgctctctctacgggcgctctaccgcccttagcccccgagggtgattcggtggcgtcaaagcacgccatctatgctgtgcaggttatcgccgaccctccgggtcccggagagggacccccagcccaacacgccgcctttctggtgccactgggtcctggacagatttccgctgaagtgcaagcaccaccgccagtggttaatgtgagagttcatcaccccccggaggcctctgtgcaagtgcatcgtatcgagtcctccaatgcagagtcggctgcaccaagccagcacctcctaccccacccgaaaccttcccatccacggcctcctacccagaagcccttagggcgctgcttccaagacaccctgcccaagcagccctgcggaagtaatccactgccaggactgaccaagcaggaggattgctgcggcagcattgggacagcttgggggcagtcaaagtgccataagtgcccacaactccagtatacaggcgtgcagaaacccggacccgtacgaggcgaagtcggtgcggattgtccacaaggctacaagcgcctgaatagcacacactgtcaggatattaacgaatgtgcaatgcccggtgtgtgccgccatggagactgccttaataatccaggaagttatcggtgtgtgtgtccgcccggacacagtttgggaccgtctcggacccagtgtatcgcggataaacctgaagaaaaaagcctctgctttagactggtgtcccctgagcatcagtgccagcacccattgaccacacgacttacccgacagctatgttgctgtagtgttggcaaagcatggggagccagatgtcagagatgcccaacagacggcacggccgcattcaaagagatttgtcctgccggtaagggctatcacattcttactagccaccagactttaaccatacagggcgagagcgacttcagtctgttcctgcacccagatggtcctcctaaaccccaacagttgcctgaaagcccctcgcaggcgccccctcctgaggacaccgaggaggagcgtggcgtgacgaccgactcaccggtgagcgaagagaggagcgtccagcagtcacaccccaccgccaccaccacaccagcccgaccctacccagagctaatctctcggccttccccgccaactatgcgctggttcttgccagacctgcctccaagccggagcgccgtggaaattgcccccacacaagtcacagaaacggacgagtgccgattgaatcagaatatctgcggccatggagaatgtgtacctgggcctccagattacagctgtcactgtaaccctggctataggagtcatccgcagcaccggtattgcgtggatgtgaatgagtgtgaagccgagccatgcggccctggcagggggatctgtatgaacaccggcggcagctacaactgccactgtaaccgcggatataggctgcacgtgggcgctggcggcagaagctgtgtggatctcaacgagtgcgccaaaccccacctctgtggagacggtggcttctgcatcaacttcccaggtcactacaagtgcaattgctatccaggttatcgcctaaaggcaagcaggccacctgtgtgtgaggatatagacgaatgccgagatccttccagctgcccagatggaaagtgcgaaaacaaaccaggcagtttcaagtgcatcgcttgtcagccagggtatcgttctcagggcgggggagcctgtcgagacgtgaacgagtgcgcagagggttctccatgcagccccgggtggtgtgagaatctgcccggcagttttcgctgcacctgcgcccagggatacgcgccggcccccgacggtaggtcgtgcctcgatgtggacgaatgtgaggccggcgatgtttgcgacaacggtatttgctctaatacccctggctcattccagtgccagtgcctctccggttaccacttgagcagggatcgatcccactgcgaagacatcgacgaatgtgacttcccagcagcctgtatcgggggagactgcattaacaccaatggctcatatcgatgtctttgcccacagggccacaggctggttgggggaaggaagtgtcaggatattgacgagtgcagtcaggacccatcactctgcttaccgcacggagcttgtaagaacctgcagggctcttacgtctgcgtgtgcgacgaaggattcaccccaacacaggaccagcatggttgcgaggaagtggagcagcctcaccataagaaagaatgttatctgaacttcgatgacaccgtattctgcgactctgtgcttgctaccaacgtgactcagcaggaatgttgctgcagtttgggagccggatggggcgaccattgcgaaatatacccttgcccagtttactccagtgccgaatttcattctctgtgtccagacggaaagggatacacacaggataataatatagtgaattacggcatacctgctcaccgggacattgacgagtgtatgctgtttggcagtgagatctgcaaggaggggaagtgcgtgaacacgcagcctggctatgagtgttactgcaagcaaggcttctactacgacggcaatctgctggagtgcgtggacgtcgatgagtgccttgacgagagcaattgtaggaacggagtctgcgaaaatactagaggaggatatcggtgtgcctgcactcctcctgccgagtactcacccgcgcagaggcagtgtctctctccagaagagatggagcgggcccctgagcgccgggatgtttgctggagccagcgcggggaggatggtatgtgtgccggccccctcgcaggacccgcgctgacctttgatgactgctgctgcaggcagggaagagggtggggtgcccaatgcagaccttgtccacctcgcggggcaggatcccactgtcctacatcgcagagtgagagcaatagtttctgggacacttcacccctcttactgggcaagccgcctcgggatgaggactctagcgaggaagactcagacgagtgccggtgtgtaagcggtagatgcgttcctaggccaggcggcgctgtgtgcgagtgtcccgggggtttccagttggacgcttcccgcgcacggtgcgtggatatcgacgagtgtagggaactgaatcaacggggcctgctgtgcaagtcagaaaggtgtgtcaacacgagcgggtccttccgttgtgtctgtaaggcagggtttgcccgttcgagaccccacggcgcttgcgtcccccagagaagacgttag

SEQ ID NO: 192766 - DNA, 921 bp, Artificial Sequence
  Description of Artificial Sequence: Synthetic coding sequence
atgctgttcggcagcgagatctgcaaggagggcaagtgcgtgaacacccagcccggctatgagtgctactgcaaacaggggttctattacgatgggaatttgttggagtgtgttgacgtcgacgaatgcctggatgaatctaattgccggaacggagtctgtgaaaatacccggggcgggtacaggtgcgcatgcacccctccagcagagtattccccagcgcagaggcagtgcctatccccggaggagatggacgtcgatgagtgtcaggaccccgccgcttgcaggccaggacgatgtgtgaacttgcccggcagttatcgatgtgagtgtaggcccccttgggtacccgggccaagtgggagggattgtcagctgccagagtcacccgctgaacgcgccccggagcgacgggatgtgtgttggagccagagaggagaagatgggatgtgtgctgggccactcgcgggtcccgcactgactttcgatgactgctgctgtcgtcagggaagggggtggggagcccagtgcagaccctgtccacccaggggggccggctcacattgtcccacctcgcagtccgagtcgaatagcttctgggatacctcccctctgttgctaggcaaaccccccagggatgaggacagttcagaagaggattccgacgaatgcaggtgcgtgagcggccggtgcgtgcctagaccgggtggggctgtgtgcgagtgtccgggaggcttccagctggacgctagtcgtgcacgatgcgtggacatcgacgaatgcagagagctgaatcaaaggggcttgctttgcaagtcagagagatgtgtcaacactagtggatcctttaggtgcgtctgtaaggccgggtttgctcggagtaggcctcatggggcctgcgtccctcaaaggagaaggtag

SEQ ID NO: 192767 - DNA, 3414 bp, Artificial Sequence
  Description of Artificial Sequence: Synthetic coding sequence
atgaccctgatcggcgagaacggccacagcaccgacaccctgaccggcagtggcttccgcgtggtggtgtgcccacttccgtgcatgaatggcggccagtgttccagtcgtaaccaatgtttatgtccaccggatttcacgggcaggttctgtcaggtccctgccgggggagcaggggggggtactggaggaagcgggcctggactgtcccgcacaggtgccctctcaacaggtgccctcccacctctggcccctgaaggagatagtgtcgcttctaagcacgctatatatgcggtgcaagtcattgcggaccccccaggccccggggaaggcccccccgcgcagcacgctgcatttctcgttccccttggccccggccagattagcgcagaggtgcaggcacctccccctgttgtgaacgtcagagtgcaccatcctcccgaggcttccgtgcaagtgcaccggatcgagtcctctaatgccgaaagtgccgctccctcacaacacctcctccctcatcctaagccctctcacccgaggcccccgacccagaagccactggggcggtgtttccaagataccctgccaaaacaaccgtgtggtagtaatccgttgcccggtctgacgaaacaagaagattgttgcggctctatcgggaccgcgtggggccaaagtaaatgtcataagtgcccgcagctgcagtacactggtgtacaaaaaccaggccctgttagaggagaggttggcgctgattgtccccagggctataaaagactcaactctacacactgccaggacatcaatgagtgtgctatgcctggggtgtgcaggcatggggactgtctgaataaccccggttcatacaggtgcgtgtgccccccaggccacagtctcggcccaagtaggacccaatgtatagccgataagccagaagagaagtccctgtgcttccgactggtgtcgccagagcaccagtgccagcatccgttgaccacgcggttaacccgccagctttgctgctgcagtgtggggaaggcctggggagccagatgccaaaggtgtccaacagacgggaccgctgcgtttaaagagatttgcccggccggcaaggggtaccacatcctgacgagccaccagaccttgacgatccagggagaaagcgacttctccttgttccttcatcccgacgggccgccaaagcctcaacagcttccggaaagccctagccaagcaccgccccctgaagatacagaggaagaaagaggagtcacgaccgattcccctgtgtctgaggaacggagtgttcagcagtcacacccaactgccacaaccactcctgctagaccataccctgagctgatcagccggccatctcctcccaccatgcggtggttcctccccgacctaccgccctctaggagtgctgtggagatcgcccctacacaggtcactgagacagacgagtgtcggctgaaccagaacatttgcggacatggcgagtgcgttccaggcccgccagactactcctgtcactgtaatccaggctataggtcacatccccagcatcgctactgcgtggacgtgaacgaatgtgaggccgaaccatgcgggcccggaagaggaatctgcatgaatacaggtggttcttacaattgtcattgtaacagaggatataggcttcatgtgggcgctggaggaaggtcctgtgtggatttaaacgagtgcgccaagccccacctgtgcggcgacggtggcttttgcatcaattttccggggcattacaaatgtaattgctacccagggtatcgtctgaaagccagtcgtccacctgtgtgcgaggatatcgatgagtgcagagaccccagttcatgcccagacggcaagtgcgagaacaagcctgggtcttttaagtgtatagcctgccagcccggctaccgtagccaaggcggaggggcgtgtagagatgttaatgaatgtgccgagggcagcccctgctcccctggatggtgcgagaatctgcccggctcattccgctgcacatgcgctcagggctacgcccctgcacccgacggacggagctgcctcgatgtggacgagtgcgaagccggcgacgtgtgcgataacggaatttgcagcaatacaccaggatcttttcagtgccagtgcttgtctggctatcacttaagtagagacagatcccattgtgaggatattgacgagtgcgactttcccgctgcatgcattggcggagattgcatcaacacaaacggttcttaccgatgtctctgtcctcaaggccaccgtcttgtcggaggtcgcaaatgccaagatatcgacgagtgcagccaggatcccagcctctgcttaccacatggcgcatgtaaaaatttgcagggtagctacgtgtgcgtctgcgacgagggattcacccccacgcaggatcaacacgggtgcgaggaagtggagcagcctcaccataagaaagagtgctatctcaattttgacgacacggtcttttgcgattccgtgttggctaccaacgtgacacagcaagagtgttgctgttctcttggggcaggatggggagatcactgtgaaatctacccatgccctgtatatagctccgccgagttccactcactgtgtcccgatggcaagggctatacccaggacaacaatatcgtgaattacggaatccctgcccatagggatatcgacgagtgcatgttgtttggttctgaaatctgtaaggagggcaaatgcgtaaacacccaaccaggatatgaatgctactgcaagcagggattctattacgatggcaatcttctggaatgtgttgatgtggacgaatgcttagacgagtccaactgccgcaacggggtttgtgagaacacaagaggtgggtatcgttgcgcttgcaccccacctgctgagtattcaccagctcaaagacagtgtctatcgccagaggaaatggacgtcgacgaatgtcaagatccagccgcttgcagacccggaagatgcgtgaacctgcctggttcatatcgatgtgagtgccgccctccctgggtgccagggccttctggtagagactgccaactgccagagagcccagcagagcgggccccagagcgtagagatgtctgctggagccagagaggcgaggatggaatgtgcgcaggccctctggccgggccagcccttacattcgatgattgttgctgcaggcaggggagagggtggggagcacagtgtcgaccctgccctcctcgcggcgcgggttctcactgccctacttcccagtccgaatcaaattccttctgggataccagcccgctgctgctggggaagcctcctcgcgacgaagattccagcgaggaagatagcgacgaatgccggtgcgtgtcaggatag

SEQ ID NO: 192768 - DNA, 2202 bp, Artificial Sequence
  Description of Artificial Sequence: Synthetic coding sequence
atgcccgccgagaccgacgagtgccggctgaaccagaacatctgcggacacggggaatgtgtcccaggcccccctgattactcttgtcactgcaacccgggctacagatcccacccacagcacagatactgtgtcgacgtgaacgagtgtgaagccgagccttgcgggcccggcagaggcatctgtatgaatacgggtggtagctataactgccattgcaacagaggctataggttacatgtgggtgccggcggccgttcttgcgtcgacctgaacgagtgtgcaaaacctcacctgtgcggggacggtggtttttgcataaatttccccggacactataaatgtaactgctatccgggctaccgactaaaagcttcgagaccccctgtgtgcgaagatattgacgagtgccgtgatccttcctcgtgccctgatggtaagtgcgagaacaaacctggatctttcaaatgcatcgcttgtcagccaggctaccggtctcaagggggcggtgcgtgccgagatgttaacgaatgcgccgaaggttcgccatgctcccctggctggtgcgaaaatctgccaggcagctttcgctgcacctgcgcacagggctatgcacctgcccctgacgggcggtcttgtctggacgtcgatgaatgcgaagcaggcgatgtgtgtgacaacggcatttgttcgaacaccccggggagttttcagtgccagtgcctgtctggataccacctgtcacgagatcggtcgcattgtgaagacattgacgaatgtgatttcccagctgcctgcatcggcggcgactgtattaacactaatgggtcctacaggtgcctttgcccccagggccatcgcttagtaggaggacggaagtgccaagacatagatgaatgtagtcaagatccgtccttgtgcttgcctcacggtgcctgtaaaaacctgcaaggaagctatgtctgcgtttgtgacgaggggtttacacctacacaggatcagcacggatgcgaggaggtggagcagcctcaccacaaaaaagagtgctaccttaatttcgacgatacagtcttctgcgacagcgtgcttgcgacaaatgtcacgcagcaagaatgctgctgttctttgggcgccggctggggggatcactgcgagatctacccctgccctgtgtacagctccgcggaattccactccctgtgtccagacggtaagggctatacccaggacaacaacatcgtcaactatggtatcccagcccacagagacatcgacgaatgcatgctgttcggaagtgagatctgcaaagaggggaaatgtgtaaatacccaaccaggttacgagtgctattgcaaacagggtttttattacgacggtaatcttcttgagtgtgtggacgtggatgaatgcctggacgagagcaattgccgaaacggggtgtgtgagaatacccgcggcggatacaggtgtgcttgtaccccacctgcagagtatagccctgcccagcggcagtgtcttagtcctgaagaaatggacgttgacgagtgccaggacccagctgcttgtcgcccaggcaggtgtgtcaatctgcccgggtcttatcgatgtgagtgcaggcccccctgggttcccggtccttctggcagggactgccagctcccggaatcacccgctgagcgggccccggagcgacgggatgtttgttggtcacagcggggagaagacggtatgtgcgcaggcccactggccggcccggcgctcacctttgacgactgctgctgcaggcagggccgcggctggggagcacagtgccggccatgtccaccaaggggtgctggaagccactgcccgacgtctcagtctgaatcaaactcattctgggatacctccccccttttactgggaaagccacctagagatgaggactctagcgaggaggattctgacgaatgccggtgtgtgagtggtaggtgtgtcccaaggccaggcggcgccgtgtgcgagtgccctggcggcttccaactcgacgcgtccagagcacgctgcgttgacattgatgagtgtcgtgaacttaaccagcgggggctgctgtgtaaatctgaacggtgcgtaaataccagcggaagcttccgctgtgtgtgcaaagcaggatttgcccgcagtcgcccacatggtgcttgtgtgccacagagaagacgatag

SEQ ID NO: 192769 - DNA, 2649 bp, Artificial Sequence
  Description of Artificial Sequence: Synthetic coding sequence
atgaccctgatcggcgagaacggccacagcaccgacaccctgaccgggagcggcttccgggtggctgataagccagaagagaagagtctgtgtttccgactcgtgtcccccgagcatcagtgccagcaccctcttactacgcgacttacgcgccagctgtgttgctgcagcgttggtaaagcctggggtgccagatgccaaagatgtcctactgatgggacagctgcctttaaggaaatctgtcccgccggtaaaggctatcacatcctcacaagccaccagacattgactattcagggggagtcagatttctcattatttttgcaccctgatggacctcccaagccccagcagttgcccgagagcccctctcaggctccacctcccgaggacacagaagaggagagaggcgtgacaacagattctccagttagtgaagagcggagtgttcagcagagccatccgacagcgactacaaccccagctagaccttatcctgagctgatctcgagaccaagtccccccactatgcgatggttcctccctgatctgccccccagcagatcagcggtcgagatcgcaccaacccaggtcactgagactgacgaatgccgtctgaaccagaacatatgcggacacggggagtgcgttcccggtccccccgattactcttgccattgcaaccccgggtaccgctcccacccacaacatcgttattgcgtagacgtcaacgagtgtgaggctgaaccctgcggccctggtcgtgggatctgcatgaataccggcgggtcatacaattgccactgcaaccggggctacagactgcatgttggtgccggaggccgttcctgtgttgacctgaatgagtgtgccaagccccatctgtgcggagatggcgggttttgtattaatttccctggccactacaagtgtaactgttaccctgggtataggctaaaggcttcaaggcccccagtgtgtgaagacattgatgaatgtcgcgacccttcctcctgtcctgatggaaagtgtgagaacaagcctggtagcttcaaatgcattgcctgccagccgggctaccgcagccagggcggtggtgcatgtagagacgtaaacgagtgtgcagagggcagcccatgcagccccggatggtgcgagaatctccctggttccttcagatgtacatgtgcacaaggatacgctcccgccccagatgggaggtcatgtctggacgtggatgagtgtgaggccggagacgtgtgcgacaacggaatttgctccaacacacctggctcattccaatgccagtgtctatcaggctatcacctatcacgggacaggtcccattgcgaagatattgacgagtgtgatttcccagccgcttgcatcggcggggactgcataaacactaatggctcatatcgttgcctgtgtccccaagggcatcgactcgtgggtggcaggaaatgtcaagacatcgacgagtgttctcaggatccctccctgtgtctaccacatggtgcctgtaagaaccttcagggctcatacgtgtgcgtgtgcgacgaagggttcactcctacacaggatcagcacggctgcgaggaggtagagcagccccatcataaaaaggagtgttacctcaacttcgatgataccgtgttttgcgacagtgtgttggctaccaacgtcacgcaacaggagtgctgttgttctctgggagcgggttggggagaccactgcgaaatctacccttgtcccgtctattcttccgcagagtttcactctttgtgtccagacggcaaaggctacacccaagataacaacatcgtcaattacgggatccctgcacaccgtgatatcgacgaatgtatgctctttgggtccgagatctgtaaagagggcaagtgcgttaatacacaacccgggtacgaatgttactgtaagcagggcttctattacgatggaaatctgctagagtgcgtggatgtggacgaatgcttagatgagagtaactgtaggaatggcgtttgcgagaatacacggggaggctaccgctgtgcctgtactccacccgccgagtattccccagcacagaggcagtgtctctcacctgaggaaatggagcgagctcctgaacggagagacgtgtgttggagccagaggggggaagacggcatgtgtgcaggacctctcgctggcccagccctcacctttgacgactgctgttgcaggcagggacgcggttggggagctcaatgtcggccgtgtccccctcgtggcgccggctcccactgtcctacttcacagtccgaatcaaactctttttgggacacctctccactgctgcttggaaaacccccccgggacgaggactcttctgaagaagactcagatgaatgccgatgtgtgagtggaaggtgtgtgccgaggccaggtggagccgtgtgtgagtgtccaggggggtttcagctcgacgcctcgagagcccgctgtgtggacatagatgaatgccgcgagctcaaccagcgcggcttgttgtgtaaatccgagaggtgtgttaataccagtggttcctttcggtgcgtgtgcaaagctgggttcgccagatcccgcccccacggggcctgtgtgccacagcgacgccgctag

SEQ ID NO: 192770 - DNA, 4761 bp, Artificial Sequence
  Description of Artificial Sequence: Synthetic coding sequence
atgggcgacgtgaaggccctgctgttcgtggccgccgcccgggccaggagactgggcggagctgctgcctctgagagcctggcagtgagcgaggctttctgcagagtgagatcctgccagcccaagaagtgcgctgggccacagaggtgtcttaatcccgttccagctgtcccaagcccaagtccgagtgtgcggaaacggcaggtgagtctcaactggcagcccttgacactgcaggaggcacgcgccctcctcaagagaagaagacccagaggacccggaggaaggggcctgctgagacgtcggccaccccagagagcaccggcagggaaggctcccgtgctgtgcccactcatctgtcataatggtggggtgtgtgttaaacctgaccgttgtctctgtccgccggatttcgcaggtaagttctgtcagttgcatagctccggggcccgcccacccgccccggccgttccaggcttgacccggtcagtgtacactatgccgctggcaaaccaccgagacgacgagcacggggtagccagtatggtctctgttcacgtggaacatccccaggaagctagcgtggttgtacaccaagtcgagcgcgtgtctggaccttgggaagaagccgacgctgaggcggtggctcgagccgaagctgccgcccgggccgaggcagccgcgccttacacagtcctggcgcagtcagctccacgtgaagacgggtattccgatgccagtggtttcgggtactgcttccgcgaattgcgcgggggagagtgcgcatcccccctaccaggtctgagaacccaagaagtatgctgcaggggggccggcctcgcttggggagttcacgactgtcagctctgttcagagcgcctgggaaattccgagagagtttctgcccccgacggtccctgccccaccggattcgagcgcgtgaatggaagttgtgaagacgttgacgaatgcgcgacgggcggacgttgtcagcatggggaatgcgcgaatactagaggaggctacacgtgcgtgtgtcctgacgggttcctgctggatagctctcgttcctcatgcatttctcagcacgtgatatctgaggccaaagggccctgctttagagtgctgagggatggcggatgctctttgcctatcctgagaaacatcacaaagcagatctgctgctgtagtagagtcggaaaggcatggggcagggggtgtcaactctgtcccccgtttgggtcagaaggcttccgagagatttgtcctgcagggccaggataccactattccgccagcgaccttcgatacaatacaaggcccttgggtcaggagcctccacgtgttagtttgagccagcctaggacgttgcctgccacttcaagaccaagcgcaggattccttcccacccaccgcttggaacctcgcccagagccaaggccggacccaagaccaggtcccgagctgccgctgcctagtatccctgcatggacaggcccagagatccctgagtcaggcccctcttccggcatgtgccaaaggaatccccaggtgtgcggcccggggagatgtatctcgcgtcctagcgggtacacctgcgcttgtgacagcggtttcaggctgtccccacaaggaactaggtgcatagatgttgacgaatgccgaagagtgcctcccccctgcgcacccggacgctgtgaaaattctcccggatcctttagatgtgtgtgcgggcccggcttcagggcagggccacgggctgccgaatgcttggacgtcgacgaatgccacagagtgccaccaccctgtgatctcggccgctgcgagaacacgcccggctctttcctgtgcgtgtgtccagctggataccaagctgccccccacggagccagctgccaagacgtcgatgaatgcactcagagcccaggcctttgtggaagaggagcctgcaagaatttaccagggtccttcagatgtgtctgccctgccggcttcaggggttccgcttgcgaagaagatgtagatgaatgcgctcaggagcctcctccatgtggacccgggcgctgtgacaacacagccggttcttttcattgtgcctgccccgcaggattccgaagtcgagggcctggcgccccatgtcaagatgtggacgagtgcgctcgctcccctccaccatgcacgtacggtagatgcgaaaataccgaagggagctttcagtgtgtgtgccccatgggattccaaccaaacaccgctgggagtgagtgcgaagacgtggatgagtgtgagaaccaccttgcctgtcctgggcaggagtgcgtgaactcccccggatcttttcagtgccgcacgtgcccctccgggcaccacctccacaggggcaggtgcaccgacgtggacgagtgctcatcaggcgcacccccgtgtggcccccatgggcattgcaccaacacagagggatccttcaggtgttcctgtgcccctgggtacagggcgccctccggacgccctgggccatgtgccgatgtgaacgaatgtctggaaggggacttttgttttccacatggggagtgtctgaacaccgatgggtccttcgcatgtacatgcgctcctggataccggccgggtcctcggggtgcttcatgtttggacgtcgatgagtgcagcgaggaggatctctgtcaatcaggcatctgtacgaatactgacggaagtttcgagtgcatttgccccccaggccatcgcgctggccctgacctcgcatcttgtctggacgtcgacgaatgcagagaacgaggacctgcgctctgtggatcccaaagatgtgagaactcacccggatcgtaccgatgtgtgcgagattgtgacccaggctaccacgccggtccagaaggtacttgcgacgatgtcgacgagtgccaggagtacggccctgagatatgcggtgctcagcgttgcgagaatacaccgggttcttatcgctgtaccccagcatgcgaccccggataccagccgacacctggcgggggatgccaggacgtcgacgaatgccgcaataggagtttttgcggcgctcatgcagtctgccagaacctccctggttcgttccagtgcttgtgtgaccagtatgaaggggcgcgagacggccgacattgtgtggacgtgaatgaatgtgagactttacaaggcgtttgtggggcggcactgtgcgagaacgttgaagggagttttctgtgcgtgtgtccgaatagcccggaagaattcgaccccatgaccggcaggtgcgtacccccccgaacatccgccggaacattccctggctcccaaccccaagccccagcgtcaccagtcctgccagctcggccccccccaccccccctgccgcggagaccctctaccccccggcaaggaccggtgggctctggcaggcgggagtgttactttgacaccgccgcccccgatgcctgcgataacattttagctcgaaacgtgacttggcaggaatgttgctgcaccgtcggagaaggttggggatcagggtgtaggatccagcagtgtcctggcacagaaactgctgagtatcaaagcctctgccctcatggacggggctatctagcaccgagcggcgacctgagcctgaggcgggacgtggacgagtgtcaactctttcgtgatcaggtatgcaaatcgggcgtgtgcgtaaacacagcaccaggatacagctgctactgctcgaacgggtattattatcatacgcaacgactagaatgcatagataacgacgaatgcgccgacgaggaaccagcctgtgaaggggggaggtgtgtgaacacggtgggatcctaccattgcacatgtgaacccccactggtcctcgacgggagtcagagacgttgtgttagtaacgagagtcagtctcttgatgataaccttggcgtgtgctggcaggaggtgggggcagatctggtttgttcccatccgcgcctcgatcgtcaagccacatatacggagtgctgttgtctatacggcgaggcctggggaatggattgcgccctgtgcccagctcaggattctgatgatttcgaggcactttgcaacgttctgcgaccccccgcctactcaccacctaggcctggcggctttggcctgccctacgaatacggaccggaccttggtcccccatatcaaggactcccctatggcccagaactttacccgcctcccgctctgccttatgacccgtatcctcctccacctgggccctttgcacgcagggaggctccatatggggccccccgctttgatatgcctgattttgaggatgacggaggaccatatggggagtctgaggcccccgcaccccctggccccgggaccaggtggccatatagaagccgggacaccagaagatctttccctgagccagaagagcccccagaaggtggttcttatgcaggctctttagcagaaccttatgaggaactggaggcagaggagtgcggcattttggacggctgcaccaatgggagatgcgttagggtgcctgaaggctttacgtgccgttgtttcgatggctacaggttagatatgacaaggatggcctgcgtagacatcaacgaatgcgacgaggccgaagccgccagcccgctgtgcgtgaacgctcgctgtcttaacacggatgggagcttccggtgcatctgccgcccagggttcgcccccacacatcagccccaccactgtgctccagcccgaccacgcgcttag

SEQ ID NO: 192771 - DNA, 561 bp, Artificial Sequence
  Description of Artificial Sequence: Synthetic coding sequence
atgctgggcggcgccggcggcggccccggcctgcggaccccctgccccgccgatgttgacgaatgtagcgaagaagatctgtgccaatcagggatctgtactaacacagacggaagcttcgaatgtatctgtcccccaggacaccgggccggacctgacctagcttcttgcctcgacgttgatgaatgccgggaacggggacctgccttgtgcggctcacagagatgcgaaaacagtcccgggtcttatagatgcgttcgggactgtgacccagggtaccatgccgggccggaaggcacatgtgatgatgttgacgagtgtaggaataggagcttctgcggcgcacacgctgtgtgccagaatcttcccgggagcttccagtgtctgtgcgaccagtacgaaggggcacgggatgggcgtcactgtgttgatgtgaatgagtgtgagacactgcagggtgtgtgtggagcagccctttgtgaaaacgtcgagggcagcttcctgtgtgtctgtcctaacagtcccgaggagtttgacccgatgaccggccggtgcgtttag

SEQ ID NO: 192772 - DNA, 4872 bp, Artificial Sequence
  Description of Artificial Sequence: Synthetic coding sequence
atgccccggcccggcaccagcggccggcggcccctgctgctggtgctcctcctgccccttttcgcggctgctacatcagcagcttccccaagccctagccccagtcaggtggtggaggtacctggcgtgccttcccggcccgcaagcgtcgccgtttgccggtgctgtcctggtcagacctcccgtaggagccgatgcataagggcattctgccgagtcagatcgtgccaacccaaaaagtgcgcgggcccacagcgatgtctgaatcccgtaccagccgtcccatcccccagcccatcggtgaggaaaaggcaggtttccttaaactggcagccactgaccctgcaggaagccagggccctcctaaagcgcagacgtccccggggacctggagggcggggcctgttaagacgaaggcccccgcaacgagcccctgcaggcaaagcccctgttttatgccctttaatttgccacaatggaggcgtttgcgtgaaaccagatcgttgtctctgccccccagattttgcagggaagttctgccagttgcacagtagtggcgcgcgcccgcctgcaccagcagtccccggccttactaggagcgtctacactatgcccctcgccaatcatcgcgatgatgaacacggcgtcgcatcaatggtgagcgtccacgtggagcacccccaagaggccagcgtcgtggtgcatcaggttgagcgggtctcaggaccttgggaagaggcggatgctgaggctgtggctcgcgccgaggctgctgcacgggccgaggcagcggctccttacactgtgctggcccagtcagcacctcgggaggatggctactcagacgcaagtggatttgggtattgctttcgagagctacggggcggcgagtgcgcttctcctctccctgggctgcgaacccaagaggtttgttgtcggggcgccggactggcctggggcgtccacgattgccaactgtgctccgagcgtctgggtaactctgaaagggttagtgctccagacggaccttgccccacagggtttgagcgagtgaatggatcctgtgaagacgtcgacgagtgcgcgacgggggggagatgtcagcacggagagtgtgcaaatactaggggcggctacacatgcgtctgcccggacggcttcctgctcgattcatcccggtctagctgtatctcccaacacgtcatctccgaggccaagggcccttgctttcgcgtcctaagagacggagggtgttcgctccctattctgcgtaatattaccaagcaaatttgttgctgctccagggtcggaaaggcttgggggcgaggttgccagttgtgccccccgtttggcagcgagggcttccgagagatctgccccgcggggccagggtaccattacagcgcttccgacctgaggtacaacactcggccactcgggcaagagcctcctcgagtatctctaagccagccccgcacactgcccgcaacttcaaggccctctgccggctttttacccactcatcggctggaaccacgaccagaaccccgcccagacccacggcccggcccagagctgccattgccttctattcctgcttggacaggtccagagatccccgaaagtggcccgtcatcgggaatgtgtcagcgtaatccccaggtgtgcggacccggcaggtgcattagtcggcctagtgggtacacatgcgcctgtgacagcggctttaggctcagcccccagggaacaaggtgtatcgatgtggatgagtgccgtcgagtgcccccgccttgcgcccccggtaggtgtgagaattctccgggctcctttcgatgtgtgtgcggccccgggtttcgcgcgggccctcgcgccgccgagtgtctcgatgtcgacgaatgtcatcgcgttcctccaccgtgtgatcttggccggtgtgaaaacacccctgggtcctttctgtgcgtctgccctgcaggataccaggccgccccacatggggccagctgccaggacgtggacgagtgcacccagagcccaggcctatgcggcagaggcgcatgcaagaacctgcctggctcgtttcgatgcgtctgtccagcaggatttagaggatccgcatgcgaggaggatgtggatgaatgcgctcaagagcctccaccttgcggccctggtagatgtgacaacactgctgggtcatttcattgtgcatgtcctgcaggattcagaagcaggggacctggggctccctgccaggacgtcgacgaatgcgcccgctctccccccccttgcacgtatggacgatgcgagaataccgaaggcagcttccagtgtgtatgtcccatgggttttcagcctaatacagctggttccgaatgcgaggacgtggatgagtgcgaaaatcacctggcctgtccaggccaggagtgcgtcaactccccaggcagcttccagtgcaggacatgccccagcggacaccatctgcataggggccggtgcaccgatgtggatgagtgtagttcaggcgcccccccatgcggccctcacggacattgtaccaacacagaaggctctttccggtgcagctgcgctccgggttatagagctccctctgggagacctggtccctgcgctgatgtgaatgagtgcctcgagggtgatttctgcttcccccacggcgagtgtcttaacacagacggcagttttgcctgcacgtgcgcccctggctacaggcccggccctcgcggggcctcctgtctcgatgtcgacgaatgctctgaagaggatctgtgccagtctggaatctgcaccaataccgacggcagcttcgaatgtatctgtcctcctggtcaccgagctggcccagatctggccagttgtctggacgtcgacgagtgccgagagcgaggccccgccctttgcggatcacagcggtgtgagaactcgcctggttcatatcggtgcgtccgagattgcgatcccggctaccatgcagggcctgaaggaacctgtgatgacgtggacgagtgccaagagtacggaccagagatttgtggagcgcaaagatgcgaaaacaccccaggaagctaccgctgtaccccggcctgcgatccaggctatcagccgactccgggggggggctgccaggatgtggatgaatgcaggaataggtccttttgcggggcccatgcagtatgccagaatctcccaggatccttccaatgcttgtgcgatcaatatgaaggagcaagggacggacggcactgcgtggacgtgaatgagtgcgagacactccagggggtttgcggcgctgctttgtgtgaaaacgttgagggttcttttttgtgcgtttgtcctaactctccggaggaattcgacccgatgaccggtcgttgcgtacctccacgcacttccgctggcactttcccaggctcccagcctcaggctcccgccagtcctgtacttcctgctaggccccctccacctccactgcccagacgaccttctactcctaggcagggcccagttggatcaggccggagggaatgttatttcgacacagctgcaccagacgcgtgcgacaatatcctggctagaaacgtgacatggcaggagtgctgctgtaccgtgggggaagggtggggtagcggctgcaggattcagcagtgccccgggaccgagaccgccgagtaccagtccctgtgtccacatggacgaggttacctggctccaagcggagatctgtccttgcggagagatgttgatgaatgccaacttttccgcgaccaggtgtgcaagagtggcgtatgtgtgaataccgcccccgggtactcctgctactgctccaatggctactactaccatacccaaagacttgagtgtatagataatgacgagtgcgccgatgaagagcccgcatgcgaggggggccgctgtgtgaacacagtgggctcctaccactgcacatgtgagccccctctggttcttgatggctcccagcggcgatgcgtgtctaatgaatctcagtcacttgatgataacttgggggtctgttggcaagaagtcggtgccgaccttgtttgctcccaccctcggttagaccgccaagctacctacacggaatgctgttgtctatatggcgaggcatggggcatggattgcgccctgtgtcccgcccaggattctgacgatttcgaagccctctgtaacgttctgcggcccccagcgtattcgcctcctcgccccggcggttttggcctgccctacgaatatggccccgacctgggaccaccctatcagggcctgccttacggtcctgagctgtatcctccacccgcactgccatacgacccctacccaccacccccaggtcctttcgcccggagggaagccccctatggagctcccagattcgacatgcctgattttgaggacgacggcggaccctacggtgagtccgaggctcctgctcccccgggcccaggaacacggtggccctaccgctcgagagacacccgtaggagtttcccagagcctgaagagcctccagagggcggctcctacgcgggatcactggcagaaccctatgaggagctagaagctgaagaatgcgggatccttgatggatgcaccaacggccgctgcgtgagggtgccagagggatttacgtgccggtgtttcgatggctacaggttagatatgaccaggatggcttgtgtggacattaacgaatgtgatgaggcggaagctgccagccccctgtgcgtcaatgcccggtgtctgaacacagacggaagcttcagatgtatttgcagacctggtttcgctcctactcatcagccccaccattgcgcaccggctcgaccaagagcctag

SEQ ID NO: 192773 - DNA, 1155 bp, Artificial Sequence
  Description of Artificial Sequence: Synthetic coding sequence
atgaccggccggtgcgtgcccccccggaccagcgccgacgtggacgagtgccagcttttccgcgaccaggtgtgtaagagtggtgtgtgtgtgaatacggctcccggatatagctgctactgtagcaatggctattactatcacactcaacgcttggaatgcatcgataacgacgagtgcgccgatgaggaacctgcctgtgaaggcggacgttgcgtgaacactgttggctcgtaccattgtacttgtgagcctccattggtcctagacggcagccagaggaggtgcgtgagcaatgaaagccagtcactcgacgataatctcggcgtgtgctggcaggaggtcggcgcggatctcgtatgctcccatccccggctcgataggcaggccacttataccgagtgttgttgtctgtacggggaggcctgggggatggattgtgcactctgccccgcccaggactcggatgactttgaagctctgtgcaacgtgcttcggccccccgcttattcccctccacgccccggcggcttcggcctgccttacgaatacggcccggatctgggtcctccctaccagggcctcccttacggccccgagctgtatccccctcccgccctgccttacgacccctatcctccccctcccggtccgtttgccaggagggaggcgccttacggagccccaaggttcgatatgcccgatttcgaagacgatggaggaccttacggtgagtctgaggcgccagccccacccggacccggaacaagatggccttatagatcccgggacacccgcaggtcttttccggaacccgaagagccaccagaaggagggagctatgccggttccctcgctgaaccctacgaggaactcgaagctgaggagtgcggcatcctggatggttgcaccaacggtcggtgtgtgcgcgtgccagagggattcacctgtcgttgtttcgacggttaccgcctggatatgactaggatggcttgtgtggatatcaacgaatgtgacgaggccgaagctgctagccctctctgcgttaacgctcgatgcctcaacacggatggcagtttcaggtgcatttgtcgaccaggctttgctccaactcatcagccccatcattgcgcccctgccagaccgcgcgcctag

SEQ ID NO: 192774 - DNA, 4671 bp, Artificial Sequence
  Description of Artificial Sequence: Synthetic coding sequence
atggccggcggcgtgcggctgctgtgggtgagcctgctggtgctgctcgcgcaactcggacctcagcccggccttggccggttaggcgagagacttagagttagattcactcctgtagtctgcggcttgcggtgcgttcacggaccgaccggctctcggtgcacaccgacgtgcgcaccccggaatgcgacctctgtggacagtggggcccccggtggtgcggccccaggcggtcccggatttcgtgctttcctatgccccctcatctgtcataacggtggcgtgtgtgtcaagcccgatcgctgcctttgtcctccggattttgccggaaagttctgccagctgcactcctccggtgctcgaccgcccgccccggctgttccgggacttactcgctctgtttatactatgcccttagccaaccacagagacgatgaacacggggtggctagcatggtgagtgtgcacgtggaacatccacaggaagccagcgttgtcgtgcaccaggttgagagagtgtcgggaccctgggaggaggccgacgctgaagccgttgccagagccgaggcggcggcaagggctgaggctgccgccccctataccgtgctggcacaatcagcccctagagaggacggttattctgatgcaagtggatttgggtattgtttccgcgagctgcgggggggtgaatgcgccagtccactgccaggcctccggacgcaggaagtctgttgtcgcggggctggcctggcttggggggtgcacgactgtcagttatgctcagagaggttgggcaacagcgagcgtgtgagtgccccggatgggccttgcccaactggctttgaaagggtcaacgggagctgcgaggacgtggatgagtgtgctactggcggccgctgccagcacggcgaatgtgccaacacaagaggaggatacacttgcgtttgcccggacggctttcttctggatagctctagatcatcttgtatctcgcagcacgtgatatccgaagctaagggaccatgctttcgagttctgcgcgacggcggttgcagcctacctattcttagaaatatcactaaacagatatgttgttgctcgagggttggcaaggcgtgggggcgtgggtgtcaactatgccccccttttggaagtgaagggtttagagaaatttgtcctgctggacccggctaccactattccgcttctgacctacggtacaacacgcggccgttaggacaggagcctcctcgtgttagccttagccagccacgcactctgcccgccacgagccggcccagtgcaggatttcttccgacacacaggttggagcctaggcctgagccccggcccgatccaaggcctgggcccgagctgcctctgcctagtattcctgcctggaccggcccagaaattcctgaaagcgggccttccagtggtatgtgtcagcgaaaccctcaggtgtgtggtcctggccgctgtatatcacggccctctggatacacatgcgcttgtgatagtggctttcgtctgagcccccaggggactcggtgcattgacgtggacgagtgtcgccgggtccctcccccatgtgcccccggtaggtgcgaaaactctccaggcagctttcgctgcgtgtgtggtccaggctttcgcgcaggacctcgggcagctgagtgcctggatgtagacgaatgtcacagggtgcctcccccctgcgacctggggagatgtgagaacactcccggttcattcttgtgcgtctgcccagccggttaccaggccgccccccacggagctagctgccaggatgttgacgagtgtacacagagcccaggtctctgtggaagaggtgcctgtaagaacctcccagggtcattccgctgcgtctgccccgcaggttttcgcggctccgcctgtgaggaagacgtcgatgagtgtgcacaggaaccacctccctgtggacccgggcgatgcgataacaccgctggttcgtttcattgcgcgtgccctgctgggtttcggagccggggtccaggagccccttgtcaggacgtcgacgaatgcgccaggtctcccccgccgtgcacatacgggcgctgcgagaacaccgagggttcctttcagtgtgtctgtcccatgggattccaacctaacactgctggatccgaatgcgaggacgtggatgagtgcgagaaccacctggcttgtcctggccaggagtgtgtcaatagtcctggtagctttcagtgtagaacctgtccttccggacatcatttgcatcggggccgttgcacagatgtggatgagtgttcctcaggagcccccccatgtgggccccatgggcattgtactaacaccgagggctccttccgttgctcatgtgctcccgggtaccgggccccttccggcaggccagggccttgtgccgacgtgaatgagtgtcttgagggtgatttctgctttcctcatggggagtgtctgaatacggacggcagttttgcctgtacctgcgcccctggctatagaccaggccctaggggcgcatcatgcttggacgttgacgaatgcagtgaggaggacctgtgtcaatctgggatttgtaccaatactgacggctctttcgagtgtatatgcccgcccggacaccgggcagggccagatctcgctagttgtctggatgtcgacgagtgcagagaacgcggcccagccctgtgcggtagccagaggtgtgagaatagtcccggctcttatcggtgtgttagggactgtgatccagggtatcacgccggccccgagggaacatgcgatgacgtggacgagtgccaggaatacggacctgagatctgtggcgcccaaagatgcgaaaatacaccaggtagctatcgctgtacccccgcctgcgaccctggttaccagcccactcctgggggcggttgtcaggacgtggacgagtgtcggaatagaagcttttgtggagcgcatgctgtctgccaaaacctgccaggtagctttcaatgtctctgtgaccaatatgaaggtgctagggacggccgtcattgtgtggacgttaacgagtgcgagactctgcagggcgtttgcggagcggcactgtgcgaaaatgtagaaggatcttttctctgcgtctgccccaactcccccgaagaattcgatcctatgaccggaaggtgtgtaccgcctcgcacttctgcagggactttccctgggagtcagccacaagcacctgcatcacccgtgctgccagcacggcctcccccaccacccctgccacgaagaccctccactccgcggcaagggcctgtaggttcagggcgtcgcgagtgttactttgacaccgccgcccctgatgcctgtgataacatccttgctagaaatgtcacttggcaggaatgctgctgcaccgtcggcgagggatggggaagtgggtgtagaatccaacagtgtccgggcacagaaactgccgaatatcaatcactgtgccctcacgggagaggatatttggccccttcgggggacttgtcattaaggagggatgtggatgagtgtcagcttttccgggaccaagtatgtaaatctggagtttgtgtcaacacagctcctgggtactcttgttattgttcgaacggctattactatcacacccagcgcctagagtgcatcgataacgatgagtgtgcagatgaggagcctgcgtgcgaaggcggtcgttgtgtgaataccgtggggtcctatcattgcacctgcgagcccccactggtgttagatggcagtcagaggaggtgcgtctcaaatgagagccagagtctggacgataacctcggagtgtgttggcaggaagtcggggccgacctggtctgtagtcacccacgcctggataggcaggccacttatacagagtgttgctgtctctacggcgaggcctggggaatggattgcgccttgtgtccggcccaggactcggacgacttcgaggccctgtgtaacgtgctgcgaccgcctgcctactctcccccgaggccaggaggatttgggctgccttacgaatatggcccggacttgggaccaccatatcaaggcctcccttacggacccgagctgtatccaccgccagccttaccatacgacccctaccccccgccaccgggcccctttgcaaggagagaggccccatacggcgcaccacgctttgatatgcccgattttgaggacgatggggggccttacggcgagtcagaggcccctgctccccctgggccaggaaccaggtggccctatcgcagcagagataccagacggagtttcccagagcccgaggaacctcccgagggagggtcctacgccggatctctcgctgagccctatgaagagttggaggctgaagagtgcgggatcctggatggatgtactaatggtaggtgtgtgcgcgtacctgagggcttcacatgccgatgcttcgatggttaccggctcgacatgacgcgaatggcctgcgtagacattaatgagtgtgacgaggccgaggcagctagtcccctttgcgtgaatgccagatgtctgaacacagatggtagctttcgttgcatctgccggccagggtttgctcccacccaccaaccacatcattgtgcaccagcccgtccaagagcatag

SEQ ID NO: 192775 - DNA, 2700 bp, Artificial Sequence
  Description of Artificial Sequence: Synthetic coding sequence
atgtgccagcggaacccccaggtgtgcggccccggccggtgcatctcacggccttccggctacacttgcgcttgtgattcagggttccgtctgagtcctcagggcacccggtgtattgatgtagatgagtgtcgtcgggtgccccccccatgtgcacccggccggtgtgagaactcaccaggctcttttaggtgcgtgtgcggcccagggttccgtgctgggccccgggccgccgagtgcctggatgttgatgaatgccaccgagtgccacccccttgcgaccttggacggtgtgaaaacactcctgggagcttcctctgcgtttgtcctgctggctatcaagcagccccgcacggggctagttgccaggacgtggacgaatgcacccagagtccaggcctctgcggtaggggagcctgcaaaaacctgcctggatcttttagatgtgtgtgccctgcaggtttcagaggatcagcttgcgaggaagatgtggatgaatgtgcgcaagagccaccaccctgtggaccaggccgttgtgacaacactgcaggaagctttcactgtgcctgtccagctggttttcggagtagggggcccggtgccccctgccaggatgtagatgaatgcgctcgctcccctcctccatgcacttatggccgctgcgaaaataccgagggctctttccaatgcgtgtgccccatggggtttcagcctaatactgctgggagcgaatgtgaagacgtagatgagtgcgaaaatcatttagcctgccccgggcaggagtgcgtcaactcacccggatcatttcaatgccgaacttgcccatctgggcaccacctgcacaggggcaggtgcactgacgtggatgagtgttcatcaggcgctcccccctgtggccctcacggtcactgtaccaataccgaaggatcttttaggtgttcatgtgcacctggctatcgggctccaagtggtaggcctgggccttgtgcagatgtgaacgagtgcctggagggggacttctgcttcccacatggggaatgcctcaatacggacggcagttttgcatgcacatgcgcaccagggtaccggcctggtcctagaggtgcttcatgtctggacgttgatgaatgtagcgaggaggacctatgtcaatccggcatatgcacaaacaccgacgggtcctttgagtgtatatgcccaccaggtcaccgtgctggccccgatctcgctagttgtctcgatgtggatgaatgcagggagcgcggccccgcgttgtgtggatcccagcgctgcgagaattctccaggctcctaccgttgtgtgagagactgtgatcctgggtatcatgccgggcccgaaggcacatgcgatgacgtgaacgagtgcgaaacgctgcaaggggtttgcggagccgccctgtgcgaaaacgtggagggctcttttctgtgtgtctgccctaacagccccgaggagttcgaccccatgactgggaggtgcgtaccgccgcggacctccgctggaacatttccaggcagccaaccccaagcaccagcatccccagtgctgcccgcaaggccaccaccaccgccactgccaagaagaccatctacccctcggcaaggccctgtgggctctggacggcgtgagtgctattttgacaccgctgctcccgatgcctgcgacaatatccttgcccggaatgttacttggcaggagtgctgctgtaccgttggtgagggctgggggtccggctgcaggatacagcagtgtcctggtaccgaaaccgcggagtaccagtccctgtgcccccacggccgcggttacctcgctccctccggggacctaagcctgagacgggatgtggatgagtgccagctgttccgcgaccaagtgtgcaagagtggcgtgtgtgtcaataccgcacctggctactcatgctattgctctaatggttactactatcatacccagagacttgaatgcattgacaatgatgagtgcgcagatgaggagcctgcttgtgaaggtggtcggtgcgtaaataccgtaggctcatatcactgtacttgcgaacccccgctcgttctcgacggctcccaacgcagatgtgtcagcaacgaatctcagtctctggacgataaccttggcgtgtgctggcaggaggtgggcgccgatctcgtctgcagtcaccctcggctggacaggcaagcaacgtacactgaatgctgctgcctgtacggcgaggcttggggtatggactgcgcactttgtccggcccaagacagtgacgacttcgaagcgctgtgcaacgtccttcggccccccgcctatagtccgccacgccccggcggctttggcctaccctatgagtatgggcctgatttgggccccccataccagggattgccctacggccctgaactgtacccacctcctgcactgccttatgacccttaccctccccctccaggcccattcgccaggagggaggccccatacggtgcgccccggttcgatatgccagactttgaggacgacggcggaccttacggtgagtccgaagcccccgctcctcctgggcccggcaccagatggccatatcggtcacgggacacacgtaggagcttccccgagccagaggaaccgccagaggggggctcttacgccgggtccttagccgagccatatgaagaattgtag

SEQ ID NO: 192776 - DNA, 639 bp, Artificial Sequence
  Description of Artificial Sequence: Synthetic coding sequence
atgtggaccagcgccaccgcctgccggcggcgggtgaccagcggcgcagcccgaacaaggcaagcggcctcttgtgcttgcgcccccccaggcaccagactccatagaaccgagcctgctgcacgaatgtggatgtccgtgcctgaggcgccccatcccgccccgaccgccggagtgagaacacagaaagctgctagttccgtctctgctccgtgggccagtaatccgaccctgcttgctccaaacgttgacgagtgcgagaatcaccttgcatgtcctggtcaggagtgtgtcaactcccccgggtctttccagtgtagaacatgtcccagcggtcatcacctgcatcgaggccggtgtacggacgtagatgagtgctcttccggcgctcctccttgcggtccccatggtcactgcactaacacagaaggttcctttcgctgtagttgcgctccgggatatcgcgctccgtccggaagacctggcccttgtgcggatgtgaatgagtgtttggaaggcgacttctgcttcccgcatggcgaatgcctgaacacagatggcagcttcgcatgcacctgcgcccctggctataggcctggtccaagaggagccagctgcctgggaagttacccaggttag

SEQ ID NO: 192777 - DNA, 669 bp, Artificial Sequence
  Description of Artificial Sequence: Synthetic coding sequence
atggagatcccccccaccaactaccccgccagccgggccgccctggtagcacagaactacattaattatcagcaaggtacaccccatcgggtgttcgaggttcagaaagtaaaacaagcttcaatggaagatatacccggacgcgggcataagtatcatctgaagtttgctgttgaggagataattcagaaacaggtgaaggtcaattgcacggctgaagttctttatccgtctacaggtcaagaaacggcaccggaagtgaactttacttttgagggggagacaggcaaaaaccctgatgaggaggacaatacattttaccagcgtctgaaatcaatgaaggagcctctcgaggcccagaacatcccagataattttggcaacgtgtcaccagagatgactctggtcttgcatcttgcgtgggtggcgtgtggttacataatctggcagaattccacggaggatacctggtacaagatggtgaagatccagaccgtgaaacaggtgcaaagaaatgacgactttatcgagctcgattataccatcctgctgcacaacatagcctcacaggaaattatcccatggcagatgcaggtgctctggcaccctcaatacggtaccaaagtgaagcataattctagacttccaaaggaagtgcaactggaatag

SEQ ID NO: 192778 - DNA, 888 bp, Artificial Sequence
  Description of Artificial Sequence: Synthetic coding sequence
atgggcctgcccgtgagctgggccccccccgccctgtgggtgctgggttgttgtgccttacttctgtcactgtgggcattgtgcacagcctgtcgccggcccgaggacgccgtcgcgccgaggaagcgtgccagacgccaaagggccagattacagggatctgccaccgctgcggaggcttccctcctcaggagaactcacctatgcagtctgagtaaatctgatacaaggttacacgaactgcatcggggaccccgctcctctcgcgctctgcggcccgcctcaatggatcttctgcgcccccactggcttgaggtcagccgcgatatcaccggcccacaggctgctccaagcgcttttccccaccaggagctccccagagcactaccagctgctgctgctactgccggctgcgccgggctagaagctacatactcaaacgtgggtctcgccgctctccctggtgtgagcttggcggctagcccagtagtggccgaatacgcccgcgtgcagaagcgcaaggggacccataggagtccgcaggaaccacagcaaggaaagactgaggttacccctgccgctcaagtggatgtcctttacagccgcgtatgcaagcctaagagaagagaccctggacccaccaccgatcccttggaccctaagggacagggcgccatcctggctctcgccggagacctggcttaccagacattaccactgcgggccctggatgtagattcggggccactcgagaatgtatacgagtctattcgggagctgggcgaccccgcagggagatcctccacttgcggggcaggcaccccgccagccagttcctgcccctctctgggaaggggctggaggcctctccctgcatcgcttccttag

SEQ ID NO: 192779 - DNA, 324 bp, Artificial Sequence
  Description of Artificial Sequence: Synthetic coding sequence
atgggcctgcccgtgagctgggccccccccgccctgtgggtgctgggctgctgtgcccttctgctgagtttgtgggcactgtgtactgcttgtaggaggccggaggacgccgttgcaccccgcaagagagcccggaggcagagagcacggttacagggttcggccactgcggcagaggccagtctacttcgcagaacccatctgtgttccctctctaagtccgacacccggctccacgagctgcacagggggcctaggtcttctcgagccctaagacctgccagcatggacctgttgcgacctcactggttagaggtaagttag

SEQ ID NO: 192780 - DNA, 2094 bp, Artificial Sequence
  Description of Artificial Sequence: Synthetic coding sequence
atgggcgagcgggccggcagccccggcaccgaccaggagcggaaggccggtaagcatcattattcgtacctgtccgacttcgagacgcctcagtcgtctggacggagtagcctggtgtctagctccccagccagcgtgaggagaaagaaccctaaaaggcagacctcggatgggcaggtgcaccaccaggctcccaggaagccttctccaaaggggctgccaaaccgtaagggagttcgcgtgggcttccgtagtcagtccctgaatcgggagcctctcagaaaggacacggacctggtcactaaaaggatcctcagcgcaagactgctcaaaataaatgagctgcagaatgaggtgagtgagttgcaggtcaaattggcagagctcttaaaagaaaacaagtctctcaagcgattgcaatatcggcaagagaaagcattaaacaagtttgaagacgcagaaaatgaaatctcgcagctcatctttaggcacaacaacgaaatcaccgccctcaaggagcgactccgcaagtctcaggaaaaggagagagctaccgaaaagcgagttaaggatactgaatctgagcttttcaggaccaagttctcattgcaaaaactgaaggaaattagtgaggcgaggcacctgccagagagggacgatctagccaaaaaactggtaagcgcagagctgaaactggatgacaccgagaggagaatcaaggagcttagcaagaatttagaactgagcacgaattctttccagcgacagctgctggccgaacggaagcgggcctacgaggcccacgatgaaaacaaagttctccagaaagaggtccagagactctaccataaactcaaggaaaaggaacgagaacttgacattaaaaatatttatagtaatagacttcctaaatcctcccccaataaggagaaagagcttgctttaaggaaaaatgcggcatgccagagcgacttcgctgacctatgcaccaagggcgtgcagacaatggaagattttaagccagaggagtacccactcaccccagagacaattatgtgctatgaaaacaaatgggaagagccgggccatctgaccctggatctgcagtcccaaaagcaggaccgtcacggcgaggctggcatcttgaatcccatcatggagcgcgaagaaaaattcgtgactgacgaagagctgcacgtcgtgaagcaggaggtggagaagcttgaagacgagtgggagcgtgaggagctagataaaaaacagaaagaaaaggcctcgctcctggagagggaagagaagccagagtgggaaacaggaaggtatcagcttggcatgtatcctatacagaacatggacaagctgcagggtgaggaagaagagcggttgaagagagagatgctgttagctaaacttaacgagatcgatagagagcttcaagattcaagaaatcttaagtaccccgtgctgcccttactcccagattttgagagtaaactccactcgcctgagcggtcacccaagacatatagattctcggaatctagcgagaggctgttcaacggtcatcacctgcaagacatatctttctccacacccaagggcgaggggcagaactctggaaatgtccgtagccctgcgagccctaacgagttcgccttcgggtcatacgtcccctctttcgccaagacctccgagagatctaaccccttctctcagaaaagttcgtttttagattttcagcggaattctatggagaaactgagcaaagatggggtcgacttgattaccaggaaggaaaagaaggcgaatttaatggagcagctgttcggcgccagcggaagcagcacaatttcatctaaatcgtctgatccaaactctgttgcctcgtcaaagggcgatatcgatcccctgaattttctccctggcaacaaagggagccgtgatcaggaacacgatgaggacgaggggtttttcctgtcagaggggcggtctttcaatccgaaccgacaccgactcaaacatgccgatgataaacccgctgtgaaggctgcagatagcgtggaggacgagatcgaggaagtggcgttgcggtag

SEQ ID NO: 192781 - DNA, 2094 bp, Artificial Sequence
  Description of Artificial Sequence: Synthetic coding sequence
atgggcgagcgggccggcagccccggcaccgaccaggagcggaaggccggcaaacaccattacagttatctctcagatttcgagacccctcagagctccggccggtccagcctagtcagctcctctcctgccagcgttcggaggaagaaccccaagcgtcagacctcagacggacaggtccaccaccaggccccgcggaagccttctcctaaaggcctccccaatcggaaaggcgttagggtggggttccgaagtcaaagcttaaacagagagccactgcgcaaggacacagacctggtgacaaagagaattctgagcgcccggctgcttaagattaacgaacttcaaaatgaggtcagtgaactgcaggtcaagctcgcagaacttctgaaagagaacaagagccttaaaaggctgcagtacagacaggagaaagccctgaataagtttgaggacgcggagaacgaaattagccagctcatcttcagacacaacaatgagatcaccgccctgaaggagcggttgcgcaagtcacaggagaaggagcgcgcgaccgagaaacgcgtgaaagataccgagagtgagctgttccggaccaagttctccctccagaagctgaaggagataagcgaggccaggcatttgcctgagagagacgatctggcaaagaagttggtatctgctgagctgaaacttgatgacaccgaaaggaggatcaaggagctgtccaagaatctcgagctttcgactaactctttccagagacagctactcgctgagcggaaacgggcttatgaagcacatgatgagaacaaagttcttcaaaaggaggtccagcgcctttatcacaagctcaaggagaaggagagagagctggacattaagaacatttattcaaatcgtctgcccaaatcaagcccaaacaaggaaaaggagttagcactccggaagaacgcagcctgtcagagtgactttgccgatctttgcaccaaaggcgttcagaccatggaggacttcaaaccagaggaataccccctcacaccagaaacaattatgtgttatgagaacaagtgggaagagccaggacacctgacgttagatcttcagtctcaaaagcaggaccgacatggagaggccggtatcctgaatccgattatggagcgagaagagaagtttgttactgacgaagagttgcacgtcgtcaagcaagaagtagagaagctggaagatgagtgggagcgggaagagcttgacaaaaaacaaaaggaaaaagcttccttactcgaacgtgaggagaaacccgagtgggagacaggcagatatcagctgggaatgtaccccatccagaacatggataaacttcagggcgaggaggaggagcgtctgaagagggaaatgctcctagccaaacttaatgagatcgaccgcgagttgcaggactctcgcaaccttaaatatcccgtgctccctctgctcccagactttgagtctaagctccatagcccagagcggagcccaaaaacctataggttttctgaatccagcgaacgactttttaacgggcaccatctgcaggacatatcattcagtacgccgaagggggagggacagaacagcgggaacgtgcgctctcctgcatcacccaacgagtttgccttcggatcttacgtgccttccttcgccaaaacatcagagcgatccaaccccttcagccagaagtcttcatttctggacttccagcgaaatagtatggaaaaactaagtaaggatggggtggatttgataacgagaaaggaaaaaaaggctaatttgatggaacaactgtttggagcttccgggtcgtctacaatctcctccaaaagctccgacccaaattccgtagcctctagcaaaggggatattgatcccttaaactttttgcctggcaataaggggtccagggaccaggaacacgatgaggacgaaggcttcttcctgagtgaagggcgaagcttcaaccctaatagacacagactgaaacacgctgacgacaagcccgctgtaaaggcggccgacagtgtggaagacgagatagaggaagtggcccttcgctag

SEQ ID NO: 192782 - DNA, 693 bp, Artificial Sequence
  Description of Artificial Sequence: Synthetic coding sequence
atgaagaaccccatgctggaggtggtgagcctgctgctggagaagctgcttctgatctccaacttcaccctgttctcaagcggggctgccggagaagacaaggggcggaattccttctacgagacgagctcattccatagaggagacgtgctggaggtcccaagaactcatctgacccactacgggatctaccttggagacaacagagtcgcccatatgatgccagatattttgctggctctgaccgatgatatgggtaggactcaaaaggtggtctcaaacaagcggctgattctgggtgtaattgtgaaggtcgccagtatccgggtcgacactgtggaagatttcgcatatggggccaatatcctggttaaccatctagatgagtcactgcagaagaaggcattactgaacgaggaagtagcccgccgtgctgaaaaactgctgggttttacaccatacagtttattatggaacaattgtgaacatttcgttacctattgccgatacggcacccccatttccccccaatctgataagttctgcgagactgtgaaaataatcattcgagaccagaggtctgtgctggcatcggctgtgctcgggctggcctcaatcgtgtgcacagggctcgtgtcctataccaccctacctgctatctttatccccttctttctctggatggccggctag

SEQ ID NO: 192783 - DNA, 210 bp, Artificial Sequence
  Description of Artificial Sequence: Synthetic coding sequence
atgaagaaccccatgctggaggtggtgagcctgctgctggagaagctccttttgatctccaattttacgctgttctcttctggtgcggcgggcgaggataaaggccggaattccttctacgaaactagttctttccacagaggcgacgtgctcgaggtaccccggacgcatttaacccattacggaatttacctgggagacaaccgctag

SEQ ID NO: 192784 - DNA, 693 bp, Artificial Sequence
  Description of Artificial Sequence: Synthetic coding sequence
atgaagaaccccatgctggaggtggtgagcctgctgctggagaagctcctgctgatctctaacttcacactattttcttcaggcgcagccggtgaggacaaggggcgtaattcattctacgagaccagttccttccacagaggggacgtcttggaggtccctcgtactcacctaacccactatggcatctacttgggcgacaatagagtggcacacatgatgccagatatcctgctcgcactgacggacgacatgggccgaactcagaaggtggtctccaacaaacggttaatactgggcgtcatagtcaaagttgcaagcatccgcgtggacacagtggaggacttcgcatatggagccaacatattggtgaaccatctggacgaatccttgcaaaaaaaggcgctgctcaacgaggaagtggcacgacgcgcggagaagctcctggggtttacaccttattctcttctgtggaacaactgtgaacactttgtcacgtactgtcggtatgggacccccatcagtcctcagagcgacaagttttgcgaaacagtcaaaattatcatcagggaccagcgctcagtgctcgcctccgctgtgctcggcctcgccagcatcgtgtgtaccggcctcgtttcctacaccacgttgcctgccatctttatccctttctttctgtggatggccgggtag

SEQ ID NO: 192785 - DNA, 1110 bp, Artificial Sequence
  Description of Artificial Sequence: Synthetic coding sequence
atggtgtgggcccccctgggccccccccggaccgactgcctgaccttgctccatacaccctctaaagactctcccaagatgagcttagagtggttggtggcctggtcctggagcctcgacggtttacgggactgcattgccaccggtatccagtcagtgagagattgtgacaccaccgccgtgatcacagttgcctgtttactcgtgctgtttgtgtggtattgctatcatgtgggcagggaacagccacggccttatgtcagcgttaactctttaatgcaagccgcagacgccaatggcctgcagaacgggtatgtctattgtcaaagtcctgaatgcgttcggtgtacccataatgagggactgaatcagaagttataccataatctgcaggagtatgcgaaacggtatagctggtctggcatggggcgaatccacaaaggaatccgagaacagggccggtatctaaacagcagaccctcaatacaaaagccggaggtatttttcctgcctgatctcccaacaaccccttatttctctcgggatgcccagaaacatgacgtagaggtgctggagcggaactttcagacaatcctgtgcgagtttgagactctttataaggcattctccaactgctcactgcctcaggggtggaaaatgaacagcacccctagcggagagtggttcaccttctaccttgtgaaccagggcgtttgcgtgcctcgaaattgtagaaaatgccctaggacgtataggctcctcggttcactgagaacctgcatcggaaacaacgtgttcggaaacgcctgtatcagtgtcctgtcaccagggacagttattactgagcactacggaccgacaaatattcggatacggtgtcacctgggcctgaagacacccaacggctgtgagctcgtcgtgggcggggaaccccaatgctgggccgaaggacggtgtttgttatttgacgattcattccttcatgccgccttccacgaagggagtgccgaagacggccctagagtcgtcttcatggtggacttgtggcatcccaatgtggcagcagctgagcggcaggccctggacttcattttcgcccctggcagatag

SEQ ID NO: 192786 - DNA, 984 bp, Artificial Sequence
  Description of Artificial Sequence: Synthetic coding sequence
atgagccagcccagcggcggccgggcccccggcacccggatctactcgtggtcttgccctacggtgatgagccccggggagaaactggaccccattccggattcctttatcctccaaccccccgtgttccacccagtggttccctacgtgactaccatctttggtggcctccatgccggaaaaatggttatgctgcagggggtggtcccactcgacgcccatagattccaggtggatttccagtgtggatgttcactgtgccctagacccgatatagcctttcattttaacccaaggtttcataccaccaagcctcacgtgatctgtaatacattgcatggcgggcggtggcagcgcgaagctcgctggccccatctggccttgcggagaggaagttccttcttgattctctttcttttcggaaatgaagaggtgaaagtgtctgttaacgggcagcattttctccatttcagatacaggcttccactgtcacatgtagatactcttggaatcttcggcgatattctcgtcgaggctgtggggttcttgaatatcaacccgtttgtagaggggtcccgcgaataccctgctggccacgaggtgccgtgttctcatgcattgccccagggactgagcccaggtcaggtaatcatcgtcagaggcctggtgctgcaagaacctaagcactttaccgttagcctgcgcgatcaggctgcacacgctcctgtgactctgcgggcaagctttgcagataggaccttggcctggatctcccggtggggccagaagaaactgataagcgccccattcctcttttatcctcagcggttcttcgaggttctccttttgtttcaggagggcggattgaagcttgcacttaacggtcaggggctgggagctacatcaatgaaccagcaagctctcgaacagttaagagaattgcgaataagcggctccgtacaactgtactgcgtgcactcatag

SEQ ID NO: 192787 - DNA, 1014 bp, Artificial Sequence
  Description of Artificial Sequence: Synthetic coding sequence
atgagccagcccagcggcggccgggcccccggcacccggatctacagctggtcatgcccgacagtgatgtctcccggggagaaactggatcctatccctgatagcttcattctccagccccccgtctttcaccccgttgtgccctacgttaccaccatcttcggcggcctgcacgccggcaaaatggtgatgctccagggcgtagttcctctagatgctcattcacggttccaggtagacttccagtgtgggtgttctctgtgtccccgaccagatatcgccttccactttaatcccaggtttcatacaacaaaaccacacgttatttgcaatactcttcacggtgggcggtggcagagagaggcccgctggccccatctcgcactccgtagaggctctagttttctcatcctcttcttgtttggcaacgaggaggtaaaggtgtcagtcaacggacagcacttcttgcacttccggtaccgcctgccactctctcacgtcgacaccctgggaattttcggagacatcctcgttgaggccgtaggattcctcaacattaacccttttgtggagggcagccgcgaatatcctgccggacatccatttctgcttatgagtcctagactggaggtgccttgtagccatgccttaccgcaaggattgtctcccgggcaagttataatcgtccggggcttagtgctgcaggagcctaaacacttcaccgtttcacttcgtgaccaggccgctcacgctcccgtgactctcagggcctccttcgccgaccggactcttgcctggatctctcggtgggggcagaagaagttgataagcgcccctttcttgttttatccgcagcgcttttttgaggtgctcttgttattccaggaagggggtctgaagcttgccctaaatggccagggactgggggctacgtcaatgaaccagcaggcacttgagcaattaagagaactccggataagtggtagcgtgcaactgtactgcgtccacagctag

SEQ ID NO: 192788 - DNA, 1011 bp, Artificial Sequence
  Description of Artificial Sequence: Synthetic coding sequence
atgagccagcccagcggcggccgggcccccggcacccggatctacagctggtcctgtcctactgtgatgtcccctggtgagaagctggacccaattcctgattcatttatcctccagcctcccgtattccatcccgtagtcccgtatgtgactacgatttttggagggctacatgccggcaagatggtgatgctgcaaggcgtcgtgccactggacgctcacagatttcaagtggatttccaatgtggctgcagtctgtgtcctcggccagatatcgcattccacttcaatcctcgttttcacactactaaaccacacgtcatttgtaacacacttcatggtgggcgctggcagcgggaagcaaggtggccgcatctggcattgcggcgtggatcgtctttcctgatcctgtttcttttcgggaatgaagaagtgaaagtgtctgtgaacgggcagcatttcctgcatttccggtatagactgcccctcagccatgttgacactctaggcatttttggagatattctggtggaagccgtgggatttcttaatatcaatccatttgtggaaggatcaagagagtatccagctgggcacccctttctgctaatgtccccacggcttgaggttccatgttcacatgcactgccacaaggactgagtccagggcaggtaattatcgtgcgtggccttgtactgcaggagccaaaacactttaccgtcagcttgcgagaccaggccgctcatgcccccgtgactctgcgcgcatcttttgccgatagaacactggcttggataagccgctggggtcaaaagaaactcatctcagccccatttctcttctacccccaaagattctttgaggtgttacttctctttcaggagggcggccttaaattggcactcaacggtcagggccttggtgcgactagtatgaaccaacaggccctcgagcaactgagggagttgcgaatttcaggctccgttcaactttactgcgtacatagctag

SEQ ID NO: 192789 - DNA, 828 bp, Artificial Sequence
  Description of Artificial Sequence: Synthetic coding sequence
atggtgatgctgcagggcgtggtgcccctggacgcccaccggttccaggtcgacttccagtgtggttgcagcctgtgccccagaccagacatagcgttccactttaacccacgctttcatacaacaaagccacacgtgatttgcaacaccctacatggcggccggtggcaacgggaagcccgatggcctcatctggccctcaggcgaggcagcagctttctcatcctgttcctgtttggcaatgaggaggtgaaagtgtcggtgaacggacaacacttcctacatttcagataccgcctccctctcagccacgtagatacacttggcattttcggcgatattttagttgaggctgtgggtttcctgaatataaatccctttgttgaaggctctagagagtaccctgccggtcacccattcttgctgatgtcgccgcgactcgaagttccttgttcacacgctctaccacagggactgtcaccgggccaagtgatcatcgtgagagggctggtgctgcaggagcccaagcattttaccgtgagtctcagggatcaggccgcacatgctcccgtgaccctgagggcttcattcgccgatagaactctcgcttggatatctagatggggacagaaaaagcttatttccgctcccttcctgttttatcctcagagattttttgaagttttgctactatttcaggagggaggcctgaagctggcactgaatgggcaaggcctgggggcaacctcaatgaatcaacaggcacttgagcagctgcgcgagctgcgcatctcaggatctgtgcagttatattgtgtgcattcgtag

SEQ ID NO: 192790 - DNA, 801 bp, Artificial Sequence
  Description of Artificial Sequence: Synthetic coding sequence
atggtgatgctgcagggcgtggtgcccctggacgcccaccggttccaggttgatttccagtgcggatgctcgctatgtcctagaccagacatcgcctttcatttcaatccgcgtttccacaccacaaagccacatgtgatatgcaatacactgcacggagggcgttggcagagagaggcgcgatggccccatctcgccctacgacgggggtcaagctttctgattttgttcttatttggaaacgaggaggtaaaggtgagtgtgaacggacagcacttcttacattttaggtaccgcctacccctttcgcacgttgacactcttgggatctttggcgatatcttagtagaggcagtggggttccttaatattaatccattcgtggagggtagcagagagtaccctgccggccatgaggtaccgtgttctcatgctctgccacaaggcctcagtcctggtcaagttataatagtccgcggattggtgctgcaggagcccaagcacttcacagtaagtctccgtgatcaggcagcacatgctccagtcactctccgcgctagctttgccgatcgcacacttgcctggatttcccggtggggtcaaaagaaactgattagcgcaccctttctgttctatccacagcgtttctttgaggttttgcttctcttccaggagggcggactgaagctagccctaaacggtcagggactgggagccacaagcatgaatcaacaagccctggagcagctgcgtgagctgcgtattagcggttctgtgcagctgtactgcgtccacagttag

SEQ ID NO: 192791 - DNA, 378 bp, Artificial Sequence
  Description of Artificial Sequence: Synthetic coding sequence
atggccgacgaggagctggaggccctgcggcggcagcggctggccgagctgcaagctaaacacggagaccctggcgatgctgctcagcaggaggcaaagcatagagaagcggaaatgcgaaatagtatcctcgctcaagtgctcgaccagtccgctcgggcccgcctgtcaaatctcgcgctcgtgaaacctgagaaaacaaaggccgtggagaactatctgatacagatggcgcgttacggacagctgagcgaaaaagtgagcgagcagggtctgatcgagatccttaagaaggtgtctcagcagactgagaagactactactgttaaattcaacaggaggaaagtgatggattccgacgaggacgatgactattag

SEQ ID NO: 192792 - DNA, 1530 bp, Artificial Sequence
  Description of Artificial Sequence: Synthetic coding sequence
atgggcgtgcaggccggcctgttcggcatgctgggcttcctgggcgttgctctcggcgggtcgcctgccctcagatggtatcgcactagctgccacctgaccaaagccgtgcccggaaatcccctaggttatctgtctttcctagcaaaggacgcacagggactggccctcattcatgcccggtgggatgcgcacagaaggctgcagagctgtagctgggaggacgaaccggaactgactgccgcctacggcgccctatgcgcccacgagacagcctggggctcttttatacacacccccggcccagagcttcaacgtgccctagccactcttcaaagccagtgggaggcttgtcgcgccctcgaggagtctccagctggcgcgagaaagaagcgagccgccggacagagcggcgtgcccggcggcggtcatcaacgggagaaacgaggatggactatgccaggcactctgtggtgcggagttggcgatagcgcaggtaattctagtgagctgggtgtcttccagggccccgatttatgttgtagggaacacgacagatgtccacagaatatttcccccttgcagtataattatggaattcggaattaccgtttccacactatatcacattgcgattgcgacacaagattccagcagtgccttcaaaatcagcatgatagtatctctgacatagtgggtgtggcatttttcaacgtactggaaattccctgctttgtgctggaagaacaggaagcctgtgtcgcgtggtactggtggggcggttgccgtatgtatgggacagtgcccctcgcccgactgcagcctcgcactttctataacgcaagctggagttctagggcaaccagccccaccccttcctcaaggtctcccgcccccccaaaacctcggcagaagcagcaccttagaaaaggaccaccgcatcagaagggatcaaaacggccttcgaaggccaatacgacagccctgcaggacccaatggttagcccaaggctggacgtcgcccctaccgggctccagggccctcaggggggtctgaagcctcagggagctaggtgggtctgtaggagtttcaggaggcatcttgaccagtgtgaacaccagatagggcccagggagattgagtttcagttactgaacagcgctcaagagcctctttttcattgtaattgcaccaggcggctggcacggtttttgcgtctccacagccctcctgaggtaacgaacatgctgtgggagctgttgggtaccacatgcttcaaactggctcctccactcgattgcgtcgaaggtaaaaactgctcaagagaccccagagccatacgagtgagcgccaggcacctgcggcgactgcaacagcgccggcatcaactacaggacaagggaaccgacgagaggcaaccatggccctctgaaccgctccgagggcccatgtcgttttataaccagtgcctccagcttactcaagcagctaggagacctgacaggcagcagaagagctggtcacagtag

SEQ ID NO: 192793 - DNA, 93 bp, Artificial Sequence
  Description of Artificial Sequence: Synthetic coding sequence
atgaccggcgagctggaggtgaagaacatggacatgaagcccggctccactttgaaaattactggttcaatcgctgacggcacggatggttag

SEQ ID NO: 192794 - DNA, 1758 bp, Artificial Sequence
  Description of Artificial Sequence: Synthetic coding sequence
atgacccccccccggctgttctgggtgtggctgctggtggccggcacacagggagtgaatgatggggacatgcggctggccgacggaggcgccaccaaccagggccgtgtggagatattctatcgaggccagtggggtacggtgtgcgataacttgtgggatctgactgacgctagtgtcgtgtgcagagccctcggttttgagaatgccacccaggctctgggtcgcgccgcattcgggcaaggcagtggccccatcatgcttgatgaggtgcaatgcacggggacagaggcttccctggccgattgtaagagcctgggctggctgaagtcaaactgtcgccatgaaagagatgcaggggtcgtgtgcacaaacgaaactcgcagcacccacacactggatctctcacgggagctatctgaagcactaggccaaatcttcgactcccagcgagggtgtgatctcagcatatccgtaaacgtgcaaggggaggacgcgttagggttctgcggtcacacagtaatcttaacagctaacctggaagcccaagctctatggaaggaaccaggctcgaatgtcaccatgtctgttgacgccgagtgcgtcccaatggtgcgcgacttgctgcgatatttttatagtcgccgaattgatattaccctctcctcagtcaagtgcttccacaagctggcatctgcatatggtgctagacagttgcagggttattgtgcatccttgtttgctatcctgctgccccaggaccctagtttccagatgcctttggatctctatgcttatgccgtggcgacaggtgacgccctgctcgaaaagctctgtctgcagttcctggcatggaattttgaggccttaactcaggctgaggcttggccctctgtccccactgatctgctgcagcttctgctgcccagatcagacctcgctgtgccctccgagctcgcattgctgaaggcagtggacacctggagctggggagagagggctagtcatgaagaagttgagggtctcgtcgaaaagatcaggttcccaatgatgctccctgaagaactgttcgaactgcaatttaatcttagcctgtattggagtcatgaagctttatttcagaagaagacactgcaggcacttgagtttcatactgtgcctttccagcttcttgctaggtacaaaggccttaacttaacagaggatacatataagccacggatatacacatctccaacttggtctgcctttgtcaccgatagttcttggagcgcacggaaatctcaactcgtgtaccagtcaagacgaggccccctcgtcaagtacagctccgactactttcaggcaccaagcgactacagatattacccctatcagtcatttcagacgccccagcacccgtccttcctgtttcaggacaagagggtctcctggtcactggtttacctacccaccattcagtcctgctggaactacggcttctcctgttcttcggatgaactgcccgtcttgggactgaccaaaagtgggggttccgatcggaccatcgcctacgaaaacaaagcattaatgctctgcgaagggctttttgtggctgatgtgaccgatttcgaaggatggaaagccgccataccaagcgctctcgacacaaacagctctaagagtacctcctcatttccctgccctgctggccatttcaatggctttcgtacggtaattaggcccttctatctaactaattcatccggcgttgactag

SEQ ID NO: 192795 - DNA, 1722 bp, Artificial Sequence
  Description of Artificial Sequence: Synthetic coding sequence
atgacccccccccggctgttctgggtgtggctgctggtggccggcactcagggcgtgaacgacggagatatgaggcttgcagacggcggagccacgaatcaaggacgcgtagagatcttttaccgcggccaatggggcacagtctgcgataatctctgggatctgaccgacgcaagtgtggtatgtagagccctcggatttgagaacgccacccaggctctgggacgggccgccttcggacagggatcagggcccatcatgttagctgattgcaaatctttgggatggctcaagtcaaattgccgccacgagcgggatgcgggtgtggtgtgtacaaatgagactcgctctactcataccctcgacctgtcccgagaactatcagaggccctgggccagatcttcgatagccagcgcggttgcgacctgagcatctctgtgaacgtgcagggtgaggacgctctagggttctgtggacacactgtcatactgactgcaaacctggaagctcaggccctgtggaaagagcctggttccaatgttactatgtcagtcgatgcagaatgcgtgccgatggtccgcgatctgctgaggtacttctactcgcggcgcattgatatcaccctctcctccgtcaaatgttttcataagttggccagcgcctatggtgcacggcaactccagggatattgcgcatcactcttcgccatccttttaccccaggaccccagctttcagatgcctctggacctttacgcatatgccgtggccactggggatgcactactggaaaagttgtgcctgcagttcctagcctggaattttgaagccctgacacaggccgaggcatggccatcagtgcctaccgatctgctccagctgctcctgccacgcagtgacctcgccgtgccctcagaactggccttgctcaaagcagtcgatacctggtcatggggtgagcgggcgtcccacgaggaagttgagggccttgtggagaagatcagatttccaatgatgctccccgaagaacttttcgaactgcagttcaatttgtcactgtattggtcccacgaagctcttttccagaaaaaaacgcttcaagcactcgaatttcatacagtgcctttccagctcctggcaaggtataaggggctcaacctcacagaagacacctataagccccgcatctataccagccccacctggtccgctttcgtcacagactccagctggagcgcgcggaagtctcaattagtttaccagtcacggcgcggtccgctggttaaatattcatctgattattttcaggccccaagcgactacagatattatccctatcaatcatttcagacccctcagcacccatcttttttgttccaagacaagagggtgtcgtggtctctcgtttatctgccaacaatccagagctgctggaattacggctttagttgtagttctgacgagttaccggtgctgggtttaaccaagagtggaggcagtgacaggaccatagcctatgagaacaaggcacttatgttatgtgaggggctcttcgtggccgacgtcactgacttcgagggttggaaagccgctatacctagcgcgcttgacaccaatagctccaagagcaccagtagttttccctgtccggcaggacacttcaacggcttccggacagtgatccggccattctatctgaccaacagctccggggtcgactag

SEQ ID NO: 192796 - DNA, 411 bp, Artificial Sequence
  Description of Artificial Sequence: Synthetic coding sequence
atgagcaacgtgccccacaagagcagcctgcccgagggcatccggcccggtaccgtcctgcgaatacgcggactggtgcctcccaatgcaagccggttccacgtgaacctgctgtgtggcgaggagcaagggtcggacgctgccctccactttaatccccgcctggacacaagcgaggtcgtgtttaactccaaagagcagggatcctgggggcgagaggaacgtggtccgggtgtcccattccagcgcggccagccttttgaagtgctcatcatcgcaagcgacgatggcttcaaggctgtggtaggggatgcacagtatcatcattttcgccacaggctgcctctcgcgcgcgtccgcctcgtggaggtcgggggggacgtccagttggactccgtacggatattttag

SEQ ID NO: 192797 - DNA, 954 bp, Artificial Sequence
  Description of Artificial Sequence: Synthetic coding sequence
atgatgctgagcctgaacaacctgcagaacatcatctacaaccccgtcataccattcgttggcaccattcctgatcaactggatcctggcactctgatcgtaattagaggacacgtgccgtccgacgcagatcgattccaggttgatttacagaatgggagcagtatgaagccccgtgcggacgtggcatttcattttaaccctcggtttaagcgcgcaggatgtattgtgtgcaataccttgatcaacgagaagtggggaagagaggagattacatacgacacgccttttaaacgtgaaaaatccttcgagatcgtaatcatggtgctcaaagacaagtttcaagtggccgtgaacgggaagcatacccttctgtacggacatcggatcgggcctgaaaagattgataccctaggtatttacggaaaggtgaatatacactctattggattctccttcagttcggatctacagtctacccaggcctcttccctggaactgaccgagatatctagggagaacgttccaaagagtgggacccctcagctacggctccccttcgcggctcgtctgaacacccctatgggccctggcagaacggtggtagttaagggggaggtgaatgccaatgctaaaagctttaatgtggatctgttagctggtaagtcaaaagatatcgctcttcaccttaatcctaggttgaatataaaggccttcgtgagaaacagttttctccaggagtcttggggggaggaggagcggaatatcacaagcttcccctttagccctggtatgtattttgagatgattatatactgcgacgtgcgtgagtttaaagttgccgtgaatggtgttcatagtctggaatataaacatagattcaaggagttgtccagcatcgatacattagaaattaacggtgatatccacttgctggaggtgaggagctggtag

SEQ ID NO: 192798 - DNA, 1080 bp, Artificial Sequence
  Description of Artificial Sequence: Synthetic coding sequence
atgatgctgagcctgaacaacctgcagaacatcatctacaaccccgtgatccccttcgttggcactataccagatcagctggatcccggaaccttaatcgtgattcgcgggcacgtgccttccgatgcagatcggtttcaggtcgatctccaaaatggctctagcatgaagccccgcgctgacgtcgcatttcactttaatccaagattcaagcgagcaggctgtattgtatgcaacactctcattaacgagaagtggggacgggaggagatcacttacgacactccctttaagcgggaaaaatcatttgaaattgttatcatggtgcttaaggataaatttcaggtggcggtcaacgggaaacatacccttctgtatggtcaccgcatagggccagaaaaaattgacacactgggcatttacggaaaggtgaatattcattccatcggattctccttctcatcagatctgcagtccacccaggctagctctcttgagcttaccgaaattagccgcgagaatgtccccaagtctggtactcctcaacttccttccaaccggggaggcgacatctccaagatagcacctcgtactgtctatacgaaatcaaaggattccacggtcaatcacacacttacttgcaccaaaattccccccatgaactatgtctcgaaacggctacctttcgctgctagactcaatacgcccatgggcccgggacgcaccgtggtggtcaaaggagaggtgaacgccaacgcaaagagcttcaatgttgacctgttagcagggaagtcgaaggatatagcactccacctgaaccctcgtctaaatattaaagcctttgtgcggaacagcttcctccaggagtcatggggggaagaggagaggaatatcacatcattcccattttcccccggtatgtactttgaaatgatcatctactgcgatgttagggagtttaaagtcgctgttaatggtgtgcacagcctggagtacaagcaccgctttaaggaactgagctcaatagataccctcgagatcaatggagatattcacctgctggaggtaaggagctggtag

SEQ ID NO: 192799 - DNA, 1077 bp, Artificial Sequence
  Description of Artificial Sequence: Synthetic coding sequence
atgatgctgagcctgaacaacctgcagaacatcatctacaaccccgtgattcctttcgtgggcaccatcccagaccaattggaccccggaactttgattgtgatccgtggacatgtgccttctgatgctgatagatttcaagtggacctccaaaacgggtcttccatgaaacctcgagccgacgttgcgtttcatttcaatccaagattcaagcgcgcgggctgtatcgtgtgcaacacactgattaacgagaagtgggggcgggaagagattacctatgatacaccattcaaaagagagaaatccttcgaaattgtgattatggtcctgaaggataagtttcaggtcgcagtgaatggcaagcacactttgctctatggtcacaggattggccctgagaagatcgacactttggggatctacgggaaagtaaacattcatagtattggcttcagtttttcaagtgacttacagtcgacacaggccagcagcctcgagttgacggagatcagccgcgagaacgtgccaaaatcgggcacacctcagcttagacttagtttgccttcttgggatctgcaaggccatggatcggaaaccttccgttctgtattatggacgcgcgtgttcgagattgccttctgtcggcccctgggaacagtggcaagcttccagaggttgccatttgctgccaggttaaacacccccatgggcccgggccggaccgtggtggtgaaaggcgaggtgaacgctaatgcaaagagttttaacgtcgacctgctcgcaggcaagagtaaggacatcgctctccatctcaaccctcgtctaaacatcaaagccttcgtccgaaacagtttcctgcaggaatcttggggcgaagaggagcgaaatataaccagtttcccattttcgcctggcatgtacttcgagatgattatttattgtgatgtcagagagtttaaggttgccgtcaacggggtccactctctcgagtacaagcaccgcttcaaggaattgtcttccatcgatacacttgagattaatggcgatatacacctcctggaggtccgtagctggtag

SEQ ID NO: 192800 - DNA, 954 bp, Artificial Sequence
  Description of Artificial Sequence: Synthetic coding sequence
atgatgctgagcctgaacaacctgcagaacatcatctacaaccccgtaatccccttcgtggggacaatccccgatcaactggacccaggcaccctgatcgtaatcaggggccacgtcccatcagacgctgatcgctttcaggttgacctgcagaatggatctagcatgaagccgagagcagatgttgcattccacttcaatccccggttcaagagggctggatgtattgtgtgtaacactctcattaacgagaagtggggccgcgaggaaatcacctacgacacgcctttcaaacgagaaaagtcattcgagatagtgataatggtgctcaaggataaattccaggtggccgtaaatgggaaacacacactgctgtacgggcaccggatagggccagaaaagatcgatactctgggaatctacgggaaagtcaatattcactcaattggttttagcttttcatcagacctgcagagtacacaggcatcttcacttgaactgacagagatcagcagagagaatgtgccgaagtcgggcacaccacagctcagattgccattcgcggctcggcttaacacgcccatggggcctggtagaaccgtggtggtgaagggggaggtgaacgccaacgccaaatccttcaacgtggatctgctggccgggaagagcaaggacattgctttgcatctcaaccccaggttgaacattaaggcatttgtgcgcaatagcttcctgcaggaaagctggggcgaagaggaaaggaatatcaccagtttcccattctcccctggtatgtattttgagatgatcatctattgtgacgtgagagagttcaaagtggcggttaacggtgtgcattccctcgaatataagcaccggttcaaggagctgtcttctattgacacactggaaatcaacggcgacatccatctcctggaagtcaggtcctggtag

SEQ ID NO: 192801 - DNA, 627 bp, Artificial Sequence
  Description of Artificial Sequence: Synthetic coding sequence
atgatgctgagcctgaacaacctgcagaacatcatctacaaccccgtgattccattcgtcggcactatacctgatcagctcgaccctgggacgctgattgtgataagagggcatgtgccgagcgatgccgacagatttcaagtggacctccagaacggttcttcaatgaagccccgagcagatgtggccttccactttaatccacgctttaaacgggccggatgcatagtctgtaacacactcatcaatgagaaatggggcagggaggagattacatatgacacacccttcaagagggaaaagagcttcgagatcgtcattatggtactcaaggataaatttcaggttgccgtcaatgggaaacataccctgttgtatggccacagaatcggtcctgagaaaattgataccctgggcatttacgggaaggtgaatatccacagtatcggttttagttttagctctgacttgcagtcgacccaggcctcttccctcgagctgacagagatctctcgggagaacgtgcccaaatctggtaccccacagcttccctccaacaggggcggcgacatcagcaaaattgctccccggactgtatacacaaaatctaaagacagtaccgtatag

SEQ ID NO: 192802 - DNA, 903 bp, Artificial Sequence
  Description of Artificial Sequence: Synthetic coding sequence
atgatgctgagcctgaacaacctgcagaacatcatctacaaccccgtgattcctttcgtggggactattcccgaccaactggatcccgggaccctaattgtgattaggggacacgtgccctctgacgcagataggttccaggttgatctccagaacgggagcagcatgaaacctagagccgacgtcgcctttcacttcaacccaagattcaagcgagccgggtgtatcgtctgtaatacgctgatcaacgagaaatggggtagggaggagataacatatgacacgccctttaaacgggaaaagagttttgagattgtgatcatggtgctgaaggacaaattccaggtccctaagtccgggacaccccagcttccctccaaccggggcggcgatatctctaagatcgctccaagaaccgtctatactaaaagcaaagattccactgtcaatcacacattaacctgtactaagataccacctatgaactacgtttccaagcgcctcccttttgctgcccgattgaatacgccaatgggacccggaagaactgtggtagtcaagggggaggttaatgccaatgccaagtccttcaatgtagaccttctggcgggaaaaagtaaagacattgcacttcatctcaacccaaggctgaatattaaggccttcgtccggaacagttttctccaggaaagctggggagaggaggagaggaatattacatcatttccattttcacccgggatgtacttcgaaatgataatctattgcgatgtgagggaatttaaggttgccgtgaacggtgtacactccttagaatacaagcatagattcaaggaattgtcctccattgacaccctggagattaatggggatatccacctgctggaggtgcgctcctggtag

SEQ ID NO: 192803 - DNA, 1080 bp, Artificial Sequence
  Description of Artificial Sequence: Synthetic coding sequence
atgatgctgagcctgaacaacctgcagaacatcatctacaaccccgtcattccttttgtgggcaccattcccgatcagttggatcctgggacactaatcgtcatccgtggtcatgtacctagcgatgccgatcgtttccaggtggatttgcagaatggctcatctatgaagccacgcgcggatgtggctttccatttcaacccacgctttaaacgtgccggatgcatcgtatgtaacacccttatcaacgaaaaatggggacgagaagagatcacctacgatacgccatttaaacgtgagaagagcttcgagatagtcatcatggtactgaaagacaagtttcaggtagccgtcaacggtaagcatacgcttttatatggccatcgaatcggacccgagaagatcgacactctgggaatttatggaaaagtcaacatacacagtattggttttagcttcagcagcgatctacagtccactcaggcctcatccctagagctcactgagatcagcagggaaaatgtgcccaagtccgggaccccacagctaccttcaaacagaggtggcgacatcagtaaaatagccccccgaacagtgtatacaaaatccaaagactcaacagtaaaccacacattgacatgtactaagatcccacccatgaactacgtctctaagagactgccattcgccgcccggctgaatactcccatgggcccaggccgcactgtggtggttaagggcgaggtgaacgcaaatgccaagtcatttaacgttgacctcctggcaggcaagtctaaggacatcgccctccacctcaatccaaggctcaatatcaaggcttttgtgagaaattcttttctgcaggagtcctggggcgaggaagagcgaaacattacttcttttccattctcccctggtatgtactttgaaatgattatatattgcgacgtgagagaattcaaagtagctgtgaacggggttcacagcttggagtataaacaccgattcaaggagttgtcctcgattgacaccctggagatcaatggggacatacatctactggaggtgcgaagttggtag

SEQ ID NO: 192804 - DNA, 507 bp, Artificial Sequence
  Description of Artificial Sequence: Synthetic coding sequence
atgatgctgagcctgaacaacctgcagaacatcatctacaaccccgtgataccatttgtgggaacaatccccgatcagctggatcccggaactctgattgtgatccgtggacatgtgcccagcgatgcggaccgctttcaggttgatctccagaatggctcgagtatgaagccccgggcagacgtggctttccacttcaacccgcgctttaagcgggccgggtgcattgtctgcaatactctaataaacgagaaatgggggagggaggagatcacctacgacacaccttttaagagagagaaatccttcgaaatcgtgataatggttctgaaggacaagttccaagtcgccgtaaatggcaagcacacactgctgtacggacaccggataggccccgagaagattgacacactcggtatctatggaaaagtgaatatacactcaataggcttcagcttctcctccgacttgcagtcaacccaagcttcctcactggagttgacatag

SEQ ID NO: 192805 - DNA, 321 bp, Artificial Sequence
  Description of Artificial Sequence: Synthetic coding sequence
atgatgctgagcctgaacaacctgcagaacatcatctacaaccccgttatcccgttcgtggggaccattccagatcaactggaccctggtaccctcatcgtgattaggggccacgtgccttccgacgccgatcggtttcaagttgatttgcaaaacgggtccagcatgaaaccaagggccgatgtagcttttcatttcaaccctaggtttaaaagagcgggatgtatagtgtgcaacacactcattaatgagaagtggggaagagaggaaatcacgtatgacaccccatttaagcgcgagaagtcattcgagatcgtgtag

SEQ ID NO: 192806 - DNA, 1080 bp, Artificial Sequence
  Description of Artificial Sequence: Synthetic coding sequence
atgatgctgagcctgaacaacctgcagaacatcatctacaaccccgtgatcccttttgttggcaccattcctgatcagttggacccaggtactctgatcgtgatcaggggccacgtaccttccgatgcagaccgcttccaggtagatttgcaaaatggcagcagcatgaaaccacgggctgacgtggcatttcacttcaaccctagattcaagcgcgctggttgcattgtttgcaacactcttattaatgagaagtgggggcgcgaggaaattacctatgatacaccattcaaacgagagaaaagtttcgagattgttattatggttttgaaagataaatttcaagtggccgtgaacggaaaacatacacttctgtatgggcaccgcatcggtccagagaagatagacacattagggatttacgggaaagtcaatatccattccattggattttcttttagcagtgacctccagagtacacaagcctctagtcttgagctgaccgagatctccagagagaatgtccccaaatccggcaccccccaactgccttctaaccgaggaggtgatatttccaagattgctcccaggacagtctataccaagagcaaagactctacggtgaatcacacactgacctgcactaagatccctcctatgaactatgtatcaaagcgcctaccattcgcggctaggctgaatacacccatgggacctggccggactgtggttgtgaaaggagaagttaatgccaacgctaagtctttcaacgtggatctgctggccggaaaaagcaaagatatagcccttcatctgaaccctagacttaacattaaggccttcgtgcgaaactcttttttacaagagtcatggggggaagaggaacgtaatatcacctccttccctttttctcctggaatgtactttgagatgataatttattgtgatgttagagaatttaaagtcgccgtgaatggtgtgcatagtctcgagtacaaacacagattcaaggaactttctagtattgatactctggagataaacggagacatccacctattagaggtgaggtcttggtag

SEQ ID NO: 192807 - DNA, 954 bp, Artificial Sequence
  Description of Artificial Sequence: Synthetic coding sequence
atgatgctgagcctgaacaacctgcagaacatcatctacaaccccgtgattccgtttgttggaaccattcccgaccaactggatcctgggacactgatcgtgattcgaggacacgtcccttccgatgccgaccgttttcaggtggatttgcagaacggatcgtccatgaagcctcgtgccgacgtggcattccacttcaacccgcggttcaagcgtgctggctgtattgtgtgcaatactctgatcaatgaaaagtggggtcgggaggagattacatacgatacacccttcaaacgcgaaaagtcctttgagatagtgatcatggtgcttaaagacaaattccaggtggccgtgaacggaaaacacactctgctgtatggtcatagaattggacctgaaaaaatagacaccctcggaatctacggaaaggtaaacatccattcaattggtttctccttttccagcgacctgcagtccacccaggccagctccctggagctcaccgaaataagcagagagaatgtgccaaaatcaggcacaccccagctgcgactgccctttgcggcccggctgaatactccaatgggtccaggtagaaccgtggtagtgaaaggagaggtgaacgccaacgccaagtcatttaacgttgaccttctggcgggcaaatcaaaggacatcgctctccatttaaacccgcgcctcaatatcaaggctttcgtgcgaaattcctttctccaggaaagctggggggaggaagaacgcaatataacgagcttccccttctcccccggcatgtacttcgagatgattatctactgtgatgttagagagtttaaggttgctgttaatggggtccactcccttgagtataagcataggttcaaggaactctcatccatcgataccctggaaattaatggagatattcacctcttagaagttcgcagttggtag

SEQ ID NO: 192808 - DNA, 1080 bp, Artificial Sequence
  Description of Artificial Sequence: Synthetic coding sequence
atgatgctgagcctgaacaacctgcagaacatcatctacaaccccgtgatcccatttgtcgggacaataccagaccagcttgacccaggcaccctcatcgtgatcagagggcacgttccatccgatgcagaccggttccaggtagaccttcagaatgggtcttccatgaagcctcgggccgacgttgctttccacttcaatcctagattcaagcgggccggctgcatcgtatgtaatactctgatcaacgaaaagtggggccgtgaagagattacctacgacacaccttttaaacgcgaaaagtctttcgagatagttattatggttttaaaggataaatttcaggtggccgttaatgggaaacacactctgctttatggccaccgcattggacctgaaaagatcgacactctcggaatttacgggaaggtaaacattcattcgatcggattctcctttagctccgatttgcagagtacccaagccagcagcctcgaactgacagaaatttcaagggaaaacgtgccaaaaagtggcacaccacaactgccttccaatagaggtggggacatctcaaagattgcgccccggacagtgtacaccaaaagcaaggattctaccgtgaaccataccctcacctgcactaagatcccccccatgaactacgtgtccaaacgactgcccttcgccgcgcggctgaacactcctatgggcccaggccgcactgttgtagtgaagggggaagtcaacgctaacgctaagagttttaacgtggacctgctcgccggtaaatctaaagacattgctctacacctcaaccccaggctcaacatcaaggcgttcgttagaaactcattcttgcaggaaagttggggtgaagaggagcgcaacatcacgtcatttccattctcgcccggaatgtattttgagatgatcatctattgcgacgtgcgcgagtttaaggtggctgtgaatggggtccactcactggaatataagcatcgcttcaaagaactgtcctctatagacactctggagataaatggggacattcatctgctcgaggtacgctcttggtag

SEQ ID NO: 192809 - DNA, 132 bp, Artificial Sequence
  Description of Artificial Sequence: Synthetic coding sequence
atgatgctgagcctgaacaacctgcagaacatcatctacaaccccgtaattccttttgttggaaccatccccgatcaactggaccccggtacactcatagttattcgtggccacgtgccaagcgacgcatag

SEQ ID NO: 192810 - DNA, 972 bp, Artificial Sequence
  Description of Artificial Sequence: Synthetic coding sequence
atggccttcagcggcagccaggccccctacctgagccccgccgtgccattttcaggtacaatccagggaggtctccaggacggtctccaaattaccgtaaacggaacagtgctgtcatctagcggcaccaggttcgccgtgaactttcagactggtttttcaggcaatgatatagccttccatttcaatcctcggttcgaagacggaggctacgtggtctgtaacactcgccagaacggaagctggggacccgaagaacgcaaaacacacatgcctttccagaaggggatgccattcgacctttgttttctcgtccagagcagcgatttcaaagtgatggtgaacgggatcctgttcgtgcagtactttcacagggtgccgtttcatagagttgacacaatatctgtgaatgggtcggtgcagctgtcctatatcagctttcagcccccaggagtgtggcccgccaatccagctcctattacacagacagtgattcacaccgtccagagcgctcccggccagatgtttagcacgccggccataccaccaatgatgtaccctcatcctgcctaccctatgccatttatcacaaccattttggggggactatacccatcaaagagtattttattgtccggaaccgtgctcccgtcagcacaaagattccacataaatctttgcagtggtaaccatatcgcgttccatttgaacccaagatttgacgagaacgccgtggtccgtaacacccaaattgacaactcctggggtagcgaagagcgctcactgccgcgtaaaatgccttttgtcaggggccagtcattttccgtgtggattctatgcgaggcccactgtctgaaagtggccgtcgacggtcagcacctgttcgagtactaccaccgcttacggaatcttccaaccatcaatcgtttggaggttggtggggacattcagttaacacacgtccagacatag

SEQ ID NO: 192811 - DNA, 936 bp, Artificial Sequence
  Description of Artificial Sequence: Synthetic coding sequence
atggccttcagcggcagccaggccccctacctgagccccgccgtgcctttctccggaaccatccagggtgggctgcaggatgggcttcagatcacagtgaacggcaccgttttgtctagttctggaaccagattcgcagttaatttccagacgggttttagtgggaatgatatagccttccactttaaccctcggttcgaggatggcggctacgtggtctgtaacacccggcagaatggatcctggggccctgaagaacgtaaaacccatatgccctttcagaagggcatgccctttgacctctgtttcctcgtgcagtcttcagacttcaaagtaatggtgaatggcatcttgttcgtgcagtactttcatagggtgcccttccaccgcgtggatactattagtgttaacggaagcgtgcagctgagctatatctcattccaaacccaaacggtaatccataccgtgcaaagcgcgcccggacagatgtttagcacacccgcgatcccgcctatgatgtacccacacccagcttaccctatgccctttattactaccattttaggtggattgtaccccagtaaatcgatcctgctgtcaggcacagtcctccctagtgcacagaggttccacatcaacctatgttcaggtaatcacatcgcattccacctgaaccctcgctttgacgagaatgctgtggtcagaaatactcagatcgataatagctggggaagcgaggagcgcagcttgccacggaaaatgcccttcgtgcgaggccagagcttctccgtatggatcctgtgtgaggcccactgtctcaaggtagcagtggatggacaacacctctttgagtactatcatcgtctgcgaaatctgcctactataaacaggttagaagtgggaggcgacatccaattaacacatgtccaaacatag

SEQ ID NO: 192812 - DNA, 741 bp, Artificial Sequence
  Description of Artificial Sequence: Synthetic coding sequence
atggccttcagcggcagccaggccccctacctgagccccgccgtgccattctctggcaccatccagggaggtttgcaggacggccttcagattactgttaacggaactgtgttatccagctctggcacaaggtttgccgtaaacttccagactggctttagtgggaatgacatcgcattccattttaatcctcgctttgaggacgggggctatgtggtatgcaacactcggcagaacggatcttggggtcccgaggaaagaaaaactcatatgccgttccagaaaggcatgccctttgacctttgttttttggttcagagctcagattttaaagtcatggtcaacgggattctatttgtgcaatacttccacagagtgcccttccacagggtcgatacaatctcagtgaatgggagcgttcaactctcttacatctcttttcagcctcccggggtgtggccagccaatcctgcccccatcactcagacggtcatccacacggtacagagcgcgcctgggcagatgtttagcacccctgctattccaccaatgatgtatccacaccctgcctatcccatgcccttcattacaacaattttgggtggcctttacccctcaaaaagtattctcctcagcggcacggtgctgcccagtgcacagaggtgtggaagctgcgtcaagctgactgcctcgcgttggccttggatggtctccacatgtctgaatactacaatcgcctag

SEQ ID NO: 192813 - DNA, 1068 bp, Artificial Sequence
  Description of Artificial Sequence: Synthetic coding sequence
atggccttcagcggcagccaggccccctacctgagccccgccgtgccgtttagcggaacaatccagggaggcctgcaggatggactgcagatcacagtcaatggtaccgtcttatcctcttcaggaacacggttcgctgtgaactttcaaactgggttctccggaaacgacattgccttccactttaatccaagatttgaggatggtgggtatgtggtgtgcaatacgcgccagaacggtagctgggggcctgaagagagaaagactcatatgcccttccagaagggaatgccctttgacctctgcttcctggtgcagtctagcgacttcaaggtgatggttaatggcatcctgtttgtgcagtacttccatcgggtgccatttcatcgagtggacaccatctctgtgaacgggtccgttcagctcagttacatttctttccagaacccacgcacggtgcccgtgcagcccgctttttctactgtgccctttagccagccagtctgttttcctcctcggcccagagggagaaggcagaagccacccggggtttggcccgcaaatcccgccccgatcacacagactgtaatacacacagttcagtccgccccaggtcagatgtttagcacgccggcgatcccacccatgatgtacccccaccccgcctaccccatgcccttcattaccacaattctaggcggcttataccctagtaagtctatcctgttaagcggtactgtgttaccgtctgcgcagcggtttcatattaacctctgctctggtaaccacatcgcctttcacctgaatcctcgctttgatgaaaacgccgtggtccgaaacacccagatcgataactcttggggatcagaggagagatcacttccaagaaagatgccctttgtgcggggtcagagcttcagcgtctggattctatgcgaggcccattgtctcaaggtagccgtggatggtcagcacctgttcgagtattaccaccgactgaggaacctgcctaccatcaatagactcgaggttggcggggatatccagcttacccacgtgcagacgtag

SEQ ID NO: 192814 - DNA, 666 bp, Artificial Sequence
  Description of Artificial Sequence: Synthetic coding sequence
atgggccccttcagcgcccccgtggagcccgacggcggctacgtggtgtgtaatacaagacagaacggctcttggggccctgaagagcgcaagacacacatgccgttccagaaaggtatgcctttcgatctctgttttcttgtccaatccagtgacttcaaagtgatggtgaatggcatcctgttcgttcagtatttccatagggttccttttcacagagtggataccataagtgtaaatggttctgtacagctaagttacattagcttccagaaccctaggactgtgcccgtgcagcctgccttctccacagtccctttttcccaacctgtttgtttcccgccaaggcctagaggccgccgccagaagccacctggcgtgtggccggcaaaccctgcgcctattactcagaccgtgatccacaccgtccaatccgctcctggccagatgttttctactcccgccatcccccctatgatgtatcctcatccggcatatcctatgcccttcattacaacaattctaggtgggctttacccttctaagagcatcctgctctccggcacagttcttccaagcgcacagcgttgcgggtcctgcgtcaaacttaccgcatctaggtggccctggatggtgtcgacatgcttaaatacgaccatagcatag

SEQ ID NO: 192815 - DNA, 360 bp, Artificial Sequence
  Description of Artificial Sequence: Synthetic coding sequence
atggccttcagcggcagccaggccccctacctgagccccgccgtgcctttctcggggactatacagggcgggttgcaggatggactgcagattaccgtcaatgggaccgtactgagctcgtctggtaccaggttcgccgtgaacttccagactgggttcagcgggaatgacatcgcatttcactttaacccacggttcgaggatggaggctacgtagtctgtaatacccgacagaatggatcctgggggccagaggaaagaaaaacccatatgccttttcagaagggaatgccatttgatctgtgtttcctggtgcagtcctccgacttcaaggtgcaccttcttctgctgttgctgtag

SEQ ID NO: 192816 - DNA, 1533 bp, Artificial Sequence
  Description of Artificial Sequence: Synthetic coding sequence
atggccggcagccggcagcggggcctgcgggcccgggtgcggcccctattttgcgctctactgctgagcttgggaagattcgtcagaggcgacggagtcggaggggaccccgctgtagccctcccacacaggcggtttgaatacaagtactccttcaagggcccccacttagttcagagtgacggaactgttccgttctgggcgcatgcaggaaatgcaatcccaagcagcgatcagattcgggtggcaccctccctcaagtcacaacgtggcagcgtctggacgaagactaaggcagctttcgaaaattgggaagtggaggtgacctttagggtaactggacgtggcaggattggggctgatgggctggccatctggtatgccgagaatcaaggcctggaggggccggtattcggatctgcagacctgtggaatggcgtaggtatcttttttgactcttttgacaatgacggcaagaaaaataatccagccattgtgattataggcaataatgggcagattcactacgatcatcaaaacgacggggcctctcaggcactggctagttgtcaaagggatttccgtaacaagccgtaccctgtgagagcaaagattacgtattaccagaatacactgaccgtcatgattaataacggatttacacctgacaaaaatgactatgagttctgcgccaaagttgaaaatatgatcattcccgcccaaggacattttggcatcagtgctgccactgggggtctcgccgacgatcacgacgtgcttagcttcctgaccttccagttgacggagccggggaaggaaccccctacccctgataaagaaatcagtgagaaggaaaaggagaagtatcaggaagaatttgagcatttccaacaggagctggacaaaaaaaaggaagagttccagaagggccatcccgacttacagggccagcccgccgaggagatattcgagtcagttggcgatcgggaattacgccaggtatttgaggggcagaatcgtatccatcttgaaattaaacaactcaaccgtcagttagatatgattctggacgagcaaaggagatacgtatccagtctgaccgaagagatcagcaaacgcggtgcgggtatgccggggcagcatggccagatcacacagcaggagctggacaccgttgtgaaaacccaacacgagattctgcgccaggtcaacgaaatgaaaaatagcatgtctgaaactgtccggctggtgagcggtatgcaacacccaggatctgccggaggtgtgtatgaaaccactcaacattttatcgatatcaaagagcatttacacatagttaaacgggacattgataacctcgtccagaggaatatgccatcaaatgagaagcccaaatgtccagagctcccaccattcccctcttgcctcagtacggtgcactttataatctttgttgttgttcaaaccgtgctatttattggttacataatgtacaggtcccagcaggaagcggccgccaaaaaatttttttag

SEQ ID NO: 192817 - DNA, 1101 bp, Artificial Sequence
  Description of Artificial Sequence: Synthetic coding sequence
atgcagcccctgtggctgtgctgggccctgtgggtgctgcccctggcctctccgggggcagcgttgaccggagagcagcttctaggctccctgttgagacagctccaactgaaagaagtacctacgctggatcgggccgacatggaagaacttgtcattccgacacatgttcgggctcagtatgtggcccttttacaaagaagtcatggcgaccggagtcgcggtaagcgcttcagccagtcctttcgcgaagttgcgggtaggtttctcgcgctggaagcctcaacccacttgcttgtcttcggaatggagcaaaggcttccccccaatagcgaactagtgcaggcagtgctgaggttatttcaggagcccgtacctaaagctgctctccatcggcatggccggctttctccacgatccgcgagggcgagggtcaccgtggagtggctacgtgtccgcgatgatggtagcaaccgtactagcctcattgactcccggcttgtgtccgtgcatgagtcaggctggaaggcatttgatgtgaccgaggcagtgaatttttggcaacagttgtcccggcctcggcagcccctgttactgcaagtgtccgtgcagcgcgagcaccttgggccactcgcctccggcgcacataagctggtgagatttgcatctcagggagcaccagctgggctcggcgagccccaattagagctgcatacacttgatcttggcgactacggggcccaaggcgactgcgacccagaggctcctatgaccgaaggcacacggtgttgccgccaagaaatgtacattgacctccagggaatgaagtgggccgagaactgggtgcttgagccacctggcttcctggcgtacgagtgtgtgggcacatgtcgacagccccccgaggccctcgcatttaagtggcccttcctgggccctcgccaatgtattgccagtgaaaccgacagtctccctatgattgtgagcattaaggagggagggcgtactcggccccaggtcgtgagcctccctaacatgcgggtgcagaagtgcagttgtgcgtcggatggcgctctggtcccacgcaggcttcagccttag

SEQ ID NO: 192818 - DNA, 1101 bp, Artificial Sequence
  Description of Artificial Sequence: Synthetic coding sequence
atgtggcccctgtggctgtgctgggccctgtgggtgctgcccctggccggccctggcgccgctctcactgaggaacagctcctggggtctttgctgcggcagctccagctgtccgaagtccccgtgctggacagggctgacatggagaaactagttattccagcccatgtccgcgcgcagtacgttgtcttgttgaggagaagccacggggatcgctcaaggggaaagagatttagccagagcttccgtgaagtcgccgggcgatttctcgcatccgaagcttctactcatttgttggttttcggcatggaacagagactgcccccaaattccgaacttgtgcaggctgtcttaagattgttccaggagcccgtccccaaagctgccctacaccgtcacggtagactcagcccccggtctgcccaagcaagggtgacagtcgagtggctcagagtgcgggatgacgggtccaatagaacatcactcatcgactcccgcttggtctctgtgcatgagtcaggctggaaggcttttgacgtaacagaggctgtgaatttctggcaacagctctcccgcccgcgccagcccctgctgctacaggtcagtgtgcagagggaacacttaggtccactcgcctctggggcccacaagctagtgaggttcgcaagtcagggagccccagccggcctcggagaaccccagctcgagctacataccctggatctcagggactatggggctcagggtgactgtgacccggaggcccccatgaccgagggcactcgatgctgcaggcaagagatgtacattgatctgcagggtatgaagtgggcaaaaaattgggtgcttgaaccacctggcttcctcgcatacgaatgtgtaggcacctgccagcagccccctgaagccctggcctttaattggcccttcctgggccccagacagtgtatagcgtctgagaccgctagcttgcctatgattgtgtctatcaaggagggcggccgcaccaggccgcaggtggtaagcctgccaaatatgcgggtgcagaaatgctcctgcgctagtgacggcgcactcgttccgagacgtcttcagccctag

SEQ ID NO: 192819 - DNA, 999 bp, Artificial Sequence
  Description of Artificial Sequence: Synthetic coding sequence
atgtggcccctgtggctgtgctgggccctgtgggtgctgcccctggcaggcccaggtgccgcactcacggaagagcagctgttgggtagccttctgcgtcagctgcagttatcagaagtacccgtgctcgatcgtgccgatatggaaaaactggtgatccctgcccacgtgagagcccaatacgtcgtactgctgcgcagatctcatggggaccgcagccgtggcaaacggttttcccagagtttcagagaggtcgcgggacgttttctggcctctgaagcagcactgcacagacatggcaggttgtcacctcgctccgcacaggctcgcgtaactgttgagtggctgagagtgcgtgacgacggctccaaccgcacaagcctgatcgactcacgtctggtttccgtacacgaatcagggtggaaggccttcgatgtgaccgaggctgtgaatttttggcagcaactgtcccgccctagacagccgctgctgctccaggtgtctgtgcagcgtgagcaccttggccccctagcatctggggcccacaagttagtccgattcgcaagccagggggccccagcaggcctcggagagccccagctcgaactccatacactagatttaagagactatggcgcccaaggtgattgcgacccagaggctccaatgacagagggcaccagatgttgtagacaagaaatgtatatcgacctgcagggcatgaaatgggccaagaactgggtcctcgaaccccccggtttcctcgcctacgaatgcgtcggtacttgtcagcagccacctgaagccttagccttcaactggccattcctaggccccagacaatgcatcgcatccgagactgcctctctccctatgatcgtttctatcaaagagggaggcagaacccgcccacaggtcgtgtcgcttcccaatatgcgcgtacaaaaatgctcgtgcgctagtgatggggcattagtgcctcgacgcctccaaccttag

SEQ ID NO: 192820 - DNA, 1131 bp, Artificial Sequence
  Description of Artificial Sequence: Synthetic coding sequence
atggtgtggaaggtggccgtgttcctgagcgtggccctgggcatcggcgctgtacccattgatgatcccgaggacgggggaaaacattgggtggtcatcgttgcaggtagcaatggatggtataactacaggcaccaggctgacgcatgtcatgcttaccagatcatccacaggaatggaattcccgacgagcagattgtagtgatgatgtatgacgatattgcttactctgaagataaccccactcctggaatcgtcatcaatcggcctaacggcaccgatgtatatcagggagttcctaaagactataccggcgaagatgtgacaccccagaattttctggcggtcctgcgaggcgatgcagaagctgttaaggggattggaagtggaaaagtcctgaaatcggggccgcaggaccacgtgtttatttacttcaccgaccacggctccaccgggattttagtgttccccaacgaggacctgcatgtcaaggatcttaatgaaacaattcactacatgtataagcataaaatgtatagaaagatggtattctacattgaagcgtgcgaatcagggtccatgatgaatcatctccctgacaacattaatgtttacgctaccacagccgctaatccaagggaatcctcctacgcttgttactacgacgaaaagcggtctacctacctgggagattggtacagcgtgaactggatggaagacagcgatgtcgaggatttgaccaaagagactctgcacaagcaatatcacttagtcaaaagccataccaacacaagccacgtgatgcagtatggcaataaaactattagtaccatgaaagtgatgcagttccaaggcatgaagaggaaagccagctctccagttccgctcccaccagtcacacatttagacctgacccctagcccagacgttcccctgaccattatgaagaggaaattaatgaacaccaacgatctggaggagtcaaggcagctgacagaggaaatacagaggcaccttgactatgagtatgctttgcgccacctctacgttctggtcaatctctgcgagaagccttaccctctgcaccgcatcaagctgagtatggaccatgtctgtctcggccactactag

SEQ ID NO: 192821 - DNA, 1119 bp, Artificial Sequence
  Description of Artificial Sequence: Synthetic coding sequence
atggtgtggaaggtggccgtgttcctgagcgtggccctgggcatcggagctgtgcctattgatgaccctgaggatggcggcaagcactgggtggtgatcgttgctggcagcaatggctggtacaactaccgacaccaggctgacgcctgccatgcttaccagataatccatcgcaatggaatcccggacgagcagattgtggtaatgatgtatgacgatattgcatacagtgaagacaatccaacgccaggaattgtgattaacagacccaacggaaccgatgtctaccagggtgtgcctaaagactacaccggagaggacgtgaccccgcagaactttttggccgtcctccggggcgacgcagaggccgttaaaggaatcggcagtggaaaggtgctgaagtccggaccacaggaccacgtgttcatatatttcactgatcatgggtccactggcatcttagtgtttccaaacgaagacttgcacgtgaaagacttgaacgagactatacattacatgtacaaacataagatgtaccgcaaaatggtgttctacatcgaagcttgtgaaagtggctcaatgatgaaccatcttccagacaacatcaacgtgtatgcgactactgctgctaaccctcgcgagagcagttacgcatgttattacgacgaaaaacgaagtacgtacctgggagactggtattccgttaattggatggaagacagcgatgtagaggatctcacaaaagagacactccacaagcagtatcacctagtgaagtcccatactaacaccagtcacgtaatgcagtacggcaacaagactatttctacaatgaaggtgatgcagttccaggggatgaagcggaaagcctcctcacctgtgcccctgcctccagtgacccatctggatcttacaccgagcccagatgtgccactgacaataatgaagcgtaaactgatgaataccaacgatttggaggagtcccggcagctcacagaggaaatccagaggcacctggatgacaaaatcgtgcatggcccaagggtaccttggtccctgctgaagagctgcctgctcgaagcattcccctctgtttccgctccacccactgtatgttag

SEQ ID NO: 192822 - DNA, 1302 bp, Artificial Sequence
  Description of Artificial Sequence: Synthetic coding sequence
atggtgtggaaggtggccgtgttcctgagcgtggccctgggcatcggggctgtaccaatcgatgaccctgaggacgggggtaagcactgggtggtgatcgtcgcgggcagcaatggatggtacaattatcgccaccaggcggatgcatgccatgcctaccagatcatacacagaaacggcatccctgacgaacagattgtggtcatgatgtacgatgacattgcatattcggaggataacccgacccctggcatagttataaaccgaccaaacggtacggacgtttatcagggggtacctaaggactacactggggaggatgttactcctcagaactttctggctgtgctcaggggggacgcagaggccgtcaagggtattggttccggaaaggtgctgaagtcaggcccacaggatcatgtatttatttactttaccgaccatggctctaccgggatcctcgtctttcccaatgaagacctgcatgtgaaggacctgaatgagacaatacactatatgtacaagcataaaatgtataggaagatggttttctacatcgaggcctgtgagagtgggtctatgatgaaccacttacccgataatatcaatgtttacgcaaccaccgcagccaaccctcgagaatcaagttacgcctgctattatgacgagaagcgttctacatacctgggggattggtattctgtgaactggatggaagactccgatgtagaggacctaaccaaggagactctgcacaaacagtaccacctggttaagtcgcacaccaacacatcccatgtgatgcagtacggcaacaaaacaataagcaccatgaaggtcatgcagttccagggaatgaaacgcaaggcttcctctccagtgcccctacctcctgtcacacacctggacctgacaccttcacctgatgttcccttaaccattatgaaaagaaaactgatgaacactaacgatctcgaggaatccaggcagctgacagaggagatacagcgccatctcgacgccaggcacctgattgagaagtcagtccggaagattgtgagccttttggctgcgtcggaggccgaggtggagcagttgctgagcgaacgcgctcccctcaccggccactcctgttaccctgaggcactgttacattttagaacacactgctttaactggcatagtcccacctatgagtacgccttgcgtcacctttatgttcttgtgaacttatgtgagaagccctacccgttacatcgcattaagctttctatggatcatgtgtgtctaggtcattattag

SEQ ID NO: 192823 - DNA, 1302 bp, Artificial Sequence
  Description of Artificial Sequence: Synthetic coding sequence
atggtgtggaaggtggccgtgttcctgagcgtggccctgggcatcggggctgttcccatcgatgatcctgaggacggtggaaagcactgggtcgtcattgttgccggctccaacggctggtacaactacagacatcaggctgacgcctgccatgcctaccagattatccaccggaacgggattccagacgaacagattgttgtgatgatgtacgacgacattgcatactcggaagacaatcctacccccggtattgtgatcaatcgacctaatggtactgatgtttatcagggcgtccccaaggattataccggagaagacgtgacgccacagaacttcttggctgtgctgcgtggagatgctgaagctgtcaaaggcataggttccggcaaggtgctgaaatctggaccacaagatcatgtctttatttacttcactgatcacggatctaccggaattctggtgttcccaaacgaagacctgcatgttaaggatctgaatgaaactatccactacatgtacaagcacaaaatgtatcgaaagatggtgttttacatcgaggcttgtgaatctgggagcatgatgaaccacctgccggacaatataaacgtttatgccactactgccgcaaaccctagggagtctagttatgcctgctattatgatgagaagaggtccacctatttgggagactggtactctgtgaactggatggaagattctgacgtagaggacttaacgaaggaaacactgcacaagcaataccacttagtaaaatctcataccaacacatcccacgtcatgcagtatggtaacaaaaccatcagtactatgaaggtgatgcagttccagggaatgaaacgcaaagcctcatctcccgtacctcttccccctgtgactcacctggaccttacgcctagtccagatgtgcccctgacaatcatgaaaagaaaactgatgaatacaaacgatcttgaggagagccgccagctgaccgaggagatccaacgtcacttggatgcgaggcacctgatagagaagtccgtccgcaaaatcgtctcactgctcgcagcaagtgaagccgaggtggaacagctcttatcagagagggcccctttgacaggtcattcatgttacccagaggctctgttgcacttcaggacacactgcttcaattggcactcacctacatatgaatatgccctcagacatctgtatgtgcttgtgaatttgtgtgagaagccataccctctgcaccgcataaagctctctatggatcatgtctgcctgggccactattag

SEQ ID NO: 192824 - DNA, 1197 bp, Artificial Sequence
  Description of Artificial Sequence: Synthetic coding sequence
atggtgtggaaggtggccgtgttcctgagcgtggccctgggcatcggcgcagtccccatcgacgacccggaagacgggggcaagcactgggtggtaatcgtggctgggtctaatggttggtacaactacaggcaccaggcggacgcttgtcacgcgtatcagataattcaccgaaatgggatcccagatgagcaaatcgtcgtcatgatgtatgacgttacgcctcagaatttcctcgcagtcctgcgaggtgatgccgaggcggtgaaagggattgggtcaggcaaagtgctgaagagtggtccacaggaccatgtctttatttactttacagatcacgggagcaccggcatcctcgtgttccccaatgaggacctacacgtcaaggatttaaacgagaccatccactatatgtataaacacaaaatgtatcgcaaaatggtgttttacatagaagcgtgcgagtccggctcgatgatgaatcacctgccagacaacatcaacgtgtacgctacaacagctgcgaatccccgggaaagttcgtatgcctgctactatgacgaaaagagatcaacctacctcggcgattggtatagcgttaactggatggaagattcagatgtggaggacctgacaaaagaaaccctgcataaacaataccatctcgtgaagagccacactaacacaagccacgtcatgcagtacggcaacaaaactatctcgacaatgaaggtaatgcagttccagggcatgaagcgcaaagcctcatcaccagtgcccctgcccccagtgacccatctggacctcacaccttctcccgacgtgccgcttacaattatgaagcggaaacttatgaatactaatgatctcgaagagtcgaggcagttgaccgaggagatccagaggcacctcgacgctcggcatttaatagaaaaaagtgtaagaaaaatcgtttcccttctcgccgcatcggaggccgaggtggaacagctgttgtccgaaagggcccctttaactgggcatagttgctacccagaggctctgctgcactttcggacccactgcttcaattggcactcccccacctacgaatacgccctaagacatttgtacgtgctggtcaacttgtgcgaaaagccctacccactgcaccggatcaaactctcgatggaccacgtgtgcttgggccattactag

SEQ ID NO: 192825 - DNA, 1233 bp, Artificial Sequence
  Description of Artificial Sequence: Synthetic coding sequence
atggtgtggaaggtggccgtgttcctgagcgtggccggcagcaacggctggtataattatagacatcaggctgacgcctgtcacgcatatcagatcattcatcgaaacggtattcccgatgaacaaatagtcgtgatgatgtacgatgatatcgcatactccgaagacaatcccacaccgggcattgtcatcaataggccaaatgggactgacgtatatcagggagtgcccaaggactatacaggcgaggatgtcacaccacagaatttcctggccgtactgaggggcgacgctgaggccgtcaagggaataggatctgggaaggtgttgaaatcaggccctcaggaccacgtttttatttatttcacggaccatggatctaccgggattctggtgtttccaaatgaagacctccacgtgaaagacctgaatgagacaatacactacatgtacaaacataaaatgtatcgaaagatggttttctacattgaggcatgtgagagcgggtccatgatgaatcacttaccggataacatcaatgtttacgccaccaccgcggccaacccgcgcgaatcctcgtacgcctgttattacgatgagaagagaagcacctacttgggagattggtattctgtgaactggatggaggattctgatgtcgaggatctcaccaaagagacactgcacaaacagtaccaccttgtgaaatcccacactaacacctcacacgtgatgcaatacgggaacaaaacaatcagtactatgaaggtcatgcagttccaaggcatgaagagaaaggccagctcacccgtgcccctgccccccgtaacgcacctggatctgacccccagtccggatgtaccactgactatcatgaagcgcaagctgatgaacacaaatgatttggaggaaagcagacagctgacggaagagatccagcgccacctcgatgctcgtcatttgattgagaaatctgtgcggaagattgtgagcttactggcggcatcagaagcagaggttgaacagcttctgtccgagcgcgcacccctgacaggccattcctgctaccctgaagccttactgcattttcgcactcattgcttcaactggcacagccctacctacgagtacgctctccgccacctttacgtgttggtgaatttatgcgagaagccctatcctctgcaccgcatcaagttgtccatggaccacgtgtgtctggggcattattag

SEQ ID NO: 192826 - DNA, 174 bp, Artificial Sequence
  Description of Artificial Sequence: Synthetic coding sequence
atggtgtggaaggtggccgtgttcctgagcgtggccctgggcatcggcgccgtccccatagatgaccccgaagacggcggaaagcactgggtggtcatcgtggccgggtcgaacgggtggtacaattaccgtcaccaggccgatgcttgccacgcctatcaaatcatccactag

SEQ ID NO: 192827 - DNA, 60 bp, Artificial Sequence
  Description of Artificial Sequence: Synthetic coding sequence
atggtgtggaaggtggccgtgttcctgagcgtggccctgggcatcggggctgttccctag

SEQ ID NO: 192828 - DNA, 177 bp, Artificial Sequence
  Description of Artificial Sequence: Synthetic coding sequence
atggtgtggaaggtggccgtgttcctgagcgtggccctgggcatcggggctgtgcccatcgacgatcctgaagacggcggtaagcactgggtggtgatagtcgcaggatccaatggatggtacaattaccggcaccaggcggacgcatgtcacgcctatcagatcatccaccgctag

SEQ ID NO: 192829 - DNA, 237 bp, Artificial Sequence
  Description of Artificial Sequence: Synthetic coding sequence
atggtgtggaaggtggccgtgttcctgagcgtggccctgggcatcggtgccgttcccatagacgacccagaggacggcggtaaacactgggtcgtgatcgtggccggatcaaatgggtggtacaactataggcaccaggctgatgcttgtcatgcgtatcagattattcatagaaatggaatcccggacgaacagattgtcgtgatgatgtacgatgatattgcgtactctgaatag

SEQ ID NO: 192830 - DNA, 237 bp, Artificial Sequence
  Description of Artificial Sequence: Synthetic coding sequence
atggtgtggaaggtggccgtgttcctgagcgtggccctgggcatcggcgccgttccgatagatgatcctgaagacggagggaaacactgggtcgtgattgtggctggctccaatggatggtacaactataggcaccaagccgacgcctgccacgcctatcagattattcatcgcaacggcatcccagacgaacagatagtagtcatgatgtacgatgatatcgcttatagtgagtag

SEQ ID NO: 192831 - DNA, 2736 bp, Artificial Sequence
  Description of Artificial Sequence: Synthetic coding sequence
atggccgccgccgccgccagcgccccccagcagctgagcgacgaggagcttttttctcagctgcggcgatacggcttgtcccctggaccagtgactgagtctacacgaccagtgtatctgaaaaaactgaaaaagttgcgtgaggaagaacagcagcagcacagaagcggaggcaggggcaacaagactcgcaattctaacaataacaataccgctgccgccaccgtcgctgccgccggcccagcggccgctgccgcagctggaatgggtgtgcggccggtgtctggggatctgtcttacttgcgaactccaggtggactgtgtcgcataagtgcctccggccccgaatccttgcttggggggcctggaggcgccagtgcggcgcccgccgccggcagtaaggtactactaggattcagtagcgacgaaagcgatgtggaggctagccccagggaccaggcgggcggaggcggtcgaaaggaccgcgccagcctacagtatagaggtctcaaagcaccacctgctcccctggccgcatcagaagtaaccaactccaattctgcagagcgcaggaaaccccattcatggtggggggccagacggccagccggccctgagctccaaactccacccggtaaggatggtgccgtagaagatgaggaaggcgagggtgaggacggcgaggagagagatccggagacggaggagcctttgtgggcgtctaggaccgtaaacggcagcagattggtgccgtacagttgtcgagaaaactacagtgactctgaggaagaggacgatgatgacgttgccagcagccgccaggtcctgaaagatgacagtctttctaggcatagaccccgtcgaactcactcaaaacctctgccccccttaactgctaaatctgccggaggccggctagaaacaagcgtgcagggagggggcgggctggctatgaacgaccgcgccgcagcggcggggagtctcgatcgcagtcggaatctcgaggaggctgctgcagctgagcagggtggcggatgcgatcaggtcgattctagtcccgtgccaaggtaccgggtgaacgccaagaagctgacccctttgctgccaccacccctgaccgacatggactctacgctggactcatctacaggttccctgctgaaaaccaacaatcacatcggcggcggagcattttccgtggactcccccaggatttactccaactcccttccgccaagtgcagctgtggccgcttccagctctcttagaatcaaccacgctaaccataccggcagtaatcacacctacctcaagaatacctacaacaagccaaagctgagcgaacccgaagaggaactgcttcagcagttcaagcgggaggaggtgtctccaaccggcagctttagtgctcattacctctctatgtttctgttgacagccgcctgtttgttctttttgattctaggattgacctatttggggatgagaggaaccggcgtctccgaggacggcgaactctccattgagaacccgtttggtgagacgttcgggaaaatccaggaatctgagaagacactgatgatgaataccctatacaaactccatgacaggttggcccagctggccggcgaccacgagtgtggttcaagtagccagcgaacgctttctgtgcaggaagccgccgcctacttgaaggaccttggcccagaatatgaagggatcttcaataccagtttgcagtggattctggagaacgggaaggacgtgggcatacgatgcgttgggtttgggcccgaagaggaattgaccaatatcaccgatgtgcaatttctccagtcgaccaggcccttgatgagtttttggtgtcgctttaggcgtgcatttgtcacagttacgcacagacttctgctcttatgcctaggggtagtgatggtatgtgtggttctgcggtatatgaaatatagatggaccaaggaggaagaggaaacgcgccagatgtacgatatggttgtgaaaattatcgacgtcctccgctctcacaatgaggcttgccaagagaataaggatcttcagccatacatgcctattccccacgtaagggattcgctgatacagccgcatgacaggaaaaagatgaagaaggtctgggaccgggccgtggatttcttggctgctaacgagtcacgtgtgcgaacagaaacaagacgtattggaggtgcggattttcttgtctggagatggattcagccaagtgcctcttgcgacaagatcctcgtcatcccgtcaaaggtatggcaaggtcaggcctttcacctggacagaagaaatagtccaccaaactcgctgaccccatgcctcaaaatcaggaatatgttcgacccagttatggaaatcggtgatcaatggcatttggctattcaggaggctattctggagaaatgctcggacaatgacggaatcgtgcacatagcagtggacaaaaacagcagggaggggtgcgtgtacgtgaaatgcctgtctccagaatatgccgggaaggccttcaaggccttacacggaagctggttcgatggaaaacttgtgaccgtgaagtacttgaggttagaccgataccaccaccggttccctcaggcgctcacatctaatacccctctgaaaccttctaacaagcacatgaactctatgtcccatcttcgactgcgcacaggcctgactaactctcagggctcttcctag

SEQ ID NO: 192832 - DNA, 4512 bp, Artificial Sequence
  Description of Artificial Sequence: Synthetic coding sequence
atgcccggcccccccgccctgcggcggcggctgctgctgctgctgctggttctcctcattgctggttccgcaggcgctgcgccactcccacagacgggcgccggggaggcccctcctgcggctgaggtcagtagctctttcgtaatcttatgcgtgtgctcccttattatattgatcgttttaatcgccaactgtgtctcttgttgcaaagatccagagatcgattttaaagagttcgaggataacttcgacgacgagatcgattttacaccaccagctgaggacacgccctccgttcaatctcccgccgaagtattcactctgagcgtgccgaacatcagtctgccggccccttctcagttccagccaagcgtggaggggcttaagtctcaggtggcacggcacagtcttaattatatccaagaaattggaaacggttggttcgggaaagtactgcttggtgaaatctacacggggacgtctgtggcacgggttattgtgaaagaattaaaggcgagcgcaaaccctaaagaacaggacacatttctgaagaacggtgagccatactacatccttcagcatcctaatattcttcagtgcgtgggccagtgcgtggaggcaataccctatctcctggtgttcgagttctgcgatctgggcgatctgaaagcttaccttaggtcagaacaggaacatatgcggggggactcccagaccatgctattgcaaagaatggcttgtgaggtagctgcaggactggctgccatgcataaactgcactttctccatagcgatctggccctaagaaattgctttctgactagcgatcttaacgtgaaagtgggagactacggcattggcttttcccggtataaggaggattatatcgagaccgacgacaagaaggtgtttcccctgcggtggacggcaccagagctagtgacctcatttcaagatcgcctgcttaccgctgatcagaccaaatatagtaacatctggtctttgggcgtaacgttgtgggaactgttcgataacgccgcccagccctacagtaatctcagcaatcttgacgtgctcaaccaggttattagagagcgcgacacgaaactgcccaagccccaactagaacagccctacagtgataggtggtacgaggtactccaattttgttggcttagtcccgagaagcggccagcagccgaggatgtccacagactgctgacttatctgagactgcaatcacagcgagattcagaggttgactttgagcagcaatggaatgccctcaaacccaacacaaactcaagagatagctccaataatgcggcctttcctatcctcgatcattttgcacgtgaccgcctgggccgcgaaatggaggaggtgcttaccgtcacagagacttcccaggggctaagttttgagtatgtgtgggaggcggccaaacatgatcacttcgacgagcggagtagaggccacctcgacgaagggctgtcatacaccagtatcttttatcccgtggaggtgttcgaatctagtctttcagacccgggccctgggaagcaggacgatagtggccaggatgtgcccctcagagtacccggggtcgtccccgtatttgacgcccataatttgagcgtgggatctgattattatattcagctcgaagagaagtcagggtctaatctggagctggattacccgcctgcactgcttaccactgatatggacaatcctgaaaggactggccccgagctgtcgcagcttacagcgctgcgaagcgtggaattagaggagtcatcaacggacgaggatttctttcaaagctctactgatcccaaagatagcagtctccctggagacttgcatgtaacgtccggacccgagtctccttttaataatatcttcaatgacgtggacaagtccgaggacctgccaagtcatcagaagattttcgatctaatggagttgaacggggtccaggccgacttcaaaccggccacacttagttcctctctggacaacccaaaagagagcgttataacgggacacttcgagaaggaaaaaccgcgcaaaatctttgattctgagccgctctgcctatctgacaacttaatgcaccaggacaatttcgatcctctgaacgttcaagagctatcagagaatttcttattcctgcaagaaaagaaccttttaaagggatccctcagctcaaaggagcacatcaacgatctgcagacagagctgaaaaatgctggctttaccgaagccatgctggaaaccagctgcagaaattcattggatacggagctccaattcgctgaaaacaagcctggactgtccctgttgcaagagaacgtctctactaagggggacgataccgatgttatgctgacaggggatactctgtctacttctttgcagagttcaccagaggtgcaagttccaccaactagttttgaaacagaagagaccccacgcagagtgcctcctgacagcctgccgacccagggtgagacccaacctacgtgtctggacgtgattgtgcccgaggactgtctacaccaagatatctcccccgatgccgtgacagtgcctgttgaaattctttcaaccgacgccaggacccattcactcgacaatcggagccaagacagccctggcgaatccgaggagacgttaagattgacagaatccgatagcgtccttgctgacgacatccttgcatctcgagtctccgtagggagcagcctgcccgagctgggccaggagctgcataataaacccttcagtgaggaccatcattctcaccggaggctggagaaaaatctggaagccgtcgagacactgaaccagctgaattctaaggacgcagcaaaggaagcaggactcgtgtcagctctgtcctctgattctacatcacaggattccttactggaggattccttatccgctcctttccccgctagcgagcctagcctggagacccctgactcgctagagtctgttgacgtgcacgaggcccttctggactcactgggatcccatacaccacagaaactcgtgccacctgataagcccgctgattcaggatacgagactgagaacttggagtcgccagagtggacactccaccccgctcctgagggcactgccgatagcgagcccgctaccactggggatgggggccactcaggccttccaccaaatccagtcatagttatctccgatgccggcgatggtcaccgtggcaccgaggttactcctgagacattcaccgcaggctcccagggaagttatcgggattcagcctatttttcagataacgattcagaacccgagaagcgatcggaagaggtccccggcaccagccccagcgctttggttctcgtccaagagcagcccctgcctgaacctgtgctcccagaacagagccccgcagcccaggattcgtgcctggaggccaggaagtctcagcccgatgagtcttgtctgtctgcactgcataattcatctgacctcgaattgcgcgccaccccggagcccgcccagaccggcgtgcctcaacaggtgcatcctactgaagatgaggcttcatcaccatggtccgttcttaacgccgagctctccagcggtgacgacttcgaaacgcaggatgacagaccatgtacccttgcttctacgggaacaaataccaatgagctgctggcttacacgaatagtgccctggacaagtctcttagttcccattccgagggcccgaagctgaaggaacctgatattgaaggcaaataccttggcaaactcggagtgagtggcatgctggatctgtccgaagacgggatggacgcagatgaggaagatgagaattccgacgacagcgatgaagatctacgtgcattcaacctgcactctttatcgtctgaaagcgaagacgaaaccgaacaccccgtgccaatcatcctgagtaacgaggacgggcggcatctgaggtccctgctgaagccaactgcagccaacgcacccgacccgcttcccgaggattggaaaaaagaaaagaaggccgttacattcttcgacgacgtgaccgtctatttgttcgatcaggaaacaccaactaaggagctcggcccctgtggaggagaagcatgcggacccgacttgtcagggccggctccggcctccgggagtccctaccttagtcgctgcataaattcggaaagtagcacggacgaagaagggggcggcttcgagtgggatgacgacttttccccggatccttttatgagcaaaactacctccaatctgctcagtagcaagcctagtttgcaaacgtctaagtactttagccccccaccgcccgcaagaagtactgaacagtcttggccccattcagctccttacagcagattttctatttcccctgcaaatatcgcttcattctcattgacacatttgaccgactccgatattgaacagggggggagctcggaagacggggagaaggactag

SEQ ID NO: 192833 - DNA, 186 bp, Artificial Sequence
  Description of Artificial Sequence: Synthetic coding sequence
atgcagccccggacccagcccctggcccagaccctgcccttcttcctgggcggggccccaagagacaccggattaagggtacccgtcattaagatgggtactggctgggaagggtttcagcgcaccttgaaggaagtggcttacatccttttgtgttgctggtgtataaaagagctgctggactag

SEQ ID NO: 192834 - DNA, 186 bp, Artificial Sequence
  Description of Artificial Sequence: Synthetic coding sequence
atgcagccccggacccagcccctggcccagaccctgcccttcttcctgggtggcgcccccagagacaccgggctgcgcgttcctgtgatcaagatgggtacagggtgggaaggcttccagcgaactcttaaagaggtggcctatatcttgctgtgttgctggtgtatcaaagagctgttggactag

SEQ ID NO: 192835 - DNA, 522 bp, Artificial Sequence
  Description of Artificial Sequence: Synthetic coding sequence
atgtacagcttcatgggcggcggcctgttctgcgcctgggtgggcaccatcctgctcgtggtcgctatggctacagatcattggatgcagtacagactctctggatccttcgctcatcagggcttatggcgttattgcttgggcaataaatgttatctccagacggattctatcgcctattggaacgcaacaagagccttcatgatcctgagcgccctctgcgccatttcgggaattataatggggatcatggcctttgcacaccagcccaccttttcacgcatcagcagaccattcagtgcaggaattatgtttttctcttcaacgttgtttgtggtccttgcactagcaatttacaccggagtaactgtctccttcctgggaagacgtttcggggactggcgattcagttggtcatatatcttggggtgggtcgcggttctgatgaccttttttgccggtattttttacatgtgtgcctatagggtgcacgagtgtcggcgtcttagcaccccacgctag

SEQ ID NO: 192836 - DNA, 681 bp, Artificial Sequence
  Description of Artificial Sequence: Synthetic coding sequence
atgcccggcggccccggcgtgctgcaggccctgcccgccaccatcttcctcctcttcctcctgagtgctgtctacctcgggccagggtgccaggccctttggatgcacaaggtacccgcttccttaatggtcagcttgggggaggatgctcattttcagtgtccgcacaacagcagcaacaatgccaatgtgacctggtggagagttttgcacgggaactacacctggcctccggagtttctcggaccgggcgaggacccaaatggaaccctcattatacaaaacgtaaataaaagccatggaggcatttatgtgtgccgcgtccaggaaggtaacgaatcctaccagcagtcctgcggcacctatctgagagtccgtcagcctcctcctcggccatttctcgacatgggagaaggcaccaaaaatcggattattacagccgaggggatcattctgttgttttgcgccgtggtccccggaacactactgttgtttaggaagcgatggcagaatgagaaactaggactcgacgcgggcgatgaatatgaagacgagaatttgtatgaggggctcaacctggacgattgcagtatgtacgaggatatctctcgtggcctccagggtacatatcaagatgtagggagtctcaatattggagatgtgcagttggaaaagccttag

SEQ ID NO: 192837 - DNA, 2001 bp, Artificial Sequence
  Description of Artificial Sequence: Synthetic coding sequence
atggccgacatggaggacctgttcggcagcgacgccgacagcgaggctgaaagaaaggacagcgattcaggatcagactctgactccgatcaggaaaatgccgcctctggctccaatgcgtccggttccgagtcggatcaggacgaacggggggactcaggtcagcctagtaacaaggaactattcggggacgacagcgaagacgagggcgctagccatcatagtggttcggataaccacagtgagcgatcagacaatcggtcggaggcttccgagcgatcggaccatgaagacaacgatcctagtgatgtcgatcaacacagcggtagtgaggctccgaatgacgatgaggatgaagggcatcggtccgacggtggctctcaccattccgaggccgaaggctccgaaaaagcccacagtgacgatgaaaagtggggcagggaagacaaaagtgaccagtcggacgacgagaaaattcagaattcagacgacgaagagcgcgctcaaggctcggacgaggacaagctgcagaactctgacgatgatgaaaaaatgcagaatacagacgatgaggagcggcctcaactctccgacgacgagcgtcagcagttgagcgaggaagagaaggcgaatagcgatgacgaacgccccgtggcatcagataacgacgacgagaaacaaaactcagatgacgaagaacagccccagctcagcgacgaggagaagatgcaaaactcggatgacgagcggccccaggcatccgacgaggagcaccgccactccgacgacgaggaagagcaggatcataagagcgagagtgcccgcggaagcgactctgaagacgaagttctgagaatgaagcgcaaaaatgctattgcctcggattctgaggccgacagtgataccgaagtgcctaaggacaattccggcacaatggatttgttcggcggagctgacgacatcagcagcggcagcgatggggaggataaaccccccacccctggtcagcccgttgacgaaaatggccttccccaggatcaacaggaggaggagcctattccggaaactcgcatcgaggttgagatcccaaaggtgaacaccgacttgggaaacgatctctatttcgtcaaactgcccaactttctgtctgtcgaaccacgaccctttgaccctcaatactatgaggacgagtttgaggacgaggaaatgcttgatgaggagggccgcacccgattgaagctgaaggtcgagaatactatccgttggagaataaggcgagacgaagaagggaatgaaattaaagaaagtaatgcgcgcattgttaaatggagcgacggaagcatgagtctccatctgggcaatgaggtgtttgatgtctataaagctccactgcagggtgaccataatcatctctttataagacagggcaccgggctgcagggtcaggcggtgttcaagaccaaattgacattcagacctcactcaaccgacagtgctacacatagaaagatgaccctgtcattggcggaccgttgctcaaaaacacagaagatccggattttgcccatggcgggaagggatccggaatgccagcgaactgaaatgataaagaaggaagaagaacgcctgcgcgcgtccatccgccgggagtcacagcagaggcggatgagagagaaacagcatcagaggggcctatccgcaagttacctcgagcctgatcgctatgacgaggaggaggaaggagaggaatccatctcactagcagccatcaagaaccgatataaaggcggcatccgagaggagcgcgcccgtatctacagctctgatagcgatgaaggatccgaagaagacaaggctcagcggctgctaaaagcaaagaaactcacctccgacgaggagggcgagccgagcggcaagcgtaaggctgaagatgacgacaaggctaacaagaaacacaagaaatacgtaatttctgacgaagaggaagaagacgacgactag

SEQ ID NO: 192838 - DNA, 1821 bp, Artificial Sequence
  Description of Artificial Sequence: Synthetic coding sequence
atggccgacatggaggacctgttcggcagcgacgccgacagcgaggcagagaggaaggacagcgactcaggtagcgactcggattcagatcaagagaatgcagcctccggttccaacgcatcaggtagtgagtcagatcaggacgagaggggagacagtgggcaaccatcaaataaggagctgtttggcgacgactcggaggatgagggcgcttctcaccactcaggcagcgacaatcactccgaaaggtctgacaaccggagcgaggcctctgagcgaagcgatcatgaagacaacgacccaagtgacgtagatcagcactccgggagtgaggcacctaacgacgacgaagacgaaggccatcgctctgatggtggctcacaccactctgaggcagaaggtagtgagaaggcacattctgacgacgagaagtggggacgcgaggataagtccgatcagtcagatgatgaaaagatccagaattctgacgatgaagagagagcccagggcagtgacgaggacaagctacagaactccgatgacgatgaaaagatgcagaatacagatgatgaagagcggccgcagctttctgatgatgaacgtcagcaactgtcagaagaggagaaggcgaatagcgatgatgaacgaccagtggcctccgacaacgacgacgagaagcagaattcggatgacgaggagcagccccaactttcggatgaagagaagatgcagaatagtgacgacgaacggccccaggctagcgatgaggagcaccggcattcagatgacgaagaggaacaggaccacaaatccgagagcgccagaggatcagattccgaggacgaggttttacgcatgaagcgcaaaaatgccatcgcctctgattcggaggctgactctgacacagaggttccgaaggacaacagtggaaccatggacctctttggcggcgccgatgatatctcctctggcagcgatggtgaagataagcccccaacccctgggcagcccgtggatgaaaatgggctccctcaggaccagcaggaagaagagcctatacctgaaacccgcatcgaagtcgaaatccctaaggtgaataccgatctgggcaacgacctgtatttcgtcaagttacccaacttcttgtcagtggaacctagtatgagcctgcatctcggcaatgaggtgtttgacgtgtataaagcacctctgcaaggtgatcacaaccacctatttattcgacaagggaccggacttcagggacaggcggtgttcaaaaccaagctgaccttccgcccccacagtaccgatagtgctacccaccgcaagatgactctctctctggcggatcgctgtagtaagacccagaagattcggattctccccatggcaggcagagatccagaatgtcaacggactgagatgatcaagaaagaggaggagcggctgagagcctcgatccgtagagaatcacagcagcggaggatgagagaaaagcagcaccagagaggtttgtccgcatcctatctggagcctgacagatacgatgaggaagaagaaggggaagagtctattagtttagctgcgattaagaatcgctacaaaggcggcattagggaggaaagggcaagaatctattcatcagattctgatgagggatctgaggaagacaaggcgcagcgccttttgaaagcaaagaaattgacctccgatgaggaaggggagccaagtggcaagcgtaaggccgaagacgatgataaggctaataaaaagcataagaagtatgtgatcagcgatgaggaggaggaggacgacgactag

SEQ ID NO: 192839 - DNA, 1935 bp, Artificial Sequence
  Description of Artificial Sequence: Synthetic coding sequence
atggccgacatggaggacctgttcggcagcgacgccgacagcgaggcggagaggaaggattcagattcgggaagcgacagcgattccgatcaggagaatgccgcttccggaagcaatgcttccgggagcgaatcggatcaagacgaacggggcgactctggacaaccatctaacaaggaattgtttggcgacgacagtgaggacgaaggggctagccatcatagtgggtcagacaaccattccgagagatctgacaacagatcggaagcgtccgagcggtccgatcacgaagataacgaccctagtgacgtagatcagcacagcgggagtgaggcaccgaatgatgatgaggacgaaggacaccggtctgatgggggctcacatcacagcgaagcagagggatcagagaaggcacactccgatgatgaaaagtgggggagggaggataagtcagatcaatctgacgatgagaaaattcaaaactctgacgacgaagaacgcgcgcagggatccgatgaagataaattacagaattcagatgatgatgaaaagatgcagaatactgatgatgaagaacgtcctcagctctctgatgacgaacggcagcagttaagcgaagaggagaaagctaatagcgatgatgagaggccggttgctagtgataacgacgacgatgatgagaggcctcaggcttcggacgaagaacataggcattcagatgacgaggaggaacaagaccataaatcagagtcagctagagggagcgatagcgaagacgaagtgctgagaatgaagagaaagaatgctatagctagcgattctgaggctgactccgataccgaggttcccaaggataacagtggtactatggatttgtttggaggagccgacgacatcagcagtggcagcgacggcgaagataagcccccgaccccaggccagcccgttgacgaaaacggcctgccccaggaccaacaggaggaagaaccaatcccagaaaccaggatcgaagttgagatccctaaggtcaataccgatttaggcaatgacttatattttgttaagttgcccaatttcctttcagttgaacctcggccctttgacccacagtattatgaggacgaattcgaagatgaagagatgctggatgaagaaggtcgaactcggctgaaattaaaggtggagaacacgattcgctggcggatcaggcgcgatgaggaagggaatgagatcaaagagtcaaacgcaagaatcgtgaagtggagcgacggctccatgagccttcacctgggaaacgaagtgttcgacgtatacaaagccccgctacagggggaccacaaccacctgttcattcgtcagggaacagggcttcagggacaagccgtgttcaagaccaagctgactttccgacctcattctactgacagcgcgacccatcggaagatgaccttatcgttggccgatcggtgctctaaaacccagaagatccggatactacccatggcaggacgggatcccgaatgccagagaaccgaaatgatcaaaaaagaagaggaacgtctgagagcttctattcggagagaatctcagcagcgtaggatgcgggagaagcagcatcagcgtgggctcagtgcatcatacttggagcctgatcggtatgatgaggaggaggaaggggaagaatcgatcagcctagcagctatcaagaatcgctataagggaggaattcgcgaggaacgagcccgcatttatagttcagactccgacgaaggctcagaagaagacaaagctcagcgactgcttaaggcaaaaaagctgacaagtgatgaagagggggaaccaagcgggaagagaaaagcagaggatgatgataaagcaaataagaaacacaaaaagtatgtaattagtgatgaagaggaggaagatgacgactag

SEQ ID NO: 192840 - DNA, 2127 bp, Artificial Sequence
  Description of Artificial Sequence: Synthetic coding sequence
atgcgggagcggatctgggccccccccctgctgctgctgctgcccctcctgctcccccctcccctgtggggcggccctcccgattctcctagacgggagctggaactggaaccaggaccgctgcaacctttcgacttgttatacgctagcggcgctgccgcttattattctggggactatgagcgggccgtccgggacctcgaagccgcgctgagatcccacagacgtctgcgggagatccgaacccggtgtgctcggcactgcgccgcacgccaccctttgccacctcccccacccggcgaaggaccaggagccgaactaccacttttcagatcactgttaggtcgcgcaaggtgttatcggagttgcgagactcagcggctgggaggtcccgcaagccggcaccgggtgtctgaagatgtgcgatcagactttcagcggagagtgccgtataattacctccagagagcttacattaaacttaatcagctcgaaaaagcagtcgaggccgcacatacgttttttgtggcaaatcccgagcatatggaaatgcagcaaaatatcgagaactatagagccacagcgggcgttgaagcgttacagttggttgacagagaagctaagccacatatggaatcctataacgcaggtgtcaagcattacgaggcagatgatttcgagatggccatccgccacttcgagcaggctctcagggagtactttgtagaggacacagagtgtcgcacattgtgtgagggtccccagcgattcgaggagtatgaatatttaggttacaaggcgggcctgtacgaggccatcgctgatcactatatgcaggtgttagtttgccagcatgaatgcgtcagagagttggccacacgaccggggagattatctccgatcgagaatttcctacctctgcactacgactatctccagtttgcctactatagggtgggtgagtatgtgaaggcactcgaatgtgcaaaagcttacctgctgtgccacccagacgatgaagacgtgctcgataatgttgattattacgagagcttgcttgatgactccatagaccctgcttcaatcgaggctagagaagatctgacaatgttcgtgaagagacacaagttagagagtgaactgatcaagagtgccgccgaagggctcggcttctcttacacggagcctaattattggattcgctacggtgggcggcaggatgaaaatcgtgtgccatcaggtgtgaatgtggaaggggccgaggtccatggctttagtatgggaaagaagttgagccccaagattgatcgagacttgcgcgaaggaggcccactgctttacgaaaatattaccttcgtttacaacagtgaacagctgaatggaactcagcgagtgctgctggacaatgttctcagtgaggagcagtgtagggagctgcatagcgtggcctcgggcataatgttggtgggagacggctatcggggaaagacttcccctcataccccaaatgagaaattcgagggagcaacagtgctcaaggctcttaagtccggctatgagggccgggtgccgctgaaaagtgccagactcttctacgacatctccgaaaaggctcggcgcatagttgaatcttacttcatgttaaattccaccttgtacttctcctacacgcatatggtgtgccgcaccgccttgagcggccagcaggacagaaggaacgatctttctcaccctattcacgctgataattgcctcttggaccccgaagccaacgagtgctggaaggagccacctgcctatacattccgggactattcagccctgctgtacatgaatgacgactttgagggcggagagtttattttcacggaaatggatgcgaaaaccgtcacggccagtatcaagccaaaatgtggccggatgatatccttctcttccggaggggagaatccgcacggagtgaaggcagtcacaaagggcaagaggtgtgcagtggcattatggtttacccttgacccactctatagagagctagaaaggatacaggctgacgaggtcatcgccattctggatcaggagcagcaggggaagcatgagctgaatattaaccccaaggacgaactctag

SEQ ID NO: 192841 - DNA, 1584 bp, Artificial Sequence
  Description of Artificial Sequence: Synthetic coding sequence
atggagatgcagcagaacatcgagaactaccgggccaccgccggcgtggaagcactgcaactagtagaccgggaagctaaaccacatatggaaagttacaatgctggcgtgaagcactacgaagcagacgacttcgaaatggccatcagacatttcgagcaggccctccgagagtacttcgtggaggatacagaatgccgcactctctgtgaaggccctcagcgatttgaagagtacgaatatcttggctacaaggcgggtctctacgaggccatcgctgatcactatatgcaggtgctggtatgccaacacgagtgtgtccgggagcttgctacaagacctggcagattgtcccccattgagaatttcctccctctgcactacgattatctccagtttgcctactatagagttggggagtatgtgaaagccctggagtgtgctaaagcatacctactgtgtcatcccgacgacgaagatgtgctggacaatgtggactattatgaaagtctgctggatgatagcatagatcccgctagtattgaggcccgagaggacctaacaatgtttgtcaagagacacaagctggagtccgaattgatcaaatccgccgcggaaggcctcgggttcagctacaccgagccaaattattggataaggtatggcggaagacaagatgagaatagagtgccttcaggagttaacgttgagggggccgaggtgcacgggttttctatggggaagaagctgtccccgaaaatcgatcgggacctacgggaaggaggccctctgctgtatgaaaatataactttcgtctacaactctgaacagttaaatggaacgcagcgggttcttcttgacaatgtcctgtcagaagagcaatgcagagagctgcatagtgtggccagcgggatcatgctggtgggggacgggtaccgggggaagacatctcctcacacaccgaacgaaaaattcgagggcgcgacagtgcttaaggcgctgaagtcaggatacgaaggtcgggtccccctcaagtcagcgcggcttttctacgacattagcgagaaggctaggaggatcgttgagagctactttatgcttaacagtacactatacttcagctatactcacatggtctgtcgcaccgcgttatccggccagcaggatcggcggaatgacctcagtcatccgatccatgctgataattgcttactcgaccccgaggcaaatgaatgttggaaggaaccccctgcgtacacctttcgcgattatagcgccctcctttatatgaatgatgatttcgagggaggagaatttatcttcaccgagatggatgcaaagactgtcacagcctcaattaaacccaagtgcgggaggatgatatccttctcttcggggggcgaaaatccacacggcgtcaaggccgtgacgaaaggcaagagatgcgctgtggcactgtggttcacacttgatcctctctatcgagaattggagaggatccaagccgacgaggtgatcgccattttggaccaggagcaacaagggaaacatgagctgaacataaatcctaaagacgagctgtag

SEQ ID NO: 192842 - DNA, 2721 bp, Artificial Sequence
  Description of Artificial Sequence: Synthetic coding sequence
atgatctgccagaagttctgcgtggtgctgctgcactgggagttcatttacgtgattacagctttcaacttgagttacccaatcacaccttggcgctttaaattatcctgcatgccgcctaattctacatacgattactttctcctgccggctggattgtccaaaaatacaagcaactctaacggacattatgagactgctgtggaacctaagttcaactcaagcggcacacatttttcaaacctgtcgaagactacattccactgctgcttccgatccgaacaggaccggaattgcagcctgtgcgccgacaacattgaaggtaaaacctttgtctccacagtgaatagcctggtgttccagcagatcgacgccaattggaatattcagtgttggcttaagggcgacctcaagcttttcatttgctacgtagagagcctcttcaagaatctgtttaggaattacaactacaaagtgcacctgttgtatgttcttccggaagtcctggaagacagccctcttgtgccccagaaaggtagcttccagatggtgcactgcaactgctctgtgcacgagtgttgtgagtgcctggtacctgtccctaccgctaagctgaatgatacgttgctcatgtgtttgaaaattacatctggtggcgttatatttcaaagcccgttgatgagtgtccagcccataaacatggttaagcccgaccccccccttggcctgcatatggagattacagacgacggtaaccttaaaatctcatggtcgtctcctccgttggttccctttccactgcagtatcaggttaaatactcagagaatagcacaaccgtcatcagggaagcggataaaatagtctctgcaacctctctgctcgttgacagcattttgccaggcagctcttacgaggttcaggtccgcggaaagcgcctggacggaccagggatctggtccgactggtcgaccccccgcgtttttaccacgcaggacgtaatttacttccctcccaaaatactgacctctgttggcagcaatgtaagctttcactgtatttataaaaaggagaacaaaatagtgccgtccaaggaaattgtctggtggatgaacctggcggagaagattcctcagtctcagtatgacgtggtttccgatcatgtgagtaaagttacattctttaatctaaacgagaccaagccccgcggtaaattcacatacgatgctgtctattgctgtaacgagcatgaatgtcaccacagatacgctgaactgtacgtcatcgacgtgaatattaatatctcatgcgagacagatgggtacctcaccaagatgacttgtcggtggagcacctccactatccagtccctggccgaatccacgcttcagctgcgctaccaccgatcttccttatactgttctgatatcccctccatacatcctatctccgagccgaaggactgctacctccagtctgacggtttctatgaatgcatctttcagcctatctttctcctttcggggtacactatgtggatcagaattaatcactctttgggttccctcgatagccctcccacttgcgttctgcccgacagcgtcgtgaaacctctgcccccttcatctgtcaaagctgaaataacaatcaacataggacttctgaagatctcctgggagaaacccgtgtttccggagaacaaccttcagtttcagattcgttacggtttgagcgggaaagaggtgcaatggaaaatgtatgaggtatatgatgccaaaagtaagagcgtcagcttaccggtgcccgacttgtgtgcagtgtacgcggtgcaggtgaggtgtaaaagactggacggcttgggatactggagcaactggagtaatcctgcttataccgtcgtgatggacataaaagtgcctatgagagggcccgagttctggagaattattaatggagacaccatgaagaaggagaagaacgtgactctgttatggaaacctttgatgaaaaatgattcactctgttctgttcagagatatgtcattaaccatcatacctcctgtaacgggacatggtctgaggacgttggtaaccacactaagttcaccttcctttggactgaacaagcccatacggtgacagtgctggcgattaactctattggcgcctccgtcgctaacttcaacttgactttcagctggcctatgtctaaagtcaatatcgtacagtctctaagtgcctatccattaaactcttcatgtgtgattgtttcatggatcctttcgcctagcgactataagctgatgtactttattattgaatggaagaatcttaacgaagatggtgagatcaaatggttgcgaatttccagtagtgtgaaaaagtactacatccacgaccacttcatcccaatagaaaaataccaattttccctgtacccaatattcatggaaggtgtggggaagccaaaaatcatcaacagtttcacacaggatgacatcgagaagcatcagtcggacgcaggcctatatgtaattgtgcccgttatcatcagctcaagcatactattactgggaactctcctcatctcccaccaacgcatgaagaagttgttctgggaggacgtgcccaatcccaagaactgttcatgggctcagggactgaacttccagaaaaagatgccagggactaaggagctgctgggaggtggctggctgacctag

SEQ ID NO: 192843 - DNA, 3498 bp, Artificial Sequence
  Description of Artificial Sequence: Synthetic coding sequence
atgatctgccagaagttctgcgtggtgctgctgcactgggagttcatatacgtcatcaccgccttcaacttatcttatcctatcactccttggcgtttcaagcttagttgtatgccccccaactctacttatgattacttccttctccctgcggggctgtcaaagaatacatccaattcaaacgggcattatgagactgccgttgaacctaagtttaactcatctggaactcacttcagcaacttatcaaagacgactttccactgctgctttagatctgagcaggaccggaactgcagtctgtgcgctgataatatcgaaggcaagacgttcgtttctacagtgaattccctagtttttcagcaaatcgacgccaattggaatattcaatgctggttgaagggagacctcaagctgttcatctgttatgtggaatcgttgttcaagaatctgtttagaaattataattataaggtgcatttgttatacgttctgccggaagtgttggaggacagccccttagtaccccagaagggcagctttcagatggtccactgcaattgcagtgttcacgagtgctgcgagtgtctcgtcccagtgcctactgccaagctaaacgatacactcctcatgtgcttaaagataacctctggcggcgtgatttttcagtcaccactcatgtcagtgcagcctatcaacatggtgaagcctgatccaccactgggactgcacatggaaatcactgatgatggaaatctgaaaatctcatggagttctccacctctcgtgccttttcccctgcagtaccaggtgaaatactcagagaacagtacaaccgtaatacgggaagcagacaaaatcgtatcagcaaccagcctcctggtagattcaatcttgccggggtcttcctatgaggtgcaggtgcgaggcaagcggctggatggcccagggatatggtctgactggtcaaccccccgcgtgttcacgacacaagatgtgatttacttcccccccaaaatcctcactagtgtggggagtaacgtgagctttcactgcatctataaaaaggagaacaaaatcgtacctagtaaggaaatagtctggtggatgaatctggccgagaaaataccacagagccagtatgacgtggtttctgaccatgtcagcaaggtcactttttttaaccttaatgagactaagcccagaggtaagttcacctatgatgccgtgtattgttgtaacgaacacgaatgtcaccatcgctacgctgaactctacgtgattgacgtaaacatcaacatatcctgtgaaaccgatggctatctcacaaaaatgacctgtaggtggtcaacatcaacaattcaaagtctggctgagtccactttacagctgaggtaccaccggagcagcctctactgtagcgatatcccttccatacacccgatcagtgagcccaaggattgctacctgcagagcgatgggttctacgagtgtatattccagcctatttttctgctctccggctacacaatgtggatcaggattaatcattctctcgggagcctagatagtcctcctacttgcgtgttgccggattccgttgtgaagcccctgccccccagctctgtgaaagccgagataacgattaacattggtcttcttaagatctcttgggagaaacccgtcttcccagagaacaacttacaatttcagattaggtacggtctgtccggcaaagaggttcagtggaagatgtacgaagtgtacgacgccaagagcaagtcagtgagcctaccagtgccggatctttgtgctgtttatgccgttcaagtgagatgcaagcgcctcgacgggctgggctactggtcgaactggagtaaccccgcctatacagtcgtgatggatatcaaggtgcccatgagaggtccggagttctggaggattataaacggcgacactatgaagaaagagaagaatgtgaccctgctgtggaaacctcttatgaaaaacgatagcctctgttccgtgcagcggtatgttataaaccaccacacttcctgcaatggaacttggagcgaggatgtggggaatcacacgaagtttacatttctgtggacggagcaggcacacacggtgactgtgctggccatcaattccatcggtgctagcgtagctaacttcaacttgacatttagttggcctatgagtaaagtcaatatagtgcaatctctctctgcctaccccctgaattctagctgcgtcatcgttagttggatcctgtctccctcagactacaagctgatgtatttcataatagagtggaaaaatcttaacgaagacggcgagatcaaatggctcaggatatcctctagcgtcaaaaaatactacattcacgaccacttcattccaattgaaaagtaccagttctcactttaccctatatttatggagggtgtcggaaagcctaagattatcaattcttttacgcaggacgacatagagaagcatcagtcggatgccggactgtacgtcatagtgcctgtgataatttctagctctattcttctgttgggcaccctcctgatctctcatcagcggatgaaaaaattgttctgggaggacgtgccaaacccaaagaattgcagctgggcacaaggactcaactttcagaaacctgaaaccttcgagcatcttttcattaaacacaccgcctcagtcacctgcggtccactactcctggaacccgagactatctccgaggatatttcagtggatacttcttggaagaataaggacgaaatgatgcccacaacagtcgtatcccttctctcgactactgacttggagaagggctcagtatgtatctctgatcagttcaacagcgtgaatttttccgaagctgagggaaccgaggtgacctacgaagacgagagccagcgacagccgttcgttaagtacgctactcttatttcaaactcaaagcccagcgagacgggggaggaacagggtctcattaactctagcgttacaaaatgtttttctagcaagaacagccctttgaaagattcattctcaaatagctcctgggaaatcgaagctcaggcgtttttcatcctgtccgaccagcaccccaacatcattagcccccatttaacgtttagtgagggcctcgatgaactcctaaaacttgaggggaacttccccgaagaaaataacgacaaaaagtccatctactatttgggcgtgacctccatcaagaagcgagaaagcggcgtgctgttgactgacaagagccgggtctcttgccctttcccagcgccgtgcctgttcaccgacatccgtgtacttcaggacagctgtagtcactttgtggagaacaatattaacctgggcacttcttctaaaaagactttcgcaagctacatgccacagttccagacctgcagcacgcagactcacaaaattatggagaacaaaatgtgtgacctcacagtgtag

SEQ ID NO: 192844 - DNA, 2721 bp, Artificial Sequence
  Description of Artificial Sequence: Synthetic coding sequence
atgatctgccagaagttctgcgtggtgctgctgcactgggagttcatatatgttattacagcgttcaacctcagttatcctattaccccttggcggttcaagctcagttgcatgccaccaaactctacatatgattactttctgttaccagccgggcttagtaagaacacctctaattccaatggccattacgaaaccgctgttgaacctaagtttaacagctcagggacgcacttctctaatctcagtaaaacgacttttcactgttgcttccggtccgaacaggatcggaattgcagtctgtgtgcagacaacatcgaaggcaaaacttttgtatctacagtaaactctctcgtctttcaacagatcgatgcaaactggaacatccagtgctggttgaaaggggatctgaagcttttcatctgttatgtcgagtcattattcaaaaatctgtttcgcaactacaattacaaagtgcacctgctctatgtcctaccagaagttcttgaggacagtccacttgtgccccagaagggatcctttcagatggtgcactgtaattgtagcgtccatgaatgctgtgaatgcctggttcccgtcccgactgcaaagctgaacgacactctgctcatgtgcctgaaaattacctccgggggcgttatctttcaaagtcctctcatgtctgtccaacccatcaacatggttaagccagatccaccactcggtcttcatatggagatcaccgacgacggcaacctgaagatcagttggtcttcccctcctttagtccccttcccattgcagtatcaggtgaagtatagcgaaaattccaccaccgtgatccgcgaggccgacaaaatcgtgagcgccacttcgctcctggttgatagtatcctgcctggatcgtcctatgaagtccaggtgcgcggtaagcgcctcgacggacctggaatctggtccgactggtcgactccccgggtgttcacaacgcaggatgtaatttatttccccccaaaaatcctgacctccgtcggaagcaacgtctcttttcactgtatttacaaaaaggagaacaaaatcgtgccgagtaaagaaattgtgtggtggatgaacctcgcagaaaaaattcctcaatcccagtacgacgtggtgagcgatcacgtcagtaaggttacattttttaatttgaatgagacaaaacctaggggaaagttcacctacgacgctgtgtactgttgtaatgagcacgagtgccatcatcgctacgccgaactatatgtgatcgatgtcaatatcaatatttcatgtgagaccgacgggtatcttacaaaaatgacctgcaggtggagtactagtacgatacagagcctggccgaatccaccctccaattacggtaccacaggtcttcactctattgttccgacataccatcaatacaccctatctctgagccgaaggactgctacctgcaatccgatggattctacgagtgcattttccagcctatctttctgctaagcggatacactatgtggataagaattaatcattcactgggtagtctggatagccctcccacctgtgtcctgcccgattctgtcgtaaaaccgctgcctcctagtagcgttaaggctgaaatcacaattaacatcgggctcctgaagatcagttgggaaaagcccgtgttccccgagaacaacttacagttccaaatcagatacgggttgtccggtaaggaagtgcaatggaagatgtacgaggtgtacgatgccaaaagcaaaagtgtgtctcttccagtgcccgacctctgcgctgtttatgctgttcaggttcgatgtaagagactggacggtctgggttactggtcaaattggagcaacccagcttatactgtagtcatggatatcaaggtccctatgagaggcccagagttttggcgtatcattaacggtgacacaatgaagaaagagaaaaatgtcaccctgctgtggaagcccttgatgaaaaatgatagcctgtgttctgtgcagcgatatgtaattaatcatcacacatcttgtaatggaacgtggtctgaagacgtagggaaccatacaaagttcacatttctgtggacagaacaggcccacacagtgacggttttggcaataaacagcatcggcgcatcagtagctaactttaatctgaccttttcttggccgatgtcaaaggtgaacatagtgcagtctctgtcggcctatcccctcaactccagctgtgtgatcgtctcctggatcttgagtcctagtgactataagctgatgtacttcatcatagaatggaagaatctcaatgaggacggcgagatcaaatggctccgcataagcagtagcgtgaagaagtattacatccatgaccactttatccctatcgagaaatatcagttttccctctaccccatctttatggagggggtgggaaagccaaagattataaacagtttcacgcaagacgatatcgagaaacaccagtcagatgctggtctgtatgtgatcgtccccgtcattatctcttcctcaattctgctactgggaaccctgttgatcagccaccagcgcatgaagaagctgttctgggaggatgtgccgaacccaaaaaactgctcatgggctcaggggctcaactttcagaagaaaatgccgggtacaaaggaacttctggggggcgggtggctgacctag

SEQ ID NO: 192845 - DNA, 2877 bp, Artificial Sequence
  Description of Artificial Sequence: Synthetic coding sequence
atgatctgccagaagttctgcgtggtgctgctgcactgggagttcatttacgttatcactgctttcaatctttcctaccccatcacaccttggcggtttaagttatcctgcatgccacccaacagcacgtacgattatttcctcttgcctgctggtctcagcaagaacacatccaatagtaacggccattatgaaaccgccgttgagccaaaattcaacagcagcgggacccacttcagtaacttgtccaaaacaacatttcactgttgtttccggtctgagcaggacaggaattgctctctatgcgccgataatattgaagggaagaccttcgtctcaaccgtgaatagtttagtttttcaacagatcgatgcgaactggaatatccagtgttggctcaagggggatctgaaactgtttatctgctatgttgaatccctgttcaaaaatctgttcaggaattataactacaaggttcacctgctctatgtgttgcccgaagttctggaggattctcctctggtgcctcagaagggatcttttcagatggtgcactgtaactgtagcgttcacgaatgctgcgaatgtctcgtacccgtgcccacagccaagctgaacgacacccttttaatgtgtttaaagatcacctcaggtggcgtgatcttccagagccccttgatgtctgtccaacctattaacatggtcaaaccagaccctccactgggcttgcatatggagattacagatgatgggaacctgaaaattagctggtcatcgccaccccttgtacctttccctctccaatatcaagtcaagtactcggaaaacagcaccacggtcatcagggaggcggataagattgtgtctgctacaagccttttagtggattcaatcctgccagggtctagctacgaggttcaggtgagaggaaaacgactcgatggcccgggtatctggagtgattggagtactccacgtgtgtttaccacccaggatgtgatttatttccctcctaaaattctgacatctgtggggagtaatgtatctttccattgcatctacaagaaggaaaataagattgtaccaagtaaggagatcgtgtggtggatgaacctggccgaaaaaattccccagtcccagtacgacgtggtttcagatcacgtgtccaaagtgacctttttcaatctcaatgaaactaaaccgcgcggcaaattcacctacgatgccgtatactgctgtaatgagcatgaatgccaccatcggtacgcggagctatacgtgatcgacgtaaacatcaatatatcgtgcgagacagacggttacctcaccaagatgacatgccgatggagcacgtccactatccagagccttgccgaatcaacactacaactgcgttaccacaggtcatccctttattgctcagacattcctagtattcacccaatttccgagccgaaggattgctatttgcagagcgacggattttatgaatgtatctttcagcctatttttttgttgtctggctacacgatgtggatccgaatcaatcactctctgggatcactggatagcccaccgacctgcgtgctgcccgatagcgtggtgaagcccctccccccatcatcggtcaaggctgaaataactattaatatcggactgttgaaaatttcgtgggagaagcccgttttcccggaaaataacctgcagtttcagatcagatacggattaagtggcaaggaggttcagtggaagatgtacgaggtttatgacgctaagagcaaatcagtgtccctgcccgtgccagacctttgcgcggtgtatgctgtacaagtgaggtgcaagaggttggatggcttgggatactggagcaattggtccaaccccgcttacactgttgtcatggatattaaggttcctatgcgcggacccgaattttggaggattataaatggcgacactatgaagaaagaaaaaaatgttacactgctgtggaaaccgcttatgaaaaatgactctctctgcagcgtacagagatacgttatcaatcatcacacgtcatgcaatgggacatggagcgaagacgtcgggaaccacacaaaattcacctttctgtggactgagcaggcccacactgtgactgtgctggccattaattccatcggggcctccgtagcaaatttcaatctgacattcagctggcccatgtccaaagtgaatatcgtccaaagcttgtccgcctatccactgaattcctcctgcgttatcgtaagttggatcttgtccccatccgactacaagctcatgtactttattattgagtggaagaacctcaatgaggacggggaaatcaagtggctgcgcatcagttcctcagttaaaaaatattacatccatgatcacttcatccctattgagaagtaccagttctcactgtaccccatattcatggaaggcgtcggtaaaccaaaaattattaattccttcacccaggacgacattgaaaagcatcagtccgacgctgggttgtatgttattgtccctgtcatcatctccagtagtattttgctgctgggaaccctactgatctcccaccagaggatgaagaagctgttttgggaagacgtgcctaaccctaagaattgcagctgggcgcagggccttaatttccaaaaaatgcttgagggcagcatgttcgtaaagagtcatcaccattcgctcatcagtagcacgcaggggcacaagcactgcggccgaccccagggcccactgcaccgaaaaaccagagacctgtgttcattggtgtatctactgacgctcccccctttactttcttatgatcctgctaagtccccatccgtccggaacacgcaggagtag

SEQ ID NO: 192846 - DNA, 2691 bp, Artificial Sequence
  Description of Artificial Sequence: Synthetic coding sequence
atgatctgccagaagttctgcgtggtgctgctgcactgggagttcatttacgtaataactgctttcaatttgtcctacccgatcacaccatggcgctttaaactgtcatgcatgccaccaaatagcacatatgactatttcctccttccggcaggactgagcaaaaacacgtctaattctaacggtcactacgagactgccgttgagccaaagtttaactcttccggcacccacttcagcaatttgagcaaaacaacattccactgctgttttcggtcggagcaggatagaaattgttccctttgtgctgataatatcgaggggaaaactttcgtgtcaactgtaaattcgttagtgtttcagcagatcgatgcaaattggaatattcagtgttggttgaagggagacctgaagctctttatatgctatgtagagtcgctctttaagaacctgtttcggaattacaattacaaggtgcacttactgtacgtgctgccggaggttctggaagattcgcccctcgtgcctcagaaaggttcattccagatggtgcactgcaactgctctgtgcatgagtgttgcgagtgcctagtccccgtgccaacggccaaactcaatgacaccctcctgatgtgcctgaagatcacgtccggaggcgtgatctttcagtcgccactgatgtccgtccagcctatcaacatggtcaagcccgacccgcctctcggtctccatatggaaatcaccgacgacggcaatcttaagatcagctggagttcgcccccactcgtgccattccctctgcagtatcaggtgaaatacagcgaaaatagcactactgtcatccgcgaggcagataagatcgtctcagctacctccctgctggtggatagcatcctgcctggatcaagctatgaggtacaagtgcgcggaaagagattagacggccctggcatctggagcgattggtcgacccctcgggttttcacaacacaggatgtcatctacttcccgccaaagatactcacctcggttggctccaacgttagcttccactgcatctataagaaggagaataagattgtaccaagtaaggaaatcgtgtggtggatgaatctcgccgaaaagatacctcagagccaatatgacgtggtctccgatcatgtgagtaaggtcacttttttcaatctgaatgagacaaagcccaggggaaagtttacctacgatgcagtctactgctgcaatgaacacgaatgccatcataggtacgccgagctgtatgtgattgatgtgaacatcaacataagctgcgagaccgatgggtatctgaccaaaatgacctgtcggtggagtacatctacaatccagagcctggcagagagcactcttcagttaagatatcaccgatcatccctctattgctccgacattccatcaatacaccccatttccgagccaaaagactgctacctccagtccgacggattttatgagtgtatctttcagcccatattcctactatctggatatactatgtggattcgcataaatcatagcctcggttcactagattctcccccaacctgcgtgctaccggattctgtagtcaagcctttaccccctagcagcgtgaaggccgagataacaattaatatcggactgctgaaaataagttgggagaagcccgttttcccagagaacaatttacaatttcagattcggtacgggttgagcggtaaagaggttcaatggaagatgtacgaggtttatgacgctaagagcaaatctgtgtccttgcctgtgcccgacctatgtgctgtctacgccgttcaggtccgctgtaaacgactggacggactgggctactggtccaattggtctaacccagcctacaccgtcgtgatggacatcaaggtgccaatgcgcgggccagagttctggaggattatcaacggtgacacaatgaagaaagagaaaaatgtcacattgttgtggaaacctctgatgaagaacgacagcttatgttcggtgcagagatacgttattaaccatcatacaagttgcaatgggacatggagcgaggacgtcgggaaccatacaaaatttacattcctttggacagagcaagctcacaccgttacagttttggccattaacagcatcggggcctcagtggccaacttcaacttgactttctcctggccaatgagcaaggtgaatatcgtgcagagcctctcagcttaccctctgaatagctcttgcgtaattgtgtcatggattctctccccctccgactataaattgatgtatttcatcattgaatggaaaaacttgaacgaagacggagagatcaagtggttacgcatcagctcctccgtcaaaaagtactacattcacgaccacttcatccccatagagaagtatcaattcagcctgtatcccatttttatggagggtgtcgggaaaccaaagatcattaacagctttacacaggatgatatcgagaagcatcagtcagatgctggcctgtatgtcattgtgccagtgatcataagttcaagtatccttttgctggggaccctcttaatttctcaccaaagaatgaaaaaattattctgggaggacgttcccaatcccaaaaactgctcttgggctcagggacttaacttccaaaagcggacagatatactttag

SEQ ID NO: 192847 - DNA, 699 bp, Artificial Sequence
  Description of Artificial Sequence: Synthetic coding sequence
atgatgcccaccaccgtggtgagcctgctgagcaccaccgacctggagaaaggcagcgtttgtattagcgatcaatttaactccgtaaatttctctgaagctgagggcactgaggtaacatacgaagacgaatcccagcgccaaccgtttgtgaaatacgcaactctgattagtaactccaagccctctgaaaccggcgaggagcagggcctcatcaattccagcgtgactaaatgcttcagttctaagaattccccactgaaggactccttcagcaactctagttgggagattgaagcccaagccttcttcatcctttcagaccagcatcctaacatcataagcccgcatctgaccttcagtgaggggttggacgagcttctcaaactggaggggaactttccagaagagaataacgataaaaagtcaatatattatctgggagttacctcaatcaaaaaaagagaatctggggtcctcttgaccgacaaatcccgcgtgagttgtccattccctgccccttgtctgtttaccgacattcgcgtactgcaggactcctgttcgcactttgtggaaaacaatatcaatctgggcactagtagtaagaaaactttcgcttcatatatgccacagttccaaacttgttctacccagacacacaagatcatggagaacaaaatgtgtgaccttactgtttag

SEQ ID NO: 192848 - DNA, 396 bp, Artificial Sequence
  Description of Artificial Sequence: Synthetic coding sequence
atggccggcgtgaaggccctggtggccctgagcttcagcggcgccatcggattgaccttcttgatgctgggttgcgccctggaggattacggtgtctattggcctctgttcgtactaatttttcatgccatttctcccatcccccacttcatcgctaaacgagtgacctatgatagcgatgccacaagctctgcgtgccgagaacttgcctatttttttacaacgggaatcgtagtgtctgccttcggcttccccgtgatcctggctagggttgctgtgattaagtggggtgcctgcggccttgtgctggctgggaacgccgtcatcttcctgactatccaagggtttttcctgatatttggcagaggtgatgatttctcctgggaacagtggtag

SEQ ID NO: 192849 - DNA, 396 bp, Artificial Sequence
  Description of Artificial Sequence: Synthetic coding sequence
atggccggcatcaaggccctgatcagcctgagcttcggcggcgccattggtctgatgtttctgatgctagggtgcgctctgccaatatataacaaatactggcccctgttcgttctctttttctacattctgtcccccattccatactgcatcgcaagaaggctggtggacgataccgatgccatgagcaatgcctgtaaagaactagccatcttcctaaccaccggtatcgtcgtaagcgcattcggcctccccatcgtttttgcccgagcacatttgatagagtggggggcctgtgctttggttctgaccggcaataccgttatttttgccaccattctaggcttctttttggtgtttgggtctaatgacgactttagctggcaacaatggtag

SEQ ID NO: 192850 - DNA, 510 bp, Artificial Sequence
  Description of Artificial Sequence: Synthetic coding sequence
atggccggcatcaaggccctgatcagcctgagcttcggcggcgccatcgggcttatgttcctgatgctggggtgtgcactgcccatttataacaagtactggcccctgttcgtgctgttcttctacattctttccccaattccatattgtattgctcggcgattggtggatgatacagacgccatgtccaatgcctgcaaggagctcgctatcttcctcacaactggtattgtggtgtctgccttcggcctgccgatcgtattcgcccgagctcatctgatgggccggctcccatttttcagtaagatgggaactgctgagtccgaaggcagggaaaccctaacacagcaactgcccttgccggccgcagccatgcgacgactgctgcctgctagccgcgtgagcactcaacccgtccttcggcttgctgattccgcagaatctctgcttgggcgccccgctctgtgggcactcgggtttctgctgtgcccaccaagtcaggcccagtag

SEQ ID NO: 192851 - DNA, 3195 bp, Artificial Sequence
  Description of Artificial Sequence: Synthetic coding sequence
atgatgaagttccggttccggcggcagggcgccgacccccagcgggagaaattgaaacaggaacttttcgccttcaacaagactgtcgagcatggctttcctaaccagccttcagcccttgcttttgacccagaactgagaataatggctattggcaccagatctggcgctgtgaaaatctacggtgctccaggggtagagttcaccggcctccacagagacgccgctactgtgacacagatgcacttcctgaccggtcaaggtagactcctgtcgctgctggatgactcatctctgcacctatgggagatcgtccaccataatgggtgtgcgcaccttgaggaggccctcagcttccagctgccatctcgccccggcttcgatggtgcctctgcccccctgtcgctgacaagggtgaccgtcgtgctgctggtcgccgcgtctgatattgctgccctgggaaccgagggcagctctgtgttcttcctggacgtgaccacccttaccctacttgaaggccaaacgttggcccccggagaggtgctgaggtccgttcctgacgattacaggtgcggtaaggcgttggggccagttgagagtctgcagggtcatctccgggatccaacgaagatcctcatcggctacagtcgaggcctgctggtgatatggaaccaagcctcccaatgtgttgaccacatattcttaggaaaccagcagctcgagtctctgtgctggggacgcgactccagtactgtcgtttcttcacattcggatggtagctacgctgtgtggtcggtagatgccggttcatttccaacattacagcctaccgtggccacgacaccttatgggccgttcccatgcaaggccatcaacaagatcctatggcggaattgcgagagcgggggacacttcatcatcttctcaggaggcatgcctcgagccagttacggcgatcggcactgcgtctccgtgttacgcgccgaaactttggtgacactggacttcacatccaggattattgacttctttacagtgcattcaacaagacccgaagacgagtttgatgacccacaagcactcgccgttctgctcgaggaggagctcgtagtgttagacctccagacccccggctggcccgcagtgcccgcgccttacttggcgcccctgcattcatctgccatcacctgctcggcccacgtcgcatccgttccagctaaactatgggctaggatcgtgagcgccggggagcagcagtctccacagccagtgtcatcggccctcagctggccgattacgggcggaaggaacttggcacaggaaccgtcccagaggggcctgctgctcactggccacgaggatggtaccgttaggttctgggacgcatcgggtgtggctctccggcctctgtataagctgtcaacggccgggttgtttcagactgactgcgaacacgcagatagtttggctcaggcagctgaggatgattggcctccatttaggaaggtgggctgctttgatccttatagcgacgaccctcgcttaggggtgcagaaagtagcactctgcaagtatacggctcagatggtcgttgcaggtaccgctggccaggtactcgtactagagctgtcagacgtcccagtggagcaggctgtaagtgttgccatcatagatttgctgcaagatagggagggatttacctggaaggggcacgaacggctatctcctcgaaccggccccttaccttggcctgctggtttccagcctcgggtgttggtgcagtgtctgccccccgctgccgtcacagcggtgaccctgcacaccgaatggagcttagtcgctttcggcacgtctcacggttttgggttatttgactaccagagaaaatctccagtgctggcaaggtgcactcttcatcccaacgattccctggccatggaagggccactgtcccgagtgaagtccctgaagaaatccctgagacagagctttcgccggatcaggaaatcacgcgtgtctggtaagaaaagagctgctaacgcctccagcaagttgcaggaggcaaatgcccagttagccgaacaggcatgcccacacgatgtggagatgaccccagttcagcggaggatagaaccccggagcgccgacgacagtctgagcggggtggtcaggtgcctgtactttgctgataccttcctgagggatggtgcccaccacgggcccaccatgtgggccggtaccaattctgggtcggtctttgcatatgctttggaagtgcctgccgccgccgttggtggagaaaagcgacccgagcaagcagttgaggctgtcctgggtaaggaagtgcagttaatgcacagggctccagtggtcgccatagctgttctggacgggcgcgggcggcccctccctgagccctacgaggccagtagagaccttgcacaggctccagacatgcagggagggcacgccgtcctgattgcatcggaagagcagtttaaagtttttaccctgcctaaggtgtctgccaaaacaaaattcaaactgaccgcacacgaaggatgtcgcgtccggaaggtcgcccttgccacctttgcaagcgtcgcgtgcgaagactacgccgagacctgcctcgcctgcctgaccaaccttggggacgtgcatgtgttctcagtccccggactgcgcccgcaggtgcactactcttgcattcggaaggaagatatctctgggattgccagctgtgtctttacgcggcatggccagggcttttacctgatcagtccaagcgaattcgaaaggttctcactgtccgccaggaacataacagagccgctgtgtagtctcgatattaattggcctagagacgctactcaggcatcttatcggattcgtgaatcccccaaactctcgcaggctaatggcacacccagcattctgctggctcctcagtccctcgacgggtccccggatcccgcccattctatgggaccagacaccccagaaccccccgaggcagccctgagtcctatgtccattgattctgcgacttcggccgacactacattggatacaaccggggacgtgactgtagaggacgtgaaagattttctcggcagctctgaggagtccgaaaagaatctcagaaatcttgccgaggatgaagcccacgcctgcgcgattctcatcaagtag

SEQ ID NO: 192852 - DNA, 1056 bp, Artificial Sequence
  Description of Artificial Sequence: Synthetic coding sequence
gagctgcccagcgccgcccccgacagcaccctgctgctgaccgcccagcactgggtggctaatctgtttatcctggccactctgattggatggaccgtgcggtccttcttcctgggaaggatggaaacttgttgctcacacctggggcttcgctccggaaggagattcgccgtctctatcggatactggcacgacccctacattcagcactttgtgcgcctgtcaaaggaaaggaaagccccggaaatcaatcgcggttactttgccagggtacatggcgtgtctcagctgataaaggccttcctacgtaaaacagaatgccactgtcagatcgtgaatctgggggcaggaatggatactacattctggcggctaaaggatgaggatctgcttccatccaagtacttcgaagtcgattttcctatgatcgtgactagaaagctgcattcgatcaaatgcaagccccctttgtccagcccaatcctcgaactccatagcgaagacacactgcaaatggacgggcacattctggactcaaagcggtatgctgtgatcggcgccgatctcagagatctgtcagagctggaggagaaacttaagaaatgcaatatgaatactcagctccctaccctgttgatagctgagtgtgtgcttgtttacatgacaccggaacagtcagctaacctactgaaatgggccgccaatagctttgaacgcgcgatgttcattaactacgaacaagttaacatgggcgataggtttggccagattatgatagagaaccttcggcggagacagtgtgatctagccggcgtcgaaacctgcaaaagcctggaaagccaaaaggaacggctgctaagcaacgggtgggagaccgcttccgcagtggacatgatggagctttataatcgcctacctcgagcagaggtgtcgcggattgaaagcctcgaatttctggatgagatggagctgctggaacaactcatgcggcactactgcctgtgctgggcgacaaagggcggaaatgaattaggcctgaaggagatcacttattag

SEQ ID NO: 192853 - DNA, 840 bp, Artificial Sequence
  Description of Artificial Sequence: Synthetic coding sequence
atggccacccggcagcgggagagcagcatcaccagctgctgcagcacatcatcttgcgacgctgatgatgagggcgtccggggcacctgcgaagacgccagtctgtgcaagaggttcgccgtgtcaatcggttactggcacgacccctatattcagcactttgtaaggttatccaaggagcgcaaggcacctgagatcaacagaggctatttcgccagagtgcacggggtgtctcaactgatcaaagcctttttgcgtaagacagagtgtcattgtcagatcgtgaacttaggcgctggtatggacacaaccttttggcgcctgaaagacgaggatctgttgcccagtaaatacttcgaggtcgacttccctatgattgttaccagaaaattgcactccatcaagctgccaactctgcttatcgccgaatgtgtcctagtgtacatgactcctgaacagtccgcaaatctattaaaatgggccgcaaactcctttgagagggccatgtttattaactacgaacaagtcaacatgggtgaccggtttgggcagattatgatcgagaatttgagacgacgccagtgtgacctggcaggcgtagagacatgcaaatctctggagtcacagaaggaacggctcctgtcaaatggatgggagacggcttcagccgtggatatgatggaactttacaaccggcttcccagagctgaggtcagtcggattgagagtctggagtttctggacgagatggaactgctcgaacagctgatgcgtcactattgtctgtgctgggctacaaaggggggtaatgaactgggcctaaaggaaatcacatactag

SEQ ID NO: 192854 - DNA, 1005 bp, Artificial Sequence
  Description of Artificial Sequence: Synthetic coding sequence
atggccacccggcagcgggagagcagcatcaccagctgctgcagcacgagcagttgcgatgctgatgacgagggtgttagagggacatgcgaggatgcgagcttatgcaagcgcttcgccgtttcaatcggatactggcacgatccctatatacagcattttgtccgcttatcgaaggagcgaaaagctcccgagattaatcgaggctacttcgccagagtgcatggggtttcacagctgattaaggcgtttctaaggaaaaccgagtgtcactgtcaaatcgtcaatctgggagccgggatggacacaactttctggagactaaaggatgaggacctcctgccatctaaatacttcgaagtagattttcctatgatcgtgactcggaagctgcatagtatcaagtgtaagccgccattgagcagccccatcctcgagctgcactctgaagacaccctgcagatggacggtcatatccttgactccaagcgatacgccgtgataggtgctgatctgagagacctgtcagagcttgaagaaaagctcaaaaagtgcaatatgaatacccagttgcctacactccttatcgccgaatgcgtgcttgtttatatgacacctgagcagtctgccaatctgctgaagtgggcggctaacagtttcgaacgagcaatgtttattaactatgaacaggtgaatatgggagacagatttggccagattatgatcgagaatctcaggcggcgacagtgtgatttggccggggtagaaacctgtaaatccctggagtctcagaaggaaaggctgctcagtaacggctgggagaccgcctcagccgtcgacatgatggaactttacaatcgactgcctagagccgaggtctcaaggatcgaatcccttgagtttcttgacgaaatggaactgctggagcagctgatgcgacactactgcctttgctgggccacaaaaggcggcaacgagctcggcttgaaggaaatcacatactag

SEQ ID NO: 192855 - DNA, 2415 bp, Artificial Sequence
  Description of Artificial Sequence: Synthetic coding sequence
atggccgtgcgggccctgaagctgctgaccaccctgctggccgtggtggccgcagctagtcaggccgaggtagagtcagaggctggatggggaatggtcacgccagacctgctgttcgcggaggggacagctgcatatgctcgcggcgattggcctggggtggttctctctatggaaagggcgctcagaagcagggccgctctgcgggccctgcgtctgcgctgtagaactcaatgtgcagctgacttcccctgggagctggatcctgattggtccccatctcccgcgcaggcctctggagccgctgctctgcgggatctttcgttcttcggggggttgctccgcagagcagcgtgcctcaggagatgcctcggtcctcccgccgcacatagtctcagcgaggaaatggaacttgagttccgaaagcgcagcccgtacaattacctccaagttgcttatttcaaaatcaacaagcttgagaaggcggtcgcagccgcccatacgttctttgtcggcaaccccgaacacatggaaatgcagcagaaccttgactattaccagacaatgtcaggcgtgaaagaggcagatttcaaggatctggaaacacaaccccatatgcaggagtttcggcttggcgtgaggctatatagtgaggagcagcctcaggaagcagtgccccacttggaggcagccttacaggaatacttcgttgcttacgaagagtgccgcgcgctgtgcgagggcccatacgactatgacgggtataattatctggagtacaacgctgacctatttcaggctatcaccgaccattatattcaggtgcttaattgtaagcagaattgtgtgactgagctagccagccatccctcacgcgagaagccttttgaagacttcttgccttcccattataattatttgcagttcgcatattataacatcggtaactatacccaggccgtggaatgcgccaagacttatcttctcttttttcctaacgacgaggtcatgaaccaaaacctggcttattacgccgcgatgttgggtgaagaacacacccggtcgatcggcccaagggagtctgccaaggaatatcgacagcgttctctgcttgagaaggaattgctgtttttcgcgtatgacgtgtttggaatcccattcgtggaccccgatagctggacaccagaggaggtgattccaaagaggcttcaagagaaacagaagagtgaaagagaaaccgcggtacgcatctctcaagagattggaaacttgatgaaggaaatcgagaccctcgttgaggagaagacaaaggaaagcctcgacgttagtaggctgacgagggagggaggaccactgctgtacgagggaattagcctgacaatgaacagcaaactccttaatggatcccaaagggtcgtgatggatggtgtgattagcgatcatgagtgccaggaactccagcggctaaccaatgtcgctgctaccagcggcgacggatacagggggcaaacctcgccccacacgccaaacgagaaattctatggagtgaccgtgttcaaggcgttgaaactcggacaggaaggcaaggtcccattgcaaagtgcccacctgtattataatgtgacagagaaggttcggaggattatggagagttacttcagactggataccccattgtatttcagctattctcatctggtgtgtaggacggcaattgaggaggtacaggcagaacgcaaggacgactcacacccagtccatgtcgataactgtatactcaatgcagagactctggtttgcgtgaaggagccaccggcgtacaccttccgagactatagcgctatcctgtacctgaacggcgacttcgacggcgggaatttctatttcacagaactggacgcaaaaaccgttacagcggaagtgcagccacagtgcggtcgcgcggtcggctttagttctggaactgagaaccctcacggagtgaaagctgtgacccggggtcaaaggtgcgccattgccttgtggttcaccctggacccacggcatagtgagagggtccgggcggccagagcaggcgaatcctcttggtgctgcggggatccattccctgagcgtccatggtttgcattcctgttccccaaatctcattgtcagtggctgagacacgagaggtctacatgggacacgagcagcaacgcactgtccctgtggagtcattgtttggtgttgccgggtccggccgtgaatgggattcaggtcgggaaagaagtcaaaaccgggagtgatgcagaatttctcgttccttccctgggtccaacaagcgcagtgctcttccagcgtgtcggacccgcagggaaagagatgtctttgggcccactcagaaatctcccttgtcccctgggcagcagctcatag

SEQ ID NO: 192856 - DNA, 2211 bp, Artificial Sequence
  Description of Artificial Sequence: Synthetic coding sequence
atggccgtgcgggccctgaagctgctgaccaccctgctggccgtggtcgccgctgcctctcaggcagaggtcgagtccgaagctggttggggcatggtcacgccagatctcctcttcgctgagggcacagctgcttacgcaaggggagactggccaggagtcgtgctttctatggagcgcgcactccggagccgagctgcactccgggcactccggctgcggtgcaggacgcagtgcgcggctgattttccttgggagctcgaccctgactggtcgccctcgcccgcgcaggccagtggagcagccgccctgagggacctgagtttctttggcggcctgctacggagggccgcttgcctcagaaggtgtctcggccctcctgctgcccactccctgagtgaggagatggagctggaattccggaaacggagtccgtacaattacctgcaggtagcttacttcaaaatcaacaagctcgaaaaagctgtggccgcagctcacacattcttcgtcggcaaccccgaacacatggaaatgcagcaaaaccttgactactaccagaccatgagtggagtgaaagaggcggacttcaaagaccttgagacccaacctcacatgcaagaatttcggctaggggtcaggctgtattctgaggagcagcctcaggaggcagtgcctcaccttgaagcagcgcttcaggagtatttcgtcgcatatgaagagtgccgcgctctgtgcgagggcccatatgactacgatggctacaattacctcgaatacaatgcagacctgttccaggcaattacggaccactatatccaagttctgaactgtaaacaaaattgtgtcacagaactggcatcacaccccagcagggagaaaccgttcgaggactttcttcccagccactacaattacctgcaattcgcctattataatatcggtaattacacccaagccgtggagtgcgccaagacatatctcttgttcttcccaaacgacgaagtgatgaaccagaatctggcttactacgctgctatgctgggggaggaacacacccgaagcatcggcccacgtgagtcggcgaaagagtacagacagcggtctcttctcgagaaagaactcctgttcttcgcgtatgatgttttcggaataccattcgtggatcccgattcttggactcctgaggaagtgattcccaagagactacaggagaagcaaaagagcgaaagggaaacggcagtgagaatttcacaggaaatcggcaacttgatgaaggagatcgaaacacttgtggaggagaagaccaaggaatcccttgacgtaagccggctcaccagggaggggggccccctgctgtacgaaggtatatcacttactatgaatagcaaacttctcaatgggtcccagcgagtggtgatggatggtgtgatttcagaccacgagtgtcaggagcttcagcgcttgaccaatgtcgccgccacatcaggtgatggctacagaggccaaacgtctccacacacacctaatgagaaattttacggggttaccgtgttcaaagccctgaaactcgggcaggagggaaaagtacctctgcagtcggcgcacctgtactacaatgtcactgagaaagtgaggcgtattatggagagttacttccggttggacaccccactgtacttttcctactcgcatctggtatgcagaacagccattgaggaagttcaagcagagcgcaaggacgactcacacccagtgcatgtggacaattgcattttgaatgccgaaacgttggtttgtgtcaaagaacctccagcctataccttccgtgattatagcgctatactgtacttaaatggcgattttgatgggggaaacttctatttcaccgagttggacgctaagacagtgaccgcagaagtgcagcctcagtgcgggagagctgtcggattctcctcaggaaccgagaatccacatggggtgaaagccgttactcggggtcagcgatgcgcaattgctctctggtttacattagacccacgtcactcagagcgagaccgggtgcaagctgatgatcttgtaaagatgctgttctcacctgaggaaatggatttgagtcaggagcaaccactggatgcacagcagggacctcctgaacccgcccaggaatccctcagtggatcagagtctaagcctaaggatgaactttag

SEQ ID NO: 192857 - DNA, 2094 bp, Artificial Sequence
  Description of Artificial Sequence: Synthetic coding sequence
atggccgtgcgggccctgaagctgctgaccaccctgctggccgtggtggcggcagccagtcaggcagaggttgagagcgaggctggatgggggatggtcactccagatttgctgttcgctgagggtacggcagcctacgcaaggggagattggcctggagtggttctatccatggagagagccctgcgatctcgcgcagctttgagggcactgagactgcgctgtaggacccagtgtgcagccgatttcccttgggaactggaccccgactggtccccctcccccgcccaggcttccggcgccgctgccctgcgggacctcagctttttcggcggtctgttgcggcgcgccgcatgtttgcggagatgcttagggcctccagctgctcactctctcagtgaggaaatggagctggaatttagaaagcgttcaccctataactatttgcaggtagcatacttcaagattaacaagctggaaaaggccgtggccgctgcgcacacattctttgtcggtaatcctgagcatatggagatgcagcaaaacctggactattaccagacaatgtctggtgtgaaggaggcagactttaaggacctcgaaacacagcctcatatgcaggaatttagactgggggtgaggctctactctgaagaacagccacaggaagcagtcccccacctggaggctgcactgcaggagtactttgtggcttatgaggaatgcagggctctgtgtgaaggcccctacgactacgatggctacaattatttggaatacaacgcagacctttttcaggccatcacggaccactacattcaagtgctgaattgtaagcagaactgcgtaaccgaattggcgtcgcacccttcacgcgaaaaaccgttcgaggactttctacctagccattacaattatttacagttcgcctactataacatcggcaactatacacaggccgttgagtgtgccaaaacgtatttgcttttttttcctaatgacgaggtgatgaaccagaatctcgcatactacgctgccatgttgggagaagagcacactcgaagtatcggacctcgcgagagtgctaaggaatatagacagcggagtttgctagagaaagaactgctgtttttcgcttatgacgttttcggaatccctttcgtcgatcctgactcgtggacccctgaggaagtgattccgaaacgacttcaggaaaagcaaaaaagtgaacgcgagacggcggtaaggatctctcaggaaattggcaacttgatgaaggagatagaaacacttgtcgaagagaaaactaaagaaagcctggatgttagtcggctgactcgcgagggtggacccctgctttatgaagggatctcattgactatgaactccaaattgctgaacggctcccaacgggttgtgatggacggcgtgataagcgaccacgagtgccaggaactccagcgcttgacaaatgttgcggctactagtggcgacggatacagaggtcagacctccccccatacccctaatgagaagttttatggagtaacagtcttcaaagccctgaaactggggcaagaaggaaaggtacccctgcagtctgctcacttgtattacaatgtcacggaaaaagttagaagaatcatggaatcctactttagattggacacacctctgtacttttcttactcccacctggtatgtcgcacggcgattgaggaggtgcaagctgagagaaaagatgacagccaccctgtgcacgtggacaattgcattctgaatgcagagactcttgtatgcgtgaaggaaccacccgcctatacctttagagattactccgccatcttgtatctgaatggggattttgacggcgggaacttctactttaccgaattagacgccaagaccgtaaccgccgaggtgcagccacagtgcggacgggccgtgggcttctcaagtggaacggagaatcctcatggagtgaaggccgttacccgcggccagagatgtgctatcgcgctctggtttacactcgaccccaggcacagtgagcgtgtgagggccgctcgggccggtcagggagctggccgatag

SEQ ID NO: 192858 - DNA, 459 bp, Artificial Sequence
  Description of Artificial Sequence: Synthetic coding sequence
tgagagcgggagaccgccgtgcggatcagccaggagatcggcaacctaatgaaggaaatagaaacactggtggaggagaagacgaaagagtctctggatgtcagtcgattgacacgcgaaggcgggccacttctatatgaaggaatctctctgacaatgaatagcaaactcttgaatggctcccagagggtcgtgatggacggggtgattagcgaccatgagtgccaggaactgcaaaggctcacaaatgtggccgcaacttctggcgacgggtaccggggccagacatcgccccacacaccaaatgaaaagttttacggggtgacagtgtttaaagcattaaaacgaggagtggtgctggtcagatttcataccgcggacaaagacgttcctgagaccggtcagttcacaaaggaacggggactccttggcctgaccgtcccgtgcgggtggggttag

SEQ ID NO: 192859 - DNA, 1806 bp, Artificial Sequence
  Description of Artificial Sequence: Synthetic coding sequence
atggagctggagttccggaagcggagcccctacaactacctgcaggtggcttacttcaaaattaataaacttgagaaagccgtcgctgcagctcatacattctttgttggaaatccagagcacatggagatgcagcagaatttggattactatcaaactatgtctggcgtcaaggaggctgactttaaagatcttgaaacgcagccacatatgcaagagtttcgccttggtgtacggttgtactctgaggagcagccccaggaggcagttccccacttggaggctgctttacaggagtatttcgtggcctacgaggagtgccgggctttgtgcgaaggtccctacgactatgacggctacaactacctcgaatacaatgcggatctctttcaggccatcactgatcattacatccaggtgctcaactgcaaacagaattgtgttaccgaactggcatcgcacccctcccgcgagaaacctttcgaagatttcctgccatctcactacaattatttacaattcgcctactataacatcggtaactacacgcaggcagtcgagtgcgcaaaaacctacttgctgtttttccctaacgacgaagtgatgaatcagaatctcgcctactatgccgctatgctcggcgaagagcacacaaggtcaatcggcccaagagagtcagctaaggagtacagacagcgttcgctccttgaaaaagagctcctttttttcgcctatgacgtgtttgggattcctttcgtggatcctgacagctggacacctgaggaggtcatccctaaacgcttgcaagaaaagcagaaatcagaaagggagacagccgttcgaattagtcaggaaatcggaaacctcatgaaggaaattgaaacccttgtcgaggaaaagaccaaggagtcactggacgttagcaggctgactagagagggcggacctttgctctatgagggcatttcgctgaccatgaattcaaaactcctgaatggaagtcagagggtagtcatggatggggtgatcagcgaccacgaatgtcaagaactgcagaggcttacaaatgtggccgctacttcaggagatggctatagaggacagacgtcacctcatactccaaatgagaaattctatggagtgacagtgttcaaggccctgaagctcggccaggagggaaaagtacccttacagagcgctcacttgtattacaatgtgacagaaaaggtgcgcaggatcatggagagctattttagacttgacacccctctttatttctcatacagtcacctggtttgccggacagcaattgaggaagtccaggctgaacgcaaagacgatagccatccagtgcacgtggacaattgtatactgaacgccgagactctggtttgcgttaaagaaccgccggcctatacttttcgggactactcggcgattctgtacctgaatggcgatttcgatggcggaaacttctattttaccgagctggacgctaagactgtgaccgccgaagtgcagccacagtgtggccgtgccgtaggtttttctagtggcaccgagaacccacacggcgtcaaggccgtgaccagagggcagcgatgcgccatagcgttgtggtttacactggaccctcgccactctgaacgcgacagagtccaagcagacgatctggtgaagatgctgttttcccctgaagagatggatctttcccaagagcaacctctggacgcacagcaagggccaccagagcccgcacaggagagtctctcgggatctgagtcgaagcctaaggacgaattgtag

SEQ ID NO: 192860 - DNA, 2355 bp, Artificial Sequence
  Description of Artificial Sequence: Synthetic coding sequence
atgaccagccccgccgccgcccagagccgggagatcgactgcctgtcccctgaggcgcagaagctcgcagaggcccggctggccgccaagcgggccgcacgcgcagaagctcgggaaatccggatgaaggaactggagaggcagcagaaggaggaggacagcgagcggtactcacggcgcagccggagaaacacttctgcttccgacgaggacgaaaggatgtctgtgggctcacggggctcgctccgcgtcgaggaaaggcctgagaaggattttacagaaaaaggatcccggaatatgcccggactgtctgccgccaccttggcgagcctcggcggaacctcaagccggcggggctcaggggacacttcaataagtattgataccgaagcctcaatacgagagatcaaggactctctggcagaggtggaggagaagtataagaaagccatggtatctaatgcgcaacttgataacgagaagactaactttatgtaccaggtcgacaccctcaaagatatgttgctggaactcgaggaacagttggcagagagccgccgccagtacgaggagaagaacaaggagtttgagagggaaaaacatgctcattcaattttacaatttcagtttgcagaggtgaaggaggccctgaagcaaagggaagaaatgctggaaaagcatgggatcatcttgaatagcgagatcgctacaaacggagagacgtccgacacactgaacaatgtaggatatcaagggccaacaaaaatgacgaaagaggagcttaatgctctcaaatcaacaggagatggaacactgggacgtgcctccgaggtggaggtgaaaaacgagatcgtggctaatgtaggaaaacgggagatcctgcataataccgagaaggagcagcacactgaagataccgtcaaggattgcgtggatattgaagtgtttcccgcgggagagaatacggaggaccagaagtcaagtgaggataccgcaccgttccttggcacacttgccggcgccacctatgaagagcaggttcagtcacagattctggagagcagttctctgccagagaacactgtgcaagtggagagcaacgaggtaatgggggctcccgacgatcgtacacggacaccactggaaccatctaactgctggtccgatttggatggagggaatcataccgagaatgtgggggaggcagcagtgacccaggtagaggagcaagctggaacagtcgcttcctgcccactgggacactcagacgataccgtttaccacgatgataaatgtatggttgaggtgccacaggagcttgaaacctccacaggacacagtctggagaaggagttcaccaatcaagaagcagcagagcccaaggaggtgccggcgcattctaccgaggtgggcagagaccataacgaggaggagggtgaggagaccgggctgcgcgatgagaaacccatcaaaactgaggttcccggctctccagcaggcacggagggtaattgtcaggaagctacagggcccagcacagttgacacccagaacgagccactagatatgaaggagcccgatgaggagaaatccgatcagcagggcgaggcactagacagcagccagaagaagaccaagaacaaaaagaaaaagaataagaagaaaaaatcacccgtgccagtggaaactttaaaggatgtaaagaaggagttaacttatcagaataccgatctttctgaaatcaaagaggaagaacaggtgaaaagtactgacagaaagtccgcggtggaggcccaaaatgaggtgacagagaacccaaaacagaaaatcgcagccgagtccagcgaaaacgtggactgccccgaaaatcccaaaataaagcttgatgggaaactcgaccaagaaggcgatgacgtgcagactgccgccgaagaagtgctggctgacggagacaccctggacttcgaggacgacacagttcagagcagcggcccaagagccggtggggaggagttagatgagggcgtggctaaagacaatgctaagatagatggagccacgcaaagcagccctgccgagcccaaatcagaagatgcggaccgctgcacccttcccgagcacgagtcacccagtcaggacatctctgacgcctgcgaagccgagtcaactgaaaggtgtgaaatgtccgagcacccttcccaaacagttcgaaaagcactggattccaactcactggaaaacgacgatttgagcgcacccggcagggagccggggcactttaatccagaatcgcgggaagacacacgtggaggcaacgaaaagggtaagtccaaagaagactgtactatgagctag

SEQ ID NO: 192861 - DNA, 2259 bp, Artificial Sequence
  Description of Artificial Sequence: Synthetic coding sequence
atgaccagccccgccgccgcccagagccgggagatcgactgcctgtccccagaggcacagaaattggccgaggccagactcgcggccaagagagctgccagggccgaggctcgcgagatcagaatgaaagagctggagcgacagcagaaagaggtggaggaaagaccagaaaaggattttaccgaaaaagggtccagaaacatgccgggcctcagcgcagccacgttggctagcctgggcggaacctcttcccggaggggaagcggcgataccagtatcagcattgatactgaagcttcaattagagagatcaaagactctctggccgaggtggaagagaagtataagaaggccatggtgtccaacgcgcagctcgacaatgagaagacaaattttatgtaccaggtggacaccttgaaggacatgctgctggaacttgaagagcagctggccgagtcgcgcaggcagtacgaagaaaagaacaaagaattcgaacgcgagaaacatgcccattccattttacagttccagttcgccgaggtcaaggaggcccttaaacaacgagaggaaatgcttgaaaagcatggcattattctgaacagtgagatagccactaacggagaaacctctgacactctgaacaacgtgggctaccaagggccaaccaaaatgacaaaggaagagctgaacgccctgaagtcaacgggcgacgggaccctaggcagagccagtgaagtggaggttaagaatgaaattgtggcaaatgtcggaaaaagggagattctgcacaacaccgaaaaggagcagcataccgaggacactgtgaaggactgcgtcgacattgaggtgttccctgccggtgagaataccgaagatcagaaaagctccgaagatacggctccctttctgggtacgttggccggcgcaacctacgaggaacaggtccagtcccaaattctggaaagctccagtctgcctgagaacaccgttcaggttgagtcgaatgaagttatgggcgctccagatgataggaccaggaccccattagaaccatcaaactgttggagcgatctcgacggagggaatcacaccgaaaatgtgggtgaggcagcagtgactcaagtcgaggaacaggcaggtacagtggccagttgtcctctggggcactccgatgataccgtttaccatgacgataagtgtatggtggaggtgccgcaggagctggagacctcgacgggacactctctggagaaagaattcaccaaccaggaggccgccgaaccgaaggaggtccccgcgcactctactgaagtgggcagggatcacaatgaagaagaaggcgaagagaccggcctaagggacgagaagcctattaagactgaagtcccaggcagcccggcaggtactgaaggtaattgccaggaggccaccggcccgtctaccgttgatactcagaatgagcctctggacatgaaagagcctgatgaagaaaagtccgaccaacagggtgaggcactggatagttcgcagaagaaaacaaaaaacaagaaaaaaaagaataaaaaaaaaaagagccctgtgccggtggagacactaaaagatgtcaagaaagaattgacttatcagaatactgacctgtccgagatcaaggaggaagagcaggtgaagtctaccgatcgcaagtctgccgtggaggcccaaaatgaagtcacggagaatccaaaacagaagattgcagccgagtcctcagagaacgtcgactgtccagagaaccctaaaataaaactggatggtaaactggaccaagagggggatgacgtgcagacggccgccgaggaagtactggccgatggtgatactctcgatttcgaagatgatacagttcagagctccggccctcgtgctggcggagaagaactggatgagggggtggccaaggataacgccaaaattgacggcgcaacccaaagttccccggccgaacctaaatctgaggacgcggatagatgtaccctgccagaacacgaaagcccctcgcaggacatctccgatgcctgtgaagcagagagtacagagagatgcgagatgtccgaacatcccagccagactgtcaggaaggctcttgattctaattccctcgagaatgatgatctgagcgctcctggcagagagcctggccacttcaatcctgaaagtcgcgaggataccagaggcggaaatgagaagggtaagagtaaggaggactgcacaatgagctag

SEQ ID NO: 192862 - DNA, 1893 bp, Artificial Sequence
  Description of Artificial Sequence: Synthetic coding sequence
atgaccagccccgccgccgcccagagccgggagatcgactgcctgtcacctgaagcccagaagctggcggaggctcggcttgcagcgaagcgcgccgcccgagcagaggctagggagatacgtatgaaggaacttgagcgacagcagaaggaggtcacctcagcccaagagaaatactatggattagatacaaagtggggagacatcgagcaatggatggaagattcagagcggtacagccgtaggtccaggcggaatacaagtgctagcgatgaggatgagagaatgagtgtaggttcacggggatccttgcgaagccaacccgatctagagtacggaggtccatatgcatggactaatggatatgacggagagttgtacggtagtcagagtcttaacagaaggagcggccgccctagttgtctctacagcgctgcaaggcccagcgggagttacagggctagtgtgctagacgaaggctctttcggcggtactaggcgggggtctacatcaggctcacgagccccatctgaatactcgggacacttgaacagtagcagcagggcctctagccgagcctcgagcgcacgggcctcccctgtcgtggaggagagacctgagaaagactttacagagaaggggtcaaggaatatgcctgggttgagtgcagcgacgctcgcctccttagggggaaccagcagtcgccgggggtctggtgacacttctatcagcatcgacaccgaggcttctatccgcgagatcaaggagctgaacgaattaaaggaccagattcaggacgtagaaggaaagtacatgcaggggctaaaggaaatgaaagacagtctcgcagaggtagaggagaagtataaaaaggcaatggtttctaacgcacaactcgataacgagaaaacaaacttcatgtaccaggtggatacactgaaagatatgctgctagagctagaagagcagctcgccgagagccgccgccaatacgaagagaagaataaagagttcgaacgtgagaagcatgcgcattctatcctccaatttcaatttgcagaagttaaagaggcccttaagcagcgcgaggagatgctcgaggagatcaggcagttacagcaaaagcaggcttcaagtattagagagataagcgatctccaggaaactattgagtggaaagataagaagatcggcgcccttgaacgccagaaggagtttttcgattctgtgcggagcgaacgcgatgatctgcgagaagaggttgtcatgctcaaagaagagttgaaaaaacacggtataattctgaatagcgagattgctacaaacggggaaacttctgatacccttaacaatgttggctatcagggccccacgaaaatgacaaaagaggagctgaatgcgctgaagagtactggcgacggcactctggacattagattaaagaagctggttgacgagcgcgagtgcctgctggagcaaatcaaaaaactcaaagggcagctggaagagcggcagaaaattggaaagctcgataacctcaggtccgaggacgatgtgctagagaacggaaccgatatgcacgtgatggatttacaacgggacgctaaccgccagatcagtgacctcaagttcaaactggctaagagtgaacaggagattaccgctttggaacagaacgttatcagactggagtcacaggtgtcccgctacaaatccgcagccgaaaacgccgagaagattgaagatgagctgaaggcagagaaaaggaagctccagcgtgagctccgttccgccttagacaaaacagaagaactggaagtctcaaacggacatctggtgaaacggctggaaaagatgaaggcaaataggtcggcgctgctatcccaacagtag

SEQ ID NO: 192863 - DNA, 2427 bp, Artificial Sequence
  Description of Artificial Sequence: Synthetic coding sequence
atgaccagccccgccgccgcccagagccgggagatcgactgcctgtccccagaggcccagaagctcgccgaggcgcgtctcgctgcaaagagagccgcaagggcggaggcaagagaaataagaatgaaagagttggagcggcagcagaaagaggaggactccgaaagatattcacggcggtctcggagaaacacgtccgcatcagacgaagacgaacgcatgagtgtaggttcccgtggaagcttgcgcgtggaggagcgccccgagaaggacttcaccgagaagggcagcagaaacatgccagggcttagtgccgcgacactggcctcactgggaggcacatcatcccgccggggaagcggggacacctccattagcatcgatacagaagcttctatcagggagatcaaagagctaaacgagctcaaagaccagattcaagacgtcgagggtaagtatatgcagggtctaaaggaaatgaaagactcactggccgaggtggaggagaaatataagaaggccatggtaagcaacgcacagctcgacaacgagaaaaccaacttcatgtaccaggtggatacgctaaaggatatgctgctcgagctggaggaacagctcgccgaaagtcggagacagtacgaagagaagaataaagagttcgaacgcgagaagcatgcacattccatattacaattccagttcgccgaagtgaaggaagccctgaagcagagggaggagatgctggaaaagcatgggattattctgaattccgaaattgccaccaacggcgagaccagcgacacacttaacaacgtggggtatcaaggccctaccaagatgaccaaagaagagctgaacgctttgaagtcaacgggcgatgggaccttgggccgagccagcgaagttgaggttaagaatgaaatagtggccaatgtaggcaagcgagagatcctccacaataccgagaaggagcagcacacagaggacacagtcaaagactgtgtcgatattgaggtgttcccagcgggtgaaaacacagaggaccagaagtcttctgaggacactgctccattcctagggacactggccggcgccacatatgaagaacaagtgcagtcgcagatccttgagtcctccagtctcccagagaacactgttcaggttgaatcaaacgaggtaatgggagcacctgacgacagaactcgtacccctctagaacctagcaattgctggagcgatctcgatgggggcaaccacaccgaaaatgtcggagaggctgccgtaacccaggttgaggagcaagcaggaaccgtggcctcatgtccgctaggtcactccgatgatacagtttaccacgatgataagtgtatggtggaggtacctcaggaacttgagacttccaccggacatagtttggaaaaagaatttacaaaccaggaggcagcggagccaaaggaagtgcccgcccacagcactgaggtgggtcgagaccataacgaggaagaaggcgaagagactggacttagagacgagaagccaatcaagaccgaggtgcccggctctcccgcaggaaccgagggcaactgtcaggaagccactggcccctccaccgttgacacccaaaatgagcctctcgatatgaaggagcccgacgaagagaaaagtgatcagcagggggaagcactggacagctcacagaagaagacaaagaataagaagaagaagaataaaaagaagaagagcccagtccccgtagagacattaaaggacgtgaagaaggaactgacatatcagaatactgatttgtccgagatcaaggaggaagagcaggttaaatctaccgaccgcaaatctgcggtggaggcccagaatgaagttactgagaatcctaagcagaaaatcgctgccgaaagcagcgaaaatgtggactgtccagagaatccaaaaataaaactggatggaaagctggaccaggaaggagacgacgttcagacagccgcggaggaggtcctggccgacggcgatacattggatttcgaggatgacacagtgcagtcctctgggccgcgagctggtggtgaggagctcgacgagggggttgcaaaagataacgccaaaatcgatggcgccacacagtccagccccgctgagcctaagtcggaggacgccgatcgatgtaccctgcctgagcacgaatccccgtctcaggatatttcagatgcttgtgaagccgagtccacagaaagatgtgaaatgagtgaacacccttcacagactgtgcggaaggccctcgatagtaatagcttggagaatgacgacctgtccgcccccgggagagagcccggtcatttcaatcccgagagccgagaggacacacgtgggggcaatgaaaaaggcaagagcaaagaagattgcactatgtcctag

SEQ ID NO: 192864 - DNA, 1923 bp, Artificial Sequence
  Description of Artificial Sequence: Synthetic coding sequence
atggacatgggcacccagggcagcggccggaagcggctgcccaacagggagcgcttaaccgcggaggacgacgcgctgaaccaaatcgcccgggaagccgaagctagactggccgctaaaagggccgcccgcgccgaagccagggaaataaggatgaaggagttggagcggcagcagaaggagatctatcaagtacagaagaagtactacgggctcgacacgaaatggggagacatcgaacagtggatggaggattctgagcggtattccagaaggtcccgccgaaacacaagcgcctccgacgaagacgaacggatgagcgtgggatcacgcggcagcttaaggtcccagccggacctggagtacggaggcccctacgcttggacaaacggatacgacggggagctgtatggatcacaaagtctcaaccggcgctccggtcggccgagttgtctttatagtgcagcccgtcctagtggctcctaccgtgctagcgtattggatgaggggtctttcgggggcactaggcgcggttccacctccggaagtcgcgctccttctgagtactcaggccatcttaatagctcatcaagggcttcctcaagggcaagctccgcccgcgcgagtccagtggtcgaggagagacctgagaaagatttcactgagaaggggtcgagaaacatgcccggtttgtctgccgcaacacttgcgtctctgggtggcacctcttcccgtcgcggaagcggggacacatctatatccattgacacggaggcctcgattcgcgagataaaggagctcaatgagcttaaagaccagatccaggatgttgaaggaaagtacatgcaggggttaaaggaaatgaaggactctctagcagaagtggaagaaaaatataagaaagctatggttagtaacgcacaactggacaatgagaagacaaactttatgtatcaggtggataccttaaaagacatgctactcgaactcgaggagcagctggccgagtccagacgacagtatgaagagaaaaacaaagaattcgagcgggaaaagcatgctcattccattctccagttccaattcgcggaggtcaaggaggctctcaagcagagggaggagatgctggaagagattcggcaactgcagcagaaacaagctagcagcattcgggagatctctgatttacaagagactatcgagtggaaagacaagaagatcggggctctcgagcgacaaaaagaattctttgatagcgtgcggtctgagcgggacgacctaagagaggaagtggttatgctgaaagaggagctcaagaagcacggtattatcttgaattctgagatcgccacaaacggagaaacgagtgataccctgaacaatgttgggtaccaggggcccactaagatgaccaaagaagaactcaatgccctgaaatctactggagatgggacactcgacatacgtcttaaaaagttggtcgacgaaagggagtgtctccttgaacagataaagaaacttaagggccagctggaagagcgacagaagatcgggaagctggataacttaagaagcgaggacgacgttctggagaatggaacagacatgcatgtcatggatttgcagcgcgatgcaaatcggcagatctccgatttaaaattcaaacttgccaagagcgagcaagagatcaccgcactggaacaaaacgtgatccgattagaatctcaagtgagtcggtataaatcagctgcagagaatgccgagaaaattgaagacgaattgaaagcggaaaagcgcaagctgcagcgcgaattacggagcgcgctcgataagacggaagagctggaagtgtctaacggccatttggtgaagcgtttggagaagatgaaagcaaaccgaagtgctctgttatctcaacagtag

SEQ ID NO: 192865 - DNA, 2166 bp, Artificial Sequence
  Description of Artificial Sequence: Synthetic coding sequence
atgggcacccccgccagcggccggaagcggacccccgtgaaggaccgcttcagcgctgaggacgaggcgttgagtaatattgcccgggaggccgaagcaagactcgccgccaagagagctgcgcgcgccgaggcgcgcgacattcgaatgcgtgaactggaaaggcaacagaaggaatatagtctacattctttcgacagaaaatgggggcagatacagaagtggctcgaagattcggagcgtgccaggtatagtcacaggtctagtcaccatcgtccctacctgggtgtagaggatgcactgagtatcaggagcgtgggcagccataggtacgatatgtttaaggaccgctccagcagactaagttcactgaaccattcctacagccattcacatggtatgaagaagaggagctctgatagccataaagacctgctgagcggcctgtactttgatcagcggaactattcatccctccgtcattccaaacctactagtgcctactataccaggcagagctcctctctgtactcggatccactggcgacatataagtctgacagagcctctccaaccgccaattccgggctgcttagatcagcctcattggctagcctgtataacggtgggttatataacccctacggaccccgcactccctcagagtgctcttattacagcagccgaatctccagcgctagatcgtctccaggcttcaccaatgacgacaccgccagcatagtgagctctgaccgggcctcccgtggcagaagggagagcgtggtctccgctgccgattacttttctcggagcaatagacgggggtccgtcgtaagtgaagtcgacgacatctccatccccgacctcagctctctggacgagaaatcagataaacaatacgctgaaaactacacaaggccctccagtaggaactctgctagcgccaccacacccctatcaggaaactcctcccgcagagggagtggcgatacaagttccctgatcgaccccgatacttcactttcagaactccgggatatctacgacctcaaagatcaaatccaggacgttgagggcaggtacatgcagggcctgaaagagctgaaagaaagcctgtcagaagtggaagaaaagtacaagaaggccatggtgtcaaatgctcagttggataacgagaagaataatttaatttaccaagttgacaccttgaaggatgttatagaagagcaggaggagcaaatggcggagttttacagggagaacgaggaaaaatccaaagaattagaaagacaaaaacacatgtgctcagtgctacagcacaagatggaagagctgaaggaaggtctgcggcaaagagatgagttgatagaggaaaagcagaggatgcagcaaaaaattgacactatgaccaaggaggtgttcgatctgcaggaaacgctgctctggaaggacaaaaagataggtgccctggaaaagcagaaggagtacattgcatgcctgcgaaatgagagggatatgttgcgtgaggagctggcagacctgcaggagactgtgaaaacaggagagaagcatggcctggttattatccctgatggcacgcccaatggcgatgttagtcacgagcccgttgcaggcgccataacagtggttagccaagaggctgcccaggtgctcgagagcgccggcgagggaccactcgacgtgcgccttcggaaactggctggagagaaggaggaactgttatcccagatacgaaaacttaagctccagctggaggaagagaggcagaagtgtagtcgcaacgatggtacagtcggcgaccttgccggcttacagaatggctccgaccttcagttcatagagatgcaacgcgatgccaacaggcagatttccgaatacaagtttaaactgtctaaggcggaacaggatattacaactctggagcaatccatttcacgtctggagggacaggtcctcagatataaaaccgcagcggaaaacgccgagaaagttgaagatgaactcaaggcagagaaaaggaaattgcagagggagctcaggactgctctggataagatcgaagagatggagatgacgaatagtcacctcgccaagaggctggagaaaatgaaggcaaacaggactgccctgctcgctcagcaatag

SEQ ID NO: 192866 - DNA, 1203 bp, Artificial Sequence
  Description of Artificial Sequence: Synthetic coding sequence
atgggcacccccgccagcggccggaagcggacccccgtgaaggacagattcagcgctgaagatgaggctctgtctaatatcgccagggaggccgaggcccggttagccgccaagcgggctgcacgagctgaagccagggatatcagaatgcgcgagctggagagacagcagaaagaactggatgagaagagcgacaaacaatatgccgagaactatacccgaccgtcctcacggaactctgcttccgctaccacccctctgtcaggcaacagttctagacgcggcagcggagacacctccagtctaattgatccggatacatccctgtctgagctgcgagaaagtttgagcgaggtcgaggaaaaatacaagaaagccatggtttccaatgctcagctggacaatgaaaaaaacaatctgatctaccaagttgatactctgaaggatgtcatcgaggagcaggaggagcaaatggccgagttttatcgggaaaatgaagaaaaatctaaggaactcgagcggcagaagcacatgtgctccgttctgcagcataaaatggaagagcttaaggagggtcttcggcaacgggatgagttgatagagaaacatggactcgtgattatcccggacggcaccccgaatggagacgtgagccatgaaccagtggcaggcgcaatcactgtagtgagtcaggaggcagcccaggttttagagtctgccggcgaaggaccacttgacgtgcgcttaaggaaactggccggagagaaagaggagttgctgagccagatccgcaaactgaagctgcagctggaagaggaacgccagaagtgtagccgcaacgatgggaccgtgggcgatctagcaggactccagaatggatccgacttgcaatttatcgaaatgcaacgggacgcaaaccggcaaatcagtgaatataaatttaagctgagcaaggccgagcaggacatcacgaccctggaacagagtatttctcggttagaaggacaggtgctgagatataaaacagccgcagagaacgccgagaaagtggaagacgaacttaaggccgaaaagaggaaactgcagagagaactgcgcacagcactcgacaaaatagaggaaatggagatgactaactcccacctggctaaacggctggagaagatgaaagcaaatcgaaccgcgctgctcgctcagcaatag

SEQ ID NO: 192867 - DNA, 2166 bp, Artificial Sequence
  Description of Artificial Sequence: Synthetic coding sequence
atgggcacccccgccagcggccggaagcggacccccgtgaaggaccggtttagcgccgaagacgaagctctcagcaatattgcgcgggaggctgaagccagactggcagccaaaagagctgctcgggccgaggcgagggacatacgcatgagagagctcgagcgccaacagaaggaatactccctgcacagcttcgaccgtaagtggggccagatccagaagtggctggaggatagcgagcgcgcaaggtacagccaccggagctctcaccacagaccctacctgggggttgaagacgcgctgtctattcgttccgtgggatcacatcggtacgacatgttcaaagataggagttcaagactgtctagcctaaaccactcctactcacacagccacggcatgaaaaagagatcatccgacagccataaagatctactatctggactgtatttcgaccagaggaattattcgagcctgcgccacagcaagccaacctccgcatactacactcgccagtcctcctccctgtactcagacccactcgccacatacaaaagcgatagggcatccccgacagccaatagcggcctgttgcgcagcgcctcattagcgtcgctctataacggcggcctctataatccatacggtccgcggaccccctcggaatgcagctactattcatcccgaattagctcagcacgctcttctccagggttcacaaacgacgacaccgccagcattgtctcgtccgaccgagcaagtcggggacggagagaatcagtggttagcgcggccgattactttagtagatctaaccgtagaggtagcgtagtttctgaagtcgacgacatcagcattcccgacctcagtagtcttgatgaaaagtctgataagcagtatgcagaaaattacactcgtcccagcagccgcaactcagccagcgccaccaccccactatccggtaatagctctcgaaggggctcaggagacaccagcagcttaatcgatcctgacacgtccctgagcgaattgagagacatttacgacctgaaggatcaaattcaggacgtggaaggaagatatatgcaaggactgaaagagttaaaggagtcgctgtccgaggtggaggaaaaatacaagaaagccatggtgagcaacgcccagctggacaatgagaagaacaatctcatttatcaggttgacaccctgaaggacgtcattgaggagcaggaggagcagatggccgagttttaccgggagaacgaggaaaaatccaaagaactcgagcggcagaagcacatgtgtagcgttctgcagcacaaaatggaggagctgaaggaggggctcaggcagagagacgagttgatagaggagaagcagagaatgcagcagaaaattgacacaatgacaaaggaggtattcgatcttcaagaaacactgttgtggaaagataagaaaattggtgccctggaaaagcagaaagagtatatcgcatgcttgagaaacgagcgcgacatgttgcgcgaggagcttgccgacttgcaggaaacggtaaaaacaggagagaaacatggcttagtgataattcccgatggcacgcctaacggcgacgtgagccacgagccagtcgcgggcgctatcactgtggtgtctcaagaagcagcccaggtattggaaagtgcaggtgaagggccccttgatgttcggctccgaaaactggccggtgaaaaggaggagctgctgagccaaatccggaagctgaagctgcagttagaggaggaaaggcagaaatgttctcggaacgatgggactgtgggtgatcttgccggcctgcagaatggatcagacttgcagtttatcgaaatgcagcgtgacgccaacagacagatctcagagtataaattcaaactgagtaaagcagaacaggatatcaccacattggagcaatctatctccaggctggaagggcaagtcctaagatataaaacagccgccgagaacgccgagaaagtggaggacgagctgaaggccgagaaaagaaaattgcagcgcgagcttagaactgcactcgacaagattgaagagatggagatgactaattcacacctggctaagcggttggagaagatgaaggccaaccggactgccctgcttgctcagcagtag

SEQ ID NO: 192868 - DNA, 180 bp, Artificial Sequence
  Description of Artificial Sequence: Synthetic coding sequence
atgggcacccccgccagcggccggaagcggacccccgtgaaggaccgcttctcagcagaggatgaagcactaagtaacatagctcgggaggccgaagctcggctggccgccaagcgagctgcacgagcagaggccagggatattcggatgcgggagttagagcgccagcagaaagaatag

SEQ ID NO: 192869 - DNA, 180 bp, Artificial Sequence
  Description of Artificial Sequence: Synthetic coding sequence
atgggcacccccgccagcggccggaagcggacccccgtgaaggaccggttcagcgcggaggatgaggcactcagtaacattgcacgagaagccgaagcccgcctcgccgcaaagagggcagcacgcgcggaagcccgagatattagaatgcgtgagcttgagcgccagcagaaggaatag

SEQ ID NO: 192870 - DNA, 180 bp, Artificial Sequence
  Description of Artificial Sequence: Synthetic coding sequence
atgggcacccccgccagcggccggaagcggacccccgtgaaggaccggttttcggccgaagacgaagctctgagtaatatcgcccgagaggccgaggcacggctagcggctaagcgggccgctcgggcagaagccagagacattcggatgagagagctcgaacggcaacagaaagagtag

SEQ ID NO: 192871 - DNA, 1275 bp, Artificial Sequence
  Description of Artificial Sequence: Synthetic coding sequence
atgggcacccccgccagcggccggaagcggacccccgtgaaggaccgcttcagtgccgaggacgaagctctctctaatattgccagggaggccgaggcccgattagccgcgaagcgggctgcccgggccgaggcccgtgacattaggatgcgcgaactggagcgccaacaaaaggagctggatgaaaagagcgacaaacagtacgccgagaactacacccggccatcttcacggaatagcgcctccgcaaccacccctctatccggtaattcctccaggagaggttctggtgacacgtccagcttgatcgaccccgatacgagcttgtcagaactccgggacatatatgatctcaaggatcagattcaggacgtggaaggacgctatatgcagggtttgaaggaactcaaggagtctctctccgaagtggaagaaaaatacaaaaaagccatggtgagcaatgcccaactggacaacgagaagaataatctgatctaccaggtggacacactgaaggatgtcatcgaggagcaggaggaacagatggctgagttctaccgggaaaatgaggagaaatctaaggaattagagcgccagaaacatatgtgctcggtgcttcagcacaagatggaagagcttaaggaagggttgagacagcgcgatgagctaatagagaagcatggcctggtgatcatcccagacgggactccgaatggcgatgtaagccacgagcccgtagcaggagccatcacagttgtctcacaggaagctgcccaggtcctggaatcagctggcgaggggccactggatgtacgtttgagaaaactggcaggcgaaaaggaagaacttctgagtcagataagaaagctcaaactgcagctcgaagaggagcgacaaaaatgcagtcgaaacgatggaactgtaggagatcttgccggcttgcagaacgggtctgatcttcagttcatcgaaatgcagagggacgccaacaggcagatcagtgagtacaaatttaagttgtctaaagctgaacaggatatcactacgctcgagcagagcatctccagactggagggccaggtcctccgatataaaacggctgcagaaaatgcagaaaaggtggaagacgagctaaaagcggaaaaacggaagttgcagagagaactccgcactgcactggacaagatcgaggaaatggaaatgacaaactctcatctcgctaagagactcgagaagatgaaagccaaccgcactgctctcctggcacagcaatag

SEQ ID NO: 192872 - DNA, 2316 bp, Artificial Sequence
  Description of Artificial Sequence: Synthetic coding sequence
atggcccccggccccttcagcagcgccctgctgagccccccccccgcagccctgcctttcctgctcttgctttgggccggtgcatcccgcggacagccatgccctggacggtgcatttgtcaaaacgtcgctccaacgttgacaatgttatgcgcaaagactggtctgctgtttgtgccccctgccattgatcggagggtggttgagctgaggcttacagacaatttcatcgctgcagtgcggaggcgcgatttcgctaacatgaccagtctcgttcatctcacactcagtaggaatacaattggccaggtggcagcaggggcgttcgctgacctgcgtgccttgcgagcattgcacctagacagcaacagactcgccgaggtgcggggtgaccagctgcgcgggctgggcaaccttcgtcacctgatcttaggcaataaccagattagacgcgttgaatccgcagcctttgacgccttcctgagtaccgtcgaggaccttgatctatcttataataacctggaggccttaccttgggaggcagtgggccagatggttaacttgaacacgctcactctcgatcacaaccttattgaccacatcgctgagggcacttttgtgcagctgcacaagctagttcggctggatatgacctcaaatcgtctgcataagcttccccccgatgggctctttctgcgatctcagggcactggcccgaagcctcccactcctctgacagtgagctttggcggaaatcccttgcactgcaactgcgagcttctgtggctcaggaggttgactcgcgaagacgacctcgagacgtgtgccacacccgaacacttgactgaccgctatttttggagcatccccgaggaagaatttctgtgcgagccacctctaatcacccggcaggccggaggccgcgctctggtggttgaaggccaggcagtgagcctacggtgcagggccgtcggcgaccccgaaccggtggtccattgggtagctccagacggaagactcttggggaatagttctcgcactagagtgcggggagatggaacccttgacgtaaccattaccaccctgagagactctggaacctttacctgtatcgcctcaaatgctgcgggcgaggctaccgccccagtggaggtgtgcgtggtgccactgccattgatggcgcccccccctgccgctcctcctcctctgaccgaacccgggtcctctgacatagctactccagggcgcccaggcgctaacgatagtgcagctgaaaggcgcctcgttgccgccgagctgacaagcaactccgtgctgatccggtggccagcacagagaccagtcccaggaatccgcatgtaccaagtgcagtacaattcttctgtcgatgatagcttggtctaccgcatgatcccttcgaccagccagacctttctggtaaatgatctggccgccgggcgcgcttacgatctttgcgtccttgctgtctacgacgatggtgcaactgctttgcctgcgacgcgggtggttggctgtgtccagtttactaccgctggcgatccagcaccatgccgacccctgcgcgctcattttctgggaggcacaatgatcattgccattggcggggtgattgtggcgtccgtgttagtgttcattgttctacttatgatccggtataaagtatacggagacggagactcccgaagggtcaagggcagccggagcctgccccgcgtttcccatgtgtgctcccaaacaaacggcgcgggcactggcgcggctcaggctcccgccctcccagcacaggatcactatgaggcgctgcgcgaggttgaatctcaggctgcccccgccgtcgctgtcgaagcaaaggcaatggaggccgaaaccgccagtgctgaaccggaggttgtcttaggacgctctctggggggaagtgcaactagcctctgtctgctcccttcagaagaaacaagcggtgaggaatcgagagccgcagttggccctagaagatctaggtccggggccctggagcctccgactagtgcaccacccaccttggcactcgtacctggtggggccgccgcccggccaaggccacaacagcggtacagtttcgacggagactacggagcgctattccaaagccactcttacccacgacgcgctcgtcgcactaagcggcacagatctaccccccacttggacggagcaggagggggagctgccggagaggacggcgacctgggcctgggatcagctcgagcctgtctagcattcactagcacagagtggatgctggaatccacagtttag

SEQ ID NO: 192873 - DNA, 2370 bp, Artificial Sequence
  Description of Artificial Sequence: Synthetic coding sequence
atggagaccctgctgggcggcctgctggccttcggcatggccttcgccgtggtagacgcttgtccaaagtattgcgtgtgtcagaacttaagcgaaagcttggggaccctgtgtccctcaaaagggttgctgttcgtccctcctgacattgatcgcagaacagtggaactgaggctgggaggaaatttcattatccatattagtcgacaagactttgccaatatgactgggttagttgacctgactctaagcagaaacactatatctcatatccagcccttttctttcctggacttggagtccttgagatcactccacctggactctaaccgtttaccaagtctgggagaagataccctgcggggactggtgaacctgcagcatctcatcgttaataacaaccaattaggggggatagcagacgaagcatttgaggactttttacttaccctcgaagatctggatctcagttataataacctgcatggccttccgtgggattctgttagacgaatggttaacttacaccaattgtccctggaccacaatctactagatcacatcgccgagggcaccttcgcagacctgcagaagctcgccagactcgatctgacttcaaatcggctccagaagctgcctccagatcccatctttgccaggtcacaagcctctgctctcaccgcaaccccctttgctccacccctatcattttctttcggggggaatccattacactgtaattgcgaactgctgtggttgaggagactggaacgcgacgacgacctggagacttgtgggtccccagggggactaaaaggtcgttatttttggcatgtcagagaggaggagtttgtgtgcgaaccgccccttataactcagcacacccacaaactgctggtgctcgaaggtcaggctgccacactgaaatgtaaagccattggggacccatccccgctgatccactgggtagcgcctgacgataggctggtgggaaactctagcaggacagccgtctatgataacgggactctggatatctttattaccaccagccaggatagtggcgccttcacatgtatcgccgccaatgctgccggagaagcgacagctatggtcgaggtgagcattgtccagttgccacatcttagcaattccacaagtcggaccgcccctcccaaaagtcgcctcagtgacattactggatcctctaaaacctcccgcggaggagggggcagtggcggcggcgaaccacccaaatctccaccagaaagagcagtgctcgtgagtgaggtgacgaccacaagcgccctggttaaatggagtgtgtctaagagcgcgcctcgggtgaagatgtatcagcttcagtacaattgctcagatgacgaggtactgatctaccggatgattcccgcctccaacaaagcctttgttgtgaacaacttagtgagtggaaccggatatgatctgtgtgtgctcgccatgtgggatgatacagctaccactttaaccgccaccaatattgtagggtgcgctcagttcttcactaaagctgattaccctcaatgccagagcatgcattcccagatactaggaggcacaatgatactcgtgatcgggggaatcatagttgccacacttcttgtcttcatcgtgatactgatggtcaggtacaaggtgtgcaaccacgaggcacctagcaagatggcagcagctgtgtccaatgtgtactcacaaacgaacggtgctcagcccccacctccctcttccgcacctgcaggcgctccccctcagggaccccctaaggtggtggttcggaacgagctcctggacttcaccgctagtctggcgcgtgcaagcgattctagttccagctctagtctgggttctggggaggccgccggtctgggcagggcaccttggcgaatccccccctctgcgccaagacctaagccctctctggaccggctcatgggagcttttgcaagtctcgatctgaaatcccaaaggaaggaagaattattggacagcagaactccggctgggagaggggctggcacttcagctcgcggacaccacagtgaccgagaaccgctcctcggccccccagccgcacgcgcacgctctctccttccattgccgctggaaggaaaggccaagcgctctcatagctttgacatgggagatttcgcagccgccgccgccggaggagtggtacccggcgggtattccccaccccggaaggtgtccaatatctggactaaacggagtcttagcgtaaacggtatgctccttccctttgaggaatctgatttggtgggcgcacgtgggacctttgggagctcagaatgggtcatggagagtacagtatag

SEQ ID NO: 192874 - DNA, 1887 bp, Artificial Sequence
  Description of Artificial Sequence: Synthetic coding sequence
atggccatcctgcccctgctgctgtgcctgctgcccctggcccccgcgagctctcctccccagtccgcaaccccctccccatgccctaggcgctgccggtgtcagacacagtctttaccattatcagtcctgtgccctggtgcaggccttctctttgtcccaccaagcctcgacaggagggccgctgagcttcgactcgcagataatttcatcgcaagcgtgagaagacgagacctggcaaacatgaccggcctgctccacctttctctgtccagaaatactattagacacgtggcagctggcgccttcgctgacctgagagctctacgggcgctgcatctggatgggaatagactcacaagcctgggtgagggccaattaaggggcctggtaaacttgaggcacctgatcctaagcaataatcagcttgcggcgttagcagctggagcacttgatgactgcgctgagacattggaggacctggacttgtcctacaacaaccttgagcagctcccttgggaggcccttggtagactgggtaacgtgaataccctggggctcgaccataatctcctggcctccgtaccggctggagccttcagccgacttcataagttagctcgtcttgacatgacaagcaatagactcacgacaatccctcccgacccactgtttagtcgcctgcccctcctagcccggcctcgaggcagccccgcaagcgccctcgttctggcttttgggggcaatcctcttcattgcaactgcgagcttgtctggttgagacggctcgcgcgggaagatgaccttgaggcttgtgccagcccccctgcgttggggggccggtatttctgggcagtcggcgaggaagaatttgtctgtgagcctcctgtagtgacccaccgcagcccacccctggccgtgccagcgggccggcccgcagccctccggtgtagggctgtaggagatcccgaaccgcgtgtgcggtgggtgtctccgcagggacgacttctcggaaattcctcaagagctagagcgtttccgaatggcactctggagctgctggtcacagaacctggcgacggaggaatttttacatgtattgccgccaatgccgcaggcgaagccacagctgccgttgagctgactgtgggacctcctccacctccacaactggccaatagcacaagttgtgatccacctcgcgatggcgaccccgatgcgttaacaccccctagcgccgcaagcgcctcagccaaagtggccgacactggacccccaaccgatagaggcgtgcaagtgactgaacatggggctactgctgcactcgtgcagtggccggatcagagaccaatccctggcatcagaatgtaccagattcagtacaactcaagcgctgacgatatacttgtgtaccgcatgatccccgctgaaagtcggagcttcctgctcacagacctggcatcaggtcgaacgtatgacctctgcgtcctcgccgtatatgaagactccgctacaggtttgacggccaccagaccagtgggttgcgccaggtttagtaccgaaccagctcttcgtccctgtggcgcccctcacgccccctttctgggaggcactatgatcattgcattgggaggagttattgtcgcatctgtcttggtgttcatcttcgtcctgctgatgcggtataaggtacatggcggacagccccccggtaaagccaaaattcccgctcccgttagctctgtctgcagccaaacaaacggcgccctgggcccgacccccacgccagcccccccagccccggagcccgctgctctgagggcccacactgtggtccagctcgattgcgaaccttggggaccgggacacgagcctgtgggcccatag

SEQ ID NO: 192875 - DNA, 1887 bp, Artificial Sequence
  Description of Artificial Sequence: Synthetic coding sequence
atggccatcctgcccctgctgctgtgcctgctgcccctggcccccgccagttcgccaccacagtccgctaccccaagcccttgtccacgtcggtgccgatgccagacccaatccttgcccctcagcgtgctctgtcccggagcgggtttgctgtttgtgccaccatcactcgacaggagggccgccgagcttagactagcagataatttcattgcctctgtcaggagacgggacctggccaatatgacggggctcttgcatctctccctgtccagaaacaccatcaggcacgtggcggcaggagccttcgccgacctgagagccctgcgagctctccacctggacgggaatcggttgacaagccttggggagggtcagctgcgaggcctagtcaaccttaggcatttgattctatcaaacaatcagctggcggctctcgcggctggagcattggacgactgtgcagaaactctagaggatctggatctatcttacaataatctggagcagctgccttgggaggccttaggacggctggggaacgtgaatacattgggtctggatcacaacttactggccagcgtacccgctggcgcctttagcaggctgcataagctcgcccgtctcgatatgactagcaatcgccttacaacgattccacctgatccacttttttctcggctgcccctcctcgcacgaccaaggggaagtccagcctctgcgttggtccttgcctttggaggcaaccccctccattgcaattgcgagctcgtgtggcttcgacgtctggctagggaagacgacttggaggcctgtgcgtcccctccagcattgggtggccgctacttttgggcagtgggcgaggaagagtttgtctgtgagccacccgtggtgacccatcgtagcccccccctcgctgtgcctgcaggacgacccgcggctcttcggtgccgtgccgtcggcgatccagaacctagagtcagatgggtttcccctcagggccggctgttaggtaattctagccgagctcgggctttccccaacggaactctggagttgctggtaacggagcccggagacggaggaatctttacctgtatcgctgcaaatgccgccggtgaggctactgctgccgtcgagctcaccgtcggtcctcccccccctccccaactggccaatagtacaagctgtgacccaccgcgggacggagatccagacgcactaacccctccgtcagccgcctcggcctctgccaaggtggccgataccggccctccgactgaccggggcgttcaggtcactgaacatggtgccactgccgctctggtgcagtggcccgatcagcggcctatacccgggatcagaatgtaccagattcaatataactcatccgccgacgatattctggtttataggatgatcccggccgagtcccgctccttcctgctgacagacctggcgtctggccggacttatgacctttgcgtccttgcagtgtatgaagatagcgctacagggctcaccgcaacaaggccagtgggatgcgccagattttccactgagcctgctctgcgcccttgtggcgcaccacacgcccctttcctgggaggcacaatgatcattgctcttggaggtgtcatagttgcaagtgtgttagtatttatcttcgtgctcctgatgcggtataaagttcatggaggccagccccccggaaaagctaagataccagcacccgtctcatccgtgtgctctcagaccaacggagctctgggcccaactcctacccccgccccccccgcaccagagcccgctgcactaagagcacacacagtggtgcagcttgattgcgagccgtggggtccggggcacgaaccagtgggtccatag

SEQ ID NO: 192876 - DNA, 1908 bp, Artificial Sequence
  Description of Artificial Sequence: Synthetic coding sequence
atggccccccccctgctgctgctgctgctggccagcggcgccgccgcatgtcctctcccctgcgtttgccagaatctttcagaatcgctgtctaccctgtgtgcccacaggggtctgctgttcgtcccacccaatgtggataggcggacagtggagctgaggctggctgataactttatccaggcactggggcccccggacttcaggaatatgacaggactggtggacttaaccctgtcccggaatgccatcacccgaattggcgcaagagcctttggagatttggaaagtctccgttccttgcatctggatggaaatagacttgttgagctgggtaccggatctctcagaggacctgttaatctgcaacatctgattctgtctgggaaccagctggggaggatagctccaggcgcatttgatgatttcttagaaagcctggaagacctcgacctgagttataacaacctcaggcaggtaccctgggcaggcattggagcaatgccagcccttcatacactcaatctggaccacaatctaatcgatgctctgcccccgggcgcattcgctcagctgggacagctatcacgactggatttaacatcgaaccgtctcgcgaccttggccccagatccattgttcagcagaggtcgcgatgctgaggccagccccgcccctcttgtgcttagctttagcggcaaccccctccactgtaactgcgaactgctgtggctgcgcaggctggcccgccctgacgacctagaaacttgtgcttccccgcccggattggcaggcagatatttctgggcggtgcccgagggcgaatttagttgcgaaccaccacttatcgcccgccatacacaacgcttgtgggtgctggaaggacagcgtgctacactaaggtgccgggcattgggcgaccccgcacccacaatgcactgggtagggccagacgacagactcgtgggcaacagctctagagcccgagcattcccaaatggcaccctcgaaatcggagttaccggcgctggagatgctgggggatatacgtgtattgctactaaccccgcaggcgaggccacagctagggtcgagctgcgggtactcgccctgccacacggaggaaatagttccgctgaggggggccggcccggcccaagtgatattgctgctagcgctagaaccgcggctgagggagagggcacgctggagagcgagcctgctgttcaggtgaccgaagtgaccgccacatctggcctcgtttcttggggacccggaagaccagcagatcctgtgtggatgttccagatccagtacaattcatccgaggacgaaactctgatctacagaatcgttcctgcgtcctcccatcatttcctactgaagcacctagtgcctggagctgactatgacctctgcctgctggcactgtcccctgccgccggcccttccgacctcaccgctactcgtttgctcgggtgtgcacacttctctacactgcccgcgtctccactgtgtcacgccctgcaggcacacgtgctcggaggcactctgacggtggcggtggggggtgtgctggtggcagctttactggtattcacggttgccctgcttgtgcggggacggggagcggggaatgggcgcctaccgttaaagctcagtcacgtgcagagtcagactaatggaggcccctcgccaactcccaaggctcatccaccaagaagcccacctcctcgcccacagcggtcatgctccctggacttgggcgacgccggatgttatggctatgcccgccgactgggcggagcatgggcgcggaggtcccattctgtacatggaggtttgcttggggccggttgcagaggagttgggggaagcgctgaaaggctcgaggagtctgtcgtgtag

SEQ ID NO: 192877 - DNA, 2160 bp, Artificial Sequence
  Description of Artificial Sequence: Synthetic coding sequence
atggagaagatcctgttctacctgttcctgatcggcatcgccgtgaaggcgcaaatctgtcctaaaagatgtgtgtgccaaattcttagtcctaatttggccaccctctgtgcaaagaagggcttactctttgtccctccaaacatcgataggcgaactgtcgagctgaggctggccgacaactttgtgaccaatatcaaaaggaaagattttgccaatatgacatctctcgtggacttgactcttagcaggaacacaatctcctttatcacgccgcacgctttcgccgaccttaggaatttgagagccttgcatcttaatagcaaccgcctgacaaaaattactaatgatatgtttagtggtctcagcaacttgcatcacttaatcttgaataacaaccaacttaccctgatcagctccacagcatttgacgacgtgttcgcgcttgaggagcttgatttatcttacaataacctggaaaccattccgtgggatgccgtggaaaaaatggtgagcctccacactctcagcctggatcacaacatgatagacaatatcccgaaggggactttctcacacttgcataaaatgaccagactggatgtgacgagtaataagctgcaaaaactcccccccgacccactgttccaacgtgcgcaggtactcgcgaccagtgggatcatatccccctctaccttcgctctgtcttttggcgggaatccactgcactgtaattgtgaacttctgtggcttagacgactatctagggaggacgatctcgaaacttgcgcttcccctcccctacttacaggacgatatttttggtcaattcccgaggaggaatttctctgcgaacccccgctcatcacgaggcatacccatgaaatgagagtgctggagggccagagggcaacactccggtgcaaagcccgaggtgaccctgagcccgcaattcactggatcagccccgaaggtaagctgatctcaaacgccactaggtcattagtgtatgacaacggcaccttggacatcctgatcaccaccgtgaaagatacaggagctttcacatgcattgcatccaatccggccggggaagctactcaaatcgtggacttgcacattattaaactaccacatttgctgaactcaaccaatcatatccatgaacccgacccaggctcctctgatattagtaccagtacaaagagtggatccaacacatcgagcagtaacggagataccaagctttcccaggataagatcgtggttgcggaggctacatctagcacagcccttctgaaattcaattttcagaggaatataccaggaatccggatgtttcagatccagtataatggaacctatgatgacacattagtgtaccggatgatccctcccacttcaaaaactttcctggtaaataatctggctgccggaactatgtacgatctctgtgttctcgctatctatgatgacggtattacctctctcacagccactcgggtggtgggttgcatacaatttaccacggaacaggattatgtcagatgtcacttcatgcagtcccaatttctgggcggcaccatgattataataatagggggcatcatcgtggcctcagtgcttgtgtttatcatcatcctgatgattaggtacaaagtctgcaacaataatggccagcataaagttaccaaggtgtctaacgtttattcacagacaaacggcgcgcagattcaggggtgctctgtcacgttgccccagtcagtcagcaagcaagcagtgggacacgaagaaaatgcacagtgttgtaaggccacctctgataacgtgatccagagctctgagacctgcagttcacaagattctagtacgaccacatccgcactgccacccagttggacctccagtacctccgtatcccaaaagcagaagcggaaaaccgggaccaaacccagtaccgaaccacaaaatgaggccgtcactaatgtggaatctcagaataccaataggaacaactccacagcactgcagctcgcctccaggccaccagattcagtgaccgaaggcccaacttctaagagagcccacattaagccaaacgcactgctaacaaatgtggaccagatcgtccaggagacacaacggttagaactgatctag

SEQ ID NO: 192878 - DNA, 1863 bp, Artificial Sequence
  Description of Artificial Sequence: Synthetic coding sequence
atgcaggtgagcaagcggatgctggccggcggcgtgcggagcatgccatcccctctgttggcttgctggcaacccattctgcttctggtcctggggtcggtactctcaggtagcgccacagggtgtcctcccaggtgcgaatgcagcgctcaggatagggccgtgttatgccatcgaaagagattcgttgccgtccctgagggaatccccacagagaccaggctcttggacctagggaagaatcggattaagaccctcaatcaggatgagttcgcttcttttccacacctggaagagctcgagctaaacgagaatattgtttcagctgtcgagcccggtgccttcaacaatttgttcaatcttcgaaccttaggcttaagaagcaaccggctgaagcttataccccttggtgtctttacaggattaagcaacctcaccaagttagatatctctgagaataagattgtgattctcttggattatatgttccaggacctgtataacttgaagagcctggaagtgggggataacgatctcgtttatatctcccatagagcattctcggggctgaacagtctagagcagctgactcttgagaaatgtaacctgacctctattccaaccgaagctctgtcacacctccatggcttgatcgtacttaggttacggcacctgaacatcaatgctatcagagattattcgtttaagcgcctgtaccgcctgaaagtcctggagatttctcactggccttatttagataccatgacgcctaattgcctatatggactgaaccttacgtccctgagtatcacacactgtaatttgactgcggtcccctacctagctgtccggcatctggtctacttacgctttttaaacctgagttataacccaattagtactatcgaggggtccatgctccacgaactgctgcgcctgcaagaaattcaacttgtgggcggccagctcgcggtggtggagccctatgccttcagaggactcaattacctgagagttctgaatgtgtctggaaatcagctcacaacactggaggaaagtgtcttccattcagtcggcaatttggaaactctgatactagactcaaatccactggcctgcgactgccgactgttgtgggtgtttagaagacggtggcggttaaacttcaacagacaacagcccacatgcgcaacccccgagtttgtgcagggcaaagaatttaaagacttcccagacgtcttgctgcctaattactttacgtgtcggagggcccgcatccgggataggaaggctcaacaggtgttcgttgacgaaggacatactgtgcagttcgtgtgcagggcagatggagatcccccccccgcaatcctttggctcagcccacgaaagcacctcgtgtctgccaagagcaacggcagacttacagtttttcctgacggaacactggaagtccggtacgctcaggtccaggataacggtacttacctctgcatagccgcgaatgcaggcggcaacgattccatgcccgctcacctgcacgtgagaagctacagtccagactggccacaccagcccaacaaaacatttgctttcatcagtaaccagccaggggaaggcgaagccaactccacccgcgcaacagtccctttccccttcgatataaaaactctaatcattgccacgacaatgggctttatctcatttcttggcgttgtgctcttctgtctggtgctgctgtttttatggtcccggggcaagggtaacacaaaacacaatatagaaattgaatatgtgccaagaaagagcgacgcaggaatctcttctgctgatgcacctaggaagtttaacatgaaaatgatttag

SEQ ID NO: 192879 - DNA, 168 bp, Artificial Sequence
  Description of Artificial Sequence: Synthetic coding sequence
atgctggccggcggcgtgcggagcatgcccagccccctgctggcctgctggcaacccattttgttgctcgtgctcggttctgtcctgtccggtagtgccactgggtgtccccctcggtgcgagtgctctgcccaggatcgagctgtattatgtcaccgcaagagatag

SEQ ID NO: 192880 - DNA, 1845 bp, Artificial Sequence
  Description of Artificial Sequence: Synthetic coding sequence
atgctggccggcggcgtgcggagcatgcccagccccctgctggcctgctggcagcctattctcctgctggtgctcgggtcggtcctgagtggctccgccacaggatgtccgcccaggtgtgagtgttccgcccaggacagagccgtgctgtgccatcgaaagagatttgttgccgtaccagagggtattcccaccgagacaaggctgctggatctcggtaagaaccgaattaaaacgcttaaccaggacgagttcgccagttttccccatttggaggagctcgagcttaacgaaaatatcgtctctgctgtggaacccggcgcctttaacaacctgtttaacttacggactctgggtctcagatccaatcgccttaagctcattcccctgggcgtgtttacgggactgtctaatctgacgaaactcgacattagtgagaacaaaatcgtgatactcctggactatatgttccaggacctctacaacctgaaatctctggaggtgggggataatgacttagtctacatatcccatcgtgcgtttagcggtctgaacagtctcgagcagttaactttggagaagtgtaatctcacatctattcctacagaagcactatctcatcttcatggtctgattgtacttcgactgagacatctgaatatcaatgccataagagattatagctttaaaaggctgtaccggctcaaagtcctcgagatctcccactggccttatctggatacaatgactcccaattgcctttatggcctgaatttgacctcattatccataactcattgtaatctgaccgcagtcccttacctcgccgttagacatctcgtgtacctacgctttctcaacctgagctacaaccccatcagcaccatcgagggttctatgcttcacgagcttctcaggcttcaggaaatccagttggtgggaggccagttggccgtcgtcgagccatacgcctttcgcgggctgaattaccttcgtgtgcttaacgtttcaggtaatcagctcaccaccctggaggagagcgtgttccactcggttgggaatctcgagacactcattcttgactccaacccactcgcctgtgactgtaggctgctgtgggtgtttcgccggagatggcgactcaattttaacagacaacagcctacttgtgccacacctgaattcgtgcaaggcaaagaattcaaagattttcctgatgtcctcttacctaactatttcacatgcaggcgtgccagaatccgcgaccggaaagctcagcaggtctttgtggacgagggccacacagtgcagtttgtttgcagagctgatggcgacccgccccccgccattctgtggctgtctcctcggaagcaccttgtgtccgccaagagcaatgggcgcctgaccgtgttcccagacggcacactggaagttagatacgcccaggttcaggacaatggcacctatctctgtatcgccgccaatgcaggtggaaacgacagcatgcccgcccacctccatgtcagatcctactctccggactggccccatcagcccaacaagaccttcgccttcatttctaatcagcccggtgagggcgaggcaaactcaacccgcgccactgttccattcccatttgatatcaagacacttataattgctactactatgggatttatttctttcctcggcgtggttctgttttgtttagtgctcctgttcctgtggagtcggggcaagggcaatactaagcacaacattgaaatcgaatacgttcccaggaagagcgatgctggcatctcaagcgccgatgcccctagaaaatttaacatgaagatgatttag

SEQ ID NO: 192881 - DNA, 1821 bp, Artificial Sequence
  Description of Artificial Sequence: Synthetic coding sequence
atgctgcacaccgccatcagctgctggcagcccttcctgggcctggcagtggtgctgatttttatgggctcaaccatagggtgtccagcacgatgcgaatgcagcgcgcagaataagtccgttagttgccaccgccgaagactgattgccattcccgaagggatcccaatcgagactaagatcctcgacctgagcaaaaacagactcaagagcgtcaatcctgaggagtttatcagttaccctctgctggaagagatcgacttatctgacaatatcattgctaacgtggaaccaggagcctttaacaacctgtttaaccttcggagcctacgcttgaagggtaaccgtctgaaacttgttccgcttggcgtattcacgggactatctaatctgacgaagctggatattagcgagaacaagattgtaattctgctcgattacatgttccaggacctgcacaacctgaagtctcttgaagtcggcgacaatgacctggtatatattagccaccgcgcctttagcggcctgctttccctggaacaactgacactcgagaagtgcaacctcactgctgtaccaacagaggccctcagccacttacgctcacttatttctctgcatctcaagcacctgaatatcaacaacatgcctgtgtacgcctttaaaaggctgttccatcttaaacatcttgaaatagactactggcccttgcttgacatgatgcctgctaacagcttatatggtctcaacctcacctctctctctgtgaccaacacaaacttatctacagttccattcctggccttcaagcatctggtgtacctgacccatctcaatctgtcatataaccctatttccactattgaagccggaatgttctctgatcttatccggttgcaggaactacacattgtcggagcgcaactgcgcaccatagagccacattcatttcaagggctgcgctttttgcgcgtcctgaacgtgtctcagaatctccttgaaactctggaagaaaatgtgttctctagtcctagggcccttgaggtcttgagcatcaataacaaccctctggcttgtgactgtcgactgctttggatactacaaaggcagccaacactgcagtttgggggacagcagcctatgtgtgccggccccgatacaatccgtgaacggtccttcaaagatttccattccaccgcgctctctttctatttcacatgtaaaaaacctaagataagagaaaagaagctgcagcacctgctggtggacgaaggccaaacagtgcaactcgagtgcagcgcagacggggatccacagcctgtaataagttgggtgacgcctcggcggcggttcattaccaccaagtccaatggccgggcaaccgtgcttggcgatggcacattggaaattagattcgcccaggatcaggattcagggatgtatgtctgtattgcgtcaaacgcagcggggaatgacacattcacagcatccctcacagtaaagggcttcgcctctgatagatttctttacgccaacagaactccgatgtacatgacggactccaatgatacgatcagtaatgggactaatgccaacaccttcagcctggatttgaagacaattctggtgtcaacagcaatggggtgttttactttcctgggggtggtgcttttctgctttctgctcctgtttgtgtggagtagaggaaagggtaaacataaaaattccatcgacctcgagtacgtgcctaggaagaacaacggtgcggtcgtcgagggcgaggtagccggcccccgccggtttaatatgaaaatgatttag

SEQ ID NO: 192882 - DNA, 1821 bp, Artificial Sequence
  Description of Artificial Sequence: Synthetic coding sequence
atgctgcacaccgccatcagctgctggcagcccttcctgggcctggccgtggtgttaatctttatgggcagcaccatcggatgtcctgccagatgcgaatgtagcgcgcagaataagtccgtgtcttgtcatcgccgtagactaatcgcaatcccggaagggattccaatagaaactaaaatactggacctgagtaagaatcggttaaaaagcgtcaacccggaagaattcatcagctaccccttgctggaagaaatcgatttaagcgacaacattatcgctaacgtggagccgggggcattcaacaacctctttaacttgaggtcccttaggttaaagggcaatcggctaaagctcgtccctttaggcgtgttcacagggctgtccaacctaaccaagcttgatatttctgagaacaaaatcgtgattctgctggactacatgttccaagacctccacaatctcaagtcccttgaggtcggggacaacgatctggtttacataagtcacagggctttctctggcctgctgtcccttgagcagctgacattagaaaagtgtaatcttacggccgtgcctactgaggccctaagccatttgcgttcactcataagccttcacttaaaacatctgaatatcaacaatatgcctgtctacgcctttaagcgcctgttccaccttaagcatctggagatcgactactggcctcttttagacatgatgccagcaaactctctgtacggattaaacctgacatcactgagtgtcaccaacaccaacctttcaacagtgccctttctcgcatttaagcacctggtatacctcacccaccttaacctctcctacaaccctatttcaactatcgaggccggcatgttttccgatcttattagactccaggagctacatatagtcggcgctcaattgaggactatcgaacctcattcttttcagggtctacggttcctgagggtgctgaacgtgtcacagaacctgcttgaaacgctggaggagaatgtgttttcaagcccgagagccttggaagttctgtctattaacaacaatcccctggcttgcgactgtcgcctcctttggatcctacagcgccagccaactttgcaatttggtgggcagcagccgatgtgtgccggccccgacacaattcgggaacgcagctttaaagatttccattccacggctctctctttttattttacctgtaaaaaaccaaagattcgagagaagaagttgcaacacttgctggtagacgagggccagactgtgcagctggagtgctctgcagatggtgacccacagcctgttatttcatgggtcacccctcggagacgtttcatcacaactaagtccaacggtcgcgctacagtcttgggggatggaactttggagattcgcttcgctcaggatcaggatagtggaatgtacgtgtgtattgcaagtaatgccgccgggaatgacacttttacagccagcctgacagtgaaggggttcgcctcggatcgctttttatacgccaaccgcaccccaatgtacatgaccgacagcaatgataccatctcaaatggtacgaatgccaacacatttagtctggacctgaagaccattctggtgtctacggccatgggctgctttacctttttaggcgtggttctgttctgctttctcctccttttcgtgtggtcacgcggtaaggggaaacataaaaactcaatcgacctggaatatgtacccaggaaaaacaatggagcagtcgtggaaggcgaagtggctgggccacgtcggttcaacatgaaaatgatctag

SEQ ID NO: 192883 - DNA, 1779 bp, Artificial Sequence
  Description of Artificial Sequence: Synthetic coding sequence
atgacctgctggctgtgcgtgctgagcctgcccctgctgctgctgccagctgccccacctccagccggcggttgtccggcgcgttgtgagtgcacagtgcaaactcgggctgtcgcttgcacgaggcggaggcttactgcagtgcccgacggcattccggccgaaacccgcctcctggagttatctaggaatcgcatacgatgcctgaaccctggggacctcgccgcgcttccagccctcgaggagctcgacctctctgaaaacgcaatcgcccacgtggagcctggcgctttcgcaaacctgccacgcctgagggttttgcgcctgcgggggaaccagcttaaactaattcccccgggagtctttacaaggctcgataacctcactctgcttgacctctccgagaataagctcgtgatcttattagactacacatttcaggatcttcactctctgaggcgtctggaggtgggggacaacgatctggtctttgtgtctagaagggcctttgccgggctacttgcccttgaagagctgacactggagaggtgcaaccttacagcattgtcgggggagagcctcggacacctgaggagcttgggcgctctgcgtctccggcacctcgcgattgcttcacttgaggatcagaatttccggcgtcttccaggtttgctgcatctggagatcgataattggcctttactggaggaagttgccgctggcagtttgcgggggctcaacctgacatccttaagcgtaactcacaccaacattactgcggtccccgctgcagcccttcgacaccaagctcatcttacctgtttaaatctcagtcataacccaattagcactgtcccaaggggctctttccgagaccttgtgcggctcagagagcttcatctggccggagctctgctggccgtcgtagagccacaagcatttctgggactccggcagattagactgttgaatttgtctaacaatctgctgtctacacttgaagagagcacctttcatagcgtgaacaccctcgagacccttcgagtggatgggaatcctctggcttgtgattgcagattgctctggatcgtgcagcggaggaagactctgaattttgatggaagactaccggcttgcgcaacacctgccgaggtacggggcgacgctctgagaaacttgccagacagcgtgctgttcgagtatttcgtgtgtcgcaaacctaaaatacgagaacggagactgcagagggtaactgctaccgccggagaggacgtgaggttcttatgcagggccgaaggggagcccgctcccaccgtcgcatgggtaacaccacagcatcgccccgtcactgctacttcagcaggccgggcacgggttctccccggaggcactcttgagatccaggatgcaaggccccaagacagtggcacatacacctgcgtagccagtaacgctggaggcaacgacacctattttgccactctgacagtgcggccagagcctgctgcgaaccgcactcctggcgaggcacataatgaaacccttgccgctctgcgcgcccccctcgacttgaccaccattttagtgtcaacggcaatgggctgcatcacttttctcggggttgtgttgttctgctttgtgctcctgttcgtctggtctaggggcagaggacaacacaaaaacaacttctccgtcgagtactcatttcggaaggtggatggccctgcggcggctgcaggccagggcggagcacgcaagttcaacatgaagatgatctag

SEQ ID NO: 192884 - DNA, 2172 bp, Artificial Sequence
  Description of Artificial Sequence: Synthetic coding sequence
atgcccctgttcttccggaagcggaagcccagcgaggaggcccggaaaagactggaataccaaatgtgccttgccaaagaggccggcgccgatgacatactcgatatctccaagtgcgagttgagcgaaattccgtttggtgccttcgccacctgcaaagtgcttcaaaaaaaggtgctgatcgtgcacacaaaccatttgactagtttgcttcccaagagctgcagtcttctttcattagcaactatcaaggttctggatttgcacgacaaccagctgaccgctcttcctgatgacctgggacagcttaccgctctgcaggtgttaaatgtcgaaaggaaccagcttatgcagctgccaagaagcatcggcaacctcacccagctgcagacactaaatgtgaaggataacaagttgaaggagctccctgacacagtcggcgagctgcgcagtttacggactcttaacattagcggaaacgagatccagagactgccccaaatgctagcccatgtgcgtacgctggaaatgttaagtctggatgcgtctgccatggtgtatcccccaagggaggtctgcggagccggtacagctgctatcctgcaattcctgtgcaaggagtccggtctggaatattatcccccctcccaatatctgcttcccatccttgaacaagacggtatcgagaactcccgggactcgcctgacgggcctactgaccgattcagcagagaggagctggagtggcagaatagattctccgactacgagaagagaaaggagcagaaaatgcttgaaaagctggagttcgaaagaaggctcgaactcggtcagcgagaacacacgcagctcctgcagcagtcaagctcgcagaaggatgagatcctgcaaactgttaaggaggagcaatctcgtttggagcagggcctaagcgagcatcagcgtcatctgaatgccgaaagacaacgcctgcaggagcagcttaaacagacggagcagaacatttcctcccggatccaaaagctgctccaggataatcaaagacagaaaaagtctagcgagatcctaaaaagcttggaaaacgaacgaattaggatggagcagctgatgagcattactcaagaagagaccgagtcgcttaggaggagggacgtggccagcgcaatgcagcagatgctgactgaatcctgcaaaaaccggctgatccagatggcatacgagagccaacgccagaacttggttcagcaggcttgtagtagtatggccgaaatggacgagagattccaacagatcctatcctggcaacagatggatcagaacaaggccattagccagatcctgcaggaatctgcaatgcagaaggccgctttcgaggcgctgcaggttaagaaggacctgatgcacaggcagattcggtctcagattaaactgatcgagacggaactgctccagcttacccagctggaactaaagaggaaaagcctcgacactgagtcactgcaagaaatgatctctgagcagcgatgggccctgtcatcacttctgcagcagctgttaaaggaaaagcagcagcgggaagaagagctccgagaaattctgactgaacttgaagcaaaaagcgagacgcgccaggagaattactggttgatccaatatcagcggctgttgaaccagaaacctcttagcctcaaattgcaggaagaaggaatggaacggcaactcgtcgcactcctggaagaattaagcgcagaacactatttaccaatattcgcccatcaccgactcagtctcgatttgctgagtcaaatgtctcccggcgatctggctaaagtcggagtaagtgaagccggcctgcagcacgagatcttgaggagggtgcaggaactgctggacgccgcaaggattcagcctgagctgaagcctcctatgggggaggtggttactccaaccgctccgcaggaacctcccgaaagtgtgcggccatccgccccacctgccgagctggaagtgcaggcctccgaatgtgtcgtgtgccttgaacgggaggctcaaatgatctttctgaactgtggccacgtatgctgctgtcaacagtgctgccagcccctccgaacttgccccctgtgccggcaggacatcgcccagaggctccgcatctaccattcatcttag

SEQ ID NO: 192885 - DNA, 2172 bp, Artificial Sequence
  Description of Artificial Sequence: Synthetic coding sequence
atgcccctgttcttccggaagcggaagcccagcgaggaggcccggaagaggctcgaatatcagatgtgtctggcaaaagaggctggagctgatgacattctggacatctccaaatgtgagttgagcgagattccgtttggcgctttcgcaacgtgtaaggttcttcagaagaaggtcttgatcgtgcacaccaaccatctcactagcctcttgcctaaatcttgttccctgctgagtctggctaccatcaaggtgcttgatctgcacgacaatcagttaactgccttgcctgacgacctgggacagctgacggcgctccaggttcttaatgtagaacggaaccagctgatgcaacttcccaggtcaattgggaatctgacccagcttcagaccctgaacgtgaaggacaacaaactgaaggagctgcccgatactgtgggtgaactcagaagtctcaggaccttgaatatctctggaaacgaaattcagcggttgccgcagatgctggcccatgtcaggactctggagatgctatccctggatgcttccgctatggtctacccaccgcgcgaagtctgtggtgccggaactgcagcaatacttcaattcttgtgcaaagagagtggcctggagtattacccgccaagtcagtatctgctgcccatcctggaacaggacggaatcgaaaactcccgtgattctcctgacggccctacagacagattcagccgcgaagagctcgagtggcagaacagattttccgactatgagaagcgcaaagagcaaaaaatgctggaaaaacttgagttcgaacgcaggctcgagcttggccagcgcgaacacactcaactgctccagcaaagttcctcccaaaaagacgagattttgcagaccgtgaaagaggagcaaagtcgtctggaacaaggactatcagagcatcagcggcatcttaacgcggagaggcagagactccaagagcaattaaaacaaacagagcagaatatttcatctagaatccagaagctgctccaggataaccagagacagaaaaaaagttccgagatcttgaaaagcttagaaaatgaaagaatcagaatggaacagttgatgtcaatcacacaggaggagactgagagtctgcgcaggcgcgacgtggcatcagctatgcaacagatgctgaccgagtcgtgtaagaatcgactgattcagatggcttacgagagtcagcggcagaacctagtgcagcaagcatgcagctcaatggccgagatggatgaacgcttccaacagatcctcagctggcagcagatggatcagaataaagcaattagtcaaatcctgcaagagagtgctatgcaaaaggctgcattcgaagctctgcaggtgaagaaggatttgatgcaccgtcaaatacggtctcagatcaagctaattgagaccgaattgctgcagctcactcagttggaactgaagaggaagtcacttgataccgagtccctgcaagagatgattagcgagcaacggtgggcactgtcctcacttctccagcaactgcttaaagaaaagcagcagcgggaggaggagctccgagaaatacttacagaactggaagcgaagtctgaaacacgccaggagaactattggttgatccaataccagaggcttcttaaccagaagcctctgagcctgaagttgcaagaagagggcatggaaaggcagctggtggcacttttggaagagctcagcgcagaacactacctccccatcttcgctcaccaccgactctccttggacctgctttctcaaatgtcccccggcgatttggccaaagtcggagtgagcgaggccgggttacaacatgagatcttacggagggtgcaggaactgctggacgcagcaagaatacagccagaactgaaaccacctatgggcgaggtcgtgactccaacagcgccacaggagccgcctgagtctgtgagaccatccgcaccacctgccgagttggaggtgcaagcaagtgaatgcgtagtttgtctcgagagagaggcacagatgatctttctcaactgcggccacgtgtgctgctgtcagcagtgctgtcaaccactccgtacgtgccctctttgcaggcaagatatcgcccagagactccgaatttatcactccagttag

SEQ ID NO: 192886 - DNA, 2172 bp, Artificial Sequence
  Description of Artificial Sequence: Synthetic coding sequence
atgcccctgttcttccggaagcggaagcccagcgaggaggcccggaaaagactagagtaccagatgtgtctggcaaaagaggctggcgcagacgacatattagacatttctaagtgtgagttgtctgaaatcccgttcggcgcgttcgctacctgcaaggttctccagaagaaggtgcttatcgttcatactaaccatctgacctccttgctcccaaaatcatgcagcctcttgtcactggcgaccatcaaggtcctggatctgcatgataaccagctgaccgcactcccagacgatctcgggcaactcactgccctccaggtgctgaatgttgagcgaaatcagcttatgcagcttccgaggagtatcggcaacctaacccagctccaaacactaaatgtcaaagacaacaagctcaaggaattacccgacaccgtcggcgagctcaggtctttgcgaaccctgaatatatctgggaacgaaatccaacggcttcctcagatgctggctcatgtgcgcaccctggagatgctgtcattagacgcctctgccatggtctacccacctcgcgaagtgtgtggcgccggaactgcggccatccttcagttcctttgcaaagaatcaggcctggagtattatcccccctcccagtacctcctaccgatcttagaacaagatggtatcgaaaactcgagggattctccagacgggcccacggacagatttagccgggaggagctggagtggcagaaccgctttagtgattacgaaaaaaggaaagagcagaagatgctcgaaaagctagaatttgagcgtcggcttgaactgggacagagggagcatacacagctcttacagcagagctcatctcagaaggatgagatcctgcaaacggtgaaggaggaacaatccaggctagaacagggcctgtccgagcaccagcgccatctcaatgccgagaggcagcggctgcaggaacagctgaagcagaccgagcagaacatcagttcaaggatccagaaattgttacaggataatcagcgtcaaaaaaagtcttccgaaattttgaaatccctcgagaacgaacggattagaatggagcagctcatgtctataacgcaggaggagacagagagcttgagacgtagagatgtggcaagcgccatgcagcagatgctgacagagtcctgcaagaataggctgatacaaatggcctacgaaagccagcgacaaaaccttgtccaacaggcatgcagctccatggctgaaatggacgagaggtttcagcagatcctctcatggcagcagatggaccagaacaaagccataagccagattctgcaagagtctgcaatgcagaaagctgcattcgaggcgttacaggtgaaaaaggacttgatgcacagacaaatccggtcccaaatcaaactcattgagactgaactattgcaactgacccaactggaactcaagcgcaagtcgctagataccgagtccctccaagaaatgatcagcgagcaaagatgggctctgagtagtctccttcagcaactcctgaaagagaagcagcaaagggaagaggaactgcgagagattttgaccgaactcgaggccaaaagcgagacgcgacaggagaattattggttaattcagtatcagcgcttactgaatcaaaaaccactgtccctgaagctgcaagaagagggcatggaacgacagctggtcgcattactggaagaactgagtgctgaacattatctgccgatttttgcgcaccatcggttaagtctggacttgttatctcaaatgtccccgggagacctggccaaagtgggcgtcagcgaggccggcctccagcacgaaatcctgcggcgggtgcaagaactgctcgacgccgccagaatacagccggaactgaagccacccatgggggaggtcgtgactcctaccgccccccaagagcctcctgaatccgtccgaccatctgcacctccagcagagctggaagtccaagcttctgagtgcgttgtgtgtctcgagcgcgaagctcaaatgatcttcctcaattgtgggcatgtgtgctgttgccagcaatgctgtcagccactcagaacctgccccctctgcaggcaggacatagcgcagaggctccggatataccacagcagctag

SEQ ID NO: 192887 - DNA, 2091 bp, Artificial Sequence
  Description of Artificial Sequence: Synthetic coding sequence
atgcccctgttcttccggaagcggaagcccagcgaggaggcccggaaacgtctggagtaccagatgtgcctggctaaagaagctggtgctgatgatatcctcgatattagcaagtgcgaattgagtgagatcccctttggtgcctttgctacttgtaaagtgctccagaaaaaagtactcatcgtgcataccaatcatctgacctccctgctccccaaatcttgctctctgctctccctagcaactataaaggtgctggatcttcacgataaccaactcactgccctcccagacgacctggggcagctgacagctctgcaagtgcttaacgttgagcgcaatcaactcatgcagttgccacgatccattggcaatcttactcaactccagaccctgaatgtgaaagacaacaagctgaaggagttacctgacacagtaggtgaacttcgaagtcttagaacactgaatatttccggaaatgagatacagaggttaccacaaatgttggctcacgtgcggacactggaaatgctgagcctggatgcttccgccatggtgtatccgccccgggaagtatgtggcgccggcacggccgctattctccaatttctttgtaaggagtccggactggaatactatccaccttcccagtaccttctgcccattctggagcaggacgggatcgagaactccagagacagtcccgacgggcccaccgatcgcttcagccgggaggaattagagtggcagaataggttttctgattatgagaaacgaaaagagcagaagatgttggaaaagctcgaatttgagaggaggctggagctggggcagcgggaacacactcagctcctccaacagagttccagccagaaagatgagattctccagacagtgaaggaagagcagtctcggctggagcagggcttatcggaacaccaaagacaccttaacgcagaacgacaacgcttgcaggagcagctgaaacaaacagagcagaacatttcctcccgtatccaaaaactcctccaagacaatcaacgacagaaaaaatccagcgagatactgaagtcgctcgaaaatgagagaataaggatggagcagctcatgtcaataacccaagaagaaaccgaatccctgcgaagaagggacgtggcaagcgcaatgcagcagatgctgacggaatcttgtaagaaccggcttatccagatggcctacgagtcccagcgacagaacctggttcagcaggcgtgttcatctatggcagaaatggatgagcggtttcaacaaatcctgtcatggcagcagatggatcaaaataaggccatttctcagattctccaagagtcagccatgcagaaggcggctttcgaagctctccaggtgaagaaggatctcatgcatcgccagataagatcccaagagatgatctcagagcagcggtgggccctgtcatctctgctgcagcaattgctgaaggaaaaacagcagcgggaagaagagctgcgggagatccttaccgagctggaagctaagtccgaaacgcgtcaggagaattattggctaattcagtaccagcgattgctgaaccagaagcctctctcactgaagctgcaggaggagggcatggagcgccagcttgtggcgctgctggaggaattatcagctgagcattacttgcctatatttgcccaccatagactgagcctggatctgctttcccagatgagtcccggggacctggccaaagtgggcgtttctgaggcagggcttcagcatgaaatattgcgtagagtccaggagttgctcgatgccgcccgcatccaaccggaacttaaaccccccatgggagaggtggtgaccccgactgcccctcaggaaccccctgagagcgttcgcccttccgcacccccggctgaactggaagtgcaggcgagcgaatgcgtggtttgcctggagagagaggcccagatgatcttcctgaactgtggacacgtttgttgctgtcagcaatgttgccagcctttgagaacatgcccgttgtgtcgccaggatattgcccagagactgcggatctaccacagctcctag

SEQ ID NO: 192888 - DNA, 465 bp, Artificial Sequence
  Description of Artificial Sequence: Synthetic coding sequence
atgttccactgcatccccctgtggcggtgcaaccggcacgtggagtcaattgacaaaagacactgcagcttagtctacgtgcctgaagagatatacaggtacgctcgctcgcttgaagaactcctcctggacgccaatcagctccgcgagctgcctgagcagttctttcagctggtgaaactcaggaagttagggttgtctgataatgagattcagagactgcccccagagatcgccaatttcatgcagctggtggaactcgacgtgtcacggaatgagataccggagatccccgagagcatctctttttgcaaagctttgcaggtcgcagatttcagcgggaatccgctgacccgtctgcctgaatccttccccgagctgcaaaatctaacctgtctcagcgtgaatgatatctccctccagtcactgcctgaaaacattggcaagcaaaagacaacttcatag

SEQ ID NO: 192889 - DNA, 1575 bp, Artificial Sequence
  Description of Artificial Sequence: Synthetic coding sequence
atgttccactgcatccccctgtggcggtgcaaccggcacgtggagtccattgacaagcggcattgctccctggtgtatgtgccagaggagatttatcgctacgcccgaagcctcgaagagctcctgctcgatgccaaccagctgcgagaactgcccgagcagtttttccaactggtgaaactgcgcaagctcggattgagcgacaacgaaatccaacgcctgccgccggaaattgctaacttcatgcagctggtggagcttgatgtctcaaggaacgagatccctgagatccctgagtctatctcattctgtaaggcccttcaagtggcagatttctcgggtaatcccctaacccgtctgcccgagtccttccccgaactgcagaacctgacctgcttgagcgtgaacgatatatctctacagtcactgcccgagaacattgggaacctgtataacctcgccagcctggagctacgggaaaatctgttaacatatttgccagactccttgacacagttgcgacggttagaggagctggacctgggcaacaatgagatctacaacctaccggagagtatcggggctttgcttcacctaaaggatttgtggctagacggcaaccaactgtctgagcttccgcaggaaattgggaacctaaaaaatctattatgtctggatgtgtctgaaaatcgcctcgagcgattacctgaagaaatctccgggctgacatcccttaccgacctcgttatcagtcagaatttactggaaactattcctgatgggattggaaagctcaagaaactgagcatactaaaggttgatcagaacagactaacccaattacccgaagctgttggcgagtgtgagagcctgaccgaattagtgcttactgagaatcaactactaactttaccaaaatcgatcggaaagttaaagaagctgtcgaacttaaacgcggatcgaaacaaactggtctccctgccaaaggagattggcgggtgttgttcactgaccgttttctgtgtgagggacaatcgactgacgaggatccctgccgaggtgtcccaagctacagaacttcatgttctagacgttgccgggaataggttgcttcaccttcccctgtcattgactgcccttaagctgaaggccctatggctgtctgataatcaatcacagccactgctgacttttcagacagatactgattacaccaccggcgagaaaatcttaacgtgcgttctgctcccccaactcccctcggagcctacttgtcaggagaacctgccccggtgcggcgccctggaaaatctggtaaatgacgtgtctgacgaagcatggaatgaaagagccgtgaatcgcgtgtcagccattagatttgtggaggatgagaaggatgaggaagacaatgaaactcgcaccttactgcggcgcgccactccacacccaggagaactcaaacatatgaaaaaaacagtcgagaatctgagaaacgatatgaacgcggccaagggactcgatagcaacaagaatgaggttaatcatgccatcgaccgggtgacgacatccgtgtag

SEQ ID NO: 192890 - DNA, 834 bp, Artificial Sequence
  Description of Artificial Sequence: Synthetic coding sequence
atgggcaacaccatccgggccctggtggccttcatccccgccgacagatgccaaaattacgtggtccgggacctgcgcgagatgccgttggataagatggttgacttgtcgggaagccagctgaggcgattcccgctgcacgtttgttccttccgcgaattagtaaaactgtacctgagtgataatcacctaaattccctgccccctgagttaggacagttacagaatctccagattttggcccttgactttaacaatttcaaagctttgcctcaggtggtgtgtacgctgaaacagctgtgcattctctatctcggtaacaacaaactctgcgacctgcctagcgagctttctctgctgcagaatctaagaaccctgtggattgaagctaattgtctgacacagttgcccgacgtggtttgtgagctgtcacttctgaaaacactgcacgctggctcgaacgctctgcgcctgctgcctgggcaactccgccgcttgcaggaactgagaaccatttggctaagcggcaaccggctgaccgatttcccaaccgtgttgctgcatatgcccttcctggaggtaattgacgttgactggaacagcatcaggtacttccctagtctggcacatttgtcatcacttaaactggtgatttatgaccataacccatgtaggaatgcccccaaagttgccaagggggtcagaagggtgggaagatgggctgaggagacacccgaacccgacccccgaaaagcccgcaggtatgccctggtccgggaggagtctcaggaattgcaggctccagtgcccctgctccccccaactaatagctag

SEQ ID NO: 192891 - DNA, 4116 bp, Artificial Sequence
  Description of Artificial Sequence: Synthetic coding sequence
atgaccgaggagagcagcgacgtgccccgggagctgatcgagagcattaaagacgtcataggtaggaagattaaaatctcggttaagaagaaggtaaagctggaggtcaagggcgataaagttgagaacaaagttttagtgctgacctcctgtagggccttccttgtgaccgcgagaataccgactaagctcgagctgaccttttcatatcttgaaatccatggcgtggtgtgtagcaaaagcgcccagatgatcgtggagacggaaaaatgtagcatttcaatgaaaatggcgtctcccgaggacgtgtccgaagttctggcccatatcggcacatgtctcaggaagattttcccagggctgagccccgtccgtatcatgaaaaaggtatccatggagccatccgagcgcttggcttccttgcaggcattatgggattctcagactgtcgctgaacagggcccatgcggtggattcagtcaaatgtacgcctgcgtgtgcgactggctaggttttagctacagagaggaagttcagtgggatgtggataccatctatctaacacaagacacaagagagctcaaccttcaggacttctcccaccttgatcaccgcgacttgatcccaattatcgctgccctcgagtacaaccagtggttcactaaactctccagcaaagacctaaaattgtctactgatgtttgcgaacagatcctgcgggttgtcagccggagtaataggctggaggaactggtgctcgagaacgctggactgcgcacggacttcgcccagaaattggcttccgccctcgcacacaatcccaacagtggcctccacactataaacctggctggaaaccccttggaggatagaggagttagtagcctcagtatccaatttgcaaagctgcctaaagggttaaaacacttgaacttgagtaaaacctccctgagtcctaaaggcgttaattccttgagccagtccctgagcgccaaccctcttacagcttctaccctggtgcacttagacctgtcaggcaacgtgttacgcggggatgatttgagtcacatgtacaattttctcgcccagcccaacgctattgtgcacctggacctcagcaacaccgaatgtagcctcgatatggtgtgtggagctttgctgagaggctgccttcaatatttggcggtcttaaatctgtcgcgtaccgttttcagccacagaaaaggcaaggaagtcccaccgtctttcaaacagttcttctcctctagcctggcacttatgcacatcaacctgtcaggaacgaagctgagccccgagccgctgaaggccctgctgttgggcctggcttgtaatcacaacctcaagggggtgagcctggatttgtctaactgcgaattgcggtctggcggagcccaggtcctggagggttgcatcgccgagatacataacatcacaagcctggatattagcgacaacggactagaatcagacttgtcaacgctcattgtctggctgtccaagaatcggagcatacaacacttggccttgggcaagaactttaataatatgaaatctaaaaatctgacgcctgtgttggacaacttggtacagatgattcaggatgaggagtcccctctgcagagtctcagcctcgcagactccaagttgaagaccgaggtgactataattataaatgctctgggatccaacaccagcttaactaaggtggacatctcaggaaatgggatgggtgatatgggcgcaaagatgttggccaaagcgctgcagatcaatactaagctgcgcactgtgatttgggacaagaataatattaccgcacaagggttccaggacattgccgtggccatggaaaagaactatacgctgcgcttcatgcctatccccatgtatgacgcctcccaagcactaaaaactaatcctgaaaaaaccgaggacgccttacaaaaaattgaaaactatctattgcgcaaccacgaaacccggaagtacctgcaggagcaggcataccgtctgcaacaagggatcgtgacttccacgacacagcagatgattgacagaatctgcgtgaaggtccaggaccatctgaatagccttcgcaactgtggcggggatgcaatacaggaggacttgaaatctgcggaacgtctgatgagggacgctaaaaactccaagacactgcttcccaatttgtatcatgtcggcggcgcctcttgggcaggagcttctggtctgctgagctcacccattcaggagacactagagtcaatggcaggagaggtgactagagtggtcgacgaacagcttaaggctctcctggaatctatggttgatgctgcagagaacctgtgccccaacgtgatgaagaaagcacacattaggcaggatctgatccacgccagcacagagaaaatctctatccccaggactttcgtcaaaaacgtgcttttagaacagagcgggattgatatcctgaataaaatctcggaggtcaagctcaccgtcgcctccttcctgtcggaccgaattgttgatgaaatcctggacgccctaagtcattgtcatcacaagctggccgatcacttctcccggaggggcaagaccctccctcaacaggagtcactggaaatcgagctggctgaagaaaagcccgtgaaacgcagtatcatcacagtggaggagctcactgaaatcgagcgacttgaagacctcgacacatgcatgatgacaccaaagagcaaaagaaagagcatccacagccggatgctgcgccccgtgtcccgggccttcgaaatggagtttgacctagataaagcactcgaggaggtcccaattcacattgaagacccaccctttccctcactcagacaagaaaagcggagctccggttttatttctgagctgccgtctgaagagggaaaaaagttggaacactttacgaagctgagaccgaaaagaaataagaagcaacagcccacccaggctgcagtgtgtgccgccaacattgtctctcaggacggcgaacagaatgggcttatgggacgcgtggatgaaggtgtagacgagtttttcaccaaaaaggtaacaaaaatggattcaaaaaaatggtcaacacggggctcagagtcccacgagctcaacgaaggaggcgacgagaagaaaaaacgtgatagtcgcaaaagttctggatttttaaacctcatcaagagcaggtccaaatcagagcggccaccaactatactgatgacggaggaaccttcatcaccaaaaggtgcagttagaagcccgcctgtcgactgcccccgcaaagataccaaggctgcagagcacaatggcaacagcgaaaggatcgaggagatcaagactccagattccttcgaggagagtcaaggggaggagattggcaaggtcgagagatccgattccaaaagttccccccaggccggacggcggtatggcgtccaggtaatggggagcggcctgctggctgagatgaaggctaagcaggaaaagagagcggcctgcgctcagaaaaaactggggaacgacgctgttagccaggactctagttcccccgcccttagtggggtggaaagaagcgacggcggcggtgcagttcctaagctccatcccgggctccccgagaaccgcttcggactgggaacacccgaaaagaataccaaagcagaacccaaggcagaggccgggagccggagtagaagcagtagcagcacccccacatctccaaagcctcttctccaatctcccaaacccagcctcgccgcacgcccagtcattcctcaaaagcctagaactgcttcacggccagacgacattccagactcccctagctcccccaaagtcgcacttctcccgccggtgctgaagaaagtcccgtctgataaggagcgagacggccagtcctcccctcagcccagccctcgcactttctctcaggaggtttctcggcgtagctgggggcagcaggcccaggaatatcaggaacagaaacaaaggagtagttcaaaagacggccaccagggatcgaagagcaatgatagcggggaagaggcagagaaggagttcattttcgtgtag

SEQ ID NO: 192892 - DNA, 531 bp, Artificial Sequence
  Description of Artificial Sequence: Synthetic coding sequence
atgtacgcctgcgtgtgcgactggctgggcttcagctaccgggaggaggtgcagtgggacgtcgataccatttatcttacacaggataccagggagctgaatctgcaggatttttcccacctcgaccatcgcgacctgattccaattatagctgcgcttgaatataatcagtggttcactaaactttcctctaaggacctaaagctgagtacagatgtttgcgaacagatcctacgcgtagtgtcccgctccaatagacttgaagaactcgtgctggagaacgccggtctacgcaccgacttcgcacaaaaacttgcgagtgctttggctcataatccaaactctggcctccatactatcaacctggcgggaaaccccctggaggacagggaaacaacaactaagatcaagcgccagaacgtgcctaccgttttgcaaacatatctagtcgtctgcccatcagattatcagccgtgtcccctgcccttgggaaaagacaattattacagtgacttctcccacgatggctag

SEQ ID NO: 192893 - DNA, 3981 bp, Artificial Sequence
  Description of Artificial Sequence: Synthetic coding sequence
atgaccgaggagagcagcgacgtgccccgggagctgatcgagagcatcaaggacgtaatcggacggaaaatcaaaatctctgtaaaaaagaaggtgaagctagaggtgaagggggacaaagtcgaaaataaggtgctggtgttaacttcgtgtagagcatttctggtcactgcgaggattcccaccaagctggaacttacgttcagctacctggaaattcacggcgtggtttgttctaaatcggctcagatgattgttgaaaccgaaaaatgcagcatctccatgaagatggccagccctgaggacgtgtccgaagtcctggcgcatattggaacatgccttcgtaagatttttcccggcttatctcctgtacgtatcatgaaaaaggtttctatggagccctccgaaaggttggcttcactccaagctttatgggattcccagaccgtggcagagcagggcccctgtggtgggttctcacaaatgtatgcgtgcgtatgtgactggctcggtttctcctatcgcgaggaagtccagtgggacgtagacaccatctacttaacccaggacacacgggaacttaacctccaagatttttctcacctcgatcaccgggacttgattccgatcattgccgccctcgagtacaaccaatggttcacaaagctgtcaagcaaagacctgaagttatcaaccgacgtgtgtgagcagatcctgagagttgtgagccgttccaacaggctcgaagaacttgtgctcgaaaacgctgggctgagaacggattttgcgcagaagctggcaagcgctctggcgcacaaccccaattcgggcctgcataccatcaacctggctggcaacccccttgaagatagaggagtaagttctctatccatacagtttgcgaaactccccaagggactgaagcacctcaatctgagtaagacatctctgtcacccaagggagtcaatagcttaagtcaatcactgtctgcgaacccactaacagctagcacactggtgcatctggacctgtccggaaatgtgctgcgcggtgatgacctgtcacatatgtataacttcctggcccaacctaatgccattgtgcacctggacctgagcaataccgagtgcagccttgatatggtctgcggcgcccttttgcggggatgtctccaatacctcgctgtgctgaacttgtctcgaacagtgttcagccatcgaaagggcaaagaggtgcctccttctttcaagcaattctttagtagtagcctcgccctcatgcacatcaatctctctggcactaagctctcccccgagcctctgaaggccctgctgctgggcctggcgtgtaatcacaatctgaaaggcgtaagcctcgatctgtcaaactgcgagctgagatccggcggtgctcaggtgctggaggggtgtatcgccgagattcataatatcacttctctggatatcagcgataatgggctggagtccgatctgagtacattaatcgtgtggctgtccaaaaaccggtctatccagcacttagccttggggaaaaattttaacaatatgaaatccaaaaaccttaccccagttctggataacctcgttcagatgatacaagatgaggaaagccctctccagtccttaagcctagccgactcaaaacttaaaaccgaggtgaccattatcataaatgccctcggaagtaatacaagccttacaaaagtggacatcagtggcaacgggatgggggacatgggggccaaaatgctggccaaggctttgcagattaacactaaactaagaacagtgatttgggacaaaaacaacataacagcacagggtttccaggacatcgcggttgctatggaaaaaaactacacattgaggtttatgccaattcctatgtatgacgcaagtcaggccctgaaaacaaacccagaaaaaaccgaggatgcactccagaagatagaaaactaccttttgcgaaaccacgaaactcggaagtatctgcaagagcaggcctatcgccttcagcagggcatcgtgacttctacgacccagcagatgattgataggatatgcgtgaaggtccaagaccacctgaactccctccgcaattgcggcggggatgcaattcaggaagacctgaagagcgccgagaggttgatgcgcgatgcaaaaaattctaagacactgctgcccaatctgtaccacgtcggtggcgcaagttgggccggggcatctggcttactgagtagtcctattcaggaaaccctggagagtatggcgggagaggtgactcgcgtggtggatgaacagcttaaagccctgctagagagcatggtggatgctgcagagaacctctgtccaaacgtcatgaagaaggcccacatcaggcaggatcttattcatgcttcaaccgagaagatctctatccctagaacgttcgtgaagaacgtactgctagagcagtcaggcattgacattctgaacaagatcagcgaagtaaaacttaccgtggcttcctttctgtccgatcggatcgtcgacgagattctggatgccctcagtcactgccatcataagttagcagatcacttttcacgacgcggtaagactcttcctcagcaggagtctctggagattgaacttgctgaggaaaaacccgtaaaaagatcaatcattacggtcgaggagctgactgaaattgagagactggaagacctggacacatgtatgatgaccccaaaaagcaaacgcaaatccatccattctcggatgctgcggccagtgagtcgggcctttgagatggaattcgacctggataaggcactggaggaagtccccatacatatagaagaccccccctttccctcattacgccaggaaaagagatcatccggcttcatttctgagctgccaagtgaagaaggcaaaaagctggagcacttcaccaaactacggcccaagcgaaacaaaaaacagcaaccgactcaggctgcagtgtgcgcggcaaacattgtctctcaggatggagaacagaatggccttatgggccgagttgacgaaggggtggatgaattctttaccaagaaggttacgaagatggatagcaagaaatggtcaacacgcggctccgagtcccatgagcttaacgagggcggtgacgagaagaaaaagagagactcgcgaaaatcaagtggatttctcaaccttataaaatcccggagcaaaagtgagaggccacccactatcctgatgacagaggaaccgagcagtcctaagggtgcggtgaggtctccacctgtcgactgccctcggaaagataccaaggccgctgagcacaatggcaatagcgaacggatcgaagaaatcaagactccggactccttcgaagaaagccagggtgaagaaatcgggaaagtagagaggtctgatagcaagtcctcacctcaagccgggcgacgatatggggttcaggtcatgggctcaggattactagccgaaatgaaagcaaagcaggagaaccgttttggactggggacaccagagaagaatactaaggcagaacccaaggccgaggctggttctcgatcaagatcaagctcttcaaccccaacttctccaaaacccctactgcagtcccccaagccaagcctggcagctcgaccagtcatcccacagaagcccaggaccgcctcgcgtccagacgatatccccgattctccaagctctccaaaagttgcactattgccacccgttttgaagaaggtgccgagcgataaggagagagacggacagagttccccgcaaccaagcccaagaacgttctcccaggaggtgagtagacgctcctggggccagcaggcgcaggagtatcaggagcagaagcagcgaagcagcagtaaagatggccatcagggatcaaaatctaatgattctggggaagaagctgaaaaggagtttattttcgtgtag

SEQ ID NO: 192894 - DNA, 1116 bp, Artificial Sequence
  Description of Artificial Sequence: Synthetic coding sequence
atgggccacaaggtggtggtgttcgacatcagcgtgatccgggccttgtgggaaactcgggtcaagaagcataaggcatggcagaagaaagaggtggagcgcctcgagaagagtgctttagagaagataaaagaggagtggaactttgtggcagaatgtagacgcaaggggattccccaggctgtgtattgcaaaaacggatttatagacacatcggttcggcttcttgataagatcgagcgaaataccttgacgcggcaatcttcgttgcccaaggaccggggcaagagaagtagtgcatttgtcttcgaattaagcggagaacactggaccgaactgccggattcactgaaagagcagacgcatctaagagaatggtacatctctaacacactgatccagataattcccacgtatattcagctttttcaggccatgaggatacttgatctacccaaaaaccagatttctcacctgccagctgagattggctgcctcaagaacctgaaagaactgaatgtgggcttcaattatcttaagtctattccccccgagctgggagactgcgagaatctggagagactggattgtagcggcaacctcgagctgatggagcttccgttcgagctgagtaacctgaagcaggtcacgttcgtcgacatctctgcgaataagttctcctcagtgcctatttgtgtcttgcgtatgtctaacctgcagtggctcgacatctcgagcaataacctgacggatttaccccaagatattgacaggctggaggagttgcagagttttctgctctacaaaaacaaacttacgtacctgccatatagcatgctgaatttgaagaaactcactctactcgttgtgtccggcgatcacctcgtcgaactgcccactgctttatgtgattcgagcaccccgttgaaattcgtgtctctaatggataaccccatcgataacgcgcagtgcgaagatgggaacgagattatggagtccgaacgggatcgacagcactttgacaaggaggtgatgaaagcctacattgaggatttaaaagagcgagagtctgtcccgtcctacactaccaaagtgtccttctcattacagctgtag

SEQ ID NO: 192895 - DNA, 1116 bp, Artificial Sequence
  Description of Artificial Sequence: Synthetic coding sequence
atgggccacaaggtggtggtgttcgacatcagcgtgatccgggccctgtgggaaacccgcgtgaaaaaacataaggcctggcaaaagaaggaggtcgagcgactagagaaatctgcccttgagaagatcaaggaagagtggaacttcgtggcggaatgccgcagaaaaggtattccccaggccgtgtactgcaaaaacgggtttattgacactagtgtccggcttctggataagatcgagaggaacacactaacacggcagtcctccttgccgaaagacaggggcaagcgaagttccgcctttgtgttcgagctgtcaggagagcactggactgagctgcctgatagcctcaaggagcaaacccatctgagagaatggtatattagcaacaccttgattcagatcattccaacctacattcagcttttccaagcgatgcggattctcgatttacctaagaaccagattagccatctaccagctgaaatcggctgcctgaagaatctcaaggagctaaatgtaggtttcaattacctcaagagcatccccccggaacttggtgattgcgagaacctcgaacgcctggactgcagtggtaacctggaactgatggaattgcctttcgagctaagtaatctcaagcaggtgacattcgtggacatttccgcaaataagttcagctcagttcctatttgtgtcttacggatgagcaatctgcagtggctggatattagtagcaataatttgaccgatctaccccaagacatcgacagactcgaagagcttcaatcttttctcctgtacaagaacaaacttacatacctgccgtattctatgttgaatctgaagaagcttacccttctcgtcgtgagcggtgatcacttggtggagttaccaacagccttatgtgactcgagcacacctctgaaattcgtgtctctgatggacaaccccattgataacgcccagtgcgaagatggaaatgaaattatggagtctgagcgtgatcgccagcacttcgataaggaggtgatgaaggcctacatcgaagatctgaaggagcgcgagagcgtgccctcgtacacaacgaaagtcagcttttcccttcaactctag

SEQ ID NO: 192896 - DNA, 918 bp, Artificial Sequence
  Description of Artificial Sequence: Synthetic coding sequence
atgggcggcaccctggcctggaccctgctgctgcccctgctgctgagggaatccgattccctggaaccctcctgcacagtgtcgtcggctgatgtggattggaacgccgagttttcagccacttgcctgaatttttctgggctctccctgagtctccctcataatcagtccctgagagcctcaaatgtgatcctgttggacctctcaggaaatggacttagagagctgcctgtgacattttttgctcacctacagaaactggaggtgctgaatgtcctcagaaacccactgtcgcgggtggatggcgccctcgcggcccggtgtgacctcgacctgcaggcagattgcaattgcgctctcgagtcttggcatgatattcgtcgcgacaactgctccggacaaaaaccactgctgtgctgggacaccactagctcacagcataatctgtccgcctttcttgaagtcagctgcgctcccgggctggcatcagccaccattggtgccgttgttgttagcggatgcttgttgttggggcttgcaatagccggtcctgtcttagcttggcgcctgtggcgatgcagggtggcgcgcagtagggagctgaataaaccatgggctgcccaagatgggccaaaacctggcctgggtctgcagccgaggtacggctcaaggtcggcgcctaagccccaggtggccgttccttcgtgcccctccactcccgactacgagaatatgttcgtaggacagcccgctgccgagcaccagtgggatgagcaaggcgcacaccccagtgaggacaatgatttttatatcaattataaagatatagatctggcctctcaacccgtatactgtaatctgcagagtttaggccaggctcctatggacgaagaggagtatgtgatacccgggcactag

SEQ ID NO: 192897 - DNA, 1005 bp, Artificial Sequence
  Description of Artificial Sequence: Synthetic coding sequence
atgcggggccccagctggagccggccccggcccctgctgctgctgctcctcctcttatcaccctggcccgtttgggctcaggtaagtgctacagcctctcccagcggtagcctgggcgcccccgattgtcccgaggtttgcacatgtgtcccgggaggtctcgctagttgtagcgctctgtccctccctgccgtgccacccggactctcgctgagactgcgggcgcttctgcttgatcacaaccgggtacgcgctcttccgcctggcgcattcgccggagcgggtgcgttacaacggttagacctccgggagaacggcctccatagcgtccacgtccgagcgttttggggcctcggcgccctgcagttgcttgacctctctgctaaccagctcgaagctctcgcccctggaacttttgctccgcttagagcactgcggaacctgtccctggctggcaaccgccttgccaggctcgagccagcggctctcggcgcgctgcccctcttgcgttctttgtccctccaggataacgaacttgccgccctggctcctgggctgctgggcaggcttccagcactggatgcacttcacctgcgagggaacccttggggttgtggttgcgccctgcgccctctctgcgcatggctacggaggcaccctctccctgcgagcgaggccgagacagtgctttgcgtgtggcctggacggctcaccctatctcccctaaccgctttcagcgatgccgccttttcgcactgtgctcagccccttgcactgcgcgacttggctgtggtgtacaccctgggccctgccagctttctggtatccctagcctcatgtctggccctgggaagcggattgacggcttgtcgagcccggagacgaaggcttaggaccgccgcccttcggccaccccggccaccagaccctaacccggaccctgatcctcacgggtgtgcctctcctgccgatccgggttccccagctgctgcggcgcaggcctag

SEQ ID NO: 192898 - DNA, 1923 bp, Artificial Sequence
  Description of Artificial Sequence: Synthetic coding sequence
atgctgaacaagatgaccctgcacccccagcagatcatgatcggccccagatttaatagagctctgttcgatcctttgctcgtggtgcttttagccctacagttgctggtggtggctgggttagtgagggctcaaacatgtccatctgtgtgttcgtgttcaaaccagtttagcaaggtcatttgcgtgaggaaaaaccttagggaggtgccagacggcatttcaactaatacgaggctcctgaatctacacgagaatcagatccagatcatcaaggttaattcctttaagcacctgaggcacctggaaatcttgcagctgtcgcggaaccacatcaggacaatcgagatcggtgcgttcaatggactggctaacctaaatacactagagctgttcgacaatcggcttactacgatacccaacggcgcatttgtatacctatcaaagctaaaggagttgtggttgcgcaacaatcctatagagtcgattccctcatacgcatttaacaggattccctccctcagaagactcgatctcggcgagctgaagcgcctaagttacatctccgagggcgcctttgaggggctaagcaatctgcgctatcttaacttagccatgtgtaacctgcgcgagatccccaacttgacaccactcattaagctggatgaactggatctttccggcaaccacctttctgctatccgacctgggagcttccagggcttgatgcacctccaaaagctttggatgattcagtcccaaatacaagtaatagagcggaacgcgtttgacaatctgcaaagtctggtggaaattaacctagcgcataataatttgacactactgccccatgacctctttacccctctgcaccacctcgagcgcattcatctccaccataatccttggaattgcaattgtgatattttatggttgtcgtggtggatcaaggacatggcacccagcaatactgcgtgttgtgctagatgtaacacccctccgaatctcaagggcaggtatattggggaactggaccagaattattttacttgttacgccccagtcattgtcgaaccacctgcagacctgaatgtgactgagggaatggcagccgagctcaagtgccgggcttctacaagcctgacctcagtgagctggatcactccaaatggcactgttatgacgcacggcgcctacaaggtcagaatcgctgtgctgagtgacggaacactgaatttcactaacgtcaccgtgcaggacactggaatgtacacctgtatggttagcaacagcgtggggaataccactgccagtgctacactcaacgttacagccgccactactacccccttttcttattttagtacggttacagtggagacaatggagcccagccaagacgaggcacgcacgaccgacaacaacgtgggaccaacacctgttgtcgactgggagacgactaatgtgacaacttccctgacgccacagtctacccggtccactgagaaaacttttaccatacccgtaacagacatcaactctgggatcccaggtatcgatgaggttatgaagaccacaaaaatcatcatcggctgcttcgttgctattacgttgatggccgccgttatgctagtcatcttctataagatgcgcaagcagcaccacagacagaatcaccacgctcccactcgtaccgtcgaaataatcaacgtggatgacgaaatcaccggagacaccccgatggagtcccatctacctatgccagctatagaacacgaacatctgaatcactataatagttacaaatctcccttcaatcatacaactaccgtgaacacgatcaacagcattcactcttcagtgcacgaaccactgctgataaggatgaatagtaaggacaacgttcaggagacacaaatatag

SEQ ID NO: 192899 - DNA, 1923 bp, Artificial Sequence
  Description of Artificial Sequence: Synthetic coding sequence
atgctgaacaagatgaccctgcacccccagcagatcatgatcggccctcgctttaaccgggcccttttcgacccattgctcgtggtgcttctcgcgctgcagctccttgtggtggctggcctggtgcgcgctcaaacctgccctagtgtgtgttcctgttcgaaccagttctccaaagttatttgtgttcgcaagaatcttcgcgaggtacccgatggcatcagcactaacacacggttgcttaacttgcacgaaaatcagattcagatcatcaaggtcaactcattcaaacatctgagacatttggaaattcttcagttatcaagaaatcatattcgcaccattgaaatcggagcctttaacggtctcgccaatctaaacacccttgagctatttgataacaggctgactacaatccctaatggcgcattcgtgtacttgagtaaattaaaagagctgtggttgagaaacaatccaattgaatccataccatcttatgcatttaatagaatcccaagcctccgtcggctggacctcggtgagctcaaaagactgagttacatcagcgagggtgcattcgagggtctgagcaatttgagataccttaacttggccatgtgtaaccttcgtgaaatcccaaatctgacacccctcatcaaacttgacgagctggacttatctggcaaccatctatctgctattcgaccagggtcatttcagggccttatgcatttgcagaaactctggatgattcaaagccagattcaggtaattgaaagaaatgctttcgataaccttcagtcactagttgagattaacttagctcacaacaacttgactctcttgccgcacgatctgtttactcccctgcaccacctggaaagaatccacctgcaccataacccatggaactgcaattgtgacattctgtggctgagctggtggattaaagatatggcgcccagtaacaccgcctgttgcgcaagatgcaacacacctccaaatctgaaaggccgttatattggggagctggatcagaattatttcacttgctatgctcctgttatagttgagccgcccgcagatcttaacgtcactgaaggtatggctgccgaactgaagtgccgtgcctctacgtcactcacaagcgtctcatggatcacaccaaatggcacagttatgactcacggcgcatataaggtgagaatcgccgttctaagcgatggcacacttaattttactaacgtgacagtccaggacacaggcatgtatacttgcatggtgagcaacagtgtgggcaatacaacagcatcggcgacccttaatgttaccgccgccaccacaacaccattcagttacttctcaacagttacagtcgagacgatggagccaagtcaggatgaggccagaacaaccgataataatgtgggtcccacgccagtggtggattgggagaccactaacgtcactacaagcctcactccccagagcacccgatctactgagaagacttttaccattcccgtgaccgatattaactctgggatccccgggatagacgaggtaatgaagacaacaaagatcattattggctgttttgtggccattactctcatggcagctgtcatgctcgtcatcttttacaagatgcggaaacagcatcataggcagaaccaccatgctccaacgcgaacggtggagataatcaacgtagatgacgagatcaccggggacacccctatggaatctcacctccctatgccggcaatcgagcacgagcacctaaatcattacaacagctacaaaagcccattcaaccataccacgaccgttaacaccataaatagcatccattcctctgtgcacgaacctctgcttattaggatgaactctaaggataatgttcaagagacccaaatctag

SEQ ID NO: 192900 - DNA, 1923 bp, Artificial Sequence
  Description of Artificial Sequence: Synthetic coding sequence
atgctgaacaagatgaccctgcacccccagcagatcatgatcggcccaaggtttaacagggctctctttgacccactgctggtggttctgctggccctgcagcttctcgtggtggctgggctggtaagagcacagacctgtccatccgtgtgcagttgcagtaaccaattttccaaggtaatctgcgtgcggaagaacctgagggaagtacctgacggaatatctactaacacgagactgttgaacctccacgaaaatcaaatccaaattattaaggtcaactcattcaaacatttgcggcatttagaaatactgcaactgagcagaaatcacatccgcactatcgaaataggtgctttcaacggacttgctaacctgaacacgttagagctttttgacaacagactgactactatcccaaacggcgccttcgtgtacctctcaaaactgaaagagttgtggttgaggaacaatcccatcgaatcaatcccttcctacgctttcaatcgcatcccttccttgagaaggttggacctcggagaactgaagcgattatcatatatctccgagggggcctttgagggcctgtctaacttgaggtatcttaacctggcaatgtgcaacctgcgtgaaatccccaacttgaccccactaatcaagttggacgagcttgaccttagtgggaatcacctgtccgcaatcaggcctggatcatttcagggcctgatgcatctgcagaagctatggatgatacagtcacagatccaggtgatagagcgcaacgcctttgacaatctccagtcattggtagagataaatctggctcacaataatctgacactgctgccccacgacctctttacaccgctccatcacctggaacgaattcacctgcaccacaacccgtggaattgcaactgcgatattctgtggctctcctggtggataaaagatatggctcctagtaataccgcttgttgcgccaggtgtaacaccccccccaatctgaagggccgctacatcggtgagctcgaccagaattacttcacctgctatgcccctgtgatagttgaaccaccggccgacttaaacgtgacagaaggcatggccgcagaactcaaatgccgagcctcaacatctctaacctccgtttcctggataacaccaaacggcaccgtaatgacacacggggcttataaggtcagaatagccgtgctgagcgacggaacactgaacttcactaatgttaccgtccaggataccggtatgtacacctgcatggtctcgaatagcgtgggaaataccactgcttccgccactcttaacgttacggccgccaccactacaccattttcctatttctcaacggtgacagtcgagaccatggaaccctcgcaggatgaggcaagaacaaccgataacaacgttgggccaacaccagtggtcgattgggagacgaccaacgtgaccacgtctcttacccctcagtctaccaggtccacagagaaaacctttacgatccctgttaccgacatcaatagcgggatccccgggattgatgaagtgatgaagactaccaagatcattatcgggtgcttcgtggcaatcacactgatggccgccgtgatgctggtgatcttctacaagatgcgcaaacaacaccatcgtcagaaccaccacgcgcctacaaggacagtggagatcatcaatgttgatgatgagattaccggtgacacgccaatggaatcacatctgcctatgccagcaatagagcatgagcacttaaatcactataactcctataagtcacctttcaaccacacaacaaccgtgaatacgattaatagtatccattccagcgtgcacgagccgctattgatcagaatgaactctaaggataacgtacaggaaacccagatctag

SEQ ID NO: 192901 - DNA, 1923 bp, Artificial Sequence
  Description of Artificial Sequence: Synthetic coding sequence
atgctgaacaagatgaccctgcacccccagcagatcatgatcggcccaagattcaacagggcactgttcgaccccctgctagtggtgctgctggcactacagctgctcgtggtcgctggccttgtcagggctcagacgtgcccgagtgtatgttcctgctccaaccagttttccaaagtgatctgtgttcggaagaacctccgcgaagtacctgatggaatcagcaccaacacacggttgttgaacctgcacgaaaatcagattcaaattatcaaggtgaactcgtttaaacatttgaggcacctggaaattctccagctctccaggaatcacataagaacaatcgagattggagcatttaatggtctcgccaacttgaacaccctggaactgttcgataatcgtctgacgaccatcccaaatggcgcatttgtctatttgtcaaaattgaaagagctttggctgcgtaataatcctattgagtccatcccctcatacgctttcaacagaattccgagtctacgccggctcgatctgggcgagctcaaacggctgtcatacatttccgaaggggcgttcgaggggttgtctaatctgcgctatttaaacttagccatgtgtaatctgagagaaatcccaaacctgactcctctgataaagctggacgagctggatttgagtggaaatcatttgagcgcaattcggcccggaagttttcaggggcttatgcatctgcagaaattatggatgattcagagccaaatccaggttatcgagaggaatgcttttgataatctgcagtctctggttgagataaacctcgctcacaacaatctaacccttcttccgcacgacctgtttacccccctgcatcacctagagcgcattcatcttcatcataatccatggaactgcaattgcgacattctgtggttgagctggtggatcaaggacatggcaccttcaaatacagcatgctgcgcacgctgtaacactccacccaatctgaaaggcaggtacatcggggaattagaccaaaattatttcacgtgttacgcccccgtcattgtcgagccccccgctgacctaaacgtaaccgaggggatggcagcggagcttaagtgtagggcctcaacttccttgacgtccgtaagctggatcactcctaatggtactgtgatgacccacggggcctacaaggttaggatagctgtgttgagcgacggtactctgaactttacaaacgtgaccgtgcaggacactggaatgtatacctgcatggtgtctaactccgtcggtaataccaccgcgtccgccacactcaatgttaccgctgcaaccactacacctttctcctactttagtaccgttaccgttgaaacaatggaaccatctcaggacgaagcccgaacaacagataataatgtcgggccaactccagtggtcgactgggagacaactaatgtgaccacgtctctcactccgcaatccaccagatctactgagaagactttcaccatacctgtgacagatattaacagtgggattccagggattgatgaggtgatgaaaactaccaaaatcattattggatgcttcgttgctattacgttgatggcagcagtgatgttggttatcttctacaagatgagaaaacagcaccaccgccaaaaccatcatgctccaacaagaacagttgagattataaatgttgatgacgagatcaccggtgacacccccatggagagccacctgccaatgcctgcaattgaacacgagcaccttaaccattacaacagctacaagtccccgtttaaccacactacaactgtgaatacgattaatagcatccattctagtgtccacgagccactgctcattcgcatgaacagcaaggacaacgtgcaagaaacacagatatag

SEQ ID NO: 192902 - DNA, 126 bp, Artificial Sequence
  Description of Artificial Sequence: Synthetic coding sequence
atgctgaacaagatgaccctgcacccccagcagatcatgatcggcccgaggttcaaccgcgctctgtttgaccctctgttggtagtgctgctggccctccagctgttagtcgtggccgggctatag

SEQ ID NO: 192903 - DNA, 4614 bp, Artificial Sequence
  Description of Artificial Sequence: Synthetic coding sequence
atgaccaccaagcggaagatcatcggccggctggtgccctgccggtgttttagaggcgaagaggagataatcagcgtgctggactatagtcattgcagcttgcagcaggtgcctaaggaggtgtttaactttgagcgtaccctcgaagagctgtacctcgacgccaaccagatcgaagaattacccaaacagctatttaattgccaggcactgcggaaattgagtatccctgacaacgatctgagcaatctgcctaccacaatcgcctcactggtgaacttaaaagaactggatatctccaaaaacggagtgcaggaatttcctgagaacatcaaatgctgcaaatgtttgaccatcatcgaggcgtctgtgaaccctattagcaagctgcctgatggcttcacacagttactcaatctaacacagttgtatctgaacgacgcatttcttgagtttcttcctgcaaactttggtagactggtaaagttgaggatcctcgagctccgggagaatcacctgaagacgttaccaaagtcgatgcataagttagcccagctggagaggctcgaccttggaaataatgagttcggggagttgcctgaggtgctcgaccagatccagaatctccgagaactttggatggacaataatgccttacaggtgctgcccggttctatcggtaaacttaaaatgctcgtgtacctggacatgtcaaaaaacagaattgagacagtcgacatggatatctcaggctgtgaagccttagaagatctgttactgtccagtaacatgctgcagcagctgcccgatagtattggactactgaaaaagctcaccaccctgaaagtcgacgataatcagctgactatgctgcccaacactatcgggaacctgtccctgcttgaagagttcgactgcagctgcaatgaactcgaaagcttgccgtccacgatcggctatctccactcactgcgtactctggcagtcgacgagaacttcctgcctgagctcccccgcgagataggatcctgtaaaaatgttacagtaatgtctttaagatctaataagctggaattcttacccgaggaaattgggcagatgcagaagttgcgagtcctgaacctgagcgacaaccggttaaagaatcttccctttagcttcactaaactcaaagagttggccgcgctctggctgtctgacaaccagtctaaggcattaatcccacttcagactgaggcccaccctgaaactaagcaacgcgtgttaacaaactatatgttcccacagcaacctaggggcgatgaggactttcagagtgattctgactcctttaatcctacactttgggaagagcaaagacagcagcggatgaccgtggcctttgagtttgaagacaagaaggaagatgacgagaacgccggcaaggtgaaagatctcagctgccaggccccttgggagaggggccagaggggcattacattacagcctgcgagactcagcggggactgttgcaccccatgggccaggtgcgatcagcagattcaagatatgcctgtaccccagaatgatcctcagctcgcatggggatgcattagtggcctgcagcaggagcgctcaatgtgcacgccactgcccgtggcggctcaaagtacgacgttgccgtctttaagtggtcggcaggtagaaatcaacctgaagagatatcctactccctatcccgaggatctcaagaatatggtgaagtccgtgcagaatctcgtcgggaaaccgtcccacggggttcgggtggaaaattcaaatccaaccgcaaatacggagcagacggtcaaagaaaagtatgagcacaagtggccagttgctcctaaagagattacagtggaggacagctttgtgcaccctgccaatgaaatgcgcataggcgagctgcaccccagtctagcagagactccactttatcctcccaaactcgtgctcttgggcaaggacaagaaagaaagcaccgatgagtctgaagtggacaagactcattgtctaaacaactcagtgagctcaggcacctactcggattactctccgtctcaagccagctccgggtcctcaaatactagggtcaaggtaggatcccttcagaccacagctaaggatgcagtgcacaattcattatggggaaatagaatagcgcctagctttccccaacccctggactctaagcccctgttgagccaacgagaggctgttcccccagggaatattccccagcggcctgacagactcccaatgtccgacacatttacagacaattggacggacgggtcccattatgacaacacaggtttcgtggccgaggaaacaaccgcagaaaatgccaactctaacccactgctcagttccaaaagccgatctactagcagccacgggcgtcgccctctgatacggcaggaccgcattgttggggtcccattagaactggaacagtccactcaccgccatacccccgagaccgaggtgccaccatctaacccctggcagaactggacaagaacaccttctccgttcgaagaccggacagccttcccatccaagctggagacaaccccaacgaccagcccccttcccgagagaaaggagcacataaaagaatctacagagatcccgtcgccgttctcccccggggtgccatgggaataccacgactctaacccaaaccggtcactctcaaacgtgtttagtcagattcactgtagaccagagagctccaagggagtgattagcatctccaagtcgacagaacgcctctcaccattgatgaaggacataaagagcaataaattcaagaaaagtcagagcatagacgagattgatattgggacttataaggtgtataacattcctttagaaaactacgcctcgggatccgaccatctgggttctcatgaacggccggacaagatgctcgggcccgagcatgggatgagttctatgagtcgaagtcagtcagtacccatgttagatgacgagatgttaacctacggaagttccaagggcccacagcaacagaaggcatccatgaccaaaaaggtgtatcagtttgaccagagtttcaacccacagggttctgtggaggtgaaggcagagaagaggatccccccaccattccaacacaatccagaatatgtacaacaggctagcaagaatattgcaaaggatttaataagcccccgggcttaccgggggtaccccccgatggagcagatgttcagcttttcacagccgtcagtgaatgaggatgctgtggtcaatgcccagtttgcatcgcagggagcccgcgcaggatttctccgccgggcagacagcctggtgagtgctactgaaatggcgatgttccggcgggtcaacgagccccacgagctaccaccaactgatcgttatggacggccaccatatcgggggggcctcgatcgtcagtcaagcgtcacagtgacagagagccagttcctcaaacgaaacggaagatacgaagatgagcatcccagctaccaggaggttaaagcacaggcaggatccttcccggttaaaaatctaacccagcggcggccgttgtctgccagatcatactctactgaaagctatggggcatcacagacaaggcccgttagtgcaaggcctaccatggctgccctcctggaaaaaatcccctctgactataatttgggaaattatggcgataagccttctgacaattctgaccttaaaaccagacccacaccagttaagggagaagagtcttgcggcaaaatgcccgctgattggcggcagcaactgctgagacacatcgaggctagacgactggatcggaacgctgcctacaaacacaataccgtgaacctgggcatgcttccctacggtggcatttcagccatgcatgccggtcgatccatgacattgaatctccagaccaaatcaaaatttgaccatcaagaactcccactccagaagacacccagtcagcagagcaacatcctggacaatggccaagaagatgtttctcctagtggccagtggaatccctaccccctcggcagacgcgatgtgccccccgataccatcacaaagaaagccggatcccacatccaaacgttaatgggctctcagagtctgcagcatagaagcagagaacaacagccatacgagggaaacattaacaaagttactattcagcagtttcagtcgccactgcctatccagatccctagctctcaagctacccggggcccccagccaggacgctgcttaatccagaccaagggacaaagatcaatggacggatatccagagcagttttgcgtgcgcatagagaaaaatcccggactcggtttcagcatcagcggaggcatatccgggcagggaaacccatttaagcccagtgataaaggcatctttgtgactcgggtccaaccagatgggcccgcctccaatttactgcaacctggagataaaattttacaggccaatgggcacagcttcgtgcacatggaacatgaaaaggcagtgttgctactgaagtcattccaaaatacagtcgatcttgtcatacagcgtgagctgaccgtctag

SEQ ID NO: 192904 - DNA, 4488 bp, Artificial Sequence
  Description of Artificial Sequence: Synthetic coding sequence
atgcagtgcctggagatgaccaccaagcggaagatcatcggccggcttgtgccttgtaggtgcttcaggggagaggaggaaatcatttctgtcctcgactattcacattgtagccttcagcaagtccctaaggaagtgttcaatttcgagcgaacccttgaggagctgtatttagacgcaaaccagatcgaggaattgccaaaacagctgttcaattgccaggctcttcgcaagttgtcgatccctgacaatgacctaagtaacctgcccacaacaatcgcttctcttgtaaacttaaaggaattggatatttcaaagaatggggtgcaggagttccccgagaacattaagtgctgtaagtgtttgaccattattgaggcctctgtgaaccctatcagcaaactgcctgatgggtttactcagttactcaacctgacgcagctgtatctcaacgacgcgttcctggagttcctgccagctaacttcggcagactagtgaagcttcggattctggagctgcgtgaaaatcatttgaagacactgcccaagagcatgcataaactcgcacagctcgagaggctggaccttggcaacaacgagttcggagagctccccgaggtattggaccagatccagaacctacgagagttgtggatggacaacaatgccctacaagtgcttcctggaagtatcggcaagttaaagatgctcgtttacctagatatgtcaaaaaacagaatcgaaaccgtcgatatggacataagcggctgtgaggccctggaggatcttttgcttagctccaacatgctgcagcagctgcccgactccatagggctgcttaaaaagcttaccacactgaaggttgacgataatcagttaactatgctcccgaatactatagggaacctatccctattggaagaattcgactgttcctgcaacgagctggagagtctgccctctacgatcgggtatctccattccctgagaactcttgcagttgacgagaacttcctgcccgagttgccccgagagattggctcttgcaaaaatgtgacagtgatgagcttgaggagcaataaactggagtttctccccgaggagattggacagatgcaaaagctgcgcgtcttaaacttaagcgataacagattgaagaatcttccatttagttttacaaagctgaaggaactggcagccctgtggctctcagacaatcagagcaaggcccttataccactgcaaaccgaggcacaccctgagacaaaacagcgggtgctgacgaactatatgttccctcaacaacctcggggcgacgaggattttcaaagcgactccgattccttcaaccctactttgtgggaggagcagcggcagcaacgcatgaccgttgcgtttgaatttgaggataagaaagaagacgatgagaacgcgggcaaggtcaaggatctttcctgtcaggctccttgggaaagagggcagcggggaataacactgcagccggcaaggctttctggcgactgctgtactccctgggcgaggtgcgaccagcagatccaagatatgccggttccgcaaaacgatccacagcttgcttgggggtgcattagcggcttgcaacaggagcggagcatgtgtacacctttgcccgtggccgcccagtccaccactctgcctagtctgtcaggcagacaggtggagatcaacctgaaacgttatcccacgccttacccagaggacctgaagaacatggtgaagagcgtgcagaacttggtgggcaaaccctcacacggcgtacgtgtggagaactctaacccaacagctaatactgagcagactgtcaaagaaaaatatgagcacaagtggccagtggcgcctaaagagataacagtggaagattcgtttgtccatcccgcaaacgaaatgcggataggcgaattgcatccaagcctggccgagacacccctctacccccctaaacttgtgctcctcggcaaggacaagaaggaatcaacagatgagagtgaagtggacaaaacacactgtctgaataatagcgtgagctctggaacatattcagactactccccttctcaggcatcatcaggatcatccaatacacgtgtaaaagttggcagcctgcagacaactgctaaggacgcagtgcataactccctatggggcaataggatcgccccttcctttcctcaacccttggattcaaaacctttgttaagtcagcgagaggcagtccctcccgggaatattccacaacgcccagaccggttgcccatgtccgacacattcaccgacaattggacagacgggagccattatgacaataccgggtttgtcgcagaggagaccaccgcagagaacgctaatagcaatcccctgctgagttctaaatccaggagtacttcatcgcacggcaggcgcccactgatcaggcaggacagaattgttggcgtcccccttgagctggagcaatcaacccaccggcatactcctgagaccgaagtccctcctagtaatccctggcagaactggacccggactccctcgccatttgaagacagaacagcctttccctctaagctcgagacaacccctacaacctcacccttgcctgaaaggaaggaacacatcaaagaaagcactgagattccctcgccttttagccctggcgttccctgggagtatcatgatagcaaccctaacaggtctctgagcaatgtctttagtcagatacactgcaggcctgagagtagcaaaggggtaatttcaatttcgaagagcaccgaaagactttctcctctcatgaaggatatcaaatccaacaaatttaagaaatctcagtccattgacgagatcgacatcgggacctacaaagtatacaacatccccctggagaactatgcctcaggctccgatcacctgggctcacacgagcgaccagacaaaatgctgggaccagaacatggaatgtcatctatgagccgatcccagtcggtgccaatgctagacgacgaaatgctgacatacggaagctcaaagggtccccagcagcaaaaggcctctatgactaaaaaagtgtatcagtttgaccaatcctttaatccccagggctccgtcgaggtcaaggctgaaaagcggatacctcccccatttcaacataacccagagtacgtccagcaagctagcaagaacatcgctaaggatttgattagtccccgagcgtataggggttacccccctatggagcagatgttctcgtttagccagccatccgtgaatgaagatgccgtcgtgaacgctcagttcgcttctcagggagcacgggccgggttcttgagacgggccgactcactggtgtccgcaaccgagatggcgatgtttaggcgcgtaaacgagccacacgagctgccacccactgaccggtacggaagacccccatacagaggaggcctggaccgacagagcagcgtgaccgtgaccgagagccagtttctgaagcggaatggtaggtatgaagatgaacacccgagctaccaagaagtcaaggcccaagctggctccttcccggtgaaaaaccttactcaaaggagaccactgtccgcaagatcttattcaaccgagtcatatggcgcttcccaaactcgtccagtgtccgcacggccaaccatggccgcattattagaaaaaattccctctgactataaccttggtaattatggcgacaaaccttccgacaattctgacctgaagacacgtccgacccctgtcaagggcgaagagtcctgcggcaaaatgccagcggactggagacagcagctgctcagacatattgaagccagaagactcgacaggaccccttctcagcagtccaatatactggacaatggccaggaggacgtcagtcccagtggccagtggaacccataccccctcggacgtcgagatgtgcctccggatactattactaagaaggcaggaagccacatccagaccctcatgggttcacagagcttacagcatcgttcaagagaacagcagccttatgaggggaacatcaacaaggtcactattcagcagttccagtctccactacctatccaaattccaagctctcaggccacgcgcggcccacaacccggtagatgtctgattcagaccaagggacagcgaagcatggatggttaccccgagcaattctgtgtgcgaatcgaaaagaaccctggcctgggcttcagcatttccggcgggatcagcggtcaggggaatcctttcaagccttccgataagggaatttttgtgacacgtgtgcagcccgatggcccagcctctaacctactgcaacccggagataaaatcctgcaggcgaatgggcacagcttcgtccacatggaacacgaaaaggctgtcctgctgctgaaaagttttcagaacactgtagacctcgtcatacagcgggagctgaccgtctag

SEQ ID NO: 192905 - DNA, 540 bp, Artificial Sequence
  Description of Artificial Sequence: Synthetic coding sequence
atgaccaccaagcggaagatcatcggccggctggtgccctgccggtgtttcagaggagaggaggaaatcatctctgtgctcgactattcacactgcagcctgcaacaggtaccaaaggaagtcttcaactttgaacgcacactagaagagctgtacctcgacgccaatcagatagaggaactgccaaagcagctgtttaactgccaagcattaagaaagttaagcattccagacaacgacctgagtaatctaccgaccaccatcgcatccctggtcaacttgaaagaactagatatcagtaagaatggggtgcaggaatttccagagaacatcaaatgttgcaaatgtctgaccattatcgaagctagtgttaaccccattagcaaactgccagacgggttcacgcagctccttaacctaacccaactatacctgaatgacgcattcctggaatttctccctgcgaacttcgggcgacttgtcaaactgagaattcttgagcttagggagaatcacctgaaaacactacctaagatatag

SEQ ID NO: 192906 - DNA, 3942 bp, Artificial Sequence
  Description of Artificial Sequence: Synthetic coding sequence
cggagcatgcacaagctggcccagctggagcggctggacctgggcaacaacgagtttggtgagctcccagaggtgctcgaccagattcagaatctgcgcgaactgtggatggacaataatgccctccaagtgctgcctggttccatcgggaagctgaagatgctagtgtatctggacatgtcaaaaaacaggatcgaaactgtcgacatggacatctcaggctgtgaagccttagaggatttactgttgagctcaaacatgctacagcaactgccggactccattggactgctgaagaagctgaccactttgaaagttgacgataatcagctaaccatgctgcctaataccattggaaacctaagcctgctggaagagttcgactgctcctgcaacgagctggagagtcttccgtccacaatagggtatcttcattccctccggacactggcagtggacgaaaatttcctgcccgaactccctcgcgagattggctcctgtaaaaacgttaccgttatgtcattgagaagcaataaactggagttcctgcctgaagagattggacaaatgcaaaaactgagagtcctcaacttaagcgacaatcggctgaaaaatttaccattttctttcacaaagctgaaagagctagccgccctgtggctgtccgataaccagtcaaaagcactgatcccactgcagaccgaagcccatccggagaccaaacaacgtgtcttgacgaattatatgttcccccaacagccgcgcggcgacgaagactttcagtccgactccgattcatttaacccgactctgtgggaggaacagagacagcaacgcatgaccgtcgcctttgaatttgaggataagaaagaggacgatgagaatgccggtaaggtgaaagatctctcctgccaggctccttgggagagaggacagagaggcatcacattgcagcccgccaggctgagcggcgattgctgtactccttgggctcgctgcgaccagcagatccaggatatgcctgtgccacaaaacgatccccagctggcctggggctgcatttctggtttacagcaggaaaggtccatgtgcacaccactgcccgtggccgcccagagcactaccctccctagcttgtcgggacgccaggttgaaatcaatctcaagcgctatccaactccttatcccgaagatctgaagaatatggtgaaatcggtgcagaatctcgtgggaaagccctctcacggggttcgcgtggagaacagcaaccctaccgccaacacagagcagaccgtcaaagagaaatatgagcacaagtggcctgttgcaccaaaggaaataaccgtggaggatagcttcgtgcatcccgccaacgaaatgagaatcggcgaactgcatcctagtctggccgaaacgccactctaccccccaaagctggtgcttttaggaaaagataagaaagagagcacagatgagtcagaggttgacaaaactcactgcctcaataattctgtgtctagcggcacctacagtgattattccccatctcaagccagcagtggaagttccaatactcgtgttaaagtcggctccctccaaaccaccgcaaaagacgcggtgcacaactcgctctggggcaatcgcattgccccttcgttcccccaacccctcgactctaagccactgctgtctcaacgagaagcagttccaccaggtaatataccacaacggccggaccgcctgccaatgtcagataccttcacggacaactggaccgacggatctcattacgacaatactgggttcgtcgcagaggagactactgcagagaatgccaatagcaatccgttgcttagctctaagtcgcgcagcacttcctcgcatggaagaagacctttgatcaggcaagatagaattgttggcgtacctctggagctggagcagtccactcaccgtcatacccccgagacagaggtccccccatcaaatccttggcagaactggactcgcacccccagcccattcgaagaccgaacagcatttccctctaaactggaaaccaccccaacaacaagccctctgccagaacgcaaggagcacatcaaagagtccaccgagatcccctcacctttctctccaggcgttccatgggagtatcacgattcgaatccgaatcggtccttatccaacgtctttagtcaaattcactgccgtcccgaatcttccaaaggcgtgataagtatctcgaagagcacagagcgactgtccccactgatgaaggacataaaatctaacaaatttaaaaaaagccaaagcatcgatgagatcgacataggaacctataaggtctacaacatacctctcgagaattatgcatccggaagtgatcacctggggtcccacgaaagacccgataagatgttaggcccagaacacggtatgagttctatgagtagatcgcagagcgtacctatgttagacgacgagatgctgacttatggctctagtaaaggcccgcaacagcagaaagcttctatgactaaaaaagtgtaccagtttgatcagagctttaatcctcaaggctctgtcgaggtcaaggccgaaaagcgcatacctccaccatttcagcataatcctgaatacgtacaacaggcctctaagaacatagcaaaagacctcatcagccctagagcataccgcggatacccacctatggagcagatgttcagcttcagccagccttccgtgaatgaggatgctgtagtaaatgcccagttcgcgagtcaaggcgctagggccggctttctccgtcgggcagacagcctggtgtccgccaccgaaatggcaatgttccgccgtgtaaatgagccacacgagctgccccctacggataggtacggcagacctccgtatcgagggggtctggatcggcagagctcagtgaccgtgaccgagagtcaattcctgaagagaaacgggcgttatgaggacgagcatccgtcgtatcaagaggtcaaggcgcaggccggttcttttcctgtaaagaatctgacacagagacgccccctttctgcccgaagctactctaccgaatcatacggagcttctcaaaccaggccagtatcagcccgtcccacaatggccgctttattggaaaaaattccttctgactacaacttgggcaattacggcgataagccgtccgataattcggatctcaagactcgccctacacccgtaaagggggaagaatcttgtggtaagatgcctgccgattggcgtcagcaactcctgaggcacattgaggcgagaaggcttgaccgtacccccagtcagcagtctaacattttggacaatggtcaggaagacgttagcccgtcaggccaatggaacccatacccactcggacgaagggacgtgcctccagatactatcacaaagaaggcagggagtcatattcaaacgctgatgggttctcagtccttacagcaccggtcacgggagcaacagccatacgagggtaacattaacaaagtaacaattcaacagttccagtctcctctaccgatacagatccctagttcgcaagctaccagaggaccgcaacctgggcggtgcctgatccaaacgaaaggccaacggtctatggacggataccctgaacagttctgtgttcggatcgaaaagaatcccggcctggggttcagtatttcagggggcatctccggacaaggcaaccctttcaaaccatcagacaaaggcatattcgtgactagggtgcaaccagatggaccagctagcaaccttctacagcccggagacaagatcctccaagccaatggtcatagttttgtgcatatggaacatgagaaggctgtcttacttctcaagagttttcaaaatacagtggatctcgtaattcagcgcgagctgaccgtctag

SEQ ID NO: 192907 - DNA, 654 bp, Artificial Sequence
  Description of Artificial Sequence: Synthetic coding sequence
atgatggagaacctgatccggggccggaaccccccccagtaccagagatccccttgtaaagaggtccgggccgcgcttcgtaaaaggcctgaggaagaattacagtgcctagaaatgaccaccaaacgaaagatcatcggtagacttgtgccttgcaggtgtttccggggggaagaggaaattatcagcgtgctggactacagccattgctcccttcagcaagtacctaaggaggtgtttaacttcgagcgtacacttgaggagctgtatctcgatgcaaaccagatcgaggagttacctaaacaactcttcaactgtcaggctctgcggaaactctctatcccagataacgatctgtcaaacctgccaactaccatcgcctccctcgttaatctgaaggaactggacatcagcaaaaatggagtgcaggaattccctgaaaacatcaagtgttgcaaatgcttgacaattatagaggcttccgtgaacccaatatctaagttacctgatggctttacacagctgctcaacctaacacagctttatcttaacgatgcgttcctcgagttcctccctgccaacttcgggcggctcgtgaaacttcgcattctggagctgcgagaaaatcacctgaagaccctccctaatatctag

SEQ ID NO: 192908 - DNA, 2466 bp, Artificial Sequence
  Description of Artificial Sequence: Synthetic coding sequence
atgaccaagatgctgggcaagctgcggatcgcccccagcttcccccagcccctcgattcaaagcctctcctctcacagagagaagcggtgccccccggaaacattccgcagagaccagataggctgcccatgagcgacacatttactgacaactggacggacggcagccattatgacaatacaggctttgtggccgaggagaccacggccgaaaacgcaaactcaaaccctctgctctcatctaagagccggagcaccagttcacatggaagacgccctctcatcagacaggatcgaatcgtcggagttcctctcgagctggaacaaagcacgcataggcatacccctgaaaccgaggtgccaccctcaaacccttggcagaattggactcgcaccccatctccattcgaggatagaactgctttcccaagcaagcttgagacgacgcccactacaagcccactccccgaaaggaaagagcacattaaggaaagcacagagattccatcccctttctcgcctggggttccgtgggaatatcatgacagtaatcccaatcggtcgcttagcaatgtgttcagtcaaattcattgtagaccagagagctccaaaggagtgatttctatcagtaagtctacggagcgtctctcccctttaatgaaagatatcaaatcaaataaatttaagaagtctcagtctatcgacgagattgacatagggacgtataaggtgtacaacatccctcttgagaactatgcaagtggaagtgatcatcttgggtcccatgagaggcccgacaaaatgttggggcctgagcatgggatgagcagtatgtctcgcagccagtctgtcccgatgctcgatgatgagatgctgacctacgggtctagcaaggggccacagcagcagaaggcgagcatgacaaagaaagtctatcagtttgatcagagcttcaacccacagggaagcgttgaagtaaaagccgaaaaaagaattcctcccccctttcagcataaccccgagtatgtacaacaggcctctaagaacatagctaaggacctcatctcccctcgtgcctaccgcggataccctcctatggagcaaatgtttagctttagccagccttctgtgaacgaagacgctgtggttaacgcgcagtttgcatcccagggcgcccgcgcagggtttctgagaagggccgattcacttgtaagcgccactgagatggctatgttccgacgggtcaacgagcctcatgagctgcctcctacagaccgatacggacgcccaccataccggggcgggctggacagacagtctagcgtcactgtgaccgagagtcagtttctgaagcgcaatggccgatacgaggacgagcatccttcgtatcaggaagtgaaggcccaggccggatcattccccgttaaaaacctgacacagagacgacccctttctgcgcgctcttactctacagagtcctatggcgcttctcaaacgaggccagtttcagcacgcccaaccatggcagccctgttggaaaagatcccttctgactacaacttggggaactacggagacaaaccttccgacaactcggatctaaaaacacggccaactcccgttaaaggcgaagagagctgtgggaaaatgcctgcggattggcggcaacagctcctacggcatattgaagctaggagactggatagaaacgccgcttacaagcataacacagttaacctgggcatgctcccttacggcggcatttcagccatgcatgccgggcggagtatgactctaaatctccagactaagtcgaaattcgaccaccaggagcttcccctacagaaaactccttcccagcaaagcaacatcctggataacggacaggaagatgtgtccccctccgggcagtggaatccctatcccttgggccgaagagatgtgccccctgacactatcaccaagaaggcagggtcacacatccagactctgatggggagccaaagcctgcagcataggtcacgtgaacaacaaccctacgagggaaacatcaataaggtcacaatacagcagtttcaatcccccctgcccattcaaatacccagttcacaagcgactagaggaccccagcccgggcgttgtcttatccagaccaagggacaaaggagcatggatggctaccccgagcagttctgcgtgcgcatcgagaaaaatccaggcctaggcttttccatctctggaggcatttctgggcagggcaacccgtttaagccaagcgataaaggcatcttcgtcacacgggtccagcccgacggacctgcaagcaatctgctgcagcctggcgacaagattctgcaggccaatgggcacagcttcgtgcacatggagcacgaaaaagccgtacttttactcaagtctttccagaatacagttgacctagtcatacagcgcgagcttacagtttag

SEQ ID NO: 192909 - DNA, 2433 bp, Artificial Sequence
  Description of Artificial Sequence: Synthetic coding sequence
atgatccccgtgaccgagctgcggtacttcgccgacacccagcccgcgtatcgcattctgaagccatggtgggacgtcttcacagactacatctctatagtgatgctgatgattgctgtgttcggcggaactctgcaggtgacacaagacaagatgatttgcttgccttgtaagtgggtgaccaaggactcctgcaacgactcttttcgcggttgggccgctcctggacccgaaccaacctacccaaactctaccatcttacctactcccgatactggcccaacaggcatcaagtacgacctggatcgtcaccagtacaattacgtagatgctgtgtgttacgagaacaggttgcattggtttgctaaatacttcccatacctggtactgcttcataccttaatcttcctggcctgcagcaacttctggttcaaattcccgagaacctcatccaagctagagcacttcgtgtcgatccttctcaagtgtttcgattccccttggacaacccgagcactttctgagaccgtggtcgaggagtcggatccaaagcccgctttcagcaagatgaatgggagtatggacaaaaaatcttcgacagttagcgaggatgttgaggccacagttcccatgctacagcgaactaagagtcggattgagcagggcatcgtcgacaggtcagaaactggcgttctggataagaaagaaggggagcaggcaaaagcactgtttgagaaagtcaaaaagtttcggacacacgtggaggaaggagatatcgtataccgcttatacatgcggcagaccatcatcaaagtcattaaattcattctcatcatctgctatactgtttattatgttcataacatcaagtttgatgtggactgcaccgtagacatcgagtccctgacaggttatagaacctacagatgtgctcaccctctcgctaccctgtttaagattctcgcatccttttatatttctctagtgatcttctacggactgatttgcatgtacacactgtggtggatgttgcgcaggtctctgaagaagtattcattcgaatcgattagagaagagtcctcatactctgatatacctgacgtcaagaacgactttgcctttatgctccacctgattgaccagtacgatcccctctacagtaagcgttttgccgtgtttctgagtgaggtgtcagagaataaactcaggcagttgaaccttaataatgagtggactttagataaattgcgccaaagactgaccaagaacgcccaggacaaactggagctccacctgtttatgttatctggaatcccagatacggtattcgatctggttgagctggaggttctgaagttagaattgattcccgatgttactatacccccttctatcgcgcagcttaccggcctgaaagaactctggctgtaccacactgctgcaaaaatcgaggccccagccctggcttttctgcgcgagaatcttagagctctgcacataaaatttaccgacatcaaagagatacccctctggatctactccctgaaaactttagaggagctccatctaaccggaaacctcagcgctgagaataatcggtacattgttatcgacggactccgggaactgaaacggcttaaagtcctgaggctcaaaagcaatctgagtaagctgccgcaagtcgtcaccgacgtcggcgtccatcttcaaaagctctctataaacaacgagggaacgaaactcatagtgttaaactccctgaaaaagatggctaatttaactgaactggagctcatacggtgcgacctggagcgcatccctcactctatcttttcgctccacaatcttcaagagattgacctgaaggataacaatctcaagactatcgaggagatcattagcttccagcacctccaccgacttacatgcctgaaactctggtataaccacatcgcttacattcccatccagattgggaatctgaccaacctggagcgtttatatctgaataggaataaaatcgagaaaatccctacacagttgttttattgcaggaagctccgctacctcgacctgtctcataataatttgactttcttgcctgccgacatcggactgctgcaaaacttacagaacctcgctatcactgctaatcggatcgaaacactgccgcctgagctctttcagtgccgcaaactgagagccctccatcttggcaacaatgtactgcaatccctaccttcccgagtcggagagctgaccaaccttactcagatagagctgcggggcaacaggttagagtgcctgcccgtggagctgggtgagtgtcccctccttaagcggtctgggctagtggtggaagaggacctgtttaatactctccctccagaggtgaaggagagactgtggcgagccgacaaggagcaggcgtag

SEQ ID NO: 192910 - DNA, 2433 bp, Artificial Sequence
  Description of Artificial Sequence: Synthetic coding sequence
atgatccccgtgaccgagctgcggtacttcgccgacacccagcccgcctatagaatattgaaaccatggtgggacgtcttcacagactatatttccatcgtgatgttgatgatagcagtgtttgggggtacactgcaggtgacacaggataaaatgatctgtttaccatgcaagtgggtgaccaaggattcttgcaatgattcttttcggggatgggctgcacccggccctgagccaacgtacccgaattccacaatcctgccaactcccgacaccggtcccactgggataaaatacgacctggatagacaccaatataactatgtcgacgccgtttgctacgagaaccgtctccactggtttgccaaatacttcccatacctcgtcttgctgcacacccttatctttctagcctgtagtaacttctggtttaaattccccagaacctcttctaaactggagcatttcgtaagcatcctgttgaagtgctttgattccccctggacgactcgggccctgtccgagactgtcgttgaggaaagcgatcccaagccagccttctctaagatgaacggatctatggataagaagtccagcacagtctccgaggatgtggaggccacagtgcccatgttgcagcgcacaaaatcccgaattgaacagggaattgttgaccgctccgaaacaggagttctggataagaaggagggtgagcaagctaaagcactattcgaaaaggtcaagaagtttcggacccacgtggaagagggcgacatcgtgtaccggttgtacatgcggcagacaatcatcaaggtgatcaaatttatcttgatcatttgctacactgtctattacgtgcacaatatcaaattcgatgtcgattgcaccgtggacattgagagcctcactgggtatcgaacttatagatgcgcccacccactcgctactctcttcaaaattcttgccagcttttatatctccctggtcatattctatgggctcatctgcatgtatactttgtggtggatgcttaggaggtccctaaagaaatatagctttgagagcatcagagaagaatctagctactccgacattcctgacgtgaagaacgattttgcatttatgttacatttgatagatcaatatgatcctctttattcaaaaaggtttgccgtcttcctcagcgaggtgagcgagaataaactgaggcagctcaacttgaacaacgaatggacattggataaattaagacagcggctgaccaagaacgcccaagataagctagagttgcaccttttcatgctttctgggatccccgatacagtgttcgaccttgttgagctcgaggttcttaagctggagctgatacctgatgtgactattcctccatccatcgcccagctgacgggacttaaagagctctggctctatcataccgcggccaagattgaagctcctgcactagcattcctgcgcgagaatctgagagccttgcacatcaaattcaccgatattaaggaaatccctctttggatatacagtttaaagaccctcgaagagctccacttgaccggcaatctgtccgcagaaaataacaggtacatcgtgattgatgggctccgggaactgaaaagactgaaggtcctgaggctcaagtctaacctttctaagcttcctcaggtggtcactgatgtcggggtccatttgcagaagctctctataaacaatgagggtaccaaattgattgtgttaaactcgctgaaaaagatggcgaatttgaccgagctcgagctgatccgctgcgatctggaacgaatccctcattctatcttctccttgcacaacctccaagaaatcgatctcaaagacaacaatctgaagactatcgaagagatcatatccttccagcacctccaccggctcacctgtctaaagttatggtacaatcatattgcctatatacctattcaaattggaaacctgaccaacttagaacggctgtacctaaataggaacaagatcgagaaaatcccaacccagctattctattgtaggaagctgagatacctcgacctgtcacataataacctgacttttctgccagccgacataggcctgttacagaatttgcagaacctcgccatcacagcgaatcgaatcgagaccctgccaccagagctgttccaatgcagaaaactgagagccttgcatcttggcaacaacgtcttgcagtccttgccatcaagggtcggagagctaaccaacctaactcagatcgaactccgcggaaatcgattggagtgcttgcctgtagagctgggggagtgtcctttgctgaaacggagcggcctagtggttgaggaagacctgtttaacactctcccccccgaggtgaaagagcgcctctggcgcgccgacaaggagcaagcatag

SEQ ID NO: 192911 - DNA, 2433 bp, Artificial Sequence
  Description of Artificial Sequence: Synthetic coding sequence
atgatccccgtgaccgagctgcggtacttcgccgacacccagcccgcctatcgtatcctgaagccatggtgggacgtgttcacagattatatcagtatagtcatgcttatgatcgccgtctttggcggtacactgcaagttacccaggataagatgatatgcctgccctgtaagtgggtgaccaaagattcttgcaatgactccttcaggggttgggccgcgcctggtcccgaacccacctatcccaacagtaccatcttaccaacaccggacaccggaccaactggcatcaaatacgatctcgatcgccaccagtacaactatgtggatgccgtctgttatgaaaataggttgcattggttcgccaagtactttccgtacctcgttctgctgcacacccttattttcctcgcctgttccaatttttggttcaaatttcccaggacctcaagtaaactagaacatttcgtttcaatcttgctgaagtgcttcgactcaccttggactacccgagcgctaagcgaaacagtggtagaagaatccgaccccaagcctgccttttccaaaatgaacggcagcatggataagaagtcatctacagtgagcgaagacgttgaagccaccgttcctatgctccagagaactaagagtagaattgaacaaggcatcgtagaccgctctgagacgggcgttctcgataagaaggagggggaacaggccaaggctctgtttgaaaaggtcaagaaattcagaacacacgtcgaggagggcgatatcgtatatagactctacatgaggcagaccatcataaaggtgattaaattcattctgatcatttgctacactgtctactacgtgcataatatcaagttcgacgtggattgcactgtcgacatcgagtctctgacgggctatcgcacgtatagatgcgctcaccctctggcaaccctatttaagatcctggccagtttctacatctccttagtaattttctacgggctgatatgcatgtataccctgtggtggatgctccgtcgctctctgaagaaatactcctttgagtctattagggaggagtcttcctactcagacatccctgacgtaaagaatgatttcgcgtttatgttgcaccttattgaccagtatgaccctctctattctaagagatttgccgtcttcttatcagaagtatcagagaataagttgaggcagctaaacctgaataatgagtggaccctggacaaactgaggcagagactcaccaagaacgctcaggataagttggagcttcacctgttcatgttgtcaggtattcccgataccgtgttcgacctggtggagttggaggtcctgaagcttgaattgattccagatgtgactattcctcccagcatagcccaattgactggattaaaggagctgtggctttaccatactgcagccaagattgaagcccccgccctcgcctttttgagggagaacctgcgggcactgcatatcaagtttacagacatcaaggaaataccactgtggatttattcattgaagacccttgaagagctgcacttgacaggcaacttgtctgcggagaataaccggtacattgtgatcgacggccttcgcgagcttaagagactgaaagttcttcggctgaagtctaacctgtctaagcttccacaggtcgttactgacgtgggagttcacctgcaaaaactgagtattaacaatgaaggaaccaagctgattgtcttaaacagcctgaagaagatggccaatctgacagagttggagctgatccgctgtgacttggagcgtataccacattccatcttcagcctacataatctgcaagagatcgaccttaaggacaataacttgaagaccatagaagaaattatctctttccagcacctgcacaggctgacttgcctgaagctctggtacaatcatattgcctatatccccatccagatcggcaatctcactaacctggagagactgtaccttaatagaaacaagattgagaaaatccctacacagctgttctactgtagaaaacttaggtacctggacctcagccacaacaacttgacatttcttccggctgatataggactgttgcagaaccttcagaatttggcaattactgctaaccggatcgaaacactgcctcctgagctgtttcaatgcaggaaactgcgagcgttgcacctggggaacaatgtcctgcagagcctacctagtagggtcggagaactgacgaatctgacccagattgagctacggggcaatcgtttagagtgcctgcccgtagaactgggcgagtgccccttgctcaagcggtctggattggtggtcgaagaggatctctttaataccttgcctccagaagttaaggaacgtctatggcgcgccgacaaggaacaggcttag

SEQ ID NO: 192912 - DNA, 2412 bp, Artificial Sequence
  Description of Artificial Sequence: Synthetic coding sequence
atgatcaccctgaccgagctgaagtgcctggccgacgcccagagctcctaccacattctgaagccctggtgggacgtgttttggtattacatcacgctgatcatgctcttggtagccgtcctcgcgggcgctctgcagctaacccaatctcgggtcctctgttgcctgccgtgtaaagtcgaattcgacaaccattgtgctgtaccgtgggatattctgaaggctagtatgaacacctcctcaaaccctggcacccctcttcctctgcctttacggatccagaatgacctgcataggcagcagtactcctatatcgatgcagtctgctatgagaaacagctgcattggttcgccaagttcttcccgtaccttgtgctgctgcatacactcatatttgctgcatgctccaatttttggctgcactacccgtccacttcttccagattggagcacttcgtggccattctccataagtgtttcgattcgccctggactactcgagctctgagcgaaacagtagcggagcagagtgtacggccactcaagctttctaaatccaagatcctcttaagtagcagtggttgttccgccgatatcgacagcggcaagcagtctctgccctacccccaacctggccttgaatctgcgggtatagagagtcccacatcctccgttctcgataagaaggagggcgagcaggctaaagccatattcgagaaagtaaagcgcttccggatgcatgtggaacagaaagatatcatttacagggtctacctgaagcagattattgtcaaagtgattctctttgtgctcatcattacttacgttccctatttcctgactcacatcaccctggaaattgattgctcggtcgatgtgcaggctttcactggttacaaacgctaccagtgtgtctattctttggcagagatcttcaaggtgcttgcttccttctacgtgatattggttatcctctacggattaacatcttcttacagcttgtggtggatgctacggagttctctgaagcaatacagctttgaagcactccgcgagaaaagcaactacagcgacatccccgatgtaaaaaatgattttgcctttattttgcatctggccgaccagtatgaccctctgtactctaagcgcttctcaattttcctcagtgaagtttccgaaaacaagctgaagcagatcaatcttaacaatgaatggacggttgaaaaactgaaatccaaactggtcaagaacgctcaggacaagatcgagttacatctgttcatgctgaacgggttgcctgacaatgtgttcgagttaacagagatggaggtactctctttggagctgattcctgaagtgaagctgcctagcgccgtgagccaattggtcaatctgaaagagctgcgcgtgtaccactctagccttgttgtcgatcaccccgccctggcttttctagaggagaacctgaagatactccgcctcaaattcacggaaatgggtaagataccaagatgggtcttccatctgaaaaatctgaaggaactgtatctatcaggttgcgtgctgccagagcagctttccacaatgcagttggagggcttccaggatctcaagaatctgcgaacactgtacctgaaatcaagcctgtctcgaatcccacaggtggtcaccgacctgttacccagcctgcagaagttgtctctcgataatgaggggtccaaattagttgtcctgaataatctaaaaaaaatggtgaacttgaaaagccttgagctcattagttgtgacttggaacggataccacattctatcttttcactgaacaacctgcatgaactggatttgcgtgagaataatcttaaaactgtcgaggaaattatttcctttcaacacctgcaaaatcttagctgtcttaagctgtggcacaacaacatcgcttacattccagcccagatcggagccctcagcaacttagagcagctgagcctggatcataataacatcgagaacttacctctgcagttgttcctgtgcacgaaactccactacttagacctgagctataaccatctgacatttattcccgaggagatccagtatttgagcaatctccagtacttcgccgtcacaaataacaatatcgagatgctgccagacggactctttcagtgcaagaaactccaatgcctccttctggggaagaacagtttaatgaatttgtctcctcacgttggcgaactgagtaatctcactcacttggagctgatcggaaactatttggagacccttccccccgagctggaaggttgtcagtctctcaagcgcaactgtctgatcgtcgaagagaatttgctgaataccctgcctctgccagtgaccgagaggctacagacatgcctcgacaagtgttag

SEQ ID NO: 192913 - DNA, 2412 bp, Artificial Sequence
  Description of Artificial Sequence: Synthetic coding sequence
atgatcaccctgaccgagctgaagtgcctggccgacgcccagagcagttatcacattctcaagccctggtgggatgtcttttggtattacatcacactgattatgctgcttgttgcagttttggccggggctttgcaactcacgcagagcagagtcctgtgctgcctgccctgcaaggtggagttcgacaaccattgtgccgtgccatgggacattttaaaagcttcgatgaacacttcctccaatcccggcacgcccttgccgcttcccctaaggatacagaacgatctccatcggcagcagtattcctatattgacgctgtgtgctacgaaaagcagctccactggttcgccaaattctttccttatctggtcctgctgcataccttaattttcgctgcctgttcgaacttttggttacactatcctagcacctcgtctagattagaacactttgtggccatactgcacaagtgcttcgatagtccctggactactcgcgcactgtcggaaacagtggctgagcaaagcgtccggcctttgaaactgtcaaagtctaaaatccttctgtccagtagtggatgctcggcagacatcgactcggggaagcagtcccttccttatcctcagccgggcctggagtcagcaggtattgaatcccctacaagttcagtgctggacaagaaggaaggcgagcaggccaaggcaatttttgaaaaggttaaacgtttccggatgcatgtggaacagaaagatatcatttatcgcgtatacctgaagcagattattgtgaaggtgattctttttgtgctcatcatcacttatgtgccgtacttcctcacccacatcactctagaaatcgactgctcagtggatgtccaggcttttacaggctacaagcgctaccagtgcgtgtacagtcttgctgaaatcttcaaagtgctggctagcttttatgtcatactggtaattctgtatgggctcacttcctcttattccctgtggtggatgctccgctccagcttaaaacagtactctttcgaagctctgagagagaaaagtaactatagcgatatcccggatgttaagaatgatttcgcttttatcttgcatcttgcagaccaatacgaccccttatatagtaaaaggttctccatcttcctctcggaggtttctgaaaataagctgaagcagataaaccttaataatgagtggaccgtagaaaagctcaaatccaagctggtaaaaaacgcacaagataagatcgagctccacctctttatgctcaacggtttgccagataatgtcttcgagcttacagaaatggaggttttgagtctggagttgatccccgaagtgaagctgcctagcgccgtaagtcagctggtcaacttgaaggagctgagggtctatcacagctctctcgtggttgaccatccagccctcgcttttttagaggaaaatttaaagattctgcggctgaaattcactgaaatgggaaaaataccaagatgggtgtttcatctgaagaacctgaaggagctgtacctatccggttgcgttctgcccgagcagctaagcactatgcagcttgaggggtttcaagatctaaagaatttgaggaccctgtatctgaagagttcactgagccggattccacaggttgtgaccgatctgctgccctccctccagaagctctctctcgacaacgaaggatcaaaactagtcgtcctgaataatctcaagaagatggtcaatctcaagagtctggagctgattagctgcgacctcgagaggatccctcactcaatttttagcctgaataacctccacgaactagatctgcgggagaacaacctgaagacagtagaagaaattatcagctttcagcacctgcaaaacctcagctgcttgaagctgtggcacaataatatagcatatattcctgcccagatcggggctctgagcaatttggaacagctgagcctagaccataataacatagagaacttgcctttacaactgttcctgtgcacgaagctacattatctggatctaagctacaatcacttgacgtttattccagaggaaatccagtacctctctaacctgcagtattttgcggtgacgaataataacatagagatgctgcccgacggcctgttccagtgtaagaagttacagtgccttctcctgggtaaaaattccttgatgaatctttcccctcacgtgggagagctgtccaacctcacacacttagagctgatcggtaactacctcgaaacactgccgcccgaactggagggttgtcagagcctgaaaagaaattgtttgattgtggaggagaacttgctgaacacgttgcctctaccagtgactgagcgtctgcagacgtgtctggataagtgctag

SEQ ID NO: 192914 - DNA, 2412 bp, Artificial Sequence
  Description of Artificial Sequence: Synthetic coding sequence
atgatcaccctgaccgagctgaagtgcctggccgacgcccagagcagctatcatatactgaaaccctggtgggacgttttttggtattatatcacactgattatgctcctcgtggccgtgctcgccggcgccctgcagctgacgcaaagccgggttctgtgctgcctcccctgcaaggtggaattcgataaccactgcgcagtgccttgggatattctgaaagcatctatgaatacttcatccaatccaggaaccccattaccacttcccctacggatccaaaatgacctccatcgccaacaatatagttatatcgacgccgtttgctatgagaagcagctccactggttcgcaaaatttttcccctatttggtcctgctacacaccctaatcttcgccgcctgttcaaacttctggcttcattacccctccactagttctaggctcgagcacttcgtggcgattctgcacaagtgcttcgatagtccttggaccactagagccctctcagaaacagttgccgaacagagtgtccggccccttaaactttcaaaatccaagatcctgctttccagctctggatgctctgccgacattgattccggtaagcagagcctaccatacccgcagcctggcctcgagagtgctggaattgaaagtccaactagctctgtcctcgacaagaaagagggcgagcaagccaaggccattttcgaaaaggtgaagaggtttagaatgcacgttgaacagaaggatataatctatcgcgtgtacctgaagcagatcattgtcaaagttatcctgtttgtattgattatcacatacgtcccctacttcctcacacatataacgctcgaaatagactgcagcgtagacgttcaagccttcaccggctacaagagatatcagtgcgtgtactccctggccgagatctttaaggtactggcctccttctacgtaatcttggtgatactctacggccttacctccagttacagcctatggtggatgctgaggagtagtctaaagcagtattcgtttgaggcactgcgtgagaagagcaactattccgacattcctgacgtcaaaaacgatttcgcattcattttgcatctggcagaccagtacgaccccttgtacagtaagcggtttagtatcttcctgagcgaggtgagcgaaaataagttgaagcagattaaccttaataacgagtggactgtggagaagcttaaatccaagctggtgaagaacgctcaggacaagatcgagcttcacctgtttatgctcaatggacttcccgacaacgttttcgagttgacagaaatggaagtgctcagcttggagttaattcctgaagtcaaactgccctccgctgtgtcacagctggtcaatttaaaagaactccgagtgtatcatagtagcctggtggtcgatcaccctgcgctggcgttcttggaagagaacctgaagattctgaggctgaagttcactgagatggggaagattccacgctgggtgttccacctcaaaaatcttaaggaactatacctgtcaggctgcgtgctacccgaacagctctcaactatgcagctcgaaggttttcaggatctgaagaacctgcgtactctgtatctcaaatcttcactgtctagaataccacaggtggtgaccgacttactaccctctttacagaagctaagtttggacaatgagggatcgaaactcgtcgttctgaataacttaaaaaagatggttaacctgaagagtctcgaattgatttcttgcgatttggaacgaattccacattccattttctccctgaataatctacacgagcttgatctgagagagaacaatttgaaaaccgtcgaggagatcattagctttcaacatctccagaacctgtcctgtctgaagctgtggcacaacaatatcgcctatatccccgcccagataggagctctgtcaaatctggagcagctgagcctggaccacaacaatatcgagaaccttccactccagctgtttttgtgcacaaaattgcactacctcgacctttcctataatcatttgacttttatacccgaggaaattcagtacctgagcaatctgcagtacttcgctgtaactaataataacatcgaaatgctcccagacggtctgttccagtgtaaaaagctgcagtgtctgttgctgggaaagaattccctgatgaatttgtcaccacatgtcggagagctgagtaacctgactcatctggagctgatcggaaactatctcgaaacactgccacccgagcttgaaggttgtcagtcactcaagagaaattgtctaatcgtggaggagaatcttttgaacaccctgccattgcctgtcactgagaggctgcaaacttgtcttgacaagtgctag

SEQ ID NO: 192915 - DNA, 312 bp, Artificial Sequence
  Description of Artificial Sequence: Synthetic coding sequence
atgatcaccctgaccgagctgaagtgcctggccgacgcccagagcagctatcacatcctaaaaccttggtgggacgtcttttggtactacataaccctcattatgctcctggtggcagtcctggctggcgctctccaactcacacagtcacgcgtgctgtgttgtctgccctgtaaagtagaattcgataaccactgtgccgtcccttgggacattttgaaagcttcaatgaatacatcctccaacccaggcactcccctgcccttaccactcagaatacagaatgatctgcatcggcaacagtactcctag

SEQ ID NO: 192916 - DNA, 693 bp, Artificial Sequence
  Description of Artificial Sequence: Synthetic coding sequence
atgatcaccctgaccgagctgaagtgcctggccgacgcccagagctcatatcatattctgaaaccgtggtgggacgttttttggtactacatcactctgatcatgctgttggtcgccgtcctggccggcgctcttcagctcacccagtcccgcgtgctgtgttgtctgccatgcaaggtggaatttgacaatcattgtgccgtaccgtgggatatcctgaaagcgagtatgaatacatcttcaaaccccggtacaccgctcccccttccccttcgcatccagaatgatttgcatcgccagcagtatagctatatagacgcagtttgctacgaaaaacagctgcactggtttgcgaaattctttccgtacctggtgctgctgcacaccctgatctttgccgcttgctccaatttttggttgcattatccaagtactagcagtagattagaacatttcgtcgccatactacacaagtgctttgactctccatggacaactagggccctgagcgagacggtcgccgagcagagcgtgagacctctgaagctgtcgaaaagcaagatcctgctaagttcatccggatgtagcgctgacatcgacagtgggaagcagagcctgccatacccccagcctggcctagaatccgctggaatcgagtccccgactagctccgtccttactgagggcggctag

SEQ ID NO: 192917 - DNA, 2412 bp, Artificial Sequence
  Description of Artificial Sequence: Synthetic coding sequence
atgatccccgtgaccgagttccggcagttcagcgagcagcagcccgcctttagagtgctcaagccatggtgggacgtctttaccgactacctgtccgtggccatgctcatgatcggggtcttcgggtgcacactacaggtgatgcaggataaaatcatttgtctgccgaagagagtccagccagcccagaaccattcgtcgctgtcgaatgtgagccaagctgtcgccagtacgacacccctgcctcctcccaagccgtcaccagccaatcctatcaccgtggagatgaaaggtcttaagaccgatctggacctccagcaatattccttcatcaatcagatgtgctacgagagggccctccattggtatgcaaaatacttcccctatctcgtcctgatacataccctagtgttcatgctctgcagcaacttctggttcaagttcccaggttcttcctctaaaattgagcattttatttccattttgggaaagtgtttcgatagtccctggactaccagagctcttagcgaggttagtggagaggactcggaagaaaaggacaatcgaaagaacaatatgaataggagcaacaccatccaatccggtcccgaagatagcctggtcaacagtcagtctttgaaaagcatccccgagaaattcgtcgtggacaagagtaccgccggtgctttagataaaaaagagggcgagcaggccaaggctttattcgaaaaggtgaagaagttccgattgcatgtggaggaaggcgacattttatacgccatgtatgtccggcagaccgttctgaaggtcattaagttcctgattatcattgcttacaatagcgcattggtaagtaaggtgcagtttactgtcgactgtaatgtggatattcaagatatgacgggctacaagaacttctcctgcaaccatactatggcccacctgttctccaaacttagcttttgttatttgtgctttgtgtctatctatgggcttacatgcctgtacaccctttattggctgttctataggtcccttcgcgaatactctttcgagtatgttagacaggagaccggtatcgacgatatcccggatgttaagaacgattttgcctttatgctccacatgatagaccaatatgaccctctatattccaagcgattcgccgtgttcctgtccgaggtctctgaaaataagctcaaacagttgaatctgaataacgagtggaccccagacaaactgcgccaaaaattgcagacaaacgctcacaaccggttggagcttccactaatcatgctgtccgggttacccgataccgtcttcgagatcactgaattgcagtccctgaaactagagattattaagaacgtcatgatacctgctaccatcgcccaactggataatctccaggaactgagcctacaccagtgcagcgtgaaaatacatagtgctgcactgagctttctaaaggagaacttaaaggtgctctcagtcaaattcgatgacatgcgtgagctccctccatggatgtatggtctcagaaatcttgaagaattatatcttgtggggagtctctctcacgatataagtcggaacgtgacactcgaatccctaagggacctgaagtccctgaagattctgagcatcaaaagcaatgtctccaaaattccgcaggcggtagtcgacgtttcatcacacctacagaagatgtgcatccacaatgacggaacaaagttggtgatgttaaataatctcaagaagatgactaatttgacagagttagagctggttcactgcgatctggaaagaataccacacgccgttttcagtctactgagtcttcaggagctggatctaaaggaaaataatcttaagtcaatcgaggagatcgtatcatttcaacacctgcgcaagctgacagtcctaaagttatggcacaactccatcacctacattcctgagcacataaagaagctgacaagtcttgaacgtctgagtttttctcataacaaaatcgaggtcctgccttcccatttattcctgtgcaataagattaggtatctggacctttcctacaatgatattaggttcatcccccccgaaattggtgtactccaaagtttgcaatatttcagtatcacctgtaacaaagtagaatccctgccagatgagctttacttttgcaagaagcttaaaacactgaaaatcgggaaaaactccctaagcgtgctgtcccctaagatcgggaacttgctgttcctgtcatatctggacgtcaagggaaaccattttgaaatcctgccccctgagctgggcgactgccgagccctaaaacgcgccggattggtggtggaggatgccctgttcgagaccttgccctcggacgtaagggaacaaatgaagacagaatag

SEQ ID NO: 192918 - DNA, 2577 bp, Artificial Sequence
  Description of Artificial Sequence: Synthetic coding sequence
atgttcaccctggccgaggtggccagcctgaacgacatccagcccacctataggattctaaagccttggtgggatgtgtttatggattatctcgccgtggtgatgctgatggtcgctatcttcgccggaacaatgcagctcaccaaagaccaggtggtctgtttgcctgttctgccaagtccagtaaatagcaaggcacacactccgcctggtaacgctgaggttacgacaaatatacctaaaatggaggcagccaccaaccaggaccaggacggtaggaccactaacgatatcagtttcggcacgagcgctgtgacccccgatattccccttcgcgccacttaccctcgtacagactttgccctgccgaatcaggaggccaagaaagagaagaaagatccaaccgggagaaagaccaacttggactttcagcagtacgtgttcatcaaccagatgtgctaccatctggccctgccatggtattcaaaatatttcccatatctggctctgattcacacaatcatcctgatggtttccagcaatttctggttcaagtatcctaagacttgcagtaaggtggagcacttcgtgtcaatcctgggcaaatgctttgaatcgccatggactactaaggccttgtctgaaacggcatgcgaagactccgaggagaacaagcagaggatcacaggcgctcagactctgccaaaacacgtcagtactagttccgacgaaggaagcccctccgcttcaacccctatgataaacaagaccggcttcaagtttagtgcggagaagccagtcattgaggtcccttcgatgaccatcttggacaagaaagacggggagcaggcgaaggccctattcgaaaaagttaggaaattccgagctcatgtagaagacagcgatttaatttacaagttgtatgtggttcagacagtcatcaagaccgccaaattcatctttatcctgtgttacacagcgaattttgtgaatgctatttcattcgagcatgtgtgtaagccaaaagtggagcaccttataggctacgaagtctttgaatgtacacacaatatggcctacatgttgaagaagctgttaatctcctatataagcatcatttgcgtgtacggatttatctgtctgtataccctgttttggctgttccgcattcccttgaaagagtacagttttgaaaaggtgagagaggagtcttctttcagtgacataccagatgttaagaacgatttcgcctttttactgcacatggtcgaccaatatgaccagctttatagcaaacgctttggcgtcttcctcagcgaggtgagcgagaacaaacttcgcgagattagcctgaatcacgagtggacatttgaaaaactgcggcagcatatatcaaggaacgcccaggacaaacaggaattgcacctatttatgctgagtggagtgccagatgccgtgtttgacctcacagatttggacgtgcttaaactggaactgataccagaagctaagataccggctaagatcagccagatgaccaacctccaggaactgcacttatgtcactgtccagcgaaggtcgagcagaccgccttttccttcctgagggatcacctgagatgccttcacgtgaaatttaccgatgtggccgagatccccgcttgggtctacctgctgaagaacctgagggaactttatttaataggaaatctgaattccgaaaacaataaaatgataggactggaaagtctccgcgagctcaggcatctcaagatcctgcacgtgaagtccaacctgactaaagtgccatcaaacattaccgatgttgccccccaccttacaaaattagtgatccacaatgacggaacaaaactgttggtgctgaactcattaaaaaagatgatgaatgtcgccgaattggaactccagaactgcgagctggaacgtataccgcatgctatttttagcctaagcaatctgcaggaattggacctgaaaagcaataacatccgcacaatagaagaaattatctcgttccagcatctgaaaagactgacatgccttaaactctggcataacaagatagttacaatcccccctagcatcactcacgtgaagaacctcgagagcttgtacttttctaataataaactggaatccctgccagtggccgtgttctctcttcagaagctcaggtgtcttgatgtgagttataataatatatccatgatcccaattgaaataggccttttacagaatctgcagcatcttcacatcaccgggaataaagtggacatactccctaaacagctctttaagtgtattaaactccgcacactgaatctcggccagaactgtatcacctcccttcccgagaaagttggacagctctcacagttgacacaattggaactgaaaggtaactgtctggatcgcttgcccgcccagctggggcagtgtaggatgttgaagaagtcagggctggtcgtggaagaccatttgtttgacacgctccccctcgaggtgaaggaagcgctgaatcaggatataaacataccatttgcaaacggcatttag

SEQ ID NO: 192919 - DNA, 2577 bp, Artificial Sequence
  Description of Artificial Sequence: Synthetic coding sequence
atgttcaccctggccgaggtggccagcctgaacgacatccagcccacatacagaattcttaagccttggtgggatgtcttcatggactacctggccgtggtcatgctgatggtcgcaatcttcgccggcaccatgcagctgacgaaagaccaggtcgtgtgtcttcctgtgctgcctagccccgtgaattccaaggcacacactccacctgggaacgctgaagttacgacgaatatccctaagatggaggccgctactaaccaggaccaggatgggaggacaactaatgatatctcttttggcactagtgcggttacgcccgatatccccctgagagcaacatatccaaggacagattttgctctgcctaaccaggaagccaaaaaagaaaagaaggaccctactggacgaaagactaacttagacttccagcagtacgtcttcatcaaccaaatgtgctaccacctcgcccttccgtggtactcaaaatacttcccttatctcgcgctcattcacactatcatcctgatggtgtcatcaaatttctggtttaaataccccaagacctgcagtaaagttgagcacttcgtttctatactgggtaaatgcttcgaatccccctggaccactaaggctctctctgagactgcctgcgaggactcagaggagaacaaacagaggatcacgggagcgcagacgctccccaagcacgtatctacgtccagcgatgagggcagcccttccgcctctacaccgatgataaataagacagggttcaaattctctgccgagaagcctgttatcgaggtgccttccatgaccatcttggacaagaaagatggcgagcaggcgaaggcgctgtttgagaaagtcaggaagttcagagcccacgtggaagactccgatcttatttacaagctgtatgttgtccaaacagtgataaagaccgcgaagttcatatttattctttgctacactgcaaatttcgtcaacgcaatttcttttgagcatgtttgcaaacccaaggtggaacacctcattggctatgaggtttttgagtgtacacacaacatggcttatatgctaaagaagctcttgatcagctatatatccataatctgcgtttacggatttatctgcttgtacacgctgttttggcttttcagaatcccactcaaagagtattcattcgagaaagtgcgagaggaatcttccttctccgacatacctgatgtcaagaacgatttcgcgttccttctgcatatggtcgaccagtatgaccagctgtattccaagcgctttggggtgttcctgagtgaagtctctgaaaacaaactgagagaaatctcactgaatcacgaatggacatttgagaaactccgtcagcacattagccgtaacgcccaggataaacaagagcttcatctgtttatgctatccggtgtaccagatgctgtatttgacctgaccgacttggacgtgttgaaactggagctgatccccgaggccaagattccagctaagatttctcagatgacgaacctgcaggaactgcacctgtgccattgtcccgccaaagtcgagcagaccgccttttctttccttagagatcatctgagatgcctgcacgttaagtttacagatgtagctgagattcctgcatgggtatacctcttaaagaatttgagggagttgtacctgatcggtaacctgaactctgaaaataataagatgatcggactcgagtcattgagagagttgcgacatctgaagatattacatgtgaaatccaatctgactaaagtcccctctaatattaccgacgtggccccccatctcacaaagctagtcattcacaatgacgggacaaaattattggtcctcaacagcctgaagaaaatgatgaacgtggcagaactggagctgcagaattgtgaacttgaacggatcccacatgcaatattcagcctgtctaatctccaggaattggacttaaaatctaacaatatcagaacaatcgaagaaatcatcagcttccagcatcttaagagactgacgtgccttaagctgtggcataacaaaatcgtcactatcccgcctagtattacacacgtcaaaaatctggagtctctctacttcagcaacaacaaattagagagcttacctgtggctgtgtttagtctccagaagctgagatgtctggacgtgtcttataacaacatctctatgatacctatcgagataggcctgctgcaaaatctgcagcacctccacattacaggaaacaaggtcgatatcctgcccaagcaactgttcaagtgcatcaaactgcgcacactcaatctgggacaaaactgtatcacatctctgcctgaaaaggtgggtcagctcagtcagctaacccaactcgagctgaaaggaaattgtctggatagactccccgcccagttgggacagtgtaggatgcttaaaaagtctgggctggtggttgaggatcacctcttcgacactctgcccctggaggttaaggaggccctgaaccaggacattaacattccttttgctaacgggatctag

SEQ ID NO: 192920 - DNA, 354 bp, Artificial Sequence
  Description of Artificial Sequence: Synthetic coding sequence
atgttcaccctggccgaggtggccagcctgaacgacatccagcccacataccggatcctgaagccctggtgggacgtgtttatggactatctggcagtcgtcatgctgatggtggcaattttcgcgggaacaatgcagctgaccaaggatcaggttgtgtgtctgccggtcctcccctctccagtgaacagcaaagctcacacaccccctggaaatgctgaggtgaccaccaacattccaaaaatggaagcagcaaccaaccaagatcaggatggacggaccaccaacgatattagctttggaacatcagcagtgacacctgacataccattgagggcgacatatcccaggtag

SEQ ID NO: 192921 - DNA, 825 bp, Artificial Sequence
  Description of Artificial Sequence: Synthetic coding sequence
atgttcaccctggccgaggtggccagcctgaacgacatccagcccacctacaggatactgaagccatggtgggatgtattcatggactacctggcggtagtgatgctcatggtcgccatatttgctggaacaatgcagcttaccaaagatcaggtcgtgtgcctgccagtactgcccagtccagtcaattccaaagcccacactcctcctggaaacgccgaagtgactacaaacatcccgaaaatggaggcagctaccaatcaggaccaagacggccgcaccaccaacgacatatcattcggtaccagcgctgtaactcccgacattccactcagggccacatacccccgtactgacttcgccttgcccaaccaggaggcaaaaaaggagaagaaggatcctactggaagaaaaacgaaccttgattttcagcagtacgtattcatcaatcaaatgtgctaccacctggcactcccgtggtatagcaagtacttcccttatctcgcactgatccacactattattcttatggtgtcatcaaacttttggttcaagtatccgaaaacatgttccaaggtcgagcattttgtgtcaatcctgggcaaatgcttcgagtcgccttggacgacaaaggctctgtctgaaacagcatgtgaagactcagaggaaaataagcagcgaatcactggagcccagactctgccaaaacacgtgtcaaccagcagcgacgagggctcgccttcagcctctactccaatgattaacaagactgggtttaaattttcagcagagaagccagttatagaggttccgtctatgacatag

SEQ ID NO: 192922 - DNA, 96 bp, Artificial Sequence
  Description of Artificial Sequence: Synthetic coding sequence
atgttcaccctggccgaggtggccagcctgaacgacatccagcccacttatcgcatcttgaaaccctggtgggacgtgttcatggactacctgtag

SEQ ID NO: 192923 - DNA, 564 bp, Artificial Sequence
  Description of Artificial Sequence: Synthetic coding sequence
atgttcaccctggccgaggtggccagcctgaacgacatccagcccacctatcgcatcctcaagccgtggtgggacgtattcatggattacctagccgtggtcatgctcatggtagccatttttgctggcactatgcagttaactaaggaccaggtggtttgcttgccggtgctgccctctcccgtgaacagcaaagctcacacaccaccagggaacgctgaggtaaccacaaacatccccaagatggaagcagcgacaaatcaggatcaggacgggagaactacaaatgatatttcgtttggtacgtctgcggttacaccagatataccgctccgtgctacttatccaaggaccgattttgcgctgcccaaccaggaggcaaagaaggagaaaaaagatcccactggaaggaagacaaacttggactttcagcagtacgtcttcatcaaccagatgtgctaccacctcgcgctaccttggtactctaagtattttccgtacctggcactgatccacactatcattctgatggtgtcttccaatttttggtttaaatatccgtag

SEQ ID NO: 192924 - DNA, 369 bp, Artificial Sequence
  Description of Artificial Sequence: Synthetic coding sequence
atgttcaccctggccgaggtggccagcctgaacgacatccagcccacatatcgtatcctgaaaccatggtgggacgtgttcatggactacttggccgttgtgatgctgatggtggcaatttttgctggaactatgcaactgacaaaggaccaggtggtgtgtctgcccgttctgccttcaccagtgaattcaaaagcacacacgccgcccggaaacgctgaagtgacaaccaacatccctaagatggaagcggccactaatcaggatcaggatggccggactacaaacgacataagcttcggaacttctgccgttactcctgacatccccctgcgggctacgtacccccgcacagattttgctttatag

SEQ ID NO: 192925 - DNA, 2391 bp, Artificial Sequence
  Description of Artificial Sequence: Synthetic coding sequence
atgatccccgtggccgagttcaagcagttcaccgagcagcagcccgccttcaaggtgctgaagccatggtgggatgtactggccgagtatttaaccgtcgctatgctcatgatcggcgtctttggctgcaccctccaagtcacgcaggataagattatctgtttaccgaatcatgaactgcaggagaacctatcagaagccccctgtcagcaactgcttccacggggtatccctgaacaaatcggagctctccaagaagttaaaggcttgaagaacaacctggacctccaacagtactccttcattaaccaactgtgctacgagaccgccctccactggtacgccaaatactttccatatctggtggtgattcatactttaatttttatggtctgcacatccttttggttcaagtttcccggaacctcctctaaaattgagcatttcataagcatccttggaaaatgttttgatagtccatggacaacacgcgcattgagcgaggtgagcggggagaatcagaagggcccagcggcgaccgagcgcgcagccgccaccatcgtggcaatggccgggactggacccggcaaggctggcgagggtgagaaagagaaggtcttggcagagcctgagaaggtagtcactgagccaccagtggtaacgctgttggataaaaaagaaggcgaacaggccaaggctctgttcgaaaaggtcaaaaagttcaggatgcatgtcgaggaaggggatattctgtacaccatgtacatccgtcaaactgtccttaaggtatgtaaattcctggcaatcctggtgtataacctggtgtacgtggagaaaatcagcttcctcgtggcatgtcgcgtcgaaacctccgaggtgactggctacgccagtttttgctgtaatcacaccaaggctcacttattctccaaactggctttttgctacatttccttcgtgtgcatctacggtctaacctgcatctatacactctattggttatttcataggccactgaaagaatactcattcaggagcgtacgcgaggagacaggaatgggcgatattccggatgtgaagaatgacttcgctttcatgctgcacttaatcgaccagtatgattcgctctatagcaaacgatttgctgtcttcctgagcgaggtgtcagaaagccggctgaagcagcttaacctgaatcacgagtggacacccgagaaacttcggcagaagctgcaacggaatgccgccgggaggttagagcttgccctgtgcatgctgcccgggttgcccgacactgtgttcgaacttagcgaggttgaatccttacggttagaagcaatttgtgacatcactttccccccagggctctcccagttagtgcatctgcaggaattgagcctgctacacagccctgcccggcttcctttcagtcttcaagttttcttacgagatcacctgaaggtgatgagggtgaagtgtgaggaacttcgagaggtcccgctttgggtgtttggcttacggggcttagaggaactccacttggaggggctctttccccaagaacttgcgcgcgccgcaacacttgaatcgctgcgagagctgaaacaactcaaggttctttcattacgcagcaacgccgggaaggtgccagcatcggttaccgatgtggctggccatttacaacgcctgtctttacacaacgatggcgctaggctggtggcccttaacagtctaaaaaagttggctgcactgcgggaactggaactggttgcttgcgggttagagagaataccccatgcagttttttcgctgggtgcattgcaggaactggacttaaaagacaatcacttgagaagtattgaggagattctctcattccagcactgcaggaagctggtgacactccggttgtggcataaccaaatagcctatgtccccgagcatgttagaaaactgagaagcctagaacagctctatctgtcttacaataaactcgagactctgccaagccagcttggtctgtgttctggtttgaggctgctggatgtttcccataatggactccactccctcccgcctgaggtgggtctgctgcagaatttacagcacctagcgctgtcatataatgctctggaggccttgcctgaagagctgttcttctgtagaaagttgaggaccctactgttaggagacaatcaattgtctcagctctccccacatgtcggggccctccgcgctctgtctagattggagctgaaaggcaaccggctggaagccttgccagaagagctagggaattgcggcggcctgaaaaaggctggcctgcttgtcgaggacacactgtaccaggggctccctgctgaggtgcgggacaaaatggaggaagaatag

SEQ ID NO: 192926 - DNA, 1569 bp, Artificial Sequence
  Description of Artificial Sequence: Synthetic coding sequence
atggacttcctgctgctgggcctgtgcctgtactggctgctgcggcgcccctccggagtggtcttgtgcttacttggcgcttgttttcagatgctcccagctgcacccagcggttgccctcaactgtgtcgctgcgagggtcgcttactgtactgtgaggcacttaatctcaccgaagcacctcacaacctgtccggacttcttggcctttctctgcggtataatagtctatccgagctgagagctgggcaatttacgggcctgatgcagctaacctggctgtacctcgatcacaaccacatctgcagcgtgcagggtgacgctttccagaagctgagaagggttaaggagcttaccctgagctccaaccagatcacccagttacccaataccaccttccggcccatgcctaacctgagaagcgtggacctgagctataacaagcttcaagccctggctccagatctgtttcacggacttcgcaaactgactaccctgcacatgcgagcaaatgccatccagtttgtgcctgtgcgcatctttcaggactgtcgctccttaaagttcctggatatcggctataatcaactgaaaagtctggctcggaactcctttgcaggcctgttcaagttgactgaattgcatctggagcataatgacttggttaaggtgaattttgcacactttccacggctgattagcctgcactccttgtgtcttaggcgtaacaaggttgcaatcgtggtgtcttcactggattgggtttggaaccttgaaaaaatggacctgagcggcaatgagatcgaatacatggaaccacatgtcttcgaaaccgtgccacatctccaatccctccagctggactcaaacaggctgacctatatcgagccaagaatcttaaactcatggaagagcctcaccagcatcaccctggcgggcaacctttgggactgcgggagaaacgtgtgtgcccttgcatcgtggttgaacaatttccagggcagatacgatggtaacctgcagtgcgcttcgcccgagtatgcccagggggaagatgtgctggacgcagtgtatgcctttcacctttgcgaagacggggcggagccgacctccggacatcttctttctgcagtaacaaaccgcagcgacctgggacctccagccagcagcgcaaccacacttgccgacgggggcgaggggcagcacgacggcactttcgaaccagcaactgtggccttgcccggcggcgaacatgccgagaatgcagtccagatccacaaggtggttactggaactatggccctaatattctcattccttatagtcgttctggttctgtacgtttcttggaagtgtttccccgccagcctacgccagcttaggcagtgctttgtgactcagaggagaaagcagaagcagaagcagactatgcatcaaatggccgccatgtctgctcaggaatactacgtcgattacaagccgaatcatatcgaaggtgccctggtgatcataaacgaatacggatcctgcacttgccaccaacaaccagcacgcgaatgcgaagtgtag

SEQ ID NO: 192927 - DNA, 1569 bp, Artificial Sequence
  Description of Artificial Sequence: Synthetic coding sequence
atggacttcctgctgctgggcctgtgcctgtactggctgctgcggcggccttccggggtggttctgtgtctcctgggggcctgcttccagatgctcccagctgcccccagtggctgccctcagttgtgccgctgtgagggacgtttgctctactgtgaggccttaaatttgacagaggcccctcataacttaagtgggcttctaggactatcccttagatacaactccctgagcgagttgcgcgcagggcagttcacgggtctgatgcagctgacctggctatatctggatcataatcatatttgctcagtgcagggcgatgccttccagaaactgagacgggtgaaggagctgacattaagtagtaaccagattacgcaactgcccaatacaacattcaggcctatgcccaatctgcggagtgtggacctgtcatataataaactccaggccctggcccctgatctgttccatggcttgaggaaactgacaacattgcacatgcgggctaacgcaatacagttcgtacccgtgagaatctttcaggattgtaggtccttgaaatttctggatatcgggtacaatcagctcaagtccctcgcacgaaactcctttgcgggtctgttcaagcttaccgagctgcatttggaacataacgatcttgtgaaagtgaattttgcgcactttccgcggctgatttcgttacactctctctgccttaggcgtaacaaggtggccatagtcgtctccagcctcgactgggtttggaacttggagaagatggacctctccggaaatgagatcgagtacatggaaccccacgtgttcgagacagtgcctcatcttcagtcactgcagctggatagcaaccgccttacctatattgaaccccgcatactcaattcatggaaaagtctcacttctattacacttgctggaaatctctgggattgtggtcgcaacgtatgcgctcttgcctcatggctgaacaatttccaggggcgctatgacggtaacctgcagtgcgcttcacccgagtacgcccagggggaggatgtgctggatgcagtgtatgcctttcacttgtgtgaagatggcgccgagccaacgtccggacatctgctgagcgccgtaacaaatagaagcgacctgggccctcccgcatcatccgcaacaaccttagccgacggaggcgaggggcagcatgacggaacattcgagcccgcaacggtggccctgccagggggggagcatgcagaaaacgctgtgcagattcataaagttgtgacgggcacaatggccctgattttcagcttcctgattgtggtactggtgctttatgtttcctggaaatgcttccccgcctctctgcgacaattgcggcagtgtttcgtaacccagaggcgcaaacagaaacagaaacaaaccatgcatcagatggcagccatgagcgctcaagagtattacgtggattacaaaccaaaccacatcgagggggccctggtcattataaacgaatacggcagctgtacatgccatcaacagccggcgagagaatgcgaggtgtag

SEQ ID NO: 192928 - DNA, 330 bp, Artificial Sequence
  Description of Artificial Sequence: Synthetic coding sequence
atggacttcctgctgctgggcctgtgcctgtactggctgctgcggcgtcctagcggcgtggtcctgtgcctgctaggtgcctgctttcaaatgttaccagccgcgcccagcggatgccctcaattgtgcagatgcgaaggcaggctgctgtattgcgaagccctcaacctgacagaagctcctcataacctgtcgggcctgctgggactgagcttaagatataatagtctatcagagctgagagccggtcagtttactggcttgatgcagttgacctggttatacctggatcacaaccatatatgttcggtgcagggagatgcattctag

SEQ ID NO: 192929 - DNA, 672 bp, Artificial Sequence
  Description of Artificial Sequence: Synthetic coding sequence
atggacttcctgctgctgggcctgtgcctgtactggctgctgcggcgacccagcggggtagtcctctgcctcctgggagcctgcttccagatgcttccagctgccccgtcagggtgccctcagctgtgtagatgtgaaggaaggctcctttattgcgaagctttaaacttgaccgaagccccccacaacctttcaggattactgggcctgagcttgcgatataacagcctctctgagctaagagctggacagtttaccggcttgatgcaattaacctggctgtacctcgatcacaaccacatatgtagtgtacagggcgatgcattccagaaattgagacgagtgaaggagttgactctgagtagcaatcagatcacccagctgcccaatacaacctttcggccaatgccaaacctccggagcgtcgatctgtcctacaataaactccaggccttggcccccgacctgttccatggtctccgaaagctgacaaccctacatatgagagccaatgcaattcagttcgtgccagtcaggatcttccaggattgcagaagcttgaagtttctggacattggctacaatcagctcaaaagcctggctaggaattcatttgccggactctttaaactgacagagctccacctggaacataatgatctcgtgaagtag

SEQ ID NO: 192930 - DNA, 1569 bp, Artificial Sequence
  Description of Artificial Sequence: Synthetic coding sequence
atggacttcctgctgctgggcctgtgcctgtactggctgctgcggcggccttctggcgtggtgctgtgcctcctcggcgcatgttttcagatgttgccagcggccccctccgggtgccctcagctctgtagatgtgaggggcgactgctctactgcgaagccctcaacctcactgaagctcctcataatttatcaggccttctcgggcttagcctgaggtataactctttgtccgagctgagggcaggacagttcacagggctaatgcagctgacatggctctacctcgaccacaatcacatatgttccgttcaaggagacgccttccagaaactgcggagagtaaaggagctgacactgagctcaaatcagataacacagcttccaaataccacctttagacccatgccaaatttgcggtcagtggaccttagctacaataagctgcaagctctcgcccctgatttatttcacgggctgaggaagctcaccacccttcatatgcgagctaatgcgattcagttcgtgccagtgcgaattttccaggattgccgttcactcaagttccttgacatcggatataaccagctgaagtccctggccaggaactcttttgccggcttgttcaaactgacagaattgcatctggaacataatgacctggtgaaagtgaattttgctcattttccccgactgatcagcttgcattctttgtgtctgcggcgcaacaaagtcgctatcgtggtctcctctctcgattgggtgtggaatctcgaaaagatggatctgtctggtaacgagatcgagtacatggaaccgcatgtgttcgagaccgtgccacatctgcagtccctgcaactggacagcaataggctcacctatattgaaccccgcattctcaacagctggaaaagcctgactagcatcactctggccgggaacctctgggattgcggaaggaacgtctgcgcactagcaagttggctaaataacttccagggtaggtacgatggcaatctgcaatgtgcttcaccggaatacgcccaaggcgaggatgtcctcgacgcagtgtacgctttccatctgtgcgaagacggggcagaacctacatctggtcatctgctgagcgccgtcacaaatcggtcagatctagggccgcctgctagtagcgctaccacgctcgcagacgggggggagggtcagcatgacggcactttcgagcctgccacagtggccctcccaggaggggagcatgccgagaatgccgttcagatccacaaagtagtgactggcacaatggcgctcatattctcatttctgatcgtggttcttgttctgtatgtcagttggaaatgctttcccgcctctcttcgccagcttaggcagtgcttcgtcactcagcggcggaaacagaagcaaaagcagactatgcaccagatggccgctatgagtgcgcaggaatattacgtggactacaaacccaatcatatcgagggcgcactggtgattatcaatgagtatggatcttgcacttgccaccagcaacctgcacgagaatgcgaggtgtag

SEQ ID NO: 192931 - DNA, 1569 bp, Artificial Sequence
  Description of Artificial Sequence: Synthetic coding sequence
atggacttcctgctgctgggcctgtgcctgtactggctgctgcggaggcccagtggtgtcgtgttgtgtcttcttggagcgtgctttcaaatgcttcctgctgctcccagtgggtgtcctcaactgtgccgctgcgaaggacgtctattgtactgtgaagcactgaacctgacggaggccccacacaatctttctgggctcctaggcctatctctgagatacaactcgctgtctgagctacgcgcaggccaatttacaggattgatgcagctgacctggctgtatctggatcacaaccacatctgttccgtgcagggcgacgcgttccagaagctgaggcgcgtaaaggaactgaccctgtcttccaatcagatcacccagctgcccaacaccaccttcaggccgatgcccaatctccggagcgttgacctatcttacaacaaactgcaagccttggctccagacctgttccacggactcagaaaattgacgacccttcacatgcgcgcaaatgcaattcagtttgtgcctgtaaggatcttccaagattgcaggtctcttaaatttctcgacattggctataaccaactaaaaagtctggcacgcaactcattcgccggtctcttcaagttgacggaacttcacctcgaacacaatgatttggttaaggtcaatttcgcccatttcccgagactgatttctctgcacagtttatgtcttcggcgtaacaaagtcgccatagtggtatcttccttagattgggtgtggaacctggaaaagatggatctgtccgggaacgaaatcgaatacatggagccacacgtgtttgaaaccgtcccccatctgcaatctctccagctggactccaataggctcacctatattgaaccccgaatcctcaatagttggaagagtctcacctcgatcaccctggccggaaatctctgggactgtggcagaaatgtatgtgcgctggcctcttggctgaacaacttccagggacgttacgatggcaatctccagtgcgcatctccagagtatgcacagggagaagacgtgttggatgcggtttatgcctttcacttatgtgaggacggggcagaaccaacgtcaggacaccttttatcagctgtcaccaatagatccgatctcggtccgcccgctagcagtgccacaactctggccgatgggggagaggggcagcacgacggaacatttgagccagccactgttgctcttcccggcggcgaacatgccgagaacgccgtgcagattcacaaagtggtcactgggaccatggctcttatctttagcttcctgattgttgtattggtgttgtatgtgtcctggaaatgctttcccgcgagtttgagacagctgcggcaatgtttcgtgactcagcggaggaaacagaagcaaaagcagaccatgcaccagatggccgccatgagtgcccaggagtattacgtggactacaagccgaaccacatcgaaggcgctttggtcatcattaacgaatatggcagttgtacctgtcaccagcaaccagcgcgcgaatgcgaggtctag

SEQ ID NO: 192932 - DNA, 552 bp, Artificial Sequence
  Description of Artificial Sequence: Synthetic coding sequence
atggacttcctgctgctgggcctgtgcctgtactggctgctgcggcgcccctcaggtgtcgtgctgtgtctgctgggggcatgctttcaaatgctgcccgccgcgccctccgggtgcccacagctctgtaggtgcgagggaaggcttctctactgtgaggcactgaacttgacagaagcgccacacaacctatcggggctgctgggactgtccttgaggtacaattctctcagtgagcttcgggctgggcagttcacaggtcttatgcagctgacatggttatatctcgatcacaaccacatctgctccgtgcagggggatgcctttcagaaactccggcgggtgaaggagctgactctgtctagcaatcaaattacacagttacctaataccacattccgccctatgcctaacttacggtcagtcgatctctcttacaacaaactccaggctttggccccagacctattccacggtctgcgcaagcttacaacactgcatatgcgggccaatgctatccaattcgtgcccgtgagaatctttcaggactag

SEQ ID NO: 192933 - DNA, 1551 bp, Artificial Sequence
  Description of Artificial Sequence: Synthetic coding sequence
atgggcctgcacttcaagtggcccctgggcgcccccatgctggccgcaatatacgcgatgtctatggttctgaaaatgctgcccgccttgggtatggcctgtccgccaaagtgtaggtgtgagaagctgctgttctattgcgactcacagggattccatagcgtaccaaatgctactgataagggatcactgggtctgtcccttaggcataaccatatcacagagttggagagggatcaattcgctagtttttctcaactcacttggctgcacctggatcacaatcagatcagcactgttaaagaggatgcttttcaagggctgtacaagctgaaggagctcattctgagctctaacaaaatcttctatctgccaaacactacttttacgcaacttatcaatttgcagaacctcgacctgtcttttaatcagttgagtagtctccatcctgagttgttttacggcctgaggaagctacaaacactacatctgaggtccaattcgctgcgaacaatccccgtaagactcttctgggactgtcggtccctcgagtttctagatctcagcaccaatagattgcgctcactggctcggaatggttttgccggattaattaaactccgagagctgcaccttgagcacaatcagttaacgaagatcaatttcgcccattttctacggctgtcttctctgcatacactttttcttcagtggaacaagatctccaacctgacatgcggcatggagtggacttggggtacccttgaaaagcttgatctaacaggtaacgaaatcaaggctatagatctgactgtcttcgagacgatgcctaacctgaagattctcttaatggacaataataaattaaattccctcgattctaaaattctcaacagccttcgctcactgactaccgtcggacttagcggcaatctgtgggagtgttcagcccgaatttgcgctctggcttcctggctcggctcgtttcaggggagatgggagcatagcatactgtgtcactcgcccgaccatacacaaggggaggatattctggatgcagtgcacggattccagctatgttggaacctgagcaccactgtgaccgtgatggctacgacgtacagagatccaactactgaatacactaaaaggattagctcctcttcataccatgttggggataaggaaatccccaccacggctggaatcgcggtgacaactgaagagcatttccccgaaccagataacgccatctttacccagcgggtcatcactggcactatggcactcctgttcagttttttcttcattatcttcattgtatttatttcccggaaatgctgtcccccaaccctgcggcgcattcgtcagtgtagtatggtgcagaaccatcgccagctcagaagtcagactcggcttcacatgtccaacatgagcgatcagggtccatacaacgagtacgagcccactcatgaaggcccatttatcatcataaacggctacggacagtgcaagtgccagcagcttccttacaaagagtgtgaggtctag

SEQ ID NO: 192934 - DNA, 1746 bp, Artificial Sequence
  Description of Artificial Sequence: Synthetic coding sequence
atgggcttcaacgtgatccggctgctgagcggcagcgccgtggccctcgtgatagcccctactgttctactcaccatgctgagcagtgcagagcggggctgccccaaagggtgtcgttgcgagggcaaaatggtgtactgcgaaagtcaaaaattgcaggaaattccttccagtatttctgcaggttgcctgggactgtccctccggtataattccctgcagaagttgaagtacaatcagtttaagggcctgaaccagctgacttggctctacctggatcacaatcacatcagtaacatcgacgagaatgcatttaacggcatccgaaggctgaaggaactaatcctatcctctaatcggattagctacttcctaaataacacgttcagacctgtgactaacttacgcaacttggacttgtcatataaccagcttcacagcttgggctccgagcagtttaggggattgcgaaaactgcttagcctgcacctgcgttccaatagcctgcgcacaattccagtacggatcttccaagactgtaggaacctcgagctgttagatcttggctacaaccgaatcaggtcactggccagaaacgttttcgctgggatgatacggctgaaggagttgcatcttgagcacaaccaatttagcaaactaaacttagcactttttccacgcctggtctcattgcagaacctgtacctccagtggaataaaatcagcgttatcggccagacaatgtcatggacttggtcctccctgcagaggctcgacttaagtggcaacgaaatcgaagcgtttagcgggccgagtgtctttcagtgtgtgcccaaccttcagaggctgaacttagattctaacaagctaacatttattggtcaggaaatcctcgacagctggataagcctgaacgatatcagtcttgccggaaatatctgggaatgttccaggaatatctgctccctagtgaactggctcaagtcatttaaaggactgcgggagaatactataatatgcgcttctccaaaggagctgcagggagtaaacgtgatcgatgcagtcaagaactattccatctgcgggaaatcaaccaccgaacgtttcgacttagccagagccttgcccaaacccactttcaagcctaagctgcctcgtcccaagcacgagagcaagcctcctctgccccccaccgtgggcgccactgagcccggccccgagacagatgcagacgccgagcacatctcctttcacaagatcatcgcggggtccgtggctctgtttttatcggtgttggtgatcctactcgtgatctatgtgtcatggaaaagatatccagccagtatgaaacagcttcagcagcggagcctgatgaggagacatcggaaaaagaagagacagtcactgaaacaaatgacgccatccacccaggagttttatgtggattacaagccaacaaacactgagacctcggagatgcttctgaacggaaccggcccatgcacatacaacaagtccggcagtcgcgaatgcgaaattccactgtcaatgaatgtttcgacgtttctcgcctacgaccagcctactatttcttactgcggtgttcatcatgagctattgtctcataagagtttcgagactaatgcgcaggaagacacgatggagacacatctggagaccgagctggacttgagcacaatcacgaccgcgggcagaataagcgatcacaagcagcagttggcgtag

SEQ ID NO: 192935 - DNA, 1746 bp, Artificial Sequence
  Description of Artificial Sequence: Synthetic coding sequence
atgggcttcaacgtgatccggctgctgagcggcagcgccgtggccctggtaattgccccaactgtgttgttaacgatgctctcttctgcagaaagggggtgcccaaaaggatgtcgctgtgaaggcaagatggtgtattgcgagagccagaagctgcaagagatacccagttccatctcagccggttgcctgggcctaagcctgcggtacaattcattgcaaaagctcaaatacaaccagttcaagggactaaatcagttgacatggctctatctggatcataatcacataagtaacattgatgaaaacgcctttaacggcatccgccgtctcaaagaattgatcctgtcgtccaaccggatctcatatttcttaaacaataccttccggcccgtgacgaacctgagaaatcttgacctttcttacaaccagcttcactcactggggtcagagcagttcaggggccttcgaaagctcctgagtctgcatcttcggagcaattcactccgtaccataccagtgcgcatattccaggattgtaggaatctcgagctgttagacctcggctacaaccggattcgttctctggcccgtaacgtcttcgctggcatgatcagactgaaggaactgcacctggagcacaaccaattcagcaagttaaaccttgcattgtttcctcgcctcgtctcattgcagaacctgtatcttcaatggaacaagatctccgttattggtcagactatgtcctggacatggagcagtctgcagcggctggacctgtcaggcaacgagattgaagccttcagcggacctagcgtgtttcagtgcgtacccaacttacagaggcttaatttggactccaataagctgaccttcataggtcaggagatcctcgactcctggatctccctcaacgacatctccctcgcagggaatatctgggaatgtagccgaaatatctgcagtctcgtcaattggctgaagtctttcaagggactaagggaaaatacaattatctgtgctagtcctaaggaacttcaaggagttaacgttattgatgccgtcaaaaactacagcatctgtgggaagtcaaccaccgagcgtttcgatttagccagggcactgcccaaacctacctttaagcctaaactcccccgaccaaaacacgagtcaaagccacctctccccccaactgttggtgctacagaaccgggccctgaaactgatgctgacgctgagcacatatctttccacaagattatcgcagggtccgtcgccctgtttttatcagtgttggtgattctgttggtcatctatgtctcatggaaacggtatcccgcatcaatgaagcagctgcagcaacggtccttgatgcgcagacacaggaaaaaaaaacgccagtcgctcaagcaaatgacgcccagtacccaggagttctatgtggactacaaaccgactaacaccgaaacttctgaaatgctgcttaacggcaccggcccgtgcacctacaataagagcgggtcacgggagtgcgagattcccctgagtatgaacgtgagcacctttttggcctacgatcagccaactatctcttactgtggagtgcatcacgaactccttagtcataagtcctttgagacgaatgcccaggaggacaccatggaaacccacctggaaacagaacttgacctgagcactatcacgacagcgggacgaatctcagatcacaaacaacagctggcctag

SEQ ID NO: 192936 - DNA, 1557 bp, Artificial Sequence
  Description of Artificial Sequence: Synthetic coding sequence
atgggcttccacctgatcacccagctgaagggcatgagcgtggtgctagtcttactgcccacccttctcctcgtaatgctgaccggtgctcagcgcgcctgtccgaagaattgcagatgcgacggcaagattgtatactgcgaatcccacgccttcgctgatattcccgaaaacatctctggtggatcccagggcctttcattaagattcaattctattcagaagttgaagtcaaatcaatttgccggattaaaccaacttatctggctctatttagaccataattatatttccagtgttgatgaggatgcattccaggggatacggcgtctgaaggagcttattctctccagcaataaaattacatacttacataacaaaacctttcatccagtccctaacctacggaacctcgatctcagctacaacaagttacaaaccttgcagtctgagcaattcaaaggcctgaggaagttaatcatccttcacctgaggtcaaactcacttaaaactgtgcctatccgggtttttcaggactgtagaaacctggatttcctggatctgggatataatcggttgagaagcctgagtcgcaacgctttcgccgggctacttaagttgaaagaattacacctcgagcacaatcaattcagcaagataaatttcgcccacttcccaagactgtttaatctgcgtagtatatatctgcagtggaatagaatacggtctatctcccaaggcctgacctggacctggtccagcctgcacaacctggacctgagtggcaatgacatccaaggcatcgaacctggaacttttaagtgccttcccaacctccaaaagctaaatctggacagcaataagttaactaatattagccaagagaccgtgaacgcctggatcagcctgatctccatcaccctctctgggaacatgtgggagtgctctagatccatatgccccttgttttactggctgaaaaacttcaagggaaacaaggagtctaccatgatttgcgccggcccaaagcatatccagggcgaaaaggtgtcagacgctgtggagacctataacatttgttccgaggtgcaggttgtgaacactgagcgctcccacctcgtcccccagacgccacaaaaacccctgattataccccgtcctacaatttttaaaccggatgtgacccagtctaccttcgaaaccccgagtccaagtcccgggtttcagattccgggtgctgaacaggagtatgagcacgtgtcattccataaaatcatcgcagggtccgtcgccctcttcctttctgttgctatgatcttacttgtgatctacgtttcatggaagcgctaccctgcctccatgaaacaacttcagcaacattctttgatgaagcgcaggcgcaaaaaggcccgggagtctgaacgccagatgaactcacctttacaagaatactatgtggactacaaacctacaaactcagagaccatggacatctccgtcaatgggagtggaccctgtacttatacaatctccggtagcagggaatgcgaggtgtag

SEQ ID NO: 192937 - DNA, 1773 bp, Artificial Sequence
  Description of Artificial Sequence: Synthetic coding sequence
atgggcttccacctgatcacccagctgaagggcatgagcgtggtgctggtgctcctgcccactctactgttggtaatgctcactggcgcccagagggcatgcccaaagaattgtagatgcgatggcaagatcgtttactgcgagtcacacgcattcgctgatattcctgaaaacatcagcggtgggtctcagggcctttcccttaggttcaactccatacagaaactgaagtctaaccagtttgccgggctcaatcagctaatctggctctacttggaccataattacatatcgagcgttgacgaggacgcgttccagggaattaggcggcttaaagaattgattctgtcaagtaataagattacgtacctgcacaataagaccttccaccctgtgccgaatctgaggaacttggacctcagctataataaactgcagaccctgcagtctgaacaatttaagggcttaaggaagctgatcattttgcacctccggtccaacagcctgaagacggtgcctatccgcgtgtttcaggattgtcggaacctggacttcctggatcttggctacaacagactacgctccttgtctagaaatgcatttgccggactcctgaagctaaaagagttacacttagagcataaccagttctccaagatcaactttgcccactttcctaggctcttcaacctccgaagtatctacttacagtggaacaggatccgtagtatctcacagggcttaacatggacatggtctagcctgcacaacctcgatctgagtggcaatgatatccagggaattgaacctggaaccttcaaatgcctacccaacctccagaagctcaacctcgatagcaataaactcaccaacatttcacaggaaaccgttaatgcctggatatcactgataagcataaccttatctggaaacatgtgggaatgttcaaggtccatctgtcccctcttttactggcttaaaaactttaagggcaacaaagaaagcaccatgatctgcgctggccccaagcacattcagggtgagaaagtcagcgatgccgttgagacctataacatctgctccgaggtgcaggtggtgaatacggaaagatcccatctggtgccccagacgccccagaaaccactgattatacccagacccaccatcttcaaacctgatgtgacacagtcgacattcgagacccccagcccttcacccggcttccagatccccggcgcagagcaggaatacgagcacgtgtccttccacaagattatagcagggtctgtggcactttttctatcagttgctatgattttgttggtcatctacgtgtcatggaaacggtatcccgcttctatgaagcaactgcagcaacactccctgatgaagagaaggagaaagaaagcacgggagtccgaacggcaaatgaactcccccctgcaagaatattatgtcgattacaaacccacaaatagtgagacaatggatatcagcgtgaatgggtctggaccctgcacgtacacaattagtggaagtagggagtgcgaaatgcctcaccatatgaagccgttgccctactatagttatgaccagccagttatcggttactgtcaggcccatcagccgctccacgtcacaaagggatacgaaactgtatccccagagcaagacgagagcccaggacttgagctggggcgagaccattcttttatcgcaacaatcgcacggtctgccgcccccgccatttatctcgagagaatcgccaattag

SEQ ID NO: 192938 - DNA, 1773 bp, Artificial Sequence
  Description of Artificial Sequence: Synthetic coding sequence
atgggcttccacctgatcacccagctgaagggcatgagcgtggtgctggtgctgctacccactctcctgctcgtgatgttaacaggagcccagcgagcctgtccgaaaaactgtcgttgtgacggaaagatcgtgtactgcgagagccacgcctttgctgacatcccggagaacattagcggcggttcccaaggactatcactaaggttcaacagtattcagaaattaaaatcaaaccagtttgccggcctcaatcagcttatctggctgtacctggatcacaattacatctctagcgtcgatgaagatgcctttcaaggcatccggcgtctaaaggaacttatccttagctcaaataagatcacctatcttcataataaaactttccaccccgtgccaaatctgagaaacctggacctgagctacaataagctccagacgttacagtcagaacagtttaagggcctacgcaagttgataatccttcacctgaggtcgaactctctcaaaacggttccaatcagggtgtttcaggactgtagaaatcttgattttctggacctcggctacaatagactgaggtctctgtcccgcaatgcttttgcgggcttgctgaaactcaaggaacttcatttggaacataatcagtttagcaagattaatttcgcgcattttccacggctatttaacttgagatcaatctatctgcagtggaataggatccgctcgatatctcagggcctcacatggacatggtcgtccctgcataacctcgacctgtccggaaatgatattcaggggattgagccagggacgtttaaatgtttgcctaacctacagaagctcaacctcgattctaacaagcttaccaatatctcacaggaaacagtgaacgcatggatttctctgataagtataacattgtcaggtaatatgtgggaatgtagtcgatcaatttgccccctgttctattggctgaaaaattttaagggaaacaaagagagcacaatgatctgtgccggccctaaacacatccagggagagaaagtcagcgatgcggtcgaaacatacaatatttgtagtgaggtacaagtggttaataccgagcgtagccatctggtgccccagactccacaaaaacccctgatcattccacgtccaaccatattcaaacctgacgtgacgcaatctaccttcgagacccccagcccctctcctggctttcagatcccaggcgcagaacaggagtatgagcatgtatcatttcataaaattatcgccggaagcgttgcactgtttctcagcgtggctatgatcctgctggtgatttatgtatcatggaagagatatcccgccagcatgaagcaattacagcaacactccttgatgaagcgccggcggaagaaagcccgcgagagtgagcggcaaatgaattctcctttacaggagtattatgtggattataagccgacaaatagtgaaaccatggacatcagcgtaaacggatccggtccctgcacctataccataagtggctctcgtgaatgtgagatgccgcaccatatgaaacctttaccgtactacagttacgaccaaccagttatcggctactgtcaagcccatcagcctctgcacgtaacaaagggctacgagaccgtttcccccgagcaggacgagagcccagggctggagcttggccgggaccactcctttatcgcaaccattgcccgctcagccgcccctgcaatctatcttgaacgcatcgctaactag

SEQ ID NO: 192939 - DNA, 1776 bp, Artificial Sequence
  Description of Artificial Sequence: Synthetic coding sequence
atgcccggcttccacctgatcacccagctgaagggcatgagcgtggttctggttctgttgcctactctgttgcttgtcatgctgaccggcgctcagcgcgcctgcccaaagaactgtcgttgtgacggaaaaatcgtgtactgcgagagccacgcctttgccgatataccagagaatataagcggagggagccagggcctgtcgttgagattcaatagtatccagaagctgaagagtaatcagttcgctggactgaaccagctgatttggctgtacttggaccacaactacattagttccgtcgatgaagacgccttccagggaataaggcgcttgaaagagttgatactatccagtaataaaattacttacctgcacaacaaaacatttcacccagtacctaatctccgaaatctggacctgagctacaataagctccagacattgcagtcagaacagttcaaaggattgcgaaagctgatcatactgcacctgcgcagcaacagcttgaaaacagtgccgattcgcgtctttcaagactgccgaaacctcgattttctggaccttggttataatagattaagatcgttgtcaagaaacgcttttgccggtcttctcaaactgaaggaactgcacctggagcacaatcagttcagcaagattaattttgcacatttccctcggctgttcaaccttagatcaatctatctacagtggaatagaataagatcaatctcccagggcttgacttggacatggagtagtctgcacaacctggacctgagcggcaatgatatccagggcatcgagcccgggaccttcaagtgccttccgaatctgcagaaattaaatctggatagcaacaaactgactaacatctcgcaggagactgtgaacgcctggatctctttgatctccattaccctttccggcaacatgtgggaatgttcgaggtcaatatgtccccttttttactggcttaagaactttaaaggaaacaaggaaagcaccatgatatgcgccggccctaaacacattcaaggtgagaaggtcagcgacgccgtggaaacttacaacatctgcagtgaggtgcaggtcgttaataccgaacggagccatctggttccacagaccccccagaagccactgatcatccctaggccaaccatttttaagccagacgtgacacagtctacattcgagacaccctcaccttcgcctgggttccagattcccggggccgagcaggagtacgaacatgtctctttccataagataatcgccggttcggtggccctgtttctgagcgttgcgatgattttgctggtgatttacgtgagttggaaacggtaccctgcatctatgaagcagcttcaacagcattcactcatgaagcgaagaaggaaaaaagcccgggaatcagaacgccagatgaacagtcccttgcaagagtattatgtagattacaaaccaactaatagcgaaacaatggacatcagtgtgaacgggagcggcccctgtacctacacaataagcgggagtagagaatgcgaaatgccccaccacatgaaacccctgccatactattcctatgatcagcccgtgatcggttattgccaggcacaccagccgttgcatgtcactaaagggtatgagacagttagtccagagcaggacgagtctccaggacttgaactgggcagggaccacagcttcatcgctacgatcgctaggagtgccgcccctgcaatctatctcgaacggatagctaactag

SEQ ID NO: 192940 - DNA, 579 bp, Artificial Sequence
  Description of Artificial Sequence: Synthetic coding sequence
atgaacaagcgggactacatgaacaccagcgtgcaggagccccccctcgactactcctttagatcgatccacgtaatccaagacctcgtgaatgaggagcctaggactggcctgcgcccactgaaaagatctaagagtgggaaaagtctgacgcagtcactgtggctgaataacaatgtgctgaacgacctccgagacttcaaccaggtcgcctctcaactcttggagcatccggagaacctagcctggatcgatctctcgtttaacgaccttacaagcattgatcctgtccttactacattctttaacttaagcgtgctctatctgcacggaaattcaattcagaggcttggggaagtcaacaagctggccgtcctccctcggcttcgaagtctgaccctgcacggaaaccccatggaggaagagaagggatacagacaatacgtgctgtgtactctgtctcgaatcacaacatttgacttttctggcgtcacaaaagctgataggaccactgctgaggtgtggaagaggatgaatatcaaaccaaaaaaagcctggaccaagcaaaatacactatag

SEQ ID NO: 192941 - DNA, 876 bp, Artificial Sequence
  Description of Artificial Sequence: Synthetic coding sequence
atgggcaccccctggcggaagcggaagggcatcgccggccccggcctgccagatttgtcttgcgccttggtgcttcaaccacgggctcaagttggcacgatgtcccctgctatcgctctcgcctttttgcccctggtcgttacattgttagtgcgctataggcattacttccggctgttggtgagaactgtgctattgcggtccttgcgggattgtctcagcggcctccgcattgaagagcgtgccttttcctacgtcctcactcacgccctcccgggtgatcctgggcatatcctcaccacccttgaccattggagtagccggtgcgaatatttatcacacatgggccctgtcaaagggcaaatcctgatgcgcctcgtagaagagaaggcaccggcttgtgtgctagagctgggtacatactgtggctacagcaccctgctcatcgccagagccctgccgccaggtgggaggctacttactgtggaaagagacccgaggacggctgccgttgctgagaagctcatcagactggctggttttgatgagcatatggttgagcttatcgtcggatcatccgaagacgttatcccatgtcttcggacacagtaccaactctcgagagccgatcttgttctgcttgcccacagaccaaggtgctacctgcgcgacttgcagctcctcgaagctcacgccctcctgcctgccggggctacggttctcgctgaccatgtgctttttcccggagccccacgattcttgcagtatgcgaagtcttgtggaaggtatagatgcagactgcaccatacaggcctccccgatttccctgccattaaggacggaattgcgcagctgacttatgccggcccaggttag

SEQ ID NO: 192942 - DNA, 441 bp, Artificial Sequence
  Description of Artificial Sequence: Synthetic coding sequence
atgaacaagcgggactacatgaacaccagcgtgcaggagccccccctggactatagtttccgctcaatacacgtcatccaggacttggtgaatgaggagccaagaaccggcctccgaccattgaagcggtctaaaagtggaaaaagcctcacccagagcctgtggctcaacaacaatgtacttaatgacctccgggacttcaaccaggtggctagtcagctactggagcaccccgaaaacctggcgtggattgacctgagcttcaacgacctcactagtattgatcctgtccttacaaccttcttcaatttatccgtcttgtacttgcatggaaactctatccagcgcttaggggaggtgaataagctggcagtgctgccgcggctgcgatccctcaccctacatggaaaccccatggaggaagagaagggttaccggtag

SEQ ID NO: 192943 - DNA, 756 bp, Artificial Sequence
  Description of Artificial Sequence: Synthetic coding sequence
atgggcaccccctggcggaagcggaagggcatcgccggccccggcctgcctgacttatcttgcgctctggtgctgcagccgtcccttagggattgcctttccggcctgcgaatcgaagaaagggcttttagctatgtgctgacccatgccctaccaggagatcccggccatattttgacaacactcgaccattggtcctcacggtgtgaatacctcagccacatgggccctgtcaaaggacagatcctcatgagattggtcgaagaaaaagcccctgcctgtgttctggagttaggcacctactgcggctatagcacactgttgattgccagggctcttccccccggagggcgcctgctcactgttgagcgggatccaaggactgccgccgtggccgaaaaattaatacgtctggcaggattcgatgaacacatggtcgagctaatagtggggtccagcgaagacgttataccatgccttagaacgcagtaccagctgtctcgcgccgacctggtcttactggctcaccgaccaagatgctacttgcgggatctacagctattggaggcccacgctctactgcccgcgggggccacggtgctcgctgatcacgttctgttccctggcgcacctaggtttctacagtacgctaagtcctgcgggcgctacagatgcagactgcaccataccggcctgcctgattttcctgctataaaggatggtatcgcccaactgacttacgccggtcccggttag

SEQ ID NO: 192944 - DNA, 876 bp, Artificial Sequence
  Description of Artificial Sequence: Synthetic coding sequence
atgggcaccccctggcggaagcggaagggcatcgccggccccggcttgcctgacctatcttgcgctctggtgctgcagccaagggcacaggtcggaaccatgtctccggccattgcactggctttcctgccactggtggtgaccctcctcgtgcggtacagacattacttcagacttcttgttagaaccgtgcttttacggagcctcagagattgtctgagtggccttcgtatcgaggagagggcctttagttacgttctgacacacgcgttaccaggcgatcccggacacattcttaccaccctcgatcattggagttctcgttgcgagtacctgagccatatgggccctgtaaaggggcagatcctcatgcgtctggtcgaagagaaggcgcctgcatgcgtcttggaactaggaacttattgcgggtacagcactcttctcatagcaagagctttgccaccaggcgggcggctgctcacagttgaacgggatccacgtacagctgcagttgcagagaaacttatccggctcgccggatttgacgagcacatggtcgagttgatagtcggctcctccgaagacgtcataccatgcttacgaactcagtaccagttgtcgcgggcggaccttgtgttgctcgcgcaccgtcctcgatgctacttgagggacttacagttactggaggctcacgccctcttgcccgccggggccaccgtgctggctgatcacgttttgtttccgggcgcccctcgtttcctgcagtacgctaagtcctgcggcaggtataggtgccgcttgcatcatacaggattgcccgattttcccgctatcaaggatggcatagcccagttgacttatgctggccctggctag

SEQ ID NO: 192945 - DNA, 477 bp, Artificial Sequence
  Description of Artificial Sequence: Synthetic coding sequence
atgaacaagcgggactacatgaacaccagcgtgcaggagccccccctggattacagtttccgcagtattcatgtgatccaggatttggtgaacgaagagcctcgcaccggactgcggcccctcaagcgctcgaaatccggcaagtcccttactcagagcctgtggctgaataacaatgtacttaatgacctaagagacttcaatcaggtcgctagtcaactgctcgagcaccctgaaaatctagcctggatcgatctgagcttcaatgatttaacctccatcgaccctgtcttgaccacctttttcaatctgtctgtgctctatttacacgggaacagcatacaacgattaggagaggttaataagctcgctgtgctgcctagactgcgctcgctgactctgcacggcaatccaatggaggaagagaaggggtaccgggttcctgggtccgtggaaatgccacacaggccaccatag

SEQ ID NO: 192946 - DNA, 279 bp, Artificial Sequence
  Description of Artificial Sequence: Synthetic coding sequence
atgaacaagcgggactacatgaacaccagcgtgcaggagccccccctggactactcctttaggtcaattcacgtgattcaggatctcgtcaatgaggaacccagaactgggttgagacctctaaagcgctcaaaatcaggaaagagcttaacccagtctctctggctgaacaacaatgttttgaacgacctgcgagattttaaccaagtggcgtctcagcttctggagcatccggagaacttggcctggatcgatctgtcttttaacgatcttacctag

SEQ ID NO: 192947 - DNA, 579 bp, Artificial Sequence
  Description of Artificial Sequence: Synthetic coding sequence
atgaacaagcgggactacatgaacaccagcgtgcaggagccccccctggattactcctttaggtcgatacacgtgatccaggacctcgtgaacgaagaacccaggactggccttaggcctctcaaaaggtccaaatcgggaaaaagccttacccagagcttatggctgaacaataacgttctcaacgatttgcgggattttaatcaggtggcatcacaacttctagagcatcctgaaaacttggcctggattgacctgagcttcaacgatttgaccagcatcgatcccgtgctgactaccttcttcaatcttagcgtcctctatttgcacggaaattctatacagcgcctgggggaagtgaataaactagccgtcctcccacgacttcgatcactaactctacacggaaaccctatggaagaggagaagggatacaggcagtacgtgctatgcactttgtcccggataacaacattcgacttctctggcgtcactaaagctgatcgtactactgctgaagtgtggaagagaatgaacatcaaaccaaaaaaagcatggactaaacagaacaccctgtag

SEQ ID NO: 192948 - DNA, 477 bp, Artificial Sequence
  Description of Artificial Sequence: Synthetic coding sequence
atgaacaagcgggactacatgaacaccagcgtgcaggagccccccttggactactcctttcggtccattcatgtgattcaagatttggtgaacgaggagccgcgcaccggtctgcgtcctttaaagaggtccaagagcggcaaaagtttaacccagtctttgtggctgaacaataacgttcttaatgacctgagggactttaaccaggttgcatcccagcttttggagcatcccgaaaatctcgcatggattgatctgagttttaatgacctcacctcaattgacccagtgctcacaactttctttaacttatctgtgctgtacttacacggaaacagtatacagaggctgggggaagtaaacaagttggcggtgctgccaaggctgagatccttgacactccatggcaacccaatggaggaggagaagggataccgtgtgcccggtagtgtagaaatgccccaccgccctccatag

SEQ ID NO: 192949 - DNA, 315 bp, Artificial Sequence
  Description of Artificial Sequence: Synthetic coding sequence
atgaacaagcgggactacatgaacaccagcgtgcaggagccccccctggactactctttccgttcgatccacgtgattcaggaccttgtcaacgaggaaccccgtaccggcctgcgacccctgaagcgtagcaaaagcgggaaatctctcacccaaagcctgtggctcaacaacaatgtcctaaacgatttaagagactttaatcaggttgcctctcagctgctcgaacatcccgagaatctcgcctggatagatctgtcctttaatgatttaaccagcatcgaccctgtgttaacgacctttttcaatctgtag

SEQ ID NO: 192950 - DNA, 525 bp, Artificial Sequence
  Description of Artificial Sequence: Synthetic coding sequence
atggtggagttccagcccagcgtgaccgacctggtgaacgaggagcccagaactggcctccgtccactgaagcgatctaagtctggaaaaagccttactcagagcctttggcttaacaacaatgtactcaatgatttgcgcgattttaatcaggtggctagccagttgttggagcaccctgagaacttggcgtggatagatctcagtttcaatgacctcacatccatcgatcccgtactcaccaccttcttcaatctttcagtgctgtatctgcatggtaacagtattcagaggctcggcgaagtcaacaaactcgccgtcttgcctaggcttcggtccctaaccctgcacggaaacccaatggaagaagagaaaggatatcgccaatacgtcctctgcaccctgtctaggatcaccacatttgacttcagcggagtcactaaggcagataggaccacagccgaggtgtggaaacgtatgaacatcaagcctaagaaagcctggactaagcaaaatactctgtag

SEQ ID NO: 192951 - DNA, 3231 bp, Artificial Sequence
  Description of Artificial Sequence: Synthetic coding sequence
atggccgagttcaccagctacaaggagaccgccagcagccggcacctccgtttcaagctccagagtctgtccaggaggctcgatgaattggaagaggccaccaagaacttgcagaaggccgaggatgagctactcgacctacaggacaaagttattcaggcggagggatcgaactcctccatgctggctgaaatcgaggtcctcagacagcgcgtattgcggatcgagggaaaagacgaggagatcaaacgcgctgaagatttatgccgacttatgaaggagaagttagaagaggaggagaatcttactagagagctcaagtccgagattgaacggctgcagaaaaggatggcggagcttgagaaacttgaggaggctttttctcggagtaaaaatgattgcacacagctgtgcttgtctctaaatgaggaacgtaatctgacaaagaagataagtagcgaattggagatgctgagggtgaaagtgaaagagctggagtcctccgaggacaggctcgacaaaactgaacagagcctggcatctgaactcgagaagttaaagtctctgacccttagctttgtgtctgagagaaagtatctcaacgaaaaggaaaaagaaaatgagaagttaattaaagagttgacacaaaagcttgagcagaacaagaagatgaacagggactatacaagaaatgcttccaaccttgagagaaatgatctgagaatcgaggacggaatctcttctaccttacccagtaaagagagcagacgtaaggggggcctggactatttaaagcaggtcgaaaatgagacacgcaacaaatcagagaatgaaaaaaacaggaatcaggaggataacaaggtgaaagacttaaaccaggagatagagaagctgaaaactcagatcaagcatttcgaatccctggaagaagagcttaagaagatgaagagcaagaacaacgatttacaggataactacctgagcgaacagaataagaacaaactacttgccagccagctcgaagagatcaaactccaaattaaaaagcagaaagaacttgaaaacggggaggtggaaggcgaagacgcattcctctcttcgaagggaagacatgagagaacaaagtttcgtgggcacggcagcgaggcctctgtgagtaagcataccgcaagagaacttagcccccaacacaagagagaacgtttgcgaaatcgagaattcgccctaaataacgagaactacagcctgagcaaccggcaggtgtcaagtcctagttttacaaatagacgggccgcaaaggccagtcatatgggagtgagcacggactctggaacccaggaaacgaaaaagaccgaggatcggtttgtgccaggttcctcacagagtgagggcaaaaaaagcagggagcagccaagcgtactatcaagatacccccccgccgctcaggagcatagtaaggcttggaagggaactagtaagccagggaccgagagcggcttgaaggggaaggtggagaagactacaagaacgttttcggataccacccacggttccgtgcctagtgacccactgggtcgcgccgataaagcctctgatacaagcagcgagactgtcttcggcaagcgcgggcacgtgctcggtaatggatcacaagttactcaagccgccaatagcggttgtagcaaggctataggggctttagcttcgtcccggagatcatcgtccgaggggctgtctaaaggaaaaaaggctgcgaacggccttgaagcagataattcttgtcctaactcaaaggccccagtcctgagcaagtatccatacagttgccgatctcaggagaatatcctgcagggcttttccaccagccacaaggagggagtaaatcaaccagcggcagtcgtgatggaggattcgagtcctcacgaggccttaagatgcagggtgattaaaagcagtggccgggagaaacccgattctgatgacgatctcgacatcgcctcactggtcaccgccaagctggtcaacacaactatcacccccgagccagagcccaaaccacagccaaatagcagggaaaaggctaagactagaggcgctcctcggacctccttatttgaaaacgataaagatgctggtatggagaacgagtcggtaaagagcgtaagggcatccaccaacaccatggaactaccagatacaaatggtgctggggttaagtcccagcggcccttctcaccacgagaagctctaaggtctagagcaattattaaacccgtcatcgttgacaaggatgtgaaaaagatcatgggaggtagtgggaccgagacaaccctcgaaaagcagaaacctgtctctaagcccggtcccaacaaggtcacctctagtataacaatatatccgtcagattcctcatctcctcgggcagctcctggagaggccctaagggagcgtcacaccagcacctctaacatccaggtcgggcttgccgagttaacctcagtttctaatcatgtatcttccccttttgaactatcaatacacaaacacgatatcaccctccagctggcggaggccgagcgaatggcagacggtcccctaaaggacagacccgaaacagtcgtctcacgttcgtctattataataaagccaagcgaccccgtggaacgcaatagtcacgctccccccgcagagactattcggtggaagagccattccgctcctagtgaagtggggttctcagacgcccggcatgttacggtccgcaatgcgtggaagtcccggcgggaccttaagagtttagaggatccacctacaaggattggtaaaaatgtggaatctacgaatagcaacgcgtacacgcagcggtcatccacagattttagcgaactggagcaaccccggagttgcttgttcgagcagggcacacggagagtgggaccatcctccggtgacgccccggaaccaagctcacgaaggacacagtccagcttgactgtgtcagaggtccttactaggcgcaatcgtgtgggcgatactataaccgtggcagcgtggaaccacagcgcttcaatggaggaggaaggtgaggactgcacgctgagtgtgtacagacagttacacaactctctagatccttctgagttgccgggaaaacaaggcctccctgagtcaggaagggtacgcgccgaggagcgcctcagacccacccgcccttgcgccgaggagaattag

SEQ ID NO: 192952 - DNA, 3081 bp, Artificial Sequence
  Description of Artificial Sequence: Synthetic coding sequence
atggccgagttcaccagctacaaggagaccgccagcagccggcaccttagatttaaattgcagtcgctctcgagacgactggatgaactcgaggaggcaacaaaaaatctccagaaggccgaggacgagcttttggatcttcaggacaaggttattcaggcagagggaagcaatagtagcatgttggctgaaatagaggtcctcaggcagcgagtgctgcgaatagagggaaaagacgaagaaatcaagcgtgcggaggacctgtgtcgcctgatgaaggaaaagctggaagaggaggaaaatctgactagagaattaaaatccgaaatcgaaagattgcagaagcgcatggcggagctggagaagctcgaagaggcctttagcagaagcaagaatgactgcactcagctctgcttgtcgctgaacgaagaacgtaatttgaccaaaaagatctcctccgagctggagatgctgcgagtcaaggttaaagagcttgagagctccgaggacaggctcgataaaacagaacagtccctggctagcgagctggaaaaactgaaatctttaacactatccttcgtgtcagagaggaaatacttaaacgagaaggaaaaagagaacgaaaagcttatcaaagagctaacgcaaaaactggagcagaacaagaaaatgaatagagattatactcgcaatgcgagcaacctggaacggaacgaccttcggatcgaggatggtatctcctcaactctcccatccaaggagtcccggcgcaagggcgggctcgactatctcaaacaggtggagaacgagactcggaacaagtctgaaaacgaaaagaacagaaaccaggaagataacaaagtgaaggaccttaaccaggagattgagaaactcaagacgcagattaaacattttgaatcactcgaagaggaactcaagaaaatgaagagcaaaaataacgatctccaggataactacctttcagagcagaataagaataaactgctggcctcacagctggaggaaattaaactccagatcaaaaaacagaaagagcttgagaacggagaggtggaaggcgaagatgcattcctgtcaagtaaaggcaggcacgagcggacgaaattccgtggccacgggtccgaggctagtgtgagcaagcacactgcccgggaactgagtccacagcacaaacgtgagcgcctccgcaaccgcgaattcgccctgaacaatgagaattattctctgagcaaccgacaagttagttcccccagctttacaaatagacgggccgctaaagcctcccacatgggtgtatcaacagatagtggcacccaagagacgaagaagactgaggacaggtttgttcctggctctagtcagtccgaaggtaagaagagccgcgaacagccatccgtcctcagccggtatccgcccgctgctcaggaacatagcaaggcttggaagggcacctccaagccgggcaccgagagcgggctgaaagggaaggtagagaagacaacacggactttctctgacacaacacacggttcagtcccatctgaccccctggggcgggctgacaaggcttctgatacctcctcagagactgtttttggtaaacgcggacatgtgctagggaacggctcacaggtgactcaagccgcaaattctggctgctcaaaggcgatcggtgctttggcctccagcagacggagctctagcgaggggttgtccaaaggcaaaaaagctgccaacggcttagaggccgacaactcgtgtcccaacagtaaggcccctgtactctccaaatacccatactcatgccggtcccaggagaacatactgcagggctttagtactagtcataaggaaggagtgaaccagcccgcagccgtggttatggaagattcttcaccccacgaggcacttaggtgccgggtaataaaatctagcggacgggagaagccagattcagatgacgatctggacattgcatctctcgtgaccgccaagctcgtcaataccacaataacgcctgagcctgagccaaagccccagcctaacagccgtgagaaagccaagacaagaggtgccccacgtaccagtctatttgagaacgacaaagacgctggcatggaaaatgagagcgtgaagtcggttcgggctagtaccaatacaatggagctcccagacaccaatggcgccggagtcaagtcgcaacgaccattcagtccacgagaggcgctgcgatcccgcgccattatcaagccggtgattgtagataaggatgtgaagaaaatcatgggtggtagcgggacggagacgactttagagaagcaaaagccagtctcaaagccaggtcccaataaggtgactagtagtatcaccatatatccctccgactcgagctctcctagagcggcccccggcgaggccctccgggagaggcacacatctactagcaatatccaggtagggctcgcggaacttacaagcgtttcgaatcacgtgtcctcgccattcgaactgtcgatccataagcatgatattaccctacagctggccgaggctgagcggatggcagacgggccactcaaggacagaccagagacagtagtgagccgttcatcaatcattattaagccttctgatcccgtggaacgtaactcccatgctccccccgccgagaccatcaggtggaaaagtcattcggcgccctccgaggttggattctccgacgcacggcatgtgacagtgcggaacgcttggaagagtagacgggatcttaaatctctggaggatcctccaacacgtatcggcaaaaatgtagagtcgacgaactccaacgcctatacacaacgcagtagcaccgacttcagtgagctcgagcagcctagatcctgcctcttcgaacagggcacacgacgggtggggccttcctctggagatgcccccgaaccctccagtaggcgcacccagagttcattaacggtaagcgaggtgctgacccggagaaatcgcgtgggcgacacaatcaccgtggccgcttggaatcactccgcatctatgagtagctag

SEQ ID NO: 192953 - DNA, 3231 bp, Artificial Sequence
  Description of Artificial Sequence: Synthetic coding sequence
atggccgagttcaccagctacaaggagaccgccagcagccggcacctgcgcttcaagctgcagtccttgtcaaggagactagacgaattagaggaggcgacaaaaaacttacagaaagccgaagatgaactgttagacctacaggacaaagtcatccaggctgaggggagtaactctagcatgctggccgaaatagaagtgctcaggcagcgggtcctacgcatcgagggtaaagacgaggagattaagagggccgaagatctgtgcagattgatgaaagaaaaattagaggaggaggagaacctgacaagggaactgaaatctgagatcgagagactgcagaagagaatggcagagctggaaaagctcgaagaggctttctccaggagcaaaaacgattgtacgcaactgtgcttgtccctcaatgaagaacgcaatttgaccaaaaagattagctcagaacttgagatgttgcgcgtcaaggtgaaggagttggagtcctccgaagatcgcctggacaagaccgaacagagcctggcttccgagcttgaaaagcttaagagcctgaccctgagctttgtttctgagaggaaatatcttaacgagaaggaaaaggaaaacgagaaactgatcaaagaactcacccagaaactcgaacaaaacaaaaagatgaaccgcgactacacccgtaacgccagtaatctagagcgtaacgacctgcggatcgaagatggcatctcaagcactctacctagtaaggagtctcgccgtaaaggcgggctcgattacctaaagcaggtggaaaatgagactcgcaataagtcggaaaacgagaaaaacagaaatcaggaagacaacaaggttaaagatctcaaccaggaaatagagaaactgaaaacccagattaagcacttcgaatctctggaagaggagctcaaaaagatgaaatcaaagaacaacgacttacaagacaattacctatctgagcagaataaaaataaactcttggccagtcagctggaggagataaaattacagatcaagaaacagaaagagctcgagaatggcgaagtggagggcgaagatgcatttctctcatctaagggacgccacgaacgcacaaaattccggggccacggatcagaggcttccgtcagcaaacacactgctcgtgaactaagccctcaacacaaacgcgagagacttagaaatcgcgagtttgcgttaaataacgagaactactccctttccaaccggcaggtttcatcgccatcttttactaatcggagggctgccaaagctagccacatgggcgtgagcacagactccgggacacaggaaaccaagaagactgaagacaggttcgtccctggttcatctcagtccgaggggaagaaaagtagggagcaaccctctgtcctttctagatatccaccagccgcgcaggagcattctaaagcctggaagggcacgtccaagcctggcacagagtcggggttgaaaggtaaggtggagaagacaacacgcactttctccgacaccactcacggctctgtgcctagtgatcctctcgggcgcgcggacaaggcaagcgatacgtcttccgaaacagttttcggcaagaggggacacgttctcggtaacggctctcaggtcacccaggccgccaattcggggtgctccaaggcaatcggggcacttgctagttctaggagatccagtagtgagggactgtcaaagggaaaaaaagcagcaaacgggctcgaggccgacaatagttgtccgaatagtaaggcccctgtgctttctaaatacccctatagctgccggtcccaggaaaatatcttacaaggctttagtaccagccacaaagagggggtgaaccagccagccgccgttgtcatggaggatagttctccccacgaggcgctgagatgccgggtcattaaaagttccggcagagaaaaacccgatagcgatgacgatctggatatagcttctctagtgactgctaagctggtgaataccactataacaccagaacccgagcctaagccgcagccgaactctcgcgagaaggcaaagaccaggggtgctcctcgtacttctttattcgaaaatgacaaggatgctggaatggagaacgagtccgttaagagcgttcgcgcatccacgaatacgatggaactgcccgacactaacggcgctggcgtaaagagccagcgacccttctctccccgggaagcacttagatcacgtgccattatcaagcctgtaatcgtggataaggacgtgaaaaaaattatgggaggatccggaaccgaaaccacactagaaaaacagaaaccagtaagcaaaccaggcccaaataaagttacgtccagcatcactatataccctagcgattccagcagtccccgcgcagctccgggtgaggctctgcgggaacggcacacgagcacttctaacatccaggttggactggcggaacttaccagcgtgtccaatcatgtgtcctcaccttttgaactcagcatccacaagcatgacatcactctgcagcttgctgaagcagagcgaatggcggacggacccctgaaagatcgccctgagacagtcgtgtctaggtcgtccatcatcatcaagccctcagatccagtcgagcgtaatagccatgccccccccgctgagaccattcggtggaaatctcactcagcaccctccgaggtcggattctccgatgctcgtcatgtgactgtcaggaatgcatggaagagccggcgtgatttgaagtccctggaggatccccctacgcggatcgggaagaacgtcgagtccacgaacagcaacgcgtacacacagagatccagcactgatttttccgagcttgagcaaccccgatcatgtctctttgaacagggcaccagacgcgtcgggccctcttccggggatgcacctgaaccaagctcacgccgaacacagagtagcctgaccgttagtgaggttctgacccgcaggaatcgagttggcgatacaatcacggtggcagcttggaaccactctgcatccatggaagaggagggagaggattgtaccctgagtgtttaccgccagctgcacaactcactcgacccttctgagctgcccggcaagcaggggctccccgaaagcgggagagtgcgggcagaggaacgactccgtcctactagaccttgcgctgaagagaattag

SEQ ID NO: 192954 - DNA, 3231 bp, Artificial Sequence
  Description of Artificial Sequence: Synthetic coding sequence
atggccgagttcaccagctacaaggagaccgccagcagccggcacctgaggttcaaactgcagagcttgagtaggcggctcgacgagttggaggaggcaaccaagaatctgcagaaggccgaagacgagctgctagacctgcaggataaggttatacaggcagagggaagtaatagcagcatgctcgctgagattgaggtcctgagacagagggtgctgcggattgagggcaaggacgaagaaatcaagcgtgccgaggacttatgccggctgatgaaagagaagctcgaagaagaagaaaacttaactagagagctgaaatccgagatcgagcgccttcagaaaaggatggcggagctggagaagttggaggaggcctttagtaggtctaagaacgattgcacccagctctgtctctctctcaacgaggaaagaaatttaacaaagaaaatttcgtctgagctggaaatgttgagagtcaaagtcaaagagctggaatcatccgaggatcgactggacaagacggaacagagcctggcatcggaactggaaaaattaaagtctcttactctgtcatttgtgtcagagcggaaatacctgaatgagaaggagaaggaaaatgaaaaattgatcaaggagttgacccaaaagctggaacagaacaagaaaatgaatcgcgactatacgaggaatgccagtaatctagaaaggaatgaccttcggatcgaagatggaatctctagtactttgccgagcaaggagtcgagaaggaaaggcggcctggattacctgaagcaggtggaaaatgagacaaggaacaagagtgaaaacgaaaagaacagaaatcaggaggacaacaaggtgaaggacctgaatcaggaaatcgaaaagcttaagacacaaattaagcacttcgagagtttagaagaggagttaaagaagatgaagtcaaaaaacaacgaccttcaagacaactacctctctgaacagaacaagaacaagcttctggcttcacagctagaggaaataaaacttcagattaagaagcaaaaggagttagagaacggcgaagtagaaggtgaagacgcattcctgagcagtaagggcagacacgagcgaaccaagtttcggggtcacggatccgaagcatcagtatccaaacacaccgctagagagctgtccccccagcacaagcgcgaacgtctgcgcaaccgggaattcgccttgaacaacgagaattatagtctttccaatcggcaggtatcttctccgtcgttcaccaatcgtcgggctgcaaaagcaagccacatgggagtgtcaactgactctgggacacaggagacgaaaaagacagaggatagatttgtacccgggtccagtcagagtgagggaaagaagagcagagagcagccatcagtgctgtccagataccctcctgcggctcaagaacattctaaagcctggaagggcaccagtaaacccgggaccgaaagcggcttaaagggcaaagtcgagaaaacgacaagaaccttttcagacaccacccacggctctgtacccagcgaccctctgggcagagccgataaggcgtctgatacaagttccgagacggtgtttgggaagcgaggccacgtgctcggtaatgggtcacaggtcacccaggctgctaattccgggtgctcaaaagccatcggtgccctcgcaagctctcgtagatcaagttcagaaggcctttctaaggggaagaaggcagctaatggactcgaggctgacaactcgtgccccaactccaaggcaccagtactgtcaaaatacccatacagctgtcggtcccaggagaacattctgcaaggttttagcacgagccacaaagaaggagtcaaccagccggctgcagttgtcatggaagattcctctccacacgaggccctgcgctgccgcgtgataaagagctcagggcgagaaaaacctgatagtgacgatgacttggacattgcatccttggtaaccgcaaaactagttaacactacgattacccctgagccggaacccaagccacagccgaactcacgggaaaaagctaagactaggggggctcctcgtacctctctcttcgagaacgataaggacgctggaatggagaatgaatccgtaaaatctgtgagagccagtactaacactatggagcttcctgatacaaatggagccggcgtcaaaagccagcgcccgttctcaccaagggaggccctgaggagccgggccatcataaagccggttatagtagataaagatgtgaaaaagattatggggggctctggcaccgagacaaccttagagaaacagaaaccagtttccaagccaggtcctaataaggtcacctcaagcatcactatctacccgtcagactctagcagccccagggccgctccaggagaggcccttagggagcggcatacctctacctctaacattcaagttgggctcgccgagttgacatccgtcagtaaccacgtgtcctcaccattcgagctgtccattcacaaacatgatattaccttgcaactcgctgaggctgagcggatggccgacgggcctttaaaagaccgccctgagaccgtcgtttccaggtcttcaatcattattaaaccttctgatcccgtcgagcggaattcgcacgccccacctgccgaaactattaggtggaagtcacatagtgctccaagcgaggttggcttttccgatgccaggcacgtgacagtgagaaacgcctggaaaagtcgccgggatctgaaatctctggaggatccccctacgaggatcggcaagaatgttgaaagcacgaattctaacgcctatacccaaaggtcatccacagattttagcgaattggagcagcccagatcgtgtctttttgaacaggggactaggcgggtggggcccagttctggggatgcccccgagccttcttcccgcagaacccagagcagcttaactgtgtccgaggttctgactcgcagaaacagggtgggtgataccatcactgttgccgcctggaatcactcggcttccatggaggaagagggagaggattgtaccctatcagtctatcggcaactgcacaattcactggatccctcagagctgcctgggaagcaggggctccctgagtcaggcagggtgcgggccgaggagcggctccgtccaactaggccatgcgcggaagagaattag

SEQ ID NO: 192955 - DNA, 822 bp, Artificial Sequence
  Description of Artificial Sequence: Synthetic coding sequence
atggccgagttcaccagctacaaggagaccgccagcagccggcacctgaggtttaaacttcagtcccttagtaggcggcttgatgagttagaagaagctactaaaaacttgcagaaggccgaagacgagttgctggacctgcaagacaaggttatccaggccgagggctcaaactcctctatgctggctgaaatcgaagtcctgcgacagcgcgtgctgagaattgaaggaaaggatgaggagatcaaaagggccgaggacctgtgccgcctgatgaaagagaaacttgaagaggaggagaacctcacacgggagctaaagagcgagattgagaggctgcagaagcggatggcagagctggaaaagctcgaagaagctttctcccgaagcaagaacgattgcacccagctctgcctctccctgaatgaggagcgcaacctgactaagaagatcagcagtgagctcgaaatgctccgtgtcaaggttaaagaattggagagtagcgaagataggctggataagactgagcagtctctggcatccgaactggaaaagttgaagtccttgaccttatcgttcgtaagcgagcgcaaatacctcaacgaaaaagaaaaagagaacgaaaaactaataaaggaattgacgcagaaactagaacaaaataagaagatgaatagggactatactcggaacgccagcaatctagaaaggaacgatctaaggattgaagatggcatctcgtctacattaccctccaaggagtcacggagaaaaggtggattggactacctgaagcaagtagaaaatgagacccggaactag

SEQ ID NO: 192956 - DNA, 108 bp, Artificial Sequence
  Description of Artificial Sequence: Synthetic coding sequence
atggccgagttcaccagctacaaggagaccgccagcagccggcacctgaggttcaagttgcagagtttgagcaggagactagatgagctggaagaggccactaagtag

SEQ ID NO: 192957 - DNA, 1041 bp, Artificial Sequence
  Description of Artificial Sequence: Synthetic coding sequence
atgaagttcagccccgcccactacctgctgcccctgctgcccgccctggtactgtctaccagacaggactacgaggagttagagaagcagctcaaagaagtcttcaaagaaagatccaccatactacggcagttgacaaagaccagtcgcgaactggatgggatcaaggtgaatctgcagagcctcaaaaacgacgaacaatccgcaaaaactgatgtgcaaaagctactggaactgggccagaagcaaagggaagaaatgaagagtttgcaggaagccctgcagaatcaacttaaggagacaagcgagaaagctgaaaagcatcaagctacaattaattttctgaaaactgaagtggagcgaaagtcaaaaatgatacgcgacctgcaaaatgagaataaaagccttaaaaacaagctgctgagtggtaataaactatgtggcattcacgccgaggagtctaaaaagattcaagcacagttgaaggagttaaggtacggtaagaaggatctcctattcaaggcccagcagctgacagatctggagcagaagctggctgtcgctaaaaatgaactcgagaaggccgccctggatcgtgagtctcagatgaaagccatgaaggagactgtacagctctgtttgaccagcgtgtttcgcgatcaaccgcccccccccctgtctctgatcacctcgaatccgacccgtatgctcctcccccctagaaacatagccagcaagttgccagatgcagccgccaaatccaaaccccagcaaagtgctagtggcaataacgagtcatctcaggtggaatccacaaaagaaggcaatcccagcaccacggcctgtgacagtcaggacgaggggagaccatgttccatgaagcacaaggagagtcccccttccaatgctactgccgagactgagcccatacctcagaagctgcagatgcctccatgcagcgaatgcgaagtaaagaaggcccccgaaaagcctctgacctctttcgagggtatggcagcccgggaggaaaagatcttgtag

SEQ ID NO: 192958 - DNA, 783 bp, Artificial Sequence
  Description of Artificial Sequence: Synthetic coding sequence
atgaagagcctgcaggaggccctgcagaaccagctgaaggagacctctgaaaaagccgaaaaacatcaggccaccatcaacttcctcaagactgaagtggaaagaaagtccaaaatgatcagagatttacaaaacgagaacaaatcactgaagaataaactgctgtccggcaataagctttgcggcatccatgctgaggagtccaaaaagattcaggcccagctaaaggagctcagatacgggaagaaagacctgcttttcaaagcccaacagctcacggacctcgagcagaagctggcggtggctaagaacgagctggaaaaagccgcccttgatagagaatcccagatgaaggccatgaaggaaaccgtccagttgtgcctgacctcagtatttagggaccagcctccgccccctctgtcactgatcacatccaaccccacacggatgctgctgccccctcgaaatatcgccagcaagcttcctgatgctgctgccaagtccaagccccagcagagtgcatcgggcaacaatgagtctagccaagtagagagcaccaaggaagggaacccctcaaccaccgcctgcgactctcaggacgagggacggccgtgttcgatgaaacacaaagaatccccaccttcaaacgcgacagcggaaacggagcccattccccagaaattacaaatgccaccctgttcagaatgtgaggttaaaaaggcccccgagaaaccactcactagttttgaaggcatggctgcccgggaggagaaaattttatag

SEQ ID NO: 192959 - DNA, 900 bp, Artificial Sequence
  Description of Artificial Sequence: Synthetic coding sequence
atggccgagctgggcctgaacgagcaccaccagaacgaggtgatcaattacatgagatttgcaaggtccaaacgcgggttgcggctgaaaactgtcgattcctgcttccaggatctgaaagagtcacgcctagtagaagacacatttacaattgacgaggtgtccgaagtcctgaatggattgcaggcagtcgtgcattctgaggtagagagcgaattaatcaacaccgcttacacgaacgtactgctgctccgccaactttttgcgcaggcagaaaagtggtatctgaaactgcaaacagacatcagcgaactggaaaatagggaactgttagaacaggtagcagaattcgaaaaggcggaaatcacttctagcaataaaaagccaatcttagacgtgacgaagcccaaactagcgcccctcaatgagggaggcaccgcagagctgttaaataaagagatcctccggttacaagaagaaaatgaaaagctgaagagtaggcttaagaccatcgaaatccaggccacaaatgctctggatgagaagtccaaactcgaaaaagctctgcaagatctccagttagaccaggggaatcagaaggattttatcaaggcgcaggatctgagcaacctggaaaacaccgtggccgctctgaagtccgaattccagaagactcttaatgataagacggaaaatcagaagtcgcttgaagagaacttagcgacggccaagcatgatctcctgagggttcaggagcagctgcatatggccgaaaaggaactggagaagaagtttcagcaaaccgcggcttaccggaacatgaaggagatcctgactaaaaagaatgaccagataaaagatctgcgcaagcgcctggctcagtatgagccagaagattag

SEQ ID NO: 192960 - DNA, 849 bp, Artificial Sequence
  Description of Artificial Sequence: Synthetic coding sequence
atgcggttcgcccggagcaagcggggcctgcggctgaagaccgtggacagttgctttcaagatctcaaggaatcaagactggtcgaggatacatttaccattgacgaggtgtctgaggtcctgaacggtctgcaagccgtagtccattctgaggtggaatcggagctcatcaataccgcttatacgaatgtcttgttgttaagacagttgttcgcccaggcggagaagtggtatctgaaactgcagacggacatctccgaactcgagaatagagagctgctggaacaggtggccgaattcgagaaagcggaaattacctcttccaataaaaaacctatcctggacgtcacgaagcctaaattagcccccttgaacgagggaggcactgctgaactcctcaacaaggagattctgcggctacaagaagaaaacgagaaattaaagagcaggcttaaaaccatcgaaatccaggctacaaatgcgctggatgaaaagtctaagttagaaaaggctctgcaggacctgcagctcgaccagggcaaccagaaagacttcattaaagctcaggacctgtccaacctcgaaaacactgtcgccgcccttaaatccgaattccagaaaactctgaatgacaaaaccgagaaccagaagtcactggaggagaatctcgccaccgccaagcacgacctgttacgggttcaggagcagcttcatatggccgaaaaggagctagagaaaaagttccaacagaccgcagcctataggaatatgaaggagatcctcaccaaaaagaacgatcaaattaaggatctccgcaagagactggctcagtacgagccagaggactag

SEQ ID NO: 192961 - DNA, 771 bp, Artificial Sequence
  Description of Artificial Sequence: Synthetic coding sequence
atgcggaaccaggaccccggcaagatgggccggcagcggaagagcattaaactctatcccacacatcccctggtcactttcccccgctcttgggccaagtttcaagagaaggctctattggtcgaggacacgttcacaattgacgaggtgtcagaagtattaaatggattgcaggccgttgtgcatagcgaggtcgaatccgaactaattaacaccgcctatacaaacgttctgttactgcgccagcttttcgctcaagcggaaaagtggtacctcaagctccagaccgacatctcagaacttgagaatcgagagctactggagcaagtggctgaattcgaaaaggctgaaataacttctagcaataaaaaacccatattggacgtgaccaaacccaaattggcgccactcaacgagggcgggacagcagagctgttaaacaaggaaatactccgcctccaggaggaaaacgaaaaactcaagagtaggttgaagacaattgagatccaggctactaacgcgctagacgagaaaagtaaacttgagaaggcactgcaggacctgcaattggatcagggcaaccaaaaagatttcattaaggcccaggacctctcaaatttggagaacactgtagccgctcttaaatcagaattccagaaaacattgaacgacaagactgagaatcaaaagtcccttgaggaaaacctcgccacagcaaagcacgatctcctcagagtgcaggagcagttgcatatggccgagaagatctag

SEQ ID NO: 192962 - DNA, 441 bp, Artificial Sequence
  Description of Artificial Sequence: Synthetic coding sequence
atggtggacgagctggtgctgctgctgcacgccctgctgatgcggcacagggccctgtccatcgaaaatagccaattgatggagcagctgagattgctagtgtgcgaacgggctagccttctaaggcaagtgcgccctcctagttgtcccgtccccttcccagagactttcaatggtgaaagttcccgcttgccagagtttatagtccaaacggcttcatacatgctggtgaacgaaaacagattttgcaacgacgccatgaaggtggctttcctgatcagtctattaaccggggaagcagaagaatgggtagttccctacatcgagatggatagccccatccttggtgattaccgggcatttttggacgaaatgaaacaatgctttggctgggatgatgacgaagatgatgatgacgaagaagaagaggacgattactag

SEQ ID NO: 192963 - DNA, 2220 bp, Artificial Sequence
  Description of Artificial Sequence: Synthetic coding sequence
atggccagcatcctgctgcggagctgccggggccgggcccccgcccgtttacctccccctccacggtacacggtacctaggggaagccccggcgatcctgcccacctgagctgcgcatcgacgttgggcctgcgaaattgtctgaatgtgccattcggctgttgtactcctatccacccagtgtatacgtcaagtcgcggcgaccatctgggctgttgggcactccggcccgaatgtctgaggatagtctccagggctccatggactagtacgagtgtgggatttgtagccgtgggcccccagtgtttgcctgtccgaggatggcatagctcgcgtcctgtgagggatgactctgtggtggagaaatccctgaaaagccttaaagacaaaaacaaaaaactagaagagggaggcccagtctactcaccacccgctgaagtggttgtgaaaaaatccctggggcagagggtgttggatgagctgaagcactactatcacggcttccgcctgctgtggatcgacacgaagattgcagcgcggatgctgtggagaattctgaacgggcactcattgacccgcagggagaggcgacagttcctcaggatctgcgcagatctgttcaggctggtcccattcctggtattcgttgttgttccgttcatggagttcctcttgcccgtggccgtcaaactctttcccaatatgttgccaagcacttttgagactcagtccctgaaggaggagagactcaagaaagagctcagagttaagctagagcttgccaaatttcttcaggatacaatagaggaaatggccctgaagaacaaggccgcaaaaggatcagcaacgaaagacttcagcgtgttcttccagaagattagagagaccggtgagcgcccaagcaacgaagaaatcatgcggttctcgaagctcttcgaggatgaactgactcttgacaatctcacaagaccccaactcgtggcactgtgcaagctgctggagctccaatccattggaaccaataattttcttagatttcagttgaccatgcgcctacggtctatcaaggcggatgataagttgattgcagaagaaggggtggattccctcaacgtgaaggaactccaggcagcctgcagggcccgaggcatgagggcgctgggagtgaccgaggatagattaagaggccagctgaaacagtggttagacttgcacctccaccaagaaattccaacctctctgctcattcttagcagggcgatgtatctgccagacacattatcccccgccgatcagctcaagtcaactcttcagacattgcctgaaatagtggcaaaggaagcccaagtgaaagtagccgaagttgagggcgaacaggtagataataaagcaaaattggaagctacactgcaggaggaagccgcgattcaacaggagcatcgagagaaagaactgcaaaaacgctcggaagttgccaaggatttcgaacccgagcgggtagtggcggccccccagcgacctgggaccgaaccgcagcccgaaatgcccgataccgtcctacagtcggaaactctgaaagatacagcccccgtgctggaaggattgaaggaagaagagatcacgaaggaggaaattgacatcttgtctgacgcatgtagcaaactccaggagcagaagaaaagcctcaccaaagagaaagaagaactcgagctgcttaaagaagacgtacaggattattccgaagatcttcaggagattaaaaaggaactgtcaaagaccggagaagaaaaatatgttgaggagtccaaagcctccaagaggttgaccaagagggtgcagcaaatgattggacaaattgatggcctgataagccaactagaaatggaccagcaagcgggaaaattggcaccggccaatggaatgccaaccggagagaacgtcatctccgtcgccgaactgatcaatgccatgaaacaagttaaacacattcccgagtcaaaattaacaagcttggccgccgccttggacgagaataaggacggtaaggttaatattgacgatctcgtcaaagttatcgaactcgttgataaggaggatgtgcacatcagtactagccaggtagctgagattgtggcaactcttgagaaagaggaaaaagtggaagaaaaggaaaaagccaaagaaaaggctgaaaaggaagtagcggaagtaaaatcatag

SEQ ID NO: 192964 - DNA, 759 bp, Artificial Sequence
  Description of Artificial Sequence: Synthetic coding sequence
atgcggcacacctggcccttccggaacgtgcccttcggctgctgcaccccgatccatcctgtctacaccagtagcaggggtgaccacctggggtgctgggcattacgtccggagtgcctcagaatcgtttctagggccccctggacatccacgtccgtcggcttcgtggctgtgggaccccagtgcctgccagtcagagggtggcactcaagccggcccgtacgcgatgactctgtggtggaaaagtccctgaagtcccttaaagataagaacaagaagctggaggagggcggcccagtttattccccacctgccgaagtggtggtaaaaaaatctctcggccaacgggtcttagacgagctgaaacactattaccacggcttccggcttctatggatcgacactaaaatcgcagcgagaatgctttggcgcatcttgaacggccattcactgacaagacgggagagacgacaatttctgcgaatatgtgccgatctgttccgtcttgtgccattcttggttttcgtcgtggtgccctttatggagttcttgttgcccgtggctgtaaaactcttccctaatatgctccccagtaccttcgaaacgcaatcgttgaaagaggagcggctgaagaaggagctgcgcgtcaaacttgagctggctaaatttttgcaggacacaatcgaagagatggccctgaagaataaggcggcgaaggggagtgcgacaaaggatttttcagtgtttttccaaaaatag

SEQ ID NO: 192965 - DNA, 4185 bp, Artificial Sequence
  Description of Artificial Sequence: Synthetic coding sequence
atggccgccctgctgcggagcgcccggtggctgctgcgggccggcgccgcacctcgactcccacttagtttgaggctgctgccagggggacccggccgcctccacgccgcctcctacttgcccgcagcccgtgccggtcccgtggcaggcggacttctgtcgccagccagactttatgcaattgctgcaaaagagaaagatattcaggaggagtctacattttccagcaggaagattagcaaccaatttgactgggccctgatgagactcgatctctcagttcgcagaaccggtaggattccaaaaaagttattacaaaaagtgtttaatgatacctgccggtcagggggcctgggcggaagtcacgcgctgttgcttctcaggtcttgcggatcgctgttaccggaacttaagctggaggagaggacagaattcgcccacagaatttgggacaccctacaaaaactcggagctgtgtatgatgtcagccactataatgcattacttaaagtctacctgcagaacgagtataagttttcacctacagacttcctggcgaagatggaggaagccaacatccaacccaacagagtaacgtaccagaggctcatcgccagctattgcaacgttggagatatcgagggggcctcaaaaatcttgggattcatgaagacaaaagatctcccagtcacggaggccgtcttcagtgctctcgtgaccggtcacgctcgcgctggggatatggaaaatgccgagaacatcctaactgttatgcgggatgctggaatcgagcccggtccagacacctacttggctctcttgaacgcctacgcggaaaaaggggatattgatcacgttaagcagacgctcgagaaggttgaaaagtctgagctgcacttgatggatcgcgacctgctccagattattttctctttttctaaggcgggttacccgcagtatgtgagtgagattttagagaaagtaacctgcgagagaagatacatcccagatgcaatgaacctgatcctgttgctggttacagaaaagctggaggacgtggccttgcagattctcctcgcttgcccagtctccaaagaagacggacccagcgtcttcgggtccttttttctccagcattgcgtgacaatgaacacacctgtggagaagctcacggattactgcaagaagctgaaagaagttcagatgcactccttccccttacagtttacactccactgcgccctgctcgcgaataagacggatcttgctaaagcactgatgaaagccgtgaaggaggaaggttttcccatccgccctcattacttctggcccctgctggtggggagacggaaggagaaaaacgtgcaggggatcattgagatcctcaagggcatgcaggagctcggtgtgcatccagaccaagagacctatacggactacgtgattccgtgctttgacagtgtgaacagcgctcgcgctatactgcaggagaacggttgtctaagtgattccgacatgttctcccaggctggcctgagatccgaggctgccaacggcaatctggactttgtcctaagcttccttaagtccaatacgctgccgattagccttcagtctatcaggagtagcctcttacttggattccggagatcaatgaacattaatttgtggtctgagatcaccgagcttctttacaaagacggccggtattgccaggaaccaagaggtccgacggaagccgtcggctactttctctataatctgattgattctatgtcggactcagaggtacaagccaaagaggaacaccttcgtcagtactttcatcagctggaaaaaatgaacgtcaaaatcccggaaaatatatacagagggatccgcaacttgttagaaagttatcatgtacccgagcttatcaaggatgcccatctgctggtggaaagcaaaaacctcgatttccagaaaacagtccaactgacatcctcagagttggaatctaccctggagacactaaaggccgaaaatcaacccattagagatgttttaaaacagctgatactggtgctctgtagcgaggaaaacatgcaaaaagctctggaactgaaggccaaatacgagtctgatatggttacaggtggatacgccgcccttatcaacctgtgttgccgccacgacaaggtggaggatgccctgaacctcaaggaagagttcgacaggctggatagttcggccgtcttagacaccggaaaatatgttggactggtgcgagtcctggccaaacacggaaagctccaggacgccataaacattctgaaggaaatgaaagaaaaagacgtcttgattaaggataccactgccctcagcttcttccacatgcttaatggggcagctctgcgcggagaaattgaaacagtgaagcagctacatgaagcgattgttacactcggcttagccgagccttccacgaatatctctttcccacttgtgacggtgcatcttgagaagggtgacttatcaacagccctcgaggtcgccatagactgttacgagaaatataaagtgctcccacggatacatgacgtgctgtgtaagctagttgagaagggcgagaccgatttgatacagaaggctatggactttgtttcccaagaacagggggaaatggtgatgttgtatgatttattctttgccttcctgcagaccggcaattataaggaggcaaagaaaatcattgaaactccaggaattagggcacgaagcgcaagactgcaatggttctgtgacagatgcgtggccaataatcaggtggaaacactggaaaagctggtcgaactaacccagaaacttttcgaatgcgacagagaccaaatgtattataatctgttaaaactttacaaaattaatggggactggcaacgcgcggatgcggtttggaacaaaatccaggaggagaacgtgataccacgcgaaaaaaccctgcggctgctagccgaaatcctgagagagggcaaccaggaggtcccctttgacgtacccgaattgtggtatgaggatgagaaacacagtctgaacagttcaagcgccagtaccacggagcctgatttccagaaagatatcctgatcgcatgtagattgaaccagaagaagggggcctacgatatatttctcaacgccaaggaacagaacattgtctttaacgcagagacgtacagcaatcttataaaactcctgatgtccgaggattatttcacccaggccatggaggtgaaggcattcgctgaaacacacatcaaaggattcactctgaatgatgctgccaatagccgcttgatcatcacccaggttcgccgtgactatctgaaggaagccgtgactacattaaaaactgtactcgaccagcagcagaccccttcccgtctggctgtgacgagagtaattcaggccctggctatgaagggggacgtggagaatatcgaagttgtccagaaaatgctcaatgggttagaagacagcattgggctcagcaaaatggtcttcatcaataacatagccctggcacaaattaaaaataacaacatcgacgccgccattgagaacatcgagaacatgttgacttcagaaaataaggttattgaaccacagtacttcgggctggcctatctttttcgaaaagtcatcgaggaacagctagaacctgccgtggagaaaattagtatcatggccgagaggctggccaaccagtttgccatttacaagcccgtgacagacttctttctgcagctggtggacgcagggaaggtcgatgacgccagagcgcttctgcagcgctgtggagcaatcgctgaacaaaccccgatcctgcttctgtttctgctccggaactcacggaagcagggcaaggcttccacagtgaaaagcgtactggagctcatcccagaactgaacgaaaaggaagaggcctataatagcctgatgaagtcctacgtaagcgagaaggatgtgacatccgctaaagcactttatgagcacctgaccgcgaagaatactaagctcgacgacttattccttaaacgatacgcgtccctgctaaagtatgccggggagccagtgcccttcatagaacctcccgagagtttcgagttctacgcacagcagctgcgaaaactgcgggaaaactcttcatag

SEQ ID NO: 192966 - DNA, 3264 bp, Artificial Sequence
  Description of Artificial Sequence: Synthetic coding sequence
atgcccccccccatctgcccccccctggcccccggcccctggcccggcgggttgggtggatcacacgctctgctgctgctcaggtcatgcggctcactgctgcccgaactaaaactcgaagaaaggaccgaatttgctcacaggatctgggatacactgcaaaagctgggagctgtatacgacgtgtctcactataatgccctactgaaagtgtacctgcagaacgagtacaaatttagcccaactgacttccttgccaaaatggaagaggctaatatccagccgaatcgggtgacctaccaaaggctgattgcttcatattgtaatgtaggcgacattgagggcgcatccaagattctgggcttcatgaaaaccaaagatttgcctgtgaccgaggcagtattctctgctctggtgacaggacatgcccgagcaggcgacatggaaaacgccgaaaacattctcacagtgatgcgagacgccgggattgagcctggacccgacacttacctggctcttttgaatgcttacgccgagaaaggcgacattgatcacgtgaaacagacactggaaaaagttgaaaaatctgagctgcatctgatggaccgggacctgctccagattatctttagtttcagcaaagcaggatacccccagtatgtctcagagattttggaaaaagtgacttgcgagcggcggtacattccagacgctatgaatctcattctcctgcttgtcaccgagaaattggaggatgttgccctccagattctgctggcctgtccagtctcaaaggaggacggcccatcagtgtttgggagcttcttccttcaacattgtgtaactatgaatacgcccgtggaaaagctgacagattactgtaagaagctgaaagaagtgcagatgcactcgtttccgttacagttcaccctccactgcgccctgctggctaacaaaactgatttggccaaggcgctaatgaaggcagtgaaagaggaaggttttcctattaggccccactacttttggccacttttggtgggacgacgcaaagaaaagaatgtccaggggataattgagattctcaagggcatgcaggaactcggtgtacacccggatcaggaaacctacacggattatgtgatcccctgcttcgattccgtcaatagcgctcgggcaattcttcaggaaaacggttgcttatctgactcagatatgttttcccaagctgggctccggtcggaagccgccaacgggaatctggatttcgtgctgtcgttcttgaagtctaacactctccccatctcacttcagagcattagaagcagtcttttgctaggattccggaggtccatgaatatcaatttatggtcggagatcaccgaattgctatacaaagatgggcgatattgtcaggaaccaaggggccctactgaagctgtggggtactttctttacaatctgatagactcgatgtcggacagcgaggttcaggctaaagaggaacacctaaggcagtactttcatcagctggagaaaatgaacgtgaagatcccagaaaatatctatcggggtattaggaacctacttgagtcttaccatgtgcctgagctcataaaggacgctcacttacttgtggagtccaagaatctcgacttccagaagaccgtgcagctgacttcaagcgaattagagagcaccttggaaactctcaaagccgaaaaccagcccatcagagacgtgttgaagcagctcatactggtcctttgtagtgaggagaacatgcagaaggctcttgagctgaaagcgaaatacgagtccgatatggtgacaggtgggtatgcagcccttatcaacctttgttgccgccacgacaaagtggaagatgcactgaacctgaaggaagagtttgaccgcctggattcctcggcggtgttagacaccggcaaatacgtgggactcgtacgtgttctcgccaagcacggcaaattgcaggatgccattaatattctcaaggagatgaaggaaaaggacgtcttgataaaagacacgactgccttgtccttctttcatatgcttaatggcgcggctttacgcggtgaaattgaaacggttaaacagctccatgaggccatcgtaactctgggcttggccgagccaagcactaatatcagcttccccctggtgaccgtccatctggaaaagggggacctgtcaaccgccctggaggttgccatcgattgttatgaaaagtataaggtcctaccgagaatacatgatgtcctgtgcaagttggtggagaagggggagacagatctgatacagaaggccatggatttcgtgtctcaagagcagggggagatggtcatgctgtacgatctattcttcgctttcctgcagacaggcaattataaagaggcgaagaaaatcatcgagacacccggcattagagcaaggtccgcgagactgcagtggttttgcgatcggtgtgtggctaacaatcaggtggaaacactggagaagcttgttgagcttacgcagaaactctttgaatgcgatcgtgaccagatgtactataacctactcaagctgtacaagatcaatggagattggcagcgagctgacgctgtctggaataagatacaggaagagaatgtcatcccgagagaaaaaacccttcgactgttggccgagattctacgggaaggtaatcaggaggtccccttcgacgtgccagagctatggtatgaggacgaaaagcactctctgaactcatcttctgcctctaccaccgaacccgactttcagaaagacatactcatcgcttgtcggctcaaccagaagaagggcgcttatgatattttcttaaacgccaaggaacagaatatagtgttcaacgcagagacctactccaatctcatcaaactgttgatgagcgaggattactttacgcaggccatggaggtaaaagcgtttgccgaaactcatatcaagggatttacattgaacgatgctgctaattcgagattgatcatcactcaggtaagaagggattacctcaaagaggccgtcacaacacttaagacggtcctggatcagcagcagactcctagtcgactggccgtcacccgggtcatccaggcattggcaatgaaaggggacgtcgagaatatcgaagtcgtgcagaaaatgttgaacgggctggaggattccattggcttgtccaagatggtgtttattaacaatatcgccctggcccagtag

SEQ ID NO: 192967 - DNA, 2856 bp, Artificial Sequence
  Description of Artificial Sequence: Synthetic coding sequence
atgcccggccccctgggcctgctgtgcttcctggccctgggcctgctagggtccgccggaccttccggggctgctccccccctgtgcgccgcgccttgttcatgcgacggggatcgccgggtggactgcagtggaaaaggcttgactgccgtcccagaggggctgagtgcttttactcaggcattggacatcagcatgaacaacattacccagctgcccgaggacgccttcaagaacttccccttcctcgaggagttgcaactggctgggaatgaccttagctttattcatccaaaggctctgtcaggattgaaagagttgaaagtgctgacccttcaaaacaaccagttaaagacagtaccttccgaggctatccgcggactgtctgccttgcagtccctgcgcctggatgcaaatcacattaccagcgttccagaggattctttcgaaggactggtgcagttaaggcacctgtggttagacgacaattccctgaccgaggttcccgtccatcccctgagcaatttaccaaccctccaggcactaacacttgcacttaacaagatctcatcaatccctgacttcgcatttactaacttgtctagtctcgttgtcttacatctgcataacaataagattcgatccctttcacagcattgctttgacgggttggacaacctggagactctggatctgaactataataaccttggcgaattccctcaggcgatcaaggctcttccgagcctgaaggagttgggcttccacagcaactccatctccgttatccccgacggtgcattcgatggcaatcctctcctgcgcaccatccacctctacgacaatcctctgagcttcgtgggaaactccgcgttccataacttgtctgatctgcattcattagtgatacgaggggcctctatggtgcagcagtttccaaaccttacaggcacagttcatctcgagtcactcaccttaactggaactaaaatctcctccatccctaacaacctgtgtcaggaacaaaaaatgctgaggacactggatctgagttataacaatattcgtgatctgccatccttcaacggttgtcatgcccttgaagaaattagcctccagcggaaccagatttaccagattaaagagggaacatttcagggccttatctcccttagaattttggacctgtcccgcaacctgattcacgagattcattcacgtgcattcgcaacactggggccaattactaacctggatgtgagtttcaacgagctgacatccttcccaacagagggcctgaatggcctgaaccagctgaagctcgtcggcaacttcaagctcaaagaggccctggccgccaaagacttcgtgaatctgagatcattaagcgtgccctatgcctatcaatgttgcgccttttggggctgcgacagttacgcaaacctgaatactgaggacaatagtctgcaggatcattcagtggcccaggaaaagggtaccgccgacgcagcaaacgttacctccaccttggaaaatgaagagcattcccagatcataattcattgcaccccttccactggagccttcaagccttgcgagtacttgctcggcagctggatgatccgcctgaccgtctggtttatttttctggtcgcactctttttcaacctactcgtgatacttactaccttcgcctcctgtacaagtctccccagcagtaagctctttattgggctgatttcagtgtccaatttgtttatgggaatatacaccgggatattgaccttccttgacgcagtgtcttgggggagattcgccgagtttggaatttggtgggaaactgggtccggctgcaaggttgcaggatttttggccgtcttctccagcgaaagtgctatcttcctgctcatgttggcaactgtggagcgttctctgagcgctaaggacatcatgaagaacggtaaatccaaccacttgaaacagttccgcgtcgctgcccttctggcgttcctcggtgcaaccgtcgcaggctgcttccccctctttcacaggggtgagtactcagcttcccctctgtgcttgccttttccaacaggagaaactcccagcctgggtttcaccgtgacgcttgtattgcttaactccctggccttcctcctcatggcagtcatatataccaagttgtattgtaacttggagaaagaggacctctcagaaaattcacagagtagtatgataaaacatgtcgcgtggttgatctttacaaactgtattttcttttgtcctgtagcatttttttctttcgctccactcattacagcaatcagtattagccccgaaattatgaagtctgtgactctgattttcttccccctgccagcgtgtctgaatcctgtcctctacgtgttctttaatcccaagtttaaggaggactggaaactgttaaagcgcagagtgaccaaaaagtcgggctccgtgtctgttagtatctcctctcaaggcggctgcctcgaacaggatttctattacgattgtgggatgtacagccatttgcagggcaaccttacagtttgtgactgctgcgaatcatttctactgactaagccggtaagttgcaaacaccttattaaaagccattcctgtcctgccttggctgttgcgtcatgccagcgtcctgagggttactggtcggactgtggcacccagtcagctcactctgattatgctgatgaggaggattcttttgtgagcgactccagcgaccaggtgcaggcgtgcggacgagcctgtttctaccagagtaggggcttcccactggtccgctacgcttacaatctgccacgcgtgaaagattag

SEQ ID NO: 192968 - DNA, 2724 bp, Artificial Sequence
  Description of Artificial Sequence: Synthetic coding sequence
atggacaccagccggctgggcgtgctgctgagcctgcccgtgctgttgcaactcgccacaggcggatctagcccaagatcgggggtgttgctgcgaggatgcccaacccactgccactgcgaaccagacgggcggatgcttctcagggtcgactgctcagacctgggcctgtccgagttgcccagtaacctgtcagtttttacgtcttatctggacttatcgatgaataacatttctcagcttctgcctaacccactcccttctttgcgattcctggaagagcttagactagccggcaacgctctgacatatatcccaaaaggagcatttaccggactgtacagccttaaggtcctgatgttgcaaaataatcagctccggcatgtgcctacagaggcgctgcagaatctgcgtagcctgcagtccttaaggctggacgcgaatcatatctcgtacgtgccaccatcttgctttagtggacttcacagtcttcggcacctgtggctcgatgataacgctctaaccgaaataccagtgcaagccttcaggagcctgtccgccctccaggccatgacattggctctgaacaagattcatcacatccctgactacgctttcgggaacctaagcagcctggtcgtgttacatctgcacaacaatcgcatccactctcttggaaagaaatgctttgacggcctccacagtttggagaccctcgatcttaattacaacaaccttgacgaatttccaacagcgatcagaacattatcaaacctgaaggaactaggatttcatagcaacaatatcaggagtatcccagagaaggccttcgtgggtaatccttctcttatcactatccatttttatgataaccctatacagttcgtggggcgaagcgcattccaacatttgcccgagcttcggacccttacgcttaacggtgcttcccagattacggagttcccagacctcacaggcactgcaaacctggaaagcctgacactgaccggagctcagataagtagtttgcctcaaactgtctgcaaccagctgcctaacctacaggtgctggatctgtcatacaatcttctggaagacctgccttctttttctgtgtgtcagaagctgcaaaagattgatttgcgtcacaacgagatatatgagatcaaggtagacaccttccaacagctgttgtcacttcgatccctgaacctagcatggaacaagatagcaatcattcacccaaatgccttttctactctccctagccttatcaaactcgatctctcctctaatctgctctcttctttccccataaccggtctccacggcctgacccatctgaagctgaccgggaaccacgcactgcaaagcctcatttcttctgagaactttcccgaacttaaagtcatagaaatgccatacgcttaccagtgctgcgcttttggggtgtgtgaaaatgcttataaaatatctaatcaatggaacaaaggcgataactctagtatggacgatctgcataagaaggatgctggcatgttccaggctcaggatgaacgcgatctggaggattttttgctggacttcgaagaggatttgaaggccctccattccgtgcagtgctcccccagcccgggtccttttaagccctgtgagcatctcctcgatggttggctcatccgaatcggggtttggacaatcgctgtattggctctaacttgtaacgcacttgttaccagcactgtctttcggtctccactatacattagcccaataaagctgctcattggtgtcatcgctgctgtgaatatgctgaccggcgtgtccagcgctgtgctggctggtgtggacgccttcactttcgggtctttcgccagacatggagcttggtgggagaatggagtcgggtgccatgtcatagggttcctgtcaatctttgcctctgagagctctgtttttcttctgaccctggccgctctggaacgcggcttttctgtcaaatactccgccaaatttgagacaaaggcaccttttagtagcctgaaggtgatcattctcctgtgtgcactgctcgctcttaccatggctgcggtgcccctgctgggagggtctaagtatggagctagcccactatgtctgcccctcccttttggcgagccttccactatgggatacatggtcgcgctcatactgctgaattccctgtgctttttaatgatgacgattgcttacacgaaactatattgcaacttggataagggagacctcgaaaatatatgggattgctccatggtcaagcatatcgcactcctgttattcactaattgcattctgaattgtcctgtggcttttctctccttttcaagcctgattaatcttacatttattagcccggaggtcatcaaatttatactcctggtggtggtgccgttgcccgcttgcctgaatccactattgtacatcctgttcaatcctcactttaaggaggatttggtctcactgaggaaacaaacatacgtatggacacggtctaagcatccaagtttaatgagcatcaactctgacgatgttgaaaagcagagctgcgactctacacaggccctggtcaccttcacgagctcttccataacatacgacctccctcccagctcggttcccagccccgcctatccggtgacagaaagttgccacttaagctctgtagcattcgtgccctgtctttag

SEQ ID NO: 192969 - DNA, 2334 bp, Artificial Sequence
  Description of Artificial Sequence: Synthetic coding sequence
atggacaccagccggctgggcgtgctgctgagcctgcccgtgctgttgcaactggcaacaggaggtagctctccacgcagcggagtgctgctcaggggctgccccacccattgccattgtgagccggacgggcggatgctcctgcgcgttgattgttcagatttgggcctgtccgagctccctagcaacctgtcagtgtttacgtcctacctggaccttagcatgaacaacatcagtcagttattacctaacccgctcccttcccttcgctttctggaggaactcaggctcgctggtaacgcactgacctatataccaaagggcgccttcacagggctgtactccttgaaagtgctcatgctgcagaacaatcagcttcgtcacgtccccaccgaagcacttcaaaatctaaggagtctacaaagcttgcgactcgatgctaaccatatcagttatgtaccacctagctgtttcagcgggctgcactccctgcggcacctgtggcttgacgacaacgcattaacggaaatccctgtgcaggcgtttagaagtctaagcgcactgcaggccatgactctggccctgaacaaaattcatcacatacccgactacgcattcggaaatctttcttctctcgttgtgctgcacttacacaacaacaggatccacagcctcggcaaaaagtgcttcgatggcctgcactctttggagacattagatctcaattataacaatctggacgagttcccaactgccatccgaaccttaagcaatctgaaggaactagggtttcactctaataatattcggagcatcccagaaaaggctttcgttggtaaccccagtctgatcaccattcacttctacgataaccctatccagtttgtgggtagatccgcctttcagcatctccctgagctcagaacccttacgctgaatggtgctagccaaattactgaatttccagatctgaccggtaccgcaaacttagaaagcctgactttgactggggctcagatctcaagcctaccacaaacggtgtgtaaccagcttcccaatttgcaggtgctggatctgtcgtacaacttgttagaggatctaccttcctttagtgtgtgccagaagttgcagaaaatcgatctgcgacataatgagatctacgagatcaaggtcgatacttttcagcagctcttgagtcttcgcagccttaatctggcctggaacaagatagctatcattcaccctaatgctttctccacactcccgagcctgataaagttagatctcagtagcaacctgctgagtagctttccgatcactggactgcacgggctgacgcatcttaaactgaccggtaatcacgccctgcagtccttgattagcagcgaaaatttccccgaactgaaggtgatcgaaatgccatacgcatatcagtgctgcgccttcggcgtgtgcgagaatgcgtacaaaatttccaaccagtggaataagggggacaactccagcatggatgacctgcataagaaagatgctgggatgttccaggcccaggacgaacgggatctggaggacttcctgttagatttcgaagaagacctcaaggctctgcacagtgtgcagtgtagcccctctccgggccctttcaaaccttgtgaacacctcctggacggatggctgattagaatcggagtttggacaattgccgtcctggcgttgacttgtaacgccctggtcacgtcaaccgttttcaggagcccattgtacatcagtccaattaagttgctaatcggagtcattgccgccgtgaatatgctgaccggagtgtcgtctgcggtcctcgccggagtggacgctttcaccttcggttctttcgcccgccacggcgcctggtgggaaaatggggttggatgtcacgtcatcggcttcttgtctatattcgcatctgagtcatcagttttcctactgacgctggcggcactggaacgcgggttctccgtgaaatacagtgccaagttcgagaccaaagccccattttctagtctcaaggttatcatcttgctatgtgccctgctagccctgacgatggctgccgtccctctcctcgggggatctaaatacggcgcttcacctctgtgccttccacttctccctcatgacgatcattgtctgcaccaagccctgctgcagttcggacagggccgccctggcgagtacctcggcctactctatggtaaaacacactgccccgtggcccttcaccagctacaccctaagctgccttgcggctttctcgtcctgctcttatttaataaaccttacatctatcagtcctag

SEQ ID NO: 192970 - DNA, 2508 bp, Artificial Sequence
  Description of Artificial Sequence: Synthetic coding sequence
atggacaccagccggctgggcgtgctgctgagcctgcccgtgctgcttcaactggctacaggcggttccagcccccgctcgggggtactgctcaggggttgtcccacccactgtcattgtgagccagatggccggatgctgttgcgcgtagactgtagcgacctaggtctgtcggagctgccatccaatctgagcgtcttcaccagttacctggacctgtctatgaataatatctcacagctcctgccaaaccccctgccctccctccgatttctcgaggagctacgtctcgcagggaatgcgctaacctacattcccaagggggcatttactggattgtacagcctgaaagtcttgatgctgcagaacaatcagctgcggcatgtgccaacggaggcgctgcaaaaccttaggtctcttcaaagcctgcacctgcataacaatcgcatacactcccttggcaaaaagtgctttgatggtctacacagtttggagaccctcgatctgaactacaacaacctggatgagtttccgaccgcgatccgcacattatccaacttgaaggagctgggttttcacagtaataatataagatccatacccgagaaagcttttgtgggcaatccatccttgattactattcatttttacgataacccaatccaatttgtaggccgttccgccttccagcaccttccggagcttcggactctgaccctgaacggggcatcccagattactgagtttcccgatctcaccggcaccgccaatctggaatccctgactctgaccggagctcaaataagttcgctgccacagaccgtgtgcaatcaattgcccaacctacaggtgctagacctgtcatataacttactcgaagatctccccagcttttcagtgtgtcagaaactgcaaaaaattgacctgaggcataacgagatctatgaaattaaggtcgacaccttccagcagctcctatctctgcgtagcctcaatctagcctggaataaaatagcaattatccatccaaacgcgtttagtactctaccctctctgataaagctcgatttaagttccaaccttctgtcctcgttccctattactggacttcatggtctgacccatttaaagttaactgggaatcacgccctgcagtctctgatctcttcagagaattttccagagctcaaggttatcgagatgccatacgcatatcaatgctgtgcctttggagtatgtgaaaacgcttataaaatctccaatcaatggaacaagggagacaacagctcaatggatgatctccataagaaggatgcaggcatgtttcaagcccaggatgaacgggacctagaggattttttattggattttgaggaagaccttaaagcactccactcagttcaatgctcaccttctcctgggccattcaagccatgtgagcatctgctcgatggctggctgattagaattggggtatggaccattgctgttttggctctgacctgcaatgccctcgtgacttccactgtgttccgatcacctttgtacatcagccccatcaagctgctcattggtgtgattgctgcagtgaacatgctgaccggcgtttcaagcgccgtgctcgccggcgtcgacgcatttactttcggaagttttgctcggcacggggcttggtgggaaaatggtgtaggctgtcatgtcatcggattcttgtcgatatttgccagtgaatcctctgtgtttctgctaacgctggccgcactcgagcgaggcttctcagtaaagtactcagcaaaatttgagacaaaggcccccttctcatctctgaaggtaatcattctcctttgtgctttgttggccctgactatggctgcagtccccttactgggtgggagcaagtatggtgctagtcctctttgcctgccgcttccatttggcgaaccgtctacaatgggttatatggtggctttgatactgcttaactctctctgttttttgatgatgaccatcgcctatactaagttgtattgtaacctcgacaagggagacttggaaaacatctgggattgcagcatggtaaagcacatagccctcttgcttttcaccaactgcatcctcaactgccctgttgcttttctctcatttagttccctcattaatctaaccttcatttcccccgaagttatcaagttcatcctcctggtggtagttcccctgccagcctgcctcaaccccctgctgtacattctgttcaatccccactttaaagaggacctggtatcactcagaaaacagacttatgtgtggacacggtcaaagcatccctctcttatgtcgattaattccgacgatgtcgagaagcagtcatgtgattcaactcaagcccttgtcacctttacctctagttccataacctatgatctgccacccagcagcgtcccttctccggcctaccctgtcacagaaagttgccacctgtctagcgtagctttcgtgccttgtctctag

SEQ ID NO: 192971 - DNA, 2652 bp, Artificial Sequence
  Description of Artificial Sequence: Synthetic coding sequence
atggacaccagccggctgggcgtgctgctgagcctgcccgtgctgctgcagctggcgaccggtggaagttcgcccagatcgggcgtgttactccgaggctgtccgacacactgtcactgtgaaccggatggcaggatgctgttacgcgttgattgctccgatctggggctgtctgagctcccctccaatctcagcgtcttcacctcctacctcgatctatccatgaataatatctcccagctgttgcccaacccactcccctctctccggtttctcgaagaattgagacttgccggtaatgccctcacatacatacctaaaggagcattcaccgggctctattccctcaaggtgctgatgcttcaaaataatcaactaagacatgtgcctacagaggcccttcagaatttaaggtccttgcagtccctaaggcttgatgctaaccacatttcatatgtccctccgagctgttttagcggccttcactctctgcgacatctctggttggatgacaacgcactgactgagatccccgtccaagcttttcggtctctctcagctttgcaggctatgacgctggcgcttaataagatccaccatattcccgactatgccttcggaaatctgtcttccttagtggtacttcatctgcacaacaatcgaatccactcgcttggtaagaaatgcttcgacggcctccattcactggagaccctggaccttaactataacaatcttgacgagtttcccaccgcaatacgaacactgtctaacctcaaagagctccatttttatgacaatcccattcagtttgtcggcagaagcgctttccagcacctgccggagttgcgaaccttaactttgaacggcgctagccaaattaccgaatttccagacctcactgggaccgctaacttggagtccctaaccctgacaggcgcccagattagctcgcttccgcagactgtatgcaaccagctgcccaacttgcaagtcctggatcttagctacaacctgcttgaggacctgccctctttctcggtgtgtcaaaagctccagaagattgacctgcggcacaatgagatctatgagattaaagtggacacattccagcagctgttaagcctgagaagccttaatcttgcttggaacaagattgccatcatccaccctaacgccttcagtaccttacccagcctaattaagttagacctgagcagtaatctcctgtcatcgttccccataactggtttgcacggactgactcacctgaagttgacaggaaaccacgccctgcaaagtctgatttctagtgagaattttcccgagcttaaggttattgaaatgccatacgcttaccaatgctgcgcctttggtgtatgcgaaaatgcctataaaatctccaaccagtggaataagggtgacaactccagcatggacgacttacacaagaaggacgcagggatgttccaggcccaggatgagagggatctggaggactttctccttgactttgaagaggacttgaaggcgctgcattcagtgcaatgttcaccatctccaggacccttcaaaccctgcgagcacctgctggatgggtggttaatccgaatcggagtctggacgatcgctgtcctggccctgacgtgtaatgctttggtcaccagcaccgtttttcgctctccactatatatctcgccaatcaagctcctgattggagtgatcgcggcggttaacatgttaaccggagtatcaagtgcagttctcgctggggttgacgcattcacatttgggtcttttgcaagacacggcgcttggtgggagaacggagtaggatgtcacgtgattggcttcctcagcatctttgcctctgagtctagtgttttcctgttgacactggctgcattagaacgtgggttttcagtcaaatattccgccaagtttgaaactaaagcaccattctctagcctcaaagtaatcatcctcttgtgcgccctcctggccctgacaatggccgccgtccccctactcgggggttctaaatatggtgctagtcccctttgcctcccattgccgtttggcgaaccctctaccatggggtatatggtcgcattgatcctgttaaactctctttgcttcttgatgatgacaatcgcctacacgaagctatactgcaacctggataaaggcgacctcgagaacatatgggactgctcaatggtcaaacatattgcactccttctgtttaccaattgcatcctcaactgccctgtggcctttctgagtttcagtagccttattaacctcaccttcatcagtccagaggttattaagtttatactgcttgtggtggtacccctcccagcttgtctcaatcccctgctgtacatcttgtttaatcctcatttcaaggaagacctggtctcccttagaaaacagacatatgtatggactcgttctaagcatccttccctcatgagtattaacagtgacgacgtcgaaaagcaaagctgcgacagcacacaagcattagtgacctttacgagttctagtatcacctatgacctgccaccttccagtgttccgtcccccgcctaccccgttacagaatcctgtcacctgtccagcgttgctttcgttccatgcctttag

SEQ ID NO: 192972 - DNA, 2748 bp, Artificial Sequence
  Description of Artificial Sequence: Synthetic coding sequence
atgggccggccccggctgaccctggtgtgccaggtgagcatcatcatttccgcgcgcgatctatccatgaataacttgaccgaacttcagccaggcctcttccaccacctcagattcctggaggagctgcgcctgagcggaaaccacttgtcgcatattccgggacaggccttctccggcctctacagtctgaaaatcctgatgctgcagaacaatcagctgggcgggatacccgctgaagccctgtgggaattgccctccctgcagagcctgcgtttggatgcaaatttaataagcctggtccctgaacggtcgtttgaaggtctcagctcactcaggcacctttggctggacgataacgcccttacggaaataccagtgcgcgcactcaacaatctgcccgccctgcaggctatgacccttgcactcaaccggatctctcacatccctgactacgcctttcagaacctaacctcattagtggtcttgcacctgcacaacaacagaatccagcatctgggcactcacagcttcgaaggactacacaatttggaaaccctcgacttgaactacaacaaactccaggagttcccagttgcgatcagaaccttgggtaggctgcaggagttagggttccacaacaacaatatcaaggccatcccagaaaaggcgtttatgggtaacccccttctccaaactatacatttctacgacaatcctatacagtttgtgggccgctcagccttccagtacctgcctaagttgcacactctgagcctcaacggggccatggacattcaggagttcccggatttaaaggggacaacatcgcttgagattcttaccctgacacgagccggaataaggctgcttccatctggcatgtgtcagcagctgcctaggctgcgcgttctggaactctctcacaaccagatcgaggagctccccagcttgcaccgttgccagaagctggaggagatcggcctgcagcacaacaggatttgggagattggggccgatactttttcgcagctttcaagcctccaggctctcgacctttcctggaatgcgatccggtcaatacatccagaggccttctctaccctgcacagtctggtaaaattggacctaacggacaatcagcttacgacactgccactagctggcctgggcgggttaatgcacctgaagctgaagggtaatctcgctctatcccaggcctttagtaaagactcattcccaaagctgaggattcttgaagtgccttacgcctaccagtgttgcccgtatggaatgtgcgcctcattcttcaaagcctctgggcagtgggaagctgaggaccttcacttggacgacgaagaatcttcaaaaaggcctttgggtctgctggcacgccaggctgagaatcactatgaccaagaccttgatgagctccagctcgagatggaggacagtaaaccccatccctctgtgcaatgcagtcccacacctggaccttttaagccctgtgaatacctgtttgagagttggggaatccggcttgcagtgtgggcaattgtactgctgagcgttctctgcaacggcctggtcctgcttactgtctttgctggtggtcctgtacctctgccgccagtgaagttcgtggtgggagccatagcaggggccaacacccttaccggcatcagttgcggacttctggcttcagtggacgccctgacctttggccaattctctgagtacggcgctcgctgggagactggattgggatgccgggcaactggattcctggccgtcttgggctctgaggcctctgtgcttctgctgacgttagctgcagtacagtgctcggttagtgtttcttgcgtgcgcgcctatggtaagtcccctagtcttggaagcgtgcgggctggggttttaggctgtctggctctcgccggcctcgccgccgccctgccccttgcaagcgtgggggaatatggcgccagcccactatgtctgccatatgccccacctgaggggcagccggccgcactgggattcacggtggccctggtgatgatgaattccttttgtttcttggtggttgcgggtgcctacattaaactatactgtgacctaccccgcggcgactttgaagctgtctgggactgtgccatggttcggcacgtggcttggctgatattcgccgacggcctcctgtattgccccgtcgcctttctgagttttgcctccatgctcggcctcttccccgtaacgcccgaggcggtgaagtcagtcctcctcgtggtcttgccgctccctgcttgcctgaatccacttttgtacctgctgttcaaccctcatttcagggacgatctgaggcgtctgcgcccacgcgcgggggattcgggccctctcgcctatgcagctgccggggagctagagaagtccagctgtgatagtactcaggccctggtagctttctcagatgtcgacctgattcttgaagcctcagaggccggtcggcctcctggcctcgagacatacggcttcccaagtgtgacactgatttcctgtcaacaacccggcgccccccgactcgagggcagccactgtgtggaacccgaggggaatcacttcgggaacccccagcccagcatggatggagagctactgctgagggccgagggctcaactccagctgggggggggttgtctggaggcggaggctttcaaccaagtggccttgcattcgcgagtcacgtctag

SEQ ID NO: 192973 - DNA, 699 bp, Artificial Sequence
  Description of Artificial Sequence: Synthetic coding sequence
atgaacaacctgaccgagctgcagcccggcctgttccaccacctgcgttttttggaggaattacgcctcagcggcaatcatttgagccacatcccgggtcaggccttttcgggcctctattccctgaaaatcctcatgttgcagaacaatcagctgggaggtattccagccgaagcactgtgggaattgccgagtctgcagtccctcagattggatgccaatcttatttcactggtgcccgagagatcttttgaaggcttgagctctcttcgacatctctggcttgacgataacgcactcaccgaaataccggtacgtgccctaaataatctaccagccttacaagcaatgacattagccttaaaccgcatttcgcatatcccagattacgcatttcaaaacctaacatctctagtggtgctagacctgaactataacaagcttcaggagtttccagtggccataaggacccttggtaggctacaagaactgtctttgaatggagcgatggacatccaggaattccctgacctgaaagggaccacaagtctagagatccttacactgaccagagccggaatccgactgctaccctctggcatgtgccagcagcttcccaggctgcgcgtactggagttatcacacaatcaaatcgaggagctgccatccttgcacagatgccagaaactggaggaatag

SEQ ID NO: 192974 - DNA, 2904 bp, Artificial Sequence
  Description of Artificial Sequence: Synthetic coding sequence
atgcccagcccccccggcctgcgggccctgtggctgtgcgccgccctgtgtgcgtcccggagggctggcggagcaccacagcctggaccagggcccacagcgtgtccagcaccctgtcattgtcaggaggacgggataatgctaagtgctgactgctccgagttaggtctcagcgctgttccaggagatcttgaccccctcacagcgtatcttgacttatcaatgaataatctgacagaacttcaacctggtctctttcatcatttacgattcctggaagaactgaggctgagtggaaaccacctcagtcacatcccaggacaggcattctcgggtctctattctctcaaaatccttatgctgcagaataaccaactgggggggatacccgctgaggctttgtgggagctgccctcccttcagtctcttcgactcgatgctaacctcattagtctggtgccggaaaggtccttcgaggggttgagctccctgcggcacctgtggcttgacgataacgccctgaccgagatcccagttagagccctgaataaccttcccgccctccaggccatgacccttgcattgaaccgtatatctcatattcccgactacgcatttcagaatttgacctcactggtggtgcttcacctccacaataataggattcagcatctggggacgcattcattcgaaggtcttcataacttggagaccctcgatcttaattataacaagctacaggagtttcctgtagccatccggactctggggagactacaggaactcggattccacaataacaacattaaagctataccagaaaaggcgtttatgggcaaccccctcttacaaactattcatttttatgataatcctattcagttcgtaggcagaagcgctttccagtatctccccaagctgcatacactatctcttaacggagcaatggacattcaagagtttcccgaccttaagggtaccacttctctggaaatcctcaccttgactcgcgccggtattcgtttgttgccctccggcatgtgccaacaactgccgaggcttcgggtgctggaacttagccataatcagattgaagagctgccaagcttacaccggtgccagaagctcgaggagatcgggctccaacataaccgcatctgggagatcggcgccgatacctttagccagcttagttccctccaggcgttggacctgagctggaacgctattcggagtatccatccggaagcattcagtacgctacacagccttgtgaagctggatctgaccgataatcaactgactacactgcctctggcgggcctgggcggactcatgcacctgaaactcaaagggaacctggccctgtctcaagcattctctaaggactcattcccgaaactgaggatcctagaggtcccatacgcctaccagtgttgcccctacggaatgtgtgcctcctttttcaaagcgagtggacagtgggaggctgaggacctgcacctggacgatgaggagtccagtaaaagacctctcggactgctggcccgacaggccgagaaccattacgatcaggacctggatgagctccagctcgagatggaggatagcaaaccccatccatcagttcagtgcagccctacccctggaccgttcaagccttgcgagtatctgtttgagagctgggggatcagactcgccgtgtgggccatcgttctcctgtcagtattgtgtaatggactggttttgcttactgtcttcgccggaggtcctgtccctctcccgccagtcaaatttgtcgtgggggcaatcgcaggagccaatacactgactggcatcagctgtggtcttttagcttccgtggacgcgcttaccttcggccagtttagcgaatatggcgcccgttgggagacgggactggggtgtagagccacgggctttctggcggtcctcggatccgaggcttctgtgctgcttttgactctcgcagcggtccagtgttccgtatcagtcagctgtgtgcgtgcctatggaaaatcacctagtctgggcagtgtccgcgcaggcgtactcgggtgtcttgccttggcgggtctggccgctgccctccccctggctagtgttggcgaatacggagcttccccactctgcctgccatacgcgcccccagaaggacagcctgcagcccttgggtttactgttgctctagtcatgatgaatagtttctgctttttggtcgtggcaggagcttatattaagctctattgtgacctgcctcgtggcgactttgaagccgtgtgggactgcgccatggtgcgacatgtggcatggttaatattcgccgatggccttctgtattgcccggttgcatttctctcattcgcgtccatgctggggcttttcccagttacacccgaggctgttaaatccgtgcttctggtcgtactgccactgcccgcctgcttgaatccacttctgtatctactgttcaatccccatttccgtgacgacctgcggcggctcaggcctcgggctggcgacagcgggcctctcgcttatgccgccgccggcgagcttgagaaaagctcgtgcgattcaacacaggcgctcgttgcattttccgatgtggatcttatcctcgaagccagcgaggcagggcggcctccgggactggaaacatacggtttcccttctgtgacacttatcagctgccagcagcccggggctcctcgactcgaggggtcacattgcgtagaacctgagggtaatcattttgggaacccacagccgagtatggacggcgaattgctgttaagggcagaagggtctacccctgctggagggggactttctggaggcggagggttccaaccatccggcctagcattcgcctctcatgtgtag

SEQ ID NO: 192975 - DNA, 228 bp, Artificial Sequence
  Description of Artificial Sequence: Synthetic coding sequence
atgctgagcgccgactgcagcgagctgggcctgagcgccgtgcccggagatttggatcccttgaccgcctatctagccgttcccggcatggtggcagaaggcaaggcagacaggacgggcggggggggtagttcaaggccggagaagacccgcagatctctggaagaagccattgacaggactatcggcggtgcccaggaactgtgggctcccgaggtcagttcttag

SEQ ID NO: 192976 - DNA, 2487 bp, Artificial Sequence
  Description of Artificial Sequence: Synthetic coding sequence
atgcggctggagggcgagggccggagcgcccgggccggccagaacctgagcagggctgggagcgcaaggcgtggcgccccaagggatctttctatgaacaacctgactgaattacagccaggtctgtttcaccacttgagatttctcgaggagttgcgcctgagtggtaaccatctgtcacacattcccgggcaggctttcagcgggctttatagtctcaagattctgatgcttcaaaacaatcagctcggtgggattcccgccgaggccctctgggaactcccctctctccaaagcctggacctgaactataataagcttcaagaattcccagtcgccatccgaactctcgggagactacaagagctaggctttcacaacaacaacataaaagcaattcccgaaaaagcatttatgggaaatcctctccttcagacaatccatttctacgacaatccaattcagttcgtgggcagatccgctttccagtatctgccaaagttgcataccctgagcctaaacggggccatggacatccaggaattcccggatctcaaagggaccacaagcctggagatcctgacactgacacgggcaggcattaggctgctcccctcggggatgtgccagcagctgcccagactgagggtgcttgagctgagccataatcagattgaagagctgccgagcttgcaccggtgtcagaagctggaggaaattggcctgcaacataaccgtatatgggagataggcgccgacaccttcagtcagctgtcttcactgcaggcacttgacctgagctggaatgccattcgatccatacatcctgaggctttcagcacgctgcatagcctggtgaaactcgacctgaccgacaaccaactcactactctgcctttagccgggctgggcgggctgatgcaccttaagctgaagggaaatctcgccctgtcacaggccttctcaaaagactccttccctaaactgagaatacttgaagtgccgtatgcctaccagtgttgtccctatggcatgtgcgcgagttttttcaaagccagcggacagtgggaagccgaggatctgcatctggacgacgaagagagtagtaaacgcccactaggcctcctggcgcggcaggctgagaatcactacgaccaggaccttgacgaattacagctcgagatggaagattccaagccacaccctagtgttcagtgcagcccaacacccgggcccttcaaaccgtgcgagtatttattcgaatcatgggggattagactggctgtgtgggctattgtgctgcttagcgtcctgtgcaatggcttagttcttctcaccgtttttgctggaggccctgttccattgcctcccgtgaagttcgtcgttggcgcaatcgcaggggccaatacacttaccggcatcagttgcgggctattggccagcgtcgacgcactgacgttcggacaattttcagagtacggagcaaggtgggagaccggccttggatgccgagcaaccggatttctagctgtgcttggatcggaggctagtgtgcttctgctgacgttagctgcagtgcagtgttccgtaagtgtgtcatgtgtccgcgcttatggcaagtccccgagcttaggatccgttagggctggagtcctaggctgcttggccttagccgggctcgccgccgcattacccctggctagtgtaggagagtacggcgcttcaccattatgcctgccttacgctccgccagagggacaaccagcggcactgggcttcacagtcgcgcttgtcatgatgaacagtttttgtttcttggtggtagccggagcttacattaaattgtattgcgacctgccaaggggtgatttcgaggctgtgtgggactgcgctatggtgaggcatgtggcatggttgattttcgcggatggtctgctctattgccccgtggcgttcctgagcttcgcgtcaatgctggggttgtttcccgtcactccagaagcagtgaaatccgtgttactggtagtgctgcccctccctgcatgtctcaaccctctgctatacctcctgttcaatcctcactttcgtgatgacctgagaaggctgagacctcgggcaggcgactcagggccactcgcttacgccgcagccggtgagttggaaaaaagttcctgcgatagcacgcaggcattggtggctttcagcgacgtggaccttatcctcgaggctagtgaggccggaaggcctcccggacttgagacctatggcttcccaagtgtcacgctgatctcctgtcaacagcccggggctccaaggctcgaaggatctcattgtgttgaacccgaagggaaccattttggcaaccctcaaccctccatggacggagaactcctcctccgcgctgaaggctctactcctgctggaggtgggctatcaggtggtggggggtttcagccctccggcctggcctttgcctctcacgtttag

SEQ ID NO: 192977 - DNA, 6039 bp, Artificial Sequence
  Description of Artificial Sequence: Synthetic coding sequence
atggagaccctgaacggcgccggcgacaccggcggcaagcccagcactagagggggcgaccccgctgcccggtcacgaaggaccgaaggaatccgagctgcctacaggcgaggcgaccgcggtggcgcacgagatttgctcgaagaggcttgtgatcagtgtgcgtctcagctggagaagggtcagctgcttagcatccccgccgcctacggagatttggagatggttcgttatctcctttcaaaaaggctagtggagcttccaacagagcctacggacgataaccccgcagtggtggctgcttacttcggccacaccgcagtcgttcaggaactgctcgagccactgaccccaaaacagacagagtgggagcagaccgcacccttctcaggaaccttcccactttcttgtcatttactgcctggaccttgtagtccacaacgtttgttaaactggatgctcgccctagcgtgtcagcgaggccatttgggtgtggtcaaactcttggtgctgacccatggcgccgatcccgaatcctacgccgtccgcaagaacgagttccctgtgatagtgagacttccactgtacgccgccatcaaatcagggaatgaggatatcgccatcttcctacttcgacatggcgcttatttctgctcatacattttgctggactcgcccgatccatccaagcatctgctgaggaagtactttatagaggcaagtcccttaccctctagctacccagggaaaactgccttacgtgtaaagtggagccaccttcggctcccctgggtggacctggactggctgatcgacataagctgccagattactgaactggatcttagtgctaattgtctggcgaccctgccgtcagttatcccatgggggctgattaacctgcggaaattaaatctgtcagataaccatctcggcgaactcccaggagtacaatcctccgatgagatcatttgctcaaggctgctggagatcgacatctcttcgaataagttgagtcacctgcctcctggatttctccatctttccaaactccagaagctgactgcaagtaaaaactgccttgagaaactgtttgaagaggaaaatgccactaactggatcgggctgcgtaagctccaagaactggacatttccgataataagctgacggaactaccagccctttttctgcacagcttcaagagcctaaactccctgaatgtgagcagaaacaatttaaaagtcttcccggacccctgggcttgcccactgaaatgttgtaaggcttcaaggaacgccctggagtgtctgccagacaaaatggcagtcttctggaaaaaccatctgaaggacgtcgactttagtgagaacgccctgaaggaggttcctctcgggctcttccaattggatgcgctgatgttcttacgattgcagggaaatcagttagcggcgcttcccccacaggagaagtggacctgtaggcagttaaaaacgttagatctttcgcggaaccagctgggcaaaaatgaagatgggctgaagactaagcgaatcgcattcttcaccacacgcgggagacagcgcagcggtaccgaagccgccagtgtgctcgaatttcccgcctttctgtcagaaagccttgaggtgttatgcctgaatgataaccacctggataccgtaccaccatctgtctgtttgctcaaatcactttcagagctctatctcggtaataaccccggccttagagagctgccacccgagctaggtcaactcggcaatctctggcaactggatactgaggatctgacaatcagcaacgtccctgcagaaatccagaaagaaggtcccaaggcgatgctcagttatttgcgcgcccagctccggaaggcagaaaagtgtaaactcatgaaaatgattatagtgggcccacccaggcagggtaagagtactttactggagatcctccagacagggcgtgctccccaggtcgtgcacggggaagcaactatcaggaccactaaatgggaattacagcggccggctgggtcccgcgccaaagtagaatcagtggagttcaatgtttgggatataggtggccctgcaagtatggccaccgttaaccaatgcttcttcacggataaggcgctatacgtggtagtctggaatctggccctaggtgaagaagctgttgccaacctgcagttctggctgttgaacatagaagccaaagcgccaaacgccgtggtgctggtagtgggaacacacttggatttgatagaggcaaagtttcgggtggagcgtatcgctaccctgcgagcatatgtccttgcgctgtgcagatctccctccgggtcacgtgcgacaggttttccagatatcaccttcaagcacctccatgagataagctgcaagtccctggagggccaggaaggtttacggcagcttattttccatgtgacctgttctatgaaagacgtgggctcgactattggatgtcagagactagccggccgactgattccacgttcatatctgagcctacaggaagctgtgctagccgagcagcagcgcaggtcacgcgacgacgatgtgcaatacctgaccgacagacaactggagcaactcgtggaacagacacccgacaacgacatcaaggattacgaggacttgcagagcgccataagcttcctcatcgagactggaacacttctgcatttccccgatacttcccacggcctgcgaaatctttactttctggatccaatctggctgtccgaatgcctgcaacgcatctttaatattaaagggagccgatcagtggccaagaatggtgtgatacgtgccgaggacttgaggatgcttctggtggggaccggctttacacagcagaccgaggaacagtatttccaattcttggcaaaatttgaaattgccctccccgtggctaatgacagctatctcctaccgcacctgcttcctagcaagccaggtcttgacacccatggaatgaggcacccaacagccaacacaatacagcgcgtctttaaaatgagcttcgtgccggtgggcttctggcagagatttatcgcgcgtatgttgatttcactggctgagatggacttgcaactgttcgagaacaaaaaaaacaccaaaagccggaacaggaaggtgaccatctactccttcactggcaaccagcgcaaccggtgtagcacctttagagtgaagcgaaatcagacaatctactggcaggagggattgttggtgacattcgacgggggatacctgtctgtcgaatcctccgacgtcaactggaagaaaaagaaaagcggcggaatgaagattgtatgtcagagcgaagtgcgggatttttcggccatggccttcattactgaccacgtcaatagccttatagatcagtggtttcctgctctgacagccacagagagtgacggcacccctcttatggagcaatacgtgccatgccccgtgtgcgagacagcctgggctcagcacaccgatccttcagaaaaatcagaggatgttcagtacttcgacatggaagactgtgttctcaccgcaattgaacgcgactttatctcctgtccacgacacccagacctccctgttcccttacaggaactggtaccagagctgtttatgactgactttcctgcacggctgtttctcgagaattcaaagctagagcactccgaagatgaggggagtgtcctagggcaaggaggctccggcactgtcatttatcgggcgcggtatcagggacaacccgtcgctgtgaagagattccatattaaaaagttcaaaaattttgccaacgtccccgcagatacaatgctgcgacacctccgggcgactgacgctatgaaaaacttctctgagttcaggcaagaagctagcatgcttcacgcccttcagcatccttgcatcgtggcccttatcggaatttctattcaccccctctgctttgcactcgagcttgccccactatccagccttaatactgtgctctctgagaatgctagagattccagctttatccctcttggacacatgctgacacagaaaatcgcataccaaattgcgagcggcttggcatatttgcacaagaagaacatcatattttgtgatctgaaaagtgataatatcctggtctggagccttgatgtgaaggagcatattaatatcaaattgtctgactacggcatttcccggcagagtttccacgagggcgccttaggagttgaggggaccccgggatatcaggcccctgagatccgtcctagaattgtgtacgacgaaaaagtggatatgtttagttacggcatggttttatatgaattgctgtcaggccagcgtccggcacttgggcaccaccagctgcagattgccaaaaaactctccaagggcatcagacccgtgcttgggcagcccgaagaagtgcagttccggcgcctgcaagcactcatgatggaatgttgggatacaaaaccagaaaagaggcctctggctctcagcgtggtttcacagatgaaggaccctacatttgctaccttcatgtatgagttatgttgcggaaagcaaaccgccttcttctcctcccagggccaggagtataccgtggtgttctgggatgggaaagaagagagccgcaactataccgtggtcaacaccgagaagggactgatggaggtgcaacgcatgtgctgtcctggaatgaaggtgagttgccaactgcaagtccagcggtccctctggactgccacggaggatcagaagatttacatttatactctcaaaggcatgtgccccctcaataccccccaacaagccctcgacacccccgccgtagtaacttgctttctggcagttccggttattaaaaagaatagctatctggtgctggccggcctcgctgatgggctggtggcggtgttccccgtcgtccgagggacacccaaagattcttgctcctacctgtgtagccacacggctaaccgctcaaaattctccattgccgatgaagatgcacgacagaacccataccctgtgaaagccatggaagtagtgaatagtggcagcgaagtttggtacagcaatggtcccggactgctggttatagactgtgcctctttggaaatttgtcggcgactagaaccctatatggcgccaagcatggtaactagcgtggtgtgttcatcagagggcagaggcgaagaggttgtttggtgtctcgacgataaagccaattcgctggttatgtaccactcaacgacctatcaactttgcgcgagatacttttgtggcgttcccagccctctccgtgacatgtttcctgtaagacctctggatacagagcctcccgccgcatctcataccgccaatcccaaggttcctgagggcgattcaattgccgatgtctccatcatgtatagtgaggagttgggcactcagatactgatacatcaggagagtctaactgattactgcagcatgtctagctactcatcttctccaccccggcaggccgcccgcagcccttcttcactcccatcaagccctgctagttcatcgtccgtccccttcagcacggactgcgaggactcagacatgctacatacacctggcgccgcaagtgacagaagcgagcatgatctgaccccaatggacggggagacgttcagccagcacctgcaagccgtgaaaattcttgcagtgagagatttgatctgggtcccgaggaggggtggagacgtcatcgtgattggactagagaaagatagcggagctcagcgtggtcgggtgatcgccgtgctgaaggctcgcgagctcaccccccacggagtgctggtggacgctgccgtagttgccaaagatacagttgtctgtactttcgaaaacgaaaacacagagtggtgcctagccgtttggaggggctggggcgcccgcgaatttgacatcttctaccagtcctacgaagaactgggaaggttggaggcctgcacgaggaagcgcagatag

SEQ ID NO: 192978 - DNA, 6048 bp, Artificial Sequence
  Description of Artificial Sequence: Synthetic coding sequence
atggccggcatgagccagcggccccccagcatgtactggtgcgtggggccagaagaaagcgcagtgtgccctgaacgggctatggagaccttgaatggcgctggggacactggtggcaagccaagtacacggggaggcgaccccgccgcccgcagtaggcggactgaaggaatcagagccgcgtacaggcgcggcgaccgcggcggtgcgagggatctcttggaggaggcttgtgaccaatgtgctagtcagcttgagaaggggcagctgttgtccattccagccgcatatggggatctagaaatggttaggtacctactaagtaagcgcctcgtggaattaccgactgaacctactgatgataaccccgctgttgtggccgcttattttggccacaccgcagtggttcaggagttgttggagagcctccctggcccttgctctccgcaacgattgctaaactggatgctggccctggcttgccagcgcggacatctgggcgttgtgaagctgctcgtgctgacacatggcgctgatcccgaaagttacgctgtgaggaagaatgaatttcccgtaatagtacgactcccactgtatgccgctattaaatcaggtaacgaagatatcgctatcttcctcctacgacatggcgcttacttctgctcatacatccttctcgatagccctgatcccagcaagcacctgttgcgaaagtacttcattgaggcatcgccactaccctcgtcctatcccgggaaaacagccctcagagtcaagtggagtcacctgagattgccatgggtggatctcgattggctgatcgacatctcctgtcagataacagaattagacctctctgccaattgtttagctacattgccctccgtgataccctgggggctgatcaatcttaggaagctgaatctgtctgacaatcacctgggggaactgccaggcgtccagagttctgatgagattatttgttcccgcctgctggagattgacatctctagtaataaactgtcacatctccctcctggtttcttacatctctccaaactgcaaaaattgaccgcctcaaagaactgcctcgagaagttatttgaggaggagaacgcaactaactggatcggccttaggaaactacaggagctggatatctccgacaataaacttacagagctgcctgctctcttcctgcattctttcaagtccctgaattcgttgaacgtgtcacggaacaatctcaaagtgtttccagatccctgggcatgtcctctgaaatgctgtaaggcttcgcgcaacgccttagagtgtctgccagataaaatggcagtgttctggaaaaatcacttgaaggatgtcgatttctccgagaacgctctcaaggaggtacctctggggctctttcagcttgacgctctgatgtttctacgtctgcagggcaaccaattagccgccctacccccccaggagaaatggacttgccgacagctgaaaacgttggacctgagcaggaatcagttggggaaaaacgaagacggattgaagacaaagaggattgccttcttcacgacaagagggcgtcagcgcagcggcacagaggcagcctcagtgctggaattccctgcatttctgtccgagtccttggaagtgctttgcctgaacgataaccatttggacacagtcccccccagcgtctgtctgctgaaatcactgtcagagttatacttgggcaataacccggggctgagagagctaccccccgaactggggcagttggggaacttgtggcagttagataccgaagacctgacaattagcaacgtaccagcagagattcaaaaagagggaccaaaggcaatgctgtcctacttgagggcacagttgcggaaagcagaaaagtgtaagcttatgaagatgataattgttggtcctccacgacaaggaaagtcaaccctgctagaaatcctgcagactggacgagcacctcaggtggtgcacggggaggctactatcaggacaactaagtgggaattacagaggccagctggatcacgcgcgaaggtagagtccgtcgagttcaacgtatgggatataggagggcctgcgtccatggccacagtgaaccaatgcttcttcacggacaaggcgctgtacgttgtggtgtggaatctggccctgggcgaggaagcggttgcaaatctccagttctggcttctgaacatcgaggctaaggcccccaacgccgtggtgctcgtcgtgggcactcatctggaccttatcgaggctaaattccgggtggaacgtatcgcaacattacgtgcatatgtgcttgccctctgtagatcaccttccgggagcagagctacagggttcccagacattacctttaaacaccttcacgagataagttgcaagtctctcgagggacaggaagggcttcggcagctcatctttcatgtcacctgttccatgaaagatgtgggctctaccatcggatgtcagcgtcttgcaggcagacttatcccaaggtcctacctctctctgcaggaggccgtgctcgcagagcaacaaagacgtagtagagatgatgacgtgcagtatcttacggataggcagctggagcagctcgtcgagcagacccccgacaatgacatcaaggattacgaggatcttcagtctgctatctccttcctaatagagaccggaacgctcctacacttcccagatacctctcacggtctgcgaaacctctactttctggatccaatatggttgtcagaatgcctccaacgaatttttaatattaaaggcagtcgctcagtggccaaaaacggtgtcattcgtgccgaagacctgcgaatgctcctcgttgggaccgggttcacacaacaaactgaggagcagtacttccagttcctggctaaattcgaaatagcactcccggttgctaatgactcctacttgcttccccacctgctcccctctaaaccagggttggacacacacggaatgcgccatccaaccgccaacacgatacagagggttttcaagatgtcgttcgtgcctgtaggcttctggcaacggttcattgccagaatgttgattagcctggccgaaatggacctacaactgttcgaaaacaaaaagaacactaagagcagaaatcgaaaagttactatttatagcttcacaggaaatcagagaaacaggtgttccacttttcgcgtcaagagaaaccagaccatttactggcaggaaggactgttggtcacttttgacggcgggtaccttagtgtggagtcctcagatgttaactggaaaaagaagaaatcgggcggcatgaaaatagtatgtcaaagtgaggtcagagatttctctgccatggcctttattaccgaccacgtgaactcactgatagatcaatggtttccagctttgacagccaccgagtccgacggcactcccctgatggaacaatacgtgccctgcccagtctgtgagacagcatgggcacaacacaccgacccaagcgaaaagagtgaagatgtgcagtatttcgatatggaagattgcgtacttactgctatcgagagggacttcatttcttgtcctagacatccagacctacccgtgcccctgcaagaattggtgccagagctgtttatgacagattttcctgccaggctgtttctggagaattcaaagctggaacatagcgaagatgaggggagcgtcctcggtcaggggggctccggaacggtcatttaccgagcccgataccagggacagccagtcgccgtcaagcgtttccacatcaagaagttcaagaactttgccaacgtgccggccgataccatgctgcgccacctgcgggccactgatgcgatgaagaatttttccgagtttcgacaggaagcatccatgctccacgccctgcagcatccttgtatcgtggcactaataggaatttctattcatccgctgtgcttcgccctggagctggctcccttaagctcactcaacaccgtgttaagtgaaaatgctcgagatagttcttttatacccctaggacacatgctcacacaaaagattgcataccagatcgcgtcaggcctcgcctacttgcataaaaaaaacatcatattttgtgacctgaagagcgacaacatcctggtgtggagcttagatgtgaaagaacacatcaatattaaactcagtgactatggaatttctcgccagagttttcatgaaggggcactgggagtggagggaacccccgggtaccaggccccagagatacggccacggatcgtttatgatgaaaaagtggatatgttctcgtacggaatggttctgtacgaactcctgagcggacagagacctgctctcggccaccatcaactgcagattgcaaaaaaactgtccaagggcatccgacccgttctcgggcagcccgaagaggtgcagtttcgtcgcctccaggccttgatgatggaatgctgggatacaaaacctgagaaaaggccgttagccctaagcgttgtttctcagatgaaagatcccacctttgccaccttcatgtacgagctgtgctgtgggaagcagacagctttcttttcttctcaaggacaggagtacacagtagtgttctgggatgggaaggaggagagccgaaactacactgtggtaaacacagaaaagggtctgatggaggtacaaagaatgtgctgccctggaatgaaagtatcctgccagctgcaggtacaacggtccttgtggactgccacagaagatcagaagatttatatttataccttgaaaggaatgtgcccactgaacacgccgcagcaggccctagacacacccgctgtggttacctgcttcctagctgtccccgtgatcaaaaagaatagctacctcgtactcgcagggttagcagacggattagtagcggtctttccggtcgttcgaggcacccccaaagacagctgctcttatttatgctctcacaccgcaaataggtcaaagtttagtattgctgatgaggatgcgcggcagaacccgtatcctgtcaaggcaatggaagtggtgaactcaggcagtgaggtctggtattctaacggtcccggtcttctcgtcatcgactgtgccagcctggaaatctgccggcgactcgagccatacatggcgcctagtatggttacctctgtggtctgttcctcagaaggtcgcggggaagaagtggtttggtgtcttgacgataaggcgaattccctggtgatgtaccacagcactacgtatcagttatgtgcgaggtacttttgcggggtaccctctcctctgagagacatgttccctgtaaggcccttagacacagaacctcccgccgcatctcataccgcgaatcccaaagtgcctgaaggagactccatcgcagacgtatctattatgtattccgaggagttaggcacacagatcctcatccatcaggagagcctgaccgactactgttctatgtcttcctattctagctctccccccaggcaggctgcgaggagcccttcgagtcttccttctagtcccgcttctagctcctcagtacctttttcaacggactgcgaggactcagatatgctccacaccccaggtgccgcctccgaccggtccgagcacgaccttacccctatggatggcgagacatttagccagcaccttcaggccgtgaagatcctggccgtccgcgacctcatctgggtgccacgtcgaggaggcgacgtcatagtgattggattggaaaaggacagcggagcacagcgcgggcgggtgattgccgtgttgaaagcccgggaactcacacctcacggcgtgctagtcgatgccgccgtggtggcaaaggataccgtggtctgtacgttcgagaatgagaatacagagtggtgcttagctgtttggcggggatggggtgcccgggagttcgatatcttctatcaaagctacgaagagcttggtcgtttagaggcgtgcacacgaaagagacgttag

SEQ ID NO: 192979 - DNA, 2025 bp, Artificial Sequence
  Description of Artificial Sequence: Synthetic coding sequence
atgctgcacgccctgcagcacccctgcatcgtggccctgatcggcatctcaatacatccattgtgcttcgctttggaactagcccctctctcgtctctaaacactgttctgagtgaaaatgctcgggattcatctttcatccctctgggccacatgctcactcagaaaatagcttaccagatcgcgtctggcctggcataccttcataaaaaaaacattatcttttgtgatctaaagtctgacaacatcctggtttggtccctggacgtgaaggaacatattaacattaagctttcagactatgggatctcgaggcagagctttcatgaaggagccttaggcgtcgagggtacgcctggataccaggctcccgagattcgtccacgaatagtctatgacgagaaggttgatatgttttcctatggcatggtgctttatgagctgctctccggccaacggccagctttgggccatcaccagctgcagatcgccaagaagctcagtaaagggattcgccctgtcttagggcagcctgaagaggtgcaattcaggcggttgcaggcgctcatgatggagtgctgggacaccaagccagagaagcgccctctcgctctctctgtagtgagtcaaatgaaggatcccactttcgctaccttcatgtatgagctttgctgcggcaagcagactgctttcttttcaagccagggccaggagtatacagtggtcttctgggacggaaaggaagagtccagaaactacactgtggtgaataccgaaaaaggcctgatggaggtacagagaatgtgttgcccaggcatgaaggtgagttgtcagctgcaggtacagcggtccctgtggactgcaaccgaagaccagaagatatacatctataccctcaagggcatgtgcccactgaacaccccccagcaggccctggacacccccgccgtcgtgacttgcttccttgcagtgccagtaatcaagaagaactcctatttagtgttagcggggttggccgacggattagtggccgtctttcctgtcgtccggggcaccccgaaggatagttgctcatatctgtgcagccacaccgctaatcgctctaaattttcaatcgccgacgaggatgccagacaaaacccgtatcccgtgaaggcaatggaggttgtcaactccggatccgaagtgtggtacagcaacggcccaggactcctcgtaatcgattgtgcaagtttggagatttgccggcgtctagagccttatatggcgcccagcatggtgacttccgtggtctgcagttctgaggggagaggagaagaagttgtgtggtgcctggacgataaagctaacagcttggttatgtatcattcaaccacatatcagctctgtgcaagatacttttgtggtgtgccgagtcctcttagagatatgttccccgtacgccccctggatacagagcctcccgccgccagccatactgcaaatcctaaagtgcccgagggcgactcaatcgctgacgtcagtataatgtactccgaggagctgggaactcagatacttatccaccaggagtcactgacggactactgctcgatgtcatcatatagctccagccctcctcgccaagcggctagatcgcctagcagtctgcctagttccccagcctcatcctccagcgtaccttttagcactgattgcgaagactccgatatgctgcacacccccggcgccgcatccgataggagcgaacacgacctgacacccatggatggcgagaccttcagccagcacctccaggccgttaagatcctcgcggtgcgcgacctgatttgggtgccgcgccgaggcggcgatgttatcgtgatcggcctggaaaaggactccggcgctcaacggggcagagttatcgcggttcttaaggcaagagagctcactccacacggtattatgccagttagtagcgtcaaagtttgttgggcggggtggcctgtaagagacatggtgtatatggtcgccgtcatgtag

SEQ ID NO: 192980 - DNA, 99 bp, Artificial Sequence
  Description of Artificial Sequence: Synthetic coding sequence
atggccggcatgagccagcggccccccagcatgtactggtgcgtgggacctgaggaatcagccgtctgtcccgaaagggctatggaaacgctgaactag

SEQ ID NO: 192981 - DNA, 1506 bp, Artificial Sequence
  Description of Artificial Sequence: Synthetic coding sequence
atgttcagctacggcatggtgctgtacgagctgctgagcggccagcggcccgccttaggtcatcatcagctccaaattgccaagaaactgtcaaaagggattcggccggtgcttggccagcctgaagaagtgcaattcaggaggctgcaggcattaatgatggagtgctgggacactaaaccagagaagagacccctggctttgagcgtcgttagccagatgaaggaccccacgttcgctacctttatgtacgaactttgctgtggaaagcaaactgccttcttcagtagccaggggcaggaatatacagttgtgttctgggatgggaaggaagagtccagaaactacacagtagtaaacaccgagaaaggcttaatggaggtccagagaatgtgctgtccaggtatgaaggttagctgtcagcttcaggtccagcgtagcctgtggactgccactgaagatcaaaaaatatatatatatacgctcaagggtatgtgcccccttaacaccccacagcaggccctcgacacccctgctgtcgtcacatgttttttggccgtccctgttattaagaagaattcgtatcttgtgctggccgggctagccgatggtctggtggcagtttttccggtcgtgcggggcacgccaaaagatagctgttcatacctatgttcccacacagccaataggtcaaaattttctatcgctgatgaagacgccagacagaacccctaccccgtcaaagctatggaagtggtgaacagcggctctgaagtttggtattctaacggacctgggctgctggtgatcgactgcgcttctctcgaaatctgccgccgcttggaaccctacatggccccctcaatggtcacttccgtcgtgtgctctagtgaagggaggggtgaagaggtagtatggtgcttggatgataaggctaactcccttgtgatgtaccatagcaccacgtaccagctctgcgctcgatatttttgtggtgtcccctcccctctgcgtgacatgtttcctgtccgaccactggacaccgaaccccccgctgcctctcatactgcaaaccctaaggtgccagaaggagacagcatcgctgacgtctctatcatgtattccgaagagttgggcactcaaatcctgatacaccaggagagcctgacagattattgttccatgtcttcatatagctcatccccaccgaggcaggctgcccgatcaccttcttctctgcctagttccccagcttccagctcatctgtccccttcagtactgactgtgaggactctgatatgctccacacacccggggccgcctctgatcggagcgaacatgatttaacaccgatggacggcgagacattttctcagcatctccaggcagtgaaaattctcgcggttcgagacttgatctgggtccctaggcgtgttgagatgctgtcttccctggcttggcggcggattcttgccccgtccggtgctgaatcccttcctagttag

SEQ ID NO: 192982 - DNA, 7584 bp, Artificial Sequence
  Description of Artificial Sequence: Synthetic coding sequence
atggccagcggcagctgccagggctgcgaggaggacgaggagaccctgaagaaacttattgttagattaaataacgtacaagaggggaaacagatcgagaccctggtgcagatcctggaagatttgctcgtgttcacttattcagaaagggcctcaaaactcttccaaggcaaaaatatacatgtacctctccttattgtcctggactcgtatatgcgggtcgccagtgtacagcaggtagggtggagtttgctgtgcaagctgatcgaggtctgccccggcacaatgcaatcccttatgggaccccaggatgtcggcaacgactgggaagtcttaggagtgcaccagctgattctgaaaatgctcactgttcataacgcgagcgtgaatttgagcgtcatcggcttaaagacccttgacctgctcctcaccagtgggaaaattactctactgattcttgatgaggagtcagacattttcatgttaatcttcgatgcaatgcattcatttcccgctaacgacgaggttcagaaactcggatgcaaagccttgcatgtgcttttcgagcgcgtgagcgaagaacagctgacagagtttgttgagaataaggattacatgatcctactatcggcactcactaacttcaaggatgaagaagaaatcgtgctgcacgtgctgcactgtcttcattccctggctatcccatgcaataacgtggaggtcctaatgagcgggaacgtgcgatgctacaacatcgttgtggaggctatgaaagccttccccatgagcgagagaatccaggaagtttcatgttgcctgctgcatcggctcaccttagggaacttcttcaatatcctggtgctgaatgaagtgcacgagttcgtggtaaaggccgtgcaacagtaccccgagaacgcagctctccagatatctgccttgagttgcctcgctctcctcaccgaaaccatctttctgaaccaggatctggaggaaaaaaacgaaaatcaggaaaacgatgacgaaggcgaagaagataagcttttctggctggaggcttgttacaaagcactgacatggcaccgaaaaaacaagcacgtgcaggaagctgcctgttgggcactgaacaatctgctgatgtatcagaactccctccacgagaaaatcggcgatgaggacgggcacttcccagcgcacagagaggttatgctgtctatgctaatgcacagttcttctaaagaggttttccaggcttcagccaatgcgctgtcaacacttctcgagcagaatgtgaatttccggaaaattctgctctccaagggcattcatctcaatgtcttagagctcatgcagaagcacatccatagccctgaggtggctgagagtggatgcaagatgctgaaccacctgtttgagggttccaatacatcactcgatattatggctgccgtggtcccgaagatcctgactgtgatgaaaagacatgagaccagtttacccgtgcaacttgaggccctgagagccatcctgcatttcattgtcccagggatgcctgaagaatcacgggaggatacggaattccatcacaaactaaatatggtaaagaagcagtgtttcaagaacgacatccacaaactggtactggccgcgttaaatcgttttattggaaatcctggcattcagaagtgcggcctgaaagtcattagcagtatcgtgcacttcccagacgccctcgagatgctgtcccttgagggcgccatggactcagtcctccacaccctgcagatgtatcctgacgaccaagagatccagtgcctcggactgtctctgatcggctacctgatcacgaagaagaatgtgtttattgggactggccacctgctggcaaaaattttagtttcatccctatacaggtttaaggatgtcgctgaaatccagacaaagggttttcaaaccatcttggccatcctgaaattgtctgcctccttctcgaagctccttgtgcaccactccttcgatctcgttatttttcaccaaatgtcaagcaacattatggagcaaaaggaccagcagttcctgaacctctgctgcaaatgctttgctaaagttgcaatggacgattacctgaagaacgtcatgttggagcgggcctgcgatcagaacaactccatcatggtggaatgcctgttgctgctgggagccgatgcgaatcaggccaaggaggggtcctccctcatatgccaggtgtgtgaaaaggagtcgagccctaagctggttgaacttctacttaacagcggctcaagagagcaggatgtaagaaaagccctgaccatctccattggtaagggagatagccagattatttcccttttgctgcgtcgattggctctggacgtagcaaacaattcgatctgtctgggcggattttgtatcgggaaggtggaaccgtcttggcttgggcccctgttccctgataagacttcaaacctgcggaagcagacgaatattgcgtccactcttgcacgcatggttattaggtaccagatgaagtcagctgtcgaagaaggcactgccagtggttcagacgggaacttctccgaggacgtccttagtaaatttgatgaatggactttcattcccgactctagcatggacagtgttttcgcacaaagcgacgacttggactccgagggaagcgaaggaagtttccttgtgaaaaagaagtccaatagtatcagtgtaggtgaattctatcgggatgccgtacttcagagatgcagtcccaatcttcaacgacactccaactcccttggcccaattttcgaccacgaggacctgctgaaacgtaagaggaaaatcctatcttctgatgactctctgcgctcttctaagctgcaaagccatatgcgacactctgacagtatctcctcgttggcttctgagagagaatacataacgagcctggatttatcggccaacgagttgcgggacatagacgccctgagccagaaatgctgcatatccgtgcatcttgagcacttagagaagctggaactccaccagaacgccctcacttcctttccgcagcagctgtgcgaaactctaaaaagcctcacgcacctggatctgcattctaacaaattcacaagctttccctcctatctgctgaaaatgtcctgcatcgcgaatctggacgttagccggaatgatatcggaccatctgtagttctcgaccccacagttaaatgccccacactgaaacagttcaacctgtcttacaatcagttgtcttttgtgccagaaaatctgactgatgtggtggaaaaactggagcagctcatcttagaaggcaacaaaatcagcggcatctgttctcctctgcgcctgaaagagttgaaaattctcaatctgagtaagaatcacatttcatccctatcagaaaatttcctggaagcctgccccaaagtggagtccttctctgcacggatgaactttctcgcagcaatgcccttcctgcccccctccatgactatactgaagctgtctcaaaacaaattttcatgcatccccgaggcaatcttgaatctgcctcatcttcgatccctggatatgagctctaatgacatacaatacctgcctggcccagcccactggaagtctttaaatctgcgggaattactattttcacataaccagatcagcatcctagacctttctgaaaaggcctatttatggagtcgggtcgagaagctgcacctgtcacacaacaagctgaaggaaatccccccagagatcggatgcctcgaaaaccttacctctctagacgtctcctataacctcgagctgcggagcttcccgaacgaaatgggcaagttatccaaaatttgggacttgcctctggacgaattacatttgaattttgattttaaacatattggctgcaaagcaaaagatatcattagatttctgcagcagagactcaaaaaggccgtcccatataatcgcatgaaactgatgattgtcgggaacacgggatcagggaagaccacactgctgcagcaacttatgaagacaaagaaatctgacctgggcatgcaaagcgcaaccgtggggattgacgtgaaagattggcccatccagattcgggacaagagaaagcgagatctggtgctgaatgtttgggacttcgcgggtcgcgaggaattttactctactcacccacattttatgactcagagagccttgtacttggccgtctacgacctatctaagggtcaagctgaagtggacgccatgaaaccatggctcttcaacatcaaagcacgggccagttcctcccctgtcatcctggtgggcacacatttagatgtttccgacgaaaaacaaagaaaggcctgcatgtcgaaaatcactaaggaattattgaataagagaggctttcccgctatcagagactatcacttcgtaaacgccacagaggagtccgacgccctggccaagttaaggaagaccataataaacgaatcactgaatttcaaaatccgtgaccagctggtggtggggcaattgattcctgactgttacgtcgaactggagaaaattattctgtcagagaggaaaaatgtgcccatcgaatttcctgtaatcgataggaaaagattactgcaacttgtgcgcgaaaaccagcttcagctcgacgagaacgaattaccacacgctgtccatttcctgaacgagtctggtgtcttgctgcattttcaggatcccgccttgcagctctcagacctgtattttgtggagcccaagtggttgtgcaagatcatggctcagatcctgaccgtgaaagtggagggatgcccaaagcacccgaaaggcataatttctcgccgggatgtcgagaagttcctaagtaagaaacggaagttccccaaaaactatatgagccagtattttaagctgctcgagaaatttcagattgccctgcccatcggcgaggagtacttgctggtgccttcatccctgagcgaccaccgtcccgtgatagagcttcctcactgcgagaattccgagattattattcgtctctatgaaatgccatattttcccatgggcttctggtctaggctgatcaatcggctgctagaaatctccccctatatgctgtctggaagggagcgggcgctgagacctaatcggatgtactggcgccaaggaatatatctgaattggagccctgaggcttactgtctcgtgggcagcgaggtcctagataatcaccccgaatcttttctcaaaattaccgtgccgtcctgtcgcaagggctgtattctgctggggcaggtggtagatcacattgacagcctgatggaggaatggttccctgggctgctggagattgatatctgtggagaaggcgagaccctacttaagaagtgggctctctattcatttaatgacggagaggaacatcagaagattcttcttgatgacctaatgaagaaagcagaggagggcgatctgctcgtgaatcctgaccagcctagattgacaattccaattagccagattgctccagaccttattctggctgacttaccaaggaatattatgttgaacaatgatgagctcgaattcgagcaagcccctgagttccttttgggagatggttcattcggcagcgtatatagggccgcatacgaaggagaggaagtcgctgtcaaaatatttaacaagcacacctcattgaggttgcttcgacaagaattagtcgtgctttgtcacctgcatcacccaagcttaatttcgctgcttgccgcggggatacggccacgaatgctggtcatggagctggccagtaagggctcattggatagacttctgcaacaggataaagcaagccttaccagaactcttcaacaccggatcgccctgcacgttgccgacgggttaagatatcttcacagtgcaatgattatttacagagatcttaagccacataacgtcctgctttttaccctgtatcccaacgctgcgatcatcgctaaaattgcagactatggcatcgcccagtactgctgtcggatgggaattaagacctcggaggggacccctggttttcgggcccccgaggtcgcacgaggaaatgtgatctataaccagcaagctgatgtttactctttcggcttgctcttgtatgatatcttgacaactggcggccgaattgtggaaggactcaaatttccaaacgagtttgatgagctcgagattcaggggaaactgcctgaccctgttaaggagtacgggtgcgcgccctggcccatggtcgagaaactcattaagcagtgtcttaaggagaaccctcaagagcgtcctacctccgctcaggtcttcgatattctgaattcggcggaattggtctgtctgaccagacgaatccttctgcccaagaatgtgatagtagaatgtatggttgctacacaccacaattcccggaatgcctctatatggctggggtgtggtcacacagatcgcggccaactttccttccttgatcttaacaccgagggatatacttctgaagaagtcgcggattccagaatcctttgcctcgccctggtacacctcccggtagagaaggagtcttggatcgtcagcggaacccagtcgggcactctgctggtaattaacactgaagacggcaaaaaacgccataccctggagaaaatgacggactccgtgacctgcctctattgcaacagcttcagcaagcagtctaagcagaaaaacttcttgctggtgggaaccgccgacggaaaactcgcgatcttcgaggataagaccgtcaaattaaagggcgccgcccctttgaagattctgaacattggcaatgtttccactcccctgatgtgcctgtccgaaagcaccaacagcactgagaggaacgtaatgtgggggggttgcggtactaagatcttttccttttctaatgatttcaccatccagaaacttatagaaacgaggacgagccagcttttctcttacgcagcatttagcgatagtaacatcataacagttgtagtcgacacagctctgtatattgcaaagcagaattctcctgtggtagaggtttgggataagaaaacggagaaactgtgcggcttaatcgattgtgtgcattttctgcgagaggtgatggtcaaagaaaataaagagtctaaacataaaatgtcatattctggcagggtgaagacactttgtttgcagaagaacacggcgctatggattgggacaggcggaggacacatcctgctgctggacctgagcacccgccgcttgattcgggtgatatacaatttctgtaacagcgtcagggtcatgatgaccgcccaactggggtctctgaagaatgtgatgctggtgcttggctataatcggaaaaataccgagggcactcagaagcaaaaagagattcaatcttgtctgacggtctgggacattaatctacctcacgaggtgcagaacttggagaagcacatcgaagtacgcaaggagctagcggagaaaatgcggcgaacaagcgttgagtag

SEQ ID NO: 192983 - DNA, 582 bp, Artificial Sequence
  Description of Artificial Sequence: Synthetic coding sequence
atgaccagcagctgcttccggagcaccacccggcggagcctgagctctcagacggctcagcgactggtgtgtcctcagtttataaacggaactgccaaggattctattctgacctcacgttctcaggtccccatcatactgcagtggaacaaatctagcaagaagtttgtccctcatggtgacattcctaacatggaagacgtgttagcagttaagtccttccgaatgcagaatacattgtacctgtctctgaccagattcataggcgactctagggtcatgagatggaactccaagcagttcgtcgaaatccaggctttgcctagccgcggggcaatgaccctgcagcccttttctttcaaggacaaccactacttggccctgggaagtgattatacattttcccagatttaccagtgggataaggaaaagcagcttttcaaaaagttcaaggaaatttatgtacaggctccgagaagctttaccgccgtgtccacggatcgccgagactttttctttgccagttcctttaaggggaaaactaagatcttcgagcatatcatcgtggatttatcattgtag

SEQ ID NO: 192984 - DNA, 1638 bp, Artificial Sequence
  Description of Artificial Sequence: Synthetic coding sequence
atggccctgcggcggggcggctgcggcgccctgggcctgctgctgctactccttggggcagcgtgtctgattccgcgctccgctcaggtgaggcgtctggccaggtgccccgcaacctgctcttgtaccaaggagagtatcatttgtgtcggtagcagctgggtacctaggattgtgcctggagatattagttctctgtcgctggtgaacggtaccttcagcgagattaaagataggatgttcagccatttgcccagtctgcagctcctcttgctgaatagtaactctttcactatcatcagggacgatgcctttgctggcctgtttcacctggagtacttgtttatagagggaaataagattgaaaccatatccagaaacgcttttaggggcctgagggatctgacccacctgtctctcgctaataatcacattaaggccctgccaagggacgtattctcagatttagacagtctgatcgagctggatctgcgtggcaacaaatttgaatgtgattgcaaagctaaatggctgtacctgtggctcaagatgactaactccaccgtgtccgacgtgctttgtattggccccccagaataccaggagaagaaactgaatgatgtgaccagttttgactatgaatgcaccacgacagattttgtagtgcatcagacgttaccctatcaatcagtcagtgtggacactttcaattctaagaatgatgtatacgtggctattgctcaaccatccatggagaattgcatggtgctcgagtgggaccacatagaaatgaattttcgatcatacgacaatatcaccgggcagagcattgtggggtgcaaggccattctgattgatgaccaggtctttgtcgttgtggcccagctttttgggggctctcacatctataagtatgatgaaagttggaccaagtttgtgaagtttcaggatatcgaggtgtcccgcatttccaagccgaatgatattgaactctttcaaatcgatgacgagaccttcttcgtcattgccgatagcagtaaagctgggctctcaactgtgtacaaatggaattccaaggggttctattcctaccaatctctgcacgagtggtttcgggacaccgacgccgaattcgtggacattgatgggaaatcccatctgattctcagcagccggtcccaggtgcctataatactgcagtggaacaagtcatcaaaaaaattcgtgccacacggtgacatcccaaacatggaagatgtgttggccgtcaagagctttagaatgcaaaacacactgtacctctcactgacacggtttattggtgactcgcgggtgatgcgctggaacagcaaacaatttgtagagatccaagcattgccctccaggggagcaatgactctgcagcctttttcgttcaaggacaaccactatctagcgctggggtctgattacacattttcccagatctatcagtgggacaaagagaaacagttattcaaaaaattcaaagagatttatgttcaggccccaaggagctttacagccgtttccacggacaggcgagatttttttttcgcgtcctcatttaaaggaaaaacaaagattttcgagcacatcatcgtggatctcagtctatag

SEQ ID NO: 192985 - DNA, 1647 bp, Artificial Sequence
  Description of Artificial Sequence: Synthetic coding sequence
atggccggcctgcgggcccggggcggccccggccccggcctgctggcgctctccgcacttggcttctgcctgatgttgcaggtaagcgccaagcgcccaccaaaaacacccccatgtccaccttcgtgcagctgtactcgcgacactgcattctgtgtcgatagcaaagctgttccacgtaatcttccctccgaagttatttccctgacgctggtgaacgcagccttctctgagatccaggacggtgccttctcgcatctccctctgcttcaattcttactcctgaatagtaacaaattcactctgatcggagacaatgcttttaccggactgagtcatctgcaatatctcttcattgagaataacgatatctgggctttatctaagttcacatttcggggactgaagtccttgacccacctgagtctggccaataataacctgcagactctcccccgcgatattttccgccccctcgatattttaaatgacttagacctgcgcgggaattcactcaactgtgactgcaaggttaagtggttagtggagtggcttgcccatacaaatacaactgttgcgccaatttattgcgctagcccaccacgattccaggagcataaagttcaggatctgccactcagggagtttgattgtatcacgaccgatttcgtgttgtatcagactctggcattccctgcagtctcagccgaacctttcctatactccagcgatctttacctcgctctcgcgcaacccggcgtcagcgcatgcactatactcaaatgggactacgtcgagcgtcagctaagggattatgatcgtatccccgcacccagtgctgtgcactgcaagccaatggttgtagattcccaactgtacgtggttgtggcccagttattcggaggctcctacatttaccattgggatccaaacacaacaagattcaccagactacaagacatcgacccgcagcgtgtgcggaaaccaaacgacctggaggctttccggatcgacggcgactggtattttgctgtagcggacagttcaaaagctggggccacaagtctttaccgctggcatcagaacggattctactctcaccaggcactgcacccatggcaccgcgatactgacctcgagttcgtggatggtgaaggcaagccacgcttgattgtcagctccagctcccaagctcctgtcatctaccaatggtcgagaacccagaaacagttcgtcgcccagggcgaggttacccaggtccctgatgcgcaggccgtgaagcactttagggctggcagagactcatatctgtgcctgtcacgttatatcggcgatagtaagatccttcgatgggaaggcaccagatttagcgaagtgcaggccctgccgtcaagaggatcactggctctgcagccatttctcgtgggagggcggaggtacctggcactgggctctgacttcagttttacacagatctaccagtgggatgaaggcaggcagaagttcgttcggttccaagaactcgccgtccaggcgccacgagctttctgctatatgcctgccggggacgctcagcttttgttggctcctagcttcaaaggacagactctcgtatacagacatatcgtggttgatctgagcgcatag

SEQ ID NO: 192986 - DNA, 1614 bp, Artificial Sequence
  Description of Artificial Sequence: Synthetic coding sequence
atgggcggcgccggcatcctgctgctgctgctggccggcgccggcgtggtcgtcgcttggaggcctcctaagggtaagtgtcccttaaggtgttcttgttcaaaagactcagccctttgcgaagggtctcccgacctacccgtgtcttttagcccgaccttactcagcttgagtttggttagaacgggcgtaacccaacttaaggccgggagctttcttcggattccttccctccacttgctgcttttcacgtctaacagtttctcagtcatcgaggatgacgcctttgctggactttcacacttgcagtaccttttcatcgaggataatgaaatcggcagcatctcgaaaaatgcgctgcgcggtctgaggagtctgacgcacctcagcttggctaacaaccacttagagacgctgccgcgtttcctcttccggggactggacactcttacccacgtggatttacgaggaaacccattccagtgcgactgccgagttctctggctccttcagtggatgcccaccgtcaacgcatcggtgggcacaggtgcctgcgctgggcctgcctctctcagtcacatgcagctgcaccatctggatcctaagaccttcaagtgccgcgctatcgaactctcttggtttcagactgtcggcgaatccgcacttagtgtcgaaccatttagctatcaaggcgaaccgcacatcgtcctggcccagccttttgcaggccggtgtctgattttatcatgggactacagcctgcaacgtttcagacccgaggaggagcttcctgctgcgagcgtggtttcatgcaagccactggtcctggggccatcccttttcgttctggccgccagactttggggagggtctcagctatgggcaagaccctctccaggtttgcggctggcacccactcagacactggccccaaggcggctattaaggccaaacgatgccgaactcctatggctcgaaggacaaccatgcttcgttgtggccgatgcttctaaagcagggtcaacaacgctgctctgcagagacgggcctggcttttatccccaccagtctctacacgcatggcatcgggacaccgatgcagaagccctggagcttgacggtcggccccatctccttctggccagcgcctctcagcggcctgtgctgtttcattggacaggcggcaggtttgagcgccggacggatatccccgaggctgaggacgtctatgcaacgagacatttccaggcaggtggagatgttttcctctgtctgaccagatacattggggattccatggttatgcgctgggacggaagcatgttcagattgttacagcagctgccctcacgaggggctcatgtctttcaacccctccttattgcccgggaccaacttgccatactggggtccgactttgcttttagccaggttttaagactggaaccagacaaaggcttgctggagcctttgcaggagctgggtcccccagccttggtcgcaccccgtgcctttgcccacattactatggccggcaggagattcctctttgcagcctgctttaaaggtcccacgcagatttatcaacatcatgagatcgacctgtctgcctag

SEQ ID NO: 192987 - DNA, 1485 bp, Artificial Sequence
  Description of Artificial Sequence: Synthetic coding sequence
atgggcggcgccggcatcctgctgctgctgctggccggcgccggcgtggtggtggcttggcgaccaccaaagggtaaatgcccccttcggtgcagctgctcaaaggactcagccctgtgcgagggctcccccgacctgcccgtgagcttcagcccaaccctcctgtcactctctcttgtgcgcaccggagtgacacaactcaaggcaggcagttttctccgaattccttctctgcacctccttctgttcacctcaaatagcttctcagtgatcgaagatgatgccttcgcaggcctgtcgcacttgcagtatcttttcatcgaagacaatgaaattggtagcatcagcaagaatgccctcaggggcctcaggtcactcacacacctctccttagctaacaaccatctggaaaccctaccacggtttctcttccgaggcctggacacactcacgcacgtcgacttgcgtgggaacccatttcagtgtgactgcagagtcctttggcttctccaatggatgcccactgtaaatgccagcgtaggaacaggagcctgcgctggcccagcttcattgtcacatatgcagcttcatcacttggacccaaagaccttcaagtgtcgagctatagagttgtcctggtttcagactgtcggggaaagcgctctgtcagttgagcctttttcttaccaaggagagccccacatcgtgcttgctcaacctttcgccggcaggtgtctgattctgagttgggactatagcctgcaaaggtttcgccctgaagaagaactgcctggcgagccgccaccaagaccatccgcctgtcctgcagcgtgcctcgccggactgacctgtttaccaacatccccgcaaaggccgccctggtgccccgcttctcattggtgttgggcccgggcgtcctcctgctggctgcctgcctgtggaggagctcattcttgtgggcctggtcctgtcccggcctgtgcttggccccagaggcgcccttggccacgggggggttgctgcggcccaatgactccatcatcttgtggttggaagggtaaccctgcttcttggtggcctatgccacctaggagagcagcacccagatgttgtgctgctaccggtcccgcttttactagaacgagggcctgcacaccggggacagggactcgaaccctacgcccctggtcatggaccgcgggccctacttgctgttggcccagactgccctccgggccatgtagttcaactgggccagtcgccgcctcccgggacgcgcagacctcccccagaccgagaatgagcatgccacatgccacatcacggcttgtaggaacttgctcgtgtgcttctcatgccacattgggaactccatggagttgcgctggaacagctccctgctttgtgtgttgttctaacttcccccgagctgtaccaactagtagtagccactgctcgtcccccgggacaagttggccctcttag

SEQ ID NO: 192988 - DNA, 1617 bp, Artificial Sequence
  Description of Artificial Sequence: Synthetic coding sequence
atgggcggcgccggcatcctgctgctgctgctggccggcgccggcgttgtggtggcctggaggccgcccaagggcaaatgtcccctacggtgctcttgctccaaagacagcgccctttgtgaaggttctcctgatctgccagttagtttcagcccaacccttctgtccttgagtctggtgcgcacaggagtcacccagctgaaagcaggcagcttcctacggatcccgtctctgcatctgctcctcttcacatcgaacagctttagtgtgatcgaagacgatgccttcgctgggctctcccaccttcagtacctcttcattgaggacaatgaaatcggttccatatcaaagaatgcactgcgaggactaaggagtctcacacatctgtccctggctaacaaccatcttgaaacccttccacgtttccttttccgcggactcgataccctgacgcacgtcgacttacgggggaaccccttccaatgcgactgccgcgtgttatggcttcttcagtggatgccaacagtgaatgcatcagtggggactggggcatgcgccgggcccgcaagcctgtctcacatgcagctgcatcatctggatccaaaaaccttcaagtgtcgggcaattgagctaagctggtttcagacagtgggcgagtcagctctaagtgtcgagccattcagctatcagggagagccgcatatcgtgttggctcagcccttcgcaggaaggtgcttaatcctctcatgggactactctctgcagaggtttagaccagaggaagagttgccagccgcctcagtcgtcagctgcaagcccttggtgcttgggccctctctgtttgtgctggctgctcgattgtggggtggctctcagctatgggcgaggccctcccccggcttgcggctggcacctacacaaactttagccccacgtcgtttgcttcgcccgaacgatgccgaactgctgtggctcgaggggcagccctgtttcgtggtggcagacgcaagcaaagctggctcaaccacgctactgtgccgtgacggccccgggttttacccccaccagtcactccacgcttggcatcgagacaccgatgccgaagcgctggagctggatggacggccccatcttctgttggcttccgcttctcagcggccagtgctgtttcattggactggcgggcggtttgaacgaaggaccgatatccctgaagcggaggacgtgtacgctacaaggcatttccaggccggtggcgacgttttcctatgccttacgcgatatataggagactcgatggtggttatgagatgggacggcagcatgttcagactgctccagcagctcccgtctaggggagcacacgtgtttcagccacttctgatcgcacgggatcagctggccattttggggtctgattttgccttttcccaagtactaagactggaaccagacaaagggcttctcgagccactgcaggaattgggtccacccgccctagttgcaccccgggccttcgcccatatcaccatggccgggcgcaggtttctattcgcggcctgtttcaagggccctacacagatctaccagcatcatgagatcgatcttagtgcctag

SEQ ID NO: 192989 - DNA, 2091 bp, Artificial Sequence
  Description of Artificial Sequence: Synthetic coding sequence
atggccacccccggcagcgagccccagcccttcgtgcccgccctgtcagttgcaactctgcatcccttacatcaccctcatcatcaccaccaccatcaccagcaccatgggggaacaggcgcgccaggcggggccgggggcggtggaggtggttccggtgggttcaacctgcccttaaatagaggcctggaaagggctctggaggaggcagcgaactcagggggcctcaacctcagcgctaggaagctgaaagaatttcccagaactgccgccccaggtcacgaccttagtgatacagtacaggccgatctaagcaagaacaggctggtggaagtgcctatggaactttgccactttgtgtccctagagatacttaacctgtatcataactgtatcagggtgatcccggaagccatcgtgaaccttcagatgctcacatacctgaatttatctaggaaccagctgtccgcattaccggcctgcttatgtggcttacctctcaaggtcctgattgccagtaataacaagctcggatctctgcctgaggaaattggacaactgaagcaactgatggagcttgatgtcagttgcaatgagattacagccctaccgcagcagatcggtcaactgaaatcactgcgggagttaaacgtcaggcgcaattatctcaaagtactccctcaggagctggtggatttgtcgcttgtgaagttcgacttctcttgtaacaaggtgctggtgatcccgatatgtttcagggagatgaagcagctccaggttttgttgctggagaacaacccgctccaaagtccaccagctcagatttgcacaaaaggcaaagtacatatcttcaagtacctttctatccaggcctgccagatcaagactgccgactccttgtatctgcataccatggagagaccccacctgcatcagcacgtagaggacggcaagaaggactcggatagtggcgttggcagcgacaatggagacaaacgattgtctgcaacagagccatctgacgaagacactgtttcactaaacgtccctatgtccaacatcatggaagaagagcagatcatcaaagaagacagttgccatcgcctctcacccgtgaagggtgagtttcatcaggagttccaaccagaaccctccttactgggcgatagtactaattcaggggaggaacgagatcagttcacagatcgcgctgatggcctgcactccgagtttatgaactataaggctcgagccgaggattgtgaggagcttctcaggatcgaagaggacgtccactggcaaacagagggcatcattagctcttccaaggatcaggatatggatatagccatgatcgaacagcttagagaggccgtcgacttactgcaggatccaaacgggttgtctacagacatcacagagcgttctgtactaaacctgtacccaatggggagcgctgaggccctggagctgcaagattctgcactgaatggtcagatccagttagaaacatcgcccgtgtgcgaggtgcaatctgacctgaccctccagagcaatggttctcaatatagccccaacgagatacgcgagaacagtccagctgtgtcacctactaccaatagtactgctccatttgggcttaagcccaggagcgtgtttttgcgcccacagcggaaccttgagtcaatcgaccctcaatttaccatccgccggaagatggagcagatgagagaggagaaagaactggtggagcagctgagggagagcatcgagatgagactgaaggttagtttacacgaggacctgggggcagcccttatggacggggtggtgctgtgccaccttgtgaaccatattcggcccaggtcagtggccagtatccacgtgccatcccctgctgtgcccaagctgagtatggccaagtgtcgcagaaacgtcgaaaactttctggaggcctgcaggaaacttggcgtgccagaggagaagctgtgcctgcctcaccatattcttgaagagaagggactagtgaaggtaggcattactatccaagcactgctggatatcaccgtaacaaaggcactgttcacatag

SEQ ID NO: 192990 - DNA, 2187 bp, Artificial Sequence
  Description of Artificial Sequence: Synthetic coding sequence
atggccacccccggcagcgagccccagcccttcgtgcccgccctgtccgtggcaactctgcacccactccaccacccccaccaccatcaccaccatcaccagcatcacggcgggacaggcgcccccgggggcgcaggggggggcggcgggggctctgggggtttcaatctcccattaaacagggggctggaacgggcattggaagaggccgcaaactcaggcggcctgaatctttctgcccggaaacttaaggagttccctagaaccgccgctcccggccatgatctatccgatacagttcaggccgacctatcaaagaataggctggtggaggtgccaatggagctgtgtcattttgtttctctggaaatccttaacctctatcataattgtatccgagttatacctgaggcaattgtgaacctccagatgcttacctatctgaatctgagccgcaaccagctctcggcactgccagcatgcttatgtggactgccactgaaggtgctgatcgccagcaacaacaagctagggagtctcccagaagagatcggacagctgaaacaattgatggagctggacgtttcatgcaatgaaattaccgctcttcctcagcagattggtcagttgaagagccttcgggagctcaatgttcgtcgcaactacttgaaagtcttgcctcaggaactggtcgaccttagcctcgtaaagttcgatttttcctgtaataaagtgctagtcatacctatatgcttccgggagatgaagcaactgcaagttcttttgctcgaaaacaatccgctgcaatctcccccagcacagatttgcaccaaaggaaaagtccatatcttcaaatacctatctatccaggcttgtcaaattaaaacagcagactcactgtacttgcatacaatggagcgaccgcacctgcatcagcatgtggaggatgggaagaaggacagcgacagcggagttggctctgacaacggagataaacggttatcggcgacggaaccatccgatgaggacacagtgagcctgaatgtgccaatgtctaacatcatggaagaggagcagattataaaagaggactcctgccaccgactcagcccagtaaagggcgaatttcatcaagaattccaaccagagccctcgctgctgggagatagcacaaattccggggaggaacgcgaccagttcaccgaccgggcagacggcttgcacagcgagtttatgaactataaagcccgggcagaagattgtgaggagctgctgagaatcgaagaggatgtacattggcagaccgaagggattatctcctcaagcaaagaccaggatatggatatcgccatgattgaacagctgagagaggctgtggatctcttgcaggacccaaatggacttagcacagacatcaccgagagatctgtgctgaatctgtacccaatgggcagcgccgaggctctggaattgcaggacagcgccctgaatggacagatccagctagagacaagccctgtttgtgaggttcagtctgatctgaccctacagtctaatggcagccagtactcgcccaacgagatccgggaaaattcacctgccgtgtctccgacgaccaattccactgctccatttgggctcaagcctagatctgtgttcctgaggccacagagaaatctagagagcatcgatccccaattcaccatccgccgcaaaatggagcagatgcgcgaggagaaggagctggttgagcagctgcgggagtcaattgaaatgaggttgaaggtgagtcttcacgaagatttgggcgccgcgctgatggatggggttgttctttgccacctggttaatcacatccgaccacgctcggtggccagcatacacgtgccttcacctgcagtgcccaagctgtcaatggcgaaatgtcgccggaacgttgagaacttcctggaagcctgtaggaaactgggggtgccagaggcagacctgtgctcaccatgcgacatccttcagcttgatttccggcacattcggaaaaccgtggacaccctgttggcattgggagagaaagcccctccacccacctcagcgcttaggtcaagagacctaatcggattctgccttgtgcacatcctgtttatcgtcctggtgtatatcacttatcactggaacgcgctatctgcctag

SEQ ID NO: 192991 - DNA, 2292 bp, Artificial Sequence
  Description of Artificial Sequence: Synthetic coding sequence
atggccacccccggcagcgagccccagcccttcgtgcccgccctgagtgtggctaccttacatccactgcatcacccccaccatcaccatcatcatcatcagcaccacggcgggactggggctcccggtggtgctgggggaggtggcggcggaagcggaggcttcaatttaccccttaacaggggcctcgagcgggctctggaggaggccgcaaactcgggcgggctcaatttgagtgcacgcaaactgaaggaattcccccggacagccgcacccgggcacgatttatccgatacagtgcaggcagacctatccaaaaacaggcttgtggaggtcccaatggagctctgtcacttcgtaagccttgaaatccttaacctttaccacaactgcatccgggttattcctgaggctattgtaaatctacagatgttgacatacctgaacctttcgcgcaaccagctctcagctcttcccgcctgcttatgcggactgcctctgaaagtgctcattgccagcaacaacaaactgggttctttgccggaggagatcggtcagctgaagcagcttatggagctggacgtatcttgtaacgagataacggccctgccccagcaaattggccagctgaaatccctgagagagctgaacgtgcggaggaattatctaaaagtgttgccccaggagctcgtggacttaagtcttgtgaaattcgacttcagctgcaacaaagtgctggtcatcccgatctgctttagagaaatgaagcagctgcaagtgctgctgctggagaacaacccgctccaatcgccgccggcgcagatctgcaccaaaggaaaggttcatatatttaaatatttaagtatccaggcctgccaaattaagacagccgattcactctatctgcatacaatggaacgccctcacttacaccaacatgtagaggatggcaagaaggacagtgactccggagtaggcagcgataacggggataagcggttgtctgctactgaaccctccgatgaggacacagtgagcttgaatgttccaatgagcaacataatggaggaagaacagattattaaagaagattcctgtcaccggctttctcctgtgaaaggagaattccaccaagaattccagccagaacccagcctactgggtgactctactaattcaggtgaggaaagggatcagtttaccgacagagctgatgggctgcatagcgaatttatgaactataaagccagagccgaagattgcgaggaattgctgagaattgaagaggatgtgcattggcagactgagggtataatatcctcctccaaagaccaagacatggatattgcgatgatcgagcagctgagagaagcagtagacctgctgcaggatccgaatggtctgagcactgacatcaccgagagatcagtactgaatctgtatccaatgggttctgcggaggcgttggagctgcaagacagcgctctgaacgggcagattcagctggagacttctcccgtttgtgaggtccagtcagacctgacactgcaaagcaacggtagtcagtactccccaaacgaaatccgcgaaaacagtccagccgtttctcctacaaccaatagcacagctccttttggactgaagcctcggagcgaccctgctctcattttaccccccatctctttcaacaccctcacacaggcacagacctgggatagctcatcttattcagtgccttctgagggagactccgataatgtttttctgcgcccacaacggaatctggaatccatagacccacagttcactatacgccgaaaaatggagcagatgcgtgaggagaaagaactagtagaacaactgagggagagcatcgaaatgcggctcaaagtctctttgcatgaggacctcggcgccgccctgatggacggcgtggttctgtgccacttggtgaatcacattagaccccggagcgtcgcaagtatccatgtgcctagtccagctgtcccaaagctttccatggctaagtgtcgaagaaacgtggagaatttcttagaagcctgtagaaagctgggagttccagaggccgatctttgttccccttgtgatatcttgcagctcgattttagacacatccgaaagacagtagacactctcttggctctcggcgagaaagccccccccccaacatccgcccttagatcaagggatttgatcggattctgccttgttcacattctttttatcgtgctggtgtacattacctaccactggaatgccctatctgcttag

SEQ ID NO: 192992 - DNA, 3282 bp, Artificial Sequence
  Description of Artificial Sequence: Synthetic coding sequence
atggcccggcccgtgcggggcggcctgggcgccccccggcggagcccatgcctgctattattgtggctgttgctgcttaggctggaacctgtcaccgccgcagctggtccacgcgccccttgcgctgctgcatgcacctgcgccggggatagcctcgactgcggtggcagaggactggctgcgctgcccggcgacctaccctcttggacccgcagtttgaatctgagctataataaactgtctgaaatcgatccagcggggtttgaggacttgcctaatctgcaggaggtctacctgaacaacaacgagctgacagccgtgccctcattgggggcggctagcagccatgtcgtcagcttgttcctacaacataacaagatcaggagtgtcgaggggagccagctgaaagcttacctgagcttagaagttctggatttgagtctcaataacattacagaggtacgcaacacttgttttcctcacgggcccccgatcaaagagctcaatttggccggaaatcggattggcactctggaacttggagcgttcgacgggctgtcgaggtctctcctgaccctaaggctctctaagaatcggataactcagctcccagttagggcattcaagctgccccgactgacacagctggacctgaatcgaaatagaattaggcttattgagggattaaccttccagggcctcaatagcctcgaggtcctgaaactgcagcgcaacaacatttctaaacttacagatggggctttctggggactgtccaagatgcacgtgctgcacctagaatataactccctggtggaggtgaattccgggtccctttatggcctgaccgccctgcaccagctgcatctttctaacaatagtattgctcgaatccatagaaagggctggtcattttgccagaaattgcatgagcttgtcctgtcgttcaataatctgactcggctggatgaagagagtctggctgaactgagcagtttgagcgtgctgaggctgagtcacaacagcatttctcatatcgctgaaggcgcttttaaaggcctccggtcattgcgggtgttggacctggaccataatgagatttcagggactattgaagacacatctggtgctttctccggactcgactccctaagcaagctgaccctctttgggaacaaaatcaaaagtgtggcgaagagggctttttcaggtttggaaggccttgaacacctcaatctcggaggcaacgctatacgctccgtgcagttcgatgcattcgttaaaatgaagaacctaaaggagttacacatttccagtgatagcttcctgtgtgattgtcagctcaagtggttaccgccgtggctgatcggtcggatgttacaggccttcgttactgccacctgcgctcaccccgagtcacttaagggccagtcaatcttctccgtaccacccgaaagtttcgtttgtgacgattttctaaagcctcagattattacacagccagaaaccacgatggcaatggttgggaaagacatcagattcacatgttccgccgcatcttcttcctcgtcacctatgaccttcgcatggaagaaggataacgaagtattgacaaacgctgacatggagaactttgtgcacgtgcacgcccaagatggcgaggtcatggagtatactaccattcttcaccttcgccaggtgactttcggtcatgagggccggtatcagtgcgtcattaccaatcattttggctctacctatagccacaaagccaggttgacagtgaatgtgctgccctctttcaccaagactccgcatgacataaccatccggacaactactatggcccggcttgaatgtgcagctaccggacatcccaacccgcagattgcttggcagaaagacggtggaacagatttccccgcagccagggagcggcgcatgcatgtgatgccagacgatgacgttttctttattacggatgtgaaaatcgatgacgccggagtgtacagctgcacagcccaaaactctgcgggtagcatcagtgccaatgctacactgactgttcttgaaacccccagcctggtggtgcccttggaggacagggtagtgtccgtgggcgagactgtcgccctccagtgcaaagccacaggcaatccaccgccaaggatcacttggttcaagggcgatcgcccactaagcctgaccgagcgacaccatctcacacctgacaaccaactgctggttgtccagaatgttgttgcagaggacgcgggacggtacacctgcgagatgtccaacactcttgggactgagcgagcacacagccagttgtccgttttgcctgctgctgggtgtcgcaaggatggaacaactgtcggcatctttactattgccgtggtgagtagtatcgtgctcacaagcctggtctgggtatgtattatctaccagaccaggaagaagtcggaagaatacagtgtgactaatacagatgagaccgttgtgcctccggacgtgccctcctatctctcctcacagggaacactgagcgacaggcaggagactgttgtgcgcacggaaggcggcccccaggccaacgggcacatcgaaagtaatggtgtttgtcctcgcgacgcctcccacttcccagaacccgatacccattccgtggcctgcaggcagccgaagctttgtgcgggctctgcctaccacaaagagccttggaaagcaatggaaaaagcggagggcaccccaggaccgcataagatggagcacggaggcagggtggtgtgttcagactgtaataccgaagttgattgctattcgaggggccaggcctttcatcctcagcctgtgtcacgtgattctgctcagccatctgctcctaacggccccgagccaggaggctccgaccaggagcacagccctcatcatcaatgcagccggactgccgcagggagctgtccggagtgccagggaagtctgtatcccagcaaccatgaccggatgttaacggctgtgaaaaagaagccgatggcctctctcgacggaaaaggcgatagtagctggactctcgctcgtttatatcaccccgactcgacggagctgcagccagcatctagcctgacctccggaagccctgagagggcagaagctcagtatctgctcgtctccaatggacatctgccaaaggcatgcgatgcctcccccgagtcaacgcccctgactgggcagttacccggcaagcagcgcgttccactccttttggctcccaaatcttag

SEQ ID NO: 192993 - DNA, 2991 bp, Artificial Sequence
  Description of Artificial Sequence: Synthetic coding sequence
aacctgagctacaacaagctgagcgagatcgaccccgccggcttcgaagatctgcctaatctgcaggaggtgtatcttaacaacaatgagctaacggccgtgccaagccttggagccgccagtagccacgttgtgtccctgttcctgcagcacaataaaatccgctcagttgagggcagtcagcttaaagcgtacctctctctggaggtgctagatttgtctctgaacaatatcacagaggtacgaaatacatgcttccctcatggaccgcctattaaggaacttaacctcgctgggaaccgtattggtaccctggagctgggcgcttttgatggcctgagccggtctctgcttaccttgaggttgtctaagaatcgtattacccagcttccggtacgggctttcaaactgcccaggctcacacaactagacttgaacaggaaccgcatccggcttatcgaagggctgacatttcaggggcttaacagtctggaagttcttaagctgcaaagaaacaacatttccaagcttaccgacggagccttctggggcctgtcgaagatgcacgtgttgcatctggaatacaactcccttgttgaggtgaacagcgggtctttgtatgggcttactgccctccaccagttacacttgtcgaataactccatcgcacgcatacacaggaaaggatggtccttctgccagaagctccatgaactggtgctgtcctttaataacctcacccgactcgacgaggagtctttagcagaattgagcagtttgagtgttctgaggctgtcacacaattctattagccacatagccgagggcgcttttaaaggactgcgcagtttacgggtgctggacctggatcacaatgagataagcgggacgattgaggacacaagcggcgcatttagcggccttgattcacttagcaagctaaatttaggaggcaatgccattcggagcgttcagttcgacgcgtttgtgaaaatgaagaatctcaaggagctgcacatctcctccgattccttcctgtgcgattgtcagcttaagtggctgcccccgtggttgatcgggagaatgctccaggcatttgtaactgctacatgcgcccaccccgagagcctgaaaggtcagagcattttctcggtacctcctgagtcattcgtctgcgatgatttcctgaagccgcagatcattacccagccagaaaccaccatggctatggtcgggaaagacatccgctttacatgttctgcagcatcttcaagcagctcgccaatgactttcgcatggaaaaaagataatgaggttctcacaaacgccgacatggaaaattttgtacatgtgcacgcccaagatggtgaagtgatggagtataccacaatattacaccttagacaggtaaccttcgggcatgaaggcaggtatcagtgtgtgattaccaaccacttcgggtctacatactcgcacaaggctagattgacagtcaacgtgcttccaagcttcaccaagactcctcatgacataacaatccgcaccacgacaatggcccgccttgaatgtgccgccaccggccatcccaaccctcagattgcttggcaaaaagatggcggcaccgatttccctgctgcgcgcgagaggcggatgcacgtgatgccagatgatgacgttttcttcatcacagacgttaagattgacgacgcaggtgtttactcctgtacagcccagaatagtgcagggtccatttcagctaacgctaccctgacagtcctcgagacacctagcctggtggtgcccctggaggaccgagtggtatcggttggagagactgtagccctgcaatgtaaggcaactggcaatccaccaccacgcatcacttggttcaagggcgatagaccactgtctctgactgaaagacatcaccttacacccgacaatcagctcctggtcgtccagaacgtcgtcgcagaggacgccggcagatatacctgcgagatgtccaacaccttggggacagagcgagcccacagccagttgtctgtcctgcccgccgctgggtgtaggaaagatggtacgacagtaggaatattcacaatagccgtcgtgtcatctattgttttaacgagcctggtatgggtctgcatcatctatcaaacccgcaaaaagagcgaggagtatagcgtaacaaataccgatgaaacggtggtgccccccgacgtgcctagctacctgagtagccagggaactctttccgaccgccaggaaacagtggtccgcacagaaggtgggccccaggccaacgggcatatagagtccaacggtgtgtgcccacgcgacgcatcgcactttcccgagccagatacgcattcagtggcctgccgacagccaaagctgtgcgctggcagtgcgtaccacaaggagccttggaaggccatggagaaagcggagggtacaccagggccgcataaaatggaacatggcggccgggtggtctgttccgactgcaatactgaagtggattgttactcaagagggcaggccttccacccacagccggtaagtagagactcagctcaacctagcgcacctaatggtcctgagccaggaggctcagaccaggaacacagccctcatcaccagtgtagtcgcacagccgccggtagttgtccagaatgtcaggggtctctgtaccctagcaaccacgatcgcatgcttaccgctgtaaagaaaaaacccatggcctcactggacggtaagggcgattcctcatggaccctggccaggctgtaccatcctgattcaacggagcttcagcccgcttcttcgctaacatctggcagtcctgaacgggccgaggcacagtacctgcttgtatcgaatgggcacttgcctaaggcatgtgacgcatctccagagtcaacaccgctcactggacagttgcccggcaaacagagggtaccactgctcttggctcccaagagctag

SEQ ID NO: 192994 - DNA, 3213 bp, Artificial Sequence
  Description of Artificial Sequence: Synthetic coding sequence
atggcccggcccgtgcggggcggcctgggcgccccccggcggagcccatgtttattactcctttggctgctcctgttgaggctggagcctgtgactgccgccgccggacctcgagcgccgtgcgctgccgcctgtacatgtgccggcgattctctagattgcggcggacggggactggcagccctgccgggtgatcttcctagctggacacgcagcttgaacttgtcctataataagctgtctgaaatcgaccccgccggcttcgaagatctccccaacctgcaagaagtgtatctcaacaacaatgagcttactgcggtgccatccttgggggccgcctcctcacatgtggtcagcctcttcctacagcacaacaagatcaggtccgtcgagggcagccagctgaaagcttacctctcacttgaggtacttgacctgtcattgaataatatcacagaggtaagaaacacctgttttccccacggtccccccatcaaggaacttaacctcgctgggaataggattggcaccttagagttgggtgcctttgatgggttgtcacgatctctactcacactcagattaagcaaaaacagaatcacccagttaccagttcgcgcttttaagctgccaagacttacccaattggacttgaatcgaaatcggataaggttaatcgaaggtctgactttccagggactcaattccctagaggtgctcaagcttcagaggaataacatttccaaactgaccgacggcgccttctggggtctgtccaaaatgcacgtgctgcacctcgagtataactcgctggtggaagtaaatagcgggtccctgtacgggctcaccgctctgcatcaactccacctctcaaataatagcattgctaggatccatagaaagggctggagcttttgtcaaaaactacacgaactggtgctatcctttaacaacctgaccagactggacgaggaatccttggcagagttgtcatccttatctgtgctgaggctttctcacaacagcatcagccatatcgccgaaggggcctttaagggattaaggtccctgcgtgtgctggatctggaccataacgaaataagtggcacaatagaggatacatcaggcgcattctcaggcttagactccctaagcaagctgctactgctggagccttcacagtcagctggttgttcaagcccctctcagccacacatgtcagctggaggccgaactcttttcggaaataaaatcaaatctgtagctaagcgcgccttctctggactggagggcctggagcatctcaatctaggcggcaatgccattagaagcgtgcaatttgacgcctttgtcaagatgaaaaatctgaaagagctgcatatcagttctgacagcttcttatgtgactgccagcttaagtggctgccaccgtggctgattgggcggatgctgcaagccttcgtcacagcaacttgcgctcaccccgagagtttgaagggtcagtccattttttctgttccgccggaaagctttgtatgcgatgacttcttaaaacctcagatcataactcagcccgagactactatggctatggttggaaaggacattcgctttacatgttccgctgcatcaagctcgagcagccccatgacgttcgcttggaaaaaggacaacgaggtcttaactaacgcagatatggagaactttgtacacgtccacgctcaggacggagaggtcatggaatatacgaccatccttcacctacgacaagtgaccttcggacacgaaggcagataccagtgtgtcatcaccaaccactttggctcgacgtatagccataaggcccggctgactgttaacgtgttgcctagtttcacaaagactccacacgacattactatccgtaccaccactatggctcggctggagtgcgctgccaccggccaccccaaccctcagattgcatggcagaaggacggcgggactgactttccagctgctcagacacccagccttgtagtccccctggaagacagggtggtgagcgtgggagagaccgtggcgctgcagtgcaaggcaacgggtaacccgccccctcgaatcacttggtttaagggggataggcccctgtctctgactgagagacaccacctgactcccgataatcagctgctcgtggtgcagaatgtggtggccgaggacgctggcagatacacttgcgagatgtcaaataccctcggcacagagcgcgctcattcccagctaagcgttctacctgccgccggatgtagaaaggatgggacaacagtcggcatcttcaccatcgccgtggtcagctccatagttctgaccagtctggtatgggtgtgcatcatctaccagacccgcaaaaagtcggaggagtactccgtgactaacaccgacgagacagtggtcccaccggatgtcccctcatacctgtcctcacagggaacgctgtccgatcggcaggagactgtggtgaggacagagggcggcccacaggcgaacggtcatatagaaagtaatggggtgtgtcccagggatgcctctcactttcccgagcccgatacccattccgtagcatgtagacagcccaaactctgcgccggcagcgcttaccataaagagccttggaaagctatggaaaaggcggaaggcactccaggcccgcataagatggagcacggcggacgtgtggtgtgcagcgactgtaacacagaagttgactgctattccagaggccaggcattccatccgcagcccgtgagccgggatagtgcgcagccttcagctccaaatggcccagaacctggaggatcggaccaggagcattcgccacatcaccagtgtagccgaaccgccgctggttcttgccctgagtgccagggttctctgtatccttctaatcacgatagaatgctgacagctgtcaagaaaaaaccgatggccagtttggacggaaagggtgattcgtcatggacgttagccagactgtaccatccagacagcaccgaactccagcccgcttcctcgctaacttccggaagcccagagcgcgcagaagcccagtatctgctggtctccaatggccatctgcccaaagcttgtgacgcatcgcccgagagcacgcctctgaccgggcaacttccgggtaaacagagagttcccctgctactggctcctaagtcctag

SEQ ID NO: 192995 - DNA, 3198 bp, Artificial Sequence
  Description of Artificial Sequence: Synthetic coding sequence
atggcccccgcccccctgggcgtgcccgaggagcagctgctgggctgtaggtcccgcgtgctatcaaggctccttttcatcgcgcagaccgcacttctccttctgcctgccgctggagctgggctgtgtccagcgccctgctcatgtcgtatccctcttttggactgttctcggagaaagctgccagcacccagctggcgagctctgagtgggctcctaccccccgacactgccatcttggactttagtcataacaggttgagcaattggaatatctcactggaatctcagacactccaggaggtaaagatgaattacaacgagttgactgaaataccatattttggggaaccaactagcaacattacactcctatctcttgtccacaatattatcccggaaattaacgcacaggcgcttcagttttatccagctctggaatctctggacctgtccagcaacattattagtgaaatcaaaacctcatcattccctcgaatgcagctcaaataccttaacctgtctaataatagaattactacactcgaggctggatgttttgacaatctgagctcctccctactggtggtcaagctgaataggaaccggatgtctatgatcccaccaaaaatctttaagcttccccaccttcagttcttggagctaaaaagaaatcggataaagattgtggagggccttacattccagggcctcgactctttgcgcagcctaaaaatgcagaggaacggcatctcgaaacttaaggatggcgctttcttcggcctgaataatatggaagaactcgagctcgaacataacaatctgactagggttaacaagggatggttatacgggctccgcatgttacaacagctgtacgttagtcagaacgccatagaacgcatttcaccggacgcctgggaattttgtcagcgactgtctgagcttgacctgtcttacaaccagcttactagactggatgagtccgcattcgtcggcctttctctgctcgaacgccttaacctgggcgataatcgggtcacacacatcgctgatggcgtcttcagattcctttctaacctgcagactctggaccttcgcaataatgagatctcttgggccattgaagacgccagtgaggccttcgctggtctgactagtctgaccaagctcattctccagggcaaccaaatcaaatctatcactaaaaaggccttcatcgggcttgagtccttggagcaccttgatctgaataataacgccattatgtcaatccaagaaaatgcatttagccagacgcatttgaaagagctcatcctaaatacctctagcctgctgtgtgattgccacctaaagtggctgttgcagtggctggtcgacaacaactttcagcactctgttaatgtctcgtgtgcccatccagaatggcttgcgggccaatccatcctgaatgttgacctgaaggacttcgtttgtgacgatttccttaaaccgcagatccgcacccacccagaaacaattatagccctgaggggtatgaatgtaactcttacatgtaccgcagtcagttcgtctgacagcccaatgtctactgtatggaggaaggactccgagattttgtacgatgtggatactgaaaattttgttcgctactggcagcaagcgggcgaggctctagagtacacatccatcctccatctcttcaatgtgaactttacagacgaaggcaagtatcagtgcattgtaaccaatcactttgggtctaattactcccaaaaggccaaactaacagtcaacgaaatgcccagctttctcaagacacccatggatctgacaatcaggactggagccatggcccgtctggagtgtgcagccgagggccaccctgccccacagatctcttggcaaaaagacggtggaacggactttccagctgcccgggagagacggatgcatgtcatgcctgaggacgatgtcttcttcatcgcaaatgtgaagatagaggatatgggcatatactcttgcatggcccagaatacggctgggggccttagcgccaatgcatctctcaccgtccttgaaacgccctccttcatcaggccgctggaggacaagactgttacccggggcgaaacggccgtcctccagtgtatagctggaggttccccggctccccgattgaactggacaaaggacgacggacctctgctggtcaccgagcggcatttctttgcagccgccaatcaactcctgatcatagtcgacgcagggctggaggacgctggcaaatacacttgtattatgtccaacactctgggtacggaacgtggccatatttatttaaatgttatctcttctcctaactgtgatagcagtcaatcctctatcggacatgaggatgatgggtggacaaccgtgggaatagtgataatcgttgtggtgtgttgcgtggtgggcactagccttatttgggtgatcgtgatttaccatatgagacggaaaaacgaggattactcgattactaacacagaagagctcaatttaccggctgacattcctagctacctgagctcacagggcactctcagcgagccccaagagggatacagtaatagcgaagccggcagccaccaacagcttatgccacccgccaacgggtacatacataagggaaccgacggcggcaccgggacacgtgtaatttgcagtgactgctatgataacgcaaacatctacagcagaaccagagaatattgtccgtacacctatatagcggaggaggatgtacttgatcaaactctttcctctttgatggtgcagatgcctaaagaaacctacctcgttcacccacctcaggacacgactgccctggagtctctgatcccttccgcgaaccgagagccgtctgcattccccacaaatcatgaacgcatatcagaaaagaaactgccaagcacacagatgtcaggagagactttgcagcggccagtctggaatattaacagagagttaggcctcccccatcctcctttctctcagcagccggtacatgagtcccctcagcttcaccaaaacgaaggcttggcgggacgagaacccgattgctccgctagtagcatgtcttgtcatagattgcaggaccacgcgtttgacttctccaggacgaggaacatacaggacggcagcgaaggcacatag

SEQ ID NO: 192996 - DNA, 876 bp, Artificial Sequence
  Description of Artificial Sequence: Synthetic coding sequence
atggagagcgagcggagcaagcggatgggcaacgcctgcatccccctcaagcgcatcgcatactttttatgcctgctgtccgccctgcttctaacagaggggaagaaaccagccaagcccaagtgtcccgcagtgtgtacctgcacaaaggacaacgctttgtgcgagaatgcccgttctattccacgaacagtaccgccagatgtgatctctctgtccttcgtgcgatcagggttcacagagatctctgagggttcattcctgttcacaccaagcttgcaactgttattgtttacctctaactcattcgacgtaattagtgacgatgcattcattgggctaccccatcttgagtacctgtttatcgagaataacaatataaaatccatttccagacacaccttccgaggtctcaagagcctcatccatctctcgctggctaataacaacctgcagacccttccaaaagacatctttaagggtctggatagccttacaaatgtggacctgcgggggaatagttttaattgcgactgcaagctcaagtggctggtcgagtggctcggacatactaatgccacagtcgaagatatctactgcgaaggtcctcccgagtacaagaagcggaagatcaattcattgtcatctaaggactttgactgcataatcaccgagtttgccaagtcccaggacctgccatatcaatcccttagtattgacaccttcagctacctcaacgacgaatatgttgtgattgctcagccttttacaggtaagtgcattttcttggaatgggaccacgtcgaaaagacgtttcggaactacgataacataacagtgcttagagaaatccacaggttcaccaacatgtcatag

SEQ ID NO: 192997 - DNA, 1674 bp, Artificial Sequence
  Description of Artificial Sequence: Synthetic coding sequence
atggagagcgagcggagcaagcggatgggcaacgcctgcatccccctgaagagaatcgcttactttctgtgtctattgagcgctctgcttctcacggaaggtaagaaacctgccaaaccaaaatgtccagccgtctgcacctgcactaaggacaatgcactatgtgagaatgccaggtccattcctcgcacagtcccccctgacgtcatctccttaagcttcgtgcggagtgggttcacagagatatcagaagggtctttcttgttcacaccttcgctgcaattattgctctttacgtccaattcttttgacgtgattagtgacgacgcctttattggactgcctcatttagaatatctcttcatcgagaataacaacatcaaatccatatcaagacatacttttaggggattgaagtcactcatccacctgtccctcgctaacaataatctacaaacactgcctaaagacatctttaagggactcgatagtctgactaacgtcgatctgcgcggaaactcgttcaactgtgattgcaaattaaaatggctggtggagtggctcggtcacaccaatgccacagtcgaagacatctactgtgaagggccgccagagtacaagaaaaggaaaattaatagcctgtctagcaaggattttgactgtatcataacagagttcgccaagtcacaggatctcccttaccagtccttatccatcgataccttctcttatctgaacgacgagtacgtggtgattgcacagccatttacggggaaatgtatctttcttgagtgggatcacgttgagaagaccttcagaaactacgacaacattaccggcactagtactgtggtctgtaaacctatcgtcatagagactcaactttatgtgatagtggcccagctcttcggcggatctcacatctataagcgggatagtttcgcaaacaaattcatcaagattcaggacattgaaatcctgaaaatacgcaagcctaatgatatcgaaacttttaaaatcgaaaataactggtatttcgtggtcgctgatagttccaaggccgggtttaccacaatttacaaatggaacggtaatggcttctacagtcatcagtcactccatgcatggtaccgcgatacggacgtggaatatctcgaaatagtccgcactccacagacactgcgtacaccacacttaatactcagctcttcttcgcaacgccccgtgatctaccaatggaataaggcaacccagctcttcaccaaccagactgacataccgaacatggaggatgtgtacgcagttaaacacttcagcgtaaagggtgacgtttacatctgtctgacgagattcattggcgactccaaggtcatgaagtggggcggaagttcattccaggacatccagcgaatgcccagtagagggagcatggtattccagcccctgcaaataaacaattaccaatacgccattctggggagcgactactcctttactcaggtttacaattgggacgctgaaaaggccaagtttgtgaagttccaggagttgaacgtacaagcgcctcgaagcttcacacacgtttccataaacaaacgtaacttcctgttcgcgtccagcttcaagggaaatacccaaatatataagcatgtaatcgtagacctgagcgcctag

SEQ ID NO: 192998 - DNA, 1530 bp, Artificial Sequence
  Description of Artificial Sequence: Synthetic coding sequence
atggagagcgagcggagcaagcggatgggcaacgcctgcatccccctgaagagaattgcctacttcctgtgcttgctgagcgctctgttgctaacggaaggcaaaaagcccgctaagcctaaatgtcctgccgtctgcacctgtaccaaggataacgctttgtgtgagaacgcaaggtccataccgaggactgtgccacctgatgtgatatctttatcatttgtgaggtccgggttcacggaaatttctgagggatctttcctcttcacacctagcttgcagctcctctccctcgctaacaataacctccagacactgccgaaggacattttcaagggtctggattccttgacaaacgtggatttgagaggaaattctttcaactgcgactgtaaattgaaatggctagtggaatggcttggccacacaaacgctacggtcgaggacatctactgcgaaggcccccctgagtacaagaaaaggaaaatcaattcactcagttccaaggatttcgactgcatcatcaccgaatttgcgaaatctcaggacctgccttaccagtcactctccatagacacatttagttacctgaacgacgaatacgtagtgatcgcccagccattcaccgggaaatgcatctttctggagtgggatcatgtggagaagacctttaggaattacgataacattactggaacatccacggtggtatgcaagcctattgtgattgagacccaactctatgtgatcgttgcacaactgttcggcggaagccacatttacaagcgcgactcatttgccaataaattcatcaaaatacaagacatcgagattcttaaaatcagaaaacccaacgacatagagacctttaagatcgagaacaattggtatttcgtcgtcgctgactctagcaaggccggctttactaccatctataaatggaatggaaatggattttactcacaccaatcgctgcatgcttggtatcgggatactgatgtggagtatcttgaaattgtgcgcacgcctcagacgctgagaacaccgcatctaatcctatcttccagttcgcagagacccgtcatctaccagtggaataaagcaacccagttattcactaatcagaccgacataccaaacatggaggacgtgtatgccgtcaagcatttttctgtgaaaggcgatgtctatatctgtctcacaagattcataggggattccaaggttatgaagtggggcgggagtagttttcaggacatccaacgaatgccatctaggggctccatggtgttccagcccctgcagattaacaactatcaatacgcgattctgggctctgattacagtttcacacaagtgtacaattgggatgccgaaaaggcgaagttcgttaaattccaagagcttaatgttcaggcgcctcgttctttcacccatgtgtcgattaacaaaaggaacttcctttttgcgtccagtttcaagggaaacacacagatttataaacacgtaatagttgatctatcagcatag

SEQ ID NO: 192999 - DNA, 777 bp, Artificial Sequence
  Description of Artificial Sequence: Synthetic coding sequence
atgagcgcctaccccaagagctacaaccccttcgacgacgacggcgaagacgagggggcccgcccagctccctggcgcgacgcccgcgatttaccagacggccccgacgctcctgcagataggcagcagtacttgagacaagaggtgcttcgccgagccgaggccaccgccgcctccacatcacggtctctggccctcatgtacgagtctgagaaggttggtgtggcctcatccgaggagctcgctcgccagaggggggttctcgaacgtaccgagaagatggtagacaagatggaccaggatctgaaaatttcgcagaagcatattaactcaatcaaaagcgtctttggtggcttggtgaactatttcaaatcaaaaccagtggagactcctccagagcagaatgggacattaacctcccagcctaacaaccgtctgaaggaagctataagcaccagcaaggagcaagaagcaaagtatcaggcctcccatcctaacctgcggaagttagatgacacggatccggtccccagaggagccggcagtgctatgtctaccgacgcatatccgaagaatccacacctccgcgcttaccatcagaaaattgatagcaatctggacgaattatccatgggactgggacggttaaaagacattgcccttggtatgcagactgaaatcgaggaacaggatgacattcttgaccggctcaccacaaaggtggataagctcgacgttaatattaaatcgacagagcggaaggtgcgtcagctgtag

SEQ ID NO: 193000 - DNA, 2466 bp, Artificial Sequence
  Description of Artificial Sequence: Synthetic coding sequence
atggccggccccggcagcaccggcggccagatcggcgccgccgccttggccggcggagctcgttctaaggtcgctcccagcgtggattttgaccactcctgcagcgattccgtggaatatcttaccctcaacttcggccccttcgagacagttcataggtggaggcggctcccaccatgcgatgagtttgtcggtgcccggcgaagcaagcacacagtggttgcatataaggacgcgatctacgtattcggcggcgataacggcgctttcaccaccggcactcctccagcccccaggtaccatcacagtgctgtcgtgtacggtagttctatgttcgtgttcggaggatacacaggagatatttattcaaacagcaatctcaaaaacaaaaatgatttattcgagtacaagtttgccacaggtcagtggaccgagtggaagatagaggggcgtcttcccgtagcgaggtctgctcatggggccactgtttattccgacaagctgtggatttttgccggttacgacggtaatgcacgccttaatgacatgtggaccatcggattgcaagatagagagcttacttgctgggaagaggtggcccaatctggggaaatcccaccctcctgttgcaatttccccgtagccgtgtgtagagataaaatgtttgtattctctgggcagagcggcgctaagatcaccaataatctctttcagtttgaatttaaggacaagacctggactcggattccgactgagcacctcttaaggggaagcccaccccctccccagcggagatatggccacactatggtggctttcgatcgacacttgtatgtttttggtggcgctgcagacaacactcttccaaacgaactccactgttacgacgtagacttccagacctgggaagttgtccaaccaagttccgacagcgaagtgggtggagccgaggttcctgagcgggcttgcgccagtgaggaggttccgactctcacttacgaggagagagtaggatttaagaagtcccgtgacgtctttgggttggatttcggaaccacctccgcgaagcagccaacacagcctgcttcggaattgccgtcaggccggctgttccatgccgcggctgtgatatctgatgccatgtatatattcggcggcaccgtggataataacattcggagcggcgagatgtacaggtttcagttcagctgctacccgaaatgtaccctacacgaagattatgggcggctttgggaaagcagacaattttgtgacgtggagttcgtgctcggtgagaaggaggaatgcgtccaaggtcacgtcgccatcgtaaccgcccgtagcaggtggctgagaaggaagatcacccaggcccgcgaacgcctcgcgcagaagttggaacaagaggctgcacctgtcccgcgtgaagcaccaggggtggcagcgggcggggctcgcccacccctactccacgtggcaatcagagaggcagaggctcggcctttcgaggtgcttatgcagtttctgtatacagacaagatcaaatacccccgaaagggtcacgttgaggacgtgctacttataatggacgtctataagctggcattgtcctttcagctgtgccgactggagcagctctgcagacagtacatcgaggcgtctgtggacctgcagaatgtgctagtcgtatgtgaaagcgccgcacgcttacaactctcccagcttaaagagcactgcttaaacttcgttgtcaaggagtctcactttaaccaggtgataatgatgaaggagttcgaaaggttaagctcgccacttatcgtagaaatagtacgacggaagcaacagcctcctcctcgcactccgttagaccaaccagtggacataggaacatcccttattcaggatatgaaggcgtacctggagggcgcaggggcggaattctgtgacataacgctgctcctcgatggccacccccgccccgcccataaggcaattctcgccgcacggagttcttacttcgaggctatgttcaggagtttcatgccggaagacggacaggtgaacatctcaatcggcgagatggtgccaagccggcaggccttcgagtccatgctgcgctacatctattacggcgaggtaaacatgccccccgaagactcactgtacttgttcgcggccccctattactatgggttttacaacaacaggctgcaggcctactgtaaacagaacttggagatgaacgtaactgtacagaatgtgttgcagatactagaggctgcagacaagactcaggccctggacatgaagcgtcactgtcttcatattattgtgcatcaatttacaaaagtctcgaagctgccaaccctgcgttccctgtcacagcagcttctgcttgatattattgacagcttagcatctcatatttctgataaacagtgtgcagaattaggggctgacatctag

SEQ ID NO: 193001 - DNA, 2400 bp, Artificial Sequence
  Description of Artificial Sequence: Synthetic coding sequence
atgaactacgaccccatcgtgagcaaggtggccgaggtgctggcctcgggacgcgcaatccgcaagcgcgaggttgagagatccaaacacacggttgttgcttataaggatgccatatacgtgttcggcggagacaatggcaagacaatgctgaacgatctactacggtttgatgtcaaagactgctcttggtgccgcgcctttaccacaggcactcctcctgctccccgctatcaccactccgcagtggtatatggctcttccatgtttgtctttggcggttatacaggcgatatatatagcaatagcaaccttaaaaacaaaaacgacctgttcgaatataaatttgcgaccggtcagtggaccgaatggaagatcgagggcagacttcccgtagcacgctcagcccatggcgccacagtatattcagacaaactgtggatattcgcagggtacgatggaaacgctcggctgaatgacatgtggacgatcggccttcaggacagggaattgacctgttgggaggaggtggctcagagtggcgaaattcctccatcttgctgtaatttccccgttgccgtgtgtcgagacaagatgtttgtcttctcaggccagtcgggtgctaagatcactaataacttgttccaattcgagtttaaggacaaaacctggacgcgtatacctaccgagcacctgctacgtggatctcctccgcccccccaacggcgatatgggcatacaatggtggctttcgaccgccacctctacgtctttggaggggctgcggacaacaccttacccaatgaactacactgttacgatgtggatttccaaacttgggaggtcgtccagccaagttctgattcagaggttggaggcgccgaagtgcccgagagggcatgtgcgtcggaggaggtccctacactcacttatgaagagcgggtcggttttaagaagtctagggatgtttttggactcgatttcgggactacaagcgccaagcagccaactcagcctgcgtctgaactcccaagtgggaggctgtttcatgcggctgctgtgatcagtgatgcaatgtatattttcggaggtactgtagacaacaatatcagatctggagaaatgtatagattccagtttagctgttaccccaagtgtactttgcacgaggattatgggcgtctatgggagagcaggcaattctgcgacgtggaattcgtgcttggcgagaaagaagaatgcgtccaaggccacgttgctattgtaacagcccggagccgctggctccgacgaaagattacgcaggcgagagagagactagcgcagaaactggagcaagaggccgccccagtgcctagggaagccccaggggtggccgcggggggagcccggccccctctgctgcacgtggcaattagggaggctgaggccagaccttttgaagtactcatgcagtttttatatacagacaagatcaaatacccacgaaagggccacgtcgaggacgtcctattgatcatggacgtttacaagctcgccctaagctttcaactgtgccgactggagcagctctgcaggcagtatattgaggcatccgtagatttgcagaatgtgcttgtggtttgcgagtccgctgccaggctccagctcagtcagctaaaagagcactgcctcaatttcgttgtcaaggagtcacattttaatcaggttattatgatgaaggagtttgaacgtttgtcatcgcccctgatcgtcgagatcgttcggagaaaacagcagccacccccacggactcctctcgaccagccagtagacatcggcactagcctgattcaagatatgaaggcctaccttgagggcgctggggccgagttttgcgatattacactcctcttggacggtcacccccgccctgcccataaagccatcttagccgcccgttcttcgtacttcgaggccatgtttaggtctttcatgccagaggacggacaagtcaatattagcattggggagatggtgccttcccgacaagccttcgaaagcatgctgaggtatatttactatggcgaagtcaacatgcctcctgaggactcgctttacctgttcgcagccccttattactacgggttctacaataaccgcctgcaggcttattgcaagcagaacctcgagatgaatgtgacagtgcagaatgtgcttcagatcttggaagccgccgataaaacccaggctctggacatgaagcggcactgcttgcacataattgttcatcaatttactaaagtgagtaaattacccacattaagaagtctgtcgcagcagctgctgttggatatcatagattccctggcttcacacatctctgacaaacagtgtgccgagctgggagcagacatatag

SEQ ID NO: 193002 - DNA, 1560 bp, Artificial Sequence
  Description of Artificial Sequence: Synthetic coding sequence
atgagctacccccagttcggctacccctacagcagcgccccccagtttctgatggccacaaacagcttgtccacttgttgtgaatccggtggcaggaccttggccgattcaggacctgctgcctctgcccaagcccctgtgtattgtcccgtttacgagagccgcctcctggccaccgcacgccatgagctgaatagtgctgccgctctcggcgtttacggcgggccttatggcggctcccaaggatatggcaattacgtcacgtacggctctgaggcctccgctttttattcgttaaacagcttcgatagcaaggacggtagcggaagcgcccacggcggccttgcacccgccgccgcagcctattacccctatgagccagccctgggtcaatacccatacgatagatacggcacaatggacagtggcacgagacgcaagaatgctaccagggagaccaccagcactcttaaggcatggctacaggaacacagaaagaacccatatccaactaagggagaaaagataatgcttgctatcataaccaagatgacactcacccaagtctcaacttggtttgccaacgctagaaggagactgaaaaaggaaaacaaaatgacttggccccctcgaaataaatgcgcagatgagaagcgtccgtatgctgaaggcgaagaggaggagggaggagaggaggaagcccgcgaagaaccactcaagtccagtaagaatgctgaacccgtcgggaaagaagagaaagaattggagctctctgacctggatgatttcgaccctctggaggccgaaccaccggcctgcgagttaaaacctccatttcactcacttgatggaggactggaacgtgtgcctgcggctcctgacggaccagtgaaggaggcctcgggtgccctgagaatgtcattggcagctggtgggggggccgctcttgatgaagacttggagcgcgcgcgaagttgtcttaggtccgccgctgccggccctgagccgttaccaggcgctgaagggggaccacaggtttgtgaggccaaacttggatttgtgccagccggggcgtctgcgggattggaggctaagccgaggatttggtccctagcccacaccgctacagctgccgccgcagctgctacgagtctttcccagacagaatttccatcctgtatgctgaaaagacaaggcccggcagctccagccgccgtttcaagcgcacctgcaacctcaccttcagtggctctgcctcattctggggctctcgataggcatcaggacagccccgtgacgtccctccgcaattgggtcgatggcgtcttccatgatccaatcttgaggcacagcacattgaatcaagcctgggcaaccgccaagggagctctgcttgatcccggtccactgggtcgctcattgggcgccggcgccaatgtcctgacagcccctctggcgagagcctttccccctgccgtgcctcaggacgccccagccgctggtgcagctcgagaactgcttgccctgcctaaggcaggtggcaaacctttttgcgcctag

SEQ ID NO: 193003 - DNA, 3036 bp, Artificial Sequence
  Description of Artificial Sequence: Synthetic coding sequence
atgatcgagaacagcatgttcgaggaggagcccgacgtggtggacctcgctaaggagccctgcttgcaccccctagaacctgacgaggtcgaatacgagccccgggggtcgaggctactggtgagagggttgggggagcacgagatggaggaggatgaggaggattatgagtctagcgccaaattgttgggcatgtcattcatgaaccgatcttcaggtctgagaaacagtgctactgggtacagacagtctcccgatggagcttgcagcgtgccatccgcgagaaccatggtcgtgtgcgccttcgtgatcgtggtcgccgtgagcgtgatcatggtgatttatctactgcctaggtgtacattcacaaaggaaggatgccataaaaaaaatcagagcatcggactgatccagccttttgctaccaacggcaagttattcccctgggcccagattaggctgcctactgccgtggtacctctaaggtatgagctctcactccatcctaatctgacttctatgacctttcggggttcagtgacgatcagcgtgcaggctctccaggttacgtggaatattatcttgcattcaacaggccacaatatttcgcgtgtgacgttcatgagcgccgtttcctcccaggagaaacaagccgagatcttggagtacgcatatcatgggcaaatcgccatcgtcgcccctgaggcactgttagccggccataattacaccctcaaaatcgagtattcagctaacatcagttcaagttattatggcttctatggtttttcgtacaccgacgagtctaatgaaaaaaaatatttcgctgccactcaatttgaacctcttgctgccaggtcggcctttccatgctttgatgaacctgctttcaaagctactttcattatcaaaataatccgtgacgagcagtataccgccctgtcaaatatgcccaaaaagagtagcgtggtcctcgacgacgggctcgttcaagatgaatttagcgagtccgtgaagatgtccacttatctggtcgcgtttatcgtgggggagatgaagaacttgtctcaggacgtaaatggcacccttgtgagtatctacgccgtgccggagaagataggacaagtacattacgcgctcgagaccacggtcaaactcttggaatttttccagaattattttgaaatacaatatcctttgaagaaacttgacttagtggcaattcccgacttcgaggccggggccatggagaactggggactgctgactttccgagaggagaccctgctatatgattccaacacctcctctatggcagacagaaaactggtaaccaagatcatcgcacatgaacttgctcaccaatggttcggcaacctggtgaccatgaagtggtggaacgacctctggcttaacgaaggatttgcaaccttcatggagtatttcagtctcgaaaaaatctttaaagagctgtcttcctacgaggatttcctggatgcccggttcaaaactatgaaaaaggattccttaaatagttcccaccctatttcatctagcgtgcaaagttccgaacagattgaggaaatgtttgactccttgtcatacttcaaggggagctctttactactcatgctgaaaacgtacctctccgaggacgtgtttcaacatgcagtcgtgctctacctccacaatcatagttatgcttctattcagtcagatgacctgtgggactcttttaatgaagtaaccaaccagacgctggatgtgaaaaggatgatgaaaacttggaccttacagaagggttttcccttagttacggtgcagaagaaggggaaagagctttttattcagcaagaacgcttttttctgaacatgaaacccgagatccaaccctccgatacatcgtacctgtggcatatacctctatcatatgtcaccgaaggccgcaactattctaagtatcagagtgtctcgctccttgataagaaatctggggttataaatttgacggaggaagttctctgggttaaggtcaacatcaacatgaatgggtactacattgtgcactatgccgacgacgactgggaggctctgatccatcagctcaagatcaacccctatgtactatccgataaggacagggccaaccttatcaacaacattttcgagctggctggcttgggcaaagttccgcttaaacgcgcctttgatctcattaactatctgggtaatgaaaaccacactgctcctatcacggaggcactgtttcagacagatttgatctataacctcttagagaaactgggatatatggatttggcctccaggctggtgacgcgggtgttcaaactgttgcagaaccagattcagcaacagacatggacggatgaaggaacaccctccatgagggagctgcgctccgcacttttggagttcgcgtgtacgcacaacctgggaaactgttctactactgccatgaagctgttcgacgactggatggcttccaacgggacccagtctctgccaactgacgttatgacaaccgtgttcaaagttggcgctaagactgacaaaggatggagttttctcttaggtaaatacatctccatcggcagtgaggctgagaaaaataaaatcctggaggccttggcctcctctgaggatgtgagaaaactctattggctcatgaagagtagtcttaacggcgataatttccgcacccaaaagctttctttcattattcgcaccgtaggcaggcactttcctgggcatctgctcgcctgggatttcgtgaaagagaactggaacaagctagtccaaaagttccccttggggagctatacaattcagaacattgtggctggatccacttatcttttttccacgaaaactcacctgtccgaggtgcaggccttcttcgaaaatcaatctgaagccacttttaggctgcgatgcgtacaagaggctttggaggtaatccagctcaatattcaatggatggagaagaatctgaaatctctgacatggtggctttag

SEQ ID NO: 193004 - DNA, 3450 bp, Artificial Sequence
  Description of Artificial Sequence: Synthetic coding sequence
atggccgagcggaagggcaccgccaaggtggacttcctgaagaagattgagaaagaaattcagcagaaatgggacactgaacgggtcttcgaggttaatgctagtaacctggaaaaacagacttccaaggggaagtacttcgttacattcccatatccctacatgaatgggagattgcacctggggcacaccttcagccttagcaaatgcgaggcctgcgccgataaacttaaacgagaaatcgaactgtacggctgcccaccagattttcctgacgaagaggaggaagaagaagagacatccgtgaagacagaggatattatcatcaaggacaaggccaagggaaagaaaagcaaggccgccgccaaggccggatccagcaagtaccagtggggaataatgaaatccctaggactgtcggatgaagagattgtgaagttcagcgaggccgaacattggcttgactatttcccacccctggccattcaggatctcaaaagaatgggacttaaggtagactggaggaggtcctttatcacaaccgacgttaacccatattacgatagtttcgtcaggtggcaattcttgacattgcgtgagcgcaacaaaataaaattcggtaagagatacaccatctacagccctaaggacggacagccctgcatggaccatgaccgccagactggagaaggtgtcggcccccaggaatataccctgttgaaattgaaagttctggagccttacccctccaagctgtccggtctgaaagggaaaaatatctttcttgttgcagcaacactccgccccgagaccatgttcggccagaccaactgttgggtccgacccgacatgaaatacatcggcttcgagactgtgaatggagatatcttcatctgcacgcagaaggcagctaggaacatgtcgtaccagggtttcaccaaggataatggagttgtacctgtcgttaaagagttaatgggcgaggagatcctaggagccagcctttcagcgcccctcacaagctacaaggttatctacgttctgcctatgctgaccatcaaggaggataaggggaccggggtggtgacgtccgtcccctccgattcaccagacgatatcgctgctctcagagatctcaaaaaaaaacaggcccttcgagccaagtatggaatcagagacgatatggtgcttccatttgaaccagtccccgtcatcgagatcccaggtttcgggaatctgagcgcagtcacaatctgcgatgaattgaagatccagtctcaaaacgatcgtgaaaaacttgctgaggccaaagagaaaatctacctcaaggggttttacgaagggattatgctcgtggacgggttcaagggtcagaaggtccaggatgtaaagaagaccatacagaagaagatgatagacgctggcgatgccttgatatacatggaacctgagaaacaggtcatgtctcggagttccgacgaatgtgtggtggccctatgtgatcagtggtatctagattatggggaagagaattggaaaaagcagacctcccagtgtctaaagaacttagagaccttctgtgaggagacgcgccggaactttgaagccaccctgggctggcttcaggagcatgcctgtagcagaacctacggccttgggacccacctgccttgggatgagcagtggctgatcgagtcactgtcagactctaccatctacatggctttctacactgtggctcacttactacaaggcggaaatctgcatggacaggccgagtcacctttgggcatcaggccccagcaaatgactaaggaggtctgggactacgtcttcttcaaagaggcccctttcccaaagacccagattgccaaggagaagctagatcagcttaagcaggagttcgagttttggtacccagttgaccttagagtatccggcaaggacctcgtgccgaaccacctttcctattacctgtacaatcatgttgccatgtggcctgaacagtcggacaaatggcccacggctgtcagggccaacggacatctactcctgaattctgagaaaatgagcaaatccaccggcaatttcctcacactgacccaggcaattgataaattctccgcagatggtatgcgactggcactggccgacgcaggtgacaccgtggaagatgcaaatttcgtagaagcaatggctgacgccggcatccttagactttatacttgggtggagtgggtcaaggagatggtggctaattgggattctcttcggagtggacctgcctcaacgtttaacgatcgagtgttcgctagtgagctgaacgctggcatcatcaagaccgaccagaactacgagaagatgatgtttaaagaggccctcaaaactggattttttgagtttcaagctgcaaaggacaagtacagagaactggcggttgaaggaatgcaccgcgagctcgtttttcgatttattgaagtgcagacattgctgctggctcccttctgtccacatctctgcgagcacatttggactctgctcgggaaacctgatagtatcatgaacgccagttggccggtagccggtcctgtgaatgaggtcctgattcactcgagccaatatctcatggaagtgacacatgaccttagacttcgactcaagaattatatgatgcccgctaagggtaagaaaaccgacaagcagccattgcaaaagcccagccattgcaccatctacgtcgctaagaactacccaccatggcagcacactacgttgtccgtgttgaggaagcatttcgaggcaaataacggaaagctgcccgataacaaagtgatcgccagtgagctgggttccatgcccgagctgaagaaatacatgaagaaagtgatgcccttcgtggctatgattaaggagaacctcgagaaaatgggacctagaatcctcgacttgcagctggaatttgatgagaaggctgtgctgatggagaacatcgtgtacctcaccaattcacttgagctcgaacacatcgaggttaagtttgcctcggaagctgaggacaaaatcagagaggactgctgcccaggaaagcctttgaatgtgtttaggatcgaacctggagtcagcgtctcactcgttaacccacagccatccaacggccacttttccacaaaaattgaaattagacagggcgacaactgtgatagcattattcgccgcctgatgaaaatgaaccgtggcatcaaggatctcagtaaggttaagctgatgagattcgatgaccccctgcttggtcccaggagggtgccggtgctgggaaaagaatacaccgaaaagacacctatatccgaacatgccgtctttaacgtggatttgatgagcaagaagattcacctgaccgaaaatgggatccgggtcgacattggagataccataatctaccttgtacattag

SEQ ID NO: 193005 - DNA, 480 bp, Artificial Sequence
  Description of Artificial Sequence: Synthetic coding sequence
atggccgagcggaagggcaccgccaaggtggacttcctgaagaagattgaaaaggagattcagcagaagtgggacactgagcgcgtatttgaagtcaatgccagcaacctggaaaaacagactagtaagggcaaatacttcgtgacatttccctacccctatatgaacgggcgtcttcacctcggacatactttttccctgtccaagtgcgaattcgctgtaggataccaaagattgaagggtaaatgttgtctgtttccattcggtctacactgcaccggtatgccaatcaaggcgtgtgctgataagctgaagcgagagatcgagctttatggatgcccccccgactttccagacgaggaggaagaagaggaggagacctctgtcaagacagaggatatcatcattaaggataaggctaaaggcaaaaaatccaaagctgccaagcttgatctactcaatacatcgggcgccctgtag

SEQ ID NO: 193006 - DNA, 3531 bp, Artificial Sequence
  Description of Artificial Sequence: Synthetic coding sequence
atggccgagcggaagggcaccgccaaggtggacttcctgaagaagatcgagaaagaaatccagcagaagtgggatacggagcgtgttttcgaagtaaacgcctccaacctagaaaaacagacttccaagggaaaatactttgtgaccttcccctacccgtatatgaatggccggctgcacctgggacacaccttctctttgtcaaaatgcgagtttgcagtgggctatcagcgcctcaaaggaaagtgttgtctgtttcctttcggtctccattgcacgggcatgcccatcaaggcatgcgctgataaactcaagcgtgagattgagctgtacggctgcccccccgatttcccggatgaagaagaagaagaggaagagacctcagtgaaaaccgaggacatcattatcaaggataaggcaaaaggcaagaaatcaaaagctgccgctaaagcaggcagctcgaagtatcaatgggggatcatgaagagcttgggcctgagcgacgaggagattgtcaaatttagcgaggccgaacattggctggattacttccccccactcgccatacaggatctcaagaggatgggtctcaaagtcgattggcgacggtcctttatcacaactgacgtgaacccatattacgactcattcgtcaggtggcagttccttacgctccgggaacgtaataagattaagttcggcaaaagatacacgatatactcacctaaggatgggcagccctgcatggatcacgaccgccagacaggtgagggggtgggaccccaggagtatactctcttaaaactgaaagtgctcgagccctatccttcgaagctctctgggttaaagggaaagaacattttccttgtcgcagccactctgcgccccgaaaccatgtttggccaaacaaattgctgggtacggcccgatatgaagtatattggattcgaaactgttaatggcgatatttttatctgtactcaaaaggcagcgagaaatatgtcttaccaggggttcactaaggacaacggtgtggtacccgtggtgaaagagctaatgggggaggagatccttggtgccagcctgtccgccccactaacgagttataaggttatatacgttctgcccatgcttacaattaaggaggacaaggggaccggagtagtaacttctgtgcccagcgactcccctgacgacatcgctgccctgagagatttaaagaagaaacaagctctgagagccaaatacggcatcagagatgacatggtcttaccctttgagccggtgccagttatagagattcctggattcgggaatctgtccgcagtgactatttgcgacgagctgaaaattcaatctcaaaatgatcgcgagaagctcgcggaggccaaagagaaaatctacctgaaggggttctacgagggaattatgctcgtggatggcttcaaaggacagaaggtgcaggacgtaaagaaaactatacagaaaaagatgatcgatgccggagacgctttgatttacatggagcccgagaaacaggtcatgagtaggagtagcgatgaatgtgtggtcgcgctttgtgaccagtggtatctagattatggtgaggagaactggaaaaaacagacatcccagtgcctgaaaaacctggaaaccttctgcgaggagactcgcaggaacttcgaagccaccctcggatggctgcaagaacacgcttgctctaggacctacgggctggggactcacctgccctgggacgagcagtggctgatcgaatccctctccgacagtacaatttacatggccttctacacagtcgcacacctcctacagggagggaaccttcacggacaggccgagtccccgcttggaattcgacctcagcagatgacgaaagaagtctgggactatgtcttttttaaggaagctccctttccaaagacacagatcgccaaagagaagttagaccagttgaaacaggaatttgagttctggtaccctgtggatctgagagttagcggcaaggatcttgtcccaaaccatctcagctattatttgtataaccatgtggccatgtggcccgaacagtctgataaatggcctaccgcagtgagagcgaatggacatctcctgcttaactcagaaaaaatgtccaagagcacaggcaactttctgacactgactcaggctattgataaatttagcgctgatggcatgcggttggcattggctgatgctggagatacagtggaagatgcaaactttgtggaagccatggctgacgcaggtattctgcgcctttatacttgggtggagtgggtaaaggagatggttgcaaattgggattccttacgatccggccctgcctctacctttaacgacagggtgttcgcttccgaacttaacgccgggattattaaaacagatcagaattacgagaagatgatgttcaaggaagctctcaaaacaggtttcttcgaattccaggctgcaaaagataaataccgcgagctggccgtagaaggaatgcatagggagctggtcttccgctttatcgaggttcagacattgttattggccccattttgtccacatctttgtgaacatatttggaccctcttagggaaacccgatagtattatgaatgcaagctggccggtcgccggtccagtgaatgaagtcctgattcattcaagtcaatatctgatggaggtgacgcacgatctgcgtcttaggcttaagaattacatgatgcccgcaaaaggcaagaaaactgataagcagcctctgcagaaacccagtcactgtacaatctacgttgccaaaaattatcctccctggcagcacacaaccctcagtgtgctgagaaagcacttcgaggccaataacggtaagctacctgacaataaggttatcgccagcgaactgggctcgatgccagagctcaaaaaatatatgaagaaagtgatgcctttcgtggctatgattaaggagaacctggaaaaaatgggccctaggatcctcgatcttcagctggaattcgacgagaaagcagtacttatggagaatattgtgtatctgacgaatagcctggagttggagcatattgaggttaagttcgcctccgaagcggaggacaaaattcgcgaggattgctgcccagggaagccactcaatgtgtttagaatcgagcccggcgtttcagttagcctcgtgaatcctcagccatcaaatgggcatttcagtaccaaaattgagataaggcagggcgacaactgtgacagcattattaggcgcctcatgaagatgaatcgcggcattaaggatcttagcaaagtcaagttaatgagatttgatgatccgctacttggccctcggagggtgccggtattggggaaagagtatacggaaaaaacacccataagcgagcacgctgttttcaacgtcgatctgatgtctaaaaaaattcatttgaccgagaatgggatccgagtggacattggagacacgatcatctaccttgtgcattag

SEQ ID NO: 193007 - DNA, 3369 bp, Artificial Sequence
  Description of Artificial Sequence: Synthetic coding sequence
atgaacggccggctgcacctgggccacaccttcagcctgagcaagtgtgaatttgccgtcgggtaccaacggctaaaaggtaagtgctgcctctttccattcgggctgcattgcacaggcatgcccattaaagcctgcgctgataaactcaagagagagattgaactttatggctgcccccctgatttcccagacgaggaggaagaagaagaggaaacgtccgtgaagactgaagatatcattatcaaagacaaagcgaaagggaaaaaaagcaaagctgctgcaaaagccggtagctcaaagtaccagtggggtattatgaagagtttgggcctgagtgacgaagagatcgtgaaattctctgaggcagagcattggctagactacttcccccccctggcgattcaggatctcaaaagaatggggctcaaagtggactggaggagatctttcataacaacagatgtaaacccctattatgactcctttgtacggtggcagtttttgacactgcgggagcgcaacaaaatcaagttcgggaaacggtataccatctactcccctaaagatgggcagccctgcatggatcacgataggcagacaggagagggcgtcggccctcaggaatacacattactgaagctgaaggtgcttgagccgtacccatcaaagttgagcggcctgaagggcaagaatatcttcctcgtggctgctaccctgaggcccgagacgatgtttggccaaactaattgctgggttcggccagatatgaaatatattggtttcgaaacagtgaacggggacatcttcatctgtacgcagaaagcagccagaaacatgtcatatcagggattcaccaaagataacggcgtcgtgcccgtcgtgaaggagttgatgggtgaagaaattttaggcgctagtctcagcgcccccctgacatcttacaaggttatctacgtgctgcccatgctgacgatcaaagaggacaaaggaaccggagtcgtgacttccgtcccttcagacagccccgacgatattgcagcacttagggatctgaagaagaagcaggctctccgcgccaaatatggcatccgagatgacatggtgcttccatttgaacccgtaccagtgatcgaaatccccggatttggtaatctgtccgccgtaactatatgcgacgagctgaaaatacagagtcaaaacgatcgagagaagctggccgaagccaaggagaaaatctacctgaagggtttctatgaggggatcatgctagtggatggattcaagggtcaaaaggtccaggatgtgaaaaaaaccattcagaaaaaaatgatcgatgccggcgatgccctgatttatatggaaccggagaagcaggtcatgtcacggtcaagcgacgaatgcgttgtcgcactgtgcgatcaatggtatcttgactacggtgaggaaaattggaagaagcagacctcccagtgtctcaaaaatctggaaaccttctgtgaggaaactcggaggaactttgaagctaccttagggtggctgcaggaacacgcctgctcccggacatacggcttaggaacgcacctgccctgggacgagcagtggctcatcgaatcgctgtctgacagtaccatctatatggcgttctataccgtggcccacctgctccaagggggtaatctccacggacaggctgagagtcccctgggaattcggccgcagcaaatgacaaaggaggtctgggactacgtgtttttcaaggaagcaccatttcctaagacacagattgccaaggagaaactcgatcaacttaaacaggagtttgagttctggtatccagtcgatctcagggtcagcgggaaggatctggtccctaaccacctttcctactatttgtacaaccatgtggcgatgtggccagagcagagcgataagtggcccacggctgttcgagccaatggacatctgctgctcaactccgaaaagatgtctaaaagcacaggcaattttcttacactgactcaggccattgacaaattctcagctgatggtatgcggctcgccttagctgacgcgggtgacactgtggaggacgctaacttcgtggaggccatggcagatgccgggatcctgcgcctctatacatgggtcgaatgggtgaaggagatggttgccaactgggactccctacggtcaggccccgcgagtaccttcaacgatcgcgtttttgctagcgagttaaacgcgggaattataaaaaccgaccagaactacgagaagatgatgttcaaggaggccctgaagacaggattcttcgaatttcaggctgccaaggacaaatacagagagcttgccgttgaaggtatgcatcgtgagctagtcttccgcttcatcgaagttcagacattgctgcttgcccctttttgcccacacctctgtgaacatatatggaccctgctgggcaagcccgattccatcatgaacgccagctggcccgtggctggtcccgtgaatgaggtgctgatacactcaagccagtaccttatggaggttacccacgacctgagactcaggctgaagaattatatgatgccagccaaaggcaaaaagacggacaaacaaccccttcagaagccgtctcactgcactatctacgtcgcaaaaaattatccgccatggcagcacaccaccctctcagtactgcggaagcattttgaggccaacaatggtaagctgcctgacaacaaggtgatcgcgagcgagctggggagtatgcctgaactgaaaaaatatatgaaaaaagtgatgccatttgttgccatgattaaagaaaacctggagaagatgggccctcggatactcgacctgcagttggagttcgacgaaaaggccgttttgatggagaatatcgtgtatctgaccaactctctggagctagagcacatcgaagtcaaatttgcttcggaggcagaagataaaataagggaggactgctgcccaggaaagcctctgaacgtgtttcgcattgaaccaggcgtgtccgtctccctagttaacccccagccaagcaacgggcacttctccaccaagattgagatcaggcagggcgataactgcgattccattatccgtagactgatgaaaatgaacagaggtattaaggacctgtcaaaggtgaaactcatgcggtttgatgatccgctgttaggaccccgccgggtgcctgtactcgggaaggaatatacggagaagactcctatttcagagcacgctgtgtttaacgtggatctcatgtccaagaaaatccacctgacagaaaatgggattagagtcgacatcggggacacaatcatttacctcgtccattag

SEQ ID NO: 193008 - DNA, 372 bp, Artificial Sequence
  Description of Artificial Sequence: Synthetic coding sequence
atgtggcccgagcagagcgacaagtggcccaccgccgtgcgggccaatggccatctcctcctgaatagcgaaaagatgtccaagtccactggaaatttcctcaccctgactcaggccatagataaattcagtgcagatggcatgcgcttagctcttgcagacgccggtgacacagtggaagacgccaactttgttgaagcaatggcagatgctggcattttgcggttgtacacatgggtggagtgggtgaaggaaatggtagctaattgggacagtctgaggtcgggccccgccagcacctttaacgatcgggtatttgcaagcgagctgaacgcaggtattatcaagaccgatcaaaccatgaagcgctag

SEQ ID NO: 193009 - DNA, 1458 bp, Artificial Sequence
  Description of Artificial Sequence: Synthetic coding sequence
atgtggcccgagcagagcgacaagtggcccaccgccgtgcgggccaatggccacctcttgctgaactctgagaaaatgtcaaaatcaacggggaacttcctgacacttactcaagctatcgacaaattctcggcggacgggatgagattagccctagctgacgccggcgataccgtggaggacgctaacttcgtggaagccatggcagacgcgggtatccttagactgtatacttgggttgaatgggttaaggagatggtggccaactgggattcccttagatcagggcccgccagtacttttaacgacagagttttcgcaagcgagctgaacgctggtatcattaagactgaccagaattacgagaaaatgatgtttaaagaggcactaaagactggtttcttcgaatttcaggctgcgaaagataaataccgcgaactggccgtggaagggatgcatcgggagctagtgttccgttttatcgaggtacagaccctattgttggccccgttctgcccgcacttgtgcgaacatatctggaccctcctggggaagcccgactctatcatgaacgccagttggccggttgccgggccagttaacgaagtgctgatacattccagccaatacctcatggaagtcacgcacgacctacgcctgaggctgaagaattatatgatgccagctaagggaaagaagaccgataagcagcccctgcagaagccttcccactgtaccatttacgttgccaaaaattatcctccctggcagcacaccacattatccgtcctgcgtaagcactttgaagcaaacaatggtaaactccctgataataaggtgattgcttccgaactcggctccatgccggaacttaaaaaatatatgaaaaaggtgatgccctttgtggcaatgattaaagaaaacctggagaaaatggggcctcgaatccttgatcttcagctggaatttgacgagaaagccgtgctcatggagaatatcgtgtacctgaccaatagcctggagctggagcatatagaggtgaaattcgcaagcgaagcagaagacaaaataagagaggactgttgtcctggcaagcctctgaatgtcttcagaatcgagcccggcgtttctgtctcactggtaaatccccagcctagtaatggccatttttccacaaaaattgagatcagacagggcgacaattgcgatagcatcattagacgcctgatgaagatgaatagaggcattaaggatctgagcaaggttaaactgatgcgattcgatgacccactgctgggtccgaggagagttcctgttctcggcaaagagtatacagaaaaaacccctatttcagaacacgccgtgttcaacgttgatctcatgtccaagaaaatacatctgactgagaacggaatcagggtggatattggcgataccatcatctacctggtgcactag

SEQ ID NO: 193010 - DNA, 3393 bp, Artificial Sequence
  Description of Artificial Sequence: Synthetic coding sequence
atggccgagcggaagggcaccgccaaggtggacttcctgaagaagattgagaaagagattcagcaaaaatgggacacagagagagtgttcgaggttaacgcctccaacctggaaaaacagacttctaaaggcaaatactttgtcacatttccctacccgtacatgaatggtcgacttcatctcggacatacgttttctctttcgaaatgcgagtttgcagtgggttatcagcgcctcaagggcaaatgttgtctcttcccatttggacttcattgtacgggcatgccaatcaaaagcaaagctgctgcgaaagcgggcagtagtaagtatcagtgggggattatgaagagcctcggtttatccgacgaagaaatcgtgaagttttccgaagcagaacactggcttgattatttcccccctctcgccatacaggatctgaagcggatgggcttgaaggttgactggaggcggtccttcataacaactgacgtcaacccatattacgactcatttgtccgatggcaatttctaactctgagagaaagaaataagattaaattcggcaaacgttataccatctactcgccaaaagacggtcaaccttgtatggaccacgaccgtcaaaccggcgagggagttggtccccaggaatatacactcctcaaactgaaagtgctggaaccttacccttcaaagctcagcgggctgaagggcaaaaatatctttttagtggcagctaccctgcgtcccgaaactatgttcgggcagacgaattgctgggtcagacccgacatgaagtacataggcttcgagacagtgaatggcgacatctttatatgtactcaaaaggctgcccgaaatatgtcttatcagggtttcacgaaagataatggtgtggtgcctgttgtgaaggaattgatgggtgaagaaatcctgggcgcttcactgtctgcccccttaacctcatacaaggtgatatatgtccttccaatgttaacaatcaaagaggacaagggtaccggcgtggtgacctcagtaccgagcgactccccagatgacatagccgcactgcgagacctaaagaaaaagcaggctctgagagcaaagtatggaattagggacgacatggtgttgcctttcgagcctgtgccagtgatagagatccccggctttggcaaccttagcgccgtcaccatatgtgatgagcttaagatccagtcacagaatgatagggaaaaactcgccgaggccaaggaaaagatttacctaaagggattctatgaggggatcatgctagttgatggatttaaaggccagaaagtgcaggacgtgaaaaaaacgatccagaaaaaaatgatcgacgctggagacgccttgatttatatggaacctgagaaacaggtcatgagcaggtctagcgatgaatgcgtcgttgcgctgtgtgaccagtggtatctcgattacggcgaggaaaactggaagaaacagacctctcagtgcttgaagaatctggagacgttttgcgaagaaactcgaaggaacttcgaggcaaccctgggttggctccaggaacacgcatgttctcgcacctacggtctcggaacacacttgccgtgggacgaacagtggctgattgagtcgttgagtgattcgactatctatatggccttctatactgttgcacatctgctgcaggggggcaatttgcatggccaagcagaaagcccactcggtatcaggccgcagcaaatgacaaaggaggtgtgggactatgtcttctttaaagaagctcctttccctaagactcagattgcgaaggagaagctggaccagctgaagcaggagtttgagttctggtatcccgttgacctgagagtttccggcaaggatttagtgcccaaccatctgagttattatctctacaaccacgtagccatgtggcctgaacagtccgataaatggccaaccgccgtgcgcgctaacggccacctcttgctgaatagcgaaaaaatgagcaaatccacaggcaactttctcaccttgacacaggccattgacaagtttagtgcggacggcatgaggctggctttggcagatgccggcgatacggtcgaagacgccaactttgtagaggccatggcagacgccggcatattaagactgtacacttgggtagagtgggtcaaagagatggtggccaactgggactccctgagatcagggccagcatcaacgtttaacgatcgagtctttgcatccgagctcaacgccggaatcatcaaaactgaccaaaattatgagaaaatgatgttcaaggaggccctcaaaacgggctttttcgagttccaagctgccaaagataaatatagggaactcgcagtcgagggcatgcatagagagctggtatttcgttttattgaagtgcagaccctgttgctggcgccattctgcccccacctgtgcgaacacatctggaccttgctcgggaaacctgactccattatgaacgcgagctggcccgttgccggaccagtgaacgaggtgcttatccacagctctcagtatctgatggaggtgacccacgacctgcggctgagacttaagaattacatgatgccggccaaaggcaagaagacagacaaacagcctctgcaaaaaccaagccactgtacaatctacgtagccaagaactaccctccatggcaacatactactctgtcagtccttcgaaaacattttgaggccaataatggcaagctcccggacaataaggttatcgcttccgagttggggtctatgcccgagctcaagaaatatatgaaaaaggtgatgcctttcgtggccatgatcaaagagaatctggaaaagatggggccccgcatcctggatctgcagttagagtttgatgaaaaagctgtactcatggagaacatcgtgtaccttacgaactcgcttgagctggaacacatcgaagtaaagtttgcctcagaagcagaggacaagatccgcgaggattgctgtccaggcaagccactgaatgtttttcggatcgaacctggtgtaagtgtgagtctggttaacccgcagccaagcaatggccactttagcacaaagattgagatcagacaaggcgataactgtgatagtatcatacgaagactaatgaaaatgaatcgcggtatcaaggatctgagtaaggttaagttgatgcgattcgatgatcccctgctcgggccacgcagggtacccgttcttggaaaagagtacacagaaaaaacgcccatctcggagcatgcagtgttcaatgtggatcttatgagcaagaagattcatctgactgagaacgggataagggtggatattggcgataccattatctacctcgtccattag

SEQ ID NO: 193011 - DNA, 2712 bp, Artificial Sequence
  Description of Artificial Sequence: Synthetic coding sequence
atggccagcgtgtggcagcggctgggcttctacgccagcctgctgaagaggcagcttaatggtggcccagatgtcataaagtgggagcggcgggtcatccctggttgcacgcggagcatctatagtgccaccgggaaatggactaaggagtacaccctgcaaactcgtaaagatgttgagaaatggtggcaccagcgtatcaaggaacaggcgagtaagatatccgaagcagataaatctaagcccaagttctatgtactcagcatgtttccttatccatctggcaagttgcacatgggtcatgtgcgtgtatacactatcagtgacaccattgctaggttccagaaaatgcgaggtatgcaggtgattaacccaatgggctgggacgccttcggcttgcccgccgaaaacgcggccgtggagcggaacctgcaccctcagtcttggacgcagagcaacataaagcacatgaggaagcaactggataggctcggcttgtgtttctcatgggaccgcgaaattaccacgtgtctgcccgattactacaagtggacccagtatctttttataaaattgtatgaggccggactggcctaccagaaagaggcccttgtcaactgggatcctgttgaccagacggtgctggccaatgaacaagtcgatgaacacggatgttcatggaggagcggagccaaggtggaacagaaatatttaaggcagtggtttattaagacgacagcctatgcaaaagcgatgcaggacgctctcgccgacctgcctgaatggtatggtattaagggcatgcaggcccactggataggggattgtgttggatgtcacttggacttcaccctgaaagtgcatgggcaggccaccggtgaaaagctgacagcttacactgcaacacccgaagcgatctacggcaccagccacgttgcgatctcaccttctcaccgcttgctgcatggccatagcagtcttaaggaagcattgaggatggcgttggtgcccggaaaagattgcctcacgccggtcatggcagttaatatgctgacccaacaggaggtacctgttgtcatccttgcaaaggccgatcttgaggggagtctcgatagcaagatcgggatcccaagtacttcaagcgaggacactatcctggctcagaccctgggcctggcctattctgaggtaatcgaaacacttccagatggaaccgagcgtcttagcagctccgccgaattcaccggcatgacacggcaggacgcatttttggctctgacccaaaaggcacgtggtaaaagggtcgggggggatgtaacctctgacaagttgaaggactggctgattagtagacagcgctattggggcacccccattccgattgtccactgcccagtttgcggtccgactcccgtccccctcgaggacctccccgtcactctgcccaatatcgcctccttcactggtaaagggggccccccccttgccatggcaagtgagtgggtgaactgcagttgtcccagatgcaagggcgccgccaagcgggagacagacactatggataccttcgtggattccgcctggtattactttagatacaccgatccacataacccgcatagtcccttcaacaccgccgtagctgactattggatgcccgtggacctttacatcggagggaaggagcatgccgtcatgcacctgttttacgcgagatttttctcccacttttgtcatgatcaaaagatggtaaaacatcgtgagccctttcacaaacttctcgcccagggtttgatcaaaggacaaacattcagattgccctcgggtcagtatctgcaacgagaggaggttgatctgactggaagcgtgcccgtgcacgccaagactaaggagaaactggaggtgacgtgggagaagatgtctaagtctaagcacaatggagtggatcctgaggaggtggtggaacaatatggaatagacaccattcgtctgtatatcctcttcgccgccccccccgaaaaggacattctgtgggatgtgaaaactgatgctctaccgggagtgctgagatggcagcagcggttgtggacccttaccacaaggttcatcgaggcccgagcctctggaaagtcgccgcagccacagctcctgtctaacaaggaaaaggctgaggccaggaagttatgggagtacaaaaactcagtgataagtcaggttacgacccacttcactgaggatttcagcctgaactcagctataagccagttaatgggcctgagcaatgccctgtcacaggcatcccaaagcgtcatcctgcattctcctgaatttgaggacgcactgtgcgcgttgatggtcatggcagcaccactggcaccacacgtgactagcgagatttgggcgggactagcactagtgccacgaaaattgtgcgcacattatacgtgggacgcctctgtcctcctgcaagcttggcctgcagtggatcccgagttcctccagcagcctgaggtggtgcagatggctgtgctcatcaacaacaaggcttgcggaaaaattcctgtgcctcagcaggtggctagggaccaagacaaggtacacgagtttgttttgcagtctgaactgggcgtaaggctgctgcaggggcggagcatcaagaagagctttctgagcccccgcaccgccctcattaacttcctagtgcaggattag

SEQ ID NO: 193012 - DNA, 2583 bp, Artificial Sequence
  Description of Artificial Sequence: Synthetic coding sequence
atggccagcgtgtggcagcggctgggcttctacgccagcctgctgaagcgccaattgaatggaggacccgacgtgattaagtgggaacgcagagtgattccaggctgtacaaggtccatctatagtgccaccgggaaatggactaaggagtatactcttcagacccgaaaggatgtggaaaagtggtggcatcaacggatcaaggagcaggcttccaaaataagcgaagcggacgtcattaatcccatggggtgggatgcttttggactaccagcagaaaacgccgctgtggaacggaatctacacccacagtcctggacccagagcaacattaaacacatgaggaaacagctggacaggctagggttgtgcttcagttgggatagagaaattaccacgtgtctgccagattactataagtggacacaatacctatttataaagttatatgaagcagggttagcgtaccagaaagaggcccttgtcaattgggacccagtagatcaaactgtattggctaacgaacaagtggacgagcacggttgtagttggagaagtggcgccaaagtggagcagaaatacttgcgccagtggtttattaaaactacggcctacgcaaaggccatgcaggacgctttagcggacctgcctgaatggtatgggattaagggcatgcaggcccattggatcggcgattgtgtgggctgccatttagacttcaccctgaaggttcacggtcaggctaccggggaaaaactgaccgcttacactgctacgcctgaggctatctatggcacatcccatgttgccatatcaccctcccatcgcctcctgcacggacactcatcactgaaggaggcacttcgaatggcactggtccctggcaaggactgcctcactcccgtgatggccgtgaatatgctaactcagcaagaagtgccggtggtgatcctggccaaggcggatctggagggctcactggacagcaaaatcggtatcccctctacatcctctgaggatacaatcttggcgcaaaccctcggtctggcctacagcgaggtgatagagacactaccagacgggactgagcgcctgtctagctctgcagaattcaccggtatgacccggcaggatgcttttcttgctctgacacaaaaagcacgggggaaacgagtcggcggcgatgtgacctccgataagctgaaagactggttgatttctagacaacggtactggggaacaccaattcctatcgttcactgtccagtttgcggacccacacctgtaccactggaggacctcccagtcaccctgcccaatatcgcctcatttactggtaagggcggcccaccgctcgctatggcctctgaatgggtcaactgtagctgccccagatgtaaaggcgcagcgaagcgggagacagacacgatggacacgttcgtcgacagcgcctggtactattttcgctatactgacccccataacccccacagccccttcaacactgcggtggctgactactggatgccagtcgatctctacattgggggtaaagagcatgccgttatgcatctgttctatgcaagattcttctcccatttctgccacgatcagaaaatggtcaagcaccgcgaaccattccacaaattactggcccagggccttattaagggacagacttttcgtctccccagcggccaatatctacagcgcgaggaggtggacttgaccgggagtgttcctgtacacgctaaaaccaaagaaaaactggaggtgacttgggaaaagatgtctaagagtaaacacaacggggtggatccagaagaggttgtcgagcaatatggcattgacaccataaggctgtatatcctgttcgccgcacctccagagaaggacatattgtgggacgtaaaaacggacgcgctgccgggagtgctccgttggcagcagcggctgtggaccctgacgacgagattcatcgaggctcgggcatctgggaagagcccccaacctcagctcctgtctaacaaggaaaaggctgaggccagaaagttatgggaatacaagaattctgttatctctcaggtcaccactcactttactgaggacttttctctgaatagtgcaatttctcagctcatgggcctgagtaacgcactgtcccaggcatctcaatccgtgattctgcacagtccagagtttgaagacgcactttgcgcactgatggtgatggcggctcctcttgcgccgcacgttacaagtgagatctgggcaggactggccctggtgcctcgcaagttgtgtgcacattacacatgggatgcttctgtgctcctccaggcgtggcctgcagtggatccagaatttcttcagcagccggaagtggtgcagatggccgtcctgattaataacaaggcttgcggtaagatccccgtgccccagcaggtcgctagagaccaggacaaagtgcatgagtttgtgctgcagtccgagttgggtgtgagattacttcagggcaggagtattaaaaagagtttcctgtcgccccggaccgccttgatcaattttctcgttcaggactag

SEQ ID NO: 193013 - DNA, 2712 bp, Artificial Sequence
  Description of Artificial Sequence: Synthetic coding sequence
atggccagcgtgtggcagcggctgggcttctacgccagcctgctgaagcgccagttgaatggcggaccggatgttatcaagtgggagcggcgcgtgatccccggatgtacaaggtccatttattccgccaccggcaagtggaccaaggagtatacactccagacgagaaaagatgtggagaaatggtggcaccaacgcatcaaagagcaggcctccaagatctcggaggccgacaagtctaagccgaagttttacgtgctgtctatgtttccatatccgtctgggaagctccacatgggacatgtgcgggtttacaccatctctgacacaatcgcccggtttcaaaaaatgcgcgggatgcaggttatcaatccgatggggtgggacgcatttggactgcctgcagagaatgccgcggtggagcgtaacctgcacccccagagctggacgcaatctaatattaagcatatgagaaagcagctggacaggctaggcctgtgtttttcttgggatagagagatcacaacgtgcctgcccgactactataaatggacgcagtacttgttcatcaagctctacgaggctgggctggcttatcagaaagaagccctggtgaattgggaccctgttgaccaaaccgtattggcaaatgaacaagtcgacgagcatgggtgctcctggcgatccggcgcaaaagtagaacagaagtatcttcgccaatggtttattaagacaaccgcttatgcgaaggccatgcaggatgccttggcagatctgcctgaatggtacggcattaaaggtatgcaagcgcattggatcggtgactgcgtggggtgccatctggatttcaccttaaaagtacatggacaggccaccggcgagaagttaacggcttacaccgccacgccagaagcgatttatggcactagccacgtcgccatctctccgagtcacaggcttcttcacgggcactcatcactgaaagaggcgctgcgcatggctcttgtgcccggaaaagactgcctgacgccagtgatggcagtcaacatgctgacccagcaggaagttcctgttgtcatcctggccaaagccgatctggaaggtagcctggactcaaagataggaattccctcgacatccagtgaggataccattttggctcagaccttgggcttggcctattccgaggtcatcgaaacattaccagatggcaccgagcgcctctcttcctcagctgagtttacaggcatgacaaggcaggacgcattccttgcattgacacaaaaagctagaggaaagagagtgggtggcgatgtcacaagcgataaacttaaagactggttaatctctcggcagagatattggggcacccctataccaattgtgcactgccctgtctgtgggcccactcctgtccctttagaggacctccctgtcaccctgccaaatattgcttcgtttactggaaagggcggtccccctctggcgatggctagcgagtgggtaaattgctcatgcccccgatgtaaaggcgctgcaaagcgcgaaactgacactatggacacatttgtcgattccgcttggtattactttaggtacacggatccacacaacccccactcccctttcaataccgcagtggctgactattggatgcccgtggacctgtatatcggcggaaaagaacatgccgttatgcacctcttctacgcacgctttttctctcatttctgtcacgaccagaaaatggtcaagcatagggaaccgtttcacaagttgttggctcagggtctcatcaagggacagactttccgcctgcccagtggccagtacctccaacgtgaagaggtcgatttgacaggctccgtaccagtccatgcaaagactaaagaaaaattggaggtcacctgggagaaaatgtccaaaagtaagcacaacggggtggatccagaagaagtcgttgaacaatacggtatcgacaccattaggctgtacatccttttcgccgctccccctgaaaaggacatattatgggatgtcaagactgatgcactccctggggtgctccgttggcagcagagactgtggaccctgaccacccggttcatcgaggcacgtgcaagcggaaagagtccccagcctcagctgctcagcaacaaggaaaaggctgaggcacggaaactctgggaatacaaaaattctgtcatctctcaggtgacgacccattttaccgaggatttcagtctgaattccgctatttcgcagcttatgggcctttccaatgctctttcccaggcaagccaaagtgtcatcctccactctccagagttcgaagatgctctgtgtgccctgatggtgatggccgcacctctggctccacatgtcacatccgagatctgggctgggctagccctggtgccaagaaaactttgcgcccactacacctgggacgcgtccgtgctgcttcaggcctggccggccgtagatccagagttcttacagcagcccgaagtggtgcagatggctgttctcatcaacaacaaggcctgtggaaagattccagttccccagcaagtcgcaagggaccaggacaaggtgcacgaattcgttttacaaagcgagttaggcgtacgtttactgcagggacgttcaattaagaaaagtttcctgagtccacgcacggcccttatcaatttcttagtgcaggactag

SEQ ID NO: 193014 - DNA, 345 bp, Artificial Sequence
  Description of Artificial Sequence: Synthetic coding sequence
atggccagcgtgtggcagcggctgggcttctacgccagcctgctgaagcgccagttgaatggcggacccgatgtcattaagtgggagcgtagagtcattcccggatgcacacgctctatctactccgcaacgggcaagtggacaaaggagtacacactccagacacggaaagacgtggagaagtggtggcatcagagaattaaagagcaggcatcgaaaattagcgaggccgataagtctaagcccaagttctatgtgctgtctatgttcccctaccccagtgggaagcttcatatgggtcacgtcagagtgtatactatctccgacaccatagccagattttag

SEQ ID NO: 193015 - DNA, 609 bp, Artificial Sequence
  Description of Artificial Sequence: Synthetic coding sequence
atgaaggtgctggccgccggcgtggtgcccctgctgctggtgctgcattggaaacacggcgcaggcagtcccctgcctatcacccccgttaatgctacgtgtgcgatccggcacccctgccacaacaacttgatgaaccagataaggagtcagctggcccagctgaatgggtcagctaacgccctgtttatcctctactataccgcccagggcgagcccttccctaataatcttgataagctttgtggacccaacgtcactgacttccctccattccatgctaatggaaccgaaaaggccaagctggtagaactgtatcggatcgtggtgtacctggggacatccctcggtaatatcaccagagaccagaaaatcctgaatccctctgccctttctctacattccaagttgaacgctaccgccgatattctccgaggccttcttagcaatgtgctctgccgtctgtgttccaagtaccatgtcggacatgtcgatgtgacctatgggcctgataccagtggcaaggacgtctttcagaaaaagaaacttggatgccagctacttggcaagtataagcaaatcattgctgtcctggctcaggccttttag

SEQ ID NO: 193016 - DNA, 3294 bp, Artificial Sequence
  Description of Artificial Sequence: Synthetic coding sequence
atgatggacatctacgtgtgcctgaagcggcccagctggatggtggacaataagcggatgagaacagcatcgaatttccagtggctactgagcacatttatcctcctctacttaatgaaccaggtcaattcacagaagaagggggccccgcacgatttgaagtgcgtcaccaacaatctccaagtgtggaactgctcctggaaggcgccctcaggcaccggccgcggaaccgactacgaggtttgcatagaaaatcgctctaggtcttgctatcagctggaaaaaacttcaataaagattccggccctgagtcatggcgactacgagattacgattaacagcttacatgattttgggagctctacctccaagttcaccctaaacgaacaaaacgtgtctttaataccagacacaccggaaattctcaatctgtcggccgatttttcaaccagcactctgtatctcaaatggaacgataggggctctgtgtttccacataggtcaaacgttatttgggagattaaggtgctccgtaaagaatcaatggagctggtcaagctggttacccataacactactctgaacggcaaggacacattacaccactggagctgggcctcagatatgcccctggagtgtgccatccacttcgtggagatccgatgttatatcgataacctccacttttctgggctcgaggagtggagtgattggtcgcccgtcaagaatatctcttggattccagatagtcagaccaaggtcttcccacaggataaagtgatcctggtcggatcagatatcaccttttgctgtgtgtctcaggaaaaggtcctgtctgcccttataggacacacgaattgcccactgatccatctagatggggagaacgtagccatcaaaatccggaacatttccgtgtccgcaagctctggtaccaatgttgtattcacaacggaggataacatctttggcacagtgatatttgcaggttaccctcccgacactccgcagcaactgaactgcgagacgcacgatcttaaggaaataatatgcagttggaatcctggaagggtgactgcactggttggacctagggcaacatcgtacacactagtggagtccttttccggaaaatacgtgcgtcttaagcgagctgaggctcctactaacgagtcttatcaactcctctttcagatgctacctaatcaagagatttataacttcacacttaatgcccataaccccctcggacggtcacagtccaccattctcgtgaacatcactgagaaggtttacccccacacacccacatcttttaaggtaaaagacataaattctacggctgtgaagttgtcctggcacctacctggcaatttcgccaagataaactttctgtgcgagatcgagattaagaaatctaacagtgtgcaggagcagaggaacgtgactattaagggcgtggagaattcatcctacctggtcgcactcgacaaattaaacccatataccttgtacacatttagaattagatgttcaacggagactttttggaagtggtcaaagtggtccaataaaaaacagcacctaactacagaggccagcccaagcaaagggccggatacctggcgcgaatggtcttccgatggcaagaacctgatcatctactggaagcctttgccaatcaacgaagccaacggcaaaatcctgtcatacaatgtgtcatgtagttccgacgaggaaacccagtctctgagtgaaatcccagatccccagcacaaagcagagatcagactcgacaagaacgattatatcatctcggtcgttgcaaaaaattcagttggtagctctccgccaagcaaaatcgccagcatggagattcccaatgacgaccttaaaatcgagcaggttgttggtatgggaaaggggatcctcttgacctggcattatgaccccaatatgacatgcgactatgtgattaagtggtgcaactcaagtaggtccgagccatgtctgatggattggcgcaaagtgcccagcaacagtaccgagaccgtgatcgaaagcgacgagtttcgcccaggcatcagatacaatttcttcctctatggctgcagaaatcagggctaccagttgctgcgatcaatgattggctacatcgaagagctggcccccatcgtggctcctaattttaccgtggaggacacttcggctgacagcattttagttaagtgggaggacattccggtggaagagttgcgcggattcctgcgggggtacctcttttatttcggcaagggtgaaagagacacatctaaaatgcgagtgctggagagtggacggtctgacataaaagtgaagaacattacagatatctcacaaaagactctgaggatcgctgacctacaggggaaaaccagttaccacctggtcctgcgcgcctacacagacggaggagtcggtccagagaagtccatgtatgtcgtgactaaggagaacagtgtcggcctgattatagccatcctgataccggtcgctgtggcagtaatcgtgggggtagtgacctccatcttgtgctatagaaagagggagtggattaaggagactttttatcctgatatacctaatcctgagaattgcaaggctctccagttccaaaaatccgtgtgcgagggctcctctgccctaaaaaccttggagatgaacccttgcacgcctaacaatgttgaggttctcgagactagatcagccttccccaagatcgaggatactgaaataataagtcccgtggccgagagacccgaggaccggagtgacgctgaacctgagaatcacgtggtcgtctcatattgccctcctataattgaggaagaaattccgaaccctgcagccgatgaggcaggcgggaccgcccaagtaatctacattgacgtgcagtccatgtaccagccacaggccaagcctgaggaagagcaggaaaatgacccagtaggaggtgccggttacaagccgcaaatgcacctccctatcaactctaccgtcgaggacatcgcggctgaggaggatctcgacaaaacagctgggtaccggcctcaagccaacgtcaacacttggaacctcgtatccccagacagccctagatccatcgactctaattcagagatagtaagttttgggtctccctgctccatcaatagcagacagtttcttatcccgcccaaagacgaggacagtcccaaatctaatggcggcggttggtcttttacaaacttttttcaaaacaaacctaatgattag

SEQ ID NO: 193017 - DNA, 3294 bp, Artificial Sequence
  Description of Artificial Sequence: Synthetic coding sequence
atgatggacatctacgtgtgcctgaagcggcccagctggatggtggacaacaaacgcatgcgtaccgccagcaactttcaatggctgttatccaccttcatattgctgtatcttatgaaccaggtgaattcgcagaagaaaggagccccacacgatctgaagtgtgtgaccaataacttgcaggtctggaattgttcttggaaggcgcccagcggtacgggcagaggtacagattacgaagtgtgcatcgagaatcggtcccggtcatgttaccagcttgaaaaaacgtctatcaaaattcccgccctatcccacggggattacgaaatcacaataaattccttgcacgactttggaagcagcacatcaaaatttacactaaacgagcaaaacgtctctctgattcccgatactcccgagatcctgaatctcagtgctgactttagcactagcaccctgtacctgaaatggaacgacagaggatccgtattcccgcacaggtccaacgttatctgggaaatcaaagttctgcggaaggagtcaatggagctggtaaaactcgtcacgcacaatacaactttaaacggaaaggacactctgcatcattggtcgtgggcttccgacatgcctctcgaatgcgcaattcacttcgtggagattagatgctatattgacaatctccacttcagtggtttggaggaatggtctgactggtctcctgttaagaacatttcctggatcccagatagtcagaccaaggtctttccgcaggataaggtcattcttgtgggtagcgacatcactttttgttgtgtctcacaggagaaggttctgtctgcactcataggtcacacaaactgtcctcttattcacttagatggtgagaacgttgctatcaaaatccgcaatatctcagtgtcagcaagctctggcacgaacgttgtgtttactactgaagacaatattttcggcacagtgattttcgcgggctatccccccgatacaccccagcagctcaactgtgagacccacgatcttaaagaaattatatgcagttggaaccccggaagggttaccgcgctcgtgggcccccgtgccacatcttacacccttgtagagtcatttagcggcaaatacgttagactgaaacgcgccgaagcacccacaaatgagtcctatcaactgctttttcagatgcttccaaaccaagagatctacaactttacactgaatgctcacaatccccttggtcggagtcagtctacgatcttggtgaacattacggaaaaggtttacccccacaccccaacatcttttaaggtgaaggacattaattctaccgcagttaagctgagctggcacctaccgggcaacttcgctaagataaacttcctgtgtgaaatcgaaatcaagaagagcaatagtgtgcaggagcagcggaacgtgacaatcaaaggcgtggagaattcctcatatctggtggccctggacaagctgaatccatatactctatatacttttcggatccgctgttccaccgagacattttggaagtggtcgaagtggtcgaataaaaaacagcatctgacaacagaggcctccccatcgaagggaccagacacctggagagagtggtcctccgatggcaaaaatttaatcatctattggaaacctctccctattaatgaggccaatggaaaaattctcagttataatgtgagctgctcttcagatgaggaaacacagagtttgtccgaaattcccgatccgcagcataaagctgaaattcggctggacaagaacgattacatcatcagcgttgtcgctaagaactcggtcggatcttcacctcctagcaaaattgctagcatggagatacctaatgacgacttgaaaattgagcaggtggtcgggatggggaaagggatcctattgacgtggcattacgacccaaatatgacctgtgactatgtgatcaaatggtgtaattcttcgcgaagcgagccctgcttaatggactggcggaaggtgccatccaattccaccgagacagtgattgagtctgatgagttccgtcccggaatccgctacaatttctttctgtacggttgccgaaaccagggctatcagctgctgcgctctatgattggctatatcgaggagctggctcccatcgtcgctcctaacttcacggtagaagatacgagcgccgacagcatcttggtgaagtgggaagatatcccagtcgaagagctacgtggttttcttagaggttatctattttactttggaaagggggaaagagacacttctaagatgagggtgttagagagcggcaggtctgatatcaaggtcaaaaatatcaccgatatcagccaaaagacgctcagaattgccgatcttcagggcaagacttcttatcacttggtgttaagagcatacacagacggtggggtggggccggagaagtcgatgtatgtggtcaccaaggaaaactccgtcggactgatcatcgccatcctaattcccgtggctgtggccgtgatagtgggagtggttacctctatcctgtgttaccgaaagagggaatggattaaggaaaccttctacccagatattccaaatcccgagaactgcaaggccctccaatttcagaagtcagtgtgtgagggatctagtgccctgaaaacattggagatgaatccttgcacaccgaataatgtcgaagtcctcgagactcggtctgcctttcctaaaatcgaagatacagaaatcatatcccccgtggcagaacgccctgaagatcgcagcgatgccgaaccggagaaccacgtggtggtgtcctactgccctcccatcatcgaggaggagatccccaatcctgcagccgacgaggcaggtggcacagcacaggtcatatacatcgacgtccaatcaatgtaccagcctcaggccaagcccgaagaagagcaggaaaacgatcccgtggggggagccgggtacaaaccgcagatgcatctgcccatcaattccaccgttgaggacatagccgctgaggaggatttagacaagaccgctggctatcggccccaggccaatgtgaacacttggaatcttgtttctcctgacagcccccgcagcatcgactccaactcagagatcgtttcttttggctctccatgctcgattaattcacggcagttcctcatacctcccaaggacgaagactctcctaagtctaacggtggcggctggagcttcaccaacttctttcagaacaagccaaatgactag

SEQ ID NO: 193018 - DNA, 381 bp, Artificial Sequence
  Description of Artificial Sequence: Synthetic coding sequence
atgatggacatctacgtgtgcctgaagcggcccagctggatggtggacaataagcgaatgcgaacagcaagcaatttccagtggttactgagcacttttatactgctgtatctaatgaaccaagtaaactcccagaaaaaaggagccccgcacgatctaaagtgtgtgaccaacaacttacaggtgtggaactgctcatggaaggcccccagcggcacaggccggggaaccgattatgaggtgtgtattgagaaccggtcacgctcgtgttatcaacttgagaagacgtctattaagatcccagctctgtcccatggagattatgaaattacaataaatagtctccacgacttcggcagcagcacctcaaaattcacttag

SEQ ID NO: 193019 - DNA, 228 bp, Artificial Sequence
  Description of Artificial Sequence: Synthetic coding sequence
atgatggacatctacgtgtgcctgaagcggcccagctggatggtggataacaaacggatgcgaacggcgagtaacttccaatggctgctcagtactttcattctcttgtatctcatgaaccaggtgaacagccagaaaaagggagcccctcatgaccttaaatgtgtgactaacaacttacaggtttggaactgttcctggaaggctccgtccggcacgggtcgttag

SEQ ID NO: 193020 - DNA, 456 bp, Artificial Sequence
  Description of Artificial Sequence: Synthetic coding sequence
atgttcagcaccaaggccctgctgctggccggcctgatcagcaccgcactggccggaccttgggctaatatctgcgcaggtaagagctctaatgaaatccgaacttgtgacagacacggttgtggccagtactcggcccagaggagtcaacgcccccaccaaggcgtagacattctctgctccgctggatctactgtctacgctcctttcacgggcatgatcgtcggacaggagaaaccataccagaataagaatgccattaataacggagtcagaatttctggacggggtttctgcgtcaagatgttctacattaaaccgattaaatacaagggcccgatcaaaaagggtgagaagctgggtactcttctccctctccagaaagtctacccaggaatccagtcccatgtgcacatcgagaattgcgacagctccgaccctacagcttatctgtag

SEQ ID NO: 193021 - DNA, 1128 bp, Artificial Sequence
  Description of Artificial Sequence: Synthetic coding sequence
atgacccccatcctgaccgtgctgatctgcctgggcctgagcctggatcctcgcactcacgtgcaagcagggccactccccaagcccaccctttgggctgaaccggggtctgttatcactcaaggcagtcccgtaaccctgagatgtcagggatctcttgagacccaagagtatcacctctaccgcgaaaaaaagactgccctatggattacacgcatccctcaagagcttgttaaaaaaggccagttcccgattctctcaatcacatgggagcacgcggggagatactgttgcatctacggatcccatacagctggcttgagcgagtcttctgaccccctcgagctggttgtgaccggcgcttatagcaaaccaacattgtccgctctgccgagcccggtggtcacttctggtgggaatgtgacaattcagtgcgattctcaggtagcttttgacgggttcatcctttgtgtgagcaaaaaacccagtcttagcgtgcagcctgggccagtggttgctcctggggaaaagctgacgttccagtgcgggtcagacgcagggtatgaccgattcgtcctgtacaaggaatgggggagggactttttacaacgccccggaagacagccacaggcggggctatctcaggccaattttacactggggcctgtctcgcgctcctatggtggtcagtatacatgtagtggcgcctacaatctgagctcagagtggagcgctccgtccgaccctttggacatcctaatcactggccagatcagagcacggcccttcctgtctgtgaggcctggaccaacagtagcttcaggagaaaacgtcacactcctctgccagtcacagggcgggatgcacacttttctgctgaccaaggagggtgcagccgactcgcctttgcgcctcaagtccaaacgccagagccataaatatcaggccgagtttcccatgtctcctgtgactagcgctcacgcaggtacgtatcgctgttatgggtcactcagctcaaatccttatttactgacacatccttctgacccgctggaactggttgtttctggggccgcagaaacactcagccccccccaaaataagtccgactccaaagccggggagtag

SEQ ID NO: 193022 - DNA, 1956 bp, Artificial Sequence
  Description of Artificial Sequence: Synthetic coding sequence
atgacccccatcctgaccgtgctgatctgcctgggcctgagcctgggaccacgtacacatgtccaagcggggcatctccctaagcccaccctgtgggcagaaccaggctcagtcatcactcaggggagtcccgtgacattgaggtgtcagggtggtcaggagacccaggaatacagactgtatcgcgagaaaaagacagctctgtggattactcgaattcctcaggagctggtgaagaagggccaattccctatacctagcataacatgggaacacgcaggcagatatcgctgctactacggatccgatacagctggacgctcagagtccagtgacccattagaactcgttgtgacaggagcctacattaaaccaaccctcagcgcccagccttcacccgtggttaactccggtggaaatgttattctccagtgtgactctcaggtcgccttcgacggatttagtctctgcaaagaaggtgaggacgagcatcctcagtgtctgaactcccagccacacgctcggggttcttctcgggcgattttctcagtcggccctgtctccccatcccgccgatggtggtatagatgctacgcttacgactcaaatagtccgtacgaatggagcctgccctccgatctgctcgagctattggtgttaggggtctccaagaagccctccctgtccgtccagccagggcccatagtggcccctgaagaaaccttgacactgcagtgtggaagtgacgcagggtacaatcgtttcgtgctgtataaggacggggagagagattttttgcaacttgccggagcccagccacaggctggcctcagccaggctaattttaccctggggccggtgtctcggtcctacggggggcagtatcgttgttacggggctcacaatctatcctcggaatggtcagctcctagcgacccactggatatcctaattgccgggcaattctatgatcgggtctccctatctgtccagcccgggcccacggtggctagcggcgagaacgtcacactgctgtgtcagagccagggctggatgcagaccttcctcctcaccaaggaaggtgcagctgacgatccatggcggcttaggagcacgtatcagagtcaaaaatatcaggctgagttccctatggggccggttacgtctgcccacgctggcacatacaggtgttatggcagccagtcctccaaaccgtacctgcttacccatcctagtgatcccttagagctggtggttagcggcccttcaggcgggccaagcagtccaactacgggaccaacctcaaccagcgctgggcctgaggaccagcccctgacaccaaccggatcggacccacagtctggtctggggaggcaccttggtgtggtaattggcatcctggtggctgttattctcctgttgctgctccttcttctcctattcctcatcctgcgccaccgacggcaagggaagcactggaccagcacacaacggaaggctgattttcagcatcccgccggagctgtgggccccgagccaaccgacaggggtttacagtggcgaagtagccccgcagctgacgcacaagaagaaaacctctacgccgccgtcaagcatacccagcccgaggacggcgtcgaaatggataccagaagcccacacgatgaggatccccaggcggtaacgtacgctgaagttaaacactcacgacctaggagggagatggcttccccccctagccccctttcaggggaattcctcgacaccaaagacaggcaggcggaggaggataggcaaatggacaccgaggccgccgcgtctgaggctccccaagatgtgacttatgcccagcttcactccctcaccctaagaagggaggcgactgaacctcccccgagtcaggaagggccaagcccggctgtgccaagcatctacgccactcttgccattcactag

SEQ ID NO: 193023 - DNA, 1956 bp, Artificial Sequence
  Description of Artificial Sequence: Synthetic coding sequence
atgacccccatcctgaccgtgctgatctgcctgggcctgagcctgggtcctcgtacacacgtgcaggctggacatctcccaaagcccacactctgggcggagccaggttctgttataacccaaggaagcccggtcacactcagatgtcagggtggacaggagacgcaagaataccgcttatatcgggagaagaaaaccgctctctggattacgcggattcctcaggaactggtcaagaagggccaatttccaattccatctatcacatgggagcacgcaggtagatatagatgctactatggctcagacacagcaggccgctctgaatcttccgacccactcgagctggttgtcaccggtgcttacatcaaacccaccttaagtgcccaaccatccccagtcgttaactcaggggggaatgttatactgcagtgcgattcacaagtggcatttgatggattctcgctgtgtaaggagggagaggatgaacatcctcagtgcctgaattcacagccgcatgccaggggcagctcccgggccattttttccgtggggccggttagtccctctcgtcggtggtggtaccgctgttacgcatacgacagtaactctccatacgaatggagcctgcccagcgatctcttagagctcctggtgctcggtgtgtccaaaaaaccctccttaagcgttcaaccaggtcccattgtggcccccgaggagaccctgacgctgcagtgcggatcagatgcaggctacaatagatttgtgctctacaaggatggcgaacgggatttcctgcaactggcgggcgcgcaaccacaggccggtctgagtcaggctaatttcactctgggccctgtgtctcgatcatatgggggccagtataggtgttacggagcccataacctttcaagtgagtggtcggctccaagcgatcctctcgatattctgatcgctggtcagttttacgatcgcgtgtccttaagtgttcaacccggtcctaccgtcgcctctggggagaacgtaactctcctttgtcaaagccaggggtggatgcagacttttctgctaacaaaggaaggcgcagcggacgatccttggagacttaggagcacatatcaaagccagaaataccaggcggaatttccaatgggaccagttaccagtgcccacgctgggacttatagatgctacggcagccagagctcgaagccttatctccttacccaccccagcgatcctctggagctcgtggtgtccggacctagtggaggcccatcgtctccgactaccggaccaacaagcactagtggcccggaagatcagcctctgaccccaaccggatcggatccacagagcgggctcgggcgacaccttggcgtagtgatcggtatactggttgcagtgatccttctgctcctgctgctccttttgctgttcctgattctacggcaccggcggcagggtaaacactggacctcaactcagaggaaagctgattttcagcaccctgcaggtgcagtgggacccgaacctactgatcggggactgcagtggagaagcagccctgccgctgacgctcaggaagagaatctttatgcagctgtcaagcacacgcagccagaagatggtgtcgaaatggacaccagacaatcaccccacgatgaagaccctcaggccgtgacctacgccgaagtgaaacacagcagaccccgccgcgagatggcctcaccaccaagtcctctttctggcgagtttctagacacaaaggataggcaggccgaggaagatcgtcaaatggacaccgaggcagccgccagcgaggcgccccaagatgtgacctacgcccaactccacagcttgacactgcgaagggaggctacagaacctccacccagtcaggagggcccctctcccgctgtcccctccatttacgccaccctggcaatccactag

SEQ ID NO: 193024 - DNA, 1794 bp, Artificial Sequence
  Description of Artificial Sequence: Synthetic coding sequence
atgacccccatcgtgaccgtgctgatctgcctgggcctgagcctggggccccggactcacgtgcagaccggtacaattcctaagcctacgctttgggccgaaccggactctgtcatcacacagggcagcccagttacactgtcctgccagggtagcctcgaagcacaggagtacaggctctaccgtgagaaaaaatcggcctcttggattaccagaattcgcccagagctcgtgaagaacggtcagttccacattcccagtatcacatgggagcacacaggccgatatggctgtcagtactactctcgcgcccggtggtcggagttatctgatcctctcgtgcttgttatgacaggagcttatcccaagcctaccttgtctgcccagccctctcccgtggtgacttccggtgggcgtgtgaccctacagtgtgaaagtcaggtggcctttggcgggttcatcctctgtaaggaaggagaagaagagcatccgcagtgcttgaattcccagccccatgcccggggttcaagccgggccattttctcagtggggcctgtgtcacccaaccgacggtggagtcatcggtgttacgggtatgatctgaactccccttacgtgtggtcatccccctccgacctcctggaactgctcgtgccaggggttagtaaaaaaccctcactgtccgttcagcctggccccgttgtggctcctggagaaagcttgacactacagtgtgtttccgacgttggctatgatagatttgtcctctataaggaaggcgagcgggatctccggcagctgcctggtagacagcctcaggcaggtctatcgcaggcaaattttaccttaggtcctgtgagtcgtagttacgggggacagtatcggtgttacggagcccataacttatcgtccgaatgctccgcgccttctgacccattggatatcctgataactggccagatcagagggaccccctttataagcgttcagcctgggcctacggtggcaagcggtgaaaatgtcactctcctttgccaaagctggcgtcagttccataccttcctgctgacaaaggctggagccgccgatgcccctcttcggctgcgcagcatacatgaatatcccaagtaccaagccgagtttcccatgagcccagtcacttccgcccatgctggtacgtataggtgctacggctctctgaattccgacccctatctcctatcacacccatctgaacccctggagcttgtagtgtccggaccatccatgggtagctccccacctcctactggacccatctcgaccccgggaccggaggatcagcctctgacacccaccgggtctgacccacagtccggccttgggaggcacctaggagtagttattgggatccttgtggcagtagtgcttctgttgctcttactactgctgctgttcctgatactcagacataggagacaagggaaacactggactagcacccagcggaaggccgacttccaacacccagccggcgcagtaggccccgaaccgactgatcgaggccttcagtggcggagcagccctgccgcggacgcgcaggaagagaacctgtacgcagcagtgaaggacactcagccagaggacggtgtggagatggataccagagccgctgcaagtgaggcgcctcaggacgtaacttatgcacagcttcattcgctgacactacggcgtaaagctacagagcctcctcctagccaagagcgggaacctcctgccgagccatccatctacgcaacactggccattcactag

SEQ ID NO: 193025 - DNA, 1899 bp, Artificial Sequence
  Description of Artificial Sequence: Synthetic coding sequence
atgacccccgccctgaccgccctgctgtgcctgggcctgagcctggggccccgcactcgggtgcaggccgggcccttccctaagcccacattatgggcagaacctggaagtgtgatttcatgggggagcccagttacaatctggtgccagggatcccaggaagcgcaggagtacagattacacaaagagggttcaccggagccgttggacaggaataaccccctcgagcctaagaataaagcacggtttagcatcccatctatgaccgagcatcacgcaggacggtatcggtgtcactattacagctcagctggctggagtgagccttctgaccccctggagatggtcatgaccggcgcctattctaaaccgacgctgtccgccttgccaagcccggtggtcgcttctggaggcaacatgacgttgaggtgcggctcccagaagggctaccatcactttgtcctgatgaaagagggggaacaccagctgccaagaacacttgattcccagcagctgcattcacggggtttccaggccctcttcccagtcggccctgtgacaccttctcacaggtggaggtttacatgctattactactatactaacactccttgggtctggtctcaccccagcgacccgctcgaaattctgccatctggggtgtcacgtaaacctagcttgcttacactgcagggcccggtcctcgctccaggccaaagtctgaccttacagtgtggatcagatgtaggatacaacagattcgtgctatataaagagggggaacgagactttctgcagcgtccaggacaacagccacaagccggcctgtctcaggcaaacttcacactgggccccgtgagcccatcaaacgggggtcagtaccgctgctatggggcccataatctaagtagtgagtggtctgctccgtccgacccactgaacattcttatggctgggcagatctacgacaccgtgagcctgagtgctcagcccggacctacagtggcttccggtgaaaatgtcacgttactctgtcagtcatggtggcaatttgacaccttcttgttaacgaaggaaggcgcagctcatccgcccctgaggctgcgaagtatgtacggcgcacacaagtaccaggcagaattcccaatgtcccctgtaacaagcgcgcatgccggcacgtatcgctgctacggatcatattcgagtaatccccatcttctgtcacacccgagtgaaccgttggaattggtggtatccgggcactctggaggctctagtcttcctccgacaggaccgcctagcactcctggactcggccgatatcttgaggttttaattggggtgagcgtcgcctttgtgctcctgctctttctgttattgttcttgctactgcggaggcagcgccacagtaaacatcggacctctgaccaacgtaaaactgattttcagcgccccgccggcgccgctgagactgagccaaaagataggggactcctgcgaaggtcatcaccagcagctgacgtccaggaggagaacctctatgctgcagtgaaagacacccaatccgaagacagggtagagctggactcgcaacagagcccccacgatgaggacccacaggcagtcacttatgcccctgtgaaacattctagtccacggcgggaaatggcctcgccccccagtagtctgagcggggaatttctggacacgaaagacagacaggtggaggaggatcgacagatggacacagaagctgccgcatccgaggcctcccaggatgtgacctatgcacaactgcacagcctcacgttgcgacgaaaagccactgagcctccaccctcacaggaaggagaaccacccgccgagccatccatctatgctaccctcgcaattcactag

SEQ ID NO: 193026 - DNA, 1344 bp, Artificial Sequence
  Description of Artificial Sequence: Synthetic coding sequence
atgatccccaccttcaccgccctgctgtgcctgggcctgagcctgggtccccggactcacatgcaggcgggcccgctcccaaagcccacactttgggccgagcccggtagcgtcatcagttggggaaactcggtgacgatctggtgtcaggggaccctggaggccagagagtatcgattggacaaggaggaatcaccggcaccctgggaccgccagaacccactggagcctaagaacaaggcacggttctcaatccccagcatgaccgaggactacgccggacgctatcgttgctactaccgaagccccgtgggctggtcccaaccatcagacccactggagctcgtgatgacaggagcctacagcaaacctacactttccgcattgccctctcccctggtgacaagcggaaaaagcgtgacgctgctttgtcagagcaggagccctatggacaccttcctgctcatcaaagagagggcagcgcaccccctgctccaccttcgttccgagcacggggcccagcagcaccaggctgagtttccgatgagccccgtgacaagcgtgcatggcggaacataccggtgttttagcagccacgggttctctcattatttactcagtcacccctcggatcccctggaactcatcgtctccgggagcctggaagatccccggcctagtccaaccagaagcgtctccaccgcggccgggcctgaggatcaaccattgatgcctactggcagcgtccctcactcaggtcttagaaggcactgggaggtccttatcggagttctggtggtgtcaatcctcctgctgagccttctcctcttcttgctcctgcagcactggaggcagggaaaacaccgtacactagctcagagacaggctgactttcagcgacctccaggcgccgccgagcctgaacctaaggatggaggcctgcaacggagatcttcacccgcagccgatgtccagggggagaacttctgtgccgccgttaagaatacccagcctgaagacggcgtggaaatggatacccgcagtccgcacgacgaggacccgcaggcagtgacttatgccaaagttaagcattcacgacccagacgcgaaatggcttctcccccatcaccgctctctggcgagttcctggataccaaagacagacaggccgaggaagacagacagatggacactgaggctgcagcctccgaagccccccaggatgtcacctacgcccagctgcatagttttacattgcgccagaaggctaccgaacccccaccttcacaggagggggcctctcctgccgaaccgtccgtgtatgctactctggcaatccattag

SEQ ID NO: 193027 - DNA, 1476 bp, Artificial Sequence
  Description of Artificial Sequence: Synthetic coding sequence
atgaccctgaccctgagcgtgctgatctgcctgggcctgagcgtgggaccccgaacatgtgtacaggctgggaccttaccaaagccaaccctttgggccgagccagcctctgtgattgcccgcggaaagccagtcactttgtggtgccaaggacctcttgaaaccgaggagtaccgcctggataaggaaggcttgccgtgggctcgaaagcgacagaatcctctggagcctggggcgaaggccaagttccacattccatcaaccgtctacgattcagcaggtcgataccgatgttactatgagacacccgccggttggtctgagcctagcgatccactggagctggtcgctacaggagtctctcggaaacctagcttgttaattccccaggggtctgtagtggcccggggtgggtccctcacactgcagtgcaggtccgacgtaggatacgacatatttgtactctacaaggaaggggaacacgatcttgtgcagggttctggtcagcagccccaggccggcctgtcccaggcgaatttcactctcggccctgtttctagatctcacgggggtcagtacaggtgttacggtgcccacaatctcagtccaaggtggtcggcccctagtgaccctcttgatatcctaatagcagggctgatcccggatatcccagcgttgtctgtccagcctggacctaaggttgcctctggggagaatgtgactttactatgccagtcatggcatcagatcgacacgttcttcttgacgaaagaaggcgcagcacaccccccattgtgcctaaaaagcaagtaccagtcctaccggcaccaggccgagtttagcatgtcacctgtgacgtccgctcaaggtggaacttatagatgctactctgcgattcggagttacccctatctgctcagcagcccttcttaccctcaggaattggtcgttagcgggccttcaggcgatccttccttaagtcccacggggtcaacccctactcccgctggacccgaagatcaaccacttactccgactggcttggacccccaatctggtcttggccggcatctgggagtggtgaccggtgtctcggtggcgttcgtgctgctattgttcctcctgctgtttctgctgctcagacacagacaccaatccaagcacaggacgtccgcgcacttttacaggccagccggagccgctggaccagagcccaaagatcaagggttgcagaagagggcctccccagttgcggacattcaggaagagatcctcaacgcagctgtgaaggacacccaaccaaaggacggcgtcgagatggacgctcgggccgcagcttcagaggcaccccaagacgtcacgtatgcccagcttcatagtttaactttaaggagggaagctaccgagcctcccccttcccaggagcgcgaacccccagccgaaccttctatctacgcaccgctggccatccattag

SEQ ID NO: 193028 - DNA, 1470 bp, Artificial Sequence
  Description of Artificial Sequence: Synthetic coding sequence
atgacccccatcgtgaccgtgctgatctgcctgcggctgagcctggggccacggactcacgtgcaggctggtacccttcccaagcctactttatgggcagagccgggtagtgtcattacacagggaagcccggtgacactctggtgccagggcatcctcgaaacacaagagtacaggctttacagggagaagaaaacagccccatggattacaaggatcccacaggagatcgtgaagaaaggccaatttcccatcccaagcattacatgggagcacactggcagatataggtgtttctacggctctcacaccgcaggttggtccgagcctagcgacccattggagcttgtggtgacaggggcttacatcaagccaacgctgagcgctttgccctctccagttgttacaagcggcggtaatgttacactccattgtgtttcacaggttgcctttggatcttttatcttgtgtaaagagggtgaagatgaacacccccagtgcttaaatagtcagcctcgcacccacggatggagccgggcaatcttctctgtgggtccagtcagcccctcaaggagatggtcctaccgctgctacgcctatgatagcaactcacctcatgtgtggagtctgccctccgacttgcttgaactgctagttctcggtgtgtctaaaaagcccagcctgtctgtgcaacccgggcccatcgttgcacctggagagtccttgactctgcagtgtgtatcagacgtttcatacgaccggttcgtcctctacaaggaaggtgagagggactttctccagctgcccggcccccagccgcaagctgggttgtcccaagctaactttaccctgggacccgtgtcgaggtcttatggcggccaatatcgttgttctggagcttacaacctgtcgagcgagtggtccgctccctccgatcctttagatattttgatcgctggccagtttagagggcgaccgttcatctctgttcacccaggacccacagtggcctctggtgaaaatgttacactcctttgccaatcatggggcccttttcacaccttccttctgactaaagccggggccgctgatgccccccttaggctacgcagtattcatgaataccccaagtaccaggcagaattccctatgagtccggttacatcagctcattctggcacttatcggtgctacggtagcctgtcttcgaacccataccttctctcccaccccagtgattccctggagcttatggtgtcgggagcagctgaaaccttgagtcctccccaaaataagtccgattccaaagctggagctgcgaacacactgtccccgtcccaaaacaaaactgcctctcatcctcaggattataccgtcgaaaacttgattcgcatggggatcgctggtctcgtactggtagtgttgggcattttgctgtttgaggcccaacatagtcagagaagcctctag

SEQ ID NO: 193029 - DNA, 1401 bp, Artificial Sequence
  Description of Artificial Sequence: Synthetic coding sequence
atgacccccatcctgaccgtgctgatctgcctgggcctgagcctgggcccccggacacacgttcaagccggccacctccctaaacctaccttatgggctgagcccggatccgtgatcattcagggcagccccgttacactgcggtgtcagggttcccttcaagcggaagaatatcacctgtatagagaaaataagtctgcttcttgggtgcggcggatacaggagccaggcaagaacggtcaatttccaattcctagtataacctgggagcatgctggcaggtaccactgtcagtattatagccataaccattcaagtgaatattccgacccactcgagcttgtcgtgactggcgcctactctaaaccaactctcagtgctctgcccagccccgtcgtcacactcggtggaaacgtcactctccaatgcgtgagtcaggtggcttttgatggctttatactgtgcaaggaaggggaggacgaacatccccagcggctgaatagccattcccacgcccggggttggtcttgggccatcttcagcgtgggtcccgtgtccccttcaagacgctggagctaccgatgctacgcttacgacagcaactccccttatgtgtggagcctcccatcagatctacttgagcttctagtgcctggtgtgtcaaagaagccttctttgtcggttcagcctggcccaatggtggcaccgggcgagagccttacgcttcagtgtgtgtccgatgtgggctacgataggtttgtcttgtacaaggagggcgagcgcgatttcctacaacgccctggatggcagccccaagctgggttgagccaggccaactttaccttagggcctgtgtctccttctcacggaggacagtataggtgctatagtgctcataatctaagctccgagtggagtgcaccctcggatcccttagacattctcatcacaggacagttttatgataggccatctctcagcgtgcaaccagtcccaacagtagcacccggcaagaatgtaaccctgctctgccagagtcgggggcagtttcacaccttcctcctcacaaaagagggggctgggcacccacctctgcacctgaggagcgagcatcaggcccagcaaaaccaggcagaatttagaatgggccccgtgacgtccgctcacgtgggcacctaccgctgctattcatcactctctagcaacccctaccttctgtcccttccatcagacccgttggagctggtcgtgtctgccagtttgggccagcatccacaggattatacagtagagaatctgatcagaatgggcgtagcaggcctggtcttagttgttttaggtatcctattattcgaggcccaacacagccagagatcattgcaggatgctgctgggcgctag

SEQ ID NO: 193030 - DNA, 1452 bp, Artificial Sequence
  Description of Artificial Sequence: Synthetic coding sequence
atgacccccatcctgaccgtgctgatctgcctgggcctgagcctgggccccaggacccatgtccaggcagggcatctgcccaagcccaccctgtgggcggagcccgggagcgtgattattcaaggatctcctgtcacactgcggtgccaggggagtctccaggctgaagagtaccacctgtatcgcgagaacaagtcggcttcctgggtaaggagaatccaggaaccaggtaagaacggccagttccctataccatctatcacttgggaacatgccggacggtaccactgccaatactatagccataatcacagttcggaatacagcgaccctctggaacttgttgtcacgggggcctatagcaaaccaacattgtctgcattaccttcacctgtcgtaactctcggcggcaatgtcaccctccaatgcgtttcgcaggtggccttcgacggatttattctttgcaaggagggagaagatgaacaccctcaaaggctaaactcccacagtcacgcacgtggatggagttgggccatcttcagcgtgggacctgtttcgcctagtaggaggtggtcttataggtgctatgcttacgattccaactcaccttatgtctggagcctaccttctgatttgctggaactcctggtgccaggcgtctcgaagaagccttccctaagcgttcagcctggcccaatggtcgcccctggcgagagtttgactctgcagtgcgtgagcgacgtcggttatgatcgtttcgtgctgtacaaggagggggagagagatttcctgcaacgccccggctggcagccccaagccggactgagtcaggccaatttcaccctgggacctgtgtctcccagccacggtgggcagtaccgatgctactccgcgcacaatctgtccagtgagtggtctgccccctccgaccctctggatatcttgatcaccggccagttttatgatcggccctctctgagtgtccaaccagtgccaacggtggcccctggcaagaacgttacattgctctgccaaagccgagggcagttccacactttcttgcttactaaggaaggggcaggacacccacctttacacctgagaagcgagcaccaagcccaacagaaccaggctgagttcagaatggggcccgtcacttccgcccacgttggcacatatcgctgttactcctcgctttcgtctaatccttacctattgtctctcccttcagaccccttggaactcgtggtttcagaagcagcagagactctctctccttcgcagaacaagacagatagtacaaccactagtcttggacaacatccccaagactacactgttgagaatcttatccggatgggcgtggcaggcctggtgttggttgtattaggcatcctgttgtttgaagcccaacactcccagaggagtctgcaggatgccgctgggcgttag

SEQ ID NO: 193031 - DNA, 1452 bp, Artificial Sequence
  Description of Artificial Sequence: Synthetic coding sequence
atgacccccatcctgaccgtgctgatctgcctgggcctgagcctggggcccagaacacatgtgcaggccggacacttaccgaagcctaccttatgggctgagcctgggagtgtgatcatccagggctccccagttaccttacgctgccagggctctctgcaggcagaggagtaccatctctacagagagaataagtctgcctcttgggtgagacggatccaagaaccaggaaaaaacgggcagttccctattccatctatcacttgggaacatgcaggccgctatcactgccaatactattcacacaatcactcaagtgaatatagtgatccactggaattagtcgtgaccggtgcgtacagcaaaccaacattgtcagccctgccaagtcccgtagtgactttgggtgggaatgtcactcttcagtgcgtgagccaggtggccttcgacggttttatcttatgtaaagaaggcgaggatgaacatcctcagagattgaattctcattcccacgcccgagggtggtcatgggccattttctcagtcggtcctgtcagcccatcccggaggtggtcctacaggtgctatgcatacgatagcaactcaccttatgtttggtccctccccagcgacctcctggagctgttggtcccaggggtttctaagaagccaagcctgtcagtccaaccagggcctatggttgcccctggcgagtcactgactctccagtgcgtgtccgatgtgggctatgataggttcgtgctctacaaggagggagagcgggattttttgcagcgcccgggttggcagccccaggccgggctatcccaagccaacttcacactggggcccgtctcaccatcacatggggggcagtacagatgctattcagctcataacctatcttccgaatggtctgcaccttccgatccactagacatcttgattacagggcagttctacgacagaccatctttatctgtccagccagtccctactgtggctccgggcaagaacgttaccctgctctgccagagccggggtcagttccatacatttctcctgacgaaggagggagctggacatccacctctgcaccttaggtccgagcaccaggcccagcaaaatcaggctgagtttagaatgggcccagtgacaagcgcccacgtgggaacctatcgctgctattcgtcgctgagctcaaacccataccttctgtccttgccgagcgatccccttgagttagtggtgtctgaagctgccgagaccctgtctccctctcagaataaaactgactccaccacaacgagtctgggccagcaccctcaggattacactgtggaaaacttgataaggatgggagtcgctggcttggtgctggtggtgctgggtatactcttgttcgaagcacagcattcacagcgaagcttgcaggacgctgccggccggtag

SEQ ID NO: 193032 - DNA, 984 bp, Artificial Sequence
  Description of Artificial Sequence: Synthetic coding sequence
atgacccccatcctgaccgtgctgatctgcctgggcctgagcctgggcccccggacccacgtgcaggccggacacttgcccaagccaacactgtgggccgagcccgggtcagtgatcatccagggttctccggttaccctgcgatgtcagggtagtctgcaggctgaagagtaccacctctacagagagaacaagtcggcttcctgggtgcgcaggatccaggagccaggaaaaaacggacaattcccgataccaagcatcacatgggagcacgctgggcggtatcactgccagtattatagccacaaccacagctcagagtactctgatccccttgagctggttgtgaccggggcttactcaaagcctacgttgtccgcgctgccttccccagttgtcaccctaggagggaatgttaccctccaatgcgtcagccaagtagccttcgatggctttatattatgcaaggagggcgaagacgaacaccctcagcggcttaattcacatagtcacgcccgcggctggagctgggctattttttccgtaggtcccgtaagcccgtcccggcgctggtcttatagatgttacgcatatgatagcaatagtccctatgtctggtcactgcctagcgatctgctcgagctgttagtccctggcgtcagcaaaaaaccaagcttgagtgtgcaaccagggcccatggtggcccctggtgagagcctgacactgcaatgtgtctcagacgtgggttatgatagattcgttctctacaaggagggggaacgcgattttctgcagagacctggctggcaaccacaagcaggcctatcacaggctaacttcacactggggcctgtctccccctcacatgggggccaatataggtgttattccgctcacaacctatcatcggaatggtccgcaccatccgatcccctagacatcctcatcaccggacaattttatgacaggcccagtctcagttag

SEQ ID NO: 193033 - DNA, 1320 bp, Artificial Sequence
  Description of Artificial Sequence: Synthetic coding sequence
atgacccccatcctgaccgtgctgatctgcctgggcctgagcctggatccacgaacacacgttcaagcaggtccactgcctaagcccaccctgtgggccgaaccgggttcagttatcactcaggggagcccagtgacactccgatgtcaggggtcactcgaaacccaggaataccatctgtatcgggagaaaaagaccgccctctggatcacccgaataccccaagaactcgtgaagaaggggcaattccccatcctcagcattacttgggaacatgctggcagatattgctgtatttatggatcccatacggcaggtctttcagaaagtagcgatcctttggaactcgtcgtcaccggcgcctactctaagccaaccctgagcgccctcccctcccccgtggtgacaagcggcgggaatgtaacaattcagtgcgattcccaggttgctttcgatggattcatactgtgcaaagaaggtgaggacgaacaccctcagtgcctgaattcccactcacacgcacggggcagctcccgagccattttttctgtgggtccggttagccctagcagaagatggtcctatcggtgttacggctatgacagccgggccccttacgtgtggtccctgccctccgacttgctgggcctgcttgtgcccggggtctcaaagaagccttcactgtcagtgcagcccggaccagtggtggccccaggagaaaagctcacattccagtgtggctccgatgctggatacgaccggttcgtactctataaggagtggggccgggattttttacaaaggccgggcaggcagcctcaggctggtttgtctcaggccaacttcacgttggggccagttagtcgaagctacggcgggcagtacacgtgctctggtgcctataacctgagctctgagtggtccgctccgtcagatcctctcgatatactaattacagggcaaattcgcgctagacccttcctgtctgttcggccgggacctactgtggcctcgggtgagaatgtcacactgctctgccaatcccaaggaggcatgcatacgttcctgttaaccaaagagggtgccgccgattcaccactgcgcttgaaatcgaagcggcagagccataagtatcaggctgagttccctatgagccctgtcacttcggctcacgcagggacataccggtgctacggatcactgtcctccaacccctatctgctgacgcatccgagcgaccctctcgagctcgtcgtgtcaggggcagccgaaacactgagcccaccccaaaacaagtccgactccaaagccggcgaatag

SEQ ID NO: 193034 - DNA, 1371 bp, Artificial Sequence
  Description of Artificial Sequence: Synthetic coding sequence
atgcaccggggcctgatccacccccagagcagcgccgtgggcggcgacgccatgaccccaatcttaacagtattgatttgcctcgggttatcactggaccctcggacccacgtgcaggcagggccattgcccaaaccaacactgtgggcagagcctgggtcagttatcacccaggggagccctgtgacactgcgatgtcaggggagcctcgagacacaggagtatcacttgtatcgggagaaaaaaacagcactctggattactagaatcccccaggagctggtaaaaaaaggtcagttcccaattctgagtatcacctgggagcatgccggccggtattgttgcatatatgggtcacacaccgccggtctgtcggagagttcagacccactggaactcgtggtgacaggtgcctattccaaacctacactgagcgccctgccaagtccagtggtgacgtctggcggcaatgtcaccatacaatgtgactcacaagtggcattcgatggctttatactatgcaaagagggcgaggacgagcacccacagtgtcttaattcccatagccacgccaggggaagttcaagggctattttcagtgttggtccagtgagcccgtcccggcgttggtcatatagatgctacgggtacgattcccgtgcaccatacgtgtggtccctgcccagtgaccttttgggattgctggtaccaggagtttccaaaaagcctagtttaagcgtccaaccaggacccgtcgttgcacccggagaaaaactgacatttcaatgtgggtccgatgccggctatgacaggtttgtactgtacaaggaatggggcagggacttcttgcagagacctggccgccaaccccaggctgggttatcacaggcaaactttaccctgggccccgtgtcgcggtcatatggcggtcaatacacctgctccggcgcctataatctgagctctgaatggagcgcaccttcggaccctctggatatactgatcactgggcagatacgtgcccgcccgttcctgtccgtacgaccaggcccgacggtagccagtggggagaatgttactcttttgtgtcagtctcaagggggtatgcatacgttccttctcactaaggaaggagccgccgacagtccgttgcgcctgaaaagtaaaaggcaatctcacaaatatcaggcggagtttccaatgtcacctgtgacatccgcccatgccggtacatatcgttgttacgggtcgctttctagcaatccctatctcctcactcacccctcggatccactggagcttgtcgtctctggcgctgccgagacgctgtcaccaccgcagaataaaagcgattctaaggccggagagtag

SEQ ID NO: 193035 - DNA, 1959 bp, Artificial Sequence
  Description of Artificial Sequence: Synthetic coding sequence
atgacccccatcctgaccgtgctgatctgcctgggcctgagcctgggaccccgtacgcatgtccaggctggccacctgcccaaacctacgctatgggctgagccgggctctgttattactcaggggtctcccgtcaccctgagatgtcagggcggtcaggaaacacaagagtatcgtctgtatcgggagaaaaagaccgccttatggatcactaggattccccaggaactggttaagaagggccaattcccgattccttcaatcacctgggaacacgcaggccgttaccgctgttactacggcagcgacacagccggccgaagcgaatcttctgacccactggagctggtggtaaccggcgcgtacatcaaacctacgctgagcgcacaacctagccccgttgtgaattcaggcggcaatgtcatcctgcaatgcgattcccaggtggcctttgatggcttcagcttatgcaaagaaggcgaagatgagcatccccagtgtctgaattcgcaacctcacgctagagggtctagtagagccatcttctcagtgggacccgtgtcgccgtcgcggaggtggtggtaccggtgttatgcatacgattcaaactcgccctatgagtggtcgctaccctccgatttgctggaactcctggtgctgggggtgagcaagaaaccctcactgtcagtgcaacctggccctatcgtcgcccctgaagagactctgactctgcagtgcggtagcgatgcgggctataaccggtttgtgctgtacaaagacggcgaaagagactttctccagctcgccggcgctcaaccacaagccggactctcccaggcaaacttcacactcggccctgtgtctaggtcgtatggtggacagtacagatgctacggtgcacacaacttaagtagcgaatggtctgccccctcagaccccttggacatcttaatagcgggacagttttacgatcgtgtttctctctccgttcagccagggccaacagtcgcatctggagaaaacgtcaccctgttgtgccagtctcaagggtggatgcaaacatttctgttaaccaaggaaggggctgccgacgatccctggaggctgagatccacctaccagtctcagaaataccaggccgagttcccaatgggacctgtgaccagcgcccacgctggaacgtatcggtgttatggttctcagtcctccaaaccgtacctccttacccacccaagtgaccctctcgaattagtggtctcgggcccatctggcggacctagcagtcccaccactgggcctacatcaacctctgcaggtccagaagaccagcctctcacccccacgggatccgacccccagagcggtctgggtagacatttgggggtggttatcggcatcctggtagcggttattttgctgctgctgctgctgctccttctgtttttaattctgaggcacagacgtcagggcaaacattggaccagcacgcagcgtaaggcagacttccagcatcctgcaggcgctgttggcccagaacccacggaccggggacttcagtggaggtcctccccagcagccgacgctcaggaggagaatctctacgcagccgtcaaacacacccagcccgaggatggggtggaaatggatacgcgtcagagcccacacgacgaggacccccaagcggtcacctatgccgaagtcaagcacagccgacccagaagagagatggcttcacctccctccccgttatccggagaattcctcgacacaaaggatcggcaggcagaagaggatcgccagatggacaccgaggctgccgcaagcgaggctccacaggatgtgacctatgctcagctccactccttgactctcagacgcgaggccactgaacctcctccttctcaggaaggcccctctccggccgtgccgtcaatatacgcgacactagccatacactag

SEQ ID NO: 193036 - DNA, 1953 bp, Artificial Sequence
  Description of Artificial Sequence: Synthetic coding sequence
atgacccccatcctgaccgtgctgatctgcctgggcctgagcctgggccctaggacacacgttcaggctggccacctgcccaaaccgacactgtgggccgagccaggatcggtcatcacacaggggagccctgtcacgttgcgatgccaaggtggtcaggagacacaggagtatagactgtatcgtgagaaaaagaccgctctgtggattacgaggatccctcaggagctagtaaagaaaggacagttccccattccaagcatcacttgggaacatgcagggcgctaccgctgttactatggatccgacacagccggccgaagtgagagcagcgaccccttggagctcgtcgtcacaggagcttacattaaacccaccttaagtgcgcagccttccccagtggtcaactcaggagggaacgttatcctccaatgcgattcacaggttgcattcgatgggttctccctatgtaaggaaggtgaggatgagcatccgcagtgtctcaattctcagccacacgcaagaggcagctcaagagccattttttctgtaggccctgtcagtcctagccgtcggtggtggtaccgttgctatgcctatgattctaattccccttatgagtggtctctccccagtgacctgctggagttgctggtcctgggggtgagtaagaagccttctctgagtgtccagcctggacccatcgtcgccccagaagagaccctgacccttcaatgtggatccgacgctggctataatcggttcgtgctttataaagacggagagagagatttcctccagctcgcgggcgcccagccacaggctggcctgtcacaggctaattttacattggggcccgtttcccggtcttacggaggccaatatagatgctatggtgctcacaatctatcaagtgagtggagcgcccctagtgacccactggatatcttgatcgcgggtcaattttacgacagggtgagtctcagcgtgcaaccaggtcctacggtggcttccggggaaaacgtaactctgctgtgtcagtcccagggctggatgcaaactttcctcctgacgaaggaaggcgccgccgacgatccatggaggcttaggtctacttaccagagccagaagtatcaggccgagtttccaatgggcccagtgacgagcgcccatgccgggacctaccgctgctacggaagtcagtcctctaaaccttatttgctgacacatccctccgatccgctggagttggtggtcagcggtcctagcgggggcccttctagtcccactacaggacccacttccacatcggggcccgaagatcaaccccttacaccaactggcagtgatccgcagtctggactgggtcgccacttgggtgtcgtgattggcatcctggtggcagtcatcctgctgctgctgttattacttctcttgttcctgatcttgaggcacagaagacagggtaagcactggacaagcacccagagaaaagcagactttcagcaccctgcaggcgcagtggggccggagcccaccgacagggggttgcagtggagaagttcacccgcagctgatgcgcaagaggagaatctatatgctgcagtgaagcacactcagcccgaagatggggttgagatggatacaaggagcccccacgatgaggacccccaggccgtaacctacgctgaggtcaagcactctaggccccgaagagagatggcctctcccccgtctccacttagcggcgagttcctggataccaaagatcgccaggctgaagaagaccgtcaaatggataccgaagctgctgcatcagaggccccccaagacgtcacctatgctcagctccactccctgactctgaggagggaggccacagagcctccccccagtcaggaaggacccagccccgctgttccttccatctatgctactctcgccatccactag

SEQ ID NO: 193037 - DNA, 1953 bp, Artificial Sequence
  Description of Artificial Sequence: Synthetic coding sequence
atgacccccatcctgaccgtgctgatctgcctgggcctgagcctgggcccacgaacgcacgtgcaggctgggcacctgcccaaaccgaccctctgggccgaaccagggtctgtaatcacccaggggtctcctgtcacattacgatgccagggggggcaagagacccaggaatatcgtctttatcgagaaaagaagactgctctttggatcaccaggattccgcaagagctggtgaagaagggccaatttcccattccctctataacatgggagcacgcagggcgctaccgttgctactatgggtccgataccgccggaaggtccgaatcctccgacccactggagctcgtggtgaccggagcatacattaagccaacgctgagtgcgcagccttcaccagtagttaatagcggaggaaatgtcatcctccaatgtgatagccaggtggcctttgacggcttttccctgtgcaaagaaggcgaagatgagcatccccaatgtctgaatagtcagccacacgcaagagggtcaagcagggcaatcttttctgtgggacccgtgtcccctagcaggaggtggtggtaccggtgttatgcctacgactcaaattccccttacgaatggtccctgccttccgatctgcttgagttgctcgtgctaggggtgagcaaaaaaccaagtctttctgtgcagccaggtcctattgtcgcccctgaggaaaccctcacccttcaatgcggctctgatgctgggtacaataggtttgttttgtacaaggatggggagcgggactttttacagttggctggagctcagccccaggctggcctgagtcaggctaatttcacactggggccggtgtccagatcatacggaggccagtaccggtgctatggggcccataatctttcaagcgaatggagcgcgccctcggacccgcttgacattctgattgcaggccagttttacgatagggtcagcctttccgttcagcccggccccaccgtagccagtggagaaaatgttaccctgttatgtcagtctcagggctggatgcagacctttttgttgactaaggagggcgctgcagatgatccctggcgcctgcgtagcacttaccagtcgcagaagtaccaggcggaattccctatgggccccgttacgtctgcgcacgccggtacttataggtgctatgggagccaatctagcaagccctacctcttaacacacccctctgacccgttggaattggtggtttcaggtcctagcggcggcccgtcctccccgaccacaggaccaacatctaccagtggcccagaagaccagcccctgactccaaccgggagcgatccccagagtggtcttggcagacacttaggagtagtgattggaatcttggtggctgtgattcttctgcttttgctcctgcttttactctttttgattctgaggcacagacgccagggcaaacactggacaagtacacagcgaaaggcagacttccagcatcctgccggagccgtgggaccggaaccgactgatcgtggactccagtggagaagttctccagcagctgatgcgcaggaagaaaacctctacgccgctgttaagcatacccagcctgaggatggagttgaaatggatacgaggtcaccgcacgacgaggacccccaggccgttacttacgccgaagtgaaacactcacggcccagacgcgaaatggccagccccccatcccccctgtctggtgagttcctggacactaaggacaggcaggctgaggaggataggcagatggataccgaggcggctgcatcggaagcccctcaggatgtcacctatgcccagctccattcactcacactgcgcagggaggctaccgagccccccccctcccaagaaggcccaagcccagcggtgccttctatttacgcaacactcgcaattcattag

SEQ ID NO: 193038 - DNA, 1905 bp, Artificial Sequence
  Description of Artificial Sequence: Synthetic coding sequence
atgacccccatcctgaccgtgctgatctgcctgggcctgagcctggggccccggacacatgtgcaggcaggccacctacctaaacctacattgtgggctgaacctggctcagttatcacccaggggtcaccagtcactttaagatgtcagggaggacaggagactcaggaataccgcttatatcgagaaaaaaagaccgcgctttggattactcgcattccgcaggagctggtcaagaaagggcaattcccaataccaagcattacttgggagcatgccgggcgctacaggtgttactacggaagtgacacggctggtagatcagagtccagcgatccactggagctagtggtcacgggggcctatatcaagcccaccctgagcgcccagccttcacctgtagtgaactcaggaggaaatgtcattctgcagtgtgactctcaggtggcctttgatggtttcagtttgtgtaaggagggagaggacgagcatccgcagtgcctgaatagtcaaccgcacgccagagggtcgagccgggccatcttctctgttggaccagtgagtcctagtaggcgttggtggtatagatgctacgcctatgattccaactccccttacgagtggtcattacccagtgacttactggagttgttagtgctgggggtgagcaagaaaccttctctgagcgtgcagcctggcccgattgtggcacccgaggaaaccctcaccctacaatgtggatcagacgccgggtacaaccgtttcgtgctgtataaagatggcgagcgagatttcctacagctggcaggggcgcaaccgcaggccggtctctcccaggctaattttactcttggcccagtctctcgtagctatggagggcagtataggtgttatggtgcacataatctgagtagtgaatggtccgcacccagcgacccgctggatatcctaattgcaggacagttctatgaccgcgtgagcctgagtgtgcaacccgggccgaccgttgcttctggggaaaacgtgacactactctgccagagtcaggggtggatgcagactttcctcctgaccaaggagggagccgcagatgacccctggcggctgagatcaacatatcagtctcaaaaataccaggccgagttccccatgggccccgtgacatccgcccacgcaggtacatatcgctgctacggctcacagtcgagcaagccctacctgctcacccacccctctgatccgctggaactggttgtgagtgctgggcccgaagaccagccacttacaccaacaggctctgatccccagtcggggttaggccgccatcttggtgtagtgattgggatcctggtagccgtcattcttctgctgctcctgttattgctgcttttcctgattctgaggcacaggagacagggcaagcactggaccagcacccagaggaaagccgattttcaacaccctgccggggctgtcggacccgagcccacggaccggggattgcaatggagatcatcccctgccgcggatgcccaggaagagaacctctacgctgcagtaaaacacactcagccggaagacggtgtcgaaatggacacgcggagtccccatgacgaggatcctcaggccgttacctacgcagaagtgaaacattccaggccgcgaagggagatggcgtctccaccaagcccactatctggcgaatttttggacaccaaggaccgacaggccgaagaagaccgtcagatggacaccgaagctgctgcaagtgaggccccgcaggatgtgacctatgcccagctgcactctttgaccctgagacgggaagcaaccgagcctcccccatctcaagagggaccctctcccgctgtgccgagtatttacgcaacgttagctattcactag

SEQ ID NO: 193039 - DNA, 1953 bp, Artificial Sequence
  Description of Artificial Sequence: Synthetic coding sequence
atgacccccatcctgaccgtgctgatctgcctgggcctgagcctgggtcctcgaacccatgtgcaagcagggcatctcccaaaacctacactctgggcagagccagggtccgtgattactcaaggctcccctgtgacattaagatgtcaaggtgggcaagagactcaggagtaccgtctttaccgtgagaagaagaccgccctgtggataacgaggattccccaagagcttgtcaaaaaggggcagttccctatcccgtcaattacttgggagcacgccgggagatatcggtgttactatggctctgatactgccgggcgctctgagtcctccgatccactggagctggtggtgacaggagcttacatcaagcctaccctgagtgctcagccttcacccgtggtcaactctggtggcaacgtcatactacagtgcgactcccaggttgccttcgacggattttccctgtgtaaggagggagaggacgagcaccctcaatgtttgaatagccaaccacacgctcgcggttccagccgcgccattttctcagtgggcccagtcagtccatcccgcaggtggtggtacagatgttacgcctacgacagtaattcgccttatgaatggagcctgccttccgacctacttgagcttctcgttctgggcgtgtctaagaaacccagcttatcggtgcagccagggccaatagtagctccagaagaaaccctgaccctgcagtgcggtagtgatgctggatataataggttcgtactatacaaggacggggagcgagattttctccagcttgcaggggcccagccccaggccggccttagtcaggctaacttcaccctcgggcctgtatccaggtcctacgggggtcaatacaggtgctatggggcacataacctgagctctgagtggtcggccccttctgatcccctcgacatccttatcgcaggccagttctatgatagagtctccctgtccgtacaaccgggccccactgtggcatcgggtgaaaatgtgaccttgctgtgtcagtctcagggttggatgcagacttttctgttgaccaaagagggagccgccgacgacccctggcggctgcgatcaacctaccagagtcagaagtatcaggcagagttccctatggggccggttacctcggcacatgcgggtacttaccggtgctacggtagtcagtcctccaaaccctacttgctgacccacccgagtgaccctctggagttggtcgtgtccggcccctccggggggccaagctccccgacgaccgggccaacatctacatcaggcccggaggaccaaccactgaccccaaccgggtcggacccccagtccggcctgggtcgccatctgggcgtggtcattgggatactagttgccgtcatcctgcttctgctgttgttgctgctgctgttccttattcttcgccatcgcagacaaggaaagcactggaccagcactcagcgaaaggccgacttccagcatcctgctggcgccgtcggcccagagccaacagatagagggttacagtggcgtagctcccccgcggcagatgcccaagaagagaacctgtatgctgctgttaaacatacacagcccgaggacggggtcgagatggacaccagaagccctcacgacgaagatcctcaagccgttacatatgccgaggtcaaacactcccgtcctcggcgtgagatggccagccctccctctccactatcaggtgaattcctggacacaaaggatagacaggccgaagaagaccggcaaatggacacagaggctgccgcatctgaggccccccaggacgtcacgtacgctcagctgcactccctcactttacggcgggaggctaccgagcccccccccagccaggaaggtccttccccagctgtgccctcaatttacgcgaccttggctattcactag

SEQ ID NO: 193040 - DNA, 1533 bp, Artificial Sequence
  Description of Artificial Sequence: Synthetic coding sequence
atgacccccatcctgaccgtgctgatctgcctgggcctgagcctggggccacgaacacatgtgcaggcgggacatctccccaaacccacactgtgggcagagccgggctctgtaatcacacagggcagcccagtgaccctgagatgccaggggggccaggaaacgcaggagtaccgactgtatagggaaaaaaaaactgccctctggatcacgaggataccccaagaacttgtgaagaagggccagtttccaatcccttctataacctgggagcacgctggtagatatagatgttattatggttcagataccgccggccggtctgagtcgagcgacccattagagctcgtggtaactggagcttatataaaacctaccctctcggcccagcctagtcccgtagtgaattccgggggtaacgtcatcctgcaatgcgactctcaggttgcgtttgacggattctcgctctgtaaagaaggagaagatgagcacccacaatgcctgaattcacagcctcatgcaagaggatccagtagggctatcttctcagttgggcctgtgtcacctagcagaaggtggtggtaccggtgctacgcatacgatagcaatagtccttatgaatggagtctaccctccgacctactggagctccttgtgctaggagtgagcaaaaagccttcccttagcgtccagccaggccctatcgtggcccctgaagaaacactcacacttcaatgcggttccgacgcaggatacaaccgcttcgttctgtataaggacggggagagagactttcttcaattggcgggcgcacagccacaagccggcctctcccaggcaaacttcacgctaggcccagtgtctcgctcatatgggggacaataccggtgctacggggcgcacaatctctccagcgaatggagcgctccctctgatccattggacatcctgatagccggccagttttatgaccgggtatcacttagcgtacagcccgggcctaccgtcgccagcggggagaatgttacactgctgtgccagtcccagggatggatgcaaaccttcttgttgacaaaagagggagcagcggatgatccctggcggttgcgctcgacctaccaatcgcagaaatatcaagccgagttccccatgggcccagtgacgagcgctcacgccggcacctaccgctgctacggctcccagagttccaagccttatctcttgacccacccctctgatccgctggagctcgtcgtcagtgggccatcaggaggcccatctagccctactaccgggcctacaagcacttctggacctgaggaccaacctctcacccctacaggatccgatccgcagtctggattgggaagacatctgggcgttgtcattgggatcctcgtcgccgtcatacttctgctgctcctgctgctcctcctttttttgatcctgcgccaccgccgccagggcaagcattggacctcttctccagcacagctgccaatgcctagaaagaaaacctccatgctcccatag

SEQ ID NO: 193041 - DNA, 1797 bp, Artificial Sequence
  Description of Artificial Sequence: Synthetic coding sequence
atgacccccatcgtgaccgtgctgatctgcctgggcctgagcctgggcccccggacccatgtgcagacaggtacaattcccaagcctaccctctgggcggagcccgacagcgtgattacacaaggtagccctgtcacactgtcctgtcagggcagtttagaggctcaggagtatcggctttacagagagaaaaagagcgctagttggataacccggatcaggcctgagctggtgaaaaatggtcagttccacatccccagtatcacatgggaacacacagggaggtatgggtgccaatattacagtcgcgcgcgctggtctgagcttagcgaccccctcgtgctggttatgacaggggcttaccctaagcccacgttatctgctcagccctctcctgtagtgacgtcaggaggtcgggtgaccctgcaatgcgagtcccaggtggcatttggcggtttcatcttgtgcaaggagggagaggaagagcatcctcagtgcctcaactcacaaccccatgcacgggggtcttctagggcaatcttctcagtgggacctgtcagtccaaatcggcgctggtcccaccgctgttacggctatgatttgaactcaccctatgtgtggagctccccttcagacctgttagagctccttgtgccaggcgtcagcaaaaagccatcactgtcggttcagccgggtccagttgtagctccgggggagtcattgacactacagtgcgtgtccgacgtgggttacgaccggttcgtattgtacaaagaaggcgagcgcgacctgcgacagctacccggaaggcagccccaagctggcttgagtcaagccaatttcacactgggtccggtatccaggtcctacggagggcagtataggtgttacggcgcacataacctgagctctgaatgcagtgctccctctgaccccctggacattctgataacaggccaaatccgcggcacgccgttcattagtgtgcagcctggccctaccgttgccagcggcgagaatgttacccttctctgtcagagctggaggcagtttcatacatttctccttacaaaagcgggcgcagctgatgcgccactgagattgaggtccatccacgaataccctaaatatcaggcggaatttccaatgagtcctgtgactagtgcacatgctggcacataccggtgctatggctctctcaacagcgacccttatctcctatctcatccatccgagccactggaacttgtagtgtccggccccagcatgggctccagcccccctcctacaggacccataagtacgccggcagggcccgaggatcagccccttactcctacaggttcggacccacaatcggggttgggcagacatctgggagtggtgatcggcatcctagttgccgtggtactcctcctgctgttgttattgttattattcttgattcttcgacaccgccggcaggggaaacactggacctcaacacagagaaaggcagactttcaacaccctgcgggcgcagtcggaccagagcccacggaccgaggcctccagtggcgttctagccccgccgctgacgcgcaagaggagaatctctatgccgctgtcaaggacacccagcctgaggatggtgtcgaaatggataccagagctgctgccagcgaagccccccaggacgtcacctacgcccagttacactcattaaccttgagacgcaaggccaccgagcccccgccaagtcaagagagggaaccccccgctgaaccgtccatctacgccacactggccatccactag

SEQ ID NO: 193042 - DNA, 1449 bp, Artificial Sequence
  Description of Artificial Sequence: Synthetic coding sequence
atgaccggcgcctaccccaagcccaccctgagcgcccagcccagcccagtcgtgacttctggtggcagggtcacactgcagtgtgaatctcaggtggccttcggaggatttatcttatgtaaggagggggaagaagaacatccccaatgtctcaattctcagccccacgcaaggggaagtagccgcgcaatattttctgtgggacctgtgtctcccaatagaagatggtctcaccggtgttatggatatgatctgaactctccatacgtctggtcctcacctagcgatctgctggaattgttggtacctggagtgagtaagaaaccatcactgtcagtgcagccgggtcctgtggtggctccaggtgaatccctgactctgcagtgtgtatcggacgtcggttacgatcgcttcgttctgtacaaagagggtgagcgggacctccggcagctgcccggccgacaaccacaggcaggcctgtctcaggccaacttcactttaggacctgtctctcgaagctacggaggccagtaccgctgttatggtgcccacaatctctcaagcgaatgtagcgctccatccgatcccttagatatcttgattacgggacagatcagagggactccatttattagtgtacaaccaggcccaaccgttgcaagtggcgaaaacgttacacttctgtgccaatcttggagacaattccatacattcctacttacaaaggcgggagctgctgatgctcccctgcggttaagaagcatccatgagtacccaaaatatcaggctgaattccccatgtctcccgtgaccagtgcacacgccggcacttaccgttgctacggatctctgaactctgacccttatctgttgtcacacccctcagagccactcgaacttgtcgtgtctgggccttccatgggaagctctcctccaccgactggcccaattagtactcctgcaggtccagaggaccagccgcttacccctacaggatctgaccctcagagtggtctgggtcgtcacttgggcgttgtgatcggcatccttgtggcggtcgtgctgctcctgctcctgctgcttctactcttcctgattctgagacatcgaagacaaggcaaacattggacaagcacccagcgtaaggccgactttcagcaccctgcaggcgccgtggggccagaacccacagatcggggactccaatggcgatcctctccagccgccgacgcgcaagaggagaatctttatgccgccgtaaaagacacacagccagaggatggcgttgaaatggatacaagggctgccgcttccgaagcccctcaggatgtaacgtatgcccaactgcatagcctgaccctgcggcgaaaggctactgagcccccgccctcacaggagcgagaaccaccagcggaaccctcgatttacgcaacattagccattcactag

SEQ ID NO: 193043 - DNA, 1932 bp, Artificial Sequence
  Description of Artificial Sequence: Synthetic coding sequence
atgacccccgccctgaccgccctgctgtgcctgggcctgagcctggggccgagaactagagtgcaggccggcccctttcctaagccgacactgtgggcggaaccgggttcagtgatctcctggggctcccccgtgacgatatggtgccagggcagtcaggaggcacaggagtaccgtctgcacaaggaggggtctccagagcctctagacaggaataacccccttgaacccaagaataaggcacgcttcagtattccgagtatgaccgaacaccatgccggccgctacagatgccactattattcttctgcaggttggagcgagcccagtgacccgctcgagatggtcatgaccggagcctattccaagcccaccttgagcgccctgcctagcccagtggtggcctcaggaggcaatatgaccttacgatgtgggtcccaaaagggctatcatcacttcgtgttaatgaaggaaggggagcatcagctcccccgcacgctggattcacagcagttacacagccgcgggttccaggctttgtttccagtcggccctgtgactccctctcacagatggagattcacttgctattattactatacgaacactccgtgggtctggtctcatccttccgaccctcttgaaatattaccttcaggtgtgtctcgaaagcctagcctgctgacgctgcagggaccggttctggccccagggcagagtctgacactccagtgcggaagcgacgtgggatacaatcggttcgtgctgtataaggaaggggagagggatttcctccagcgtcctgggcagcagccacaggcaggtctgtcacaggctaattttactctgggcccagtttccccttctaatggaggccagtatcgatgctatggtgctcacaatctatccagtgaatggagtgcccctagcgatcccctgaatattcttatggcaggacaaatttatgacacggtcagcttgtcggcccagcctggacctacagtcgcttccggagaaaacgttactctcctgtgtcagtcctggtggcaattcgatacttttctgcttaccaaggaaggtgcggcccacccccctctgaggctcaggtcgatgtatggggcacacaagtatcaagcagagttcccaatgagtccagtgacctccgctcacgcggggacctacaggtgttacggctcttacagctcaaatccccacttgctaagccatccatcggagcccctggagttagttgtgagcgggccagaagatcagcctcttaaccctccgggctccgggcctcaaaatccgccagggttaggttctggcgccggaacgcgggccgccggcctcggccgctacctcgaggtgctgataggggttagcgtggcattcgtcctgctactcttccttctgctgtttttactgcttcggaggcaaaggcactccaaacaccgtacttctgaccaaagaaagactgattttcaacgtcccgctggagcagctgagacggagccaaaggatagggggctgctacgaaggtcctcacccgcagccgacgtgcaggaagagaatctgtatgcagctgtgaaagatacgcagtccgaagaccgggtggaactcgattcccagtccccacacgacgaggatcctcaggccgtgacctatgccccggttaagcacagctcacccaggcgcgaaatggccagtcccccttcttccctgagtggtgagttcttggacacaaaggatcgtcaggtggaagaggacaggcagatggatacggaagccgccgcatcagaagcaagccaggacgtgacatacgctcagctgcactcactcaccctcagacgcaaggccactgagcctccaccatcacaggagggcgaacccccggccgagcctagcatttatgccacccttgcaattcactag

SEQ ID NO: 193044 - DNA, 1896 bp, Artificial Sequence
  Description of Artificial Sequence: Synthetic coding sequence
atgacccccgccctgaccgccctgctgtgcctgggcctgagcctgggtccaaggacccgtgtgcaagcagggccatttccaaaaccaaccctctgggccgaacccggatcggtgatttcctggggcagtcccgtcacgatctggtgccaaggctcccaggaagcccaggaataccggctccacaaggaagggagtccggaacctcttgataggaataatccgcttgaacccaagaataaagcgcggttttcgataccctcgatgactgagcatcatgctggccgttaccgctgtcactactactctagtgccggatggagcgagcccagtgaccctctggaaatggtcatgaccggagcctattctaagccgaccctgagtgcattgcccagtcctgttgttgcctcaggaggtaacatgaccctgcgctgcggttcccagaagggataccatcacttcgtccttatgaaagagggggagcatcagctgccccggacccttgacagtcagcagctgcactcccggggctttcaagctttatttccagtcgggcccgtgaccccttcacacaggtggcggtttacatgctattattactatacaaataccccttgggtttggagccacccatctgatcccctcgagatcctgcctagcggggtgtctcggaaaccatcactcctgacactgcagggccccgttttggcccctggccagagtctgacactgcagtgtggctccgacgtgggttacaacagattcgtcctgtataaagaaggtgaacgggactttctgcagcgacccggccagcagccccaagccgggctgtcgcaggctaatttcaccctcgggcccgtctccccgtccaatgggggccagtaccggtgttatggggcccacaacttgagttctgaatggtctgccccaagtgacccgcttaacatcctgatggcaggtcagatttacgataccgtgagtctatcagcgcagcccgggccgacagtggccagcggtgaaaatgtaaccctcctgtgtcaaagctggtggcagtttgacactttcctgttaaccaaagagggcgcggcccatccccctttacgtttgcgcagcatgtacggcgcccataaataccaggcagaattccccatgtccccagtaacttccgcccatgccgggacataccgatgctacggcagctactcttcgaatccgcacttactttcacacccctctgaaccgctggaactggtggtgtctggccatagtggaggaagctcattgccgcctaccgggcctcctagcacacctggcttaggccgatacctggaggtgctgatcggagtgagtgtcgctttcgttctcctgcttttcttgttgctcttcctgcttctgcgcaggcagcgccactcaaagcatcggacttcggaccagaggaagactgacttccagcgccccgccggggctgctgaaaccgaacctaaggaccgcggattacttagacggagttcacctgccgctgacgtacaggaagagaatctgtacgcagcagtgaaggatacacagagtgaagaccgcgtggaattagattctcagagtccccacgacgaggaccctcaggcagtgacgtatgctccggtgaaacatagcagccctcgtcgagaaatggcatcgccaccttcctctctctcaggagagttcctggacacaaaagacagacaggtggaggaggatcggcagatggacactgaggccgcggcaagtgaagcctcccaggatgtgacctacgcccaattacatagcttgacactgcggagaaaagcgactgaacctccccctagccaggaaggagagccaccggccgagccatccatatacgctaccctggcaatccactag

SEQ ID NO: 193045 - DNA, 1947 bp, Artificial Sequence
  Description of Artificial Sequence: Synthetic coding sequence
atgacccccgccctgaccgccctgctgtgcctgggcctgagcctgggtcctcgtacacgggttcaggctgggccgtttccaaaaccgaccctgtgggcggagcccggttctgttatctcctggggtagtcccgtcacgatctggtgtcagggatcacttgaagcccaggagtatcagctggacaaggagggatcccccgagccacttgatcgtaataaccccctggaacctaagaataaggcaagattctccattcccagtatgacacaacaccacgctggaagatacaggtgccattactactcctctgcaggctggagcgagccctctgatcccctagaattggtgatgacgggggcatactccaaaccaaccctcagcgcattaccctcccccgtcgtggcttctggaggcaacatgaccctacggtgcgggagccaaaaggggtaccaccacttcgtgctgatgaaggagggagaacaccaattgccaaggaccctagacagtcaacaactgcatagcagagggttccaggccctgttccctgtgggcccggttactccttctcatcgctggcgctttacctgttactactattatactaataccccttgggtctggtctcacccatctgatcccctagagatcttgccgagcggtgtgagccggaagccctcattgctgaccctgcagggccctgtcctcgcgcctggccaaagcctcactctgcagtgcgggagcgacgtcggatacaacaggtttgtgctgtacaaagagggtgaacgggactttctccagcgccccggacagcaaccccaagccggtttaagccaagccaactttactctgggtccagtcagtcccagcaatgggggccaataccggtgttatggggcacacaacctgtcttcagagtggtcagctcccagcgaccctttgaatattctgatggctggacagatctacgataccgtttcgctctctgcccaacccgggcccactgtggcatccggtgaaaatgtgaccctcctttgccaaagctggtggcagttcgatactttcctacttacaaaggaaggagccgcccacccaccattaaggttgcgcagcatgtacggagcccataagtatcaggccgagttccccatgagcccggtgacatctgctcatgcaggcacgtaccgatgctacggatcttacagcagcaatccccatttgcttagtcacccctcagagccattagaactcgtggtctcagggcatagcggcgggtccagtcttccaccgacgggaccaccgagcacccccggaggcccggaggatcagcccctcaaccccccaggcagcggtcctcaaaaccggctcggcaggtacctggaagttctcataggagtcagcgtggcgtttgtattgttgttgttcctcttgctattcttgcttcttcggcgacagcggcatagcaaacacaggacctcagatcagaggaagacagatttccagaggccagctggcgctgccgagacagaaccgaaagaccgcggcctgcttcgccgcagttctcccgccgcagacgtgcaagaggagaatctgtacgctgctgtgaaagatacgcagagtgaggatagggtggagctggactcgcagagcccccatgatgaagaccctcaagccgtcacttacgccccggtgaagcattcctccccacgccgagagatggcttccccaccttcctccctttctggagagttcctggacacaaaagacagacaagtggaagaggacaggcagatggatacggaggcagccgcctccgaagcttctcaggatgtaacatacgcacaacttcattctctcaccctccgccgcaaggccaccgaacctccaccatctcaggaaggtgagccaccagctgaaccatctatttacgccactctagctatccactag

SEQ ID NO: 193046 - DNA, 1896 bp, Artificial Sequence
  Description of Artificial Sequence: Synthetic coding sequence
atgacccccgccctgaccgccctgctgtgcctgggcctgagcctgggaccccggactcgcgttcaggcgggaccattcccgaaacccaccctgtgggccgaacccggctcggtgatctcctgggggtcacccgtgacgatttggtgccaggggagccaggaggctcaggaatatagactgcataaagagggaagcccggagcctctggatcggaacaatccacttgaaccaaaaaataaagcccggttctccatcccttccatgaccgagcaccatgcaggccggtaccggtgtcactactatagctctgcagggtggtcagagccgagcgaccctttagagatggttatgacaggggcctacagcaagccgactctgtcagcgcttcccagtcccgttgttgccagtggagggaacatgaccctgcgctgtgggagccagaaggggtaccatcattttgtgcttatgaaagaaggggagcatcagctaccgaggactctagactcccagcagctgcactcccggggctttcaggccttattccccgtgggccccgtcaccccgtcacaccggtggcgctttacttgttattattattacacaaatacaccctgggtatggagtcacccctcggatccactcgagatcctgccctccggagttagccgcaaacccagtcttcttacattgcagggacccgtacttgccccaggccagagtttgactctgcagtgcgggtcagatgtgggctacaatcgcttcgtgctgtataaggagggcgagcgggattttctgcagcgtcccggccagcaaccccaagcaggtctgagccaggccaatttcaccctcggtcccgtgtcccctagcaacggcggccagtacaggtgctacggggcgcacaatctcagcagcgaatggagcgctccatctgaccctctcaatattcttatggcaggacagatatacgatacggtgtctctcagtgcccagccagggcccaccgtagcatccggggagaacgttactttgttatgtcagtcatggtggcagtttgatacattcctgttgaccaaagagggggcagcccaccccccgctgcgactcaggagcatgtacggtgcccataagtaccaagccgagtttcccatgtcgcccgtgacatctgctcacgcagggacatataggtgttacggttcttatagcagtaatccccatctgctctctcacccgagcgagcctcttgaactcgtggtttccgggcattctggaggcagctctctccccccgaccggcccgccttctactcctggcctcggaagatacttggaggtgctaatcggggtctccgtcgcattcgtgctcctattgtttctgttactctttttgctgctgcgcaggcagagacactccaaacacaggactagtgaccagcgcaagaccgatttccaacgacccgctggggccgctgaaaccgaaccaaaagaccgaggcctgctccgccgctcctcaccagctgcagacgtgcaggaggaaaacctgtatgctgcagtgaaggacacccagagtgaggaccgcgtggaactggacagtcagtccccccacgatgaagacccacaggctgtcacctatgcgcccgtgaaacactcttctcccaggagggagatggcttcccccccttcgtccctgagcggcgaatttctagatactaaagataggcaggtcgaggaggatagacagatggataccgaggcggcagcgagcgaggctagccaggacgtgacgtatgctcagcttcatagccttacgctgagacgcaaggcgacagagccacccccatctcaagagggcgaacctcctgccgaaccctccatttatgctactttggccatacactag

SEQ ID NO: 193047 - DNA, 477 bp, Artificial Sequence
  Description of Artificial Sequence: Synthetic coding sequence
atgacccccgccctgaccgccctgctgtgcctgggcctgagcctgggccctaggacgcgggtacaagccgggcccttccccaagcccactctatgggcggagccaggtagtgttatctcctggggaagccccgtcacaatctggtgccagggaagtcaggaggcccaggaatatcgacttcacaaggagggctcccctgaacccttggatcggaataaccccctggagcctaaaaataaagcccggtttagcattccttcgatgaccgaacatcacgctgggaggtatcgatgtcattactatagcagtgcgggatggtcggaaccttctgacccccttgaaatggttatgactggcgcgtactccaagcctactttgagtgccctgccctccccagtggtagcgtccggcggcaatatgactctgagatgtggaagccagaaggggtaccaccatttcgttttgatgaaggagtag

SEQ ID NO: 193048 - DNA, 1347 bp, Artificial Sequence
  Description of Artificial Sequence: Synthetic coding sequence
atgatccccaccttcaccgccctgctgtgcctgggcctgagcctgggcccaaggacccacatgcaggctgggcccctgcctaagccaacactctgggccgaacccggctccgtgatctcttggggcaatagcgttaccatctggtgtcagggtacactggaagctcgcgagtatagacttgacaaagaagagtcgccggccccatgggacagacagaatcctcttgaacccaaaaacaaagcacgcttttctatccctagtatgacggaggattacgccgggagatataggtgttactatcggagtcctgtgggctggtcccagcctagtgatcccttagagctcgtaatgacgggcgcctactctaaacctacattatcagcactgcccagccctctggtcactagtggcaaatccgtgactctactatgccagtctcgctcccctatggacacgttcttgcttatcaaggagagagctgctcacccactgctgcatctccgaagtgagcacggcgcacagcaacatcaggccgaattccccatgtcccctgtgactagtgtgcatggcggcacctaccggtgtttttcttcccatggcttctctcattatctgttatcccaccctagcgatcctctcgaactgattgtctctggctcactggaggacccccggccctcaccaacacgtagtgtcagtacggccgctgggcccgaagatcaacctctgatgccgaccggctctgtgccgcatagtggacttagacgacactgggaggttctgatcggagtgctggtcgtgtcgatcctgctgctttcactgttactattcctgcttctgcagcactggaggcagggaaagcaccggaccctggctcagcggcaagcagactttcaacgccctccaggggctgccgagcccgaacccaaggatggggggttgcaaaggcgctcaagcccagctgctgacgtgcagggtgaaaacttctgtgctgcggtcaagaatacacagccagaagacggtgttgaaatggatacccgacagagtccccacgatgaggacccccaggcagtcacttatgcaaaggtgaagcactcgaggcccagacgggaaatggcctcgcctccctccccattgtctggcgaatttctggatactaaagacagacaagctgaagaggaccggcagatggataccgaagccgctgcgtcagaggcacctcaagacgtgacatatgcgcagctccattccttcaccttaagacagaaagcaacagagcctccgccctcccaggagggcgcatcgccggccgaacctagtgtttatgcaacgctggccatccactag

SEQ ID NO: 193049 - DNA, 1347 bp, Artificial Sequence
  Description of Artificial Sequence: Synthetic coding sequence
atgatccccaccttcaccgccctgctgtgcctgggcctgagcctgggacctaggacacatatgcaggcaggcccgctcccaaaaccaactctttgggctgagccagggtccgtcatttcatggggcaattctgtcacaatctggtgtcagggcacactagaggcgcgcgagtaccggttagacaaggaggaatcgccagccccctgggacaggcagaatccacttgagccgaaaaataaagcgagattctcaatcccttccatgaccgaagattatgccggaagatatagatgttattatagaagccctgtaggatggtctcagccatctgatcccctggagttggtgatgacaggcgcctactccaagcccacactgtccgccctccctagccctctggtcacgagcggcaaatccgttaccctcctgtgccagagtaggtcccccatggacacatttctgttaataaaagagcgggccgcgcaccccttgcttcacctgcggagcgaacatggagcacaacagcatcaggctgaatttcccatgtcgcctgtgacctcagtgcacggtgggacttaccgctgtttctcctcccatgggttctctcattacctgttgtcccaccccagcgatcctctggaactcattgtttccggatccctggaggatcctcggcccagccctacgaggtctgtgtcaacggccgccgggcccgaagaccagcccctgatgcccactggctctgtgccccattccggcctgcggcggcactgggaggtacttatcggggtgctggtcgtaagcatcctgctcttaagcctgctcttgtttctcctgctgcagcactggagacagggcaaacacagaaccctggctcagagacaagcagatttccagagaccacccggtgccgccgagccagagcccaaggacggcggactgcaacggaggagcagcccagccgctgatgtccagggggagaatttctgtgccgccgttaagaatacccagcctgaggatggtgtggaaatggatacccgacagtcaccccacgacgaggaccctcaggctgtgacctatgcaaaggtaaagcacagccgtcccagaagagagatggcctctccacccagtccgttgagcggagaatttctggacactaaagacaggcaggccgaagaagacagacagatggataccgaagctgccgcaagcgaagctcctcaagatgtcacatatgcccagttgcactcgttcactcttagacagaaagccacagagccccctccttcacaggagggagcaagccccgcggagccttcagtctatgccacgctggctatccattag

SEQ ID NO: 193050 - DNA, 1773 bp, Artificial Sequence
  Description of Artificial Sequence: Synthetic coding sequence
atgaccctgaccctgagcgtgctgatctgcctgggcctgagcgtgggccctcgaacttgcgtccaggctggcaccttgccaaaaccaactctctgggccgaacccgcctcagtgattgcgagagggaaacctgtgaccctgtggtgccaggggcctctggagacagaggagtataggctcgacaaggagggcttaccatgggcgagaaagcggcaaaaccccctggaacccggcgcaaaggctaaatttcatataccatccaccgtgtacgatagcgctgggagataccgttgttactatgaaacgccagcgggatggtcagagccctccgacccgttggagctggtggcaacagggttttacgcggaacccacattgctggccctgccctctccagtggtagcttccggtggcaacgtgactttgcagtgcgataccctggacggcttattgacgttcgtcctcgtggaggaggaacagaagctcccccgaaccctgtattcacagaagttgcccaaaggaccctcccaagccctgtttcctgtcggcccagtaaccccatcctgtcggtggcgcttccgatgctactattactatcgcaagaatcctcaggtatggtcaaacccatccgacttgctagaaattctagtccctggagtgagccgcaagcccagcctgcttatcccacagggatccgttgtagcaaggggaggtagtctgacgctccaatgcaggtcagatgtggggtacgatatcttcgttttatacaaagagggcgagcacgatctggtccaaggatctggccagcaacctcaggctggtttgagccaggcgaatttcacacttgggccggtgtctcgaagtcatgggggtcagtatcgatgctacggcgcccacaacctttctccacgatggagcgctccatctgaccctttggacatcctaatagcggggctgattccggacattcccgccctgagcgtgcagcctggccctaaggtcgcaagcggtgagaacgtgaccttactgtgtcagtcatggcatcaaatagatacattttttctgaccaaggagggtgccgcacatcccccactctgcctgaagtctaagtatcaatcataccgacatcaggcagaattttcaatgtccccggtgactagtgcacaggggggcacttacagatgctatagtgcaattcgctcatatccttacctgctgagcagtccgtcttatcctcaggagcttgtcgtttcaggcccaagcggagatccaagcctcagcccaaccgggagcacccctactcccggtcctgaggatcagcctctcactccaaccggcttagatccccagagcggactcggccgccatctaggtgtcgtgactggggtctcagtggccttcgtgctgctgctgttcctcctgcttttcttgctattacgacaccggcaccagtcaaagcaccgcaccagcgctcacttctatcgccccgccggcgcagcaggccccgagccaaaggatcagggtctgcagaaacgggcttctccagtagcggatatccaagaggagatccttaatgccgcagtcaaggatactcagcctaaagacggagtagaaatggatgctagggccgctgccagtgaagccccacaggacgttacctacgcccaattgcattccctgaccctgaggagagaggccaccgaacctcctccatcacaggagcgcgagccgccagctgagccgtccatttacgccccgctggccatacattag

SEQ ID NO: 193051 - DNA, 1776 bp, Artificial Sequence
  Description of Artificial Sequence: Synthetic coding sequence
atgaccctgaccctgagcgtgctgatctgcctgggcctgagcgtggggcctaggacatgtgtccaagccggcaccctgcctaaacccaccctttgggctgaacctgccagcgtgatcgctcggggcaaaccagttaccctgtggtgccagggaccattggaaacggaggaataccggttggataaagaggggctgccttgggccaggaagcgtcagaatcccctggaaccaggggctaaagccaagttccacataccgtctaccgtgtacgactctgcaggccgctacaggtgctactatgagacacctgcaggttggtccgaaccatcagaccctcttgaacttgtggctaccggtttttatgccgaaccgaccttgcttgcgctgcccagtccagtggttgcctctggcggaaatgtcacgctgcagtgtgacacattagacggcttgctaacctttgttcttgtcgaggaggagcaaaaactgcctcgaacgctgtatagccagaaactgcctaaggggccatcgcaggccctatttcccgtgggacccgtgactccttcctgcaggtggcggtttcgctgttactactattataggaaaaatccacaagtgtggtccaaccctagtgatctcttagagatcctagtgccaggcgtatcccgaaaaccctccttgcttatccctcagggatcagttgtggctcgaggaggatctttgaccctgcagtgtcggagcgacgtcggttatgacattttcgtgctctacaaggagggggaacatgatctcgtgcagggtagtggacagcagccacaagccgggctttctcaggccaactttaccctgggccctgtcagccgctcacacggaggccagtatagatgttacggcgcacataatctgtccccgcgctggagcgccccctcagacccactcgacattctaattgccggcctaattccggacattccagccttgtccgtccagccaggcccaaaagtagcttctggagagaacgttaccttgctgtgccagagctggcatcagatcgacacgttctttttaaccaaggaaggcgctgcccaccccccactgtgcctgaagagcaaataccagtcctaccggcaccaggcagagtttagtatgagtccggtaacaagcgcccaaggcggcacctatcggtgttactcagctatcaggtcctacccctatctgttgtctagcccaagttacccccaggagttggtcgttagcggaccatcaggcgacccaagcttgagcccaaccggatcaacacccaccccggccggcccggaggatcagccgctgaccccgacaggtctcgaccctcagagcggcctgggcaggcatctgggcgtggtcacaggcgtgtccgttgccttcgtgctcctactgtttctgttgctgttcctgctcctccggcacagacatcagtcaaaacatagaacaagtgctcatttttatcgccccgccggcgcagccgggccagagcctaaggatcaggggctgcaaaaaagagcctcccctgtagcagatatccaggaggagattctcaacgccgcagtgaaggatacacagcccaaagacggggtcgaaatggatgccagggcagctgcgtccgaggccccccaggacgtaacatacgctcagctgcacagtctgacactccgcagagaggccactgagccgcctccatcacaggagagggagcctcctgccgagccgagtatctatgcccccctagctatccactag

SEQ ID NO: 193052 - DNA, 1869 bp, Artificial Sequence
  Description of Artificial Sequence: Synthetic coding sequence
atgaccctgaccctgagcgtgctgatctgcctgggcctgagcgtggggccccggacatgtgtgcaggcgggcacactgcccaaaccaaccctgtgggctgagcctgcgtccgtcatcgcgagaggaaagcccgtgactttgtggtgtcagggtcccttggagacagaagaatatcggctggataaagagggcctgccttgggccagaaaaaggcaaaacccacttgagcccggtgcaaaggctaagttccacatcccctcaacggtgtatgacagcgccgggaggtaccgctgctattatgagaccccagccggctggtcagaaccatctgacccgctcgagctcgtggctacggccctccctagccctgttgtcgcctccgggggtaatgtcacattgcaatgtgacaccctggatgggctgcttacttttgtactcgtggaggaagagcagaagttgccacggactctatacagccagaagctgcctaagggaccgtcacaggccttgtttcccgtggggccagttacacccagttgccggtggcgctttaggtgttactactattataggaagaatccccaggtgtggtcaaatcctagtgatctgctcgagatcctggtccccggagtttccaggaaaccctccttgcttataccgcagggctccgttgtggcgcgcggagggtctctaactcttcaatgccggtcggatgtcgggtacgatattttcgtgctatacaaggagggtgagcatgatctggtgcaggggtcagggcagcagcctcaggcaggcttgtcccaggctaatttcactttgggacctgtttctcgttcccacgggggacaatatcgctgctacggtgcgcataaccttagtcctaggtggtccgcaccctctgaccccctagacatcctgatagctgggctgatccccgacatccctgctctgtccgtgcaaccgggtcccaaggtcgctagtggagagaatgtcactctgctttgccagagttggcaccagatcgataccttttttctgaccaaggaaggagcggcacatcccccactgtgtctgaaatccaaataccagagctatcgccatcaggccgagttcagcatgtctccagtgactagtgctcagggcggaacgtaccgttgctattccgcaatcagatcttacccctacctactgtcctcgccaagttatcctcaagagctggtggtctccggcccctcaggggaccctagcttgagtccaacgggcagtacccccacacctgccggaccggaggaccagccgcttactcccacaggtctcgacccccagtctggtcttggacggcatctcggcgtggttactggagtcagcgtagctttcgttctactattgttccttttactgttcctgttgctgagacatcgccaccagagcaaacaccgtacatcagcacacttttaccgcccggcaggtgctgctggaccagagcccaaggaccaggggctccagaagcgggcttctccagtggcagacatacaggaggagatactgaatgctgctgtcaaggacacacagcccaaggacggcgtggagatggatgcgcgtcagtcaccccacgacgaggaccctcaggccgtcacgtacgcggaagttaagcacagccgccccagaagggagatggctagccctcctagtccattatccggcgagttcctagataccaaagaccgccaggcagaggaggacagacagatggacaccgagcgggtcctctccagccctggtccgcaggcatcaccccccccacctcgctcactacctttgactcttccaagatgtcggcttctgcatctgaagccccccaggatgtag

SEQ ID NO: 193053 - DNA, 2595 bp, Artificial Sequence
  Description of Artificial Sequence: Synthetic coding sequence
atgggctgctggggccagctgctggtgtggttcggcgccgccggcgcgatattgtgcagcagtcctggctcccaggaaactttcctgcgtagcagccctcttcccctcgctagcccaagtcctcgtgatcccaaggtgtccgccccaccttccattctggagcctgcctccccccttaattcccccggcacagagggaagctggctcttctccacgtgtggcgccagtggccgccacggtcctacccagacacaatgtgatggggcatacgccgggacaagcgtcgtagttacagtcggggctgcaggccagctacgcggagttcagctctggcgagtccccggtccaggtcagtacctgatatcagcatatggcgctgctgggggtaagggggcaaagaatcatctatccagggcacacggggtgttcgtttctgccatctttagtcttggtcttggtgagtctctgtatatactggtgggccagcaaggcgaagatgcttgcccaggtggatcccctgaaagtcaattagtttgcctgggcgagagccgtgcagtggaagagcacgccgcaatggacggttcagagggcgtgcccggatcccgtcggtgggcagggggcggtggggggggaggaggagctacgtacgtgtttagagtcagagcaggggaactcgagcctctgttggtagccgccggagggggcggacgtgcatacctgagaccgagagaccgcggcagaactcaggcatctcccgagaagttggagaacaggagcgaagctcctggcagcggtggccgaggaggcgccgctggaggtggtggagggtggacttcaagagctccatcccctcaggcaggccgctcactccaggagggagcggaaggtgggcaggggtgcagcgaggcatgggccacgttgggatgggccgctgccggaggattcggcggtggagggggggcttgtacagcagggggcggcggtggaggttatagaggtggggacgctagtgaaacggacaacctgtgggccgatggagaggatggcgtctcctttattcatccttcctctgagctgttcctccagccattagccgtgacggaaaatcatggcgaggtcgaaatcaggaggcacttgaattgcagccactgccccctgcgagattgccagtggcaagctgaactgcagcttgccgaatgtctgtgcccagaaggaatggaactcgcagtggacaacgtgacctgtatggatctccataagccccccggacctcttgtcctgatggtagcggtcgtggcgacctccacattgagtctgcttatggtgtgtggtgtgctgatactggtaaagcagaagaagtggcaagggctgcaggaaatgcggctgccaagccccgaactcgaactgagcaaattacggacgtctgcaatccgtactgcccccaacccttactactgccaagtcggtctgggccctgctcaaagttggcctctgccgcccggggtaacagaagtgagtccggccaacgtgactcttctccgtgcattgggacacggggctttcggggaggtgtacgaaggattggtgatcggactgccaggggatagtagtccccttcaagtggccatcaaaactcttccggaactttgtagcccacaggacgagctcgactttctcatggaagccctcattatatccaaattccggcaccagaatattgtccggtgtgttggcctgagcttgagggccacccctagattaatactgctggagctcatgtctggaggagacatgaaatccttcttgcgccactctaggccccacttaggacagccttctccactggtgatgcgggacctgctgcaactggcccaggatatcgctcaaggttgtcactatttggaagaaaaccacttcatacatcgcgatattgccgcccgaaattgtctactctcttgcgcgggcccttctagggtggccaaaatcggggacttcggcatggcacgtgacatctatcgagccagttactaccgtcgaggggatagggccctccttcctgtcaagtggatgccacctgaggcgtttctcgagggaatcttcacgtctaaaaccgactcttggagctttggggtgctgttgtgggaaatcttttccctgggctatatgccctacccgggccgcaccaatcaggaagttttagacttcgttgtgggtgggggcagaatggacccacccagaggatgccccggccctgtgtacaggataatgacccagtgctggcagcatgaacctgaacttcggcccagcttcgccagtatcctggagcgcttgcaatattgtactcaggatcccgatgtgctcaactctctcctgcctatggagctgggccccaccccagaggaggaaggcacctccgggttggggaatcggtccttggagtgccttcgcccaccacagccccaggagctctcccctgaaaaactcaaatcttggggaggctctccacttgggccctggctgtcatccggcttaaaacccctgaaatcgcgcggattgcagccgcagaacctctggaatccgacatatcgctcttag

SEQ ID NO: 193054 - DNA, 2412 bp, Artificial Sequence
  Description of Artificial Sequence: Synthetic coding sequence
atgggctgctggggccagctgctggtgtggttcggcgccgccggcgcaatcttgtgctcctcaccaggaagccaggagacttttctgaggtctagccccctcccacttgcctcaccatcccctcgggatcccaaggtgagtgcccccccttctatcctggaacccgcctcaccgttaaattcccccgggactgaggggtcatggctttttagtacatgcggagcctctggtaggcatggcccaactcagactcagtgcgatggggcgtacgctgggacatctgtagtcgttactgtaggagctgcgggacagctgcggggcgtgcagttgtggagggttccggggcccggccaatacctgatcagtgcttacggagcagctgggggaaagggagcgaaaaatcatctctcgcgagcccatggggtgttcgtgtctgccatattcagtttgggtctaggagagtccttgtacattctggtcggacaacagggagaggatgcttgtccaggcgggtctcctgagagtcagctggtctgcctgggggagtcaagagccgtggaggaacatgctgccatggatggttcggaaggcgtgccagggtcccggcggtgggccggcggtgggggcggtggcgggggcgcaacctatgtgttcagagtccgcgcaggcgagcttgagcccctgctggtggccgctggcggcggtggccgggcctacctgagacctcgggaccgcggacgcactcaggcatcacccgagaagctggaaaataggagtgaggcgcccggctccggcgggcggggtggagccgccggcggtgacgctagcgaaaccgataatttgtgggcagatggggaagatggagtaagcttcattcacccgtcctccgaactgttcctccaaccactggctgtaacggagaatcacggcgaggtcgaaataaggaggcacttgaactgctcacactgccctctacgggattgccagtggcaggctgaactgcagctggcagaatgtctgtgcccagaagggatggaattggccgtagacaacgtgacgtgcatggatctgcacaaaccccctggtccgcttgtgcttatggtcgccgtagtagctaccagcacacttagcctactcatggtgtgcggggtcctgattctagtcaagcagaagaagtggcagggcctacaagagatgcggctcccaagcccagaactcgagctttcaaaattgcgcacaagtgccattcgcactgccccgaacccatattattgccaagtcgggctgggaccagcgcagagctggcccctgccaccaggcgtaacagaggtgtcacctgctaacgtgacattattgagagcattgggccatggggcctttggtgaagtgtatgaaggactggtgattggcttgccaggcgattctagccctcttcaggtcgccatcaaaaccctcccggagctgtgctcaccccaggatgagctggacttcctgatggaggcactgataatctcaaagtttcgtcaccaaaacatcgtgcggtgtgtcggacttagcctccgagcgactcctcgccttattcttctcgaactgatgagcggtggggacatgaaatcgtttttgaggcattctcgccctcatctcggacagcctagccctttggtgatgagggacctcctgcagctggctcaggacatcgcccagggatgccattacctcgaagaaaaccatttcattcaccgggacatcgccgccaggaactgcttgctgtcatgtgcagggcccagccgtgtggcgaaaatcggtgactttgggatggcaagggacatctatagggcctcttactaccggcggggtgatagggcgcttctgcctgtcaagtggatgccgcccgaagccttcttggaagggatcttcaccagtaaaactgactcatggagctttggggtcttattatgggaaatcttttcccttggttatatgccctatccgggcagaacgaatcaagaggtactggatttcgtagtgggtggagggcgcatggacccacccagaggatgtcccgggcctgtataccggatcatgacccagtgctggcaacatgaacccgaactgagaccttcgttcgcaagcattcttgaaaggctccagtactgtacacaagatcctgacgtactgaattctctcctgcccatggagctgggcccaacacccgaggaagaaggcacaagtggcttagggaaccggtcgctggaatgtctaaggccacctcaaccccaggagcttagtcctgaaaagttgaaatcttggggagggtcaccgctgggcccatggctctcttccgggctgaagcctctgaagagcaggggtctgcagccccaaaatctctggaatccgacctataggtcctag

SEQ ID NO: 193055 - DNA, 1437 bp, Artificial Sequence
  Description of Artificial Sequence: Synthetic coding sequence
atgggctgctggggccagctgctggtgtggttcggcgccgccggcgctattttgtgcagctccccaggctcacaggagacctttctccggagtagccctctcccactcgctagtccctctccccgagatcctaaggtgtctgcccccccgtctatcctggagccggcatctcccctgaattccccagggacggaaggatcatggcttttttcaacgtgcggggcgagcggccgacacggaccaacacagacacaatgcgatggggcctatgcgggcactagcgtagtggttaccgtgggagctgcaggccagttacggggggtccagctgtggcgggtcccaggcccgggacagtacttaatttccgcgtacggtgccgccggcgggaaaggagcaaagaaccatctatcccgcgcacatggagtctttgtgtctgcaatattctctctaggactgggtgagagcttgtacatattggtgggccagcagggcgaggacgcctgccccggggggagcccggagagccagctcgtgtgcctgggagaaagtagggcagtggaggagcatgcagcaatggacggatcagagggagttccggggagtagacggtgggctggtggcggcggaggcggcggaggggctacatatgtttttagggttcgcgctggtgagctagagccgctgctggttgccgctgggggggggggacgggcctatctgaggcccagagacaggggccggacgcaggcctctccagagaagttagaaaatcgaagtgaagcccctggttcgggaggcaggggaggagccgccggtggggggggaggctggacatctcgagctccaagtcctcaggcaggcagaagtctgcaggagggtgcggaaggtggtcaaggatgctcagaggcttgggccacactcgggtgggccgccgctggagggtttggaggcggtggcggcgcatgtactgctggaggtggtggtgggggttacagggggggggatgcaagcgagactgacaacctctgggctgacggcgaagacggtgtttcctttattcacccctcttctgagctcttcctccagcccctcgccgtcacagagaatcacggggaagtcgagatccgaaggcatctgaattgctctcattgtccactgagagactgccagtggcaggcagaattgcagctggctgaatgtctatgcccagagggcatggaactcgccgtggacaacgtgacatgtatggaccttcacaaaccaccagggcctctggtgctcatggttgctgtggtcgcgacctccacactgtctctgctgatggtatgcggcgtcttgattctgggaacaaaacggctggcaggtaccgtcgatagtcggctcctgctatctagtgagctggggtgggtctccgccggtgggggacgccgccggtag

SEQ ID NO: 193056 - DNA, 2205 bp, Artificial Sequence
  Description of Artificial Sequence: Synthetic coding sequence
atgggctgctggggccagctgctggtgtggttcggcgccgccggcgccatcctgtgcagttctcctggcagtcaagaaaccttcttgagatcgtcacctctcccacttgcgtctcccagccctagggacccaaaagtgtccgcaccaccatcgatactggaacccgccagccccctgaatagtcccggcactgaggggtcatggttattttcgacctgtggagcctccgggaggcacgggcctacccagacccagtgcgacggcgcctacgcagggacttctgtcgttgtgaccgtgggcgctgctgggcaactgagaggggtgcagttgtggagggtccctgggccgggacagtatttgatttcagcctacggagctgctggcggaaagggcgctaaaaaccatttgagccgtgcccacggggtgtttgtctcagccattttttccttgggactgggggagtccctctacattctagtgggtcagcaaggagaggatgcctgccctggaggttctcccgaatcacagttggtgtgcctcggagaaagccgagctgtggaggaacacgcagcaatggacggttccgagggcgtgcctggtagccgtcgatgggccgggggtggcggaggtggcgggggagcgacctacgtgttcagagtacgtgcaggcgagcttgagcctctcttagtggcagcgggaggtggcgggcgagcgtacctgcgcccgcgtgatagagggaggacacaggctagcccagaaaaactggaaaacagatcagaggctccaggctctggcggacggggcggagccgctggaggcgatgcatcagagactgataatttgtgggcagacggcgaggacggcgtttctttcatccatccatcttctgagctattcctgcagcccctcgcggtgacggaaaatcacggagaagtcgagattcgaaggcatttaaactgttcacattgcccactccgggactgccaatggcaggcggagctgcagcttgcagagtgtctgtgcccagaagggatggagctcgcagttgataacgtcacctgcatggacctgcacaagcctcccggcccattggtgctgatggtcgccgtggtggcgacctccacattatccctgctcatggtatgcggcgtattgatcttggggggcgcttggcctggtccagtcctcgcgtctgctacccggtgtcaccggggcttcccaagccaatgctactccgcccaaacacttcctgagctatgtagcccccaggatgaactggactttctcatggaggctctcatcatttccaaattcaggcatcagaatatagtacgatgcgtcggactcagtctgcgtgcgaccccccggctcatcctcctggagcttatgtcagggggcgatatgaagtccttccttaggcactcaagaccacatttaggccagccgtccccgctcgtaatgagggatcttctgcagttggctcaggatatcgcccaggggtgtcattatcttgaggagaatcacttcatccatcgcgacattgcggctagaaactgtctcctgtcatgtgctgggccatctcgcgtcgctaagattggcgactttggaatggccagggacatctatagagcttcctattaccgcaggggcgaccgggctctgctccccgtcaaatggatgcctccagaggcattcttagaggggatcttcacttcgaagaccgatagttggagtttcggcgtgctgctatgggagattttctccttggggtacatgccatacccaggtaggaccaatcaagaagtgttggacttcgtggtgggggggggacgcatggaccctccccggggatgcccaggcccagtgtaccgtatcatgactcaatgttggcaacacgaacccgagctgcgcccctcctttgcaagtatcctggaaagactccagtattgcactcaggacccagacgtgctgaatagcttgctaccaatggaactggggcccacaccggaggaagaaggcacctccgggttgggtaatcggtctttagagtgtcttcgcccaccccagccccaggagctcagccccgagaagttgaagtcctggggcgggtctccattgggcccctggctcagctcagggctgaagcccctgaagtcccggggactgcaaccccagaatctgtggaacccaacttatcggagctag

SEQ ID NO: 193057 - DNA, 180 bp, Artificial Sequence
  Description of Artificial Sequence: Synthetic coding sequence
atgctgagccggaacgacgacatctgcatctacggcggcctgggcctggggggactgctgctcctcgcagttgttctgttgtccgcctgtctctgttggttgcaccggcgaggcccagggttactgcgcgccggcacacctctgtgtatctccgcggaagctgcttctgctcagcaatag

SEQ ID NO: 193058 - DNA, 201 bp, Artificial Sequence
  Description of Artificial Sequence: Synthetic coding sequence
atgctgagccggaacgacgacatctgcatctacggcggcctgggcctcggaggtttgctcctactcgcagttgtgctgttgagcgcctgcctgtgctggctccatagaagagcccccagcgtgctggttcctggccccggcttgttgcgtgcaggcaccccattgtgtatttcggccgaggcagcaagcgcccagcaatag

SEQ ID NO: 193059 - DNA, 222 bp, Artificial Sequence
  Description of Artificial Sequence: Synthetic coding sequence
atgctgagccggaacgacgtgaagcggctggagcggagctggcacctcttaagttggtcccaagctcagggcagcagcgaacaggaactccactacgcctctctgcagcgcctgcctgtcccttcctcagaaggtcctgatctgagaggacgggataaacggggaactaaggaggatccacgagccgattacgcatgcatcgccgagaacaaacccacgtag

SEQ ID NO: 193060 - DNA, 201 bp, Artificial Sequence
  Description of Artificial Sequence: Synthetic coding sequence
atgctgagccggaacgacgtgaagcggctggagcggagctgggcccagggcagctcagaacaggagttgcactacgcctcactgcagagattacccgtgccttcctctgaggggcctgatctgaggggccgagataaacggggaaccaaagaggatcccagagctgactatgcttgcatcgcagagaacaaaccaacttag

SEQ ID NO: 193061 - DNA, 108 bp, Artificial Sequence
  Description of Artificial Sequence: Synthetic coding sequence
atgctgagccggaacgacgcccccagcgtgctggtgcccggccccggactgctgagagctggcaccccgctctgtattagcgcggaggctgcgagcgcgcagcaatag

SEQ ID NO: 193062 - DNA, 315 bp, Artificial Sequence
  Description of Artificial Sequence: Synthetic coding sequence
atgctgagccggaacgacgacatctgcatctacggcggcctgggccttggtgggctcctgctgctagctgtggtacttctaagtgcctgcttgtgttggctccatcggcgtgttaagagattggaaagaagctggcatctcctgagctggagtcaggcccagggcagttccgagcaggagctgcattacgctagcctccaaagactgcctgtcccttcaagcgaaggtcctgatctgaggggccgcgataaaagaggcaccaaagaggatccaagggctgattatgcttgtatagctgagaataagcctacgtag

SEQ ID NO: 193063 - DNA, 42 bp, Artificial Sequence
  Description of Artificial Sequence: Synthetic coding sequence
atgctgagccggaacgacgaggccgccagcgcccagcagtag

SEQ ID NO: 193064 - DNA, 108 bp, Artificial Sequence
  Description of Artificial Sequence: Synthetic coding sequence
atgctgagccggaacgacgcccccagcgtgctggtgcccggccccggactattaagagcgggtacaccattgtgcatctcagcagaggcagcatccgctcagcaatag

SEQ ID NO: 193065 - DNA, 276 bp, Artificial Sequence
  Description of Artificial Sequence: Synthetic coding sequence
atgatctacgtgagcaccggcgcctggggctgggccggcagctgcttttggcagtggtccttttgtccgcctgcctgtgtgggatgcattgaggaacatctgctctcttggagccaagcccaagggtcctccgagcaggagctgcactatgcctccctccagagactccccgttcctagtagcgaaggacctgacctccgtggccgagacaaaaggggcactaaggaggacccaagagctgattacgcatgcatcgccgaaaacaaacctacgtag

SEQ ID NO: 193066 - DNA, 156 bp, Artificial Sequence
  Description of Artificial Sequence: Synthetic coding sequence
atgctgagccggaacgacgtgaagcggctggagcggagctggcggctgcctgtcccttcttcagaaggacctgacttaagaggtcgtgataaaagagggaccaaggaggatccacgtgcagactatgcctgtattgccgagaacaaacccacgtag

SEQ ID NO: 193067 - DNA, 192 bp, Artificial Sequence
  Description of Artificial Sequence: Synthetic coding sequence
atgcacctgtgccggggctgccagtgccccgccgtgcgggacctgacttctggggcggaaacccgcgaagcgcctcgtagaattcaggagttaaccatgcctgccctccttcgcacaaatcctcccgaacatcctaggcacctgcctcagccgaggcgtgtagaccgagtgcctctctggagctcacagtag

SEQ ID NO: 193068 - DNA, 222 bp, Artificial Sequence
  Description of Artificial Sequence: Synthetic coding sequence
atgctgagccggaacgacgtgaagcggctggagcggagctggcacctgctgagctggtcacaagcgcagggatcaagtgaacaggaactgcattatgcctctttgcagcgtttgccagtaccttctagcgaaggacctgatcttcgaggaagggacaaacgcgggaccaaggaggacccaagagctgattatgcctgtatcgcggaaaacaagccaacctag

SEQ ID NO: 193069 - DNA, 108 bp, Artificial Sequence
  Description of Artificial Sequence: Synthetic coding sequence
atgctgagccggaacgacgcccccagcgtgctggtgcccggccccggcctgttgcgtgctggcactcccctctgtatctctgccgaagctgccagtgcccagcagtag

SEQ ID NO: 193070 - DNA, 201 bp, Artificial Sequence
  Description of Artificial Sequence: Synthetic coding sequence
atgctgagccggaacgacgacatctgcatctacggcggcctgggcctcggcggattactgctgttggctgtggtgctcttgagcgcgtgtctttgctggctacaccgccgtgccccgagtgtgctggtcccaggccctggcctcttgagagcagggactccattgtgtatttctgccgaggcagcctctgctcaacagtag

SEQ ID NO: 193071 - DNA, 315 bp, Artificial Sequence
  Description of Artificial Sequence: Synthetic coding sequence
atgctgagccggaacgacgacatctgcatctacggcggcctgggcctgggcggcctgctcctgttggccgtggtcctgctttcagcttgcctgtgctggctgcatcgccgggttaagcggctggagagatcctggcaccttctgtcttggtcccaggcccaggggagcagtgagcaagagctgcactacgcatccctccaacggctacctgtgccttcctcagaaggcccagatctgcgcggccgagacaaacgaggtaccaaggaggaccctcgagccgattacgcatgcatcgccgaaaacaaacctacctag

SEQ ID NO: 193072 - DNA, 135 bp, Artificial Sequence
  Description of Artificial Sequence: Synthetic coding sequence
atgctgagccggaacgacgacatctgcatctacggcggcctgggcctaggcggcctgctcctcctcgcggtcgtgctgttgtctgcctgcttgtgctggctacacagaagagaggccgcatcagctcagcagtag

SEQ ID NO: 193073 - DNA, 201 bp, Artificial Sequence
  Description of Artificial Sequence: Synthetic coding sequence
atgctgagccggaacgacgacatctgcatctacggcggcctgggcctgggtggattactactccttgctgttgttttgctctccgcttgtctatgttggttacacagaagagtgaagcgcctggaaagatcctggagactgccagtcccctcaagtgaagggccggacctgagaggcagagacaagcgcggtactaaatag

SEQ ID NO: 193074 - DNA, 201 bp, Artificial Sequence
  Description of Artificial Sequence: Synthetic coding sequence
atgctgagccggaacgacgtgaagcggctggagcggagctgggcccaggggagcagcgaacaggagctgcactatgcatctctgcagaggctgcccgttccatccagcgaaggtccagacctgagaggcagagacaaacgcggcacaaaagaggacccacgggccgattacgcttgtattgccgagaacaaacccacgtag

SEQ ID NO: 193075 - DNA, 294 bp, Artificial Sequence
  Description of Artificial Sequence: Synthetic coding sequence
atgctgagccggaacgacgacatctgcatctacggcggcctgggcctgggaggtctactgctgctagctgtggttctgctatccgcgtgtctgtgttggctacatcgacgagtcaaaagattggaaaggagctgggcccaaggaagttcagagcaggaattacattacgcaagtctccagcgcttacctgtgcctagctctgagggcccagatctgaggggcagggacaaaaggggaactaaagaagacccccgagctgattacgcctgcatcgctgagaataagccgacctag

SEQ ID NO: 193076 - DNA, 180 bp, Artificial Sequence
  Description of Artificial Sequence: Synthetic coding sequence
atgctgagccggaacgacgacatctgcatctacggcggcctgggcctgggaggcttattgctgttggcagtggtgcttctatcagcatgtttatgctggctgcatcgtcgcggtcccggcctgttgcgtgcaggcacacctctctgcatcagcgccgaggccgcaagtgctcagcagtag

SEQ ID NO: 193077 - DNA, 87 bp, Artificial Sequence
  Description of Artificial Sequence: Synthetic coding sequence
atgctgagccggaacgacggccccggcctgctgcgggccggcaccccactttgcatctctgcggaagcggcctctgcccagcaatag

SEQ ID NO: 193078 - DNA, 87 bp, Artificial Sequence
  Description of Artificial Sequence: Synthetic coding sequence
atgctgagccggaacgacggccccggcctgctgcgggccggcacccccctgtgtatttccgccgaagcagcttcggctcagcaatag

SEQ ID NO: 193079 - DNA, 87 bp, Artificial Sequence
  Description of Artificial Sequence: Synthetic coding sequence
atgctgagccggaacgacggccccggcctgctgcgggccggcacccctctttgtatcagcgctgaggctgccagcgcgcaacagtag

SEQ ID NO: 193080 - DNA, 87 bp, Artificial Sequence
  Description of Artificial Sequence: Synthetic coding sequence
atgctgagccggaacgacggccccggcctgctgcgggccggcaccccgctgtgcatctccgccgaagccgccagcgctcagcagtag

SEQ ID NO: 193081 - DNA, 42 bp, Artificial Sequence; identical to SEQ ID NO: 193063
  Description of Artificial Sequence: Synthetic coding sequence

SEQ ID NO: 193082 - DNA, 249 bp, Artificial Sequence
  Description of Artificial Sequence: Synthetic coding sequence
atgctgagccggaacgacgacatctgcatctacggcggcctgggcctgggcggacttctactgctggccgtggtgttgctatccgcatgcctttgttggctgcaccgaagggtaaagcggctcgagagatcttggaggttacctgttccatcatccgagggtcccgatctgagggggcgagataagcgggggacaaaagaggatccacgcgccgattacgcatgcatagcggagaacaaacccacgtag

SEQ ID NO: 193083 - DNA, 201 bp, Artificial Sequence
  Description of Artificial Sequence: Synthetic coding sequence
atgctgagccggaacgacgtgaagcggctggagcggagctgggcccaggggtctagcgagcaagagctgcactacgcgtccctccagaggctgcccgtaccttccagtgaagggccagatctgcgcggacgagataaaagggggacgaaggaggatccaagagcagactatgcgtgcatagccgagaacaaaccaacctag

SEQ ID NO: 193084 - DNA, 201 bp, Artificial Sequence
  Description of Artificial Sequence: Synthetic coding sequence
atgctgagccggaacgacgtgaagcggctggagcggagctgggcccaaggttcgagtgagcaagagctgcactacgcaagccttcagagactgcctgtgccctcttccgaaggacctgatctgcggggaagggacaagcgaggaacaaaggaggatcccagagccgactacgcctgtattgctgaaaataagcctacttag

SEQ ID NO: 193085 - DNA, 294 bp, Artificial Sequence
  Description of Artificial Sequence: Synthetic coding sequence
atgctgagccggaacgacgacatctgcatctacggcggcctgggcctgggtggcctgctacttctcgcagtcgtgcttctgtccgcttgcctttgctggctgcacaggcgggtgaaaaggctggagcgttcatgggctcagggttcatcagagcaggaactgcactacgctagcttgcaaaggctgcccgtcccaagctccgaggggcccgacttgcgtggcagagataagagaggaacaaaggaggaccccagggccgactacgcgtgcatcgcagaaaacaagcccacctag

SEQ ID NO: 193086 - DNA, 156 bp, Artificial Sequence
  Description of Artificial Sequence: Synthetic coding sequence
atgctgagccggaacgacgtgaagcggctggagcggagctggcggttgcccgtcccatccagtgaggggccggatcttcggggcagggacaaaagaggaaccaaggaggatcccagggccgactacgcctgcatcgccgaaaataagcccacatag

SEQ ID NO: 193087 - DNA, 294 bp, Artificial Sequence
  Description of Artificial Sequence: Synthetic coding sequence
atgctgagccggaacgacgacatctgcatctacggcggcctgggcttaggtggcctgctattgcttgcagtggtgctgctgtccgcgtgtctgtgttggctccacaggagagtgaagcggctcgagcggtcatgggcccaaggcagttcagagcaggaactccactacgcaagcctccaacggctccctgttccatccagtgagggtccggacctccgcggaagagataagcgggggacaaaagaggaccctcgtgcagattacgcttgcatcgcagaaaacaagcccacctag

SEQ ID NO: 193088 - DNA, 315 bp, Artificial Sequence
  Description of Artificial Sequence: Synthetic coding sequence
atgctgagccggaacgacgacatctgcatctacggcggcctgggcctcgggggccttttactgctcgcagtggtccttctttctgcatgtctgtgctggttgcaccgtcgggttaagcggctcgagaggtcctggcacctgttgagctggtcacaagcccagggaagttcggaacaggaactgcactacgcaagcttacagaggttgcccgtcccctccagcgaggggccggatctgcgagggagagataaaagaggaacaaaagaggaccctagagcagactacgcctgtatagccgagaataaaccaacgtag

SEQ ID NO: 193089 - DNA, 132 bp, Artificial Sequence
  Description of Artificial Sequence: Synthetic coding sequence
taccggggcatgatgatctacgtgagcaccggcgcctggggctgggccggctcttgcttctggcagtggagcttctgcccgcctgcttgtgtaggctgtattgaggagaggttgcctgtccctagcagctag

SEQ ID NO: 193090 - DNA, 111 bp, Artificial Sequence
  Description of Artificial Sequence: Synthetic coding sequence
atgctgagccggaacgacgacatctgcatctacggcggcctgggcttgggagggttacttttgctcgctgtggtcctgctgtcagcctgcttgtgctggctacacagatag

SEQ ID NO: 193091 - DNA, 315 bp, Artificial Sequence
  Description of Artificial Sequence: Synthetic coding sequence
atgctgagccggaacgacgacatctgcatctacggcggcctgggcctgggcggcctcctgctactcgcagtggtcctcctaagcgcttgcctgtgttggctgcatagaagagtgaagcggttggaaaggtcttggcacctcctctcctggtcccaggcccagggttcttccgaacaggagctgcattatgccagcctccaacggctgcctgtgcccagcagcgagggtcccgatttgcgaggcagagataaaagggggacaaaggaggaccccagggcagattacgcttgtatcgccgaaaataagcctacgtag

SEQ ID NO: 193092 - DNA, 141 bp, Artificial Sequence
  Description of Artificial Sequence: Synthetic coding sequence
atgctgagccggaacgacgacatctgcatctacggcggcctgggcctcgggggcctgctcttgcttgccgttgtcctcctgtcggcgtgtctctgttggctgcacaggcgtgagcactgtcttgcccttgagccactctag

SEQ ID NO: 193093 - DNA, 42 bp, Artificial Sequence; identical to SEQ ID NO: 193063
  Description of Artificial Sequence: Synthetic coding sequence

SEQ ID NO: 193094 - DNA, 87 bp, Artificial Sequence
  Description of Artificial Sequence: Synthetic coding sequence
atgctgagccggaacgacggccccggcctgctgcgggccggcaccccgctgtgcatctccgcagaggctgccagcgctcagcagtag

SEQ ID NO: 193095 - DNA, 201 bp, Artificial Sequence
  Description of Artificial Sequence: Synthetic coding sequence
atgctgagccggaacgacgtgaagcggctggagcggagctgggcccaaggcagcagtgaacaggagctgcactatgcatctttacaaagactgccagtgccatcttcggagggcccagacttaagaggacgggacaagcgcggcacaaaggaggatccacgcgctgactacgcatgcatcgcggaaaacaagcccacttag

SEQ ID NO: 193096 - DNA, 87 bp, Artificial Sequence
  Description of Artificial Sequence: Synthetic coding sequence
atgctgagccggaacgacggccccggcctgctgcgggccggcacccccctctgcatctccgccgaagctgccagcgcacagcaatag

SEQ ID NO: 193097 - DNA, 87 bp, Artificial Sequence
  Description of Artificial Sequence: Synthetic coding sequence
atgctgagccggaacgacggccccggcctgctgcgggccggcacccctctgtgcatttcagcggaagccgccagtgcacagcagtag

SEQ ID NO: 193098 - DNA, 132 bp, Artificial Sequence
  Description of Artificial Sequence: Synthetic coding sequence
tgaagccggaacgacgacatctgcatctacggcggcctgggcctgggcggcttgctgctcctggccgtggtcttactgtccgcctgcctgtgttggctgcacagacgtgaggccgcttccgcccagcagtag

SEQ ID NO: 193099 - DNA, 156 bp, Artificial Sequence
  Description of Artificial Sequence: Synthetic coding sequence
atgctgagccggaacgacgtgaagcggctggagcggagctggcggcttccagtaccttcgtccgagggccccgacctgcggggccgggataaacgagggactaaggaagacccgcgcgcagactatgcttgtattgccgaaaacaaaccaacatag

SEQ ID NO: 193100 - DNA, 108 bp, Artificial Sequence
  Description of Artificial Sequence: Synthetic coding sequence
atgctgagccggaacgacgcccccagcgtgctggtgcccggccccggactgttacgggctggcacccccctctgcatctcggctgaggctgccagcgcccagcagtag

SEQ ID NO: 193101 - DNA, 42 bp, Artificial Sequence; identical to SEQ ID NO: 193063
  Description of Artificial Sequence: Synthetic coding sequence

SEQ ID NO: 193102 - DNA, 294 bp, Artificial Sequence
  Description of Artificial Sequence: Synthetic coding sequence
atgctgagccggaacgacgacatctgcatctacggcggcctgggcctcggaggactgctgctacttgccgtagtgctcctgtccgcatgcctgtgctggttacaccgtcgtgtcaaaaggctcgagaggtcatgggctcaggggagttctgaacaggagctgcactacgcctctctccaaaggctgcctgtgccctctagtgaggggcctgacctgagaggacgggataaacgcggaaccaaagaggaccccagggcagactatgcatgtattgcagaaaacaagccaacgtag

SEQ ID NO: 193103 - DNA, 201 bp, Artificial Sequence
  Description of Artificial Sequence: Synthetic coding sequence
atgctgagccggaacgacgtgaagcggctggagcggagctgggcccagggttcctctgagcaggagctgcactacgcctcactgcagaggttacccgttccatcctccgagggacctgacctgcggggcagagacaaacgggggacaaaagaagatcccagagccgactacgcctgcatagccgaaaataagcctacctag

SEQ ID NO: 193104 - DNA, 141 bp, Artificial Sequence
  Description of Artificial Sequence: Synthetic coding sequence
atgctgagccggaacgacgacatctgcatctacggcggcctgggcttgggcggtctcctccttctagctgtggtcctcttatcggcttgcctttgttggctgcacagacgcgaacattgtctggcactcgaacccctttag

SEQ ID NO: 193105 - DNA, 132 bp, Artificial Sequence
  Description of Artificial Sequence: Synthetic coding sequence
tgaagccggaacgacgacatctgcatctacggcggcctgggcctgggcggactgctgctgctcgcagtggtgctgcttagcgcttgtctgtgttggctgcatagacgagaagccgccagcgctcaacagtag

SEQ ID NO: 193106 - DNA, 141 bp, Artificial Sequence
  Description of Artificial Sequence: Synthetic coding sequence
atgctgagccggaacgacgacatctgcatctacggcggcctgggccttgggggactattgctcttggctgtggtgcttcttagcgcatgcctgtgttggctgcacagaagggaacattgccttgcactggagcccctctag

SEQ ID NO: 193107 - DNA, 87 bp, Artificial Sequence
  Description of Artificial Sequence: Synthetic coding sequence
atgctgagccggaacgacggccccggcctgctgcgggccggcaccccattgtgcatctctgcagaggcagcgtcggcacagcagtag

SEQ ID NO: 193108 - DNA, 132 bp, Artificial Sequence
  Description of Artificial Sequence: Synthetic coding sequence
tgaagccggaacgacgacatctgcatctacggcggcctgggcctgggagggctcctccttctcgccgtcgtgctcctgagtgcgtgcctgtgctggctccatcgtcgggaggccgcttctgcgcagcaatag

SEQ ID NO: 193109 - DNA, 201 bp, Artificial Sequence
  Description of Artificial Sequence: Synthetic coding sequence
atgctgagccggaacgacgtgaagcggctggagcggagctgggcccagggctctagcgagcaggagcttcattatgccagcctgcagagactgccagtgccatccagcgagggtccagacctccgaggacgcgacaaaagagggaccaaagaggacccccgggcggactacgcgtgcatcgccgagaataagccaacctag

SEQ ID NO: 193110 - DNA, 180 bp, Artificial Sequence
  Description of Artificial Sequence: Synthetic coding sequence
atgctgagccggaacgacgacatctgcatctacggcggcctgggccttggcgggttgctcctgttggccgtggtactgctttcagcttgtctgtgctggctgcatcgtagaggccctggcctcctgagggccggtacccccctttgtatttctgccgaagcagcgagtgcccaacagtag

SEQ ID NO: 193111 - DNA, 222 bp, Artificial Sequence
  Description of Artificial Sequence: Synthetic coding sequence
atgctgagccggaacgacgtgaagcggctggagcggagctggcacctcctgtcatggtcacaggcccaaggctcctcagaacaggagctgcactatgcatccctccagagactgcccgtcccctcatcggagggacctgatttacgcggccgcgataagagagggaccaaggaggacccgcgggctgattacgcttgtatcgcagagaacaagcccacttag

SEQ ID NO: 193112 - DNA, 201 bp, Artificial Sequence
  Description of Artificial Sequence: Synthetic coding sequence
atgctgagccggaacgacgacatctgcatctacggcggcctgggcctcggaggtttattgcttctggcggtcgtccttctgagcgcttgtctttgctggttacaccgaagagcaccctccgtgctggtgccaggtcccggtctcctccgggctggtactcccctctgtatttccgcagaggctgcatctgcccaacaatag

SEQ ID NO: 193113 - DNA, 201 bp, Artificial Sequence
  Description of Artificial Sequence: Synthetic coding sequence
atgctgagccggaacgacgtgaagcggctggagcggagctgggcccaagggtctagcgaacaggaactgcactatgcaagtctgcaacgcttgcccgttccttcatcggaggggcctgatctgaggggtagagacaaacgagggactaaggaggacccccgggccgattacgcctgcattgctgagaacaaaccgacctag

SEQ ID NO: 193114 - DNA, 87 bp, Artificial Sequence
  Description of Artificial Sequence: Synthetic coding sequence
atgctgagccggaacgacggccccggcctgctgcgggccggcacccccctctgtatttctgctgaggctgcatcagcccagcagtag

SEQ ID NO: 193115 - DNA, 249 bp, Artificial Sequence
  Description of Artificial Sequence: Synthetic coding sequence
atgctgagccggaacgacgacatctgcatctacggcggcctgggccttggcgggctcctgttgctggctgtcgtgctcctgtccgcatgcctctgttggctgcataggcgagtcaaacgactcgagaggtcatggaggcttcctgtgccttccagtgagggccctgacttgcggggaagggacaaacggggaaccaaggaggatccccgagccgactacgcttgcatcgcagaaaataagcccacctag

SEQ ID NO: 193116 - DNA, 156 bp, Artificial Sequence
  Description of Artificial Sequence: Synthetic coding sequence
atgctgagccggaacgacgtgaagcggctggagcggagctggcggctgcctgtcccttccagcgagggccctgatctccgcggtagggacaagcggggcacaaaggaggatccaagagctgattacgcctgcattgccgagaacaagccaacctag

SEQ ID NO: 193117 - DNA, 180 bp, Artificial Sequence
  Description of Artificial Sequence: Synthetic coding sequence
atgctgagccggaacgacgacatctgcatctacggcggcctgggcctcggcggattgttactgttggccgtggttctgttgtccgcctgcctgtgttggctacataggcggggacctgggttactgagggcgggcactcctttgtgtattagtgctgaggctgcctccgcgcagcaatag

SEQ ID NO: 193118 - DNA, 201 bp, Artificial Sequence
  Description of Artificial Sequence: Synthetic coding sequence
atgctgagccggaacgacgtgaagcggctggagcggagctgggcccaaggcagttccgaacaggaactgcattacgcatccctacagagactccctgtgccttcctccgagggcccagatcttcgtggtagagacaagagaggtactaaagaggaccctagagcggactatgcttgtatagccgagaataaacctacatag

SEQ ID NO: 193119 - DNA, 156 bp, Artificial Sequence
  Description of Artificial Sequence: Synthetic coding sequence
atgctgagccggaacgacgtgaagcggctggagcggagctggcggctgcccgtgccatcctccgagggtccagatctgcggggacgcgataaaaggggcacgaaagaagacccacgcgctgactacgcctgtatcgccgagaataaacccacttag

SEQ ID NO: 193120 - DNA, 249 bp, Artificial Sequence
  Description of Artificial Sequence: Synthetic coding sequence
atgctgagccggaacgacgacatctgcatctacggcggcctgggcctgggcggactcctcctgttggctgtcgtgctcctgtcagcttgtctctgttggcttcatagacgcgttaagagacttgagcgatcctggaggcttccggtcccctcctcagagggccctgacttacgaggccgtgataaaagaggcactaaggaagatccccgggccgactatgcatgcatcgccgagaacaagcctacctag

SEQ ID NO: 193121 - DNA, 141 bp, Artificial Sequence
  Description of Artificial Sequence: Synthetic coding sequence
atgctgagccggaacgacgacatctgcatctacggcggcctgggcctaggcggactgttgctgttagctgtggttctcctgtccgcttgcctttgttggcttcaccgtagagagcattgcttagccctcgaacctttgtag

SEQ ID NO: 193122 - DNA, 108 bp, Artificial Sequence
  Description of Artificial Sequence: Synthetic coding sequence
atgctgagccggaacgacgcccccagcgtgctggtgcccggccccgggctgctcagagctggcacacccctgtgcatctcagctgaagcagcgtccgcccagcagtag

SEQ ID NO: 193123 - DNA, 249 bp, Artificial Sequence
  Description of Artificial Sequence: Synthetic coding sequence
atgctgagccggaacgacgacatctgcatctacggcggcctgggccttggaggattgcttctcctcgccgttgttctgctgtcggcgtgtctttgttggctgcaccgcagagtcaagcgactggagcgctcctggcgcctgcccgtcccctcatcggaaggtcccgatctcagggggcgagataaacgcggtacaaaggaggacccccgcgcagactacgcatgtattgccgaaaacaaaccgacctag

SEQ ID NO: 193124 - DNA, 87 bp, Artificial Sequence
  Description of Artificial Sequence: Synthetic coding sequence
atgctgagccggaacgacggccccggcctgctgcgggccggcacccccttgtgtatttccgctgaggccgcatcagcccagcagtag

SEQ ID NO: 193125 - DNA, 294 bp, Artificial Sequence
  Description of Artificial Sequence: Synthetic coding sequence
atgctgagccggaacgacgacatctgcatctacggcggcctgggcctgggaggtctgctgcttcttgccgtggtgctactatccgcatgcctctgttggctccacagaagggtgaagcggctggagcgatcttgggctcaggggtcctcagagcaggagctgcattacgcttcactccagagactgccagtgccgagctcggaagggccagacctgagaggcagggacaagcgaggtaccaaggaggaccctagggccgattatgcctgcatcgctgagaataaacccacctag

SEQ ID NO: 193126 - DNA, 87 bp, Artificial Sequence
  Description of Artificial Sequence: Synthetic coding sequence
atgctgagccggaacgacggccccggcctgctgcgggccggcaccccgttatgcattagcgccgaagccgcatccgctcaacagtag

SEQ ID NO: 193127 - DNA, 108 bp, Artificial Sequence
  Description of Artificial Sequence: Synthetic coding sequence
atgctgagccggaacgacgcccccagcgtgctggtgcccggccccggtctcttgcgcgccggcaccccactgtgcatctctgcagaggctgcctccgcacagcagtag

SEQ ID NO: 193128 - DNA, 294 bp, Artificial Sequence
  Description of Artificial Sequence: Synthetic coding sequence
atgctgagccggaacgacgacatctgcatctacggcggcctgggcttaggggggctccttctccttgctgttgtgctgctgagcgcctgtttgtgctggctgcaccggagagtgaaaagactggagcgctcctgggctcagggtagctctgagcaagagctgcactatgcgtccctgcagaggctcccagtcccttcttctgagggcccagacctgcggggtagggacaaaaggggtacaaaggaagaccccagagccgattacgcctgcatcgcagaaaataagccgacgtag

SEQ ID NO: 193129 - DNA, 201 bp, Artificial Sequence
  Description of Artificial Sequence: Synthetic coding sequence
atgctgagccggaacgacgtgaagcggctggagcggagctgggcccagggctcaagcgaacaggagctgcattatgccagtctgcagcggctaccggtgcctagttccgagggccctgacctgcggggccgcgacaagcgaggcacaaaggaagatccccgggcagactacgcatgcattgccgaaaacaaacctacatag

SEQ ID NO: 193130 - DNA, 201 bp, Artificial Sequence
  Description of Artificial Sequence: Synthetic coding sequence
atgctgagccggaacgacgtgaagcggctggagcggagctgggcccagggatctagtgaacaggaactccattacgcgagtctgcagaggttacccgtcccaagctctgaaggcccagatcttcgtggacgcgacaaaaggggtacgaaggaggatcctcgcgccgactacgcttgcattgctgaaaataagccgacatag

SEQ ID NO: 193131 - DNA, 42 bp, Artificial Sequence; identical to SEQ ID NO: 193063
  Description of Artificial Sequence: Synthetic coding sequence

SEQ ID NO: 193132 - DNA, 87 bp, Artificial Sequence
  Description of Artificial Sequence: Synthetic coding sequence
atgctgagccggaacgacggccccggcctgctgcgggccggcacccccctctgtatatccgcagaagctgcttccgctcagcaatag

SEQ ID NO: 193133 - DNA, 111 bp, Artificial Sequence
  Description of Artificial Sequence: Synthetic coding sequence
atgctgagccggaacgacgacatctgcatctacggcggcctgggcctcggcggcctgctccttctggcagtcgtgctgctcagcgcctgcctctgttggctccacagatag

SEQ ID NO: 193134 - DNA, 294 bp, Artificial Sequence
  Description of Artificial Sequence: Synthetic coding sequence
atgctgagccggaacgacgacatctgcatctacggcggcctgggcctgggcggcctcctgcttctggctgttgtgctcctgagcgcctgtctgtgttggttgcaccgacgagtaaagagactggaaaggagctgggctcagggcagcagcgagcaggagcttcattatgcatccctgcagagactgccagtcccatctagtgaggggcctgacctgcgcggaagggataagcgaggcactaaagaggacccaagggctgactacgcctgcatcgctgagaataaacctacatag

SEQ ID NO: 193135 - DNA, 180 bp, Artificial Sequence
  Description of Artificial Sequence: Synthetic coding sequence
atgctgagccggaacgacgacatctgcatctacggcggcctgggcctgggaggactgctcttattggctgttgtcctgttaagcgcatgcctatgttggcttcatagacgcggaccaggtctgcttcgcgcagggaccccactgtgcataagcgccgaggctgcatctgcccagcagtag

SEQ ID NO: 193136 - DNA, 294 bp, Artificial Sequence
  Description of Artificial Sequence: Synthetic coding sequence
atgctgagccggaacgacgacatctgcatctacggcggcctgggcctggggggcctcctgctgttggcagtggtgttgctttctgcgtgtctctgttggctacatagacgggtgaaacgcctcgagagaagctgggcccagggcagctcagaacaggaattgcattacgctagtctgcagaggctgcccgtgccttccagcgaaggccctgacttgcgtggtagagacaagagaggcactaaggaggatccaagggcggactatgcctgtattgctgaaaacaaacccacctag

SEQ ID NO: 193137 - DNA, 201 bp, Artificial Sequence
  Description of Artificial Sequence: Synthetic coding sequence
atgctgagccggaacgacgacatctgcatctacggcggcctgggcctggggggtcttctgctgctcgctgtcgtgcttttatccgcatgtctgtgctggttgcatcggcgtgctccctctgttcttgtgcctggccctggcctcctgagagctgggacccctttgtgcatctccgcggaagccgcttctgcccaacagtag

SEQ ID NO: 193138 - DNA, 87 bp, Artificial Sequence
  Description of Artificial Sequence: Synthetic coding sequence
atgctgagccggaacgacggccccggcctgctgcgggccggcacccccctctgcattagcgctgaggccgcatctgcacagcagtag

SEQ ID NO: 193139 - DNA, 180 bp, Artificial Sequence
  Description of Artificial Sequence: Synthetic coding sequence
atgctgagccggaacgacgacatctgcatctacggcggcctgggcctgggagggcttctcctgctagcagtcgttctgctctcagcctgcctgtgttggctgcataggcggggtcctggattacttcgagccggaacccccctgtgtatttcagccgaagctgcctccgctcagcagtag

SEQ ID NO: 193140 - DNA, 201 bp, Artificial Sequence
  Description of Artificial Sequence: Synthetic coding sequence
atgctgagccggaacgacgtgaagcggctggagcggagctgggcccaggggtcgtccgaacaggaactgcactatgcaagtctgcagcgacttccggtcccctcaagcgaaggccccgatcttcgcggccgggacaagagaggtacaaaagaagacccaagagccgactacgcatgcattgccgaaaacaaaccaacatag

SEQ ID NO: 193141 - DNA, 108 bp, Artificial Sequence
  Description of Artificial Sequence: Synthetic coding sequence
atgctgagccggaacgacgcccccagcgtgctggtgcccggccccggactactgcgcgccggcactcccttgtgcatctctgctgaagcagcttccgctcagcagtag

SEQ ID NO: 193142 - DNA, 201 bp, Artificial Sequence
  Description of Artificial Sequence: Synthetic coding sequence
atgctgagccggaacgacgtgaagcggctggagcggagctgggcccagggctcttccgagcaagagctgcactatgcttctttacagagactgcctgtcccgagtagtgaggggcctgatctgaggggccgggacaaaaggggaaccaaggaggaccccagagcggactatgcctgtattgctgaaaacaaaccaacatag

SEQ ID NO: 193143 - DNA, 87 bp, Artificial Sequence
  Description of Artificial Sequence: Synthetic coding sequence
atgctgagccggaacgacggccccggcctgctgcgggccggcacccccctgtgcatctctgccgaggccgcatctgcccagcagtag

SEQ ID NO: 193144 - DNA, 108 bp, Artificial Sequence
  Description of Artificial Sequence: Synthetic coding sequence
atgctgagccggaacgacgcccccagcgtgctggtgcccggccccggcttgttacgcgccggtacacccctgtgcatctccgctgaagcagcatcggcacagcagtag

SEQ ID NO: 193145 - DNA, 132 bp, Artificial Sequence
  Description of Artificial Sequence: Synthetic coding sequence
tgaagccggaacgacgacatctgcatctacggcggcctgggcctgggcggactactcctgctggcggtagtgctgttatctgcttgcctctgctggctgcaccgcagggaggctgcgagcgcacaacaatag

SEQ ID NO: 193146 - DNA, 111 bp, Artificial Sequence
  Description of Artificial Sequence: Synthetic coding sequence
atgctgagccggaacgacgacatctgcatctacggcggcctgggcctggggggtcttctcctcctggcggttgtcctgctctcagcgtgtttgtgctggctacataggtag

SEQ ID NO: 193147 - DNA, 111 bp, Artificial Sequence
  Description of Artificial Sequence: Synthetic coding sequence
atgctgagccggaacgacgacatctgcatctacggcggcctgggcctcggcggattgctgctcctggccgttgtattgctctctgcctgtctctgctggttgcaccggtag

SEQ ID NO: 193148 - DNA, 201 bp, Artificial Sequence
  Description of Artificial Sequence: Synthetic coding sequence
atgctgagccggaacgacgtgaagcggctggagcggagctgggcccaaggaagctccgaacaggaactgcattatgctagtctccagcggcttcccgtaccttccagtgagggccctgaccttaggggtcgcgacaagcggggaacgaaggaggatcctcgagccgattatgcatgcatcgccgagaataaaccgacttag

SEQ ID NO: 193149 - DNA, 294 bp, Artificial Sequence
  Description of Artificial Sequence: Synthetic coding sequence
atgctgagccggaacgacgacatctgcatctacggcggcctgggcttgggtgggctgctcttgttggcggtggtgctgctgagcgcttgcctctgctggctacatcggagggtaaaacgtctcgagcggtcctgggcccaggggagctcggaacaggagctgcactacgcaagcctgcaaaggctgcccgtcccatcgtctgagggacctgatttgaggggtagagacaagcgaggcacgaaagaagatccacgggccgactatgcctgtatcgcggagaataaacccacctag

SEQ ID NO: 193150 - DNA, 87 bp, Artificial Sequence
  Description of Artificial Sequence: Synthetic coding sequence
atgctgagccggaacgacggccccggcctgctgcgggccggcacccctctctgcattagcgctgaagcagccagcgcccagcagtag

SEQ ID NO: 193151 - DNA, 315 bp, Artificial Sequence
  Description of Artificial Sequence: Synthetic coding sequence
atgctgagccggaacgacgacatctgcatctacggcggcctgggcctgggcggactgttgctgctcgctgtcgtgctgctttcggcctgcttatgttggcttcatcgcagggtgaaaagactggagcgctcctggcatcttctgtcttggagtcaggctcagggttcctccgagcaggaattgcactatgcgagcctgcagcgcctcccagttccctcatctgagggcccagacctacggggcagggacaaacgcgggacgaaggaggacccccgcgccgactatgcatgcatagccgaaaataaaccgacatag

SEQ ID NO: 193152 - DNA, 201 bp, Artificial Sequence
  Description of Artificial Sequence: Synthetic coding sequence
atgctgagccggaacgacgtgaagcggctggagcggagctgggcccagggatctagcgagcaggaactccattacgcaagcctgcagcgcctgccagtgccatccagcgaggggccggacctccgaggcagggataagagggggaccaaagaagatccaagagctgattacgcctgcatcgctgagaacaagccgacatag

SEQ ID NO: 193153 - DNA, 111 bp, Artificial Sequence
  Description of Artificial Sequence: Synthetic coding sequence
atgctgagccggaacgacgacatctgcatctacggcggcctgggcttagggggcctgctcctgctggcagtggtcctgctaagcgcctgcctgtgctggctgcacaggtag

SEQ ID NO: 193154 - DNA, 294 bp, Artificial Sequence
  Description of Artificial Sequence: Synthetic coding sequence
atgctgagccggaacgacgacatctgcatctacggcggcctgggcttaggaggtctcttgctgttagccgttgttttactgtcggcctgtctctgctggctccacagacgggttaagcgattagaaagatcctgggcccagggttcctccgaacaggaattgcactacgcaagcttacagcgcctgcctgtcccctcatccgaggggcctgacctccgaggacgggataagcggggaaccaaagaggacccaagagcagattatgcctgtattgctgagaacaagcctacgtag

SEQ ID NO: 193155 - DNA, 156 bp, Artificial Sequence
  Description of Artificial Sequence: Synthetic coding sequence
atgctgagccggaacgacgtgaagcggctggagcggagctggcggcttccggtgccatcatctgagggccccgatctgaggggccgtgataagcgtggaactaaagaagaccccagggccgactatgcctgcattgctgaaaataagcctacatag

SEQ ID NO: 193156 - DNA, 315 bp, Artificial Sequence
  Description of Artificial Sequence: Synthetic coding sequence
atgctgagccggaacgacgacatctgcatctacggcggcctgggcctggggggtctgctgctgctggccgtggttttgctttcggcttgcctgtgctggctacatagacgcgttaagcgccttgagcggtcatggcacctcctatcatggtcccaagcccagggcagctctgagcaggagttgcattatgccagcctgcaaaggctgcccgtgccatcctcagagggccctgatttgagagggcgcgacaaacggggaacaaaagaggaccctcgcgctgactatgcctgcatcgctgaaaacaagccgacatag

SEQ ID NO: 193157 - DNA, 294 bp, Artificial Sequence
  Description of Artificial Sequence: Synthetic coding sequence
atgctgagccggaacgacgacatctgcatctacggcggcctgggcttggggggcctactcctgctggccgttgttctattgtcggcctgcctttgttggttacacagacgcgtaaaacgattagagcgcagctgggctcaggggagctctgaacaggaattgcactacgctagtctccaacggctcccggttccttccagcgaaggacccgatctgaggggacgagataaaagggggaccaaggaagatccaagggccgactacgcgtgtatagccgaaaataaacctacctag

SEQ ID NO: 193158 - DNA, 315 bp, Artificial Sequence
  Description of Artificial Sequence: Synthetic coding sequence
atgctgagccggaacgacgacatctgcatctacggcggcctgggcttaggaggacttttacttcttgccgtggtgctgctgtcggcttgcctttgctggcttcatcgtagagtgaagcggttggaacgttcatggcaccttctgtcgtggtctcaagctcagggttcttctgagcaggagcttcactacgcaagtctgcaacgcctgccggtgcccagctcagagggacctgatcttcgtgggagggacaagaggggaactaaagaagacccccgggccgattacgcttgtatcgccgagaacaagccgacctag

SEQ ID NO: 193159 - DNA, 156 bp, Artificial Sequence
  Description of Artificial Sequence: Synthetic coding sequence
atgctgagccggaacgacgtgaagcggctggagcggagctggcggcttcctgtcccctcctcagagggccccgatctgcggggtagggacaaaagaggcactaaggaggacccccgcgccgactatgcatgcattgcggaaaacaagcctacatag

SEQ ID NO: 193160 - DNA, 201 bp, Artificial Sequence
  Description of Artificial Sequence: Synthetic coding sequence
atgctgagccggaacgacgacatctgcatctacggcggcctgggcctgggaggactcctactgttggcagtggttcttctgtccgcctgtctttgttggctccacagaagggcgccttctgtgctggtgcccggtccaggtctactccgagctggtaccccactctgcatcagtgccgaggctgctagcgctcagcagtag

SEQ ID NO: 193161 - DNA, 111 bp, Artificial Sequence
  Description of Artificial Sequence: Synthetic coding sequence
atgctgagccggaacgacgacatctgcatctacggcggcctgggcctgggcgggttgctcctgctcgcggtcgttctcctcagtgcttgcttatgctggttgcatcgctag

SEQ ID NO: 193162 - DNA, 222 bp, Artificial Sequence
  Description of Artificial Sequence: Synthetic coding sequence
atgctgagccggaacgacgtgaagcggctggagcggagctggcacctcctgagctggtcacaggcccaaggcagtagtgagcaggagctgcattatgcctccctgcagagactgccagtgccgagcagcgagggcccggatttaagggggcgcgacaaacggggaacaaaggaggacccaagggccgattacgcttgcatcgctgaaaacaagcccacttag

SEQ ID NO: 193163 - DNA, 201 bp, Artificial Sequence
  Description of Artificial Sequence: Synthetic coding sequence
atgctgagccggaacgacgtgaagcggctggagcggagctgggcccagggaagttctgaacaggagctgcattatgctagcctccaaaggctccccgtgccatctagcgagggtcctgacttacgagggagggataagcggggcacaaaagaggaccctcgagctgattatgcttgtattgccgagaataagccgacctag

SEQ ID NO: 193164 - DNA, 201 bp, Artificial Sequence
  Description of Artificial Sequence: Synthetic coding sequence
atgctgagccggaacgacgtgaagcggctggagcggagctgggcccaggggtcctcggagcaagagctacattacgcttcactgcagaggctgcctgtacccagcagcgaaggccccgatttaagagggcgcgacaagaggggcacaaaggaggacccccgggccgactacgcatgcattgctgagaataagcctacttag

SEQ ID NO: 193165 - DNA, 108 bp, Artificial Sequence
  Description of Artificial Sequence: Synthetic coding sequence
atgctgagccggaacgacgcccccagcgtgctggtgcccggccccggtctgctgcgagccggaaccccactgtgtatttctgccgaggcggcatcagcccagcagtag

SEQ ID NO: 193166 - DNA, 87 bp, Artificial Sequence
  Description of Artificial Sequence: Synthetic coding sequence
atgctgagccggaacgacggccccggcctgctgcgggccggcaccccactgtgtattagcgctgaggccgcatcggcacaacagtag

SEQ ID NO: 193167 - DNA, 141 bp, Artificial Sequence
  Description of Artificial Sequence: Synthetic coding sequence
atgctgagccggaacgacgacatctgcatctacggcggcctgggcttaggcgggctgttactgttagcagtcgtactacttagcgcctgcctgtgctggctgcaccgcagggaacactgcctggctcttgagcccctgtag

SEQ ID NO: 193168 - DNA, 141 bp, Artificial Sequence
  Description of Artificial Sequence: Synthetic coding sequence
atgctgagccggaacgacgacatctgcatctacggcggcctgggccttggaggtctcctcctcctggccgtcgtgctgcttagtgcctgcttatgctggctgcatcgccgggaacactgtctcgccctcgagccgctgtag

SEQ ID NO: 193169 - DNA, 201 bp, Artificial Sequence
  Description of Artificial Sequence: Synthetic coding sequence
atgctgagccggaacgacgacatctgcatctacggcggcctgggcctgggaggactcctgctactagctgtagtattgctatctgcttgtctgtgttggttacatcgaagagcaccttccgtgctcgtccccggtccgggactgctgcgggccggcactcctctatgcataagtgccgaggccgccagcgcacagcagtag

SEQ ID NO: 193170 - DNA, 141 bp, Artificial Sequence
  Description of Artificial Sequence: Synthetic coding sequence
atgctgagccggaacgacgacatctgcatctacggcggcctgggcctaggtggtctcctgctgttagccgtggtgctgctctctgcttgtttatgctggctccacaggcgggagcactgcttggctctggagcccttgtag

SEQ ID NO: 193171 - DNA, 87 bp, Artificial Sequence
  Description of Artificial Sequence: Synthetic coding sequence
atgctgagccggaacgacggccccggcctgctgcgggccggcacccctttgtgcatcagcgcagaggccgcaagcgcccagcagtag

SEQ ID NO: 193172 - DNA, 294 bp, Artificial Sequence
  Description of Artificial Sequence: Synthetic coding sequence
atgctgagccggaacgacgacatctgcatctacggcggcctgggcctgggcggcctccttctacttgctgtggtgttgctgtcggcatgcctatgttggcttcacagaagggttaagcggctcgagcggtcatgggcccaggggtcgtctgaacaggaactgcactatgcaagtttgcagagactcccggtcccatcttccgaagggcctgacctccgcggtagagataaaaggggcactaaggaggatcctagggctgattacgcctgcattgccgagaataaacccacctag

SEQ ID NO: 193173 - DNA, 180 bp, Artificial Sequence
  Description of Artificial Sequence: Synthetic coding sequence
atgctgagccggaacgacgacatctgcatctacggcggcctgggcctggggggtttactcctgcttgccgttgtgctactttctgcctgcctttgttggctccaccgacggggcccggggctactgcgggcgggcaccccactgtgcatatcagcggaagctgcctcggcgcaacaatag

SEQ ID NO: 193174 - DNA, 294 bp, Artificial Sequence
  Description of Artificial Sequence: Synthetic coding sequence
atgctgagccggaacgacgacatctgcatctacggcggcctgggcctgggcgggctcctcctgcttgccgtcgtgttactctcagcctgcctctgttggctacatcgaagagtgaaacggttggagcgctcatgggcccaaggcagcagcgagcaagaactgcactacgcctctctgcagcgtttaccagttccctccagcgagggaccggatctacgcggacgggacaaaaggggcactaaagaggacccgcgcgctgattacgcatgcatcgccgaaaacaaaccgacatag

SEQ ID NO: 193175 - DNA, 87 bp, Artificial Sequence
  Description of Artificial Sequence: Synthetic coding sequence
atgctgagccggaacgacggccccggcctgctgcgggccggcacccctctgtgtatttctgctgaagcagctagcgcacaacagtag

SEQ ID NO: 193176 - DNA, 111 bp, Artificial Sequence
  Description of Artificial Sequence: Synthetic coding sequence
atgctgagccggaacgacgacatctgcatctacggcggcctgggcctgggaggtctgctgttgcttgccgtggtgttactgagtgcatgtctctgttggctgcaccgatag

SEQ ID NO: 193177 - DNA, 156 bp, Artificial Sequence
  Description of Artificial Sequence: Synthetic coding sequence
atgctgagccggaacgacgtgaagcggctggagcggagctggcggctccctgtgccatcatcagagggcccagacctccgggggagggataagcgagggacaaaagaggaccccagggctgactacgcgtgcatcgcagagaataaacctacatag

SEQ ID NO: 193178 - DNA, 42 bp, Artificial Sequence; identical to SEQ ID NO: 193063
  Description of Artificial Sequence: Synthetic coding sequence

SEQ ID NO: 193179 - DNA, 201 bp, Artificial Sequence
  Description of Artificial Sequence: Synthetic coding sequence
atgctgagccggaacgacgtgaagcggctggagcggagctgggcccagggatcttccgaacaggaactccattacgcaagtttgcagcgtcttccagtacctagttctgaaggtccggatctcaggggccgtgacaaaaggggaacgaaggaggacccaagggctgattacgcctgtatcgccgaaaacaaacccacctag

SEQ ID NO: 193180 - DNA, 87 bp, Artificial Sequence
  Description of Artificial Sequence: Synthetic coding sequence
atgctgagccggaacgacggccccggcctgctgcgggccggcaccccgctgtgtattagcgccgaagctgcatccgcccagcagtag

SEQ ID NO: 193181 - DNA, 315 bp, Artificial Sequence
  Description of Artificial Sequence: Synthetic coding sequence
atgctgagccggaacgacgacatctgcatctacggcggcctgggcctgggtggcctgctactgctggccgttgtcctgctgagcgcctgtctatgctggctccatcgccgggttaagcgcctggagcgctcatggcacctgctctcctggagccaggctcagggtagctctgaacaggagttgcattatgcatcattgcagcggttaccagtaccgtcctctgagggacccgacctacggggcagagacaaacgagggacaaaagaggatccccgtgccgattacgcctgtatcgctgaaaataaaccgacgtag

SEQ ID NO: 193182 - DNA, 249 bp, Artificial Sequence
  Description of Artificial Sequence: Synthetic coding sequence
atgctgagccggaacgacgacatctgcatctacggcggcctgggcctggggggattgttgttgcttgccgtagtgctgctgtctgcgtgtctgtgttggctgcaccggcgagtgaagaggctcgaaaggtcctggaggctacctgtccctagttccgagggcccagatctccgcggccgggataagaggggaactaaggaggaccctagagccgattatgcctgcatcgcggaaaacaagcccacctag

SEQ ID NO: 193183 - DNA, 201 bp, Artificial Sequence
  Description of Artificial Sequence: Synthetic coding sequence
atgctgagccggaacgacgtgaagcggctggagcggagctgggcccagggctccagtgagcaggagctgcattacgcaagcctgcagagactgcccgtgccttcatccgagggcccagacctgcgagggagagacaagcgaggaaccaaggaagatcctcgggcagattacgcgtgtattgcagaaaacaagccaacatag

SEQ ID NO: 193184 - DNA, 87 bp, Artificial Sequence
  Description of Artificial Sequence: Synthetic coding sequence
atgctgagccggaacgacggccccggcctgctgcgggccggcacccctctctgtatttctgccgaggcagcatcggcacagcagtag

SEQ ID NO: 193185 - DNA, 132 bp, Artificial Sequence
  Description of Artificial Sequence: Synthetic coding sequence
tgaagccggaacgacgacatctgcatctacggcggcctgggcctgggcgggctgctgttgcttgcagtcgtattattatccgcttgtctctgctggcttcacaggagagaggcggcctccgcccagcagtag

SEQ ID NO: 193186 - DNA, 249 bp, Artificial Sequence
  Description of Artificial Sequence: Synthetic coding sequence
atgctgagccggaacgacgacatctgcatctacggcggcctgggccttggaggcctgctgctattggccgtggtcctgctatcagcttgtttgtgctggcttcacaggcgagttaagcgactggagcggtcatggagactccccgtgccctcttcagagggtcccgaccttcgtggacgcgacaagaggggcaccaaagaggatccccgcgctgattatgcatgtattgccgagaacaagcctacctag

SEQ ID NO: 193187 - DNA, 201 bp, Artificial Sequence
  Description of Artificial Sequence: Synthetic coding sequence
atgctgagccggaacgacgtgaagcggctggagcggagctgggcccaaggcagcagtgagcaggaactccattatgcctctctgcagagattgccagttccaagttctgaaggaccggatttgcgcggaagagataagagggggactaaagaggatcccagggcagactacgcttgcatagcagagaacaaacccacctag

SEQ ID NO: 193188 - DNA, 180 bp, Artificial Sequence
  Description of Artificial Sequence: Synthetic coding sequence
atgctgagccggaacgacgacatctgcatctacggcggcctgggccttggtggactgctcctgttagccgttgtgttgcttagcgcttgtttatgttggctgcatcgccgcggacctgggctgttacgagcagggacacccctgtgtataagtgctgaagcagcctctgcccaacaatag

SEQ ID NO: 193189 - DNA, 87 bp, Artificial Sequence
  Description of Artificial Sequence: Synthetic coding sequence
atgctgagccggaacgacggccccggcctgctgcgggccggcacccctctttgcatttctgctgaagcagcctcagctcagcagtag

SEQ ID NO: 193190 - DNA, 249 bp, Artificial Sequence
  Description of Artificial Sequence: Synthetic coding sequence
atgctgagccggaacgacgacatctgcatctacggcggcctgggccttgggggccttttgctgctggctgtggttttactatcggcctgtttatgttggttgcatcgcagggtcaaacgcctcgaaagatcgtggagactgcccgttcctagttcggagggccctgatctacgaggtcgcgacaagagagggactaaggaagaccctcgggcggactacgcatgtattgccgaaaacaagcccacctag

SEQ ID NO: 193191 - DNA, 111 bp, Artificial Sequence
  Description of Artificial Sequence: Synthetic coding sequence
atgctgagccggaacgacgacatctgcatctacggcggcctgggccttggggggttactgcttctggctgtcgtcctcctaagcgcatgtctgtgctggttgcaccgatag

SEQ ID NO: 193192 - DNA, 222 bp, Artificial Sequence
  Description of Artificial Sequence: Synthetic coding sequence
atgctgagccggaacgacgtgaagcggctggagcggagctggcaccttctaagttggagtcaggcccaagggtcatcggaacaagaactccattatgctagcctgcagagactgcctgtgcctagcagcgaaggtccagacttaagaggccgtgacaaacgcgggacgaaagaagatccaagggctgattatgcttgcattgcagaaaataagccaacatag

SEQ ID NO: 193193 - DNA, 201 bp, Artificial Sequence
  Description of Artificial Sequence: Synthetic coding sequence
atgctgagccggaacgacgtgaagcggctggagcggagctgggcccaggggtcttctgagcaggagcttcactacgccagccttcagcgactgcctgtgccgtcctccgaaggccctgacttgagaggaagagataaaaggggtaccaaggaagacccgcgggctgattatgcttgcatagcagaaaacaagcccacatag

SEQ ID NO: 193194 - DNA, 87 bp, Artificial Sequence
  Description of Artificial Sequence: Synthetic coding sequence
atgctgagccggaacgacggccccggcctgctgcgggccggcacccctctttgcattagcgcagaggcagcttccgcccaacagtag

SEQ ID NO: 193195 - DNA, 201 bp, Artificial Sequence
  Description of Artificial Sequence: Synthetic coding sequence
atgctgagccggaacgacgacatctgcatctacggcggcctgggcctgggcggcctgctcctgcttgctgttgtgttattgtcggcctgcctctgttggttgcaccgtcgggccccctcagtattagtgcccggcccagggctgctccgtgctggcactcccttatgtatctctgccgaggccgccagtgcccagcagtag

SEQ ID NO: 193196 - DNA, 222 bp, Artificial Sequence
  Description of Artificial Sequence: Synthetic coding sequence
atgctgagccggaacgacgtgaagcggctggagcggagctggcacctcctgagctggagtcaggcccagggatcctctgaacaggaactgcattacgcaagtctccagcgtctccccgtcccatcaagcgaaggccccgacctgcgggggagagataagagaggaaccaaagaagacccgcgcgctgattatgcttgcattgccgagaataagccgacatag

SEQ ID NO: 193197 - DNA, 201 bp, Artificial Sequence
  Description of Artificial Sequence: Synthetic coding sequence
atgctgagccggaacgacgacatctgcatctacggcggcctgggcctgggtgggctcctcctgctagctgtcgtgctcctgtcagcttgcctgtgctggctccaccgccgcgcccctagtgttctcgttcccggacccggccttctgagagccggcactccactgtgtatatcggctgaagccgcttcggcacaacaatag

SEQ ID NO: 193198 - DNA, 87 bp, Artificial Sequence
  Description of Artificial Sequence: Synthetic coding sequence
atgctgagccggaacgacggccccggcctgctgcgggccggcacccccctctgcatctctgcggaggctgccagcgctcaacagtag

SEQ ID NO: 193199 - DNA, 87 bp, Artificial Sequence
  Description of Artificial Sequence: Synthetic coding sequence
atgctgagccggaacgacggccccggcctgctgcgggccggcacccccctgtgcatctctgctgaggccgccagtgcccagcagtag

SEQ ID NO: 193200 - DNA, 87 bp, Artificial Sequence
  Description of Artificial Sequence: Synthetic coding sequence
atgctgagccggaacgacggccccggcctgctgcgggccggcaccccactgtgtattagcgctgaggctgcgtctgcccagcaatag

SEQ ID NO: 193201 - DNA, 87 bp, Artificial Sequence
  Description of Artificial Sequence: Synthetic coding sequence
atgctgagccggaacgacggccccggcctgctgcgggccggcacccctctttgtatttccgcagaagccgcctcagcccagcagtag

SEQ ID NO: 193202 - DNA, 294 bp, Artificial Sequence
  Description of Artificial Sequence: Synthetic coding sequence
atgctgagccggaacgacgacatctgcatctacggcggcctgggcctcggtggcctgctactgctagcggttgtcctgctgtccgcatgtctgtgctggctgcatcggagagtcaagcgcctggaaagaagttgggctcagggctcaagcgagcaggaactccactatgcaagtctgcagaggttacccgtgccatcctccgaagggcctgatctccggggacgcgataaacgaggtaccaaggaggacccacgggctgattacgcctgcattgcggagaataaaccaacatag

SEQ ID NO: 193203 - DNA, 222 bp, Artificial Sequence
  Description of Artificial Sequence: Synthetic coding sequence
atgctgagccggaacgacgtgaagcggctggagcggagctggcacctcctcagctggagccaagcacaaggcagttcagaacaggagctccactatgcttcccttcagcgcttaccggtgccatcttccgaagggcctgatctaagaggtcgcgataagcggggaaccaaagaagatcctagagcagattatgcatgcatagccgagaataaaccaacgtag

SEQ ID NO: 193204 - DNA, 87 bp, Artificial Sequence
  Description of Artificial Sequence: Synthetic coding sequence
atgctgagccggaacgacggccccggcctgctgcgggccggcacccctttgtgtatatccgccgaggctgcttccgctcagcaatag

SEQ ID NO: 193205 - DNA, 294 bp, Artificial Sequence
  Description of Artificial Sequence: Synthetic coding sequence
atgctgagccggaacgacgacatctgcatctacggcggcctgggcttagggggcttattgttgctggcggtggtgctgctttcagcctgtttatgttggctgcatcgtcgggtgaagaggctcgaaagatcctgggcccagggatccagtgagcaggagttgcattatgcctccctgcagcggctgccggtgcccagctctgaggggccagatctgagggggagagataagcgtggcactaaagaagatcccagagcggactatgcgtgtatagctgaaaataaacctacctag

SEQ ID NO: 193206 - DNA, 201 bp, Artificial Sequence
  Description of Artificial Sequence: Synthetic coding sequence
atgctgagccggaacgacgtgaagcggctggagcggagctgggcccagggctccagtgagcaggaactccattacgcgtccctgcagaggttgcctgtgcctagctccgagggccctgatctgagaggccgtgataaacggggcacaaaggaagatcccagagcagattacgcctgcatagctgagaataagcccacctag

SEQ ID NO: 193207 - DNA, 87 bp, Artificial Sequence
  Description of Artificial Sequence: Synthetic coding sequence
atgctgagccggaacgacggccccggcctgctgcgggccggcacccccctgtgcatctctgccgaagctgcaagtgctcagcagtag

SEQ ID NO: 193208 - DNA, 201 bp, Artificial Sequence
  Description of Artificial Sequence: Synthetic coding sequence
atgctgagccggaacgacgtgaagcggctggagcggagctgggcccaggggagcagcgagcaggagttgcattatgcttctctacagagactgcctgtacctagcagcgagggtcctgacctcagaggaagagataaacgcggcactaaggaagatccaagggctgactacgcatgcatagccgagaacaagccaacttag

SEQ ID NO: 193209 - DNA, 42 bp, Artificial Sequence; identical to SEQ ID NO: 193063
  Description of Artificial Sequence: Synthetic coding sequence

SEQ ID NO: 193210 - DNA, 132 bp, Artificial Sequence
  Description of Artificial Sequence: Synthetic coding sequence
taccggggcatgatgatctacgtgagcaccggcgcctggggctgggccgggagttgtttttggcagtggtccttctgccccccagcatgcgtcggatgtatcgaggagcggctcccagttccatctagctag

SEQ ID NO: 193211 - DNA, 201 bp, Artificial Sequence
  Description of Artificial Sequence: Synthetic coding sequence
atgctgagccggaacgacgtgaagcggctggagcggagctgggcccagggctcctctgagcaggagctgcactatgcctccctccagcgtctcccagtgccatcatctgaaggacctgatttgagagggagggacaaaaggggaaccaaagaagaccccagggcagactacgcgtgtatcgccgagaataagccaacttag

SEQ ID NO: 193212 - DNA, 294 bp, Artificial Sequence
  Description of Artificial Sequence: Synthetic coding sequence
atgctgagccggaacgacgacatctgcatctacggcggcctgggccttggcggcttgctgctgctcgcagtggtgctgctctcggcctgtctgtgttggctgcacagacgtgtgaagaggttggagaggtcttgggctcaaggaagttcagaacaggaactccactatgcttcactgcagcggctgccagtgcctagcagtgagggccccgatttgcgcggacgggataagcgagggaccaaggaagatccccgcgccgattacgcctgtatcgccgagaacaaaccaacctag

SEQ ID NO: 193213 - DNA, 222 bp, Artificial Sequence
  Description of Artificial Sequence: Synthetic coding sequence
atgctgagccggaacgacgtgaagcggctggagcggagctggcacctgttgagctggtcgcaggcgcagggaagttcagagcaggagctgcactacgccagcctgcagcgcctgcctgtcccaagtagtgaaggcccggatctgcgaggcagagacaaacgtggaaccaaagaggacccacgcgcagattatgcctgtattgcagagaacaagcccacatag

SEQ ID NO: 193214 - DNA, 42 bp, Artificial Sequence; identical to SEQ ID NO: 193063
  Description of Artificial Sequence: Synthetic coding sequence

SEQ ID NO: 193215 - DNA, 276 bp, Artificial Sequence
  Description of Artificial Sequence: Synthetic coding sequence
atgatctacgtgagcaccggcgcctggggctgggccggcagctgcttctggcagtggtctttttgccctcccgcatgtgtgggctgcattgaagagcacctgctaagctggtctcaggcccagggatcaagtgagcaggaactgcattacgcctccctccagcgattaccggtcccctcatccgagggaccggacttgcgaggcagagataaaagagggactaaggaggaccccagggcagactacgcatgtattgccgaaaataaacctacatag

SEQ ID NO: 193216 - DNA, 276 bp, Artificial Sequence
  Description of Artificial Sequence: Synthetic coding sequence
atgatctacgtgagcaccggcgcctggggctgggccggcagctgcttttggcaatggtcattctgtcctccagcctgcgtgggatgtatcgaagaacacctgctgagctggagtcaggcacaaggttcgagtgaacaagagctacattatgcctctctccagcgcttgcctgtcccttcctccgaggggcccgacctgcgcggtcgggacaagcgtggaacaaaagaggacccacgggctgattacgcttgtatcgctgaaaacaagccgacctag

SEQ ID NO: 193217 - DNA, 276 bp, Artificial Sequence
  Description of Artificial Sequence: Synthetic coding sequence
atgatctacgtgagcaccggcgcctggggctgggccggcagctgcttttggcagtggtctttctgtcccccggcatgcgtgggctgcattgaggaacaccttttgagctggagtcaggcccaggggagttcggagcaagaactccattacgccagcttgcaacggcttccagtgccctcaagtgagggcccagatctgaggggacgcgataagcgcggcacgaaagaggatcctcgcgctgattacgcttgcatagccgagaataaacctacttag

SEQ ID NO: 193218 - DNA, 108 bp, Artificial Sequence
  Description of Artificial Sequence: Synthetic coding sequence
atgctgagccggaacgacgcccccagcgtgctggtgcccggccccgggctcctaagggcaggcacccccttatgtatcagcgcagaggctgctagtgcacaacaatag

SEQ ID NO: 193219 - DNA, 276 bp, Artificial Sequence
  Description of Artificial Sequence: Synthetic coding sequence
atgatctacgtgagcaccggcgcctggggctgggccggcagctgcttctggcagtggtctttctgtccgcccgcatgcgtgggctgcattgaagaacacctcctgtcttggagtcaagcccaagggtcatctgagcaggaactgcactatgcaagtttgcaaaggcttcctgtgccctcctcagaggggcccgatctgagaggccgagataaaagggggacgaaggaagacccgagggccgattatgcatgtatcgccgagaacaaacccacctag

SEQ ID NO: 193220 - DNA, 108 bp, Artificial Sequence
  Description of Artificial Sequence: Synthetic coding sequence
atgctgagccggaacgacgcccccagcgtgctggtgcccggccccggacttctccgagccggcaccccgttatgcatcagcgcagaggctgcttcagcacaacaatag

SEQ ID NO: 193221 - DNA, 108 bp, Artificial Sequence
  Description of Artificial Sequence: Synthetic coding sequence
atgctgagccggaacgacgcccccagcgtgctggtgcccggccccggcctgctgcgtgcaggcactcctctgtgcattagcgccgaggcggcctccgcccagcagtag

SEQ ID NO: 193222 - DNA, 276 bp, Artificial Sequence
  Description of Artificial Sequence: Synthetic coding sequence
atgatctacgtgagcaccggcgcctggggctgggccggcagctgcttttggcaatggtccttctgccctcccgcttgtgtggggtgcattgaggagcacctcctgtcctggtcacaagcacagggcagctctgagcaggaacttcactatgcgtcactgcagagattgcccgttcctagctcagagggcccggatctccgcgggagagataagcgagggaccaaagaggatcccagagccgactatgcctgcatcgctgaaaacaaacctacctag

SEQ ID NO: 193223 - DNA, 276 bp, Artificial Sequence
  Description of Artificial Sequence: Synthetic coding sequence
atgatctacgtgagcaccggcgcctggggctgggccggcagctgcttctggcaatggagtttctgtccgcctgcctgtgtcgggtgcatcgaggaacacctgctgagttggtcacaggcccaaggaagcagtgaacaggaattacactatgccagtctccagagattaccagtcccaagctctgaagggcccgatttgcgcggccgggacaaacgcggaacgaaggaagaccccagggccgattacgcctgtatagccgaaaataagccgacctag

SEQ ID NO: 193224 - DNA, 108 bp, Artificial Sequence
  Description of Artificial Sequence: Synthetic coding sequence
atgctgagccggaacgacgcccccagcgtgctggtgcccggccccggtctgctgcgggcggggactccattgtgtatttccgccgaggcagcctctgcccagcaatag

SEQ ID NO: 193225 - DNA, 108 bp, Artificial Sequence
  Description of Artificial Sequence: Synthetic coding sequence
atgctgagccggaacgacgcccccagcgtgctggtgcccggccccggactgcttcgggcaggcactcctctgtgtatctccgctgaagccgctagtgcccagcagtag

SEQ ID NO: 193226 - DNA, 108 bp, Artificial Sequence
  Description of Artificial Sequence: Synthetic coding sequence
atgctgagccggaacgacgcccccagcgtgctggtgcccggccccgggctgcttcgcgctgggacccccctatgcatcagcgccgaggctgccagcgcccagcagtag

SEQ ID NO: 193227 - DNA, 108 bp, Artificial Sequence
  Description of Artificial Sequence: Synthetic coding sequence
atgctgagccggaacgacgcccccagcgtgctggtgcccggccccgggttactaagagctgggacccctctgtgcatttccgccgaggccgcaagcgcgcagcagtag

SEQ ID NO: 193228 - DNA, 276 bp, Artificial Sequence
  Description of Artificial Sequence: Synthetic coding sequence
atgatctacgtgagcaccggcgcctggggctgggccggcagctgcttttggcagtggagtttttgtccgcctgcctgcgtcggatgcattgaggagcacttgttaagctggtcccaggcacaggggtcttctgaacaggaactgcattacgcctcattgcaacgactgcccgtcccttcgagtgagggacctgacctgagaggcagggacaagagagggactaaagaggaccctcgggctgactatgcatgtatcgccgagaataagccgacttag

SEQ ID NO: 193229 - DNA, 843 bp, Artificial Sequence
  Description of Artificial Sequence: Synthetic coding sequence
atggagcgggagatggtgctgtgcctggcccagaccatccacacccaggaagatttgccccggccttctattagtgctgagcccgggacagttattcccttaggaagccatgtgactttcgtgtgtcgcggacctgtaggggttcagacctttcgcctggagagggaaagccgcagtacctacaatgacactgaagatgtgtcccaggcaagcccatccgagagcgaagctaggtttaggatcgacagtgtgagtgagggcaatgccgggccttatagatgtatctattataagccgcctaagtggagtgagcaatccgattatctggagctcctggtcaaggagacgtcaggcggtccagatagcccggatactgaaccagggagttctgctggcccaactcagaggccgtctgataactcacacaacgagcacgctccggcttcccaagggctgaaagctgagcacctatacatcctgattggcgtttctgtcgtttttctgttttgcctcctgctcctcgtgctgttttgtcttcatcgccagaatcagataaaacagggaccaccgcggagcaaagatgaagagcaaaaaccacagcagagacctgatctggcagttgatgtgcttgagcggactgccgacaaagcgaccgttaacggattacctgagaaagaccgagagacagacacctctgctctagctgctggatcctctcaagaggttacctatgcccagctggatcattgggccctgacacaaaggacggcccgcgccgtatcaccacaaagcacaaagcccatggccgagtccatcacttatgctgcggtcgctcgccactag

SEQ ID NO: 193230 - DNA, 813 bp, Artificial Sequence
  Description of Artificial Sequence: Synthetic coding sequence
atgagcccccaccccaccgccctgctgggcctggtgctgtgcctggctcagaccatccacactcaggaagaggatctgccacgccctagcatttcagcggagccaggtactgtcattccactgggttctcacgtgacatttgtctgtaggggacccgtgggcgtccagacattcaggctggagcgagagtctcggagtacatacaatgatacagaggacgtttctcaggcatctccctccgaatctgaagctaggttccggatcgactcggtgagcgaggggaatgccggaccctataggtgcatatactacaaaccacctaagtggtctgagcagtctgattacttagaactgttggtgaaggggcctacgcagcggccaagtgacaactctcacaacgagcacgcccctgcaagccaaggactaaaggccgaacatctttatatactgattggggtgtcggttgtttttttgttctgccttctcttgctcgtgcttttctgcctacatagacagaaccagatcaagcaggggcctccccggagcaaggacgaagaacaaaagccccaacagcgccctgatttggccgtagacgtgctcgagagaacagccgataaggcgaccgtcaacggcttaccagaaaaggaccgagagaccgacacctccgcccttgctgctggcagtagtcaagaagtgacctacgcccagctcgatcactgggccctcacgcagcgcactgcccgcgctgtgtccccgcaatctactaaacccatggccgagagcatcacatatgccgcagttgccaggcattag

SEQ ID NO: 193231 - DNA, 864 bp, Artificial Sequence
  Description of Artificial Sequence: Synthetic coding sequence
atgagcccccaccccaccgccctgctgggcctggtgctgtgcctggcacagaccatacacacccaagaagaagacctgcctcggcctagtatatctgccgaacctggaaccgtcatcccattgggatcccacgtgacctttgtctgcaggggtccagtgggggtacagacctttcgcctggaacgggaatcccgttccacctataatgacactgaggacgtatcacaggcttcaccctccgaaagtgaagctagattccggatcgactctgtgtcagaaggcaatgccggaccgtatcgctgcatctactacaagccgccaaagtggtcggaacagagcgactacttagagctcctggttaaggagacctccggtgggcccgactcccctgacaccgaaccgggatcatccgcaggccctacccagcgacctagcgacaacagtcacaatgagcacgctcccgccagccaaggtctcaaggccgagcatctgtacattctgattggggtctctgtggtcttcctattctgcttgctgctgctggtgctcttctgcctccaccggcagaatcagattaaacagggtccccctagaagcaaagatgaggaacaaaaaccacagcaacggcccgacctggcagttgacgtcttagaaagaacggccgacaaagccaccgtcaatggcctgcctgaaaaagatcgggagacagacactagtgctctggccgctggaagttcacaagaagttacctacgcccagttagaccactgggctctcacccaaagaacagcccgcgcagtctctccacagtcaactaagcctatggctgagagcatcacatacgcggccgtcgcaagacactag

SEQ ID NO: 193232 - DNA, 1545 bp, Artificial Sequence
  Description of Artificial Sequence: Synthetic coding sequence
atgctgacccgggtgaagagcgccgtggccaacttcatgggcggcatcatggccggctcctccgggagtgagcacggtggtggtagctgtggcggttcagatctgccgcttcggtttccatatggtagaccagagtttttgggtctttctcaagacgaggtggaatgtagcgccgatcacatcgcccgcccaatactgatccttaaagaaacccgtcgattgccttgggctaccggatatgctgaggtgattaatgcaggcaagtcaactcataatgaggatcaggcatcttgcgaagtcctgacagttaaaaagaaggccggtgcagtgacctccacaccaaaccggaactcaagcaaacgacgaagcagcctgcctaatggagaaggattgcaactgaaagagaattccgagtccgagggggtgagctgccactactggtcgttgttcgacggacatgccggctccggcgccgccgtcgtggcgagtagattacttcagcatcacatcactgaacaactacaggacattgtagatatcctgaaaaattccgcagtgctgccccctacctgcctgggtgaagaacccgaaaatactcccgccaactcaaggacccttacacgcgccgccagccttagggggggcgtcggggccccaggctccccatctactccccccacgcggttcttcaccgaaaaaaaaattccacacgagtgtctggtgatcggcgcccttgagtccgcatttaaggagatggacctccagattgagcgagaaagatctagttacaatatctctgggggctgcaccgctctcatagttatttgcctactggggaagctttacgtagccaatgcaggagatagcagagctatcatcatacgtaatggagaaatcatccccatgtcatctgagttcacacctgaaacagaaagacagcgcctgcagtatctggccttcatgcagccccatctcctggggaatgaatttacccacctggaattcccgcgccgggttcagaggaaagaactgggaaagaagatgctgtatagggatttcaacatgacagggtgggcctacaagacgatcgaagacgaagacctgaaattccccctcatttacggggaaggtaagaaagcccgtgtgatggcaacgatcggggtgacaagaggtctgggcgaccatgacctgaaagtgcatgacagcaacatctacattaaaccttttctgagttccgccccggaagtacggatctatgatctttcaaagtacgaccatggctccgatgatgtcctaattctcgcgacggatggcctctgggatgtcctgagcaacgaggaggtagccgaagccatcactcagttcctcccaaactgcgatcccgacgacccgcaccgatacacgcttgcagcgcaggatttggtgatgcgcgcacgaggtgtgttgaaagaccgaggctggcggattagtaacgataggcttggttccggagacgatatctcagtgtacgttattcccctgattcacggcaataaactgagctag

SEQ ID NO: 193233 - DNA, 1527 bp, Artificial Sequence
  Description of Artificial Sequence: Synthetic coding sequence
atgctgccccagcggaacctgagcaagcggcaggtgcccaccatgcatattcctgtcaaaacgagacgactgttggctgctctgaaagtgttagacaccaaagacttaactattgagaaagtcgtcatcaacggacaggaggtcaaatatgcccttggggagcgtcagtcctataaaggctcacctatggagatttcgctccctatcgcgttgtccaagaatcaggagatagtgatcgagatctctttcgagaccagccccaaatcatcggctctgcaatggctgacacccgagcagacatctggaaaggagcacccatacctcttctcacagtgccaggctatccactgccgcgctatcctcccttgccaggatactcccagcgttaagttgacgtataccgccgaggtaagcgttccaaaggagctggtggccctgatgagcgcaatccgagatggagagactcctgaccctgaggatccatctcgcaagatttacaaattcatccagaaagtgcccatcccgtgttacttaatcgcgttagtggttggcgctttagagtctcggcaaataggaccccggactcttgtttggtctgaaaaagaacaagtcgaaaagtctgcctacgagttcagtgagaccgaatcgatgctgaaaatcgctgaggatttgggcggcccttatgtgtggggccaatacgatctgcttgttttgcccccaagcttcccatatggggggatggagaatccatgtttgaccttcgttacgcccacactgctggctggtgacaagagcctctccaatgtaattgcccatgaaatcagtcactcatggaccggcaatctggtcacaaacaagacttgggatcatttttggttgaacgaaggtcacaccgtatacttagagcggcacatctgtggacggctgtttggggagaagttccgccacttcaacgcattaggcggatggggagagttacagaactccgttaaaacattcggagagacccacccgtttacaaagctcgtcgttgacctgactgacattgacccagacgtggcctactctagtgtcccttatgagaagggctttgccttgctgttctacctcgagcaactgctcggcggacctgaaatctttcttggatttcttaaggcctacgtggagaagtttagctacaagtcaataaccacggacgattggaaagattttctttatagttactttaaagacaaggtagacgtgctgaaccaggtagactggaacgcttggctctatagccctggattgccacccattaaacccaattacgatatgacgctgactaacgcttgtatcgcattgtctcagcgctggattactgcgaaggaggacgatctcaactccttcaatgctaccgacttaaaggacctttcgtcacaccagctgaacgaattcctggcccagactcttcagaggatggcggctgcacttcactcgatacaggtcggtggacgaaactcctttggggccaaggacggaaactag

SEQ ID NO: 193234 - DNA, 1764 bp, Artificial Sequence
  Description of Artificial Sequence: Synthetic coding sequence
atgctgccccagcggaacctgagcaagcggcaggtgcccaccatgcacatcccagttaagacccgccgtctcttggcggcgctcaaggtcttggacacaaaagatctcactatagagaaggtggtgatcaatggccaggaagtcaaatatgccctgggagagcgtcagtcttacaagggatcacccatggagatcagcctccctatcgccctctcaaaaaaccaggaaattgtgattgaaatatcttttgagacatcaccaaaatccagcgccctgcagtggttaactccggagcagactagtggcaaagaacatccctacttattcagccagtgccaggccattcactgccgggccattctcccatgtcaagatacgcctagcgtgaagctgacctatacagccgaagtgagcgttcccaaggaactcgtagccctaatgagtgctattagagatggcgagacacccgatcccgaagaccccagtaggaagatctataaatttatccagaaggtccctatcccatgctatctgatcgccctagtcgtgggcgcactggaatctcggcagatcggccccaggacactagtgtggagcgaaaaagagcaggttgaaaagtcggcctacgagttcagcgagactgagtccatgttgaagatcgcggaagatctgggaggcccttatgtgtggggtcagtacgacctcttggttcttccacccagttttccctacggcggcatggaaaacccatgtctgactttcgtcacccctacattgctggcgggggataagtccctgtcaaatgttatagcccatgagatctctcactcctggacagggaacctcgtgactaacaagacttgggatcacttttggctgaacgaaggccacaccgtgtacctcgagcggcatatctgcggccggctgttcggagagaagttcagacactttaatgccttaggagggtggggcgaactccagaactctgttaagaccttcggtgagacccacccgttcactaaattggtggtcgatctgactgatattgatccggacgtggcttactccagcgtgccatacgagaaaggttttgccctcctgttttacctggagcagctgctggggggcccagaaatctttttgggatttcttaaagcttatgtggaaaagttcagctacaaatccattacgacagatgactggaaggacttcctttacagctattttaaagataaggtcgacgtcctgaatcaggtggactggaacgcatggctgtactccccaggactccctccaatcaaacccaattacgatatgactcttactaacgcctgcatcgccctctcccagagatggatcacggccaaggaagacgatctgaatagtttcaacgccactgacctgaaagacctgagtagccaccagctcaacgagtttctggcacaaacacttcaacgcgcccctcttccactggggcacattaaacgaatgcaggaggtctacaatttcaacgctattaataacagcgagattcggtttcggtggctgaggttatgtattcagagcaaatgggaagatgccattcccctcgcgctcaaaatggcaactgaacaagggcgcatgaaattcaccagaccccttttcaaggacctagctgcattcgacaagtcacacgaccaggccgttagaacctaccaggaacataaggcctccatgcaccccgtcactgcgatgctggtgggcaaagatttaaaggtggattag

SEQ ID NO: 193235 - DNA, 1059 bp, Artificial Sequence
  Description of Artificial Sequence: Synthetic coding sequence
atgaacaccaccagcagcgccgccccccccagcctgggcgtggagttcatcagcttgctagctattatcttgctatctgtagcccttgccgtcgggctcccaggcaatagtttcgtcgtgtggtcgatcctcaagagaatgcagaaacgctctgtgacggccctgatggttctcaatttagctctggccgatctggcggttctgctgactgcgcccttctttctgcacttcctcgcacaggggacttggagcttcggccttgccggttgtcgcctctgccactacgtttgcggagtctccatgtatgcatcagttctgttgatcacagcaatgtccctggatcgctcactagcagtcgccaggcccttcgtctcccagaaacttcggaccaaggctatggctagaagagtcctggccggaatatgggtactttcctttctccttgcaacacctgttctggcgtaccggacagtggttccctggaagacaaacatgtcattgtgttttcccagatacccctctgagggtcatagagcctttcacttgatttttgaggctgttaccggttttctgttacccttcctagccgttgtggccagctactctgacatcggtaggcgcctccaggctaggcggttccggcggagccgacggactgggcgcctcgtcgtgcttatcatcctcacattcgcggctttctggctgccgtatcacgtggtgaacctggctgaagctggccgggcattggcgggccaggcagccggtctgggccttgtgggtaaacggctgagcctggcccggaacgtgctgatcgctttggcttttctgtcctctagcgtcaatcccgtgctgtatgcctgcgctggggggggactgttgcgtagtgccggcgtcggctttgtcgctaagctgttagagggcacgggcagtgaggcttcgtcgacgcgccggggtggctctctggggcagaccgctcgttcaggacccgcggcactcgagcctgggccctcggaatcccttactgcctctagtcccctgaagctcaacgagctgaattag

SEQ ID NO: 193236 - DNA, 1059 bp, Artificial Sequence
  Description of Artificial Sequence: Synthetic coding sequence
atgaacaccaccagcagcgccgccccccccagcctgggcgtggagtttatatctctcctggctataatcttactgtccgttgccctggccgttggccttccaggcaattcctttgttgtgtggtccatccttaagaggatgcagaagcggtctgttactgccttaatggtactgaacctcgccctagctgacctggccgtgctgctgactgccccattcttcctgcacttcctggcacagggtacatggtcttttggtttggcaggatgcaggctgtgtcactacgtatgcggggtctctatgtacgcctctgtattgttgattacagctatgagcctcgacagaagtctcgctgttgctcgccctttcgttagtcagaagctccggaccaaagccatggctagaagggtgctggctggaatctgggtgctgtccttcttattggcgacccctgtgttggcctatagaactgtggtgccatggaagaccaacatgagtctgtgctttccacggtacccatccgagggccacagggcgttccacttaatttttgaggccgtcactggatttctcttgccgttccttgcagttgtggccagttatagtgacatcgggcgaagactgcaggcgaggaggtttcggcggagcaggcgaacgggaaggttggtcgttttaattatcctcacatttgcagccttctggctgccctatcacgtggtcaatttggccgaggctggacgggcgcttgccggacaggcagccggactcggactggtgggcaagcggctctcccttgctaggaatgtgttgattgccctggctttcctgtccagtagcgtgaatccagttctctacgcttgtgccggaggcggactgttgagatcagctggagtcgggttcgttgcaaaattgctggagggcaccgggtccgaagcctcaagtacgaggcggggaggttcattgggacagactgcccggtccgggccagcagcattagaacctgggccttccgagtcattgaccgcaagtagcccgctaaagctgaatgaactgaactag

SEQ ID NO: 193237 - DNA, 1059 bp, Artificial Sequence
  Description of Artificial Sequence: Synthetic coding sequence
atgaacaccaccagcagcgccgccccccccagcctgggcgtggagtttatctcactgctcgcaatcatcctcctgtccgtagccctagctgttggactgcctgggaacagcttcgtcgtgtggtctattctgaagcgcatgcagaagcgaagtgtaactgcactcatggtccttaacctggcgttggccgacctggccgttttactgaccgcaccctttttcttacacttcctggcacaagggacctggtcttttggcttggccggatgcagactctgtcactatgtctgcggagtgtctatgtacgcatctgtgctgctcattacagccatgagcctggaccgtagcctcgccgtggccagaccctttgtgtctcagaaactgcggaccaaagcgatggcccggcgcgtgctggctggcatatgggttctgtcctttctgctcgcaacaccggtgctcgcctaccggacagtggtaccatggaagacgaatatgagcctttgcttcccacgctacccttcagagggccatagggcattccacctcatcttcgaagctgtaactggattcttgctcccattcctcgcagtggtggcctcttacagcgatatcgggcgccgtcttcaggcccgcagatttcgacgaagccgacgaactggccgactggtagtgttaattatcctgactttcgccgccttttggcttccttatcatgtggtaaacctcgctgaagctgggagggccctggctgggcaggcagccggactggggttagtgggcaagaggctatcactggccagaaatgtgttaattgcgttagcattcctctcaagttcagtcaatccagtgctgtacgcgtgtgccggcgggggccttctgcgcagcgcaggagtcggattcgtcgcaaagctgctcgagggaactggtagtgaggcatcaagcacccgtagaggtgggtcgctgggtcagacagctcgctcagggcctgccgcactggagcccgggccatctgaaagcttgaccgcttcttcccctctcaagctcaatgaactgaattag

SEQ ID NO: 193238 - DNA, 309 bp, Artificial Sequence
  Description of Artificial Sequence: Synthetic coding sequence
atgaacaccaccagcagcgccgccccccccagcctgggcgtggagttcatcagtcttctggccataatcctgttatctgtggcactcgccgtgggcctcccaggtaactcctttgtagtctggtccattctcaaacgcatgcagaaaaggtctgtaacagcgctgatggtccttaatttggcattagccgatctcgctgtcctactgacagcacctttttttctgcatttcctcgcgcaggggacttggtcatttgggctggccgggtgcaggctctgccactacgtctgtggtgtctctatgtactag

SEQ ID NO: 193239 - DNA, 483 bp, Artificial Sequence
  Description of Artificial Sequence: Synthetic coding sequence
atgagcgtgtgctaccggccccccggcaacgagaccctgctgagctggaagacaagcagagccactggcaccgcctttttgttactggcagcccttctgggactccccggaaatggatttgtggtctggtctctggccgggtggcggcccgcccgaggtagacccttagcagccaccctggtgctccaccttgctctggcagacggtgccgtactgttgcttacccccttattcgtggctttcctgacaaggcaagcatggcctctgggacaggctggctgtaaggcagtgtactatgtgtgtgcactgtccatgtatgcgagcgtgctccttacagggttgctgagtctgcagcgctgtctggctgtgacgagacccttcctagcccctaggttacgatctcccgccctggcccgccggttactccttgctgtgtggttggcagccctgctcttagcggtgcctgccgccgtctacagatag

SEQ ID NO: 193240 - DNA, 1170 bp, Artificial Sequence
  Description of Artificial Sequence: Synthetic coding sequence
atggcccccagccaccgggccagccaggtgggcttctgccccacccccgaacgcccactgtggagactacctcctacgtgtaggccccggagaatgtctgtgtgctacaggccccccggtaacgaaacactgctgtcgtggaaaacgtcacgcgctaccgggactgcttttctgcttctggcggcgctattggggctacccggcaatggctttgtggtctggtcactggcaggttggagacccgcaagaggcaggcccctggccgctaccctcgtcctgcacctggctttggcagacggtgccgtcttgctgcttacccccttattcgtggcatttctcactcgacaagcctggcctctcgggcaggcgggatgcaaggccgtgtactacgtctgcgcactgtccatgtatgccagcgtgttgttgactggacttctgagtttacagcgctgcctggccgtgacgagacccttcctggctcctcgcctgcgcagccccgcgttggccagacgcctgctcctggcagtgtggctggcggctctgctgctggcagttcctgccgctgtgtaccgccacctctggcgagaccgtgtctgtcagttgtgccatccatcacccgttcatgcagccgcgcatctgtcccttgagactctgacagctttcgtgctcccttttggactgatgctcggatgttactctgtaaccctcgccaggctccgaggagcaaggtgggggagcggacgccatggcgcccgggttggcagattagtgtctgctatcgtcctggccttcggcctactgtgggctccgtaccacgctgtgaatctactccaggccgttgcagctctcgcaccacccgagggagcactggctaagctcggtggcgccgggcaagctgctcgcgccggcacaacggccttggcattcttctcctcctcagtcaacccggtgctgtacgtgtttactgcgggagatctacttccaagagcagggccccgctttctgacccggctgttcgagggatccggggaagctaggggtggcggcagatcacgcgaaggcacaatggagctgcgtaccaccccacagctaaaagtggttggtcaagggagaggcaatggagaccctgggggcggaatggagaaggacggtcccgagtgggacctgtag

SEQ ID NO: 193241 - DNA, 960 bp, Artificial Sequence
  Description of Artificial Sequence: Synthetic coding sequence
atgagcgtgtgctaccggccccccggcaacgagaccctgctgagctggaaaacatctagagctaccggcaccgctttcttactgctggccgctcttctggggctgccgggcaatggcttcgtggtctggagtcttgctggatggcgacccgctagggggagacctctggcggctactctcgttctgcatctggccttagctgatggtgctgtgcttctgttgaccccgctgtttgtagcattcttaacgaggcaggcctggccactgggccaagcggggtgtaaagcagtgtattatgtctgcgccctatccatgtatgcgtccgtgctgctgacaggccttctctctttgcagcgttgcttggcggtgactaggcctttcctcgcaccacggctgagaagccctgcacttgctcgacgcctgctccttgccgtgtggctggccgccctgttactggccgtgcctgctgcagtgtacaggcacctctggcgcgaccgcgtttgtcaactgtgccaccccagccctgtgcacgccgccgcacacctgtctctagagacactgaccgccttcgtcctgccattcggactgatgctcgggtgttattccgtcaccctggcacgactccgcggcgcaaggtggggttctggcagacatggtgcgcgagtgggccgcttagtatctgctattgtgctggctttcgggctgctgtgggctccatatcacgctgtgaatcttttacaggcagtggccgctctggcccctccagaaggggccctcgccaagcttggcggcgccggccaggcagctagggcaggtactacagctctggcattcttttcctccagtgtaaaccccgtgttgtacgttttcaccgcaggagacttacttcccagagccgggcctaggttcctcacccggctcttcgaggggagcggggaggcaagagggggaggccggtag

SEQ ID NO: 193242 - DNA, 1077 bp, Artificial Sequence
  Description of Artificial Sequence: Synthetic coding sequence
atgagcgtgtgctaccggccccccggcaacgagaccctgctgagctggaagacgtcgagggcaacaggtaccgcgtttctgttgctcgcggctctgctcggcctgccgggtaacggatttgtggtatggtctctcgcgggatggcgccccgctcggggccgacctctggcggcgacattggtgttacacctggcattggcggatggggccgtgctacttctgacccctcttttcgtggcattcctcaccagacaggcttggcctctgggacaggccggctgcaaagctgtgtactatgtgtgtgccctgtcaatgtacgctagcgtgctgcttacaggtcttctgagcctccagagatgtctggccgtcacgcgaccatttcttgccccacgcctcaggagtccagcactggcaaggcgcttgctgttggcagtttggctagcggcactcctcctggccgtacctgcagctgtgtacaggcatctctggcgcgaccgcgtgtgtcaactctgccaccctagccctgtgcatgctgcagcccatctgagcctcgagacacttacagcctttgttttgccgttcgggttgatgttgggatgctactccgtaaccttggcccggttgaggggcgcccgatgggggtccgggaggcatggcgctcgcgtcggccgtctggtgtccgcgattgtgttggcctttggcctcctgtgggccccctaccacgcagtcaatttactgcaggcagttgcagctctcgcccccccagaaggcgcccttgccaagctgggcggagctggacaggcggctcgggccggaaccactgccctagcatttttttcttcctccgtaaaccccgtgctatacgtttttaccgccggggatctcttacctagggctggaccacgctttctgactaggctgtttgagggttctggagaagcccgaggcggaggcagatcacgggagggaacaatggagttgagaactaccccacagctgaaagtagttgggcaagggagaggaaatggagatcccggagggggcatggaaaaggatggtcccgagtgggatctgtag

SEQ ID NO: 193243 - DNA, 1077 bp, Artificial Sequence
  Description of Artificial Sequence: Synthetic coding sequence
atgagcgtgtgctaccggccccccggcaacgagaccctgctgagctggaagacttctcgtgccacagggacagcgtttctattattggccgccctgctgggccttcccggcaacggcttcgttgtgtggtccttagctggatggagacctgctcgggggaggccactggccgccacattagtgctccacctggccttagcggacggcgccgtccttctgctgacaccgttgttcgtggcttttctgactaggcaggcttggcctctcggccaggccggatgcaaagccgtgtattatgtatgtgcactgtctatgtatgcctcagttcttctgaccggactgctttctttgcagaggtgtctggctgtgactaggccttttctcgccccccgcctccgtagcccagcgttggctcgccgcctccttctggccgtatggctggccgccctactgctcgcagtgcccgcggcggtctatcggcacctctggcgcgaccgggtatgccagctctgccaccccagccccgttcatgcagccgcacatctatcactggagactcttaccgccttcgtccttcctttcggcctcatgcttgggtgttattccgtcacgctggcgaggctcaggggagcgcggtggggttcaggcagacacggggcccgagtcggcagactggttagtgccattgtgctcgcattcgggcttctatgggctccttatcacgccgtgaatctcctccaggccgtggcagccttggcccctcccgagggggctttggcgaaactcgggggggccgggcaggcagctcgggcaggtacaaccgctcttgctttctttagcagttccgtgaatccggtgctgtacgtgttcaccgccggcgatctcctacccagggctggccccaggttcctaacacgcttattcgagggttcaggtgaggctcggggtggaggtcgcagcagagaaggaaccatggaactacgcacgactcctcagttgaaggtggtgggtcagggacgcggcaatggggatccaggaggcgggatggaaaaagatggcccagaatgggacctctag

SEQ ID NO: 193244 - DNA, 453 bp, Artificial Sequence
  Description of Artificial Sequence: Synthetic coding sequence
atgaaggacgaggtggccctgctggccgccgtgaccctgctgggcgtgctgctgcaggcttacttttcacttcaagtgatttccgctagaagggcttttagagtgtctcccccgttgactaccggccccccggaattcgaacgagtgtatagagctcaagtgaattgttccgagtacttcccgttgttcctggctactctgtgggtggccggcatcttttttcatgaaggagctgccgcgttgtgtggtctagtgtaccttttcgcacgcctacgctattttcaggggtatgccagatcagctcagctgcgtctggccccgctgtatgccagtgccagggccttgtggttgctggtagccctggccgcccttgggctgttggcacatttcctgcccgccgcacttagagctgcactgttgggccgactacgcacgctgctcccatgggcttag

SEQ ID NO: 193245 - DNA, 1161 bp, Artificial Sequence
  Description of Artificial Sequence: Synthetic coding sequence
atggaggagctggacgccctgctggaggagctggagcggagcaccttgcaagattcagacgagtactccaatcccgcccccctccctctggaccagcattcccgaaaggagacgaacctggacgaaacctccgagatattgagcatccaagataatacatcccctctgcctgctcagctggtctatactacaaatatccaggagcttaatgtctactccgaagcacaagaaccaaaggagagccctccaccgagtaagacttctgcagctgcccagcttgacgaactgatggctcacctaacagagatgcaggctaaagtggctgtgcgtgcagacgcgggaaagaagcaccttccagataaacaggatcacaaggcttctttggattctatgctgggaggcctggagcaagagcttcaagacctagggatagccactgtgcctaagggccactgtgctagctgtcaaaaacccatcgctggcaaggtcatacacgccctcggccagtcctggcatcccgagcattttgtgtgcacccactgtaaagaggaaattgggagctccccctttttcgaacggtctggactcgcttattgtcccaacgattatcaccagttgttttctcctcgatgtgcatactgcgcggccccgatcctcgacaaagtgctgactgccatgaatcagacatggcaccctgagcacttcttctgttctcattgcggcgaggtgttcggggccgagggcttccacgagaaggacaagaagccgtattgcaggaaagatttcctggcaatgttctcacctaagtgcggcggctgtaaccgaccagtcctggagaattatctgtcggcaatggacacagtgtggcatccagaatgttttgtctgcggtgactgtttcacaagttttagcactggaagcttctttgagctggacggacgtccgttttgtgagctgcattaccaccacaggagagggacattgtgtcacgggtgtggccagccaattacaggtaggtgtatttccgctatgggctacaagtttcacccagagcacttcgtgtgtgctttctgcttaacacagttaagtaagggcattttccgtgaacaaaacgacaaaacatactgccagccctgctttaacaaattgtttcccctgtag

SEQ ID NO: 193246 - DNA, 1176 bp, Artificial Sequence
  Description of Artificial Sequence: Synthetic coding sequence
atgagcaccctgctgatcagcagcagcgacgccctgctggaggagctcgaaagaagcactctgcaggactctgatgagtatagcaatcctgctcccctgcccctagaccagcatagccgcaaagaaaccaacctcgacgagactagtgaaatactgtccattcaagataacacctctcccctccctgcacagctggtctacactacaaatattcaagaactcaacgtttatagtgaagctcaggagcccaaggaatctcctcctccatctaaaacaagtgcggccgcccagctggacgagttaatggcacacctcactgagatgcaggctaaggtggccgtccgggcggatgccggcaaaaagcacctacccgataagcaggaccataaggcttcacttgactccatgcttggcggactggaacaggagctgcaggatttgggaattgcaacggtgcctaaaggacactgtgcttcttgccagaaacctattgctggcaaagtcattcatgcacttggccagtcctggcatcccgaacacttcgtatgtacccattgcaaggaagagataggctcttccccttttttcgagagatcgggactggcttactgccctaatgactatcatcagctattctccccacgctgcgcatattgcgctgcaccaatactggataaggtcctgactgcaatgaatcaaacttggcaccccgagcacttcttttgttcgcactgtggagaggtctttggcgccgaggggttccacgagaaggataagaagccctactgccggaaagatttcctcgccatgtttagtcccaagtgtggtggttgcaatcgacctgttctcgagaactatttgtccgccatggataccgtgtggcatcctgagtgcttcgtctgcggggactgctttacttcattttccacgggtagtttttttgaactggatggacgtccattttgtgagctgcattaccatcacagaagaggaaccttgtgccatggttgtggacagccaatcactggtcggtgtatttcagcgatgggctataaatttcaccccgagcattttgtgtgtgctttctgtctcacgcagcttagcaaggggatatttcgcgaacagaacgacaagacatattgccagccgtgctttaacaagctgttcccactgtag

SEQ ID NO: 193247 - DNA, 1131 bp, Artificial Sequence
  Description of Artificial Sequence: Synthetic coding sequence
atgaactacgagttcgagcgggagatcggcttcatcaacagccagcccagtctggccgagtgtctgacatccttcccacccgtagctgacacattccaatctagctctatcaaaacctctacgctcagtcattcgacgctgatccctccaccattcgaacagaccatcccttcactaaaccccggaagccatcccaggcacggtgctgggggcagacccaaaccctcgcctgccggcagccggggaagcccggttcctgcaggcgccttacagccgccggagtacccttggatgaaagaaaaaaaagccgcgaagaaaacagctctactcccagccgccgctgctgcagccaccgccgccgccacagggcccgcctgcctaagtcacaaggaaagccttgaaatcgcagacggctcaggcggcgggtcccgcagactccgcaccgcgtatactaatactcagttgttggagttagaaaaggagttccattttaacaagtacttatgtcggccacggcgggtggagattgccgctctcctggatctgaccgagcgacaagtgaaggtctggtttcagaacaggcgtatgaagcataagaggcaaactcaatgcaaggaaaaccagaattctgaggggaaatgtaaaagcctggaagactcagaaaaggtggaagaagatgaagaggagaagactttattcgaacaggccctgagtgtcagtggtgccctgctggagagggaaggatacacattccagcagaacgccctgagtcaacagcaagctccaaacgggcacaacggggactcccaaagttttcccgtgagtcccctgacctccaatgaaaaaaatttaaagcatttccaacatcagtcaccaacggtcccgaactgcctttctactatgggccaaaactgtggtgccggcctgaacaatgatagtcctgaggccctcgaggtgcctagcctccaggatttctctgtgttctcaacagactcttgtctgcaactgagtgacgccgtcagtcccagcctacccgggtcactggattctccggtggacataagcgccgattcactggacttctttacggatacgctgacgactatcgacctccaacacctgaattattag

SEQ ID NO: 193248 - DNA, 753 bp, Artificial Sequence
  Description of Artificial Sequence: Synthetic coding sequence
atgacccccggccggtgctgcctggccgccgacatccaggtggagacctttatcttcactgacggtgaagacgaagctttagcgcgtcacacagggaacgtagtcatcacaaattgcagcgcggcgcacagccggcaagcgctcagctgtaagatggccgtcgagtacgacagatttattgaatcagggaggaagtggttttgtcacgtagatgatgacaattatgtgaacttaagggctttactgcgcctcctcgcctcgtaccctcacacaagggatgtgtatgtaggtaagccttctcttgacagaccgatccaggccatggaacgggtgagcgagaataaggtgcgccccgtacatttctggtttgccaccggtggtgctggattctgtatcagtcgcggcctggcgttgaaaatgtccccttgggcaagtgggggacacttcatgaacacagcggagcgcatcagactgccagatgactgcacaattggctatattgtagaggcgcttctcggcgttcccctaatcaggagcggtctgttccacagtcatttagaaaacctgcagcaggtacctaccagcgagttgcacgaacaagttacactgtcctacgggatgttcgaaaataagcgaaacgcagtgcatgttaagggcccattttctgtggaagcagatccttctcggttccgctctattcactgccacctgtacccggataccccctggtgtccacgaactgctattttctag

SEQ ID NO: 193249 - DNA, 1086 bp, Artificial Sequence
  Description of Artificial Sequence: Synthetic coding sequence
atgctgaagcggtgcggccggcggctgctgctggccctggccggcgcacttcttgcctgtcttttggtgctgactgccgacccgccaccaccccccctgcctgccgagagaggtaggagagcactccggagtctggcaggacccgctggggccgctcctgcccccggtttgggcgcggcggcagcagctcccggagcgctggttagagacgtccactctctaagtgagtattttagtctgctcaccagagctaggagagatgcgggccccccgcctggtgcagcccccaggcccgcagatggccaccctaggcctctagctgaaccccttgctccgagagacgttttcatcgccgtgaagacaaccaagaagtttcatagggccagattggatttgctccttgaaacttggatttcacgccataaggagatgaccttcatctttactgatggggaagacgaagccctggctcgacacacagggaacgttgttatcaccaactgcagcgcagcacacagtcgacaggcactgagttgtaaaatggcggttgagtatgaccgatttattgagagtggacggaagtggttttgtcacgttgacgacgataattatgtcaatctccgcgccttgctgcgtctcctggcttcttatccccatactagggatgtgtatgtaggcaagccctccttagaccgccccatacaagcgatggaacgcgtttctgaaaataaggtgcgaccagttcacttttggttcgctaccgggggagcgggtttttgcatcagtcgcggtcttgcgttaaagatgtcaccttgggcaagcgggggacatttcatgaacaccgccgaacgcattcgcctgcccgatgattgcacaatcggatatatcgtggaagcgcttctaggagtgcctctcattcgctccggcctgttccatagccatttagaaaatctgcagcaggttccgacttcggaactccatgagcaggttacgttatcctatggtatgtttgagaataagcgcaacgccgtccacgtcaaggggcctttttctgtggaagccgacccttcccggtggggaaactag

SEQ ID NO: 193250 - DNA, 753 bp, Artificial Sequence
  Description of Artificial Sequence: Synthetic coding sequence
atgacccccggccggtgctgcctggccgccgacatccaggtggagacatttatattcaccgacggggaagatgaagccctcgcccgacacaccggcaacgttgttattacaaattgtagtgcagctcatagccgacaagccctgtcatgtaagatggctgtagaatacgaccgtttcattgaaagtggaaggaagtggttctgtcacgtggacgatgataactacgttaacttacgtgcactcctgagactcttggccagctaccctcataccagggacgtgtatgttggcaagccttcccttgatcgaccgatacaagcaatggagcgggttagcgagaataaggtcaggcctgtccatttctggtttgcgacaggcggtgccgggttttgcatctcccgcggcttggcactcaaaatgtcgccctgggcttccgggggccacttcatgaacactgctgagcgcattcgtttgcctgatgattgtacgataggatacatcgtcgaggctctgttaggcgttccactgatccgcagtggcctattccattcacatctcgaaaacttgcagcaagttccaactagcgagctccacgagcaggtaacacttagctacggtatgttcgagaacaagcgaaacgcagtccacgttaaggggcccttctcagttgaggctgacccaagccgatttaggtccattcattgtcacctttacccagatactccttggtgcccgaggacggctattttttag

SEQ ID NO: 193251 - DNA, 927 bp, Artificial Sequence
  Description of Artificial Sequence: Synthetic coding sequence
atggacgagcagaccggccggctgcggctggacacctactgcatgagcgccaagcagatatgggcgtggagcaaatgtagcggccggctctgggatgagcatatgaagtggatggaaggatggaccgatcgatggacagacggttggatggatggctggatggatgaatggtccccaactcccgctttacggtcgtacggagggggcctgagccagcagactttcattttcactgacggagaagacgaagctttggcccggcacacggggaatgtggtcattacaaactgcagcgcagcccacagccgccaagctttatcgtgtaagatggcggtggagtatgatcgttttatcgagtcaggccgcaagtggttctgccacgtcgatgacgacaattacgtgaacttgcgcgctctgctgcgcctcctagcaagttatcctcacaccagggatgtctacgttggaaagccaagcttagaccggcccattcaggctatggaaagggtcagcgagaacaaagtgagacccgtgcatttttggttcgccactggaggggcaggcttctgcatatcccggggccttgcattgaagatgtccccttgggctagtggaggtcatttcatgaatacagctgaaaggatcagactgccagacgattgcactattgggtacatcgtagaggccctccttggcgtccctctaatccggtcagggctgttccattcacatctggagaacctgcagcaggtgccaacctcagagctgcacgagcaggtcaccctgagctacggcatgttcgagaacaaacgcaacgccgttcacgtcaaggggccatttagtgttgaagcggacccctcaaggttcaggtctatacactgccacctttatccggatacaccatggtgcccccgtaccgccatcttctag

SEQ ID NO: 193252 - DNA, 1302 bp, Artificial Sequence
  Description of Artificial Sequence: Synthetic coding sequence
atgcagcggatgatccagcagttcgccgccgagtacaccagcaagaacagcagcactcaggatcctagtcagcccaatagcacaaagaaccaatcgctgccgaaggcttcccccgtcacaaccagcccgacagcagctacaacacagaatccggtgctgtcgaaactgctaatggcagatcaggacagccccctcgatctgaccgtacgaaaatcccagagcgaaccctctgagcaggacggcgtgttggacctttccaccaagaagagcccttgtgctggaagtacttcgttaagtcacagccctggttgctctagcactcagggtaacggacggcccggccggccatctcagtaccgaccagacggtctgcggagtggggacggcgtacctccacgctcccttcaggacggcacccgtgaggggttcgggcatagcacatcactaaaggtgcccctcgcaaggtctctgcagatttctgaggagttactgagccgtaatcagctctcaaccgctgcaagcctcgggccttcgggactgcagaaccacggacagcatcttatcctcagccgggaagcttcttgggcaaagcctcactacgagtttaacctgtcacgcatgaaatttaggggaaacggtgctttgtcaaacataagtgatctgccgtttctcgctgagaatagtgccttcccaaagatggctttgcaggcaaagcaagacggaaagaaagatgtatcccactccagccccgtggacctgaagatcccccaagttagggggatggatctcagttgggaatctaggacaggcgaccagtattcttacagttcgcttgtcatgggctctcagaccgaaagtgcacttagtaagaaactaagggccattctgcccaaacagtcccgtaagtctatgttggacgcaggccccgactcctgggggtccgatgccgagcagagcactagtggccagccctatcccacaagcgatcaagaaggcgatccaggaagtaaacagcctaggaaaaagagagggagataccggcagtataactctgagattctggaagaggcaatcagcgtggtaatgtctggaaagatgtctgtgtcaaaagcacagagcatctatggcataccccatagcaccttggagtacaaggtcaaagaacgcctaggaacgctcaagaacccacctaagaagaaaatgaagctcatgcgaagcgagggccccgatgtaagtgttaagatcgaactcgacccccagggggaagccgcgcaatccgcaaatgagagcaagaatgagtag

SEQ ID NO: 193253 - DNA, 1302 bp, Artificial Sequence
  Description of Artificial Sequence: Synthetic coding sequence
atgcagcggatgatccagcagttcgccgccgagtacaccagcaagaattcatctactcaagatccgtcacagcccaactccacgaagaatcagtccttaccgaaggcatcccccgtgactacaagccctaccgctgctaccacacagaacccagtcctcagtaaactcctgatggctgaccaggattcccccttggatttgactgtccgaaaaagtcagtctgaaccttccgagcaggatggtgtactggatctgtctacaaagaaatcgccctgcgctggcagtaccagcctatcccatagtccaggctgtagttctacacaaggtaacgggcgacccgggcgaccttctcagtataggcccgacggactgaggtcaggcgatggcgtgccacccaggagtttgcaggatgggacccgtgaaggtttcggccactctacttctctgaaagtacctctggcccgcagcttgcagatctccgaggagctgctctccaggaatcagctgagcacagccgcctccctgggaccgagtggtttgcaaaatcacggacaacatctgattctgtcccgggaggcctcatgggctaagccgcattacgagttcaatctcagccgcatgaaattccggggcaacggcgctctctcgaatatctcagatctgccctttctggccgagaatagcgcttttccaaagatggccttgcaggcaaagcaggacgggaaaaaggatgttagccactcatctcctgtggatctgaagataccacaagtccgggggatggacctgagctgggaatcccggacaggggatcaatactcctatagcagcctcgtaatgggttcccagacagaaagtgccctcagtaagaagcttcgcgccattctgcccaagcagtcccgtaagtccatgctggatgctggccctgatagttggggttccgatgcggaacaatcgactagcggtcaaccttatcctacgtcagaccaggaaggagaccccggcagcaaacagcctcgcaagaagagggggcggtatagacagtacaactccgaaatccttgaggaggccatttcagtcgtcatgtccggcaagatgagtgtcagcaaggctcaaagcatatatggtatcccgcattccaccttagaatacaaagtcaaggaaaggctcggaacacttaagaacccaccaaaaaaaaagatgaagctcatgaggtcagaaggccctgacgtctcagtcaagatcgagcttgacccccaaggggaggcggcccagagcgcaaacgaatcaaaaaatgagtag

SEQ ID NO: 193254 - DNA, 1302 bp, Artificial Sequence
  Description of Artificial Sequence: Synthetic coding sequence
atgcagcggatgatccagcagttcgccgccgagtacaccagcaagaattcctcaacgcaggacccgagccagcctaactctacaaagaatcagtcgctgccaaaagcctcgcctgtaaccacatcacctactgccgctactacccaaaaccccgttctcagtaagcttctgatggccgaccaggattccccattagacttaactgttcggaaatcacagtccgagcccagcgagcaggatggggtactcgacctgtcaaccaaaaaatcaccatgcgcagggtccacaagtctttcccattcccctggctgtagttccacccagggtaatgggagaccaggacggccttctcagtaccggccggacggactacgaagcggggacggcgtcccgccacgctcacttcaagacggcacaagagaaggcttcggacatagcacatctttaaaggttccacttgcacgctcactgcaaatttcagaggagctgctctcccggaaccagctctcaactgctgccagcctaggtccaagcggcctgcagaatcatggtcagcaccttattctgtctagggaagcttcctgggcaaagcctcattatgagttcaatctctcccgcatgaaattcaggggcaatggcgccctatccaatatttctgacctgcctttcttggccgagaatagcgcctttccaaagatggcactccaggcaaagcaggatggtaagaaagacgtctcccactccagccctgtcgatctcaagatacctcaagtgaggggaatggatctgtcctgggaatccagaaccggggatcagtacagttatagcagtctggtgatgggaagccagacggagagcgcgctcagtaagaagctgagagcaattcttcccaaacagtctcgcaagagcatgctcgacgcagggcccgactcctggggtagtgatgcagagcagtctacctctggacaaccataccccacttcagaccaggagggagacccaggcagcaaacagcccagaaaaaagcgtggaagatatcggcaatataatagcgaaatcctagaagaggcaatttccgtggtgatgtccgggaagatgtcagtgtccaaggctcagagcatctatggcataccccactccacactcgaatacaaggttaaggaacgcctcggcactctcaaaaatccccctaagaagaagatgaagctgatgagatcagagggtccagacgtgtccgtaaagattgaactcgacccacagggcgaagcagcacagtctgctaacgagagcaagaatgagtag

SEQ ID NO: 193255 - DNA, 1221 bp, Artificial Sequence
  Description of Artificial Sequence: Synthetic coding sequence
atgcagcggatgatccagcagttcgccgccgagtacaccagcaagaactcaagcacacaggaccctagccagcctaattccacaaagaatcagagtctgccaaaggcatcacccgtgaccacgagccctaccgccgctacaacacagaatccagtcttgtctaaactgctgatggctgatcaggactcacctctggacctcacagtgagaaaaagccagtctgaaccttcagaacaggacggagtgctcgatctttctaccaaaaagtccccctgcgctgggagcacgtcattgtctcacagcccaggctgcagttcaactcagggcaatggccgcccaggccgcccttctcaataccggccagacggcttaagatcgggggatggggtgcctccaagatctctgcaggatggtaccagggaaggctttggacacagtacctccctgaaagtccccttagcccgttcactccagataagcgaggagctgctcagccgaaaccagttgtccacagcagcctccttaggtccttctggactgcagaatcacggccagcacctgattctttcccgggaagcttcctgggccaaacctcactacgagttcaatctcagccgcatgaagtttagggggaacggagctctgagtaacatctccgatctgcctttcctcgctgaaaactccgcattccccaagatggccctccaggctaaacaggacggcaagaaagatgtgtcccactcttcacccgtcgatctgaagatccctcaagtcaggggtatggatctgtcttgggagagccggaccggggaccagtattcctatagctccttggtgatgggctcccagacagagagcgctttatcaaaaaagctcagagctatcttgccaaagcagtctaggaagtcaatgctggacgccggcccagacagctggggatcagacgccgaacagtctacatccggccagccttacccgacgtcagaccaggaaggcgatccaggatctaaacagccccggaagaaaagaggcagataccggcagtacaacagcgaaattctcgaggaggccatctcagttgtaatgagcggtaagatgtctgtgtcaaaagcacaaagcatctatgggattcctcattcaaccctggagtataaggttaaggagagattgggtaccttgaagaacccccctaaaaaaaaaatgaagctgatgtcagggtag

SEQ ID NO: 193256 - DNA, 957 bp, Artificial Sequence
  Description of Artificial Sequence: Synthetic coding sequence
atggacaagggccgggagcggatggccgccgccgccgccgccgccgccgccgcagccgccgccgcacaatgtcgaagtccaaggtgtgctgccgagagacgcggtttcagacgcgagctggactcctggcggcataggcttatgcactgcgtgggcttcgaatccatactcgagggactgtatggccctcgcctgcgaagagacctcagcctgttcgaagactgcgaacctgaagagttgaccgactggagcatggacgagaagtgttccttttgcaacctgcagagggaagccgtgagcgactgcatcccaagcttagactcaagtcaaagcacccctaccgaggaactttcttcccagggccagagcaacaccgacaaaatcgagtgccaggccgaaaactacctgaacgccctgttccgcaagaaggacctccctcagaactgcgatcctaacattccgctcgtagctcaggagctcatgaaaaagatgatacgccaatttgccattgagtacatctccaaaagcgggaaaacacaagaaaatcgaaacgggtcaatcggcccgagcattgtgtgcaagtccatccaaatgaatcaggcggagaattctctacaggaggaacaagaaggccccctggatctgacagttaaccgaatgcaggagcaaaacacccagcagggagatggtgtgctagacctgagcacaaagaagaccagcataaagtccgaggagtctagcatctgtgacccttcctctgagaactctgtagcaggcatgcttcaggttaagactgacgagaagctgaacgtctctgacgagaacaccgcgtcgtgtccgttgagtccgataaagatgtgtctcaatcggcccatcgagtggaatcttaaccttactacggcgtccctaacatcatgtaccgtccataaccagaatctgaagtcggaagagaagtag

SEQ ID NO: 193257 - DNA, 1557 bp, Artificial Sequence
  Description of Artificial Sequence: Synthetic coding sequence
atggacgagaagtgcagcttctgcaacctgcagcgggaggccgtgtctgactgtattccctccctagattcaagccagtcaacccctaccgaggagctgtcatctcaggggcagtctaacacagataagattgagtgccaggccgaaaactatctgaatgctcttttccgaaagaaagacttgcctcagaattgcgaccctaacatcccactcgtggcccaggagctgatgaagaagatgattagacagttcgccattgaatatatctctaagtctgggaaaacccaggagaacagaaacggctctatcggtccctccattgtctgcaagtccatccagatgaatcaagccgaaaatagtttgcaagaagagcaggagggacccctggacctgaccgtcaatagaatgcaggagcaaaacacgcagcagggtgacggtgtcctcgatcttagtacaaaaaagacttccataaaaagcgaggaatcctccatttgtgatccctcctccgagaacagtgtcgccggtagattacacagaaaccgcgaggattatgttgagcggagcgcagagttcgctgacggccttctgagtaaagctctgaaggacatccagtctggagcccttgatattaacaaagccgggatcctgtatgggatcccccagaagactttgctcttgcacctggaagcattgcccgccggcaagcctgcaagttttaaaaataagacacgcgactttcacgatagctactcttacaaggattcaaaggaaacgtgtgccgtacttcaaaaggtagccctttgggcacgcgcacaggcagagcggaccgagaaaagtaagttgaatttgctggagacctccgaaattaagttccccactgcgagcacctacctgcatcaactgactcttcagaaaatggttacccaatttaaagaaaagaatgaatctctccagtacgagaccagcaacccaactgtccaactgaaaatcccccagctccgggtctcctccgtaagcaagtcccagcccgatggttcaggtttgttggacgtgatgtatcaggttagcaagacttcttccgttctggaaggtagcgccctgcagaaactgaagaacatcctgcctaaacaaaataaaattgaatgtagcgggcccgtgacccacagcagtgtggactcctacttccttcacggagacttatctcccctgtgtttgaactccaagaatgggacggttgacggaacatccgaaaatacagaggacgggctggatcgcaaagactcaaaacagccgcggaaaaagcgaggccgctaccggcagtatgatcacgagataatggaagaggccatagccatggtgatgtcgggaaagatgtctgtcagtaaggcccagggcatctatggcgtaccccactctacgcttgagtacaaagtgaaagagcgcagcgggaccctgaagacacctcccaagaagaagctacggctgccagataccggcctgtacaatatgacagatagtggaaccggatcttgcaagaattcaagtaaacctgtgtag

SEQ ID NO: 193258 - DNA, 1809 bp, Artificial Sequence
  Description of Artificial Sequence: Synthetic coding sequence
atggacaagggccgggagcggatggccgccgccgccgccgccgccgcagcagccgcagcagccgctcagtgcaggtcaccccggtgtgcagctgaacgccggggtttccggcgagagctggactcgtggaggcaccgactcatgcactgcgttggtttcgagagcattctggaaggactctacggcccccgtctgcgcagagatctgtcactctttgaggactgcgagcccgaggagcttacggattggtcaatggacgaaaagtgctctttctgtaacctgcagcgtgaggccgtgtccgactgcatacccagcctcgatagttcacagtccacaccaacggaagagttgtcgagccagggccaatcgaacactgataaaatagagtgtcaagccgagaattacctgaatgcccttttccgcaaaaaggacctgccgcagaactgcgatccaaatatcccgctggtggctcaggaactcatgaagaaaatgatcagacaatttgcaattgagtatattagcaagtctggcaaaacacaggaaaacagaaacggaagtattggtccatccattgtttgtaagagcatccaaatgaaccaggctgaaaatagcttacaggaagaacaagaagggccacttgatctgacagtcaataggatgcaggaacagaatacacagcagggagacggtgtactcgatctgtccacaaagaaaacctcaatcaagtctgaggagtcctcgatctgtgacccgtcatcagagaattcggtagccgggcgtctacatcggaatcgcgaggattacgtcgagcgctctgcggaattcgcagacgggctcctgagcaaagcgcttaaagacatccagtctggcgcactggacatcaacaaggcagggattctctatggaatcccccagaaaacactgttactacacctcgaagccttacccgccggcaaaccagccagcttcaaaaataaaactagagattttcacgattcttattcctacaaggattctaaagagacctgtgccgtgctgcagaaggtcgcactgtgggccagggcgcaggccgaacgcacagaaaagtccaagttaaaccttctggagacgagtgagatcaagtttccgaccgcctcaacttatctgcatcagctgactctgcaaaagatggttacccagttcaaggagaagaatgaatccctccagtacgaaacctccaatccgaccgtacaactgaaaatcccacaactgcgtgtatcctctgtttccaagagccagcctgacggtagcgggctactggatgtgatgtaccaggtttcgaagaccagttccgtcctcgagggcagcgccctgcagaagcttaaaaacatcctgcctaagcaaaacaagattgaatgttctggaccagtaacccattccagcgttgatagctatttcctgcacggtgacttaagccccctatgtttgaactcaaaaaatgggacggtggatggcaccagcgagaatacggaagacggactcgaccggaaggatagtaaacaaccccgtaagaagcgaggacggtacagacagtatgatcatgagatcatggaggaagccatcgccatggtgatgtccggaaaaatgtccgtttcgaaggcgcaaggcatctatggagtgcctcatagcacactcgagtacaaggtgaaagaaagatctgggacattaaagacgccccccaagaagaagctgcgtctccccgatacggggctgtataatatgaccgatagcggaacaggctcttgcaagaatagctccaagccagtctag

SEQ ID NO: 193259 - DNA, 435 bp, Artificial Sequence
  Description of Artificial Sequence: Synthetic coding sequence
atggaccacggctacgaggagaccagcgtgtacctgaaggactgcatccccagtctggacagttcacagtcaaccccgacagaggagctgtcctcacaggggcaaagcaacacagacaaaattgagtgccaggcagagaattacctgaacgctctcttccgaaaaaaggatctgccccagaattgtgatcccaacatcccactggtcgctcaggagctgatgaagaagatgattagacagtttgccatcgaatacatctccaaatccggaaagacccaagagaaccgtaatgggtctatcggcccctctatagtgtgtaagtccatccagatgaatcaggccgagaactccctgcaagaggaacaagaggggcccctggacctgactgtgaatcggatgcaggagcagaatacacagcaggcgtgctacaaatag

SEQ ID NO: 193260 - DNA, 2187 bp, Artificial Sequence
  Description of Artificial Sequence: Synthetic coding sequence
atgaaccagcccgagagcgccaacgaccccgagcccctgtgcgccgtgtgcggccaggcacacagtctagaagagaatcatttctacagttaccccgaagaggttgatgatgaccttatttgccacatttgcctgcaggcactcctggaccctttagacacgccttgcggtcacacctactgcactctctgtctcaccaatttccttgtggaaaaggacttctgccctatggataggaagccactggtgctgcagcactgtaaaaaaagttctattctggtaaacaagttactcaataaactgctcgtcacatgtccgttccgggaacactgcacccaagtgctgcagagatgcgacttggaacaccactttcagacaagttgtaagggtgcctcccattatggcctgactaaggaccgtaagcgcaggtctcaggacggttgtcctgacggatgcgcctctcttactgcaacagcaccatccccagaagtctctgctgctgcgaccatctcattaatgacagatgagccagggctcgacaacccggcctatgtcagcagcgccgaggacggccaacccgctatctcacccgtcgacagcgggcgcagtaatcgaactcgggcccgtccttttgaaaggtccactattcgctctcggagcttcaaaaagatcaatagagccttaagcgtgctgcggcgcaccaaaagcggttccgcggttgccaatcacgccgaccagggaagggaaaattccgagaatacaactgctccggaagtcttcccacgactgtatcacctcatcccagacggcgaaattaccagcataaagatcaaccgggtggatccttcagagagcctgtctataaggctggtgggtggcagtgaaacgccgctggtccacatcataattcaacacatatatcgggatggagtaatcgcgcgcgacggtagactccttccaggggatatcatattgaaagtaaacggaatggatatttctaatgtcccgcacaattatgctgtacggttattgagacaaccatgccaggtcctctggctcaccgtgatgcgcgagcagaaattccgctcaagaaataacgggcaggccccagacgcttaccggcctagggacgatagctttcacgtaatcttgaataagagctcacctgaagagcaactgggaattaagctggttaggaaggttgatgaacctggcgttttcatctttaacgtcttggatgggggcgtagcctaccgacatgggcagctggaggaaaatgatcgtgtcctggccattaatggacacgatctccggtacggctcaccagagagtgccgcacatctgattcaggcgtctgagagacgcgtgcatctcgtcgtgagtcgccaggtccgccaacgatccccagatatatttcaggaagcgggctggaattccaacggtagctggtctcccggtccaggcgaaagatccaatacacctaaacccctccatccaaccatcacttgtcacgaaaaggtcgttaacattcaaaaagacccgggtgagtcactgggaatgaccgtcgctggcggcgctagtcacagggagtgggatcttcccatctacgtaatcagtgtcgagcccggaggtgtaatatcccgcgacggacgcataaagacgggagatatcctgctcaacgttgacggggtggagctgactgaggtgtctaggtcagaggctgtggctttgttgaagcggacaagctcgtccattgtgcttaaagcactcgaggtaaaagaatacgaacctcaggaagactgtagctcaccagccgccctcgattccaatcataacatggccccgcccagtgattggagcccaagttgggtcatgtggctcgagctacctcgttgcctatataattgtaaggacatcgttcttcgaagaaacaccgcaggttcactgggtttctgtatcgttggcgggtatgaggaatataatggaaataaaccattttttattaaatccattgtggaaggtacccctgcgtacaacgatggcagaatcagatgtggcgacattctcctcgccgtgaacggacgcagcacttcaggtatgatccatgcatgtttagcacggctccttaaagaactgaagggacgtatcacactcacgattgtctcttggcctggcaccttcctctag

SEQ ID NO: 193261 - DNA, 1899 bp, Artificial Sequence
  Description of Artificial Sequence: Synthetic coding sequence
atgaaggccctgctgctgctggtgctgccctggctgagccccgccaactacattgacaatgttgggaatcttcacttcctctattccgagctctgcaaaggtgctagccattatggattaaccaaagatcggaagcggagatcccaggacgggtgccccgatggatgtgcctccctcactgcgactgccccaagtcctgaggtttcagccgccgctacaataagtctcatgaccgatgagccagggctggataaccctgcctacgtgtcatcagcagaggacggccagccggcaatctctccggtggattctggtcggtctaaccgaactcgggcgcgtccatttgagaggtccaccatacgctcacgctcattcaagaagataaaccgagcactcagtgtacttagacgcactaaatctggctccgctgtggcgaaccacgccgatcagggccgtgaaaactccgagaatactactgcacctgaggtgtttcctcggctttatcatttaatccccgatggcgaaatcacctcaataaagattaaccgtgtagatccatccgagagtctcagcatccggctggtgggcggttctgagactccattagtgcacatcattattcagcacatttatcgggatggtgtgatcgcccgcgacgggcggctgcttcccggggatatcatactgaaagtaaacggcatggatatctccaacgttccccacaattatgccgtaagactgttgcgccagccctgccaagtgctttggttaacggtaatgcgggaacaaaagttcagatccaggaataacgggcaggccccagacgcctaccggccgagagatgacagctttcacgtcattctgaacaaatctagtcctgaagagcagttgggaataaagctggtgaggaaggtagacgaaccgggtgtgttcatatttaacgtccttgacggtggcgtcgcgtatcgccacgggcaactggaagagaatgatcgcgtactcgccatcaacgggcacgaccttcgatacgggtcccctgagagcgccgcccacctaatccaagctagcgagaggcgggtccatctggtcgtgagccggcaggttcgccagaggtcacctgatatttttcaggaggcaggctggaacagcaacggctcttggtcccccggcccgggcgagcgaagcaatacaccgaaaccactccaccccaccattacttgtcacgaaaaggtggtgaacatccagaaggatccaggcgagtccctgggaatgactgttgctggcggagcaagccatcgagaatgggacctgcctatatatgtaatctcagtcgagcccggcggggtaatctctcgcgatggacgtattaagaccggggatatcctgctgaacgtcgacggagtggagttaacggaggtgagtcgatccgaagctgtggcactgctcaagagaacatcgtctagtatcgtgctgaaggcgcttgaggtgaaggaatacgaaccccaggaggactgcagcagcccggcagccctggattccaaccacaacatggctcctccgtccgactggtctccatcctgggttatgtggctcgaactccctcgctgtttatacaactgtaaagatatagtgctgcgccgcaacacagcagggtcactgggcttttgcattgtgggaggttacgaagagtataatggaaacaaacctttttttatcaagtctatcgtcgagggcacaccagcatacaatgacggccgtatccgatgtggagacattctcctggccgtcaatggacgcagtacatctggaatgattcacgcctgcctggcccggctgcttaaagagctgaagggccgcatcacgcttacaatagtttcttggcctgggacattcctgtag

SEQ ID NO: 193262 - DNA, 21 bp, Artificial Sequence
  Description of Artificial Sequence: Synthetic coding sequence
atgaaccagcccgagagctag

SEQ ID NO: 193263 - DNA, 51 bp, Artificial Sequence
  Description of Artificial Sequence: Synthetic coding sequence
atgaaccagcccgagagcgccaacgaccccgagcccctgtgcgccgtctag

SEQ ID NO: 193264 - DNA, 300 bp, Artificial Sequence
  Description of Artificial Sequence: Synthetic coding sequence
atgaaccagcccgagagcgccaacgaccccgagcccctgtgcgccgtatgcggtcaggcacacagcctagaagagaaccacttctactcttaccccgaggaggttgacgatgacctgatctgccacatctgcctacaagcactgctcgacccactggacactccatgcggacacacatattgcactctgtgccttactaactttctagtcgagaaggatttctgtcctatggatcggaagcccctggttctgcagcattgtaaaaagtcatcgatcctggtgaataaactactgaattag

SEQ ID NO: 193265 - DNA, 273 bp, Artificial Sequence
  Description of Artificial Sequence: Synthetic coding sequence
atgaaccagcccgagagcgccaacgaccccgagcccctgtgcgccgtgtgcggacaggcgcattctctggaagagaaccacttctactcttacccagaggaagtcgacgatgatcttatctgtcacatctgtctgcaagcacttctggaccccctcgatactccgtgcgggcatacctactgtacactctgccttaccaactttttggttgaaaaagatttctgtcccatggacagaaaaccgctggtgcttcagcactgtaagaaatcctag

SEQ ID NO: 193266 - DNA, 381 bp, Artificial Sequence
  Description of Artificial Sequence: Synthetic coding sequence
atgaaccagcccgagagcgccaacgaccccgagcccctgtgcgccgtatgtgggcaggcccattccctggaagaaaaccacttttacagttaccccgaggaggtggatgacgatctgatctgccacatctgtcttcaggccctgttggaccctctggacacgccatgcggacacacatattgcactctgtgtcttaccaatttcctcgtagagaaagacttctgccccatggacagaaaacccttagtcctgcagcattgcaaaaaatcttccatactagtcaacaagctgttaaacaaactgctggtgacttgccctttcagggagcactgtacgcaggtactccagaggtgcgatctggagcaccacttccaaacttag

SEQ ID NO: 193267 - DNA, 1701 bp, Artificial Sequence
  Description of Artificial Sequence: Synthetic coding sequence
atggccgtgcagaccgccgtgcgggccagccagccccggctgccccccctggataacccagcttatgtgtcatccgccgaagatggccagccagctatttctcctgtggattcgggccgttctaaccgcacacgggcccgcccctttgaacggagtaccatcagaagccggtcgtttaagaagatcaatcgagccttgtccgtgttgagacgtaccaagtctggatccgccgtggctaaccatgctgatcaaggcagagaaaattcagagaataccactgctcctgaggtcttcccgcggctctaccacttaatacctgatggagagataacgagtatcaaaattaacagggtcgacccgagtgagtctctctccatcagactcgtggggggtagtgaaacgccgttagtccacatcattattcaacacatatatcgtgacggtgtcattgctagggatggccgcttacttccgggggatattatattaaaagtgaacggaatggacatcagcaacgtgccccacaactatgctgtgcgtctacttagacaaccgtgccaagttttgtggctgactgtcatgcgggaacaaaaattcagaagccgaaataacggtcaggccccggatgcgtatagacctagggatgatagttttcacgtgattcttaacaagtcttccccagaagagcagctgggaattaagctggtgcgaaaggtggatgagccaggcgtcttcattttcaacgtgctggatgggggtgtcgcttacagacacgggcaactggaagaaaatgaccgggtgcttgccatcaacggccatgatctgaggtacggaagccctgaatctgccgcacatcttatccaagcatctgagcgccgagtgcatctagtggtgagtcggcaggttcggcagcgtagccccgacatctttcaagaagccggatggaattctaatggttcatggagtcccgggccaggtgaaaggtccaatacccctaaaccattacaccccactatcacatgccatgaaaaggtagtgaacatccagaaagaccccggggagtccctgggcatgaccgtggccggcggggcgagtcaccgcgagtgggaccttcctatatacgtaatctctgtagagccggggggcgtgattagtcgggatggacgaatcaaaacgggcgacatcttgcttaacgtagatggcgtcgagctgacagaagtgtctaggagcgaggccgttgcgctcctgaagcgcacaagttcaagtattgtcctaaaagcgctcgaggtcaaggaatatgaacctcaggaggactgcagtagtccagccgcgctcgacagtaaccacaacatggctcccccttcagactggtcacctagttgggtaatgtggctggagctgcccagatgcctgtataattgcaaggacatcgtgctgagaagaaatactgctggctctcttggtttctgcatcgtaggagggtacgaggagtacaacggtaacaagccatttttcattaaaagtatcgttgagggaactccggcatacaacgatggtcgtattagatgcggcgacattcttctcgcagtgaacgggcggtcaacaagcggtatgatacacgcatgcctggcgagactcctcaaggagctgaaggggcgcattaccctgaccatcgtgagctggccagggaccttcctgtag

SEQ ID NO: 193268 - DNA, 2073 bp, Artificial Sequence
  Description of Artificial Sequence: Synthetic coding sequence
atgggcaccaccagcgacgagatggtgagcgtggagcagaccagcagttcttccttaaacccactgtgttttgagtgcgggcaacagcactggactagggagaaccacctctataattaccaaaacgaagttgatgatgacctggtctgtcatatctgtctacagcctctattgcaacccttggacacaccgtgcggacataccttttgttataaatgccttcgtaattttctacaggagaaggatttctgtcctctggacagaaaacggctgcacttcaagctctgtaagaagagttccatcctcgtgcataagcttcttgacaaactgctggtgctctgtcctttcagctcagtgtgtaaggatgtgatgcaacgctgtgatctcgaggcccacctcaagaataggtgtccaggcgcttcccatcggagagtggcactggaacgtaggaagaccagtaggactcaagccgagatcgagaacgagaatgggccaacactcctggacccagctggaaccctgagtcctgaagccgactgcttgggcaccggcgctgtgcccgtggaacggcacctgacatctgcatccctctcaacctggtccgaggaacctgggctagataatccagcattcgaggaatcagctggcgcagacactacacagcaacccctctcactgccagagggcgaaattacaacaatcgaaatacacaggagcaatccttacattcagctcggcatctccatcgtaggcggtaatgaaacacccctaattaacatcgtaattcaggaggtgtaccgggacggtgtcatagcaagagatggacgcctgctggccggagatcagatcctccaggtaaacaattacaatatcagcaacgtgtcccataattatgcccgcgctgtcctctcacaaccatgcaatactctgcatctaactgtcctgcgagagagacgctttggcaacagagcccataatcatagcgactcgaatagtcctagggaggagatcttccaagtcgccttacacaagagggactctggggagcagctggggattaagctcgtcagacgcaccgatgaacccggggtgttcatcctcgatctcctggagggcggactagccgcccaggacggccgtctgagcagcaacgatagggtgttagcaattaacggtcatgatttgaagtacggcacaccggaactagcagcgcagataatccaggcatccggcgagcgggtgaatttgaccatcgcccgaccaggaaagcctcagcctgggaataccattcgggaagctgggaaccattcaagttccagccaacatcatacaccacccccatactattcaaggccatcctctcacaaagacctgacccagtgtgtgacatgccaagagaagcacattacagtgaaaaaagagccacatgagagcctcggtatgacggtggcgggtggacggggtagcaagagtggagagctgcctatctttgtgacatccgtgccgcctcacgggtgtcttgccagggacggtaggatcaagaggggtgacgtcctgctaaatataaacggaatagacctgactaacctcagccatagcgaagcggtggccatgcttaaggccagcgccgcctcacccgctgttgctttgaaggctctcgaggtgcagatagtggaggaagcgacacagaatgcagaggagcaaccctctacattctcggaaaatgaatacgacgcaagctggagccccagttgggtgatgtggctaggcctcccttccaccctccatagttgccatgacatcgtgctcagacgctcatacttgggcagttgggggtttagcatagtgggcgggtatgaggaaaaccacacaaaccagcctttcttcatcaagactatcgtcctcgggaccccagcatattatgacggacgtctgaagtgtggcgatatgattgtggctgttaacgggctgtcaaccgtaggaatgagccattccgctctagtaccgatgctgaaggagcagcgcaataaggttactcttacagtcatctgctggcccggcagcctcgtgtag

SEQ ID NO: 193269 - DNA, 2115 bp, Artificial Sequence
  Description of Artificial Sequence: Synthetic coding sequence
atgctgggcatctgccggggccggcggaagttcctggccgccagcttgtctttgttatgcattccagccatcacttggatctatctgttcagcgggagctttgaggatggtaagcctgtttcccttagccctttggagtcacaggcccatagcccgagatacaccgcctcttcgcaaagagagcgtgagagtttagaagtccgcatgagagaggtggaggaagaaaatagagccctccggcgccagctttccctagctcaaggccgtgcgccctcccaccggcgtggaaaccactcaaagacctattccatggaagagggcactggcgattccgagaatctcagagctggtattgtagccggtaattcaagtgagtgcggccagcagcccgtggtggaaaagtgcgaaaccatacacgtagctatcgtgtgcgccgggtacaacgctagtcgggacgttgtaactctcgtgaagagcgttctgtttcacaggcggaatcccctccattttcacctcatcgccgattccatcgccgaacaaatcctcgccacgctgtttcagacatggatggttcctgccgttagagtcgacttctacaatgccgatgagttgaagtccgaagtatcctggatcccaaacaagcactatagcggaatctacgggttgatgaagctggtcttgaccaagacgctgccggccaatctggaacgagtgatagtactcgataccgacatcacgttcgctactgatattgcagaactctgggctgtgttccacaagtttaaaggacagcaggttttgggcctagttgaaaaccagagtgactggtatctaggcaatttatggaaaaatcataggccttggccagccctgggccgaggttataacacgggagtaattctgctactcctcgacaaactccggaagatgaagtgggaacagatgtggcgcctgaccgcagagcgagagctcatgggtatgctgtctacatctctggctgaccaagacatctttaacgccgtcattaagcaaaatccttttttggtgtatcaactgccgtgtttttggaatgtacagctctccgaccacacccgctctgagcagtgctaccgtgacgtaagtgatctgaagctccagaagcaacttagtgagctggacgaagatgacctctgctacgaattccgacgggagcggtttaccgtgcacaggacccacctgtacttccttcactacgaatatgaacccgctgcagacagtaccgacgttacgctggtcgcccaactctcgatggatagactgcagatgctggaggccatctgcaagcactgggaaggccctattagcctcgccctgtacctgagtgacgcagaagcccagcagtttttgcggtacgcacagggctcagaggtcctcatgagccgccacaatgtggggtatcacatcgtatataaagagggccaattttacccggtcaacctgctgcgcaacgtagcaatgaagcatatttccaccccgtatatgtttctgtccgacatagattttctacccatgtacggcctttatgagtacctgcggaaatccgttatccagttggacttagcgaacaccaagaaagccatgattgtgcccgcatttgagaccctccgatataggctgtcttttcccaagtcaaaggctgagcttctgtcaatgttggatatgggcaccctcttcaccttcagataccatgtttggacgaagggccacgctccaacaaactttgccaaatggcggacagccaccactccatatcgcgttgagtgggaagccgacttcgagccgtatgtagtcgtgaggagagactgtccagagtacgatcgaaggttcgtgggctttggatggaataaggtcgcacatatcatggagctcgatgtgcaggagtacgagtttatcgtcttacccaatgcctacatgatccatatgccacatgcaccatcatttgacattacaaaattccgctctaacaagcagtatcgcatttgtctcaagaccctgaaggaagagttccaacaggacatgtcccggcgctacgggtttgcagccctcaagtatcttactgctgagaataacagctag

SEQ ID NO: 193270 - DNA, 2271 bp, Artificial Sequence
  Description of Artificial Sequence: Synthetic coding sequence
atgctgggcatctgccggggccggcggaagttcctggccgccagcttgtccctactatgcattcccgcgatcacctggatctatctcttcagcgggtcctttgaggacgggaagcctgtctcactctcacccctagagagtcaggctcactcccctcgctataccgcctcgtctcaacgcgagagggaatcccttgaagtgaggatgagggaggtcgaagaagagaacagagctctaagacggcaattgtccttggcacaggggcgggcaccttctcataggcgcgggaaccatagcaaaacgtatagcatggaggaaggtaccggagacagcgaaaacctgcgggccgggattgtcgctggcaattctagtgaatgtgggcagcagcctgtagtggagaaatgtgaaactatccacgtggccatagtctgcgccggttacaatgcatccagggatgttgtgacactggttaaatctgtattgtttcatcgtcgtaaccctctgcactttcacttaatcgctgattcaatagccgagcagatcctggctaccctgttccagacttggatggtcccggccgtcagagttgacttctacaatgctgacgaactgaagagtgaggtgtcttggattccaaataagcattattcaggcatctacggcctcatgaagctggtgctaactaaaacactgcccgccaatctggaaagagtcatcgtgctcgatacagatattaccttcgccaccgacattgctgagctctgggccgtgttccacaagttcaagggccagcaagtactgggcctcgtggaaaatcagtctgattggtacctgggaaacctatggaaaaatcacagaccctggcccgccctgggccgagggtacaataccggcgtgatcctgctcctgctggataagttgaggaagatgaaatgggagcagatgtggcgtctcacagccgagcgcgagcttatgggcatgctctcgacctccctggcagaccaggatatcttcaatgctgtcatcaagcaaaacccctttctggtgtatcagctgccatgtttctggaatgtgcagctgtccgaccatactcggtccgagcagtgttatagagatgtgtcggacctgaaagtcatccattggaattccccaaagaaattaagggttaaaaacaagcatgttgagtttttcagaaatttatacctaacgtttcttgagtatgacggtaatctactgagacgggagcttttcgggtgccccagcgaagcggacgtgaacagcgaaaacctgcagaagcagctctctgagctcgatgaagatgatctgtgctacgaattcagacgagagcgtttcacagtgcatcgcacccatctatatttcctgcactacgagtacgagcctgcagcagactctaccgacgtcactctcgtagcacaactgagcatggacagacttcaaatgctagaggctatctgcaagcattgggaagggcctatatcccttgcattgtacctcagtgacgccgaagctcagcagtttttgcggtatgcccaggggagtgaggtgttgatgtcacgccataatgttgggtaccacattgtatacaaggagggacagttctatcctgtcaacctactgcgtaacgtggctatgaaacacatctcaaccccttacatgtttttgagtgacattgattttttacctatgtacggcctttacgaatacttgaggaagtccgtaatccagctcgacctggcaaacaccaaaaaagccatgattgtgcctgcctttgaaacactgcgataccgactgagcttcccgaaaagcaaagccgagttgctcagtatgctggatatgggaaccctgtttactttcaggtatcacgtgtggactaaaggccacgctcctaccaactttgccaaatggcggacggccacgacaccctatcgggtggagtgggaagccgacttcgaaccctatgtcgtcgtcaggagagactgcccagaatatgacaggagatttgtcggattcggatggaacaaggtggcccacataatggagctggacgtacaggagtatgagttcatcgtgttgccgaacgcctatatgatccacatgccacacgctcccagcttcgatatcacaaaattcaggagtaataaacagtaccggatttgcctcaagacccttaaagaggagttccagcaggacatgtcccgccgatatgggtttgctgctctgaaatatttaactgcggaaaataatagctag

SEQ ID NO: 193271 - DNA, 2271 bp, Artificial Sequence
  Description of Artificial Sequence: Synthetic coding sequence
atgctgggcatctgccggggccggcggaagttcctggccgccagcctgtcattactgtgtatccccgccatcacatggatctacttgttctctgggtccttcgaggacggaaagcccgtgtctttgagccccttagagagccaagctcactcgccccggtatacggcatctagtcaaagagagcgagagagtttagaggtgcgaatgcgggaggtggaggaggagaacagggcgctcagacggcagctgagcttggcccaaggcagggcacctagccacagacgtggtaaccactccaagacgtattcaatggaagaaggtaccggagatagcgagaacctcagggctggcatagtggctgggaacagttccgaatgtgggcagcagcctgtggtagagaaatgtgaaacaatccacgtggctatcgtatgtgcgggctacaatgcctcccgtgatgtggttacactggtaaaatctgttctttttcacagaagaaatcccctacacttccatctgatcgccgactcaatcgctgagcagatcctcgctacgctgtttcagacctggatggtccccgccgtcagagtcgatttttataacgcagatgaactcaagagcgaagtgagttggatcccgaataaacattattccggaatatacggccttatgaagctagtcctgactaagacactccctgcaaaccttgagcgggtcattgtactggacacagatatcacgtttgccaccgatattgcagagctgtgggccgtgttccacaaattcaaaggtcagcaggtgctgggtcttgtggagaatcagagcgactggtacctggggaacctgtggaaaaaccacaggccatggcctgcactcggccgtgggtataacaccggtgtcatcctgctgctgctggataagctgaggaaaatgaagtgggaacagatgtggcgtctgaccgccgagagagaactgatgggaatgctgtccactagtctggccgatcaggatattttcaatgccgtcatcaagcaaaacccttttctggtataccagctaccttgtttctggaacgtgcaactgtcagaccatacccgtagtgagcagtgttaccgcgacgtctccgatctcaaggtcatacattggaattctcccaaaaaacttagagttaagaataaacacgttgaattcttccggaacctgtatttaacattcctggaatatgatggcaacctgttaagacgggaactgttcggctgtccctctgaggccgacgtgaacagtgaaaacctgcagaaacagctttccgagctcgatgaggatgatttgtgttatgaattccggagggagaggttcaccgtgcacaggacgcatctgtatttcctccattatgagtacgaacccgcagcagacagtacagacgtgacattggtggcgcaactcagcatggatcgactgcagatgctggaggccatctgtaaacattgggagggtcccattagtctcgctctttatttaagtgatgccgaggcgcagcagtttctgcgttacgcacaagggtccgaagtgcttatgtccagacataacgtgggataccatatcgtgtacaaggagggccaattttaccccgtcaatctgctgagaaatgtggctatgaagcacatttccaccccctacatgttcctgtctgatatagatttcttaccgatgtatgggctctatgagtatttgagaaagagcgtaatacaactcgatctggccaacactaaaaaagccatgatcgtccctgcattcgaaaccctgcggtaccggctgtcatttccaaagtcaaaggctgagctgcttagcatgctggacatgggcaccttattcaccttcaggtatcatgtttggacaaaaggtcacgcgcctaccaatttcgcaaaatggcgtactgccacaacaccctacagagtggagtgggaggcggatttcgagccatacgtggttgtgaggagagactgtccagagtacgataggaggtttgtaggatttggatggaataaagttgcccacattatggagctcgatgtccaagaatatgaatttattgtgttgcctaatgcttacatgattcatatgccccacgcgccatctttcgacatcactaaatttagaagtaacaagcagtacaggatatgtcttaaaaccctaaaggaggagttccagcaggacatgtcacggagatatggatttgctgctctgaaatatctaacagccgaaaataacagctag

SEQ ID NO: 193272 - DNA, 2115 bp, Artificial Sequence
  Description of Artificial Sequence: Synthetic coding sequence
atgctgggcatctgccggggccggcggaagttcctggccgccagcctctccttgctgtgtatccccgctattacttggatctatcttttctctgggtctttcgaggatgggaaaccggtaagcctctctcctctggagtctcaggcccatagtcctcggtacacggcttcttcccagagagaacgtgagtcattggaggtcaggatgcgcgaggtcgaggaggagaaccgcgcgctcaggcgacagctgtcacttgcccagggacgggcccctagccaccgcagggggaatcacagcaagacctattctatggaagagggtacgggcgacagcgagaacttgcgagccggcatcgttgctggaaattccagtgaatgcggccaacagcccgtcgtggaaaaatgtgagacaattcacgtggcaattgtatgtgcagggtataacgctagccgcgatgtggtgactttagtaaaaagtgtactattccatcggcggaacccgctccattttcacctcatcgcagattctattgctgaacagatactcgcaactttgtttcagacatggatggtgcctgccgtgcgcgtggacttctataatgcagacgagctaaaatccgaggtatcctggatacccaataagcactacagtgggatttatggactcatgaagctcgtattaactaagacgctccccgccaatttggagcgagttatcgtactagatactgacatcactttcgccacagacatcgcggaactgtgggctgtcttccacaagtttaaggggcagcaggtcctggggctcgtcgagaatcaatcagactggtatctaggcaacctgtggaagaatcaccgaccttggccagctctcggtcgtggatataacaccggcgtgattttgctcctcctggataagctgagaaaaatgaagtgggaacagatgtggagactcacagctgaaagggaacttatgggcatgcttagcaccagcctcgctgatcaggatatcttcaacgccgtgatcaagcagaacccatttctggtgtaccagttaccgtgcttctggaacgttcagctcagtgatcacaccaggagtgagcagtgctacagagatgtgagcgacttgaagttacagaagcagctgtctgagctggatgaagatgatttatgttatgagttccgacgggagagattcaccgtgcaccgtacccatctctacttcctccactacgagtatgagccagctgcagattcgacagacgtgaccctggtggcccagcttagtatggaccgactgcagatgctggaagcgatatgcaagcactgggagggacccataagtctggctctctaccttagcgacgcggaggcccagcagtttctgcggtatgcccagggctccgaggttctgatgtcgaggcacaacgttgggtatcatatagtgtataaggagggtcaattctacccggtcaacctgctgcgcaatgtggcaatgaaacacatcagtacgccttacatgtttttgagcgatattgattttctcccgatgtatggcctgtatgaatacctgcgaaagagcgtgatccaacttgacctggcaaatactaaaaaggctatgattgtcccggcctttgagacactgcgatatcggctgagtttcccaaagagtaaagccgagctgctgtctatgctcgatatgggaactctatttacattccgctatcacgtttggactaaaggacacgctcccactaacttcgcaaagtggagaactgcgaccacgccttaccgggtcgagtgggaggctgatttcgagccctacgttgttgtacggcgcgattgtccggagtatgacaggaggttcgtgggatttggctggaacaaggtggcgcacataatggagctcgacgtccaagagtacgaatttatcgtgctccccaacgcctacatgatccatatgccccacgcccccagtttcgatattacgaaatttcgcagcaacaagcaataccgaatctgcctaaagactctgaaggaggaattccagcaggatatgtcaagacgctatggtttcgccgccctgaagtatctaacagccgagaataattcttag

SEQ ID NO: 193273 - DNA, 408 bp, Artificial Sequence
  Description of Artificial Sequence: Synthetic coding sequence
atgctgggcatctgccggggccggcggaagttcctggccgccagcctcagcctactgtgtataccggctataacttggatctacctcttttctggctcattcgaggacggaaagccggtgtccttatcccctctggagtcccaagctcacagcccccgctacacggctagttcccagcgcgagcgcgaatccctggaggttagaatgagagaagtggaggaggagaaccgggccctccgccgccagctgagtttagctcaggggagggccccctcccatcgccgggggaaccatagcaaaacttatagtatggaggaaggtactggagacagtgaaaacctcagagccgggatagttgcaggcaacagctccgaatgtgggcagcagccagtggtggaaaagtgctag

SEQ ID NO: 193274 - DNA, 144 bp, Artificial Sequence
  Description of Artificial Sequence: Synthetic coding sequence
atgctgggcatctgccggggccggcggaagttcctggccgccagcctgtctctattatgtattccagcaatcacctggatatacctgtttagcgggtccttcgaggacggcaagcctgtgtccctgtcacctttggaaagttag

SEQ ID NO: 193275 - DNA, 411 bp, Artificial Sequence
  Description of Artificial Sequence: Synthetic coding sequence
atgctgggcatctgccggggccggcggaagttcctggccgccagcctctctcttctgtgcattcccgcgatcacttggatctatcttttctccggcagcttcgaggatgggaaaccagtcagcctgtcccctctggagagtcaagcacactctccccgatacacagcctcttcacagagggaacgggaatccctcgaggtgcggatgagagaagtggaagaggaaaatagagcgctccgccgccagctttcgttagctcagggccgagcaccatcccataggagaggcaatcactccaaaacttattctatggaggagggtaccggtgacagcgagaatctgagggctggcatcgtcgcggggaattctagcgaatgcgggcagcaacctgtcgtggaaaagtgcgaatag

SEQ ID NO: 193276 - DNA, 183 bp, Artificial Sequence
  Description of Artificial Sequence: Synthetic coding sequence
atgctgggcatctgccggggccggcggaagttcctggccgccagcctatcgctgctgtgcattcccgcgatcacttggatatacctctttagtggatctttcgaggacggaaaaccggtcagtctttccccgctcgagagccaagctcatagcccaagatacaccgcaagctcccaacgatag

SEQ ID NO: 193277 - DNA, 330 bp, Artificial Sequence
  Description of Artificial Sequence: Synthetic coding sequence
atgctgggcatctgccggggccggcggaagttcctggccgccagcttgtcactgctctgcatacctgctatcacatggatttaccttttttccggctcctttgaagatggcaagccagtgtccttgtcccccttagaaagtcaggcgcatagcccacgctatacggcctcctctcagcgtgagcgcgaatctctggaggtgaggatgagagaggtcgaggaagagaaccgtgccctgaggcgtcaactctctctcgctcagggacgcgctccaagccaccgacggggaaatcattcgaagacctattcaatggaagaggggacagggtag

SEQ ID NO: 193278 - DNA, 2124 bp, Artificial Sequence
  Description of Artificial Sequence: Synthetic coding sequence
atgctgggcatctgccggggccggcggaagttcctggccgccagcctctctctcttgtgcataccggccataacttggatatacctcttctccgggagcttcgaggatggtaagcctgtttccttatcaccactcgaaagtcaggctcatagccctaggtacacagctagtagtcaacgggagcgcgagtcacttgaggttaggatgagggaggtcgaggaggaaaatcgcgcactccgcaggcaactgagcctggcgcaggggagggctccaagtcatcggaggggaaaccatagcaagacttactcaatggaggagggcaccggtgactccgaaaatttaagagccggaatagttgccggcaactcctctgaatgtgggcaacaacctgttgtcgaaaaatgtgagaccatccacgtggccatcgtttgcgctggatacaacgcgagcagagacgtcgtgactcttgtgaaatcagtgctgtttcatagaaggaacccactccacttccatctaatcgctgactcaattgcggagcaaatcctcgctacactctttcaaacatggatggtgcctgccgtgcgagttgatttttacaatgccgacgagctcaagtctgaagttagttggattccgaataagcattactctgggatctacggcctcatgaagctcgtgctgacaaagacactgccagctaacctggaaagggttatcgttctggatactgacattactttcgctacagacatcgcggaactgtgggcagtgttccataagtttaaaggtcagcaggtgctgggtcttgtcgagaaccagagtgattggtacctcggaaacttatggaaaaatcatagaccatggccagcattaggcaggggctacaatactggggtgatcctgttgctgttggacaagctcagaaagatgaagtgggagcagatgtggcggttgacggccgagcgggagcttatgggtatgctctccacgtcattagccgatcaggatatattcaatgcggtgataaagcagaatccattcctagtttaccagctgccctgcttttggaatgtgcagctgtccgatcacactaggagcgagcagtgttatagagacgtcagtgatttaaaggtgatacactggaattcccctaaaaaactgcgcgtgaagaataaacatgtagagttctttcgtaatttatatctgacattcctggaatatgatggtaatctcttaagaagggaactgtttggctgcccctccgaagctgatgtaaattcagaaaacctgcagaaacagctgtcagagcttgacgaggacgatctttgttacgaatttcgccgcgagaggtttaccgttcaccgcactcacttgtatttcttgcactacgagtacgagcccgcggccgatagcacagatgtcacccttgtcgctcaactgagcatggacagacttcagatgctcgaagccatttgcaaacattgggaagggcccatatccttggctctctatctgtccgatgcggaagcacagcagttcctgcggtatgcacaagggagtgaggtgctcatgtcgaggcataacgtcggctatcatattgtgtataaagagggtcaattttatccggtcaatctgctacggaacgtggcaatgaaacatataagcactccatacatgttcttgagtgacatagacttccttcctatgtacggcttgtacgaatacctgcggtaccatgtctggactaagggtcacgcgcccaccaacttcgccaaatggaggaccgctactacaccgtacagggtagaatgggaggcagatttcgagccctacgtcgtcgttcgacgggactgccccgagtatgaccggagatttgtggggtttggatggaacaaggtggctcatattatggaactcgatgtgcaggagtacgaatttatagtgttgcccaacgcttacatgatccatatgccccacgctccatcttttgacatcaccaagtttcggtccaataaacagtatagaatctgcctcaaaaccttaaaggaagagttccaacaggatatgtcacgacgctacgggtttgcggccctgaaatatctcaccgctgagaataacagctag

SEQ ID NO: 193279 - DNA, 1668 bp, Artificial Sequence
  Description of Artificial Sequence: Synthetic coding sequence
atgctgatctggagcgaggtgagctggatccccaacaagcactacagtggcatctatggtctgatgaaactggttcttaccaaaaccctccccgctaacctagaacgtgtaatcgtactcgatacggacataaccttcgccacggatatagcagagttgtgggccgtgttccataagttcaagggtcagcaagtactgggacttgtggaaaatcagtccgactggtatctcggaaacctgtggaaaaatcatcgcccctggccagctctaggtagaggatataataccggtgtaattctgttactgctggacaagcttagaaagatgaagtgggaacagatgtggcgtctcaccgcagagcgagagctgatgggaatgctttctacctcactggctgaccaggatatcttcaatgcagtgataaaacagaatccattcctggtttatcagttaccgtgtttctggaacgtccaactgtcagaccatacccgcagcgagcagtgttatagagatgtttcggatctgaaagtcatccactggaactcaccgaagaaattacgggtaaagaacaagcacgttgaattcttcaggaatctctatctcacttttctggaatatgacgggaacttactgcgccgggaactcttcgggtgtccttctgaagccgacgtgaactcagagaacttgcagaagcagctctccgagcttgatgaagacgacctctgttacgagttcaggagggagagattcactgtacatcggacccacctctattttctccactacgagtacgagccagctgccgactccaccgacgtaacactggtcgcccaacttagtatggaccgcctccagatgctggaggctatatgcaagcattgggaaggcccaatcagcctggccctttacctgtccgacgccgaggcccagcagtttctgagatacgcacaggggagcgaggtcctcatgtcacggcacaatgtgggataccatattgtgtacaaggaaggacagttttatccagtcaacctgctgcgtaatgtcgcaatgaaacacatcagcaccccctatatgttcctgtcagacatcgactttttgccaatgtacgggctctatgagtatctccggaaaagcgtgattcaattggatctggctaacaccaagaaggcgatgatagtccctgcttttgagaccttacgttatcgtttgtcctttccaaagagcaaagctgaactgctctcaatgcttgacatgggaactctgttcacctttaggtatcacgtgtggacaaagggacacgccccaacgaattttgccaaatggagaactgctacaacgccttatcgcgtggaatgggaagcggacttcgagccttatgttgtggtgagacgggactgtcctgaatatgaccggcggttcgtcggattcgggtggaacaaagtggcacacatcatggaactcgacgtgcaagaatacgaattcattgtgctccctaacgcatatatgatccacatgccacatgctcctagcttcgatatcactaagttccgaagcaacaagcagtatcggatctgcctgaaaacgctgaaggaggagttccagcaggacatgagtaggcgctatggcttcgccgctttgaagtacctaactgcggagaacaattcttag

SEQ ID NO: 193280 - DNA, 1098 bp, Artificial Sequence
  Description of Artificial Sequence: Synthetic coding sequence
atggccaaggtggccaaggacctgaaccccggcgtgaagaagatgtccttgggacagttacagagtgcacggggcgtcgcctgtttagggtgcaaagggacttgttctgggttcgagccacatagctggcgcaagatctgtaagagttgtaaatgttcccaggaagaccactgccttacttctgatctcgaggacgatcggaagatcggcaggctcctgatggactccaagtattcgacactcactgccagggtcaaaggcggtgacggtattcggatatataaaaggaataggatgatcatgaccaacccgattgctaccggaaaagaccctactttcgatacaatcacctacgagtgggccccccctggagttacccaaaagctgggattgcaatacatggagctgatccctaaggaaaagcagccagtcaccggcacggagggtgcgttctaccggcggagacagcttatgcaccaactgcctatatatgaccaggacccctcccggtgcagaggcctccttgaaaatgagttaaaattgatggaggaattcgtcaaacaatacaaatctgaggccctgggagtgggcgaagttgcgttacctgggcagggaggtcttccaaaagaagaaggaaagcagcaggagaaacctgaaggcgcagagacgacggccgcaacaacaaacggatctttatcggatccctcaaaggaagtggagtacgtgtgcgagctttgtaagggtgccgcgccgcctgattccccagtagtctacagtgatcgagccggatacaacaagcagtggcacccaacatgcttcgtctgtgcaaaatgtagcgagcccctggtggatcttatctacttctggaaggacggagccccttggtgcggacgtcattactgtgagagtctgagaccgagatgtagcggttgtgacgagatcatatttgcagaggattatcagcgcgtcgaagacctagcttggcatcgcaagcacttcgtctgtgaggggtgtgaacagctgttaagcggccgggcttatatcgtgaccaaaggacagctcttgtgtccaacttgctccaagtccaaacgatcctag

SEQ ID NO: 193281 - DNA, 762 bp, Artificial Sequence
  Description of Artificial Sequence: Synthetic coding sequence
atgttcggcatgcagggcgacgtgttcggcctgcgggccaccttcatggaggggcttcagtacatggagctcattcctaaggagaagcaacctgtaaccggaaccgaaggagccttctatcgtagacggcaattgatgcatcagctgccaatttacgaccaggatccctccaggtgccgtgggctgctggaaaacgaactgaaattaatggaggaatttgtgaagcaatataaaagtgaagccttgggcgtgggtgaggttgcactgcccggacaggggggtctgcccaaggaggaaggcaaacaacaggagaagcccgaaggggcagaaaccaccgccgcgacaactaatgggtcactgtctgacccttcgaaggaggtagagtacgtgtgcgagctctgcaagggtgccgccccccccgattcgccggtcgtgtactccgatcgtgctggttacaataaacagtggcaccccacctgttttgtctgtgcaaagtgcagcgaacccttggtagatctgatctatttttggaaagacggcgccccttggtgtggacggcactactgcgagagcctccgcccacggtgcagcggatgtgacgagattattttcgccgaggattaccagcgtgtggaagatctggcgtggcaccggaagcacttcgtgtgcgaagggtgtgagcagctgctatctggacgggcatatattgtcactaaggggcagctgctttgcccaacatgtagcaaatctaaacgtagctag

SEQ ID NO: 193282 - DNA, 879 bp, Artificial Sequence
  Description of Artificial Sequence: Synthetic coding sequence
atggacagcaagtacagcaccctgaccgcccgggtgaagggcggcgatggtatcaggatttacaagagaaacaggatgattatgactaaccccattgccaccggaaaagatcccactttcgacaccataacctatgaatgggcaccccctggagtcacacagaagttagggctacagtacatggagttgatacccaaagagaagcagcccgtgaccggaactgagggagctttttacagaaggcgacaacttatgcaccagttgcccatatacgatcaagatccaagtagatgtcgaggcttgctagagaatgaactgaagctaatggaagaattcgtgaaacagtacaaaagtgaggctttgggcgtcggcgaagtggcccttccaggtcaaggtggcctccccaaggaagagggaaaacaacaggagaaaccagagggggccgagacaacagccgccacaacaaacgggtccttgagtgacccgagtaaagaagtagaatacgtgtgcgaattatgtaagggagctgctccaccagactcacctgtcgtgtacagcgatagggccggttacaataagcaatggcaccccacctgttttgtctgtgcaaagtgcagtgaacccctcgtggacctaatctacttctggaaggacggggcgccatggtgcggccggcattattgtgaatcgctgaggcctcgctgctcaggctgtgacgaaattatcttcgccgaggattaccagagagtggaggacctggcctggcatcggaagcacttcgtctgtgaagggtgcgagcagctcctgtctggcagagcgtacatcgttacgaaaggacagctattatgccctacctgcagcaaatcaaagcggagctag

SEQ ID NO: 193283 - DNA, 744 bp, Artificial Sequence
  Description of Artificial Sequence: Synthetic coding sequence
atggccaaggtggccaaggacctgaaccccggcgtgaagaagatgagtctagggcagctacagtcagcacgaggcgtcgcatgtctggggtgcaagggcacttgttccggttttgagcctcactcatggcggaagatttgtaaaagttgtaaatgctcacaagaagaccactgccttactagcgatctcgaagatgatagaaagattggacggctcctgatggacagcaagtattctacgctaaccgccagagttaagggcggtgatggaatcagaatttacaaaaggaacaggatgataatgactaatcccatagcaacaggaaaggaccctaccttcgacacgattacctacgagtgggcccccccaggagtgacccagaagctgggacttcaatacatggagctgattccaaaggaaaaacagccagtgacgggcacggaaggcgccttctaccggcgtcgacagctgatgcaccagctccctatttatgaccaggacccctcccgatgcagaggactgttggagaatgagctcaagctgatggaagaattcgttaaacagtacaaatccgaagcgctcggtgtgggtgaagtcgccctcccaggccaaggcggactgcctaaggaggagggaaaacagcaggagaagcccgagggcgcggaaactaccgctgctaccacaaatggaagcctcagcgatccctccaaggaggttgagtacaagcccgttccactagtatag

SEQ ID NO: 193284 - DNA, 786 bp, Artificial Sequence
  Description of Artificial Sequence: Synthetic coding sequence
atgaaccccaactgcgcccggtgcggcaagatcgtgtaccccaccgagaaggtgaattgcctggacaagttttggcacaaggcttgcttccactgcgagacttgcaagatgaccctaaacatgaaaaactacaaaggatatgagaaaaagccgtactgtaatgcgcactaccctaagcagagctttaccatggttgccgacactcccgaaaatctccggctcaaacagcagagtgagctgcagagtcaggtgcgatataaagaagagtttgagaaaaataagggcaaaggcttttcggtcgtggctgatacacccgagttgcagagaatcaaaaaaacacaagatcaaatatctaatataaagtatcacgaggaattcgaaaagtcaaggatgggaccgtctgggggcgagggcatggaacccgaaagacgcgactctcaggacggcagcagctataggaggcctttagaacagcaacagccacaccatatacctacatctgccccagtctatcagcaaccacagcagcagcccgtcgctcagtcatatggcggctataaggagcccgccgcgccagtgtcaatccagaggtccgcaccaggcgggggcggaaagagataccgggctgtctacgattatagcgccgcagacgaggatgaggtatctttccaggacggcgataccattgttaatgtccagcaaatcgatgacggctggatgtatggaactgtggagaggacaggcgatacaggtatgctgccggccaactatgtcgaggccatctag

SEQ ID NO: 193285 - DNA, 501 bp, Artificial Sequence
  Description of Artificial Sequence: Synthetic coding sequence
atgaccctgaacatgaagaactacaagggctacgagaagaagccctattgcaacgctcactaccccaaacagagctttaccatggtggccgacaccccagaaaatcttcgactcaagcagcagagtgaactgcagagtcaggtgagatataaggaggaatttgaaaaaaacaagggtaagggcttctcagtggtcgccgatacgccagaactccagaggatcaagaaaacacaggatcagatttccaacattaagtaccacgaggagtttgagaagagtaggatgggtccctcaggtggggaaggcatggagccagagagacgcgactcccaagatggctcttcctatcggcgacccctggaacagcagcagccccatcacattccgacaagcgctcctgtgtaccagcaacctcagcaacaacccgtagcacagtcttacggtggctacaaggaaccggcagcgcctgtaagtattcagagaagcgcaccgggagggtag

SEQ ID NO: 193286 - DNA, 618 bp, Artificial Sequence
  Description of Artificial Sequence: Synthetic coding sequence
atgctgcccctgcgggacctgcaggacgacaccgagcacgaggagttacaaggactgcgggaggaagccctcctccaacgggtgaggtacaaagaggaatttgaaaaaaacaaaggtaaggggtttagcgtcgtcgcggacacgcctgagctacagaggattaaaaaaacccaagaccagatctcaaacatcaagtatcacgaggaatttgagaaaagtagaatgggaccaagtggtggcgaaggtatggaaccagagaggcgcgactcgcaggacggatcaagctaccgtagacctctggagcaacagcagcctcaccacatccctacttccgctcctgtgtaccagcaaccccagcagcagcctgttgcccagtcatacggcggttacaaggaacccgccgccccagtcagcatccagagatcagcgcctggcggcgggggtaagcgctatcgcgccgtatacgactacagtgcggcggacgaagacgaagtaagctttcaggacggagatacgattgtcaacgtgcagcagattgacgatggctggatgtatggaacggtcgagcggactggcgacaccggcatgctgccagctaattatgtggaggctatctag

SEQ ID NO: 193287 - DNA, 786 bp, Artificial Sequence
  Description of Artificial Sequence: Synthetic coding sequence
atgaaccccaactgcgcccggtgcggcaagatcgtgtaccccaccgaaaaagtgaattgccttgataagttctggcacaaagcttgcttccactgcgagacgtgtaagatgaccttgaacatgaaaaactataaaggttatgaaaaaaaaccatattgtaacgctcactatcccaagcagtcctttacaatggttgcggacacacccgagaacctgcggcttaagcagcaatccgaacttcagagccaggttcgttataaagaggagttcgagaagaacaagggaaaaggtttcagtgttgtcgccgacacccctgagttgcagcggattaaaaaaacccaggaccagatcagcaacataaaataccacgaggaatttgagaagtcccgaatggggcccagtggcggagaggggatggaacccgagcgccgcgacagtcaggacgggtctagctatagacgaccactggagcagcaacaacctcaccatatcccaacatcagcacccgtatatcagcaacctcaacagcagcctgttgctcagagttacggcgggtataaagaaccggccgcccccgtgagcatccaacgaagcgcgccagggggagggggtaaacgatatcgcgctgtgtacgactatagtgccgcggatgaggatgaggtttcatttcaggacggagacacgatcgttaatgtccagcagatagatgatggatggatgtatggcacagtcgaaagaaccggcgacacaggcatgctgcccgcaaactatgtcgaagcgatctag

SEQ ID NO: 193288 - DNA, 378 bp, Artificial Sequence
  Description of Artificial Sequence: Synthetic coding sequence
atgaaccccaactgcgcccggtgcggcaagatcgtgtaccccaccgagaaagtgaattgtctggacaagttttggcacaaagcctgtttccactgtgagacatgcaagatgacactgaatatgaaaaattacaaaggctacgaaaaaaaaccttactgcaacgctcactacccgaagcaaagttttacaatggtcgcggatacgccggagaaccttcgactgaaacagcagagcgagttgcagagtcaggtgagatacaaagaggaatttgagaagaacaagggaaagggcttctccgtggtagctgacacacctgagttgcagagaagcagcctggggttcctctggaacgagatccccccatccccacacttatag

SEQ ID NO: 193289 - DNA, 4050 bp, Artificial Sequence
  Description of Artificial Sequence: Synthetic coding sequence
atgaagaagatccggatctgccacatcttcaccttctacagctggatgtcctatgatgtcctgtttcagcggaccgagttgggggcactggagatctggagacaattgatatgtgcccatgtgtgcatctgcgtcggttggttgtatctaagggatcgcgtgtgttcaaagaaagacatcatcctacggaccgagcagaacagcggcaggaccatcttaataaaagccgtcaccgagaagaattttgaaactaaagatttccgagccagcctcgaaaatggggtcctgctatgtgatctgattaacaaactgaagccaggggtgattaaaaaaattaatagactgagtacccctatcgcaggactggataacatcaacgtgttcctgaaagcctgcgagcagataggcctcaaggaggcccagctgtttcatccaggtgatctccaggatctttccaatcgggtcaccgtgaaacaggaggagacagaccgcagagttaaaaacgtgctgattacgctgtattggttaggccgcaaggctcagtctaacccatactataacggccctcacctgaacctcaaggcttttgagaacctgctgggccaagccttgacaaaggccctggaggactcctcgttcttgaaacgctcgggacgtgattcaggttatggcgacatttggtgccccgaacgcggagagtttctggctcctcctcggcaccacaaacgcgaggatagcttcgagagcctcgatagccttggatccagatcactcacctcctgttcgtccgatattacactccgggggggacgcgagggcttcgagtccgacacggattctgaatttacttttaagatgcaggattataacaaggacgacatgtcttatcggcggatctcggccgttgagcccaagaccgcgctgccattcaaccggttcctcccaaacaagagtcggcagccttcctacgtgccggcccctctcaggaagaagaagcccgataaacatgaagataaccgtaggagctgggcgagccctgtctataccgaggccgacggcactttttcgcggctgttccagaaaatttacggagaaaatgggtctaagagcatgtccgacgtgtccgccgaagatgtgcagaacctgcgtcaactgcggtacgaagaaatgcagaagattaaatctcagctgaaggagcaggaccagaaatggcaggatgacctagcgaagtggaaagacagacggaaatcgtacacctcggacttgcaaaagaagaaggaggaacgcgaagagatcgaaaaacaggcgctggagaaatccaaaagatcctcaaagacgtttaaagagatgcttcaggacagagaatctcagaaccaaaagtccactgttcctagtcgacggcgaatgtactcttttgacgacgtgctcgaagaaggaaaaagacctccaactatgaccgtctctgaggcctcataccagtccgagagggtcgaggagaagggagccacttacccttccgaaattcctaaggaggacagcaccacgttcgccaagagagaggacagggtgactaccgagattcaacttccaagccagtcccccgtcgaagagcagagtcctgccagtctgagttctttgagatcacgatccactcagatggaaagcactagagtgagtgccagtctccctagaagctatcgaaagacagacactgtgcgtctgacaagcgtggttacacccagaccttttgggagccagacccgggggatcagttccttgccacggtcctatactatggacgacgcctggaagtataatggcgatgtggaagatatcaaacgcacgcccaataatgttgtctctacccctgcaccctcccctgatgctagccagttagcctctagcctatccagccaaaaggaggtagccgcaacagaggaggatgtcacgcgcttgccaagccccacctctcctttttctagcctgagccaagaccaggctgccaccagtaaagccacactttccagtaccagcggcctagatctgatgtccgaaagcggggaaggggaaatttcaccccagcgcgaggtctcgcgctcgcaggatcagttttcagacatgcggatatcgataaaccagacgcccggtaaatcgctcgacttcggctttacaattaagtgggatatccccggcattttcgtcgcctctgtcgaagctggttccccggctgagttttctcagttacaggtggacgacgagattattgcgattaataataccaagttcagctataacgacagcaaggagtgggaagaggcgatggccaaagcacaagagacaggacatcttgttatggacgtgagacgctatggtaaagcggggtcccccgagaccaaatggattgatgcaactagcggcatctataattcagaaaagtcttctaacttatcagtaaccaccgatttcagtgaaagcttgcagagcagcaatatcgagtcgaaggagatcaacggcatccacgatgagtccaacgccttcgaatctaaggcatcggaaagcatctccttgaagaatctgaagcggcgttcacagttcttcgaacaggggtccagcgatagtgttgtgcctgacctgccggttcccaccatcagcgccccaagtcggtgggtctgggaccaggaagaagaaaggaagcggcaggagagatggcaaaaggagcaagatcgcctgttgcaggagaaatatcagagagaacaggagaaactaagggaggagtggcagagagccaaacaggaagctgagcgggagaactcgaaataccttgatgaagagttgatggtactgtctagcaactcaatgagtctgaccacaagagagcccagcctggcaacttgggaggctacatggtctgagggatctaagtcttctgaccgggaaggaacgagggccggtgaagaggaacggagacagccccaggaggaggtagtgcatgaagatcaggggaagaagccccaggatcagctggtgatagagcgcgaacgaaaatgggagcagcaactgcaagaggagcaggaacaaaagcggctgcaggcggaggccgaggaacagaaacggccagcagaagagcagaaaagacaagccgaaatcgagcgagaaactagtgtgagaatctatcaataccgaagaccggtcgactcatacgacatccccaagacagaggaggccagctctggatttttgccgggcgatcgaaacaagtctcgttccactacggagctggatgactactccacaaataagaacggcaataataaataccttgatcagatagggaacatgacatcttctcagaggcggagcaagaaagagcaggtgccatccggcgccgagctagagcgacaacagatccttcaggaaatgcggaagagaacacccctgcataacgacaacagctggattaggcagaggagtgcaagcgtcaacaaagagcctgtgtcactccccgggatcatgcgcagaggcgaatcactcgacaacctggactccccacggtcaaatagttggcggcagcctccttggctgaatcagcctaccgggttttacgccagcagctccgtgcaggatttctcacggccgccgccccagctagttagcacctctaaccgggcttatatgcgcaatccttcttcctctgtgccaccaccatccgccggctcagtgaagacctccacaacaggggttgccacaacacaatctcccaccccccggtctcattctccgtctgcgtcgcagtccggctctcagctgcgtaaccgaagcgtgtctggcaaacggatctgctcatactgcaacaatatcctgggcaagggagcagcaatgattattgaaagcctaggattgtgttaccatctgcattgctttaagtgtgtcgcttgtgaatgtgatttaggcggttccagcagcggcgcggaggtaagaataaggaatcaccagctatattgtaatgactgctacttgcgatttaagtccggtcgcccaaccgcaatgtag

SEQ ID NO: 193290 - DNA, 5013 bp, Artificial Sequence
  Description of Artificial Sequence: Synthetic coding sequence
atgaagaagatccggatctgccacatcttcaccttctacagctggatgagctacgatgtgctgttccagcggacagagctcggtgcactcgagatatggaggcagctgatttgcgctcacgtgtgcatttgtgtgggctggctgtacctgcgcgacagagtatgtagcaagaaagatattattctcaggactgagcagaactcaggtcgaacaatcctcatcaaggctgtgaccgaaaaaaactttgaaactaaagacttccgtgcctccttggagaatggcgtgctcctgtgcgacctcataaacaaacttaagccaggggtgataaagaaaatcaacagactctcaacaccaattgctgggctggacaacattaatgtattcctcaaagcctgcgaacagatagggttaaaggaggcgcagctctttcacccaggggatctccaggacctgagtaatagagtcacagtaaagcaggaggaaacagaccggagggtaaagaatgtgcttattactttgtattggctgggaagaaaggcccagtccaacccctactataatggcccacatctgaacctcaaggcctttgagaacctgctcggtcaagctttaaccaaagctttagaagatagtagtttccttaagcggtctgggcgggattccggttatggagacatttggtgtcccgagcggggagaattcttagcgccgccccgacaccacaagagggaggacagctttgaaagcctggactctctgggcagccgctccctgacctcctgctcatccgatattacactgcgcggtgggcgggagggatttgagagtgacacagactccgagtttactttcaagatgcaggattataataaggatgacatgtcctatcgaaggattagcgccgtggaacccaaaaccgcgctcccgttcaacaggttcctccctaacaagtcgagacagccctcatacgtacccgcccctctgcgtaaaaaaaagcccgataaacacgaagataatcgcagatcctgggcgtcccccgtttatacagaagcagatggtacatttagctcaaaccaacgccgcatttggggcacaaatgtggaaaattggcccaccgtgcagggaacctctaagtcctcttgctaccttgaggaggagaaagccaagacacgctcaataccgaacatagtgaaggacgatttgtacgttcgcaaacttagtccggtgatgcctaacccgggaaatgcgttcgaccaatttctgcccaagtgttggacccccgaggacgtaaactggaaacggattaaaagggagacctataagccctggtacaaggagttccagggttttagccaatttttactcctgcaggcacttcagacctactccgatgatatcttgtcgtcagaaactcatactaagatagaccctaccagtggcccccgcttgattacaaggaggaagaacctttcttacgctccaggctatcgccgcgacgacctggagatggccgcgctagatcctgacttagaaaacgacgactttttcgttcgtaagacaggagcattccatgccaacccatatgttctgcgggcctttgaagacttccgcaagttcagtgaacaggatgatagcgtggaacgagatattattctgcagtgtcgggagggcgaactggtgttgccagatctagaaaaggacgatatgatagtgcggcgcatccccgcccagaagaaggaggtgcccttgtccggcgcaccagaccggtaccaccccgtgcctttccccgagccttggacactgccgcctgagattcaagccaaatttttatgtgtcttggagagaacctgtccatctaaggaaaaatcgaacagctgtaggatcttagtgccatcataccggcaaaagaaggacgacatgctaaccagaaagatccagagttggaagctgggaaccaccgtacccccaattagcttcacacctggcccctgtagtgaagccgatttgaaacggtgggaggcaatccgagaggcctccagattgcggcacaaaaaaaggctaatggtggaacgcctatttcaaaagatctacggggagaatgggtctaagtccatgtccgacgtctccgcagaggacgtgcagaatctcaggcagctcaggtatgaggaaatgcagaagataaaaagtcaattgaaagaacaggatcagaaatggcaggatgacctggccaaatggaaggataggcgaaaatcatatacctctgacctgcagaaaaagaaggaggagcgtgaggaaattgagaagcaggcattggaaaaatccaagaggagctctaagacctttaaggaaatgctgcaggaccgggagtctcagaatcagaaaagcaccgtgccaagtcggaggcgtatgtactccttcgatgatgtcctggaggagggaaagcgaccgcccactatgacagtttcagaggcttcgtaccagtctgaacgagtggaagaaaagggcgcaacgtatcctagtgagattcccaaggaggattccacaaccttcgccaagagggaggatcgcgtgactaccgaaattcaactccctagccagagccctgtagaagagcagtcccctgcctctctttcaagtctgagatctaggagtactcagatggagtcgacgcgcgtatcagcctctctgcccagatcctaccggaaaaccgatactgttcggctgacatccgtggtaactccgaggccgtttgggagccagactcgggggatttcatccctgccaaggagctacactatggatgatgcttggaagtataacggcgacgtcgaagatattaaaagaactccgaacaacgtcgtatctactccggctccttcccctgacgcaagtcagttagcctcctctctgtcgagccagaaggaagtggccgctactgaggaggacgtcacccgcctcccttctcctacttcacctttctcgtctttgtcgcaggatcaggctgcaacaagcaaggccactctgagcagcacgtcgggcctagatctgatgagcgagagtggtgagggggaaattagccctcaacgagaggtatcgcgttcccaagaccagttcagcgacatgcggatctctattaatcaaactccgggcaagagcttggattttggttttacaatcaagtgggatattcctggtatctttgtggctagtgtggaggccggtagcccggccgaattttcccagttacaggtggacgacgaaattattgctattaacaacactaagttctcctacaacgacagcaaagagtgggaagaggctatggccaaggcccaggagactggacacttagtcatggacgtgaggaggtacggcaaggccggctctccagagacgaagtggatcgatgcgacatcaggtatttataacagcgaaaagtcttctaacctgagtgttacaacggacttttccgaatccctccagtcttctaacatcgagtcaaaggagattaatgggattcacgacgaatccaatgcctttgaatccaaggcgagcgagagcattagtctgaaaaatcttaagagaagaagccagttttttgaacaggggtcttccgacagtgtggtccccgatctgccggtgccaacaatttccgcccctagcaggtgggtgtgggatcaggaagaggaacggaagcgccaggaacgatggcaaaaggagcaggacaggctattgcaagagaagtatcagagagagcaggagaaactccgagaagaatggcagcgcgccaaacaagaagcagaaagggagaactccaagtacctggatgaggaattgatggtgctgtccagtaacagtatgagtttgacaacgagagaacccagtctggcaacatgggaagccacatggagcgagggctcaaagagctcagaccgtgagggaactcgggccggtgaggaagaaaggcgacagccccaagaagaagtggttcatgaagaccaggggaaaaagcctcaggaccagcttgtgatcgaaagggaaaggaagtgggagcagcagctgcaggaggaacaagagcagaagcggctgcaggccgaagccgaggaacaaaagcgaccggctgaagaacagaagcgtcaggcagagatcgagcgagagacgtccgttaggatttaccagtatcgacggcccgtggatagctacgacattcctaaaactgaagaggccagctctgggttcctgcctggggaccggaacaagtcacggtctaccacggagctggacgactactctaccaacaagaatggcaacaataagtacctcgaccagattggaaacatgacttcgagtcagcggcggtccaaaaaagagcaggtccccagcggcgcagagctcgagcggcaacaaatcttacaagaaatgagaaagagaaccccactccacaatgacaactcatggatacgtcaaaggtcagctagtgttaataaggaaccagtgtcattacctgggatcatgagacggggagaatccctggataacctggattcccctcggtctaattcgtggcgtcaacccccttggttaaaccagccgacaggcttctacgcctcttcctctgtccaggacttctcacggccacctcctcagttagtctcgactagtaacagagcatacatgcggaacccttcctcctcagtgcctccccccagtgctggatctgtgaaaactagcactactggcgtggccacaactcagtctcccactccaaggagtcactcgccaagcgcaagtcagtctggctcacagctgaggaacagtgtgttgccggtgagcgtgacttcagaagcattgccccaggaacttaagtcaggtagcgaaaccacaaactgtaccgctaccacggccatcagcgattctaacctggatggacagcctccttgcgatgtatccctccataccaaggccctcctgcagatcgaggaggaggtggtagccgctcatgtagacctctag

SEQ ID NO: 193291 - DNA, 4845 bp, Artificial Sequence
  Description of Artificial Sequence: Synthetic coding sequence
atgaagaagatccggatctgccacatcttcaccttctacagctggatgtcctatgatgtactcttccaaaggaccgaactaggcgcactggagatttggcggcagttgatctgtgctcacgtttgtatctgcgtaggctggctttacttaagagaccgagtttgttctaaaaaagacatcatcctcaggactgagcaaaactctgggcgcacaatactgattaaggccgtgaccgagaaaaattttgagaccaaagactttcgggcctcgctggaaaacggagtgttgctttgtgacctgattaataagctgaaaccaggagtcattaaaaaaatcaatagattgagcacaccaattgctggcctcgacaacatcaacgtattcttgaaagcctgcgagcagattgggctgaaagaggcccaactctttcacccaggtgacctccaggatttgtccaacagagtgaccgtgaaacaagaggagaccgatcgccgcgtgaaaaatgttctgattacactgtactggctgggaagaaaagcccagagcaatccctactataacggcccccatcttaacctcaaggcgtttgaaaatcttcttggccaggctcttacaaaagccctggaggattcctctttcctgaagcgctcaggccgggactcaggctacggtgatatctggtgtccagagcgaggagagtttcttgccccacctcgtcaccacaaaagagaggattctttcgagagcctagactctctgggttctcgttctcttacaagctgctccagcgacattacactcagaggaggccgggagggatttgaaagcgataccgatagcgaattcaccttcaaaatgcaggattacaacaaggatgacatgtcatatcgaaggatcagtgccgttgaacctaagacagccttaccgttcaaccggttcctgcctaataagtcccggcagccatcctatgtgcctgccccgctgcgcaaaaaaaagcctgacaaacacgaggataaccggcggtcctgggcctctccagtgtacaccgaggccgatggcacgttctcctccaatcagagaagaatttgggggacaaacgttgaaaactggccaacggtccaggggacctccaagtcttcatgctatttggaggaagagaaggcaaagacaaggtccattcccaatattgtcaaagacgatctgtacgtgaggaagctgagcccagtgatgcctaatcccggaaatgccttcgaccaattcttaccgaaatgctggacaccagaggatgtgaattggaagagaatcaagagggagacgtataaaccttggtataaggagtttcagggcttttctcagttcctgctgttacaggccctccagacttacagcgatgacatcctgtcgtcagaaacgcacaccaaaatagaccccacctcaggtccccgcttgataacgaggagaaagaacctgagctatgccccgggttaccgccgggatgacctagagatggctgctcttgaccccgatctagagaatgatgacttttttgtccggaagacaggagctttccatgcaaacccgtatgtgttgcgggcttttgaggacttccgcaagtttagtgagcaggatgacagcgtcgagcgagacattatccttcagtgcagagagggtgagctggtcttacctgatttggaaaaggatgatatgattgtgagaaggatccccgctcagaaaaaggaggtgcccctatccggcgcaccggacagataccacccagtccccttccccgaaccgtggaccctccctcccgagattcaggccaaatttctatgtgtcctcgagcgaacttgtccatctaaagaaaaatccaactcctgcaggatactagtgccttcttaccggcaaaagaaggacgacatgttgactaggaaaatccagagttggaagctcggcacaacggtcccccccatctcctttactcctgggccatgcagtgaggctgacctcaaaaggtgggaagctatcagagaggcatcgagattgaggcacaaaaagagacttatggtcgaaaggttgttccagaagatatacggagagaacggatcaaaatccatgagcgacgtgtccgccgaagacgtacagaacttgcgacagctgcgctacgaggaaatgcagaaaattaaaagccagttgaaggagcaggaccagaagtggcaagacgacttagcaaagtggaaagaccgaaggaagtcttatacatcagatcttcagaagaagaaagaggagcgagaagaaattgaaaaacaagccctggagaagtcaaagcgaagtagtaaaacctttaaggaaatgctccaggatagggagtctcagaatcagaagtctactgttccctcaagacggcgaatgtactcattcgacgatgtgctggaggaaggcaaaaggccccctacaatgactgtaagtgaggcttcctaccagtctgaaagagtggaggagaaaggagctacataccccagcgagattcccaaagaggactctactacctttgccaagcgagaagatcgcgtcaccacagagattcagcttcctagccagagccccgtagaggaacagtcacctgccagtcttagctcacttcgctcccgatccacacagatggaatccaccagggtgtccgcttctcttccccgcagctatagaaagactgataccgtgcgcctgaccagtgtagtgactccaaggccctttggaagtcagacccgcggaatcagtagcctgcctcgaagttatacgatggatgacgcatggaaatacaatggtgatgtagaagatattaaacgaacaccaaataatgttgtgtcaacccccgccccttctccagacgcatcgcagttggcaagcagcctgtctagccaaaaagaagttgccgcaaccgaagaagacgtcacgcggttgccttctcctacatcaccgttctcatccttgtctcaagatcaagcagccacctctaaagctacactgagtagcacatccgggctggacttgatgagcgagtcaggggagggcgagatttccccacaacgagaagtatctcgcagccaggaccagttttccgacatgcgcatcagcatcaatcagacccctggcaagagtctagactttgggttcaccataaagtgggacattcccggtatattcgtggcaagtgttgaggccggttcaccagcagaattctcccagctccaggtagacgatgaaattattgccataaacaatactaaattttcgtacaacgatagcaaggagtgggaggaggcaatggccaaagcgcaagagaccgggcaccttgtgatggacgtacgacgctatgggaaggctggtagcccggagactaagtggatcgatgccactagtggaatttacaactccgaaaagtcgtctaacctctcagtcacaaccgacttctctgagagcttgcagtcatctaatatcgaaagtaaggaaatcaacgggatccatgacgagtccaatgccttcgagagtaaagcctcagagtccatttctctgaagaacctaaagcgtaggtcacagttctttgagcagggttccagtgactctgtggtcccagatctgccagttcccaccatctcggcccccagtaggtgggtgtgggatcaggaggaagaaaggaaacgccaggaaagatggcagaaggagcaggaccgactgctccaggaaaagtaccagagagagcaggagaagctgcgcgaagaatggcaaagggcgaaacaggaagcagagcgagagaactcaaaatatctggatgaggagctaatggtgctctcctccaacagcatgtcactgactactcgggaaccatccctcgcaacctgggaggctacgtggagtgagggttctaagagctctgatagagagggtacaagagctggcgaagaggagcggcgtcagccccaggaggaggtggttcacgaagatcagggcaagaagccacaggatcagttagtaatcgagcgagaaaggaaatgggagcaacagttgcaggaagaacaggagcaaaaacgcctgcaggctgaagcggaggaacagaaacggcccgctgaggaacagaaacggcaagcagaaatagagcgcgaaacctctgtgcggatctaccagtaccggagacccgtggactcatacgatatccccaagactgaagaagcatcctctgggttcctgcccggagaccgaaacaagtctaggtccaccacagagcttgacgactacagcactaacaagaatgggaacaacaaatacttggaccagatcgggaatatgacctcatcccaaaggcgcagtaagaaagaacaggttccctctggcgcggaactggaaagacagcagatcctacaagagatgcgcaaaagaactccgctgcacaacgacaattcatggattcgccagagaagcgcatctgtcaacaaggagccagtgagcctcccaggaatcatgaggcggggggaatctctagacaatctcgattctccaaggagtaactcctggaggcaacctccctggctgaatcagcctacgggattctacgcttcaagctcggtgcaggatttttccaggcccccacctcagctcgtgagcacatcgaatagggcgtacatgcgcaatccttcaagttccgtgcccccccccagtgcaggctcggtaaaaaccagtaccacgggcgtcgccacgacacagtctccaacgccacgcagtcactcaccgtctgcttcacagtccgggtctcaactgcgcaacagctggactgcgaaccgtcacgtcatgtag

SEQ ID NO: 193292 - DNA, 4158 bp, Artificial Sequence
  Description of Artificial Sequence: Synthetic coding sequence
atgcaggactacaacaaggacgacatgagctaccggcggatcagcgccgtagaacctaaaacggccctccctttcaaccgttttctgcctaacaagtctcgccagccatcatatgttcccgccccactcagaaagaagaagcctgacaagcatgaggataaccgtaggtcttgggcctccccagtgtacacggaggctgacggcacattcagctctaatcaaaggagaatttgggggaccaacgtagagaattggccaacagtgcagggtacatccaaaagctcttgctacttagaggaggaaaaggcgaaaacgcggtcaatacctaacattgtgaaggatgacctgtatgtgagaaagcttagccctgtgatgcccaaccctggaaacgcctttgaccagttcctccccaagtgctggacacccgaggatgttaattggaaacggattaagagagagacctataagccatggtataaggagttccaaggcttctcacagttcctccttctacaggctctgcaaacctactccgacgacattctgagctctgagactcatacaaagatcgatcctacctcaggcccaaggttgatcacgcggaggaagaacctgtcatacgctcctggatacaggcgggatgacttggaaatggccgccttggatcctgatctcgagaacgatgatttctttgtgcggaagaccggggcttttcatgccaacccttacgtcttacgagcttttgaggactttaggaaattctctgaacaggatgatagcgtcgaacgagacataatcctgcagtgccgggagggagaactcgtcctgcccgacctcgagaaagatgatatgattgtgcggcgcattccagcacaaaaaaaagaggtgccattgtctggggcgccagacagataccaccctgtgcctttccccgagccatggacactgccgccggagatacaggccaagtttctgtgcgtgttggagcgaacgtgcccttcaaaagaaaagagcaatagctgcagaatcttggtaccctcttacagacagaaaaaggatgacatgctgaccaggaaaatccagagttggaaactggggacgacggtgccacctatctcatttaccccaggaccatgttcagaggccgacctgaagagatgggaagccatcagagaggcatccagactgagacataaaaaaaggttaatggtggagcgcctttttcagaagatctatggggaaaatggctcaaaatctatgtccgacgtgtccgccgaggatgtccagaacctgaggcagctgcgctacgaggaaatgcagaaaattaagagtcagctgaaggaacaggaccagaaatggcaagatgacctggcaaaatggaaggaccgccgcaaatcctacacctctgatctgcagaaaaagaaagaggaacgcgaggagattgaaaaacaggctctggagaaatccaagagaagctccaagacctttaaagaaatgttgcaggacagggagagccagaatcagaagagcaccgtgccgtccagacgcagaatgtacagctttgatgacgtgctggaggaggggaagaggccccctaccatgaccgtctctgaagctagttatcagagtgaacgagtagaagaaaagggagcgacatacccatccgagattcccaaggaggactctactacttttgctaagagagaggatcgagtgacgacagagatccaattacctagccagagtccagtcgaagaacaaagtcccgccagcctgtcttctctccgctctaggagtacacaaatggagagcactagagtgtcagcctccctaccccggtcttataggaaaacagacacagtgcgactgacatccgtagtaaccccacggccatttggctcacagactagagggatctcgagcctaccgcgatcatatacaatggatgacgcctggaagtataatggcgacgttgaagacataaaaaggacccctaacaatgtggttagcactcctgctccctctccagacgcgtctcagttagcctcatcgttatcgtctcagaaggaagtagccgctaccgaggaggatgtcacccgactgccatctccgactagcccgttttcttccctgagccaggaccaggctgctacatcaaaggcaacgttatccagtacttcaggcttagacctgatgtccgaaagtggcgagggcgagatcagcccccagcgggaggtgtcaaggtcacaggaccagttttccgatatgcggatctctattaaccagacccccggtaaatccctggattttggattcaccatcaaatgggacatcccgggaatttttgttgctagtgtggaggctggctctcccgccgagtttagtcagctgcaagtggatgatgagatcattgccattaataatacgaagtttagctacaacgattcaaaggagtgggaggaggcaatggctaaggcccaggagactggccatctggtcatggacgttcgtcggtacgggaaagcaggcagtccagagaccaaatggatagatgccacttccggcatctataattccgaaaaatcctctaacctcagtgtcacaacagatttttctgaatccctccagtcctcaaacatcgagagtaaagaaatcaatggaatccatgatgaatccaacgctttcgagagcaaggcctccgagtcaatttcgttgaaaaatcttaaacgtcgaagccagttctttgagcaaggctcaagcgactcagtggttccagatttgccagtccctacgatttcggcccccagtcgatgggtttgggaccaggaggaagaacgcaaaaggcaagagagatggcaaaaggagcaggatcgcttgttacaggagaagtaccaacgggaacaggaaaaattgagggaggagtggcagcgggctaagcaggaggcagagagagaaaatagcaagtatttggatgaggagctgatggtactgagttcaaattccatgtccctcacaactagggagccgtccctcgcaacctgggaggcaacctggtccgaaggcagcaaaagctctgatcgggaggggacccgggctggcgaggaggagcggcgccagcctcaggaggaggtggtccatgaagaccaagggaagaagccccaagatcagttggtcatcgaaagagagaggaagtgggaacagcaactgcaggaggagcaggagcaaaaacgcctgcaagcggaggctgaagaacaaaagagacccgctgaagaacaaaagagacaggccgagattgagagagagaccagtgtccgtatatatcagtatcggcgcccagtcgactcctatgatattccaaaaacagaagaggcttcgtcaggctttctgcctggcgatcgtaacaaaagcaggagtacaacagagctcgatgattattccacaaacaagaatggcaacaataaatatctagaccaaattggcaatatgacgagctctcagaggcgctctaagaaggaacaagtgcctagcggcgctgaacttgagagacagcagatactgcaggaaatgcgcaaacggacaccactgcacaacgacaattcttggatccgccaacgcagtgccagtgtgaataaggaacctgtttcgcttccgggaataatgagaagaggcgagagcctcgataatctggactctcctaggtcgaatagctggcgacagcccccatggcttaatcaacctaccggtttttatgcttctagttctgtgcaggacttctctcgccctccaccacagctggtgtctacctccaatagagcttacatgcggaatcctagcagcagcgtcccgcctccgagtgccgggagcgtgaaaaccagcacaacaggcgtagccacaactcaatcccccaccccccgcagccattccccctcagcgagtcaatctggctctcaactgagaaactcagtcttgcccgtgagcgttacgtccgaagctctcccccaggagctcaaatcggggtccgaaactacaaattgcaccgccacaacagcgatttcagattctaacctggacggacagccaccgtgcgacgtcagtcttcatacaaaggccttattgcagatcgaagaggaggtggtagccgcccacgtagatctgtag

SEQ ID NO: 193293 - DNA, 2280 bp, Artificial Sequence
  Description of Artificial Sequence: Synthetic coding sequence
atggagagcagccccttcaaccggcggcagtggaccagcctgagcttgcgcgtgacagctaaagagctatctttggtcaataagaacaaatcctcagccatcgtagaaatcttttcgaaatatcagaaagctgccgaggagactaacatggaaaaaaaaagaagcaacaccgagaatctgtcccaacatttccgcaaaggcactttaacagttttgaagaaaaagtgggagaaccctggcctcggcgcagaatcacacactgactcgctgcgcaacagctcaacggaaatcaggcaccgagctgatcatccacctgccgaagtgacctctcatgctgcctcaggagccaaggccgatcaggaagaacagatacacccccgtagccggcttcggtcccctcccgaggcactggtgcagggccgctatccacatatcaaagacggtgaggacctgaaagatcactctacagagagcaaaaagatggaaaattgtttaggggagagccggcatgaagtggaaaagagtgaaatttccgagaacaccgacgcatctggcaaaatcgagaaatacaatgtgcccctgaatcggctaaagatgatgtttgagaaaggagagcctacccaaacaaagatactccgggcgcagagcaggtctgcttccggccgaaagatatcagaaaatagctattccttggacgacttggaaatcgggccgggacaactgtcctcctcaacgtttgactcagaaaagaacgaatccaggcggaacctagaacttccccggctgtctgagacatccatcaaggatcgtatggctaaatatcaggcagcggtcagtaagcagtcttctagtaccaattacacgaatgagctaaaagcctcgggaggcgaaattaaaattcataagatggaacagaaggagaacgtgcccccggggcctgaagtctgcattacccatcaggaaggggagaaaatatcagcaaacgagaattctctggccgtgagatctacgcccgccgaggacgactcccgggactcacaggttaagtctgaggtgcagcagccggtgcatcccaagcctctatcccccgactccagggcaagctcattatcagaaagctcacctcccaaggcaatgaagaagtttcaagcaccggccagggagacatgtgtcgagtgtcagaagaccgtgtaccccatggagaggctactcgctaatcaacaggtcttccacatcagctgttttcgatgctcatactgtaataataagctgtctctcgggacttatgcgtcactgcacggacgcatatactgcaaaccacacttcaatcaactctttaagagcaagggcaactacgatgagggctttggacataggccacacaaagacctgtgggcatctaaaaatgagaatgaggaaattcttgagcgccctgctcagctcgctaatgctcgggaaaccccccactcacctggggtcgaagacgcacccatagcaaaggtaggcgttctcgcagcatcaatggaggcaaaggcttcctcccaacaggagaaggaagacaaacccgccgagacaaaaaaactcagaatcgcttggcctcccccaacagaactgggttcaagcggttcagcactagaagagggcattaagatgtctaaaccgaaatggccacccgaggacgagatcagtaaacctgaagttccggaagatgtggacctcgatctgaaaaagctgcggcgctcctcatcactcaaggagcgatctcggccattcactgtggccgcgagtttccagagcacatccgtgaagtcccctaaaaccgtaagtccccctataagaaagggttggagtatgtcggagcaaagcgaggagagcgtggggggacgggtcgcggagaggaagcaggtcgagaacgcaaaagcctctaagaagaatggtaacgtggggaagaccacatggcaaaacaaggagtcaaagggtgaaactggtaagcgctccaaggaggggcatagcctcgaaatggagaatgaaaatctcgtggaaaatggtgccgacagtgatgaagatgacaatagttttctgaaacaacagtcaccgcaggaaccaaaaagtctgaattggtccagttttgtagacaatacctttgctgaagaattcaccacacagaatcaaaaaagccaggacgtcgagctttgggagggggaagtggtcaaagagttgtctgtggaggaacagatcaaacggaacaggtactatgacgaagatgaggacgaggagtag

SEQ ID NO: 193294 - DNA, 2283 bp, Artificial Sequence
  Description of Artificial Sequence: Synthetic coding sequence
atggagagcagccccttcaaccggcggcagtggaccagcctgagcctgagggtcactgcaaaagaattgtccctcgtcaacaagaacaagtctagtgccatcgttgaaatcttttcaaagtatcagaaagcggcagaagagacaaatatggagaaaaagcggtctaataccgaaaacttgagccagcacttccgcaaaggaactttaaccgtgctaaaaaagaagtgggaaaaccccggactgggtgctgaaagccacaccgactcactgcgtaactcctcaactgaaatccgtcaccgtgcagatcaccctcccgcagaggtcacatcacatgctgcttctggggccaaagctgaccaagaggagcagattcatcctagaagtcggctcaggagccccccagaagctctggttcagggccgatacccccacatcaaggatggcgaagatcttaaagaccactctactgaatccaaaaagatggaaaattgtctgggcgagtcgagacatgaggtggaaaaatctgaaatcagcgaaaacactgatgccagtggcaaaatcgaaaagtacaacgtgccattgaaccgactgaaaatgatgtttgagaagggcgaacctacacagacaaaaatactgagggcccagtctcgttccgcctcaggtaggaagataagtgaaaactcctacagccttgatgaccttgaaattggaccaggccagctgtcttcatcaacattcgactccgagaagaacgaatccagacggaatctggaactgccgagactctccgagacgagtatcaaagataggatggctaaataccaagctgccgtctccaagcagagctcttctaccaattacaccaatgaactgaaggcttctggtggcgagattaagatccacaagatggaacaaaaggaaaacgtgccgccgggtccagaagtgtgtatcacccaccaagaaggtgagaaaatcagcgccaacgaaaactctctcgcagtccgatccacacctgccgaagacgactccccaggagatagtcaggttaagtctgaggttcagcagcctgtacatcccaaacctttgtcaccagactcaagggcctccagtctttcagagtcatcccctcctaaagccatgaagaagtttcaggcgcctgcccgagagacctgcgttgagtgtcagaagacagtctatcccatggagcggctgctggctaaccaacaggtttttcatatctcctgttttcgctgtagctactgcaataataaactctctctggggacatacgcttccctgcatggacgcatttactgcaagcctcactttaaccagctctttaagtcaaaggggaattatgacgagggatttggccaccggccccacaaggacctgtgggcctctaagaacgaaaatgaggagattttggagcgcccagcgcagctggctaatgcacgagaaacaccccattccccgggtgtggaggacgcgccgatcgccaaggttggcgtcctggccgcgagtatggaggcaaaagcctcatcccagcaggagaaggaagacaagcctgccgaaacgaagaaactacggatcgcctggccacccccaacggagctgggatcctcgggttcagcactggaagaaggcatcaagatgtcaaaaccaaaatggccccctgaggacgagatctccaagccggaggtacctgaagacgtcgacctggacctgaaaaagttgcggaggagctccagtcttaaggagcggtctaggcccttcaccgttgctgccagtttccagtctaccagcgttaagtcacctaagaccgttagtccccctatcagaaagggctggtctatgtccgagcagtccgaggaaagtgtaggtgggagggtagccgagagaaagcaggtggagaacgccaaggcttctaaaaaaaacgggaatgtggggaaaactacatggcagaataaggagtccaagggcgagactgggaaacggtctaaagaggggcacagcctggagatggagaacgagaacctggtcgagaacggagctgactccgatgaggatgataactctttcctcaagcaacaaagcccacaggaaccaaagagtctgaattggagtagtttcgtggacaatacttttgcagaagagtttacaacgcaaaatcagaagagtcaggacgtggagctttgggagggcgaagtggtgaaggaactgagtgttgaggagcaaataaagcgaaatcgctattatgatgaagacgaggacgaggagtag

SEQ ID NO: 193295 - DNA, 2037 bp, Artificial Sequence
  Description of Artificial Sequence: Synthetic coding sequence
atgtggcagggctgcaactgcagccagctgagcgagaccgccgtggatcaggaacagctgggggtcctgactttcatccttcagagaaccacatgtctgaatgttagtgcagatcaggaagagcagatacacccccggtctagactgcggtctccccccgaggcgctggtccagggccggtatccacatattaaagacggggaagatttgaaagatcactctactgagtctaagaagatggaaaactgtttgggggaaagccggcatgaagtggagaaatcagagatatcagagaataccgatgccagcgggaagatcgaaaagtataatgttcccctaaacagactaaagatgatgtttgaaaaaggggagcctacgcaaaccaagattctccgcgcgcagtcaaggagtgcctccggtagaaagatttcggaaaacagttactctctggatgatttagagatcgggcccgggcagttgtcatccagtacctttgactctgagaaaaacgaatctcggagaaacctggagcttccccgcttatccgagacctcgattaaggacagaatggcaaagtaccaagcagcggtatctaaacaaagctcaagtacaaattataccaacgaactgaaagccagcggaggagaaatcaagatccacaaaatggagcagaaggaaaacgtaccaccggggcccgaagtgtgcatcacccaccaagagggggagaaaatcagtgccaacgaaaactcccttgccgtgagatctacacccgctgaagacgattctcgcgattcccaggtcaagagtgaggtgcaacaaccagttcatccaaagccactgtccccagacagtcgtgcatcatctttgagcgagagctccccacctaaggccatgaagaagttccaggcccctgccagggagacatgtgtggagtgtcagaaaacagtctatcctatggaacggctccttgctaaccaacaggtctttcatatctcttgcttcagatgctcatattgcaacaacaaattgtctcttggcacttacgctagcctgcacggcaggatttactgcaaaccccatttcaaccagctattcaagtcaaagggaaactatgacgagggattcggtcacaggcctcataaagacctctgggctagcaagaacgagaatgaggagatcttggagcggccggcccagctggctaacgcgagggagaccccccacagccctggcgttgaagacgccccaattgcaaaggtcggtgtgctcgccgcctccatggaagccaaagcctcgagccagcaggagaaggaggacaaacctgcagagaccaagaagttacgcatagcttggccgccccctacagagctgggaagctctggctccgccctggaggaagggattaagatgtccaagcccaagtggccaccggaagacgaaatttctaaacctgaggtgcccgaggacgttgatctcgacttaaaaaaactgcgtcgcagcagctcattgaaggaacgttcaaggcctttcacagtggctgcttcctttcagagcacgtccgtgaagagcccgaaaactgtgtctccccctatccgaaaaggttggagtatgagtgagcagtctgaggaaagcgtggggggacgcgtcgcagagaggaagcaggtggagaacgccaaggcctctaaaaagaacgggaatgtcggcaaaacaacttggcagaataaagaatccaagggagagactggaaagcgatccaaagaggggcattcactggaaatggagaacgagaacttggttgaaaacggagcagattcagatgaagatgataactcctttctgaagcaacagtcacctcaggagccgaagagtctgaactggagttctttcgtcgacaacactttcgctgaggagttcaccacccagaatcagaagtctcaagacgttgagttgtgggagggagaagtggtcaaagaactgtctgtcgaggaacagatcaagcgcaatcgatactacgacgaagacgaagatgaagagtag

SEQ ID NO: 193296 - DNA, 1374 bp, Artificial Sequence
  Description of Artificial Sequence: Synthetic coding sequence
atggagcagaaggagaacgtgccccccggccccgaggtgtgcatcacgcatcaggagggcgaaaagatctcagccaatgagaattccctcgcagtgcgatcgacaccagccgaggatgatagccgggatagtcaggtcaaatctgaggtccagcagcctgtccaccccaagccactgtcccctgattcgcgggcgagctctctctctgaatcatccccccctaaggctatgaagaagtttcaagccccggccagggagacttgcgtggagtgccagaagacagtgtatcccatggagcgtttactagcgaatcagcaagtcttccatatttcatgttttagatgctcatattgcaataacaagttatcgctgggcacatatgcctcactgcacgggcggatttattgtaagccacacttcaaccagttgttcaaatccaagggcaactatgatgaaggcttcggccaccgccctcacaaggacctgtgggctagcaaaaacgaaaatgaagaaatcctggaacggcccgcccagttggccaatgctcgcgagacacctcattcacccggggtggaggacgcccctattgctaaggtcggagtgctggccgcctcaatggaggccaaagccagctcccagcaggaaaaggaggataagcccgccgaaacgaaaaagctccgcatcgcatggcctcctcctaccgaactgggaagttccggctctgcactggaggaggggattaagatgagcaaaccgaaatggccacctgaagatgaaatctcaaagcctgaagtacccgaagacgtggacttggaccttaaaaagctgcgcaggtcaagctcattgaaggaacgcagtagaccattcaccgtagcagcgtcattccaatccaccagtgttaagtcaccgaagacggtctcacctcctattaggaagggctggagcatgtcagaacagagtgaggagtccgtgggaggccgcgtcgctgagcggaaacaggtggagaatgctaaagccagcaaaaagaatgggaacgtgggcaaaaccacttggcagaacaaggaatcaaaaggggaaacaggcaagcggtccaaagagggccacagtctggaaatggagaatgagaacttagtagagaacggagcagactcagacgaagatgacaatagcttcctcaagcaacagtctcctcaggagccaaagtcactcaattggagcagttttgtggataacactttcgctgaagaatttactacacagaaccagaagagtcaggatgtggaactgtgggagggggaagtcgtgaaagaactctccgttgaagagcagatcaagagaaaccgttattatgatgaggacgaggacgaagagtag

SEQ ID NO: 193297 - DNA, 336 bp, Artificial Sequence
  Description of Artificial Sequence: Synthetic coding sequence
atggagagcagccccttcaaccggcggcagtggaccagcctgagccttagggtaaccgcgaaggaactctcgctcgtcaacaagaacaaatcttccgcgatcgtcgagattttctctaaataccagaaggcagctgaggagactaacatggaaaaaaaacggtccaacaccgagaatctgagtcagcacttccgcaagggcactctgacggttcttaagaagaagtgggaaaacccggggctcggggccgaaagtcatacggactcattacgaaatagcagtacagagatccgccatcgcgccgaccaccctcccgccgaagtcacatcacattag

SEQ ID NO: 193298 - DNA, 393 bp, Artificial Sequence
  Description of Artificial Sequence: Synthetic coding sequence
atggagagcagccccttcaaccggcggcagtggaccagcctgagccttcgggtgactgcaaaagagctgagcctagtaaacaaaaacaagtcgtcagctatcgtggaaatcttcagtaaatatcagaaagccgcagaagagacgaacatggagaagaaaagatcaaatacagagaacttgtcccaacattttcggaagggtacgctgaccgttctgaagaagaaatgggagaaccccggacttggcgccgaatcccatactgattcactgcgaaattcatcaaccgagattcggcaccgcgccgatcatccccctgcggaagttaccagccacgcagcatcgggcgccaaagcagatcaggaggaacaaattcacccccgttcccgcttgtag

SEQ ID NO: 193299 - DNA, 1371 bp, Artificial Sequence
  Description of Artificial Sequence: Synthetic coding sequence
atggagcagaaggagaacgtgccccccggccccgaggtgtgcatcactcatcaggaaggggaaaaaataagcgccaacgagaacagtttagccgttcgctccacccctgcagaagacgatagtcgagactcgcaggtaaaaagtgaagtccagcaacctgtgcaccctaagcctcttagtccagattccagggcctcttcattgagcgagtcttctccgccgaaagcgatgaaatttcaggcccccgcaagagagacttgcgtggagtgtcagaagactgtgtatcccatggagcgactgctcgctaaccaacaggtctttcacatctcctgtttcaggtgttcctattgtaataacaagctctctctcggtacctacgcatctctccacggtcggatctactgcaagccacacttcaatcagttgtttaaatcaaaaggcaattacgatgaaggcttcggacacaggcctcataaggatctgtgggccagcaagaacgaaaacgaggaaattctggaacggcctgctcagttggctaacgccagggaaactcctcattccccaggcgtcgaggacgcaccaattgccaaggtcggggttttggctgcaagtatggaggcaaaggcctccagccaacaggaaaaggaggataaaccggccgaaacaaaaaagttacgaatcgcttggccccccccaaccgagcttgggagctctggctcagctcttgaagaggggattaagatgtctaagcccaaatggcccccagaggacgagattagtaagcctgaggttccggaagacgtggacctggatctgaagaaactaaggcgctcttcctccctgaaggagcggagtcgtcccttcaccgtggctgctagttttcaatccacaagtgtgaagtcacccaagaccgtttcccctcccattagaaagggttggagtatgtcagagcagtctgaggagagtgtgggcggccgagtagcagagcggaaacaggtggagaatgcaaaggcctctaagaagaacggcaacgtgggaaagactacctggcagaacaaagaaagcaaaggcgagacagggaagcggagcaaagagggtcacagtttggagatggaaaatgagaatctggtggaaaacggcgcagactccgacgaagatgacaatagctttttaaagcagcagagtccacaggaaccaaagtcactgaactggtccagctttgtcgataatacgtttgctgaggaatttaccacacaaaaccagaagagtcaggacgttgaactttgggaaggtgaagtcgtaaaagagctttctgtggaagaacaaatcaagcgtaaccgatactacgacgaggacgaggacgaagaatag

SEQ ID NO: 193300 - DNA, 1803 bp, Artificial Sequence
  Description of Artificial Sequence: Synthetic coding sequence
atggagaactgcctgggcgagagccggcacgaggtggagaagagcgaaattagtgagaacaccgatgcatcagggaaaatagaaaaatataacgtgcccctaaacagactcaagatgatgtttgagaagggagagccaacccagacaaagatcctcagggcacagtcacgtagcgcatctggacgaaaaatcagtgaaaactcatactcactcgatgacctggagatcgggcccggccagctgtcctcatctactttcgacagcgaaaaaaacgagtcaaggaggaatctcgagctgccccggctcagcgaaacttctattaaagacagaatggctaaataccaggcggccgtatctaagcagagcagctccacaaactacaccaacgagctgaaggcctcaggcggggagataaaaatccacaagatggagcagaaggagaatgtgcctcccggcccggaagtgtgcatcacacaccaggaaggagaaaaaatatccgctaacgagaactccctggcagtcagatcaacaccagccgaggacgattcccctggggatagccaagttaagagtgaagtgcagcaaccagtccaccctaaaccactgtccccagacagcagagcatcttcactaagtgagtcaagtccaccaaaagctatgaaaaagttccaggcacctgctagagaaacctgtgttgagtgccagaaaacagtttatccaatggaaagactcctagcaaaccagcaggttttccacatctcttgttttagatgtagttactgcaacaataaattgtccctgggaacatatgcgtccttgcacgggcgaatctactgcaaaccccacttcaaccaactgttcaagtctaaaggtaattacgatgagggttttggtcaccgaccccataaggatctctgggcctcgaaaaatgagaacgaagaaatactagaaagaccagcccagctagctaacgcccgggaaacgccacacagccctggtgtcgaagacgctcctattgctaaagttggggtactggctgctagcatggaagcaaaggcttcatctcagcaggagaaggaagacaaacctgccgagacaaagaagctgcggatcgcttggcctccacccaccgagctcggctccagtggctcagcactcgaggagggaattaagatgtctaagcccaagtggccacctgaggacgaaatctccaaacctgaggtcccagaagacgtggacctggatctgaagaagctgcgccgctctagcagtctcaaagaaagaagccgaccttttacggtggcagcttcttttcaatccacctccgtgaagtcaccaaaaactgtcagtccccctatccgcaagggctggagcatgtccgagcagagcgaggagtccgtcggaggcagggtggctgagaggaagcaagtcgagaacgcaaaagcaagtaaaaaaaatgggaacgtggggaaaaccacctggcagaacaaggaaagcaagggggagactgggaaaaggtccaaggaaggacactcgctggaaatggagaatgagaatctggtcgagaatggggccgattcggacgaggacgacaatagcttcctgaagcaacagtctcctcaggagcccaagtcccttaactggtcctcgttcgtcgataacaccttcgccgaggagttcaccacccagaatcaaaagagtcaggacgttgaattgtgggagggagaggtcgtcaaagagttgtccgtcgaagagcagattaaacgaaatcgctactacgatgaagacgaagatgaagagtag

SEQ ID NO: 193301 - DNA, 1800 bp, Artificial Sequence
  Description of Artificial Sequence: Synthetic coding sequence
atggagaactgcctgggcgagagccggcacgaggtggagaagagcgagatcagcgaaaacacagatgccagcggaaagatagaaaagtacaacgtgcccctgaacaggttgaaaatgatgtttgagaagggcgaaccaacccagactaagattctgcgcgcacagtctagatctgcctcaggccgtaaaatcagcgagaattcttactcactggacgatcttgaaatcggcccaggccagcttagttcttcaactttcgatagcgaaaaaaacgagtcccgccgaaatctagaactcccacggctaagtgagactagcattaaggaccggatggcaaaataccaggcagccgtttctaagcaatcaagcagcacaaactacaccaacgagctgaaagcctcaggcggcgagataaagattcacaagatggagcagaaggagaatgtgcctcccgggcccgaagtctgtatcacacatcaagagggagagaagatttccgccaacgaaaactcacttgctgtgagatcaaccccagctgaagacgacagtagggactcacaggtgaaatccgaagtacagcaaccagtgcaccctaagccgctgagtcctgacagcagagctagtagtctgtcagagtctagtccacccaaggctatgaagaagtttcaggcccctgcccgggagacatgcgtcgagtgccagaaaactgtgtatccaatggaacggcttctggcaaatcagcaggttttccacatctcttgtttccggtgctcttattgcaacaacaaactgtcactgggcacctatgctagcctgcatggccggatctattgcaagccccacttcaaccagctgttcaaaagcaaggggaattatgatgaggggtttggtcacagacctcacaaagatctctgggctagtaagaatgagaatgaagaaatactggaaaggcctgcccaacttgccaatgcgagggaaacccctcactcccctggtgtggaggacgcccccatagcgaaagtgggcgttcttgctgctagcatggaggctaaggcaagctctcagcaagagaaagaggacaaaccagcagaaacaaagaagctgcgcattgcttggcccccacctaccgagcttggcagttcaggaagcgccctggaggaaggcatcaaaatgtcgaagcccaagtggcctcctgaggacgagatcagtaagcctgaggtgcccgaggacgtcgacctggatctgaagaaactcagacgcagcagctctctgaaggagaggtcccggccctttaccgttgccgcatcctttcaatccacctcggtgaagtcacctaaaacagtttcaccgccaattcgaaaaggttggtccatgtccgagcagtctgaagagagtgtgggcgggcgggtggcggagagaaagcaagtggaaaatgctaaggcatccaagaagaatgggaatgtaggcaaaaccacctggcaaaataaggaaagcaagggggaaactgggaagagaagcaaggaggggcacagcctcgagatggaaaacgagaatttagtggagaatggagctgattccgacgaagatgataattcttttctgaaacagcaatctcctcaggaaccaaagtccctgaattggagtagctttgtggataataccttcgctgaagaatttactacccagaaccagaagagtcaagacgtcgagttatgggagggcgaggtcgtgaaagaactgtcggtggaagagcagataaaaagaaataggtattacgatgaggatgaggacgaggaatag

SEQ ID NO: 193302 - DNA, 1128 bp, Artificial Sequence
  Description of Artificial Sequence: Synthetic coding sequence
atgctggaccgggacgtgggccccacccccatgtacccccccacctacctcgaaccaggcattggtaggcacaccccgtatggcaatcaaaccgattacagaattttcgagctgaataagaggctgcagaactggacagaggagtgtgataatctgtggtgggatgcttttacgacagaattctttgaggacgatgccatgctcacaataactttttgtctcgaagatggtcctaagcgctataccatcgggaggacattgatccctagatatttccgttccatcttcgaaggaggtgccaccgagctgtattacgtcctcaagcacccaaaagaagccttccactccaacttcgtttctctggactgtgaccagggctccatggtgacccagcatggtaagcccatgttcacccaggtgtgtgttgaaggccggttgtacctggagtttatgttcgacgatatgatgaggattaagacctggcacttttcgatacgtcagcatcgcgagctgattccacgctctattttagccatgcacgctcaagatccacagatgctggaccagctgagcaagaacatcacacgctgcgggctgagtaactctactctgaattatctgcgcctctgtgtgattctggaaccaatgcaggaactgatgtctcggcataagacatattcactatccccgcgggattgtctcaaaacttgcctgtttcagaagtggcagcgtatggtggccccacccgcagaacccacccgacaacaaccaagcaagcgtcgcaagaggaagatgagcggcgggtcaaccatgtctagtggaggaggtaataccaataattccaattcgaaaaaaaaatctccagcttccacctttgcattaagcagccaggtgcccgatgtcatggtcgtgggcgaaccaactttgatggggggcgagttcggggatgaggatgagcgtctgatcacccggcttgagaacacccagttcgacgcagccaatggaatcgatgacgaagactcattcaacaattctcctgccctgggggccaatagcccctggaattcaaagcccccctcttcgcaggagtctaaaagtgagaatcctactagccaggcctctcaatag

SEQ ID NO: 193303 - DNA, 1236 bp, Artificial Sequence
  Description of Artificial Sequence: Synthetic coding sequence
atgagcgtgggctgcgcctgccccggctgcagcagcaagagcttcaaactatatagcccaaaagaacccccaaatggcaatgcctttccacctttccacccaggaacaatgttggacagagatgtcggtcccacccctatgtacccccccacatacctggagcccggcatcggcaggcatacgccttacggcaatcagaccgattaccgcatcttcgagctgaataagcggctgcaaaattggactgaagagtgtgacaatttgtggtgggatgcctttactaccgaattcttcgaggacgatgccatgctgactatcaccttctgtctggaggacggccccaaacggtataccattgggagaacacttatcccaagatatttcaggtcaatattcgaggggggagctactgaactgtactacgtcctcaaacatcccaaagaagcttttcactctaattttgtatcacttgactgtgaccaaggctctatggtcactcagcatggtaaaccgatgttcacccaagtctgtgtcgaaggacgcctgtatctggaattcatgtttgacgacatgatgaggatcaagacgtggcatttcagcatccgacagcaccgtgaactcataccaaggagtattttggccatgcacgcccaggatccacagatgctggaccagctgtccaagaacattacaaggtgtggcctgtcgaacagtactctaaattatctgcggctgtgcgtaattttagagccaatgcaggagcttatgagtaggcataaaacatatagtctgtccccgcgggactgcttaaagacctgcctcttccaaaagtggcaaaggatggtggcccctcccgccgagcctaccaggcagcagccatctaagcggaggaagcggaaaatgagcggtggctctacaatgtcgagcgggggaggaaatacaaataactcaaactccaagaaaaagtcaccagcctcgaccttcgcactttcgtctcaggtgccagacgtcatggtggttggagaacccactctcatgggcggggaattcggcgacgaggatgaaagactcatcacccggctggaaaacacccagttcgacgcagcaaatggtatcgacgatgaggacagttttaataatagccccgccttgggcgccaacagcccatggaatagtaagccaccatcttcccaggagagcaagtccgaaaaccctacatcccaggccagccagtag

SEQ ID NO: 193304 - DNA, 1122 bp, Artificial Sequence
  Description of Artificial Sequence: Synthetic coding sequence
atgagcagcaccccccacgaccccttctacagcagccccttcggcccattttaccggcggcatacaccatacatggtacagcccgaataccgaatatatgagatgaataaaaggctgcagtcccggactgaggacagtgacaacttgtggtgggacgcctttgctactgagttctttgaggacgacgccacacttaccctgtcattctgcctcgaggacggacccaaacgatacacgataggacgaacattgattccccgatacttttcgactgtgttcgagggtggagtcacggacttatattacatccttaaacacagcaaggaatcatatcataattcaagcatcacagttgattgtgatcaatgcacgatggtgacccagcatggtaagcccatgtttacaaaagtatgtaccgagggaagattgatcctcgaattcacatttgatgacctgatgaggatcaaaacctggcactttaccatccggcaataccgtgagttggtaccgagatcgattctagccatgcacgcacaggaccctcaagtgctagatcagttgtcaaaaaacataacacgaatggggctgaccaattttaccctcaattaccttcgactctgcgttatcctggagccaatgcaggagctgatgtcacgtcataagacttacaatttatcccccagagactgccttaaaacctgcctctttcagaagtggcagaggatggtggccccacccgctgaacctaccaggcaaccgacaacaaaacgccgcaagagaaagaacagtaccagcagcacatctaattccagtgctgggaataacgcgaactccactggatccaagaaaaagaccaccgcagcaaatctgtccctgagttcacaagtgcccgatgtcatggtagtaggggagcccaccttaatggggggcgaattcggagacgaagatgagaggttgatcactcggctggaaaatactcaatatgatgccgcaaacggaatggatgatgaggaggactttaacaatagtccagctctggggaacaattccccctggaatagcaagcccccagctactcaagaaactaagagtgagaatccaccccctcaggctagtcagtag

SEQ ID NO: 193305 - DNA, 996 bp, Artificial Sequence
  Description of Artificial Sequence: Synthetic coding sequence
atgagcagcaccccccacgaccccttctacagcagccccttcggcccattttaccgccgccacaccccctatatggtacagccagagtatcggatctacgaaatgaataaacgcctgcagtcccgcaccgaggactctgataatctctggtgggatgctttcgctacggagttctttgaggatgacgccactttgacattgagcttttgcctggaagatgggccgaaacgttacacgatcggtaggaccctgatccccagatacttctccactgtcttcgaaggtggagttaccgacctgtattatatcctgaagcactctaaagaaagttatcacaatagtagtataaccgtggattgtgatcaatgcacaatggttacccagcacggaaaacccatgttcacgaaagtgtgtacggagggtagacttatcctggagtttacgtttgatgacctgatgagaatcaagacgtggcacttcacgataagacagtatcgcgagctagtcccccggagcatcctagccatgcacgcccaggacccgcaggtgctggatcagctatctaaaaacatcacccggatgggtctgactaatttcactctgaattatctgcgattgtgtgttattctggagcctatgcaggagctgatgtcaaggcacaagacctacaacctgtctccccgcgattgccttaagacttgtttgttccagaagtggcagcgcatggtggctcccccggctgagcccacccgccagcctacaacaaaaaggagaaagaggaagaatagtacatctagcacgagcaattctagtgccggcaacaacgcaaacagcactgggtcaaaaaaaaaaactacagccgctaacctgtctctcagttcccaggtccctggcctgggggctatccccaactgctcgctgaatcccgggagagatggggacttgtgtcattccacagccgtgacacccagtggacagttcaaggaaaaacactag

SEQ ID NO: 193306 - DNA, 942 bp, Artificial Sequence
  Description of Artificial Sequence: Synthetic coding sequence
atgagcagcaccccccacgaccccttctacagcagccccttcggccctttttaccgtagacatacaccctatatggtgcagcctgaatatagaatttacgagatgaacaagcgccttcagagtaggacagaggatagcgacaatttgtggtgggatgcattcgcaaccgaatttttcgaggacgacgcaacactcaccctgtccttttgtcttgaggatggacccaagcgctacacaatcggcagaacccttatccccaggtactttagtacggtcttcgagggcggggtcactgacctgtattatattctcaagcactctaaggaatcttatcataactcatctataacggtggactgtgaccagtgtacgatggtcacccagcatggaaagccaatgtttaccaaagtgtgtaccgaaggcagactaattttggagtttacatttgacgatcttatgaggatcaagacttggcacttcacgatcaggcagtaccgggaactggtgccccgttccatcctcgcgatgcatgcgcaggacccgcaagtgttggaccaactctctaaaaatatcacgaggatggggcttacaaacttcactcttaactatttacggctctgcgtaatcttggagccaatgcaagaactgatgagccgccataagacctataacctttccccacgagattgccttaagacttgtcttttccagaagtggcagaggatggtcgccccccccgctgaaccgacccggcagccaactaccaaaagacgtaaaaggaaaaactcaaccagcagcacctcgaattctagcgctggtaacaatgcaaatagcacaggatccaaaaagaagaccacagccgctaatctttccctgagtagccaggtccctatagccagtatcgcgcgctcccccgtgagcggctgcgctctcaggacttag

SEQ ID NO: 193307 - DNA, 570 bp, Artificial Sequence
  Description of Artificial Sequence: Synthetic coding sequence
atggtgacccagcacggcaagcccatgttcaccaaggtgtgcaccgagggaagactgatcttggaatttacatttgatgatctaatgagaattaagacatggcactttaccatccgtcagtacagagagctcgtgcctcgatctatcctcgccatgcacgcccaggatcctcaggtcttggaccagctctctaagaacatcacacgaatggggctgactaacttcacactaaattacctgcgcctgtgcgtgatcttggagccaatgcaggagctgatgtctcggcacaagacatacaatctaagcccgagggactgtctgaagacatgtctttttcagaagtggcagcggatggtggcacctccagccgagcccacccggcagcctaccacaaagcgtcggaagcgcaagaattcaacttcttccacaagcaattcctccgcaggaaataacgctaattccacagggtcgaaaaaaaagactaccgccgctaatctgtccctgagttcccaggtgcctattgcctctatcgcaaggagccctgtctctgggtgcgccttgcgtacctag

SEQ ID NO: 193308 - DNA, 495 bp, Artificial Sequence
  Description of Artificial Sequence: Synthetic coding sequence
atggtgcagcccgagtaccggatctacgagatgaacaagcggctgcagagccggaccgaggacagcgacaacctctggtgggatgcgtttgctacagaattctttgaagacgacgccacactgactctgagtttctgcctcgaggacgggcctaagcgatacaccattggccgaaccctcatccctcggtactttagcactgttttcgagggtggcgtcacagatctgtactatatcctcaagcatagcaaggaatcgtaccataacagtagcatcacagtggactgcgatcaatgtacaatggtaacacaacatggcaaacccatgttcaccaaggtgtgcaccgaagggcggctgattttggagttcacgtttgacgatctgatgcgtataaagacatggcactttacgatacgacagtacagagagctcgtgcccaggagcattctggcaatgcatgcccaggatccacaggtgctggaccagctcagctag

SEQ ID NO: 193309 - DNA, 333 bp, Artificial Sequence
  Description of Artificial Sequence: Synthetic coding sequence
atgagcagcaccccccacgaccccttctacagcagccccttcggccctttctatcggcgtcacacaccctacatggtgcagcccgaatataggatttacgaaatgaacaaacggttacagagccgcaccgaagacagcgataacttgtggtgggacgcttttgccacagagttctttgaagacgacgccacactgactctatccttctgcctggaggatgggcctaaaaggtatattgttcacagtgccgcagacgctagagggaactgtaaccagttaggcgacagtgagccggacgcttgcgacggcctgttgcagtttccgattatgtag

SEQ ID NO: 193310 - DNA, 321 bp, Artificial Sequence
  Description of Artificial Sequence: Synthetic coding sequence
atgagcagcaccccccacgaccccttctacagcagccccttcggccccttttataggagacacactccatatatggtccaacccgagtatagaatctacgaaatgaacaaaagacttcaatcgaggactgaggattccgataatttgtggtgggatgcttttgccaccgagtttttcgaagatgatgccactctgactctctctttttgcctggaggacggacctaagcgataccgcactaaaaatctgcgccccattggcgagaagatgaacatcaatgggaagtgctatagacaggaccctcacccccctcttctctag

SEQ ID NO: 193311 - DNA, 1116 bp, Artificial Sequence
  Description of Artificial Sequence: Synthetic coding sequence
atgagcagcaccccccacgaccccttctacagcagccccttcggccccttctacagacgacacacgccgtacatggttcagcccgagtaccggatttacgagatgaacaagaggctccaatcgcgcaccgaggacagcgacaatttgtggtgggacgctttcgcaactgagttttttgaagacgacgccacattgaccctttctttctgtctcgaggatgggcctaaacggtacaccattggccgcaccctgattcctagatacttctccacagtctttgagggcggggtcaccgacctgtactacattcttaaacactctaaggaaagttatcataactcctctattaccgtcgactgcgaccaatgtactatggtaacccaacatggaaaacccatgttcactaaagtgtgtacggaggggaggctgattttagagtttacatttgacgatcttatgaggatcaagacctggcatttcaccattcgtcagtacagggagctggtgcccagatcaatcttggcaatgcacgctcaggacccgcaggtgctggaccagctgtccaaaaatattactagaatgggccttaccaattttaccctgaactacctcagactatgtgtgatcctcgagcccatgcaggagctcatgagcagacacaagacgtacaacctgtctccccgggactgtctaaagacttgcctgttccagaagtggcagcgtatggtggcccccccagctgaaccaaccagacagcccaccaccaaaaggagaaagcgcaagaatagcacatcttcaacttcaaattccagtgccggtaataacgcaaattcgacagggtcaaagaaaaagaccaccgcagcaaacctgagcctgagtagccaggatgtgatggtggtgggtgaacctacacttatgggcggggagtttggagacgaggatgagcggctgatcactcgactcgagaatactcagtatgacgctgcaaacggtatggatgacgaagaagactttaataattctccggctcttggaaataattcaccctggaatagtaaacctcctgccacacaggagactaagtcagaaaatcccccaccacaggcctcacaatag

SEQ ID NO: 193312 - DNA, 1854 bp, Artificial Sequence
  Description of Artificial Sequence: Synthetic coding sequence
atgagctacagcgtgaccctgaccggccccggcccctggggcttccgcctccaaggcggaaaggacttcaatatgcctcttaccatttccagaatcacccctggatctaaggccgcacagagccagctgtcccagggagatctggtggtggctattgacggggtgaataccgataccatgacccacctagaggcccagaacaagattaaaagcgccagttataacttgtccttaactctgcaaaagagcaagagaccaatcccaatttccactactgctcctcccgtccagactcctttgcccgtgatcccccaccagaaggtggtcgtcaactcccctgccaacgctgattaccaggagaggtttaacccatctgccttgaaagacagtgcactgagtactcataagccgattgaagtcaaggggctcggaggaaaggccaccataatccatgcgcaatataatacccctatttccatgtactcccaggatgctataatggacgccatagccggccaggctcaggcccagggctccgacttctccgggtccctacccattaaggatcttgctgtggactccgcctcccctgtttatcaggctgtgatcaagagtcagaacaaacccgaagatgaggcagacgaatgggcacgacggtccagtaacctccagagccgcagcttccggattctcgcacagatgacaggcaccgaatttatgcaagaccccgacgaggaggccttgcggaggagtaggccccaggccagcagctacagccccgcggtggccgcctcaagtgccccagcgacacacacatcatactctgagggccccgccgctccagccccaaagccaagggtcgtgactacagcatctatcagaccttccgtctatcagcctgtgccagccagtacttacagtcccagccccggtgcaaactattcccctactccttacaccccttctcctgcccccgcgtatacccccagcccggcccccgcatacaccccatctcccgtacctacctatactccaagtccggcaccagcctatacaccttcccctgcacccaattataacccagcaccctccgtggcttacagcggtgggcccgccgaacccgcaagtcgccctccttgggtcaccgacgatagcttctcccagaaattcgcccccggaaaatctaccacttcaatcagtaagcaaaccctgcctcgcggcggccctgcttatactcctgcgggaccccaggtccctcctttggcccgaggtaccgtgcagcgcgccgaacgtttcccggcttcatcccgcactccactgtgtggccactgcaacaatgtcatccgcggaccttttctggttgccatggggcggagttggcatccagaggaatttacatgtgcctattgcaaaacttctctcgccgatgtgtgtttcgtggaggagcagaacaatgtgtattgcgagagatgctatgagcaatttttcgccccactgtgcgctaagtgcaatactaaaatcatgggagaagtgatgcacgccctgagacagacctggcataccacctgtttcgtttgcgctgcctgcaaaaaacctttcggcaattccctcttccacatggaggacggcgagccttactgcgagaaagattacatcaacctgttttcgactaagtgtcacggctgtgatttcccagtggaagctggtgataagttcatcgaagctttaggacatacgtggcacgacacatgcttcatttgtgcagtgtgccatgtgaatctggagggtcaacccttctattccaagaaggacaggcctttgtgcaaaaagcacgctcacacaatcaacctgtag

SEQ ID NO: 193313 - DNA, 993 bp, Artificial Sequence
  Description of Artificial Sequence: Synthetic coding sequence
atgagctacagcgtgaccctgaccggccccggcccctggggcttcaggctgcaaggaggcaaggacttcaacatgcctctgacaatcagcaggattacccccgggtcaaaggctgcacagtcgcagctgtctcaaggagatctggtggtagctatcgacggagtaaataccgacacaatgacccatctggaggcccagaataaaatcaagtccgcctcctacaatttgagcctgaccctgcagaaatccaaacggcccatacccatctctacgacagccccccccgttcagactccactccccgtaattccccatcagaaagacccggccctagataccaatggctctcttgtagcccccagcccaagccccgaggcacgggcttcccccggcactccagggaccccggagctacgccctaccttctcccccgcgtttagtcgcccatccgcatttagctctttggccgaagcatctgaccctggtccaccccgagcctccctgcgtgctaaaacttccccagagggagcgcgagatcttttgggacccaaagctctgccaggaagctcgcagccccgccaatacaacaatccgatcgggctgtactccgccgaaacgctccgggaaatggcgcagatgtatcaaatgagcttgcgcggcaaagcctccggcgtgggtctccccgggggatcacttcctataaaggatttggccgttgattcggcatcacctgtgtatcaggccgtgatcaaaagtcagaataagcccgaagatgaagctgatgaatgggcaaggagatccagtaatctgcaaagcaggtcattcaggatcctggcccagatgacaggaaccgagtttatgcaagatcctgatgaagaggctcttaggcggtcaagagaacgatttgagaccgagagaaattctccacggttcgcgaaactaagaaactggcaccacggtctatctgcgcagattctgaacgtgaaaagctag

SEQ ID NO: 193314 - DNA, 1413 bp, Artificial Sequence
  Description of Artificial Sequence: Synthetic coding sequence
atgagctacagcgtgaccctgaccggccccggcccctggggcttcagactgcagggaggtaaagacttcaacatgcccctgaccatttcgagaatcacccctggaagtaaggcagcccagagccagttgagtcagggggatctcgtcgttgccatcgacggcgtgaataccgataccatgacacacctggaggcacagaataagatcaaaagcgcttcctacaacctgtcccttacgctgcaaaagtcaaagagaccaattcccatttccacaacggctcctcctgtgcagaccccgctccccgtaattccacatcaaaaagccagctcttattccccagccgttgcagcttccagcgcgcccgctacccatacttcatattctgagggcccagccgcccctgcacctaagcccagagtggtgacgactgctagcattagacccagcgtctaccaacctgttccggcctcaacttactccccaagtcccggagccaactacagcccaaccccttacacaccgagtcctgcaccagcatatacccccagtcctgcccctgcttacaccccctcacctgtcccgacttacactccatcacctgctcccgcttacacgccctccccagcgcctaactacaacccagctcccagtgttgcttattcgggcggcccagcagagccggcttcaagaccaccatgggtaacggatgacagtttcagccaaaagttcgctcctgggaagtctacaactagcatcagtaagcagacactgcctcgagggggcccagcctatacacctgctggcccccaggtaccacctctggcacgaggcacagtgcaaagggccgagcgattcccagcgagttcaagaacccctctgtgcggtcactgcaacaatgtgattcggggtccctttttggttgccatggggaggtcatggcacccggaggagtttacgtgtgcgtattgcaaaacttctttggcagacgtctgttttgtggaggaacagaacaatgtctactgtgaacgctgctatgagcagttctttgcccccctctgtgctaagtgcaatactaagattatgggcgaagttatgcacgctctgagacagacgtggcacactacatgcttcgtgtgcgccgcttgcaagaaaccatttggaaatagcctttttcacatggaggacggcgagccctattgtgagaaggattacatcaatctgttcagcactaaatgtcacggatgcgacttccccgtcgaggctggagataagtttatcgaggccctggggcacacctggcacgacacatgcttcatctgcgccgtgtgccacgtcaacctggaaggacagccattctactctaagaaggatcgcccactttgcaaaaagcatgcccatacaattaatttgtag

SEQ ID NO: 193315 - DNA, 2184 bp, Artificial Sequence
  Description of Artificial Sequence: Synthetic coding sequence
atgagctacagcgtgaccctgaccggccccggcccctggggcttccgccttcagggaggaaaagattttaacatgccactgacgatctcccggattacccccggctctaaagctgcccagtctcagctgagccaaggggatcttgttgtcgccattgatggagtgaataccgatactatgacacatctcgaggctcagaataagattaagagcgcaagctacaacctatcgctgactctccagaaatctaagcggccgatcccaataagtaccacagctcctcccgttcagactcctctccccgtaattccacaccagaaagacccggccctcgacaccaacggctctctcgtggccccatcgccatcgccagaagcacgggcctcccccggaacacccgggacgcccgagctccgcccgacgtttagtcctgccttcagccggccatctgcatttagttccctggcggaggccagtgatcccggaccccctagggccagtctgagagcgaagacgagcccagagggagcccgcgaccttttagggccgaaggcccttcccggctccagccagccacgccaatacaacaatcctataggtttatactctgctgaaactcttcgagaaatggcacaaatgtatcaaatgtcgcttcgggggaaagcgagcggggtgggcctgcccggcggatctctacccatcaaggatctggccgtggattcggctagtcctgtgtaccaggccgtgattaagagccagaataaacccgaggacgaggcagacgagtgggcacgccggagttcaaatcttcagtcacgcagctttcggatcttggcacagatgacaggaacagagttcatgcaggatccagacgaagaagccctgcgacggagctccacacctatcgagcatgcccccgtctgcacatctcaagccaccacaccgctgctaccggcatccgctcaacctcctgctgcagccagtccttccgctgcttcccccccgttggccaccgccgccgcccacacggctattgcatctgcctccactacggcacctgcgtcctcccccgccgattctccaaggcctcaggcttctagctacagccctgccgtagccgccagtagcgccccagcgactcacacctcctattctgaagggccagcagcgcccgcacccaagccccgggtagtgaccactgcatctattagaccctctgtataccagcccgtgccagcttccacatattcaccttcaccaggcgcaaattacagtccaaccccatacacaccttcccctgcccctgcctataccccctcccccgctcctgcttatacaccctccccagtgcctacatacactcccagcccagctccagcctacacaccttccccagcccctaattacaatccagctccttctgtagcatactccggaggtcctgcagagccggcctcccgtccaccttgggttactgacgacagcttttctcagaaattcgctcctgggaaatcaactacaagtatctccaaacagacccttccgcgcggaggacctgcctacacccctgccgggcctcaggtccctcccctggccagaggcacggtgcagcgagccgagaggttccctgcaagcagcaggacccccctgtgtggacattgcaataacgtgattcgaggtcctttcctagtggccatggggagaagctggcacccagaggaattcacctgtgcatactgtaagacctcattagccgatgtttgctttgtggaagagcagaataacgtgtattgtgagagatgctacgagcagtttttcgcccctctgtgtgcgaagtgcaatactaagattatgggggaggtcatgcatgcgctgcgccagacctggcacaccacgtgttttgtgtgtgcggcgtgcaagaaacccttcggcaattctctgtttcacatggaggacggagagccatactgcgagaaagactacattaacctattcagtacaaaatgccatgggtgtgactttcctgtggaggcaggagataagtttatcgaagcattgggtcacacatggcatgacacgtgcttcatctgtgctgtgtgtcatgtgaatctggagggacagccgttttacagcaagaaagatagaccgctgtgcaagaagcacgctcataccatcaatttgtag

SEQ ID NO: 193316 - DNA, 1197 bp, Artificial Sequence
  Description of Artificial Sequence: Synthetic coding sequence
atgagctacagcgtgaccctgaccggccccggcccctggggcttcagactccaaggcggcaaagatttcaatatgcctctgacgatcagccggattacaccaggatctaaggctgctcaatcccagctgagccagggcgatcttgtggtggccatcgacggcgttaatacagacacaatgacacatctggaagcgcaaaacaaaatcaagtccgcaagctataaccttagtctgaccctgcaaaagtccaagcgaccaattccaatcagtaccactgccccccccgtacagacgcccttacctgttatcccgcaccaaaaggacccagctctggacactaatggctctttggtggctccaagcccgagcccggaggcaagagcatcgcccggcacacccggtacgccagaactgcgcccgacatttagccctgccttctctcggccttcagcattttcatccctcgcggaggcaagtgaccccggcccgcctagggcttccctgcgcgccaagacgtcacccgagggcgccagggaccttctcggacccaaagcgctacctggcagctcacagccccgccagtacaacaatcctatcgggctgtactcagccgagactcttcgggagatggcccagatgtaccagatgtcacttcgggggaaagccagtggcgtgggccttcctggcggagccgattatcaggaaagatttaacccaagtgccttaaaggattccgccctgtcaactcacaaacctatcgaagttaaaggtctcggtgggaaagctaccattattcacgcacaatacaatacaccaatcagtatgtatagccaggacgctatcatggacgccatcgcagggcaggcacaggctcaagggagcgatttctccgggagcctaccaataaaagatctagcggtggatagcgcctctccggtgtatcaggcagtcatcaagtcccagaataaaccagaagatgaggctgacgagtgggcgcggcgctccagcaatctccaatcccggagttttagaatcctggcccaaatgaccggtaccgagttcatgcaagaccccgacgaggaggccttgcgcaggtccagggagaggttcgaaaccgaacgcaacagcccaagattcgcaaaactaaggaactggcaccacggcttgtccgctcaaatcctgaatgtaaaatcctag

SEQ ID NO: 193317 - DNA, 852 bp, Artificial Sequence
  Description of Artificial Sequence: Synthetic coding sequence
atgagctacagcgtgaccctgaccggccccggcccctggggcttccggctgcagggtggcaaggactttaacatgccactaactataagccggataacaccaggctccaaggccgctcaatctcaactgtctcagggcgacctggttgtggcgattgacggtgtgaacaccgatactatgactcacctcgaggcccagaataagatcaaatctgcgtcttacaatctctcccttactttgcagaagtcaaagagacctattcctatctccacgacagctccacccgtacagacaccactgccagtgattccacaccaaaaagtagtggtgaattcgccagctaatgctgattaccaggagcgtttcaatccctccgctctgaaagacagcgctctgagcacgcacaagcccatcgaagtgaaaggattgggcgggaaggccactattattcatgcccagtataacaccccgatcagtatgtacagtcaggatgccatcatggatgccatcgccggccaggctcaagcccagggctccgattttagcggctctctccctatcaaggaccttgccgtggattctgccagccccgtatatcaggctgtcattaaaagtcagaataagcccgaggatgaggccgatgagtgggcccgcaggagctcaaacctccagtctcgttcattccgcatcctggcccaaatgacggggaccgaattcatgcaggacccggatgaggaggcactacggcgcagcagagagcggttcgaaaccgaacggaacagtcccaggtttgccaagcttaggaactggcaccacggcctgtccgcacagattctcaatgtgaagtcttag

SEQ ID NO: 193318 - DNA, 2199 bp, Artificial Sequence
  Description of Artificial Sequence: Synthetic coding sequence
atgagctacagcgtgaccctgaccggccccggcccctggggcttccgactacaagggggcaaggacttcaacatgcccttgacaataagcagaatcactccaggtagcaaggccgcccagagccaactttcccaaggcgatctggttgtggctatcgacggagtgaacacagatacaatgactcatctcgaggcacagaataagattaaaagcgcatcttataatctgagtctgacactgcaaaagtccaaaaggcctattccaattagtacaacagcacctcccgtccagacccctctcccggtgatcccacaccaaaaagaccctgctctggacaccaatgggtcactcgtagccccctcgccctcccctgaagccagggccagcccaggaacgcctggaactcccgaactgcggcctaccttcagtcctgccttttcccggccctctgccttttctagtctggccgaggcttccgatccgggtccgccaagagcaagcctgcgtgccaagacgtcccctgaaggcgcccgcgacctgctgggcccgaaggctctccctggatccagccagccccgccaatataacaacccaataggactgtattcagccgaaacactgcgagaaatggcccaaatgtaccaaatgtccctaaggggcaaggcaagtggcgtcggtcttcctgggggagcagactaccaagaacggtttaatccctctgccttgaaggatagtgccttgtccacacacaagccaatagaagttaaagggctgggcggcaaagccacaataattcacgcccagtataatacaccaatatccatgtattcccaggacgcaatcatggatgccattgctgggcaggcgcaggctcaaggaagtgacttttctggctccctgccaattaaagacctggctgtagacagcgctagtcctgtttaccaagccgtgatcaagtcacaaaacaaacctgaggatgaagctgatgagtgggccaggaggtcgtctaacctgcaatctaggtcgtttcgaatcctcgcccagatgactggcaccgaattcatgcaggaccctgatgaggaagctctcaggcgcagccggccgcaagcttcttcatacagtcccgctgtagccgcctccagcgcccctgccacccacaccagctactcagaaggccccgctgctcccgcccctaaaccaagagttgtgacaacagcctccattcggccgagtgtgtaccagcctgtgcctgcttccacttatagtccttcccctggtgcgaactattcccctactccgtatacaccatcgcccgcacccgcatataccccatccccggcccctgcctatactcctagtcctgtgccaacttacaccccttccccagctcccgcgtataccccctcgccggcccccaattataatcccgccccaagtgtcgcatattcagggggcccagctgagcccgcatccaggccaccttgggtgaccgatgacagcttctcccagaaattcgctcccggtaaaagcactactagcataagcaagcagaccctgcctcgcggcggacccgcttacactcccgctggccctcaggtcccccccctggcacgtggcacagtgcagcgagccgagcgtttcccagcctctagccgcactccactatgtggccattgcaacaacgtgatcagaggtccatttctcgtcgctatggggaggtcatggcacccagaggaattcacgtgtgcttattgtaagacctctcttgccgacgtgtgctttgtggaggagcagaataatgtgtactgtgagcgttgttatgagcagttctttgccccactgtgcgccaagtgtaatactaaaattatgggagaagtgatgcacgcattgcgccagacttggcacaccacatgctttgtgtgtgcagcctgtaaaaagccattcggaaattcactcttccacatggaagacggcgaaccatattgcgagaaggattatatcaatctgttctcaacgaagtgccacggctgtgactttcctgtggaagctggcgacaaatttatcgaggcattagggcatacatggcacgatacctgcttcatctgcgcggtgtgccacgtgaacctggaggggcagccattttattctaaaaaagatcggccgctgtgtaaaaagcatgcccacaccattaacctctag

SEQ ID NO: 193319 - DNA, 1854 bp, Artificial Sequence
  Description of Artificial Sequence: Synthetic coding sequence
atgagctacagcgtgaccctgaccggccccggcccctggggcttcaggctgcagggcgggaaggacttcaatatgcctctcacgattagcagaatcacacccggaagtaaagctgcacagtcgcaattgagtcaaggggacctggttgtcgctattgacggcgtgaataccgacacaatgacccaccttgaagcacagaataagattaaatccgcttcttacaacttatctctgacattacagaagtccaaacgcccgatccccatcagtacgactgctcctccagtgcagactcccctccccgtgattccgcaccagaaagtggtcgtaaactctccagcgaacgccgactatcaggagcgcttcaacccaagcgcactgaaggactctgccttgagtacgcacaaacccattgaagtgaagggacttgggggaaaagcgactatcatccacgcccagtacaacactccgatatctatgtacagccaggacgcaatcatggatgctatagcaggtcaggcccaagctcaggggtctgacttttcaggaagcctgcccataaaagatctcgcagtggacagcgcgtctcccgtgtaccaggccgtgatcaagtcgcagaataaacccgaagacgaggcggacgaatgggcccggaggagctccaacctgcagagtagaagcttcaggatcttagcccagatgaccggcacagaatttatgcaggacccagatgaggaagccttgcgaaggtcccgcccacaagccagctcttacagccccgccgtagcggccagtagtgcaccagccacccacacttcctactccgaggggcctgccgctcctgctccaaaaccccgcgttgtgaccaccgccagcattagacccagcgtgtaccagcccgtgcctgcctccacttactcgccgtcacctggcgcaaattactctcctaccccatacaccccaagtcctgccccagcttacactccatcccctgcccctgcatacactcctagccccgtgccgacctacacccccagccccgcccccgcttacacaccttccccagcacccaactacaatcccgcaccgtcggtagcctacagcggcggtccagccgaacctgcaagtaggccaccatgggtaacggatgactctttttcccagaagtttgctcctggcaaatcaaccaccagcatcagcaaacagacactaccccggggcggtcccgcttacacgccagcaggcccacaggtgccacccctggcccgagggactgtgcagagagccgagaggtttccggcctcatcccggacccctctctgtggccactgcaataacgtcatccgaggccccttcctggtggcaatgggccgaagctggcatcccgaggagttcacatgtgcgtactgcaaaactagcctggccgatgtgtgcttcgttgaagaacaaaataacgtctactgtgaaaggtgctacgaacagttttttgccccactctgcgccaaatgcaacacaaagataatgggggaggtaatgcatgcactgcgacagacctggcatactacctgcttcgtctgcgccgcctgtaaaaagccattcgggaatagtctgtttcatatggaggatggcgaaccttactgtgagaaggactatatcaaccttttctccactaagtgccacggatgcgatttcccagttgaggcgggcgataagtttattgaagcgctaggtcacacctggcatgacacttgctttatctgcgccgtctgtcacgtgaacctggaagggcaacccttttactcgaagaaggacagacctctgtgtaagaaacacgcgcacaccattaacctatag

SEQ ID NO: 193320 - DNA, 1947 bp, Artificial Sequence
  Description of Artificial Sequence: Synthetic coding sequence
atgagctacagcgtgaccctgaccggccccggcccctggggcttccggctgcaggggggcaaggactttaatatgcctttaaccatcagtcgcatcacacccggcagcaaagccgcccaaagccagctttctcagggcgaccttgttgttgcgattgacggtgttaacaccgatacgatgactcacctggaggcccagaacaaaattaagagtgccagctacaatctgtcccttactctccaaaaatccaaaaggcccatcccaatctctacaaccgcacccccagtgcagacacccttaccagtcatcccacatcagaaagaccctgcgctggatacaaatggcagcctcgtggcccctagcccttctcctgaagctcgggcgtcacctggtacacctggtacccccgaactgagacccaccttttcaccagccttctcacggccaagcgcattctcgtcactagctgaagcatcagaccctggcccccctcgagcatctcttagagcaaagacttcaccagaaggggcaagagatcttctgggacccaaggcactccctggttcctctcagcctcggcagtacaacaaccctattggcttgtactccgcagaaacgctgcgtgagatggctcagatgtatcagatgtctctgagagggaaggctagcggtgttgggcttcccggaggaagcctgcctatcaaagacttggcggtggactccgcctccccagtgtaccaagctgtgataaagtcacaaaacaaaccagaagatgaagcagacgagtgggcacgaagaagctccaatctgcagtcccggtcttttaggattttagcccagatgaccgggacagagttcatgcaggatcccgacgaagaagcccttcgtcggagccgccctcaagctagcagttactctccagccgtcgccgcctcctccgcccctgccactcacacttcttactccgaaggaccggccgctccagctccgaagccacgggtggtgaccacagctagcatcaggccttctgtctaccagcctgtccctgcgagtacctacagcccaagtccaggcgcgaattattccccaactccctacacacctagtcctgtgccaacatacacccctagcccagcccccgcgtataccccttcccctgccccaaattacaatcctgccccctccgtggcctactccggaggacctgctgagcctgccagcagacccccttgggtgacagacgacagttttagtcaaaaatttgctccagggaagtcaacgacgtcaattagcaagcaaactcttcccagaggcggacccgcctacactccagctgggcctcaggttccacccctcgctcgcggcaccgtgcaaagggcagagcggtttcctgcatcttcgagaacgccgctctgtggccactgcaataacgtgatccgcggaccatttctggtggcaatggggcgatcttggcacccggaagaattcacatgtgcgtattgcaaaacatccctcgccgatgtgtgcttcgttgaggaacagaacaacgtctattgcgaacggtgctacgaacagtttttcgctccactgtgtgctaagtgcaatacaaagatcatgggtgaggtgatgcatgccctgagacagacttggcacactacgtgtttcgtctgtgccgcctgcaaaaaacctttcgggaacagtctgttccatatggaggatggagaaccttactgcgagaaggactacatcaacctgttcagcaccaagtgccacggctgtgacttccccgtagaggcaggcgataagttcatcgaggcattgggtcacacctggcatgacacctgtttcatttgtgccgtctgccacgtcaatttggagggtcagcccttctatagtaaaaaggatagacctttgtgtaagaagcacgctcataccatcaacctgtag

SEQ ID NO: 193321 - DNA, 696 bp, Artificial Sequence
  Description of Artificial Sequence: Synthetic coding sequence
atgagctacagcgtgaccctgaccggccccggcccctggggcttccgtttacagggcggcaaagactttaacatgcctctcacaatcagtcgcatcacccccggctcgaaagcggcgcagtcacagttaagccagggcgatctggtggtggctatagacggcgttaacacagacactatgacacacttagaggctcagaacaagatcaagagtgcgtcttacaacctgtcccttacactccagaagtccaaacggcctatccctatctccacaacagctccacctgtgcagaccccacttcctgtgatcccccaccagaaagaccctgcgcttgatactaacggctcccttgtcgccccgagcccaagtccagaggcgcgggcttcccccggcaccccagggacccccgagctcaggcctacatttagtcccgccttcagtcgaccctcagcttttagctctctggccgaagcttcagatcctggcccaccccgcgcgagtctccgcgctaaaaccagccccgaaggtgctcgcgacctcctcgggcctaaggcacttcctggatcgtctcagccacgacaatacaacaaccctattggtctctatagtgccgaaacactgagagagatggcccagatgtatcagatgagcctccgggggaaggcatccggcgtagggttgcctggtggatggtag

SEQ ID NO: 193322 - DNA, 1839 bp, Artificial Sequence
  Description of Artificial Sequence: Synthetic coding sequence
atgagccaccccagctggctgccccccaagagcaccggcgagcccttgggtcatgttcccgcccgcatggagacaacacattccttcggcaacccttccatcagcgtcagcacccaacagccccccaaaaaattcgccccggtcgttgccccaaagccaaaatataatccgtataagcagcccgggggggagggcgacttcctccctccccctcctcctccactggacgactccagtgccttgccatctattagtggcaatttcccaccaccacctcccctcgacgaggaagcattcaaagtgcaaggtaaccctggtggcaaaactttggaggagagacggtcctcactggacgctgagatagactcgttaacctcaatactggccgatttggagtgctcgtctccttataagccgcgacctccacaatccagtacgggatccaccgcatctcctcccgtgtctactcctgttactggccacaagcggatggttatcccgaaccagcctcccctcaccgcaaccaagaagtctaccctgaagcctcagcctgccccacaagcaggcccaatccctgtcgcacctatagggacactgaagccacaaccccagccagtgccagccagttatacaaccgcctctacctcaagtcgcccaactttcaacgtacaggtaaagtcggcacaaccctcccctcactacatggccgctccctccagcgggcagatatacggctccggaccccagggttataatacacagcccgtccccgtatcaggccaatgcccccctccttcgacacgaggaggcatggattacgcatatatcccgcccccaggccttcaaccagagccaggatatggatatgcaccaaatcaggggcgttattacgagggatactacgctgctggacccgggtacggcggtcggaatgattccgatcctacgtatgggcaacagggccaccccaacacgtggaagcgtgaaccaggttatacccccccgggcgctgggaatcagaacccccccggcatgtaccctgtgacaggtccaaagaaaacctacattaccgaccccgtgtctgccccgtgtgccccaccactacagcctaaaggtggtcattccggccagttgggtccctccagcgtggcgccaagctttagaccagaagacgaactggaacacctcacgaagaaaatgctctatgacatggagaatccgccagccgacgaatactttggcaggtgtgctagatgtggtgagaacgtggtaggcgaagggacagggtgtaccgctatggaccaagtctttcacgtcgattgctttacttgtataatctgtaataataagctgcgcggtcagccgttttatgctgtggaaaaaaaggcttattgcgagccatgctacataaatacattagagcaatgtaacgtgtgctccaagccgattatggaacgcattctcagggccaccgggaaggcttaccaccctcactgcttcacctgcgttatgtgtcataggagcctagacggtattccatttaccgtagacgctgggggactgatccattgtatcgaagactttcacaaaaagttcgctcctcgatgttccgtgtgcaaggagcccatcatgccggccccagggcaggaagagacggtgagaatcgtggcactggaccgcgatttccacgtccactgctaccgttgtgaggattgcggcgggctcctttctgagggcgataatcagggttgctatcctttggacggtcatatactgtgtaaaacctgtaacagcgcgagaatccgagtcttgaccgccaaggcctcaacagatctgtag

SEQ ID NO: 193323 - DNA, 282 bp, Artificial Sequence
  Description of Artificial Sequence: Synthetic coding sequence
atgagccaccccagctggctgccccccaagagcaccggcgagccccttgggcacgtccctgctcgtatggaaaccactcactcttttggcaatccgagtataagcgtcagcacacaacagccaccaaaaaagtttgctcccgtggttgcccctaagcctaagtataacccatacaaacaaccgggaggggaaggggatttcttacccccaccccccccaccgctggatgatagctcggccctgccaagtatctccggtaacttcccccccccaccaccttag

SEQ ID NO: 193324 - DNA, 456 bp, Artificial Sequence
  Description of Artificial Sequence: Synthetic coding sequence
atgagccaccccagctggctgccccccaagagcaccggcgagccccttggacacgtgcccgccaggatggaaactactcacagctttggaaacccatcaatctctgtgtcaacacagcaaccccctaaaaaattcgcacccgttgtcgctcccaagcctaaatataatccgtacaagcagccgggcggagagggcgactttttaccccccccacccccccccctagacgattcctccgccctcccttccatttccgggaattttccccccccaccgcccctcgatgaggaggcattcaaggtacagggtaatcctgggggcaagacgttggaggagcggcggtcctctctggacgccgagattgactccctgaccagcattttggctgatctggagtgcagttctccatataaacctcggcccccgcaaagctccaccggatccactgcctcttag

SEQ ID NO: 193325 - DNA, 336 bp, Artificial Sequence
  Description of Artificial Sequence: Synthetic coding sequence
atgagccaccccagctggctgccccccaagagcaccggcgagcccctcggacacgtgcccgcgcgaatggaaaccacgcacagtttcggcaacccctcgatttcggtgtctacacagcaaccacccaagaagttcgcacccgtggtagctccaaaacccaaatataatccctataaacagcccggcggagagggagacttcctgccaccaccaccccctccgttggatgatagctcagcacttccctctatcagcggcaactttcctccccctccccccttggatgaggaagcattcaaagtgcaaggaaaccctgggggaaagacactggagtag

SEQ ID NO: 193326 - DNA, 201 bp, Artificial Sequence
  Description of Artificial Sequence: Synthetic coding sequence
atgagccaccccagctggctgccccccaagagcaccggcgagcccttgggccatgtccccgccaggatggagaccacacattcattcggaaatcccagcatcagcgtgtctacccaacagccgccgaaaaagtttgctcccgtcgttgcacccaaacccaaatataatccatataaacagcccgggggagagggcgactag

SEQ ID NO: 193327 - DNA, 162 bp, Artificial Sequence
  Description of Artificial Sequence: Synthetic coding sequence
atgagccaccccagctggctgccccccaagagcaccggcgagccccttggtcatgtccctgctaggatggagacaacccatagctttggaaatcccagcattagcgtatcaacccagcaacccccaaaaaagttcgcgccagtggtagcccccaaaccttag

SEQ ID NO: 193328 - DNA, 144 bp, Artificial Sequence
  Description of Artificial Sequence: Synthetic coding sequence
atgagccaccccagctggctgccccccaagagcaccggcgagcccttgggtcatgtacccgctagaatggaaaccactcacagtttcggcaatccctctatctccgtgagcacacagcagcctcccaaaaagttcgctccatag

SEQ ID NO: 193329 - DNA, 1287 bp, Artificial Sequence
  Description of Artificial Sequence: Synthetic coding sequence
atgagccaccccagctggctgccccccaagagcaccggcgagcccctgggccacgtacctgcccggatggagaccacccatagttttggcaatccgtccatctctgtgagcacccaacaaccaccaaagaagtttgctccagtggtggcacccaagccaaaatacaacccctacaagcagccagggggggagggggacttcttgccgccgcctcccccacctctagacgactcaagtgcgttaccaagtatctccggaaatttccccccacccccccctctcgacgaagaggcttttaaagtccagggcaaccccggaggaaagaccctggaagagaggcgaagctctctggatgccgaaatagacagtctcacaagcatcttagctgatctagagtgtagcagtccatacaaacccaggccaccgcagtcaagcaccggaagtactgctagtccacctgttagtacccctgtgaccggccacaaacggatggttatacccaaccagccgcccctaacagccacaaagaaatctactctcaagccgcaacctgcccctcaagcaggaccaattcctgtggcacctatagggaccctaaaaccgcaacctcagcccgttcctgcttcctacacaactgctagcactagctctcgccccacctttaatgtgcaagtgaaatccgcccaaccgagtcctcactacatggctgcaccatcttctgggcagatatacggatctggtccacagggctataacacacagcccgtgcctgtgtcaggacaatgcccaccaccaagcacccgcggagggatggattatgcttacatcccacctccaggcttgcagccggagcccggatacggttacgccccaaatcagggtaggtactacgagggctattacgcagcagggccaggctacggcggacggaatgactccgaccctacttacgggcaacagggccatcctaatacctggaaaagagagcctggatacacccctccaggcgcaggcaaccagaacccaccagggatgtaccccgtgactgggccaaagaagacctatattaccgatcctgtgtccgccccttgcgctccccccttacagcccaaaggcggccactcaggtcaactggggccgtcatccgtagctccttccttccgtcccgaggatgagttagaacacctgactaaaaagatgttgtacgatatggaaaacccccccgcggacgaatacttcggagaatggggcctggagctgacaagtgaagtcactatactgctctag

SEQ ID NO: 193330 - DNA, 198 bp, Artificial Sequence
  Description of Artificial Sequence: Synthetic coding sequence
atgagccaccccagctggctgccccccaagagcaccggcgagcccttgggtcacgtacctgctcggatggagaccacccatagctttgggaatccaagtatctcggtgtccactcagcagccgccgaagaaatttgcacctgtagtagctccaaaacctaagtataacccatacaagcagcccggaggcgaagggtag

SEQ ID NO: 193331 - DNA, 174 bp, Artificial Sequence
  Description of Artificial Sequence: Synthetic coding sequence
atgagccaccccagctggctgccccccaagagcaccggcgagccccttgggcatgttccggcaaggatggagaccactcacagcttcgggaatccctctataagcgtcagtacacaacaaccacccaaaaaattcgcacctgtggttgctcctaaaccgaaatataacccttag

SEQ ID NO: 193332 - DNA, 1839 bp, Artificial Sequence
  Description of Artificial Sequence: Synthetic coding sequence
atgagccaccccagctggctgccccccaagagcaccggcgagcccctggggcacgtcccggcaaggatggagactacacacagcttcgggaatccgtctatctctgtaagtacccagcagccgccgaaaaagttcgctcctgtggtcgcccctaagcccaagtataatccgtacaagcagcctggcggcgaaggggattttctcccccccccgcctccgcctttggatgactctagtgccttgccatctattagcggaaacttccccccccctcctccattagatgaggaggcatttaaagtacagggaaacccgggtggaaaaacactggaggaaaggcgctctagcctggatgctgagatcgattcgcttacatcaatcttggctgatctggagtgtagttcaccctacaaaccaagacctccccagagcagcactggcagcaccgcaagcccaccggttagtacccctgtcacgggccataagagaatggtcattccaaatcagcctccattaaccgcaactaagaaaagtacacttaagcctcagcccgcccctcaagctggtcccattcctgtagccccgattggcacactcaaaccccagccacaaccagttccagccagctataccaccgccagcacaagctccagacccacattcaacgtgcaggtaaagagtgcacagccctctcctcactacatggccgctcctagctcagggcagatatacggctccggaccccaggggtacaacacacagcctgtcccagtatccggccagtgccctcctcccagcacacgtggcggcatggattatgcttacataccccctcctggtctgcagccggaacctggttacggctacgcccccaatcagggccggtactacgagggatactatgcggcagggcccggatatggagggcgcaatgattccgaccccacatacgggcagcagggccacccgaacacttggaagagagagcctggctacactccacccggcgctggcaaccagaatccgccaggaatgtaccctgtcaccgggccaaagaagacatacatcactgacccggtgagcgccccatgcgcccctcccctacaacccaagggggggcactcgggccagctcggtccttcttccgttgcccctagcttccgccccgaggatgagctggaacacctgacaaagaagatgctatacgacatggaaaatcccccggcagatgagtacttcggtagatgcgcccggtgcggggagaacgtagtcggcgagggaaccggctgtaccgccatggatcaagtcttccacgttgactgtttcacttgcatcatctgcaacaacaagctgagagggcagccattttacgccgtggagaagaaagcgtactgtgagccgtgctacattaatactctggaacagtgtaacgtgtgctctaagccaattatggagagaatcctgcgagccaccggcaaagcttaccacccacattgtttcacttgcgtcatgtgtcaccggtcactggatggcatccccttcacggttgatgcaggcggcctgatccattgcatcgaagattttcacaaaaagttcgccccccgctgtagcgtgtgcaaagagccaattatgcctgccccgggccaagaggaaacggtccgtatcgttgcacttgaccgtgatttccatgtccattgttataggtgtgaggattgcggaggcctgctctccgagggggataaccagggttgctatccactcgacggtcatattctgtgtaagacctgcaacagcgccagaatccgggtgcttacagccaaggcttcaacagatctgtag

SEQ ID NO: 193333 - DNA, 471 bp, Artificial Sequence
  Description of Artificial Sequence: Synthetic coding sequence
atgcagaagaaggagaagagcttcggcatccagatgctgagcgtgcagccagacacgaaacctaagggctgcgccgggtgcaataggaaaattaaggatcggtatctcctgaaagcgctggataagtactggcatgaggactgcctcaagtgtgcctgctgcgattgtagactcggtgaggtgggtagcaccctgtacacaaaagctaacctcatcttatgcaggagagattacctccgtctcttcggagtgacaggtaactgcgctgcctgttctaagcttataccagccttcgaaatggtaatgagagctaaggacaacgtgtaccacctggattgcttcgcttgccaactttgcaaccaaaggttttgtgttggcgataagtttttcctcaagaacaacatgattctgtgccaaacagactacgaggaaggactcatgaaagaggggtatgccccacaagtgagatag

SEQ ID NO: 193334 - DNA, 438 bp, Artificial Sequence
  Description of Artificial Sequence: Synthetic coding sequence
atgctgagcgtgcagcccgacaccaagcccaagggctgcgccggctgcaaccgcaagataaaggacagatacctattaaaggccctcgacaaatactggcacgaggattgtttaaagtgcgcctgttgtgattgccgcctgggtgaagtgggcagcaccttgtatacaaaagctaacctgatcttgtgtagacgggattacctgcggctatttggagtcaccggtaactgcgctgcttgtagcaagctcattccggcctttgaaatggttatgagagccaaggacaatgtataccatctcgactgtttcgcatgtcaactgtgtaaccagaggttttgcgtgggcgacaagtttttcctgaaaaataacatgatcctgtgccagaccgactacgaggagggtctgatgaaggagggttatgccccacaggttagatag

SEQ ID NO: 193335 - DNA, 438 bp, Artificial Sequence
  Description of Artificial Sequence: Synthetic coding sequence
atgctgagcgtgcagcccgacaccaagcccaagggctgcgccggctgtaaccgcaagattaaagatcggtatctgctgaaggctcttgataagtattggcacgaagactgtctgaagtgcgcgtgctgcgactgcagattgggtgaggtggggtccacgctgtacaccaaggctaacctaatattatgtcggcgtgattacttgcggctgttcggggtgacaggtaattgtgctgcctgttctaagttaatccccgcgttcgagatggtaatgagggctaaggataacgtgtaccatctggattgcttcgcttgccaattgtgcaatcaacgcttttgcgtcggagacaaattcttcctgaaaaataacatgattctgtgccagacagattatgaagagggcctgatgaaggagggatacgcacctcaggtgaggtag

SEQ ID NO: 193336 - DNA, 438 bp, Artificial Sequence
  Description of Artificial Sequence: Synthetic coding sequence
atgctgagcgtgcagcccgacaccaagcccaagggctgcgccggctgcaaccgtaaaatcaaggatcgctatctcttgaaggccctggataaatactggcatgaggactgccttaagtgtgcatgctgtgactgccgactaggtgaagtgggctctacactgtatactaaggccaacctaatcctgtgtcgcagggattatctgcggctctttggcgtgacagggaattgcgccgcctgctctaagttgatccctgcatttgagatggtaatgagggccaaagacaacgtataccacctggattgtttcgcctgccagctgtgtaatcagcgcttctgtgtaggtgacaaattcttcctcaagaataacatgatactttgccagaccgattatgaagaaggtctcatgaaggaggggtatgctcctcaggtgcggtag

SEQ ID NO: 193337 - DNA, 438 bp, Artificial Sequence
  Description of Artificial Sequence: Synthetic coding sequence
atgctgagcgtgcagcccgacaccaagcccaagggctgcgccggctgcaaccgcaagataaaagaccgctacctgcttaaggccctcgataagtactggcacgaagactgcctcaagtgcgcttgctgcgattgtaggcttggagaggtcggctctaccctgtataccaaggccaaccttatcctttgtcgccgcgactatcttaggttattcggcgtcaccgggaattgcgcagcctgctcaaaacttatccccgcttttgagatggtgatgagagccaaggataatgtgtatcaccttgactgcttcgcctgccagttgtgtaaccagcggttttgcgtgggggataaatttttcctcaagaacaatatgatcctgtgccagactgactacgaggagggccttatgaaagagggctacgcaccccaagtgcgttag

SEQ ID NO: 193338 - DNA, 438 bp, Artificial Sequence
  Description of Artificial Sequence: Synthetic coding sequence
atgctgagcgtgcagcccgacaccaagcccaagggctgcgccggctgtaacaggaagattaaagatcggtatttactaaaagcattagataaatactggcatgaagattgtttgaagtgcgcctgctgtgattgtcgactaggcgaagtgggatcaacgttgtataccaaagcgaatctcatcctctgtaggcgcgattacttgcggctattcggagtaactgggaactgcgccgcatgcagtaaactgattccagcttttgaaatggtgatgcgggccaaggacaatgtataccacctggactgttttgcgtgtcaactctgtaaccagagattctgcgttggggataagtttttcctgaaaaataatatgatactctgccagaccgattatgaggaggggctcatgaaggagggttatgccccccaggtgcgctag

SEQ ID NO: 193339 - DNA, 438 bp, Artificial Sequence
  Description of Artificial Sequence: Synthetic coding sequence
atgctgagcgtgcagcccgacaccaagcccaagggctgcgccggctgcaaccgcaagattaaggatcggtatctcctgaaagccctcgataagtattggcacgaagactgtttaaaatgtgcatgttgcgattgccggttgggggaggttggtagcaccctttataccaaggccaacttaattctctgccgcagggactacttaagactctttggggtaactggcaattgcgcagcctgtagtaagttgattccggcttttgaaatggtgatgagggccaaggataacgtttaccaccttgactgttttgcatgccagttgtgcaaccaacggttttgcgtgggtgacaagttcttcctcaagaataacatgatattgtgtcaaaccgactacgaggagggtcttatgaaggagggctacgcaccccaggtgcggtag

SEQ ID NO: 193340 - DNA, 438 bp, Artificial Sequence
  Description of Artificial Sequence: Synthetic coding sequence
atgctgagcgtgcagcccgacaccaagcccaagggctgcgccggctgcaataggaagataaaagacaggtacttgctgaaggctctggataagtactggcacgaggactgtctgaaatgtgcctgttgtgattgtagactcggcgaggtaggcagtaccttgtacacaaaggccaacctgatcctctgccggagggattacctccgcttgtttggagtcacggggaattgtgccgcttgtagcaagctgataccggcatttgagatggtaatgagagctaaggacaacgtgtatcacctggattgcttcgcctgtcagctgtgtaatcagagattctgcgtcggcgacaagttctttcttaagaacaatatgatcctgtgccagacagattatgaggaaggtctcatgaaagagggttatgcaccgcaggtgagatag

SEQ ID NO: 193341 - DNA, 357 bp, Artificial Sequence
  Description of Artificial Sequence: Synthetic coding sequence
atgctgagcgtgcagcccgacaccaagcccaagggctgcgccggctgtaatcgcaaaatcaaggacagatatctcctgaaggccctggataaatattggcacgaggattgtctcaaatgcgcttgctgcgattgtagattgggagaagtcggctccaccctgtatacgaaagctaatctgatcctatgtcgcagagattaccttcgcctattcggggtcaccggtaattgtgccgcttgctccaaactaattcccgcgtttgaaatggtgatgcgggccaaggacaacgtgtatcacttggactgtttcgcatgccagttgtgcaatcagcgcttttgtgtcggggataaattttag

SEQ ID NO: 193342 - DNA, 177 bp, Artificial Sequence
  Description of Artificial Sequence: Synthetic coding sequence
atgctgagcgtgcagcccgacaccaagcccaagggctgcgccggctgtaatcgtaaaatcaaagatagatacttgctcaaagctctggataagtactggcacgaggactgccttaagtgcgcctgttgcgactgcagattaggggaggtcgggagcactctgtacactaaagcgtag

SEQ ID NO: 193343 - DNA, 294 bp, Artificial Sequence
  Description of Artificial Sequence: Synthetic coding sequence
atgctgagcgtgcagcccgacaccaagcccaagggctgcgccggctgcaacaggaagatcaaggacagatatctgctgaaggccttagacaagtactggcacgaagattgtctgaagtgtgcctgctgcgactgtcgcttgggggaggttggcagcacattgtacaccaaggcaaaccttatcctttgtcgccgtgattacttgagactctttggggtgaccgggaactgtgccgcttgcagcaagctgataccagccttcgaaatggtgatgcgagctaaagacaatgtctag

SEQ ID NO: 193344 - DNA, 357 bp, Artificial Sequence
  Description of Artificial Sequence: Synthetic coding sequence
atgctgagcgtgcagcccgacaccaagcccaagggctgcgccggctgcaaccgcaagattaaagacagatacctactgaaggccctggacaaatactggcacgaagattgcttgaagtgtgcttgttgcgactgccggctaggcgaagtggggagtacactctacaccaaagccaacctgatcctgtgcaggcgagactatctacgcttgttcggtgttaccggtaattgtgcggcctgttcaaagttaatccctgccttcgagatggtcatgagggctaaggataacgtataccacctagactgcttcgcctgtcagttgtgcaatcaaagattttgcgttggcgacaagttttag

SEQ ID NO: 193345 - DNA, 255 bp, Artificial Sequence
  Description of Artificial Sequence: Synthetic coding sequence
atgctgagcgtgcagcccgacaccaagcccaagggctgcgccggctgtaaccgaaagattaaagacaggtatctattaaaggcattagataagtattggcacgaggactgcttaaaatgtgcttgctgtgactgcagactgggtgaagtcggctccacactctataccaaggccaacctgattttgtgccgccgcgactacttacgactattcggcgtaacagggaattgcgcggcctgttctaaactgatttag

SEQ ID NO: 193346 - DNA, 438 bp, Artificial Sequence
  Description of Artificial Sequence: Synthetic coding sequence
atgctgagcgtgcagcccgacaccaagcccaagggctgcgccggctgtaatagaaaaattaaagatcgctatctgctaaaggcacttgacaagtactggcatgaagactgcctaaagtgtgcctgttgcgactgccggctcggcgaagttgggtctaccctgtataccaaagctaatctcatcttatgtagaagagactacctccggttattcggggtgaccgggaactgtgccgcctgctccaaactaattccggctttcgagatggtgatgcgtgcgaaagacaatgtctaccatctagactgtttcgcatgtcagctgtgcaatcagcgtttttgcgtgggagacaagttcttcctgaaaaataacatgatcctctgccaaactgactacgaggagggactgatgaaggagggttatgccccacaggtccgctag

SEQ ID NO: 193347 - DNA, 492 bp, Artificial Sequence
  Description of Artificial Sequence: Synthetic coding sequence
atgctgatggagggcggccgggccgccgccgcccggaacgtgagcagtatccagatgctgtcagtgcagcccgatacaaaacccaagggatgtgctggttgcaatcggaaaataaaggaccgctacttacttaaggccttggataaatactggcatgaggactgtctgaagtgtgcctgttgtgactgcagattgggcgaggtaggctccaccctgtacactaaggcaaatcttattctctgcagaagagactatcttaggctattcggcgtgaccgggaattgtgctgcatgctcaaagctcatcccagcattcgaaatggtgatgagagccaaggacaacgtctatcacctggactgtttcgcttgtcagctgtgcaatcagaggttctgcgtgggggacaaatttttcctgaagaataacatgatcttatgtcagactgactatgaagaaggcttgatgaaggagggttatgctccacaggtcagatag

SEQ ID NO: 193348 - DNA, 438 bp, Artificial Sequence
  Description of Artificial Sequence: Synthetic coding sequence
atgctgagcgtgcagcccgacaccaagcccaagggctgcgccggctgtaacagaaaaattaaggaccggtatctcctgaaggccctggacaagtattggcacgaggactgtctaaagtgtgcttgctgtgactgccgacttggggaagtcggaagcacactgtacaccaaggccaacctcattctttgtaggcgggattacctgcgcctgttcggcgtaaccggaaattgcgctgcttgttccaaattaattccagcttttgaaatggtgatgagagcaaaagacaatgtgtaccacttagactgcttcgcgtgtcagttatgtaaccaaaggttctgtgttggggacaaatttttcctcaaaaataacatgattttgtgtcagactgactatgaggaaggccttatgaaagagggctatgctccccaggtgcgttag

SEQ ID NO: 193349 - DNA, 378 bp, Artificial Sequence
  Description of Artificial Sequence: Synthetic coding sequence
atgctgagcgtgcagcccgacaccaagcccaagggctgcgccggctgtaaccggaagattaaagaccggtacctgcttaaggcactggacaaatattggcacgaggattgtttaaagtgcgcttgttgtgattgccgctgggagcgcttgtttggcgtgacgggaaactgtgcagcgtgttccaagcttattcctgccttcgaaatggtgatgagagctaaagacaacgtgtaccacctcgattgttttgcttgccagctctgtaatcagcggttctgcgttggggacaagttctttctgaaaaataacatgattctgtgccagacagactacgaagaaggactgatgaaggaaggatatgcaccacaggtgcgatag

SEQ ID NO: 193350 - DNA, 267 bp, Artificial Sequence
  Description of Artificial Sequence: Synthetic coding sequence
atgctgagcgtgcagcccgacaccaagcccaagggctgcgccggctgcaacagaaagatcaaggatagatacctgctgaaagcacttgacaagtattggcacgaggactgcctcaagtgtgcgtgctgtgattgtcgtttgggcgaggttgggtcaaccctgtacactaaagctaatctgattctgtgtaggagagactacctccgtctgttcggagtgactgggaattgcgctgcttgttctaagttaatcccggcgttcgaatag

SEQ ID NO: 193351 - DNA, 333 bp, Artificial Sequence
  Description of Artificial Sequence: Synthetic coding sequence
atgctgagcgtgcagcccgacaccaagcccaagggctgcgccggctgtaaccgaaagataaaagatcgctatctgctaaaggccctggacaaatattggcacgaagattgcctgaagtgtgcttgctgtgactgtcggcttggagaggtgggttctactctatatacaaaagcaaacctcatcctgtgcagaagggactatctccgcttgttcggcgtgacaggcaattgcgccgcttgttcaaaacttattcccgcgttcgaaatggtgatgcgagccaaagataatgtctaccacttggattgttttgcatgccagctatgtaatcagtag

SEQ ID NO: 193352 - DNA, 357 bp, Artificial Sequence
  Description of Artificial Sequence: Synthetic coding sequence
atgctgagcgtgcagcccgacaccaagcccaagggctgcgccggctgtaatcgaaaaatcaaagaccgatatctcctgaaagcattggataagtattggcacgaagattgcctgaagtgcgcctgttgcgactgccggctgggggaggttgggagcacattgtatactaaagccaatctgatcctgtgccggcgagactatctccggctgttcggggttactggcaattgcgctgcttgttctaagctcatccccgcgtttgagatggtgatgcgtgctaaggacaacgtataccacctggactgttttgcctgccagctttgtaatcagcgtttctgcgtcggtgacaagttctag

SEQ ID NO: 193353 - DNA, 498 bp, Artificial Sequence
  Description of Artificial Sequence: Synthetic coding sequence
atggtgaaccccggcagcagcagccagcccccccccgtgaccgccgggagtctttcttggaagagatgcgctggctgcggaggcaagatagccgaccggttccttctatatgccatggattcatattggcactcgaggtgtctgaagtgctcttgctgccaggcacagctcggcgatattgggacctcttgttacactaagtccggcatgattctgtgtaggaacgactacatccgcctgtttggaaactctggggcttgtagcgcctgtggacagtctatccccgcctctgaactcgtgatgcgagcccaggggaacgtgtatcacctgaagtgctttacatgctcaacctgcaggaacagactggttcctggcgaccggttccactatatcaatggtagccttttctgcgaacatgatagacccaccgctctaatcaacggacacctgaactctctccagtcgaacccacttctaccagaccagaaagtctgctag

SEQ ID NO: 193354 - DNA, 498 bp, Artificial Sequence
  Description of Artificial Sequence: Synthetic coding sequence
atggtgaaccccggcagcagcagccagcccccccccgtgaccgccggctccctgtcctggaagagatgtgcagggtgcggcggcaagatcgccgaccgattcctcctatatgccatggactcctattggcattctcgctgtcttaagtgctcttgctgccaggcccagctgggggacatcggtacgtcctgctacacaaagagtggtatgatcctgtgcagaaacgattatatccgactatttggcaattccggcgcatgctccgcttgcggccagtcaatccccgcctccgaactcgtgatgcgagctcagggtaatgtctaccacctgaagtgttttacttgtagcacttgccgaaatagactggtaccaggagataggtttcattacattaacggaagcttattctgcgaacacgaccgacccaccgcccttattaacggacacctgaacagcttgcagtccaacccactgctacccgatcagaaggtatgctag

SEQ ID NO: 193355 - DNA, 2031 bp, Artificial Sequence
  Description of Artificial Sequence: Synthetic coding sequence
atggacaagtacgacgacctgggcctggaggccagcaagttcatcgaagatctgaatatgtatgaggccagcaaggatggcttgttccgggtagataagggagccgggaacaaccccgaatttgaggagaccaggcgggtctttgcaaccaaaatggctaaaatacacctgcaacagcagcagcaacagctgctccaggaggagacactaccccgcgggagccgcggcccggtcaacggcggtggaagattgggacctcaggcccgatgggaggttgtgggaagcaagctaacagtggacggagccgctaaacctccactcgctgcaagtactggcgcccctggtgccgtgaccacactggctgccggccagcccccatacccaccccaagaacagaggtcccgaccctatttgcacgggacaaggcacggcagtcaggattgcggttcccgggagtctctcgccacatccgaaatgtctgccttccaccagcctgggccctgtgaggacccctcatgcctgacacacggggattattatgataacctcagcctagcatccccaaagtggggagataagcccggagtcagccccagcatcggcctgtccgtagggagtggctggccatcctctcctggttccgatccccccctgccaaagccatgtggagatcaccctctgaaccacaggcagctgtccttgagctcctcccgcagcagtgagggatctctgggaggacagaactccggaatcggagggcgtagttcggagaagcctaccggcctatggtccacagctagctcgcagagagtctcaccaggactgcctagccccaatctggagaatggggccccagctgtgggccccgtgcagccccgtactcccagtgtctccgcgccattggctctgtcatgtccgcgacaaggaggattgccacgctcaaacagtggtcttggtggagaggtatcgggggtgatgtccaagccgaatgtagaccctcaaccgtggttccaggacggccctaagtcctacctcagttcaagcgcccctagcagcagtcccgcgggcctggatggctcccagcagggagctgtacctggcctgggccccaagccaggatgcaccgatctaggcacaggacccaagcttagccctacttccctggttcacccagtcatgagtacactgcctgagctgagctgcaaggagggaccactgggctggtcctccgacggtagcttaggctccgttcttcttgattccccttcctcgcctcgcgtccggttgccatgtcaacccctggtgccaggtccggagctacgacctagcgcagccgaactgaagctggaggcactgacccaacgactcgagcgtgaaatggatgctcatcctaaggcagattactttggagcatgcgtaaaatgctctaaaggtgttttcggagcaggccaggcatgtcaggccatggggaatctataccatgatacctgctttacctgtgctgcctgtagtcgaaaactcagaggaaaggctttctacttcgtcaacggcaaggtgttctgcgaagaagacttcttgtacagtggatttcagcagtccgcagatagatgcttcttgtgtgggcacctcattatggacatgattctacaggcccttggcaagagttaccatccagggtgctttcgctgcgtaatttgcaatgagtgtttagatggggtgccctttacggtggactctgaaaacaagatctactgtgtccgcgactatcacaaggtgctggcgcccaaatgcgccgcctgcgggctcccaatccttcctccagagggatccgatgaaactattcgagttgttagtatggacagggactatcatgtggagtgctatcattgtgaagattgtggcctggagctaaatgatgaagatggacatagatgttacccccttgaggaccacttgttttgccactcctgccatgtaaaacgacttgagaagcggccctcatcaaccgcgctccaccagcatcacttttag

SEQ ID NO: 193356 - DNA, 1221 bp, Artificial Sequence
  Description of Artificial Sequence: Synthetic coding sequence
atggtgcactgcgccggctgcaagcggcccatcctggaccggttcctgctgaacgtcctggacagggcttggcacgtcaagtgtgtgcagtgctgtgaatgcaaatgtaacttgacagagaagtgcttctcacgggagggcaagctgtactgtaagaacgacttcttcagatgcttcggcaccaaatgcgcgggctgtgctcagggcataagcccatctgatctcgtcaggcgcgcgcgaagtaaagtgttccacctgaactgcttcacgtgcatgatgtgcaacaagcagctgagcactggggaagagctgtacatcatagatgaaaataaatttgtctgcaaggaggactatctgtccaattcctccgtggccaaggaaaatagtctgcattcagccacaacaggtagcgatcccagcctgagtcccgattctcaggatccttctcaggacgatgctaaggatagcgagagtgctaacgtctctgacaaggaagcaggttccaatgagaatgatgaccagaatctcggagccaaaagacgtgggccccgcactacaatcaaagcaaaacaactggaaacattgaaagctgccttcgctgccacccccaaacccacaaggcacataagggaacagctggcccaggagacagggttgaacatgagggttattcaggtgtggttccagaaccggcgatccaaggagcggaggatgaagcagctgtctgcattaggcgcgcggagacacgccttcttccggtctcccaggcgaatgcggcctctcgtggatcggcttgagccaggcgaacttatacctaatggccccttttccttctatggggattaccaaagcgagtactacgggccgggcggaaactatgatttttttccccagggtcccccctcctctcaagcccagaccccagtcgatctcccatttgtaccctcctctggaccttccggtactcctctgggtggtctggaacatcctcttccagggcatcacccatcttctgaagcacaaaggttcactgacatcttggctcacccccctggggactctcctagccctgaaccttccttacctggacccctgcattcaatgagcgctgaggttttcggaccctcccccccctttagctcactgtctgttaatgggggtgcttcatacgggaaccatctctctcatccaccagagatgaacgaggctgctgtctggtag

SEQ ID NO: 193357 - DNA, 1221 bp, Artificial Sequence
  Description of Artificial Sequence: Synthetic coding sequence
atgctgttccacagcctgagcggccccgaggtgcacggcgtgatcgacgagatggatcggagggccaagtcagaggcacccgctatttcttcggccatagatcggggagataccgaaacaactatgccgtctattagctctgatcgcgctgctctttgcgcagggtgtggcggtaagatttcagacagatattatcttctggcggttgacaaacagtggcacatgaggtgcttgaagtgttgcgagtgcaagctcaatctcgagtccgaactaacctgcttttccaaggacggaagcatctactgcaaagaggactactaccggcggttctccgtgcagcggtgtgcccgctgtcatctgggtatctcagcctctgaaatggtgatgagggcgcgcgacctcgtctatcatctcaattgctttacctgtaccacctgtaataaaatgctgaccaccggcgaccatttcggtatgaaagacagccttgtgtactgccggctgcacttcgaagctctcttgcaaggagagtaccctgcgcattttaaccacgctgacgtcgccgcggcagccgctgctgccgctgccgcaaagtcggcgggtctgggggcagcgggagccaaccccctggggcttccctactacaatggcgtaggaacagtgcagaaaggacgccctcgaaagcgaaaatccccggggcctggggctgacctggcagcgtacaacgccgccctgagctgcaatgagaatgacgcagaacatctggaccgggatcagccatacccgagttcgcagaagactaaaaggatgagaacatcattcaagcatcatcagctcagaaccatgaagtcatatttcgcaatcaatcacaacccggacgccaaggacttgaaacagttggcacaaaaaacggggctgactaagcgcgtgttgcaggtctggttccagaatgccagggccaaatttagacggaacctactcagacaggagaataccggggtggacaaatctaccgatgccgctttacagaccggtaccccctcaggtcctgcttccgaactgagcaatgccagtctttccccaagcagcacaccgaccacactcactgacttgactagccctaccctcccaactgtaacatcagtgctcacaagcgtgcccggcaacctcgagggccatgagcctcactctccgtcacagaccacattaactaatctgttttag

SEQ ID NO: 193358 - DNA, 1194 bp, Artificial Sequence
  Description of Artificial Sequence: Synthetic coding sequence
atggaggcccggggcgagctgggccccgcccgggagagcgccggcggcgacctactcctagcactcctggctaggagggccgatttgaggcgagagattcctttgtgcgctgggtgcgatcagcacatactggatagatttattctgaaggccactgccactgggactgcatctgtgagcagcgctgcgacggccacgcctctggccgagaggtgtttttcccggggagagtctgtgtactgtaaggacgatttcttcaagaggttcggcaccaaatgtgccgcatgtcaacttggaatcccacccacacaagttgtcagacgcgcgcaggacttcgtgtaccacctgcactgtttcgcctgtgtagtttgcaagcgccagttggctactggcgacgagttttacctcatggaggatagccgccttgtgtgcaaggcagattacgagaccgctaagcagcgtgaggctgaggcgactgcaaagaggccccggactaccattactgccaagcagctggagacccttaaaagcgcttacaacacctccccaaagccagctagacatgtgagggaacagttgagttcagaaaccggtctcgatatgcgagtggtgcaggtgtggttccagaatagacgggctaaagagaagcggttaaaaaaggacgctggaagacagagatgggggcagtacttccgtaacatgaaaagaagccgtggcggatcaaagtctgacaaggacagcgtacaagagggacaagattcagatgctgaagtcagctttcccgtctccttgccatggcgcaaatgggctagacccatggcctccacaggcgcatggggccatccaggccttggccctgcactgggctcccctggacagctgctgccaggcgcttggcgaccgggcagacccagagctgttccgagggccgcaagtcgacagccgctgaggtgcccgcctattccacgaaggccggcagaaccgccgtggcccccccttctctcatccctggtctaccctgacaccagtctgggtctcgtgccttcaggtgccccgggcggccccccccctatgagagtcctggccggaaacggcccttcctcagacctaagcactggaagctccggcggataccccgacttccctgctagtcctgccagctggctggatgaagtagatcacgcacagttctag

SEQ ID NO: 193359 - DNA, 1209 bp, Artificial Sequence
  Description of Artificial Sequence: Synthetic coding sequence
atggaggcccggggcgagctgggccccgcccgggagagcgccggcggtgaccttttgctcgcactgttggctcgtcgtgctgatctaaggcgagaaattccactatgcgcgggctgtgaccagcacattctggacaggtttatcctgaaggctttggaccgccactggcactctaagtgtctcaagtgtagtgattgtcacacccctctagccgagcgctgctttagtaggggggagtccgtgtattgcaaggacgactttttcaagaggtttgggaccaaatgcgctgcgtgtcaactgggaatccctccaactcaggtagtcagacgagcccaggatttcgtctatcatttacattgctttgcttgcgttgtttgcaaacgccagctggctacaggcgatgaattttacctgatggaagacagcaggttggtgtgcaaggcagactacgaaactgctaaacagcgggaggccgaagcaactgccaagcgaccgcggacaaccatcaccgctaaacaactggaaacactcaagtctgcctacaatactagtccaaaacctgctagacatgtcagagaacagctgtcctctgagaccgggctggacatgagagtagtacaagtctggtttcagaatcgcagggccaaggaaaagcgacttaaaaaagatgccgggaggcagcgctggggtcagtactttcggaacatgaagcgcagccgagggggaagcaaaagcgataaagattccgtgcaagaggggcaggattcagatgctgaggtgtcattcccagacgagccttccctggcagagatgggacccgccaatggtctgtacgggagcctcggtgaacctactcaagccctggggcgtccttcaggggcgcttgggaactttagccttgaacatggcgggctagccggcccagagcagtacagggagcttagacctggatcaccatatggagtacccccttctccagctgctccacagtccctgcctggaccacagcctctactctcctccctcgtctacccagacacttccctgggcctagtgccgagtggcgcgccgggcggacctccccccatgcgggtgctggccggcaatggcccgagctctgacctttcgaccgggtcaagcggcgggtaccccgacttccccgcctctccagcatcctggttggacgaggtggatcacgcacagttctag

SEQ ID NO: 193360 - DNA, 1194 bp, Artificial Sequence
  Description of Artificial Sequence: Synthetic coding sequence
atgctgctggagaccggcctggagcgggaccgggcccggcccggcgcagctgctgtctgcactcttggaggcactagagagatacctctgtgtgccgggtgtgatcagcacattttagatcggttcattttgaaagccctggatcggcattggcactccaagtgtttgaagtgcagtgactgccatacaccccttgcagagaggtgtttctcccggggggaaagtgtctactgtaaggacgattttttcaaacgtttcggaactaagtgtgcagcatgccagctggggattccgcctacccaagtggtaaggagagcccaggactttgtgtatcacctccactgtttcgcatgtgtggtatgcaagcgtcaactggccaccggagatgagttctacctcatggaggatagcaggctagtttgcaaggctgattacgagacagcaaaacagcgggaggccgaagccacagctaagagacccagaaccaccattacggcgaaacaacttgagacattgaagtctgcctataacaccagccctaagccagcaaggcacgtcagagaacagctgtcaagtgaaacaggtttagacatgagagttgtacaagtgtggttccagaaccgacgggctaaggagaaaagattgaaaaaggacgccggccggcagcgatggggacaatacttccgaaacatgaaacggtccagaggaggaagtaaatcagataaggacagtgtgcaagaaggtcaagatagcgatgccgaggtgagcttccctgatgagccctctctggcagaaatggggcctgcgaacgggttatacggctccctaggggaaccaacgcaagcactgggcaggccatcaggcgccctgggaaacttctccctcgaacacggtggcttggccggtcctgaacagtacagggagctccgtcccggctccccctacggagtgccacccagtcccgccgccccacagagcctgcccgggccacaaccgcttctgtcctctctcgtctacccagatacaagcctcggtttggttccatccggtgccccaggaggtcccccccccatgagagtcctggctggcaatggtccttcctctgacctgagtaccgggagctctgggggctacccagactttcccgcatcaccagcctcttggttggacgaggtggatcatgcccagttctag

SEQ ID NO: 193361 - DNA, 1173 bp, Artificial Sequence
  Description of Artificial Sequence: Synthetic coding sequence
atgatgcagagcgccaccgtgcccgccgagggcgccgtgaagggcttacctgagatgttgggagtacccatgcaacaaatcccgcaatgtgccggttgtaatcagcacatactcgataaattcatcctcaaagtgttagatcggcactggcactccagctgcctcaaatgcgctgattgccagatgcaacttgccgatagatgctttagccgggcaggcagtgtgtactgcaaagaggatttctttaagcggttcggaacaaagtgcaccgcctgtcagcagggcatcccccccacgcaagtcgtgcggaaagcacaggacttcgtctatcatctccactgtttcgcctgcattatctgtaataggcagctcgctaccggcgatgagttttacctgatggaggatgggcgtcttgtatgtaaggaagactatgagacggccaagcagaacgacgattcagaggctggagcaaaacggcctcgaaccactattactgccaaacaactagagactcttaaaaacgcttataagaacagccccaagccagctcggcacgtgcgcgaacagcttagctctgaaaccgggctagatatgcgcgtcgtgcaagtgtggtttcagaaccgtagggccaaagagaaaagactgaaaaaggacgctggtcgacatcgctgggggcaattctacaagtccgtgaaacggagccgcggatcttccaagcaagaaaaggaatcttccgccgaggattgcggggtgtctgattcagagctctccttccgggaagaccagatcttgtccgagttggggcacaccaataggatctacggcaatgtcggagacgtaaccggaggacagttgatgaacggatctttttcaatggacggcacaggtcagagttaccaggacctccgggatgggagcccttatggcatcccccagtcaccttcatctatttcatctttgcctagccacgctccgctgcttaacggtttagactacactgtcgatagcaatttaggaattatcgcccatgccggccagggggtgagtcaaactcttagagccatggccgggggaccaacttctgacatttccacaggttcatctgtgggctatcccgatttccctacctctcccgggtcttggcttgatgaaatggatcatcctccattctag

SEQ ID NO: 193362 - DNA, 1209 bp, Artificial Sequence
  Description of Artificial Sequence: Synthetic coding sequence
atgatggtgcactgcgccggctgcgagcggcccatcctggaccggttcttgcttaacgttctcgacagggcctggcacatcaaatgcgtccagtgttgtgaatgtaagactaatttgtcagagaaatgtttttcgagggaagggaagctctattgtaaaaacgattttttcaggcgcttcgggaccaagtgtgcggggtgtgcacagggcatctccccatccgacctggtacgcaaagcacgcagtaaggtgttccacctgaattgtttcacctgcatggtgtgcaacaaacagctgtctacaggtgaggagctgtatgtgattgacgagaataagtttgtgtgcaaggatgattatctgtctagttccagcctgaaagaaggctccttaaatagtgtgtcatcctgcaccgacaggagcttgtctcccgatcttcaggatgcgctgcaggacgacccaaaagagactgacaactccacttcttctgataaggaaacagccaataacgagaatgaggagcagaattccgggacaaaaaggagaggtccccgtacaactatcaaggccaaacagcttgagactcttaaggctgcctttgctgctacacccaaaccaacccgacatatccgggagcagctggcacaggagacaggtctgaacatgagggtaattcaggtgtggttccagaatcggagatctaaagaacgacggatgaagcagttatctgctctcggggcacggcgacatgccttcttccgctccccaagaaggatgaggccattgggtgggcggctcgacgagtccgaaatgctgggttctaccccttacacttattatggggattatcagggggactactatgcacccggcagcaattacgattttttcgcccacggccccccctctcaggcccaaagtccagccgactctagcttcttggctgcttccggcccaggaagcacgcctctgggggcattggagcctccattagctgggcctcatgccgcagataaccctcgattcacggatatgatcagccatccggacacaccatcccccgaacccggtctacccggtaccctgcatcccatgcctggggaggtattttccgggggacccagccccccatttccaatgagtgggacatctggctattccggcccactttctcatccaaatccagagctaaacgaggcagcagtttggtag

SEQ ID NO: 193363 - DNA, 1071 bp, Artificial Sequence
  Description of Artificial Sequence: Synthetic coding sequence
atgcagatcctgagccggtgccagggcctgatgagcgaggagtgcggacggacaacggcccttgcagcaggtcggaccaggaagggtgcgggggaggaagggctcgtgagccctgaaggcgccggggatgaggacagctgctcttcttcggcgcccctcagtcccagctcaagtcccaggtcaatggccagcggaagcggatgtccgccagggaaatgcgtctgtaattcatgcggcctggaaatcgtggataaatacctcctgaaagtaaacgacttatgctggcacgtccgctgccttagctgctcggtttgccggaccagcctggggcgccatacgagctgttatataaaagataaggacattttctgcaagttagactattttaggcgttacggcactcgctgctctcggtgcggtaggcacatccatagtacagactgggtccgccgcgcgaagggcaatgtgtatcaccttgcatgctttgcctgtttttcgtgcaaaaggcagctgtccactggcgaagaatttgccctggtggaagagaaagtgctctgtcgtgtgcactacgattgcatgcttgacaacctcaaaagggaagtcgaaaacgggaatggaattagcgttgaaggcgctctgcttacggagcaggacgtcaaccatccaaagcccgctaagcgcgccagaacgtctttcactgccgatcagttacaggttatgcaagctcaattcgcccaagacaacaatccagatgcccagaccctgcagaagctggctgagcgtacaggtctgagtcgcagggtgatccaagtttggtttcagaactgtagagcgagacataagaagcatgtctcccccaaccactcaagttccacaccagttacagccgtaccaccatcacgcctgagtccgcccatgctggaggagatggcatacagcgcttacgtcccccaagacggcactatgctgacggctttacacagctacatggacgcccactccccaaccaccctcgggttgcagcctctcttgcctcacagcatgactcagttgcctataagccatacatag

SEQ ID NO: 193364 - DNA, 1041 bp, Artificial Sequence
  Description of Artificial Sequence: Synthetic coding sequence
atgagcgaggagtgcggccggaccaccgccctggccgccggccggaccaggaaaggagccggagaggagggtctggtgagtcccgaaggagcaggagatgaggactcctgcagtagttcagctcccctgtcaccaagttcctcaccaaggtccatggccagtggctcaggctgcccccccggcaaatgcgtctgcaacagttgcggactggagatagtggacaaataccttctgaaagtgaatgatctctgctggcacgttaggtgcttgagttgttcagtgtgccgcacatctctcgggaggcacacctcatgttacatcaaggacaaagacatattttgcaaattggattatttccggcgctacggcacacggtgttccagatgcggacgtcatatccacagcactgattgggtccggcgggccaaggggaacgtgtatcaccttgcttgtttcgcctgcttttcctgtaagcgccagctgagtaccggcgaagagtttgcacttgtggaagaaaaggtcctgtgccgtgtacactatgactgtatgttggacaacctaaaaagagaggtggagaatggtaacgggatttccgtcgaaggcgcgttactgacagagcaggacgtgaaccatccaaagcccgccaagagggcccgaacaagtttcacagccgaccaactgcaggtaatgcaggcccagttcgcccaggacaataaccctgacgctcagaccctccagaagttggccgagaggactggactaagccggcgggtcatccaggtctggtttcagaactgtcgggccaggcacaaaaaacatgtttctccaaaccattcttcatcaactcctgtaacggctgtgccccccagccgcctctctccccctatgctggaggagatggcctactccgcttacgtgccgcaggacgggacaatgctgaccgcattgcactcttacatggatgcccacagccctaccaccctggggctgcaacctctcttgccgcacagcatgacccagctgcctatttcgcacacatag

SEQ ID NO: 193365 - DNA, 1194 bp, Artificial Sequence
  Description of Artificial Sequence: Synthetic coding sequence
atggagatcgtgggctgccgggccgaggacaacagctgccccttcagacctccagcaatgctctttcacgggatcagtggtggccatattcagggtattatggaagagatggaaaggcggtccaaaacggaagcccggctggccaagggagcccagctcaacggccgtgacgccgggatgccaccgttgtcacccgagaaacccgcactttgcgctggctgcggcggcaagatctcagaccggtattacctgctagcagtggataaacaatggcatctgcggtgcttaaaatgctgtgagtgcaagttggcactggagagcgagttaacatgttttgccaaagatggtagtatttactgcaaagaggattactacagacgcttctccgtgcaacgctgcgcccgttgtcatctgggcattagcgcctcagaaatggtgatgagagccagggatagcgtataccatctgtcatgttttacttgctcaacttgtaataagacgctgaccactggcgaccacttcgggatgaaggattcattagtttactgtcgggcccacttcgagacactgcttcagggggaatacccgccacaactgtcctatacagaattggcagctaaaagcggaggactggcgctgccttattttaacggcaccggaaccgtgcaaaaaggccgtccacgcaaacggaaaagccccgccctgggagtcgacatcgtgaactacaactctggctgtaacgaaaacgaagcagatcatctggatcgggaccagcagccttaccctccatcccagaagaccaagagaatgcggacttcctttaagcaccaccagctgagaaccatgaagtcttattttgctatcaaccacaatccagatgccaaagacctcaaacaactcgcccagaagactggactgactaagagagtgctacaggtgtggtttcagaacgcgcgcgcaaagtttcggagaaaccttttaaggcaggagaacggaggtgttgacaaggcagatggcaccagcttaccagcaccaccaagtgctgactccggcgcattgactcctcctgggactgccacaacactcacagatcttaccaaccccacaataaccgtggtaacctcggtgacgtccaatatggactcccacgaatccggtagcccttcccagaccactttaactaacctgttttag

SEQ ID NO: 193366 - DNA, 1167 bp, Artificial Sequence
  Description of Artificial Sequence: Synthetic coding sequence
atgctgaacggcaccaccctggaggccgccatgctgttccacggcataagcggcggacacatacaggggattatggaggaaatggaaaggcggagcaaaactgaggcgcgcttagccaagggagcccaattgaacgggcgtgatgctggcatgccaccactgtcccccgagaaaccagctctctgtgcaggctgcggaggcaaaatatccgatcgttactacttgctagccgtcgataagcagtggcacttgagatgcttgaagtgttgcgagtgtaagctcgctttggaatccgagctgacgtgcttcgctaaagacggctccatttattgtaaggaggattattatcgccggttctccgtccaacggtgcgcgcgttgccatcttggtatcagcgccagcgagatggtgatgcgcgctcgggattctgtgtatcacctgtcctgctttacgtgctcaacttgtaataagacactcacaaccggagaccacttcggtatgaaggacagcctggtctattgccgggctcattttgaaacgctgttgcagggggaatatcctccacaacttagttacactgagcttgcggcaaaatcagggggcttagccctgccctactttaatggcacaggtacagtacagaagggaagaccgcgcaagaggaagagcccagcgctcggggttgatatcgtaaactacaactctgggtgtaacgagaacgaggccgaccatctagaccgcgaccagcagccctaccctccctcccaaaagacgaagaggatgcgcacctcattcaagcaccatcagctacgtactatgaagtcatacttcgccattaaccataatccagacgcgaaggatttgaagcagctcgctcagaaaaccggtctcaccaaacgggtgctgcaggtgtggtttcagaacgcacgagccaaattcaggcgtaacctcctcaggcaggagaacggcggcgtcgacaaggcggatggtacctctctccctgctccgccttccgctgacagcggcgcactgacgcctccgggcactgcaaccactttaacagacttgactaatccaacgatcacagtggtgaccagtgtcacttcaaatatggacagtcatgagtcagggagcccttcacagacgaccctaaccaatctgttttag

SEQ ID NO: 193367 - DNA, 1149 bp, Artificial Sequence
  Description of Artificial Sequence: Synthetic coding sequence
atgctggacggcctgaagatggaggagaacttccagagcgccatcgacacctccgcttctttcagctcactgttgggccgggcggtctcccccaaatccgtgtgcgaaggatgtcagcgcgttattctagatcgtttcctcttgagattaaacgacagcttttggcacgaacagtgcgtgcagtgcgcatcttgcaaggaacccttggagactacctgcttctatagagataaaaaactgtattgcaagtatgactatgagaaattatttgcagttaaatgcgggggttgttttgaagccattgcccctaacgagttcgtgatgagagcacaaaagtcagtttatcatctctcatgtttctgttgttgcgtgtgtgagcgccagttgcagaagggtgacgaatttgtcctgaaggagggccaactcctttgtaaaggggactacgagaaggagagggaattactgtcacttgttagccccgctgcgagcgacagtggcaagtctgatgatgaagaaagcctgtgtaagtcagcccatggagccggaaagggtaccgccgaggaggggaaggaccataagagacccaaaagacccagaaccattctgaccacccagcaaaggagagcgttcaaggcgtctttcgaggtctcctccaaaccttgcaggaaagtgagggaaactctggcggcagaaaccggtctgagtgtgcgagtggtgcaggtgtggttccaaaaccaacgtgctaagatgaagaagctggcccgcagacagcagcaacagcagcaggatcagcaaaacacccagaggttatcatccgcacagaccaatgggggaggttctgcaggcatggagggaataatgaacccttacactgctcttcctacgccacagcagctgcttgccatagagcaatctgtgtactcctcggatccattcaggcagggcctcaccccccctcagatgccaggagatcacatgcacccctatggggcggaacccttgtttcacgacctcgacagcgacgacacaagtttatctaacctgggggactgctttcttgctacatcagaagctggcccactacagtctcgtgtggggaatccgatcgaccacctgtattctatgcagaactcctattttacttcgtag

SEQ ID NO: 193368 - DNA, 1149 bp, Artificial Sequence
  Description of Artificial Sequence: Synthetic coding sequence
atgctggacggcctgaagatggaggagaacttccagagcgccatcgatacaagtgcaagcttcagctcgttattgggacgagctgtgagcccgaaatcagtgtgtgaggggtgccagcgcgtaattctggatcggttcctgctcagactgaacgattccttttggcacgaacagtgcgtgcagtgcgcgtcctgtaaggagcccttggaaacaacttgcttttatagggataagaagctgtactgcaagtacgactatgaaaaactgtttgcagtgaaatgcgggggttgtttcgaggcaatcgcacccaatgaatttgttatgcgggctcagaaatctgtatatcatttaagctgcttctgttgttgtgtgtgcgaaagacagttgcagaagggagatgagttcgtgttgaaggaggggcagttgctttgcaaaggggactacgaaaaagaaagggaactactgtctctggtttctcctgccgcatccgactccggaaagtcagatgatgaggaatctctctgtaagagcgctcacggcgccggcaagggtaccgcagaagagggcaaggaccataaaaggcccaaacggccacggacaatcttgacaactcagcagagacgagcatttaaggcttcttttgaggtctcatcaaaaccctgtagaaaggttagagaaacactggcagctgaaacaggtctgtccgtgcgtgtcgtgcaagtgtggttccagaaccaaagagccaagatgaagaagctagctaggaggcagcaacaacagcagcaagaccaacagaacacacaaagactatcgagcgcacagaccaatggggggggcagcgcagggatggagggcattatgaacccttataccgcgttgccaacccctcagcagctgctggccatcgagcaaagcgtgtattcatcggacccatttaggcaggggctgacacctccccaaatgccaggtgatcacatgcacccttatggggccgaacctctgttccacgatctggacagtgatgatacctccctaagcaacttgggggactgcttcctcgcaacttctgaggccggcccactccaatctagagttgggaatcctatcgatcacctgtacagtatgcagaactcgtacttcaccagctag

SEQ ID NO: 193369 - DNA, 1149 bp, Artificial Sequence
  Description of Artificial Sequence: Synthetic coding sequence
atgctggacggcctgaagatggaggagaacttccagagcgccatcgatacgagcgcctcgttctcgagcctcctgggcagggcggtgagccccaagtctgtatgcgagggatgccagagagtcatactggataggttcctgttgaggctcaacgacagtttttggcacgagcagtgcgtgcaatgtgcgagttgtaaggagcccttggagacaacctgcttttatcgggacaaaaaattgtattgcaagtacgactacgaaaaactcttcgcagtgaagtgtggtggatgcttcgaagccatcgctcccaatgagtttgtaatgcgcgcccagaagagcgtataccatctttcatgtttttgttgctgcgtctgcgaaagacagctccagaagggagatgagtttgtactgaaggaaggccagctgctgtgtaaaggggactacgaaaaggagcgtgagcttctctctctagtctcgccagccgcttctgattctggtaaatcagacgatgaggagtccctgtgcaagagcgcacacggagccggaaaaggtacggctgaggaggggaaggatcacaaacgtcctaagcgacctcgaactatcctgacaactcagcaaaggcgcgcgtttaaggcctcatttgaagtttcttctaaaccttgtcgcaaggtcagagaaactctggccgcggaaacaggcctttcagttcgcgtggttcaggtatggttccagaatcagagggctaaaatgaaaaaattagcccggcgacagcagcagcagcaacaggatcaacagaatacgcaaaggttgagctctgcacagactaatggcggaggaagcgccggaatggaagggataatgaacccttacacggcactccccacaccccagcagctactggctattgaacagagtgtctactcttccgacccatttcgacagggcctgaccccgccacaaatgcctggcgaccacatgcatccctatggggcagaaccgctgttccacgatctggattccgatgatacatccctgtcaaacctgggcgattgtttcctcgccacaagcgaggccggacccctgcagtcccgagttggtaacccaatcgaccatctgtactccatgcagaactcatatttcactagttag

SEQ ID NO: 193370 - DNA, 1221 bp, Artificial Sequence
  Description of Artificial Sequence: Synthetic coding sequence
atggacatcgccaccggccccgagagcctggagcggtgcttccccagaggccagactgactgcgccaaaatgctcgacgggatcaagatggaagagcatgccctccgccccggccctgcaactctcggagtcctccttggatcggactgcccccaccctgctgtttgcgagggatgtcaaaggcctatttcggatcgattcctaatgagagtcaatgaaagctcctggcacgaggaatgcttacagtgtgcggcttgccaacaggcccttacaacgtcttgctacttcagagaccggaagctttattgtaaacaggattaccagcagctctttgcagccaaatgttcaggatgtatggaaaagatcgctcccacggagttcgtaatgagagccctggaatgcgtgtaccacctgggctgtttctgttgttgcgtctgtgagcgccagctgagaaaaggtgatgagttcgtgctcaaggagggtcagctactttgcaagggagattatgagaaagagaaagatctcctgagttcggtgagcccagacgaatcagatagcgtaaagagcgaggacgaagatggagacatgaaacctgcaaaaggacagggttcccagagtaagggatcaggtgacgacggcaaagatcctcgcaggcccaagcggcctcgcacaatattgaccacacagcagcgccgtgccttcaaggcttcattcgaggtatcctcaaagccttgtaggaaggtacgcgagaccctcgctgcagagaccgggctgtcagtacgggtggtacaggtgtggtttcagaatcaacgcgccaaaatgaagaagctcgcccgtcggcaccaacagcagcaagagcagcagaatagtcagagacttggccagggggaaccaggccctggccagggcctcgggcaggaggtcctcagttcacgcatggaaggaatgatggcgtcttatacccctctcgcccctcctcagcaacaaatcgtggcaatggagcagagcccctacggaagctctgacccttttcagcaagggctgaccccaccccagatgcccggaaatgactcaatcttccacgacattgactccgatacttctctcacttccctgtcagattgcttcctgggttctagcgacgttggatctctgcaggcccgcgtcggaaacccgatcgaccgtctttacagtatgcagtctagctatttcgccagttag

SEQ ID NO: 193371 - DNA, 1209 bp, Artificial Sequence
  Description of Artificial Sequence: Synthetic coding sequence
atggacatcgccaccggccccgagagcctggagcggtgcttcccccgcggacagactgactgcgccaaaatgctagacggaatcaagatggaggagcacgcgctgaggccaggccccgcaacgttgggggtgctgttagggtccgactgcccgcaccctgcggtctgtgagggctgtcagcgcccaatctcagaccgctttcttatgcgtgtgaatgaaagttcttggcacgaggagtgcctgcagtgtgctgcttgtcaacaagctcttacaacaagttgttacttcagagatcggaagctgtattgcaagcaggactaccagcagttgttcgccgccaagtgcagtggttgtatggaaaagatcgcccctactgaatttgtcatgcgcgccctagaatgcgtgtatcatctgggctgcttctgctgttgcgtctgtgagaggcagctgcggaagggcgatgagttcgtgttgaaagaagggcagctcctgtgtaagggggactatgaaaaagagaaggacctgctgtcttccgtgtcccctgacgaatctgatagtgttaagagcgaagatgaggacggggacatgaaaccggctaaaggccaggggtcccagagtaaggggtctggggatgacggtaaagacccccgtagacctaagaggcctcgcacaatcctgactactcagcagagaagggccttcaaggccagttttgaggtgagttctaagccatgcaggaaggtacgggagaccctagcagcagaaacaggattgagcgttcgagtggtgcaggtgtggtttcaaaaccagcgggcaaagatgaagaagttggctaggcgacaccagcagcaacaggaacagcaaaatagtcagcggctggggcaagaagtgctgagctctagaatggagggtatgatggcgagctatacacccctcgcaccgccgcagcagcagatcgttgctatggaacaatcgccctacggatccagtgacccttttcagcagggtctcacaccaccccagatgcctggcgaccacatgaatccttacgggaacgattccattttccatgacattgatagcgacaccagtctgacaagtctgagtgattgcttcctgggttccagcgacgtgggatctctgcaagctagagtgggaaatcctatcgaccgcctgtactctatgcagtcatcctatttcgcatcctag

SEQ ID NO: 193372 - DNA, 1119 bp, Artificial Sequence
  Description of Artificial Sequence: Synthetic coding sequence
atgctggacggcatcaagatggaggagcacgccctgcggcccggccctgccaccctgggcgtgcttcttgggtccgattgcccccacccagccgtgtgcgaggggtgtcagagacccatatcggaccgtttcctgatgcgcgtgaatgagtcctcctggcatgaagagtgccttcagtgtgcggcatgccaacaagcactcactaccagttgctacttccgggatagaaagctatactgcaaacaagactaccagcagctgttcgctgccaaatgtagtggttgtatggaaaagatcgctccaacagagtttgtcatgcgggcattggaatgtgtgtaccatctgggctgtttttgctgctgtgtctgcgagcgccagctgagaaagggagacgagttcgtgctgaaggaaggccagttgctctgtaaaggcgactacgagaaagagaaagatttgctgtcttccgtttctccagatgaaagcgactctgtgaagtctgaggatgaggacggagatatgaagcctgctaaggggcagggatcgcagtctaagggcagtggcgacgacgggaaggacccgagaagaccaaagcgtccacgtacgatcttgaccactcaacaaagacgggcattcaaggccagctttgaagtctcttcgaagccttgtcggaaggtgagagagacgttggccgctgagaccggcctgtcagtccgcgttgttcaagtgtggtttcagaatcagcgggcgaagatgaagaagctggccagacggcaccagcagcagcaggaacagcagaattcgcagagattgggccaggaggttctcagcagccgcatggagggaatgatggcgagctatactccactggctcctcctcagcagcagattgtggctatggaacagtcaccttatgggtcttcagacccctttcagcagggtctcacccctccccagatgcctggaaacgatagcatattccatgacatcgacagcgatactagtttaaccagcctgtccgattgctttcttggaagcagtgacgttggctctctgcaggcccgcgtgggcaatcccattgaccgcctgtatagtatgcagtcctcctactttgccagctag

SEQ ID NO: 193373 - DNA, 1188 bp, Artificial Sequence
  Description of Artificial Sequence: Synthetic coding sequence
atggacatcgccaccggccccgagagcctggagcggtgcttcccccgtggacagaccgactgtgccaaaatgttggacggaataaaaatggaagaacatgccctcagacccgggccagcaaccctgggcgttcttctcggaagcgactgcccacacccggctgtgtgtgaaggttgccagagaccgatcagtgaccggttccttatgagggtgaacgaaagctcttggcatgaagagtgtctgcagtgtgccgcctgtcagcaggcactcactacgagctgttacttcagagaccgcaagctgtactgcaaacaagactaccagcagctgtttgccgctaaatgttctgggtgtatggagaagatagcccccacagaatttgtgatgcgtgccctagagtgcgtgtaccacctcggatgcttttgttgctgcgtgtgtgagaggcaactgcggaagggagacgaatttgtcttaaaagagggtcagctgctgtgcaagggggattacgagaaggaaaaggacttgctctccagcgtgagcccggacgagtctgatagcgtaaaaagcgaagatgaggatggagatatgaagcccgcaaaaggccagggttcccagtccaaggggagcggcgacgacggtaaagacccgcgtcgtcctaaaagaccccggacgatcttaacaacccaacagaggagagccttcaaggcatcattcgaggtgtcctctaagccttgtcggaaagtcagggaaaccctggcagccgaaacagggctgagcgtaagagtggtgcaggtttggttccagaatcagagggctaagatgaagaaactcgcccggaggcaccagcagcagcaggagcagcagaacagccagcgtctgggccaggaagtcctgtcttcccgcatggaaggaatgatggctagttacacaccccttgcgccaccccagcagcagatcgtcgcaatggagcagtctccgtatggatcctccgacccgttccaacagggattaactcctcctcagatgccaggaaatgactcaatttttcatgatatcgatagcgacacatccctaacgagtctgtccgactgctttctgggaagttccgatgtgggatccctgcaggcccgcgtgggcaaccctatcgatcgcctctacagtatgcagtcctcctacttcgcctcctag

SEQ ID NO: 193374 - DNA, 318 bp, Artificial Sequence
  Description of Artificial Sequence: Synthetic coding sequence
atgagcatctacttccccatccactgccccgactacctgcggagcgcaaaaatgacagaggtgatgatgaatacacagccaatggaagaaatcggcttgagcccccgtaaagacgggctttcttaccaaatcttcccagacccttcagatttcgaccgatgctgcaagctgaaagacagattacctagcattgtggtggaaccaacggaaggggaagtggaaagcggcgagctgcgctggcccccagaggagtttctggtccaggaggatgaacaggacaactgcgaagaaacagcgaaagagaataaggaacagtag

SEQ ID NO: 193375 - DNA, 264 bp, Artificial Sequence
  Description of Artificial Sequence: Synthetic coding sequence
atggtgagcagcgtggtgggcttctacagcctgcggttcttcggcaattttacacccaaaaaagacgacaccacgatgaccaaaatcattggcaattgtgtgagcattctcgtgctgagctccgctctgcctgtgatgtcccgcacactggggctgcacaaattgcatctgcctaacacttccagggacagcgagacagctagcgtgatgacttcctccgcaagggacacgggcttccaccacttgcaagcactgatgtgctag

SEQ ID NO: 193376 - DNA, 687 bp, Artificial Sequence
  Description of Artificial Sequence: Synthetic coding sequence
atggagggccaggacgaggtgagcgcccgggagcagcacttccacagtcaggtacgcgagagcactatttgttttctcctgtttgcaatcttatatgtcgtgagctattttataatcactagatataagcgcaagagtgatgaacaggaggacgaggacgcaattgtcaataggatctctttgttcctctcaaccttcacccttgcagtgtccgcaggagccgtattgctgttgcccttttctatcatctcaaacgagatcctcctgtccttccctcaaaattattacattcagtggctgaacggcagtctgatacatggcctttggaatttagcttccctgttcagcaacctgtgcctgtttgttctgatgcctttcgcatttttttttttggagagcgaaggcttcgccggcctgaagaaaggtatcagggctaggattctggagacattggttatgcttcttttgctcgctctcttaatcctgggaatcgtgtgggtggcctccgctctgatcgacaacgatgcagcaagcatggaatccctgtacgatctgtgggagttttatctgccatacctgtactcctgcatctcattaatgggatgtctcctgctccatctgcctaacacatccagggatagtgagacagcaaagccgtctgttaatggccaccaaaaagccctgtag

SEQ ID NO: 193377 - DNA, 1473 bp, Artificial Sequence
  Description of Artificial Sequence: Synthetic coding sequence
atggagggccaggacgaggtgagcgcccgggagcagcacttccactctcaggtacgggagtctaccatctgtttcctgctgttcgccatcctgtatgtggtgtcctacttcataattacacggtacaaaagaaagagcgatgagcaagaggacgaggacgcaatcgtgaacaggattagcctgtttttgtctacgtttaccctggcggtttcagcgggagccgtccttttgctgcccttttccattatcagcaatgagatcttgctgtcatttcctcagaactactatattcagtggcttaatggtagcctgatccatggcctgtggaacctggcctcactgttttccaacttatgcctatttgtccttatgcccttcgctttcttttttttggaatccgaggggttcgccggcctgaaaaagggcatcagggccagaatattagagacattggtgatgctattactactggcattactcatcctgggaatcgtctgggttgcctccgctcttatagataacgatgccgcatctatggaatcactgtacgatctttgggagttctacctcccctatctctacagttgcataagcttgatgggatgtttgctattgctgttatgcacgcctgtggggctgtcaaggatgttcacagtgatgggccagctacttgtaaaaccgaccattctggaggacctggacgagcagatttacatcattacattggaagaagaggctctgcagcgcaggctgaacggcttgtccagctcagttgaatacaatataatggaactggaacaggagttggaaaatgtgaagactctcaaaacaaaactcgagcgccgaaaaaaggcgtccgcctgggaacgcaaccttgtttaccccgcagtaatggtgctgctgctgatcgagacctccatctccgtgttgttggttgcttgcaatatattatgtctgctggtagacgagacagctatgcccaaaggcacgaggggcccagggattggaaacgctagcctcagcacgtttggattcgtgggcgccgccctggagattatcctgatcttttacctgatggtgtctagcgtagtgggcttttatagcctgcgattcttcgggaactttacacctaaaaaagatgacaccacgatgactaaaattataggcaattgtgtgtcaatcttggtactcagttcagctctgccagtgatgtcccggaccctgggtataacgaggtttgatttgctcggtgacttcggacgattcaattggctcggcaatttctacatagttttgagctacaacctgttgttcgctatcgttaccaccctctgtctcgtgaggaagtttaccagcgcggtacgggaggaactcttcaaggcattggggctgcacaagttgcacctgccaaatacctcacgtgactctgagaccgccaaaccgagcgttaacggacatcaaaaagccttatag

SEQ ID NO: 193378 - DNA, 1596 bp, Artificial Sequence
  Description of Artificial Sequence: Synthetic coding sequence
atggagggccaggacgaggtgagcgcccgggagcagcacttccactctcaagtgagggagtccacaatctgtttccttctgttcgcgattctgtatgtcgtctcctacttcatcataactaggtataagcgtaaatctgatgagcaggaagacgaagatgccatcgtgaacaggattagcttgtttctatcgaccttcaccctggcagtgtccgcaggggcggtcctcttgctgcctttcagcatcattagcaatgagatcctgctgtctttcccacaaaactattatatccagtggctgaacggatcactcatccacgggttatggaacctggctagtttgttctctaacttgtgtctgtttgtgctgatgccttttgcctttttttttctggagtcagagggattcgccggtctcaaaaaaggcatccgcgctcgcatactggagacccttgtgatgctgctgttgcttgcgctgttgatcctcggaattgtttgggtggcctccgcactgattgacaacgatgccgcgagtatggagtctctctatgacctctgggagttttacctgccctacctgtactcctgcatcagtcttatgggatgtctcctgctcctgctttgtactcccgtaggtctttcaaggatgtttaccgtcatgggtcagcttctggtaaaacccactattcttgaggacctggacgagcagatttacattattacactcgaagaggaagctctccaacgtaggctgaatgtgggcatgctgtgcgctggcaatcctgaagttgctacaggaaggcaggtgccagaagaacaggccggacagctgcttctgggcaaatggattcaggaaggcggcgatatgattgctaacccccgcttgtcttcctctgtagagtataatataatggaactggagcaggagctggagaatgtgaagacactcaaaactaaattagaacgcagaaaaaaggcctccgcatgggagcgtaacttggtctacccagctgtcatggttttgctcctgattgagacctcaatctcggttctcctggtggcttgcaatattctctgtttgctggtggatgagacggctatgccgaaagggacccggggcccaggcatcggaaacgccagtctcagcacgtttggcttcgtgggtgccgcgctggaaatcatcctgattttttatctgatggtgtcctcagttgttggtttttacagtctccgattttttggcaatttcacacccaaaaaagacgacacaacaatgactaaaatcatcgggaattgtgtttccattctggttctatcctccgccctgcccgttatgtcacggacgctcggaataacacgttttgacttattgggtgatttcgggaggttcaattggctcggtaatttttacattgttctgtcctataatctcctgttcgcaatcgtaacaaccctgtgtctggttcggaagtttacaagtgctgtgagggaagaactgtttaaagctctggggctccacaagctccacctgcctaatacaagccgtgattcggagacagccaaacccagcgttaatgggcatcagaaggcactgtag

SEQ ID NO: 193379 - DNA, 855 bp, Artificial Sequence
  Description of Artificial Sequence: Synthetic coding sequence
atgctgctgctgctggccctgctgatcctgggcatcgtgtgggtggcttctgcattaatcgacaacgacgcagcatccatggagtcactatatgacctgtgggaattctacctgccttatctttactcatgcatctctctgatgggatgcctcttgttgcttttgtgcacacccgtaggcctctctcgcatgttcaccgtcatggggcaacttctcgtgaagccgaccatactggaagatctggatgagcaaatatatattattactcttgaggaggaggcattgcaacggaggctcaatggcctgtcatccagtgttgagtacaacattatggagctcgagcaagagctggagaacgtgaagacactgaagactaaactggaaagaagaaaaaaggcgtcagcttgggaaagaaacttggtgtatccagccgtcatggtcttgctgctcattgagacatcgattagtgtgcttctggtcgcctgtaatattctgtgcctgttggtagacgagaccgctatgccaaaagggaccaggggtcccggcattggaaacgcctctttgagtacttttggttttgttggagctgcactcgagatcattcttattttctacctgatggtgagttctgtggttggattctattcactgcggttcttcgggaatttcaccccgaagaaggacgacactacaatgaccaagataataggtaactgtgtctcaatccttgtgctgagctccgctctgccagtaatgtcaaggaccctgggtctccataaacttcacttgccaaacacgtctagggactccgagacagccaagcccagcgttaacgggcaccagaaggccctttag

SEQ ID NO: 193380 - DNA, 1590 bp, Artificial Sequence
  Description of Artificial Sequence: Synthetic coding sequence
ggccaggacgaggtgagcgcccgggagcagcacttccacagccaggtacgggagtctacaatttgctttctgcttttcgcaatcctgtacgtggtttcctatttcattatcacaagatataagagaaaatctgacgagcaggaggacgaggatgcaatcgtaaataggatatccttattcctgtccacttttacccttgcagtaagtgccggggctgtactcctgttacctttttccattatctctaatgagattcttcttagcttcccacagaactactatatccagtggctgaatggcagcctcattcatgggctgtggaatcttgcctcactcttttctaatctatgtttgttcgttctgatgccatttgcattttttttcctcgagagtgagggttttgcagggctgaaaaaaggcataagagccagaatcttggagaccctggttatgctattgctattggctctacttatactggggatcgtgtgggtggccagcgccctcattgataacgacgcagcttccatggaatcgctgtacgatctgtgggaattctacctgccatacttatattcttgcattagcctgatgggatgtctgctgttattactctgtacacccgtggggctctctagaatgtttactgtgatgggccaacttctggtcaagcccacgattctggaggatttggacgaacagatttacatcataacgctcgaagaggaggctttacagcgaaggctgaatgttggtatgctgtgtgctggtaacccagaagtcgctactggacgccaagttcctgaggagcaggccgggcagcttttgctgggaaaatggatccaagagggcggggatatgattgccaaccccagactcagttcatctgtagaatacaatattatggagctggaacaggaactagagaacgtgaaaacactcaaaaccaagttggagcggcgtaaaaaggcctccgcatgggaacggaacctagtctatccggctgtaatggtgctactcctgatagaaacctctatctctgtgcttctcgttgcgtgcaacatcctgtgtctgctcgtggacgagactgctatgcctaaagggacaagaggcccagggatagggaacgcctctctctcaactttcggtttcgtcggcgccgctctggagattatcctgatattctacttaatggtgagtagtgtggtcggattctattctctccgtttttttggcaattttacacctaaaaaggatgacaccacaatgactaaaattattggaaattgcgtgagtatcctggttctttctagtgctcttccggttatgtcccgtacactgggcataactcggtttgatctgctgggggacttcggccggttcaactggctggggaacttctacatagtgctcagttataacctgctgttcgccatcgtcacgacactgtgcctcgtccggaagttcacttcggccgtgcgggaggagctattcaaggccttaggcctgcataaattgcacctccctaacacttcccgtgatagcgagacagccaagcctagcgtgaatgggcaccaaaaagccctctag

SEQ ID NO: 193381 - DNA, 1248 bp, Artificial Sequence
  Description of Artificial Sequence: Synthetic coding sequence
atgaaggaggacggccgggccggccggggcgtgggcgccggcgccgccctgcctcagccaagtgccggagttcatgacgagcaagaagatgaggatgccattgttaacagaatttccctattcctgagtacttttacattggccgtttctgccggagctgtgttactcctgccattctccatcatttccaatgaaattctgcttagtttcccacaaaattattatattcagtggctcaatggcagcctgattcacggactgtggaatctagcttccctgttttctaatctttgcctgtttgtccttatgcccttcgctttttttttcctggagtccgagggctttgccggtctcaagaaggggatccgcgcgagaatcctcgagactctcgtcatgttattgcttctggccttactgatactggggatcgtttgggttgcctctgctctgattgacaatgacgcagccagcatggaatctttgtacgatctatgggaattttaccttccatatctgtatagctgcatctccctaatgggatgcctgcttctattactgtgtacccccgttggcctatccagaatgttcactgtgatgggtcaactgctagtgaaaccaaccatattggaggacttggatgagcagatctacatcatcacccttgaggaagaagccctgcaacgcagactgaacgggcttagcagcagtgttgaatacaatatcatggagctcgaacaggagctggagaacgtcaaaacattgaaaaccaagctggagcggcggaagaaagcatctgcgtgggagcgtaatttggtttatccagcagtcatggtgttgctgctaattgagacttctatatctgtcctactggtcgcctgcaatatcttgtgtctgctcgtggacgagacagcaatgcctaaaggaaccagaggccctgggatcgggaacgcatccttaagtacattcggctttgtgggggccgcactcgagatcatcctcatcttctacctgatggtctcatctgtggtcggcttctacagtcttaggtttttcgggaatttcactcctaagaaagatgacacaactatgaccaaaataattgggaactgtgtcagcattcttgtcctgagctctgccttgcctgtgatgtcccgaacattggggctgcataaactgcatctgccgaatacgagcagagactccgaaaccgcaaaaccgagtgtcaatgggcaccaaaaggctctttag

SEQ ID NO: 193382 - DNA, 1470 bp, Artificial Sequence
  Description of Artificial Sequence: Synthetic coding sequence
atggaggcccccgactacgaggtgctgagcgtgcgggagcagctgtttcatgagcgaatccgcgagtgtatcatttctaccctccttttcgcaacattgtatatactctgtcatatatttttaacaagatttaagaaacccgctgagttcacaaccgttgatgatgaggatgcgacagtaaacaagatcgcccttgaactttgtactttcaccctcgcgatcgccttgggagccgttctgctgcttcctttctctatcatttctaacgaagttctgctgtctctccctcggaattactacatccagtggctgaacggatccctgattcatggtctctggaatctcgttttcctgtttagcaatctctctcttatttttctaatgccctttgcatacttcttcaccgaatccgagggatttgccggcagccgcaagggagtgcttgggcgggtttacgaaaccgtggtgatgttgatgctgctgactttgctcgttctgggtatggtgtgggtagcttccgctatcgtagataagaacaaagcgaatagggagagcctgtatgatttttgggagtattatttgccctacctctattcatgcatttcattcctgggtgtgctgttactcttggtgtgtactcctcttggcttagcaagaatgtttagtgtgactggaaagcttctcgtgaaaccgaggctgctggaagacttggaggaacaactctactgtagtgcattcgaagaagccgctctgacgagaagaatttgtaatcccacgagctgctggctgcccctggacatggagctgctgcataggcaggttctcgcgttgcaaacacaaagggtccttctggaaaaaaggcgaaaagcttcagcctggcagagaaatctgggctatccactagccatgctatgcctcctggtcctgaccggtttgtcagtcctcatcgtcgccatccatattcttgaactgctgatagacgaggctgccatgccacgggggatgcaaggcacttcgctggggcaggtatcattttcaaagttagggtcatttggggcggtaattcaagtagtactcatattctacttgatggtttctagtgttgtgggcttttacagtagtcccctgttccgatcccttaggccacggtggcacgatactgctatgacccagattattggcaactgtgtgtgcctcctagttctgagctctgcattgcccgtgtttagccggaccttggggctgacccgcttcgacctgctcggcgacttcggcagatttaattggctcggcaatttttacatcgtgttcctctacaatgcagcttttgctggactgactaccctctgtctggtgaagactttcacagccgccgtcagagctgaactgattagggctttcggcctggaccggctacccttacccgtttccgggttcccccaggcctccagaaagacgcagcaccagtag

SEQ ID NO: 193383 - DNA, 1455 bp, Artificial Sequence
  Description of Artificial Sequence: Synthetic coding sequence
atggtgaacgtgaaggccctgtgcgagcccgaggtgagcaactgctggatgaacgtcatcaccggcactggctctgttagctcccctctcctggttttgccacaaccagggccggagacgtccctgatgactggagaaccagtggacgatgaagatgcgaccgtgaacaagatcgctctggagctgtgcaccttcaccttggccatcgccctgggtgccgtgctgctgctcccttttagtatcatatcgaacgaagtcctcttatcgttacctcggaactattatattcagtggcttaatggctccttgattcatggcctgtggaacctggttttcctgtttagtaacctgtctctgatcttcctgatgcccttcgcctatttctttaccgagtcagagggcttcgctgggagtcggaagggggttctcgggagagtgtatgagacagtggttatgctgatgctgctcactctgctagtgttaggcatggtctgggtggcttcagcgatcgtggacaaaaacaaagcaaacagggaatctctgtacgatttctgggaatactacctgccttacttatactcctgtattagttttctgggggtcctgcttctgcttgtgtgtacccctctcggactcgctcgaatgttttcagtaacaggaaagcttttggttaaaccaagactgctggaggacctggaggagcagctttattgctctgcttttgaagaggcggctctgactcggcggatctgtaatccaacgagctgctggttacccttagacatggaacttctgcaccggcaggtcctcgctcttcaaactcaacgggtgttgctcgaaaagcggcgcaaagcatcagcctggcagaggaacttgggctaccccctggctatgctctgtttgttggtactgaccggactgtctgtgctaatcgttgctatacatatcctggagctgctgattgatgaagccgccatgccaagggggatgcaaggcacatcactcgggcaagtatcgttctctaagctgggctccttcggcgccgtaattcaagtggtgctcatcttttacctcatggtgtcaagtgtcgttggcttttattcttctcctctgttcaggtcccttcggcctaggtggcacgatactgcgatgacacagatcatcgggaattgcgtatgtctcttagtactcagctcagcgttacctgtgtttagcaggacccttggtctaactcgtttcgacctgttgggcgacttcggtcgctttaattggctgggtaatttttacatcgtctttttgtataatgcagcctttgccgggctgacgactctgtgcctggttaagacattcactgctgctgttagggcagagctcattcgcgcctttggtttagatcgtctacctttgccggttagtggtttcccacaggcgtccagaaaaacacagcaccagtag

SEQ ID NO: 193384 - DNA, 1410 bp, Artificial Sequence
  Description of Artificial Sequence: Synthetic coding sequence
atggaggcccccgactacgaggtgctgagcgtgcgggagcagctgtttcatgaaaggatcagagagtgcattatttctactctgctgttcgccacactgtatatcctgtgccacatatttcttacaagatttaaaaagcctgccgaatttactaccgtcgacgacgaggacgcgactgtgaataaaattgccctcgagctttgcacctttactttagcgattgcgctgggcgcagtattactactcccctttagcatcatctcgaatgaggttctgctcagtttacctcgaaactactacatccagtggctaaacggatctttaattcatggactgtggaatttagtcttcctctttagcaatctgtctctgatattcctcatgccctttgcgtatttctttactgaaagcgagggatttgcggggtctagaaaaggcgtgcttggccgcgtctatgagacggttgttatgctcatgctgctcacactgttggtgctcggaatggtgtgggtggcttccgctatagtggacaagaataaggcaaacagggagagcttgtacgacttctgggagtactaccttccatacctttactcttgcatctcttttctgggagtgctgcttcttctcgtgtgtactcccttgggactggcccgtatgttcagcgtcactgggaaacttttagttaagcccaggctactcgaggatctcgaggagcagctctattgtagtgcttttgaagaggccgccctaacacggagaatttgcaaccccacaagctgctggctgcccctggacatggaactgctgcatcgacaggttctcgctttacagacccagcgagtgttgttggaaaagcgacgaaaggccagcgcctggcagaggaacctcggttaccccttggcaatgctttgtctgctcgtgctgaccggattatctgtgctgatcgtcgcaattcatattctagaactcctgatagacgaagccgccatgcctcggggcatgcaggtggttctgatcttctatttaatggtcagctctgttgtcgggttttactcctcacccctattccgaagtctaagacctaggtggcacgatactgctatgacacagattatcggcaactgcgtgtgcctgctggtccttagtagtgccttgcctgtcttttcccggacgttaggcttgacaagattcgacctgctgggcgactttggccgatttaactggctgggtaatttctatatagtgtttctgtataatgccgccttcgctggcctgacgacgctttgcctggtcaaaacatttacagctgctgtcagggctgagctgatccgggcctttgggctagataggctcccattgccagtcagtggattccctcaagctagccgcaagacccagcatcagtag

SEQ ID NO: 193385 - DNA, 384 bp, Artificial Sequence
  Description of Artificial Sequence: Synthetic coding sequence
atggaggcccccgactacgaggtgctgagcgtgcgggagcagctgttccatgagcgcatacgggagtgcatcatttccacccttctgtttgccactctgtatattctctgccatatcttcctaacccgttttaagaaaccggcagagttcacaaccgtcgacgacgaagacgccactgtgaacaaaatcgccctggagctttgcacgttcacactagcaattgccctgggcgcagtgctattgcttccctttagcataatctccaacgaagtactcttgtctctgcccaggaactactacatccagtggctaaacgggagtttgattcatggactctggaatctggtgttcctcttttccaaccttagtttgattttcctgtag

SEQ ID NO: 193386 - DNA, 1017 bp, Artificial Sequence
  Description of Artificial Sequence: Synthetic coding sequence
atggtgcggcgggtgcagcccgaccggaagcagctgcccctggtgctcttgcggctcctgtgcctgctgcccacgggcttacccgtgagaagtgtggactttaatcgaggcaccgacaatattactgtcagacaaggtgacacagcaatcctgcgatgcgtggtcgaagataagaatagcaaggtagcctggcttaaccgcagcggcatcatcttcgctggccacgataagtggtccctggacccgcgggtggagctggagaagcgtcattctctggagtattcattgcgaatccagaaagtagacgtatatgatgaaggcagttacacttgttcagttcagactcaacacgagcctaagaccagccaggtctacttaattgtgcaggttcccccaaaaatctcaaacatcagttcagatgtcaccgtaaacgaagggtccaacgttacgttagtatgcatggccaatggcaggcccgaaccagtaatcacttggcggcacctcacacccaccggcagggagtttgaaggcgaagaggagtatctcgaaatcttagggattacccgagagcaatccggcaagtatgagtgcaaggcagccaacgaggtatcctcagccgacgttaagcaggttaaagtaactgtgaactacccacctactatcacggagtcaaaatcaaacgaggctaccacaggacgacaggcctccctgaagtgcgaggcttcagcagtgcctgcaccggattttgagtggtatagggacgatactcgtataaattccgccaacggtctggagataaagtccaccgagggacaaagctccctgacagtaacaaatgtgaccgaggagcactacggaaattacacctgtgtggccgcaaataaactcggggtcacgaatgcttctctggtcctgtttcgcccagggtccgttcggggaattaacggctctatttcgctggcggtgccactatggcttctggcagcctccctcctttgtctgctaagtaagtgctag

SEQ ID NO: 193387 - DNA, 1077 bp, Artificial Sequence
  Description of Artificial Sequence: Synthetic coding sequence
atgcggacctactggctgcacagcgtgtgggtgctgggcttcttcttatcgctcttctctttgcaggggctgccggtgcgctccgtagatttcaacaggggaactgataatatcaccgtgcggcaaggtgacactgcaatcctgcgctgcgtcgttgaggataagaactcaaaggtcgcctggctgaataggtccgggataatcttcgccgggcacgacaaatggtccttggacccgagggtcgagttggagaaacgacattcactggagtacagtttgcggatccagaaggtcgatgtttacgatgaaggctcgtacacgtgctcagttcaaacgcaacacgaacctaagaccagccaggtttatctcatagtacaagtccctcctaagataagcaacattagctcggacgtcaccgtgaacgagggctccaatgtgacgcttgtgtgtatggccaatggtcgacctgaaccagtgattacatggcgacatcttacccccacaggcagggaattcgaaggggaggaagagtatttggagattctcggcattacgagggaacagagcggcaagtacgagtgtaaggccgccaacgaggttagctctgcggatgtgaaacaggtgaaggtgaccgtgaattatccccctactattactgaatccaaaagtaacgaggctacaaccggtcgacaagcaagcttgaagtgtgaagctagtgcagtgcctgcacctgatttcgaatggtacagagacgacacaaggataaattcggcaaacggcttagagattaagtctaccgaagggcagtccagtctgaccgtgactaacgtgacagaggaacattacggaaactacacatgcgtggccgccaacaaactcggcgtgacgaacgccagcctcgtgctgtttaaacgcgttcttcccacaatcccccatcctatccaggaaatcgggacaaccgtgcattttaagcagaaaggccctgggtctgtccgcggaattaatggatccatttccttggcagtacccctgtggctgctggccgcctcgcttttgtgtctcctctctaaatgttag

SEQ ID NO: 193388 - DNA, 753 bp, Artificial Sequence
  Description of Artificial Sequence: Synthetic coding sequence
atggccgagggcggcgccagcaagggcggcggcgaggagcccggcaagttgcccgagccagctgaggaagagtctcaggtgctgagaggtaccggccattgcaaatggttcaatgtgcgtatgggcttcggatttatttcaatgatcaatcgtgagggctccccactggatattcccgtagatgtgtttgtgcatcagagcaaactttttatggagggctttaggtccctgaaggaaggcgagccagtggagttcacgttcaagaagtccagtaagggtctcgaatctatacgggtaaccggacctggcggcagcccatgcctggggtccgaaagaaggccaaagggaaaaaccctgcaaaagagaaagcctaaaggagaccgctgttataattgtggtggactagatcaccacgccaaggagtgctcgctgcctccccagccaaagaaatgccattactgtcagtcaatcatgcatatggtggctaattgcccacacaagaatgtggcccagccccctgcttctagtcaaggcagacaagaagcagagagtcaaccctgcaccagcacgctgcctagggaggtgggcgggggccacggctgcacatcacctccgtttcctcaggaggctcgtgccgaaatttctgagcgttctgggcggagcccgcaggaggcttccagtactaagtcttcaatagcccccgaggagcaatcaaaaaaaggaccatctgttcaaaaaaggaaaaagacttag

SEQ ID NO: 193389 - DNA, 2250 bp, Artificial Sequence
  Description of Artificial Sequence: Synthetic coding sequence
atggaggtggtgcccgccgaggtgaacagcctgctgcccgaggagatcatggacactggcattacacttgtggatgatgattccatcgaagctgtgattgtctcctcgcccatcccaatggagacagagctagaggagatagtcaatatcaattctacgggcgatagcacagcgactccgatttcaacggaacccatcactgtctatagcaaccatactaaccaagtggccgtgaacaccacaattacaaaggcagattctaatactacagtcaaacctgcttttccaagcggactacagaaactgggggcccagacccctgtaactatttccgcaaaccagatcatactgaataaggtctctcagacatctgacttaaagctcggtaatcagaccctgaagccggacggccagaagcttatccttacaactctcggtaaaagtggctccccaatcgtgctggctcttccccacagccagctgccccaagcccagaaggtgactactcaggctcagtctggcgacgctaaacttcctccccagcagatcaaagtggtcactattgggggtaggcccgaggtgaaaccggttattggcgtttcagctttgacacctggaagtcagttgataaatacgacaacccagccatcagtgctccagacgcagcaattgaagaccgtccagattgccaaaaagccacggacccccacctccggcccagtgataacgaaactgatcttcgccaaacctattaattccaaggccgtgactggacagactacccaggtgtcaccccccgtaatcgccggcagagtgttgtcccagtcgacgccagggacacccagcaagactattactattagtgaaagcggggtgatcgggtccactctgaatagcacaacccaaaccccaaataagatcgctataagtccactgaaatccccaaataaggccgtgaaatctactgttcagacgatcaccgtgggtggtgtatcaacgtcccagtttaaaacaatcattccgctcgcaaccgcacctaatgttcagcagatccaggtccccggatccaaattccactacgtacgcctggtgaccgctacatcggcatcttctagcactcaaccggttagtcagaatcctagtacaaatacacagcccctgcagcaagctaagccagtcgtcgttaatacaacccctgtgcgcatgagcgtgcctattgtgagcgcacaagcggtgaaacaagtggtgcccaagcccattaatccaaccagccagattgtgacaacatcacaaccccagcaaagactgatcatgcccgcaactcccttgccacaaattcaacccaatctgaccaacctccccccaggaacagtgttagccccagctccaggcaccggaaatgtgggctacgcggtgctcccggctcagtacgttactcagctgcagcagtcgagctatgtgagcatagcgtcaaattctacgttcactggaaccagtggaattcagacgcaggccaggctgccatttaatgggatcatcccctccgaatcagccagcagaccacgtaaaccttgcaactgtacaaaatctctgtgtctgaagctctattgcgactgcttcgctaacggggagttttgcaacaattgcaattgcactaactgctacaacaacctagaacacgaaaatgaaagacaaaaggccattaaggcctgtcttgaccgaaacccagaggcttttaaaccaaaaattgggaagggtaaggaaggagagagcgaccggagacactcaaaaggatgtaactgcaagaggtccggatgcctgaaaaattactgcgagtgctatgaggccaagatcatgtgctcatcaatttgcaagtgcattgggtgtaagaacttcgaagagagccccgaacggaagacactgatgcatcttgcagacgctgctgaagtgcgagtgcagcagcaaaccgcagctaagaccaaactgagttctcagatcagcgatctgctgacgcgccctacccccgcactgaatagcggaggcggcaagttgccctttacatttgtaacaaaggaagtggctgaggctacgtgtaactgtctactggcgcaggctgaacaagcagacaagaaaggaaaaagcaaagctgcagctgagcgcatgattttggaggagtttgggcggtgcctgatgtccgtgatcaatagcgcaggaaaagcaaagtcagatccgtgtgctatgaactgttag

SEQ ID NO: 193390 - DNA, 732 bp, Artificial Sequence
  Description of Artificial Sequence: Synthetic coding sequence
atggaggtggtgcccgccgaggtgaacagcctgctgcccgaggagatcatggatacgggcatcaccttggtggatgacgactcgatagaggctgtgatagtcagtagccccatccctatggagactgagctggaagagatcgtgaatatcaattctactggggactccaccgccacacctatatctacagaacccatcactgtgtactccaatcataccaatcaggtggccgtgaatacgacaattactaaagctgattctaacacgactgtgaaacccgcgtttccatcgggactgcagaagctgggcgcgcaaacgcccgtgaccatttcggcgaaccagataattctcaataaggtaagtcagacatcggacctgaaacttggaaatcagacactcaaaccagacggtcagaaactgattcttacaacactcggtaagagcggtagtccgatcgtcctggccctgccacatagtcagctgccccaggctcagaaagttaccacgcaggcacagtctggtgacgctaaacttcccccacagcagatcaaggtggtgaccatcggcgggaggccggaggtgaagccggttattggcgtgtccgcacttactcctggcagccagctgattaacaccactacacaaccgagcgtattacagacccaacagttgaagacagttcaggtgggtttctttcacagcctgctccctgagctgcatcagagaccctag

SEQ ID NO: 193391 - DNA, 1983 bp, Artificial Sequence
  Description of Artificial Sequence: Synthetic coding sequence
atggaggtggtgcccgccgaggtgaacagcctgctgcccgaggagatcatggacactgggatcacactagtcgacgacgactccattgaggccgtgattgtctcctcgccgattcctatggagactgaacttgaggagatagttaatatcaactcaaccggagacagcaccgccacgccaatttcgaccgaacctatcacagtatatagcaatcacacgaatcaggtggccgtgaatacaacaattaccaaggccgacagcaatacgaccgtgaaacccgcatttccttctggcttgcagaaattaggcgctcagacccctgtcactatcagcgccaaccagatcattctcaataaagtttcccagacaagcgatctcaaacttggtaaccaaacacttaaacctgatggccagaaactgattttaacaaccctcggaaagagtgggtcccctatcgttctggccttgcctcatagccagctgcctcaggcacagaaggttacaacccaggctcagtccggggatgccaaactgccaccgcagcagatcaaggtcgtgaccattggcggcaggcccgaggtgaaacccgtgattggggtgagcgccctgactccagggtctcaactaataaacacgactacacagccatccgtcctgcagacccagcagctgaaaactgtacaggcagtcaaaagcaccgtccaaactattaccgtgggtggggtctccactagccaatttaaaaccatcattccgctggcaacggctccaaacgtacagcagattcaggtgcctggctctaagtttcactacgtgagactggtaactgcaacctctgcttctagtagtactcagcccgtcagccagaatccctctaccaatacccaacctttacaacaggctaagccggttgttgtcaacacaacaccagtcagaatgtctgtccccattgtgtctgcacaggccgtgaagcaggtggttcccaagcctattaatccaacctcccagatcgtgacaacgtcccagccccagcagcggcttatcatgccggccacacccctaccccagatccagccgaatttgacgaacttaccacccggtaccgtactggccccagcccccggcaccgggaatgtaggttatgccgtgttgcctgcccagtacgtgacacagttgcaacaaagcagctatgtctctattgccagtaattcaacgtttacaggcactagcggaatccagacccaggctagactgcctttcaacggcattattccttctgaaagtgcttcccgcccaaggaagccatgcaattgtaccaaatctctgtgcctcaaactctactgtgactgctttgccaatggcgagttttgtaataactgtaactgcaccaactgttacaataatctagagcacgaaaatgaacgccagaaggcaatcaaagcgtgtttggaccgcaacccggaggcattcaaaccaaaaattgggaaagggaaggaaggggagagtgaccgccgtcatagtaagggttgtaactgcaagcgctctggctgcctgaagaactactgcgagtgctacgaagctaagattatgtgtagtagcatttgcaagtgcattggctgcaaaaattttgaagagtcgcctgagagaaagaccctgatgcaccttgctgatgcggcggaagtgagggttcagcagcagaccgccgctaagacaaaactgtctagccagatttcagatttactcacaagaccaactcccgcattaaatagcggaggggggaaactcccatttacatttgttaccaaggaggtggctgaggctacttgtaattgtctgctggcccaagccgagcaggcggataagaaaggtaaaagcaaggcagctgcagagcgtatgattctagaggaatttgggcgctgcctgatgagcgtcattaactcagccggcaaagcgaaatcggacccgtgtgccatgaactgctag

SEQ ID NO: 193392 - DNA, 1587 bp, Artificial Sequence
  Description of Artificial Sequence: Synthetic coding sequence
atggaggtggtgcccgccgagatcgccaagaagccccggacccccaccagcgggccggtcattaccaaattgattttcgcgaagcctatcaacagtaaggcggtgaccggacagaccacgcaagtctcccctcccgtaatcgctggccgggtactgtctcaatctacccccggtactccttcaaagactatcaccatatctgagtctggggtaatcgggtctacccttaactctaccacccaaaccccaaataagattgccatttcccctcttaagtcccccaacaaggccgtgaaatctacagtgcagacaatcaccgtggggggcgtatccacttctcaattcaagaccataattcccctggctacagcacctaatgttcagcagattcaagtgccggggtctaagttccattatgtgcggctcgtgacggccaccagcgcctcttcctcaacacaacctgtatcccagaacccaagcactaacactcaacccctccagcaggctaagccggtcgtggtgaacaccacccccgtgcgcatgagcgtccctatcgtatccgcacaggcagtcaagcaggtggtgcctaagccaatcaaccctacgtctcaaatcgtcaccacctcccagccacaacaacggcttataatgccagctacccccctcccccaaatccaacccaacctcaccaatctgccacctggaactgtgctggctcctgccccggggacaggtaacgtaggctacgccgttctgccagcacagtatgtgactcagcttcagcaaagctcttacgtgtctatcgcaagtaactcaacttttaccggcacctccgggatacaaacacaggcaagactcccattcaacggcataataccttctgagtctgccagtcgccctcgtaagccttgcaactgtacaaaaagcttatgcttgaagctctattgtgactgcttcgcaaacggcgaattttgcaacaattgtaactgtaccaattgctataacaacctggagcacgagaacgaacggcagaaggcaatcaaggcttgcctggatagaaaccctgaggccttcaagccaaaaattggcaagggcaaggaaggggaatccgacagacgccacagtaaaggatgtaattgcaaacgatcaggctgtctcaagaattattgcgaatgttacgaagcgaagatcatgtgctcaagtatctgtaaatgcatcggatgtaaaaattttgaagaatctcccgaacgcaagactctgatgcacctggctgatgcagccgaggtcagagtccagcagcagactgctgccaagaccaaactctctagtcaaattagcgacctcttgacaaggcctacgcccgcactgaactcaggcggtggtaaactgcctttcacttttgtgactaaggaggtcgccgaggccacctgcaattgcctgttggcccaggcagagcaagccgataaaaagggaaaatcaaaagccgctgccgaaaggatgatactggaggagttcggacggtgtctgatgtcagtaataaacagcgcaggcaaagccaaatctgatccgtgtgcgatgaattgctag

SEQ ID NO: 193393 - DNA, 1587 bp, Artificial Sequence
  Description of Artificial Sequence: Synthetic coding sequence
atggaggtggtgcccgccgagatcgccaagaagccccggacccccacgagcggtccagtgattaccaaacttatttttgcaaagcctataaactccaaggccgttactggacagactacacaagtcagtccccctgtaatagcaggtcgcgttctaagccagagcacaccgggcaccccttccaagaccattaccattagtgaatccggagtgattggctccactttaaattccacgacccagactcctaataagatagccatctcccccctgaagagtcccaacaaagccgtgaaatctaccgtccagacaataactgtgggcggggtctccacctctcagttcaagactataatacctctagccacggcccctaacgtgcagcagatccaggtccctggttccaagttccactacgtgcgattagtcacagcaacatcagcctcgtcttctacccaaccagtctctcagaatccatcaacgaacacacaaccgctccagcaagccaaacccgtggtggtaaacacaacccctgtccggatgtccgtacctattgtctcagcccaggccgtgaagcaagtggtccccaaaccaataaaccctacatcccaaattgtgactacaagtcaacctcagcagagactaatcatgcctgccacccccctcccccagatccaacccaatcttaccaatctaccacctggcactgtgctcgcaccagctcctggcactgggaacgtcggatacgccgttctgcctgcccagtatgtaacgcagttacagcaatccagttacgtctctattgcctccaatagtaccttcaccggtaccagtgggatccaaacccaggcgcggttgcctttcaatggcataatcccaagcgaatctgcaagcaggcctcgaaaaccgtgtaactgtaccaaatccttgtgcctaaagttatattgcgattgttttgccaacggcgagttttgtaataactgcaattgtactaattgctacaacaatctcgaacacgagaatgaacggcagaaagctattaaagcttgtcttgatcgcaaccccgaggctttcaagccaaagatcggcaaggggaaggagggtgaatctgacagaagacattctaaaggttgcaattgcaagcggagcggatgtctgaaaaactactgtgaatgctacgaggctaaaattatgtgttcctccatctgtaaatgtataggttgtaagaatttcgaggaatcccctgaacgaaaaactctgatgcatctcgccgatgccgccgaggtgcgcgtccaacaacagaccgccgcgaagacgaagctgtcatcacaaatcagtgacctgctgacacggcccactccagctctgaatagcgggggtggcaaactgccttttaccttcgtaacgaaagaagtggctgaggccacgtgcaattgtctgctggcacaagctgagcaggcagacaaaaagggaaaatctaaggctgccgccgagcgaatgattctggaggaattcggacggtgcctgatgtcagtgatcaactcagcaggtaaagcgaagtccgacccatgtgccatgaattgctag

SEQ ID NO: 193394 - DNA, 2250 bp, Artificial Sequence
  Description of Artificial Sequence: Synthetic coding sequence
atggaggtggtgcccgccgaggtgaacagcctgctgcccgaggagatcatggacaccggaatcactctggtcgatgacgactccatagaagccgtgatagtgtcctctcctatcccaatggagacggaattggaggagatcgtgaacattaatagcaccggcgatagcaccgcaaccccgatcagtaccgagcctatcactgtctattccaaccacactaatcaggtggccgttaacacaaccatcaccaaggccgactcgaacacaacggtaaaaccagctttccctagcggcctgcagaagttgggtgcccagactcccgtgaccatctctgccaaccagatcatcctgaacaaggtgtctcaaacgtctgaccttaagcttggcaaccagaccctgaaaccagacggacaaaagctgatactgaccaccctggggaaaagtgggagccccatcgttctcgccctgcctcactcccagctgccgcaggcacagaaggtgacaactcaggcccagagcggcgacgccaagttacctccgcaacagataaaggttgtgactataggggggcgacctgaagtgaagccagtaataggggtgtctgccctgaccccaggtagtcagctcatcaatacaaccactcaaccaagtgtgctgcagacacagcagctgaagacggtacaaatcgcaaagaaaccaagaactcctacctcaggacccgtgattacaaagcttatctttgccaaacccatcaactcaaaggccgtgacagggcagaccacacaagtgagtcctccagtaattgctgggagggtgctgagccagagcacccctgggactccatccaaaacaattacaatttctgagtccggcgtcattgggtccaccctcaattctaccactcagacccccaacaaaatcgccatttcccctctcaagtccccaaacaaggcagtgaagtccactgtgcagacaataacagtgggaggagtgagtacttctcaattcaagacaataattcctcttgccacagcaccgaacgtacagcagattcaggttccaggctctaagttccactatgtgcgactcgtgacagcgacctctgctagtagttctacccagcctgtttctcaaaacccctccaccaacacccagcccctgcagcaagctaagcccgtggtggtgaacactacacctgtccgtatgtcagtgccaatcgtctccgcgcaggccgtgaaacaggtagtcccgaagcctattaaccctacatctcagatcgtgacaacctcacaacctcagcagcgcctgattatgccggcgacaccactgccacagatccagcctaatctgaccaatctcccacccggaacggtgttggccccagctcccggcaccggcaatgtggggtacgctgtgctgcccgctcagtatgtgacccaacttcaacaaagcagctatgtcagtatcgcctctaacagcacatttacgggaacgtctggaatccagacacaagcacgtctgccattcaacggcatcatcccaagcgagtcagcttctcgtcccaggaagccctgtaattgcactaagagcctctgcctgaagttgtactgcgactgctttgccaacggtgaattctgcaataactgcaattgcaccaactgttataataacctggaacatgaaaatgaaaggcaaaaggcaattaaggcctgcctggatcggaaccccgaggcattcaagcctaaaattggcaagggcaaggagggtgaatccgaccgacgtcactccaagggctgtaattgtaaacgatcaggttgtctgaaaaattactgtgaatgttacgaggccaagatcatgtgctcttccatctgtaagtgtataggctgcaaaaacttcgaggagagtcccgaacggaagacgttgatgcaccttgccgacgcggcagaagttcgtgttcaacagcaaaccgccgccaagaccaaactttcgtcccagatctctgaccttctcacccggccaacccctgctcttaattcaggcgggggcaaattaccctttacatttgtcaccaaagaggtggccgaggctacttgtaactgcctacttgcccaggccgagcaggccgacaagaaagggaagtcaaaagcagctgcagaacgcatgatcctcgaagaattcggacggtgcctgatgtctgtcattaatagtgccgggaaagcaaaaagcgatccttgtgctatgaattgttag

SEQ ID NO: 193395 - DNA, 1587 bp, Artificial Sequence
  Description of Artificial Sequence: Synthetic coding sequence
atggaggtggtgcccgccgagatcgccaagaagccccggacccccaccagcggaccagtcattaccaagctcatcttcgctaagcccatcaattccaaagctgtgacaggccaaacgactcaagtgtcaccccctgtcatcgcagggcgcgtactgtcacagtcaacccccgggaccccctctaagacaattacaatttccgaatccggcgtcatcggatcaaccttaaacagcaccacccagaccccaaacaagatcgctatctcccctctgaagagtcctaacaaggctgttaaatcaactgtccagacaatcaccgtcggaggcgtcagcacatctcagtttaaaactataatacccctcgccactgcccctaatgtgcagcaaatacaggtccccggctcgaagtttcattacgtcaggctggtcactgccactagtgcttcctcttctacccagccagtttcccagaatccctctacaaatacacagccgcttcagcaggccaagcctgtggtggttaataccacaccagttcgcatgtcagtgccgatcgtctcagcccaggcagttaaacaggtcgtgccaaaacccatcaacccgactagtcagattgtgaccaccagccaacctcagcaaagattaatcatgccagccactcctctcccccagattcagccaaacctgacaaacctcccccctggcaccgttctggctcccgcccccggaactggcaatgtgggatacgctgtcctccctgcacaatacgtgactcagcttcagcagtctagctacgtctccatcgcttctaactcaacgtttacaggtacaagtggtattcagacgcaggcccgcctcccctttaacggcattattcccagtgagtctgcatcgagaccgcgcaagccctgcaactgcacaaagagtctgtgtttgaaattgtactgtgactgcttcgccaatggcgagttctgcaataactgtaattgtacaaactgttataataatcttgaacacgaaaacgagcggcaaaaggctatcaaggcatgcctagaccgcaacccagaggccttcaagcctaaaatcggcaagggcaaagagggagagtcggacaggagacactctaaaggctgtaactgtaaacggagtgggtgcctgaagaattactgcgaatgttacgaggcaaagataatgtgtagcagtatatgtaagtgtatcggatgtaagaacttcgaagagtcacccgaacggaaaaccctgatgcacttggcagacgccgcagaagtcagagttcagcaacagactgcagccaaaacaaaactgtccagtcagattagtgacctgttgaccaggcccactccggcactcaattcgggcggaggaaagctgcccttcacctttgtcacaaaggaagtggccgaggcgacctgtaactgcttgctggctcaagcggaacaggccgataagaaagggaaaagtaaggccgctgctgaacggatgattcttgaggaatttggccgctgtttaatgtcggtcatcaactcagcgggcaaagcaaaatcagacccctgcgcaatgaattgttag

SEQ ID NO: 193396 - DNA, 2025 bp, Artificial Sequence
  Description of Artificial Sequence: Synthetic coding sequence
atgtggcacgaggcccggaagcacgagcggaagctgcggggcatgatggttgactacaagaagcgagccgaaaggagaagagaatactatgagaagattaagaaagatcccgcgcagttcctacaggtccatggtcgagcctgtaaagtgcatttggatagcgctgtcgccctggcggccgaatctcccgttaatatgatgccttggcagggagacaccaataacatgatcgatagattcgatgttcgggcgcatttggaccatattcccgactatacgcctccactgctgacgactataagtcctgagcaagagtctgatgaaagaaagtgtaattacgaacggtacagggggctggtgcagaacgacttcgctggcatctccgaggaacagtgtctgtaccagatctatatcgatgaattgtatggcggtctgcaaagaccaagtgaagacgagaagaaaaagctggctgaaaaaaaagctagtattggttacacctatgaggacagtactgtagcgaaggttgagaaagccgcagagaagcccgaggaggaagaatcagccgcagaggaagagtccaatagcgacgaagatgaggtcattccagacattgatgtggaggtcgatgtggatgaactgaatcaggaacaggtcgccgatctcaataaacaggccacaacatacggaatggcagacggcgatttcgtcaggatgctgcgcaaagataaagaagaggccgaagctattaaacacgcaaaagcacttgaggaggaaaaggccatgtactctggacggagatctcgcagacagcgccgggagtttagggaaaaacgtctgagaggtaggaagatttctccaccgtcgtatgccagaagagacagcccaacatatgacccatataaacggtcacccagtgagagctccagtgaaagcagatcgcgatcccgctcaccaactcccggtcgcgaggagaaaatcacattcattacaagctttggaggcagtgacgaagaggcggctgctgcagcagcagcagctgccgcaagcggggttaccaccggcaagccccccgcaccgcctcagcccggtggccccgcgcccgggagaaacgctagtgctcgtaggaggtcttctagcagtagctcgtcttcttccgcctcgaggacctcttcctccagatccagttctcggtcctcttccagatccagacgggggggcggctattatagatccggccgccacgctcgctcccggagtaggtcctggtcacgctcacgctcccgttcaaggagatactctaggtcacgttctagaggaagacggcactccggaggcggcagcagagatggacatagatactccagaagtccggcaaggagaggtgggtatggccctcgcagacgctctcgttcaaggagccacagtggcgatagatataggcgaggtgggaggggtctgcgccaccatagctcctctcggagtagatctagctggtccctgtcgccctctaggtcaaggagcctgactcggagcaggagccatagtccttcaccctcccagtctcgttcacgaagtcgtagccgttcccaaagtccctctcccagtcctgcacgtgagaagctgactcggccagccgctagccccgctgtcggcgaaaaactgaagaagacggaaccagcagccggcaaagagaccggtgctgcaaaacctaagctgacacctcaggagaagctaaaactgcggatgcagaaagcactaaatcgccagtttaaggccgataagaaggccgcccaggagaagatgatacagcaggaacatgaaaggcaggaaagggaggacgagctgcgtgctatggctagaaagatccggatgaaggaacgcgaacgcagggagaaagagcgcgaggaatgggagagacaatatagcaggcagagccgcagccctagtcccaggtacagtcgcgaatactccagtagcagaaggcggtctcgaagtcgctccaggtccccacactataggcattag

SEQ ID NO: 193397 - DNA, 594 bp, Artificial Sequence
  Description of Artificial Sequence: Synthetic coding sequence
atggccgccctgggcgagcccgtgcggctggagcgggacatctgccgagctattgaattgctcgaaaaactacaaaggagcggcgaggtgcctccccagaaattacaagcattgcagcgggtcctccagtccgagttttgcaatgcagtgcgcgaggtgtatgagcatgtgtacgagacagtggatatcagcagctctcctgaggtacgggccaacgctacggccaaggccaccgtagccgctttcgcggctagtgagggacacagtcacccgcgtgttgttgaactgcctaagacggaggagggcctcggttttaatattatgggtgggaaggagcagaactcaccaatctacatttctagaatcatcccaggaggaattgctgatagacatggcggcctaaaacgcggcgatcagcttctgagtgtgaacggggtctctgtcgagggagagcatcacgaaaaagccgtggaattgcttaaagcagcacagggcaaagtgaagctggttgtccgctacactccaaaggtccttgaagagatggagagcagatttgagaagatgagaagtgccaagagaaggcaacagacgtag

SEQ ID NO: 193398 - DNA, 759 bp, Artificial Sequence
  Description of Artificial Sequence: Synthetic coding sequence
atggaggaggccatcctggtgccctgcgtgctgggcctgctgctgcttccaattcttgctatgctgatggccctgtgcgttcattgccatcggctgcctggcagctacgattctacgtcatccgactcgctgtaccctagaggaatccagtttaaaagaccacacacagtcgctccatggccacctgcctaccctcccgtcacctcctatcctcccctgtcacaacctgatcttctcccaattccacgatcaccacagccacggcgagactctgatggtgctaatagcgtagcctcatatgagaacgaaggcgcatcaggtatccgcggagcacaggccgggtggggcgtttggggcccaagctggacacgtttgactccggtttctctaccaccggaaccggcctgcgaagatgctgatgaggacgaggatgactatcataatcccggatacctcgtggtcctgcctgactctaccccagctacctcgacggctgccccatctgctcccgcattatccactcccggaattcgcgatagcgcattctccatggaatcgatcgatgactacgtaaatgtgcctgagagcggagaatccgccgaggctagcttagacggctctagagagtacgtgaatgtgtcccaggaactgcatcccggagccgcaaagaccgagcctgcggctctgagtagccaggaggctgaagaagtcgaggaagaaggagcccctgactacgaaaacctgcaggaacttaactag

SEQ ID NO: 193399 - DNA, 789 bp, Artificial Sequence
  Description of Artificial Sequence: Synthetic coding sequence
atggaggaggccatcctggtgccctgcgtgctgggcctgctgctgcttccgatcctcgccatgctcatggccttgtgcgtgcactgtcaccgccttccaggaagctatgatagtacgagtagtgactcactgtaccccaggggcatccagtttaaacggccccacaccgtagctccctggccgccagcctatcctccagtaacctcataccccccgctgtcgcagccagaccttctcccaatacccaggagccctcagccactgggaggctcccatcgcactccctctagccgccgggactcagacggcgccaattccgtggcctcttatgaaaacgaaggggcctcaggaatcaggggagctcaagctggctggggagtctggggtccctcctggactcgtctgaccccagtgagtctccctccagaacccgcttgtgaagacgcagatgaggacgaagacgactaccacaaccccggctatctggtcgtgttgccagattctactccagccaccagcaccgccgcaccctccgctcccgccctcagtacccccgggattcgggactcggctttctccatggagagcatcgacgactatgttaatgtccccgagagcggagagtctgctgaggcatctctggatggatccagagagtacgtaaatgtcagtcaggagttgcatccaggggccgccaagacagaacccgcagcattgtcaagtcaggaggccgaggaagtggaagaggagggtgctccagactacgaaaaccttcaggagctgaactag

SEQ ID NO: 193400 - DNA, 702 bp, Artificial Sequence
  Description of Artificial Sequence: Synthetic coding sequence
atggaggaggccatcctggtgccctgcgtgctgggcctgctgctgctgcccatcctcgctatgctgatggctctgtgcgtgcactgtcatcgactacctggctcctatgatagcacctcatctgactcactgtaccctcggggcatccagtttaagcggccccacacggtggccccttggcccccggcttacccacccgtaacatcttacccacctttgtctcaacccgatcttctgcccattccaaggagtccacagccccttggcggcagccacaggacccccagcagtcgcagagatagtgacggcgcgaattccgttgcgagctatgaaaacgaggaacccgcttgtgaggacgcggacgaggatgaggacgactaccataatcccggttatctcgtggtgctgcctgatagtacgccagctaccagcacggcagcaccctctgccccagctttgagtacacccgggattcgcgactcagctttctccatggagtctattgatgattacgttaatgtgcccgagtcgggagaaagcgctgaggcttctctggatggtagccgagagtatgttaacgtctcccaggagctgcacccaggcgccgcaaaaaccgagcccgccgccctcagctcacaggaggctgaggaggtcgaagaagagggtgcaccagactacgaaaacttacaggagttaaattag

SEQ ID NO: 193401 - DNA, 810 bp, Artificial Sequence
  Description of Artificial Sequence: Synthetic coding sequence
atggaggccaccgccgccagctggcaggtggccgtgcccgtgctgggcggggcatcaagacctctggggccacggggtgccgcttcactcctcagggcccccttacagatggaggaagctatcctagtcccttgtgtgcttggtttgctgcttttgcctatattggctatgctcatggcgctgtgtgtgcactgtcaccggctccccgggtcctacgactctactagctctgacagtctgtaccccagggggattcagttcaagcggcctcatacggtggccccctggcccccagcctaccctccagtgacatcttacccgcccctgtctcaaccagacctgctcccaataccccgctccccacagcctttaggcggtagccaccgaactccctcctctcggcgtgactctgacggggccaactcggtggcttcatacgagaacgaggagccagcctgtgaggatgccgacgaggatgaagacgactatcataaccctgggtacctcgtggtcctccctgactctactccagcaactagcaccgccgcaccttccgcccccgctctcagcactcccggcatcagagattcagccttttcaatggagtcaattgacgactacgtaaatgtgccagaatcaggcgaatccgccgaggcctctctggatgggtcgagagagtacgtgaatgtgtctcaggaactgcacccaggggctgcaaagaccgagcctgctgccctgtcctcccaggaggcagaagaagtggaggaggagggagccccggattacgaaaacttacaggagcttaattag

SEQ ID NO: 193402 - DNA, 699 bp, Artificial Sequence
  Description of Artificial Sequence: Synthetic coding sequence
atggaggaggccatcctggtgccctgcgtgctgggcctgctgctgctgcccatcctcgctatgttaatggcgctctgcgtgcattgccacagactacccggatcctacgactccacgtcttctgactcactctacccccggggcatccagttcaaacgtcctcacacagtcgcgccatggcctcctgcatatcctcccgtgacatcctaccctccgctatctcagccagacctcctcccgattccctctccacagcccctgggggggtctcatcggaccccctcttcaaggcgcgattcagacggcgctaactctgtggcctcatacgagaatgaggaacccgcctgtgaagacgccgatgaagatgaggatgactatcataaccctggatatttggtcgtgcttcctgattctacacctgccacaagtaccgccgcaccaagtgccccggctctgagcaccccagggatcagggactctgcttttagcatggaaagtattgacgattacgtgaatgtgccagaaagtggcgagtcagccgaagcctcccttgatggatctagagagtatgttaatgtgtcccaagagcttcaccccggcgccgccaaaacagagccggctgccctgtcttcgcaggaggctgaggaggtggaggaagaaggggccccggactatgaaaacttacaggagctgaattag

SEQ ID NO: 193403 - DNA, 732 bp, Artificial Sequence
  Description of Artificial Sequence: Synthetic coding sequence
atgagcagcggcaccgagctgctgtggcccggcgccgccctgctggtgctgctgggagtggcggcatctttgtgcgtcagatgctctcgcccgggcgccaagcgaagcgagaaaatataccaacaaaggagcctgcgagaagatcagcagagtttcactgggtccaggacttattcccttgttgggcaggcttggcccggccctcttgccgacatggccccaacgaggaaagacaaactacttcagttctatccgagtttggaagatccagcttcaagcagatatcagaacttcagtaaaggatctcgccacggcagcgaggaagcctatattgaccctattgcgatggagtactataattggggccgtttttctaaacctcctgaagatgacgacgctaattcctatgagaacgtcctgatctgcaaacagaaaacaaccgaaaccggagcgcagcaggagggaattggtgggttatgtaggggggatctgtccctgagcctggctctgaagacaggacccactagtgggctctgccccagcgcttcacctgaggaagatgaggaatcagaggactaccagaatagtgctagcattcatcagtggcgcgaatctcgaaaggtaatgggacagctgcaacgagaagcttctcctggcccggtgggcagcccagatgaagaggatggagagccagactatgtaaatggggaggtggcagcgacggaggcctag

SEQ ID NO: 193404 - DNA, 732 bp, Artificial Sequence
  Description of Artificial Sequence: Synthetic coding sequence
atgagcagcggcaccgagctgctgtggcccggcgccgccctgctggtgctcttgggtgttgcagccagtctctgcgtgcgctgttctagacctggcgccaagagatccgagaagatctaccaacagagaagccttcgcgaggatcagcaatccttcaccggaagcagaacatactcactggtgggacaagcatggcccgggccattagcggatatggcccctactaggaaggacaaactcctccagttttacccctcactggaggatccagcttcttcaagatatcagaatttctcaaaaggatctagacatggctccgaagaggcatatatagacccaatcgcaatggagtattacaattgggggcgatttagcaaaccccccgaagatgatgatgcaaacagttatgagaacgttttaatttgtaagcagaaaacaaccgagactggcgcgcaacaggaagggatcggagggctttgtcgtggggacctgagcctgtccctggctctgaaaacgggaccaacaagcggattgtgccctagcgcctcccctgaagaagacgaagagtctgaagactaccagaattcagcgtctatccatcagtggcgcgaaagtagaaaagtcatgggacagctccagcgagaagcgtccccgggccctgtgggtagccccgacgaggaagatggcgaacccgactacgtgaatggggaggtggccgccacagaggcttag

SEQ ID NO: 193405 - DNA, 195 bp, Artificial Sequence
  Description of Artificial Sequence: Synthetic coding sequence
atgagcagcggcaccgagctgctgtggcccggcgccgccctgctggtgcttctaggcgtcgccgcctccttatgtgtgaggtgcagccgcccgggagccaaaagaagcgaaaaaatttaccagcagcgctcactgcgagaggatcaacagagtttcacgggttcacggacatactccctcgttggccaggcctag

SEQ ID NO: 193406 - DNA, 732 bp, Artificial Sequence
  Description of Artificial Sequence: Synthetic coding sequence
atgagcagcggcaccgagctgctgtggcccggcgccgccctgctggtactgcttggggtcgccgcctccctgtgcgtgcgctgtagcagacccggggccaaacgaagtgagaaaatctaccagcagagatcactccgggaggatcagcagtcctttacaggcagtaggacttattcacttgtaggacaggcctggcctggcccacttgctgatatggcgcccactcggaaagataaactgctccaattttatccttcactggaagatcctgccagctcgcgctaccagaacttctccaagggttcaagacatggatctgaggaggcctacatcgatccaatcgcaatggaatactacaactgggggcggttctcaaagcccccagaggatgatgacgctaattcttacgaaaacgtccttatttgcaagcagaagaccactgagactggagcccagcaggagggtattggcggattatgtcgcggcgatttatctctcagccttgcccttaagaccgggccaacatctgggctgtgcccctccgcctctccggaggaagacgaagagtccgaagactaccaaaactccgcttctatccaccaatggcgggaatccagaaaggtgatggggcagttgcagcgcgaagcatcacccggcccagtaggatcaccagacgaggaggatggggaaccagactacgtgaacggggaggtggccgctaccgaggcgtag

SEQ ID NO: 193407 - DNA, 732 bp, Artificial Sequence
  Description of Artificial Sequence: Synthetic coding sequence
atgagcagcggcaccgagctgctgtggcccggcgccgccctgctggttcttcttggggtcgccgccagtttgtgcgtgaggtgttcgaggcctggggccaaaaggagcgagaagatttatcagcagcgatcactccgcgaggatcagcagagctttacaggatccagaacctactccctggtaggacaggcctggcccggcccacttgcggatatggcacccactaggaaggataaactgctccaattctaccccagcctcgaggatccggcaagctctagataccagaattttagcaaaggaagtaggcatggctcagaggaagcatacattgaccccatagcaatggagtactataactggggacgattctccaagcctcccgaagacgatgacgccaattcatacgaaaacgtgcttatttgtaagcagaagaccactgagacaggagcccaacaggaaggcataggaggcctttgcagaggggacctgagcttgtcactggcacttaaaacaggtcccacttccggactgtgccccagcgctagccccgaagaagatgaggaaagcgaggactatcagaacagtgcatcaatccatcagtggcgggagtcccggaaggttatgggccagctgcagcgcgaggctagcccagggccggttgggtctcccgacgaggaagatggagagccagattacgtaaacggcgaagtcgcagcaacagaggcctag

SEQ ID NO: 193408 - DNA, 177 bp, Artificial Sequence
  Description of Artificial Sequence: Synthetic coding sequence
atgagcagcggcaccgagctgctgtggcccggcgccgccctgctggtgctccttggcgtagctgcgagcttgtgcgtgaggtgcagcagaccaggtgccaaaagatctgagaaaatttatcagcagcgctccctcagggaagaccagcagagttttacgggatcccgaacctactag

SEQ ID NO: 193409 - DNA, 303 bp, Artificial Sequence
  Description of Artificial Sequence: Synthetic coding sequence
atgagcagcggcaccgagctgctgtggcccggcgccgccctgctggtgctgctgggggttgccgcttcactgtgtgtgaggtgctctcgtcctggcgctaagcggagcgaaaaaatatatcaacagagatcgctcagggaggatcagcagagtttcacaggttctcggacctatagtctggtggggcaggcctggcctggcccgttagctgatatggcgccaacacgaaaagataaactcctccagttctacccttcacttgaggatcctgcgtcctcaaggtaccagaacttttcaaaatag

SEQ ID NO: 193410 - DNA, 1704 bp, Artificial Sequence
  Description of Artificial Sequence: Synthetic coding sequence
atgcggcccgacagccccaccatggccgcccccgccgagagcctgagaaggagaaagaccgggtactcagatcctgaaccagaatctccgccggcaccaggtcgtgggccggcgggatctcccgcccacctacacactggcaccttttggttaacccggatcgtgcttcttaaggccctcgccttcgtttatttcgtggccttcttggtggcttttcaccaaaataaacaactcattggcgacaggggactgctgccctgcagagtatttttaaagaattttcagcaatactttcaggaccgaacgagttgggaggtgtttagttatatgccaaccatcctgtggctgatggactggtctgacatgaacagtaacctggacctgctggctttattgggcctcggcatttccagcttcgtccttattactggttgcgcgaacatgcttctgatggccgccttgtggggactgtacatgtctctcgtgaacgtcgggcatgtgtggtactcattcggttgggagtcacagttactggagactggattcttggggatcttcctgtgtccactctggactttaagccgacttccgcagcatacaccaacaagtcggatcgtcctatggggattcagatggcttattttcaggatcatgctgggtgctggccttatcaaaatcagaggcgataggtgttggagggatcttacttgcatggatttccactatgaaacccagcccatgccaaaccccgtagcctattatctccaccacagcccttggtggttccatcggttcgagacgctatcgaatcatttcatcgaactgcttgtgcccttcttcctatttttgggcaggagagcctgcattatccacggcgtcctccagatccttttccaggccgtcttgattgtatccggaaacctgtcttttctgaactggttgacaatggtgcccagtctcgcatgcttcgacgatgcgacactgggttttctgttcccctctggccccggatctctcaaggaccgcgtgcttcaaatgcaaagagatatacggggggcgaggcctgagccaagattcggctctgtggttcgcagagctgctaatgtaagccttggggtcctcttggcctggctcagcgtaccagtggttctgaacttattatcttctcgccaagttatgaatacccactttaattctctgcacattgtcaatacgtatggcgcgtttgggtcaatcacaaaggagagggctgaggtcatcttgcaaggtacagctagctccaatgcgtccgccccggacgccatgtgggaagattatgaattcaaatgcaaaccaggcgacccctcccggagaccatgcctgatctccccttatcattatcgcttggattggctgatgtggttcgccgccttccagacctacgagcataacgactggataatccatctcgcaggaaagctcttagccagtgacgccgaggctctgagcctgctggcccataacccctttgctgggagacctccaccccggtgggttcggggtgagcattataggtataaattttccagaccaggcggcaggcacgccgcagaagggaagtggtgggtcagaaagaggattggagcttacttcccaccactgtctcttgaggagctgaggccatacttcagagacagaggctggccactgcccggcccgctgtag

SEQ ID NO: 193411 - DNA, 1704 bp, Artificial Sequence
  Description of Artificial Sequence: Synthetic coding sequence
atgcggcccgacagccccaccatggccgcccccgccgagagcctgagacggagaaaaacgggatactccgaccctgaacccgaatctccacccgctcctgggcggggaccagccggttcacccgctcatctgcataccgggaccttctggctaaccagaattgtgctcctcaaggccctggcctttgtgtactttgtggccttcctggttgcatttcatcagaataagcagctcattggcgacagaggactgctaccctgccgcgtattccttaagaattttcagcagtactttcaggacaggacgtcttgggaggtcttctcgtacatgcccacaatcctgtggctaatggattggagcgacatgaatagtaatttggaccttctggccctgctgggcctcggtataagctcttttgtgctcattaccggctgcgctaacatgttgctcatggccgctctctgggggctgtatatgtcactcgtaaatgtgggacatgtttggtattcgttccggtgggagtctcaacttctggagaccggatttctgggcatctttctctgccccctgtggaccctaagtcgtctcccccaacatacacctaccagtaggatcgtactctggggctttcgctggttaattttcagaattatgctgggtgccggcctgattaaaatccgcggggacagatgctggagggatctgacatgtatggacttccattacgaaacacagcctatgcctaaccccgtcgcatattacctgcatcattctccttggtggttccatcgttttgaaaccttaagcaatcacttcattgagctattggtcccattcttcctctttcttggtaggcgggcctgcataatccatggcgtgttgcagattctcttccaggccgtactcatcgtatctggcaatctgagcttcctgaactggctcaccatggtgcccagtcttgcttgttttgatgatgccactttgggcttcctcttcccatctggtccaggaagccttaaggatagggtactgcaaatgcagcgcgacatccgaggtgcccgtccagaacctcgatttggatctgtggtcagaagagccgctaacgtgagtctaggagtgttgcttgcatggctttccgtgccagtcgtcctgaacttactgtcctctcggcaggtgatgaacacccattttaactccctgcacattgtcaacacgtacggagcttttggaagtataactaaggagcgagccgaagtcattctccagggtacagccagtagtaatgcttccgctcctgatgctatgtgggaggactacgagtttaagtgtaagccgggggacccatctaggagaccttgcctaatctcaccataccactacagactagactggttgatgtggttcgcagcatttcaaacgtacgagcacaacgattggattatacacttggcaggtaaattgctggcatccgacgccgaggccttgagcttgctggcccacaatccttttgctggtcggcctcctcctcgatgggtccgcggtgagcactaccggtataaattttcaaggcccgggggtcgtcacgccgccgagggcaagtggtgggtccggaagcgcatcggagcctacttcccacccttatctctcgaagagctccggccttattttcgggacagaggctggcccttgcccgggcctctgtag

SEQ ID NO: 193412 - DNA, 558 bp, Artificial Sequence
  Description of Artificial Sequence: Synthetic coding sequence
atgcggcccgacagccccaccatggccgcccccgccgagagcctgcgccgtcgaaagaccggctatagcgacccagaacctgagtccccccctgcacccggacggggacctgcagggagtcccgctcacctgcatactggcacattttggctgacccggatcgttctgctgaaagcgctggcttttgtgtatttcgtggccttcttagtagcttttcaccaaaataagcagctgattggggacagaggacttttgccatgtagagtattcctgaagaactttcagcagtacttccaggacagaaccagttgggaggtcttctcatacatgccaacgatcttatggctcatggattggagtgacatgaatagcaatctggatttgctggcgctcctgggcctgggaataagttcctttgtcctgattactggatgcgcaaatatgctgctgatggccgccttatggggactgtacatgagcctagtcaacgttgggcacgtatggtgtcctagcctcgctagtgcaatctccctgccgtccatgcatggagggcagtag

SEQ ID NO: 193413 - DNA, 501 bp, Artificial Sequence
  Description of Artificial Sequence: Synthetic coding sequence
atggccgcccccgccgagagcctgcggcggcggaagaccggctacagcgacccagagccggagagcccccccgcgccgggccgtggtcctgctggttcccctgcgcacctgcataccggcaccttctggctgacccgaattgtcctgttgaaggcccttgcatttgtttatttcgtcgcttttcttgttgcattccatcaaaataaacagctcattggagatcggggactcctgccatgtcgggtgttcctgaaaaacttccagcagtactttcaggaccggacctcctgggaggtgttcagttacatgcccactatcctttggttaatggactggtctgatatgaatagtaatcttgacctacttgcactcttagggctcgggataagtagcttcgttcttattacaggctgcgccaacatgctactcatggccgcactgtggggtctttacatgtcacttgttaacgtggggcacgtgtggtatagttttggcaagtag

SEQ ID NO: 193414 - DNA, 1053 bp, Artificial Sequence
  Description of Artificial Sequence: Synthetic coding sequence
atgcggggcgccggcctgatcaagatccggggcgaccggtgctggcgagatctcacctgcatggacttccactatgaaacccagccaatgcccaacccagttgcatattatctacatcattctccctggtggtttcaccggtttgagaccttgtcaaaccatttcattgaattactagtgccattctttctgttcctgggcagacgggcctgtattatccacggagtgctgcagatacttttccaggctgttctgatcgtaagcggaaacctatccttcttgaattggctgacaatggtgcctagcctcgcttgctttgatgacgccactctgggtttcctgttccctagcggcccaggcagtctgaaagaccgtgtgttacaaatgcagcgggatatcagaggggctaggcctgaaccaaggttcgggtcggtagttcgccgggctgctaacgtgtctctcggagtcctccttgcctggttatccgtccctgtggttctcaatctgttaagctccaggcaggttatgaatacccatttcaacagcctgcatatcgtcaatacctacggagcctttgggtctattactaaggagcgtgcggaagtgatcctgcaaggcaccgctagcagcaacgcttccgcgcctgatgccatgtgggaggattacgaatttaagtgcaaacctggggaccccagtcgccggccatgtcttatcagcccttaccattaccgcctggattggctgatgtggtttgcagccttccaaacatacgagcataacgactggatcatccatctggcgggaaagttgctggcatcagatgccgaggccctgagcttgctggctcacaatccatttgcaggtcggccacctcctagatgggtcaggggagaacactacagatacaagtttagtagacccggaggacgccatgcagcggagggcaaatggtgggtgaggaagcgaataggggcctattttccaccccttagcctggaggagctgcggccttattttcgggatagaggttggccacttcctggacccctgtag

SEQ ID NO: 193415 - DNA, 993 bp, Artificial Sequence
  Description of Artificial Sequence: Synthetic coding sequence
atggacttccactacgagacccagcccatgcccaaccccgtggcctactatcttcatcatagcccctggtggtttcataggtttgagaccctgtctaaccatttcatcgagttgttggtgccattctttctctttctcggacggcgagcttgtatcatacatggcgtccttcagatcctgtttcaggctgtcctaatcgtttccggcaacctatctttcctgaattggctgactatggtgcctagcctcgcatgcttcgacgacgctaccctgggcttcttattcccgtcaggcccaggttccctgaaggatagggtcctgcagatgcaacgcgatattcgaggggctagacctgagccacggtttggaagcgtagtgagacgcgctgcaaatgttagcctgggcgtcctactggcttggcttagtgtgccagtggtgctaaatctgttgagcagccggcaggtgatgaacacacactttaactctctccacatcgttaacacgtatggtgcatttggatccatcacaaaagaacgcgcagaagtcatactgcaggggaccgcgagctcaaatgcctccgcccccgatgccatgtgggaggattacgagtttaagtgtaagccaggtgacccttcgagaaggccttgccttatttctccttatcactataggctggactggttgatgtggttcgcagcctttcagacctatgagcataacgattggatcatccacctagccggaaaacttctcgcttccgacgcggaagcactcagtctcttggcgcacaatcctttcgctggcaggccaccaccaaggtgggtgagaggagaacactatagatacaaattttcaagaccagggggcaggcatgctgccgaaggcaaatggtgggtccggaaaaggataggggcatacttcccgccgttgtctcttgaggaactacggccctacttcagggatcgaggctggccactccctggcccactttag

SEQ ID NO: 193416 - DNA, 792 bp, Artificial Sequence
  Description of Artificial Sequence: Synthetic coding sequence
atgcccaaccccgtggcctactacctgcaccacagcccctggtggtttcataggttcgaaacactgtccaaccattttatagaactgttggttcctttcttcttgtttttagggcgcagagcatgtatcatccacggagtgctccagatattgttccaggctgtgttgatagtgtccggtaacttgtcttttttgaactggcttaccatggtccccagcttggcttgtttcgacgatgctaccctgggatttctcttcccttccgggcctggatcattgaaggacagagtacttcaaatgcagcgcgacatcaggggggccaggccagaacccaggttcggaagcgtcgtacgacgcgccgctaacgttagtctaggcgtcctcctcgcatggctttccgtgcccgtggtcctaaaccttctgtccagcaggcaggtgatgaacactcattttaactcgctgcatattgtcaatacctacggcgcctttgggtcgatcaccaaagagcgtgccgaggtcatcctgcaaggcactgcctcatctaatgcatctgccccagacgccatgtgggaggattacgaattcaaatgtaagcctggggatccttccaggcgaccatgtctgataagcccgtaccactaccgacttgactggctgatgtggtttgccgcctttcagacttatgagcataacgattggatcattcacctggccggaaagcttctcgcctccgatgcagaagcacttagcctgctagcccacaacccattcgctggccgaccacccccatag

SEQ ID NO: 193417 - DNA, 1503 bp, Artificial Sequence
  Description of Artificial Sequence: Synthetic coding sequence
atgagcaacagcgtgcccctgctgtgcttctggagcctgtgctactgcttcgctgccggctcgccggtaccttttggcccagaaggccggctcgaagacaaactccacaagcccaaagcgacccaaacggaagtgaagcccagcgtccggttcaacctccgcactagcaaagaccctgaacacgagggctgctacttgtctgtgggccactcccagcccttggaagattgttctttcaacatgactgcaaaaacatttttcatcatccacgggtggactatgtctggaatcttcgagaactggctgcacaaactggtgtcagcattgcacactagggaaaaggacgcaaacgtggttgtggtggactggctgccactggcacatcagttatatacagatgcggtgaacaacacacgtgtcgtaggccacagcatagcccgcatgttggattggttgcaggagaaggacgactttagtctcggaaatgtgcaccttatcggttactctctgggagcacacgtcgccggatatgctggaaactttgtcaagggtaccgtgggcaggataacagggcttgaccctgccggacccatgtttgaaggcgctgacatccacaaacgcctgagtcccgacgacgcagacttcgtcgatgtgctccatacctataccagatcattcggcctttccattggaattcaaatgcccgttgggcatattgacatataccctaacggaggagatttccaaccaggatgtggtcttaacgacgtgctcggatccattgcctacggaactatcaccgaggtggtgaaatgcgaacacgagcgagccgtacatctgttcgtggattcccttgtgaaccaggacaagcccagcttcgcgttccagtgcacagattctaatcgatttaaaaaaggaatatgcctgtcgtgtcgcaaaaaccgctgcaattctatcgggtacaatgcaaaaaagatgcgcaacaagcgcaactctaaaatgtatcttaagacccgcgcagggatgccctttagggtgtaccactaccagatgaaaattcacgtcttttcctacaagaacatgggagaaattgaacccactttttatgttacgctgtatgggactaacgctgatagccagacgctaccgctggagatcgtagaacggatcgagcaaaacgctaccaatacgttcctagtttacacagaagaagatttgggggatctgcttaagatccagctaacctgggaaggggcctcacaaagctggtataacctctggaaagaatttaggagctatctgtcccagccacggaaccccggccgcgagcttaacatcaggcggatcagagtgaagagcggagaaacgcagcgcaagctcactttttgtaccgaggatcccgagaacaccagtatttctcccggacgcgagctgtggttccgaaagtgtcgcgatggatggcgcatgaaaaacgagacgtctccaaccgtggaactcccctag

SEQ ID NO: 193418 - DNA, 1281 bp, Artificial Sequence
  Description of Artificial Sequence: Synthetic coding sequence
atgagcaacagcgtgcccctgctgtgcttctggagcctgtgctactgttttgctgcagggagcccggtcccgtttggccctgagggaaggctagaggacaaactccataagccaaaggcaactcagaccgaagtcaagccatccgtgaggttcaatctgcgcacgagcaaagacccagagcatgaggggtgttacttgtccgtggggcatagtcagccgttggaagactgcagttttaatatgactgccaagaccttttttatcatccacggttggaccatgtcaggcatcttcgagaactggcttcacaaactcgtgtccgccctccacacccgcgaaaaagatgcgaacgttgtcgtagtcgactggttacctctagcacaccagctgtacactgacgccgtcaataatactcgcgtagtcgggcactccattgctcgcatgttggattggctgcaggagaaagacgactttagtctgggaaatgttcacctgatagggtactctctgggcgctcacgtggcaggatacgcaggcaactttgtgaaaggaacagtgggtaggatcacagccatcaccgaggtagttaagtgcgagcatgaacgcgcagtgcacctgtttgttgacagtctcgttaaccaagataagccctcctttgcattccagtgcaccgattcaaataggttcaagaaaggtatttgtttaagttgtagaaagaatcggtgcaactccattggctacaatgccaagaaaatgcggaacaaacggaatagcaagatgtacctgaaaacaagagccggaatgccattccgcgtgtatcattaccagatgaagattcatgtattttcctacaaaaacatgggggaaattgagcctaccttttacgttaccttatatggaacaaatgccgactctcaaactcttcccctcgagattgtcgagagaattgaacagaatgccacaaatactttcctggtgtacacagaagaggatctcggtgatcttctcaaaatccaactgacatgggagggcgcctcacagtcctggtacaatttgtggaaggagtttcggtcctacttgtcccagccacggaatcccgggcgtgagctgaacattcgtcggatccgggttaagtcaggagagacacagcggaaactcaccttctgcacagaagatccagaaaataccagcataagtcccggtcgggagctgtggttcagaaaatgccgggatggatggagaatgaagaacgaaaccagcccaactgtagagctgccttag

SEQ ID NO: 193419 - DNA, 1101 bp, Artificial Sequence
  Description of Artificial Sequence: Synthetic coding sequence
atgaacatcagccagatcatcagctactggggctaccccgacgaggagtacgacatcgtgactgaggacgggtatatcctcgggctgtatcggatcccttattggagaacagataacaataaaaaccttgctcaacgcgttgtagtatatcttcagcatggcttgctcacctccgctagctcgtggatcagcaatctccccaataattctctaggttttattctcgccgatgctgggtatgacgtgtggatgggcaactctcgcgggaatacatggtctcgtaagcacctttatcttgagacctcttctaaagaattttgggctttctccttcgacgaaatggccaaatacgatcttcctgctagtattgatttcactgtgaaacaaaccagacaggaagagatcttttatgttggtcacagccaggggacgacgataggctttattacattctctaccattagcaagatcgccgagagaataaagatcttcttcgccctggctcctgtgttttccactaagtatcttaaatctccccttatcagaatgacgtacaaatggaaatctattgtcatggcgttttcagggaacaaggactttctccctaagacctccttcaaaaagttcatcggcagcaagctctgtcccctgcagatattcgacaaaatctgcctgaacattctttttatgatgtttgggtacgaccctaagaacctgaatatgtcacgattggatgtctatttttctcataaccccgccgggacttctgtgcagaatatgttgcattggagtcaactcctaaactccacacacttgaaggcctacgattggggcagtcctgacctgaatctggtgcactacaaccagacaacctctcctctttacaatatgacgaacatgaacgttgctacagctatctggaatggaaagtctgacctgcttgcagacccagaagatgttaatatcctgcattctgagataacgaatcatatatactataagacaatctcatactacaaccacatcgactcacttttcggactagacgtgtatgatcaggtgtatcatgagatcattgacatcatccaggacaacctctag

SEQ ID NO: 193420 - DNA, 1200 bp, Artificial Sequence
  Description of Artificial Sequence: Synthetic coding sequence
atgtggcagctgctggccgccgcctgctggatgctgctgctgggcagcatgtacgggtacgataagaagggaaataatgccaatccagaggccaacatgaatattagccagatcatcagttactggggatacccatacgaggagtacgatgtcaccacgaaggatggttatatactcggcatttaccgtattcctcacggacgcgggtgtccaggtaggactgccccgaagccagccgtctacttgcagcacggtctgattgccagtgcctcgaactggatttgcaatttgcccaacaattctcttgctttcctgctcgctgacagtgggtatgatgtttggctggggaacagtagaggcaacacctggagtcggaagcatcttaagttgagtcccaaatctcccgaatactgggctttctctctggacgaaatggccaagtacgatcttcccgctactataaactttatcatcgagaaaactggccaaaaacgcctgtattatgtcggtcacagccagggaacgacaatcgcttttattgccttctcaacaaatccggaactggccaaaaaaattaaaatctttttcgccctcgcaccagtcgttaccgtgaaatacacacaaagccccatgaagaaactcacaaccctctccaggcgcgtggtcaaagtgctatttggtgataagatgtttcacccccataccctgtttgatcagtttatagctacaaaggtttgcaaccgcaagctgttcaggcggatatgttccaattttctgttcacgctgtctggcttcgacccccaaaatctgaacatgagtcgcttggacgtgtacttgtcacataatccagcgggaacctccgtccaaaacatgttacactgggcgcaagctgtgaattctggacagctacaggccttcgattggggtaattctgatcagaacatgatgcactttcaccagcttacgccacccttgtataatattaccaaaatggaggtgcccactgctatttggaacggcgggcaagacatcgtggcagaccccaaggacgtagaaaatttactgccacagattgctaatcttatttactacaagctgatccctcactataaccacgttgatttttatttgggagaggatgcgccccaagaaatctaccaggatctcataatcctgatggaagaatacctccagaactag

SEQ ID NO: 193421 - DNA, 1272 bp, Artificial Sequence
  Description of Artificial Sequence: Synthetic coding sequence
atgctggagaccctgagccggcagtggatcgtgagccaccggatggaaatgtggctgctgattctggttgcctatatgtttcagaggaatgtgaacagtgtccatatgcctaccaaagcagttgatccagaggcatttatgaatatttcagaaataatccagcatcagggttacccatgtgaggagtacgaagttgctacagaagacggctatattctgtcagtgaacaggattccccgcggccttgtgcaacccaagaaaactgggtctagacccgtggttttgctacagcatggattggttgggggggcctccaactggattagcaacctccctaataactccctcggttttattctcgccgatgctggcttcgacgtctggatggggaacagcagaggaaacgcctggtctcgcaagcataaaacgctgtccattgaccaggacgagttctgggccttcagctatgatgagatggctagattcgacctgccagctgtgattaacttcatcctgcagaagactggtcaagaaaagatctactatgtgggctatagtcagggcaccacaatggggttcatagcatttagcacaatgccagagttggctcagaagattaaaatgtatttcgccttggcccccatcgcaaccgtgaagcacgcaaagtcccccggcactaaattcctgctcctgcctgacatgatgatcaaaggtttattcggcaaaaaggaattcctgtatcagactaggttcctgcgccagcttgttatctacctctgtggccaggttattctggatcagatatgcagtaacattatgctgctgctgggcggatttaataccaataacatgaatatgagccgcgcttcagtgtacgctgcccataccctagccgggacttcagtacaaaacattctgcactggagccaggccgtcaactctggagagctaagggcatttgattggggatctgagacgaagaatctagaaaaatgcaatcagcctacccctgtccgctatcgggtcagagacatgacagtgcctacggcaatgtggacgggcgggcaggattggctctccaatcccgaagatgttaagatgctcctctccgaggtgaccaatctgatctaccataagaacatccctgagtgggctcacgttgattttatctggggcctggacgccccccatcgaatgtacaatgagatcatccatctgatgcagcaggaagagactaacctctctcaggggagatgtgaggcagtgctttag

SEQ ID NO: 193422 - DNA, 1152 bp, Artificial Sequence
  Description of Artificial Sequence: Synthetic coding sequence
atgacccggcccctggaccggaagcagagcgagatcatccagcaccagggatatccctgcgaggaatatgaggtggctactgaagacggctatatcctgtcggtgaatagaatacccaggggtctggtccagcctaaaaagactggtagccgacccgtggtccttctgcaacacggactagtcggcggtgcttccaactggatctccaatcttcctaacaactccctcggctttattctcgcggatgcaggatttgacgtgtggatggggaactcgcgaggcaatgcgtggagtagaaaacacaaaaccctgagcatagatcaagatgagttttgggccttcagctacgatgaaatggctagattcgatctcccagctgttatcaactttatccttcaaaaaaccggacaggaaaaaatatactacgtgggctactcacaaggaaccacaatgggatttatcgcgttctcaactatgcctgagctggcccaaaagattaaaatgtattttgcattggcgcctatcgctacggtcaagcatgccaaatcccccgggacaaaattcctcctgctcccagacatgatgatcaagggtctgtttgggaagaaagagtttctgtaccagaccagatttctgcggcagttggttatatacttgtgtggacaggtgatcctggatcagatctgctcaaacatcatgcttctgctgggcggcttcaatactaataatatgaatatgagtagagcgtctgtgtacgcagcccacactctggcaggcacctccgtgcagaacatactacactggagccaggccgttaactccggagaattgcgtgcctttgattggggctctgaaactaagaacttggagaaatgtaaccagcctacccccgtgcggtatagggtacgtgatatgaccgtgcctactgctatgtggactgggggccaagactggctctccaacccggaggacgttaagatgctgttgtctgaggtaactaacttgatttatcacaagaacatccctgagtgggctcacgtggatttcatctggggcctggatgctccccacaggatgtacaatgaaatcattcacctaatgcagcaggaggagaccaacctgagccaagggaggtgcgaggccgttttatag

SEQ ID NO: 193423 - DNA, 1197 bp, Artificial Sequence
  Description of Artificial Sequence: Synthetic coding sequence
atgatgtggctgctgctgaccaccacctgcctgatctgcggcaccttgaatgccggagggtttctggatttggagaacgaggtcaatcccgaagtctggatgaacacatccgagattattatctacaacggctacccttctgaggagtatgaggtaacaactgaggatggatatatcctcctggtcaatcggattccttacggacgcacccatgcccgctccactggtccccggccagtagtctatatgcagcacgcactgtttgcggacaacgcctattggctcgaaaactatgcaaacggctcactaggcttcctcctcgccgatgccggctatgatgtttggatgggaaattcacgcggcaatacctggagccggcggcataagacactgtctgaaactgacgagaagttctgggcctttagttttgacgagatggcaaagtatgatctgccgggggtgatagacttcatcgtgaataagactggacaggagaagctttactttatcggccattctcttggtaccacgatcggatttgtggcattctcaacaatgcctgaactggcccagaggataaagatgaacttcgccttggggcctacaatctcctttaaatatcccacaggcatcttcacccggttttttctgctgccaaatagcatcattaaggccgttttcggtaccaaggggttcttcctggaggataaaaagactaaaatcgcaagcactaaaatttgcaacaacaaaatcctttggctcatctgtagcgagtttatgagtctgtgggcaggaagtaacaagaaaaatatgaatcagagcaggatggatgtctatatgtctcacgcacccactgggagttctgttcacaatatactgcacattaagcagctctaccattctgacgaattcagagcatacgattggggaaatgatgccgacaatatgaagcactataatcagagccatccaccgatttacgatttgactgcaatgaaagtccccacagcaatatgggctggaggccatgacgttctggtgactccccaggacgtggcaagaattctgccccagatcaagagcctccattactttaaacttctaccggattggaatcattttgatttcgtctgggggctggatgcccctcagaggatgtattctgagattattgccctgatgaaagcgtattcgtag

SEQ ID NO: 193424 - DNA, 1500 bp, Artificial Sequence
  Description of Artificial Sequence: Synthetic coding sequence
atggacaccagccccctgtgcttcagcatcctgctggtgctgtgcatctttatccagtccagtgcactgggacagagcctcaaacccgagccattcggaagacgcgctcaagccgtggaaaccaacaaaaccctgcatgagatgaagacgcggtttcttttgttcggtgaaacaaatcagggttgccagattaggataaatcacccagacaccttgcaggaatgtggttttaattcttctctgcccctggtgatgataattcacgggtggtcagtggacggtgtgcttgagaattggatttggcagatggtggctgcacttaagagtcagccagcccaacctgtcaacgtcgggctggtggactggatcactctggcccacgaccactataccatagccgtcagaaatacacgtcttgtcgggaaggaggtggctgcgctcctcaggtggcttgaggaatccgttcaattgagcagatcccatgtgcatctgataggttactcactgggcgcccatgtgagcgggtttgccggcagcagcatcggagggactcataaaattgggaggataaccggcctggacgctgcaggacctttatttgaaggctctgccccatctaatcggctgtccccagatgatgccaacttcgtcgatgctattcacaccttcactcgagagcacatgggactcagcgtcggcatcaagcaacccatcggtcactacgacttctatcctaatggcggcagtttccaaccaggatgtcactttctggagttatatcggcacatagcccagcatgggtttaacgcaatcacccagactattaagtgtagtcatgaaagatccgtccacttatttatagactccctcttacatgccggcacgcagagcatggcatatccctgtggggatatgaattcattctcacagggactctgcttgtcatgcaaaaagggtcgatgcaacaccttgggctatcacgtgcgacaggagcctcgttccaagagtaagcgactatttttagtaactcgggctcagtctcccttcaaagtgtaccattaccagtttaagattcaatttatcaaccagactgagactcccattcagacaacattcaccatgtccttactggggactaaggagaaaatgcagaaaatccccattactctcggaaaggggatagcctccaacaagacatatagctttctgatcaccctggatgttgacatcggagagctgataatgattaagttcaagtgggagaactccgctgtctgggccaatgtatgggacaccgtgcaaacaattataccatggagcactggacctagacactccgggctggtactgaagaccattcgcgtcaaagcgggcgaaacccagcagcgaatgactttttgtagcgagaatacagatgacctcctgctgcgccccacccaagagaaaatattcgtgaagtgtgagatcaaaagcaagacaagtaagagaaagattcgctag

SEQ ID NO: 193425 - DNA, 1500 bp, Artificial Sequence
  Description of Artificial Sequence: Synthetic coding sequence
atggacaccagccccctgtgcttcagcatcctgctggtgctgtgcatattcattcagtctagtgctctcggacagtccctcaaacctgaacccttcgggaggcgggctcaggccgtcgagactaataaaactctgcacgagatgaaaacccggtttctgctctttggcgagacgaaccagggctgccaaattcgtatcaaccatcccgacacccttcaggaatgtgggtttaattcaagccttccacttgtgatgatcattcacggctggagtgtggatggggtcctagaaaactggatctggcagatggtggccgctctcaagagtcagccagctcagcctgttaacgtggggttagttgactggatcaccttggcccatgaccattataccattgcggtgagaaacactaggttggtgggaaaggaagtggccgccctcctcagatggctagaggagtcggtgcagctgtcacgcagccatgtgcacctgataggctactctctgggagctcacgtttcagggtttgccggtagctcgattggaggaacacacaaaatcgggcgcataactggcctggatgccgctggcccactcttcgaggggagcgcaccatctaaccggctgtccccagatgatgccaattttgttgacgcgatacacacgtttacccgtgaacatatgggactgagcgtcgggattaagcagcccatcggacattacgacttctatcctaatggaggctcctttcagcccgggtgccacttcttagaactgtatagacatatcgctcagcacggtttcaacgctatcacccagactattaaatgctcccacgagcggtcagtacacttattcatagattccctactgcatgctggcacgcagtcaatggcctacccctgcggtgatatgaacagttttagtcaagggttgtgtctgagctgtaagaaaggacgttgtaacactctgggataccatgtgaggcaggagccccggtctaagtccaagcgcctgtttctggttaccagagcgcagagtccattcaaggtgtaccactatcagttcaagattcagttcatcaaccagacagagactcccatccagaccactttcaccatgagccttctgggtacaaaggaaaaaatgcagaagatccctataacgttagggaagggaattgcatctaataagacctactccttccttatcaccctggacgttgatataggcgaacttataatgatcaagttcaagtgggaaaattctgctgtttgggctaacgtctgggacacagtgcaaaccatcattccttggtctactggccccaggcacagtgggttagtgttgaaaacaatccgcgtcaaggccggcgaaacacagcagcgtatgacattttgttccgagaatacagatgacctcctcctccgccccacccaggaaaaaatctttgtgaagtgcgaaataaaaagcaagacaagcaaacgaaaaatccgctag

SEQ ID NO: 193426 - DNA, 3231 bp, Artificial Sequence
  Description of Artificial Sequence: Synthetic coding sequence
atggagcccggcagcaagagcgtgagccggagcgactggcagcccgagccccaccagcgacccatcactcccctggaacccggacccgaaaagacaccaatcgcacagcccgaatcaaagaccctccagggtagcaatacccaacagaagccagctagtaaccagcggccactgacacagcaagaaacacccgcgcagcatgacgccgagagtcaaaaagagccaagggctcaacagaaatccgcctcccaggaggaattccttgctccgcagaaacccgctcctcaacagtccccctacatccagcgcgtgctgctcactcagcaggaggccgcctctcagcaaggtccaggactgggcaaagagtctatcactcagcaggagcctgctttgcgccagcgccatgtcgcccagcccggaccaggccccggcgagcctccccccgcccagcaggaggcagagtccacccccgctgcccaagcgaaaccaggggccaagcgggagccctcagcaccaaccgagtctactagtcaggaaacccctgaacagagcgataagcagacaaccccagtccagggcgcaaagagcaaacaaggcagcctcacagagctgggatttctcaccaaacttcaggagctgagcatccaacgctctgctctcgagtggaaggcgctgagtgagtgggttactgattcggaatcggagtcagacgtcggctcctcttcagacaccgatagtcccgcaactatgggcggcatggtagctcagggggttaagctcggttttaaggggaagagcggctataaagtcatgagtggctactccggaacgagcccccacgagaaaacatccgcacggaatcacaggcactaccaagacacagctagtagattgatccataatatggatttgcggaccatgacacagtccctggtcacgttggcagaggacaatattgcgttcttcagcagtcagggcccgggagagaccgctcagagactgagcggggtctttgctggagtgagggagcaggcccttggcctggagccagctctcggacggttactgggagtcgcccatctcttcgaccttgaccccgaaacacccgccaacggctatcgcagtctcgtgcacacggcccgctgttgtttggctcacctgctgcacaagagtagatatgtggcgagtaacagacgttccattttttttcgtacatctcataatctggcggagctggaagcgtatctggccgcattaacacagctccgggctcttgtatattacgcccagcgccttctggtaactaaccgtccgggagtcctgttcttcgagggagatgagggcctgaccgctgattttctgcgcgagtacgtgaccctgcataagggttgtttttacggtcgctgcctggggttccagttcaccccagctattcgtcctttcctccaaacaatctccataggcctggtgtctttcggtgaacactacaagcgcaacgagaccggactctctgtagcagcctcgtctctttttactagtggccggttcgccattgacccagaactgcgcggggccgagtttgagcgcattacccagaatctggacgtgcacttttggaaggcattctggaatatcacggagatggaagtcctatcctccctggccaacatggccagcgcaaccgtgagagtctcacgcctcctgagtttgccacctgaagcttttgagatgccattgacggctgacccgacactgactgtcacgatctctccccctcttgcgcatactgggcccggcccagtgctcgtcaggctgatcagttacgatcttagggagggccaggacagcgaagagctcagttccctgattaagtccaatggccagaggagtcttgaactctggccacgaccacaacaggctcccaggtctagaagtttaatcgttcattttcatggtggcggattcgtagcccagactagcaggtcccacgaaccttacttgaagagctgggcccaggagttgggtgcgcccatcattagcattgactactcgctggcaccagaggcacctttccctagggccctggaggagtgttttttcgcttactgctgggcgataaagcattgtgcgttgctgggcagcaccggggaaaggatctgcctcgcaggcgatagcgcaggcggaaacctgtgttttacagtggcccttcgagcagcagcgtatggtgtccgcgtgccagatggtatcatggccgcttatccagccaccatgcttcagcctgctgcttcgcctagccggttgctgtctcttatggaccctctcctacctctatccgtcctgtccaaatgtgtgagtgcatatgccggggccaagacagaagaccacagcaattccgaccagaaggctttaggaatgatgggtctagtccgaagagacaccgcactactgctgcgtgattttcggctgggggcctcaagctggctcaattcatttctcgaactgtcaggtcgcaaatctcagaaaatgagcgaaccaatagctgagccaatgagaaggtccgtctctgaggcggctctggcccagcctcagggaccactcgggacggattctctgaaaaacctgactctgagggatctgtccctgagaggcaattccgaaactagctccgacacgccagagatgagcctaagtgccgagacgctttctccctccacgccttctgatgtaaacttccttctaccccccgaggacgcaggtgaagaggcagaggccaaaaacgaactgtcaccaatggacaggggcttgggcgtgagagcggcttttcctgaagggttccatccacggaggagcagccagggagccactcaaatgcccctttacagctcccccattgtgaaaaatcctttcatgtctccactgttggcgcctgacagcatgctgaaatccctgccaccagtgcacattgtggcgtgcgccttagatccaatgctggacgattctgtaatgttagccagaaggttgcggaacttgggccagcccgtgacactgcgcgttgtggaagatctgcctcatggatttttaacactcgctgcgttgtgccgagagacgcgccaggccgctgaattatgcgtggaaaggataaggttagtgttaaccccccccgctggagccggaccttccggagaaacaggagctgccggcgtcgatgggggatgcggcggacgacattag

SEQ ID NO: 193427 - DNA, 1356 bp, Artificial Sequence
  Description of Artificial Sequence: Synthetic coding sequence
atgctgcggttctacctgttcatcagcctgctgtgcctgagccggtcggacgcggaggagacctgcccctcattcactcgcctttctttccactcagctgttgtgggaaccggactaaatgtccgtcttatgctgtataccagaaagaacttgacatgcgcccaaacaataaatagctcagcattcggaaatcttaacgtgaccaaaaagactacctttatcgttcatggcttcaggcccaccgggagccctcccgtgtggatggacgacctagtgaagggactcttgtccgttgaggatatgaacgtcgttgtcgttgattggaaccgtggcgccaccaccctgatctacacgcacgcttccagtaaaacaagaaaagttgcaatggtgctcaaggagttcattgaccagatgctcgccgagggagcctccctggacgacatttatatgatcggggtgtccctgggagcacacatcagcggcttcgtaggggaaatgtacgacggctggctcggccggatcactggcctggatcctgccggtcctctctttaatgggaaacctcatcaggatcgccttgatcccagcgatgcccagttcgtagatgtaatccactctgacacggacgcattgggatataaggagcccctcggtaatattgatttctaccccaacgggggtctggatcagccgggatgtcccaaaaccattttaggagggtttcaatactttaaatgcgaccaccaaagaagcgtctacttatatctgtcgtccttgagagaaagctgcaccattaccgcttacccttgcgattcctatcaggactatcggaatggtaagtgcgtgagttgcggcacctcacagaaagagagttgcccgctattagggtactatgcggacaactggaaggatcaccttcgcggaaaagatcctccaatgacaaaggccttcttcgatactgcggaagaatcccccttctgcatgtaccactacttcgtggacatcatcacctggaataaaaacgttcggaggggtgacataacaatcaagttacgggacaaggcaggcaacactactgagagcaagattaatcacgagcctacaacctttcaaaaatatcaccaggtgtctctgctggcacggttcaaccaggaccttgataaggtggcagcaatttcgctcatgttttcgacaggatccctcatcggccctcgatacaaactccgcatcctgaggatgaagttgcggtctctggcccaccccgagcggcctcaactgtgtcgatacgatctggtactgatggaaaacgttgaaaccgtctttcagccaatcctgtgtcctgaacttcagctgtag

SEQ ID NO: 193428 - DNA, 1446 bp, Artificial Sequence
  Description of Artificial Sequence: Synthetic coding sequence
atgctgctgaagtgcctgcacaacaacctgtgccagaagtacagcgcacacgcatttcagttttcaccacgcaacgtgctgtggctcctcgtggtgtgccttcgttcagataacaagcgcccatgtttagaattttcacagcttagtgtgaaagactcttttagagaccttttcatcccgcgtatcgagacaatcttgatgatgtatacccggaacaatcttaattgcgccgagcctttgttcgagcagaacaattctctgaacgtcaacttcaatactcaaaagaagaccgtttggctgattcatggttatcgaccagtggggagcattcctctatggcttcaaaatttcgtccggatcctattgaatgaggaagacatgaatgtgattgtggtggactggtcacgaggcgctactacctttatctacaatagagcagtgaagaacacacggaaggtggcagtgtccctaagcgtgcacataaagaatctgctcaagcatggagcctctctagataactttcactttatcggggtctccctcggggcccacatttcagggttcgtgggcaaaatctttcacgggcagctcggcagaattactgggctggatccggcaggaccgagattcagtaggaagcctccctacagtcgacttgattacacagatgctaaatttgtcgacgtcatacactccgactctaatggactcggcatacaagaacccctgggccatatagacttttatcctaatggcggcaataagcagccaggatgccccaagtctatcttctctggcattcagttcatcaagtgtaaccatcagagggctgtgcatctttttatggcctccctggaaaccaattgcaacttcatctcctttccatgcaggtcttataaagattacaagaccagcctgtgcgtggattgtgactgctttaaagaaaagtcttgtccacgcctgggctatcaggccaaactgttcaaaggcgttctgaaagaacgcatggagggaaggcctcttaggaccactgtgtttcttgacaccagtggaacgtaccctttttgcacatactatttcgtcttgagcattatcgtccccgacaagactatgatggatggcagtttttcattcaagcttctaaatcagctaggaatgattgaagaaccgaggctgtacgagaaaaacaagcccttctacaagctgcaggaagttaagatcctggctcagttctataacgacttcgtaaatattagtagcattggtctgacttacttccagagctcaaaccttcagtgctcaacatgcacctataaaatccagcggctcatgctgaaaagcctgacttatccagagaggcccccactgtgccggtacaacatcgtacttaaggatcgggaagaagtcttcctcaaccccaacacttgtacccctaagaatacctag

SEQ ID NO: 193429 - DNA, 471 bp, Artificial Sequence
  Description of Artificial Sequence: Synthetic coding sequence
atgaacgtgatcgtggtggactggagccggggcgccaccaccttcatttataacagagctgtcaaaaacacaagaaaagtcgcggtgagcctgagcgtgcatattaagaatttattaaaacatggagcctcactagacaactttcattttataggtgtctctctgggagcgcatatatccggctttgtgggaaagatattccacgggcaactcggtagaattacaggcctggacccggccgggcctagattttctaggaagccaccttatagtcggcttgattatacagatgctaagttcgtggatgttatccacagcgacagtaacggaatccagtttattaagtgtaatcaccagcgagccgtgcatctgttcatggcgtcacttgagacgaactgcaatttcatctcctttccttgtagatcttataaggattataagactagtctatgcgtcgactgcgactgctag

SEQ ID NO: 193430 - DNA, 426 bp, Artificial Sequence
  Description of Artificial Sequence: Synthetic coding sequence
tgatacaaccgggccgtgaagaacacccggaaggtggccgtgagccttagcgttcacattaaaaacctgttgaagcacggcgccagcctcgacaatttccacttcattggcgtctctttgggcgcacacatatctggcttcgtaggcaagatctttcacggacagctaggacggatcacggggttggaccccgcaggaccaagattctctcgcaaaccaccatactcaagactggactacaccgacgccaagtttgtggacgtgattcatagtgattcaaacggaatccagtttatcaagtgtaaccatcagcgcgcagtccatctgttcatggccagtctcgaaacaaactgtaacttcatttcctttccctgtaggtcgtacaaggactacaaaacgtccctctgtgtggactgcgattgctag

SEQ ID NO: 193431 - DNA, 1383 bp, Artificial Sequence
  Description of Artificial Sequence: Synthetic coding sequence
atgcgggtgtacatcttcctgtgcctgatgtgctgggtgcggagcgacaacaagaggccatgccttgagttcagtcagctgtccgtgaaagactcattccgcgacctgttcatcccccggattgaaaccatcctcatgatgtatacacgcaataacctgaactgtgctgaacccctgttcgagcagaataatagccttaatgttaatttcaacacccagaaaaaaaccgtgtggcttatccacggctatagacctgtgggatccataccattatggctccaaaatttcgtcaggatcctgctgaatgaagaggatatgaatgtgattgtggttgattggtcccgaggggcaaccacatttatctataatagagcagtgaagaacactcgcaaggtggctgtgtcgctgtccgtgcacattaagaatcttcttaaacatggagcctccctggataactttcacttcattggcgtctccctgggagcacatatcagcggcttcgttggtaagatctttcatggacaactgggtaggattaccgggttagatcctgctgggcctcgattctctaggaaaccaccttactctcgcctggactatactgacgcaaagtttgtcgatgttatccattcagattcaaatggcctgggcatccaggagccgctcggacacatcgacttttaccccaacgggggcaataaacagcctggctgtccaaagtctattttttctggaattcagtttatcaagtgcaatcaccagcgggctgtgcaccttttcatggcgtcacttgaaactaactgcaatttcatcagcttcccatgtaggagttataaagactataagacatccttatgtgttgactgtgattgctttaaggagaaatcctgtcctcgcttaggctaccaggctaagttgttcaaaggcgttttgaaagagagaatggaaggaaggccactgaggaccaccgtgttcttagataccagtggcacctatccattctgtacctactacttcgtcctcagtataattgtccccgacaagactatgatggatggaagcttttccttcaaactgctaaaccagctcgggatgatcgaggaacctcgcttatatgagaagaataaacctttttataagctacaagaagtgaagatacttgcccaattctacaatgactttgtgaatattagcagtataggactgacgtactttcagtcatcaaacctgcagtgttcaacctgtacatataagatacaacgcctgatgttgaaatccctcacctaccctgagagaccccccttgtgtaggtacaatattgtgttaaaggaccgagaagaggtgtttttaaaccccaatacatgcaccccaaaaaacacgtag

SEQ ID NO: 193432 - DNA, 2673 bp, Artificial Sequence
  Description of Artificial Sequence: Synthetic coding sequence
atgaactacgtgggccagctggccggccaggtgttcgtgaccgtgaaggaactgtataagggcctcaacccagccaccctgtcaggttgcatcgacatcatagtgattagacagccaaacggaaacctgcaatgctctccttttcacgtacgattcggaaagatgggtgtgttaaggtcgagagagaaagtagtggacattgagatcaacggagaatccgtggatttgcatatgaagttgggcgacaacggcgaggctttctttgtgcaggagaccgacaatgatcaggaagtgattccaatgcatcttgccacttccccaattctttctgagggggcttcgagaatggagtgtcagctgaagcgagggtcagtcgaccggatgcgtggactggacccttccacaccggcgcaggtgatcgctcccagcgaaaccccctctagctctagcgtggtgaagaaacggcggaagaggcgccgcaaatcacagctggattcactgaagcgcgacgataacatgaatacatcagaagacgaggacatgttcccaattgagatgagctcggatgaggctatggagctgctcgaatcatcacgcaccctgcccaacgatatccctccttttcaggatgatatcccagaggagaacctgtctctggcggtcatctatccccagtcagcctcttatcccaatagtgatagagagtggtcacccactccatcccccagcggctcccggccttcaacaccgaagagcgactctgagctggtgtcaaaatccaccgagcgcacaggccagaaaaatcccgaaatgctgtggctttggggcgagcttccccaggctgccaagagctcatcaccccataagatgaaggaaagcagcccattgtccagccgcaagatctgcgacaaatcacattttcaagcaatccattccgaaagctccgatacttttagtgatcaaagccccaccctggtaggcggcgcgctgctggaccagaacaaacctcaaactgagatgcagtttgtgaacgaggaggacctggagactctgggcgcagctgccccgctgttgccgatgattgaggagcttaagccgccttcagccagcgtggtgcaaactgcaaacaaaacagacagcccttctagaaaaagagacaagcggagcaggcacttgggcgcagacggggtatacctagacgatcttaccgacatggaccccgaagtggctgctctgtattttccgaaaaatggtgacccatctggactggctaagcacgcaagtgacaatggggccagatccgccaaccagagtccgcagtctgttggctccagcggagtcgattccggagttgagtcaacatctgacggtctgcgcgatcttcccagtattgcgattagcctctgcgggggcctgtctgatcaccgcgagatcactaaagatgcctttttggagcaggctgtatcttaccagcagttcgtagataacccagccatcatcgatgacccaaaccttgtagtaaagataggatccaagtactacaactggaccacagcagctccccttctcttggctatgcaggcattccaaaaacctctgccaaaagcaactgtcgagagcattatgcgggacaagatgcctaaaaaagggggtaggtggtggttttcttggaggggtcgaaacacaactattaaagaggagagcaaaccggagcagtgcctggccggtaaggcccattccacaggtgagcagcctccccagctctcattagccaccagagttaaacacgaaagcagttctagcgacgaggagcgagcagccgcgaagccatcaaacgcgggccacctccctttgctgcctaacgtcagctataagaagaccctccggctcacttccgagcagcttaaatcattgaagttgaaaaatggtccaaacgacgtggtctttagcgttaccacacagtaccagggaacctgcagatgtgagggcaccatctacctctggaattgggatgacaaagtgattattagcgacatcgacgggaccattactaggtccgacacgcttggacatatccttccaactttgggaaaggactggacacatcagggaattgctaagctataccataaagtctcccagaacgggtacaaattcctgtactgtagcgccagagctattgggatggccgatatgacccgggggtacctgcactgggttaatgagcggggaacagttctgccgcagggaccactgcttctgtcgccctccagcttgttctctgcactacacagagaagtgatagaaaaaaagcccgagaagttcaaggtgcaatgtcttactgatattaaaaacctcttttttccgaatacagaacccttttatgcggccttcgggaaccgtcctgccgatgtttactcttacaagcaagtcggggtgtctttaaaccggattttcactgtcaaccctaagggtgagctggtccaggagcacgctaagaccaatatcagttcctacgtccggctgtgcgaagtagtagaccacgtatttccactcctgaagaggagccattcctcggatttcccatgcagcgatacattctcgaatttcactttctggagggagcccctccccccgtttgagaaccaggatatacactcagccagcgcatag

SEQ ID NO: 193433 - DNA, 1863 bp, Artificial Sequence
  Description of Artificial Sequence: Synthetic coding sequence
atgctgtggctgtggggcgagctgccccaggccgccaagagcagcagcccacacaaaatgaaggagagctccccccttagctcccgaaagatctgcgataaatcacatttccaagccatccactcggaatcttccgacaccttttccgaccagagcccaactctggtcggcggtgccctgctcgaccagaacaaaccccaaactgagatgcagtttgtcaacgaagaggatctggaaaccctgggcgctgcagctccactgctgccaatgatcgaggagcttaaaccgccatcggcttcagtggtgcagacagccaacaagacagatagcccatctaggaagcgagacaaacggagcagacacctgggcgcagacggcgtctacctggacgacctaactgacatggatcctgaggtcgcagctctttacttccctaagaatggtgatccctccggcctagccaaacacgcgtcagacaacggcgcccgatccgccaatcagtctccccagtctgttggttcttcaggagtggattctggcgtggaatctacatccgacggcctcagggatttgccaagtattgccataagcttatgcggtggtctgagtgatcacagagagattacaaaagacgcttttctggagcaggccgtgagctatcagcagttcgtcgacaaccccgctatcattgatgatccaaatctggttgtaaagatcggatccaagtactacaattggacaaccgctgcccccctgctcctggctatgcaagctttccagaagcctctgcccaaggcaacagtggaatccatcatgagagacaaaatgcccaaaaagggtggccggtggtggtttagctggcgggggcgcaacacaaccattaaggaagaaagcaaacctgaacaatgtttggccggcaaagctcattccacaggcgaacagcctccacagttgtccctggctacacgcgtaaaacacgagtctagcagctcagatgaagagcgggctgccgcgaaaccctctaacgctgggcatctgcctctgctacctaacgtttcatataagaaaaccctgcgcctgacgtctgagcaactcaaatctttaaagcttaagaacgggccgaacgacgtcgttttttccgtgacaactcagtatcaggggacatgccgatgtgagggcactatttacctctggaattgggatgataaggtgatcatctcagacatcgatggcaccatcacaaggtccgatacgctggggcacattctgccgacgttgggcaaggattggacccatcagggaattgcaaaactgtatcataaagtttcacagaacggatacaagtttctctactgcagcgctcgcgccataggaatggccgacatgacaaggggatacctgcactgggtgaacgaaaggggtacagtgctcccacagggccccctgttgctgtctcctagctccctgttttcagcgctgcaccgtgaagtgatagagaaaaaaccagaaaagtttaaggttcagtgcttgaccgatattaagaacctgtttttccccaatactgagcctttttacgctgccttcgggaaccggccagccgatgtgtactcctataagcaggtgggggtgtctctgaaccgcatttttaccgttaacccaaagggcgagttggtgcaggaacatgcaaaaactaatatatcctcatatgttaggttatgcgaggtcgtggatcacgtgtttcctttattgaagcgctcacactcttctgacttcccatgctcggacaccttctctaacttcactttctggagagaaccgcttccacccttcgagaaccaggatatccatagcgctagtgcttag

SEQ ID NO: 193434 - DNA, 2799 bp, Artificial Sequence
  Description of Artificial Sequence: Synthetic coding sequence
atgagccgggtgcagaccatgaactacgtgggccagctggccggccaggtatttgttactgttaaggagttatacaagggcctgaaccccgccacgctctccgggtgtatcgatattatcgttattcggcagcccaatggaaacctgcagtgctcgccctttcacgtgcggttcgggaaaatgggtgtactgcggagcagagaaaaagtggttgacattgaaatcaacggagagtcagtagacctgcacatgaagctgggcgacaatggagaggccttcttcgtgcaggaaactgataacgaccaggaggtgatccccatgcatctggcaacttctccaattctgtctgagggtgccagtcgcatggaatgtcaattaaagcggggaagcgtggaccggatgcgcggcttagatccctccacccccgcccaagtgatcgccccttcagagactccgtcctcctcaagtgtggttaaaaagaggcgtaaacggaggagaaaatctcaacttgattctctgaagcgggatgacaatatgaatacctcagaagatgaagacatgttccccattgagatgagtagcgatgaggcgatggaattgctggaatctagccgtacccttccaaatgatataccacccttccaggacgacatccccgaggagaacctaagcttagccgtgatatatccacagagcgcctcttatcctaactcagaccgcgagtggagtcccaccccctcttccctcgttgattgcaaaagaacagccccgcacctggcagtagcggccgaaggggggttgagctcctcttgtcccccacagagttcactattccacccctccgaatctcccagtggatcccgccccagcacacctaaatctgacagtgaacttgtctcaaaaagcacagagcgaacaggtcagaagaatcccgagatgctctggctttggggagagcttccacaggccgctaagtcgagctcgccacataagatgaaagagagttcccccctgagctcccgcaaaatctgtgacaaatcccattttcaggcaattcattcagagtcctcagacacattcagtgatcagagccctaccctggtcggaggcgcgttattggatcagaacaaaccccagaccgaaatgcaattcgtgaatgaggaggatcttgagaccctcggagccgctgccccattgctacctatgattgaggaactcaaacccccatccgctagtgtagtgcagacagccaacaaaacggacagtcctagtaggaaacgggacaaacgctcacgccatcttggggcagatggggtatacctggacgacctcaccgatatggatccggaggtcgctgccctttatttccccaagaacggtgatccctctgggctcgccaagcatgcttccgacaatggcgcaagaagcgcaaaccagtcgcctcagagtgtgggtagctccggtgtagattctggagttgagtccacatccgatggcctccgcgatctaccgtccattgcgatctccctttgtgggggtctctcggatcacagggaaatcacaaaggacgccttcttagagcaggcggtgtcctatcagcagttcgtcgacaatcctgcgatcattgacgatccgaaccttgtggtcaaaattggatccaagtactataactggaccacagcggctccactactgcttgctatgcaggcctttcaaaaaccactgcccaaggctaccgttgagtctattatgcgcgacaagatgcctaagaaaggcggcagatggtggttctcatggagaggtaggaacaccactattaaggaggaatccaaaccagagcaatgtctagccggcaaagctcattcaaccggggagcaacccccccagctttccttggccactagagtcaagcacgagtcctctagttccgacgaggagcgggcagctgcgaagcctagtaacgccggccacctgcccctgttgcccaacgtcagctacaagaagaccctccggctcacttctgaacaacttaaatctttgaagttaaaaaatgggcccaatgatgtagtattctcggttaccacacagtatcagggcacctgccgttgcgagggaacgatttacctgtggaactgggacgacaaagtgatcatcagtgatattgacggtacaatcacccggtccgatacactgggacacatcttgcctaccctgggaaaggattggacccatcagggcattgcaaagctgtaccataaagttagccaaaacggctacaagtttctctactgctctgcaagagctatcggcatggcggacatgacccggggctatctacactgggttaacgagagaggaaccgttctgcctcaaggtcccttgctgctcagccccagctctttattcagcgcattgcaccgcgaagtgattgaaaagaagcctgaaaagttcaaggtgcagtgcctgacagacattaagaacctgttctttccaaacactgagccattctacgccgcctttggtaaccggcccgcggatgtgtacagctacaagcaggtgggcgttagcctgaatcgtattttcactgtgaaccctaagggtgaactggtgcaagaacatgccaagaccaacattagctcatacgtgaggttatgcgaggtagtggatcacgtcttcccccttctgaagagatcccattcatctgattttccctgcagcgatacgttctccaattttacattctggagagaacctctgccaccctttgaaaaccaagatatacattccgcctccgcttag

SEQ ID NO: 193435 - DNA, 1176 bp, Artificial Sequence
  Description of Artificial Sequence: Synthetic coding sequence
atgcaggccttccagaagcccctgcccaagagcagctgcctgagctatctgcacgttatccttgacgccatcaggttttgcttctccaagattttcaatgcgcagatcgctaccgtggagtctatcatgagagataagatgcctaagaagggcggaagatggtggttttcctggagagggagaaataccaccataaaggaggaatcaaaacccgagcagtgcctggcggggaaggcgcactccacaggagaacagcctcctcaacttagtttggccaccagagtcaaacatgagtccagctcaagtgatgaagaacgtgcggcagctaagccatcaaacgccgggcacctcccattgttacctaacgtgtcttataaaaaaacactgcgcttaacttcagaacagctgaagagcctgaagctgaagaacggtcctaacgatgtggtgtttagcgtgacaacacagtaccagggcacgtgcaggtgcgaaggcactatctatttatggaattgggatgacaaagtgatcataagcgatattgacggaaccattactcggtcagatacactgggacatatccttccgaccctgggtaaggactggacgcatcaaggaatcgcaaagttgtatcacaaggtgtctcagaacggctacaagttcctgtattgttcagcccgcgctattggaatggccgacatgacacgcggatacctgcattgggtgaacgaacgtggcaccgttttacctcagggacctctactattgagcccctcttccctcttttcagcactacatagagaagtgatcgagaaaaagcccgaaaaatttaaggttcagtgcttgactgatattaagaacctgttttttcctaatacagagcctttctatgcagcgttcgggaacaggccggctgacgtgtactcatataaacaagtcggagtgagcctaaatcgcattttcacagtgaaccccaaaggcgaactggtccaggagcacgccaaaacgaatatcagttcttacgtgcgcctttgcgaagtcgtggaccatgttttccctctgttgaagcgatcccattcgtcggactttccctgcagcgacacttttagcaattttacattttggcgggagcccctacccccgtttgaaaaccaggacatacattccgctagcgcttag

SEQ ID NO: 193436 - DNA, 87 bp, Artificial Sequence
  Description of Artificial Sequence: Synthetic coding sequence
atgaactacgtgggccagctggccggccaggtgttcgtgaccgtgaaagaactgtacaagggcctcaacccggcaacccttagctag

SEQ ID NO: 193437 - DNA, 2691 bp, Artificial Sequence
  Description of Artificial Sequence: Synthetic coding sequence
atgagccgggtgcagaccatgaactacgtgggccagctggccggccaagtgttcgttacggtgaaggagctctataaagggctgaatccagctacactttccggctgcatcgacatcatagttatccgccaaccaaacggcaatttacaatgttcgccgtttcacgtcagatttgggaagatgggtgtgttgagatccagggagaaggtcgtggacattgagatcaatggggagagcgtggaccttcacatgaaactgggggataacggggaagccttctttgtgcaggagactgataatgatcaagaagtcattcctatgcatctcgccacctcccccatcctttccgagggcgcctcaagaatggagtgccagcttaagcggggaagcgtggaccgcatgcgaggtctggatcctagcactcccgcacaggttatcgccccatcagagacccccagctcaagtagtgtggtgaaaaaacggagaaaacgcagacggaagtctcaattagactcccttaagcgcgatgataatatgaatacaagcgaagacgaggacatgttccctattgagatgtcttcagacgaagccatggagctccttgagagctcccggacactgccgaatgacattcctccctttcaagacgacattccggaggaaaacttatccttagctgtaatttatccccagtcagcatcctatcctaacagcgatcgtgaatggagcccaactcccagtccctcaggaagtcggcctagcacccccaaaagcgactccgaactcgtttcaaaatccaccgaacgcacaggacaaaaaaaccccgaaatgctgtggctatggggagaactaccacaggcggccaagagcagttcacctcacaaaatgaaggaatcatctcccctcagttcccgaaagatatgtgataagtcccacttccaggctattcactccgaatcatccgatacctttagtgaccagtccccaactttagttggaggcgccctgctggatcagaacaaaccgcagacagagatgcagttcgtgaatgaggaggatctggaaacactgggagcagctgctcccctgttgccaatgatcgaggagttaaaaccccctagcgcctccgttgtacagacagccaataaaaccgacagccccagtcgaaaacgcgacaaaagatctaggcacctgggcgcggatggcgtctatctagatgatctcaccgacatggacccggaggtcgcagcgctgtactttccgaaaaacggggatccttctggacttgccaaacacgcctcggataacggcgctaggtctgccaatcaaagcccccagtccgtcgggtcaagcggagtggatagtggcgtagagagtacttctgacggtctgcgggaccttccctccatcgcgatttcgttatgtgggggactttccgatcatagagaaattaccaaagatgcatttctcgagcaggccgtttcatatcagcaatttgtggacaaccccgccatcatcgacgatcccaatcttgtggtgaaaatcggctctaagtactataattggaccacagctgccccgctgttgcttgccatgcaagcctttcagaaaccactgccaaaggcaacggtggaatctatcatgcgggataagatgcctaagaaaggtggacgctggtggttttcttggagaggacgcaatacaaccattaaggaggagtcaaagccggagcagtgtctggcaggaaaggcacacagcactggcgagcagcccccccagctgagcctggcgacacgtgtgaaacacgagtcctcctcgagtgacgaagaaagggccgccgcgaagccatctaacgcagggcatctgccactgctgcccaatgtctcttacaaaaagaccctcaggctgacgtccgaacagctcaaatcacttaagctgaaaaacgggccaaatgacgtcgtattttccgtcactacccagtaccaggggacctgccgctgtgaagggacaatctacctatggaattgggacgataaagttatcatatcagacatcgatggcacaatcacacgcagtgatactctgggccatatactgcccacattagggaaagattggacccatcaaggcatcgcaaaactgtaccacaaggtgtcccaaaatggttacaaatttctgtactgttctgcgagagccattggcatggccgatatgacgcgcggatatttgcactgggttaacgaaagggggacagttctgcctcaggggccactgctgctcagtccatcaagcttgtttagcgcactgcaccgagaggtgatcgaaaagaaacccgaaaagtttaaggtgcagtgccttaccgatattaagaacctcttcttcccaaacacagagccattttatgcggcctttggtaaccgcccagctgacgtttactcgtacaagcaggtgggggtctctttgaaccggatctttaccgtcaatccgaaaggcgaacttgtgcaagagcacgccaaaacaaatataagctcttacgtgagattgtgcgaggtagttgaccacgtctttccgttattaaagcgatctcacagctcagactttccctgctccgataccttctccaattttactttctggagggagccattacccccattcgaaaatcaggacatccatagcgcaagcgcttag

SEQ ID NO: 193438 - DNA, 291 bp, Artificial Sequence
  Description of Artificial Sequence: Synthetic coding sequence
atgaactacgtgggccagctggccggccaggtgttcgtgaccgtgaaagagctctataaaggcctgaaccccgccactctttccggctgcattgacattatcgttattagacagcccaacgggaatctgcaatgttcacccttccatgtacggttcggcaagatgggtgtgctcagaagccgcgagaaggtggtagatatcgagatcaacggggaatccgtcgacctgcatatgaagctgggggacaacggcgaagcctttttcgtacaggaaacggacaatgaccagtag

SEQ ID NO: 193439 - DNA, 2928 bp, Artificial Sequence
  Description of Artificial Sequence: Synthetic coding sequence
atgggcgagcaggacggcatccggagcagcagctgggagaccagccaaggcaaaagttcacccgacagcgcctggtcttggatccctataatgagggatcccggatggatcagaaacgtgtggtcgtcaaacattaacgtccagacaatgaactacgtgggacagttagccggtcaagtctttgtcacagtgaaggaactttacaagggactgaatcccgctacgcttagcggatgtattgacatcatagtcattcgacaaccaaacgggaatcttcaatgcagccccttccacgtgagattcggtaaaatgggggtcctgcggtcgcgcgagaaagtcgtagacatcgagattaacggcgagtctgtggaccttcacatgaagctcggcgataatggagaggcctttttcgtccaggaaactgacaacgaccaggaggtcatccctatgcacctcgcaacaagtcccatattaagtgagggagcatcaagaatggagtgccagctcaagcggggatcagtcgatcgtatgagagggctggacccctctactccagctcaggtcattgcaccatctgagacacctagcagttcaagtgtggtcaagaagcggcgaaaaaggagaaggaaatcccagcttgactccttgaagagggatgacaatatgaatacctcagaagatgaggacatgttccctatcgagatgtcatctgacgaagcaatggaactcctggaatcgtccagaacacttcccaatgacatccccccattccaggacgatatacctgaagagaacctgagcctggctgttatctacccacagagcgcctcctatccaaactccgaccgggagtggagccccactccgagctctctcgtcgactgtaaacgcacagcacctcacttggctgttgctgccgagggagggctgtcttcctcctgccctccccaaagctcactgtttcaccccagcgaatccccttctggcagccgtcctagtaccccaaagtcggacagcgagctggtgtcaaaaagcactgagaggactggccaaaagaacccagaaatgctgtggctgtggggggagctgcctcaagctgcaaaatctagcagcccccataagatgaaagaatcaagccccctctcctcgcgcaagatctgcgataagagtcactttcaggctatccactcagagtcatctgacacgttttctgatcagtcccctacccttgtagggggagccctgctggaccagaacaagccacagactgagatgcaattcgtgaatgaggaagatcttgagaccctcggagccgctgcccctctcttaccaatgatagaggaacttaagccccctagcgcgtccgtggtgcagactgccaacaagaccgactccccaagccggaagcgagacaagaggagcaggcatctgggagcagatggagtgtatttggatgacctaacggacatggaccctgaagtagcagccttgtattttcctaaaaatggtgatccaagtggcctcgccaaacacgcatctgacaacggggcccggtctgctaaccaaagtcctcaaagtgtggggtctagcggagtcgattccggtgtggaaagtacttcagacggtttacgcgacttaccatccatagcgatctccctgtgcggaggtcttagtgaccacagggaaattactaaagatgcctttctggaacaggccgtcagctaccaacaatttgtggacaatcctgccattatcgacgatcccaacctcgtggttaaaatcggctccaagtattacaattggaccactgccgccccactcctcctggctatgcaggcctttcagaagcccctgccaaaagcaactgtggagtccatcatgcgtgataagatgcctaagaaggggggcaggtggtggttctcctggagaggccgcaacactacaattaaggaggagtctaaacccgagcaatgcctggccggaaaagcacactccacaggggagcagccaccccagctttccttagccacccgcgtgaagcatgagagttcctcttcagacgaggagcgcgccgcagccaagcccagtaatgcagggcatctgccgttgctgcccaacgtatcctataaaaagacactgcggctgaccagcgagcagctgaagagcctcaagctgaagaatggccccaatgatgttgtctttagcgtgacgactcaatatcagggtacttgcaggtgcgaggggacgatctatttatggaattgggatgataaggtcatcatatccgacattgatggcaccatcactcgctcagacactctcggccacattttgccaacacttggtaaagattggacccaccaaggtatcgctaaactgtaccacaaggtgagtcagaatggctacaagtttctttactgttctgcgcgagctattggcatggccgacatgacccgaggatacctgcattgggtgaatgagcgcgggaccgtcctcccccaggggcctctgcttctgagcccgagtagcctgttctcggcccttcatagagaagtgattgagaaaaagcccgagaaatttaaagtccaatgcctcaccgacattaagaatctttttttccccaacaccgagccattttacgctgcttttggcaaccgacctgctgatgtgtacagctacaaacaggtgggagtgagcctaaaccgcatcttcacagttaatcccaagggcgagcttgttcaggaacatgccaaaactaatatttcttcctacgtgaggttatgtgaggtggtcgaccatgtctttcctcttctaaagcgtagccactcctctgattttccatgcagtgacacctttagtaactttaccttttggagagaacctctcccaccttttgagaatcaggacatccactctgcatccgcttag

SEQ ID NO: 193440 - DNA, 1380 bp, Artificial Sequence
  Description of Artificial Sequence: Synthetic coding sequence
atgagccgggtgcagaccatgaactacgtgggccagctggccggccaggtcttcgtcaccgtgaaagaattgtataagggccttaatccggcgacactgtctggctgtatcgatattatcgtaattcgtcagcccaatgggaacttgcagtgctcccccttccatgtgaggttcggcaaaatgggagtgctcaggtccagagagaaggtggttgatatagaaatcaatggggaatcagtggacttgcacatgaaactgggggacaatggcgaggctttttttgtccaggaaaccgacaacgatcaggaagtcattccgatgcacttggcaacctctcctatcctcagtgaaggggccagccgaatggagtgtcagctgaaacggggcagtgtagacagaatgagaggattggacccaagcacgccggcgcaagtcatcgcaccttctgagacgccctccagctctagtgtggtcaaaaagaggaggaagcgcagaagaaagagccaactggactccttaaagcgcgacgacaacatgaacacatcagaagacgaagacatgttcccaatcgaaatgtcaagcgatgaggctatggaactgctggagagtagcaggaccctgcccaatgacataccgccatttcaagatgacattcccgaggaaaatcttagcctggcggtgatttacccacaaagtgcaagctatccaaatagcgatagggagtggagcccaacacctagcagtctcgtggattgcaagagaactgctcctcacctggcagtagcggctgagggcggactttcctcgagctgtcctcctcagtcaagcctgtttcacccttcagagtctccctctgggtcccgaccttcgaccccaaaatcagacagcgagctggtttctaagtccacagagcgtacgggacagaagaaccccgaaatgttatggctatggggcgaacttcctcaggcagctaaaagttccagtccacacaaaatgaaagagagctccccccttagcagccgcaaaatttgcgacaagagtcacttccaagccatccactctgagtcctctgacacctttagcgatcagtctcctaccttagtaggcggagccttgttggatcagaataagccacagaccgagatgcagttcgtaaatgaagaagatctcgagacgctgggtgctgcagcacctctgctgcccatgattgaagagctaaaaccccccagcgccagcgtggtgcagaccgctaataaaactgattcacccagtaggaaacgagataagaggtctaggcacctcggtgccgatggagtgtatctagatgatctaactgacatggaccctgaggttgcagcattatatttccccaaaaagtag

SEQ ID NO: 193441 - DNA, 2691 bp, Artificial Sequence
  Description of Artificial Sequence: Synthetic coding sequence
atgaactacgtgggccagctggccggccaggtgatcgtgaccgtgaaagagctgtacaaaggaattaatcaggctactctgtccggatgtatcgacgtcattgtggtgcaacagcaggacggctcctatcaatgttctccttttcatgtgagattcggaaagctgggtgttctcaggtctaaagaaaaggtcattgacatcgagattaacggaagcgctgtcgatctccacatgaagctaggcgataacggagaagccttctttgttgaggagacagaagaggagtacgagaagttgcctgcctaccttgccacttctcccatccccaccgaggaccagttctttaaagacattgacacaccgttggtcaaatctggtggcgacgagaccccttctcagtcaagcgacatttcccatgtcttggagactgagacaatcttcacccctagttccgtgaaaaaaaagaaaagacgtagaaagaagtacaaacaggacagcaagaaagaagagcaggcagcctcggcagccgccgaggacacctgcgatgtgggcgtttcgtcggatgatgataagggcgcacaggcggctaggggctcttccaatgccagcctgaaggaggaagagtgtaaggagccattactctttcattcaggggatcactatcccctgtccgatggggattggtctcccctggaaacaacttacccccagaccgcatgccccaagtctgacagtgagctggaggttaagccagccgagtccctgctccggagcgaatcccacatggaatggacatggggaggctttcctgaaagtacgaaggtcagcaaaagagaacgcagtgatcaccatccacgtacggctacaataactccttctgaaaacacccacttcagggtgattccctctgaagacaatctcatctctgaggtggagaaggatgccagcatggaggatacggtgtgcactattgtcaagccaaaaccacgggccctgggtacgcagatgagcgatccgacctccgtcgctgagctccttgagcccccgctcgagtctacgcagatctcctccatgctggatgccgaccacctccctaacgccgccttagccgaagcgccaagcgagtctaaaccggcagccaaagtggactcaccctccaaaaagaaaggggtgcataaacggagccagcatcaggggcccgatgatatatacctagacgatctcaaagggctagagcctgaagtggcagccctctattttcccaagagtgaaagcgagcctggctcccgccagtggcccgaatctgacactctctcgggctcccagagccctcagtcagtgggctctgccgctgctgatagcggaactgagtgtctttccgattcagctatggacctccccgacgtcacattgtcactctgtggcggcttgagtgagaacggagaaataagcaaagagaaattcatggaacacatcattacctaccatgagtttgctgaaaatccagggttgattgataatcccaacctggttattagaatatataaccgttactataattgggccttagctgcgcctatgattttgagtctgcaagtgtttcagaagtctcttcccaaggcaaccgtggaaagctgggtcaaggacaaaatgccaaagaaatcaggtaggtggtggttttggcgcaagcgcgaatccatgaccaaacagcttccggagtccaaggaaggcaaatcggaagcaccccccgcctctgacctcccatcctccagcaaggagcctgcaggggcccgaccagcagaaaatgactcaagctcggatgaggggtcccaggagctggaagagtctattacggtggacccaatacctaccgagcccctatcccacgggagcacaacatcatacaagaaaagcctgcggctgtcttctgaccagattgcaaagctcaagctgcatgacggccccaatgacgtcgtgttttccattacaactcagtaccagggcacttgccggtgtgccggcacaatatatctctggaattggaacgataagattattatttccgacatagacggcacaattacgaaaagtgacgccctaggacagatccttccacaactcggaaaagactggacacaccagggcatagcaaagctgtaccactccatcaatgaaaatgggtacaaatttctgtactgctcggctagggccatcggcatggccgacatgacaagaggctacctacactgggtaaacgataaaggcaccattcttccaagaggaccattgatgttgtctccttcaagtctgtttagcgcattccaccgggaggttattgaaaaaaagccagagaagtttaaaatcgagtgcctcaacgatatcaagaacctgtttgcccctagcaaacaacccttctacgctgcctttggaaaccggccaaacgacgtgtacgcttatactcaggtaggggtccctgactgcaggatcttcacagtcaacccaaaaggagaactgattcaggaacgcacaaagggtaataagtcatcataccaccgactgtcagaactggttgagcacgtgttccctctgctgtcaaaagagcagaattccgccttcccatgccctgagttctcctccttttgttactggagagacccaattccggaggtcgacttggacgaccttagctag

SEQ ID NO: 193442 - DNA, 702 bp, Artificial Sequence
  Description of Artificial Sequence: Synthetic coding sequence
atgaactacgtgggccagctggccggccaggtgatcgtgaccgtgaaagaattgtataagggtatcaatcaggcaaccttgagcggctgtattgacgtcattgtcgtccagcagcaggatggctcataccagtgcagtccgtttcatgttcgattcggaaagttgggggttctaagaagcaaagaaaaggtgatagacattgaaattaacggtagcgccgtggacttacacatgaagctcggcgacaacggagaggcgtttttcgtggaggagacagaggaggagtacgagaaactaccagcctaccttgcgaccagccccattccaaccgaagaccagttcttcaaggacatcgatactcccctggtcaaaagtggcggggatgagacgccaagccagagcagcgatatctcccatgtgctggagacggagactatctttacaccttctagcgtgaagaaaaagaagcgaaggcgaaagaagtataaacaagatagtaaaaaagaagagcaggcagcaagtgccgcagccgaagacacctgtgatgtgggagtgtcttcagacgacgataagggcgctcaggcggctaggggtagttctaacgctagtcttaaggaggaagagtgcaaagaacccctactgtttcactctggggaccactacccactgagcgacggcgattggagtccactggagacttag

SEQ ID NO: 193443 - DNA, 2556 bp, Artificial Sequence
  Description of Artificial Sequence: Synthetic coding sequence
atgaactacgtgggccagctggccgagaccgtgttcggcaccgtgaaggagctttaccggggtttaaatccagcaactctctccgggggtatcgacgtgctcgtagtaaagcaagtggatggcagttttagatgcagcccgttccatgtccgctttggcaagcttggagttctgaggtcccgggagaaggtggtggacatcgaattgaatggcgagcccgtggatctacatatgaagctaggcgacagcggggaggcttttttcgtccaggagctggagagcgatgatgagcacgtccccccggggctatgcaccagtcccataccttggggcggcctgtccggtttcccttcagattctcagttaggcactgctagtgagccagaggggctggtgatggccggaactgcatcgaccggccgacggaagcgcaggcgcaggcgaaagcctaagcagaaggaggatgcagtggccaccgactcctcacctgaggagctcgaggcaggtgccgaatcagaactgagtctgccggagaagctgcgccctgaaccacccggagtacaactcgaggagaaatcttcattgcagcctaaagatatctatccatatagcgacggtgagtggccaccgcaggcatctctcagcgcaggcgaactgacttcgcctaaaagcgacagcgagctggaggtgaggacaccagaaccaagtcctctgagagcagaaagtcatatgcagtgggcctggggaagacttcctaaagtggcccgagccgagcgcccagaaagcagcgtagttctcgagggccgggccggcgctacttctcctcccaggggtggccccagcacgccgtcaactagcgtggcaggcggggtggatcccctgggcctccctatccagcagactgaagccggggctgatctgcaacccgatactgaggacccaacactagttgggccgcccttacacacaccggagacagaggagtcaaagactcagtcgtccggcgatatgggtttgccccctgcaagtaagtcctggagctgggctacactggaggtcccagttccgactggtcagccggaaagagtcagccgagggaaaggatcccccaaacgcagccagcatttgggccccagcgacatctatttggatgacctgcctagccttgactctgagaacgcagcactctacttcccccagtcggactccgggttgggagcgcgtaggtggtcagaaccctcaagtcagaaatcgctaagagacccaaaccccgaacacgagccagagcccacactcgacactgtggacacaattgctcttagcttatgtggcgggctcgccgactcacgggacatttctttggaaaaattcaatcagcattccgtcagttatcaggatttgactaagaacccaggtctgctggatgaccctaacctggtggtgaaaatcaacgggaaacactacaattgggcggtagcggcccctatgatcctgagtctccaagccttccagaagaacctccctaaatctaccatggacaaactggaaagggaaaagatgccccggaaaggcgggaggtggtggttcagttggcgcagacgcgatttcctggccgaggagcgctccgcccaaaaagaaaagactgcggctaaagagcagcaaggggaaaaaaccgaagtgctgagttccgatgatgatgcacctgatagccctgtgatccttgagataccgagcctgcccccatctacccccccttcaacccctacttacaaaaagtctctacgcctctcttctgaccagatcagacgtttgaatttacaggaaggcgccaatgatgtggtctttagcgtcacaactcagtatcagggcacttgccgttgtaaggcaactatttacctttggaaatgggatgataaagtggtgatctctgacattgatggcaccattacaaaatccgatgcgctaggacatattctgccccagttgggaaaagattggacacatcagggcataacatcactgtatcacaagatccagctgaatggctacaaattcttgtattgcagcgctcgagccatcggcatggccgacctaacgaaaggttatctccagtgggtaagcgaggggggatgctcacttcccaagggaccaatccttttgtcgccatccagcctgtttagcgctttgcatagggaagttatagaaaagaaaccggaagtgttcaaagtggcctgtctgtccgatattcagcagctctttctgccacatggccagcctttttacgcagcttttggtaacagaccaaacgacgttttcgcttatcgtcaggtgggactcccagaatctagaatattcactgtaaatccaagaggcgagttgattcaagagcttataaaaaaccataaaagcacctatgaaaggctgggcgaagttgttgaactcctttttccccccgtggcaagaggccctagcacggatctcgctaatcctgagtactcaaatttctgttactggcgcgaacccctccctgccgtcgatctggacaccctggattag

SEQ ID NO: 193444 - DNA, 1242 bp, Artificial Sequence
  Description of Artificial Sequence: Synthetic coding sequence
atgggcctgccccccgccagcaagagctggagctgggccaccctggaagtgcccgtgcctaccggacagcctgagcgagtaagccgcgggaaaggctctccaaagaggtctcagcacctcgggccttcggacatttacctggatgatctaccatctctggattcagaaaacgcggcgctctacttccctcagtctgactccggtcttggagcccgccggtggagcgaaccatctagtcagaaaagcctgcgagatcccaatccagagcacgaaccagaaccaaccttagatacggttgacacgatagccttgtccctttgcggcgggctggcggatagcagagacatctccctggaaaagttcaaccaacacagcgtgagctaccaagacttaacaaagaatcccggcttgttggacgacccaaatctagttgtgaaaattaatggaaagcactacaattgggcggtagccgcgccgatgatcctgagtctacaggcctttcaaaaaaacctccccaaacgttcagcacagaaggagaagactgccgcaaaggagcaacagggagagaagaccgaggtcctatcctctgatgacgatgcccccgattcacccgttatcttagaaatcccctcactgcctcctagcactcctccttccacccccacatacaaaaagtcccttcggctatctagcgaccagattcggcggttaaacctacaggaaggcgccaacgacgtggtgtttagcgtgactacacagtaccagggaacctgtcgctgcaaagcgacaatttacctgtggaagtgggacgacaaagtcgtgatcagcgacattgacggaaccataacgaagagcgatgctttggggcacattttaccacaacttggcaaggactggacgcaccagggcatcaccagtctttaccacaagattcaattgaatggctacaagtttctttattgctccgctagggccatcgggatggctgacctgacgaagggttatctgcagtgggtctccgaagggggatgctctttacccaaaggtcccatcctgctgagtccatcaagcttattttccgccctgcatcgcgaagtgatagagaaaaaacctgaggtctttaaggtggcttgcttgtcggacatccagcagctctttcttccacacgggcagccattttacgcagcttttgggaataggccaaatgacgtgtttgcatatagacaagtgggtctgccttag

SEQ ID NO: 193445 - DNA, 813 bp, Artificial Sequence
  Description of Artificial Sequence: Synthetic coding sequence
tgagtgaagatcaacggcaagcactacaactgggccgtggccgccccgatgatcctctccttacaggccttccagaaaaatctacccaagagatcagcacagaaggaaaaaacagctgcaaaagagcagcagggcgagaagaccgaggtcctctcatcagatgacgacgcccccgattcacccgtaatactggagatcccctctctccctccaagcacacccccaagcacaccaacttacaaaaaaagccttagactgtcctctgaccagatacgccgactgaatctgcaggaaggcgccaacgacgtggttttttccgtaactactcagtatcaggggacctgccgatgcaaagctacaatttatctgtggaagtgggacgacaaggtggtgatctctgatattgacggcaccataacaaagtctgatgccctggggcatattttaccacaactgggcaaggattggacacaccaggggataaccagcttatatcacaaaatccagctgaacggctacaaattcctgtattgttccgcgcgggcaataggaatggcagacctaaccaagggttacttacagtgggtttcagaaggaggatgttctctgcctaaaggcccaattctgctctccccttctagcctgtttagtgccctgcaccgcgaggtcatcgagaagaaaccagaggtcttcaaggtggcgtgtctcagtgacatccaacagctctttctgccccacggacagccgttttacgctgcatttggcaatagacccaatgatgttttcgcttaccgccaggtcggactgccctag

SEQ ID NO: 193446 - DNA, 531 bp, Artificial Sequence
  Description of Artificial Sequence: Synthetic coding sequence
atgaagcccctgctgctggccgtgagcctgggcctgatcgccgccctgcaagctcaccatctgttggcttcagatgaggaaatccaggacgtctctgggacctggtatctgaaggccatgacagttgatcgggagtttcctgaaatgaatctcgaatctgtcacacctatgacacttactacactcgaggggggtaacctggaagccaaggtgacgatgctcataagcgggagatgtcaagaagtcaaagctgtgctggaaaagactgatgaaccagggaaatacaccgccgacgggggaaaacacgtagcttatatcatcaggtctcacgtgaaggatcactacattttttactgtgaaggggaactgcacgggaagcccgtgcgtggggtgaaactggtcgggcgtgaccctaagaataatctcgaggctttggaggatttcgagaaagcagccggcgcccggggcttgagcaccgagtcaattctcatcccccgccaatccgagacatgctctcccggtagcgattag

SEQ ID NO: 193447 - DNA, 531 bp, Artificial Sequence
  Description of Artificial Sequence: Synthetic coding sequence
atgaagcccctgctgctggccgtgagcctgggcctgatcgccgccttgcaggcacatcacctgctggccagtgacgaagagatccaagacgtatccgggacttggtacctcaaggctatgacagtggaccgcgagtttcctgagatgaatcttgagtccgttaccccaatgactctcacaacattggaaggtgggaatttggaggccaaggttacaatgctcatcagtggcaggtgtcaagaagtcaaagcagtcctggaaaaaaccgatgaacccggaaagtacaccgccgacggcggcaagcacgttgcttatataatacggagccatgtgaaggatcactacatattctattgcgagggagagctgcatgggaagccagttcggggcgtgaaattagtggggcgcgatcccaaaaataacctggaggcgctggaggacttcgagaaggcagccggagcccgggggctgtccaccgagtctattttgatccctcgacagtctgagacctgctctcccggtagcgactag

SEQ ID NO: 193448 - DNA, 564 bp, Artificial Sequence
  Description of Artificial Sequence: Synthetic coding sequence
atgcggcagggcctgctggtgctggccctggtgctggtgctggtgttagtactggccgcaggctcacaggttcaagagtggtacccccgcgaaagccatgctctgaattggaataagttctctgggttctggtatattctggccaccgcgacagacgctcagggattcttacccgctcgggataaaaggaaactgggcgcatctgtcgttaaggtgaataaagtcgggcaactgcgggttctgctcgcatttagacgtggccagggttgcggtcgagcacagccaaggcatccgggcacctccgggcacttgtgggcctcgctgagcgtgaaaggggtgaaagcatttcatgtcctctctacagattactcttatgggctggtgtacctacgcctcggtcgagcaacacagaattataaaaatctacttctattccatagacaaaacgtctccagttttcaaagtctgaaagagtttatggacgcatgtgacattctcggcctcagcaaggctgccgtaatcctgcctaaagatgcctcccgcacacatacgattctgccttag

SEQ ID NO: 193449 - DNA, 603 bp, Artificial Sequence
  Description of Artificial Sequence: Synthetic coding sequence
atgcggcagggcctgctggtgctggccctggtgctggtgctggtgcttgtcctggctgctggatctcaggttcaggagtggtatccaagagagagtcatgcgctgaactggaataagttctcaggcttttggtacatcctcgcaaccgctaccgatgcgcagggcttccttcccgctcgggataagaggaagctgggggcttcggtggttaaggtcaataaggtgggacagctgcgtgttctcttggccttcaggcgcctcaagggctgtcaatcacaggaagttatcctgcggaaggacggcaagaaacctgtctttggcaacgcttgtgcctatgccgctgggcctagagaggggcaagagggcgtcaagggggtcaaagcattccacgttctgagcacggattattcttacggactcgtgtacctgcgtctaggaagagccacccagaattacaaaaatctcctactgttccatcgtcaaaacgtgagtagttttcagtctctgaaggagttcatggatgcctgtgacatcctgggattgtccaaggctgcagtcatcctgcctaaggacgcttctaggacccacaccattcttccttag

SEQ ID NO: 193450 - DNA, 273 bp, Artificial Sequence
  Description of Artificial Sequence: Synthetic coding sequence
accttcgagctgagcgacgacggccggttcgaggtgtggaacgccatgaccagaggacagcactgtgacacctggtcctacgtgttgatccccgccgctcaaccgggtcagttcacagtggaccatggggttgacacgagggccggctggccatcctctgggagtgcctgctgggcaggcgctggctgttgtttacctggacgatggacatcatcttccgcctgggctgagctacgagccagtcgaatgacgaccagttcatcccagatgtag

SEQ ID NO: 193451 - DNA, 579 bp, Artificial Sequence
  Description of Artificial Sequence: Synthetic coding sequence
atgcggctgctgtgcggcctgtggctgtggctgagcctgctgaaggtgctgcaggcccaaacaccgacccccctgcccctgcccccgccaatgcagagttttcagggaaatcagttccagggcgaatggttcgtgctcggactggccggtaactcatttcgcccagagcaccgggccctgctgaatgcgttcactgccacatttgagctatccgacgatgggcgcttcgaggtgtggaacgccatgacgaggggacagcactgtgatacttggtcctacgtgctgatccccgccgctcagcctggacagttcacagttgaccacggagtcgagcccggagctgaccgcgaagaaacgagggtggtcgatagcgattacacacagttcgcgttaatgctttccagaagacatacctcacgtctggcagtgctgaggatctcccttctgggaaggagctggctgctcccccccgggactctggaccagttcatttgtctcggcagggcacaaggcctgagtgacgacaacattgtgtttcccgacgttacaggttggtcaccccaggctagtgtctgttag

SEQ ID NO: 193452 - DNA, 597 bp, Artificial Sequence
  Description of Artificial Sequence: Synthetic coding sequence
atgcccctgggcctgctgtggctgggcctggccctgctgggcgccctgcatgcccaagcccaggactctacctccgatctgattccagccccccccctgtctaaagtaccgctccaacagaacttccaagacaatcagttccaaggcaagtggtacgtcgtgggcctggccggcaatgccatcctccgagaagataaggacccacagaaaatgtatgcaactatctatgaattgaaggaggacaaaagctacaacgtcacatccgtgctgttccggaagaagaagtgcgattactggatacgtacttttgtcccagggtgccaacccggcgagtttactttggggaacatcaaaagttatcctggtctcacttcttatttagtccgagtggtgtcaactaactacaaccagcacgcaatggtcttcttcaaaaaagtgtctcagaaccgcgaatactttaaaataaccttatacggtagaacaaaggagttgacgagtgaactgaaagagaacttcatcaggttctccaaatcactgggactacctgagaaccatatcgtgttccctgtgccaattgaccaatgtatagatggctag

SEQ ID NO: 193453 - DNA, 603 bp, Artificial Sequence
  Description of Artificial Sequence: Synthetic coding sequence
atgcccctgggcctgctgtggctgggcctggccctgctgggcgccctgcacgcacaggcccaggacagtacctctgatttgatacccgctccacccctgtctaaagtgccattgcagcagaattttcaggataatcagttccagggcaaatggtacgtggtagggctggctggtaacgctattctgcgtgaagacaaggatccccaaaagatgtatgcaactatttatgaactgaaggaggataagtcctacaatgtgacatccgtgctttttcgcgagaaagctcagaaatgtgactactggattcgaacctttgttccgggctgccagccaggggagttcacccttgggaatatcaagagctatccagggctgaccagctatctagtgcgggtggtgtccactaattacaaccagcacgccatggtcttcttcaagaaggtgagtcagaaccgggagtactttaagattactttgtatggtagaaccaaagagctgacatccgagctgaaggagaattttatacgattctcgaagtcactgggtctgcccgagaatcacatcgtttttccggttcccatcgaccagtgcatcgatggatag

SEQ ID NO: 193454 - DNA, 603 bp, Artificial Sequence
  Description of Artificial Sequence: Synthetic coding sequence
atgcccctgggcctgctgtggctgggcctggccctgctgggcgccctgcatgcacaggcacaagattccacttccgacctcatcccagcaccccctctctcaaaagttcctctccagcaaaatttccaagataaccagtttcagggtaaatggtacgttgttggattagcgggtaacgccatactgcgagaagataaggatccacagaagatgtatgcaaccatatacgaactcaaggaggacaagtcgtacaatgtcacgtccgtgctgtttcgtcagtggaagaaaaaatgcgactattggattcggaccttcgtgcccggatgccagcctggcgaatttactctcggaaacattaaatcctacccaggcctaacaagttacctggtgagggtggtaagtaccaattacaaccagcatgctatggtgttttttaagaaagtatcacagaatagggagtatttcaaaataactctgtatggtagaaccaaggaactgacgtccgaactgaaggaaaatttcatccgcttttccaagagcctggggcttccagagaaccatattgtgttcccagtcccaatcgatcagtgcatcgatggttag

SEQ ID NO: 193455 - DNA, 597 bp, Artificial Sequence
  Description of Artificial Sequence: Synthetic coding sequence
atgcccctgggcctgctgtggctgggcctggccctgctgggcgccctacatgcacaggcacaggatagcacttcagatctgatacctgcccccccacttagtaaggttccgctgcagcaaaatttccaagacaaccagtttcaaggaaaatggtatgtggtggggctggccgggaacgccatcctaagggaggacaaagacccgcagaagatgtacgccaccatttatgaactgaaggaggataagtcctacaacgtgacctctgtgctgtttcgcaaaaagaagtgcgattactggatcagaacattcgtgcctgggtgccagccgggtgagtttacactggggaacatcaaaagctacccaggacttacaagttacctggttcgcgtggtctcaactaattataatcagcacgccatggtgtttttcaagaaagtatcacaaaatagggagtattttaaaatcactttgtatgggcggaccaaggaactgacatccgaactcaaagaaaatttcatccggttcagtaagtctctggggctacctgagaaccacatagtcttccctgtacccatagatcagtgcattgacggttag

SEQ ID NO: 193456 - DNA, 597 bp, Artificial Sequence
  Description of Artificial Sequence: Synthetic coding sequence
atgcccctgggcctgctgtggctgggcctggccctgctgggcgccttacatgcacaggctcaggatagtacaagcgacttgatcccagcccctccactttccaaggtccctttacagcagaattttcaggacaatcagttccagggcaagtggtacgtagtgggcctagccggtaatgcaattctgcgcgaagacaaagatcctcagaaaatgtatgcgacaatctatgaactgaaagaggacaagagttacaatgtgaccagtgtgctattccgaaaaaagaagtgcgactattggatccggactttcgtgcctggctgtcagcccggcgagttcaccctcgggaatattaagtcctacccagggctgacatcgtacttggtgagggtggtgtctactaactataaccagcacgctatggtgttttttaaaaaagtgagccagaacagggaatactttaaaataaccctgtatggaaggaccaaggaacttacaagtgagctgaaagagaatttcataaggttcagtaagagtctaggactgccagagaatcacattgtatttcctgtaccaattggcaatggtcagagcggatag

SEQ ID NO: 193457 - DNA, 492 bp, Artificial Sequence
  Description of Artificial Sequence: Synthetic coding sequence
atgggcggcctgctgctggccgccttcctggccctggtgagcgtgcccagagcccaggctgtttggctggggagacttgaccctgagcaactactgggtccctggtacgtgctggccgtcgccagtcgggaaaaaggctttgctatggaaaaggacatgaaaaacgtggtcggcgtcgtagtgactcttacccccgaaaacaaccttcggaccctgtcttcccaacacggacttggggggtgtgaccagtcagtgatggatcttatcaagcgaaattccgggtgggtctttgagaacccttccattggagtgttagagttatgggtcctcgcaacgaactttcgcgactatgctataatttttacacagttagaatttggagacgagccctttaatactgtcgagctttattccttgacagaaactgccagtcaggaggcaatgggcctgtttactaagtggtctcggtccctggggtttctgtcacagtag

SEQ ID NO: 193458 - DNA, 459 bp, Artificial Sequence
  Description of Artificial Sequence: Synthetic coding sequence
atggaggagctggaccggcagaagatcggcggcttctggcgggaggtaggtgtggcctcagaccagtctctggttcttacagcacccaagagggtggagggcctattcctcacactctctggcagcaatcttactgttaaggttgcctataacagttccggctcctgcgaaatcgaaaagatagtgggctctgaaattgattccacgggtaagttcgcgtttccagggcacagggaaattcatgtgctggacacggactacgaaggttacgccattctgagagtctccttaatgtggagggggcggaatttccgagtgttgaagtattttacccgctctttagaagacaaggacagattgggtttctggaaatttagggagctgactgccgacactggcctgtatctggcggcaagacctgggagatgcgcagaattgctgaaggaagagctgatctag

SEQ ID NO: 193459 - DNA, 531 bp, Artificial Sequence
  Description of Artificial Sequence: Synthetic coding sequence
atggccctgctgctgctgagcctgggcctgagcctgatcgccgcccaggaattcgaccctcacaccgtgatgcagaggaattataacgtggccagagtatccggagtgtggtactcaatcttcatggcgtctgacgatctgaaccgaatcaaggaaaacggtgacctgcgggttttcgtaagaaacatcgagcacttgaagaacgggagtcttatcttcgacttcgagtacatggttcagggagagtgcgtagccgtggtggtggtgtgcgagaagacagagaaaaacggcgagtactccataaactatgaggggcagaataccgtggccgtgtcagagaccgactaccgactgttcatcacttttcaccttcagaactttagaaacggcaccgagactcacaccctagccctctatgagacttgcgaaaagtatgggttgggaagtcagaacatcatcgacctcactaacaaagacccttgctattccaagcactaccgctctccgccgcgcccaccaatgaggtggtag

SEQ ID NO: 193460 - DNA, 1119 bp, Artificial Sequence
  Description of Artificial Sequence: Synthetic coding sequence
atgagcctgcggtgcggcgacgccgcccggaccctgggcccccgggtgttcggacgttatttctgtagtcctgtccggccattaagttccctgccagataaaaagaaggaacttcttcagaacggaccagacttgcaggacttcgtgtctggcgacctggccgatcgctccacttgggacgagtacaaggggaacctgaagcgtcagaagggggagaggttaaggttgccaccttggctgaagacagagattcctatgggcaagaactataacaagcttaagaacactctccggaacttgaatctgcataccgtgtgcgaggaggcaagatgcccaaacataggagagtgctggggcggcggagaatatgctactgctaccgctactattatgttgatgggcgacacatgcactcgaggatgtcgcttctgctccgtcaagacggcaagaaacccgcccccgctggatgcaagtgagccctacaatacagccaaggctatcgccgagtggggtctcgattatgtagtgctgacttctgttgaccgcgacgacatgccagatggtggggccgagcatattgcgaagacagtctcatacttgaaggagcgcaacccgaaaattttggttgaatgcttgacccccgattttaggggagacctgaaggctatcgagaaggtggcactgtccgggctcgatgtctatgcacacaacgtggaaacagtgcctgagctgcagtcaaaggtgagggatcctcgcgcaaacttcgaccagtctctaagggttttaaaacacgctaagaaagtccagcccgacgtcatttcgaaaaccagcattatgctcggtctcggggagaacgacgagcaggtgtatgcaacaatgaaggctcttcgcgaagccgacgtcgattgccttaccctcggacaatatatgcagcccaccagacggcatcttaaggtggaagagtatataactcctgagaaatttaagtattgggagaaggtgggtaatgagctgggtttccactataccgcaagcggtccactcgtgagaagcagttataaagccggtgaattctttcttaagaacctggtggctaagcgcaagacgaaggacctttag

SEQ ID NO: 193461 - DNA, 969 bp, Artificial Sequence
  Description of Artificial Sequence: Synthetic coding sequence
atgagcctgcggtgcggcgacgccgcccggaccctgggcccccgggtcttcggccggtatttttgttctcccgtgcggccgctgtcctctctgccagataagaagaaagaactcctgcagaacggccccgatctgcaggattttgtctctggggacttggcagatagatctacatgggatgaatacaagggcaacctgaagaggcagaagggagaaagactgaggttaccaccttggctgaagacagagattcccatgggcaagaactataacaagctgaagaataccctacggaatttgaacctccatactgtctgcgaagaggcccgctgtccaaatatcggtgagtgttggggtggcggtgagtacgctaccgcaactgctaccatcatgctgatgggcgatacttgtacaaggggctgtagattttgcagtgtgaaaacggcacgcaacccgcccccattggacgccagtgagccctacaacacagctaaagcaattgcagagtggggactggattatgtcgtgctgactagcgtcgaccgggacgatatgcctgacggcggagccgaacacattgcaaagaccgtgtcctacttaaaggaaagaaatcccaaaatcctagtggaatgtctcacacccgattttaggggggacctaaaagccatcgaaaaggtggctctgtctgggctggatgtttacgcccacaacgtcgagactgtgcctgaactgcagagtaaagtgcgggatcccagggccaacttcgaccaatccctccgggtgcttaagcacgctaaaaaagttcaaccagacgtcatatccaaaaccagcatcatgctgggcttgggcgagaatgatgaacaggtatacgccaccatgaaggcgctcagagaagccgatgtggattgcctgactttagggcagtatatgcagcccacccgccgccacctgaaagtgaatttctcctag

SEQ ID NO: 193462 - DNA, 603 bp, Artificial Sequence
  Description of Artificial Sequence: Synthetic coding sequence
atggccagcagcctgacctgcaccggcgtgatctgggccctgctgtcattcctttgcgccgccacgagttgcgtaggatttttcatgccttattggctgtggggaagtcagcttggaaaacccgttagtttcggcaccttccgccgatgctcctaccctgtccatgacgagagcagacagatgatggtcatggtggaagagtgcggccggtacgcgtcttttcaggggataccatcagctgaatggaggatttgtaccatcgtaacaggcctcggatgtggactgttgcttctggttgcgctcaccgccctgatggggtgctgtgtctccgacctgatatctcgcaccgtggggagggtggcaggagggattcagttcctcggggggctgcttatcggggctggatgcgctttatacccactggggtgggatagcgaggaagttaggcagacttgtgggtacacaagcggtcagtttgatctgggaaagtgtgaaattggatgggcctattattgtaccggagcaggagccacagcggctatgctgctttgtacttggctagcatgtttctcagggaaaaagcagaagcactatccatattag

SEQ ID NO: 193463 - DNA, 663 bp, Artificial Sequence
  Description of Artificial Sequence: Synthetic coding sequence
atgcggagcagcctgaccatggtgggcaccctgtgggccttcctgagcctagtgacggctgtcacatcatctactagttactttctgccttattggttattcggctcccaaatgggaaaacccgtgagtttttctacatttagacgctgcaactaccctgttcgaggggagggtcactccttgatcatggtcgaagagtgcggccggtacgcctcctttaacgccatcccaagtcttgcctggcagatgtgcaccgtggttaccggcgctggttgtgctttgcttctgcttgtggccctggccgctgtgcttgggtgttgtatggaagaactgatctcccgcatgatgggcagatgcatgggggctgcccaattcgtgggtggtctgctgattagttccggatgcgcactctaccctttggggtggaatagcccagagattatgcagacatgcggtaacgtctccaatcagttccagctgggaacctgcagattaggatgggcctactattgcgctggcggaggggctgcggcagccatgttaatatgtacttggttgagctgtttcgcaggcaggaatcctaagcccgttatactggtggagtcaattatgcgcaatactaactcatacgccatggagctggaccactgtcttaaaccgtag

SEQ ID NO: 193464 - DNA, 564 bp, Artificial Sequence
  Description of Artificial Sequence: Synthetic coding sequence
atgcggagcagcctgaccatggtgggcaccctgtgggccttcctgagcctggtgaccgcagtgaccagttctacatcctattttctgccctactggttattcggttcacagatgggcaaacccgtgtcattcagtacctttcgtaggtgtaattatcctgtgaggggcgaagggcatagtctgatcatggtggaggaatgtggccgatacgcctcctttaacgctatccccagcctggcgtggcagatgtgcacagtcgtgaccggggctgggtgcgctctactgcttcttgtagccctggctgcagtcttggggtgttgcatggaggagctaatatcccgcatgatggggcggtgtatgggggccgcacagtttgttggaggcacctgcaggttgggatgggcttactactgtgccggcggcggcgccgctgccgctatgcttatttgcacatggctttcttgctttgcaggcaggaatccgaagcccgtcattctcgtggagtccataatgagaaacactaactcttatgccatggagctcgaccattgcctgaaaccttag

SEQ ID NO: 193465 - DNA, 687 bp, Artificial Sequence
  Description of Artificial Sequence: Synthetic coding sequence
atgtgccacgtgatcgtgacctgccggagcatgctgtggaccctgctatccatcgtcgtggcgtttgccgagctgatcgcattcatgagcgcagattggctcatcggcaaggcccgttcaagggggggcgtggagcccgcaggcccgggcggcggttcccccgagccttaccatcctacacttggcatttatgctcggtgtataagaaacccaggggtccaacacttccagcgtgacaccctgtgcggtccttacgcggagtcctttggagagattgcgagcggcttttggcaggccaccgcaatattcctggccgtgggtatctttattctatgtatggtggccttggtaagtgtgtttactatgtgcgtccagtctattatgaaaaaatctatcttcaacgtctgcgggcttctccaggggatcgcaggtcttttcctgatcctcggattaattctctaccctgctgggtggggctgtcagaaggccatagactactgtggtcattatgcttcagcgtacaaacccggggattgttctcttgggtgggccttctataccgcaatagggggaacagtgttgacattcatctgtgccgtcttctccgcacaggcggagatcgccacatcctccgacaaagtgcaggaggagattgaggagggcaagaacttaatatgtctcttatag

SEQ ID NO: 193466 - DNA, 687 bp, Artificial Sequence
  Description of Artificial Sequence: Synthetic coding sequence
atgtgccacgtgatcgtgacctgccggagcatgctgtggaccctgctctctatcgtcgtggcttttgccgagctgatagcttttatgtctgcggattggctgattgggaaggcccgatcaaggggaggggtcgagcccgcaggacccggaggtggcagccccgaaccgtatcaccctactctggggatctacgctcgctgcattcgaaatcctggggtccaacactttcaacgggatactctttgtgggccctacgctgaatcttttggggagattgcatcaggattctggcaagctacagcgattttcttggctgtgggcatctttatcttgtgtatggttgctctggtgagtgtgtttacgatgtgcgtgcaaagcattatgaaaaagtccatttttaacgtctgcggtctgctgcagggcattgcgggcctgttcctgatcctgggccttattctctaccctgcgggatgggggtgtcagaaagcgatcgactattgtgggcactatgcgtccgcctacaagcctggcgactgttcgttagggtgggcattttacactgctatcggggggaccgttctcacattcatatgcgccgtcttctctgcccaggcagagatcgcgacctcgagcgacaaagtacaggaggaaatcgaggagggtaagaacctgatttgcttactgtag

SEQ ID NO: 193467 - DNA, 669 bp, Artificial Sequence
  Description of Artificial Sequence: Synthetic coding sequence
atgctgcccgcccaggaggccgccaagctgtaccacaccaactacgtgagaaacagcagagccattggggtactgtgggctatcttcaccatctgctttgccatagtcaatgtcgtgtgtttcatacagccctactggatcggagacggcgtagacacaccccaggctgggtactttggcctttttcattactgtatagggaacggattttcccgggaattgacttgcaggggcagctttactgacttcagtaccctgccctcaggagctttcaaggccgcttctttttttatcggactgtcaatgatgctgattatcgcttgcattatttgctttaccctctttttcttctgtaatacagcaacagtttacaaaatctgtgcgtggatgcagctcacctcagcggcgtgtcttgtgttggggtgcatgatcttccccgatggttgggacagtgatgaggtcaaacgaatgtgcggcgaaaagacagataagtacacactcggcgcctgcagcgtgagatgggcttacatcctggcaattatcggcatcctcgatgccctgatcttgagcttcctggcctttgtgctggggaatagacaagatagtctgatggccgaggagctaaaagctgagaataaagtgcttctgagccagtactcacttgagtag

SEQ ID NO: 193468 - DNA, 711 bp, Artificial Sequence
  Description of Artificial Sequence: Synthetic coding sequence
atgcccggcgccgccgccgccgccgccgccgccgccgccgccatgctgcctgcacaggaagccgccaagctgtaccataccaactacgtgcgaaatagccgcgctattggtgtactctgggccatcttcacaatctgttttgccatcgtgaatgtggtttgcttcatccagccgtattggattggtgacggtgtggacactccccaggcaggctatttcggtctgttccactactgtatcggcaacggcttttcccgcgagcttacttgccgtggctcctttacagatttctcgactctgccctccggtgcctttaaggcggccagcttcttcatcggtctcagtatgatgctcatcatcgcttgtatcatttgctttacattgttctttttctgtaacaccgccaccgtctataaaatttgcgcttggatgcaactcacttctggcgactgtttggttctttttgaccttcacttcccagacggttgggattctgatgaagtgaagcgtatgtgtggcgagaagacagacaagtatacgttgggggcttgctccgtacggtgggcgtatattctagctattatcggcattctggatgcactgattttatccttcctggcttttgttctgggtaatagacaggatagcctcatggccgaagaattgaaggctgaaaacaaagtgcttcttagccagtattctctcgagtag

SEQ ID NO: 193469 - DNA, 699 bp, Artificial Sequence
  Description of Artificial Sequence: Synthetic coding sequence
atgcccggcgccgccgccgccgccgccgccgccgccgccgccatgctgccggcccaagaggcagctaagctgtaccacacaaactacgtgcgaaactcccgcgcaattggggtgttgtgggcgatatttaccatctgttttgccatcgtgaacgtggtgtgcttcatacagccgtattggatcggcgatggtgtggacaccccccaggccgggtatttcgggctctttcactactgcatcggaaatggcttcagtcgagagctgacatgtagggggtccttcaccgattttagcaccctcccttcgggcgcttttaaggctgccagcttcttcataggtctctcaatgatgttaatcatcgcctgtatcatttgtttcaccctgttcttcttctgcaataccgccactgtttacaaaatttgtgcgtggatgcaattaacatctggggattgcctggtgctgtttgacctgcatttccccgacggatgggactcagatgaagtgaagcgcatgtgcggggagaaaaccgataagtacactcttggagcctgttctgtgcggtgggcctatatcctggccattattgggatcttagacgccctgattctgtcatttctggcttttgtgctgggaaaccgacaggactccctaatggcagaagaattaaaagctgaaaacaaggatgacgggaatgcttag

SEQ ID NO: 193470 - DNA, 660 bp, Artificial Sequence
  Description of Artificial Sequence: Synthetic coding sequence
atggtgaagctgctgcccgcccaggaggccgccaagatctaccacactaactacgtgagaaactctcgggcggtcggtgttatgtggggcacattaacaatctgttttagtgtccttgtgatggccctgtttattcagccctactggattggtgactctgtgaataccccgcaagccggctactttggtctcttttcatactgtgtagggaatgtactgtcttcggagctcatatgcaagggtgggccgttggacttctcgagcattccatcacgcgcctttaagacagcaatgtttttcgtagctctcggaatgtttctcataataggcagtatcatttgcttctctttattctttatctgcaacactgctaccgtctacaagatatgcgcatggatgcagctcgcagctgcaaccggacttatgataggctgtctcgtgtacccagatggttgggatagctccgaagtgagaagaatgtgcggcgaacagacaggaaaatacactctgggccactgtaccattagatgggcctttatgttagccattctttctattggcgacgccctgatattgtcattcctggcattcgttctgggatatagacaggacaagctgctcccggatgattacaaggccgacgggactgaggaagtgtag

SEQ ID NO: 193471 - DNA, 660 bp, Artificial Sequence
  Description of Artificial Sequence: Synthetic coding sequence
atggtgaagctgctgcccgcccaggaggccgccaagatctaccacaccaactatgtaaggaattctcgggcagtgggcgtcatgtggggtaccctgaccatttgttttagcgtccttgtcatggccctctttattcaaccttattggatcggagactctgtgaatacaccccaggcagggtacttcggcctctttagttactgtgtgggtaatgtgctgtcctccgaactcatttgtaagggcggccctctggatttttcttccattccttcgagagccttcaagactgccatgttctttgtggctctgggtatgttcctcatcattggctcaattatctgtttttctctcttttttatctgcaatacagccactgtgtacaaaatatgtgcttggatgcagctcgcagccgccactggcctcatgattggctgcttggtttaccctgacgggtgggacagttcggaggttcgaagaatgtgtggggagcagaccggcaagtacaccctcggccattgcaccattaggtgggcttttatgctcgctatcttatctataggagacgcgctaatcctgtcctttttggcctttgtcctgggctaccggcaggataaactacttcccgatgactataaggcagatggaaccgaagaagtctag

SEQ ID NO: 193472 - DNA, 675 bp, Artificial Sequence
  Description of Artificial Sequence: Synthetic coding sequence
atgagcgtgttcggcaagctgttcggcgccggcggcggcaaggccggaaagggcggccctaccccccaggaggctattcaaagactgcgcgacactgaagaaatgctgagtaagaagcaagagtttcttgagaaaaagattgaacaggagcttacggctgcgaaaaagcacggtaccaagaataagagagctgccctgcaagcactgaagaggaagaagcgctatgagaaacagctcgcccagatcgatggcaccctaagtaccatcgagtttcagcgagaggcactagagaatgctaacacaaacacggaggtactcaagaatatgggctatgccgcaaaagctatgaaggccgctcacgataacatggatatcgacaaagtagacgagcttatgcaggacatagctgatcagcaggaactagctgaggagatcagtacagccatctcgaagccagtgggttttggcgaggagttcgacgaggatgaactgatggccgaattagaggaactggagcaggaggagctggataagaacttgctggaaatcagcggacccgagacagtacctcttcctaatgtaccttcaatcgctctccctagcaagccagcaaaaaaaaaggaagaagaggatgacgatatgaaggaactagagaactgggcaggctctatgtag

SEQ ID NO: 193473 - DNA, 1434 bp, Artificial Sequence
  Description of Artificial Sequence: Synthetic coding sequence
atgggcgccctggcccgggccctgcccagcatcctgctggccctgttgttaacttctaccccagaggctttgggtgcgaaccctggactcgttgcacgtattacagataagggcttacagtacgccgcacaggaaggcctcctggcccttcaaagtgagcttctacgcataacactgcctgatttcaccggtgatctgagaattccacacgtgggtcgaggccgctatgagtttcactcccttaatatccactcctgtgagctgcttcattccgccctgcgacccgtgcccggccagggcctgtcattgagcatatctgattcctctataagggtgcaaggcagatggaaggtacgcaagtcattcttcaaactgcagggaagtttcgacgtgagcgtgaaggggatctctatcagcgtgaacctgctcctgggctctgagtcctccggcagacccacagtgacggccagttcttgctcaagcgatattgcagatgtggaggtggacatgtctggagacttaggctggcttcttaatctttttcataatcagatcgagtcgaagtttcagaaagttcttgagtcacgcatatgtgagatgatccagaagtctgtgtcatcagacttacagccgtacttacagacactgccggtaacaacagagatcgacagcttcgccgacattgactatagcctcgttgaagccccgcgagccaccgcccagatgctggaggtgatgttcaagggtgagattttccatagaaaccatagatctccagtgaccttgcttgctgctgtcatgagcttgcccgaagagcataataagatggtatacttcgccatctcggactatgtatttaacactgcttccctggtgtatcacgaggagggttatcttaacttctcaataaccgacgatatgatccctcccgatagcaacatcagactgacaaccaagagtttcaggccgttcgtccctcgtctggcccgactgtaccctaacatgaatctggagctacagggcagcgtacctagcgctcctctactgaattttagcccgggcaacctgagtgttgatccttacatggagatcgacgcattcgtcctacttcccagctcatctaaggaacctgtctttaggctgtcggtggccactaacgtatcggccaccttaacattcaacacttctaagattacaggtttcctcaaacccggaaaggtcaaagtcgaactgaaggaatccaaagtgggtctgttcaacgctgaactgttagaggcgctgctcaactactacattttaaataccttttatcccaaattcaacgacaagcttgccgagggcttccctctgcctcttctgaaacgggtgcagctgtacgatctggggctgcagatccacaaggacttcccttcaagacgggaccaccccccctag

SEQ ID NO: 193474 - DNA, 486 bp, Artificial Sequence
  Description of Artificial Sequence: Synthetic coding sequence
atgagcgtgcccggcccctaccaggccgccaccggccccagcagcgcacccagcgccccaccgagctatgaagaaactgttgccgttaactcctattaccctaccccccccgctccaatgcctggccctactaccgggttagtcactggaccagacggcaaggggatgaacccgcccagttactacacccaacctgcccctatcccgaataacaaccccatcaccgtgcaaaccgtgtacgtgcaacacccaatcacgttccttgatcgtcctatccaaatgtgctgtcctagctgtaataaaatgatcgtgtcacaactgagctacaatgccggggcactaacatggctgagctgcggctcgctatgcctgctggggtgtatagccggctgttgctttatccctttctgtgtggatgcactgcaagatgtcgatcactattgcccaaattgcagggcgctcctcggcacctacaaacgtttatag

SEQ ID NO: 193475 - DNA, 687 bp, Artificial Sequence
  Description of Artificial Sequence: Synthetic coding sequence
atgagcgtgcccggcccctaccaggccgccaccggccccagcagcgccccgtcggcccctcctagctatgaggagaccgtggccgtgaacagctattacccaaccccaccagccccaatgcccgggccaacaaccggccttgttaccgggccggatggcaagggcatgaatccccccagctactacactcagccagcaccaatccctaacaataacccgatcaccgtgcagacagtgtacgtccagcaccccatcacctttctggaccgaccaatccagatgtgttgtccttcatgtaataagatgattgtgtctcagctctcatacaacgctggtgcactgacatggttgtcatgtggtagtctctgtctgctaggagtccacagcggcctcctgttacacccgctgttgcggggctgccccgctggccgtggcccacttctttcccaactccagagttctcctggccacctgcaagcgtttgtcggtctgtctcagacctggagggagccaggtgccgccggcagccccttccacctgtcctcctcttttaccccaggcggaggatcggccctggttgtgtcccctctacaaggtgcccatctccacgtatttttttggggtgagtacgttgccaagctgactaatcttcagactcctgagatcgccgcatggtctagagcctag

SEQ ID NO: 193476 - DNA, 459 bp, Artificial Sequence
  Description of Artificial Sequence: Synthetic coding sequence
atgagcgtgcccggcccctaccaggccgccaccggccccagcagcgccccatcggcaccccccagctatgaggaaacggtcgctgtcaatagctactatccaactcctcctgctccaatgcctggccccacaaccggcttggtgacaggccctgatgggaaggggatgaatcccccatcttattatactcagccagctccaatcccaaataacaatcctataacagtgcagaccgtgtacgttcaacacccaatcacatttcttgataggcccatccagatgtgctgtcccagttgcaacaaaatgatcgtgagccagctgagctacaatgccggcgcgttgacctggctctcatgcgggtccctgtgcctcttgggacaagaatgtagcggtactatcgtcgcgctgcgatcattcgatctccttggatcttgcaatccacccagttcagcatcctag

SEQ ID NO: 193477 - DNA, 486 bp, Artificial Sequence
  Description of Artificial Sequence: Synthetic coding sequence
atgagcgtgcccggcccctaccaggccgccaccggccccagcagcgcccctagcgcacctcccagctatgaagagactgtggccgtgaactcctattatccaacaccacctgcgcccatgccgggtcccaccaccggactggtgactggccctgatggaaaaggcatgaacccgccatcgtactatactcagcccgccccgatccctaataataaccctattacggtgcagacggtttatgtccagcaccccatcactttcctcgatagacctatccagatgtgctgccccagttgtaacaagatgattgtgagccagctgtcctacaacgctggcgccttgacgtggctgtcctgtggatcactttgcctcctagggtgcatcgcgggatgttgtttcatacctttttgcgttgacgctcttcaagacgtcgatcattattgccctaattgtcgcgcgctccttggcacatataagaggctctag

SEQ ID NO: 193478 - DNA, 6123 bp, Artificial Sequence
  Description of Artificial Sequence: Synthetic coding sequence
atggagcacaaggaggtggtgctgctgctgctgctgttcctgaagtccgcagccccagagcaaagccacgtggttcaggactgttatcatggcgacggtcagtcctaccgcggcacatactctaccactgtgacggggaggacctgtcaggcatggtccagcatgaccccacaccaacacaatcgaacgactgagaattaccccaatgctggcttaatcatgaactactgtcgtaatcccgatgccgtggcagcaccttattgttatacccgcgaccctggggttcggtgggagtattgcaacctgacacagtgtagcgacgccgagggcactgccgtggcgccacctaccgtgactccggtcccaagcctggaagcgccgagtgaacaggcgcccactgagcaaagaccaggagtgcaggagtgttatcatggaaatggacagtcataccggggtacttattccaccacggtcaccggacggacttgtcaggcttggtcgagcatgaccccccacagtcattctcggacccctgagtactatcccaacgcagggctcataatgaattactgcaggaatccggatgccgtagccgccccatactgctacacaagggaccctggggtgcggtgggaatactgtaacctgacccagtgctccgacgccgaaggaacagctgtagctcccccaacagtgacacccgtgccgagtttagaagccccctcggaacaagctccaactgagcagcgaccaggcgtccaagagtgttatcacggaaacggccagtcctacaggggaacttactcaaccacggttaccggccgaacgtgccaggcatggtctagtatgaccccccacagccatagtcgcaccccagaatattaccctaacgccggtctgataatgaattattgcaggaacccggatgccgtggcagctccgtactgttacaccagagaccctggcgtgcgctgggagtattgcaaccttacccagtgtagcgatgctgaagggaccgccgtagcccctcccactgttacacccgtgccctctctcgaggccccatctgagcaggctcctactgagcagcggccgggcgtccaggagtgttaccacggaaatggacaatcatatcgaggcacttactccacaacagtaacgggccggacctgtcaggcctggtcaagcatgacacctcactcacactcccggactcctgagtattatccaaatgcgggactgattatgaattactgccggaatcctgatgcggttgctgccccatattgttacactagggacccaggcgtgaggtgggaatattgcaatttgacccagtgtagcgatgctgagggcaccgcggtggcacctccgacagtgacccctgtcccaagtctggaagcaccatccgagcaggcccccacggagcagaggccaggagtccaggagtgctaccacgggaatggccaaagttacagggggacctattctaccaccgtgacaggacgaacctgccaagcctggagctcaatgactccccattcccactcgagaacgcctgagtattatccaaacgcagggctgataatgaattattgtcgcaatccagatgcggtggcggccccttactgttacacacgggatccaggtgtacggtgggagtattgtaacttgactcagtgttcagacgctgagggcaccgccgtcgcaccacccactgttacccctgtcccaagtcttgaggcgccaagtgaacaggcccccacggagcagaggccgggcgtgcaggaatgctatcatgggaacggccagagctaccgcggcacctactctaccaccgtaacaggcaggacatgtcaggcttggtcctctatgacacctcacagtcacagccgaactccagagtactatcccaacgcaggcctcatcatgaattactgccggaaccctgatgctgtggcggccccatattgctacacaagagaccccggggtcagatgggaatattgcaacctgacccagtgctccgatgctgaaggtactgccgtggccccacccacggtcacaccagtgccttcattggaggcgccgtctgagcaggccccaaccgaacagcgccccggcgtgcaggagtgttatcatggaaacggacagtcctataggggtacatacagtactaccgtgacagggcgcacatgccaagcatggtcttccatgaccccgcatagtcacagccgcacacctgaatattatcccaatgccggcctgataatgaactattgtagaaacccagacgccgtggccgccccttattgttatacgagagatccaggcgtgagatgggagtattgcaacctgactcagtgcagcgacgccgaaggaaccgccgtggcccccccaacagttacacctgtgccatccttggaggccccatccgaacaggctcccacagagcagaggccaggagttcaggagtgttatcacgggaacggccagtcatatcgaggcacctacagcaccacagtcacgggaagaacctgtcaggcgtggagctctatgacccctcactctcattccagaacaccagaatattatcctaacgcgggcctgattatgaattactgcaggaatcctgatcccgtggctgccccctactgctatacccgagatcctagcgtgcggtgggagtattgcaatcttactcaatgttcagatgcggaaggcaccgcagtcgctccccccactataacaccgataccctcactagaggcaccctctgaacaggcgcccaccgagcagcgcccaggggtgcaggagtgttatcacggtaatgggcaatcataccagggtacatacttcatcacagtcacaggcagaacatgtcaggcttggtcctctatgactccacattcacactctcggacaccagcatactatcctaatgcaggcctgatcaagaactattgcaggaacccagatcccgtggcggcgccatggtgctacacaacagatccctcagtaaggtgggagtactgtaacctcacccggtgcagtgacgcggagtggactgcatttgtgcctcccaatgttatcctcgctccatccctggaagctttctttgagcaggctctaaccgaagagaccccgggggtgcaggactgctactatcactacggccagtcttatcgaggaacgtactctacaacagtgaccggacgcacatgtcaggcttggagttctatgacgccacaccagcacagcaggaccccggagaattatcctaacgcgggccttacccgtaattattgccggaatcccgatgccgaaatccgaccatggtgctacacaatggacccttcggttagatgggagtactgcaatctgacgcagtgtctcgtgacagagtcatccgtgcttgccaccctcaccgtggtccctgacccatctacagaggcgagttctgaggaagcacccacagagcaaagccctggcgtccaagactgttatcacggcgacgggcagagttatcggggttccttcagtacgactgttaccggaagaacctgtcaaagctggtcatccatgaccccgcactggcaccagagaaccacagaatactacccaaatgggggtctgacgagaaattactgtaggaatcctgacgctgaaatatccccctggtgctataccatggaccccaatgtacgctgggagtactgtaacctgacgcagtgcccagttacagagtcgagtgtcttggcgacaagcacggcagtgagtgaacaagcaccaaccgaacaaagccccacagtgcaggactgttaccatggggacggccagtcctatcgtgggagtttcagtacgacagtgacaggccgcacctgtcagagctggtcaagtatgacaccccactggcatcagaggaccaccgagtactaccctaacggtggcctcaccaggaactattgccgtaatcccgacgccgagatccggccctggtgctacacaatggacccttctgttaggtgggagtactgcaatttgacacagtgccctgttatggagtccactttgctgaccacgcctactgtggtgccagtgccttcaaccgagttgcccagtgaggaggcacctacagagaatagcacaggagtccaagactgttataggggggacggccagtcctaccgtggcacgctgtcaaccacgattaccggtaggacctgtcaaagctggagctccatgacacctcactggcacaggcgaatcccattatactatccgaatgcaggcttgactaggaactattgtcggaatccagacgccgagatccgcccatggtgctacacaatggatccttctgtaaggtgggagtattgcaacttaaccaggtgcccggtcactgaatcaagcgtgttgactaccccgacggtggctccagttccgtcaacagaggcccctagcgagcaggcaccacctgaaaaaagccccgtcgtccaggattgttatcatggtgacgggcgtagttacagaggcatctcctcgacaactgtaacaggcaggacctgccagagctggagttcgatgatccctcattggcaccagagaactcccgagaattaccctaatgccggtctaactgagaattactgcagaaacccggacagcggaaagcagccctggtgctacactacggatccctgcgtgcgatgggagtactgtaatctcacccaatgctctgagaccgagagcggcgtgctggagactccgaccgtggtcccagttccttccatggaggctcactctgaggcagctccaacagagcaaactcctgtcgtgcggcagtgctaccacggcaacggacaaagttacagagggacttttagtaccaccgtaactggcagaacttgtcaaagctggtcctccatgaccccacaccggcatcagaggactcctgagaattatcccaacgacggactgacgatgaactactgcaggaacccagatgccgataccggaccctggtgttttacgatggacccctccattcgctgggagtactgcaatttgacgcgctgttctgacacagagggcacagtcgtcgccccacctactgtgattcaagtccccagcctgggtcccccatccgagcaagattgcatgtttggaaatgggaaaggctaccgcggtaaaaaggcaactactgttacggggaccccatgtcaggagtgggccgctcaggaaccacatcggcactcaacctttattccagggaccaataaatgggccggactcgaaaagaactattgtcgtaaccccgatggagatatcaacggtccttggtgttacaccatgaaccctaggaagctgtttgactactgtgatatccctctctgcgcctcgtcatcttttgattgcgggaagccacaggttgaaccaaaaaagtgtccaggctctattgtcggcggttgcgtggctcacccccacagctggccttggcaggttagcttacggacgagatttggaaaacacttttgcggagggacactcatatcgcctgagtgggtgctgacggctgctcattgcctcaagaagtcaagccggccaagctcttacaaggtaatcttgggggcccaccaggaggtgaacctggaatcccacgtacaggaaattgaggtgagccgtctgttccttgaacctacacaggccgacatcgcattgcttaagctgtctagacccgcagtgattacagacaaggtgatgcccgcctgtctcccctctcccgactatatggttaccgcaagaaccgaatgctacatcactggatggggcgagactcaggggaccttcggtaccggcctactgaaagaggcccagctgctggtgattgagaatgaagtatgtaaccactataagtacatttgtgcggaacacctcgcacgaggtactgatagctgtcagggagactccggaggccccctggtatgttttgaaaaggataaatacattctgcaaggcgttactagctgggggttggggtgcgcgcggcccaataaacctggcgtgtatgcccgcgtctctcgctttgtgacctggattgagggcatgatgagaaacaactag

SEQ ID NO: 193479 - DNA, 6123 bp, Artificial Sequence
  Description of Artificial Sequence: Synthetic coding sequence
atggagcacaaggaggtggtgctgctgctgctgctgttcctgaagtcggcggccccggagcagtcacacgtggttcaggattgctatcatggcgatggccagagttataggggcacgtatagcactactgtgaccggccggacctgtcaggcctggtcttctatgacccctcaccagcataaccggactacggaaaattacccgaacgcaggattgataatgaactactgccgtaatcccgatgctgtcgccgccccctactgctatacaagagacccaggggtgagatgggagtactgcaatctgactcaatgttcggatgcggaaggtacggccgtggcccccccgaccgtaacacctgtaccatccctcgaagcccccagcgagcaggcgccgaccgaacagcgacccggcgtgcaggaatgctatcacggtaatggccagtcataccggggaacatactctacaacggtcactgggcgtacatgccaggcctggagctccatgactccacattcccacagccggacacccgaatactaccccaacgctggactgattatgaactactgcaggaatccagatgctgtcgccgcgccctattgctatacgagggaccccggagtcaggtgggagtattgcaatctgactcagtgctccgatgcggaggggactgcagtggctcctccaaccgtcacccctgtcccaagcctagaggctcccagtgagcaagcgcctaccgagcagcgacccggagtgcaggagtgttaccacggaaatggtcaatcttatagagggacatactccaccaccgtcaccggtagaacatgccaggcctggtctagcatgacccctcacagccacagccggacacccgaatattaccccaatgctggcttaattatgaattattgtaggaatccagacgctgtggccgcaccatattgttatactagggaccctggggttcgatgggaatactgcaacctcacacagtgttccgacgcggaaggcaccgctgtggcgccccccactgtgacaccggtgccatctctcgaagctccatctgagcaggctcctaccgagcagcgacctggcgtgcaggagtgctaccacggcaatggccagagctacaggggaacgtattccaccacagtcaccgggagaacctgccaagcctggtccagcatgacaccacattctcactctagaacccctgaatactaccccaacgccgggctgattatgaattattgccgcaaccctgacgctgttgctgcaccctactgttacactagggacccgggagtacgatgggagtattgtaatctgacacaatgctctgacgctgagggaaccgccgtcgctcccccaaccgtgaccccagtgcctagtttagaggcaccttccgaacaggccccaactgagcagaggccgggcgtacaggaatgctaccatggcaatgggcagtcatatagagggacttacagcacaaccgtcacaggcagaacatgccaggcctggtcatccatgaccccccactcacacagccgcacacctgagtactaccccaacgccggcctgattatgaactattgtcggaatcctgatgcggtggccgctccctactgctacactagagatcctggagtgaggtgggaatactgtaatcttacccaatgttctgacgcggaggggacagccgtggctccacccaccgtaacacccgtaccatcacttgaggccccctctgagcaggctcctaccgagcagcggccaggagtgcaggagtgttaccatgggaatggccagtcatatagaggcacctattcaactactgtgactgggcgcacttgtcaggcctggtcgtcgatgactccccatagccatagccggactccggagtattacccaaacgccggactaattatgaattattgtcggaacccagatgctgttgcagccccctattgttatactagagacccaggagtgcgttgggaatattgcaacttgacgcagtgctcggacgccgaggggaccgctgtcgctcctcccacagttacacccgtgccatctctcgaagctcctagtgagcaggcccccaccgaacagaggcccggggtgcaagaatgctatcatggtaacgggcagtcgtaccggggcacctacagcacaaccgtgactggcagaacttgccaggcgtggagctctatgacacctcacagccatagtcgcactccagaatattaccctaatgcgggcctcattatgaattactgtcgtaatcccgacgctgtcgctgctccctactgctatacccgagatccgggcgtgcgctgggaatattgcaaccttactcaatgctctgatgccgagggtaccgcagtggccccaccgaccgtgacccccgtaccctcgttggaagcccctagcgagcaggcgccaactgagcagcgtccgggtgttcaggaatgttaccacggaaatggacaatcgtaccgggggacttacagcaccacagttaccggtcgcacgtgtcaggcctggtcttcaatgaccccacattctcacagcaggacacctgaatactatccaaatgcaggactgataatgaactattgccggaacccggatccagttgcagcgccatattgctacactagagacccctcagtcagatgggaatactgcaacctgacccagtgctccgacgctgaaggtacagcggtcgcaccaccaactattaccccgattccatccctggaggcgccctccgagcaggcacccacggagcagcgtcccggggtgcaggagtgttaccatggcaatggccaatcctaccagggaacctactttattactgtgactgggagaacatgccaagcttggagtagcatgaccccgcatagccattccaggaccccggcctattatcccaacgccggcctcattaagaattactgtagaaatcctgatccagtggctgctccttggtgttatactacagatccaagcgtcagatgggagtattgcaacctaacaaggtgctctgatgccgaatggacagcttttgtgccccccaacgtgatcttggcaccatccctcgaggccttctttgaacaagccctcaccgaggagactccaggggtacaggattgctactaccactatggacagtcttaccgcgggacatacagtactacagttacaggcaggacctgtcaggcgtggtcttctatgacgccccatcagcattctagaacacccgagaattatcccaatgccggcctgactcgcaactactgccgaaacccagatgctgaaatccgaccatggtgttataccatggacccctcggtccgctgggagtactgcaacctaacacagtgtctagtgactgaaagtagtgttctcgccacactgacggtggtgcctgacccctccacggaagcctcctctgaggaagcccccaccgagcagtccccgggggtgcaggactgttaccatggggacgggcagagttacaggggaagctttagtacaaccgtcaccgggcggacttgccagtcttggagctctatgactcctcattggcaccagagaactaccgagtattatccaaacgggggcctgacccgtaattactgtcggaacccagatgccgagatctctccctggtgctacactatggaccccaacgtgcggtgggagtattgtaatctgacacaatgcccagtgactgagagttcagtcctggccacctctaccgccgtgtctgaacaggcacccacggaacaaagcccaacagttcaggactgctaccatggtgatggccagagctatcgagggtctttttctactacagtgacagggcgcacctgccaatcctggtcttctatgactccacattggcatcagcgtactaccgagtactaccccaatggcggactcaccaggaattactgtagaaacccggacgcggagatcagaccttggtgttacacaatggatccaagtgtccggtgggagtattgcaatctaacccagtgtccagtgatggagtcaaccttgctaacgacaccgacagtggtgcctgttccgtccacagagttgccttctgaggaagcccccaccgaaaattcgaccggggtgcaggattgttaccggggcgatggccagtcttaccgggggaccttatctacaactataaccggtagaacttgtcaatcctggtctagtatgaccccacactggcacagaaggatacctctgtactacccaaacgcggggcttacgaggaattattgccgaaatccagacgctgagattaggccttggtgctacacaatggaccccagtgtgcgctgggagtattgcaacctgacaaggtgcccagttactgaaagtagtgtactgacaaccccaactgttgctccagtgccatctactgaggccccttccgagcaggcaccacccgaaaagtcacccgtggtacaggactgctatcatggtgatggacgtagttatcgcggcataagctccacaacggtgacagggagaacctgtcagagttggagctccatgatacctcactggcaccagaggactccagaaaactacccgaacgccggtttgacagagaactactgtcgcaaccctgattccggcaaacaaccatggtgttacacaacggacccttgtgtgaggtgggagtattgtaatttgactcagtgcagtgagacggagtccggagtgctggagacacctactgtcgtacccgtcccttccatggaggctcatagcgaagctgctcctacggagcagactcctgtggtgcgtcagtgctatcatgggaatggacagtcctatcgcgggacattttctacaaccgtgacgggtcgtacctgtcaatcgtggagttccatgacgccccacagacatcagcggacccctgaaaactacccgaatgacggcctcactatgaattattgtaggaatccagacgctgatactggaccttggtgctttaccatggatccttccatccggtgggagtattgcaatttgactcgatgttccgacaccgagggaaccgtggtggctccacctacagtgattcaagtcccctccttggggccaccttctgagcaggactgtatgttcggaaacggaaaggggtatcgcggtaagaaagccacaactgtgactggcaccccttgtcaggagtgggccgctcaagagccccacagacatagtacgttcattcccggcacaaacaagtgggccggactggaaaaaaattattgtcgaaacccggacggggatatcaatggtccctggtgctatacgatgaaccctcgaaagctctttgattactgcgacattcctctgtgcgctagcagcagcttcgattgtgggaaaccccaagtggagcccaagaagtgccctggtagcatcgtgggcggatgcgtggctcatccacactcgtggccatggcaggtatccttacgaacacgcttcggaaaacacttctgtgggggaacgctgatttctcccgagtgggtccttacggctgcacattgtttgaagaagagcagccgcccaagcagctataaggtgattctcggagcgcaccaggaggtcaacttagagtcgcatgtccaggagatcgaggtttctaggctttttctcgagcctactcaagccgatatcgcattgcttaagctgagtcgcccggcagtcataacagataaggtcatgcccgcatgcctgcccagtcccgattacatggtgaccgcccgtaccgaatgctatatcacaggatggggagagacccagggcacgtttggcactggtctgcttaaagaagcccagttattagtcattgaaaacgaggtctgcaatcattacaagtatatatgcgccgagcatctcgcacgcggcacggattcgtgtcagggggacagtggaggtcctttggtgtgcttcgagaaggataagtacattctgcaaggggtgacttcttggggactcggttgcgcacgcccgaacaaacctggcgtgtacgcccgcgtatcccgtttcgtcacatggatcgaaggcatgatgagaaataattag

SEQ ID NO: 193480 - DNA, 4602 bp, Artificial Sequence
  Description of Artificial Sequence: Synthetic coding sequence
atgatgcagctgaccctgaacaccctgttccccgtggtgagcacccccgcaattacctacatcgtcacggtattcacaggtgatgtacgtggggccggtacaaaatcgaagatttacctggtgatgtacggcgcgcgggggaataaaaacagcggaaaaattttccttgaaggtggtgttttcgaccgtggacggaccgatatatttcacatagaacttgccgtcctgctatcccccctcagccgggtttccgtggggcacgggaatgtgggagtcaacagagggtggttctgtgagaaagtggttatactctgtccattcaccggaattcagcagacatttccctgctctaactggctggatgaaaagaaagccgatggattgattgaacgccagttatacgaaatggttagcctgcgcaagaaaagacttaaaaaatttccctggagcctgtgggtctggactaccgatctgaagaaagccggcactaacagcccaatcttcattcagatatatggccaaaaaggtagaacggacgagattctgcttaatccaaacaacaagtggttcaagcccggaatcattgaaaagtttcggatagaactgcccgacctcgggcgtttctataaaatccgggtctggcacgataaacgctcttccggaagcggctggcaccttgagaggatgactctgatgaacactctgaataaagacaagtataactttaactgtaatcggtggctggacgctaacgaggacgacaacgagatcgtcagggagatgaccgcggaaggtccaacagtacggcgcatcatgggcatggctagatatcatgtgactgtctgcactggagagttggagggggcaggcaccgacgccaatgtatacctgtgcctgttcggagatgtgggggatactggggagagattgctatataactgtcgaaacaatacagatctgtttgaaaaagggaacgcagatgagtttaccatcgagtccgtgaccatgcgaaatgttagacgagtgcgcattaggcacgacggaaaggggagtggatccggctggtacctggaccgggtgttggtcagggaggaggggcaaccagaatcagataatgtggagtttccctgcttgcgatggttggacaaggataaagatgacgggcagctagtcagggaacttctgcccagtgattcatctgctacactcaagaacttccgataccacatcagtctgaaaacaggcgacgtctcaggcgcgtccactgactctagggtatatattaagctgtacggagataagtccgatacaattaagcaggtgttgctcgtgtctgataacaatttgaaagattactttgaaagagggagggtcgacgagtttactttggaaacactcaatattggcaatattaaccgtttagtgatcggtcatgattctacagggatgcacgccagctggttcctcggctccgtccagatacgagtgccacggcaagggaagcaatacactttccctgcaaatagatggttagataagaaccaggctgacggcagactcgaagtggaactgtatccctctgaggttgtagaaattcagaagttggttcactatgaggtcgagatctggacgggtgatgtgggcggtgccggcacttcagcacgggtgtacatgcagatatatggagagaaggggaaaacagaagtgctctttctctcttccagaagtaaggtattcgaacgtgcgagtaaggatacattccagcttgaggccgcggacgtgggcgaggtgtacaagctgcgtttgggtcacacaggggagggcttcggacccagctggttcgtggatactgtctggctgcgtcatttggtagtgagagaagtggacttaaccccggaggaagaggccaggaagaagaaggagaaagacaagctgaggcagctgctaaaaaaagagaggctgaaggctaagctccaacggaagaagaagaagagaaaagggagcgatgaggaagacgagggcgaagaggaggagtcatccagcagcgaagaatcatccagcgaggaggaagagatggaggaggaggaagaggaggaggagtttggacccggcatgcaggaagtcatagaacagcacaaattcgaggcgcaccggtggctggcgcgaggcaaggaagacaacgagcttgttgtggagttagtaccagccggcaaacccggcccagagagaaatacttacgaggtgcaagtggttacaggaaacgtcccgaaggctgggacagatgctaatgtgtatcttaccatctacggagaagaatacggcgacaccggggaacgccccttaaaaaagagcgacaaaagcaacaagttcgagcaggggcagaccgacactttcacgatttacgctattgacttgggtgccctcaccaaaattagaattagacatgacaatacgggtaatagggccgggtggttccttgatcgcatcgacataaccgatatgaataatgagataacctactactttccctgccagcgctggctcgctgtggaggaggacgacggccagctctccagagaattactgccagtggacgagtcttatgtcctccctcagagtgaggagggcaggggaggcggcgataacaatcccctcgataatctagccttggaacagaaggacaagtctactacctttagcgtgacgattaagaccggggtcaaaaagaacgcgggaacagacgccaatgtcttcatcacgctcttcggaacccaggatgacacaggtatgacactcctaaaatcatctaagaccaatagtgacaaattcgaaagggactcaattgagatcttcactgtagaaacacttgacctcggcgatttgtggaaagtgcggttggggcatgacaacacgggcaaggcgcccggctggttcgttgactgggtcgaggtggatgcaccatcgctgggtaagtgcatgacctttccctgcggcagatggcttgcaaaaaatgaggacgacggatcaataattagggacctgttccacgctgagcttcagactaggttgtacaccccattcgtgccctatgaaatcaccttgtatacatctgatgtgtttgcagccggaaccgatgccaatatcttcattatcatatatggctgcgacgctgtgtgcacacagcagaagtatttgtgcacaaataagcgcgagcaaaagcagttttttgaacggaaatctgcatccagatttatcgtagaattggaagatgtgggagagatcattgagaagatccggatcggtcataataacacaggcatgaatcccggctggcactgcagccatgtagacatccggagactgctccccgacaaggacggcgctgagacgctgactttcccatgtgaccggtggctggcgacaagcgaggacgataaaaagaccatcagagaactagtgccctatgatatttttaccgagaagtatatgaaggacggcagtcttagacaggtttacaaagaggtcgaggaaccacttgatatcgtattatactctgtccagatatttacaggcaacattccaggagccggtacggatgctaaggtctatatcacaatttacggcgacctcggtgacactggcgagagataccttggtaaatcagagaatagaaccaacaagttcgaacgcggaacagccgacacttttatcattgaagccgcggatctgggagttatttataagatcaaactgcgccatgacaatagcaagtggtgcgccgactggtacgtggagaaagtggagatctggaatgacacaaacgaagatgagtttttgttcctgtgtggaaggtggttgagcctgaaaaaggaggatggccgactcgaaagactattctacgagaaggaatatactggagacaggtcttcaaactgctctagcccggccgatttttgggaaattgccctgtctagtaagatggctgatgtggatatttcaacagtgaccggccctatggccgattatgtgcaggaagggcccattatcccttactacgtgtcagtgacaacagggaaacacaaggatgcagcaaccgattctagagcttttattttcctgatcggcgaagacgacgagaggtctaagaggatatggctggactaccctaggggtaagcgagggttttccagaggaagcgtagaagaattttacgtcgcaggactggacgtgggtataatcaaaaagattgaggtgctctatgagatgactgtctggacaggcgatgttgtaggaggcggcacagactctaacatttttatgacactgtatggcatcaacggctctaccgaggaaatgcagttagacaagaagaaagccaggttcgagcgtgaacagaatgacacattcatcatggagatccttgatatcgccccatttaccaaaatgcgtatacggatagatggattaggatcgaggccagagtggttcctcgagagggtgaagtgcctggatcctcacagcagctttcagcctccgcccacaccctcaccaggaagctcgggcttgagcatggatctggtgaaggcgcagatgtctctatag

SEQ ID NO: 193481 - DNA, 5844 bp, Artificial Sequence
  Description of Artificial Sequence: Synthetic coding sequence
atgatgcagctgaccctgaacaccctgttccccgtggtgagcacccccgcaattacctatatcgtcaccgttttcacaggagatgtgcggggggccggcaccaaatcaaagatctatttggtgatgtacggcgctcgcggcaacaagaactcgggaaagatctttcttgaggggggagtctttgatagaggccgtacagatatattccatattgaactagcagtgctgctgtccccattgagtagggtgtctgttggccatgggaacgttggtgtgaatagaggctggttctgcgaaaaggtagttattctctgtccattcactgggatccaacagacgtttccctgcagcaactggctcgatgagaagaaggccgatggtctgatcgagcggcagctctatgagatggtcagcctgagaaagaaaaggttaaagaaattcccctggagtctttgggtgtggacaactgacctcaaaaaggcgggaacaaattctccaattttcatccagatttatggacagaagggtagaacggacgagattctgttgaaccctaataataaatggttcaagcccggcatcatcgaaaagtttaggatagaactacctgacttggggcggttctataagataagggtgtggcacgataagcgcagttcaggatctggttggcatctggagcggatgaccctcatgaacacactgaataaggataaatacaattttaactgtaatagatggctcgatgccaacgaggatgacaatgagatcgtcagggagatgacggctgaagggcccaccgtgaggcgcataatgggaatggctcgctatcacgttacggtttgtacaggagagcttgagggtgctgggacagacgctaacgtatacctgtgcctgtttggagacgtgggagatacaggagagagactgctctacaattgccgaaacaacaccgatctgtttgaaaaaggaaatgcagatgagttcacaatcgagagcgtcacaatgaggaacgtccggagagttagaatccggcacgacggcaagggatctggttcagggtggtacttggatagggtactcgtccgtgaagagggacaacccgagtccgataacgtcgaatttccctgcttgaggtggctggacaaggacaaggacgatggccagttagtccgcgaactgctccccagtgacagctctgcaacactgaagaatttcaggtaccacatctctctgaagaccggagacgtcagtggcgcgtctaccgactctagggtctacattaagttgtatggcgacaagtccgataccataaagcaggtcctgcttgtttccgacaataatctcaaagattattttgaacgtggccgagtggacgagttcacattagagacactgaacatagggaatattaaccggttagttataggacacgacagtaccggtatgcatgcaagttggtttctcggctcggtgcagatccgggtccctagacagggaaaacagtataccttccctgccaatcggtggcttgacaagaaccaggctgatggccggctggaagtggaactgtatccctctgaagttgtggaaatccaaaagctagttcactacgaggtcgagatatggacaggcgatgttggcggcgcgggcacatcagcacgcgtgtatatgcagatctacggtgaaaagggcaaaaccgaggtcttattcctcagcagccgttccaaggtctttgagcgtgccagcaaagatacctttcagttggaagctgctgacgtcggagaagtatataagctgcgattaggccacactggtgagggattcggcccgagctggttcgtcgatacagtctggctccggcatctagtggttcgggaagttgatttgactcccgaggaggaggcacggaagaagaaggaaaaggacaaactcagacagttgctgaagaaagagagactcaaagcgaagcttcagagaaagaagaaaaaaagaaagggttctgacgaggaggatgagggcgaggaggaagagagttctagctcagaggaaagttcatccgaggaagaggaaatggaagaagaagaggaggaggaagagtttggacctggaatgcaggaggtcatcgaacagcataaattcgaggcgcaccgctggctggcgagaggaaaggaagataacgagctggtggttgagctggtcccagcaggcaaaccgggtccagaacgcaacacgtatgaggtccaagtggtcaccggaaacgttcccaaagccggcacagatgcgaatgtgtatctgacaatctatggtgaagaatatggggataccggtgagcgacccctaaagaaatccgataaaagcaataagttcgaacagggccagacggatacctttaccatttatgcgattgatctgggtgccctaaccaagatccgaatccggcacgataacacagggaaccgggccggttggtttttggaccggatagatataaccgatatgaataatgaaataacgtactacttcccctgccaaaggtggcttgccgtggaggaggatgacgggcaactgtcaagagagcttctgccagtcgatgagagctacgtgctgccccagagcgaggagggccgcgggggtggcgacaataacccccttgataacctggcactggagcagaaggacaagtccaccaccttttctgtgaccatcaaaacgggtgtgaagaagaatgctggcacagatgcaaatgtgttcattacgctgtttggcacgcaggatgacaccggtatgacactgctgaaatcctcaaaaacaaattcggacaaattcgaacgcgactcaatcgagattttcaccgtggaaaccctggatctcggggatctctggaaagttagactgggccacgataatacgggaaaggcccccggatggttcgtggattgggtggaggttgatgccccgagcctgggcaagtgcatgacattcccctgtggtagatggctcgctaagaacgaagatgatggttccatcataagagacttatttcatgctgagctacagactcgactgtacacgccctttgttccctacgagataactctttacactagcgatgtgtttgccgcagggacggacgcaaatatttttatcatcatctacggatgtgatgccgtgtgcacgcagcagaagtacctctgcaccaacaagcgggagcagaaacagttcttcgagcggaaatcagccagccgcttcatagtggagcttgaagatgtgggggagatcattgagaagattcgtatcgggcataacaatacgggcatgaaccccgggtggcactgtagccacgtagacattcgtcgcttgctgcccgataaggatggagccgaaacccttacatttccctgtgaccgttggctggccacaagtgaagacgataaaaagacaatcagagagctggtgccttacgacatcttcacggaaaagtacatgaaggacggatcacttagacaggtatacaaggaggtggaggagcccctggacatagtgctgtactctgtgcagattttcacaggaaacattcccggcgctgggacagacgccaaggtttacatcaccatttatggcgatttgggcgacactggcgagcggtacttagggaagtccgagaacagaacaaataaatttgagcggggcaccgccgatacttttattatcgaggcggcggacttgggtgtgatatataaaattaagctgcgtcacgacaattccaagtggtgcgcagattggtacgtggaaaaagtggaaatctggaacgacacgaatgaggatgaattcttattcctgtgcggcaggtggctctctctgaaaaaggaggacgggcggctggaacgtctcttctacgagaaagagtatacaggcgaccgatcatctaattgttcttcccctgcggatttttgggagatagccctgtcgagcaaaatggcggatgttgacatctccacagttacaggccccatggccgactatgtgcaggaagggcccatcataccttactacgtcagtgtcaccacagggaaacataaggacgctgctacagactcccgggcattcatcttcctcattggtgaagacgacgagcgctctaagcgaatttggctcgactacccccgcggcaagcgcgggttctctaggggctccgttgaagaattctacgtagctggccttgacgttggtatcattaagaagatagagctgggtcacgatggagcaagtccagagtcctgctggctggttgaagaactttgtttggcggtgcctacacaaggtaccaagtatatgctcaactgtaactgttggctggccaaagaccgtggggacggaattacatcccgggtgttcgatctcttagacgctatggtagtgaacataggcgtgaaagtgttgtacgagatgacagtgtggactggggatgtggtcgggggcggaacagacagcaacatttttatgacgctgtacgggattaacggctcaacagaagagatgcaattagacaaaaaaaaggctcggttcgagagagagcagaacgacacattcattatggagattttagacattgctcccttcaccaaaatgcgcataagaattgatggattaggctcccgaccagaatggttcctcgaacgaattctcctgaagaacatgaatactggggacctaactatgttctattacggagactggcttagtcagaggaaagggaaaaagaccttggtttgtgaaatgtgcgcagtgattgacgaagaggagatgatggagtggaccagctacacagtcgccgtcaaaacctcggatatcctaggggccggcactgacgcaaacgtattcatcattatcttcggcgaaaacggggactcaggcacgctggcactgaagcagtcagcgaactggaacaaattcgaacggaacaacacagatacatttaactttcctgacatgctctccctcggccatctgtgtaaactacgggtgtggcacgataataagggaatcttccccgggtggcatctgagttatgtcgatgtaaaggacaactctcgcgatgaaacattccatttccaatgtgattgttggctgtccaaatccgaaggagatgggcagaccgtgcgggactttgcctgtgctaacaataagatctgcgacgagttggaggagactacatatgaaattgtcatagaaactgggaacgggggggagacacgcgagaatgtatggcttattctagaagggcgcaaaaaccggtctaaggagttcctaatggaaaactcctctaggcagcgggcattcaggaaaggtacaaccgatacattcgaattcgacagtatttatttgggagacattgcaagcctgtgcgtcggacatctagcccgggaggaccgctttatcccaaagagagagctcgcgtggcacgtgaagaccataacaattacagaaatggagtatgggaatgtgtatttcttcaattgtgattgtttgatccccctaaagagaaaacgcaaatacttcaaagtttttgaggtgacaaaaaccacggaatccttcgctagtaaagtccagtccctggttcccgtcaaatacgaagtcatcgtaacaaccgggtacgagccaggcgcaggaaccgatgccaacgtgttcgtgaccatcttcggggccaatggagacaccgggaaacgggaattaaagcagaaaatgagaaatttgtttgagaggggatccaccgaccggttcttcctcgagacccttgaactcgtagtgacgaggcttggcctggcggctgagtgcggctag

SEQ ID NO: 193482 - DNA, 3435 bp, Artificial Sequence
  Description of Artificial Sequence: Synthetic coding sequence
atgctgcggcacctgaccgacaccttcaccatctacgccatcgacctgggcgcgctgaccaagatccgcattaggcacgataacaccggcaatcgcgctggatggttcctggatcgtattgacatcacggatatgaataatgagatcacttactattttccttgccagaggtggcttgcagttgaagaggatgacggacagctcagtcgcgaactcctgcctgtggacgaaagttacgttctacctcagagtgaagaggggaggggaggtggggataataaccccttggacaacctggcactggagcaaaaagataagtctaccacattttcggtcacaatcaaaaccggcgtgaagaagaatgcaggtacagacgctaacgtttttattaccctgttcgggacacaggacgacacgggaatgaccctcctgaagagcagtaagactaatagtgataaattcgagagggattcaatcgaaatttttacagtggaaacattggatctgggggatctgtggaaggtccgcctgggtcatgataatactggcaaggcccccgggtggttcgtggactgggttgaagtggacgcacctagtctgggcaagtgtatgactttcccatgcggacggtggctggctaagaatgaggatgatgggagcatcatccgtgatttattccatgccgaactgcagacacgcctgtacaccccttttgtgccatatgagattacgctgtacacaagcgacgtcttcgcggctggcacagacgccaacattttcattattatttacgggtgtgatgcggtgtgtacccagcagaaatatctctgtaccaataagcgtgagcagaagcagttcttcgaacggaaatccgcttccagattcattgttgagttggaagacgttggagagatcatcgagaagatcagaatcggccataataataccggcatgaaccctggctggcattgcagtcatgtcgatattagacggctgctgcccgacaaggatggcgcagaaacactgacttttccgtgcgaccggtggctcgcaacttccgaggacgacaaaaaaacaatccgggaactggtgccatatgatattttcacagaaaagtatatgaaggacggcagcctcaggcaagtgtacaaagaggtcgaggaacccctcgacattgtactctattctgtgcagatcttcaccggtaacatcccaggagccggaacagatgcaaaggtgtatatcaccatttacggagatctgggcgacactggtgagcggtatctggggaagtctgagaacaggacgaataaattcgagcgtggaaccgccgataccttcattatcgaggcggctgacctgggcgtgatctataaaatcaagctgcggcacgacaatagcaagtggtgtgccgactggtatgttgaaaaagtggagatatggaacgacactaacgaggatgagttcttgtttctgtgcggacgatggctcagccttaaaaaagaagatgggaggctcgagagactattctatgagaaagaatacaccggcgatagaagttcaaattgttcttctccagctgacttctgggagattgccctttcatctaaaatggcagacgtcgatattagcacagtcaccggacccatggctgactacgtgcaggagggcccaatcattccatattacgtatccgttactactggcaaacataaagatgccgctactgacagccgcgcttttatcttcttgatcggtgaagacgacgaaaggtcaaaaagaatctggttggattaccctagaggaaaacgtggattcagccggggaagcgtggaagagttttacgttgccggtcttgatgtgggcataattaaaaaaattgaagttctgtacgagatgactgtgtggacaggcgatgtcgttggcggggggaccgattcgaatatttttatgacgttatacggcatcaacggatcaactgaggaaatgcagttggacaagaagaaagcgagatttgagagggaacagaatgacacattcatcatggaaatacttgacatcgctcccttcaccaagatgcggatccgcatcgacggcctgggttcacgtcctgaatggttcttggagcggatattattgaaaaacatgaacacaggcgatctgacaatgttctactacggtgattggttgtctcagagaaaaggaaagaagacgcttgtctgcgaaatgtgcgccgtaatcgacgaggaggagatgatggagtggacttcctatacggttgctgtaaagaccagtgatatcttaggggctgggacagatgctaatgtgttcattatcatctttggagaaaacggtgacagtggtacgctggctctgaagcaaagcgccaattggaataagtttgaacgcaacaatactgacacgtttaactttccggatatgctcagccttggccacctgtgcaaactcagagtctggcacgataacaagggcatctttcctggatggcatctcagttatgtagatgttaaggataacagccgcgatgagactttccacttccaatgcgactgctggctgtctaagtctgagggtgacggtcaaaccgtgcgggatttcgcatgcgctaacaacaagatttgcgatgagttagaggagacaacctatgaaatagtaattgaaacgggtaatggtggtgaaactcgtgaaaatgtatggttgatactggagggtcgaaagaaccggtccaaggagtttctgatggagaacagtagccgacagcgggccttcaggaagggaaccacggacaccttcgagttcgattctatttatctaggcgatatcgccagcctgtgtgtggggcatctggcacgcgaagatagattcatccctaagcgcgaactcgcgtggcatgtaaagaccatcacaattactgaaatggagtacggaaacgtgtatttctttaactgcgactgcttaattccactcaagagaaagagaaagtattttaaagtgttcgaggtcaccaaaactactgaatccttcgcaagcaaagtgcaaagcttagtgcctgtgaagtatgaagtcatcgtgacaaccgggtatgaaccgggtgcgggcaccgacgccaacgtgttcgttacgatttttggcgctaacggcgacacggggaagcgggagctcaagcagaagatgaggaatctgtttgagagaggatctacagatagattctttctggaaactctggaattaggggaactcagaaaggtgagactggagcacgacagctcagggtactgctctgggtggctcgtcgaaaaggtggaagtgacgaataccagcacgggcgttgctacgatattcaactgtggccgatggctggacaagaagcgtggcgatgggctgacctggagggaccttttcccaagcgtatag

SEQ ID NO: 193483 - DNA, 921 bp, Artificial Sequence
  Description of Artificial Sequence: Synthetic coding sequence
atgcggctgggcaccaactgcgagcacccccagctgcccctggccgctccgagcggctactactttccttgccagcgctggctggccgtggaggaggatgatggccaactgagtagggagctcctccccgtggacgagagttacgttttgcctcagtctgaggaggggagggggggaggtgataataatcctctcgacaatctggcactagaacagaaggacaagagcactacgttctccgtgaccataaagactggtgtgaaaaaaaatgccgggacagacgccaatgtcttcattaccctttttgggacacaggatgacaccggtatgacgcttctcaagagctcgaaaactaattctgacaaatttgagcgggactccattgagattttcacggtcgaaactctagacttgggagatctgtggaaggtgagactgggccacgataatacggggaaagccccaggctggttcgttgactgggtcgaggttgacgctccttctcttggcaaatgtatgacctttccttgtggccggtggcttgccaagaatgaggacgatggctccatcataagggatctattccatgccgagctccagacccgtctatataccccattcgtgccctatgagattacattgtacaccagcgatgtgtttgcggccggaaccgatgcgaatatctttatcatcatctacgggtgtgacgctgtttgcactcagcagaagtatctctgtaccaacaaacgggagcaaaagcagttctttgaacgtaagtccgcctcacggtttattgttgagctggaggatgtaggcgagataattgagaaaattcggatcgggcataacaataccggcatgaatcccggctggcactgctcacatgtggatattaggaggttactgcctgataaggactag

SEQ ID NO: 193484 - DNA, 6636 bp, Artificial Sequence
  Description of Artificial Sequence: Synthetic coding sequence
atgatgccccagaagaagcggcggcggaagaaggacatcgacttcttggccttgtatgaggctgagctgttgaactacgcttccgaggatgatgagggggagctggagcacgaatactacaaagccagggtatatgaagtggtcacagcaaccggtgatgtccggggcgcggggaccgatgccaatgtcttcatcactctgtttggcgaaaatggattatcacccaagctccagctcactagcaaatctaagagcgcttttgagaaaggtaatgtcgacgtgttccgagttaggacaaacaacgtaggcctgatttataaggtccgaatcgaacatgacaatactggcctgaacgcctcttggtacctcgaccacgttatcgtcacggacatgaagcggccacatctgcggtattacttcaactgtaataattggctttctaaggttgagggtgaccgccagtggtgccgtgatcttctcgcctcctttaatccgatggatatgccccgcggaaataagtatgaagtgaaagtctacacaggcgacgttattggggcaggtacggacgcggacgtctttatcaacattttcggggagtacggagataccggggaaaggcgcctggagaacgaaaaggacaactttgagaagggcgccgaggatcggttcattttggatgctcccgatcttgggcaactaatgaagataaacgtgggccacaacaacaagggcggctcagctggttggtttttatctcagattgtgattgaggatattgggaataagcgcaagtacgacttcccacttaatcgatggcttgcactggatgaagatgacggcaagatacagagagacatacttgtcggaggggccgagacgacagcaattacctacattgtgaccgtatttaccggggatgtgcgcggcgcaggtacaaagagtaaaatttatcttgttatgtatggggctcgcggcaacaagaatagcggaaagatcttcctggagggcggagtgtttgatagaggacggacggacatctttcatatcgaattggctgtgctgctcagtcccctctcccgggtgtctgtgggccacggaaacgtaggggtcaaccggggctggttctgtgaaaaagtcgttatcctctgccccttcaccggtatccagcagacctttccatgctccaattggctggacgagaagaaagcggacggtttaattgaaagacaactgtacgagatggtgtccctgagaaaaaagcgccttaaaaagtttccctggtcactttgggtatggaccaccgacctaaagaaagcgggcacgaacagcccgatctttatccagatatatggtcagaagggtcgcactgacgagattctgctgaatcccaacaacaaatggtttaagcctgggattatcgaaaaattccggattgagttgccagaccttggaagattctacaaaatccgggtttggcatgacaagcggagctcgggctctggctggcaccttgagaggatgactctcatgaataccctaaacaaggataaatacaactttaattgtaatcgctggttggatgccaatgaagacgacaacgagatcgtgcgggagatgactgccgagggcccgaccgtgcggcggattatgggcatggcccgctaccatgtcactgtctgtactggtgaattggaaggtgcaggaactgacgcgaatgtatatctttgcctgtttggcgacgttggagataccggcgagcgcctcttgtataactgcaggaacaataccgatctctttgagaagggcaatgcagatgagttcactattgaatcggtaactatgcgaaacgtcagaagggtgagaatacgccacgatggtaagggatctggaagcgggtggtatttggacagggtcctggtgcgggaggaaggccagccggaatccgacaatgtggagttcccctgtctgagatggcttgacaaggacaaggatgatggacaactagtcagagaactgctgcctagcgattctagcgccacgctaaagaacttcagatatcacatttccctcaaaacaggcgatgtgagcggcgcttctaccgatagtcgtgtgtacatcaaactatacggcgataaatctgacacaatcaagcaagtcctgctcgtgtccgataacaaccttaaggactatttcgaacgcggcagagtcgatgagttcaccctggaaacccttaatattggcaatattaataggctggtgatcggacatgactccacaggcatgcacgcgtcttggttcctgggaagcgtacagatccgcgtaccacgccagggcaagcagtatactttccccgcgaaccgatggttagataagaaccaggctgatggccgtctcgaggttgagctgtacccgagtgaagtggtggagatccagaagctcgtccattacgaagtggagatctggactggtgacgtgggcggggctggtacttcagcgagagtttacatgcagatatacggagagaaggggaagacagaagttctctttctgtcgagcaggagtaaggttttcgagcgagcatccaaggacacttttcagctggaggctgccgatgttggcgaggtttataaattgcgcctcggacataccggggagggctttggcccatcctggttcgtcgacactgtgtggttgcgccatttagtcgtgcgggaggtagacctcacccctgaggaggaagcccggaaaaaaaaggagaaggacaagctccggcagttgctcaagaaggagagactcaaggccaaactgcagcgcaaaaagaaaaaaaggaaagggtctgatgaagaagatgaaggcgaggaggaagagtcttcctcctctgaagaatctagcagcgaggaggaggagatggaagaagaagaggaggaagaagaattcggccctggaatgcaggaggtcattgagcagcacaaattcgaagctcacaggtggctcgctcgcgggaaagaagataacgaactggtagtggagctggtgcccgcaggaaagccagggcccgagaggaacacttacgaggtgcaggtagtgacagggaacgtgccaaaggctgggaccgacgcaaacgtgtatttaactatttacggagaggaatacggcgatacgggcgagcggcccctgaaaaagagcgacaaatccaataagtttgaacagggacagaccgatacttttaccatctatgccatcgatctgggggctctgacaaaaattcggatacggcacgataatacaggaaacagagccggctggtttctcgaccgcatcgatattactgacatgaataacgagattacctactattttccatgccagcggtggctggccgtcgaagaagacgatggtcagcttagtagagagttgctgcccgtggatgagagttatgtgctgcctcagtccgaagaaggccggggtggaggggacaacaatccattggacaatctggctctcgagcagaaagacaagtctactaccttcagcgtgaccattaagacgggtgttaaaaagaacgctgggacagatgccaacgtgtttataacactgttcggaactcaagacgatacagggatgaccctcttaaaaagctccaagactaactcagataagttcgaacgcgattccattgagatattcaccgtggaaaccctagacctgggggacttgtggaaagtgagactgggccacgacaataccgggaaagcacccggttggtttgtagactgggtggaggtcgatgctccatctctgggtaaatgcatgacttttccttgtggtagatggcttgccaagaatgaggacgacggctcaattatccgggacctgttccatgccgagctgcagacgcgcctgtatactcccttcgtgccatatgagattaccctatacacaagtgacgtgttcgccgccggtaccgacgccaatatatttatcatcatttatggttgtgacgctgtgtgtacccaacaaaagtatctgtgtacaaataagagagaacagaaacaattctttgaaaggaaatcagcctcgcggtttattgttgaactggaagacgtgggcgaaatcattgaaaagatccggatcgggcataataacaccggtatgaacccgggctggcactgctcccacgtggacatcaggcgcctgctgccggataaagacggcgctgaaacattgacatttccatgtgatcgttggctggctacctctgaagacgataaaaaaaccatcagggaacttgtcccttacgacatcttcaccgaaaaatatatgaaagatggcagcctgcggcaagtctataaggaggtggaagagcccttggacattgtcttatatagtgttcagatcttcacagggaatatacctggggcggggactgatgcgaaagtttacattacaatttacggggacctaggggacactggtgagcgctatctgggcaagtccgaaaatagaacaaataagtttgagagagggaccgccgacacctttataattgaggcggcggacctgggtgtgatctacaagatcaaactaaggcatgataacagtaagtggtgcgctgactggtacgtggagaaggttgaaatctggaacgataccaacgaagatgagtttttattcctgtgtggccgctggctatctcttaaaaaggaggacggcaggttggagaggctattttatgaaaaggagtacacgggggacagaagctccaactgttcttcgccagctgacttttgggagatcgcactttcttcaaagatggcggatgtcgacatatctactgtcaccggccccatggctgactatgtacaggaggggcctattattccgtactacgtgagcgtgacgacaggaaaacataaagatgccgctactgacagccgtgcattcattttcctgattggtgaagatgatgaacgatcgaaacgcatttggttagattaccctaggggcaaacgaggttttagccgcgggtctgtggaggagttctacgtggccggactcgacgttgggatcatcaaaaagatcgaggttctgtacgaaatgaccgtttggaccggggacgtagttggaggtggcacagactctaatatatttatgactctgtatggcattaatggaagcacggaggagatgcagctcgacaagaagaaggcacgatttgaaagggagcaaaacgatacctttattatggagatactggatatcgcacctttcaccaagatgagaatccgaattgacgggctcggaagcaggcctgaatggtttctcgaaagaatcctgctgaaaaacatgaacacaggcgaccttactatgttctactatggcgactggctgagtcaaaggaaggggaagaagaccttagtctgcgagatgtgcgcggtaatcgacgaggaagagatgatggagtggacctcttacactgtggccgttaagacttcagatatcctcggcgcagggaccgacgcaaatgtgttcataataatcttcggagagaacggagatagtggtacactggcactcaaacaaagcgctaactggaataaattcgagcgtaacaatacagatacttttaattttcctgacatgttgtctctgggccacctttgcaaacttcgtgtgtggcatgacaataaaggaatatttcccggatggcatcttagctacgtggatgtgaaagataactcgcgagatgaaactttccactttcagtgtgactgttggctgagcaaatctgaaggcgacgggcaaactgtccgtgactttgcctgcgccaataataaaatctgcgacgaactggaggagaccacctacgagatcgttattgagaccgggaacggtggtgaaacgcgagaaaacgtgtggctaattctggagggcaggaagaatagatccaaggagttcctcatggagaactccagtagacaaagagctttccgaaagggcaccactgatactttcgaattcgacagtatttacctgggcgacatagcgtcactgtgtgtcggccatctggcacgagaggacaggtttatcccaaaacgagagttagcctggcacgtgaagaccataaccatcacagaaatggagtacgggaacgtgtacttttttaactgtgattgcctgatacccctaaagagaaaacgcaaatatttcaaagtgtttgaagtgactaagacaactgagtcatttgcctctaaggtccaatccctggtcccagtcaagtacgaagtgatcgtgactacaggatatgagcccggggccggcaccgatgcaaatgtcttcgtaacgatcttcggcgctaacggtgacactgggaagcgcgagcttaagcagaaaatgcggaatctgttcgaacggggaagtacggaccgcttctttctggaaacgttagagctcggcgaactgcggaaggtgcgcctcgagcacgattcttctggttattgctctggctggctggtcgaaaaggtggaggtgacaaacactagcaccggcgtcgccaccatctttaactgcgggaggtggcttgataaaaaacggggggatggattgacgtggcgggatctgtttccctcggtctag

SEQ ID NO: 193485 - DNA, 3345 bp, Artificial Sequence
  Description of Artificial Sequence: Synthetic coding sequence
atgaacaacgagatcacctactacttcccctgccagcggtggctggcagtcgaagaggatgatggacagctctcgcgagaactcctgccagtcgatgaatcatatgtcctcccacagagcgaggaaggacgggggggaggcgataataacccattggataacctagcactggagcaaaaggataagagtacaacatttagcgtgactattaagaccggggtcaaaaaaaatgccgggaccgatgctaatgtttttatcaccctttttggaacgcaggacgacactggcatgactctgcttaagtccagcaagaccaacagtgataagtttgaacgtgactcaattgagatttttaccgtggagacacttgacctgggggatctgtggaaggtacgactgggccacgacaacactgggaaagcccctggttggtttgtggattgggtggaggtggacgcaccttccttgggaaagtgcatgaccttcccctgcggacgttggctggccaaaaatgaagatgacggttcaatcatcagagatctttttcacgcggaactccaaaccagattgtacacacctttcgtgccttacgagatcacattatacacgtccgacgtatttgccgctggcactgatgctaacatttttattattatctacggttgcgatgccgtgtgtacccaacagaagtacttatgcaccaataaacgcgagcagaagcagttcttcgagcggaagtcagcaagtcgatttattgtagagctagaggatgtgggagagattatagagaaaattagaatcggccacaataataccggtatgaatcctgggtggcactgctcgcatgtggacatccggcgactgcttcctgataaagacggggctgagacgctcacttttccttgtgacaggtggttagccaccagcgaggacgacaagaaaaccatcagggaacttgtgccatatgatatattcactgagaagtacatgaaagacggctctctgcggcaagtgtataaagaggtcgaagaacccctggatattgtcctgtattccgtgcaaatctttacgggcaacattccaggagctgggacggatgcaaaagtctacataaccatctatggggatttgggcgataccggagagaggtatctgggtaaatccgagaatcgcactaataagttcgaaaggggcacggccgacaccttcatcattgaggccgccgacctaggggtgatctacaagattaagctccgtcatgataactctaaatggtgcgccgactggtacgtggagaaggtcgagatctggaacgatacgaacgaggacgagtttctctttctgtgtgggcgctggctgagcctcaagaaagaggatggacgactcgagcggctcttttatgaaaaagaatataccggggatcgctccagcaattgttcttccccagccgatttttgggagattgcgctgtcttctaaaatggccgatgtggatatttccaccgtgaccgggcccatggctgactacgtacaggagggccccattataccttactacgtaagtgtgacaacaggcaaacataaggatgcagcgactgacagccgcgcatttatatttctgattggggaagatgacgagaggtctaagagaatatggttggattatccgcgcggaaaacgggggtttagtcgaggctccgtagaagaattttacgtcgccggcctggacgttgggattatcaagaagatcgagctgggccacgatggcgcatcgccggagtcatgttggctggtggaagagctttgcctggctgtcccgacccaaggcacaaagtacatgctaaactgtaattgctggctcgcaaaagatcgtggggatggcatcacctctcgggtcttcgacctgttggatgctatggtggtgaacatcggggtgaaagtgttatacgagatgactgtgtggacgggggacgtggtgggaggtgggaccgacagcaacatctttatgactctatacggcataaacgggtcgaccgaggaaatgcaacttgataagaaaaaagcgcgcttcgagagagagcaaaatgacacattcattatggagatattggatatcgctccctttaccaagatgagaatacgcatcgacggactgggcagccggccggagtggttcctggagaggatactcctgaaaaatatgaatacaggagacctgaccatgttctactacggtgactggctgtctcagcgtaaaggaaagaagaccctcgtatgcgagatgtgcgctgtcatcgatgaggaagagatgatggaatggactagttacacagtggccgtcaagacgtctgacatcttgggtgcggggactgatgcaaatgtgttcattattatcttcggtgagaacggtgacagtggaacgcttgccttgaaacagtccgccaactggaacaaattcgaacgaaataatacagacacgtttaactttcctgacatgttatctctgggccacttgtgcaaactgagagtatggcacgataataaaggcattttcccgggatggcacctctcctatgtggatgtgaaagacaattcccgcgacgaaacattccatttccagtgtgattgctggttaagtaagagtgaaggggacggacaaactgtgagggactttgcgtgtgcgaataacaagatctgtgatgaactggaggaaacaacatatgaaattgttattgagactggtaacggaggcgagacacgagagaacgtgtggctgatactagaaggcaggaagaaccggagcaaagaatttttaatggaaaatagtagcagacagcgcgctttccggaaagggactaccgataccttcgagtttgactccatctacctcggcgatatagccagcctctgcgtggggcatctggccagagaagatcggttcattccaaaaagagagctggcctggcacgtcaaaaccattactatcaccgaaatggaatatgggaatgtgtattttttcaactgcgactgcctcatcccactgaagaggaaacgcaaatattttaaggtgtttgaggtgaccaagacgacggagagctttgcttccaaggtccaatctctggtgcctgtgaagtatgaggtgatcgttacaactggatacgagcccggtgctggaacagacgccaatgtttttgtaaccatcttcggagctaacggtgataccgggaagagagaactgaagcagaagatgcgcaacttgttcgaacggggttccacagaccggttctttttggaaaccctagagctagtagtgacgagactgggcctggccgcagagtgtggatag

SEQ ID NO: 193486 - DNA, 1539 bp, Artificial Sequence
  Description of Artificial Sequence: Synthetic coding sequence
atgaccgtgtggaccggcgacgtggtgggcggcggcaccgacagcaatatcttcatgaccctttatggaattaacggctcaacagaagagatgcagttagataagaagaaagcaaggttcgagagagaacagaatgatactttcattatggaaatactggatattgcgcccttcacaaaaatgaggatacgtatagacggattggggtctaggcccgagtggtttctggagaggatattgctcaagaacatgaatacaggcgaccttacgatgttctactacggtgattggctttcacagaggaaaggaaaaaagacactggtgtgcgagatgtgtgcggtgatcgacgaggaggagatgatggaatggacgagttataccgtggctgtcaagacatccgatatccttggggctgggaccgatgctaacgtattcattatcatttttggagagaacggcgattcgggcacgcttgccctcaaacagtccgccaactggaataaatttgaaaggaataacaccgacactttcaactttcccgacatgctctctcttggacatctttgcaagctacgggtgtggcacgacaataaagggatctttcccgggtggcacctgagctatgtagatgtcaaggacaattctagagacgagacatttcacttccagtgcgattgctggctgtctaagagcgagggggacggacagacagtacgcgacttcgcgtgcgccaataacaagatctgcgatgagctggaagagacaacctatgaaatagtgatagagaccgggaatggcggtgaaacgcgggaaaatgtctggctgatactggaaggacgcaaaaatcgcagcaaggaattcttgatggagaacagctctcgccaaagagcctttcggaaaggcacaactgacacatttgagttcgacagtatctacctgggagatatagcatcactttgtgtcggccacctggctcgagaagacaggttcatcccaaagagggaactggcgtggcatgttaagacaatcaccatcactgaaatggagtacggcaatgtttacttctttaactgcgattgtctgatcccattgaagcgcaagaggaagtactttaaggtgtttgaggtcaccaaaaccacggagagtttcgcgtctaaggttcagagtctggtgcccgtaaagtatgaggtcatcgtgactaccggctacgagcctggagcagggaccgatgccaacgttttcgtaacgatttttggagcaaacggtgataccggtaaacgcgagctgaaacaaaagatgagaaatttgttcgaaaggggttctactgaccggttttttctggagaccctcgaactgggcgaactccgaaaggtgagattagaacacgatagctctgggtattgctccggctggcttgtcgagaaagtggaagtgaccaacacttcaacaggcgtggccacaatcttcaactgcggccggtggctcgacaagaaaaggggcgatggacttacttggcgtgatctctttccatctgtatag

SEQ ID NO: 193487 - DNA, 1374 bp, Artificial Sequence
  Description of Artificial Sequence: Synthetic coding sequence
atgaccgtgtggaccggcgacgtggtgggcggcggcaccgacagcaatatttttatgaccctatatgggataaacgggtctaccgaggaaatgcagctggataagaaaaaagctaggtttgagcgcgaacagaacgacactttcatcatggagatactagatatcgcgcctttcactaaaatgcggatccggattgatggcctgggaagcagacctgagtggttccttgaaagaatcctgctaaagaacatgaacaccggcgaccttacaatgttttattacggtgactggctgtcacagcgcaaaggcaaaaagaccctggtgtgtgaaatgtgtgccgtgattgacgaggaggagatgatggagtggacatcatatacagtcgccgtgaagacttcagatatcctgggtgctgggactgacgctaacgtctttataatcatttttggcgaaaatggcgatagtggcactctggcgcttaagcagtctgcaaactggaataaattcgaaaggaataacaccgacacctttaattttcctgatatgctgtctctcggccacctgtgcaagttgagagtttggcacgacaacaaaggcatttttcccgggtggcacttgagctacgtggatgtaaaggacaatagcagagatgagacattccattttcagtgtgattgctggctgtcgaagagtgagggagatggccagacagtacgcgactttgcctgcgccaacaataaaatctgtgacgaactggaagagaccacgtacgaaatcgtaattgagaccggcaatgggggggaaaccagagaaaatgtctggttaatcctcgaaggcagaaagaacagaagcaaggagttcctgatggagaacagcagtcgccagagagcattcaggaaagggacgacagacacattcgagtttgactctatatacctgggggatattgcgtcactgtgcgtgggtcacctcgcaagggaggaccgttttattcctaaacgggagctcgcctggcacgtaaaaaccatcaccatcaccgagatggagtacggtaacgtctacttctttaactgtgattgtcttattcctctaaaacggaagaggaagtacttcaaggtgtttgaggtaactaaaactactgaaagtttcgcctccaaggtgcagtcgctggtacccgtaaagtacgaggtgatcgttaccacgggatacgagcctggcgccggcaccgacgcaaacgtgttcgtgacaatcttcggcgccaacggtgacaccggaaaacgcgaactgaaacagaagatgagaaacctattcgagcgggggagcacagacaggttcttccttgagacactggagttaggagaactcaggaaatag

SEQ ID NO: 193488 - DNA, 1122 bp, Artificial Sequence
  Description of Artificial Sequence: Synthetic coding sequence
atgctgatccccttcagcatgaagaactgcttccagctgctgtgcaactgtcaggtgccggcagctggattcaagaaaaccgtcaagaacgggctaattctgcagtcaattagcaacgatgtgtaccaaaatctcgccgtggaggattggattcacgaccacatgaacctcgaaggtaaacccatcctatttttctggcagaacagtccttctgtggttatcgggcgacatcagaatccatggcaggagtgtaatttgaatctgatgagagaggaggggatcaagctggctcgtagaaggtctggcggggggacagtgtatcacgacatggggaacatcaatcttaccttcttcaccaccaagaaaaagtatgacagaatggagaatcttaaactgatcgtgagggctctgaatgccgtgcagcctcagttggacgtgcaggcgaccaaaaggtttgatttactgctggacggccagtttaagatctcaggtacagcgagcaaaatcggcaggactacagcctaccatcactgcacgctgttatgctcaaccgatggcacattcctttcctctttgttgaagagcccataccagggtattcgtagcaatgcgacggctagcatccccagcctcgtcaaaaacctgttggaaaaggacccaacattgacttgtgaagtgctgatgaatgctgtggccactgaatatgccgcctaccatcaaatagataatcatattcacctgatcaaccctacagacgagacattgttccccggaataaattctaaggccaaggaactacagacgtgggagtggatctacggcaaaacacccaaattctcaataaacacgtccttccacgttctctatgagcagtcccacctggagataaaagtgttcatcgacatcaagaacggtcgtatcgagatctgcaatattgaagcccccgaccattggctaccgctggaaattagagacaagttgaatagctcgcttatagggagcaagttctgcccaaccgaaactacgatgttgaccaacatactactacggacttgccctcaagatcacaaactgaactccaagtggaatatcctgtgtgaaaagatcaaggggataatgtag

SEQ ID NO: 193489 - DNA, 1122 bp, Artificial Sequence
  Description of Artificial Sequence: Synthetic coding sequence
atgctgatccccttcagcatgaagaactgcttccagctgctgtgcaattgtcaggtgcccgctgcaggctttaaaaagacagtaaagaacggcctgatccttcagtccatcagcaatgacgtgtatcagaacctggctgtggaggattggattcacgatcacatgaacctggaaggtaaacccatcctattcttctggcagaattctccatcagtggtgattgggcggcatcaaaatccctggcaggaatgcaacctaaacctaatgagagaagagggaattaaactggcgaggcgccgttcaggcggcgggacagtctaccacgatatggggaacataaacctcacattctttaccactaagaagaagtacgacaggatggagaaccttaaactgatcgtgcgggccctcaacgcggtacaaccacaactggatgttcaggctaccaaaaggttcgatctgctgctggatggacagtttaagatttctggcactgcatctaagattggacggacaaccgcctatcaccattgcactctgctatgctcaactgacggaaccttcctgtctagcctgctgaaaagcccatatcaggggatcaggtccaacgccacagccagcatcccctccttagtaaaaaacctgctggaaaaggaccccactctgacttgtgaagtcttaatgaatgccgtcgccactgagtacgccgcttaccatcagattgataatcatatccatctaatcaatccaaccgacgagaccctatttccgggaattaacagtaaggccaaggaactccaaacctgggagtggatctatggtaaaactcctaagtttagcattaacacgtcctttcacgtcctgtacgaacaatcccacttagaaatcaaggtgtttatcgatattaaaaatggccgcatagagatatgtaacatcgaggcgcctgaccactggctaccactagaaatcagagataagcttaattcaagtctgataggatccaagttctgcccaaccgagactaccatgctgactaatatcctccttaggacctgcccacaggaccataaactgaattctaaatggaatatcctgtgtgaaaaaatcaagggcatcatgtag

SEQ ID NO: 193490 - DNA, 1122 bp, Artificial Sequence
  Description of Artificial Sequence: Synthetic coding sequence
atgctgatccccttcagcatgaagaactgcttccagctgctgtgcaactgccaggtaccagccgcaggttttaagaaaacagtgaagaatggcttgatattgcaaagcatatccaacgacgtgtatcaaaacctggccgtagaggattggatccatgatcatatgaatctggagggaaagcctatactgtttttttggcagaactcaccttccgttgtgatcgggaggcaccagaatccttggcaggaatgtaatctcaacctgatgcgggaggaaggcatcaaactggcaaggaggcggtctggtggcgggaccgtctaccacgacatgggaaatattaatttgaccttctttactacaaagaagaagtatgacaggatggagaacctgaaactaattgtgcgggcgctcaatgctgtgcagcctcagctggacgtgcaagccaccaagcgatttgaccttctgctggatggccagttcaagatcagcggcacagcgagtaagattggacgcacaactgcttaccaccattgtaccctcctgtgtagtacagacggcactttcctttcttcactattaaagagtccttaccaggggattcggtctaacgctacagcatcaattccttctttggtgaaaaatctccttgaaaaagatcccaccctaacatgtgaggttttgatgaatgccgtggcgacagaatatgcagcctaccatcagattgacaaccacatccacttgatcaatcccactgatgaaacactgttccctggaattaactccaaggccaaggagctgcagacatgggagtggatatacggcaagacccccaaatttagtatcaatacgagtttccatgtgctgtatgagcagagccacctcgaaatcaaggtgtttatcgatataaaaaatggtcggattgaaatttgtaacatcgaggctcccgatcattggttgcccctggaaatacgcgataaactcaattcgtccctcatcggatccaaattctgccccacagaaactacaatgctgaccaacatcctgttaaggacctgcccacaggaccataagctgaattcaaagtggaatatcctgtgcgagaagatcaaggggataatgtag

SEQ ID NO: 193491 - DNA, 1122 bp, Artificial Sequence
  Description of Artificial Sequence: Synthetic coding sequence
atgctgatccccttcagcatgaagaactgcttccagctgctgtgcaactgccaggtccccgcagcaggttttaagaagacagtcaaaaacggtctgatcctgcaaagcatatccaatgatgtctatcagaacctggcagtggaggactggatccatgaccacatgaacctagagggaaagcccatactcttcttctggcagaactccccctctgtggttatcggaaggcaccagaacccatggcaggaatgcaatctaaacctgatgagagaggagggaattaaattagccagaaggcgctctggagggggaactgtttaccacgatatgggaaatattaatctgacttttttcacaacaaaaaaaaagtatgaccggatggagaatcttaaactgatcgtcagagcactgaatgcggtccaaccacagttggacgttcaggctaccaaacgcttcgacctactcctggatggacagttcaagatctctgggacagcatctaagattggcagaactaccgcttatcatcattgtaccctgttatgctccaccgatggcaccttcctctctagccttctgaagtctccatatcagggcattaggtctaatgctactgcctctattccttctctggtgaagaatctgttagaaaaagatcccacattaacgtgcgaggtattgatgaatgcagtcgcgaccgaatatgctgcttatcatcagatagataaccacattcatctcatcaaccctactgacgagaccttgtttcctggtataaattccaaggctaaggagctacagacctgggaatggatctatggaaaaacaccgaagttcagtataaacacatcatttcatgtgctctatgagcagtcacatctcgagataaaggtatttatcgacattaagaatggcagaatagagatttgcaacatcgaagcgccagaccattggctgccgctcgagattagggataaactaaacagtagtctgatagggagtaagttctgtcccaccgaaacgacaatgctgaccaacattttgctgcgcacgtgccctcaggatcacaagctgaacagtaagtggaatattctgtgcgagaagatcaagggcataatgtag

SEQ ID NO: 193492 - DNA, 1122 bp, Artificial Sequence
  Description of Artificial Sequence: Synthetic coding sequence
atgctgatccccttcagcatgaagaactgcttccagctgctgtgcaactgtcaggttccagccgcaggatttaagaaaactgtgaaaaatgggctgattctgcagtctatatctaacgatgtctaccagaacctggctgtggaggattggatacatgatcatatgaatcttgagggcaaacccatactctttttttggcagaactctccctcagttgtcatcgggagacaccaaaacccttggcaggaatgcaatctcaatctcatgcgcgaagagggcatcaagctggcccgaaggcggtccgggggcggcactgtgtaccatgatatgggaaatataaatctgaccttctttaccactaaaaagaaatatgacagaatggagaatctcaagctcatagtgcgagcactgaacgctgtgcagcctcagctggatgtgcaggccactaaacgctttgatcttctgttggatgggcagtttaagatctctgggactgcttccaagataggtcggacaacggcctatcatcattgtacgctcctgtgcagtacagacggaactttcctgtcatctcttctgaaaagcccttatcagggcatcagatccaacgcaactgcctcaatcccatccctggttaaaaacttgctggaaaaagatcctacacttacctgcgaggtactcatgaatgccgttgccacggagtacgctgcatatcaccagattgataaccacatccatttgattaaccccaccgacgaaacgttgtttcctggcatcaactcaaaagccaaggagttacagacttgggagtggatctacggcaaaacaccaaagttttctattaatacttcatttcacgtcctgtatgagcaatcccacctcgagattaaagtatttatcgacatcaagaatggacgaattgagatctgtaatatagaggcaccagaccattggctcccgcttgaaatccgagataagctgaatagcagtctgatcggcagtaaattttgccccacagaaacaacgatgttgacaaacattctgctgaggacatgccctcaggaccacaagctgaacagcaaatggaacatcctgtgtgaaaaaataaagggcatcatgtag

SEQ ID NO: 193493 - DNA, 321 bp, Artificial Sequence
  Description of Artificial Sequence: Synthetic coding sequence
atgctgatccccttcagcatgaagaactgcttccagctgctgtgcaactgccaggtccctgcagcaggctttaaaaaaacagtgaagaacggtttgatccttcagagcatatctaatgacgtgtaccagaacctcgccgtggaggactggattcacgaccacatgaacttagaagggaagccaatcctttttttctggcagaactcccccagtgtcgtgattggacggcaccagaatccttggcaggagtgtaacctgaatcttatgcgcgaagaaggcataaagcttgcacgccgtcgcagcggaggtggaactgtgtag

SEQ ID NO: 193494 - DNA, 756 bp, Artificial Sequence
  Description of Artificial Sequence: Synthetic coding sequence
atgctgatccccttcagcatgaagaactgcttccagctgctgtgcaactgccaagttccagctgcggggttcaagaaaactgttaagaacggcctgattctacagtccatttctaacgacgtttaccagaacctggctgtggaggattggatccacgaccatatgaacctggaaggcaagcccatcttattcttctggcagaattctcctagtgtggttatcggccggcaccagaacccctggcaggagtgtaacttaaacctcatgcgggaagaaggcatcaagcttgcccggcggaggagtggaggagggactgtgtatcatgacatgggtaatattaaccttacattcttcactaccaaaaaaaagtatgataggatggagaatctgaaattgatcgtccgcgcactcaacgccgtgcagccccagcttgacgtgcaagcgacgaaaaggttcgatctgctgctggatgggcagtttaagattagcggaacagcctccaaaattggacgaacgaccgcctatcaccactgtacgcttttatgcagcactgacgggacgtttctgagctcattgttgaaatccccctatcagggcattagatccaacgcaaccgctagtattccatctctggtcaagaatttgctcgaaaaggatccaactctgacctgcgaagtattgatgaacgccgtagcaaccgaatacgccgcctaccaccagatcgataaccacatacacctcattaatcccacatag

SEQ ID NO: 193495 - DNA, 120 bp, Artificial Sequence
  Description of Artificial Sequence: Synthetic coding sequence
atgctgatccccttcagcatgaagaactgcttccagctgctgtgcaactgccaagtacctgcagcaggctttaagaaaactgtcaagaatggactaatcctgcaatcaatttcaaactag

SEQ ID NO: 193496 - DNA, 408 bp, Artificial Sequence
  Description of Artificial Sequence: Synthetic coding sequence
atgctgatccccttcagcatgaagaactgcttccagctgctgtgcaactgccaagttcctgcagcaggcttcaaaaaaacggtaaagaacggacttattctgcagagtattagcaacgacgtgtaccagaacctcgctgtggaagactggatccatgaccacatgaatctcgaaggcaaaccaatactatttttctggcagaacagtccgtcggtggtgataggccgacaccagaacccttggcaggagtgtaatcttaacctgatgagggaggagggtattaaactggctcgccggcggtctgggggtggcacagtctaccacgacatgggcaacataaatctaactttctttacaacaaaaaagaaatacgacaggatggagaacctgaagctgatcgtcagatag

SEQ ID NO: 193497 - DNA, 5301 bp, Artificial Sequence
  Description of Artificial Sequence: Synthetic coding sequence
atgggcggcaagaacaagcagcggaccaagggcaacctgcggcccagtaattccggcagagctgctgagttgttggccaaagaacaggggactgtgcctggttttatcggattcggtacttctcagtctgacctcggatacgttcctgcaattcaaggcgcggaggaaatcgatagtctggttgactccgatttccgaatggtgcttaggaaactgtctaagaaggacgtgacaactaaactgaaggcgatgcaggagtttggcaccatgtgcacggaacgagatactgagaccgttaagggagtgttgccctactggccccggattttttgtaaaatctctctagatcacgatcgtagagttcgtgaagccacacagcaggccttcgaaaagcttatactgaaggttaagaagcagctggccccgtatctgaagtctctcatgggttactggctaatggcccagtgtgacacttacacaccggcagccttcgctgctaaggatgcattcgaagcagctttccctccatcaaaacagcctgaggcaatcgccttctgcaaggatgaaatcacctccgtgctgcaggatcacttaatcaaggaaaccccagacaccctatccgatccacagactgtcccagaggaagaacgtgaagcaaaattctaccgcgtggtgacatgtagtcttctggctctgaaaaggctcctatgtctccttcccgacaatgagctggattcgttagaggaaaaatttaagagcctgctctcacaaaacaaattctggaagtacggaaagcatagcgtccctcaaattcgctccgcctacttcgaattagtgtccgctctgtgccagagaatcccccagctgatgaaagaggaagcttccaaggtttcaccttcagtgctcctatccatcgatgactccgatcccatagtttgcccggcactgtgggaggcagtcctgtacaccttaactaccattgaggattgctggctacacgtgaacgctaagaagtccgtcttcccaaaactgtctactgtcatacgagaggggggtcgaggactcgctaccgttatttacccttatctgcttcctttcataagcaaactccctcagtccatcacgaaccctaagctcgactttttcaagaactttcttacaagtcttgtggccggcttgtctacagaacgcaccaagacatcatctctggaatcatccgcagtgatctccgcattctttgaatgtctaaggttcatcatgcaacagaacctcggcgaagaggaaatagagcaaatgttggtgaacgatcaactgatcccatttatcgatgccgtgcttaaggatccaggactccaacacggccaactgttcaatcacctggccgagacactttcgagctgggaggctaaggctgatacagaaaaggatgaaaagacggcccataaccttgaaaatgttctgatccacttctgggagaggctctcagagatatgtgtcgccaagataagtgaaccagaagccgacgtggaatctgttttgggtgtgtcaaacctgttacaagtcttacagaaaccgaaaagttctctcaagtccagtaagaagaaaaatggaaaggtcaggtttgccgacgagatcttagaaagtaacaaagaaaacgaaaaatgcgtctcatctgaaggtgagaagatcgagggttgggagctgacaaccgagccctccctgacccacaattcttctgggctgctgtccccactgagaaagaagcccttagaagacctcgtgtgtaaactcgctgatattagcattaattatgtgaatgagcgcaagtccgagcaacacttacggtttctgagcacgctgctagattcattttcttccagccgggtttttaagatgctgcttggggacgagaaacagagcatagtccaagccaagccattggaaattgcaaaactcgtccagaaaaatccagccgttcagttcctttatcagaagctcatcgggtggctgaacgaagatcagcgcaaggactttgggtttctagtagatatcctgtactcagccttgcgttgctgtgataacgacatggagcggaaaaaggtcctcgacgacttgacaaaagtagacttgaaatggaactccctactcaagattatagagaaagcatgcccaagttcagataaacacgcactcgtaacaccctggctgaagggcgacatacttggtgagaaactggtgaatctggcggactgcctttgcaacgaggatctcgaatcaagggtctcctccgagtcgcacttctcagaacggtggacactgctgagtcttgtgctgagccagcatgtaaagaatgactatctgattggggatgtatatgtggagcggatcatcgtgcgcctgcacgagacgctctttaagactaagaaactttctgaggcggaatcttccgactcctcggtctccttcatttgtgacgtggcatacaattatttcagctcggctaagggttgcctgttgatgccgtcgtcagaggacctgctgttgacccttttccaactctgtgcccaaagcaaagagaagacccacctgcctgattttctgatttgtaaactgaaaaacacttggttgtccggagtgaacctcctcgtccaccaaactgactcctcgtacaaggagtctactttcctgcacctctcagctctgtggctgaagaatcaggtccaggcatcatctctcgatatcaacagcctgcaggtgttactgtccgctgtggatgatctcttgaataccctgctggagagtgaagactcatacttgatgggggtgtacataggctcggtgatgcccaacgactccgagtgggagaagatgagacagagtctgccgatgcaatggctgcaccgcccgctcctggagggacggctgtccctgaattacgaatgtttcaaaactgactttaaagagcaggacatcaaaacactgccgagtcacttatgcacctcagcactgctgtctaagatggttctgatcgccctgcggaaagagacagtacttgaaaacaacgagctagagaagatcatcgctgagctgctctatagcctccagtggtgcgaggagctcgataacccaccaatctttttgatcggattctgtgaaatactccagaaaatgaacatcacctatgacaatttgcgcgtgctggggaacacctccggactcctgcagctactgttcaatcgctccagagaacatgggactttatggtctctgatcatagccaagcttatcctgtcccgctccatttccagcgacgaggtcaaaccacattacaagaggaaggaatcattcttccccctgaccgaaggaaacctccacaccatccagtccctgtgcccgttcctctctaaggaagaaaaaaaagaattcagtgcccagtgcattcccgcgttactagggtggaccaagaaagatttatgtagcacaaatggcgggttcggccacctggccatttttaacagctgtctccagactaagtcaatcgacgatggagaactgctgcatggaatcttgaagatcatcattagctggaaaaaggaacacgaagacatctttctctttagttgtaatctttcagaggcgagtcccgaagtcctcggggtcaacatcgaaataatacgctttctgtccctctttcttaagtattgcagtagtcctctggcggaatcagaatgggacttcatcatgtgcagcatgcttgcttggttggaaactacgtctgaaaatcaggccctgtatagcatccctctggtgcagctttttgcctgtgtatcttgtgatctcgcatgtgacctcagtgcttttttcgatagcactaccctcgacaccatcgggaatctgcccgttaacttaataagcgaatggaaggagttcttcagccagggcattcactccttgttgttgcccattttggtcactgtaaccggggaaaacaaggacgttagcgagacttctttccagaacgctatgctcaaacctatgtgtgagactctcacatatatcagcaaggagcagctcctatcccataagctgccagccaggctcgttgccgaccagaaaactaaccttcccgagtatctgcagacgttactgaatacactcgctccactgctgctgttcagagcacggcctgtccagattgcagtctatcatatgttatataagttaatgcccgaactacctcagtacgaccaggataatctgaagagctatggggatgaggaagaggagcctgcactttcaccccctgctgcactgatgagcttgcttagcattcaggaggatttgctggaaaacgttctgggatgcattccagttggtcaaattgtaacaattaaacctctcagtgaggacttttgttacgtgctggggtacctgctcacgtggaagttgatcctcaccttctttaaggcggcctcatcacagcttagggcgctctattctatgtatctgcgcaagactaagtcccttaacaaacttctttatcacctgtttcgcctcatgccggagaacccaacatacgcagaaacagcagtggaagtgcccaacaaggaccctaagacctttttcaccgaggagctacagctcagcatccgcgaaacaaccatgctgccctaccacataccacacttggcctgcagtgtgtaccatatgacactgaaagacctgcccgccatggtacggctctggtggaattcctctgagaagcgggtcttcaatatagtggaccggttcaccagtaaatatgtctctagcgtcctttccttccaggaaatctcttccgtccaaactagcacccagctcttcaacggaatgactgttaaagcaagggctactacacgagaagtcatggctacctacaccattgaagacattgttatagagctcatcattcaactccccagtaattaccccctagggtcaattattgtggagtcaggcaaaagagtgggtgtggccgtccagcagtggcggaactggatgctacagttatccacttaccttacgcaccagaacggctcaatcatggaaggattggcactctggaaaaataatgtcgacaagagattcgaaggcgtggaggactgcatgatatgcttctcagtgatacacggatttaattatagcctgcccaagaaagcctgtcgcacctgtaaaaagaaattccattcagcatgcctgtacaaatggttcacctcttctaacaagtccacctgcccactgtgccgcgaaacgtttttctag

SEQ ID NO: 193498 - DNA, 1443 bp, Artificial Sequence
  Description of Artificial Sequence: Synthetic coding sequence
atgggcggcaagaacaagcagcggaccaagggcaacctgcggccctccaatagcggacgcgccgctgagctgctggccaaggagcagggcaccgtgcccggcttcataggcttcgggaccagccagagtgacctgggatacgtgccagctattcagggggctgaggagatcgattccctggtggactccgatttcaggatggtgctcaggaaactgtcaaaaaaagatgtcactacaaaattgaaagccaacgccatgcaagagttcggtacaatgtgcactgagagagataccgagaccgtaaagggtgtgcttccatactggcctagaattttctgtaaaattagtcttgaccacgatcggcgtgtgagggaagcaacccaacaggcatttgaaaagctgatcttaaaagtgaagaagcagctggccccttacctcaagtctctgatgggatactggctcatggcccaatgtgacacctatacaccagctgcgttcgctgccaaggacgcgtttgaagctgcattcccaccctctaagcagcctgaggctattgctttctgcaaggatgagatcactagcgtgttacaggaccatttgatcaaggaaacacctgacacattgtccgacccccaaacagtgccggaggaggagcgtgaggccaaattttacagagttgtgacctgttcgctgctggcactcaaacgcctgctgtgcttactacccgacaatgagctggactctttggaggaaaagttcaaatcattactgagccagaacaagttctggaaatacggtaagcattcagtgccccaaataagaagtgcatatttcgaactggtctcagccctttgtcaaagaatacctcagctcatgaaagaggaagcctcaaaagtttctccctcagttttgctctccattgacgattccgacccaattgtctgcccagccctctgggaggccgtcctgtatacactcactaccatcgaggattgttggctccatgtgaacgcaaaaaaaagtgttttcccgaagctttctacagtgatcagggagggcggacgggggctcgccaccgtgatctacccttacctattgcctttcatcagcaaactaccgcagtcaatcacaaacccaaaattggattttttcaaaaattttctgacctcccttgtggcaggccttagcaccgagcgtacaaaaacttcgtcgctggagagcagcgcagtgatatccgctttttttgaatgcctacgtttcatcatgcagcagaacctgggagaagaagagatcgagcagatgctggtcaacgatcagcttatccctttcatcgacgccgtgctgaaggatccaggcttacagcatggtcagctctttaatcatctcgccgagactctttcttcttgggaggccaaggctgatacagaaaaggatgagaagtag

SEQ ID NO: 193499 - DNA, 5439 bp, Artificial Sequence
  Description of Artificial Sequence: Synthetic coding sequence
atggaccgggtgggcggcggcaagggccccggcggcagctactaccgagtgagttcctccgccgcccgctccaggaagctctgccccgggcgagtaaacagaggactgtccgcccaatctacagcagccacagcaactatggggggcaagaacaagcaacgcacaaaaggcaacctccggccttctaactcaggccgagctgcggagctgctggccaaggaacaggggaccgtacccggcttcattgggtttggcacatcccaaagcgacttggggtacgtgcccgctattcaaggtgccgaagaaattgattccctagtcgactctgattttaggatggtgctccggaaactgtcaaaaaaggatgtgactaccaagctgaaagctatgcaagagttcggcaccatgtgcaccgagcgcgataccgagacagtgaaaggcgtgctgccttactggccacgtattttttgcaaaattagcttagaccacgatagaagggtgcgggaggccactcagcaagcatttgagaagctgatcctcaaagtcaaaaagcaactggccccgtacttgaaatcacttatgggatactggctgatggcccaatgcgacacgtataccccggcagctttcgcagccaaggacgcattcgaggctgccttcccaccctccaagcagcccgaggcgatcgccttctgtaaagatgagattaccagcgtccttcaggaccatcttatcaaagaaaccccagatacattgagcgaccctcagaccgtgccagaagaggagcgggaggccaaattttatcgcgtagtgacctgtagcttacttgctctgaagaggctgctctgtctgctgcccgataacgagcttgactcactggaggaaaagtttaaatcgctgctctcccagaacaaattctggaagtacggcaagcattcagtcccccagatacgctctgcttattttgagctggtgtccgctctgtgccagcgcatcccacagctgatgaaggaggaggctagcaaggtgtctccaagtgtgctgttgtcaattgatgactctgacccgatcgtgtgtccagcactgtgggaagcagtgctctacaccctgaccactattgaggactgctggctgcacgtgaatgcaaagaagagtgtgtttcccaaactgagcaccgtcattagagaaggcggacgaggcctggctaccgtgatctatccttatcttcttccatttattagcaagttacctcagagcataacaaatcccaagctagatttctttaagaattttctgacctccttagtcgcgggcttaagcactgagcgcaccaagaccagctcgctggaaagctctgctgtgatctcagcattcttcgaatgcctgagattcataatgcagcagaacttgggtgaggaagagatcgagcagatgctggtgaatgaccagttgattccattcattgatgccgtcctgaaggacccaggtctgcaacacgggcagcttttcaaccatctagctgagacgttgtcatcatgggaagctaaagctgatacggaaaaagacgagaagacagcacacaacttagagaacgtgctcattcacttctgggaacggctgtctgagatctgtgtggccaagatcagtgagcctgaagccgacgttgagtccgtgctgggcgtgtcaaacctcctccaggtgctacagaagcccaaatcgtcactgaagtccagtaagaaaaaaaatggtaaggtccgcttcgctgacgagattctggagagcaataaggagaacgagaaatgcgtctcttctgagggagaaaagattgagggatgggagttgacaaccgaaccctccctgactcataactcctctgggctgttgtcaccactgcggaagaaaccgctggaagatctggtatgcaagctcgccgatatttcgatcaactatgtgaacgagcggaaaagcgagcaacatcttagattcctttcgactctgttggacagcttctcttccagccgcgtattcaaaatgcttctcggtgatgaaaaacagtcgatagtgcaggccaagccactcgaaatcgccaagctggttcaaaagaacccggccgtgcagtttttgtaccagaaattgattggctggctcaacgaggaccagcgcaaagactttggcttcttggtggatattctttactcagccctccggtgttgcgataacgatatggaaaggaagaaggtgctggatgatcttacaaaagtggatctaaaatggaattcactcctgaaaataatagagaaagcatgcccctcgtcagacaaacacgctttggtcaccccgtggttaaaaggtgatatcctgggcgagaaattggtgaatctggccgattgcctgtgcaacgaggatttggagtccagagtctccagtgaaagccacttctctgagcggtggactcttcttagccttgtgctgagtcagcatgtgaaaaatgattacttaataggcgatgtgtacgtcgagcgcattatcgttagattgcatgagactctgttcaaaacaaagaaactgtccgaagctgagtcttctgactcttccgtatcgttcatttgtgatgtggcgtataactactttagcagcgccaaaggctgcctgctgatgcccagttctgaggatcttttactgaccctctttcaactctgtgctcagtccaaggagaagacccacctacccgattttctgatttgcaaattgaagaatacctggttgtcgggtgtgaatctgttggtgcaccagactgactcatcctacaaagagtccacattcctccacctgtcagctctgtggctcaaaaaccaggttcaggctagttctctcgacataaatagcctccaggttttgctgtctgcagtggatgaccttttaaacaccctgctagaaagcgaggactcatacctgatgggcgtctatattggttccgtgatgcccaatgattcggaatgggaaaaaatgcgccagtcattacctatgcagtggttacacaggcctctcctcgagggacgacttagtctcaactatgagtgcttcaaaactgattttaaggaacaggacatcaagactctaccttcccatctctgtacctcggccctgctaagcaaaatggtgttaattgccctgagaaaggagaccgtgctggagaataacgaacttgagaaaataatcgcagaactcctctattcactacagtggtgcgaagaattagataaccctccaatctttttgattggattttgtgaaatcttgcagaaaatgaacataacttacgacaatcttagggtcttaggaaacacgtctggtcttctgcagcttctcttcaatcgaagccgagaacacgggactttatggtccctcataatcgccaagctgatcctctcccggagtatctcctctgatgaagtcaagccacattacaaaagaaaggagagtttcttccccctgactgagggtaacctccacacgatacagtcactgtgtcctttcttgagcaaagaagaaaaaaaggagttcagcgcccaatgtatccccgccttgttaggatggactaaaaaggatctctgctcaaccaacggcgggtttggacatctggcaattttcaacagttgcctccagacaaaatctatcgacgacggtgagctcctgcacggcatcctgaagatcatcatcagttggaagaaggagcatgaggacatcttccttttcagctgtaacctgagcgaggcaagcccagaagttcttggagtcaatattgaaataatccgattccttagcctgtttctgaaatactgttcctcccctctggccgagtccgaatgggactttattatgtgtagcatgctggcctggctggagaccactagtgaaaaccaggccctttactcaatccctctagttcagctattcgcttgtgtttcatgtgatcttgcgtgtgacctatctgctttctttgatagtacaacacttgataccatcggaaacttgcctgtgaacttgatttctgagtggaaagaattcttttctcaggggatccacagtctgctgttgcccatattagtgaccgtgacgggcgaaaataaagatgtgtctgagacttcgtttcagaatgcaatgctgaagcctatgtgtgagaccctgacatacatcagtaaggaacagctcttaagccacaagctgccagcacggctggttgcagatcagaagacgaatctgccagagtatttgcagacactgctgaatacgctcgctccgcttctgttgtttagagcgagacctgtgcagattgctgtgtatcatatgctgtataaactcatgcccgagctgcctcagtatgatcaagataatctgaagtcatatggagacgaagaggaggaacctgcgcttagccctccagcggcactgatgtcccttctgagtattcaagaggatcttctggaaaatgtactgggctgcattcctgtgggccaaattgttaccatcaagccactgtcggaggacttctgttatgttcttggttatcttcttacgtggaagcttatcctgacgttcttcaaggctgcgagttctcagctcagagccctctacagcatgtatttgcgcaaaactaaatcgttaaacaagttgttataccatctcttcagactgatgccagagaaccctacctacgccgaaacagcagtcgaagttcctaataaagatcccaagacctttttcacggaagagctccagcttagtatccgcgagaccaccatgctcccgtatcacattccacacctggcctgctccgtatatcacatgacactaaaagatctgcccgcaatggtgcgtctttggtggaatagcagtgaaaagcgagtcttcaacatcgtggaccggtttacttccaagtacgtatcttccgtcttgtcttttcaggaaatttcatctgtgcagacgagcacccaactcttcaacggcatgactgtgaaggccagggccaccacccgggaggttatggcaacctacacgatagaggatatcgtcattgagctcattatccagctccctagcaattatccattgggatcaatcattgtggaaagcggtaagagagtgggtgtggcagtccagcagtggaggaactggatgctgcagctctctacgtatcttacccatcagaacggtagcatcatggagggtctggcgctgtggaaaaacaatgtggataagcgattcgagggcgtggaagactgcatgatttgcttctcagtcatccacgggtttaactattccttgcctaagaaggcgtgtcggacctgcaagaagaagttccactccgcatgcctttataaatggtttacttcatccaacaagtctacttgtcccctgtgccgagaaaccttcttctag

SEQ ID NO: 193500 - DNA, 1404 bp, Artificial Sequence
  Description of Artificial Sequence: Synthetic coding sequence
atgaagaaccagaacggcaccttcaaggactgggccaacgccaacgtgtcccgccaaatagaggatactgtgctgtacggctactatacattgtacagcgtgattctcttctgtgtgttcttttggattcccttcgtttacttctactatgaggagaaggatgacgatgacacttccaaatgcacacaaatcaaaaccgccctcaaatataccttaggcttcgttgtgatctgtgctctcttgcttctcgtgggtgccttcgtacccctgaacgtgccaaataataagaatagtacagaatgggaaaaagtcaaaagcctgtttgaggagctcggatctagccatgggctggccgcgctaagtttttcgatctcctctctaacactcattgggatgttggccgcgattacctataccgcatatggcatgtctgctctgcccctgaatctgattaaggggactaggtctgccgcctatgaacggctggaaaacactgaagatattgaagaggttgaacagcatattcaaacaatcaaatctaaatcgaaggatggccgccctttaccggcacgagacaagagagctttgaagcagtttgaggagagattacggaccctgaaaaagcgagagaggcacctggagtttatcgagaactcgtggtggactaaattttgtggggctctcaggccactcaagattgtttggggtatcttctttatcctggtggctctgttattcgtgatctccctgtttctctccaatctagacaaggctctgcacagtgctggcatcgactcgggctttattatcttcggagcaaatctctctaaccctctgaacatgctgctccctctactgcagacagtgttcccgctagattatatcctcatcaccatcattatcatgtatttcatttttacaagtatggcaggcataaggaacataggcatttggttcttctggattcgtttatataaaattagaaggggaaggacccggccgcaggcactgctgtttctatgcatgatcctcctgttaatcgtcctccacacatcttatatgatatatagccttgccccgcagtatgtgatgtacgggtctcagaactatttaattgaaaccaacattaccagcgacaaccataaggggaactctactttgtcagtgcctaagcgctgcgacgcagatgctcctgaggaccagtgcacggtgacccgcacctacctgttcctacataaattttggtttttctccgctgcctactattttggcaattgggcctttctgggcgtgttcctgattggtttgatcgtcagctgttgcaagggaaaaaagtccgtaattgaaggagttgatgaggatagcgatatatccgacgatgagccgtcggtatactccgcatag

SEQ ID NO: 193501 - DNA, 1623 bp, Artificial Sequence
  Description of Artificial Sequence: Synthetic coding sequence
atggccaccagcggcgccgccagcgccgagctggtgatcggctggtgtatcttcgggctcctcctgctcgccattctagctttctgctggatctacgttcgcaaataccagtcccgacgggagtcagaggtggtctctacaatcactgcaatattctcattggccatcgccttgatcacatctgcgttacttccagttgatatcttcctggtctcttatatgaagaatcagaatggtacattcaaggattgggccaacgctaacgtatctcggcagatagaagataccgtcctgtacggctattatacactgtactccgtgattctgttctgcgtctttttctggatcccgtttgtctacttctattacgaggaaaaagacgacgacgacacgtcaaagtgcacccagatcaaaacggctcttaagtacacgttaggcttcgttgttatatgtgctctcctgttgctcgtgggcgcctttgtcccattaaacgtccctaataacaaaaactctaccgaatgggaaaaggtgaagtctctctttgaggagctggggagtagccacggactcgcggccctgtccttttcgatcagctctctgacactcattggaatgctcgctgctatcacttatacagcctacggcatgtccgccctgcctctcaacctgattaaggggaccaggtcagcggcctacgagcgcctcgagaacactgaggatattgaggaagtcgagcagcacatacagacaataaaatctaaaagcaaagatggtagaccactgcctgcgcgggacaaaagagccctgaagcagtttgaggagcgtctcaggacactgaagaagagagaacggcatctggagttcattgagaatagctggtggactaaattttgtggcgcgctccgaccactgaagatcgtgtgggggatcttcttcatacttgttgcgctcctttttgttataagcctctttctctccaatttggataaggctctccacagtgcgggcattgattctggttttatcatctttggcgctaatctgagcaatcctctgaacatgctcctccccctgctgcagaccgtgttccccctggactatatcctgatcacgatcattattatgtacttcatattcacctcaatggctggcatcagaaatatcggtatatggttcttttggatccggttgtacaaaatcagaagagggagaacgcgcccccaagcattgctgtttctttgtatgatcctgttgcttattgtcctgcatacatcctatatgatttacagtctggccccccagtacgtgatgtatggcagtcaaaactacctcatagaaaccaatataacatctgacaaccacaagggtaactccacgttgagcgtaccaaaaagatgcgacgccgatgctccggaagaccagtgcacagtgacgagaacatatctctttctgcacaaattctggtttttctctgccgcctattactttggcaattgggcgttcctgggcgtttttctgattggcctgatcgtgtcttgctgtaagggtaagaagtccgtgatcgaaggcgtggatgaggatagcgacatttctgacgacgagccctctgtctatagtgcttag

SEQ ID NO: 193502 - DNA, 939 bp, Artificial Sequence
  Description of Artificial Sequence: Synthetic coding sequence
atgagctaccagaagaagcagcccaccccccagccccccgtggactgcgtgaaaacctccggtggtggcgggggcggggggggctccggcggtggggggtgtgggttctttggcggcggtggatctggcgggggctcgtcagggtctggctgcggttactcaggtgggggcggctacagcggcgggggctgtggaggggggagctccggaggggggggcggaggcgggattggggggtgtggaggaggaagtgggggttccgtgaagtatagcggagggggaggcagctctgggggaggtagcgggtgtttctcttccgggggggggggttctgggtgctttagtagcggaggcgggggcagctccggtggcgggtctgggtgtttctccagcggggggggggggtcctctgggggcggatcggggtgtttttcatcggggggcggcggcttctcaggccaagccgttcagtgccaatcctacggcggggtgtccagcgggggttcctcaggtggaggcagcgggtgcttctcatctgggggcggcggtggaagtgtttgcggctattccggggggggctccggctgcggaggtgggtcgtccggtggttcaggttcgggctatgtgagtagccaacaggtaactcagacatcttgtgctcctcagccttcctacggaggcgggtcatccggaggcggtggttccgggggcagtgggtgcttctcttcagggggtggaggaggatcatctggctgcgggggcggctcatctggaattggcagtggatgcataatttctggcggggggagcgtttgtgggggcgggtcctccggcggagggggcgggggatctagtgtggggggatccggctctggaaaaggagtgccaatttgtcatcagacccagcagaagcaagcccctacctggccgtcaaaatag

SEQ ID NO: 193503 - DNA, 1002 bp, Artificial Sequence
  Description of Artificial Sequence: Synthetic coding sequence
atgagctaccagaagaagcagcccaccccccagccccccgtggactgtgtgaaaacatcaggaggcggagggggaggtggcgggagcggcggaggtggctgcggttttttcggaggagggggcagtggcgggggaagctccggcagcggatgcggctactctggggggggaggttatagtggtggaggctgcggcgggggctcctccggggggggagggggaggcggtattggcggatgcggcgggggatccggtgggtccgtgaaatatagtggagggggtggtagttccggaggggggagcgggtgcttctctagtgggggaggtgggagcggctgcttctctagcgggggagggggatcttcaggaggtggctccggatgtttcagtagtggcggggggggatcgtcaggaggcggctccggatgtttctcctctgggggtgggggcttcagtggccaggcagtgcagtgtcaatcttatggaggcgtgtccagtggcggcagtagcggggggggtagcgggtgcttctctagtggcggcggcggtggatcagtatgcgggtattctggcggcgggtcagggtgcggcggcgggagttctggcgggtctggctccggctacgtgtcatcacagcaggtcacacagacttcatgcgctccccagccttcatacggcggcggcgtgcgacgcagacgacagaggagaaagagactcttgttgcagcggcggggccggagagagttgaggctgcgacggaggctgctcagggattggcagcggctccaccaccagtggaggggcctccggctgaggagatggttcctttggcgccggcgccgtagactcttaaggggctggctgcgcgaatggcaaggaagaccggacctgccacctgatcccgccgaagcaggtgcttacctggcagtgcagattgaccctcccggttaccacggaggcgaaggtgtggggggagtgtttcaggggcaccgctgggcctag

SEQ ID NO: 193504 - DNA, 927 bp, Artificial Sequence
  Description of Artificial Sequence: Synthetic coding sequence
atggacgccctgaagagcgccggccgggccctgatccggagcccctccctcgccaagcagagttggggtggcggaggccggcataggaagctcccagagaattggacagatacgagagaaacgcttcttgagggcatgttgttttcactcaaatacttgggaatgacgctggtggaacagcctaaaggggaagaactgtccgccgctgccatcaagcgtatcgtcgctaccgctaaggcctccggtaagaagctacagaaggtgaccctcaaggtgagtcctcgcggaattatattgacagataatctcactaaccagctgattgagaatgtgagcatctaccgcatttcatattgtaccgctgataagatgcacgacaaggtctttgcttatatcgcccaatctcagcataatcagtccctggagtgtcacgccttcctttgcacaaagcggaaaatggctcaggccgtgacactgacggttgcccaggccttcaaagtcgccttcgagttttggcaagtgtctaaagaagaaaaggaaaagagggataaagcgagccaggaaggcggggacgtgcttggagcgcgccaagactgcaccccatctctgaagtcattagtggcaaccggtaatcttctggatctggaggaaactgccaaagcacctctttcaactgttagcgctaacaccacgaacatggatgaagtgcccagacctcaggcactctccggatcttcagtggtttgggaactagatgacggtttggatgaggcatttagtcggctggctcaatcccggactaatcctcaagttcttgatacagggttgactgctcaggacatgcattacgcacaatgtctatcacccgtagactgggataaaccagactcctccggtaccgagcaggatgacctgttttcattctag

SEQ ID NO: 193505 - DNA, 810 bp, Artificial Sequence
  Description of Artificial Sequence: Synthetic coding sequence
atgagcagcgaccacctgaacaacagcaccctgaaggaggcccagtttaaagacctcttcctgaaaaaggctgaactggagtttgcccagatcattatcatagtggtagttgtaactgtgatggtggtggtcatcgtttgcctattgaatcattacaaggtcagcacgcgctcttttatcaaccgcccaaatcagtctcggaggcgggaggatggactccctcaggaagggtgcctatggcctagcgatagtgcagctccacggttgggtgcgagtgaaatcatgcacgcccctaggagtagagaccggttcactgcgccttccttcatccaaagagacagattcagccgcttccagcccacatacccgtacgtgcagcatgaaatcgatctgccacctacgattagcctgtcagatggagaggagcctcccccatatcagggcccttgtacattacagcttagggacccggagcagcaaatggaactgaatcgtgagtctgtgagagcacctcctaatagaacaattttcgatagcgatttaatcgatatcgcgatgtactctggagggccctgtccgccaagctccaattccggcatctctgcctctacttgttctagcaatgggcgtatggaggggcctccccccacttactcggaagtcatggggcaccacccgggagcctcattcctgcatcatcagcggtcaaacgcccatcgcggttcgcgactgcagtttcagcagaataacgcagagagtacaatcgtgcctattaaagggaaggaccgcaaaccaggaaatctcgtatag

SEQ ID NO: 193506 - DNA, 13635 bp, Artificial Sequence
  Description of Artificial Sequence: Synthetic coding sequence
atgctgaccccccccctgctgctgctgctgcccctgctgagcgccctggtggccgccgctattgacgctccaaaaacctgcagccccaagcagttcgcttgccgggatcagatcacttgtatcagtaaaggatggagatgcgatggggagagagattgtcccgacggtagcgatgaagccccagaaatatgcccccagtccaaggcccaacgctgtcagcccaacgaacataattgccttggcaccgaactttgcgtgcccatgtctcgtctctgcaacggggtgcaggattgtatggacggctccgacgagggaccacattgtcgcgaattgcagggtaactgtagccgtcttggctgtcaacaccactgtgtgcctactttagatggacctacctgttattgtaattcctcctttcagctccaggccgacggaaaaacctgcaaggactttgatgagtgtagcgtctacggaacctgttctcagctttgtactaataccgacgggtccttcatatgcggctgcgttgagggctatctgcttcaaccggataatagaagctgcaaggccaaaaatgagccagttgacagaccacccgtgcttctgatcgcaaattcacagaatatcttggcaacttacctgagcggtgcccaagtgagcacaataaccccaaccagcactcggcaaaccactgcaatggatttctcctacgccaacgaaacagtgtgttgggtgcatgtgggagactcagctgcacagacccagctcaagtgcgctaggatgcccgggctgaaaggttttgtagatgagcacacaattaacataagcctgtcgctgcatcacgttgagcagatggcaattgactggctgacaggtaacttctactttgtggacgatatagatgataggatttttgtgtgcaaccgtaacggtgatacttgcgtgaccctgttggacctggaactgtataacccaaaaggaatcgctctggatcctgccatgggcaaagtgttttttaccgattacggacagattccgaaagtggaacggtgcgacatggacgggcaaaacagaaccaaactggtggatagcaaaattgtttttccccatgggattacactggacctggtgtcccggctggtgtactgggctgatgcctacctcgattacatcgaagtagtggactatgaaggtaaaggccggcagaccataattcaagggatcttgattgaacacctgtacggcctgacagtctttgagaactacctgtatgccaccaatagtgataatgctaatgctcagcagaaaacctccgtgatccgggttaaccggttcaactcgactgaataccaagttgtaacaagagttgataaaggaggcgctctgcatatataccatcagaggagacagcctagagttagaagtcacgcttgtgagaatgaccagtatgggaagccaggcggttgtagcgacatttgcttgctcgcaaattcgcataaggcccggacttgccggtgccgctctgggttcagccttgggtccgacggaaagtcctgcaagaagccagaacacgaattatttctcgtctacggcaaaggaagaccgggcatcatcagggggatggacatgggcgctaaggtgccagacgagcatatgattcccattgagaacctcatgaatccccgggccctagactttcatgctgagacaggattcatttattttgccgacaccacctcctacttgattggtaggcagaagatcgatggaacagagagggagacgatactgaaagacggtatccacaatgttgagggagttgctgtggactggatgggcgataatctgtactggactgatgacggcccaaagaaaacaatttccgtcgcgagattagaaaaggctgctcagacccgcaagactttgatcgaaggcaagatgactcatccccgggcgatagttgttgacccactaaacggttggatgtactggactgattgggaggaggaccccaaggattctagacgtgggaggctggaaagggcatggatggacggttcccatcgtgacattttcgtgaccagtaaaacagtattgtggcccaatgggctgtcactcgacatccctgccggacggctgtattgggtggacgcattctacgataggatcgaaaccatactcttaaatggtaccgaccgcaaaatcgtgtacgaggggcccgaactgaaccacgctttcgggctgtgccatcacggcaactacctcttttggaccgagtacagatccgggagtgtgtatcgccttgagaggggcgtcggaggcgcacctccaactgtgacgctgttgcggtctgagagacctcccatcttcgaaataagaatgtatgatgcacagcaacaacaagtcgggacgaataagtgccgcgtgaataacgggggatgtagctccctctgcctagccacccctggctcgcgacagtgcgcctgtgctgaggatcaggtgctggacgcagacggggtgacgtgcctggctaatccaagctacgtcccgccccctcagtgccagcccggggagttcgcttgcgcaaacagccgctgcatccaggagagatggaaatgcgatggagataacgactgcctggataactccgatgaagctcctgcactctgccaccaacacacatgtcctagcgaccggttcaagtgcgaaaacaataggtgtatccctaaccgctggttatgtgacggcgataacgactgtgggaacagcgaagacgaaagcaacgcaacttgttcagctaggacttgtccgcccaaccaattcagttgtgccagtggccgctgcataccgatcagttggacatgtgatttagatgatgactgtggtgatcgatctgatgagtctgcgtcatgtgcctatcctacatgctttcctctaacccagttcacatgtaataatggacgatgcattaatataaactggcggtgcgacaatgacaatgactgcggcgacaacagcgacgaggccggatgcagccacagctgttcaagtacccagttcaagtgcaattccggtcgatgcattccagagcactggacatgcgacggcgacaacgactgcggcgactacagcgacgaaacacacgccaactgtaccaatcaagcgactagacctcccggcgggtgtcataccgatgagtttcagtgtcggctggatggtttgtgcataccccttaggtggcggtgtgatggcgacacagactgtatggactcttcagatgaaaagagctgcgaaggagtgacccacgtatgcgatccttcggtcaagtttgggtgcaaagactccgccaggtgtatttcaaaggcttgggtttgcgatggtgacaacgattgcgaggataatagtgatgaggagaattgtgaaagtctggcttgccgtcccccctctcatccatgtgcaaacaatactagcgtgtgtctgcctcccgataaactttgcgatggcaacgacgattgcggcgacgggtcggatgagggtgagctgtgcgatcagtgttcattgaacaacgggggctgctcccacaactgcagcgtcgcacctggcgaagggatcgtttgttcctgccccttaggtatggagttaggccctgacaatcatacatgccagattcagtcctattgcgcgaagcatctaaaatgctcacagaagtgtgatcaaaataaattctctgtaaaatgctcatgctacgaggggtgggtgcttgaaccagacggagagtcctgccggtcactcgatcccttcaagcctttcatcattttttccaaccgacatgaaatccgccggatagacctgcacaagggcgactattcggtactggtgcctggacttagaaataccattgccctggactttcatctgtctcagagtgcgttgtactggaccgacgtggttgaagacaagatatatagaggaaaactactggacaacggggctcttacaagcttcgaggtggtgatccaatacggccttgcgacacccgaaggactggcagttgattggattgccggcaatatttattgggtcgagtccaaccttgatcaaatagaagtagccaagttggatggcacattaagaaccaccctgttagctggggacatagagcacccccgagcgatcgcactggacccacgggatggtatcttgttttggactgactgggacgccagcctgcccagaatcgaggccgccagcatgtccggtgctgggcggagaactgttcatcgggaaactgggagtgggggatggccgaacggccttaccgttgactatctggagaagagaatcctgtggatagacgcccgctccgatgccatctactccgctcgatacgacggctctggccacatggaagttctgaggggccatgagttcctctcccaccctttcgcggttactttatacggaggagaagtgtattggactgactggagaacgaataccctggcaaaagcaaacaaatggactggtcacaacgtgaccgtggtccagaggactaacacgcagcccttcgatctgcaagtctaccaccccagcaggcaaccgatggcgccaaacccgtgcgaggctaacggcgggcaggggccctgctcccatctgtgcctgatcaattataataggactgtgtcctgcgcttgcccgcacctaatgaagctgcacaaggacaacaccacctgttacgagttcaagaaattcctgctctacgcacgacagatggagatacgaggcgtggatctcgatgcaccgtactataactacattatttcgtttacagttcccgacatagacaacgtcaccgtgctggactacgatgcccgtgagcagcgggtatactggtctgacgtcagaacccaagcgattaaacgcgcgtttatcaatggcacaggtgtggagacggtggtatcggcggatttaccaaacgcacacgggctggcggtggactgggtttccaggaacctgttctggactagctacgacaccaataagaagcagataaacgtggcccgactcgatggatcctttaaaaacgctgttgtccagggtttagagcaaccccacggccttgtggtacaccctctgcgaggtaaactatattggacagacggcgataacatttctatggctaatatggatggaagtaacagaacgcttcttttttctggccaaaaggggcccgtcgggctcgccatcgatttcccggaatccaagctctattggataagtagcggtaatcatacgattaatcggtgtaatcttgacggttcaggcctggaggtgattgacgctatgcgctctcaattggggaaggcgaccgccctcgcaataatgggagataaactttggtgggctgaccaagtctccgagaagatgggcacctgctccaaagctgatgggtccggcagtgttgtcttacggaacagtactaccctcgttatgcatatgaaggtgtacgacgaaagcattcagttagatcataagggcaccaacccctgctcagtgaacaatggcgattgcagccagctgtgtctgccaacctctgaaaccactaggagctgcatgtgcactgccggctactccctgaggtctggccagcaggcgtgtgagggagtcggctcctttctgctgtactccgtgcacgaagggattcgaggcattcctcttgacccaaatgacaagagcgatgccctcgtgccagtgagtggcacctctctggccgttggcatcgacttccacgccgagaacgatacaatctattgggtggacatgggactatcaactatcagccgggctaaacgggaccagacttggagagaagatgtagtcaccaacggtattggtcgagttgaaggaattgctgtggattggatcgctggaaacatctactggactgaccagggcttcgatgtgatcgaggtggctcggctcaatgggtcatttagatacgtggtcatttctcaaggcctggacaagccacgcgctataacggtacatcccgaaaaaggatatctgttctggactgagtggggacagtaccctcgtattgagaggtctcgcctggacgggaccgagcgcgtggttctggtgaacgtatctataagttggcccaacggcatctctgttgactaccaagacggcaagctgtattggtgcgacgcccggaccgacaaaatagagcgcatcgatctggaaaccggagaaaatcgcgaagttgtcctttcatctaacaacatggacatgtttagcgtgagtgtgttcgaagacttcatctactggtctgatcggacacacgctaatggtagtattaagcgtggcagcaaggacaacgccactgacagcgttccactgcggaccggcataggggtacaactcaaggacatcaaggtgttcaatcgggataggcagaaaggaacaaatgtatgcgccgtggccaacggaggctgccaacaactgtgtttgtatcgcggacgcggacaacgagcttgcgcctgcgctcacggaatgctggccgaagacggggcctcttgccgggagtatgccggttacttgctgtacagcgagagaacaatccttaaaagcatccacctgagcgatgaacgtaatctcaacgcccctgtgcaacccttcgaagatccggagcacatgaaaaacgtgattgccttagcttttgactaccgggcgggtacatccccagggacccccaaccggatcttcttttctgacatacatttcgggaacattcaacagattaacgacgatggctctcgccggatcacgatcgtggagaacgtgggctctgtcgaagggctggcataccaccggggctgggacacactgtattggaccagctacacgacatccaccattacacggcacacagttgaccaaaccaggcccggtgccttcgagcgggaaaccgtgatcacaatgagcggtgacgatcatcctcgggcgttcgtgctcgatgagtgtcagaatctgatgttttggactaattggaacgagcagcaccccagtattatgcgcgcagctctcagtggggcgaacgtgctgactctgattgaaaaagatatcagaactcccaacgggctcgccatagatcacagggcggaaaaactgtatttttccgacgcaactcttgataagattgaacgctgtgaatacgatggctcccaccgctatgtaatactgaaaagcgaaccggttcaccccttcggtttggccgtgtacggtgagcacatcttctggaccgattgggtccgccgtgctgtacagcgtgctaataagcacgtcgggagtaacatgaaactgctgagagtagatatcccccagcagccaatgggcattatagctgtggcaaacgacaccaacagttgcgagttaagcccctgtagaataaataatggagggtgccaagatctgtgtctgctgactcatcaaggccatgtgaactgtagttgtcgcggcggcagaattctgcaggatgacctcacatgtcgtgctgtgaactcttcatgtagggcacaagacgaatttgaatgtgccaatggagagtgtattaacttcagccttacttgtgatggggtaccccattgcaaggataagagcgacgagaaacctagctactgcaatagcagaaggtgcaaaaagacgtttcgacagtgttctaacggccggtgcgtcagcaatatgttgtggtgtaacggcgcagacgactgtggagatggctccgacgagattccctgcaacaagacagcctgcggagtgggcgaattccggtgtcgtgacggtacctgtatcgggaatagcagtcggtgcaaccagttcgtggattgcgaggacgcctcagatgagatgaactgctccgccacagattgctctagctacttcagacttggcgtaaagggcgtactattccagccatgcgaaaggacaagcctgtgctatgcgccttcttgggtctgcgacggtgccaatgactgtggtgattacagcgatgagcgcgattgcccgggtgtgaagagaccccgctgtcctctaaactactttgcctgtccctccgggaggtgtatccccatgagttggacatgcgacaaggaggacgattgtgagcacggagaagatgagacacattgtaacaaattttgctccgaagcccagttcgaatgtcaaaatcatcgatgcatttccaagcaatggctgtgtgacgggagcgatgactgcggagacgggtccgacgaagccgcccactgcgagggtaagacttgcgggccctcctccttttcttgtcccgggacgcacgtttgcgtgccagagagatggctatgtgacggagacaaggattgtgctgatggcgctgacgagtccatagctgccggatgcctgtacaatagtacctgtgatgatagagaattcatgtgccagaaccgtcaatgcatccctaaacactttgtctgtgaccatgatagggactgtgcagatggtagcgacgagtcaccagaatgcgagtatcctacttgtggacctagcgaatttcggtgtgctaacgggcgttgtctttcgagcaggcaatgggaatgtgacggcgaaaacgactgccatgatcaatctgatgaggctccgaagaacccgcactgtacgagccaggagcataagtgcaacgccagcagtcagttcctgtgttcttcaggaagatgcgtggccgaggctctcctttgcaacggacaagacgattgcggtgactcctcggatgagcgcggatgccacatcaacgagtgcctttcccgcaagttgtctggctgcagccaagactgtgaggacctgaagattggcttcaagtgcaggtgccgaccaggatttcgtctcaaggatgatgggcggacatgcgcagatgtggacgaatgcagtactacattcccctgtagccaaaggtgtattaacactcacgggtcctacaagtgcctttgtgtcgaaggctatgcaccacgagggggtgacccacactcgtgcaaggcagtgactgacgaggagccattcctgatattcgccaatcggtactatctgagaaaattaaacttggacgggtcaaactatacactgcttaagcagggactcaacaacgccgttgcacttgactttgattaccgagaacaaatgatctattggacggatgttactacccagggatcgatgatacgtcggatgcatctgaacgggtctaacgtccaagtgttgcatagaacagggctatctaatccagacggactcgccgtggactgggttggaggaaatctgtactggtgcgataaaggaagggacacaatcgaggtgtcaaagttgaatggcgcctaccgcactgtgctcgtatcatccgggctgagagagccccgggctttggtcgtcgatgtgcagaatggctacctgtattggacggattggggggaccacagcttaataggccggattggaatggatgggtcctcccgaagtgttatagtggacaccaagatcacctggcctaatggccttacccttgattacgttaccgaaaggatttattgggccgacgccagggaagactacatcgaatttgcttccctggatggtagtaatcgacacgtggtgctatcacaggacataccacatattttcgccctcaccctgttcgaggattatgtgtactggacagactgggaaaccaagagtattaaccgggcccataaaactacaggaaccaataaaaccctgcttatatccactttgcatcggcctatggacctgcatgttttccacgctctgcgacagccagacgtgccaaatcacccctgcaaagtgaacaacggtggttgttctaatttatgcctcctgtcccccggcggtgggcataagtgtgcttgccctacaaacttttatctgggttcagatgggcgcacatgcgtctccaattgcactgccagtcaatttgtgtgtaagaatgacaagtgcatcccattctggtggaaatgcgacaccgaggatgattgcggagaccactcggatgaaccccccgattgtccggagtttaagtgtaggcccggacagtttcaatgtagcacagggatatgtacaaacccggcctttatctgtgacggtgataacgattgccaggacaacagcgatgaagccaattgcgacatccatgtctgtctgcctagccagttcaagtgtaccaacacgaaccggtgtatcccaggcatttttcggtgtaatggacaggacaattgtggagatggtgaggacgaacgggactgtccagaagtcacttgcgcccctaaccagttccagtgcagtattacaaaaagatgcattccccgggtgtgggtctgtgacagagataacgactgcgtagacggttccgatgaaccggccaattgcactcagatgacttgcggcgtcgacgaattccgctgcaaagatagcggaaggtgcatccccgcgcgatggaaatgtgacggcgaggatgactgcggggatgggtctgacgagcctaaggaggagtgcgacgaacgcacctgtgagccataccaatttagatgcaaaaataaccgatgtgtgcctgggcggtggcaatgtgattacgataacgattgcggagataatagtgacgaagaatcctgtactccacggccttgttcagaatcagagttctcctgcgccaacggacgctgtattgctggccggtggaaatgcgatggtgaccacgattgcgccgacggttctgacgaaaaagactgtaccccaagatgcgatatggaccagttccagtgtaagagcggtcattgtattcctctgcgatggcgttgcgatgctgacgcagattgcatggatgggtcagacgaagaagcttgcggcacaggggtgcggacatgccccctcgacgagttccagtgtaataatacactttgtaagccactggcgtggaagtgcgacggcgaagacgactgcggcgacaacagtgatgagaatccagaagaatgcgccaggtttgtgtgtcctccaaacaggccttttaggtgcaagaatgaccgggtttgcctttggatcgggcggcagtgtgacgggacagataattgcggtgacgggactgacgaagaagactgtgaacccccgactgcccacacaacacactgcaaagacaagaaagaatttctgtgccgtaaccagcgttgtttgagttcttccctacgatgcaatatgttcgatgactgtggggacggctcagatgaggaagactgttccattgacccaaaactgacatcatgcgcaaccaatgcctccatttgcggggacgaagcccggtgcgtgcggaccgaaaaagcggcttactgcgcctgccgcagcggctttcatacagtcccaggacagcccgggtgccaggacattaacgagtgcctaagatttggtacctgtagccagttatgtaataacaccaagggtggccacctgtgttcatgcgccaggaacttcatgaagacacacaacacttgcaaggctgagggaagcgaatatcaggtgctgtatattgccgatgataacgaaatccggtcactctttccaggacacccacactcagcctacgagcaggcatttcaaggggacgaaagtgtgcgaatcgatgctatggacgttcatgtcaaggcgggccgtgtttattggacgaattggcatacaggcacgatcagctatcgatccctccccccggccgctccccccactacgagtaataggcaccggagacagattgacagaggtgtcacacacttgaacatctccggcctgaaaatgcctcgcgggatagccattgactgggtagctggcaacgtatactggaccgacagcgggcgcgacgtaatcgaagtggctcagatgaagggtgagaaccggaagaccctcatctcaggaatgatagatgaaccccacgccatcgttgttgacccactgcgggggacgatgtattggagtgactggggaaatcatcctaagatcgagaccgccgcgatggacggaacattacgggaaacactcgttcaggataacattcagtggccaactggcctggcagtggattatcataatgagcgtctttattgggccgatgccaaactctccgttattgggtcaattagactcaacggaacagaccctatagtcgccgccgactctaagcggggactgtctcatcctttctccattgatgtgtttgaggattatatttacggtgtaacgtacatcaacaaccgggttttcaaaatccataagtttggccatagtccactggtcaacttaactggagggctaagtcacgcttctgacgtcgtactttaccaccagcacaaacaaccagaggtcaccaatccttgcgatagaaaaaaatgcgaatggctgtgcctcttgtcaccttccggacccgtatgtacatgtcccaacggtaagcgcctggataacggcacttgcgttcccgtaccatctcctacaccgccccccgacgctccccggcctggaacatgtaaccttcaatgtttcaatggggggtcctgttttctgaacgcccgccgccaacccaaatgtcgatgccagcctagatataccggcgacaagtgtgagctcgatcagtgttgggaacattgcaggaatgggggaacctgcgccgctagccctagcggcatgccaacctgtagatgtcccaccgggttcacaggccctaaatgtacccagcaggtttgcgccggctattgtgccaataactctacctgcaccgtcaaccaaggcaaccagccccagtgtaggtgcctgcctggcttccttggtgatagatgtcagtacagacagtgttctggttactgtgaaaactttggaacttgccagatggccgccgacggtagcaggcagtgccggtgcacagcatattttgagggctcaagatgtgaagttaacaaatgtagtaggtgtctggaaggcgcctgtgtggttaataagcagagcggagatgttacctgcaattgtacagacgggagagtggctccgtcttgtctgacctgcgtcggacattgtagcaacggtggatcctgtacaatgaacagtaaaatgatgccagagtgtcagtgccctcctcacatgacaggaccccggtgtgaggaacacgtatttagccagcagcagcctggccacattgcctctattttgattcctctgttgctacttctgttactcgtgttagtggctggggtggtcttttggtataaaaggcgcgtacaaggtgccaagggcttccagcatcaaaggatgacaaatggcgccatgaacgtggagataggtaatcctacatacaagatgtacgagggaggggaacccgatgacgtgggcggccttctcgacgccgactttgccctcgaccctgataagccaactaacttcacaaaccccgtgtatgcgacactgtacatgggaggacacgggtcacgtcactccctggcgtccacggatgagaaaagggagctcctgggacgggggcctgaagacgagatcggcgatcctctggcgtag

SEQ ID NO: 193507 - DNA, 2142 bp, Artificial Sequence
  Description of Artificial Sequence: Synthetic coding sequence
atgctgctggccaccctgctgctgctgctgctgggcggcgccctggcccaccctgatagaatcatctttcccaaccatgcctgtgaagatccccccgcagttctgctggaggtccaaggaaccttgcagagacccctcgtgcgtgattcccggacaagccctgccaactgcacttggctaattctgggaagcaaggagcaaacagtgacaattaggttccagaagttacacctggcctgtggcagtgagcggttgacattgcgatcacctcttcagcccttaatatctctctgcgaagcaccaccctcccctttgcaattgcctggcggaaatgtaactatcacctactcatacgctggagcccgcgctccaatgggtcaaggctttcttctgagctactcccaggactggttgatgtgccttcaggaagaatttcagtgccttaaccacaggtgtgtctctgctgtccagaggtgcgacggagtggatgcctgcggagatgggagcgatgaggccggatgttctagtgacccctttccgggcctgacccctcgaccagtgccctctttgccatgtaacgttacgcttgaggacttctatggagttttttccagtcccgggtatactcatctcgcaagtgtcagccacccacagagctgtcactggcttctggacccgcatgacgggcgccgtctggccgtgagatttactgcccttgacttgggctttggtgacgctgtgcacgtttatgatggtcccggaccaccagagtcaagtcggcttctaaggtctcttacccatttcagcaacggaaaggcagtgactgtggaaacactgtcaggccaggccgtcgtgagctatcataccgtcgcctggtccaacggccgcggattcaacgccacataccatgtgcggggctactgtctaccttgggaccggccttgcgggttgggatcggggttgggcgccggagagggtctgggggaacgatgctatagtgaagctcagagatgtgacggatcctgggattgcgccgacgggacagacgaggaagattgccccggctgtcctccggggcattttccctgtggggctgctggcacgtctggagctaccgcttgctacttgcctgctgacaggtgcaattatcagactttttgtgcggatggcgctgacgagcgtcgctgccggcattgtcagccgggaaattttcggtgtagagacgaaaagtgcgtctatgaaacttgggtttgcgacggccagcccgactgtgctgacgggtcagatgagtgggactgcagttatgtgctcccccgcaaagtgattacagcagcagtcattggctccctggtgtgcggactgcttctcgtgattgctctggggtgcacctgtaagctgtacgctattcggacacaggagtatagcatcttcgctccactctctagaatggaagccgaaatcgtccaacaacaggcccctccaagctacggacagcttatcgcccagggcgctataccaccggtcgaggacttccccacagaaaatcctaatgacaactctgtgcttgggaatctgaggtccctgttgcaaatccttcgccaggacatgacaccaggtggaggcccgggagcacgtcgacgccagagaggtagactgatgcgacgcctcgtgcggaggctgcggcgatggggactgctgccacgaactaatacccccgcccgggctagtgaagcccgatcacaggttacaccttccgccgcacccctggaggctctggacggcggtaccgggcccgctcgtgaaggcggtgccgtcggcggacaagacggagaacaggcacccccactccccattaaggctcctctccccagtgcatcaacaagccctgccccgaccactgtgcctgaagcacctggtcctcttccatcactacccctcgagccttccctcctcagcggagttgtgcaagccctccgcggccgcctgcttccatccctaggcccccctggtcccacaagaagcccacctggccctcacacggctgtactcgccttggaggatgaggacgacgtgttgctcgtgccgctggcagagcctggggtgtgggtcgcagaggccgaggacgaacctctactgacctag

SEQ ID NO: 193508 - DNA, 1671 bp, Artificial Sequence
  Description of Artificial Sequence: Synthetic coding sequence
atgctgctggccaccctgctgctgctgctgctgggcggcgccctggcccaccctgaccggatcatatttccaaaccatgcctgtgaggatccccccgccgtgctcctggaagtgcaggggacactccagcggcccttggtgcgcgattccaggaccagccccgcgaattgtacatggctgattcttggctccaaggagcagactgtgacgatcaggtttcagaaattacatctggcttgcggctccgagagactcacgcttagaagtccacttcagccactgatctcactgtgtgaagcaccacccagtcctctgcagctgccaggtggtaacgtgacaatcacctactcttacgcaggagctcgggcaccaatgggccaggggttcctgctgagttatagtcaggattggctgatgtgtctgcaggaggagttccaatgcctcaatcatagatgcgtttcagcggtccagcggtgcgatggcgtggacgcgtgtggggatgggtcagacgaggccggctgctccagcgaccctttcccagggctcaccccccggccagtgccgagcctcccttgtaatgtgacacttgaagatttctatggggtgttcagctccccaggctacactcacttagcgagcgtttcacaccctcaatcttgccattggttactcgacccccacgatggtaggcgcctcgccgtaagatttactgcgttggacctgggcttcggagacgccgtgcacgtatatgacggtccaggcccgccggagtcatcacgccttttgaggtccttgacacatttttccaacgggaaggcggtaactgttgagacactgtctggccaggcggtggtttcttatcataccgtggcttggtctaacggaaggggattcaatgcaacctatcacgtgagggggtactgtctgccatgggaccgtccatgtggtctcggaagcggactgggcgctggggagggccttggtgaacgatgttattctgaggctcagcgatgtgacggaagctgggactgcgccgatggcactgacgaggaggattgtcctggatgcccccctggccactttccgtgtggcgcagccggcacctccggagctactgcatgctaccttcctgctgacaggtgtaattaccagaccttctgtgcagatggggcagatgaaaggagatgcagacactgtcagcccggcaactttagatgtcgagacgagaaatgtgtctacgagacctgggtctgcgatgggcaacccgattgcgccgatgggtccgacgaatgggattgttcctacgttctgccaaggaaagtgattacagctgcagtgataggatctctggtatgtggcctactgctggtcatcgcgctgggctgcacatgcaagctatacgccataaggacgcaggagtactcaatttttgcgccactatcaagaatggaagctgagatagtacagcaacaggcacccccctcatatggacaattaatcgcacagggagccatacctccagtcgaggactttccgaccgagaaccccaatgacaactcggtgcttgggaacctaagatctctgctgcagatcttgaggcaggatatgactcctgggggtggccccggggctagacggaggcagcgcggaagacttatgcggcgactctag

SEQ ID NO: 193509 - DNA, 13968 bp, Artificial Sequence
  Description of Artificial Sequence: Synthetic coding sequence
atggaccggggccccgccgccgtggcctgcaccctgctgctggccctggtggcttgcttggctcctgccagtggccaagaatgcgattctgcccatttccggtgcggaagcggacactgtataccagctgattggcggtgcgacggcaccaaggactgcagtgacgacgctgacgagatagggtgcgctgtggtcacttgccagcaaggctatttcaaatgccagagcgaaggacagtgtatcccaaatagctgggtttgcgatcaggaccaggattgtgacgacggtagcgacgagcgccaggactgcagtcagtccacatgcagtagccaccagatcacttgtagcaatgggcagtgcatcccctcagagtacagatgcgatcacgtccgcgactgtccagatggtgccgatgagaatgactgtcagtacccaacatgtgagcaactaacttgcgacaatggggcctgctacaacacgtcacagaagtgtgactggaaggtggactgtcgggattcttccgacgagataaattgcaccgagatctgccttcataatgagtttagctgcggcaacggcgagtgcatccctcgagcatatgtgtgtgatcacgacaatgactgccaggacgggtccgatgaacacgcttgcaactatccaacgtgcggcgggtatcagttcacctgtccctctggtcgctgtatctaccagaactgggtttgcgatggcgaagacgactgtaaggataacggcgacgaagatggctgtgaaagcggcccacacgacgtccacaagtgcagccccagggaatggtcatgtccagaaagcgggagatgcatctccatctataaggtctgcgatggtatcctggactgccccggacgcgaagatgaaaataatacaagcaccggaaaatactgttccatgaccctttgcagtgccctcaactgccagtaccagtgtcacgagactccttatggaggtgcttgcttttgcccacccggctacattatcaaccacaatgattcacggacctgcgttgaattcgacgactgccagatctggggcatatgtgaccagaaatgcgagtcacgtcctggaagacacctgtgtcattgtgaagagggctacattctggaacggggacagtattgcaaagctaacgattcttttggggaagcatctatcattttcagcaatggccgggatctgttgattggggatattcacggcagatccttcaggatccttgttgaatcccagaatagaggagtggccgtgggcgtcgccttccattaccacctgcagcgcgtgttctggactgataccgtgcaaaacaaagtcttcagcgtggatatcaatggcttaaacatccaagaggttctgaacgtgtcagttgagactcctgagaacctggccgtcgattgggttaacaacaaaatttatctcgtagagaccaaagtaaacagaattgacatggtgaacctggatggcagctatcgcgtgacactcatcacagagaatcttggccacccaaggggcatcgccgtcgaccccacagtcggatacctgttcttctcagattgggagagcctgagcggcgagccaaaacttgagcgcgcctttatggatggttcaaatcgcaaagacctggtgaagacaaagttgggatggcccgctggtgttactctggatatgatctccaagcgcgtgtactgggtggattcaaggtttgactacattgagactgtgacctacgatggaatccagcggaagacagttgtccacgggggttctctaataccacacccatttggtgtctctttgttcgaaggccaggtatttttcacagactggacaaaaatggccgttctgaaggcaaacaagtttactgagacgaacccacaggtgtattatcaggcgagcctacgtccctatggcgtgacagtctatcattccctgcggcaaccatatgcaacaaatccgtgcaaggacaacaacggcggctgcgaacaagtctgcgtgttatcacatcggactgataacgatggactcggattccggtgcaagtgtacgtttggtttccagcttgacaccgacgagcggcattgcattgctgtgcagaactttctgatcttcagctcacaggtggcgatcagggggattccattcacactgtcaacacaggaggacgtgatggtcccagtgtcagggaatccaagctttttcgttggcatcgacttcgacgcccaggacagtacgattttcttttccgatatgtcgaaacatatgattttcaagcagaaaattgatggcactggcagagagattctagccgctaatagggtggagaacgtagaatctttggcgttcgactggatttcaaagaacctgtactggacagactcacactataagtccatttcagtgatgcgcctggcagataaaaccagacggaccgtggtgcagtacctaaacaacccccggagcgtggtggtacacccctttgcgggctatctattcttcacggattggttcagaccagcgaagatcatgagagcgtggagcgatgggagtcacttgcttccagtgattaacacaaccctcggctggcccaacgggttagccatcgattgggcagcgagcaggttgtattgggttgacgcatatttcgataagatcgaacactccacttttgacgggttggacagacgtcgattgggccacattgagcaaatgactcacccttttgggttggccatattcggggagcacttgttcttcaccgattggcggctgggcgccattatcagagtccggaaggccgacgggggggagatgacagttatcagatctgggattgcatacattttacacctgaaaagttatgacgtcaatattcagaccggaagcaatgcctgtaaccaacctactcaccccaatggagactgttcgcacttttgcttcccggtgccaaatttccagcgggtatgtggctgtccatacgggatgcgcttagcttctaatcacctcacgtgcgaaggcgatcctacaaacgagcctccaactgaacagtgcgggttgttctcgttcccatgcaaaaatggcagatgtgtgcccaactactatctgtgcgacggggtcgacgactgtcatgacaactctgatgagcaactgtgcggcacacttaacaatacatgctccagctccgcatttacctgcggccatggcgagtgtattccagctcattggcgctgtgataaacggaacgattgcgtcgatggcagtgatgaacacaattgtccgacccatgctccagcgtcctgtttggatacccaatatacctgcgacaaccaccagtgcatatcaaagaattgggtgtgcgacacagacaatgactgcggcgatggatctgacgaaaaaaactgcaacagtactgaaacctgtcaaccttcccagttcaattgcccaaaccaccgatgcatcgacctatcttttgtctgtgacggagataaagactgtgtggatgggagtgacgaggttggatgcgtgctcaactgcacagcttcccagtttaagtgcgcatccggcgataaatgtattggagtcacgaatcgatgcgacggcgtgtttgactgtagcgataattccgacgaggctgggtgtccaactagacccccaggtatgtgtcatagcgacgagtttcagtgtcaggaagatggcatatgtattcccaatttctgggaatgcgacggtcatccagactgtctctacggctcagacgagcacaatgcttgtgtgcctaaaacctgccccagttcttatttccactgcgacaacggaaactgcatccatagggcctggctttgcgaccgagacaatgactgtggcgatatgtctgacgagaaagactgccctactcagccgttccgttgcccaagctggcagtggcagtgtttggggcacaacatttgtgtgaatttgtctgtggtgtgcgatggaatctttgactgtcctaacggaacggatgagtccccactgtgcaatggcaactcctgtagcgactttaatggaggatgcactcacgagtgcgtgcaggagccattcggggccaaatgtctctgtccattgggtttcctgcttgcaaacgatagcaagacttgcgaagacatcgatgaatgtgacatcctgggcagctgtagtcagcactgctacaacatgcgcggatcgtttcgctgtagttgcgatactggttacatgttggaatctgatggtcggacatgcaaagttaccgcgtccgaatcactattactgttggtagccagtcagaataagattatcgcggattccgtgacctctcaggtccataatatctatagtttagtcgagaatggtagttacatcgtagccgttgactttgactccataagcgggcggatcttttggtccgacgctactcagggaaagacatggtctgcttttcaaaatgggactgaccggcgcgtagtgtttgactcctcaattatactcacagaaactatcgcaatcgactgggtgggaaggaacctgtattggaccgactatgccctcgagaccatcgaagttagtaagatcgatggctctcacagaacggtgctgatttcaaagaacctgacaaatcccagaggtttggcactggaccctagaatgaatgaacatttgctcttctggagcgattggggccaccacccaagaattgaacgagcgtcaatggacggtagtatgcgcaccgttattgttcaagacaaaatattttggccctgcggcctgactatcgactacccaaatcgtctgctgtatttcatggactcatatcttgactacatggacttttgcgactacaatggccaccatcggaggcaggtgatcgcgtccgacctgatcattcgacacccctatgccctgacattgttcgaggatagtgtgtactggacagatagagcaacacgccgggtgatgagagcgaataaatggcatggcggaaaccagtctgtggtcatgtataacatccagtggccactcggcatcgtggcagtgcacccttcaaagcagcccaattccgtgaacccctgtgcgttctctaggtgtagtcatctctgtctgctgtcttcgcagggaccacacttctatagctgtgtttgtcccagcggctggtctctctctcctgacctgctgaactgcctccgcgacgatcagcctttcctcattactgtaagacagcacataatatttgggattagtctcaatcctgaggtcaagagcaatgatgctatggtacccatcgcagggattcagaacggactggatgtcgagttcgatgatgcagagcagtacatctactgggtcgaaaacccaggagaaatccaccgggtgaagacagacggcaccaaccgaactgtattcgccagcatctccatggtcggcccgtcgatgaatctggctctggactggataagtcggaatttgtattctaccaacccacgcacccagtcaattgaggtcctgactttgcacggcgatatcagatataggaagaccctgatcgccaatgatgggacggcattaggagtgggattccctatcggaatcaccgttgatcccgcgagaggcaaactctactggagcgaccagggtacagatagtggggtgccagctaagattgcctcagccaacatggacgggacaagtgtgaagacgctattcacaggaaacttggagcatctggaatgcgtgacactcgatatcgaggaacagaaactctactgggctgttactggacgtggtgtcatcgaacgaggcaacgtggacggaaccgaccggatgattctagtgcatcagctgtctcatccttggggcattgcagtacatgacagtttcttgtactatacagacgaacagtacgaggttattgagcgggtggacaaagcaaccggagctaacaagatagtcctgagggacaacgtgccaaacctgcgcggtcttcaggtttatcataggcgcaacgccgctgaatccagtaacgggtgcagcaacaacatgaacgcctgccaacagatctgcctccccgtacctggcgggctgttcagctgtgcctgcgccactgggtttaaacttaatccagataatcgcagctgcagcccctacaatagctttatagtggtatctatgctctctgcaatacggggcttctctctcgagctcagcgatcactccgagacaatggtccccgtagctggacagggacgcaacgccctacacgtggacgtggacgtgagcagcggatttatctattggtgtgatttcagttccagtgttgccagtgacaatgcaattaggaggatcaaaccagacggatctagcctgatgaatatcgttacccacggcattggcgaaaacggggtccggggaatcgcagtcgactgggttgctggcaatttatactttacaaacgccttcgtatctgagacacttatcgaggtcttaaggataaacactacttatcgcagagttttgctgaaggtcactgttgacatgcccagacacatcgtcgtggaccccaaaaaccgttatctgttttgggccgattacggccagagacccaaaattgaacgctcgtttctggattgtaccaatcggaccgtgcttgttagcgaaggtattgttactcctagagggctggcagtggaccggtccgacggatacgtctactgggttgacgattcattggacattatcgctaggatcagaataaacggcgaaaactctgaagtgattaggtatggttcaaggtatcccacaccgtatgggataaccgtgttcgaaaactccattatatgggtggatcgcaatcttaagaaaatttttcaggctagcaaggagcctgaaaacacggaaccacccacagtcattcgggacaatattaactggcttagggacgtgaccatttttgataagcaggtgcagccgcgttctccagcagaggtcaacaacaatccatgcctggaaaataatggtggttgctcgcatttgtgctttgccctcccgggcctccacacccccaaatgcgattgtgcctttggcaccctccagtctgacgggaaaaactgtgccattagtaccgagaactttcttatcttcgcactcagtaacagcttgaggtcactgcacctcgaccccgagaaccactcccccccgtttcagacaatcaatgtggaacgtaccgtgatgagcttggattacgattcggtatccgatagaatatactttacccagaatctggcctctggcgtcggacagatctcctacgccaccctgagtagtggcatccacacgccgaccgtcatagcctctggcataggcactgccgatggaattgctttcgattggatcaccaggcgcatatattatagcgattacctgaaccagatgatcaacagcatggcagaggatggatcaaatcgaaccgtcatcgctcgggtgccaaagccacgcgctattgttctggacccttgccaggggtacctgtactgggcagattgggatacacacgcgaagatcgaaagggcgacattggggggaaactttcgcgtgccaatcgttaatagtagtctcgttatgccttccggactaactcttgactacgaagaagacctgctgtactgggtggatgcatcgcttcaaagaatcgagagatccactcttacaggggtcgatcgggaggtgattgtgaatgccgctgtgcatgcgttcggccttaccctctatgggcagtatatatactggactgacctctatacccagaggatataccgggccaacaaatatgatggcagtggccagatcgccatgacaaccaacctgctctcacaacccagagggatcaacaccgtcgtcaaaaatcagaaacaacagtgcaacaacccctgtgaacagttcaacggcgggtgttcccacatatgcgctcctggacccaatggagccgagtgccagtgccctcacgaaggcaattggtatctggctaacaacagaaaacactgtatcgtggataacggggaacgatgcggcgcctcctcattcacctgtagtaacggccggtgcatttctgaagagtggaaatgtgacaacgacaacgattgcggtgatggtagcgatgaaatggagagcgtgtgtgcactgcatacctgctctccaaccgcctttacttgtgcgaatggccgctgcgtgcaatacagctaccgctgcgattactataatgattgtggcgatgggagcgatgaagccggctgtttatttcgcgactgcaacgccaccactgagttcatgtgtaacaataggcggtgtattccccgggagtttatctgcaacggcgtcgacaactgccacgataataatacatctgatgaaaaaaactgccctgaccggacatgccagagcggttataccaagtgccacaatagcaacatctgtataccacgggtttacctctgcgacggagacaatgattgtggggataacagtgacgaaaatcccacttactgtactactcacacttgttctagttcagagttccaatgtgcctccgggcgatgtatccctcagcattggtactgcgatcaggaaactgattgttttgacgccagcgatgaacccgcatcttgtggacactcagagcgcacctgcctagccgatgaatttaagtgcgatgggggccggtgcataccaagcgagtggatttgtgatggagataatgattgcggcgacatgagtgatgaagacaaaaggcaccagtgccaaaatcagaactgttccgacagcgagttcctgtgcgtcaacgaccggcctccagatcgaaggtgcattcctcagtcatgggtgtgcgatggagatgtcgactgtacggacggctatgatgagaaccagaattgtacacgcagaacatgttccgaaaatgagtttacctgcgggtacggcctctgcatcccgaaaatcttcaggtgtgaccgccataacgactgtggggactactccgatgagcgcgggtgtctgtaccagacctgccaacagaatcaattcacttgccagaatggaaggtgtatctccaaaacatttgtgtgcgacgaagacaacgactgcggcgatggaagcgatgaactgatgcacctgtgccacacaccggagcctacctgtccaccccatgaatttaagtgcgataacggcagatgcattgagatgatgaaattatgcaatcatttagacgattgtctggacaacagtgatgagaaaggatgtgggattaatgagtgtcacgacccttcgatttctgggtgtgaccacaactgtaccgatacgctcactagtttctattgctcctgtcgacctgggtacaagcttatgtccgataagcggacctgcgtggatattgatgaatgtaccgagatgcccttcgtctgtagtcagaaatgtgagaacgtcattggctcgtacatttgtaaatgcgcaccaggatacttgagggaaccagatgggaagacatgcagacaaaattccaacattgaaccttacctaatctttagcaaccgctattacttgagaaatctcaccattgacggctacttctattctctgatcttagagggtctggacaatgttgtagccttggactttgaccgagtggagaagagactttattggattgacacacagcggcaggtgattgaacgcatgtttttaaataagaccaacaaggaaacaattattaatcatcggcttcctgccgccgaatctctagcagttgattgggtgagtagaaagttgtactggctggacgcacgattagatggcctatttgtctctgatctcaatggaggccaccgccgaatgttagcccagcattgtgtggacgctaacaatacgttttgcttcgacaacccaagggggcttgcactgcaccctcagtatggatatctgtactgggccgattggggccaccgagcatacatcggaagggtaggcatggatggtaccaacaagtctgtgatcattagtactaaactcgagtggcccaacggcattacaattgattacacaaatgacctgctgtactgggccgacgcacacttagggtacatcgagtactcagacctggaagggcaccataggcacactgtgtacgacggagccctacctcatccttttgcaataacaatcttcgaggacaccatatactggacggactggaataccagaaccgtcgaaaagggaaataagtatgatggaagcaacaggcagacactggtcaatacaacacacagaccatttgacattcatgtgtaccatccataccggcagccaatagtgtcaaatccatgcggcaccaacaacggcggctgtagccacctctgcctaatcaaacctgggggcaagggattcacgtgtgagtgccccgacgactttagaacccttcagctctccggatccacttactgcatgccgatgtgcagctcaacacagttcctgtgtgcaaataatgaaaaatgcattcccatttggtggaagtgcgatgggcagaaggactgctcagacggctctgacgaactcgctttgtgcccacagcgcttttgtaggctgggccagtttcagtgcagcgatggtaactgcacatcccctcagacactgtgcaacgcacaccagaactgtcctgatggaagcgacgaagatcgactgttatgtgaaaaccaccattgtgattccaacgaatggcagtgtgccaacaagaggtgcatacccgaaagctggcagtgcgataccttcaatgattgtgaggacaatagcgatgaggactccagccattgtgccagtcggacttgcaggcccggccagtttagatgtgctaacggcagatgcattcctcaagcctggaagtgcgatgtggataatgactgcggagaccactcagacgagccaatcgaggagtgcatgagttcggcgcacctgtgcgataactttacagagtttagctgcaaaacaaactacagatgtataccgaaatgggctgtctgcaatggggttgacgactgccgcgataattctgacgagcagggatgtgaggaacggacctgtcaccctgtgggggatttccggtgtaaaaaccatcactgtataccactgaggtggcaatgcgatggtcaaaacgactgcggggacaattcggatgaggaaaactgcgctccccgtgaatgtacggagtcagagtttcgctgtgtcaaccagcaatgtattccgtcccgttggatttgtgaccattacaacgattgcggcgacaactcggacgagagggattgtgaaatgcggacatgccacccagaatactttcaatgcaccagcggccactgcgttcactcggagctgaaatgcgacgggagtgccgattgccttgacgccagcgatgaagcagattgtccaactagatttcctgatggggcctactgtcaggcaactatgtttgaatgcaagaatcatgtgtgtattcccccatattggaaatgcgacggcgatgatgattgcggagatggaagcgacgaagagttgcatctgtgtctcgatgtgccctgtaatagtccgaataggtttaggtgcgataacaatcgttgcatctacagccacgaggtatgtaatggagttgacgattgcggcgacggaacggatgagacggaggagcactgcaggaaaccgacccccaagccttgcactgagtatgaatataaatgcggtaatggccattgtatacctcacgataacgtgtgcgatgacgcggatgactgcggagattggtctgacgaattagggtgtaataagggcaaagagaggacctgcgccgagaacatctgtgaacagaattgcacccagctgaatgagggaggattcatctgttcatgtactgcaggtttcgagaccaacgtgttcgacagaacgtcttgccttgatatcaatgaatgcgagcagtttggcacgtgcccacagcattgccgcaatacaaaggggtcctacgaatgcgtgtgtgcagatggattcacttccatgtccgaccgccccggtaagaggtgcgcggccgaaggttcatcacctctgctgctgctaccagataatgtacggatccgcaagtataacttaagcagcgaaagattctcagagtatctgcaggacgaggagtatatccaagccgttgactatgattgggacccaaaggatatcggcctttcggtcgtctactacacagtcagaggagagggctctcgttttggggccattaaacgggcttatattcccaattttgagagtggccgcaataatcttgtccaggaagttgatttgaaactgaagtacgtgatgcagcccgacggcattgcagtggactgggtgggccgtcacatttactggagcgatgtcaaaaataaacgtatcgaagtcgcaaagctggatggcaggtaccgcaaatggttgatcagcacagatctcgatcagccagcagctattgcagtcaaccccaagctaggcctcatgttctggaccgattggggcaaggaacctaagatcgaaagcgcttggatgaatggagaggatcgcaacatcctggtattcgaagacctgggatggcccaccggtttgagtatcgactatcttaataacgatcggatctactggagtgacttcaaggaagatgtgattgaaacgatcaaatacgacggcactgaccgaagagtgattgcaaaagaggctatgaatccctattccttagatatttttgaggatcagctatactggatttctaaggagaaaggggaagtatggaagcagaacaagttcggtcaaggcaagaaggaaaagacacttgtggtgaacccctggttgacccaggttaggatctttcatcagctgcggtataataagagtgtgccaaacctgtgcaaacagatatgctctcatctctgcttactgcgccccggtggctacagctgtgcatgtccccaaggctccagcttcattgagggttctactaccgaatgcgacgctgccatcgaacttcccatcaatctgccaccgccttgtcggtgtatgcatggaggcaactgctattttgacgagaccgatcttcccaagtgtaagtgtccatcgggatacactggtaaatactgtgaaatggccttttccaaaggaatatccccggggacaaccgcggtggcggttcttcttacgattctcctaatcgttgtgattggagccttggctatagccggtttctttcattatcgcagaactgggtcactgctgcctgccctgcccaagttaccctcactgagctctcttgtgaagccatcagagaatgggaatggtgttacttttcggtctggcgctgacttgaacatggatataggagtatcgggcttcggcccagaaaccgccatcgacagaagcatggcgatgtccgaggattttgtgatggaaatgggaaagcagccaatcatcttcgagaatcctatgtattccgcacgagactcagccgtcaaggtggtgcagccgattcaggtgaccgtaagtgagaacgtcgacaataaaaattatggcagccccataaatcctagtgagatcgtgccagaaacaaacccaactagtcccgctgcagacgggacgcaggtgacaaaatggaatctctttaagaggaagtcaaagcagaccacaaacttcgaaaatccaatttacgcccagatggaaaatgaacagaaggagtccgtcgcagcaactcctcccccctcaccttctctcccagctaagccgaaacccccctctcgtagggatcctacacccacctactcagcaactgaggacacctttaaggacacagcgaatcttgtcaaggaagattctgaagtgtag

SEQ ID NO: 193510 - DNA, 3678 bp, Artificial Sequence
  Description of Artificial Sequence: Synthetic coding sequence
atggaccggggccccgccgccgtggcctgcaccctgctgctggccctcgtggcgtgtcttgctccagcttctgggcaggaatgtgactcggcgcattttaggtgtgggtcaggccattgtatccctgctgactggagatgcgatggtactaaggactgttcggacgacgccgacgaaatcggctgcgccgtcgtgacttgccagcaaggttacttcaaatgtcaatcagagggtcaatgcatcccaaatagttgggtttgcgaccaggatcaggactgtgacgatggatccgacgagcggcaagattgcagccaaagcacctgttcatctcaccaaatcacctgtagtaacggtcaatgtatcccctctgaataccggtgcgatcacgtgcgtgattgtcccgatggcgctgacgaaaatgactgccagtaccctacttgcgagcagttgacctgcgataatggggcatgctacaatacttcccaaaaatgtgactggaaggtggattgtagggactccagtgatgaaattaattgcacagaaatctgtcttcataatgaatttagctgcgggaacggtgagtgcatccctcgagcatatgtgtgtgaccacgataacgattgtcaggacggaagcgacgagcatgcctgcaattacccaacctgtggaggataccagttcacatgtccctccggccgatgcatctaccaaaattgggtatgtgatggggaggatgactgtaaggacaatggtgatgaggatggctgcgaatccggccctcatgatgtccacaaatgcagcccccgggagtggagctgtcccgaatctgggaggtgtatctctatatacaaagtctgcgacggcatactggactgcccaggcagggaagatgaaaacaacacctccacgggaaagtactgcagcatgaccctgtgtagcgcattaaactgtcagtaccagtgccatgagacaccttatgggggggcatgtttttgcccccccggctacattataaatcacaatgactcccgaacctgtgtggaatttgacgattgtcagatttgggggatctgtgaccagaagtgcgaaagccggcctggccggcacctatgtcactgcgaggagggttacatcttagagagagggcagtactgtaaagcgaacgactccttcggggaagcgtccattatattttctaacggccgcgacctcttaattggcgacatccacggtagatctttccgcatactggtggaaagccagaatcgtggagtggctgtcggcgtagcgttccactaccatctgcagcgcgtcttttggaccgataccgtacagaacaaggtattttctgtggacatcaatggcttaaacatccaggaggtgcttaatgtgtcagtagaaacacccgagaacctcgccgtggattgggtgaataataagatttatttggtggagacgaaggtgaaccggatagacatggtgaacctggatggaagctaccgtgtgaccctcatcacagagaacttaggacaccctcgcggcatcgccgtagatcctactgtaggaaaaaccgtggtgcacgggggaagcttgatcccccaccccttcggggtctccctttttgaggggcaagtcttcttcacagattggacaaagatggccgtattgaaggcaaataaatttaccgagaccaacccccaagtgtactatcaggcctccctcagaccctacggcgtgaccgtgtatcattcactccggcaaccatatgccacaaacccttgtaaagacaataatggcgggtgtgagcaagtgtgcgtcctttcacaccgcactgacaatgacggactgggctttagatgtaaatgtacattcggcttccaactggacaccgacgagagacattgcattggtcgagagattctggctgcgaatcgggtggagaatgtggaaagcctggcattcgattggatttcgaagaatctttattggaccgattcccactacaagtctatctctgtaatgagattggcagacaagaccagacgtactgtggttcagtaccttaacaacccaagatccgtagtcgttcacccttttgccgggtatctgtttttcaccgactggttcagaccagccaagatcatgagggcctggagcgacggttcccatctactgccggtcatcaatactacactcggatggccaaatgggctagccattgattgggcagcatcgcggctatattgggttgatgcctatttcgataaaatcgagcacagcacctttgatggcctggaccgcagacgactcggccacattgaacagatgacacacccatttggcctcgccatcttcggtgagcatctattttttacagattggcgcctgggagccatcatccgggtacgcaaagctgatgggggagaaatgactgtaatccgatccggtatcgcatacatcttacaccttaaatcctatgatgtgaacatacagactggctcaaacgcatgtaaccagcctacccatcccaacggagattgcagtcatttttgcttcccagttccaaatttccagagggtgtgcggctgtccctacggaatgaggctggcatcaaatcatttaacctgcgagggcgacccaacgaacgagccaccaaccgaacagtgtgggctatttagcttcccttgtaagaacggtcggtgcgtgcctaattactacctgtgtgacggggtagacgactgccacgataacagcgacgaacagctgtgcggcactctgaataatacttgttcctcctccgcgttcacatgcggacatggcgaatgtatccctgcccactggaggtgcgataagcgcaatgactgcgttgacggcagtgacgaacacaactgcccaacccacgctccagctagttgcctggacactcagtatacatgcgacaatcaccaatgtatctcgaagaactgggtctgtgatacagataacgactgtggcgacggtagtgacgagaaaaattgtaactccacagaaacttgtcagcctagccagtttaattgccctaaccatagatgcattgatctttccttcgtttgtgacggggacaaggattgtgtggacggcagcgacgaagtgggctgcgttttaaattgtaccgcctcacagtttaagtgcgcatcgggggataagtgcattggcgtgacaaacaggtgtgacggcgtcttcgactgttccgataacagtgatgaggccggatgccccaccaggcctccaggaatgtgtcattctgatgagtttcagtgtcaggaagatgggatctgcattccaaacttttgggaatgtgacggtcacccggactgtctgtacggaagcgacgagcacaacgcctgtgttccaaaaacgtgcccctcaagttatttccactgtgacaatggcaattgtattcatcgcgcctggctctgcgatcgggacaacgattgcggagacatgtctgacgaaaaagactgtcccacccagccatttagatgccccagctggcaatggcagtgtttgggtcacaacatttgcgtcaatctgagcgtggtctgtgacggtatctttgactgccccaatggtactgatgaatcaccactgtgcagcaaattcccggatcatagcctgctggctataaatagcttttag

SEQ ID NO: 193511 - DNA, 1941 bp, Artificial Sequence
  Description of Artificial Sequence: Synthetic coding sequence
atgctggcccagcactgcgtggacgccaacaacaccttctgcttcgataatcccagaggactggcccttcacccacaatatggatacctctattgggcagactggggccatagggcttatatcggcagagtgggcatggatggcacaaataaaagcgttattatcagcaccaaacttgagtggcccaacggaatcaccatcgactacaccaacgatctgttgtattgggccgacgcgcacttgggatatattgagtattcagatctggaaggtcatcacaggcacaccgtgtacgatggcgcgttgccccaccccttcgccattaccatctttgaggacacaatctattggaccgactggaatacgaggacagtggagaaggggaataaatacgacggcagtaatagacagacactcgtgaacactactcacagaccgttcgatattcacgtgtaccatccataccggcagccaatcgtgtcgaatccttgcggcacaaataatggcggatgcagccatctctgtttaattaagcccgggggaaagggctttacctgtgaatgtcctgatgactttcgcacgttgcagctgtccggaagtacatactgcatgccgatgtgctccagcacccaattcctgtgtgctaacaacgagaaatgtatccctatatggtggaaatgtgatggtcagaaagattgttctgatggcagcgacgaactcgcgctgtgtcctcagcgattttgccggctaggacagttccagtgctccgatgggaattgcaccagtccgcagaccctatgcaatgcacaccagaattgcccagatggtagtgatgaggatcgtctgttgtgcgagaatcaccactgtgactccaacgagtggcagtgtgcaaacaagaggtgcatcccagaatcatggcagtgcgacacctttaacgattgcgaagacaattccgacgaagactcttctcattgcgccagcagaacatgccggcccggacagttcagatgcgccaatggccggtgtatcccacaggcttggaagtgcgacgtcgataatgactgtggagaccattccgacgaaccgattgaggagtgcatgagttctgcccacctctgcgacaactttaccgaatttagttgcaagactaattatcgctgtattccgaaatgggccgtgtgcaacggcgtggatgattgtcgcgacaactctgatgagcagggatgcgaagaacggacatgtcaccccgttggcgatttcagatgcaagaaccaccactgtattccccttcggtggcagtgtgatggtcagaacgattgcggagacaactctgatgaagaaaactgcgcaccacgggaatgtaccgagtcagaatttcgatgcgtaaatcaacagtgcataccatcaagatggatttgtgatcactacaacgattgtggcgacaatagtgatgagcgtgactgcggcatgcggctcatgaagctcattgtgccccacgctttcctgatggttcacaccgcccgtttattatgttccaatgccaagactatgtttgtgtcgcgtcatatcggcaatgtgatggcaatgatgacagtggctatggtacaaatgaagaacttcacatgcgcatggatgtttcccgttatccaccaaacagtcagcggagtgaccactatcgctgcttttatagtgatgaggtgcgccatggtctggatgaccgttgaaatggagctgatgaggcaaagatctactgtggaaaacaggccgctgaacctggtgcagaatatgaatattagcgtggccatggggatcgcgttccacatgacaatgtgcgtgatgatgcccatgacagtggtgactggacctatgaactgggtggccataaaggagaaaaaagagcacgtcctgaaaatatacgccagcaagatcgttccaaattag

SEQ ID NO: 193512 - DNA, 2313 bp, Artificial Sequence
  Description of Artificial Sequence: Synthetic coding sequence
atggagaagcgggccgccgccggcctggagggcgcccccggcgcccgagcccagctcgccgtggtttgtctggtgaatatcttcctcacaggacggctgagctctgccgtgcctgcacttgctgcctgcagtgggaagctcgagcagcatactgagcggcggggcgtgatttatagccccgcatggccactgaattaccctccaggtactaactgctcatggtatatccagggagatagaggggacatgatcacgatctcattcaggaacttcgatgtagaagagtctcatcagtgctccctcgattggttactgctggggccagccgcaccaccccgacaggaggccttcaggctctgcgggtccgcgatcccaccagccttcatatccgccagagatcatgtttggatcttcttccactctgatgcaagttcatctggtcaagcccagggtttcagattgtcgtacataaggggaaaactcggacaggctagttgccaggccgacgagttccgctgcgacaatggaaagtgcctccccgggccctggcagtgcaacacagtagatgaatgtggcgacggcagcgacgaggggaattgcagtgcccccgccagtgaacctcccggtagtctgtgcccaggaggcacctttccctgttccggagcacgcagtacacgttgccttcctgttgaacgcagatgtgacggtctgcaggactgcggggatggatccgacgaggccggatgcccagaccttgcctgcggacgacgacttggtagcttctatggaagcttcgcatccccggacctgttcggcgcagcaaggggaccctccgatctacactgtacttggctggtggacacgcaggactctcggcgagtgctgctccaactggaactgaggttgggctacgatgactacgttcaggtgtacgagggactgggtgagcgtggcgacaggctgctgcagacgctgagctacagaagcaaccatcgacccgtgagcttagaggccgctcagggtcggctgactgtggcctaccacgcaagggccaggagcgcgggacatggctttaatgcgacatatcaagtgaaaggctattgtctgccttgggagcagccctgcggatcaagtagcgacagtgacggcggaagcctcggcgaccaaggttgctttagcgagccccaacgttgcgatggatggtggcattgcgcctcaggacgcgatgagcagggctgtcccgcttgtccacctgaccaatatccatgtgaaggagggtcagggctttgctacactccggcagatcgctgtaacaaccagaaatcttgccctgacggggccgacgaaaaaaattgtttctcttgtcagccaggcacttttcactgcgggacaaacctgtgcatctttgagacctggagatgtgacggtcaggaagattgccaagatggctcagatgagcatggatgcctggccgccgtacctcgtaaagtcattaccgcagccctgataggctccctggtatgcgggctactcctggtgatcgccctgggctgcgcgttcaaactgtattcactgcgcactcaagaataccgcgcctttgagacacagatgactcggctggaggccgagtttgtccgacgcgaggccccaccaagttacgggcaactgattgctcagggactgattcctccagttgaggattttcctgtctactccgctagccaggcctctgtgctgcagaacttacgcacggccatgcgcaggcaaatgagaagacacgcatctcggcggggcccctcacggcggaggctcggcagactctggaatagactgttccaccggccgcgcgcgcctcgcggacagattcctctcctgactgccgctagaccaagccagacagtcctcggcgacgggttccttcagccggctccaggcgccgcccctgatccacctgctccactgatggacactggctctactcgtgccgcgggggatagaccacctagcgcacctggaagagctcccgaggttggacctagtgggcctccactgccttcaggcctacgcgacccggaatgccgaccagttgacaaagatcgcaaagtctgtcgagaacccctcgtcgacggtccggcccctgcagatgctcccagggagccgtgttctgcccaggacccccaccctcaggtatccacagcctcctcaactcttggtccacattctccagagcctttgggcgtgtgccgcaatccaccaccgccctgcagtcccatgttagaagcctccgacgatgaggccttgctggtgtgttag

SEQ ID NO: 193513 - DNA, 858 bp, Artificial Sequence
  Description of Artificial Sequence: Synthetic coding sequence
atgggcaaccacctgcccgccttcggcccccggccccccggccggagagaagcactcctctctcccgattgcccacttttgcggctccatcctacaggcaagcttgggcaagcgagttgtcaggcagacgaattccgctgtgacaacggaaaatgtctccccggaccatggcaatgcaacactgttgatgagtgcggtgacgggtctgatgaaggcaactgcagcgctccagcttcagaaccaccagggtcactgtgtcctggaggcactttcccctgtagtggcgcacgtagtactcgatgtttacctgtcgagcgtcgatgtgacggcctccaggattgcggggacggctccgatgaagctggctgtccagacctggcctgtggaaggcgcctggggtccttttatggcagctttgcatctcccgacttgtttggggcagctaggggcccaagtgacctccactgtacatggctcgtggacacacaggacagccggcgggtattgctgcagctggagttgcggcttggctatgacgactatgtgcaggtgtacgagggcctgggagaacgaggggataggctgctgcagactctctcttatcggagtaatcatcggcctgtgtctctcgaggccgcacagggcaggctgaccgttgcctaccacgcgcgcgcacggtcagccggacacggctttaacgcaacatatcaggtgaaagggtattgtcttccctgggaacagccatgcggctctagcagcgattcagacggcgggagcctgggtgatcaaggctgtttttccgagccccagcgctgtgacgggtggtggcactgtgccagcggccgggacgagcagtag

SEQ ID NO: 193514 - DNA, 5718 bp, Artificial Sequence
  Description of Artificial Sequence: Synthetic coding sequence
atgcggcggcagtggggcgccctgctgctgggcgccctgctgtgcgcacacggtctcgcctcctctcctgagtgtgcttgcggtaggtcacactttacatgtgccgtgtcagctttgggggagtgtacgtgcatacctgcgcagtggcagtgcgacggggataatgactgcggtgatcattcggatgaggacggttgtatactgccaacctgctcacccctggactttcactgcgacaacggtaaatgtattcggcgaagctgggtttgtgatggggacaatgactgcgaggacgacagtgacgagcaggactgcccaccccgcgagtgtgaagaggatgaatttccttgccagaacggttattgtattcgctcgctgtggcattgcgatggggataatgactgcggggacaacagtgatgaacaatgcgatatgcgcaagtgcagcgacaaggagtttcgatgctctgatggttcgtgcattgcggaacactggtactgcgacggtgatactgactgcaaggacggctccgatgaggagaattgtcccagcgccgtaccagcacccccctgcaatcttgaggaatttcagtgcgcctatggccgctgcattctggatatctatcattgcgatggggatgatgattgcggtgactggtcagacgagtccgactgtagctcccatcagccatgtaggtctggggagttcatgtgtgatagcgggttgtgcattaatgccggctggcgctgtgacggagatgccgattgtgatgaccagtcagatgaacggaattgcaccacatcaatgtgtacggccgagcagtttaggtgccacagtggtcggtgcgtgcgattgtcctggcgctgcgacggggaagatgattgtgcagacaatagcgacgaagagaactgtgagaatacaggatctccccaatgcgccctggaccaatttctgtgctggaacggtcgctgtataggccagcggaaattgtgtaatggggtgaacgattgcggcgacaattccgatgagtctccccaacagaactgccggccccggactggcgaggagaactgtaacgtgaataatggaggctgtgcccagaaatgccagatggtgagaggcgctgttcagtgtacttgtcacaccggatatagactaacggaggacgggcatacctgtcaggacgtcaatgaatgtgcagaagagggctattgttcccagggctgcaccaattctgagggcgcttttcagtgttggtgcgagacgggctacgagttgcgccctgaccggcgatcttgtaaggcactgggcccagagcctgtactcctttttgccaaccgcattgatattcgccaggtgctgccccaccggagcgagtacactctcctgttgaataacctagagaatgccattgcattagatttccatcacaggcgtgagctagtattctggagtgacgtcacactcgataggatcctaagagctaatcttaacggttcaaacgtcgaagaggtggtgtccacaggtctggagagcccaggaggcctcgctgttgactgggtgcatgataaactctattggaccgattccggaactagtcgaatcgaggtggccaacctcgacggagcacatcgtaaagtgcttctgtggcagaaccttgagaaacctagagcgattgctttgcatcccatggaaggcaccatctactggactgactgggggaatacccctagaattgaggcatccagcatggatgggtccggccggcgcatcattgccgatactcacctattctggccaaacgggctcacaatcgactacgccggacgacgcatgtactgggtggacgccaagcatcacgttatagagagggccaacctggacgggtcccacaggaaagcagttattagccagggtttaccacacccattcgctatcactgttttcgaggatagtctttactggacagattggcataccaaatcaatcaactctgccaacaagtttacagggaagaatcaggagattataaggaacaagcttcactttcccatggatatccatactctccatccccagcggcagccagccggaaaaaacagatgtggagacaataacggcggctgcactcatctgtgtctgccatcggggcagaattacacctgcgcctgcccaacagggttccgtaaaatcagcagccacgcctgcgcccagagtctggataaattcctgcttttcgcaaggcggatggatatcagacgtatatcttttgataccgaagatttgtccgacgacgtgattccactggccgacgttcgctcagcggtggcattagactgggacagtagggatgatcacgtgtactggaccgatgtttccacagataccatcagtcgcgcaaaatgggatgggaccggtcaggaggtggtcgtagatacctccctggaaagccccgccggcctggctatagactgggttacgaacaaactgtactggacagacgccggtacagatagaatcgaagtcgcaaatacagacggtagtatgagaaccgtccttatttgggagaacttggataggcctcgggatatagttgttgaacccatgggcgggtacatgtactggacggactggggtgcatccccaaagatagagcgggccgggatggacgcatctggacgacaggttatcatctcctcgaatctgacctggccaaacggcctggccatcgattatgggagtcagcgcctctactgggccgacgctggcatgaagactattgagttcgcggggttggatggcagcaaacgaaaagttctcattggctctcagctgcctcacccattcggcctcacactgtacggcgagcgcatctactggacagactggcaaacgaagtctattcaaagcgccgatagactgactggtttggatagagagacgctccaggaaaacttggagaatcttatggacattcacgtgtttcatcgccggcgccccccagtgagcacgccttgcgctatggagaacggtggctgctcccatctttgtctgagatccccgaatcccagcggctttagctgcacttgtcccacaggtattaacctactgtccgacggaaagacttgtagcccagggatgaactcctttctgatctttgcgaggaggattgatatcaggatggtgtccttggatataccttacttcgctgacgtggtagtgcccattaatattaccatgaagaacacaatagccatcggggtggaccctcaagagggaaaggtatattggagtgacagtaccctccataggatctcacgggcaaacctagatgggtctcagcatgaggacattatcaccaccggactgcagactacggatggcctggccgtggacgcgattggtaggaaagtgtattggacagatactgggacgaatagaattgaggtgggcaatctcgatggatctatgaggaaggtcctggtttggcagaatctggatagccctagggctatagttctgtaccacgagatgggattcatgtattggactgattggggagagaatgcaaagctcgaaaggtctggcatggacgggtcagacagggctgtcctgattaataacaacttaggttggcccaatgggctgacggtggataaagcaagcagccagctcctgtgggcagacgcacacacagagcgaatcgaggctgccgacttaaacggagcaaatagacacacgctggtgtccccagtccagcacccgtacgggctgacattgctggatagttacatttactggactgattggcagactcgatccatccaccgcgcagacaaaggtactggaagcaacgtgatcctcgtgaggagcaacctgcctggactgatggacatgcaggctgtggatagggctcagccattaggattcaacaaatgtggaagccggaacggcggatgctcgcatctctgcctccctcgaccttccggcttctcttgcgcctgtccaaccgggattcagctgaagggggatggtaagacttgcgacccatccccggagacctacttactctttagttctagagggtccattcgccgcatctcgttagacacatcagaccacacagatgttcatgtacccgtccctgaacttaataacgtgatatccctggactatgatagcgttgacggcaaggtgtactacacggatgtgttccttgatgttattcggagagctgatctaaatggctccaatatggagactgtcatcggtcgaggcttgaagactactgatgggctggcggtcgactgggtggccaggaacttgtattggactgacaccgggcgaaacaccatagaagcctccaggctggacgggtcatgccgtaaagttctcataaacaactctctggatgaaccacgcgccattgcagtgtttcccagaaaaggctacttgttttggactgactgggggcacatagctaagattgaacgtgctaatcttgacggttcagagagaaaggtgttaatcaataccgatctagggtggcctaatgggctgactctagactatgacactcgaaggatttattgggtggacgcccacttggatcgcatcgaatcggcagatctcaacggaaagctgcggcaggtgctagtatcccacgtgtctcacccgttcgctctgacgcaacaggatagatggatttattggaccgattggcagaccaagtctattcagcgagtggataagtatagtggtcggaataaggagacagtcctagcaaatgtggaaggacttatggacatcatcgtggtgtcacctcagcgccaaacaggcacaaacgcctgcggcgtgaataatggcggctgcacgcacctgtgctttgcgcgtgcatcagatttcgtgtgtgcttgcccggacgagcctgatagtagaccttgcagcctggttccgggcctagttcctcccgcaccgcgcgccaccggcatgagtgagaaaagccccgtcctgccaaacacacctcctacaacactgtattcttctacaactcggacgcggacttctctcgaagaggtagaaggacggtgtagtgagcgcgatgcgaggttaggactgtgcgcacgctctaacgacgcggtgccggctgctccaggcgaaggcttacatatctcctatgcgatagggggactgttaagtattctgctcattctggtggtgattgccgcactgatgctttatcgccacaaaaaaagcaagttcacagacccagggatgggaaacctaacctattctaacccttcttaccgtaccagcactcaggaggtgaaaatcgaagctattcccaagccagcaatgtacaaccagctttgctataaaaaagaaggtggcccagaccacaactacaccaaggaaaagatcaagatcgtggagggcatctgtctcctctccggagacgacgcagaatgggacgatctcaagcagctcagatccagccggggggggcttctccgagaccatgtgtgtatgaaaaccgacactgtgtctattcaagcctcctctggcagcctggacgataccgagaccgagcagcttcttcaagaggagcagtcagagtgctccagtgtccacacagctgctactcccgagagacgtggatcactgcccgatacaggctggaagcacgaacggaagttgtcctctgagtcacaggtgtag

SEQ ID NO: 193515 - DNA, 4848 bp, Artificial Sequence
  Description of Artificial Sequence: Synthetic coding sequence
atggaggccgccccccccggccccccctggcccctgctgctgctgctgctcctgcttctcgctctatgcgggtgtccggcccccgcagccgcttcccctctgttgcttttcgcaaaccgtcgcgacgtcagactggttgatgccgggggtgtgaagctggagagcaccattgttgtttccggattggaagacgccgctgccgtagatttccaattcagtaagggggccgtttactggacggacgtgtctgaggaggctattaagcaaacgtatctgaatcagaccggtgcggccgtgcagaatgtggtgatcagtgggctggtttctcccgatggacttgcatgtgattgggttggcaagaagctgtattggacggactctgaaaccaaccgtatcgaggtggcgaatttaaatggtaccagccgcaaagtgctgttttggcaggacttggatcaacccagagctatcgcccttgatccggcacacggatacatgtattggactgactggggagagaccccgcggatcgaaagagccggtatggatgggagcacaagaaaaattattgtggactcagacatctattggccaaatggcctgaccatagatctggaggagcaaaagctctattgggccgatgcaaagctttcattcattcacagggctaatctcgacggctccttcagacagaaggtggtggagggtagtctgacacatcctttcgcattgaccctctcaggagacactctgtattggacagattggcaaaccaggtctattcacgcctgcaacaaaaggactggcggtaaacggaaagagattttgagtgcactgtacagtcctatggacatccaggtgctgtctcaagagagacagcccttctttcacaccagatgtgaagaggataacggcggctgctcgcatctctgcctgctgtcccctagcgaaccattttacacctgtgcttgcccaacaggagtacagttgcaggataacggaagaacgtgcaaggctggagccgaggaagttctgctccttgcccgcagaacagacttacgccgcatttctttagatacacccgacttcaccgatatagttttacaggttgatgatatccggcacgccatcgcaatagattatgaccccctcgaaggatatgtatactggaccgacgacgaagtgcgcgcaattagaagggcctaccttgatggttcgggtgcccaaactcttgtcaatacagagatcaatgatcccgacgggattgccgtcgactgggttgccagaaacttatactggacagataccgggacggatcgtattgaagtaactcggctgaatgggacttcaaggaagatcctggtgtccgaagaccttgacgagccaagggctattgccctacaccctgtgatgggattaatgtactggacagactggggggagaaccctaagatcgaatgcgcgaaccttgatggccaggagcgaagggtgctcgtcaacgcctccctgggatggcctaatggcctggccttagatctccaggagggcaaattatattggggggacgccaagacagataagattgaggtcataaatgttgacggcacaaagagacggactctcttagaagacaagcttccacacatctttggtttcactcttcttggggacttcatatattggacagactggcaaagacgatcaatcgaaagggtgcataaggtcaaggcatcacgggacgttatcattgaccaactaccagaccttatgggtctgaaagcagtaaacgttgccaaagtggtggggaccaatccctgcgccgaccgaaatggagggtgcagccacttgtgttttttcacacctcacgccacgcggtgcggatgccctatagggctggagctgctcagcgatatgaaaacttgtattgtccccgaagccttcctggtgttcacttctcgcgccgcaatccatcggatctctctggaaaccaacaacaatgatgtcgcgattcctttgacaggggtcaaagaggcctcagccctggatttcgatgtgagcaacaaccacatctactggactgatgtcagcttgaagacaatatcccgagctttcatgaatggcagcagcgtggaacacgtcgttgaatttggtcttgactaccccgaaggcatggccgtggactggatgggtaagaatctgtactgggcagatacagggacgaatcggattgaggttgccaggctggatggccagtttagacaggtgttggtgtggcgggaccttgacaaccctcgttctctggcattggatcctaccaagggttacatatactggactgagtggggtggcaagcctagaatcgttcgtgcattcatggacggaacaaattgtatgacgctcgtggacaaagtgggccgcgctaatgatctcacaatcgactatgcagaccagcgactctactggaccgacctggacactaacatgatagagagtagtaacatgttggggcaggagcgggtcgtcatagccgacgatcttccgcatccattcggtttgacacaatattccgactatatctattggacagattggaatcttcatagtatcgagcgggctgataagacgagcggaaggaatcgcacccttatccagggccacttagactttgtaatggacatcctggtcttccatagctcacgtcaggacgggctgaatgactgcatgcataacaacgggcagtgcgggcagttatgtcttgccattccaggtggtcatcgttgtggttgtgcctctcattatacactggacccttcctcccgcaactgcagccctccaacgacattccttctcttctcgcagaagtccgccatctcccgcatgattcctgacgaccagcatagcccggacctgatactcccactccacggattgcgcaacgtcaaggccatagattacgaccccttagataagttcatttactgggtcgacgggcgacagaatattaaaagagccaaggacgacggtacccaacccttcgtgctgacatctctcagtcagggtcagaatccagacaggcaacctcacgacctgtccatcgatatctactcgcggacattgttctggacctgtgaggctactaatacgatcaacgtgcacaggctgtcgggggaggccatgggggttgtcctacgaggggaccgggataagcccagggccattgttgttaatgccgaacgaggctacctgtactttaccaacatgcaggaccgcgcagcgaaaatagagcgcgctgctctggacgggactgagagagaggttcttttcactaccggccttattcgacccgtggcactcgtggtagataataccttgggaaagctgttctgggtcgacgccgatttgaagcgaatcgaatcatgcgacctctcaggcgcaaatagactcactcttgaagacgccaatatcgtccagcctctcggccttactattctcggcaagcacctgtattggatagacaggcagcagcaaatgattgaaagagtggagaagacaaccggagataagcgaacccggatccagggacgggtcgcacaccttaccggaattcatgccgtggaggaggttagccttgaagagttttctgcccatccctgtgcacgggacaacggaggatgcagtcacatctgcattgcaaagggggatgggacaccaagatgctcttgccctgtccacctagtgctgttgcagaatttgctcacctgtggcgaacctcccacatgtagccccgaccaattcgcttgtgcgactggtgagattgattgcattccgggcgcctggcgctgtgatgggtttcctgagtgtgacgaccagtcagacgaggaaggctgccctgtttgcagtgccgctcagttcccttgcgcaaggggtcagtgcgtagacctcaggcttaggtgtgatggcgaggccgactgccaggaccgatccgacgaagccgactgcgacgcaatctgcctccccaatcagttcagatgcgcttcagggcagtgcgtcctgatcaaacagcagtgtgactcgtttccagattgcattgacggctctgatgaactcatgtgcgaaattactaagcccccgtccgatgacagccctgcccacagtagtgccatcggaccagtgattggcataattctctcactttttgtgatggggggcgtctatttcgtatgtcagcgagttgtctgtcaaaggtacgccggcgcaaacggtccttttccccacgagtatgtatccggcactccacatgtgccactgaatttcatcgccccgggtggctcccagcatggcccctttacagggatcgcctgtggaaaaagcatgatgagtagcgtgtctctcatgggcggccggggaggagtgccattgtacgaccgtaatcacgtcacaggcgcctcttcttctagctcttccagcacgaaagctaccctgtaccctccaatcctgaatccgcctccttctcccgccacagatccatccctttacaatatggacatgttctacagctcaaacataccggcaacagcgagaccatatcggccatacatcatcaggggcatggcacctccaactacaccatgtagcacagacgtatgcgactccgactacagtgcaagccgttggaaggcctccaagtactatttagacttgaattctgactcagacccctaccctcccccgcccacaccccatagccaatacctctccgctgaagatagctgtccaccgagcccagccaccgaacggagttacttccaccttttccccccgcctccctcgccatgtactgacagcagttag

SEQ ID NO: 193516 - DNA, 4842 bp, Artificial Sequence
  Description of Artificial Sequence: Synthetic coding sequence
atgggcgccgtgctgcggagcctgctggcctgcagcttctgcgtgctcctgagagctgcacccctcctcctttacgccaatcgccgagacttgaggctcgttgatgcaaccaatgggaaggaaaacgcaaccattgtagtcggcggactcgaggatgcggctgctgtggatttcgtattctctcatggacttatttattggtcggacgtgagcgaggaggcaattaaaaggactgagttcaataaaacagagagtgtgcaaaatgtggttgtcagcggattgctttcaccggatggcctggcctgcgactggctgggggaaaagttatattggaccgattctgagaccaacagaatcgaggtcagtaatttagacggaagcctacgcaaggtgctgttctggcaggagcttgaccagcctagagcaatcgctctcgatccgtctagcggctttatgtactggaccgactggggggaagtgccaaagattgaacgggcgggtatggatgggtcatctaggttcattataataaactctgagatctactggcctaacggattgacattggattacgaggagcagaagctatactgggcggacgctaagttaaacttcatccataagtcaaacctggacggcacaaatagacaggccgtcgtcaagggcagcctgccccacccattcgccctcaccctctttgaagacattctgtattggacagattggtctacccattcaatcctggcttgtaataagtacacaggcgagggcctccgggaaatccactccgacattttctcgcccatggacatccacgcattttcccagcagcgtcagccaaatgccaccaatccttgcgggatcgacaatggcggttgtagccacctctgcctgatgtcccctgtcaaacctttttaccagtgcgcatgcccaaccggagtgaaactccttgagaatgggaaaacctgcaaggatggggccacggagctgttgctgctcgctcgccgcacagacttgcgacgtatttctcttgatacacctgactttacagacattgtgttgcaactggaggacataaggcacgcgatcgcaattgactacgaccccgttgagggctacatctattggactgatgacgaagttagggccatccggcggagctttatagacggcagcggatcacagttcgtggtcacagcccagatagcccaccccgatggtattgcagtggattgggttgcccggaatctgtactggaccgataccgggactgacaggattgaagtgacaaggttgaacggaactatgcggaagattttaatctctgaggatctggaggagccacgggctattgtgttagatccaatggtgggctacatgtattggacggactggggggaaattcctaaaattgaaagagctgcgttagatggctctgacagagtggtcttggtcaatacatcccttggatggccgaatggactggccctggattacgacgagggcaagatctattggggcgacgccaaaacagacaaaattgaagttatgaacaccgacgggaccggcagacgagtgctggtggaggacaaaatacctcacatttttggcttcactttactgggcgattacgtgtactggactgattggcagagacggtccatcgagcgcgtgcacaagcggtctgccgagcgggaagtcattatcgatcagctgccagatcttatgggattgaaagcaaccaacgtgcatcgggttatcggctccaatccctgtgccgaagagaatggaggctgtagccacctgtgcctgtacagaccacaggggctgagatgtgcgtgccccatcggtttcgaactgatttccgatatgaagacctgtattgtgccggaagctttcctcttattcagccgcagggccgacatcagacgtattagcctcgagacaaacaataacaacgtcgctattccgctcacaggagtgaaggaagccagcgccctcgatttcgacgttacagacaacaggatatactggaccgatattagcctcaagacaatctctcgtgcctttatgaacggcagtgcccttgagcacgtcgtggaatttggtctcgactaccctgagggcatggcagtcgactggctgggcaagaacctgtactgggcagatacgggcactaatcgcattgaagtctcaaaactcgacgggcagcatcgccaagtgctcgtgtggaaggacctcgactcaccccgtgccctggccctggatccagctgaaggcttcatgtactggaccgagtggggtgggaagcccaagattgatcgagcagctatggacggctccgaaagaacaactttggtccccaacgttggacgagcaaacggcttgacgatcgactacgcgaagcgaagactctactggaccgatctggatacgaaccttattgaaagctcaaatatgctgggtcttaatagggaagttatagccgacgacctccctcacccattcgggctgacacagtaccaggattatatctattggaccgattggagcagacgctctatagagagagcgaacaagacatcaggacagaaccgtaccatcatccagggacatctggactacgtgatggatattctggtttttcattctagtaggcagtccgggtggaacgagtgcgcctctagcaacggccactgttcccacctgtgtctcgctgttccagttggagggttcgtgtgtggctgtccagcacattattcacttaatgctgacaatagaacctgctctgcgcccactactttcctgctgttttcacagaaatctgctataaataggatggtgatcgatgagcagcagagcccagacataattctgcctatccactctttacgaaatgtgcgagctatagactatgacccgcttgacaaacagctatactggatagatagcaggcagaatatgatcaggaaggcccaggaggatggttcacaggggttcactgtggtggtttccagcgttccatcacagaacctcgagattcaaccgtacgacctctccatcgacatctactcccgctacatatactggacttgcgaggcgaccaacgttatcaatgtgacccgactggatggacgcagcgtgggggtggtgctaaaaggtgaacaggatcgacctagggcggtggtggtgaaccccgagaagggttatatgtattttaccaatttgcaggagagaagccctaaaatcgagagagccgccctcgacggcactgaacgtgaggtcctgttcttctcaggactgagtaagcccatcgccctggcactggactcacgccttggcaagcttttttgggccgattcagatctcagacggattgaaagtagtgatctttcaggagctaaccgtattgtgctggaggactctaacatcctacagccagtcggtcttaccgttttcgagaactggctctactggatcgataaacagcagcagatgatcgaaaagatagatatgacaggtcgagagggcagaaccaaagtgcaggcacggatagcccagttgagtgatattcatgcagttaaggaattgaacctgcaggaatatcggcagcatccatgcgctcaagacaacggcgggtgtagtcatatctgtctggtaaaaggtgatggaaccacccgctgtagctgtcctatgcacttggtgcttctgcaggacgagctaagttgtggggagccccccacgtgcagcccacaacagttcacctgcttcaccggagaaatcgactgcattcctgtagcgtggcgttgcgacggctttaccgaatgcgaggaccactccgatgaactgaattgtcctgtgtgtagcgagtcccagttccagtgcgcctccggccagtgtatagacggcgccctgcgatgtaatggcgacgccaattgccaggataagtccgatgagaaaaactgtgaggtcctctgtctgattgatcagttcagatgtgccaatggacagtgcatcgggaagcacaagaaatgtgaccataatgtggactgcagcgacaagtccgacgagctcgattgttaccctacagaagaaccagcaccccaggcgacaaatactgtggggagcgtgatcggagtgatcgtgactatattcgttagtggaacagtttactttatctgccagcgcatgttgtgtcctaggatgaaaggggacggggaaaccatgacgaacgattacgtcgtccacgggcctgccagcgtgcctttgggatacgtaccccacccctcctccctgtcaggaagcttacccgggatgtcccggggcaagagcatgatcagcagcctgagcatcatgggaggttctagcggccctccttatgaccgggcacatgtgactggcgcttcatccagttcatcctccagtacaaagggcacttattttccagctatactcaatccccctccgtcccccgctactgagagaagtcactatacaatggagttcggatacagctccaacagcccgagcacccatagatcctattcctaccggccatactcttaccgacatttcgctcccccaactacgccatgctctaccgacgtctgtgactccgactacgccccttctcgtaggatgacatccgtggcaactgctaagggatacacttccgacctgaactacgactctgaaccggtgcctccccccccaacgccgcgctcacagtacctcagcgcggaagagaactatgaatcctgccccccgagcccatatacagagaggagttattcacaccatttgtacccgcccccaccatcaccctgtactgattctagctag

SEQ ID NO: 193517 - DNA, 4437 bp, Artificial Sequence
  Description of Artificial Sequence: Synthetic coding sequence
tgactggaccagccccgggccatcgccctggaccccagcagcggctttatgtactggactgattggggagaggtgcccaagatagagagggctgggatggacggatcttcacggttcatcatcatcaattctgagatatattggcctaacggcctaacgctagactatgaggagcagaaattatactgggctgacgcgaaacttaattttatccacaagtcaaacctcgacggcaccaacagacaggccgtagtcaagggaagcctgccccatcctttcgcgcttactctgtttgaagacatactttactggactgactggagcacccactcaatccttgcttgcaataaatatactggcgaaggccttagggagatacactcagatattttctcaccaatggatatacacgccttttcccagcagaggcaacctaacgctaccaacccatgcgggattgacaacggggggtgctcccatctatgtttgatgagccccgtgaagcccttttaccagtgcgcctgtcccacaggagtcaagctgttagagaatgggaaaacttgcaaggatggagcaaccgaactccttctgctggctcggagaacagatcttcgaaggatttccctcgataccccagatttcacagacatcgtgctccagttggaagacattcgacatgccatcgcgatagactatgacccagtagaaggctacatctactggaccgatgatgaagtgcgggccattcggagatccttcatcgacgggtcgggctcccagtttgttgtgactgcccaaattgctcatcctgacggtattgcagtagattgggtggctagaaatctttactggacagacaccggtaccgaccgcatcgaggttacaaggttgaacggcaccatgcgaaaaatccttatcagcgaggaccttgaggagcctcgcgcaattgtgttggatccaatggttgggtacatgtattggacagattggggtgaaattccaaaaattgagcgtgctgccctggatggttccgatcgggtggtactcgtcaacaccagcctgggctggccgaacggcctggccctggactacgatgaaggtaagatttactggggcgatgctaagactgacaagattgaagtaatgaacacagacggcaccggccgaagggtgctggtggaagacaagatcccgcacatctttggtttcaccctgctgggcgattatgtttactggaccgattggcagcgccggagcattgagcgcgtgcacaaacgctccgctgaaagagaggtcatcatcgaccagctgcctgatctcatgggtctcaaagccactaacgtgcatcgcgtgatcggctcgaacccctgcgccgaggagaacggtgggtgctcacacctgtgtctgtatcggccccagggtctgagatgtgcatgtcccattgggttcgagctgattagcgacatgaaaacctgcatcgtccctgaggcatttctcctatttagccgccgcgcagatatacggcgtattagccttgagactaataataacaacgtggcgatacctctgacgggggtaaaagaggctagcgccctggactttgatgtgaccgataatcgaatttactggacagatataagcttgaagacaatctcccgcgcctttatgaatggaagcgctttggagcacgtggtggagttcggactcgactacccagaaggaatggccgtcgactggctcggcaaaaacctgtattgggccgatacgggaactaaccgtatcgaggtttcaaaacttgatggccaacacagacaggtgctggtttggaaggatctggattcccctcgcgctttggccttggaccctgcagagggcttcatgtactggacagaatggggtggcaagccaaaaatagaccgagcagctatggacgggtctgaacgaaccacacttgtaccgaacgtcggaagagcgaatggcctgactattgactacgccaaaagacggctgtattggacagatctggacaccaacctgatcgagtcgtccaatatgctgggtctgaaccgggaagtgattgccgatgacctacctcatccatttggcctgacacagtaccaggactacatctactggacggactggagcaggcggtctattgagagagctaataaaaccagcggtcaaaacaggaccatcattcaggggcacctcgactacgtgatggacatcctggtctttcactccagcagacaaagcgggtggaacgaatgcgcctcttcaaacgggcattgttctcacctttgccttgccgttcctgtcggaggctttgtgtgcgggtgcccggcccactattctcttaacgccgataaccgcacatgttcagcacccactaccttcctgttgttcagccaaaagagtgccatcaaccggatggtaatcgatgaacagcaaagtccagacatcatactgcccatccactctctgcggaacgtcagagctatcgattatgacccactggacaaacaattgtactggatcgatagtagacagaatatgatacggaaggcccaggaagacgggtcccaaggcttcaccgtcgtggtgtcctctgtgccctcccaaaacttggaaatccagccctacgatctgagcatcgacatatactctcgctatatctactggacttgtgaagcaaccaatgtcattaacgtgacaagactcgacggtaggagcgtgggggtggttctgaaaggcgagcaggataggccacgggctgtggtagtgaatccagaaaaaggttacatgtactttacaaatctgcaggaacgtagcccgaagatagaaagagcagcactggatggcaccgaacgggaagtattgttcttctctgggttaagtaaacccatcgctttggcactggatagccgtctgggaaagttattctgggctgattctgaccttaggaggatagaatcctcagatctgtcaggggcaaacaggattgtcctggaggattctaacattttgcagcccgtggggctgactgtatttgagaattggctttactggatcgataaacagcaacagatgatcgaaaagattgacatgactggccgcgagggcaggaccaaagtgcaagcacggatcgcacagttgtcagacatccacgccgtgaaggaattaaaccttcaagagtaccgacaacacccatgcgcccaagacaacggaggttgcagccatatctgtctcgtgaagggagacgggacaaccaggtgcagttgccccatgcacctcgtcctgctgcaggacgagctctcatgtggtgagcctcccacttgcagtccacagcagttcacgtgctttaccggcgagatcgattgcattccagttgcctggcggtgtgacggttttaccgagtgtgaagatcattcggatgagcttaattgtcccgtctgctccgagagccagtttcagtgcgcaagcggacagtgcatagatggggcgttgcgttgcaacggagacgcaaactgccaggacaaatctgatgagaagaattgcgaggtgttatgcctgatagaccagtttcgttgtgccaacggccagtgcatcggcaagcataaaaaatgtgatcacaatgttgattgtagcgataaaagtgacgagctggattgctacccaaccgaagagcctgccccacaagcaaccaacactgttggttctgtaattggcgtgatagttaccatcttcgtctcggggaccgtttacttcatatgtcagcgcatgctgtgccctaggatgaagggagatggcgagaccatgaccaacgactacgtggtgcacgggcctgcctccgtccccctcggatacgtgccacatccctcaagcctgtcaggaagcctcccaggaatgagcaggggaaagtcaatgatctctagcctctctataatgggcgggtcctcaggaccaccctatgaccgggcccatgtgaccggggcaagtagttcaagttcttccagcaccaaaggaacatatttccctgccatcctcaaccccccaccaagccccgccacggaacggagccactacaccatggaatttgggtacagctcaaactccccgtccactcataggtcatatagttataggccttattcatacaggcattttgcccctccgaccaccccctgctctacagacgtatgtgatagcgactatgctccctctagaaggatgacgagtgtcgccactgcaaaagggtatacctctgatttaaactacgatagcgagcccgttcctcccccccctactccacggtcccagtacctgagcgctgaagagaactatgagagttgccctccatcaccgtacactgaaaggtcatactctcaccatctttatcccccgcctcccagtccatgtaccgatagcagctag

SEQ ID NO: 193518 - DNA, 2382 bp, Artificial Sequence
  Description of Artificial Sequence: Synthetic coding sequence
atgggcctgcccgagcccggccccctgcggctgctggccctgctgctccttttactcctgctcttgctgctgcagctgcagcatctggcagctgctgccgcggaccctctcttggggggccaggggcccgcgaaagattgcgaaaaggaccaatttcagtgtcggaacgagcgctgcattccatcagtgtggcggtgcgacgaggacgacgactgtctggatcactctgacgaggacgactgcccaaagaaaacttgcgccgatagtgatttcacttgtgacaatggacactgtatccacgaacggtggaaatgtgatggggaagaggaatgtcccgacggttcggacgagtccgaggctacatgcacaaagcaggtgtgtccagccgagaagctgtcatgtggacccacaagccataaatgtgtccccgcatcctggcggtgcgacggagagaaggattgtgaagggggggccgatgaagccggctgcgccacctggctgaatgagtgcttacacaataacggaggatgcagccacatctgcacagatttgaaaatagggttcgagtgcacatgtcccgcggggtttcaactcctagatcaaaagacatgtggcgatatcgacgaatgtaaggatcctgatgcttgtagccaaatttgcgtgaactataaggggtacttcaagtgcgaatgttaccctggctatgaaatggatcttctcacgaaaaattgcaaggctgctgccggaaagtccccctcccttattttcacaaaccgccacgaagtgagacgcatcgacttggtaaagcgaaattacagtcggctgataccaatgttgaagaatgttgtagcgttggacgtagaagtggcgacgaatcggatctactggtgcgacctgtcgtacaggaaaatctatagcgcctacatggataaggctagtgaccctaaagagcaggaagtgttgattgatgaacaactacactcgcctgaagggctggcggtggattgggtccacaagcatatttattggaccgactctggaaacaagaccatctctgttgccacagtcgacggagggcgaagaagaaccttgttcagccggaaccttagcgaaccgcgggcgatcgcagtggatcccctcaggggcttcatgtattggtctgactggggtgatcaggctaagatcgaaaaatccgggcttaatggagtggaccgacaaacgctggtgagtgacaacatcgaatggcctaatggcattacattggatctgttaagtcagagattgtactgggtggactcgaagttgcaccagttaagttcgattgactttagcgggggaaatcgcaagaccctgataagctcaaccgactttctgtctcatccatttgggatagccgttttcgaggacaaggtgttctggacagacctggaaaatgaagcaattttctccgcaaatcgtttaaacggattggagatcagcatccttgccgaaaatcttaacaacccacacgacatcgtgattttccatgaactcaagcaaccacgggcccccgacgcgtgcgagctcagcgtccagccaaacgggggttgtgaatacctgtgccttccagcaccacagatcagttctcacagtccaaaatatacgtgtgcatgtcccgataccatgtggctcggacctgatatgaagagatgctatcgagccccacagagcacaagcaccacaaccctggcaagcacaatgacacgcacagtgcccgcaaccacacgagcaccaggaaccactgtacacagaagcacctatcagaatcatagcacagagacaccttcactcaccgctgcagtaccaagttcagtttccgtcccacgggcaccgtctatcagccctagcacgttaagccccgccacctccaaccactcacagcactacgcaaacgaagatagcaagatggggtccacagtgacggccgcggtgatcgggataatagtgccaattgtagtgatagcactgctttgcatgagcggatacctcatctggcgaaattggaaaaggaagaacacaaagagcatgaactttgacaaccccgtctaccggaagacaacagaggaggaagatgaagatgagcttcacatcggtaggacagcccagatcggacatgtctacccagctgccatctcctcgtttgaccggcccctgtgggcggagccctgcctgggtgaaaccagggaacctgaagatccagctccagcactcaaggagttgtttgttctcccaggagaaccacggtctcagttacaccagctgcccaagaacccgctgtctgagctgccagttgtgaaatcaaagagggtggctctgtcactggaagatgacgggctgccgtag

SEQ ID NO: 193519 - DNA, 2892 bp, Artificial Sequence
  Description of Artificial Sequence: Synthetic coding sequence
atgggcctgcccgagcccggccccctgcggctgctggccctgctgctcctgctcctcctcctgctccttctgcagctgcaacacctcgccgcggccgctgcggacccactgctgggaggccagggacctgcaaaggactgcgagaaagatcagtttcaatgcagaaacgaaagatgcatcccatccgtgtggcgctgcgacgaagatgacgactgcctcgatcatagtgatgaggatgattgccccaagaaaacatgtgctgactccgattttacctgcgacaatggtcattgtatccatgaacggtggaagtgcgacggtgaggaggaatgtcctgatggatctgatgagagtgaggccacatgcactaagcaggtgtgcccggccgagaaactgagttgtggacctaccagccacaagtgcgtacccgctagttggagatgtgacggagagaaagattgcgagggcggggctgacgaggcaggctgtgcaacactgtgtgctcctcatgaatttcagtgtggcaatagatcatgtctagcagccgtctttgtctgcgacggagatgacgattgcggtgacgggagcgatgaaagaggctgcgcagatcccgcgtgtggccctagagagttccggtgtggaggcgatggtggtggtgcctgcattcccgagagatgggtatgcgacaggcagttcgactgtgaggataggagcgatgaagctgcagaactgtgtgggaggcccggtcccggggctacctctgcgcctgccgcctgtgctactgcatcgcagttcgcttgccgctcgggagagtgcgtccatctgggatggcgctgcgatggggatcgggactgtaaggataaaagcgatgaagctgattgtccgttgggaacctgtcgcggagacgaatttcaatgtggagatggcacgtgcgtgctcgccataaaacattgtaatcaggagcaggattgccctgacggatctgatgaggccggatgtttgcagggccttaacgagtgcctgcacaacaatggtggatgttcccatatctgtaccgaccttaaaattggatttgagtgtacttgccctgctgggtttcagcttttagaccagaagacctgcggagacatcgacgaatgcaaggatccagatgcctgttcacaaatatgcgtaaattacaaggggtacttcaagtgcgagtgctatcccgggtatgagatggatctgctgactaaaaattgtaaggccgcagcagggaagtcaccatcccttatctttaccaaccgccatgaggtgaggcgaatcgacctggtgaagcgcaattacagcaggctgattcccatgttgaagaatgtggttgccctggacgtcgaggttgcgactaaccggatctattggtgtgatctgagttatagaaaaatctactcagcttatatggacaaggcatctgaccccaaggagcaggaggtgttaattgacgaacagctgcattctccagagggactggccgtagattgggtgcataaacatatttattggaccgacagcgggaataagacgatctctgtggctactgtagatgggggccgaaggcggactctattttcacggaaccttagcgagccgcgggccatcgccgtcgatcccctgcgcggatttatgtattggtccgactggggcgatcaggccaagatagaaaaaagtgggttgaacggcgtggatcgacaaactctggtaagcgataacatcgaatggcctaatgggattactctggacttgctttctcagagactgtactgggtggacagcaagctgcaccagctctccagcattgatttctcaggagggaatcggaaaacactcattagctccactgactttctctctcacccattcgggatcgctgtgttcgaggataaggtgttctggacagatctcgagaacgaggccatcttcagcgcaaatcggctgaacggactggaaattagtattctcgctgagaatctgaataatccccatgacatcgtcatctttcacgagctcaagcagccacgcgctccagatgcgtgtgaactttctgtgcagccgaacggcggctgtgagtatctgtgtctgccagccccacagattagctcgcactcccccaaatacacttgcgcctgcccagacaccatgtggttgggacctgatatgaagcgttgctatagagctcctcagtcaacatcaacaactacccttgcctctacgatgaccagaaccgtgcccgcaactaccagagcacccggtaccaccgtgcaccgaagtacataccaaaaccacagcaccgagacgccctccctaacagctgcagtgcccagctccgtctctgtgccacgcgccccatccatcagcccctccacactgagccccgccacctctaatcatagccagcactacgccaacgaggattccaagatgggaagcaccgtgacggcagccgtgattggcataattgtaccaattgtggtgattgccctactatgtatgagtggatacttgatttggagaaattggaagcggaaaaacacaaagtccatgaactttgataatccagtgtaccggaagactacagaagaggaggatgaagatgagctgcatataggaaggaccgcgcaaatcggccacgtatatcctgccgccatctcgtcattcgataggcctttgtgggcggaaccttgtctcggagagacccgagagcctgaggatcctgcccctgctctcaaggaactgttcgttctgccaggtgaacctagatctcagctccaccagctgcccaagaatcctctgagcgagttacccgtggtgaaatcaaagagggtagccctgtccttagaagacgacggcctgccctag

SEQ ID NO: 193520 - DNA, 2103 bp, Artificial Sequence
  Description of Artificial Sequence: Synthetic coding sequence
atgggcctgcccgagcccggccccctgcggctgctggccctgctgctactcctgctccttctcctgttactgcagcttcagcacttagccgctgcagctgccgacccgttacttgggggccagggcccggcaaaagactgtgagaaggaccagttccagtgccggaatgaaagatgtattccttctgtctggcgctgcgacgaggatgatgattgtctggatcatagcgatgaggacgactgtcctaagaagacttgcgcggactcagatttcacatgtgacaacgggcactgcattcacgaaaggtggaaatgtgatggagaggaagagtgtcctgatggctccgacgagagcgaggccacatgcacaaaacaggtgtgccctgcagaaaaattgagctgcggccccacaagtcacaagtgtgtcccagcatcatggcgatgcgacggagagaaggattgcgagggcggagccgatgaggccggctgcgcaacatcactgggaacatgtcgcggggacgaattccagtgtggggatggtacgtgcgtgctggccatcaagcactgtaaccaagagcaggattgtcccgacggctcagatgaggcaggatgcctgcagggattgaacgaatgcttacataacaatggtggttgctcgcatatatgcaccgatctgaaaatcgggtttgagtgcacctgtccggctggttttcaattgttagatcaaaagacatgtggggacatcgacgagtgcaaggaccctgacgcctgctcccagatctgtgtgaactataagggatacttcaagtgtgaatgctatccaggctacgagatggatctcctgacgaaaaactgcaaagctgccgctggcaaatccccttctctgatcttcacaaaccggcatgaggtgaggcgaatagatctcgtgaaacgcaattacagtaggctcatccccatgctaaagaacgtggtggccctcgatgtggaagtggccacgaatcgcatttactggtgcgatctatcatatcgaaagatctattccgcctacatggacaaagcgtccgacccaaaagaacaagaagtgctcattgacgaacagctgcattcgcctgaaggtcttgcagttgattgggttcacaaacatatctattggacagattcaggcaataaaacaatttcagttgctacagtggacggggggaggcgaaggaccctgttcagccggaacctctcagaacctagggctatagccgtagatcctctgaggggattcatgtattggtctgactggggcgatcaggccaaaatcgaaaagtctggtctgaatggcgtggatcgccagactctcgtgtctgataacatcgagtggccaaacggcatcaccctggatttgctgtcacagcgtctctattgggtggactcgaagcttcatcaattaagttcaattgatttcagcggcggcaatagaaagaccctcattagctccaccgacttcttatctcatccattcggcatagctgtattcgaagataaggtgttctggacagacctggaaaacgaagcgattttttctgccaacagattaaatggtttggagatcagtattctcgcagaaaacttgaataacccacatgacatcgttatctttcacgagcttaagcagcccagagccccagatgcttgtgaactcagtgtacaacccaacggggggtgtgaatatttatgccttcccgcaccccaaatcagttcacatagccccaagtacacctgcgcatgccccgacactatgtggcttggcccagatatgaagcgctgttatagggatgccaatgaggactcaaagatgggatccacagtgaccgctgcagtgatagggattatcgtcccaatcgtcgtgattgccctgctgtgtatgagtggttaccttatatggaggaattggaagcgcaagaacaccaagtcgatgaattttgataatcctgtttacaggaagactaccgaggaagaggatgaggatgagttgcatatcggaagaacagctcagattggccacgtttatccagcacgcgttgctctgtcgcttgaagatgatggcctcccctag

SEQ ID NO: 193521 - DNA, 2715 bp, Artificial Sequence
  Description of Artificial Sequence: Synthetic coding sequence
atgggcctgcccgagcccggccccctgcggctgctggccctgctgctacttctcctcctgctgctcctgcttcaactccaacacctggctgccgccgctgcagatccattgctggggggtcaaggcccagctaaagattgtgaaaaggaccagtttcaatgcagaaacgagcgatgcatcccatctgtgtggcggtgcgacgaggacgatgattgcctggaccactcagatgaagacgattgtccaaagaagacttgcgcggactctgatttcacatgtgacaatggccactgcatccacgagagatggaaatgcgatggagaggaggaatgtccagacggctcagatgaatccgaggccacttgtacaaagcaggtgtgcccagctgagaaactctcctgcggacccactagtcataaatgcgtgccggcgtcatggcgttgtgacggtgagaaagactgcgagggaggcgccgacgaggcagggtgcgctacgctttgcgcaccacacgaattccagtgcggaaatcggtcctgccttgcagccgtgtttgtgtgcgatggtgatgacgactgcggagatgggagcgatgaacgaggctgcgccgacccagcctgtgggcccagggaatttcgatgcggaggcgatggtggaggcgcgtgcatacccgagcggtgggtctgcgatagacagtttgactgtgaagatcggtccgacgaggcagcggagttgtgtgggcggcctggacctggcgccacctcagcaccagctgcctgtgcaacagcttctcagttcgcgtgtcggtccggcgagtgcgtgcacctcggctggcgctgcgatggtgatcgggattgcaaggacaagtccgatgaagctgattgtcctctagggacatgccggggagatgagtttcagtgtggtgacggaacttgtgtcctggctataaagcactgtaaccaggagcaagactgtccagatggttccgatgaagccggctgcctgcagggcctgaatgaatgcctccacaataatggaggctgctcacacatctgtactgatctcaagattggctttgagtgcacttgccccgctggcttccagcttttggatcagaagacctgtggtgatatcgatgaatgtaaggatccagatgcttgcagtcagatctgcgtgaactacaaagggtacttcaagtgcgaatgttaccccggttacgaaatggacttgttgacgaagaactgtaaggcagccgctggcaagagccccagccttatttttactaatcgacacgaggtgaggagaatcgacctcgtcaaacggaactattctcgtctgataccaatgctgaaaaacgtggtggcattggatgtggaggttgctacaaaccggatttattggtgcgacctgtcgtataggaaaatttattcagcctatatggacaaggctagcgaccctaaagagcaggaagtattaatcgacgagcaactgcactctccagaggggctggcggtggattgggttcacaaacatatttactggacggactctggcaacaaaactatttctgtggccaccgtggatggcggccgacggcgcactctgttctcccgcaatctatctgagcctagagcaatcgcagtcgaccctctgaggggctttatgtactggtcagactggggggaccaggcaaaaatcgagaaatctgggcttaacggagtcgatcggcagacattagtaagcgataatatcgagtggccaaatggcatcaccctggatctcctgagccaacgcctctattgggtcgactctaaactacaccaactctcttcgatcgactttagtgggggtaacagaaagactctgatttcttctaccgatttcctctctcacccatttggcattgctgtcttcgaggacaaagtgttttggacggatctcgagaacgaggccatcttcagtgccaaccgcctcaacggactggagatctcaatccttgccgagaacttaaacaatcctcatgacatcgtcatcttccacgaattaaagcagcctagagccccagatgcatgcgagctatccgtgcagcctaatggtggctgtgagtatctgtgtttacccgcaccacagatctccagtcactctcctaaatacacctgcgcatgcccggacacaatgtggctcggcccggatatgaaaaggtgttatcgcgcgccccaatcgacttcaactaccactctggctagcacaatgacccggaccgtgcctgccacaactagggcgcccggcaccacagttcacaggtctacatatcagaaccattccaccgagacgccttctcttaccgctgctgtacccagttccgtttccgtccccagggcaccctcgatttccccttccactctgagtcctgccacaagcaaccacagccagcactatgcgaatgaggatagcaaaatgggcagcaccgtgacagccgctgtcattggaatcatcgtccctatcgtcgtgatcgcattgctctgtatgagtggctatttgatctggcggaactggaagcgcaagaatacgaagtctatgaatttcgacaatcccgtgtatcgaaagaccaccgaggaagaggatgaggatgagctccacattggcagaaccgcccagatcgggcacgtgtacccagcccgagtcgcgctatctcttgaagatgatggactgccgtag

SEQ ID NO: 193522 - DNA, 1074 bp, Artificial Sequence
  Description of Artificial Sequence: Synthetic coding sequence
atggccccccggcgggtgcggagcttcctgcggggcctgcccgcccttctgctgctcctcctatttctggggccatggcccgccgccagccacgggggaaaatacagccgcgagaagaaccagcctaagccgagccctaagcgagagagcggagaggagtttagaatggaaaagttaaaccagctgtgggaaaaggcccagcggctacatctgccgccagtgagattggcagaactgcacgccgatctgaaaatccaggaacgcgacgagctggcatggaagaagctaaaactagacggtctcgacgaggatggggagaaggaagcacgccttatccgaaacctcaatgtgatccttgccaagtacggattggatggaaaaaaagacgctcggcaggtgacatctaattctcttagcgggactcaggaggatggcctcgacgatcctagactggagaaattgtggcacaaggccaaaacttcaggcaaatttagcggtgaggagctcgacaagctgtggagggaattcctgcatcacaaagagaaagtacacgagtataatgtcttgctggaaaccttatccagaaccgaggagatacatgagaacgtcatctccccttcagatctctcagacattaagggcagcgtgctgcactcgagacatactgagcttaaagagaaacttagatcaatcaaccaaggattggaccgcctgcgaagagtgtcgcaccagggctatagcacagaggctgagttcgaggagcctagggttattgacctctgggatctcgctcaaagtgctaaccttacggacaaagagttggaggcttttcgagaggagctgaagcacttcgaagcgaaaatagaaaagcacaaccattaccagaagcagctcgagatcgcccacgaaaaacttaggcatgccgagagcgtgggtgatggcgaacgagtttcccggagccgggaaaaacatgcactcctcgaggggcgaaccaaggaattgggctacaccgtgaaaaagcatttgcaagacctatcgggacggataagcagggcccggcataacgagctctag

SEQ ID NO: 193523 - DNA, 402 bp, Artificial Sequence
  Description of Artificial Sequence: Synthetic coding sequence
atgaactacatgcccggcaccgccagcctgatcgaggacatcgacaagaaacatctcgtccttctaagagatggtcgaacactgataggattcctgagatcgatcgatcaattcgccaacctggtgctccaccagacagttgaacgaatccacgttggcaaaaaatacggagatattccaagggggatattcgttgtgaggggcgagaacgtagttctgctgggggaaatcgacctcgaaaaagaaagcgacactcccttgcaacaggtgtcaatcgaggagatccttgaggaacagagggtggaacaacagactaagctcgaagccgaaaagctcaaagtgcaggcgctgaaggaccgcggtttatccatcccccgggccgatactttggatgaatattag

SEQ ID NO: 193524 - DNA, 588 bp, Artificial Sequence
  Description of Artificial Sequence: Synthetic coding sequence
atggccgccccccccggcgagtacttcagcgtgggcagccaggtgagctgtcggacctgtcaggagcagcgactccaaggggaggttgtggctttcgattatcaatctaaaatgttagcacttaagtgtcctagcagctcgggaaagcccaaccacgctgatatacttctaataaatcttcagtatgtgagcgaagtggagatcatcaacgacagaacagaaacgcccccgccgctggcctccctcaacgtctccaaattagcttctaaggctagaacagaaaaagaagaaaagctgagccaggcttacgcgatcagtgccggtgtgtcacttgaaggccagcaactgtttcagacaatccacaaaactattaaggattgcaaatggcaggaaaagaacattgttgtaatggaggaggtcgtgatcacacccccttatcaagtggagaattgcaaaggaaaggaaggctccgctctgagccatgttagaaagatcgtggagaagcacttccgcgatgtggagagccagaaaattttacagaggtctcaagcccaacagccacaaaaagaagccgccctaagctcctag

SEQ ID NO: 193525 - DNA, 588 bp, Artificial Sequence
  Description of Artificial Sequence: Synthetic coding sequence
atggccgccccccccggcgagtacttcagcgtgggcagccaggtgagctgcaggacatgtcaggagcagaggctgcagggcgaggtcgtggccttcgattaccaaagtaagatgcttgctttgaagtgcccaagctctagcggaaaacccaatcatgcggacattctcttgatcaaccttcagtacgtatccgaggtcgagataataaacgaccggacggaaacaccaccccctttagccagccttaatgtatccaagctggcgtccaaagctaggacggaaaaggaagaaaagctttcccaggcctatgccatcagtgccggcgtgtccctggagggccaacagctatttcagacaatacacaaaacaattaaggattgcaagtggcaggaaaaaaacatcgtggtaatggaagaggttgtgattacacctccatatcaggtggaaaattgtaaggggaaagaggggtcagccctctcacatgtgcgaaaaatcgtggagaaacatttcagagacgttgagagtcaaaagatacttcagcgctcccaggcccagcagccccagaaagaagcagcgctcagctcctag

SEQ ID NO: 193526 - DNA, 288 bp, Artificial Sequence
  Description of Artificial Sequence: Synthetic coding sequence
atgctgttctacagcttcttcaagagcctggtgggcaaggacgtggttgtggagcttaagaatgatctgagcatctgcggtaccctccactctgttgatcagtacctgaatatcaaactgactgacattagtgtcaccgaccctgagaaatatccgcacatgctctcagtcaagaactgcttcataagggggtcagttgttagatacgttcaactgccagctgacgaggtggacacacagctgctccaggacgcagcccgcaaagaggccctgcagcaaaagcaatag

SEQ ID NO: 193527 - DNA, 288 bp, Artificial Sequence
  Description of Artificial Sequence: Synthetic coding sequence
atgctgttctacagcttcttcaagagcctggtgggcaaggacgtggttgtggaacttaagaacgacctgagcatctgcgggacgctccattcagtggatcagtatctgaatattaagctcacggacattagcgtgaccgatcctgagaagtatccccacatgctatccgtcaagaactgctttattcgtggttccgttgtaagatatgtccagcttccagccgacgaggtggacacccagctcctgcaggacgctgccaggaaagaggcccttcagcagaagcagtag

SEQ ID NO: 193528 - DNA, 288 bp, Artificial Sequence
  Description of Artificial Sequence: Synthetic coding sequence
atgctgttctacagcttcttcaagagcctggtgggcaaggacgtggtcgtagagctaaagaatgatctcagtatttgtgggaccctgcatagtgtcgaccagtatcttaacataaagctgactgatatatctgtcacggaccccgagaagtacccccacatgctgagcgtgaaaaactgtttcataaggggcagcgttgtgaggtacgtgcaactgcctgccgacgaagttgatacccaattgcttcaggatgctgctagaaaagaggctctgcaacagaagcagtag

SEQ ID NO: 193529 - DNA, 288 bp, Artificial Sequence
  Description of Artificial Sequence: Synthetic coding sequence
atgctgttctacagcttcttcaagagcctggtgggcaaggacgtggtggttgagctgaagaacgatctaagcatttgtggaaccctgcactctgtcgaccaatatctaaatattaagctgactgacataagtgtgaccgaccctgaaaaatatcctcacatgctgagcgtgaagaactgcttcatcagggggagtgttgtccgctacgtgcagttgcccgctgacgaagtcgatactcagctgttacaggatgctgcacggaaagaggcgctgcagcagaagcagtag

SEQ ID NO: 193530 - DNA, 288 bp, Artificial Sequence
  Description of Artificial Sequence: Synthetic coding sequence
atgctgttctacagcttcttcaagagcctggtgggcaaggacgtggtcgtcgagttgaagaacgacttatctatctgcggcacactgcactcagtagatcagtatttaaacattaagctgacagatatatcagtgaccgaccccgagaagtacccacacatgctctcagtgaagaattgtttcatccgcgggagtgtcgttagatacgtacagctgcccgcagacgaggtggatacccaactgctccaggacgcagctcgcaaggaggcactccagcagaaacagtag

SEQ ID NO: 193531 - DNA, 288 bp, Artificial Sequence
  Description of Artificial Sequence: Synthetic coding sequence
atgctgttctacagcttcttcaagagcctggtgggcaaggacgtggtggttgagctgaaaaacgatctcagcatttgtgggactctgcactccgtggaccagtacctgaatatcaagctgaccgatatctctgtgaccgaccccgagaagtaccctcacatgttgtcagtcaaaaattgttttatccgtggcagcgttgtgaggtatgttcagttgccagcagacgaagtggatactcagttgcttcaagatgcagctcgcaaggaagccctccagcagaaacagtag

SEQ ID NO: 193532 - DNA, 309 bp, Artificial Sequence
  Description of Artificial Sequence: Synthetic coding sequence
atggccgacgacgtggaccagcagcagaccaccaacaccgtggaggagccactcgatctaatccggctttccctcgacgagaggatttacgttaagatgaggaacgaccgggagctgcgcggacgtcttcacgcttatgatcagcacctgaatatgatattgggcgatgtagaagagactgtgacgactattgaaattgacgaggaaacatacgaagaaatttacaagagcaccaagcgaaatattcccatgctcttcgttaggggcgacggcgttgtcctggtcgcaccaccattgagggtggggtag

SEQ ID NO: 193533 - DNA, 420 bp, Artificial Sequence
  Description of Artificial Sequence: Synthetic coding sequence
atgctgcccctgagcctgctgaagaccgcccagaaccaccccatgctggtcgagctgaagaacggagagacctataatggtcatcttgtgtcttgcgacaattggatgaacattaacctgcgggaagtcatatgcacgtctagagatggcgacaaattttggcgcatgcccgagtgttacatcagggggtcaaccattaagtaccttcgtatccccgacgagataatagacatggtcaaagaggaagtcgttgccaagggacgcgggcggggaggtctgcaacagcaaaaacagcagaaaggcagaggaatgggaggggctgggagaggtgtgtttggcggccgaggccgaggcggcatccccgggacaggtaggggccagcccgagaagaagcccgggcgccaagctgggaagcaatag

SEQ ID NO: 193534 - DNA, 420 bp, Artificial Sequence
  Description of Artificial Sequence: Synthetic coding sequence
atgctgcccctgagcctgctgaagaccgcccagaaccaccccatgctggtcgaattgaagaatggcgagacttataatggacatttggtatcttgcgataactggatgaatattaatctcagagaagtcatatgcacaagccgggacggcgacaagttctggaggatgcccgaatgttacattaggggcagcaccattaagtacctgcgcatccccgacgaaattatcgatatggtaaaagaagaggtggtggccaaaggacgtggacgagggggactccaacaacaaaagcagcagaagggccgaggcatgggcggcgccggacgcggcgtttttgggggccgcggaaggggcggcatccctggcaccggccgagggcagcctgagaagaagccaggccggcaggccggcaaacagtag

SEQ ID NO: 193535 - DNA, 276 bp, Artificial Sequence
  Description of Artificial Sequence: Synthetic coding sequence
atggccgccaacgccaccaccaaccccagccagctgctgcccctggaacttgttgataaatgcattggctcccggattcatatcgtgatgaaatccgataaggaaattgtcgggactttactcggcttcgacgatttcgttaacatggtgcttgaggatgtgaccgaattcgagattacacccgaaggaaggagaattaccaagttagatcaaatccttttgaacggaaacaatatcacaatgctcgtccccgggggggagggcccagaggtgtag

SEQ ID NO: 193536 - DNA, 243 bp, Artificial Sequence
  Description of Artificial Sequence: Synthetic coding sequence
atgagcctgcggaagcagacccccagcgacttcctgaagcagatcatcggtcggcccgtggtggttaagctaaattcaggggtagattatcgcggtgtgctcgcatgcctggatggctacatgaatatcgccctggagcagactgaagaatacgtgaatggccaattaaagaataaatatggagacgcgtttatcagaggcaataacgtgttgtacatctccacccagaaaaggagaatgtag

SEQ ID NO: 193537 - DNA, 243 bp, Artificial Sequence
  Description of Artificial Sequence: Synthetic coding sequence
atgagcctgcggaagcagacccccagcgacttcctgaagcagatcattggtagacctgttgtggttaaattaaacagcggagtagattatcgcggagtgttggcatgccttgacggttatatgaatattgcgctcgagcaaacagaggagtatgtgaatggacagcttaagaataagtatggcgatgcattcatccggggcaacaacgtactgtacatctccacacagaaaagacggatgtag

SEQ ID NO: 193538 - DNA, 243 bp, Artificial Sequence
  Description of Artificial Sequence: Synthetic coding sequence
atgagcctgcggaagcagacccccagcgacttcctgaagcagatcattggtcgccccgttgtggtgaagctcaactccggagtggactaccgaggagtgctagcctgcctggatggctacatgaacatagcactggaacagacggaggagtacgtgaatgggcaattaaagaataagtatggtgatgccttcatccgaggcaacaatgtgctctatatctcaacacagaaaagacgaatgtag

SEQ ID NO: 193539 - DNA, 243 bp, Artificial Sequence
  Description of Artificial Sequence: Synthetic coding sequence
atgagcctgcggaagcagacccccagcgacttcctgaagcagatcattggccgccccgtggtggtgaagctgaactccggagtggactaccgcggagtacttgcatgtttggacggctacatgaacatcgcactcgagcaaactgaagagtacgtgaatggccagctgaaaaataagtatggagacgcattcataagaggcaataatgtgctctatatttcaactcagaaacggcggatgtag

SEQ ID NO: 193540 - DNA, 312 bp, Artificial Sequence
  Description of Artificial Sequence: Synthetic coding sequence
atggccgacaaggagaagaagaagaaggagagcatcctggacctgagcaaatatattgacaaaaccatcagggttaagtttcagggcggaagggaggcaagcgggatcctgaaagggttcgatcctctcctgaatttggtactggatggcacgattgagtacatgcgcgatccagatgaccagtacaaactgactgaggacacccggcaactcgggctagtggtttgtcgtggcacaagcgtcgtgctgatctgtccgcaggacggaatggaggccattcccaatccctttatccaacagcaggacgcctag

SEQ ID NO: 193541 - DNA, 1116 bp, Artificial Sequence
  Description of Artificial Sequence: Synthetic coding sequence
atgagcgcccaggcccagatgcgggccctgctggaccagctgatgggaacagcaagagatggggacgagacacggcagcgggtcaaatttactgacgatcgtgtttgtaaaagccatttgctggattgctgtccccacgacatactggctggcactcgaatggacttgggtgaatgcacaaagatccatgatctagcacttcgcgcggactatgagattgcatccaaggagagggatctatttttcgaacttgacgccatggaccacctggaatcctttattgcggagtgcgacaggagaacagagctggccaagaaacgtttggccgagacccaggaggagataagcgccgaagtatctgccaaggcagagaaggtacacgaactgaacgaggagattggcaaattactagctaaagctgaacagctgggagcggaaggaaatgtggatgagtcccagaaaatcctgatggaggtcgagaaggtgagagccaagaaaaaggaagcagaggaggagtacaggaactccatgcctgcatcgagtttccagcagcaaaagctgcgggtttgtgaggtctgctccgcctatctgggcctacatgataatgatcgaaggcttgccgaccactttggaggaaaactacacctgggctttatccagattagagaaaagctggaccaattgaggaaaactgtcgcagagaaacaggagaaaaggaaccaggataggctccgaaggagggaggaacgggagcgtgaggagcgactttcccggcggagcgggtcaagaacacgcgatcggaggcggtcccggtcacgcgaccgccgtcggcgaagatcgcgaagcactagccgtgagcgccggaaactatccaggtcgaggagtcgcgatcggcacagaagacacaggtccaggagtagatctcactcacggggacacagacgcgcctctcgggataggtcagctaagtacaagtttagccgggaaagggcttcaagagaggaatcgtgggagagcggcagatccgaaagaggcccacctgattggcgcctcgaaagctccaatgggaaaatggctagcaggaggtccgaagaaaaggaagccggtgagatatag

SEQ ID NO: 193542 - DNA, 978 bp, Artificial Sequence
  Description of Artificial Sequence: Synthetic coding sequence
atgagcgcccaggcccagatgcgggccctgctggaccagctgatgggcacagcaagagacggtgacgagacacgacagagggtgaagtttaccgatgaccgggtttgtaagtcccatctactggattgctgcccccacgacatactcgctggcacccgaatggacctgggcgagtgtacaaaaatccacgacttggccctcagggccgactatgagatagccagtaaggaacgagatctgttttttgagctggatgccatggatcaccttgagtctttcatagctgaatgcgaccggagaactgagctggctaaaaaacggcttgccgagactcaggaggagatcagcgcggaggtgtcggctaaggctgagaaagtgcacgagttaaacgaggagatcggcaagctcctggccaaggcagaacagctgggcgcagaagggaatgtggatgaatcccaaaaaattttgatggaggtggaaaaagttcgggccaagaagaaagaggcagaagaagagtaccgcaatagcatgccagcctcgagcttccagcagcaaaaattacgagtatgcgaagtgtgcagtgcgtacctagggctccatgataacgacaggagactggccgatcacttcggggggaagctgcacctgggtttcatccaaatacgcgagaaattggatcagctgcgcaagactgtggctgagaaacaggaaaaacgcaatcaggataggctgcgccggcgtgaagagagggagagagaggaacggctgtctcgtagaagtggatcacggacccgtgatcgccgacggtcccgcagtagggatcggaggaggcgccggtctcggtccacatcgcgcgagaggcggaaattgagtaggagtcgctccagagatcgacaccgccgtcaccgctccagatcccgcagccacagtagagggcacaggcgggcctctagggatagaagcgctaagtataagtag

SEQ ID NO: 193543 - DNA, 819 bp, Artificial Sequence
  Description of Artificial Sequence: Synthetic coding sequence
atggacctgggcgagtgcaccaagatccacgacctggccctgcgggcagattatgagatcgcctccaaagaacgagacttgttctttgaattagatgcaatggatcatctggagtcattcatcgctgagtgtgataggagaaccgaactggcaaagaagcggctggcagaaacccaggaggagataagtgctgaggtcagcgccaaagcggaaaaggtgcatgagctcaatgaagagataggaaagttactggctaaagccgagcagctaggagcggaaggaaacgtcgacgagtcccagaaaatcctcatggaggtggagaaggtgcgcgctaagaaaaaggaggccgaagaagaataccggaactccatgcccgccagttctttccaacagcagaaactccgtgtttgtgaggtctgttcagcctatcttgggctgcacgataacgacagacgtctcgcggatcacttcggaggcaaattacacttgggattcatacaaataagagaaaagctggaccagctgcgtaaaacagtggcggagaagcaggagaagcgcaaccaggataggctccgaagacgggaagagagagaacgtgaagagaggctgtctaggaggtccggtagtcgcactcgagaccgccggcggtctcgcagtagagaccgccggcggcggcgttctcgaagcacaagtagggaaaggagaaaactatcccgcagtcggagcagagacagacacagacgacaccgctcccggtcccgctctcatagccggggacatcggcgtgcctcccgagaccggtccgcaaagtataagtag

SEQ ID NO: 193544 - DNA, 978 bp, Artificial Sequence
  Description of Artificial Sequence: Synthetic coding sequence
atgagcgcccaggcccagatgcgggccctgctggaccagctgatgggtacagcccgcgatggcgatgagactagacaacgcgttaagttcacagacgaccgcgtgtgcaaaagccacctgctcgattgttgtccccacgatattctggcgggcacgaggatggacctgggcgagtgtaccaagattcatgatctcgcactaagagccgactacgagatcgcctctaaagagcgcgatctcttctttgagctggacgccatggatcatctggagagctttattgcggaatgtgacaggcggacagagctggctaagaagcggctcgctgaaacccaggaagagatatcagcggaggtgtcagcaaaggccgagaaagtgcatgagttaaacgaagaaattggcaagttgctcgctaaagccgaacaactaggggcagagggcaatgtcgatgagagccagaaaatccttatggaagtagaaaaggtgagggccaagaaaaaggaagcagaggaggagtaccgaaatagcatgccggcaagtagtttccagcagcagaaactgagggtgtgcgaggtatgctctgcatacctggggctccacgacaacgaccggagactcgccgatcactttgggggaaagctgcacctgggatttatccagatcagggagaaactggatcagctgagaaaaacggttgctgagaaacaggagaagagaaaccaggacagactgagaagacgggaggagagagagagagaggagaggctgagccgtcgaagtggcagcaggaccagagaccgacgtaggtctcgtagtagggaccgccggaggcgcagaagccgctcgacctcccgggaacgcagaaaactgagtagatccaggtccagggacaggcatcggcggcataggagccgcagcagatcacacagtaggggccaccgccgcgccagtcgcgacagatccgctaagtacaagtag

SEQ ID NO: 193545 - DNA, 99 bp, Artificial Sequence
  Description of Artificial Sequence: Synthetic coding sequence
atggacctgggcgagtgcaccaagatccacgacctggccctgcgggcagactacgagatcgcgagcaaagagagagatctgttcttcgaactcgattag

SEQ ID NO: 193546 - DNA, 549 bp, Artificial Sequence
  Description of Artificial Sequence: Synthetic coding sequence
atggaccacctggagagcttcatcgccgagtgcgaccggcggaccgagctagctaaaaagcgtctggccgagacacaagaagagatttcagcagaggtctctgccaaggcagaaaaggtgcatgagctcaacgaggagatcggcaagttattggccaaggcagagcagctgggcgcagaaggtaacgtagatgagtcccagaaaatccttatggaggtggaaaaggttagggccaagaaaaaggaggcggaggaagaataccgcaattccatgccagctagcagttttcaacagcagaaactgcgagtgtgtgaggtgtgttcagcatacctcggtctgcacgataatgacagaaggcttgcagaccatttcggaggcaagctgcatctcggattcatccagatccgcgagaagctcgatcaactacgtaagaccgttgcggaaaagcaggagaaacggaaccaggatcggctcaggaggagggaagaacgcgagcgagaagaacgactgtcccgccgctccggctctcggactcgcgaccggcggtag

SEQ ID NO: 193547 - DNA, 183 bp, Artificial Sequence
  Description of Artificial Sequence: Synthetic coding sequence
tgacggcggcggagccggagccgggaccggcggcggcggcggagccgctctacatctcgcgaaaggcgtaagctctctcgatctaggagcagagatcgacatcgtagacatcgaagtagaagcagatcccactctagggggcaccgcagagcaagccgagacagaagcgctaagtacaaatag

SEQ ID NO: 193548 - DNA, 255 bp, Artificial Sequence
  Description of Artificial Sequence: Synthetic coding sequence
atggaccacctggagagcttcatcgccgagtgcgaccggcggaccgaactcgctaaaaaacgtctggcggaaacgcaagaagaaatatcagctgaagtttctgctaaggctgaaaaggtacacgagctcaacgaggagatcgggaaactcctggccaaggccgagcagctcggtgctgaaggcaacgttgatgagtctcagaaaatactgatggaagtggagaaggtgagagcaaaaaaaaaggaggcagaatag

SEQ ID NO: 193549 - DNA, 1176 bp, Artificial Sequence
  Description of Artificial Sequence: Synthetic coding sequence
atgcccgcctacctgaacctgcagggcagcgtgcggaaggccccccattcgccatcaagggatacgactcgacagcgcatcaagttttccgacgaccgagtgtgtaagtctcacttgctgaactgctgcccacacgacgtgctaagcgggactcgtatggacctgggcgagtgcctgaaggtgcatgatctggctcttcgggccgactatgaaatcgcctcaaaggaacaagatttcttcttcgagctcgacgctatggaccacctacaatcctttatcgccgactgcgaccggcgaaccgaggtggcgaaaaaaagactagccgagactcaggaagaaattagcgccgaagtcgcagcaaaagccgagcgcgttcacgagctgaacgaggagatcggcaagctgctggctaaagtcgagcagctgggagccgagggcaatgtggaggaatcccagaaggtgatggacgaggtggagaaggcacgggcaaaaaagagagaagccgaggaggtctaccggaattcaatgcccgcttccagctttcagcagcaaaagttgcgggtgtgcgaggtatgctcagcttatctgggccttcacgacaacgatagacgcctggctgaccactttggcggcaagctccatttaggttttattgagatcagggagaagcttgaggagctaaaacgcgtggtcgcagagaagcaagagaaacggaatcaggagcgactgaagcgacgggaagagagggaaagggaggagcgggagaagcttaggagaagtcggtcccatagtaagaaccccaaaagaagccggagtagggaacacaggcgacaccggtcccgaagcatgtcgagagaaaggaagcgacgcactcggtccaagtctagggaaaagcgacacagacaccggtcaagatctagttcgcgatccaggtcccggtcacaccagcgctcaaggcacagttcacgagataggtcgcgcgagaggtccaaacggcgttctagtaaagagcggttcagagatcaggatctggcgtcatgcgaccgcgatagaagtagccgtgatagatctccacgcgatagggatagaaaagacaagaaacgtagttatgagagcgcaaatggacgatcggaggataggcggtcttccgaggagagggaggcaggagagatatag

SEQ ID NO: 193550 - DNA, 1179 bp, Artificial Sequence
  Description of Artificial Sequence: Synthetic coding sequence
atgagcgcccaggcccagatgcgggccatgctggaccagctgatgggaacgtctcgtgacggagacaccactagacagagaatcaagttctccgacgaccgagtctgcaagtcacacctgctgaattgctgtccacacgacgtactctccggtacccgcatggacctgggggagtgcctgaaggtgcatgaccttgcactgcgggcggattatgagatagccagtaaagagcaggatttcttcttcgagctggacgccatggaccatctgcagagttttatcgcggattgtgatcggcgtactgaggtggcaaagaagcggctggcggagactcaggaggaaatctccgcagaggtggccgccaaggccgaacgcgtccacgaactcaacgaggagataggtaaattgctcgccaaagttgagcaactgggggctgagggaaatgtagaagagtctcagaaagtaatggatgaggtggagaaggcccgtgccaagaagcgcgaggctgaagaagtgtaccggaatagcatgcctgcttcctcctttcagcagcagaagctccgtgtttgcgaggtgtgctctgcatatctaggcctgcatgataatgatcgccgcctggcagaccatttcggaggcaagcttcatctgggcttcatagagattagggaaaagttggaggagctcaaacgggtggtcgccgaaaagcaggagaaacggaaccaggagaggctcaaaagaagggaagagcgagaacgtgaggagcgcgagaaactgagacgtagccgctcccacagtaaaaaccctaaacggtcgaggtccagggagcaccgacgtcaccgctccagaagcatgtcgcgggagcgaaagcggcggactagatccaagtctcgggaaaaacgccatagacatcgctctcgttcctctagtcgcagtagatcgagaagtcaccaacggtcccggcacagctctagggataggagcagggaacgaagcaagcgacgctcttctaaagaaagattcagggaccaggatctcgctagctgtgatcgggacaggtcctctcgcgaccgaagcccgcgtgacagggatcgcaaagacaagaaacgcagctatgagtcggccaatggcagaagtgaggataggaggagctccgaggaaagggaagctggagagatctag

SEQ ID NO: 193551 - DNA, 1170 bp, Artificial Sequence
  Description of Artificial Sequence: Synthetic coding sequence
atggtgatccacagccagctgaagaagatccagggcgccagcgagcggatgggagacaccacccgacagcggatcaaattcagtgacgatcgcgtgtgcaaatcacaccttctcaattgctgtccacacgatgttttgtctggaactaggatggaccttggtgagtgtctgaaggtccatgacctggcactcagggcagactacgagatcgcatctaaggagcaggacttcttctttgaactcgacgcaatggatcacctgcagtcatttattgcagactgcgataggcgcacagaagttgccaagaaaagattggcggagacccaggaggagattagcgctgaggtcgccgcaaaggcagagagggtccacgaactgaacgaggagattggcaagctgctggctaaggtggaacagctcggagccgagggcaacgtggaagagagccagaaggtgatggatgaggtcgagaaggccagggctaaaaaaagggaagccgaagaagtgtaccggaattcgatgccagcgagtagctttcagcagcaaaagttacgcgtttgcgaagtgtgctctgcctatttgggcttgcacgacaatgatcggcgactagctgatcacttcgggggaaagctccacctggggtttatcgagatcagggaaaaacttgaggagcttaagagggtggtcgccgagaaacaggagaagcgcaaccaggaaaggctaaaacgacgcgaagaaagagagagagaggaacgggagaagctgcggcggtcccgtagccatagcaagaaccccaagagatctcggtccagggagcaccgcaggcacaggagcagatcaatgtctcgtgaaagaaaacgccgaacgcggagtaagtcccgggaaaagcgccaccggcaccgatccaggtcttcatcccgttcccgatctcgtagccaccagcggagccgccactcctcacgggacaggtccagagagagatctaaacggaggagttctaaggaacggtttcgggaccaggatctcgcttcctgcgatagagatcgctccagccgagatagaagcccaagagatcgggatagaaaagataagaagcggtcatatgagagcgccaatgggcgatcggaggatagaaggagtagcgaggagcgcgaggcgggggagatatag

SEQ ID NO: 193552 - DNA, 1377 bp, Artificial Sequence
  Description of Artificial Sequence: Synthetic coding sequence
atggccgccctgggcagccccagccacaccttccggggcctgctgagagagctgaggtacctgagtgctgcaaccgggaggccatatagagatacggctgcctatagatacctggtgaaagccttccgtgcccaccgtgtgacaagcgaaaagctatgccgcgcccagcacgaattgcacttccaggctgccacatacctgtgtctgctcaggagtatcagaaagcatgtggccctccaccaggaatttcacggcaagggcgatactaccaggcaaaggatcaagttttctgatgatcgagtgtgcaagagccaccttctgaactgctgccctcacgatgttttgagcggcacccgcatggatctaggggagtgtctcaaagtacacgacttggccctccgagccgattatgagattgctagtaaagagcaggatttcttctttgaactggacgcgatggatcatctgcagagctttattgcagattgcgatcgaagaaccgaggtagcaaaaaaaaggctcgcggaaacacaagaggagattagcgctgaagtcgccgcaaaagctgaaagggtgcacgagttgaatgaggagattggaaaactgctggccaaagtggagcaattgggggccgagggtaacgttgaggagagtcagaaggtcatggacgaagtggaaaaggccagagctaaaaaaagagaggctgaggaagtatatagaaactccatgccagcctccagcttccagcagcagaagctcagagtctgcgaggtctgctcggcttatttgggactgcatgataatgatagaaggctggctgaccacttcggaggtaaactgcatcttggctttatcgaaattagggaaaagttggaggagctcaaaagggttgtagcagagaaacaggagaagcggaaccaagaaaggctaaagcgacgggaggaacgggaaagggaagagcgggaaaagctgagaagaagtagaagccattctaagaaccctaaaagaagccgctcacgcgagcacagaagacacaggagccggtccatgagtcgggaacgaaagcgtcgcacacgcagtaaatcaagggaaaaacgccacagacatcgctctcgatcttcttcccgctccaggagcagaagtcaccagagatccagacacagcagccgcgaccgatcgcgcgagaggtccaaacgcaggtcttcaaaggaaagattccgtgaccaggaccttgcctcttgcgaccgcgacaggtcttcccgagatcgcagtccaagagatagagatcggaaagacaagaagcgctcatacgagtcagcgaatgggagaagcgaggacaggaggagtagcgaggagagggaggcaggcgagatatag

SEQ ID NO: 193553 - DNA, 1179 bp, Artificial Sequence
  Description of Artificial Sequence: Synthetic coding sequence
atgagcgcccaggcccagatgcgggccatgctggaccagctgatgggtacctcacgtgatggcgacaccaccaggcagcgtatcaagttttccgacgatcgggtgtgtaagtctcacttgcttaattgttgcccacacgatgtgctcagtggtacgcggatggatcttggcgagtgtttgaaagtgcacgatctggccctgagggctgattacgagatcgccagcaaggaacaggatttttttttcgagctggatgctatggaccacctccaaagtttcattgctgattgcgaccgcaggactgaggtcgcgaagaaaaggctggcggaaacccaagaagagatctcggccgaagtagctgccaaggctgagcgagtgcacgagctcaacgaagaaatcggtaagctgctagctaaggtagagcagctgggcgctgagggaaatgtcgaagagagtcaaaaggtcatggacgaggttgagaaggcacgcgcgaagaagcgagaggccgaagaggtgtaccgcaactctatgccagccagctcatttcagcagcaaaagcttcgagtgtgcgaagtttgttctgcttatctgggcctccacgacaacgacaggaggcttgccgatcactttgggggtaagctgcatctcgggttcatagagatacgggaaaagctggaggagttgaaacgggtggtggccgaaaagcaagaaaaacgaaaccaagagcgcctgaagcgtcgcgaagagagagagagagaagagagagagaaactccgccgtagtaggtcacacagtaagaatcccaagagaagtaggagcagggagcatcgtcgccaccgttctagatcgatgagcagagagaggaaaagacggacaagatccaaaagtagggagaagagacaccgtcatcgttcaagatctagctctcggagtaggagccgttcacaccaacggtctaggcactcttccagagaccgcagccgtgaacgctcaaaaagaagaagcagtaaggagcgattcagggatcaggatctcgcctcatgtgaccgggatcggagcagccgggatagatcaccaagggacagggatcggaaagacaaaaaacgttcttatgagagcgctaacggacgatctgaagataggaggtcctcagaggagcgagaggccggcgagatttag

SEQ ID NO: 193554 - DNA, 252 bp, Artificial Sequence
  Description of Artificial Sequence: Synthetic coding sequence
atgagcgcccaggcccagatgcgggccatgctggaccagctgatgggaacgtccagggacggctccatgtacttatgtctgcccacctccatttgcaaaggtgtctcagagcgcccgcgaatccgacaggccgaaatccagttggtaaacgagagcaattccgtgatgaccgaatacgccagagtcacatttagcaccgtagttctgatgatgtcgtttctcgagcttgaatggatacttgagaacgtgtag

SEQ ID NO: 193555 - DNA, 1299 bp, Artificial Sequence
  Description of Artificial Sequence: Synthetic coding sequence
atgatcagcgccgcccagctgctggacgagctgatgggccgggaccggaacctggcccccgatgagaagcgcagtaacgttcgctgggatcacgagtcagtctgtaagtattacctgtgcggcttctgcccggccgagctctttaccaatactcgcagcgaccttggcccatgcgagaagatccacgatgagaacctcagaaaacagtatgaaaaatcttcccggttcatgaaagtaggatacgagagggattttttacgctatctgcagtccctcctagccgaagtcgaaagaaggatcagaagaggacacgcacgcctggccctatcacagaaccagcagtcttcaggcgctgcgggcccgacaggaaaaaatgaagagaaaatacaagttttgactgacaagattgatgtgttgcttcagcaaatcgaagaattaggttcagagggaaaggtggaagaagcgcaggggatgatgaagttggtggagcagctgaaggaagaacgtgagttgttgagatccaccactagtactatcgagtcatttgcagctcaggaaaaacagatggaagtttgtgaggtttgtggggcattcttgatcgtcggggatgcgcaatctcgcgtggatgaccatttaatgggcaagcaacacatgggctacgctaagattaaagccacagtggaagagctgaaagaaaaactccggaagagaaccgaggaaccagatagagacgagcgcctcaaaaaagaaaagcaggagagagaagagagagagaaggagagggaaagagagagagaggaacgggagaggaagcgtagaagagaggaggaggagcgggaaaaagagagagcacgggatcgcgagcgtcggaaacgatccaggtcccgttcacgacactcctctagaactagcgatcgacggtgctctaggagccgcgatcacaaacggtctagatccagagaaagacgtcggagtcggagtcgggacaggcgacgatcacgatctcatgacagaagcgaaagaaagcacaggagtaggtctcgggatcgccggcgatctaaatcccgcgaccgcaagtcatacaaacatcgcagcaagagtcgcgacagggagcaggatcggaaatctaaggaaaaggagaagcgcgggtcagacgataagaaaagttctgtcaaaagcggctcacgggaaaaacagagcgaagacactaatactgagagtaaagagtctgatactaaaaacgaggtgaacggaacaagcgaggacatcaagtcggagggcgatacacagagcaactag

SEQ ID NO: 193556 - DNA, 240 bp, Artificial Sequence
  Description of Artificial Sequence: Synthetic coding sequence
atgatcagcgccgcccagctgctggacgagctgatgggccgggaccgcaacctcgctcccgacgagaagcggtccaacgtgaggtgggatcacgagagcgtgtgtaaatattacttgtgcgggttttgcccggccgagctattcaccaacactcgtagcgacttagacgtcttcggcaggggagacaacattcgagacgtctctaaatttttagaggacgataaatggatggaggaatag

SEQ ID NO: 193557 - DNA, 1299 bp, Artificial Sequence
  Description of Artificial Sequence: Synthetic coding sequence
atgatcagcgccgcccagctgctggacgagctgatgggccgggaccgcaacctggccccggatgaaaagcgcagtaatgttcgttgggatcacgagtcagtttgcaagtactacctgtgtggattttgtccggccgagctctttaccaatacgcgcagtgaccttggaccttgcgaaaagatccacgatgagaatctacgcaagcagtacgaaaaatccagccggtttatgaaggtcggctacgagcgcgattttctcagatacctccagtcactcctggctgaggtcgaacgccgcatccggagaggccacgcacgtctggccctgtctcagaatcagcagtcctccggagccgctggccctactggaaagaatgaggagaagatacaggttcttaccgacaaaatcgatgtcttgctgcaacagatcgaggaattaggcagtgaggggaaggtagaggaggcccagggcatgatgaagctggtagagcagttgaaagaagaacgcgaattattacggtccaccacttccaccatcgagagttttgctgctcaggagaaacagatggaagtatgtgaggtgtgcggcgcgttcctaattgttggtgatgcccaatccagagtagatgaccatctcatgggaaaacagcacatgggttatgccaaaatcaaagctaccgtggaggaactcaaggagaagctgagaaagaggactgaggaacccgaccgtgacgaaagattaaaaaaggaaaagcaggaacgcgaggagcgcgagaaagaaagggagagagaacgggaagagcgcgagagaaaacgcagacgggaggaagaggaaagagagaaggagcgagccagggatcgtgaaagacggaaaagatcaagaagcaggtcacgtcactcttcccgcacatctgaccggcggtgctctcggtctcgcgaccataagaggtcaaggtccagggaacgcaggcgatcaagaagtcgtgacaggcgcagatctagatctcatgacaggagcgaacgaaaacacagatcacgcagcagagatagacggcgcagcaagtcccgggatagaaaaagttacaagcacaggtcaaagtccagagacagagagcaggatcggaaaagcaaagagaaggaaaagagggggtctgatgataaaaagtcatccgtgaagagcggtagccgggaaaaacagtccgaagacacaaacacagaatcaaaagagtcagacactaagaacgaagtgaacggtacgtcggaagacataaaatccgaaggcgacacccagtccaattag

SEQ ID NO: 193558 - DNA, 711 bp, Artificial Sequence
  Description of Artificial Sequence: Synthetic coding sequence
atgatcagcgccgcccagctgctggacgagctgatgggccgggacagaaatctggctcccgacgagaagcgcagcaacgtgcgctgggaccatgaatctgtgtgtaaatattatctttgtgggttctgccccgctgaacttttcaccaacaccaggtctgatctgggtccttgcgagaaaatccacgacgagaacctgcgcaagcagtacgagaagtcttcccggtttatgaaagttgggtatgaacgagattttctcagatacctgcaaagcttgctcgcagaggtcgagagaaggattagacgcggccacgctaggctcgcactgtctcaaaatcagcaatcttctggcgcagctggccctactggaaaaaacgaggagaagattcaggtccttactgacaaaatagacgtgctgctccagcagatcgaagagctgggctccgaaggcaaagttgaggaggcacaggggatgatgaaattagtggaacagttaaaggaagagcgcgagctgctgagatccacaacttccaccatcgagagctttgccgcacaggaaaaacagatggaggtgtgtgaggtttgtggcgcctttctcattgtgggtgatgctcagagccgggtggatgaccaccttatgggaaagcagcatatggggtacgctaagattaaagccacagttgaagagaagaagaagaagaaaaagaaatag

SEQ ID NO: 193559 - DNA, 1071 bp, Artificial Sequence
  Description of Artificial Sequence: Synthetic coding sequence
atgaaggtgggctacgagcgggacttcctgcggtacctgcagagcttgctggctgaggtcgaaagacggattcggcgtggacacgcccgccttgccctgtctcagaatcagcaaagcagcggggccgccggtcccacaggaaagaacgaagaaaaaatccaggtcttgacagacaaaattgatgttttactgcagcagatcgaagagctgggctcagaagggaaagtcgaagaggcgcaggggatgatgaaactggttgaacaattgaaagaggaacgggagctcctgagaagcaccacctccacaatcgaaagcttcgcggctcaggagaaacaaatggaagtttgcgaggtttgtggcgctttcttgattgtgggggatgctcagtcccgggtcgatgatcatctcatgggaaagcagcacatgggctatgccaagatcaaggcgactgttgaagagctgaaggaaaaactgcgcaaacgcacagaggaacctgaccgcgacgaaagactgaagaaggaaaagcaggaaagagaggagcgggagaaagaacgggaaagagagagggaagagcgtgagagaaaaagaaggagagaggaagaggagagagagaaagagcgtgctcgagacagggagaggcggaaaaggtcaagatccaggtctagacactcatcacggacctcggacagacgatgcagccggtcacgtgatcacaagagatcgagatctagagaacggagacgatcacggagccgcgacagacgacggagcaggtcacatgatcggtcagagaggaaacacagatcccggtctcgggacaggcgacggtccaagtccagggaccgcaagagctataagcatcggtccaaatcacgggatagagaacaggaccggaagtctaaggaaaaagagaagcgcgggagcgacgacaaaaagtctagtgtgaagtcaggctccagggagaagcagtcggaagacaccaatactgaatcaaaggaatcagataccaaaaatgaggttaacggcaccagcgaagacattaaaagcgaaggactgttcgtcaccgtgtag

SEQ ID NO: 193560 - DNA, 1017 bp, Artificial Sequence
  Description of Artificial Sequence: Synthetic coding sequence
atgagcctgagcgccttcaccctgttcctggccctgatcggcggcacatcgggccagtactacgattatgacttcccactgtcaatctacggccagagctctcccaactgtgccccagagtgcaactgtcccgaatcatacccttcagcaatgtactgcgatgaactgaagttgaagtccgtgcccatggttccacctggaattaaatacctgtacctgcgcaataatcagattgatcacatagacgagaaagcttttgaaaacgtgacggacctgcagtggctaatcttggaccacaatttacttgagaattctaaaattaagggacgcgtgttttcaaaactcaagcaattaaagaaactgcacataaatcataacaatctcacagaatcagttggacccctaccgaaaagcctcgaggacctgcagttaacgcataataaaattaccaagctgggttcattcgaaggactcgtgaatctcaccttcatccatctgcaacacaacagactcaaggaggacgccgtcagtgctgcattcaagggtctgaaaagcctcgaatacctagaccttagctttaatcagatcgcccggctacccagtgggctgcccgtgagtctgcttacattgtacttagataataataagatatctaatatccccgacgagtacttcaagcggttcaatgctctccagtatctgagacttagtcacaacgaactggccgattctggcattcccggcaactctttcaatgtctcgagtctggttgagttggacttatcttacaacaagctgaagaacataccaaccgtcaatgagaatctcgaaaactattaccttgaagtaaaccagctcgaaaagttcgacatcaaatccttttgtaaaatcctaggacccctgtcttattcaaagatcaagcacctgagattggacgggaatagaatcagtgagacttcacttccacccgatatgtacgagtgtctgcgtgtggcaaacgaagtgactttgaactag

SEQ ID NO: 193561 - DNA, 2100 bp, Artificial Sequence
  Description of Artificial Sequence: Synthetic coding sequence
atgaagcagcggttcagcgccctgcagctgctgaagctgctgctgctcctacagccgccactgcccagagcgctgcgcgaggccttgtgcccagagccttgtaactgcgtccccgatggcgccctgagatgcccggggccaaccgccgggctcactcgcctcagcctagcgtacttacctgttaaggtgatcccatcgcaagccttccgggggttgaatgaagtgataaagatagaaattagccaaattgactctctagagagaattgaagcaaacgcgttcgataacctgctgaatctgtcagagatcctaatacagaacactaagaacctgcgttacatcgagccaggggcgttcatcaacctgcccaggctcaagtacctgagtatttgcaacacagggataaggaagttcccagacgtgactaaagtcttttcgtctgagtcaaatttcattttggagatctgcgataatctgcatatcaccacaatccctggcaatgcctttcagggtatgaacaacgaatccgtgactctgaaactttacgggaatggatttgaggaggtccagtctcacgcctttaatggaacaacattgacttctctggaacttaaggaaaacgttcacctggagaaaatgcataatggcgcgttccgcggcgctactgggccaaaaaccttagatatatcgagcactaagctgcaagcattgccttcgtatggcctggagtccatacagagattgatagccacctcatcctacagcctgaaaaaactcccttcccgggagacatttgtgaatctgctggaggctaccctcacataccccagccactgttgcgcctttaggaatctgcccacaaaggagcagaatttctcccactccattagtgagaacttttccaagcagtgtgaaagcaccgtccggaaggtgaataacaaaaccttgtattcttctatgctcgctgaaagtgagttgagcggctgggattatgagtacgggttttgcctacctaaaactcctcgttgcgcccctgaacctgacgcttttaatccatgcgaagacataatgggctatgacttcctgcgagtactgatctggctaattaacattctcgctattatgggcaatatgactgtcctgtttgtgctgcttacatcaagatataagttaacagtaccgcgttttctgatgtgtaacctctctttcgcagacttttgcatggggctctatctgctccttattgctagcgtggacagccagacgaaggggcaatactacaatcatgccattgactggcagacaggaagtggatgttctacagccggcttctttacagtatttgcctctgagctgagtgtctacactttgaccgtgattaccctcgagcggtggcatacaattacatatgccatccaccttgaccagaagctcagactcaggcatgccatcctgataatgctcggcgggtggctcttttccagcctaattgcaatgctaccgctggttggagtgagtaattacatgaaggtgtcaatctgttttcctatggacgtggagactaccctcagccaggtctacatccttaccattcttattttaaacgtggtcgccttcttcataatttgtgcctgctatataaagatttattttgcggtgagaaatcctgagctgatggctactaacaaagatacaaaaattgccaaaaagatggccatcctgattttcacagacttcacatgtatggctccaattagcttcttcgcgatatctgcagcttttaaggtccccctgatcacagttactaacagcaaagtgctgctggtactcttctatccaataaactcctgcgctaacccctttctgtatgcaatttttaccaagaccttccagcgggatttctttctgctcctgtcaaaattcggatgctgcaaacgtagagctgaactgtacagaaggaaagatttctctgcttataccagcaactgcaagaatggctttactgggtcaaacaaaccttctcagagcacattgaagctttcaaccttgcattgccaagggactgctctattagacaagacccgatacacggaatgctag

SEQ ID NO: 193562 - DNA, 1914 bp, Artificial Sequence
  Description of Artificial Sequence: Synthetic coding sequence
atgaagcagcggttcagcgccctgcagctgctgaagctgctgctgctgctgcagccccccctgccaagagcacttagagaagcactgtgcccagagccatgcaattgcgtgcccgatggtgccctgagatgcccaggacctacagcaggactcaccaggcttagcctggcatatttgcccgtgaaagtgatcccatcccaggccttccgcggactgaacgaggtgatcaagatcgagatttcccaaatagactccctggagaggattgaggccaacgccttcgacaacctcctcaatctctcagaaattctaatccagaacaccaagaacctgcgctatattgagccgggagcttttattaacttaccacgtctgaagtatttatcaatctgtaacaccggaattcggaagtttcccgacgtcacaaaagtattttcaagtgagagcaattttatcctggaaatatgtgataatttacacatcacaacaatccccggcaacgcttttcaggggatgaacaacgaatctgtgactctgaagctgtacggcaacggatttgaagaggtgcagagccacgctttcaacggaaccacactcacatctttagagctaaaagagaatgtgcatctcgagaagatgcacaacggagcctttagaggggcgactgggcctaagaccctgcaaaatttctcccattctatttcagaaaatttttccaagcagtgtgagagtaccgtgaggaaagttaataacaagacgctgtatagttcaatgctggctgaatccgaactgtctggatgggactatgaatacggattttgtctgcccaagactcccaggtgcgctcccgaacccgatgcattcaacccatgcgaggatattatgggctatgatttcctccgagtactgatttggttgataaacatcctggccattatgggcaacatgactgtactcttcgtactgctgacttccaggtataaactgactgttccacgttttcttatgtgtaacctgtcctttgccgatttttgtatgggactttatctgttacttatcgccagcgtcgattcacagaccaaaggccaatattataatcatgccatcgattggcagaccgggagtggctgttctacggcaggtttctttactgtgttcgcatccgaactgagcgtgtataccctgaccgtgatcaccctggaaaggtggcacactatcacttacgcaatccacctggatcagaagctccgccttcggcatgcgattctgataatgctgggggggtggctgttttcttcccttatcgcgatgttacctctagtgggggtttcaaactatatgaaagtcagcatttgttttccaatggatgttgagaccacactgagtcaggtctatatccttacgattcttattctcaatgtagtggcctttttcattatctgcgcttgttacataaagatctatttcgctgtgaggaaccctgagctgatggcgaccaacaaagacactaagatagccaagaagatggccattctgatctttaccgatttcacctgcatggcccccattagcttcttcgcaatctcagcggcattcaaggttcctctgataactgtgacaaacagtaaggtcctcctggtgctcttctatcctataaacagttgcgcgaacccctttttgtacgccatctttaccaagacattccagcgagacttcttcctattgctctcaaaattcgggtgttgcaagaggagagcagaactgtatcgccgaaaagattttagtgcttacacatcaaattgcaaaaacggctttaccggttcaaataaaccctcccagtccaccctcaaattgtctaccctgcactgccaagggactgccttactggacaaaacgagatacactgagtgctag

SEQ ID NO: 193563 - DNA, 978 bp, Artificial Sequence
  Description of Artificial Sequence: Synthetic coding sequence
atgaagcagcggttcagcgccctgcagctgctgaagctgctgctgctgctgcaaccacctctccccagggcactgcgcgaggctctctgtcctgaaccctgcaattgtgttcccgacggagccctgaggtgccccggcccaaccgccggtcttacccgcctgagtctcgcatatctacctgtgaaggtcatcccaagccaggcgttcagaggactcaatgaggtgattaaaatcgagatctcgcagatcgactccctcgagcggattgaggctaacgcgtttgacaacttgctcaacctgagcgagattcttattcagaatactaagaacctgcggtatatcgagcccggcgcattcatcaatcttccgcgactcaaatacctgagcatctgcaatactggtattcgcaaatttcccgacgtgacaaaagtcttttccagcgaatccaatttcatcctggaaatctgtgacaacctgcatattacgaccataccaggtaacgcctttcagggtatgaataacgaaagcgtgactttgaaactctatggcaatggttttgaggaagtgcagagtcatgccttcaacggcaccacactgacttctctggaactgaaggaaaacgtgcatctggaaaagatgcacaatggtgcatttcgcggggctactggtccaaagactctggacatcagctcaactaagttgcaggccttaccaagctatggactggagtccattcagcggctaatcgccacctcaagttattctttaaagaagcttccctctcgggagacatttgtcaaccttttggaggccaccctgacatatccctcgcactgttgcgcctttcgcaacctccctacgaaggaacaaaatttcagccactcaatcagcgaaaacttctcaaagcagtgcgagtcgacagtgagaaaagtaaataacaagaccctgtctaagccacgcattaatggataccaatag

SEQ ID NO: 193564 - DNA, 990 bp, Artificial Sequence
  Description of Artificial Sequence: Synthetic coding sequence
atgaagcagcggttcagcgccctgcagctgctgaagctgctgctgcttttacagccgcccttgccccgtgcactgcgtgaggccctgtgcccagagccttgtaattgcgtgccagacggtgctcttcgctgtcctggccctactgccggacttactcgcttgagcttggcctacctcccagtcaaggttatacctagccaggcttttaggggcctcaacgaggtgatcaaaatcgagattagccagattgacagtttagagcggattgaggcaaatgctttcgacaacctccttaatctaagtgagattctgatacagaacaccaaaaacctgcgctacatcgagcccggcgcttttatcaacctgcccaggttaaaatatttatccatctgcaacacaggaattaggaagtttcccgacgtaacgaaggttttctcatccgaatccaacttcattctcgagatttgcgataacctccatattacgacaatccccgggaacgcattccaaggcatgaataacgaatcggtgaccctgaagctgtacgggaatggattcgaggaagtccagtcacacgcattcaatggcactactttgacaagcctcgagctcaaggaaaatgtgcacctggaaaaaatgcacaatggtgcattccgtggggctaccggtccgaagaccttggatatctcctccacaaaactccaggcacttccctcttacggtttggaatccatccagcgcctgatcgcgacgagttcatactccttgaagaagctcccttcccgggagacctttgtcaacctgctggaagctacactcacctacccctctcactgctgtgctttccgaaatctgccaacaaaggagcagaattttagccacagcatttccgagaatttctctaagcagtgcgagtcaaccgtacgcaaagtgaacaataaaaccctcttgctgcatggcgccttgagtgccgcgcattcactgtcatag

SEQ ID NO: 193565 - DNA, 2019 bp, Artificial Sequence
  Description of Artificial Sequence: Synthetic coding sequence
atgaagcagcggttcagcgccctgcagctgctgaagctgctgctgctcttacagccccctctgccccgtgcactccgggaagccctgtgccctgagccctgtaactgcgtgcctgacggggctctgcggtgcccgggacctaccgcgggcctaacaaggctaagccttgcatatctcccggtgaaggtgataccttcccaggctttcaggggtcttaacgaagtgatcaaaattgagattagtcagatcgactccctggagcgcatcgaagcgaacgcctttgacaacctgttaaacctgtcagagatattaatccagaataccaagaacctgagatacattgaacccggtgcctttattaacctgccacgcctaaagtatctgagcatctgcaatactggtattcgcaagttcccagatgttacaaaggtgttctcgagtgaatctaacttcattcttgaaatttgtgacaatctgcacattactacgattccaggaaatgcattccagggaatgaacaatgagagcgtgactctaaagctgtatggaaacggattcgaggaagtccaatcacacgcctttaatgggacaacactgacgtccctcgaattgaaagagaatgtgcaccttgagaagatgcacaacggcgcattcaggggcgctactggacctaagacactggatattagtagtaccaagttacaggccctgccgtcctacgggctggaatcgatccagcgcttgatagcgacttcctcctacagtttgaaaaaattgccaagccgggaaaccttcgtgaatctactggaagctaccctgacttatccgtcccattgttgcgccttccgcaacctgcctaccaaagattactcatcaatgctcgcagaaagtgaactttctggatgggattacgagtatggcttttgcttgccaaaaacgccaaggtgtgctcctgaaccagacgccttcaatccttgcgaggacatcatgggctatgacttccttcgcgtcctcatctggctgatcaatatcctggctatcatggggaacatgaccgtgttgttcgttctgctaacctctcgttacaagctaactgtgccacgctttctgatgtgcaatctgagttttgcagacttctgtatgggactgtacctgctcctgatcgctagtgtcgacagccagacaaagggccagtactacaaccatgcaatcgactggcaaactggatcaggatgctccactgccggcttcttcacagtattcgcatcagagctcagcgtgtatactctgacagtgattacgcttgagcgttggcataccataacgtatgcaattcacctagatcagaagctgagactgcggcatgctatcttgatcatgctgggtggttggctgttctcctccctgattgctatgctgccacttgtgggtgtgtcgaactacatgaaggtctcaatctgcttccctatggacgtcgaaactactctgagtcaggtgtacattcttaccattctcatcttaaacgtggtagcctttttcattatctgtgcctgctacatcaagatttacttcgcagtcagaaatcccgagctcatggcaactaataaggatactaagatcgctaaaaagatggcaattcttatctttaccgactttacttgtatggcccctatttctttctttgctatctccgccgcgttcaaagtccctctgattacagtcaccaattccaaggttcttctggtgctgttttacccaattaactcttgcgcaaacccttttctatacgccatctttactaagacatttcaacgggacttcttcctgctgctctccaagttcgggtgctgcaaaagaagagcggagctctaccgcagaaaggatttttcagcttacacgagtaattgcaaaaacggattcaccggttccaacaaacctagtcaaagcacgctgaagttatcaactctccactgccagggaacggcactgctcgataaaacacggtacactgagtgctag

SEQ ID NO: 193566 - DNA, 396 bp, Artificial Sequence
  Description of Artificial Sequence: Synthetic coding sequence
atgacccccctgctgaccctgatcctggtggtgctgatgggcctgccactagcgcaggcattagactgtcacgtttgtgcgtacaacggggacaattgcttcaacccaatgcggtgtccagccatggtggcctactgcatgacaacccgcacgagtgccgctgaagccatttggtgccatcagtgcactggttttggcggctgctcacacggctccagatgccttcgtgattctacccactgtgtcacaactgctactcgcgttctgtccaacaccgaggacctcccacttgtgactaagatgtgccacattggctgtcctgatatacctagcctcggactcggtccctacgtgtccattgcctgctgtcagacttcgctgtgcaatcacgattag

SEQ ID NO: 193567 - DNA, 351 bp, Artificial Sequence
  Description of Artificial Sequence: Synthetic coding sequence
atgacccccctgctgaccctgatcctggtggtgctgatgggcctgccactggctcaggccttagattgtcatgtctgtgcctacaacggtgacaactgctttaatccgatgagatgcccagctatggtagcttactgtatgacaactcggacatactatacgccaaccagaatgaaagtcagcaaatcgtgtgtgccacggtgcttcgaaactgtttatgacggatatagcaagcatgcttccacaacaagttgctgccaatatgatctgtgcaatgggaccggtctggctactcctgccactctggctttagcacccatcctcttggctacactgtgggggctgctctag

SEQ ID NO: 193568 - DNA, 351 bp, Artificial Sequence
  Description of Artificial Sequence: Synthetic coding sequence
atgacccccctgctgaccctgatcctggtggtgctgatgggcctgccactggcccaagcactggattgccacgtttgcgcctataatggcgacaactgcttcaaccctatgaggtgccccgcaatggttgcctactgtatgacaacaaggacatactacacacccaccaggatgaaagtgtcaaaatcctgtgtgcctcggtgtttcgagacagtatatgacgggtatagtaaacatgcgtccacaacatcctgctgtcagtatgacttgtgcaatggtaccgggctcgctacgcccgccaccctggctctcgcccctatcctcttagctacactctgggggctgttgtag

SEQ ID NO: 193569 - DNA, 351 bp, Artificial Sequence
  Description of Artificial Sequence: Synthetic coding sequence
atgacccccctgctgaccctgatcctggtggtgctgatgggcctgcccttggcacaggcactagactgccacgtctgcgcatacaacggtgacaattgcttcaatcctatgagatgcccggctatggtggcttattgtatgacgacgcgcacatattacacacctactcggatgaaggtcagtaaatcctgtgtccccagatgcttcgaaacggtctatgatggctacagcaagcatgcatccaccacctcatgctgccagtatgacctctgtaacgggactgggctcgccactccagccaccctcgccctggctccaatcctccttgctaccctgtggggactactgtag

SEQ ID NO: 193570 - DNA, 249 bp, Artificial Sequence
  Description of Artificial Sequence: Synthetic coding sequence
atgacccccctgctgaccctgatcctggtggtgctgatgggcctgcccctggcccaggctttggactgtcacgtgtgtgcatataatggtgacaattgtttcaatcccatgaggtgccccgcgatggtggcgtactgtatgaccaccaggacctactacacgcctacacggatgaaggtgagcaagagctgcgttccgagatgctttgaaaccgtgtatgacggatatagcaagcacgcctctacttag

SEQ ID NO: 193571 - DNA, 255 bp, Artificial Sequence
  Description of Artificial Sequence: Synthetic coding sequence
atgacccccctgctgaccctgatcctggtggtgctgatgggcctgcccctggcacaggctctcgattgtcacgtgtgtgcctacaacggggacaactgcttcaatcccatgcgatgcccagcaatggtcgcttactgtatgaccactagaacatactatactccgacaagaatgaaagtctccaaaagttgtgtcccaaggtgttttgaaactgtatacgatgggtactctaaacacgctagcacgacctcatag

SEQ ID NO: 193572 - DNA, 1041 bp, Artificial Sequence
  Description of Artificial Sequence: Synthetic coding sequence
atggaccccgcccggaaggccggcgcccaggccatgatctggaccgccggctggctgctgctgctcctcttgcggggcggcgctcaggcactggagtgttacagctgtgtgcagaaagccgatgacggctgctccccaaacaagatgaagactgttaagtgcgccccaggggtggatgtgtgtactgaggctgttggggcagtggagactatccatgggcagtttagcctggccgtgagaggttgcgggagtggactgcctgggaagaacgatcggggtctggacttgcatgggctgttggctttcattcagttgcaacaatgcgcccaggaccgctgcaacgctaaattgaatctgacatcccgagccttggacccagctggcaacgaaagcgcttacccgccgaacggcgtggaatgctatagctgcgtgggcttgagccgcgaggcctgtcagggtacctctcctcccgtagtttcatgttacaacgccagcgaccatgtgtacaagggttgttttgatgggaatgtgaccctaacagccgcgaatgtgacagtgtccctccccgtgagagggtgcgtgcaggatgagttctgcaccagggatggagttaccggtcccggctttacactgagcggcagttgttgccagggatcacgttgtaactccgaccttagaaataagacgtacttcagccctcggattccaccgctggtacgcctccccccacccgagccaacgaccgtggcaagtacaactagcgttacaactagcaccagcgctccagttcggcccacttcaacaaccaagcctatgcccgctcccacaagtcagacaccccgccagggggttgagcatgaggcctccagagacgaggaaccacgcttaacaggcggggccgccggccaccaggataggtctaacagtggccagtatcctgcaaaaggcggtccacagcaacctcacaataaaggctgtgtagcgcccaccgccggactggccgcccttctgctggccgtcgccgctggggttctcctgtag

SEQ ID NO: 193573 - DNA, 885 bp, Artificial Sequence
  Description of Artificial Sequence: Synthetic coding sequence
atggaccccgcccggaaggccggcgcccaggccatgatctggaccgccggttggctgttactgctgctcctccgggggggcgcccaagcgctcgagtgctattcttgtgtgcagaaggcggatgatggctgtagtcctaataagatgaagaccgtcaagtgcgctcctggggttgatgtgtgcaccgaggctgtcggagccgtggaaactatccacggacaatttagcctcgctgtaagaggatgcggttccggactgcctggtaagaatgataggggtttggacctgcacggattattagcctttatccagctgcagcagtgcgctcaggatcggtgtaatgctaagcttaatctcacctcacgagccctggaccccgccgcagccgcaaacgttaccgtttctctacccgtgagaggctgtgtgcaggacgaattctgtactcgggatggagtcaccggccctggtttcactttgtctggatcctgttgtcagggcagtcggtgcaattctgatctacgcaacaaaacctacttctcgcccaggatccccccactcgtacgactgcccccaccagagcccaccaccgtagccagcactacctccgtcaccacctctacaagcgcgcccgtccggcctacatccaccactaagccgatgcccgctcccacgagccaaactcccagacagggcgtcgaacacgaagcatctcgggacgaagagccccgtctcaccggcggtgccgccggccaccaggatcgatcaaacagtggacagtacccagcaaaaggcgggccccagcaacctcacaataagggttgcgtcgctcccacagccggcctagcagctcttctgctggccgtcgcggcaggggtgttgctgtag

SEQ ID NO: 193574 - DNA, 516 bp, Artificial Sequence
  Description of Artificial Sequence: Synthetic coding sequence
atggagcccggccccgccctggcctggctgctgctgctgagcctgctggctgactgcctgaaggccgcccagtcaagggatttcacggtgaaagatattatctacttacacccatcaactacaccttatcccggaggcttcaagtgtttcacttgcgagaaggccgcagataactatgaatgcaaccgctgggcaccagatatctactgcccccgggagaccagatactgttacacccagcacacaatggaagtgacaggaaatagcatcagtgtcactaaaaggtgcgtgccccttgaagaatgcttatccactgggtgccgggactccgagcatgaggggcacaaagtgtgtacctcctgttgcgaggggaacatctgtaatttgcctctgcctcgaaatgagactgacgcaacattcgcaacaacatccccaatcaaccagactaacgggcatccccggtgtatgtctgttatcgtgtcctgcctctggctgtggctggggctgatgctgtag

SEQ ID NO: 193575 - DNA, 516 bp, Artificial Sequence
  Description of Artificial Sequence: Synthetic coding sequence
atggagcccggccccgccctggcctggctgctgctgctgagcctgctcgccgattgtctcaaagccgcacaatcacgagatttcacagtcaaggatataatttatctccacccatctactacaccataccccgggggctttaagtgcttcacatgtgagaaggccgcagataattacgaatgcaatcgatgggcacctgacatctactgccctagggaaacccgctattgctatactcagcacactatggaagttaccggcaatagcatctccgtcacaaagaggtgtgtgcccttggaagagtgcctgtctacaggctgccgcgactcagaacatgaaggccacaaagtgtgcacatcctgttgtgagggcaacatctgcaaccttcctctccctcggaacgagacagacgccactttcgccacaacatctcccatcaaccaaacaaacggacaccccagatgcatgtcagttatcgtctcttgtctttggctgtggctgggccttatgctgtag

SEQ ID NO: 193576 - DNA, 162 bp, Artificial Sequence
  Description of Artificial Sequence: Synthetic coding sequence
atggagcccggccccgccctggcctggctgctgctgctgagcctgcttgcagactgcctgaaggctgctcaatcaagagactttaccgtgaaagacatcatctatttgcacccaagcacaacaccatacccggggggtttcaaatgcttcacctgtgaatag

SEQ ID NO: 193577 - DNA, 969 bp, Artificial Sequence
  Description of Artificial Sequence: Synthetic coding sequence
atggcccggtgcttcagcctggtgctgctgctgaccagcatctggactacaaggctgctcgtacaggggtctctccgagcagaagaactgtcgattcaggttagttgtcggattatgggtatcacgctggttagcaagaaagccaaccaacagctcaacttcaccgaagccaaggaggcctgtagacttctgggcttatctctcgcaggaaaagaccaggttgaaacagcccttaaggcgtccttcgaaacctgttcatacgggtgggtaggggatgggtttgtggtgatcagtcggatctctcctaatcctaagtgtggtaaaaacggagtgggagtcctgatttggaaagttcccgtcagtcgtcaatttgctgcctactgttataactcctcggacacctggactaatagctgtatccctgagattatcacaaccaaggacccaatcttcaatacccagaccgcgacccagacaaccgaatttattgtttctgacagtacctatagtgtggcgagtccctattccaccatccccgctccaactacgacacctcccgcgcccgcctcaacttcgatcccacggcgcaagaagctgatctgcgtgaccgaggtgttcatggagaccagcactatgtctacagagacggaacccttcgtggagaataaagccgccttcaagaacgaggctgccgggttcggaggggtgcctaccgctctgcttgtcctcgccctgctattcttcggagccgccgccggtttagggttttgttatgtgaagcggtatgtcaaggccttcccatttaccaacaaaaaccagcaaaaagagatgatagaaactaaagtggtcaaggaggagaaagcaaatgacagtaatcctaacgaagaatccaaaaaaactgacaagaatcctgaggaaagcaagagcccaagcaagactactgtacgctgtctggaggcggaagtctag

SEQ ID NO: 193578 - DNA, 387 bp, Artificial Sequence
  Description of Artificial Sequence: Synthetic coding sequence
atgcggaccgccctgctgctgctggccgccctggccgtggccaccgggcccgcattaaccctcagatgccacgtatgtacgagctcctctaattgcaaacacagcgtggtgtgcccagcatcgtctcgcttctgtaagacaacgaatacagtagagccactccgagggaatctggtgaaaaaagactgcgctgagagctgcacaccatcatatacgctccaggggcaggtctcaagcggaacatctagcacacagtgttgccaggaggatctatgtaacgagaaactacacaacgcagcgccaactaggactgccctggcccatagcgccctgtccttggggctcgccctgagtcttttagccgtcattttagccccctcactctag

SEQ ID NO: 193579 - DNA, 396 bp, Artificial Sequence
  Description of Artificial Sequence: Synthetic coding sequence
atgaagatcttcctgcccgtgctgctggccgccctgctgggcgtggagcgggctagcagtttaatgtgcttcagttgtctgaatcagaagagtaatctatattgcctcaaaccaacaatatgctctgatcaagacaactattgcgttactgtcagcgccagcgctggaataggcaacctcgtgacattcgggcatagcctgtcaaagacttgcagccctgcatgtccaatccctgaaggggtcaatgtgggcgtcgccagcatgggaatcagctgctgccagtcattcctctgcaactttagtgccgccgatgggggcctgagggccagcgtcactctgcttggggctgggctgctgctgagccttttgcctgctttactacgctttggcccttag

SEQ ID NO: 193580 - DNA, 396 bp, Artificial Sequence
  Description of Artificial Sequence: Synthetic coding sequence
atgaagatcttcctgcccgtgctgctggccgccctgctgggcgtggaacgcgctagcagcctgatgtgtttctcctgtcttaatcagaaaagtaacctctattgtctcaagccgactatatgcagcgaccaggataactattgtgtcacagtgagtgctagcgccggcattggtaatctggtcacgttcggacattccttaagcaaaacgtgttcgcctgcctgccctattccagagggagtgaatgtgggagtggcctccatgggcatcagctgctgtcagtctttcctatgcaacttcagcgccgcagatggcggactccgcgcttctgttacactgctaggagccggtctcctgctgagtctgctgcccgcccttctgaggtttggtccctag

SEQ ID NO: 193581 - DNA, 267 bp, Artificial Sequence
  Description of Artificial Sequence: Synthetic coding sequence
atgaagatcttcctgcccgtgctgctggccgccctgctgggcgtggagagagccagcagcctgatgtgctttagctgcttaaatcagaaatctaatttgtactgtctcaaaccgacaatatgttcagaccaggataattactgcgtcaccgtctcagcatcagccggaattggaaacctggttacgtttggacactcactgagtaaaacttgctccccagcctgtcccatcccagagggggtaaacgtcggtgtggcgagcatgtag

SEQ ID NO: 193582 - DNA, 396 bp, Artificial Sequence
  Description of Artificial Sequence: Synthetic coding sequence
atgaagatcttcctgcccgtgctgctggccgccctgctgggcgtggagcgtgctagttcactgatgtgtttctcctgcctgaatcagaagagtaacctgtattgcctgaagcccactatttgcagtgaccaagataactattgcgtcacagtgagtgcttccgcggggatcggtaatctggttaccttcggacacagtttatccaagacctgtagcccggcgtgtcctatacccgagggcgttaacgtcggagtggcgtctatgggcatctcgtgttgtcagtctttcctgtgcaacttctccgctgctgatggcgggttgagagcatccgttaccctgctgggcgcggggctgctcctgtctcttctcccggcattactgcggtttggcccatag

SEQ ID NO: 193583 - DNA, 396 bp, Artificial Sequence
  Description of Artificial Sequence: Synthetic coding sequence
atgaagatcttcctgcccgtgctgctggccgccctgctgggcgtggaaagagcgagttctcttatgtgcttttcctgtctcaaccagaaaagcaacctgtattgcctgaaacccacgatttgcagtgaccaggataactattgtgtcaccgtgagcgcttccgccggaatcggcaacctcgtgacttttggacactccctgtcaaagacatgctcccccgcgtgcccaattcccgaaggggtgaacgttggggtggccagcatgggcatctcttgctgccaatctttcttgtgtaattttagcgctgccgacggtggtcttagagcatccgtcaccctcctgggggcaggcttgctgctcagtctcctacccgccctcctgagatttgggccctag

SEQ ID NO: 193584 - DNA, 396 bp, Artificial Sequence
  Description of Artificial Sequence: Synthetic coding sequence
atgaagatcttcctgcccgtgctgctggccgccctgctgggcgtggaacgggcgtcctcccttatgtgctttagctgtctcaatcagaaaagtaacctctactgcctgaaaccaactatctgttctgaccaggataattactgcgtgaccgtctccgctagtgccgggatcggcaacctagttacattcggccattcactgagcaagacctgctccccagcttgccccatccccgaaggcgtgaatgtgggtgttgccagtatgggcatttcttgttgccaaagtttcctctgtaacttctctgcagccgacgggggtttaagagccagcgtcaccctattgggcgccgggctcctgctgtctttgctgcccgccctattgcgcttcggaccctag

SEQ ID NO: 193585 - DNA, 396 bp, Artificial Sequence
  Description of Artificial Sequence: Synthetic coding sequence
atgaagatcttcctgcccgtgctgctggccgccctgctgggcgtggagcgggccagtagtttaatgtgttttagctgtctgaaccagaagtccaatctctactgcctaaagcccacaatctgttcagaccaggacaactactgcgtgacagtctctgcctctgccggcatcgggaatctggtgacatttggccatagtctcagcaaaacttgcagccccgcttgtcccatcccagaaggtgttaatgtgggcgttgcgtcgatgggaatctcttgctgccagtctttcctgtgtaacttttcagctgcagacgggggccttcgtgcgagcgtcacactactcggcgctgggctcctcctgtccctgttgcctgccttgctacggtttggcccatag

SEQ ID NO: 193586 - DNA, 396 bp, Artificial Sequence
  Description of Artificial Sequence: Synthetic coding sequence
atgaagatcttcctgcccgtgctgctggccgccctgctgggcgtggagcgggcgtccagcctgatgtgcttttcatgtctgaatcagaagagcaacctttactgcctgaaacctacaatctgtagtgaccaggataattattgcgtgacagtttctgcatccgcagggattggaaacctggtgaccttcggtcatagtctctctaagacttgctcccctgcatgtccaattccagaaggtgtcaacgtaggagttgcttccatgggaattagctgttgccagtcatttttgtgtaacttttctgccgccgatggtgggctcagagcatccgtcacccttcttggggccggccttctgttgtcgctactacctgcattgctgagattcggtccttag

SEQ ID NO: 193587 - DNA, 402 bp, Artificial Sequence
  Description of Artificial Sequence: Synthetic coding sequence
atgaagccccagttcgtgggcatcctgctgagcagcctgctgggcgctgccttgggtaataggatgcgatgctataattgcggcggatcgccgagcagctcctgtaaggaggctgttacgacctgcggcgagggtagaccgcaaccaggcctcgagcagattaaactccccggcaatccgcccgtgactctgatacatcagcacccagcgtgtgtagctgcccatcactgtaaccaggtggagacagagagcgttggtgacgtcacatacccagcacaccgcgactgctacctgggtgacctatgcaacagcgcagttgcttcacacgtcgcccccgccggcattttggccgctgcagcgactgccctgacctgcctgctgcctggattgtggagtgggtag

SEQ ID NO: 193588 - DNA, 525 bp, Artificial Sequence
  Description of Artificial Sequence: Synthetic coding sequence
atgaagccccagttcgtgggcatcctgctgagcagcctgctgggcgctgccctgggaaatcgtatgcgctgctacaactgcggcggatctccttccagctcttgcaaggaggctgttactacctgcggcgaaggcaggccccagcccggtttagaacagattaagctcccaggaaatagaagatgtttcttaaggggccttaagatccccctgggctcgcttaagagtcatctgctttgccctcggcggcaggtactcaaacctggcgtccagcatccatctttcatcctgagcttatcgccatcagacttggactcccccacatcttctctgaggcgctctccctccctccagtcatccggggaccgggtgggaggacggcgagatctttcgtctccacaaggcttacttccggggcgccctgtccagcagcggcgcggcaagccatgcgggccctgccgtcacttcggttgttcttcttaccgaccggatctctcactggccaggactgtggaaagaatctag

SEQ ID NO: 193589 - DNA, 402 bp, Artificial Sequence
  Description of Artificial Sequence: Synthetic coding sequence
atgaagccccagttcgtgggcatcctgctgagcagcctgctgggcgccgcactagggaacaggatgaggtgctataactgcggcgggtcaccgtcttcctcgtgtaaagaagctgtgacgacctgcggcgagggacgaccacagcctggcctggaacagataaagctgcctgggaaccctccggtcactctgatccaccagcatccggcctgtgtggcagcccaccattgcaaccaggtcgagactgaaagcgtgggagatgtaacctaccctgcccacagggattgttatcttggtgatctctgtaactctgctgtcgccagtcacgtggccccggcaggtatacttgcggccgcggccacggcgctgacttgcttactgcccggactttggtctgggtag

SEQ ID NO: 193590 - DNA, 1149 bp, Artificial Sequence
  Description of Artificial Sequence: Synthetic coding sequence
atggccgtgctgttcctgctgctgttcctgtgcggcaccccccaggcagctgacaacatgcaggctatttatgtcgccctgggcgaagctgtagagctcccttgcccatcgccaccaacccttcatggtgacgaacatctgtcttggttctgctctcctgctgccggctcctttaccacattggtggcccaggtgcaggtcggtaggcccgcccccgaccctggaaaacccggcagggagagcagattgcgactactggggaattattccctttggctggaaggctctaaggaggaggacgctggccgttactggtgcaccgtgcttggtcagcaccacaactaccagaactggcgggtttacgacgttttggtgctcaaggggagccagctttccgccagggccgccgatgggagtccttgtaatgtgctcctgtgcagcgttgtgccatctagaagaatggacagcgtgacatggcaagagggtaaaggacccgtgagaggtagagtgcagagcttctggggaagcgaggccgctctcttgctcgtgtgtcctggggagggcctcagcgagccccgctctaggcggccgcgcatcatacgatgtttgatgactcataataaaggtgtgtccttttcgctagcagcctctattgacgccagcccagctctttgcgccccctctaccggatgggacatgccatggattttgatgttgctgctgacgatgggccagggcgtagtaatcctggcactaagcatagtcctgtggcgccagcgagtgcggggtgcgcccggccggggcaaccggatgcgatgctacaactgtggtggctccccctcaagctcgtgcaaggaagctgtgactacttgcggagagggacgtccacagccgggactggaacagatcaaactgcccggaaatccacctgtgactctgattcaccaacatcccgcctgtgtggccgctcaccattgcaaccaggttgaaaccgaatcagtcggcgacgtgacctaccctgcgcatcgcgattgctacctgggggatctgtgtaattctgctgtggccagccacgtggcacctgctggtatcctggctgctgcagcaacggctctcacgtgtttgctgcctggtctatggtctggctag

SEQ ID NO: 193591 - DNA, 402 bp, Artificial Sequence
  Description of Artificial Sequence: Synthetic coding sequence
atgaagccccagttcgtgggcatcctgctgagcagcctgctgggcgcagctctgggcaatcggatgagatgttataattgtggcggaagtccctccagttcctgcaaagaagcagtgacaacctgcggtgaaggcagaccccaaccaggactggagcagatcaaactgcctggaaatccacctgtcacactgattcaccagcaccctgcatgtgttgctgcgcaccactgcaaccaggtggagactgagtccgttggggatgttacataccctgcacaccgagactgctatcttggggacctctgcaattctgcagtagcgagtcacgtcgcccccgcgggtatcttggccgctgccgccacagccttaacgtgtctcctgcctggcctgtggtctgggtag

SEQ ID NO: 193592 - DNA, 402 bp, Artificial Sequence
  Description of Artificial Sequence: Synthetic coding sequence
atgaagccccagttcgtgggcatcctgctgagcagcctgctgggcgcagcccttgggaaccggatgcgctgttacaattgtggtgggagcccctcctcctcttgtaaagaggccgttacaacctgcggagagggtagaccgcaacctggactagaacagatcaagctgcccggaaacccccctgtcacactgatccaccagcatcctgcttgcgtagctgctcaccactgtaaccaggtggaaaccgagagtgttggcgatgtgacctaccccgcccatcgtgactgttaccttggggacctgtgtaactctgccgtggcatcacacgtggctcctgctggcatcctcgcagccgctgcaacagctctcacctgtttgctgccgggtctgtggagcggatag

SEQ ID NO: 193593 - DNA, 1149 bp, Artificial Sequence
  Description of Artificial Sequence: Synthetic coding sequence
atggccgtgctgttcctgctgctgttcctgtgcggcaccccccaggctgccgacaacatgcaggctatctatgtcgccctgggcgaagccgtggaactgccatgccctagccctcctacactacacggcgacgaacatttgtcctggttctgctcccccgccgcaggcagcttcacaactctggttgctcaggtacaggtggggcggccagcccccgaccctgggaagccaggcagggagagtcgcctgaggctgcttggtaactattccctttggctggaggggtccaaggaggaagatgcgggaagatattggtgtgcagtcttagggcagcatcataactatcaaaattggagggtttatgacgttctggtcttgaaggggtctcagctgtcagctcgggccgctgatggatcaccctgtaatgtgctcctgtgcagtgtcgtccccagccgtcggatggattctgtcacatggcaggagggaaaggggcctgttaggggtcgcgtgcagtcattttggggctcagaggcggctctgttgctggtatgcccaggtgaggggttgtccgaaccgcgcagtagacgtccccgcataatcagatgcttaatgacgcacaacaaaggtgtgtctttctcactagccgcctcgattgatgcgtctccagccctctgtgccccatccacaggatgggatatgccttggattctgatgctgttgctgacaatggggcagggtgtggtgatcctcgcgctcagcatagttttgtggaggcagcgtgtgcgcggggctcctgggcgaggtaatagaatgcgttgttacaattgcggggggtccccctcctctagctgcaaggaggccgtgactacatgcggtgaagggaggccgcaaccggggcttgagcagattaagctgccgggcaaccctcctgtgacattgatccaccagcatcccgcctgcgtggcggctcaccactgtaaccaggtggagaccgagtccgtaggagacgtgacttaccctgcccatcgggattgctacctaggagatctgtgtaatagtgccgttgcttcccacgttgctccagcgggcattcttgccgcggcagctactgctctgacctgtctgcttcctggcctttggtccggctag

SEQ ID NO: 193594 - DNA, 402 bp, Artificial Sequence
  Description of Artificial Sequence: Synthetic coding sequence
atgaagccccagttcgtgggcatcctgctgagcagcctgctgggcgccgctctcggaaatcgaatgcggtgctataattgtggtgggtcccctagctcaacgtgcaaggaggcggtaaccacgtgcggcgaggggcgtccacagccagggttggagcagataaagctgccaggtaatccccctgtgactcttatacaccagcacccggcttgtgtggccgcacatcactgcaaccaggtggaaaccgagtctgtgggagatgtcacgtatccagcacaccgcgattgctacctgggcgatctgtgcaactctgctgttgcctcacatgtggctccagcaggcattcttgccgctgccgcaacggccctgacatgtctgctccctgggctgtggtccgggtag

SEQ ID NO: 193595 - DNA, 402 bp, Artificial Sequence
  Description of Artificial Sequence: Synthetic coding sequence
atgaagccccagttcgtgggcatcctgctgagcagcctgctgggcgcagcactgggaaataggatgcggtgttataactgtgggggaagtccatccagttcgtgcaaggaggcggttacgacctgcggcgaaggtcggccccaaccgggtctagagcagataaaactgccaggaaatcccccggttacactgattcaccagcacccggcctgtgttgctgcccatcattgtaatcaagtggaaactgagtcggtgggcgatgtgacatatcctgcacacagggactgttatctgggcgacttgtgtaactctgccgtggcatcacacgtcgctcctgcaggaatattggccgcagcggccacagctctgacttgtctcttgcccggactctggagcggatag

SEQ ID NO: 193596 - DNA, 402 bp, Artificial Sequence
  Description of Artificial Sequence: Synthetic coding sequence
atgaagccccagttcgtgggcatcctgctgagcagcctgctgggcgcagctctcggcaataggatgcggtgctacaattgcgggggttctcctagctcttcatgcaaggaagcagtgactacatgtggcgagggccgaccccaaccgggactggaacagatcaagctgcccggaaatccccccgtgacgcttatacatcagcaccctgcttgtgtagctgcacaccactgcaatcaggtggagaccgagagcgtaggcgacgtgacgtaccccgcccatagggactgttatttgggtgatctgtgtaatagtgctgtggcctcgcacgtggctcccgccgggatcttggccgctgccgctaccgcactgacctgtctgttgcctggcctctggagcggttag

SEQ ID NO: 193597 - DNA, 525 bp, Artificial Sequence
  Description of Artificial Sequence: Synthetic coding sequence
atgaagccccagttcgtgggcatcctgctgagcagcctgctgggcgcggctctgggcaatcgaatgaggtgctataattgcggggggtcgccttcttcaagctgtaaggaggcagtcactacttgcggcgaggggcgaccgcagcccggactcgagcagatcaaactgcccggaaatcggagatgctttttaaggggtttgaagattccgctcggttcattaaagtcccacctcctttgcccacgacgacaggtgctcaagccgggcgttcagcatccctccttcatcctctcactgtcgcctagtgacctggactcgccaacgagcagcttgcgaagatctccgtcgctacagagttccggcgaccgagtgggcggtagacgagatctctcatctccacagggtctcctccccgggcgccctgtccagcagaggcgcggcaaaccatgtggaccttgccgacacttcggctgctcaagctatagacccgatctctctctcgccagaactgtggagcgtatctag

SEQ ID NO: 193598 - DNA, 486 bp, Artificial Sequence
  Description of Artificial Sequence: Synthetic coding sequence
atgctggccccccagcggacccgggcccccagcccccgggccgccccgagacctacaagatcaatgctaccggccgctatgaagggcctgggcttagccttgctggccgtgttactctgctccgctccagcgcacggactctggtgccaggattgtactttgacgacgaactcatcccattgtactcctaaacaatgccaaccatccgataccgtctgcgcctcagtaaggatcactgatcccagctctagtagaaaggaccacagtgtgaataagatgtgcgcatcgtcatgtgatttcgtgaaacggcacttttttagtgactacctgatggggttcatcaacagcggaattctgaaagtggacgtcgattgctgtgagaaagacctgtgcaatggcgccgccggcgcgggtcactccccctgggctctcgctggaggacttttgctctcgttgggcccggctttactctgggctggcccatag

SEQ ID NO: 193599 - DNA, 486 bp, Artificial Sequence
  Description of Artificial Sequence: Synthetic coding sequence
atgctggccccccagcggacccgggcccccagcccccgggccgccccgaggccaaccaggtccatgttacctgccgctatgaagggcctgggcctcgccttgctggcagtcttattatgctcagcacccgcacatggcctgtggtgtcaagattgcacactgacaaccaactcttcccactgcacaccaaagcagtgccagcccagtgacaccgtgtgtgcctctgtacgtattaccgacccctcttcctcccggaaagaccactctgttaataagatgtgcgcgagtagctgcgacttcgtgaagcgccatttctttagcgattatctgatgggtttcatcaatagtggcattctgaaggtcgacgttgactgttgcgagaaggatctttgcaatggcgccgccggggctggacatagcccatgggcactcgccggcgggctgttattgtccttgggaccagcgctgctctgggcgggcccctag

SEQ ID NO: 193600 - DNA, 423 bp, Artificial Sequence
  Description of Artificial Sequence: Synthetic coding sequence
atgctgcccgccgccatgaagggcctgggcctggccctgctggccgtcctgctgtgcagtgcacctgctcatggtttgtggtgtcaggattgcaccctgacaaccaactcatcccactgcactccaaagcagtgccagcccagtgatacggtgtgtgctagcgtgagaatcacagacccgagctctagccgaaaggaccacagtgttaataaaatgtgcgcaagtagttgtgactttgtcaagaggcatttcttcagtgattatttgatgggatttatcaattctgggatccttaaagtggatgtagattgttgcgaaaaggacctttgtaacggggccgctggagcaggtcacagtccatgggctcttgctgggggcctcctattaagcctcggcccagcgctcttgtgggctggaccgtag

SEQ ID NO: 193601 - DNA, 1971 bp, Artificial Sequence
  Description of Artificial Sequence: Synthetic coding sequence
atggtggcccccaagagccacaccgacgactgggcccccggcccctttagcagcaagccacagcgtagccaactccagatcttcagcagtgtgctgcaaacctctttgctgttcttactcatgggcttgcgggcatcaggaaaggattcagcgcccacagtggtctctggcattctgggagggtcagtcactctgcctctcaatatttccgttgacaccgaaatcgagaatgtgatctggataggccctaagaatgcactagcctttgcacgacccaaggagaacgtcactatcatggtaaaaagctatctggggcgcctcgacattaccaaatggtcatactccctgtgcatctccaacctgacactgaacgatgccggcagctacaaagcccagatcaatcagagaaattttgaggtcaccacagaggaagaatttaccttgtttgtgtatgaacaactccaggagccacaggtcacaatgaagagcgtcaaggtttccgaaaatttctcatgcaatatcaccttaatgtgctctgtgaaaggcgctgagaagagtgtgctgtactcttggacccctagagaaccccacgctagcgagagcaacggcggcagcatactcaccgtgtcccgcaccccatgcgacccggacctgccctacatctgtaccgctcaaaaccccgtctcccagcgctcgtcactccctgtccacgtgggccaattctgcactgacccaggagccagcagaggcggcaccacaggcgaaaccgttgtgggcgtcttaggcgaaccagtgacccttccattagcactccctgcctgccgggatacagagaaggtggtttggctttttaacacctcaataatctctaaggaaagagaggaagcagccacagcagaccccctgatcaagtctcgggacccctacaaaaatagggtttgggtctcttctcaggattgcagcctcaagattagtcaactgaaaatcgaggatgcaggcccctaccatgcatatgtgtgctccgaagcatctagcgtcacctccatgactcacgtcacccttctaatatatagaaggctacgaaagccaaaaattacttggtctctcagacactccgaggacggaatatgccgcatttctctgacatgttcggtggaagatggtggtaatacggtcatgtacacctggaccccgctgcagaaagaggccgttgtatcccagggggaaagtcatctgaacgtttcctggagaagctctgagaaccatccaaacctgacctgcacagcctccaacccagtgtcccgctcgagccatcagttccttagcgaaaatatctgtagcggcccagagaggaacacaaagttgtggattggtcttttcttaatggtctgcctgctttgcgtaggcatcttcagctggtgtatttggaaacggaagggtaggtgttcagtaccagccttctgctcatcccaagccgaagcccctgcggacacgcccgaaccaaccgccggtcacacactctatagcgtgctgagccaggggtatgagaaactggacacccccctgagacccgctagacagcagcccacgccaacgagcgattcatcttctgattcgaacctcactactgaggaggacgaagacaggcctgaggtccacaaaccaatctccggaaggtacgaggtattcgatcaagtgactcaggaaggtgctggccacgatcccgccccagagggtcaggccgactatgaccccgtcaccccttatgtgaccgaagtggagagtgtcgtgggggagaatactatgtatgcacaggttttcaatcttcaaggaaagaccccggtctctcagaaagaggagtcctcggccacaatctactgttcaatcagaaaaccacaagtggtagttcctcccccccaacagaacgaccttgagataccggagagcccaacttacgaaaattttacatag

SEQ ID NO: 193602 - DNA, 1566 bp, Artificial Sequence
  Description of Artificial Sequence: Synthetic coding sequence
atggtggcccccaagagccacaccgacgactgggcccccggccccttttcaagcaaaccgcagcgctctcagctgcagatattctcatcggtactccagacttccctacttttcctccttatgggattacgcgccagtggaaaagatagcgcacccacggtggtcagcgggatcctgggaggatcagtgaccctgccactgaatattagtgtggacactgagatcgaaaatgtgatctggatcggcccaaagaacgctctcgcttttgcacggcccaaagagaatgtgaccatcatggttaagagttatttaggccgtctcgacatcaccaagtggtcatatagtctctgcatctccaatctgactctgaacgatgcaggctcatataaggcacaaataaaccagagaaattttgaggttaccacagaggaggaattcactttgtttgtatatgagcaactccaggagccacaggtaaccatgaagtcggtcaaggttagtgagaacttctcatgtaacattactctgatgtgctctgttaagggggccgagaagtccgtgctttactcctggacacctcgagagccacatgcctccgaaagcaacggcggatcgatactaaccgtgtcaagaaccccatgcgatcccgaccttccatacatctgcactgctcagaatccagtgtctcagcggtcctccctacccgtgcatgttggacagttttgcaccgaccccggcgccagtagaggaggcacaaccggggagaccgtcgtgggagtactgggggagcccgttacactccctttagctttgccggcctgccgggacaccgaaaaggtggtgtggctctttaacacgtcaatcatttccaaagagcgggaagaggccgccacggccgacccgctgatcaaatctagggatccctataaaaaccgggtgtgggtgtctagccaggactgttcgctaaaaatctctcaattaaagatcgaggacgccggcccctatcacgcctacgtgtgcagcgaagccagctctgtaaccagcatgacccatgtgacactgctaatctaccgtccagaaagaaacaccaagctttggataggcctgtttctcatggtctgtctgctgtgcgtggggatcttctcatggtgtatctggaagcggaaggggagatgcagcgtgcccgctttctgcagctctcaggcagaggctcctgctgatacccctgggtatgaaaaacttgacacgcccttgcggaaaccaatatctgggcgatatgaagtattcgatcaggtgactcaggaaggagccggccatgacccagcccccgagggccaggcagattatgaccccgtcaccccctacgtgaccgaagtcgaaagcgttgtcggagagaataccatgtatgctcaggtctttaaccttcagggaaaaacgccagtgagccagaaagaggagtccagcgctaccatctactgttccatacgcaagcctcaggtagtcccaccccctcagcagaatgacctcgaaatccctgagtcccctacgtacgagaactttacctag

SEQ ID NO: 193603 - DNA, 813 bp, Artificial Sequence
  Description of Artificial Sequence: Synthetic coding sequence
atgacccacgtgaccctgctgatctaccggcggctgcggaagcccaagattacttggagcctgcggcatagcgaagacgggatttgccgcatcagcctaacctgcagcgtcgaagatggtggtaatacggttatgtacacgtggacacccctgcagaaggaagctgttgtctcgcagggggagtcgcacctgaacgtgtcctggcgctccagcgaaaatcaccccaacttgacatgtaccgcctctaaccccgtcagcaggagcagccatcagtttcttagcgagaatatctgttcaggtcctgagagaaacaccaagctctggattggactgttcctgatggtctgtttactgtgcgttggaattttcagttggtgtatctggaagaggaaaggccggtgctcagttccagctttctgctcctcgcaggctgaagcgccagcggacacacctggatacgagaagctggacacccccttacggccagctaggcagcagccaaccccaacatccgactcaagctcggactcaaacctgacaaccgaggaggatgaagaccgtcccgaggttcacaagccgatctccggccgctatgaggtgtttgaccaggtcacacaggagggggctggacatgatcctgcccccgagggtcaggcagattatgatcccgttacaccctacgttacggaggtggagtcagttgtaggggagaatacaatgtacgcccaggtcttcaatttgcaggtggtgccccccccccagcagaatgatttggagatccctgagtccccaacctacgaaaactttacttag

SEQ ID NO: 193604 - DNA, 813 bp, Artificial Sequence
  Description of Artificial Sequence: Synthetic coding sequence
atgacccacgtgaccctgctgatctaccggcggctgcggaagcccaaaattacatggtctctccggcacagcgaagacgggatttgtcgtatatcattgacatgctccgtggaggacggaggaaacacggtgatgtatacctggactcctctacagaaggaagcagtggtgagccagggggaatcccacctgaatgtgagttggagaagttcagagaaccatcccaatctaacatgtactgcatctaaccccgtgtctcgatcctcacaccagtttctcagcgagaacatctgcagtggccctgagcggaacacaaagctttggattgggctgttcctgatggtgtgtctgctgtgtgttggcatcttcagttggtgtatctggaagaggaagggccgttgctccgttccagccttctgcagcagccaagccgaagccccagccgatactcctggatatgaaaagctggatacaccgctaagaccagcacggcagcagcccactcctacgagtgattcttcatctgactccaatttaacaacagaagaagacgaggaccggcccgaagtgcacaagccaatttctggaagatatgaggtgtttgatcaggtaactcaggagggggcagggcacgacccagcacccgaaggccaagcagactacgaccctgttaccccgtacgtaacagaagttgaatctgtcgttggcgaaaacacaatgtacgcccaggtctttaatttacaggtggtgcctcctccacagcagaacgatctagagattcccgagagtccaacctatgagaacttcacatag

SEQ ID NO: 193605 - DNA, 1968 bp, Artificial Sequence
  Description of Artificial Sequence: Synthetic coding sequence
atggtggcccccaagagccacaccgacgactgggcccccggccccttctccagcaagccccagcgctcccagctccagatatttagtagcgtcctccagacttccttgctcttcctgttgatgggactacgggcgtccgggaaggatagtgcgcctacagtggtgtccgggattctcggtgggagtgttacacttcctttgaatatcagcgtggacaccgagatcgaaaacgtcatttggattgggccaaagaacgctttggccttcgctaggccaaaagaaaacgttaccatcatggttaagtcctacctgggtcgattggatattaccaaatggtcttattccctgtgtatcagcaacttgactctgaatgatgctggatcttacaaagctcaaatcaatcagagaaacttcgaagtaactacagaagaggaattcacgctgtttgtctacgaacagttacaggagccgcaggtgaccatgaaatctgtcaaagtgagtgagaactttagttgcaacataaccctgatgtgcagcgttaagggcgctgagaagtcagtcctgtactcatggactcccagggagcctcacgccagtgaaagtaacggcggatcgattctgaccgtttctaggactccatgcgacccagacctcccttacatctgcaccgcccaaaatcccgttagccagcggagcagcttgcccgtacacgtgggccagttctgcactgaccctggagctagtaggggagggaccacaggggagaccgtagttggggtcctcggggaacctgtcaccctccctctcgcattacctgcctgtcgagacacagagaaggtagtgtggctattcaatacaagtataatctcgaaggaacgcgaggaagcagcaactgccgacccactgatcaagtcacgtgacccatataagaaccgcgtgtgggtcagctctcaggactgctcactcaagatctctcagctgaagatagaggacgctggaccatatcacgcttacgtgtgttccgaggcaagctccgtgacaagcatgacccacgttacgctcctgatttaccggcgactgaggaaaccaaaaattacgtggagcctgagacattcagaggacgggatatgtcgtatcagcctgacatgttcagtcgaagatggggggaatacagtcatgtacacttggacacctctgcagaaagaggccgtggtatctcagggtgaaagccatctgaacgtgagctggaggtcctcagaaaaccaccctaacctcacttgcaccgcctccaaccctgtgtccagatctagccatcaattcctttcggaaaacatatgtagtggacctgaaaggaacaccaagctctggattggtttgtttctgatggtatgtcttctgtgtgttggtattttctcctggtgcatttggaaaagaaaaggccggtgcagcgtgcccgccttctgttcatcccaggccgaagcccctgctgacacgcccgaaccaacagctggccacaccctgtacagcgtgctctcacaaggttatgagaaactggacacccctttgaggccggcccgccagcagccaacgcccacctccgatagctccagtgactcgaacctgactactgaggaagatgaggaccggcctgaggtgcacaagccaatcagcggacgatatgaagtttttgatcaggtcacacaagaaggcgccggacacgacccagcccctgaagggcaggccgattatgacccggtgacgccgtatgtcacagaagtcgaaagcgtggttggcgagaatacaatgtatgcacaggtcttcaatctgcaggggaagacgcccgtgagccagaaagaggagagctctgctactatctattgctccatacggaagcctcaggttgtgcctcccccccaacagaacgatctggaaatcccagaatctccgacctacgagaacttcacttag

SEQ ID NO: 193606 - DNA, 1116 bp, Artificial Sequence
  Description of Artificial Sequence: Synthetic coding sequence
atggtggcccccaagagccacaccgacgactgggcccccggccccttctctagcaaaccacagaggtcccagctgcaaattttcagcagcgtattgcagacgtccctgctattcttgcttatgggactccgagcgagcggcaaggattcagctcccacagtcgtgtcaggcattctgggtggttctgtgacccttccgctgaatatttctgtggacaccgagattgagaacgtcatttggataggaccaaagaacgcactggcttttgcacgacctaaggagaacgtcactatcatggtaaaaagttacctgggacgtctagatattactaagtggtcctactctctgtgtatttccaatttgactctgaatgatgcaggtagttataaggcgcagatcaatcaacgcaactttgaggtcactaccgaggaagaattcacactgttcgtctatgaacaactacaggaacctcaggttactatgaagagtgtcaaggtgtcagagaactttagttgtaatatcacattgatgtgctctgttaagggggcagagaaaagtgtgctgtactcgtggacacctcgcgagcctcacgccagcgaatctaatggaggatccatcctgactgtcagtcgaaccccctgtgaccctgatttgccgtatatctgtactgcccaaaaccctgtttcccagagatcttccttgccagttcacgttggccagttctgcactgatccaggcgcttcccgagggggcaccacgggagaaacggtcgtcggggtgctgggtgaaccagtaactctgcctctggcccttcccgcatgccgcgataccgaaaaagtggtgtggctattcaacacgagcatcattagtaaagagcgtgaggaggccgcgaccgcagatccactgatcaaatcaagggatccttataagaaccgggtgtgggttagcagccaagactgctcactgaagattagccagctaaaaatcgaggacgctggaccgtatcatgcgtacgtgtgtagtgaggcctcctcggtaacatcaatgactcacgtgacactgcttatttatagagaaagtctgggccgcgcaccgataacacgcttcctgctgtag

SEQ ID NO: 193607 - DNA, 1809 bp, Artificial Sequence
  Description of Artificial Sequence: Synthetic coding sequence
atgggcctgcgggccagcggcaaggacagcgcccccaccgtggtgagcggtattttgggcggatccgttactttgccccttaacatctccgtggatacagagattgaaaatgtgatttggatagggcctaaaaatgctttggcgtttgctcggcctaaggaaaacgtcactatcatggtgaagagctatctaggacggctggacatcaccaaatggtcttattccctctgcatttccaacttgactcttaacgacgccgggtcctacaaggcacagatcaaccaacggaattttgaagtcactacggaagaggagttcactctcttcgtgtatgaacagttgcaggagccacaagttacgatgaagtcggtaaaagtatctgaaaacttttcttgcaacattacactcatgtgctcagtgaaaggcgctgaaaaatccgttctctattcttggactcccagagagcctcacgcctccgagtccaatggaggcagcattctgactgtttctaggaccccttgcgaccccgatctcccatatatttgtactgctcaaaatcccgtttcccaaagaagctcattgccagtgcacgtgggccagttctgtactgacccaggagccagcagaggagggacaaccggagaaaccgttgtcggggttcttggggagcccgttaccctccctctagctctccccgcgtgccgagacaccgaaaaggtggtctggctattcaatacgtcaattattagcaaagagagggaagaggcagccaccgccgacccactgatcaaaagcagagatccgtataagaacagagtgtgggtctcttctcaggactgctctctgaagatctcccaacttaagatcgaagacgccgggccataccacgcgtacgtgtgtagtgaggcttcaagtgtgacttccatgacacacgttacgttactcatatataggaggctgcgtaagccaaagatcacatggtccttgcgacacagcgaagatggcatctgcagaatttctctcacctgctcagtggaggacgggggaaacaccgtcatgtacacatggacacctcttcagaaggaagccgttgtaagccaaggggagtcacacctcaacgtcagctggagaagctccgagaatcatcctaatctgacgtgcacagcctctaatcccgtcagcaggtctagtcaccaattcttgagcgagaacatctgtagtggtcccgagcggaataccaagttgtggatcggtctttttctgatggtgtgcctgttgtgcgtcgggatcttcagctggtgtatttggaagcgcaaaggaaggtgcagcgtccccgccttttgttcttcgcaagccgaagcccccgcagatacacccggctacgagaaattagacacaccacttaggcctgccaggcagcaacctactccaacttcagactcatcctccgactccaatctcaccacggaggaagatgaagaccgtcctgaggtgcataagccgataagtggtaggtatgaagtgttcgatcaagtgacgcaggagggtgcgggacacgatccagccccagaaggacaggctgactacgatccagtcaccccctacgttactgaagttgaatccgtagtgggcgagaataccatgtatgcacaggtcttcaatctgcagggaaagactcctgtcagccagaaagaggagtccagcgctactatctactgctccatacggaagccacaggttgtcgtgccccctccacaacagaacgacctcgagattccagagagccccacctatgaaaacttcacttag

SEQ ID NO: 193608 - DNA, 582 bp, Artificial Sequence
  Description of Artificial Sequence: Synthetic coding sequence
atggtggcccccaagagccacaccgacgactgggcccccggccccttcagctccaagcctcagcggtctcagctgcagatcttctctagcgtgcttcagacatccctgctgttcctgctgatggggctccgggcatcggggaaggactctgctcccactgtggtctccggcatcttgggcggctctgtcactctccctctcaacatcagtgtcgacaccgaaattgaaaacgtgatatggattggaccaaagaatgcgctggctttcgctaggcccaaggagaatgtcacaatcatggtaaagtcttaccttgggagactggacattacaaagtggtcctatagtctgtgcatttcaaatcttaccctgaacgacgcaggctcatataaggcgcaaatcaatcaaagaaattttgaggttactacagaagaagaattcacgctcttcgtctacgctcccttcatcgaaaaattaagcgtccacgtgattgagggggatcacagaacgctcctggagggatccgggctggaatcaatcatctcaacgctagccgagcccagagtgtctgtaagggagggctag

SEQ ID NO: 193609 - DNA, 1581 bp, Artificial Sequence
  Description of Artificial Sequence: Synthetic coding sequence
atgggcctgcgggccagcggcaaggacagcgcccccaccgtggtgtcgggcattttgggggggagcgtcactctgcccctgaacatcagcgtggacacagaaatagagaatgttatatggatcgggcctaagaatgccctggcctttgctaggcctaaagagaatgtgacaatcatggtgaaatcttatttagggagactggatattaccaagtggagctattcactctgtattagcaatctcactctaaacgatgcaggctcttataaagctcagattaatcagaggaactttgaggttactacggaggaggaattcaccctctttgtatacgagcagcttcaagaaccgcaagtcacaatgaaatccgttaaagtgagcgagaactttagctgcaatattacgcttatgtgctccgtaaagggtgccgagaaaagcgtactatattcttggacaccccgcgagcctcacgcttcagaatctaacggtggcagcattttaaccgtatcccgaacaccttgcgaccccgaccttccctacatctgcactgcgcagaaccctgtgagtcagagatcctccctgccagtccatgtaggccagttttgcaccgaccccggagcctctcggggcggtactaccggagagacagtggtcggagtgttgggagagcccgtcaccctacctctggccctgcccgcctgccgcgataccgagaaggtggtctggctgttcaacacatctatcataagtaaggagcgggaggaagctgcgacagctgatcctctgattaagagtcgcgacccctataaaaatcgagtgtgggtgagttcccaagactgttctcttaaaatctctcaattgaagattgaagacgctggaccctaccacgcttatgtgtgctccgaagcttcgagcgttacatcaatgacacatgtgactttgctgatttaccggcctgagcggaataccaaactctggattggtctgtttcttatggtgtgtctgctctgtgtcggtatcttttcttggtgcatctggaagcgtaaaggccggtgctccgtccctgccttctgcagttcacaggctgaagctcctgcagacacaccagagcctacagccggacataccctgtactcagtcctgagtcaaggctacgagaaattggacactcctcttaggcccgcaaggcaacagccgacaccgaccagcgattcatccagtgacagcaatctgaccacagaggaagacgaagataggccagaggttcacaagcccataagcgggcgctacgaagttttcgaccaggtgacacaggagggagccggacacgatccagcccccgagggccaagccgattatgaccccgttactccttacgtgaccgaagttgagagtgttgtgggggagaatactatgtatgctcaggtctttaacttacagggcaaaactcctgttagccaaaaggaggagagttcggctactatatactgcagcatccgaaagccacaggttgtagtcccccctccccaacagaatgacctcgagatccctgaatcaccaacttacgagaacttcacatag

SEQ ID NO: 193610 - DNA, 1884 bp, Artificial Sequence
  Description of Artificial Sequence: Synthetic coding sequence
atggcccggggcagcgtgagcgacgaggagatgatggagctgcgggaggcttttgccaaagttgatacggacggcaatgggtacatctctttcaatgagctgaacgacctgttcaaggccgcttgtctgccactacccggctaccgcgttagagaaatcacggagaatctcatggctaccggtgaccttgaccaggatgggagaatcagctttgatgagtttatcaaaatctttcacggactgaagagtaccgatgtggcaaagacttttaggaaagccatcaacaagaaggagggcatttgcgctatcgggggcacaagcgagcagtccagtgttggcacacagcactcctatagtgaggaggaaaagtatgccttcgtgaattggattaacaaagctctagaaaacgatcctgattgccgtcacgtcatccccatgaatcccaatacaaacgacctcttcaacgctgtgggcgatggcattgtgctatgtaaaatgatcaacctgtctgtgccggacactattgatgaacgcacaattaacaagaaaaagctgacacccttcactattcaggagaacctgaacctggcgctgaattctgcctcagcaatcggatgccacgtggtgaatattggagcagaggacctgaaggagggcaaaccctatttggtgttaggcctgctctggcaggtgatcaagatcggtttgttcgccgacatagagttgtccaggaacgaagctctcatcgccttattgcgggagggcgaatcactggaggatctgatgaagctgtcacccgaggagttgctcctgcgctgggccaattatcacctcgaaaatgcaggatgcaacaaaattgggaacttctctaccgatatcaaggactccaaagcatattatcacctgcttgagcaggtggctccgaagggtgacgaagagggcgtccccgctgtggttatagatatgtcaggcttgagagaaaaggacgacatccagagggccgagtgcatgttgcagcaggctgagcgcctgggctgccggcagttcgtgactgcaaccgatgtagttcgcggaaatccaaagctaaacctcgcgtttatcgcaaacctctttaatcgctaccctgccctccataaacccgagaaccaggacatcgactggggtgcccttgaaggcgaaacccgggaggagcggaccttcaggaattggatgaattcactgggtgtgaatccccgtgtaaatcacttgtacagcgatctgtctgatgctctcgtgattttccagttatacgagaagattaaagttcccgtagactggaatcgtgtcaataagcctccttatcctaagctgggtggtaacatgaagaagctggagaactgtaactatgcagtggagctcggcaaaaatcaagccaaatttagtctagtgggaattggtggacaggacttaaacgaaggaaaccgcacccttaccttggccttaatttggcagctcatgcgccggtatacattgaacattctggaagagatcggcgggggtcaaaaagtgaatgacgatatcattgtgaactgggtgaacgagaccctgagagaagccaagaaaagttcgagcatctcctcgtttaaagaccccaagatcagcacatccctccccgtgctggacctcattgacgccatccaaccggggtctatcaactatgatctgttaaagacagagaacctgaatgacgacgagaagctgaacaatgcgaagtacgctatcagcatggctcgaaagatcggggctagagtgtacgcgctgcccgaggatctagtggaagtgaatcctaagatggttatgacagtgtttgcttgtcttatgggaaagggtatgaaacgagtgtag

SEQ ID NO: 193611 - DNA, 1884 bp, Artificial Sequence
  Description of Artificial Sequence: Synthetic coding sequence
atggcccggggcagcgtgagcgacgaggagatgatggagctgcgggaggctttcgccaaggttgatactgacgggaatggatatatctcttttaacgagctcaatgatctttttaaggcagcctgcctccctctgcctggataccgggtaagggagatcactgagaacctgatggcaacgggcgacctggatcaggacggacgcataagctttgatgagttcattaaaatattccacggcttgaaaagcacggacgtagccaaaacattccggaaggccatcaataaaaaggaaggcatatgcgctatcggcggcacttcagagcaaagctcggttgggacccagcatagctattccgaggaggagaaatacgccttcgttaactggattaataaagcactagagaatgacccagactgccgacatgtcattccaatgaaccccaataccaatgatttgtttaatgcagtgggagatggtatcgtgctctgcaaaatgattaatctgtccgtgcccgacaccatcgacgagcgcacaatcaataagaaaaagttgactccttttacaattcaggaaaatctaaacctggccttgaacagtgccagcgccatcggctgtcacgtggtgaatatcggcgctgaagacctcaaagaggggaaaccttacttggtgctggggctgctctggcaggtcattaaaatcgggctctttgcggacatcgagctatcacggaacgaggccctaattgccctcctgcgcgagggcgagagcttggaagacctgatgaaattgagtcccgaagagctcttgctcaggtgggccaattatcatctggaaaacgcagggtgcaacaagattggcaatttcagtacagacatcaaggactctaaggcctattatcaccttctggaacaggtggcccctaaaggagacgaggaaggcgtgcctgcagtggtgatcgatatgagcggccttcgagagaaggatgacattcagagagcggaatgcatgctgcaacaggcagagcggctaggatgtaggcagttcgtaaccgccaccgacgtggttagaggcaatccgaagcttaacttggcatttatagccaacctattcaataggtatccggcactacacaaaccagagaaccaagatatcgactggggcgctttggagggggagacgcgtgaggaaagaacattcaggaattggatgaactctcttggggtcaacccgcgagtgaaccatctgtacagtgatttgtccgacgccctggtgatatttcagttgtacgagaagatcaaagtgccagtggactggaatcgcgttaacaaaccaccataccctaagctgggaggaaatatgaaaaagctggagaactgcaactacgcagtggaactgggtaaaaaccaagcaaagttttcactcgtggggatagggggccaggatctgaacgaaggtaaccgaaccctcaccctggccctgatttggcaactgatgcggcggtacactttaaatattcttgaagagatcggaggcggtcaaaaggtgaatgatgacattattgtaaactgggtgaacgaaacattaagggaagcaaaaaagtcctccagcattagtagcttcaaagaccccaagataagtaccagcctccctgtactggacctaatagatgcaattcagcccggtagcatcaattacgatcttctgaagaccgaaaatctaaatgacgacgagaagcttaacaacgctaaatatgctatctcaatggcccggaagattggcgcgcgagtctatgccctccccgaagatctggtggaggtgaaccctaaaatggtgatgaccgtcttcgcctgcttgatggggaaaggcatgaagcgagtctag

SEQ ID NO: 193612 - DNA, 741 bp, Artificial Sequence
  Description of Artificial Sequence: Synthetic coding sequence
atggcccggggcagcgtgagcgacgaggagatgatggagctgcgggaagccttcgccaaggttgatactgacggcaacggctacatttcattcaatgaactgaacgatttatttaaggcagcctgcctgccgcttccagggtacagagtcagggaaatcacagagaacctcatggccaccggcgatctagatcaggacgggcggatcagctttgacgagttcatcaaaatcttccatggactgaagagcaccgatgtggccaaaaccttccgtaaagcaatcaataagaaagagggtatttgcgcaatcggcggaacgagcgagcagtcatcagtaggaacacagcatagctatagcgaagaagaaaaatacgcttttgttaactggattaataaggctctggagaacgacccagactgccgccacgtcatccctatgaaccctaacaccaacgacctcttcaacgctgttggtgatggcatcgttctttgcaaaatgatcaacctttccgtaccagacacaattgacgaacgcacaattaataaaaagaagttgaccccctttactattcaggagaacctaaatttggcccttaacagtgcctcagccatcggttgccacgtcgttaatatcggagccgaagacctgaaagagggcaagccctaccttgtgctgggcctgctatggcaagttatcaagattggcctctttgcagatatagaactgtcccgtaacgagtag

SEQ ID NO: 193613 - DNA, 591 bp, Artificial Sequence
  Description of Artificial Sequence: Synthetic coding sequence
atgtgcgccgaggacggcgacagcaagttcagcatgagcatcagcatgaatagcccttttctggagattctgcatctcgagaactgcaactatgctgtggagctggggaaaaaccaagccaaattcagtctagtcgggattggcgggcaggacttaaacgaaggcaacagaaccctgaccctggcactgatttggcagctgatgaggcgctatactctgaacatcctcgaagagattggtggcggtcagaaggttaacgacgacatcatcgtgaattgggtcaacgaaacgctccgtgaggcgaagaaaagctcctcaatcagctccttcaaggatccaaagatcagtacaagcctcccagtcctcgatctgattgacgccattcagccgggaagtattaactatgatctcctcaagactgagaatctcaacgatgacgagaagctaaacaatgctaaatacgccatcagtatggccaggaaaatcggggcacgcgtgtatgcgttgcccgaagacctagttgaagttaaccccaagatggtgatgactgtctttgcctgcttgatggggaaaggaatgaagagggtctag

SEQ ID NO: 193614 - DNA, 201 bp, Artificial Sequence
  Description of Artificial Sequence: Synthetic coding sequence
atggcccggggcagcgtgagcgacgaggagatgatggagctgcgggaggcattcgccaaggtggatacagacggaaacggctacatctcttttaatgagctgaacgacctctttaaagctgcctgtcttccacttcccggctatagggtgcgagagataaccgagaacctgatggcgacgggtgatctagatcaagactag

SEQ ID NO: 193615 - DNA, 1602 bp, Artificial Sequence
  Description of Artificial Sequence: Synthetic coding sequence
atggccctgcggaacgtgcccttccggagcgaggtgctgggctgggaccccgattccctggccgactacttcaagaagttgaactacaaagattgtgagaaggccgtgaagaaatatcatatcgacggagctcgcttcctgaatttgacagagaacgacatacagaagtttccaaaactgcgggtaccaatcctttcaaaactgagccaagagataaacaagaacgaagaaaggcgctcgatcttcacgcggaagccccaagtgccaaggttccctgaggaaactgagtcacatgaggaagacaatggtgggtggtcgtcattcgaagaggacgactacgagtcccccaatgatgatcaggatggggaggatgatggtgattatgagtccccaaacgaagaggaggaggcccctgttgaggacgatgcagactacgagccacccccatcaaatgacgaggaggcattgcaaaattccattctacctgccaagccatttcctaatagcaactcaatgtacattgaccggcccccatctgggaagactccccagcagcccccagtgcccccgcaacggcctatggcagcacttcccccgccccccgccggtcggaaccattcacccctgccacctccacagaccaaccatgaggaaccaagtagaagtcgcaaccataaaacagccaagctcccagccccttccatcgaccgctccacgaagccgccactggacaggtccttggctccgtttgatagagagcccttcacactcgggaagaaacccccgttcagcgacaagccgtctatccccgccggacggagtctaggagaacaccttcctaagatccagaagccccccctccccccgacgaccgagaggcacgagcgttccagccccctgccgggcaagaagcctccggtgcccaagcatggctggggacccgaccgcagagagaacgacgaggacgatgtgcaccagcggccactgccacagcctgccctgcttcctatgtctagtaacaccttcccttcaaggtcgaccaaaccttcccccatgaatcctttgccatccagccacatgccaggggccttcagcgaatccaattcctccttcccccagtccgcatctttacctccgtacttcagccaaggaccgagtaatcggccccccatccgggctgaagggagaaatttccccctgcctctgcctaacaagccgagaccaccatcacctgccgaggaggaaaatagcctgaatgaggaatggtacgtatcctacatcacaaggccagaggccgaggctgcattgagaaagatcaaccaggacggcaccttccttgtgagagattcgtccaaaaaaacaaccacgaacccatacgtgctgatggtgctgtataaggacaaggtctacaacattcaaattcgataccagaaggagagccaggtctatttgctgggaactggcctcaggggcaaggaagattttttaagcgtctccgacataattgactatttcaggaagatgcccctgttgttgattgatggtaagaatcggggtagcagatatcaatgcacactaacacatgctgccggatatccgtag

SEQ ID NO: 193616 - DNA, 1578 bp, Artificial Sequence
  Description of Artificial Sequence: Synthetic coding sequence
atgtgggaggcccagttcctgggcctgctgttcctgcagcccctgtgggtggctcccgtaaagccattgcagcctggagccgaagtgcctgtagtgtgggctcaggaaggcgctcccgcccagttgccttgctcccccactattcccctgcaagacttaagcctccttcggagggcaggcgttacttggcagcaccagcccgacagtggcccgccggcagctgcccccggtcaccccctggcccctgggccccacccagcagctccttcttcctgggggccccgtccaaggaggtatactgtgttatctgtaggtccgggaggacttagatccggacgcttgcccctccaacctcgtgtccaattagacgagcgcggaagacaaaggggagacttttctctgtggttgcggcctgccaggcgagccgacgctggcgagtatagggctgccgtgcatttacgggatcgtgccctctcctgtcggctgagattgcgactgggacaggcatctatgactgcttctcctccggggagtctgcgggcctctgactgggtcattctcaactgctctttttcacgaccagaccgtcctgcttcggtgcactggtttaggaatcgaggccagggccgtgttcctgtgcgggaatctccccaccatcacctagcagagtctttcctgtttctgccccaggtgtcccccatggatagtggtccatgggggtgcatcctgacatatagggatgggtttaatgtgagtatcatgtataatttgacagtccttggcctggaaccccccacaccactcactgtgtatgctggtgccggctctagggtgggcctgccctgcagactccctgctggcgtgggaacaaggtcgtttctgacggctaaatggacgccccctgggggcgggccagatctcctggtgaccggtgacaacggggactttacgctgaggttagaagatgtgtcacaggcccaggcaggaacatacacctgccacatacacttgcaggagcaacagttaaatgcaacagtgacattggccatcatcaccgtgactcccaaatccttcggctctcctggctccctcggaaagctcctttgcgaagtcactcccgtctcagggcaggaaagattcgtgtggtcctctctggatactccctctcaacgctcattctcgggtccttggctggaggcacaggaggcacagctgttgtctcagccctggcagtgtcagctgtatcagggtgagaggctgctgggggccgcagtctattttactgaattgagctcacccggggcacaaagatcagggcgggcccctggagcgctccccgcgggccatctgcttctattcctgattctgggtgttctctctctgctgcttctggtaactggagcctttggatttcatttgtggcggcgacagtggcgcccccggcgcttctctgccctggagcagggtattcacccccctcaggctcagtcaaaaattgaggagcttgaacaagagcctgagcccgagcctgaaccagagccagagccagagccagaaccagaacccgagcagttatag

SEQ ID NO: 193617 - DNA, 1020 bp, Artificial Sequence
  Description of Artificial Sequence: Synthetic coding sequence
atggccgaggccagcagcgaccccggcgccgaggagcgggaggagcttttagggcctacagcccaatggtccgtggaggacgaagaagaggcggttcatgagcagtgtcagcatgagagagacagacaactccaggcccaagacgaggaaggcggaggccatgttcctgaacgtccaaagcaagagatgcttctgagcctcaagccttcggaagcgccagagcttgatgaggatgaaggctttggggattggtctcagagaccggaacagcgccagcagcatgagggggcccagggagcactggatagcggtgaacccccccagtgtcggagcccggaaggtgaacaggaggaccgtccaggattgcacgcatatgaaaaggaggattcagacgaagttcatctagaagagctctctttatcaaaagaaggccctgggccagaagacactgtccaggataacctgggcgcggctggcgccgaagaagaacaagaagaacaccagaagtgccagcagccacgaacaccctcccctttggtcttggaggggactattgagcagagtagtccacccctttccccaacgacgaaattaatcgacaggacggaaagcctgaaccgcagcatcgagaagtctaacagtgtgaagaaaagccagcccgacttgcctatctccaaaatagaccagtggcttgagcagtacacccaagcgatagaaaccgctggtcgcactcctaaattggccagacaggcctctatcgaattgcctagcatggctgttgcctcgacgaaatctcgatgggaaacaggtgaggttcaggcacagtccgccgccaaaaccccctcctgcaaggacatagtcgccggtgatatgtcaaaaaaaagcctgtgggaacagaagggaggatcgaagacatctagtaccatcaagtcaactccgtcgggcaaacgatataaattcgtcgctactggtcacggaaagtacgagaaagtgcttgtcgaaggcggccctgcaccttag

SEQ ID NO: 193618 - DNA, 834 bp, Artificial Sequence
  Description of Artificial Sequence: Synthetic coding sequence
atgctgctgagcctgaagcccagcgaggcccccgagctggacgaggatgagggattcggcgattggagccagcggcccgagcagcggcaacagcatgagggagctcagggagctctggactctggagagcctccccagtgcaggtctcctgagggggagcaagaggacagaccaggtctgcacgcctatgagaaggaggacagcgatgaggtgcatctggaggagctgagcttaagcaaggaagggccggggcccgaggatacagttcaagataacctcggggccgctggggcagaggaagagcaggaggagcaccagaaatgccagcagcctagaactccctcccccctggtgttggagggtactatcgagcagtcaagtccccccctgagtccaacaacaaagctcatcgaccggaccgagtccctcaaccgctctatcgaaaaaagcaattcagtcaaaaagtctcagcccgacctgcctatatcaaagattgatcagtggcttgaacaatatacccaagccatcgagaccgccggtagaactcctaagctggcaaggcaggctagtatagagctgccctccatggccgttgcctcaacaaaatcccgatgggagacgggtgaggttcaagcacagagtgccgccaagaccccctcctgcaaagatatcgtcgctggcgacatgtccaagaagtccttgtgggaacaaaagggcggatctaagaccagtagtaccatcaagagcacacctagcggaaaacgatataagttcgtggccacgggtcacggaaaatatgagaaagtcttggtagaaggagggcctgctccctag

SEQ ID NO: 193619 - DNA, 834 bp, Artificial Sequence
  Description of Artificial Sequence: Synthetic coding sequence
atgctgctgagcctgaagcccagcgaggcccccgagctggacgaggatgaggggttcggagactggtcccagcggcccgaacagcggcagcaacacgagggcgcccagggcgccctcgattctggggaaccgcctcagtgtagatctccagaaggagagcaagaagataggcctgggctccacgcctacgaaaaagaggacagcgatgaagtgcatttggaggagctgagcctgtctaaggaagggcccggccctgaagatacagtgcaggacaacctgggggccgctggggcggaagaagagcaggaggaacaccaaaagtgtcagcaaccacggacccctagcccgctggttctcgaagggaccattgagcagtcctcgccccccttgtcacctaccactaagctgattgaccggacagaatccctcaaccgctccatcgagaagagtaattcagttaagaaatcacaacctgatctccccatctcgaaaatagatcagtggctcgagcagtatacccaggcaattgagaccgcagggcgcacaccgaaactcgctcggcaggcctcaattgaactcccctccatggcggtcgccagcactaagtctcgttgggagacaggtgaagtgcaggctcaatccgccgctaagacacccagttgcaaggacatcgtggccggggatatgtccaaaaagtccctttgggagcagaaggggggatcaaaaacgtccagcacaatcaagagtaccccatccggcaagcgatataaatttgtcgccactggccacggcaagtacgaaaaagtacttgtagaaggtggtcctgcaccttag

SEQ ID NO: 193620 - DNA, 669 bp, Artificial Sequence
  Description of Artificial Sequence: Synthetic coding sequence
atgctgctgagcctgaagcccagcgaggcccccgagctggacgaggatgaaggatttggggattggtcccagcgaccagaacaacgacaacagcatgaaggggcccagggcgccctagattccggcgagcctccccagtgtaggtctccagagggggagcaggaggataggccaggcctacacgcttacgagaaggaggattccgatgaagtgcacctcgaggaactgagcctgtcaaaagaaggacccggaccagaagacaccgtacaagataatctgggcgccgctggcgccgaggaggaacaggaagaacaccagaagtgtcaacagccacgtaccccctcccccttggtgctcgaagggacaatcgaacaatcctccccccctttatcccctaccaccaaactaattgatcggacggaaagcctcaatcgaagcattgaaaagagcaactcagttaagaagtcccaacctgacctgcctatctccaaaatcgaccagtggcttgaacagtatacacaggccattgaaaccgctggaaggacgccgaaacttgcccggcaagccagtattgaactgcctagcatggccgtggcttccacaaagtctaggtgggagactggtgaggtgcaggctcagagcgcagcaaaaaccccatcctgcaaatag

SEQ ID NO: 193621 - DNA, 183 bp, Artificial Sequence
  Description of Artificial Sequence: Synthetic coding sequence
atgctgctgagcctgaagcccagcgaggcccccgagctggacgaggacgagggatttggcgactggtctcagcgccccgagcaaaggcagcaacacgaaggtgcccagggcgcacttgacagtggggaaccaccgcagtgtaggagccctgagggtgaacaggaggacagaccaggtctgtag

SEQ ID NO: 193622 - DNA, 669 bp, Artificial Sequence
  Description of Artificial Sequence: Synthetic coding sequence
atgctgctgagcctgaagcccagcgaggcccccgagctggacgaggatgaaggtttcggagactggtctcagcggcctgagcagcgccagcagcacgagggtgcccagggggctctggatagtggcgagcctcctcaatgccggtcgccagagggcgagcaagaagacagacctggcctgcatgcgtacgaaaaagaggattctgacgaggtgcatctggaagagcttagtctcagtaaggagggacctggaccagaagatacggttcaggacaaccttggggcagccggcgccgaagaagagcaggaggaacaccaaaaatgccagcagcccaggacgccatctcccctggtgttggagggcaccatcgaacagagtagtccccctctgtcgccgactactaagcttatcgaccggaccgagtcccttaatcgcagcattgagaagtcgaactccgtgaaaaagtcccagcccgatctgccgatctcaaagattgaccagtggctcgaacagtatacccaggcaatcgaaaccgccggcaggacacccaagctggcacgtcaggcctcaatagagctgccttcgatggcggtggctagtaccaagtccaggtgggagacgggagaggtgcaagcacagtcggcagcaaagaccccttcctgcaaatag

SEQ ID NO: 193623 - DNA, 381 bp, Artificial Sequence
  Description of Artificial Sequence: Synthetic coding sequence
atgctgctgagcctgaagcccagcgaggcccccgagctggacgaggatgagggctttggcgattggagccagaggcccgaacagcgtcagcagcatgagggggctcagggtgcccttgattccggcgaacccccccagtgcaggtctccagagggagagcaagaagatcgccctggcctgcacgcatatgagaaagaagatagcgatgaagtccatctcgaggagctgtctctgtccaaggaggggccggggcctgaggatacagtacaggataacctgggggccgcaggcgcagaggaagaacaagaggagcaccagaaatgtcagcagccacgcacaccatcacccctcgtgttggagggtactatcgaacagagctag

SEQ ID NO: 193624 - DNA, 195 bp, Artificial Sequence
  Description of Artificial Sequence: Synthetic coding sequence
atgctgctgagcctgaagcccagcgaggcccccgagctggacgaggacgaaggttttggcgattggtcacagcgacccgagcagaggcaacaacacgaaggggcccagggagcacttgacagcggagaacctccccagtgccggtcaccagaaggggagcaggaagaccgaccaggcctgcatgcttacgagtag

SEQ ID NO: 193625 - DNA, 1404 bp, Artificial Sequence
  Description of Artificial Sequence: Synthetic coding sequence
atggcccccatctggagcccccccggccgggtgagcggctgccacctctcttccggcccggcccccggatctgcggttggcccatggctgggtactccacacccttcactcccactgcctctggcacctcacaagcccccccctcctggtttgccagggtcagccggacaaacttcactacccgcacaacgtgaatgtgtgttccccggcgatgccgccgtccatcaggaactttgtggtctgggatttgaggaatgcctgggttcaattccccaggctcatcaatgctacctcaccaacgggcccaaacgcagaaaatgttcaccaaggcggcggggcagagctcctgcttggttatgtggaggttcccccccctgccatcaaggtctgggccacgagcacccatcttcaggacccagtacgaattgtagccccagaccaactgcccagtggtctgtggaagatgaggaggaggctgttcacgaacaatgtcagcacgagcgggaccgacagttgcaggcacaggatgaggaggggggcggccacgtgcccgagaggcctaagcaagagatgcttctgtctctgaaaccctcagaagcccccgaactcgacgaggacgaaggttttggcgattggtctcagcggcccgaacaacgccagcagcatgagggagcccagggcgccttggactccggagagcccccacagtgtcggagccctgagggcgaacaagaagacagaccagggcttcacgcctacgagaaggaggacagtgatgaggttcatctggaggaactctcgttgtctaaagaaggacccggacccgaggacactgtacaggacaatcttggggctgcaggggccgaagaagaacaggaggagcatcaaaagtgtcaacagccccggaccccttctcccctggtactagaaggcacaatcgagcagagctcccctccgctgtctccaacaacaaagcttatagatcggaccgagagtctcaacaggtctattgaaaaatcaaattccgtcaagaagtcccagccagacctaccaatttccaaaatagaccagtggctcgagcagtatacgcaggctattgaaaccgccggccgtactcccaagctggcccgccaggcaagcatcgagctgccatctatggccgtcgcatcgacaaaaagtcgatgggagacaggtgaggtccaggcccagtctgcagccaaaacccctagttgcaaagacattgtggccggggacatgagcaaaaagtctctgtgggaacagaagggcggatcgaagacaagctcgactattaaaagcacgccttcagggaaaagatataaatttgtggcgacaggccatggtaaatacgagaaggttctggtggagggcggcccagcaccgtag

SEQ ID NO: 193626 - DNA, 618 bp, Artificial Sequence
  Description of Artificial Sequence: Synthetic coding sequence
atgaccccccccgagcggctgttcctgccccgggtgtgcggcaccaccctgcatctgctgctccttggactcctcttggtgctgctgccaggcgcccagggcctgccaggcgtgggcctgacacccagtgctgcccaaacagccaggcaacaccccaagatgcatttggcccatagcaacctcaagcccgcggcccaccttatcggagacccttcaaaacagaattccttgctgtggcgcgctaatactgacagagcctttttacaagacgggttctccctgagtaataactcccttcttgtaccaacatccggcatctattttgtttattctcaagtagtgttttccgggaaagcatattctcctaaggcaacttctagtcctctgtacctggcccacgaagtgcagctgttctcctcgcagtatcccttccacgtcccacttctgagttctcagaaaatggtgtaccccgggctgcaggagccctggctgcactctatgtaccacggtgcagcctttcaactgacacagggcgatcagctcagtacacacacggatggaattcctcatctggtgctgagccccagcaccgtgttcttcggggctttcgccttatag

SEQ ID NO: 193627 - DNA, 618 bp, Artificial Sequence
  Description of Artificial Sequence: Synthetic coding sequence
atgaccccccccgagcggctgttcctgccccgggtgtgcggcaccaccctgcacttgcttctgctggggttgctgctggtgttactgcccggggcccaaggcctgcccggggtcggcttaaccccaagcgctgcccagacagcacgacagcaccccaaaatgcatctggcacactctaatctgaagcctgccgctcacttgatcggggacccctctaagcagaactccctgttgtggagagccaacacagaccgagcttttttgcaggatgggttttcactgtcgaacaactccctgctcgttccgaccagcgggatttactttgtatactctcaagtggtgtttagcgggaaggcttatagtcccaaggccactagtagtccactctaccttgcacacgaggtccagctatttagctcccagtacccttttcacgtcccactgttatcgtcccagaagatggtgtatccagggctgcaggagccctggttgcattccatgtaccacggggctgctttccagctcacacaaggtgatcagctgtctacgcacacagacggaatccctcacctggtgttgtccccatcaaccgtgttttttggagcttttgccttgtag

SEQ ID NO: 193628 - DNA, 618 bp, Artificial Sequence
  Description of Artificial Sequence: Synthetic coding sequence
atgaccccccccgagcggctgttcctgccccgggtgtgcggcaccacactgcacctcctccttctgggcctcctgctggtcctgctccccggtgcccagggattacccggggtgggactgacaccttcagcagcgcagaccgctcgacagcaccctaaaatgcatttagctcactccactttgaaacctgcagcacatctgattggtgaccccagcaagcagaattcccttctgtggcgtgccaacaccgatcgcgcctttctacaggatggcttcagtctttcaaataactcattgctggtccccacctccgggatctacttcgtgtattcccaagttgtgttctcaggcaaggcgtactctcccaaggctacctcttccccattgtaccttgcacacgaggtacagttgttcagctcccagtatcctttccacgtgcctcttctaagctctcagaagatggtctatcccggccttcaagagccgtggctgcactcaatgtatcacggcgcggcttttcagctgacccagggcgatcagttgagtacacatactgacggcatccctcatcttgtcctgtcaccttctaccgtgtttttcggggcattcgctctgtag

SEQ ID NO: 193629 - DNA, 618 bp, Artificial Sequence
  Description of Artificial Sequence: Synthetic coding sequence
atgaccccccccgagcggctgttcctgccccgggtgtgcggcaccacgttacatctgttgttgctgggtttactgctggtgcttctgcccggcgcccaggggctaccaggggtcgggttgacaccttccgcggctcagaccgcaagacagcaccccaagatgcaccttgctcattcaaccctcaagcctgccgcgcatctgattggcgacccatccaagcagaacagtctcctctggagagccaacactgacagagccttcctgcaggacggcttttccctcagtaataactctctgctcgttcccacctctggaatctatttcgtgtacagtcaggtggtgttcagtggcaaggcttattcccccaaggccaccagtagccctctgtatctggcccacgaagtacaactcttttcctctcagtacccattccacgtcccccttctttcttcccagaagatggtctatccgggtctccaggagccctggctgcactccatgtatcatggagcggcatttcagttgactcaaggagatcagctctccacccacacagatggtatcccccatttagtgctgagcccctccacagtttttttcggagcattcgccttgtag

SEQ ID NO: 193630 - DNA, 618 bp, Artificial Sequence
  Description of Artificial Sequence: Synthetic coding sequence
atgaccccccccgagcggctgttcctgccccgggtgtgcggcaccacactccatctcctgttacttgggctcctcctggtgctccttcccggcgcgcagggtctccccggagtgggcctgacaccttctgccgctcagactgccagacagcacccaaagatgcacctcgcccactcaacactgaaaccagcagcccaccttattggtgacccctctaagcaaaactctttgctgtggcgagccaacactgatcgggcattcttgcaggatgggttcagtctgagcaataatagcctgctggtccccactagcggaatctactttgtctacagtcaggtcgttttctcagggaaggcctacagccccaaagccacttcctctccgctgtacctagcccacgaggtgcagttgttcagcagccagtatcctttccatgttcctctgctgtcttcccagaaaatggtgtatcccggcttgcaggagccctggctacatagcatgtatcatggggccgcattccagctgacacagggtgatcagctgtccacccatacagacggcatccctcaccttgtattaagccctagcacggtgttttttggggcctttgccctgtag

SEQ ID NO: 193631 - DNA, 618 bp, Artificial Sequence
  Description of Artificial Sequence: Synthetic coding sequence
atgaccccccccgagcggctgttcctgccccgggtgcggggcaccacactgcacctgctcttgctaggtctactcctcgtcttgttgccaggtgcgcagggtttgccaggcgtcgggttgacgccttcagctgctcagactgctagacaacatcccaagatgcatctcgcacactccactcttaaaccggccgctcacctcatcggggatccttccaagcagaacagtctgctctggcgagctaatacagaccgagcttttctgcaggatggtttttctctgtcgaataattcactccttgtgccaacatctgggatttatttcgtctactcccaggtggtattctcagggaaagcttacagcccgaaggcgactagctctcccttgtatttggcccacgaggtgcagcttttttccagtcaatatccattccatgtgccactgctttccagtcagaagatggtttaccctggattgcaagaaccttggctacactcaatgtaccacggggccgcctttcagctcacacagggtgaccagctgtcaacacatactgatggcatcccacatctcgtgctgagtccctccacagtgttctttggagccttcgccttgtag

SEQ ID NO: 193632 - DNA, 618 bp, Artificial Sequence
  Description of Artificial Sequence: Synthetic coding sequence
atgaccccccccgagcggctgttcctgccccgggtgtgcggcaccactctccatctactcctactaggtcttctgcttgtgttgctgcccggagcacaagggctgccaggggtcgggttgacccccagtgccgctcaaaccgcacggcagcaccccaagatgcatttagctcactccacgctcaagcccgctgctcatctaataggagacccatccaaacagaattccctactttggagagctaacacagatagggcttttcttcaggacgggttctctctgtctaacaacagcctgcttgttccgacctcaggaatctacttcgtgtattcacaggtggtcttttctggaaaggcttattcccccaaggctacctcctcgccactttatctcgctcatgaggtccagctcttctcctcccaatatccattccacgtcccactattgtcttcccagaaaatggtgtatcctggtctgcaggagccctggctccatagcatgtaccatggagctgcctttcagcttacccaaggggaccagctgtccacccacacagatggcattccacacctcgtgctgtctcctagcacagtgttcttcggcgcattcgccctgtag

SEQ ID NO: 193633 - DNA, 417 bp, Artificial Sequence
  Description of Artificial Sequence: Synthetic coding sequence
atgaccccccccgagcggctgttcctgccccgggtgtgcggcaccacactacacctgctccttctgggtcttttgctggtgctgctgcccggagcccagggcctcccaggtgtcgggctgaccccctccgcggcacagactgcaaggcagcacccaaaaatgcatttagcccatagtactttgaaaccggccgctcacttgattggtgacccctcaaaacagaacagcctgttgtggagggccaataccgaccgtgctttcttacaggatggtttctccctgagtaacaactccctgcttgtcccaacatcaggaatttacttcgtctattcccagggctcaagccctccgctgctgtggcccttccagcaactcaagtcatcactgatcaagtcaccagagctcagcaaaaaatag

SEQ ID NO: 193634 - DNA, 618 bp, Artificial Sequence
  Description of Artificial Sequence: Synthetic coding sequence
atgaccccccccgagcggctgttcctgccccgggtgcggggcaccactttgcatttgctcctgctgggactgctgctggtactgctgccaggcgctcagggactgcctggcgtcgggctgacaccgagcgcagcacaaacagcaaggcagcaccctaagatgcacctggctcactctactctgaaacccgctgctcaccttatcggcgatcccagcaaacagaacagcctgttatggcgggctaacacagacagagcattcctgcaggacggattttctctgtcaaacaatagtctgctcgtccctactagcggaatctatttcgtgtatagccaggtcgtgttctcgggtaaggcttactcgcccaaagccacttctagccctctttacctggcccacgaggtgcagcttttctcctcccagtatcccttccacgttccactactctcaagccagaagatggtgtatcctggtctgcaggaaccgtggcttcactcaatgtaccacggagcggcgttccagctcacccagggcgatcagctaagcacacatactgatggcattcctcacttggtgttatcaccctcgactgtctttttcggcgcatttgccttatag

SEQ ID NO: 193635 - DNA, 618 bp, Artificial Sequence
  Description of Artificial Sequence: Synthetic coding sequence
atgaccccccccgagcggctgttcctgccccgggtgcggggcaccacactgcacctgctgcttctggggctactgctggtgctcttgcccggggcgcaagggcttccaggagtggggcttactccttccgccgcccagacagccagacagcatcctaagatgcaccttgcccactcaaccctgaagcccgctgctcatctgatcggagatccctcaaaacagaattcgctgctgtggcgcgcaaacaccgacagggccttcctgcaggatggattctcattaagcaacaacagccttctcgtgcccacgtctggcatctatttcgtttactctcaagtggtctttagcggaaaagcctatagccctaaggcgacatcctcgcccctgtacctagctcatgaagtgcaattattctccagtcaatatcctttccacgttcctctcctttcctctcagaaaatggtttatccagggttacaggagccttggctgcattccatgtatcacggcgctgcctttcagttaacacagggcgatcaattatctacccataccgacgggattccacatctagtccttagccccagtaccgtgttctttggggccttcgcactttag

SEQ ID NO: 193636 - DNA, 618 bp, Artificial Sequence
  Description of Artificial Sequence: Synthetic coding sequence
atgaccccccccgagcggctgttcctgccccgggtgtgcggcaccacattacatctgctgttgctcggattgttattagttcttctccctggggcccaaggactgcccggggtgggcctgacaccaagcgcggcacagactgcccgtcaacaccctaagatgcatctcgctcactctaccctgaaacccgcagcacacctgatcggggatccctccaaacagaattccctactatggagagcaaacacagacagagcatttttacaggacggattctctctgtctaacaattcccttctggtcccaacttcagggatctatttcgtctactctcaggtcgttttctccggtaaggcttacagccctaaagcgacaagcagcccgctgtacctagcccatgaggtgcaactcttcagcagtcaatacccgtttcacgtgcccctgctcagctctcagaaaatggtctacccaggtctgcaggaaccatggctgcacagtatgtatcacggggccgcttttcaacttacacagggtgatcagctgtcaacacacacagacgggatcccccacttagttttgtcacctagtaccgtgttcttcggcgcttttgccctctag

SEQ ID NO: 193637 - DNA, 618 bp, Artificial Sequence
  Description of Artificial Sequence: Synthetic coding sequence
atgaccccccccgagcggctgttcctgccccgggtgtgcggcaccactctgcacctgctgttactaggcctcttactggtactgcttccaggagctcaaggccttcccggagtgggtctcacaccaagcgccgcacagacagcaaggcagcaccccaagatgcatttggctcactcaactctcaaacccgcagcccacctgatcggggacccgtcgaaacagaacagcctgctgtggcgcgccaacactgacagggcgtttctgcaggatgggttctccctgagcaacaactccctcctcgtgccaactagcggcatctatttcgtgtatagccaagtggtcttttcagggaaggcttattctcctaaagccacctctagccccctgtacctggcacacgaagtgcagctattcagttcacaatatccttttcacgtgccactattgagcagccagaaaatggtctatccagggctgcaagagccatggcttcacagcatgtaccatggagccgcttttcagttgacacagggagatcagctatctacacataccgatgggatcccgcatttagtgctcagcccttctacagtctttttcggggctttcgccctttag

SEQ ID NO: 193638 - DNA, 618 bp, Artificial Sequence
  Description of Artificial Sequence: Synthetic coding sequence
atgaccccccccgagcggctgttcctgccccgggtgcggggcaccactctccacttgttgcttctaggcctgttactggttctgctgcccggcgcacaaggccttcccggcgttggacttaccccctctgcagcccaaaccgcacggcagcaccctaaaatgcacctagctcatagtaccctgaagcccgccgcacatttgatcggcgacccatccaaacagaattcactgttatggcgagccaacaccgatagagcttttcttcaggatgggttctcactgtccaataattccctgctggtgcctacctcaggaatctactttgtttattcgcaggtcgtgttcagtggaaaggcttatagccctaaggccacatccagtccactgtacttagcacacgaggtgcagctgtttagctcacagtacccatttcatgttcctttactgagctctcagaagatggtttatccaggcctgcaagaaccatggctgcattcgatgtatcatggtgcagcatttcagctgacgcaaggcgatcaactgtccactcatactgatggcattccccatttagttctgtccccctcaactgtctttttcggcgcctttgctctgtag

SEQ ID NO: 193639 - DNA, 417 bp, Artificial Sequence
  Description of Artificial Sequence: Synthetic coding sequence
atgaccccccccgagcggctgttcctgccccgggtgcggggcaccacccttcacctgttgttacttggcctgctgttggtcctcctgccaggcgctcaagggttgcctggtgtcgggctcaccccatccgccgcccaaactgcccgccaacaccccaagatgcacctggcccattccacgctcaaacctgcagctcacttgattggcgatcccagcaaacagaattctctgctttggcgcgcaaacaccgatcgggcctttttacaagatggttttagcctatctaacaatagcctgctggtgccaacgagcggcatctacttcgtatattctcagggatcatctccccccctgttatggcctttccagcagttgaagtcttccttgatcaaaagcccagaactctccaaaaagtag

SEQ ID NO: 193640 - DNA, 474 bp, Artificial Sequence
  Description of Artificial Sequence: Synthetic coding sequence
atgaccccccccgagcggctgttcctgccccgggtgtgcggcaccacactccacttgctcctcttgggactgctgcttgtgctgcttccaggagcccagggacttcccggcgtagggctcactccaagcgcggctcagacagcacgccagcacccaaagatgcacctggcacattctaatttgaagcccgctgcacaccttattggcgacccctccaagcagaactcactgctttggcgcgctaataccgacagagctttcctccaggacggctttagtttatctaacaattccctgctggttccgaccagtggcatctattttgtgtactcccagctacctgaagacggagtctcacgggctgccgggactttggcagccctcgatgttccaagaggatgcgtccccgcccatcccggccgtcctgccatccatccgcaccggtggcacccacctccttctcctcagccatag

SEQ ID NO: 193641 - DNA, 417 bp, Artificial Sequence
  Description of Artificial Sequence: Synthetic coding sequence
atgaccccccccgagcggctgttcctgccccgggtgtgcggcaccacactgcacctccttttgctggggctccttcttgttctgttgcctggggcccaagggctgccaggcgtgggcctcacaccatcggccgcccagacagctagacagcatccaaaaatgcacctggcccactcaacattaaaaccagccgcccacctcattggggatccaagcaaacagaattctcttctgtggcgcgccaacactgatcgcgcctttctccaagatggattttcgttgagcaacaattcgctgctcgtacctactagtggaatttattttgtgtatagtcaggggagttctcccccgctgttgtggcctttccagcaacttaagagctccttgataaaatcaccagagctatctaaaaagtag

SEQ ID NO: 193642 - DNA, 417 bp, Artificial Sequence
  Description of Artificial Sequence: Synthetic coding sequence
atgaccccccccgagcggctgttcctgccccgggtgtgcggcaccaccttgcatctgctgctattgggcttgctgcttgtgctgttaccaggcgctcagggactgcctggcgtgggactcaccccgagtgcggctcagaccgccaggcagcacccgaagatgcatctggcccattccacactgaaaccagccgcacacctgatcggtgatcccagcaagcagaactctctgttatggcgcgccaataccgacagagcctttctgcaggacggattcagcctcagtaacaacagtttgcttgttccgacttcaggtatctactttgtgtattcacagggaagcagtcctccccttctatggccatttcagcagttaaagagttcactgatcaaatcccccgagctgtccaaaaaatag

SEQ ID NO: 193643 - DNA, 417 bp, Artificial Sequence
  Description of Artificial Sequence: Synthetic coding sequence
atgaccccccccgagcggctgttcctgccccgggtgcggggcaccacactgcacctgcttctcctggggctactgctggttttactgccgggggctcagggactccccggggtggggctgacacctagcgcagctcagactgcacgtcaacaccccaaaatgcacctcgcccactccacactgaaacctgccgctcatctcatcggcgacccctctaagcagaactcccttctgtggcgtgccaacaccgatcgcgccttccttcaggacggcttctcactgtccaataacagcctccttgtccccacttcggggatctacttcgtatactctcagggaagctcccccccacttctctggccattccagcaactgaagtcttcgctgataaaaagccctgaattgtctaagaagtag

SEQ ID NO: 193644 - DNA, 735 bp, Artificial Sequence
  Description of Artificial Sequence: Synthetic coding sequence
atgggcgccctgggcctggagggccggggcggccggctgcagggccgcggctcccttctactggccgtggctggagccacatcactggtgactctcctactagctgtcccaataactgttctggctgtgctcgccttagtccctcaggatcaggggggcctagttactgaaactgccgacccaggcgcccaagcccagcagggccttggcttccaaaagctgcctgaagaagaaccagagactgacctgagccctgggctgccagcagctcatctgataggtgccccgctcaagggtcagggactgggctgggagaccaccaaagaacaagctttcctgactagcggcacacagttttctgacgctgaagggctagcactgccgcaggacggcttgtattatctgtattgcttagttggctaccgcggaagggcaccgccgggtgggggagacccacagggacggtccgtgacattgcgcagcagtctctatagagccggcggggcctatggacctgggactcccgaacttcttttagagggggctgaaaccgtgacacctgtgcttgaccctgcaagacggcagggctatgggccactatggtacacatctgtggggtttggtggcctggtccagctccgacggggggagcgggtctacgtgaacatatcccaccctgacatggtggatttcgctcgtggtaagacgtttttcggggccgtgatggtgggttag

SEQ ID NO: 193645 - DNA, 735 bp, Artificial Sequence
  Description of Artificial Sequence: Synthetic coding sequence
atgggcgccctgggcctggagggccggggcggccggctgcagggcaggggcagcctgctgctggccgtcgccggagcaacctccctggtaacgctcttgctggccgtacccatcactgtgctggcggtgttagcgctggtgccacaggaccagggtgggctcgtgaccgagacagcggatcctggcgctcaggctcagcagggcctgggcttccagaaacttccagaggaggaacctgagacagacctgagccccggtctgcccgctgcacatctgataggcgccccactgaaagggcagggactgggttgggagaccacaaaagagcaggctttcctcacctccgggacacagttctccgacgcagaggggttagctcttcctcaagacggcctgtactatttatactgcctcgtcggctaccgcggcagggccccacccggtgggggcgatccgcaagggcgtagcgtgaccttaagatcaagtttgtatcgggccggcggcgcctacggacctgggacacccgagttgctactcgaaggcgccgagacagtcaccccagtgctggaccccgcccggagacaaggttacggcccattgtggtacacatctgtcggctttggtgggttagtccagctcagaaggggtgaacgggtttatgtcaacatctctcaccctgatatggtggattttgctcgcggtaagacattctttggagcggttatggtggggtag

SEQ ID NO: 193646 - DNA, 735 bp, Artificial Sequence
  Description of Artificial Sequence: Synthetic coding sequence
atgggcgccctgggcctggagggccggggcggccggctgcagggccgtggctctttactgctggcagtagctggcgcaacttccctcgtgacactcttgctggctgttccaatcaccgtgttagctgtgttggctctcgtccctcaggaccagggcggcctggtgacagaaaccgccgatcctggcgcacaggcacagcagggtcttggcttccagaagttgcctgaagaagagcccgaaactgatttgtcacctggcctccctgccgctcacctcatcggggctcccttgaaagggcaagggctgggctgggaaactactaaagagcaagcctttctcacctcaggtacacaattctcagacgctgagggcctggcccttccccaggatggtctttattacctgtactgcctagtgggttacagggggagagcccctccaggcggtggcgatccgcaaggcaggagcgttacccttcgctcttctctatacagggctggcggggcctatggaccaggcacgcccgagctgctccttgaaggagccgaaacagtgactcccgtgcttgatccagctcggaggcagggatatggccctctatggtacacctctgttggctttgggggtctagttcagctaaggcggggcgagagggtttacgtgaacatttcccatcctgatatggtagactttgccaggggaaagactttctttggagccgttatggtggggtag

SEQ ID NO: 193647 - DNA, 735 bp, Artificial Sequence
  Description of Artificial Sequence: Synthetic coding sequence
atgggcgccctgggcctggagggccggggcggccggctgcagggcagaggtagcctgttgctcgccgtagccggcgccacttcgctcgtgactttactcctagccgtcccaattactgtgctggctgtgctggcactggtccctcaggaccagggtgggcttgtgactgaaactgcagacccaggtgcccaagcacagcagggactgggatttcaaaaactgcctgaggaagagccggagaccgacctctcacccggcttaccagctgctcaccttatcggggccccactgaagggccaggggctgggttgggaaacaaccaaagaacaagcattcctgacaagcgggacacaatttagtgacgccgaaggcctggcgctgccgcaggatggcctgtactatttatattgtctggtgggttaccgcggccgtgcaccacccggaggcggggatcctcaaggacggagtgtaacattgagatcgtctctctacagggccgggggcgcttacgggcctggaacccctgagcttcttctcgagggagctgaaaccgtgacacctgtgctcgatcccgcacggcggcagggatatggcccgctgtggtacacaagcgtgggattcggcggtttagtgcagctgcgccgtggcgagagggtgtatgtgaacatctcccatcctgacatggttgatttcgcccgcggcaagaccttcttcggcgccgtgatggtggggtag

SEQ ID NO: 193648 - DNA, 735 bp, Artificial Sequence
  Description of Artificial Sequence: Synthetic coding sequence
atgggcgccctgggcctggagggccggggcggccggctgcagggcagaggatccctcttgctcgcagttgccggggccacaagtctggtcaccttgctgctggcagtcccgattaccgtactcgccgtgctagcactggttccacaggaccagggaggcctagtgactgagactgccgatcccggagcacaggctcagcagggtttgggcttccaaaagctgccggaggaagagccagaaactgatctctctcctggtctcccagcagctcacttgatcggagctcctctcaaaggacaagggctgggctgggaaacaacaaaagagcaggcatttttgactagcggcacgcagttctctgacgcagagggactcgcccttcctcaagatgggctgtattacctctactgcctcgtcggataccgtggacgggccccgcccggtggaggtgatcctcagggaagaagcgtcacactaagaagcagcctctacagggctggaggcgcctacgggcctggaactcccgaactcctcctggagggagccgaaaccgtgacacctgtgctggatcccgctcggagacaaggttatgggccactgtggtacacgagtgttgggttcggcgggttggtgcagcttagacgaggggaaagagtgtacgtaaacattagccaccctgatatggtcgattttgcacgtggaaaaacattcttcggagcggttatggtgggctag

SEQ ID NO: 193649 - DNA, 735 bp, Artificial Sequence
  Description of Artificial Sequence: Synthetic coding sequence
atgggcgccctgggcctggagggccggggcggccggctgcagggcagaggttcattattgttagccgtggccggagccacgagtctggttactcttctgctggccgtccctatcaccgtgttagccgtgcttgccctggtgcctcaagatcagggtgggttggtcaccgagacagcggacccaggcgcccaggcacagcaggggttgggttttcagaaactccctgaagaggagcctgaaaccgatctgtccccagggcttccagccgcccatctcataggagcccccctgaaaggccaaggcttagggtgggaaaccacaaaggagcaggctttccttacgtcaggaactcagttttctgatgctgaggggctggccttaccccaggatgggttgtactatctatattgtcttgtaggctaccggggcagggctcctccaggtggtggggatcctcaaggccgcagtgtaacactgcgaagtagtctataccgggccggcggagcctatgggcctggcacacccgagctgttgctggaaggcgctgagacggtcacacccgtgttggaccccgccagaaggcaggggtatggaccactatggtacacatccgtggggtttggaggactggtgcagctgcggaggggtgaacgggtatacgtgaacatcagccaccccgacatggtggacttcgctaggggcaagaccttcttcggtgccgttatggtgggatag

SEQ ID NO: 193650 - DNA, 234 bp, Artificial Sequence
  Description of Artificial Sequence: Synthetic coding sequence
atgggcgccctgggcctggagggccggggcggccggctgcagggccgagggagtctgctgttagccgtcgcaggtgcaactagtctcgtaactttgctgctggctgtcccaatcactgtactggcagtgttggcccttgtcccacaggatcagggagggttaggctttagaagctgtcagcgtcgctcccaaaagcagatcagcgcccctggctctcaactgcccacctcttag

SEQ ID NO: 193651 - DNA, 735 bp, Artificial Sequence
  Description of Artificial Sequence: Synthetic coding sequence
atgggcgccctgggcctggagggccggggcggccggctgcagggccgaggttcactcctgctagccgtcgccggtgccaccagcctggtgaccctcttgctcgccgtgccaataaccgtgttagccgtgcttgcgctggtaccacaggatcaggggggactcgttaccgagacagctgaccccggcgcccaggcgcagcaggggcttggttttcagaagctgccagaggaagagcctgaaaccgacctgtccccaggcctcccagctgcccacctgattggggcacctctcaaagggcagggcctgggatgggagactacgaaagagcaggcattcctcacttccggaacccagtttagcgacgcggaagggttagctcttccgcaggacggattatattacctgtactgcctcgtcggctacagaggacgggctcctccgggaggcggcgatcctcagggtaggagtgttaccctgcgctcctccctatacagagcagggggagcatatggaccagggactcctgaactgctgcttgaaggcgccgaaacagtgacacctgtgttggatcctgcacgacggcaaggatacgggcctctctggtacacgtccgtgggattcggcggactggtacagcttagaaggggggaaagggtgtatgtaaatatctcccacccagatatggtcgatttcgccaggggcaagacgttctttggcgctgtcatggtggggtag

SEQ ID NO: 193652 - DNA, 735 bp, Artificial Sequence
  Description of Artificial Sequence: Synthetic coding sequence
atgggcgccctgggcctggagggccggggcggccggctgcagggcagggggtctctactgctagccgtggctggagcgacatccctcgtgacactcctcctggctgtgccaattacagtactggctgtgttggccctggttccccaggaccagggcgggctggtgacagagaccgcagaccccggcgcacaagcccagcagggactcggattccaaaaactccctgaggaggagcccgagacggacctttctccagggttaccggctgcccatctgataggtgcccccctcaaaggccaggggttgggctgggaaacaactaaagaacaggcattcctaacttccgggacacagttcagcgacgcggaaggcctagccctcccccaagacggactttactatctgtactgcctggttggctaccgcggccgggctcctccgggtggcggggacccccaaggccgaagcgtgacccttcgcagtagtctctacagagctggaggagcgtacggacccgggactccggagctgttgctggagggcgccgaaacggtcacgcccgtactggatcccgcccgccgccagggctatgggcccctgtggtacacctctgtgggtttcggcggtctcgttcagttacgcaggggcgaacgagtctacgtcaacatctctcatccggacatggtggactttgctaggggaaagactttctttggcgccgtcatggtaggctag

SEQ ID NO: 193653 - DNA, 276 bp, Artificial Sequence
  Description of Artificial Sequence: Synthetic coding sequence
atggccgccagcagccgggcccaggtgctgagcctgtaccgggccatgctgcgggaatctaaacggttttcggcctataattatcgaacatacgcagtcaggcgcattcgcgacgctttcagagaaaacaaaaatgtcaaggatcccgtggagatacaaactttggtgaataaggcgaaaagggacctcggcgtgattaggagacaggtccatatcggtcagctgtatagtactgacaagctgattatcgagaatcgcgacatgccaagaacgtag

SEQ ID NO: 193654 - DNA, 393 bp, Artificial Sequence
  Description of Artificial Sequence: Synthetic coding sequence
atggccgccagcagccgggcccaggtgctgagcctgtaccgggccatgcttagggaatcaaagaggttctccgcttacaattaccggacatatgccgtgagacgcatacgggatgcattcagggagaataaaaacgtaaaggacccggtggaaatccagaccttggtaaataaagccaagcgagacctaggtgtgattcggagacagatggactctcactccgtggcccaagctggcgtgcactggaatgatctctcctctctccagcctctgcccccctggtttaagcagttttcatgcctttccctgccaagcagttgggattaccgacgcactcctcctcggttggccaatttctgcattttgtcccgagatgttatttccctgtactag

SEQ ID NO: 193655 - DNA, 291 bp, Artificial Sequence
  Description of Artificial Sequence: Synthetic coding sequence
atggccgccagcagccgggcccaggtgctgagcctgtaccgggccatgctccgggaatctaagagattctcagcctacaactacagaacatatgcagtcagaaggatcagggatgcttttcgagagaataaaaacgtcaaagatcccgtggaaattcaaaccctggtgaacaaagccaagcgcgaccttggagtgattcggcgacaggttgcagaacagggcactgcagctcgaagaaagagcggcaattcctcgcgatcgcttggcaaaccatgcacgagttggccttag

SEQ ID NO: 193656 - DNA, 2559 bp, Artificial Sequence
  Description of Artificial Sequence: Synthetic coding sequence
atgctgagcggcaagaaggccgccgccgccgccgccgccgccgccgctgcggctactgggacggaggcaggtcctgggaccgccgggggctcggagaacggctcagaagtggccgctcagcctgcggggttgagtgggcccgctgaggtgggacccggcgcagttggtgaaaggacccccaggaaaaaagagcctccccgcgcttcaccccccgggggcctcgccgagccccccggctctgccggtccacaagcaggccctactgtggtccccgggtcagcaacgcccatggaaaccggaatcgccgaaacacccgaaggccgcaggacttcaaggcggaaacgtgccaaagtcgagtaccgggaaatggacgagtctttggccaacttgagcgaggatgagtactacagcgaagaagagcgaaacgcaaaagctgagaaggagaagaagctgcctccccctcctcctcaggcaccgccagaggaggaaaacgaatctgagccggaagaaccatctggtgtcgagggcgcagcctttcagtcccgtctccctcatgataggatgacttctcaagaggcagcctgcttcccagacatcatttcaggaccacagcagacccagaaggttttcttgtttattaggaatcgtaccctgcaattgtggcttgacaacccaaaaatccagctcacatttgaagctaccctccagcagctcgaggccccatataattccgacactgttctagttcacagagtccatagctatctggagcggcatggtttgattaatttcggaatctacaaacgaatcaaacctctgcccaccaagaagacaggcaaagtaattattataggctcaggagtttcaggactggcagctgcacggcagctccagagcttcgggatggacgtgacccttttggaagcgcgcgaccgggtcggcggcagagtggcaacattcagaaaaggtaattatgtcgctgaccttggcgcgatggttgttacaggactcggcggaaatcctatggccgtggtctccaagcaagtgaacatggagctggcgaagattaagcaaaagtgcccattatatgaagcgaacggccaagccgtaccaaaagaaaaggacgagatggtggagcaagagtttaatcgcctcctggaagctacctcctacctgtctcaccaactcgatttcaacgttctcaataataaaccggtttcgctggggcaagccctggaggttgtgattcagctgcaggagaaacatgtcaaagatgagcagattgagcattggaaaaaaatagtgaagacgcaggaggaattaaaggagctcttgaacaaaatggtgaatttgaaagagaaaataaaagagctccatcagcagtacaaggaagcttccgaagttaaaccaccccgagacatcacagcagagttcctggtaaagagcaaacacagagacctaactgccttatgcaaggaatacgacgagttagccgaaacccagggtaaactcgaagaaaaactccaagagctggaagctaaccccccatcagacgtgtacctcagtagcagggaccgacagatactcgactggcactttgcgaatctggaattcgcaaatgccacccccctttccaccctgagcctcaagcattgggatcaggacgatgactttgagttcaccgggagtcacctcactgtgaggaacggctactcttgcgtaccagtggctctggcggaagggctggacattaagctcaacaccgcagtgcgccaggttagatatacagcttccggttgcgaggtgatcgctgtcaacacacgatcaacttctcaaacgtttatctataaatgtgacgctgtcctttgcacgctcccgctaggtgtcctgaagcagcagccaccggcagttcagttcgtccctcccctgcccgaatggaaaacaagcgccgtgcagaggatgggctttggtaatcttaataaggtggttttgtgctttgaccgtgtcttctgggacccctccgttaacttgttcggccacgttggctcaacaacagcatcgagaggggagttgtttctgttctggaacctgtataaagcccctatcttgctggccctcgttgccggagaagctgcggggatcatggagaatatctcggatgatgtaattgtcggtcggtgcctggcaatcctgaaggggatttttggaagtagcgcggtcccacagccaaaagagacagtcgtctcaaggtggcgcgctgatccctgggctagaggttcttactcttatgtggcggcgggttcctctgggaatgactacgatcttatggcccagccgatcacaccaggccccagtatccccggtgcaccccagcccattcctagactgtttttcgcgggtgaacacaccatcaggaattaccccgcgaccgttcacggtgctctgcttagcgggttgagggaagctggaagaattgccgatcaatttctcggggctatgtatacactaccacgccaggctacccctggggtccccgctcagcaaagccctagcatgtag

SEQ ID NO: 193657 - DNA, 2631 bp, Artificial Sequence
  Description of Artificial Sequence: Synthetic coding sequence
atgctgagcggcaagaaggccgccgccgccgccgccgccgccgccgccgccgcgactggcaccgaagccggcccagggactgcaggaggctctgagaacgggagcgaagtggcggctcagcccgccggcctctccgggccggcagaggtgggaccaggcgctgtcggtgagcgtacccccagaaaaaaggagccccctagagcatcaccacctggtggtctcgcggaacccccggggtctgcggggcctcaggctggccccacagtggttcctggaagcgccaccccgatggagactggtattgccgagacgcctgaaggtcgacgtacctctagaaggaaaagagctaaggtcgaatatagggagatggatgaatctttagcaaatctgtctgaggacgagtactattctgaagaggagcgcaacgccaaagcggaaaaggagaagaagcttcctccgcccccgccccaggcacctcccgaagaggagaatgagagcgagccagaggaaccttcaggtcaggcaggagggctccaagacgattcttctggggggtatggcgatggacaggctagcggcgtggagggtgcagcattccaaagtcgccttccccatgatcgtatgacatctcaggaggctgcctgtttcccagatatcatatccggaccacagcagacccagaaagttttcttattcatccgcaaccgcacactccagctgtggctggacaatcccaagatccagctgactttcgaagcgacactgcagcagctggaagccccttacaacagcgacaccgtcctggtgcatcgcgttcactcttatctggagagacacggcctgattaacttcgggatatacaaacgaataaagcctctcccaaccaaaaaaacaggcaaggtcattatcatcggcagtggcgtctccggactggctgcagccagacaactgcagtcattcggtatggatgttactctgttggaagctagagatcgcgtgggcgggcgggtggcaaccttccggaaggggaactacgtggcagacctaggcgcaatggtcgttactggactcgggggcaaccccatggccgtcgtgtctaaacaggtgaacatggagctagccaagattaaacaaaagtgcccactgtatgaggctaatggccaggccgagcggattatcgtccccaaagaaaaggatgagatggtggagcaggagtttaaccggcttttagaagctactagctacctgagccaccagctcgactttaatgtgctgaataacaaacccgtgagtttgggccaggcgttggaagtagtaatccaactacaagaaaaacacgtaaaagatgaacagattgaacattggaagaaaattgtgaagactcaagaggagctcaaggaactgttgaataagatggtcaaccttaaggagaaaattaaggagttgcaccagcaatacaaggaggccagtgaggttaaaccacctcgagatattactgctgagttccttgttaagagcaaacatagggacctgactgcattgtgcaaggagtacgatgagcttgctgaaacccaggggaaattagaagagaaacttcaagaacttgaggccaaccccccaagcgacgtctatctctcctctagggatcgccagatactggattggcatttcgcaaacctggagttcgcaaatgccaccccactcagtaccctcagcttgaaacattgggaccaggacgacgatttcgagttcactggatctcatctcactgttcggaacggctattcctgcgttcctgtcgctttagctgagggtctggacatcaagttgaacactgccgtccggcaggtgcggtatactgctagtggctgcgaggtcatcgctgtgaacacccggtctacttctcagacttttatctacaagtgcgacgccgtgctgtgcaccctgcccctgggcgtgcttaagcaacagccgcctgcagttcagtttgtcccacctcttccggagtggaagacaagtgcggtgcagcgtatggggttcggcaatctcaacaaagtggtgctctgctttgatcgcgtgttctgggatccgagcgtgaatctctttggtcacgtgggctcaacaaccgcctcacgcggcgagttgttcctgttctggaacctctacaaggcaccgatactgctggctttggtggccggagaggccgctggaatcatggaaaacattagcgacgatgtgatagttggccgctgtctcgctattctgaaggggatatttggttcaagtgcggtgccccaaccaaaagagacagttgtctccagatggcgagccgacccttgggctagaggcagctattcctacgtagccgcaggctccagcgggaacgactacgacttgatggcacagcccattacacctggcccatctattcccggcgctccccagcccattccccgcttgtttttcgccggcgagcacactatcagaaactaccccgctaccgtccacggcgcactgctctctggcctccgggaggcagggaggatcgccgatcaattcttaggtgcaatgtatacgctgccacgccaggcaactccaggggtgcccgcacagcagtccccatcaatgtag

SEQ ID NO: 193658 - DNA, 2631 bp, Artificial Sequence
  Description of Artificial Sequence: Synthetic coding sequence
atgctgagcggcaagaaggccgccgccgccgccgccgccgccgccgctgccgcaacggggaccgaggctggaccagggactgccggaggatccgagaacgggtctgaagttgctgcgcagcctgcagggctttccggtcctgctgaggtaggaccgggcgccgtgggggaacggacccctaggaaaaaggagccacccagagcctccccccccggggggctggccgagcccccaggttccgctggtcctcaggccgggcccactgttgtgcctggcagcgctacacctatggagacaggcatcgctgagactccagaaggtcggcggacatctcgccggaaacgggctaaggtggaatatcgagagatggacgagagcctcgctaatctgagtgaggatgagtactattctgaggaggagcgcaatgctaaagccgagaaggaaaagaagctcccacctccccccccccaagcgccacctgaagaggagaatgaaagcgaacccgaagaaccctcaggccaagccggaggcctgcaggacgactcttctgggggctacggggatggacaggcctccggggtggagggggctgcatttcagagtaggttaccgcacgatcggatgaccagtcaggaggctgcctgtttccctgatataataagcggcccacagcagacccagaaagtgtttctgtttatcaggaatcggaccctgcagctgtggctggataaccccaaaatacaactgacattcgaggctacacttcaacagcttgaagccccatataacagcgacaccgtccttgtccacagagtgcatagctacctagagaggcacggattgataaattttggaatttacaagcggatcaagccgctgccgaccaagaagaccgggaaagtcatcatcataggctcgggcgtgtctggcctggccgcagccaggcagctgcaatcattcggtatggatgtaactctcctggaagctcgcgaccgagtggggggccgcgttgccactttcagaaaaggtaactacgtggccgatctcggagccatggtagtcacagggctcggggggaatcctatggcagtggtgagtaaacaggtgaacatggaactcgcgaaaataaaacagaaatgcccgctttatgaggcaaatggtcaagctgacactgtcaaagtgccaaaggagaaggatgagatggtcgagcaggaatttaacaggctcctagaggctaccagctacctctcccaccagctagactttaatgtgctgaacaacaaacctgtgagtctgggtcaggctctggaggtcgtaatacaactgcaggagaagcacgttaaggacgaacagattgagcattggaaaaaaattgtcaagacccaggaggagctgaaggagctcttgaacaaaatggtgaatctcaaagagaagatcaaagaactccaccagcagtacaaggaggcgtcagaggttaaaccaccacgggacatcacagcagagttcttggttaaaagtaagcaccgagacctgacagcactatgtaaggagtatgatgaactggccgagacacagggcaagctagaagagaaattacaggaactggaggcaaacccaccgagtgatgtttatctttcaagtcgggatcggcagattctagactggcacttcgccaacctggagttcgccaacgccactccccttagtaccttgagtttaaagcattgggatcaggatgacgatttcgaattcacgggaagtcatctaaccgtgagaaatgggtactcttgcgtaccggtagctctggctgagggtcttgacattaagctcaataccgccgtgaggcaggtaaggtacacagcgagcggctgtgaggtaattgctgtgaacacacggtctactagccagaccttcatctataagtgcgacgcagtgttgtgtacgctacctcttggcgtgttaaaacagcagcctccagcggtccagttcgtgccccccctgccagaatggaagacttccgccgtgcagcgcatgggttttggcaatctcaacaaagtggtgctatgcttcgatcgggtgttctgggatccctccgtcaacttatttggccacgttgggagtactaccgccagccgaggagagctgttcttgttttggaacctgtataaagccccaatcttactggccctggtggctggagaagctgccggcatcatggagaatatctccgatgacgtgatagtcggaaggtgtctcgcgattcttaagggcatcttcggcagcagcgcggtcccccagcctaaagagaccgtggtgtcccgatggagggctgacccgtgggctcggggatcctatagctacgttgcagcagggtcgtctggcaatgattatgatttgatggcccagccgattactccaggcccatctatccccggtgccccacagcctatcccgagattgttcttcgcaggggagcacactattagaaactatcccgctaccgtccacggagctcttctgtccggcctgcgtgaggccgggcggatagccgaccagtttctaggggcaatgtatacattacctagacaagctaccccaggcgttccggcccagcagtctccgtctatgtag

SEQ ID NO: 193659 - DNA, 1773 bp, Artificial Sequence
  Description of Artificial Sequence: Synthetic coding sequence
atggccaccccccggggccggaccaagaagaaggccagcttcgaccattccccggactcgctccctcttcggagcagcgggcgccaggctaagaagaaagcaaccgagactacggacgaggacgaggatggggggagtgaaaagaaatacagaaagtgtgaaaaggctgggtgtaccgctacctgcccggtctgtttcgcctcagcctcagagagatgcgctaagaacggctatacctcccgttggtatcatctcagctgcggggaacacttttgtaacgagtgtttcgaccactattatcgtagtcataaggacggatacgacaagtatactacctggaagaagatttggacttccaatgggaagacagaaccctctcccaaggctttcatggcagatcaacaactgccatattgggtgcagtgcactaagccagagtgcaggaagtggaggcagctcaccaaagaaattcaactcactcctcagatcgcgaaaacatatcggtgcgggatgaaaccgaataccgccattaaacctgagaccagcgaccattgttctttaccagaagacctcgaggcgctcacacctcagaagtgtattccacacatcattgttcgcgggcttgtgcggattcggtgtgttcaagaggtcgagagaatcctgtacttcatgactaggaaaggtttgattaacaccggagtgctgagcgtgggggccgatcaatatctactacccaaggattatcacaacaagagcgtgattatcattggagcaggacccgccgggctggccgccgcccgccagctgcataattttggtatcaaggtgaccgtcctggaggccaaagaccggatcgggggcagagtatgggatgataaatcctttaaaggagttacggtgggtcgaggcgcacaaatcgtaaacggatgcattaataaccctgttgcgctcatgtgtgagcaggtgagtgcccggtcgtgggatcataatgaatttttcgcgcagtttgcaggtgatcacacccttctgacccccggctattcagtcatcatagagaagctggctgagggcttagacattcagttgaagtccccagtccagtgcatcgattactccggcgatgaagtgcaggtgaccaccacagacggcactggctatagtgcccaaaaagtgctggtgaccgtgcccctggcacttctgcaaaaaggcgcaatacagttcaacccccctttgagtgaaaagaaaatgaaagcaatcaacagtctgggggccgggattattgagaagatcgccctccagtttccctacagattttgggactccaaagtgcaaggggccgacttttttggccacgtccccccctccgccagcaaacggggactttttgcagtcttttatgacatggacccccagaagaagcatagcgtattgatgtccgttattgctggcgaggccgtggcaagcgttcgcacgctcgatgataaacaggtactccaacagtgcatggctactctgagagaacttttcaaagaacaggaggtgcccgacccaacaaagtactttgtgacgcggtggagcaccgatccttggattcagatggcttactccttcgtgaagaccggaggttcaggcgaagcatacgatattattgctgaagacattcagggtacagtctttttcgccggggaagctactaaccgccattttccccagacggtgaccggtgcctacttgtctggggtgcgggaggcctcaaagatcgccgctttttag

SEQ ID NO: 193660 - DNA, 2463 bp, Artificial Sequence
  Description of Artificial Sequence: Synthetic coding sequence
atggccaccccccggggccggaccaagaagaaggccagcttcgaccacagccccgattctctacctctacgaagctccggcaggcaagcaaagaagaaagctacagaaactactgatgaagacgaggacggggggagtgagaaaaagtaccgcaagtgcgaaaaggccggctgtacagcaacgtgtcctgtatgttttgctagtgcctctgaaaggtgcgccaagaatggctatacaagccgttggtatcacctatcctgcggggagcacttctgcaacgaatgttttgaccactactacaggagtcacaaggacggctatgataagtacaccacttggaaaaagatctggacatcaaacgggaagactgaaccaagtcccaaagcattcatggcagaccaacaactgccttactgggtgcagtgcacaaagccagaatgccgaaagtggaggcaacttacaaaagaaattcagctgacaccccagattgcaaaaacttacagatgtgggatgaagccgaacactgctataaagccagagacctcggaccattgcagtctgccagaggacctccgtgtactggaagtgtccaatcattggtggtattcaatgctaattctgccacctctcctcaaggactccgtagccgcccctttgctgtctgcctattatccagattgcgttggcatgagcccttcctgtacgtcgacaaaccgcgcagctgccaccggtaacgcatcccccggcaaattggaacatagcaaggccgccttatccgtccacgtgccgggcatgaaccgatacttccagcccttttaccagccgaacgagtgcggtaaggcactatgtgtaaggccagacgtcatggagctggacgagttatacgagtttccagaatacagccgggaccccacgatgtacctcgctctgcgcaatctaatccttgccctgtggtacacgaattgtaaagaagctctaacgcctcagaagtgcataccccacataatcgtgaggggcctggttcggatccgttgtgtgcaggaagtggaaagaattctctacttcatgacgagaaagggcctgatcaacaccggcgtgctctcagtgggagcagaccagtaccttttgcccaaggactatcacaacaagtctgtgatcatcattggagctggtcctgctggcctggccgccgccagacagctgcacaatttcggaatcaaagtcacagttctggaagcgaaggaccggatcgggggcagggtgtgggatgataagagtttcaagggagtgacagtggggcggggcgcccaaattgtcaatggttgtattaataaccccgtggcattgatgtgcgaacaactggggatctccatgcacaaatttggtgagagatgtgacctgattcaggaaggaggacggataacagaccctactatcgataagcgaatggattttcacttcaacgcgctcctagatgtggtatctgagtggcgaaaagacaagactcagctgcaggatgttcctcttggagagaagatcgaagagatctataaagcctttatcaaagaatccggaatccaattcagcgagctggagggccaagtgctccaatttcacctttccaacctggagtatgcatgtgggagtaaccttcaccaggtgtctgcaaggagctgggatcacaatgagtttttcgcccagtttgctggagaccacacccttttgaccccagggtatagtgtcattattgagaaacttgcggaaggcctcgatattcagctgaaaagccccgtgcagtgcattgactactccggggatgaggtgcaggtgacaaccacagatggaacaggctatagcgctcagaaggtcctggtgacagttcctctggcgcttctgcaaaaaggcgctatccaattcaatccaccgctcagcgaaaagaagatgaaagctatcaattcccttggggccggcatcatagaaaagatcgccctgcagtttccgtacagattttgggacagcaaagtacagggtgcggacttctttggccacgtccctccctcagctagcaaacggggactgttcgctgttttctacgacatggaccctcagcacagtgtgttgatgagcgttatagccggtgaagcggttgcaagcgttcgaactctcgatgacaagcaggtgctacagcagtgcatggccacactgcgggaattattcaaagaacaggaggttcctgatcccaccaaatatttcgtcacccggtggagtacagacccgtggattcagatggcttactcattcgtcaaaaccggaggttccggcgaagcctacgacattatcgccgaagatattcagggcacggtgtttttcgcgggcgaagccacgaatcggcactttccccagaccgtaaccggagcgtacctgtctggggtccgagaagccagcaaaattgccgccttttag

SEQ ID NO: 193661 - DNA, 2472 bp, Artificial Sequence
  Description of Artificial Sequence: Synthetic coding sequence
atggccaccccccggggccggaccaagaagaaggccagcttcgaccactcacccgactccctgccgctgcgctccagcggccgccaggctaaaaaaaaggccacagagactaccgacgaagacgaggatggtggatctgaaaagaaataccgaaagtgcgagaaggccggctgcaccgcaacttgtccagtgtgttttgcttcggccagcgagaggtgtgcaaagaacggctacacttctaggtggtaccacctctcttgtggagaacacttctgtaacgaatgttttgatcattactatcggagccataaagatggctatgataagtataccacttggaagaaaatctggacaagtaacggaaagacagaaccttcaccaaaggcttttatggccgaccagcagctgccctattgggtgcagtgcactaaaccagaatgtagaaagtggagacagttgacaaaagagatccaactgacacctcagatagctaagacctaccggtgcggaatgaaacccaatacagcaatcaagcctgaaacttccgatcattgctccctgcctgaggacttgagggtgctggaggtctccaaccattggtggtactcaatgttgattcttcccccgttgctgaaggactcagtggcagcaccgctgctgtcggcgtattaccctgactgtgtagggatgtcccctagctgcacatctaccaatagagcggcagccaccgggaacgcgtcacccggaaagcttgaacattcaaaggccgccctgtctgtgcatgtgcccgggatgaatagatatttccagccattctaccagcccaacgagtgcggcaaagcactctgcgttaggcctgacgtgatggagttggatgaattgtatgaatttccagaatacagtagagaccctactatgtacctggccctccggaacctcatactggccctgtggtacaccaactgtaaggaggccctgacaccccagaaatgcatcccgcatattatcgtgcgaggcctggtgcgcatccgctgcgtgcaggaggttgaacgcatcctgtactttatgactcgtaaggggcttataaacaccggggtactatctgtcggcgccgatcaatatctactgccaaaggactaccacaataaatccgtgattatcatcggcgccggtcccgccggtctggccgctgctagacaactgcacaattttgggatcaaagtgactgtgctcgaagcaaaagatcgaataggtggcagagtgtgggatgataagtcctttaagggtgtgaccgtcggaaggggagcccagatagtcaatgggtgtataaataacccagtggcactcatgtgcgagcagctgggcataagcatgcacaagttcggggaaagatgcgacctcattcaggagggcggaagaatcaccgatcccaccatcgacaagagaatggattttcacttcaacgcgttgttggacgtggtgtccgaatggaggaaggacaaaactcaactgcaggacgtaccgctgggtgaaaagatcgaagaaatctataaagctttcatcaaagagtcagggatacagttcagcgaactcgagggtcaggttctgcagttccacttgagcaaccttgagtatgcatgcgggagtaatcttcaccaagtgagcgctagatcatgggaccataacgagttcttcgcccagttcgcaggcgaccacacccttttaacgcctgggtactccgtcattatcgaaaagttggcagaaggcctagatatccagctgaagtccccacaagttcagtgcattgactacagtggagatgaagtgcaagtgactacaacggacggcaccggctatagcgcacagaaagtcttagtgacggtgccgcttgctctgctgcaaaagggcgctatacaattcaacccaccattgagtgagaagaagatgaaagccattaacagtttgggagccggaattattgagaagattgcactgcagtttccatacaggttctgggacagtaaagtccaaggggccgatttcttcgggcacgtccctccttccgctagtaagaggggtctctttgctgtgttttatgatatggatccccagaagaaacattccgtcctgatgagcgttatcgccggagaagccgtcgcgtccgtacgaactctggatgacaagcaggtcctccaacaatgcatggccaccctgcgcgagctcttcaaagaacaagaggtcccagaccccacgaagtactttgtcaccaggtggtctacagacccttggatccaaatggcctactctttcgtgaagaccggtggctcaggggaggcttatgacattatcgcggaagacatacaggggacggtctttttcgctggagaggcaaccaacaggcactttccccagaccgttaccggagcatatctctcaggggtgcgggaggcctcaaaaatcgccgctttttag

SEQ ID NO: 193662 - DNA, 1776 bp, Artificial Sequence
  Description of Artificial Sequence: Synthetic coding sequence
atggccaccccccggggccggaccaagaagaaggccagcttcgaccatagtcccgattccctaccacttcgtagttctggacgtcaggccaagaagaaagcaaccgagacaaccgacgaagacgaagacgggggcagtgagaagaagtacagaaagtgcgaaaaggcaggctgcaccgccacctgtcccgtctgctttgcgtctgcgtccgaaagatgtgctaagaacggctataccagccgatggtatcatctgtcgtgcggtgagcacttctgtaacgagtgcttcgaccattattatcgcagccataaggacggttatgacaagtacacaacatggaaaaagatctggaccagtaacggtaaaacggaaccatcacccaaggccttcatggctgatcagcaactgccgtattgggtgcagtgcactaaacctgaatgtcgcaagtggcgtcagttaacaaaagagatacagctgacgccccaaatcgccaagacctaccggtgcggaatgaagcctaacactgccatcaaaccagagacttctgaccactgcagtctgccagaggacctggaggctcttactcctcaaaagtgcattccccacattatcgtcagaggtcttgtacggattcggtgtgttcaagaggtcgagcgaatcctgtacttcatgaccaggaagggactcataaacaccggagtcttatccgtgggcgcagatcagtatctgctacccaaggattatcacaacaagagcgtcataatcatcggggctggccctgcagggttggccgctgctaggcagttgcacaactttggaatcaaagttactgtgctcgaggccaaagaccgcataggcggcagagtgtgggatgataagagttttaaaggtgtgaccgtgggaaggggcgcccagatcgtcaatggatgcattaataacccagtcgctctgatgtgcgagcaggtttcagccagaagctgggatcacaatgagtttttcgcccagtttgcaggcgatcacaccttgctgacccctgggtattcagtgattatagagaagcttgctgaaggcctggatattcagctcaagagccctcaagtacagtgcatagactactcaggagacgaagtgcaggtgactactaccgatggtactggctatagcgcccagaaagtgcttgtgactgtgcccctcgctcttctacagaagggtgccatacagtttaatccccctctgagcgaaaagaagatgaaggcaatcaactctttgggcgctggaattatcgaaaagatcgccctgcagtttccatacaggttctgggatagcaaggtgcagggagctgatttcttcgggcacgtccctccgtctgcctcaaaacgggggttgttcgctgtcttctacgatatggatccccagaagaagcattcggttcttatgtcagtgatagctggggaagccgtcgcatccgtgcggactctcgacgacaagcaggtattacaacagtgtatggctaccttgcgcgagctgttcaaggagcaggaggtgccagatcctacaaaatatttcgtgacgcggtggagtaccgatccctggattcagatggcctatagtttcgtgaaaaccgggggttccggagaagcatacgacatcattgccgaggatatacaaggcaccgtcttctttgcgggagaagcaactaataggcattttccccaaacggtcacaggcgcttacttgtctggggtccgcgaagcttcaaagatcgccgcgttctag

SEQ ID NO: 193663 - DNA, 1923 bp, Artificial Sequence
  Description of Artificial Sequence: Synthetic coding sequence
tgatgcagcctgcccgaggacctgcgggtgctggaggtgagcaaccactggtggtatagcatgctaatactcccaccattgctgaaggatagtgttgccgctccgttgctgtccgcctattatccagattgcgtgggaatgtccccgtcgtgtactagtacgaatcgggccgcagcaaccggtaacgcgtcacctgggaaacttgaacactctaaggcagccttatcagttcacgtgcctgggatgaatagatacttccagccattttaccagcctaacgagtgtggtaaagcattgtgtgtgcgccctgacgtgatggaactcgacgaactgtacgagtttcccgagtactctcgcgaccccactatgtacctagccctgcgcaacctgatattagcgctgtggtacaccaattgtaaggaagccctaacaccgcaaaaatgtatacctcacattattgtgcggggtctggtgcgtatccgatgcgtgcaggaggtcgagcgaatcctgtactttatgactcgtaaaggtctcatcaacactggagtgctctccgttggggccgatcagtacttactgcccaaggattatcataacaagagcgtgatcatcattggggctggaccagccgggctggccgccgctcgccagctgcacaacttcgggataaaggttaccgtcctcgaggccaaggacaggattgggggccgggtctgggatgacaagtcattcaaaggggtgacagtaggacggggcgcgcagatcgtcaatgggtgcattaacaaccccgttgccctgatgtgcgagcagttaggcatctctatgcataaatttggagagcgctgcgacctgatccaggagggagggcggattaccgatcctacaatagataagcgaatggactttcattttaatgctcttctagacgttgtgtctgagtggcggaaagataaaacccagcttcaggatgtccccctgggggagaaaatcgaagagatctataaggctttcattaaggaaagcggtatccagttttcagagctggaaggccaggtccttcagttccatttgagcaatctggaatacgcttgtggctcgaacctccaccaggtgtcggccagatcctgggatcataacgagttcttcgctcaattcgcaggagaccacactctccttacccccggctattctgttatcatcgagaagctagccgagggtttagacattcagctgaagtctccccaagtgcagtgcatagactattcaggggatgaggtacaggtaacgaccacagacggaaccgggtatagcgcccagaaggtgcttgtgacagtcccactggcgctccttcagaagggggcgatacagttcaacccacccctgagtgaaaagaaaatgaaagccataaacagcctaggtgctgggattatcgagaaaatagccttgcaatttccataccgattttgggatagtaaggtccagggcgccgatttcttcggtcatgttccaccatctgccagtaaacgcggattatttgccgtgttttacgatatggacccacagaaaaaacacagcgttctaatgagcgtgatcgcaggtgaagccgtggccagcgttagaacgctggacgataagcaggtgcttcagcagtgcatggctaccctgagggaattattcaaggagcaggaagttcctgacccaacaaagtatttcgtgacacgctggagtacagacccttggatccagatggcctactctttcgtgaaaacagggggatctggagaagcttatgatattatcgccgaagacattcaggggacagtttttttcgccggcgaggccaccaaccgccatttcccccaaaccgtaaccggtgcctacctcagcggggtaagagaggcaagtaagattgccgcgttctag

SEQ ID NO: 193664 - DNA, 342 bp, Artificial Sequence
  Description of Artificial Sequence: Synthetic coding sequence
atgagcgtgatcgccggcgaggccgtggccagcgtgcggaccctggatgataagcaggttctgcagcagtgcatggccactctgcgcgaactttttaaagaacaggaggtacctgaccccactaagtatttcgtgacgcgttggtccaccgacccatggattcaaatggcatattccttcgtgaaaaccggcggcagtggtgaggcctatgatatcatagccgaggatattcagggaactgtttttttcgccggcgaggcgaccaacaggcattttccacagaccgtgacaggagcttatctgagtggagttcgcgaggcatccaagatcgctgctttttag

SEQ ID NO: 193665 - DNA, 3966 bp, Artificial Sequence
  Description of Artificial Sequence: Synthetic coding sequence
atggtgctgaccctgggcgagagctggcccgtgctggtgggccggaggttcctgtcgctgtcagccgccgatgggtctgacggtagccatgactcatgggatgtggaaagggtagcagaatggccctggctatctggaaccatcagggcagtttcacacaccgacgttactaaaaaggatctgaaggtctgcgtcgagtttgacggggagtcttggcggaagaggcgctggatcgaagtgtattccctgttacgtcgcgcgttccttgtcgagcacaaccttgtactcgccgagcgcaagtcaccagaaatctctgagagaatagtgcagtggccggccatcacctataagcccctccttgacaaggcaggccttgggtctatcacttcagtccggtttctgggcgatcagcagagagtctttcttagcaaggacctcctcaagcctatccaggacgtcaattcgctccgcttgagccttacggacaatcagattgtatccaaagagtttcaagctttgatcgtgaagcacctcgacgagagtcacctgctcaagggagacaagaatttggtcggctcagaggttaagatatacagcctcgacccttccactcaatggttttcagccactgttataaacggaaatccggcaagtaagactttacaggtgaactgcgaggaaataccagctctcaagattgtggatcctagtctgattcacgttgaggtggtgcacgacaatctggttacatgcggcaactcagccaggatcggggccgtaaagaggaagagctcggaaaataacggtactctcgtgtccaagcaagccaaatcttgctctgaggcttctccatccatgtgccctgtccaatccgtgcctacaactgtgttcaaggagattctgcttggctgcacagctgccactccaccaagcaaggatccccgtcaacaaagtaccccacaggctgcaaactctccaccaaatttgggggccaaaatcccccaggggtgccacaaacagtctctccctgaagagatctctagctgcctgaataccaaatccgaagctttgaggactaaacccgacgtttgcaaagccggcttactgtcgaaaagcagtcaaataggcaccggtgacctgaagattttaacggaaccaaagggaagttgcactcagccaaagactaacaccgaccaggaaaatagactagagtcagtacctcaggcactgactgggctcccaaaagaatgtctccccacaaaggcttcttccaaagctgaacttgaaatagcaaaccccccggagctccaaaagcatctggagcacgctcccagcccttcagatgtgtctaatgcacccgaggtcaaagctggcgtaaatagcgactctcccaacaattgctccggtaaaaaggtcgagccaagcgccttagcttgcaggagccagaacttaaaagaatcctccgttaaggtggacaatgagagctgctgtagccgcagtaataataagatacagaacgcgcctagcaggaaaagcgttctaacagaccctgctaagcttaagaagttacagcaatctggggaggcttttgtgcaggacgactcatgtgtgaacattgtagcccagctgccaaagtgccgagagtgtcggctggacagtctcagaaaagataaggagcaacagaaggacagcccggtattctgtcgattttttcatttcaggagactgcagttcaataaacacggagtcctgagggtggagggatttctgacgccaaacaaatatgacaacgaagccatcggtttgtggttgccgctcacgaagaatgtcgtcggcatcgacctggatactgccaagtatatcctagccaatatcggggaccatttctgtcagatggttatttctgaaaaagaggccatgtctacaattgaaccacacagacaagtggcatggaaacgggcagttaaaggtgtcagagagatgtgcgacgtttgcgatactacaatatttaacctgcactgggtgtgtccccgttgtggattcggtgtgtgcgtagactgttaccggatgaaacgaaaaaattgtcaacaaggcgccgcgtataagacattctcctggctgaaatgtgtgaaatcccagatccatgagccagagaatttaatgccaactcaaattataccaggcaaagccctgtatgacgttggcgatatcgttcactccgtacgcgcaaagtggggcatcaaagccaattgtccttgttccaaccgccaatttaaactattctccaagcctgcgagtaaggaggacctcaagcagaccagcctggcaggcgaaaaacccactcttggtgccgtcttgcagcagaacccctctgtcctagaacctgctgccgttgggggcgaggctgcaagcaagcccgcgggcagtatgaagccagcctgcccagcgtccacctctccactgaactggttggccgatctaacttctggtaatgtcaacaaggagaacaaggagaaacagccaaccatgcccatcttgaaaaatgagattaaatgtctcccccccctgcccccgctctccaagtctagtactgtcctccacaccttcaattcaacaatccttaccccggtatccaataataactcaggatttctgcggaatttgctaaattctagtaccggtaagactgagaacggtctgaaaaacacacccaaaattttggatgacatcttcgccagcctggtgcagaataagaccacctctgatttgtctaaacgacctcagggcctgacaatcaaaccttcaatccttggatttgacacaccacactattggctctgtgacaacagactgttatgcctgcaggatcccaataataaatccaactggaatgtctttcgcgaatgttggaagcaagggcagcctgtcatggtgagcggcgtccaccataaactgaatagcgagctttggaagcctgaatcctttagaaaagagttcggcgagcaggaggtcgatctcgtgaattgtaggacaaacgagatcattacaggtgctacagttggagatttttgggacgggttcgaagatgtgcctaatcgcctgaagaacgagaaagaacccatggtgttgaaacttaaggactggcctccaggcgaggattttagggacatgatgccctcccggttcgacgatctcatggcaaatatccctctgcccgaatatacgcgccgcgatggaaagctcaatcttgccagtcgtctccctaactatttcgtgagacctgatctgggacctaaaatgtacaacgcttatgggcttatcactccggaagaccgcaaatacggcactacaaacctccatttggacgtgtcagacgccgccaatgttatggtttatgtgggaatacccaaaggtcagtgcgaacaggaggaagaggtactcaagacaatacaggatggtgatagcgacgagcttaccatcaagcgcttcatagaggggaaggaaaagccaggcgcactctggcatatctatgctgctaaggataccgagaagatcagggagtttctgaaaaaagtttccgaggagcaggggcaagagaatccagctgatcatgacccgatacacgatcagtcatggtatcttgacagatcactgagaaaacggttacaccaggagtacggtgtgcagggctgggcaattgtgcaattccttggcgacgtagtgttcatccctgcgggggcaccccatcaggtgcacaatttgtattcctgcattaaggtcgccgaggactttgtttctcccgagcacgtgaaacactgcttttggctgacccaggagtttcgttatttatcacaaacccacactaatcacgaggacaaactccaggtcaagaatgtcatctaccacgctgtgaaagatgctgtcgccatgctgaaagctagcgagtcatcattcgggaaaccctag

SEQ ID NO: 193666 - DNA, 3966 bp, Artificial Sequence
  Description of Artificial Sequence: Synthetic coding sequence
atggtgctgaccctgggcgagagctggcccgtgctggtgggccggcggtttctgtccctgagtgccgcagacggttccgatgggagtcacgattcatgggatgtagagagggtggctgaatggccttggctcagtggtactatcagagcagtgtcacatacagacgtcactaagaaggatctcaaggtttgcgttgaatttgacggggaatcatggcggaaaagaagatggatagaggtttacagcctcctgaggagggcatttctggttgagcataatttagtcctggccgagcgcaaaagccccgagatttccgagcgcattgtccaatggccagccattacatacaaaccgcttctggacaaggctgggctcggctccatcaccagtgtccgcttcttgggagaccagcaacgggtgtttctctccaaagatttgttgaagccaattcaagacgtgaattccctcagactgtccctaacagataaccaaatcgtgagcaaagagtttcaggccctgattgtgaaacacttagacgagagccatctgcttaaaggagacaaaaaccttgtgggcagcgaagtcaaaatttactcactcgacccctccacgcagtggttctcagccaccgtgattaatggtaatccagccagcaaaaccttgcaagttaattgcgaggagattcctgccctaaagatcgtggaccccagtttaatacatgtcgaggttgtgcatgataacctggttacttgtggcaacagcgccaggatcggagcggtgaagcggaagtcgagtgaaaacaatgggacgctggttagtaaacaggctaagagctgtagcgaggccagtccttccatgtgcccggttcagtctgtgcctacgacggtgtttaaggagatcctgctgggatgcactgccgcgacccccccttccaaggacccacgccaacagagcactccccaggccgcaaactcgccccccaacctgggcgctaagattccccagggctgtcataaacaaagcttgcccgaagagatatccagctgtctgaacactaagtcagaagctttgaggacaaaacccgacgtctgcaaagccggtttgctcagcaagagttcacagatcggcactggtgacctgaagattctgaccgagcccaagggaagctgtactcaaccgaaaactaatactgaccaagagaaccgactggaatctgtcccgcaggccttaactggactgcccaaggaatgcctgcccacgaaagctagtagtaaggcagagttagagatcgctaacccacccgagttacaaaagcacctcgaacatgctccgagccctagcgatgtgagcaacgcccctgaggtgaaagctggcgtgaactctgattcaccaaataattgttcgggcaaaaaggtggagcctagcgccctagcttgcaggtcccagaacctcaaggaatcctccgtgaaagtggataacgagtcatgctgttcacgcagtaacaacaagatccagaatgctccatcaagaaaaagtgttctaaccgatccagccaaactgaagaagctgcaacagtctggcgaggcgtttgtccaggacgatagctgtgttaacatagtggctcaactgccaaagtgtcgagagtgcagactagactcactgcgcaaggacaaggaacagcaaaaggactccccggttttctgcaggttttttcatttccgcagactgcaatttaacaaacacggggtcctgcgagtggaggggtttttgacacctaacaagtatgacaatgaagctataggactgtggctcccgctgacgaagaacgttgtcggaatcgacctggacactgctaaatatatcctggccaatattggggatcacttttgccagatggtgatctctgagaaggaagccatgagtacgatcgagccacatcggcaggtggcttggaagcgagcagtgaagggagtgcgcgagatgtgtgatgtctgcgacacgacaatttttaacctgcattgggtctgcccgcgttgtggatttggagtctgcgttgattgctacagaatgaagaggaagaattgccagcagggggctgcttacaaaacttttagctggttaaagtgcgtaaaatctcagatccatgaacctgagaatctgatgcccacccagatcatccctggtaaagccctatacgacgtaggcgacattgttcatagtgtccgtgccaaatggggcattaaggctaactgcccctgctctaatcggcagttcaaactcttcagtaaaccagcttccaaggaggatcttaaacagacatctctggcaggagaaaagcctaccttgggcgccgtactacaacagaaccctagcgtgctggagcctgccgcggtcggcggcgaggcagccagtaaacccgccggatctatgaaaccagcatgcccagctagcacttccccgctgaactggctagccgacctcacttccggaaatgtgaacaaggagaacaaggagaaacaacccaccatgccaattctgaaaaatgagatcaagtgtctgcccccactgcctcctctgtcaaagagctctacagtgctccacacctttaactctacgatcctgacccctgtgagcaataacaatagcgggttcctcaggaacctactgaattcttctaccggcaaaacagaaaacggactcaagaacacacctaaaattttggacgatatattcgcctcacttgtacagaacaaaaccacttcagatctctctaagcggccccaaggccttacaatcaagccatcaattttgggattcgatacgccacattactggctgtgcgacaacaggcttttatgtctgcaggacccaaataacaagagcaactggaacgtgttccgagagtgctggaaacagggtcagcccgtgatggttagtggcgtccaccataagctgaactccgagctgtggaagcccgagagctttaggaaggagtttggcgagcaggaggtcgatttggtgaactgcaggacgaatgaaatcattaccggcgctaccgtcggggacttctgggacggattcgaagatgttcccaatcgacttaagaatgagaaggagccaatggtgttgaagctgaaagactggcccccgggtgaggatttccgggatatgatgccatctcgttttgacgatctgatggctaacatccccttgccagagtatactcgcagagacgggaaattgaacctggccagcagactgcctaactacttcgtgcgaccggacctcggaccaaaaatgtacaacgcatatggccttatcacccctgaggatcggaagtacggcacaactaatcttcacctcgacgttagcgacgcagcaaatgttatggtctatgtcgggatcccgaaaggccagtgtgaacaggaagaagaggtactgaagacaatacaggacggagatagtgacgaactgacgattaaaaggtttatcgaaggaaaagaaaagcctggcgcgctttggcatatttatgctgccaaggatactgaaaagattagagaattcttgaaaaaggtcagcgaggaacaaggtcaagagaaccctgctgatcatgatcctatccacgatcaatcttggtacctggaccggtctttaagaaagaggctgcaccaggagtacggagtacaggggtgggctatagttcagttcttaggcgacgtagtatttatcccggctggggcaccccaccaggtgcataatctgtatagctgcatcaaagtggccgaggacttcgtgtcaccagagcacgtcaaacattgcttctggctgacacaggaattccggtatctatcccaaacacatacgaaccacgaggacaaactgcaggttaagaatgtcatataccatgccgtgaaagacgccgttgccatgcttaaagccagcgagagctcctttggtaagccctag

SEQ ID NO: 193667 - DNA, 3966 bp, Artificial Sequence
  Description of Artificial Sequence: Synthetic coding sequence
atggtgctgaccctgggcgagagctggcccgtgctggtgggccggaggtttctcagtctcagtgccgctgacggcagtgacggatctcatgatagctgggacgtcgaaagagtggcagagtggccttggttgtccggtacgatcagagctgtgtcccacaccgatgtcaccaagaaggacctcaaggtgtgtgttgaattcgacggtgagtcatggaggaagcgaaggtggatagaggtatactccctgctaaggcgagcttttttggtggagcataacttagtgctagccgaacggaaatcaccggagatatcagaacgtatcgtgcagtggccagcaatcacatacaagcctctgttggacaaggcagggctggggtcaatcacgtctgtgcgtttcctaggagaccagcagcgcgtgttcctgagtaaggaccttctaaagccaatccaagatgtcaatagtttacgtctcagtctcaccgacaatcaaattgtgtccaaagagtttcaggcacttatcgtgaagcaccttgacgagtcccatttgcttaaaggagacaaaaacctagtaggaagtgaggtgaagatttactccttagacccaagcacacagtggttttctgcgaccgtgatcaatgggaatccagcctcaaagaccctccaggtgaattgcgaggagatcccggcgctgaagatagtcgatcctagcctcattcacgtcgaggtcgtccatgacaatttggtcacatgtggaaatagcgcacggatcggggcagttaagagaaaatcctccgaaaataacggaaccctggttagtaagcaggccaagagttgctcagaggccagcccatctatgtgcccggtgcagtcggtgcctaccacggtttttaaggagatattacttgggtgcacagctgcgacaccaccttccaaagaccctaggcagcagtccaccccacaggctgcaaacagcccaccaaatttgggagctaagattccccaggggtgccataagcagtcactgccagaagaaatctcatcctgcctaaacaccaagtcagaggcgcttcggacgaagccagacgtttgtaaagcagggctgctgagtaaaagctcccagattgggactggagatctgaagatcttaaccgaaccgaaagggtcatgtacccaacccaaaaccaatacggatcaggagaaccgcttggagtcagtaccacaggcccttacagggctgcctaaagagtgcctccccaccaaggcttcgtctaaagccgaactggagatagctaatccccccgaactgcaaaagcacctagaacatgcaccttcaccgtccgatgtgtcaaacgcaccagaagttaaagcgggggtgaactcagatagccctaataattgctccggcaaaaaggttgaaccttcagccctggcctgccggtctcagaacttaaaagagagctctgtgaaagtggataacgaaagttgttgctcaagatcaaataataagattcagaacgcccctagtcgcaaatccgtcctgaccgaccccgctaagctgaagaagctgcaacagagtggagaagcctttgtgcaggatgactcatgcgttaatattgttgcccagttgcctaagtgccgggagtgtcgccttgacagtctgcgtaaggacaaggaacaacagaaagattctcctgttttttgcagattttttcacttcagacgcctgcagtttaacaaacacggagtccttcgtgtcgaggggtttctgacacccaacaaatacgacaacgaggccattggattgtggctgcccctgaccaagaatgttgtcggaatagacctggatactgctaagtatatcctggctaacatcggtgatcatttttgccaaatggtcatctctgaaaaggaggccatgagtaccattgagccccacaggcaggttgcctggaagagagccgtgaagggcgtacgggagatgtgcgatgtgtgtgacaccaccatcttcaacttacactgggtgtgtccccgatgtggctttggagtttgtgttgattgttaccgcatgaaacgcaagaattgccagcagggggccgcctacaagaccttcagctggttgaagtgtgtgaagagtcagattcatgagcccgagaaccttatgccgacccaaatcatccctggcaaagccttatatgatgtcggggacatagtgcattccgtgcgcgcgaagtggggaatcaaggctaattgtccctgttccaaccgccagtttaagcttttcagcaaacccgccagcaaggaagacctgaaacaaacaagcctcgccggggaaaaacccacattaggcgccgtcctgcagcagaatccttcagtcctggagcccgccgctgttgggggggaagcagccagcaaacccgctggttctatgaagccagcctgtcctgcttccacttccccgctgaattggttggcagacctgacttccggaaatgttaataaggaaaacaaggagaaacagcctacgatgccgattcttaagaacgagatcaagtgcttaccccccctgcccccgttgtctaagtccagtactgtcctgcacactttcaacagtactattttgacgcctgtgtccaataacaattccggctttttgcgcaatcttctcaattctagtaccggtaagactgagaatggtttgaagaacacccccaagatacttgatgatatcttcgcttccctcgttcagaataaaacaaccagcgatttgtccaaacggccccagggactaaccatcaagccatccatccttgggttcgacaccccacactactggctttgcgataacaggctgttatgtctgcaagatccaaataataaatccaactggaatgtttttagggagtgctggaagcagggtcagccagttatggtgagtggcgtacaccataaattaaattcagagctgtggaaacccgagagctttcggaaggaatttggtgagcaggaagtcgatctcgtcaattgccggactaacgagataatcacaggggccaccgtcggtgatttttgggacggattcgaggacgttccaaacagactgaagaatgaaaaagagccaatggttctcaaacttaaggactggccgccgggcgaggatttccgcgacatgatgccaagccggttcgacgaccttatggcaaatatccccctccctgagtacacccgacgtgatgggaaactgaacctggctagtcggctccctaattatttcgtgcgacctgacctgggacccaaaatgtataatgcatacggactgattaccccagaagaccgcaaatacggcaccacaaacctgcacctggatgttagcgacgctgctaacgtgatggtgtatgttggcatacctaaagggcaatgtgaacaggaggaggaagttttgaaaacgattcaagatggggactccgatgaactgaccattaagcggttcatagaaggcaaagagaaaccaggggcactatggcatatttatgctgctaaggacaccgagaaaatcagagagtttctgaagaaagtgagtgaggagcagggacaagagaacccagctgaccatgaccccatccacgatcaatcctggtaccttgaccggtctctgcggaaacgtctccaccaggaatacggggtgcaagggtgggcaattgtgcagttcctcggtgacgtcgtcttcatacccgccggggctccacatcaggtacacaacctgtatagctgtattaaagtggccgaagacttcgtcagccccgagcacgttaaacactgtttttggctgacccaggaattccgctacctgagtcagactcacactaaccatgaggacaagctccaagtcaagaacgtgatttatcacgccgtgaaggatgcagtcgcaatgctgaaggctagcgaatcatccttcggcaagccttag

SEQ ID NO: 193668 - DNA, 513 bp, Artificial Sequence
  Description of Artificial Sequence: Synthetic coding sequence
atggtgctgaccctgggcgagagctggcccgtgctggtgggccggaggttcctgagtctttctgcagctgatgggtcagacggatcacatgacagctgggacgtggagagagtcgcggagtggccgtggctgagtggaacaataagagctgtaagtcacacagacgtgactaagaaagaccttaaagtgtgtgtggagtttgacggggaatcctggagaaaacggcggtggattgaggtctacagcctcttgcgaagggctttcttggttgaacacaaccttgtgctggctgagagaaaaagccctgagatatcggagagaattgtccagtggcccgcaattacttacaagcctctcctcgataaggctggtctcggcagcataacttcggtccgctttcttggtgatcagcagagagtgttcctgtcaaaagatctgctgaagcctattcaggacgtgaactctctccgcctcagccttacggacaaccagatcgtatcgaaagaattctag

SEQ ID NO: 193669 - DNA, 2136 bp, Artificial Sequence
  Description of Artificial Sequence: Synthetic coding sequence
atggtgctgaccctgggcgagagctggcccgtgctggtgggccggcggttccttagcctgagtgccgcagacggctccgacggctctcatgatagctgggatgtcgagcgcgtagccgagtggccttggcttagcggtacgataagggcagtctctcacacagatgtaacgaaaaaggacctgaaagtttgtgtggagttcgacggtgaaagctggcgtaaacgccggtggattgaagtatacagtctactccgcagggcattcttagtcgagcacaatttagtcctagctgaacggaagagccccgagatctccgaaagaatcgtgcaatggcccgctatcacctacaaacctttgctggacaaggcgggactaggaagtatcaccagcgttagatttctgggagaccaacagcgggtgttcctgagcaaagatctcctcaagcctattcaggacgtgaacagtcttcgtctgtccctcactgataatcagatcgtgtccaaggagtttcaggccctcatcgtcaagcacttagacgagagtcatctactcaagggggataaaaatctggtcgggagcgaggtgaagatctacagcctcgacccttccacacagtggttcagcgccactgttattaatgggaatcccgccagcaaaacactccaagtaaactgcgaggaaatcccagcacttaaaattgttgacccgagtttaatccatgtggaggttgtgcacgacaacctcgtaacttgcgggaatagtgcgagaattggggcagttaagcgaaaatcctcagagaataatgggaccctggtcagcaaacaggcaaagagctgctccgaggcatccccgagtatgtgccccgtacagtccgtaccgacgacggtgtttaaggagatcctgctgggctgcacggcagccaccccacctagtaaggatccccggcagcagtccacaccacaggctgccaattcaccccccaacctgggggccaagattccccagggctgccataaacaaagccttcccgaagaaatctcgagctgcctcaacacaaaaagtgaggccctgagaacaaagccagacgtgtgtaaagcgggactgctcagcaaaagctcccagatcgggacaggagatctaaaaatcctgacagagcctaagggctcatgcacacagcccaaaacaaacacagatcaagagaacagactcgaaagtgttccacaggcgctcacaggactccccaaggaatgcttgcctacaaaggcatctagcaaggccgaattagagatcgccaaccctcccgaactgcagaaacatctcgagcatgcacctagtccatccgacgtttcaaatgctcccgaggtgaaggctggggtgaacagcgatagccccaataactgctccgggaagaaagttgagcctagtgccttggcctgccgtagccagaatctgaaagaatccagcgtgaaagttgacaatgagtcatgctgcagtcgcagtaacaacaagattcagaatgcgccttcgcgcaaatccgttctcacagatcccgctaagctgaagaaacttcagcagtcaggggaagcctttgtgcaggatgatagttgtgttaacatcgtagcccagcttcctaagtgtcgtgagtgccggttggacagcttgcggaaggataaggagcaacaaaaggatagtcctgtattctgcagatttttccacttcaggcggctgcaatttaacaagcacggggttttgcgggtcgagggcttccttacccccaacaagtacgataacgaggctattggcttgtggctccctctgacaaagaatgtggtagggatcgacctggataccgccaagtatatcttggccaacatcggtgaccacttctgtcaaatggtgatttctgaaaaagaggcaatgtccacaattgaacctcataggcaggtggcatggaagcgcgccgtcaagggcgtgcgtgagatgtgcgatgtctgtgatacaactatttttaatttacactgggtctgtccgaggtgcgggtttggggtgtgtgtggattgctaccgaatgaagcgcaaaaactgtcagcagggagagaaccggtttgactcaccacctgcaccgcttcactcctag

SEQ ID NO: 193670 - DNA, 366 bp, Artificial Sequence
  Description of Artificial Sequence: Synthetic coding sequence
atggtgctgaccctgggcgagagctggcccgtgctggtgggccggaggtttctttctttgagcgcagcggacggcagcgacgggtctcatgattcttgggatgtagaaagggtggcagagtggccctggctcagtgggaccatccgtgccgtatcacacacagatgtcactaagaaggatctgaaagtgtgtgtcgagttcgatggcgaatcctggagaaaacggagatggattgaggtgtatagcctgctgcgacgcgcctttttggtcgaacacaatctagtgctcgcagagcgaaagagcccagaaatatctgaaaggatcgttcaatggcctgcaattacatataaaccactcctcgactag

SEQ ID NO: 193671 - DNA, 3984 bp, Artificial Sequence
  Description of Artificial Sequence: Synthetic coding sequence
atggtgctgaccctgggcgagagctggcccgtgctggtgggccggcgctttctcagcttgagcgcagctgatggcagtgatggtagtcatgactcctgggatgttgaaagagtcgctgagtggccttggttgtccggcacaattcgggccgtctcacacactgacgtcactaaaaaagatctgaaagtgtgcgtggagttcgacggcgaatcatggcggaagcgccgttggatagaggtctatagcctgttgcgcagagcatttcttgttgaacacaatttggtgctggctgagaggaaatcacctgaaataagcgaaaggattgtgcagtggcccgcaattacatacaagcccctgctcgataaggcaggccttggcagtataacatccgtccgcttcctcggcgatcagcaacgcgtctttctgtcaaaggatctcctgaagccaatacaagatgtaaactccttacggttaagtctcacagacaatcagattgtgtccaaggagtttcaggcgttgatcgtgaaacacctagatgaatcacatctgttaaaaggagataaaaatctagttggctcagaggttaaaatctattcactggatccctccacgcagtggttttccgccactgtgatcaacggtaacccagccagcaagacactccaagtgaactgtgaggagattcctgcacttaagattgtggatcccagtctgatccacgtggaagtggtacacgacaatctcgtaacatgcggcaatagcgcgcgcatcggggcggtcaagcgcaaatcttcagagaacaatggaacactagtttctaaacaggccaaatcatgttcggaggccagtcctagcatgtgtcctgtgcagtcggtgcctactaccgtgtttaaggagatcctccttgggtgcacagctgctacccctccatcaaaggacccgagacagcagagcacccctcaggccgctaactcgcccccaaacctgggagccaaaatccctcaggggtgtcacaaacaatctctgccggaggaaatttcaagttgtctgaacaccaagtccgaagccctacgtacaaagcccgatgtctgtaaagcaggcttactgagtaaatcatctcagattgggactggcgatctgaagatcttaacagagcctaaggggtcatgtactcagccaaagaccaacacagaccaagagaacaggttggaaagcgtgccccaggcactaacaggactccccaaggaatgcttgcccactaaggcttcctcaaaggccgagctagaaatcgcaaatccacctgaactccagaaacacctggaacacgccccaagcccctctgatgtgagtaacgcacctgaagtgaaagccggagtgaattctgacagcccgaacaactgctccggtaagaaggtggaaccatccgctctcgcttgtagatcacagaatttgaaagagtctagcgtgaaagttgacaatgaatcatgctgttcaaggtccaataacaagattcagaacgcaccttcacgcaagtccgtcttgaccgaccctgccaaactgaagaaactgcagcagagtggcgaggcattcgtgcaggacgattcttgcgtcaatattgtggctcagctgcctaagtgccgggagtgcaggttggattccttgcgcaaagacaaggagcaacagaaagactctcccgtgttttgtcgattctttcattttagaaggctccagtttaataagcatggggtccttagggtggaaggatttctgacaccgaataaatatgacaacgaagccattggattgtggctgcccctcacaaaaaatgttgtgggtatcgatctcgacacagctaagtacattctagcaaatattggcgatcacttctgccagatggtaatctcagaaaaagaggcgatgtcgaccatcgaaccccaccggcaggtggcgtggaagagggctgtgaagggtgtacgtgaaatgtgtgatgtgtgtgacaccactatctttaatctacactgggtctgtccccgctgtgggttcggagtgtgcgtcgattgttatcgcatgaagaggaagaattgtcagcaaggcgcagcatacaaaactttttcctggcttaaatgcgtgaagagccagattcatgagccagagaaccttatgccaactcaaataattccaggaaaggccctgtacgacgtgggcgatattgtccattcagtgagagccaagtggggcatcaaagctaactgtccttgctcaaatcgccagttcaagttgttctcaaagcctgctagtaaagaggatcttaagcaaacctccctcgccggggagaaacctaccctgggggctgtcctccagcagaacccttccgtgctcgaaccagccgccgtcgggggagaagcagccagtaagcccgcgggctccatgaaaccagcctgtccagcaagtacttctcccttgaactggttggccgatctgaccagtggcaacgtaaacaaggaaaacaaagaaaaacaaccaacaatgccaatcctcaagaatgaaattaaatgcctcccacctcttcctcctctgtccaagtcctctactgtgcttcacacctttaattcaacgatcttgacccccgtgagcaacaataacagcgggtttctcaggaatctcctgaactcttctacgggtaagacggagaatggcttgaagaacacaccgaagattctcgatgacattttcgctagcctggtgcagaacaaaacgacttccgatctcagcaaacgaccacaaggattgacaatcaaaccaagcatcctgggatttgatacacctcactactggctatgcgacaaccgcttattgtgtcttcaagaccccaacaacaagagcaattggaacgtctttcgggagtgttggaaacagggccaacccgtgatggtgtccggcgtccatcacaaactgaatagcgaactttggaaaccagagagcttcaggaaagagttcggcgaacaggaagtcgatctggtgaactgccgcaccaacgagatcatcacgggtgctacagtcggggatttctgggacgggtttgaggatgtcccgaatcgtctaaagaatgaaaaggagccaatggtactcaaattgaaagactggcccccaggggaggatttccgggatatgatgccgagtaggttcgacgatctgatggccaatatcccactacctgagtacaccagaagagatgggaagttgaatctggcatcaaggttgcccaattacttcgtgcggccagacctcggccccaaaatgtacaacgcctacggtctgatcacacctgaagaccgcaagtacggcaccacaaatttgcacctggatgttagcgacgccgccaacgtgatggtttatgtaggcatacccaagggccagtgtgagcaggaggaagaagtgctgaagaccatccaggacggagactccgacgagctcacgataaagcgtttcatcgagggcaaggaaaagccaggggccctttggcacatctacgcagctaaggacaccgagaagatcagagagttcttaaagaaggtgtcagaagaacagggacaggagaatccagcagatcatgacccgatccacgatcagtcatggtaccttgacaggtccctgcgcaaacggctgcaccaagagtatggggtgcagggatgggccattgtccagtttcttggcgatgtggtgtttatccctgccggggcaccgcaccaagtgcacaacctgtatagctgtataaaggtggcggaggattttgttagcccagagcatgtgaagcactgtttttggcttacccaggaattcagatacctgagtcagacccataccaatcacgaggataaacttcaagtgaaaaatgtgatataccacgccgtgaaagacgccgtcgccatgttgaaagtaaatccggtactggccaacctcaacttgccagcccactggaagtag

SEQ ID NO: 193672 - DNA, 3810 bp, Artificial Sequence
  Description of Artificial Sequence: Synthetic coding sequence
atggtgctgaccctgggcgagagctggcccgtgctggtgggccggagattcctgtccctttcagccgccgacgggtctgatgggagccacgacagttgggacgtcgagcgagtcgccgagtggccctggctttctgggaccatacgagcggtcagtcatactgatgtcaccaagaaagacctaaagacctacaagcctctgctggacaaggccgggctggggagcattacttccgtccggttcctgggcgaccagcagagggtatttctttcaaaagacctgctgaagccaatccaggatgttaattccctgaggctctccctgactgataatcagatagtcagtaaagaatttcaggcactgatagtgaaacaccttgacgaatcccacttgttgaaaggtgacaaaaacctggtgggctccgaggtgaaaatttactcactggacccatcaactcagtggttcagtgctactgttattaatggcaatccggccagcaaaacactacaagtgaactgcgaggaaatcccggctctcaagatagtcgatcccagcctgatacacgtcgaggtggtccatgacaatttggtgacttgcggaaacagtgctcggattggcgcggtcaagcggaagtcgagtgagaacaatggtacgctggtgagcaaacaggccaaatcctgttccgaggccagtccctctatgtgtccagtgcagtccgtgcccaccaccgtgtttaaagaaatattgctcggatgtactgccgcaacaccaccttcaaaagatccaaggcaacagtccactccccaggctgcgaacagcccacctaacttaggcgccaagatcccccagggatgccataagcagtcacttcccgaggaaatcagctcctgcctgaacactaaatccgaagccttaaggactaagcctgacgtttgcaaagctgggctactcagcaagtccagccagattggaacaggagatttgaagatcctaaccgagccaaagggaagttgtacccagcccaagacaaatactgatcaggaaaataggctcgaatctgtgccccaggctcttacgggtctaccaaaggaatgtttgcctacaaaggcgtcttccaaagccgagctcgagattgcaaatccccccgaactccagaagcatcttgaacacgctccctcaccaagcgacgtaagtaatgcccccgaagtgaaagcaggggtcaacagtgatagtcccaacaactgctccggcaaaaaagtggagccttctgctctggcttgccgctcgcaaaacctgaaagagtcgagcgtcaaggtggataatgagagctgctgctccagatcgaacaacaagatccagaatgccccttcacgaaagagtgtactgacggatcccgcaaagcttaaaaaacttcagcagtcaggagaagccttcgtgcaggatgacagctgcgtaaatatcgtcgctcagctgcccaaatgcagagaatgccggctggattcactccggaaggacaaggaacagcagaaggactcaccagttttttgcagattttttcacttcagacgactgcagtttaataagcacggcgtcttacgggtggaaggcttccttacccctaataagtacgataatgaagcaatcggcctgtggttgcccctcacgaagaacgtggtcggaatcgatttagacacagccaagtatatattggcaaatatcggggaccacttctgccaaatggtaatctcagagaaagaagcgatgagtactattgagccacacagacaggtggcatggaaaagggcagtgaagggagtccgcgagatgtgcgacgtctgtgacacaaccatcttcaatcttcactgggtatgccctagatgtggatttggagtatgtgtggactgctatagaatgaaacgcaagaattgtcagcagggcgcagcctataaaacctttagttggctgaagtgcgtcaaaagccagattcatgaacctgaaaatctgatgcccacccagatcatcccagggaaagccctttacgacgtgggcgatattgttcacagcgtgagagcaaagtgggggatcaaggctaactgtccctgcagcaaccgccagtttaagctattctccaagcccgcttccaaagaggatctgaaacagacatcgctggccggcgagaagccaactcttggtgcagtgctgcaacagaatccgtcggttctggaacctgccgcggtaggaggggaagcagcatcaaaaccagctggcagcatgaaacccgcatgtccggcttctacttcaccattgaattggcttgccgatctgaccagtggtaacgtcaacaaagagaataaggaaaagcagccgaccatgcctattctaaagaacgagatcaagtgcctgcctccactccctcctctttcaaagtcatctaccgtcctccatacctttaactcgacaatactgacgcccgtgtctaacaataactctggatttctgagaaacctactaaattcttctactggcaaaacagagaacggacttaaaaacactccgaagatcttggacgacatcttcgccagcctcgtccagaacaagaccacctccgatctgagcaagaggcctcaggggctaaccatcaaaccgtccatcctcgggtttgatacacctcattattggttgtgtgataatcgactgctatgcctccaggacccaaataacaagagtaactggaatgtgttcagagagtgctggaagcaagggcaacccgtgatggtcagcggcgtgcatcataagttaaactctgaactgtggaagcccgagagcttcagaaaagagttcggcgaacaggaagtcgacctggtgaattgtcgtacaaacgagataattacaggggccacggtgggcgatttttgggacggttttgaggatgtccctaataggttaaagaacgagaaagaacccatggttctgaaactgaaggactggccccccggggaggactttcgggatatgatgccatcccgatttgatgatcttatggcgaatattccactgccggaatacactagacgcgatgggaaattgaacctagctagtcgactgcccaattattttgtgaggcccgatctcgggcctaaaatgtacaatgcatacggcctcataactcctgaagatagaaagtatggcaccaccaacttgcatctggacgtgagcgacgctgctaacgtgatggtgtatgtgggcatccccaaaggccaatgcgagcaagaggaagaagtgctaaagacaatacaggacggcgatagcgacgagcttaccattaaacggttcatcgaggggaaagagaaacctggcgccctgtggcacatatacgccgcaaaggacactgagaaaattcgcgaatttctgaaaaaggtcagtgaggagcagggacaggaaaatcccgctgaccacgaccctattcatgaccaaagctggtacttggatcgctctctcagaaagaggctccatcaagaatacggggtgcagggttgggctatcgtccagttccttggggacgtggtatttatccccgcgggtgccccccaccaggttcataacttgtactcgtgcatcaaggtggccgaggactttgtgtctccagaacacgtgaagcactgcttctggcttacacaggagtttaggtacctcagccagactcacaccaaccatgaggataaactccaagtgaagaatgtgatttatcatgccgtgaaggatgcagtagcaatgttgaaagcctccgagtccagtttcggtaagccatag

SEQ ID NO: 193673 - DNA, 5286 bp, Artificial Sequence
  Description of Artificial Sequence: Synthetic coding sequence
atggccgacgccgccgccagccccgtgggcaagcggctgctgctgttatttgccgacacagctgcctcagcttccgccagtgcgcccgctgccgccgccgcaagtggcgatcctgggccagctttgcggactcgggcctggagagctggcacggtgagagcaatgtccggagcagtgccccaagacctggccatcttcgtggaatttgacggctgcaattggaagcagcactcttgggtgaaggttcacgcagaggaagtcattgtgctactcctggagggatccctggtgtgggcccctcgcgaagaccccgtgctgttacagggtatccgtgtaagcatcgcacagtggcctgccctcacatttactccactggtggacaagttaggtttgggatcagtggttcccgtggagtatctgctagatagggagttacgcttcctaagtgacgccaatgggctgcacttattccaaatgggtactgatagccagaatcagatcctgctggagcacgctgccctgcgggagacggtgaatgccctgatctcagatcagaagcttcaggagatcttctctcgcgggccttattccgtgcaggggcatcgggtgaagatttatcagccagaaggggaagaaggttggctgtacggagtggtcagccaccaggattccattacacgtttaatggaggtatccgtgactgaatctggggagatcaaatcggtggacccccgcttgatccatgtgatgttaatggacaactccgccccccagtccgagggcggcaccctgaaggctgtgaaaagcagcaaaggaaaaaaaaaacgcgagagcattgagggcaaggatgggagacggcgtaaatcggccagcgatagcgggtgcgacccagcatcaaaaaaactgaaaggagataggggcgaggttgatagtaatgggtctgacggaggagaggcctcaagggggccctggaagggcgggaatgcctcaggggaacccggactagaccaacgcgccaaacagcctccatccacattcgttcctcagataaacagaaatattcgtttcgcgacctacaccaaggaaaatggtcggactctagttgtgcaagatgaaccagtggggggcgacaccccggcttccttcaccccatactctacagcaaccggtcaaacaccactggcccctgaggtgggtggagcagagaacaaagaggcagggaagaccctcgaacaggtggggcagggcatcgttgccagcgccgcagtggttaccactgcgagcagcactcccaatacagtccggattagcgacactggcttggcagcaggtactgtcccggaaaagcagaaaggcagcaggtcccaggccagtggcgaaaacagcaggaactcaattctcgctagtagcggattcggggctccactcccttcttctagtcagcctttgacattcggaagcggcagatcgcagtcgaatggtgtgttggcaacagagaataaacccttggggttcagctttggctgctcttccgcccaagaagctcagaaagatactgacttaagtaaaaatctgttcttccaatgcatgagtcagaccctgcccacctctaattattttacaaccgtgtccgaatctctcgcagatgattcatcctcacgagattcttttaaacagtccctcgaatcattgtcgagcggactctgcaaagggagatcagtactcggcacggacacaaagcccggctctaaggccgggtccagtgtggatagaaaagtcccagccgagtctatgccaactctaacccccgcttttcccagaagcctcctgaatgcccgcacacctgagaatcatgagaacctcttcctccagcctcctaaactcagtagggaggaaccatccaaccctttcttggcatttgtggagaaggttgagcactcacctttctcatcattcgcttctcaggcctcagggtcctccagctctgccacaactgtcacctctaaggtcgccccgtcttggcccgaatcacattcttctgccgactctgccagtcttgctaaaaagaaaccactttttattactaccgactcaagcaaactggtgtcaggggtgctgggcagcgccttaacatccggtggccccagcttgagtgccatgggcaatgggaggagctcctctccaacttcttcattgacccaacccatcgagatgccaacactgtcttccagcccaacagaggagcggcccaccgtgggaccaggtcagcaggataacccactgctgaaaacattctctaacgtctttggccgccactctggcggctttctaagctctcccgccgatttttctcaggaaaacaaagccccttttgaggcagtaaagcgtttctcactggatgagcgctccctggcctgccggcaggatagtgactctagcacgaattcggacctgtcggatctctctgactccgaggaacagctacaagctaaaaccgggctgaaggggattcctgagcatctgatgggcaaactggggcccaatggtgagcgctctgcggaacttcttctgggcaaaagcaagggaaagcaggcaccgaagggccggccccgcacggcgcctcttaaggtcggccagtccgtgctgaaagacgtcagcaaggtcaaaaaattgaaacaatccggagagccattcctgcaggacggctcttgcattaacgtggcaccccatctgcataagtgtagggagtgcagattggaaaggtacaggaagttcaaagagcaggagcaggacgacagtacagtcgcatgccgcttttttcattttcgccggctcatttttacgcgaaagggggttcttcgagtcgagggatttctgagcccccagcaatcagatcccgacgccatgaatctgtggatcccctctagtagcctcgcagaaggcatagacctggagacttccaaatacattctcgccaatgtcggcgaccagttctgtcagctggtgatgagcgagaaggaagccatgatgatggtggaacctcaccaaaaagtggcctggaaaagggcagtgcgaggtgttcgggagatgtgcgatgtctgcgaaaccacgctctttaatatacactgggtttgccggaaatgcggcttcggcgtatgcctggactgttatcgcctgcggaagtctaggcccagaagcgaaactgaggagatgggggatgaggaggtgttttcctggctgaaatgtgctaaaggccagagtcatgagcccgagaacctgatgcccacacagattatcccgggaaccgctctttataatattggcgatatggtgcatgccgctcgaggcaagtggggcattaaagccaactgcccatgtatctctaggcagaataaaagcgtgctcagacctgcagttactaacggcatgtcacagctgcctagcattaatccatcagcatcgtcaggaaacgaaacgaccttcagtgggggaggcggcccggctcccgtgaccacacccgaaccagaccacgttcccaaagctgattccactgatatacggagtgaggaaccactaaagaccgatagcagtgcctcaaattccaactctgagctcaaagccattaggcccccttgccccgatacagcaccaccttccagtgcgcttcattggcttgcagacctcgcaacccagaaggctaaggaggagacaaaggaagctggctcactgcgcagtgttctgaataaggaatcccacagtccattcggactcgactccttcaacagcactgccaaggtgtccccactgaccccaaaactgtttaattcattgttgctgggcccaacagcatctaataacaaaactgaggggtctagcttaagggatcttcttcacagcggtcccggcaagctgccccagactccattggataccgggatcccttttcctccagtttttagtacatcttccgccggggttaagtcaaaggcttctctgcccaatttcctagaccacataattgccagtgtggtggagaacaaaaaaactagcgacgcttctaagcgggcttgcaatctgacagacacccagaaggaggtcaaggagatggtgatgggattgaatgtacttgatcctcataccagccatagctggctctgcgatggcagacttctgtgccttcacgacccctctaacaaaaacaactggaagatctttagagaatgttggaaacagggtcaacccgtcttggtctctggggtgcacaagaagctcaagagcgaactgtggaaaccagaggcattctctcaagagttcggcgaccaagacgtcgacttagtcaactgccgcaattgtgctatcatctctgatgtgaaggtacgcgatttctgggatgggttcgagatcatttgcaagcgcttacggtccgaagacgggcaacctatggtgctcaaactcaaggactggcccccgggcgaggacttccgagacatgatgcctacgcggttcgaggatctgatggagaacctgcctctacctgagtatacgaagcgagacggtcggcttaacttggcaagccggctgccaagttactttgtgcgacccgatctgggacccaagatgtacaacgcttatggtctgataacggctgaggatcgtcgcgtcggaactaccaatctgcatctcgacgttagtgacgcagtaaatgtgatggtatacgttggcattccaattggtgagggcgcacatgatgaggaagtgcttaagacaatagatgaaggggacgccgacgaagtgactaagcaaagaattcacgacgggaaggagaaaccgggcgctttgtggcatatctacgcggctaaggacgccgaaaaaatacgcgagctactgcgcaaagttggtgaagagcagggccaggagaatccgcctgatcacgacccaatccatgaccagtcatggtatcttgatcagacactgcgaaagaggctctacgaagaatacggtgtgcagggatgggccatcgtgcagttcctgggagacgccgtctttatcccggctggcgccccccaccaagtccacaacctctactcgtgtatcaaggtggcagaggattttgttagccccgagcatgtcaagcactgcttccggctcacccaggaatttcggcatctgtctaatactcataccaaccacgaggataaactccaggtgaaaaacatcatttatcacgctgtcaaggacgccgtgggtactctgaaggcacatgagagcaaacttgccaggtcctag

SEQ ID NO: 193674 - DNA, 4254 bp, Artificial Sequence
  Description of Artificial Sequence: Synthetic coding sequence
atgggcgccatggagatcaaccggaacatccggttcgccacctacactaaagaaaacggcagaacactcgtggtccaggacgagcccgttggaggcgatactccagccagttttaccccttactccaccgcgacggggcagactcctttggcaccggaggtgggaggcgccgagaataaggaagccggtaaaactcttgaacaagttgggcaagggatagtggctagtgcggctgtggtgactacagcgagttccacccccaatacagttaggatttctgacacagggctagctgctggtacagtgcctgagaaacagaagggttcccgaagccaggcaagtggtgaaaatagccgcaactccatcctggcttcaagtggcttcggcgcaccgttgccctcctcatcgcagcccctcaccttcggttccggacgtagccagagcaacggagtccttgccacggagaacaaacccctcggtttctcatttgggtgttcatctgcacaggaagcacaaaaagacactgatttgagtaaaaatctcttctttcagtgcatgtcacagaccctacccactagtaactatttcacaactgtgtcagaatcattagctgatgattcctcatctcgggacagctttaagcaatccctggaatctttgtctagtgggctgtgcaaaggaaggagcgtgctcggcacggataccaagcccgggtccaaggccggctccagcgtcgaccggaaggttcctgcagagagcatgccgactctcactcctgcctttcctaggagcctgctcaacgcccgcactccggaaaaccatgaaaatctgttcctacaaccacccaaactctctcgggaggagccatctaatcccttcctcgcctttgtggagaaggtagagcattcaccctttagcagctttgcttctcaagcctcaggctctagtagtagcgcaactaccgtgacctccaaggtcgcccccagctggcctgagtcacattcttccgccgattcagctagcttggccaagaaaaagcctctgttcatcaccaccgacagttcaaagctggtgtccggagtgctgggctcagccctaacatctgggggcccatctctgtccgccatggggaatggcaggagttcctcccccactagctcactgacccagccaatcgagatgccaactttaagttcttctcccaccgaggaacggcctacggtcggtcccggccaacaagacaatcccctacttaagacgtttagtaatgtgttcggcaggcatagtggagggttcttgagttctcccgctgacttcagtcaggagaacaaggccccgtttgaggcagtaaagaggttttcacttgatgaaagatctcttgcttgtcggcaggatagcgattcgtctactaattctgacctcagtgacttaagtgattcagaggaacaattgcaggccaaaaccgggcttaagggcatccctgagcacctaatgggcaaacttggccctaatggcgagaggtcagccgaattgctgctgggaaaatctaagggcaaacaggctccgaagggtcgccctagaacggctccactgaaggtcggccagtctgtgttaaaagacgttagtaaagttaaaaagctgaagcagtccggtgagccgtttctgcaagacggctcctgcataaatgttgctccacatctccataagtgtagggagtgtcgcctagagcgataccgcaagttcaaggaacaggaacaggatgactccactgtggcgtgtagattttttcacttcaggcggctgatttttacaaggaagggcgtattgagagtcgaggggtttttgtccccacaacaatccgaccctgacgcgatgaacctctggatccctagctcatctttggccgagggcattgatctggaaacttccaagtacatcctggctaatgtgggagaccagttttgtcagttggtgatgtcggaaaaggaggctatgatgatggttgagccccaccaaaaagtggcatggaagagggcagtgagaggcgtcagagagatgtgtgacgtgtgcgaaacgactctgtttaacatccactgggtctgtaggaagtgtggattcggagtgtgcctggactgctataggctgagaaagtcccgccccagatccgaaacagaagaaatgggggatgaggaggtcttctcctggctgaaatgcgctaaaggacaaagccacgagccagagaacctcatgccgactcagataatccctggaactgctctgtacaatatcggagacatggtgcatgccgcaagaggaaaatggggcattaaagcgaattgcccttgtatctcccggcaaaacaaaagcgttttgcgcccagcggtgaccaatgggatgtctcaactgcctagcataaatccatctgcctccagtggtaatgaaaccacattttcaggtgggggagggcctgcacccgtgacaacacctgagccagatcatgttccaaaggcagacagcacagatatacgttctgaagagccactgaagaccgactcgtccgcaagtaattcaaacagcgagctcaaggctattcggccaccatgccctgacaccgccccacctagctctgctctgcactggctggcagatctagccacacagaaggcgaaggaagagaccaaggaggcgggatctcttagatctgtgttgaacaaggagtctcattctcccttcggactggactcctttaattcaacagccaaggtgagccccctcacaccaaagttgttcaactctctgctgctgggacccacagcatcgaacaacaagacggagggcagttccctgcgtgacctgttacactcggggccgggaaagctgccacagacacctctggataccgggatcccattcccccctgtttttagtacttcctctgcaggcgttaagtctaaggccagtctgcctaacttcttagaccacattatcgccagtgtcgttgagaataaaaagacatccgatgccagtaagagagcatgcaatctcacagacacacagaaggaagtcaaggagatggtgatgggcctcaatgtgttggatccccatacatctcattcatggctgtgtgacggtaggttactttgcttgcatgatcccagtaacaagaataactggaagatctttcgcgagtgctggaagcaggggcaaccggtcctggtgtccggcgtacacaaaaaattgaaaagtgagttgtggaagccagaggcgtttagtcaagagtttggagatcaggatgtcgacctcgtaaactgtaggaactgcgctattataagcgacgttaaggttcgggacttttgggacggatttgagatcatctgcaagcgattgagatccgaagatgggcagcccatggtgttgaagttgaaggattggccgcccggcgaggacttccgggatatgatgccgacccgcttcgaggaccttatggagaacctgcccctgccggagtatacaaaaagggacggccgattaaatctggcctcacgattgccttcctacttcgtgaggccagatctggggcccaagatgtacaatgcctacggcctaatcacggctgaggataggcgcgtgggtaccaccaacctccatttagacgtgtccgacgctgtcaacgtgatggtgtatgtcgggatccctataggcgagggcgcccatgacgaggaggttttgaagactattgatgagggagacgcagatgaggtgaccaagcaacgaatccatgatggaaaggagaagcctggagccctgtggcacatttatgccgcgaaggacgcagaaaagatcagggaactgctgagaaaagtaggggaggaacaaggacaggaaaatccacctgatcacgacccaatccacgaccaatcctggtacctggaccaaaccctgcgaaagcgcttatacgaggaatatggtgtgcagggctgggcaatagtgcaattcttgggagatgcagttttcatccccgccggagccccccaccaggttcataacctgtatagctgcatcaaagtagcagaggacttcgtatcccctgagcatgtcaagcattgcttccgccttacacaggagttccgacatctgtcaaacacccacacgaatcacgaagataagctccaagtcaagaacataatttaccacgcagtaaaggacgcagttggcaccttaaaagcccacgaatccaaactggccagatcgtag

SEQ ID NO: 193675 - DNA, 2382 bp, Artificial Sequence
  Description of Artificial Sequence: Synthetic coding sequence
atgaacctgtggatccccagcagcagcctggccgagggcatcgacttagagaccagcaagtacattttggcgaacgtcggagatcagttctgtcagctggtcatgtctgaaaaggaggccatgatgatggttgagccccatcagaaagttgcatggaaaagagcggtaagaggcgttagagagatgtgcgatgtgtgtgaaacaaccctctttaacattcactgggtgtgcaggaagtgtggctttggagtgtgtctcgattgctatagattacgaaaatctaggccaagatccgagacggaagaaatgggggatgaggaggttttctcttggctgaaatgtgcgaaaggacagtctcatgagcccgagaatctgatgcccacacagattattcccgggacggcactgtataacattggagacatggtgcacgccgcccgtggaaaatggggcattaaggctaactgtccctgcatctcacgtcagaacaagagtgtgctgcggccagccgtcacaaacggaatgtctcaactcccctccataaacccctctgcttcgtctggtaatgagacaaccttttccggaggtggcggccctgcacctgttaccactccagagcccgatcacgtccccaaagctgactcgacagatattaggagcgaggagccactgaagaccgattccagtgcctccaactccaactccgaactgaaagccatcagacccccgtgcccagatacagctccaccctcgtctgccctccactggttggctgaccttgctacacaaaaggccaaggaggaaaccaaagaagcaggcagtttgagatctgttttaaataaagagagtcattctccgttcggtctcgattccttcaattccacggccaaggtttctccactcactcctaaattgttcaactctttactccttggtcccaccgctagtaataataagacagagggcagctcattacgcgatctactgcattctgggcccggaaagctgccacaaacgccactggacaccggaatcccattccctcccgttttctctacgagtagtgccggcgtgaagtccaaggcatccctgcccaactttctggaccacattattgcgagtgttgtggagaacaaaaagacctctgacgcaagcaagagggcctgtaacttgacagacacccagaaggaagtaaaggagatggtgatgggattgaacgttctggacccacacacctcacattcttggctgtgcgacggcaggctgctgtgcttgcatgatccatcaaacaagaataactggaaaatttttagagagtgctggaaacaaggacagcctgtccttgtgtctggtgtccataagaaactcaagtcagagctgtggaagccggaagcctttagtcaagaattcggagatcaagatgtcgacttagtgaactgtcggaactgcgctattatcagtgacgtcaaggtccgggatttctgggacggatttgagatcatctgcaaacggctgcgctctgaggacgggcagcccatggttctcaaactgaaggactggccaccgggagaggatttccgtgacatgatgcccacccggtttgaggacttgatggagaacttgccactgcctgagtacactaaacgtgacggccgtcttaatctagcctctagactgccatcctacttcgttagacctgatctcggcccaaagatgtataacgcttacggcctgatcaccgccgaggaccgcagagttggtaccactaatctccatctggatgtttcagatgccgttaatgtcatggtgtatgtcggcatacccatcggggagggtgcccacgatgaggaggtactgaaaacaatcgatgagggcgatgccgacgaggtcaccaagcagaggattcacgatggtaaggagaagccaggcgcactttggcatatatacgccgccaaagacgccgaaaagatcagggagttactcaggaaggtaggcgaggaacaagggcaagaaaatccccccgaccacgaccccattcatgatcagtcatggtacctggatcaaactcttaggaagcgtctttatgaggagtacggcgtgcaaggatgggcgatcgtccagttcctgggtgacgccgtgttcatcccggccggagcgccccatcaggtacataatctctactcttgcataaaagtggctgaggatttcgtgtccccggagcacgtgaagcattgctttagactcacacaggaatttcgccacctgtccaatacgcatactaaccatgaggacaagctgcaggtgaaaaatataatttaccacgccgtaaaagacgccgtgggtactctaaaagcccatgagtctaaattagctcgaagctag

SEQ ID NO: 193676 - DNA, 4656 bp, Artificial Sequence
  Description of Artificial Sequence: Synthetic coding sequence
ggctggcggtggctgtacggcgtggtgagccaccaggacagcatcacaaggttgatggaagtgtctgttacagagagcggtgaaattaagagcgtcgacccgcgactcatccatgtgatgcttatggataactcggcgccacagagtgagggcggcaccctgaaagctgtcaagagtagtaaaggcaagaagaagcgtgagagcattgaggggaaggatggaaggcgacggaagtccgcaagtgactcaggctgtgaccctgcctccaagaagctgaaaggggatcgaggcgaagtggacagcaacggttccgacggcggtgaggcctcacgcgggccatggaaaggaggaaacgcttctggcgaaccaggcttagaccagagagccaagcagcctccaagtacattcgttccccaaatcaaccgaaatataaggttcgcaacgtacactaaggagaacgggagaacactggtggtgcaggatgaacccgtcggaggcgatacacctgccagtttcacaccttattccacagcaactgggcagaccccgctggccccggaagtgggaggtgccgaaaataaggaggcagggaaaactttggagcaggtggggcagggcatcgtagctagtgccgccgtggtaaccacagcgtcctccacccccaataccgttcgcatttccgatactgggttggctgcaggaaccgtgcccgagaagcaaaaggggtcacgttcccaggctagcggcgaaaactctagaaacagcatcctggcgagcagcggttttggcgcacccctgccgtccagctcgcagccactaacgtttggctccggccgcagtcagagcaatggggtgctcgccaccgagaataagcctttaggttttagcttcgggtgcagtagcgcccaggaggcccaaaaagatacggacctgagtaagaaccttttcttccagtgcatgagccagactcttccaacatctaattactttacaactgtatcggagagcctggcagatgatagcagtagtcgcgactcctttaagcaaagtctggagtcactgtccagtggcctatgcaaggggcgcagcgttctggggactgacacaaaaccgggcagcaaggctggaagcagtgtcgaccgtaaggttccggccgaatccatgcccaccctgacaccagccttccctcgctcccttttgaacgcccggacacccgagaatcacgagaacctcttcctgcagccaccaaagctgagccgcgaagagccttctaacccatttctagccttcgttgagaaagttgaacattccccctttagctccttcgcaagccaggcttccggttccagctctagcgccacaacggtgaccagcaaggttgccccctcctggcccgagagccactcctccgccgatagtgcatcactggctaaaaagaagcccctattcattactacggacagcagcaagctcgtgagtggggtcctggggtcagcgttgactagcggcgggcctagtcttagtgcaatgggtaacggcaggtcctcttctcccacctcatctctgacccagcctatagagatgcccactctcagcagctccccaaccgaagagcggcccacagtggggcctgggcaacaggacaatccacttctcaagaccttttctaatgtctttggccggcactctggcggatttctatcctccccggccgacttctcccaagagaataaggccccttttgaagctgtaaaacgtttttctttagacgagcgatccctcgcgtgcagacaagacagtgattcttctaccaatagcgacctgtcagatctgtcagatagtgaggagcaactgcaggcaaaaacaggcctaaaggggatcccagagcacctgatggggaaactgggcccaaatggggaaaggtccgccgagctgttgttgggaaagagtaaaggcaagcaggcgccaaagggaagacctcggactgcgccgcttaaagtgggacagtcggtgctgaaggatgtgtcaaaagtcaagaagctcaagcagtcaggagaaccttttcttcaagatggcagttgtatcaatgttgctcctcacctgcacaaatgccgcgaatgtcggctagagaggtaccgcaaattcaaagagcaggagcaagacgactccaccgtggcctgtcggttttttcactttcgcaggctgatattcactaggaaaggggtcctccgggtagagggctttctgagcccccaacagtctgatccggatgctatgaatctttggataccgagcagctccctggcggaaggtattgaccttgagacgtctaagtatatcctagcaaatgtaggcgatcagttttgtcagctggttatgagtgaaaaagaagccatgatgatggtggagccgcaccagaaagtggcctggaagagagcagttcggggggtgcgggaaatgtgcgacgtctgcgaaaccacccttttcaacatccactgggtgtgccgcaaatgtgggtttggtgtttgtcttgattgttatcggctcaggaagtcccgaccacgtagcgagaccgaggagatgggcgacgaggaggtgttttcctggttgaaatgtgccaaaggccagtcacacgaacccgaaaatctcatgcccactcagatcattccgggcactgcattgtacaatattggcgatatggtccatgcggcccgtgggaaatgggggataaaggccaactgcccctgcatttccaggcagaacaaatccgtccttagacctgctgtcaccaacgggatgtcacagctgcctagcatcaacccctctgccagtagcggaaacgaaacaacgttctctggagggggcggtccagcccctgttacgacacctgagcctgaccacgtgccaaaggctgattctacagatatccggtcggaagaaccattgaagactgactcatctgcttcaaatagcaacagtgagctaaaggccatccgacctccttgtccggatactgccccgccaagtagcgcactgcactggctggccgaccttgccacccagaaagccaaagaagagacgaaggaagccggctcccttagaagcgtgctcaataaagaaagccacagtccattcggtttggatagcttcaattctacggcaaaggtaagtccactcacccctaaactttttaatagcctgctcctcggccctacggcctcaaataacaaaactgaagggtcatcgctccgcgacctattgcacagtggtccaggcaagctgccccaaacacctttggatacagggattcctttccctccggtgttttccactagcagtgccggagtgaaaagcaaggcttcacttcccaattttcttgaccatataatcgcttccgtcgtggagaataaaaagacttctgatgcttccaagcgcgcctgcaacctcactgacacccagaaggaggtgaaggaaatggtgatgggactgaacgtcttagatccacacacatcccactcatggctatgcgatggtcgcttgttatgcctgcacgacccgagcaacaaaaataattggaagatctttagggagtgctggaaacaaggtcaacctgttctggtttctggagtgcacaagaaactcaagtccgaactttggaagccagaagcgttctctcaagaattcggcgaccaagatgtggacctggtgaattgtcgtaactgcgcgatcattagcgatgtcaaggttagagacttctgggacggatttgagatcatctgcaagcgcctccgcagcgaagacggacagccaatggttctaaagctaaaggattggcccccaggggaagatttcagagatatgatgccaaccaggtttgaggatctcatggagaacctgcccctgcctgagtatactaaaagagatggacgtctcaatttggcgagccgccttccgagttactttgtgagacctgacctgggaccgaaaatgtataacgcttatggattaatcactgcagaagatcgaagagtgggcaccactaacctgcaccttgacgtatccgacgctgttaatgtcatggtgtacgtgggcataccaatcggggaaggcgcgcacgacgaagaggtgctgaaaaccatcgatgagggggacgcggacgaagtcacaaagcagcggatacatgacgggaaggagaaaccaggtgcgttatggcatatctatgccgccaaggatgccgagaaaattcgggagctgctgcgcaaagtcggagaagaacaaggacaggagaatccaccagatcacgatcccatccacgatcagagctggtatttagaccagactttgcggaaacgactctacgaggagtatggagtgcagggatgggcaatcgtccagtttctgggagatgccgtgttcattcctgcaggcgcaccccaccaggttcataacctgtactcctgtattaaggtggccgaggacttcgtgtcccctgaacatgtcaagcattgcttcagattgactcaggagttcaggcacctgtccaatactcacaccaaccatgaggacaagcttcaggtgaaaaatatcatttaccacgcggtgaaggacgcagtcggaactctgaaagctcacgaaagtaaactggctagatcttag

SEQ ID NO: 193677 - DNA, 2148 bp, Artificial Sequence
  Description of Artificial Sequence: Synthetic coding sequence
atggccggcgtgggccccggcggctacgccgccgagttcgtgccccctccggaatgcccagtgttcgagccatcttgggaggaattcactgatcctctgtcattcatcggccgtatccgccctttggcagagaaaacggggatttgcaagatcaggcctcccaaggagtatgcactgagtggctggaatcttaacaacatgccagtgctcgaacagagcgtgctagcccatattaatgtggacatttccggaatgaaagtcccctggctatacgtgggcatgtgtttctcctcattctgttggcacattgaggatcactggtcgtacagcataaactatcttcactggggcgaaccaaagacttggtatggtgtcccttcccacgctgcggaacaacttgaggaagtaatgcgagagctcgctcccgagctttttgaatcgcaacctgaccttctgcatcagctggtgactattatgaacccaaacgtgttgatggagcatggagtgccagtgtacagaacaaatcagtgcgccggggagtttgttgtaacattcccgagagcctatcacagcggtttcaaccaaggttacaactttgccgaggctgtgaatttctgcacggctgactggctccctatcggtcgtcagtgtgtgaatcactaccgacgactcaggaggcactgtgtattctctcacgaggaactgatatttaaaatggctgctgacccggagtgccttgatgttgggctcgctgccatggtgtgcaaggagttaacccttatgacagaagaagagactaggctgcgagagtctgtggtgcaaatgggcgtcctgatgtccgaggaggaagtctttgagctcgttcctgacgacgaaaggcagtgtagcgcgtgccgcacgacctgcttcctgtcagccctcacctgcagttgcaatcccgaacgcctcgtttgtttgtaccacccaaccgacctatgcccctgtccaatgcagaagaagtgtctgcgatacaggtatcccttggaggacctgccatctctgctgtatggcgtcaaagtgagggcgcagagctatgatacctgggtatcaagagtgacagaggccctttcggcaaactttaaccataagaaagacttgatagagttgcgggtaatgcttgaggacgctgaggaccggaaatatccagaaaacgatctcttcagaaaactgcgtgatgcagtgaaggaggccgagacatgtgccagcgtggcccaactgctgctcagcaagaagcagaagcacaggcagtcccctgactccggaaggacacgtaccaagctgacagtggaggagctgaaagcttttgtgcagcagctcttcagcctgccttgcgtcatttctcaggcaagacaagtcaagaatcttctggatgacgtagaggagttccatgagagggcccaggaagccatgatggatgagacgcccgactctagtaaattacaaatgctcatcgacatgggaagcagtctgtacgttgagctgcccgaattgcccagattaaagcaggaattgcaacaggcacgctggctagatgaagttcgccttaccctgtctgaccctcaacaagtcacattggatgtcatgaaaaagttaatcgacagcggggtgggtctggcacctcatcacgctgtggaaaaagccatggcagagctgcaagagctccttaccgtttccgagagatgggaagagaaagccaaggtctgtttgcaggcccgaccccgccattctgtggcgtctcttgaatctatcgtaaacgaagccaagaacattcctgcatttctgccaaatgtcctcagcctcaaggaagctctgcagaaggcacgagaatggaccgccaaggtggaggcaatacaatcaggtagcaactatgcctacctagaacagttagaatccctttccgccaaaggcaggcccattccagtcaggctcgaagcgctaccgcaggtcgaatcccaggtggccgccgcaagagcatggcgcgaacgcacagggcgtactttcctcaaaaaaaattccagccatactctcctgcaagtgctcagccctcgcacagatatcggagtttatggctccggaaaaaacaggcgcaagaaagttaaggagctgtag

SEQ ID NO: 193678 - DNA, 4911 bp, Artificial Sequence
  Description of Artificial Sequence: Synthetic coding sequence
atggccggcgtgggccccggcggctacgccgccgagttcgtgccccctccagagtgcccagtttttgagccgtcttgggaggaatttacagatcctctctcattcattgggcgaatcaggccccttgccgaaaaaacagggatctgtaaaatccggcctccaaaggattggcagcctccttttgcttgtgaagtcaagtcgttcagatttactcccagggtgcagagattaaacgagctggaggccatgactagagtgagattagacttcttggatcaactggctaaattctgggagctccaggggtccacgttgaagattcccgtggtagagcgcaagatcctggacttgtacgctctaagcaagatcgtggcgagtaagggcggatttgaaatggtaacaaaagagaagaaatggagcaaggtgggttctagactaggctatttgccaggtaaaggtacgggaagcctgctgaagagccactacgaaaggattctgtacccatacgagctatttcagagtggcgtctctttgatgggcgtgcagatgccaaatctcgacctgaaggaaaaagtcgagcctgaggttctgagtaccgatacccaaaccagcccggaaccaggcacccggatgaacatcttacccaagcggacaagaagggtcaagacgcagagcgagtccggcgatgtgtcccggaacactgaactaaaaaaactgcagatttttggggcaggaccaaaagtagtgggtcttgcgatgggcacaaaagacaaagaagatgaggtcacacgcagacgcaaagtcaccaatagaagcgacgctttcaatatgcagatgcgccagagaaagggaacgctgtcagtgaatttcgtggatctgtacgtgtgtatgttttgtggccgcggcaacaacgaggacaaactgttgctctgtgacggatgcgatgattcctatcatactttttgtctgataccccctctccccgatgttccaaagggcgattggcgttgcccgaaatgtgtggccgaggagtgctccaagccccgcgaagccttcgggttcgaacaggcagtcagggaatataccctgcagtcctttggggaaatggccgataatttcaagtcggactacttcaacatgcctgtccatatggttcctaccgagttagttgaaaaagaattctggaggcttgtcagcagcatcgaggaggatgtgatcgttgagtacggggccgatatctcgtctaaggactttggcagcggattccccgtgaaggacgggaggaggaaaatcctgcccgaggaggaggagtacgccctgagcggctggaatctcaacaacatgccagttttggagcagtctgttctggcgcacattaacgtagatatcagcggaatgaaggttccctggctgtacgtcggaatgtgcttctcgtccttctgctggcacatcgaggaccactggtcgtattccattaattacctgcactggggagagcctaaaacctggtacggggttccatcccatgctgcagaacagctggaagaagtcatgcgggagctggccccggagttgttcgaaagtcagccagatctgctgcatcaactggtgactataatgaatcccaatgtattaatggaacatggagtgccagtataccgcactaatcagtgcgctggcgaatttgtggtgacattccctcgggcatatcactccggattcaaccaaggatacaattttgccgaggccgtcaacttttgtaccgctgactggctgcccattggccgccagtgcgtcaatcattaccggagactacgccggcactgcgtgttttcccacgaagagctgattttcaagatggctgctgaccctgagtgtcttgatgtcgggttggcggccatggtttgtaaggagttgacactgatgactgaggaggaaactcgcttgagagagtcagtcgtgcagatgggagtactgatgagcgaagaagaggtgtttgagctggtccccgatgacgaacgccagtgctcggcatgcaggactacgtgcttcttgtccgcactcacatgctcatgtaatcccgaacgcttagtctgcctatatcacccaaccgacttgtgcccttgccctatgcagaaaaaatgtttgcggtaccgctatccattggaagacctgccttccctgctttatggcgtgaaggtgcgtgctcagtcttacgacacctgggtttcccgagtgacagaagccttgtctgccaactttaatcataagaaggatctaatcgagcttcgcgtgatgctcgaggacgctgaagatcggaaatatccagaaaatgatctgtttcggaagctgagggatgctgtgaaggaagccgaaacctgtgcatccgtggctcaattgctcttgagcaagaagcaaaagcacagacaatcaccagactcgggccgcacccgtactaagctgacagttgaggagctaaaggcatttgtacagcaattgttcagtttaccctgtgtcattagtcaggctcggcaggtgaagaatctactggacgacgtggaagagttccacgagagggcccaggaggctatgatggacgagacccctgactcctctaagcttcaaatgctgattgacatgggcagttcattgtacgtcgaactgccagagttaccacggttgaagcaggaattgcagcaggctagatggctcgatgaagtgcgcctgactctgtccgatccacaacaagtgactctggatgttatgaaaaagctaattgacagtggcgtggggctggccccccaccacgccgtggagaaggcgatggcagagctccaagaactgcttaccgtctctgagagatgggaagaaaaagctaaggtttgccttcaggctcgccctaggcactcagtggcctccctggagtcgattgtgaacgaggcgaaaaacatccccgcctttctgccgaacgtgctgagtctgaaagaagctctacagaaggcaagagagtggaccgccaaggtagaggccatacagagcggctcgaattatgcttatttggaacagctggaatccttgtcggctaaggggcgccccatcccggttcgattggaggccctgccccaggtcgagagtcaggtagcagcggccagagcatggcgggagcgcacgggccggacctttctcaagaagaactcttcccacaccctgctgcaggtgctgtccccaaggacagacattggtgtatacggatctggtaagaatagacggaagaaagtaaaagagctgattgagaaagaaaaagagaaagatctggacctggaaccactctccgatctggaggaaggcctggaggagacgcgcgacacagcaatggtagtggcggtttttaaggaaagagaacagaaggagatcgaggcgatgcatagcctcagagctgctaacttagcgaaaatgaccatggtcgatcggatagaggaggtcaagttttgtatctgtaggaagaccgccagcgggttcatgcttcagtgtgagttatgcaaagattggttccataatagctgcgtgcctttgcccaagagctctagtcagaaaaaaggaagctcatggcaggccaaggaagttaagtttctgtgtcctctgtgtatgaggtcacggagacccaggctggaaaccatcctgagcttgctggtcagcctccaaaagcttcctgtgaggctgcccgagggcgaggccttgcagtgcctgacagagagagccatgagctggcaggacagagcccgtcaggcactggcaactgatgagctctcctctgctttggccaagctttcagtgctcagccagaggatggtcgagcaggcagcccgcgagaagactgagaagatcatctccgctgaattacagaaggccgccgccaatcctgacctccaggggcacttgccttccttccagcaatcagcattcaacagagtggtctccagcgtcagttcgtccccccgacagacaatggactatgacgatgaggagacagactccgacgaagatattcgggagacatatgggtatgatatgaaggatacggccagtgtgaagtcaagtagctctttagaacctaatctgttctgtgacgaagagattccgataaaaagcgaggaagtggtgacgcacatgtggactgcaccaagcttttgcgcagagcacgcctacagtagtgcctcaaagagttgtagccaggggtcctcaacgcctcggaagcaacccagaaagagccctttggtaccacggtcattggagccccccgttctggagctgtccccgggagcaaaggctcagctggaagaacttatgatggtgggagatcttctggaggtttccctcgatgagacacagcacatttggaggattcttcaggccacccatccgcccagcgaagatcgttttctgcacatcatggaggacgatagcatggaggaaaagcccctgaaagtgaaaggaaaagattccagcgagaagaagcgcaagaggaaactcgagaaggtcgaacagctattcggggaggggaagcagaaaagcaaagagctcaagaagatggacaaaccacgaaaaaagaagttgaagctaggagccgacaaatcgaaggaattgaataagttggcaaagaaactggccaaagaggaggagcggaagaaaaaaaaggaaaaagctgccgcagcaaaggtggagctcgtgaaagagtcaactgagaagaagcgggagaagaaagtcctggacatcccctcaaaatacgactggtccggagccgaggagagtgatgacgaaaacgccgtgtgcgccgcgcagaactgccagcgaccatgcaaggacaagggcgtggtgttcgtgactgaggaagagaagaacaaaaaatattag

SEQ ID NO: 193679 - DNA, 3150 bp, Artificial Sequence
  Description of Artificial Sequence: Synthetic coding sequence
atggccggcgtgggccccggcggctacgccgccgagttcgtgccccctcccgagtgtccggtgttcgaaccttcctgggaggaatttaccgacccactaagcttcatcggtaggattagaccgctggcagaaaagactgggatctgcaagatcaggccccccaaagattggcagccaccttttgcctgcgaagtcaaatctttcaggttcactcctcgcgtgcagcgcctgaacgagctggagattgtggcgtccaagggaggctttgaaatggttacaaaggaaaagaagtggtccaaggttgggtctagacttggatacctgcctggaaaaggaacaggatcactcctcaagtctcactatgagaggatcctctatccctatgagctcttccagtctggagtgtccctgatgggcgtacagatgcccaacctagatctcaaagagaaagtggagcccgaggttttgtcaactgacacacagacctcgcctgaacccggcacccgaatgaatatcctcccaaagcgtacaagacgggttaagacacagtccgagagcggagacgtctctaggaacacagagctgaaaaagttgcagatatttggtgccggcccaaaggtggtcggactggcgatgggtaccaaagacaaagaagacgaagtgacccggcggcggaaggttaccaaccggagcgacgcgttcaacatgcagatgcgccagaggaagggtactctgtctgtcaattttgtagacctgtatgtgtgcatgttttgtgggcgcggaaataacgaggacaagttgcttttgtgcgatggctgtgacgattcttaccataccttctgcctgatccctccccttccagacgttccaaagggggactggcgatgtcccaagtgcgtggccgaggaatgtagcaagccacgggaagccttcggatttgagcaggccgtgcgtgagtacactttgcaatcgttcggagaaatggccgacaattttaagagcgactactttaatatgcccgtgcacatggttcccactgaactagttgaaaaggaattctggcggctggtcagctctatcgaagaagacgtgatagtcgagtacggcgctgacatatcttcaaaggactttggtagcgggtttcctgtaaaagatggtaggcggaagattctgccggaggaggaggaatacgcactgagtggatggaacttgaataatatgcccgtactggagcagagcgttctggcccacatcaacgtggacatcagcggcatgaaagttccctggctttacgtgggaatgtgctttagttctttttgctggcacatagaagatcactggagttacagtatcaactacctccattggggagagccaaagacttggtatggagtgcccagccacgcggctgagcaattggaagaagtgatgcgtgagttagcacccgaactcttcgagagccaacccgatctcctgcaccagctggttaccattatgaacccaaacgtcctgatggagcacggcgtgccggtttataggactaatcagtgcgctggtgaatttgtggtcacttttcctagagcctaccacagcgggtttaatcagggctacaatttcgccgaagcagtgaacttttgcacagctgactggctccctatcggccgccagtgcgttaaccactatcgccgtttacgacgccattgtgtgttcagtcacgaggaattaatttttaaaatggcagccgatcccgagtgtctcgacgtcggactggcagctatggtctgtaaagaattgaccctgatgaccgaggaagaaacccgtctgagagagtccgtggtccagatgggagttctgatgagtgaggaagaggttttcgagctggtgcctgacgacgaacggcagtgtagcgcttgtagaaccacatgcttcctctcagccctaacatgttcttgcaatcccgaacgcctggtgtgcctttatcacccgacagacctgtgtccttgtcctatgcaaaaaaagtgtcttcgctaccgctatccgttggaggaccttccctccctgctctatggagtcaaagttagagcccagtcctacgacacctgggtatcgagggtgactgaagccctgtcagccaacttcaaccataagaaggatctgatcgaactaagagttatgctggaggatgcagaggaccggaaatatccagaaaacgatctttttcggaaacttagggacgctgtaaaagaggcagagacctgtgctagcgtcgcccagcttttactaagtaagaaacagaaacatcggcagagccctgactctggccggaccaggacaaagcttaccgtggaggaactgaaggcatttgtccagcaactattttcgttaccttgcgtcattagtcaagccagacaggtcaaaaatctgctggacgacgtggaggaatttcatgaacgggcccaggaggcgatgatggacgagactccagactcgtctaaactgcagatgttaatagacatgggctcttcattgtatgtggaactgccagaactgccccgcctgaagcaggaactacagcaagcaagatggctggatgaggttagactgaccctgtctgatccgcagcaggtcaccctagatgtgatgaagaaacttatcgactccggcgtgggactggccccacaccacgccgtggagaaagccatggctgaactccaggaactactcaccgtcagcgaaaggtgggaggagaaagctaaggtttgtctccaggcacgtccgcggcacagcgtggctagtttggagtcaatagtgaacgaggctaaaaatatcccagcgtttctgccaaacgttctcagtctcaaagaggccctccagaaggcgcgcgagtggacagcaaaagtggaggccattcagtccggatctaattatgcatatctggaacagctggaatctctttccgccaagggcagacccattcccgttcgactcgaagcgctccctcaagttgagtctcaggttgccgccgcacgcgcttggcgcgaacggaccggcagaacatttcttaagaaaaattcgagccacactctcctgcaggtcctttctccaaggacggacataggggtgtacggatcgggtaaaaatagacgctag

SEQ ID NO: 193680 - DNA, 5073 bp, Artificial Sequence
  Description of Artificial Sequence: Synthetic coding sequence
atggccggcgtgggccccggcggctacgccgccgagttcgtgcccccaccagagtgtcctgtatttgagccttcctgggaggagtttaccgatccactatctttcataggcaggattagaccactggcagaaaagaccggaatatgtaagattcgaccccctaaggactggcaaccgccctttgcatgcgaggtgaagtcatttcgctttactccacgggtccagcggctaaacgagctcgaagcaatgacaagagtcagactcgatttcctcgatcagctggccaagttctgggagctgcaagggtctactctgaagatcccagtggtggagcgtaagatcttggacctctatgccctgtcaaaaattgttgcctcaaagggaggatttgagatggtgaccaaggaaaagaagtggagcaaagtcggctcacgattggggtacctgccaggaaagggaaccggctccctgctgaagtcccactacgagcgcatcctgtacccttacgaattgtttcagtccggcgtctccctgatgggcgtgcagatgccaaatctcgatcttaaggaaaaggttgaacctgaagtgctctccactgatacacaaacaagccctgagccggggacacgcatgaacatcctgccaaagcggacacggcgtgtgaaaactcagtctgagagcggggacgtgtccagaaacacggaactgaagaaactccagatcttcggggcggggcctaaagtcgtgggattagcaatgggcacgaaggataaagaagatgaggtgacccggaggaggaaggtaacgaacaggtcggacgcattcaatatgcagatgcgtcagaggaaagggaccctatcagttaacttcgttgacctgtacgtgtgtatgttttgtggccgaggaaataacgaggataaactgctgctttgcgatggctgtgacgatagttaccacacgttctgcctcatcccccccttgccagacgtccctaaaggggactggaggtgccctaagtgtgtggccgaggaatgctctaaaccacgtgaagccttcggcttcgagcaggccgttcgggaatacaccctgcagtctttcggggaaatggctgataattttaagtcagactactttaatatgccagtgcacatggtgcctaccgagctggtcgaaaaggaattttggcgtctcgtgtccagcattgaggaggacgtgatcgtcgagtacggagctgatatctcaagtaaggattttggcagtgggttccccgtgaaggacgggcgaagaaagatactgcctgaagaagaagagtatgccctgagtgggtggaacctgaataatatgccagtcctcgagcagagtgttctggctcacataaacgttgacatcagcggaatgaaggtcccctggctttacgtggggatgtgcttctcctcgttctgctggcacattgaagaccattggagctacagtatcaattacctgcactggggggagccaaaaacatggtatggggtcccatcacacgctgccgagcaactggaagaagtgatgcgagagctggcacctgagctctttgaaagccagccagacttgctacatcagctcgtgacaatcatgaaccctaacgtactgatggaacatggcgtcccagtgtacaggacaaatcaatgcgcgggcgagttcgtcgtcaccttcccacgagcatatcacagtggctttaaccagggctataatttcgctgaggccgtgaacttctgtactgccgactggctgcccattggccggcagtgtgtgaatcattaccggcggctgcgccggcactgtgtgttctctcacgaggagcttatcttcaaaatggcagccgaccctgagtgcctggacgtgggactggcagccatggtgtgcaaggagctaaccctgatgactgaggaggaaacccgattgagagagagcgtggttcagatgggtgtgctgatgtctgaggaagaagtgttcgaactggttccagacgatgaacgacagtgtagcgcgtgtaggaccacctgtttcctgtccgccctgacatgtagttgcaaccccgaacgtctggtctgtctctatcatccaacggatctctgcccgtgtccaatgcagaagaagtgtctgcggtatagataccccctcgaagacctgccctcactgctctacggagtcaaagtgcgagcacaatcttatgacacctgggtgagcagggttacagaagctctgtcagccaactttaaccacaagaaggacttgattgaattaagagtaatgttagaggacgctgaagatcgcaagtatcctgagaacgacctgttccggaagctgcgcgacgctgttaaggaggctgaaacttgcgcctctgttgcccagttactactatccaagaaacaaaagcataggcagtccccagacagcggacggacaaggaccaaactaacagtggaggagctgaaagcctttgtccagcagctgttcagcttgccatgtgtgatcagtcaggcacggcaggttaagaatttgttagatgacgtggaggaattccacgagagagctcaggaagcaatgatggatgaaacccccgacagttctaaactgcagatgctcattgacatgggcagctccctgtacgtggaactacctgagctcccccggctgaagcaggaactccagcaggcgaggtggctggacgaggtgagactgactctgtctgacccccagcaagtgaccctagacgtgatgaaaaaacttatcgactctggcgtcggtctcgccccccatcatgctgtcgaaaaggctatggccgaactgcaggagttgctaaccgtatctgagaggtgggaggagaaggcaaaggtatgcctgcaagctagacctcggcattctgtggcaagcctcgaatctatagtaaatgaggcgaagaacataccagcctttcttcctaatgtcctgagtcttaaagaagcccttcaaaaagcgcgagaatggactgccaaagtggaggctatacagtccggaagcaattatgcgtacctagagcagctagaaagcctaagtgctaaggggaggcccattcccgtgcgcttggaagctctgccgcaagttgaaagccaggtggccgcggcgcgagcttggcgggaacgcacggggcgcacctttctgaaaaagaattcctctcacaccctgctccaggttttatccccaaggactgacatcggggtgtatggcagtggcaaaaacaggcgcaaaaaagtcaaagagctgattgagaaggagaaggagaaggatctggacttggaacctctgtcggacctcgaggaaggactggaggaaactcgagataccgccatggtggttgcagtttttaaggagcgggagcagaaagagatcgaagctatgcatagcctgcgggctgctaatcttgcaaagatgaccatggtggataggattgaagaagtgaaattttgtatctgcaggaaaactgccagtggatttatgctgcaatgcgagctgtgtaaggattggttccacaattcgtgtgtaccccttcctaagagctcatctcagaaaaagggcagcagttggcaggctaaagaagtgaaattcttgtgtccactttgtatgagaagcagacgcccacgcctggaaactattttatccctgcttgtttctttgcagaagcttcccgttcggttgcctgagggcgaggccctgcaatgcttgaccgagagggccatgagctggcaggaccgcgcgcgtcaggcattagccacagatgagctttcatcagcattggccaagctgtcagtgttgtctcagaggatggttgaacaggccgcccgggagaagacggaaaagataatttctgccgagttgcagaaggcagcagctaacccagacctacaagggcatttacccagcttccaacagtcagccttcaatcgggtagttagctccgtgtccagctcacctagacagaccatggactacgacgatgaagaaaccgattccgatgaggatatcagggagacctatggctatgatatgaaagacaccgctagcgtaaaaagtagctcatctctggagcctaatctattctgcgatgaagagattcctatcaaatcagaagaggtggtgactcatatgtggaccgctccaagcttctgcgctgagcatgcatactccagtgcttctaaatcatgcagtcaaggttcttccaccccacgaaaacaaccccgcaaatctccactcgtcccgagaagcttagagccacccgtactggaactctcgcccggcgctaaggcgcagcttgaggaactcatgatggtgggcgatctgctggaggtctcgcttgatgagacacagcacatttggcggatcctacaggcaactcacccgccatcagaagatcgctttctgcatatcatggaggatgattctatggaggagaaaccgttgaaggtaaaagggaaggattcttcggagaaaaaacgaaaaaggaaactcgagaaagtcgagcagctattcggggagggcaagcagaagtcaaaggagctgaagaagatggataaaccccgaaagaaaaagttgaaacttggagctgacaagagtaaggagctgaataagctggccaagaagctggctaaagaggaagaaaggaaaaagaaaaaggaaaaggccgccgcagctaaggtggagcttgttaaggaatccaccgagaagaagagagaaaagaaagtgctggatattcctagtaagtatgactggtctggagctgaggagtcagacgatgaaaacgcggtgtgtgccgctcaaaactgccagagaccttgcaaggataaggtagattgggtccagtgtgatggcggatgcgatgaatggtttcatcaagtgtgcgtaggggtttctcctgagatggctgaaaatgaggactatatttgcattaactgtgccaaaaagcagggcccggtttcgcctggtcccgctcctcctccctcattcataatgagctataaattgcctatggaggacctcaaggaaaccagctag

SEQ ID NO: 193681 - DNA, 3828 bp, Artificial Sequence
  Description of Artificial Sequence: Synthetic coding sequence
atgggcttcgcccccggcaaggccgtgggcagccacatccggggccattatgagaggatcttgaatccatacaatctgttcctgtcaggagatagtctgaggtgtttacagaaacccaacctcaccaccgatactaaggacaaggaatataaaccacacgacatacctcaacgccagtccgtgcagcctagcgaaacctgtccaccggcacgaagggctaagagaatgcgggccgaggcgatgaatatcaagatcgagcctgaggagacaacggaagcccggactcacaatctgcgacgccgtatgggatgccccacccccaagtgtgagaacgagaaggaaatgaagtcttcaatcaaacaagagccaatcgagcggaaggactatatcgttgagaacgaaaaggaaaaaccgaagtcgaggagcaaaaaagccactaatgcagtggatctttatgtttgtctgctgtgcggctccggaaacgatgaggatagattgcttctgtgtgatggctgcgatgattcttatcacacattttgccttattcctcctttgcatgacgtccccaaaggcgattggagatgcccgaaatgcttggcacaggagtgttctaaacctcaggaagcgtttgggttcgaacaggctgccagagattacacccttcgcaccttcggcgagatggcggacgccttcaagtctgactatttcaacatgcctgtgcatatggtgcctactgaactggtagagaaagagttctggaggctggtcagtactatcgaggaagacgttaccgtggaatatggggctgatatcgcctcaaaggagttcggaagtggcttccccgtccgtgacggaaaaatcaagttatcacctgaggaagaagagtatcttgatagcggatggaatcttaataacatgcccgtgatggagcagtctgtcctcgcccacatcaccgcggatatttgtgggatgaaactgccttggctctatgtgggcatgtgtttcagcagtttttgttggcacatagaggatcattggagctacagtataaattatctgcattggggcgagccaaagacttggtacggagtgccgggctacgccgccgagcaattagagaatgtcatgaagaagttggcccccgagctgttcgtctctcagccagatctgctccatcaactggttacaatcatgaaccctaacactctgatgacccacgaggttcctgtgtatagaacgaatcagtgcgccggcgagttcgtgatcacattcccaagagcctaccactctggttttaaccagggcttcaacttcgctgaggcagttaacttttgtacagtcgattggctgccactgggaaggcagtgcgtggagcattatagactgctgcaccgatactgtgttttcagccacgatgagatgatttgtaagatggcatctaaagcggatgtgctggatgtggtggtggctagcaccgtccagaaggatatggccattatgatcgaagatgaaaaggcacttagagagactgtgcgtaaactaggcgttatagatagcgagcgaatggactttgaattactccctgatgatgagaggcagtgcgttaaatgtaagaccacctgttttatgagtgccatcagctgcagctgcaagcccggcctcctcgtatgcttgcaccatgtaaaggagctctgctcctgccctccctataagtacaagctgcggtatcgttatacattggacgacctgtatccaatgatgaatgcattgaagctgcgcgcagagagctacaatgaatgggctttgaacgttaatgaggccctggaggccaaaattaacaagaagaagtccctcgtgagcttcaaggccctgattgaagagtccgaaatgaagaagttccctgacaacgacctgctgcgtcacctcagacttgtcacacaggatgctgagaaatgtgctagcgtcgcacagcaactgctcaacggcaagcgtcagacaagatatcgatctgggggtggaaagtcccagaatcagctgaccgttaatgagctacgacagttcgtcacccagctgtacgctctgccctgcgtgctcagccaaaccccgttactgaaggacttgttgaaccgagtggaggactttcagcaacactctcaaaaacttctttcagaggaaacaccgtcagccgctgaacttcaggatctgctggacgtgtctttcgagttcgatgtcgaacttccacaactcgcagagatgcgcattcggcttgaacaggctaggtggctggaggaggtccagcaagcctgcctagatcctagctccctcacacttgacgacatgaggcggttgattgatctcggtgtcggactggccccttacagcgccgtagagaaggcgatggctcgtctgcaggagctgctcactgtgagcgaacattgggatgacaaggccaaaagtcttctcaaagctagacctaggcattccctaaatagtttggccaccgccgtgaaagagatcgaagagattccagcgtacttgccaaacggagccgcacttaaggacagcgtccagagggctcgcgactggttacaagatgttgaaggcctacaggcgggtggacgcgtcccagtgttggacactctaattgaactcgtgacgaggggcaggagtatcccagtgcatctgaacagccttcctcggctagagaccctggttgccgaagtccaggcatggaaggagtgtgccgttaacacctttctcacagaaaactcaccgtattccctgctggaggtcttatgccctcggtgcgatataggcctgctgggcctgaaacggaaacagaggaagctcaaggagccactgcccaacgggaaaaaaaagtctactaaactggagtctctgtctgacttggaaagggcacttactgagagcaaggaaaccgcctctgcaatggcaacgctcggcgaggcccgactcagggaaatggaggccctgcagtccctccgcttggcaaacgagggcaagctcttgtcccctctccaggatgtagatatcaagatatgtttgtgccagaaggcaccggccgccccgatgattcagtgtgaactgtgccgagacgcattccacaccagttgcgtcgccgtcccaagcatctcccagggcctaagaatctggctctgcccacactgtcggcgctcggagaaacccccactcgagaaaattttaccgttgctcgcctcattgcagagaatcagggtcagattgccagaaggagatgccctgaggtacatgatcgagcggacagtaaactggcagcatagggcccagcagcttctgtccagcgggaatcttaagtttgtacaagatcgcgtggggagtgggctcctgtactccaggtggcaagccagcgcagggcaggtcagcgatacgaacaaagtcagccagccccccggaacaacttctttctcactgcccgatgattgggataatcgaaccagttacctgcactcccccttttcgacaggtagaagctgcattcccctgcacggggtttccccagaagtcaatgagttactgatggaggcccagctcctgcaggtatcactgccagaaatccaggagctctaccagaccttactggccaagccttcccccgcccagcaaaccgaccgaagctcacctgtacgcccatctagtgagaaaaacgattgctgtcgtggcaagcgcgacggtattaattcattagagaggaagctgaagagaagattggagcgcgagggcttgagctctgaacgctgggaaagagtgaagaaaatgcgtactccctag

SEQ ID NO: 193682 - DNA, 4743 bp, Artificial Sequence
  Description of Artificial Sequence: Synthetic coding sequence
atggaggccgccaccaccctgcaccccggcccccggcccgccctgcctctcggcgggcctgggccgctcggagagtttctaccaccacccgagtgccctgtgtttgagcctagttgggaggaatttgcagacccatttgccttcatccataaaatcagaccaatagccgagcagacgggtatctgcaaagttaggccgccacccgattggcagccaccgttcgcttgtgacgtggacaagttacattttacaccccgtatccaacgtctgaatgagcttgaggctcagacacgcgtcaagctgaacttcttagatcagattgctaagtactgggagttacaaggctccacactgaaaattccccacgttgaacgtaaaatccttgatctgtttcagctcaataagctagtggccgaagaaggtggcttcgctgtggtatgcaaagacaggaagtggactaaaattgccacaaagatgggattcgcaccggggaaggccgtgggttcacacatccgtggccattatgagcgtatcctgaacccctacaacctttttcttagcggggacagtctgcgctgcctccagaagccaaatctcacgacggatactaaagataaggaatacaaacctcacgacatacctcaacggcagagtgtccagccatcagagacttgtccccccgctagaagagcaaaacggatgcgcgcagaaagacagagcctggctgtactccctcgcctggagtgctccggcgcgattctggcccactgtaaccttagactgctggactcttccaattcttcggcatcagcctctcaagctatgaatataaaaattgaacccgaggagactaccgaggcaaggactcacaacctccgaagacgtatgggctgtcctactcccaagtgcgagaatgagaaagagatgaaatccagcataaaacaggagccgattgaaaggaaagattatatagtggagaacgaaaaggaaaagcctaaatcacggtcgaagaaagcaactaatgctgtcgatctctatgtttgcctgttatgtggtagcggcaatgatgaagacagactgttgttgtgcgacggctgtgacgattcataccacactttctgcttgataccacccctgcacgacgtgcctaaaggggactggcgatgtcctaagtgtctggcccaggagtgttccaagccccaggaggccttcggcttcgagcaagccgcaagagactatactctccgaacttttggggagatggcagacgcctttaagtcagactacttcaacatgcccgtacacatggtccccaccgaactggtggagaaagagttctggaggctggtgagcactatcgaggaagacgttacggtggagtacggcgcggatatcgcgtcgaaggagtttggcagcgggttcccggtcagggatggtaaaatcaagttaagccccgaggaggaggagtacctggactccggttggaacttaaacaacatgcctgtaatggagcagagtgtcctggctcatataacagccgatatctgtggtatgaaactgccctggctttacgtgggaatgtgctttagttccttctgttggcacatagaagaccattggtcatacagcatcaactatcttcactggggggagcccaagacctggtatggcgtgcccgggtatgcagccgagcagctcgagaatgtgatgaaaaagcttgctcccgaactgttcgtctctcagccagatttgctccaccagctcgtgacaatcatgaatcctaacacactgatgacccacgaggtccctgtctacagaactaatcagtgtgctggcgagttcgtgatcacatttccccgggcttatcacagtggttttaatcagggttttaatttcgccgaagccgtaaatttctgcacagtggactggctgcccctggggcggcagtgtgtggagcactataggctgctgcaccgctactgcgtattcagccatgacgaaatgatatgtaagatggcgagcaaagctgacgtcctggacgtcgtcgtcgcatcaacagtgcagaaagacatggccataatgatcgaggatgagaaggctctcagggaaacagttagaaagctcggagtgatcgacagcgagcgtatggacttcgagttgctccccgacgacgaacgacagtgcgtcaagtgcaaaactacctgttttatgagcgccatctcctgctcttgcaaacctggcttgctggtctgcctacaccacgtgaaagagctgtgcagctgccctccatataagtacaaactcaggtatcggtacacgctggatgacctgtacccgatgatgaacgccttgaaactgagagcagagtcctacaacgagtgggcccttaacgtgaacgaggccctggaggctaagattaataagaagaaatctctggtttcctttaaagcattaattgaagaaagcgaaatgaagaagtttcctgacaatgatctgctgcggcatctgcggttagtgacccaggatgccgagaaatgcgcatctgtggcccagcagctacttaacggaaagcggcagactaggtaccgaagcggcggtggaaagtcccagaaccaactcacagtcaatgagctccgacaatttgttacacagctttatgcactgccttgcgtgttgagccagacccctctgctgaaggatcttctgaacagagtcgaggatttccagcagcactcacagaagcttctctctgaggagacaccttccgcggccgaactgcaggatctgctggatgtctcgtttgaatttgatgtggagctgccacagcttgcggagatgaggatacgcttagagcaggctcgatggttggaagaagttcaacaggcatgtctcgatccctcatcactgaccctcgacgacatgagacgactgatcgacctaggagtaggactcgccccttatagtgcagtcgaaaaagccatggcgcgactacaggagctgttgactgtgtccgagcactgggacgataaagccaaatctctgcttaaagctcggccccgtcacagtctcaacagccttgccacggccgtgaaggagatcgaagaaatccccgcctaccttcctaacggggccgcattgaaggacagcgttcagcgagcacgcgactggcttcaggatgtggagggactgcaggccggcgggagagtgcccgtgctggatacgcttatcgagttggtgacccgcgggcggagcataccagtgcacctgaatagtctacctcgcctcgagacgctggtggcggaagtgcaggcttggaaggagtgtgcagtgaacacttttctgactgagaattctccctacagcctgctagaggtgctgtgtccacgctgtgacattggtctgctggggctaaaacggaagcagcggaagctgaaggaacctctccccaatggaaaaaagaaatccactaagctggaatcgttatctgacttagagcgagctctgactgagagtaaagagaccgcctctgccatggctaccttgggggaagctcggctgagggaaatggaagccctgcagtcactgcgcctcgccaatgagggtaaactgttgtctccattgcaggacgttgatatcaagatatgtttgtgccaaaaagcccctgccgctcccatgatacaatgcgaactgtgcagggacgcattccacacctcttgtgtcgccgtgccctccatcagccaggggctgcgaatctggctctgtccacattgtcgtaggagcgagaaacctccactcgaaaagatcctgcccctgctcgcatccctccagagaatccgcgtaaggcttcccgaaggcgatgctctccggtacatgatagaaagaacggtaaattggcagcacagggcccagcaactgctgtcttccgggaacctcaagttcgttcaggacagagtcggctccggcctcctatatagccgctggcaagctagcgctgggcaagtgagcgacacaaacaaagtatcccagccccctggaaccaccagcttctccctgccagatgactgggacaaccgcaccagctacctgcattctccattcagcaccggtaggagctgtatccccctccacggcgtttccccagaggtcaatgagctgctcatggaagctcagctgttgcaagtgtcattgcccgagattcaggagctctaccagaccctgctcgccaagccttcccctgcacagcagaccgataggtcgagccctgtccgaccctccagcgaaaagaacgactgctgtaggggcaagagagatggtataaactctctggaacgaaaacttaagcggaggcttgaaagggagggactgtctagtgagcggtgggagagggtaaaaaagatgcggactccaaaaaagaagaagataaagctcagtcacccaaaggacatgaataacttcaaactcgagcgcgagcgcagctatgagcttgtgagaagcgcagagactcatagcttgccaagcgatactagctactcggaacaggaagacagcgaggacgaagacgccatctgtcctgcagtgagttgtctgcagcccgagggcgacgaggtcgattgggttcagtgtgacggatcatgtaatcagtggttccatcaggtgtgcgtgggtgtatcccccgaaatggctgaaaaagaggactacatctgcgtgcgctgcacagtaaaggacgcacccagcaggaagtag

SEQ ID NO: 193683 - DNA, 4635 bp, Artificial Sequence
  Description of Artificial Sequence: Synthetic coding sequence
atggaggccgccaccaccctgcaccccggcccccggcccgccctgccattaggaggccctggcccactaggagagtttctaccgccacctgagtgtcccgtctttgaaccttcttgggaggaattcgcagatccctttgcatttattcataagatcagaccaattgctgagcagacaggtatatgcaaagtgcgtccgcctccggattggcagccccccttcgcatgcgacgtcgacaaactgcattttaccccccgcattcagcggcttaacgagctggaagcgcagactcgcgttaaattgaatttccttgaccagattgcaaagtattgggaactgcagggaagtaccctcaaaatcccacacgtggagcgcaagatcctggacctgttccagctcaacaaattagtggcggaggaagggggtttcgctgtcgtgtgcaaagaccgcaaatggaccaagattgctaccaagatggggtttgcccccgggaaggccgtcggatcacacatccggggtcattatgagcgcattctgaacccctacaacttgtttctgtcaggggacagcctgcggtgcctacagaagccaaatctaacaacagacaccaaagacaaagagtataaacctcacgacatccctcagaggcagtcagttcagccaagcgagacctgcccgccagctaggagagcaaagcggatgagggctgaggcaatgaacatcaaaattgaaccggaggaaaccaccgaggccagaacgcataacctccgccggaggatgggctgtccaactccaaaatgcgaaaatgagaaagagatgaaatctagcattaaacaggaacccatagaacgtaaagattatatcgtggaaaacgagaaggagaagcccaagtcgaggagcaagaaagctacaaatgcagtggacctttacgtatgcctcctttgcggcagtggcaatgatgaagacaggctgctgctgtgcgatgggtgtgacgatagttatcacactttctgcctgattcccccgttacacgatgtgccgaagggcgactggcggtgccccaagtgtctcgcacaggagtgtagtaaaccgcaagaagccttcggctttgaacaggctgcacgggattatactctgagaacttttggggagatggccgacgcctttaagagtgactacttcaatatgcccgtgcatatggtgcccaccgagctcgttgaaaaagagttctggagactggtgtctacaatagaggaagatgtaaccgttgagtatggtgcggacatcgcttcgaaggaatttggctccggctttccggtgcgggatggcaaaatcaagctatcccctgaggaggaagagtatctggattctggctggaacctgaacaacatgccagtgatggaacagtccgttctcgcccacattacagcggacatttgcggcatgaaactcccctggctgtatgtcgggatgtgcttctcctcattttgctggcatatcgaggatcattggtcttattccattaattatctgcattggggtgaaccaaagacctggtacggggtcccgggttacgcggccgagcaactggaaaacgtgatgaaaaagttggcacccgaactttttgtgtcccagccggatcttttacaccagttagtaaccattatgaacccaaacaccctgatgacccatgaggtgccagtctataggacaaaccagtgcgctggagagtttgttatcacctttccccgggcctatcactctgggtttaaccaaggttttaattttgctgaggcagttaatttttgtaccgttgactggctgccactagggcgccaatgtgttgagcattaccgactcctacacagatattgtgttttttctcacgacgaaatgatttgcaagatggcatctaaggccgacgtcctcgacgtggtcgtggcctccactgtgcagaaggatatggccattatgattgaagacgagaaagccctgcgcgagaccgtgagaaagttgggggtaatcgattccgagcgaatggacttcgagttactccccgatgatgaacgtcagtgcgtcaagtgcaaaacgacgtgctttatgtctgcaatctcctgttcctgtaagcctggtttgctggtctgcctgcaccacgtaaaggagctatgttcctgtccaccttacaagtacaaactacgttacaggtatactcttgacgacttatacccgatgatgaacgcgctgaagttgcgtgcggaatcctataatgaatgggctctcaacgtgaatgaggccctcgaagctaagataaacaagaagaagtcactcgtgtcattcaaggcgcttattgaggaatcggagatgaagaaatttccagataacgacctgcttagacacctcagattggtaactcaagatgctgagaagtgcgcgagcgtggcccagcagttgctgaatggcaagcgccagacaagatatcgaagcggcggcgggaagtcccagaaccagctcactgttaacgaactgaggcaatttgtcacacagttatatgcgctcccatgtgtacttagccagactcccctccttaaggacctcctgaacagagtggaagacttccaacagcactcacaaaagttgcttagcgaagagactccttctgctgctgagctgcaggatctactcgatgtctccttcgagttcgacgtggagctccctcagctggccgaaatgcggatccgcctcgagcaggcccggtggcttgaggaagtccaacaagcatgtctggatccctcaagcttgacattggatgatatgcgtaggttaatcgacctgggtgttggtcttgctccctatagtgccgtagaaaaggctatggcccggctccaggaactgctaacagtgagcgagcattgggatgacaaggcgaaatctctacttaaagcaagaccccggcattctctcaacagtctggcaacagctgtaaaggaaattgaggagatcccggcatacttacccaatggcgcagcactgaaagacagcgttcagagagctcgggactggttgcaggacgtagagggcctgcaggccggtggccgggtacctgtgctggataccctcattgagcttgtgacgaggggccggtccattcctgtgcatcttaactctctacctaggttggaaaccctggtggctgaggtccaagcgtggaaagaatgtgccgtgaatacctttttaactgaaaactctccatattcactgctcgaagtgctgtgtcctaggtgcgatattgggcttctcggactcaaaagaaagcaaaggaaactgaaagagccactccccaatggtaaaaagaaatccaccaaactcgagtctctgagcgatcttgagagggcgttaacagaatcaaaagaaaccgcctctgccatggcaaccctaggagaggctagactgagagaaatggaagccttgcagtctctccggctggccaatgaagggaagctgctctccccgctccaggacgtggatatcaagatttgtctctgtcagaaagccccggccgctccaatgatccagtgtgagctgtgccgcgacgcatttcacacttcttgcgtcgccgtacctagcatatcccagggcttgagaatatggctgtgcccacactgcagacgctctgagaaaccccctcttgaaaagatcctacctctgttggcatcactccagcggatccgggtcagactcccggagggcgacgcactccggtacatgatagagcgcacagtcaattggcagcacagagctcaacagcttctttccagcggaaacctcaagtttgtgcaggaccgggtgggatctggcctgctgtactccagatggcaagctagtgctgggcaggtcagtgatacgaataaagtgtcccaacccccagggactaccagctttagtctgcccgacgactgggataaccgcacgagctacttgcattcccccttctcaacgggaaggagctgcatccctctgcacggcgtgagccccgaagtgaatgaactgctgatggaggcccagctgctgcaggtgtccttaccagagatacaggagctctatcaaactctgttggcaaagccatcaccggctcaacagaccgatcgctcttcacccgtcagaccctcttccgagaagaacgattgttgtcgcggtaagcgggacggcatcaattctctggaacggaaactcaagcgccggctggagagagaggggctttcaagcgagcgatgggaacgtgtcaaaaagatgcggacccccaagaagaaaaagatcaagctatcccaccctaaggacatgaacaacttcaaacttgaacgggaaaggagctacgaactggtgcgctccgctgaaacccacagtctcccatctgatacgagctacagcgaacaggaggacagcgaggatgaggacgcaatctgccctgctgtgagctgtctacaacctgaaggcgacgaagtggattgggtgcagtgcgacggatcctgcaaccaatggtttcaccaggtgtgcgtgggcgtgagtcccgaaatggccgagaaggaagactatatttgcgtgcggtgcaccgttaaggatgcaccctccagaaagtag

SEQ ID NO: 193684 - DNA, 4161 bp, Artificial Sequence
  Description of Artificial Sequence: Synthetic coding sequence
atgggcttcgcccccggcaaggccgtgggcagccacatccggggccactatgagcgcatactgaatccatataacttatttctgtctggggattccctcaggtgcctgcagaagccaaatcttactacagacaccaaggataaggaatataagccgcacgatattcctcaacgccagtccgttcagccatccgaaacatgtccacccgcccgtcgggccaagcgaatgcgcgcggaagccatgaacattaaaatcgagcctgaggagaccacggaggcgaggacccataacctccggcgaagaatgggttgccccacccctaagtgcgaaaatgagaaggaaatgaaatcctcaataaagcaagagccaatcgagcgcaaagactacatcgtggagaacgagaaggagaaacccaaatccagatcaaaaaaggccacaaacgcggtggatctctacgtgtgcctactgtgcggatcaggcaatgacgaagatcgtctgctgctctgcgacggttgcgacgacagctatcatacgttttgtcttattcctcccctgcacgatgtgcctaagggggactggcgatgccctaagtgcctcgcccaagaatgtagtaaaccccaagaggcatttggatttgagcaggctgcaagagattacaccctcagaacgttcggagagatggcggacgcttttaagagcgactactttaacatgcccgtgcatatggtccccactgagcttgtggaaaaggagttctggagactggtgagcacaatcgaggaagacgtcacagtggagtatggagcggacatcgcctcaaaagagtttggatccgggtttcctgtgcgagacggcaaaatcaaactaagtccggaggaagaggagtatctggattctggctggaaccttaataacatgccggtgatggagcaaagtgttttggcgcacattacagctgatatctgtggcatgaagctcccttggctgtatgtgggcatgtgtttctcctcgttctgttggcacatcgaagaccactggtcctattccataaactacctgcactggggcgaacctaaaacgtggtacggcgtcccagggtatgctgccgagcaactggagaatgttatgaaaaaactcgcccctgagctgtttgtgtcacaacccgatctgctgcatcagctggttacaatcatgaacccaaatactctcatgacacatgaggtgcctgtgtaccggaccaaccagtgcgcgggagagttcgtaatcacatttccaagagcctaccattctgggtttaaccagggctttaatttcgccgaagctgtcaacttctgcaccgtggactggctgcccctgggcaggcagtgtgtggaacattatagacttctgcatagatactgcgttttcagccacgacgagatgatctgcaagatggctagtaaagcagatgtgctggatgtggtcgttgcctcgaccgtccagaaagatatggccatcatgatcgaagacgagaaagcgctccgagagacagttcggaaattgggagtcattgattcggaaaggatggattttgagcttctaccggacgatgagcggcagtgcgttaaatgcaagaccacgtgttttatgagcgctatttcttgttcttgtaaaccaggactgctcgtctgcttgcatcacgtgaaagaactttgcagttgccctccatacaagtataagctgcggtatcggtatacgcttgacgatctgtatcccatgatgaatgccctcaagctgcgcgcagagtcctacaacgagtgggctcttaatgtgaacgaggcattggaggcaaagatcaacaagaagaagtctttggtctctttcaaggccctcattgaggaatcagagatgaagaagtttccagacaatgatctgctgcgccacctcaggctggttacccaagatgctgagaaatgtgcgagtgtcgcccaacagctgctcaacggtaaaaggcagaccaggtacagaagcggtggaggaaagtcacagaaccagctgacagtgaacgaactacgccagtttgtgacacagctctacgccctcccatgcgtcttatcccagaccccactgttgaaggatctactcaatcgtgtcgaggatttccagcaacactcacagaaactgctgtcggaagagactccttccgcggccgagctccaagatctgctggatgtcagcttcgagttcgatgtggagctccctcagctagcagagatgagaatcagactcgagcaggccagatggctcgaggaggtacaacaggcatgtctcgatccatcgtctctcacccttgatgacatgagacggctcattgacttgggagtaggcttagcaccatactctgccgtggagaaagcgatggctcggctccaggaactgctgacagtttcggagcattgggacgataaggccaagtccctgctgaaagcccggccccggcattcccttaattctcttgcgacagccgttaaagagattgaagagatccccgcctacctgcctaatggcgcagctctcaaggacagcgtgcagcgggcccgagattggctgcaggacgttgaaggccttcaggccggcggacgggtgcctgtcttggacacactgatcgagctcgtgacacggggacggagtattcctgtacacttgaatagcctgccgcgtctcgagaccttggtggccgaagttcaagcttggaaggaatgtgccgtgaacacatttctaacagaaaatagcccctatagcctgttggaagtcctttgcccacgctgcgatattgggcttctgggactgaaaaggaaacagcggaaactcaaagaaccactgccaaatggtaaaaaaaaaagcacaaagctggaatcattgtccgatctggaacgtgcgctgaccgagtctaaagagaccgcctccgctatggctacactgggtgaggcccgcctacgggagatggaagcattgcagtccctgaggctcgcgaacgaaggcaagctcctatcccctctccaggacgtggacatcaaaatctgcttatgtcagaaggccccagctgcacctatgattcagtgcgaattgtgcagagacgctttccatacatcctgcgtagcagttcccagtatttcccaggggctccgaatctggctgtgtccacattgccgtcgtagcgagaagccaccactcgagaaaatacttcctctgctggcgagccttcagagaataagagtaaggcttcccgaaggagacgctctacgctacatgattgaacggacagtgaactggcaacaccgggcccaacagctgctctcttccggcaatctgaagttcgtgcaagaccgcgtgggttccgggctactctacagccggtggcaggccagcgctggccaggtcagtgatacaaataaggtttctcagccgccaggaacaacatcatttagcctccctgacgattgggataacaggactagttacctacattctcccttttccacaggacgaagttgtatacccctccacggagtgagcccggaagtgaatgaactgctgatggaagcccagcttttgcaagtgtctcttcccgaaattcaggagctataccagaccttactcgcgaaaccaagtcccgctcagcagacagataggagctcgccagtgcgcccctcatcagagaaaaatgactgttgccgcgggaagagggatggcattaattcactcgaacgaaaactgaaaaggcggctggagcgagagggcctcagtagcgaacggtgggaacgggtgaagaagatgaggactccaaagaaaaagaaaataaagctgtcccaccccaaagacatgaacaatttcaagcttgaacgcgagaggagttatgagctagtgcgatctgctgagacccacagtctcccaagtgacacgtcatactccgaacaggaggactccgaggacgaggatgctatatgtccggcggtaagctgcctgcagcctgaaggcgacgaggttgattgggtgcagtgtgacgggagctgcaatcagtggttccaccaggtgtgcgtgggtgtgtcacctgagatggccgagaaagaggactatatttgtgtcagatgcacggtgaaggacgccccatccaggaagtag

SEQ ID NO: 193685 - DNA, 933 bp, Artificial Sequence
  Description of Artificial Sequence: Synthetic coding sequence
atgatctgcaagatggccagcaaggccgacgtgctggacgtggtggtggcttccacggtgcagaaggatatggcaataatgatcgaggacgagaaagcgctccgggagactgtgaggaagttaggagtcatcgacagcgagagaatggatttcgagcttttgcctgatgacgagcgacagtgcgtgaagtgcaagaccacatgttttatgtcagctatttcctgcagttgtaagcctggactgcttgtgtgcctccaccacgtcaaggaattatgctcctgtcccccttacaaatataaactgaggtaccggtatactcttgatgacttgtatcctatgatgaatgcactgaagttaagagctgaatcttacaacgagtgggccctcaacgtgaatgaggctctggaggccaagatcaataagaaaaaatctctggttagcttcaaggcactgattgaagaaagcgagatgaagaagttccccgataatgatctcctgcgccacctgcgactggtaacccaggatgctgaaaagtgcgcgtctgtggctcagcaactgctaaatggaaaacgacaaaccaggtataggagtggtggagggaagtctcagaatcagctgactgtgaacgaacttcggcagtttgtaacacagctgtatgctcttccatgtgtcctgagtcagaccccgcttttaaaggatctcctgaaccgggtcgaagattttcagcagcactcccagaaactgctgtccgaggagacgcccagtgccgcggagctgcaagacctgctggatgtgtctttcgagttcgatgtggaactgccacaactggccgaaatgaggattcgacttgagcaagcccgctggctggaagaggtgcagcaggcttgcctagatccgtcaagcttgacactggacgacatgcgcgtcagctag

SEQ ID NO: 193686 - DNA, 4674 bp, Artificial Sequence
  Description of Artificial Sequence: Synthetic coding sequence
atggagcccggcagcgacgacttcctgcccccccccgagtgccccgttttcgaaccgagctgggccgaattcagggaccccctggggtatattgctaaaattcgtcctattgccgagaaatccggtatttgtaaaattcgacctcccgctgactggcaaccaccctttgccgtagaggttgataattttagatttaccccacggatacagcggctgaacgagctggaagcacagacacgggttaaactgaattatttggatcaaattgccaagttttgggaaattcaggggtcatctttgaaaatccctaatgttgagcggagaatcctcgacttgtattctctcagcaagatagttgtagaggagggaggttatgaggccatctgcaaggatcggaggtgggctagggtcgcacagagactgaactaccctcccggaaagaacatcggctccctactcaggtctcattatgagcggattgtttacccctacgagatgtaccaaagcggcgctaacctggtgcagtgcaatacgaggccattcgataacgaggagaaagacaaagaatataaacctcactcaatcccacttcgccagtcagtacagccgagtaaattcaacagctacggccgcagggcaaaacgcctccagcctgaccctgaacctacagaagaagacattgagaaaaaccccgagctcaagaaactccagatttatggcgctgggcctaagatgatgggcctgggactcatggccaaagacaagacgctgcgaaaaaaggacaaagagggacccgaatgccctccaaccgttgttgtgaaggaggagttgggtggggatgtaaaagtcgaaagtacctctcccaaaacgtttctcgagtccaaggaagaactctctcattccccagagccctgtactaagatgacaatgcgcttgagacgcaaccacagtaacgcccaattcatcgagtcgtacgtgtgccgcatgtgttccaggggtgatgaggatgataaactcctcctgtgcgacggatgtgatgacaactatcacattttctgccttctgccccccctacctgagattccaaagggagtgtggagatgccccaaatgtgtgatggccgagtgcaagcgacctcccgaagcctttggattcgagcaagctacacgcgaatacactttacagtcgtttggcgagatggcagattcttttaaggcggattatttcaatatgcccgtgcacatggtacctaccgaattggtcgagaaggaattctggcggttggtgaacagtatcgaggaggacgtcaccgtggaatacggagctgacattcactcaaaggagttcgggagcggcttccctgtgtcggactctaagaggcacctgacacccgaggaggaagagtatgctaccagtggatggaacttgaacgtaatgcctgtgcttgagcagagcgttctctgccacatcaacgccgacattagtggaatgaaggtgccttggttatatgttggcatggtgttctccgccttttgctggcacatagaggatcattggagctactctataaactatctacactggggcgagcccaaaacatggtatggtgtgcctagccttgcagctgaacacctggaagaagtcatgaaaaaattaacgcctgaactttttgacagccaacctgacctgttgcaccagctggtgactctcatgaaccccaacaccctaatgagccacggggtgccagttgttcggacaaaccaatgcgcgggggaattcgttatcaccttccctagagcgtaccacagtggctttaatcagggatataatttcgccgaagcagtaaatttttgcacagcagattggcttcccgcagggcgccagtgtatcgagcactatagacgcctccgcaggtattgtgtcttctcacacgaggagctgatttgtaagatggctgcctgtcccgaaaaattggaccttaatttggccgcagccgtgcacaaggagatgttcataatggttcaagaggaaaggcggctgaggaaagcgctgctggagaagggcattacagaggctgagagggaggctttcgagctcttgccagacgatgaacgccaatgcatcaagtgtaagaccacctgctttttgtccgccttggcatgctatgattgtccagacggtctcgtttgtttgtcacatatcaatgacttgtgtaaatgctcatcctcccgacagtatctccgctaccgctatacactggacgaactgcccgccatgcttcacaaactcaaggtgagagccgagtcgtttgacacctgggctaataaggttagagtggccttggaggttgaggatggcagaaagcgtagtctcgaggagctgagagccctcgagtctgaagccagggagcgacgattcccaaatagtgagctgctccagcagctaaaaaattgcctctccgaagccgaggcttgcgtgtctcgcgccctcgggctcgtatcagggcaggaggctggcccccatcgcgtggccggcctacagatgacactgactgaacttagagcattcctagatcaaatgaacaacctgccatgtgccatgcaccagatcggtgacgtgaagggcgtcctggaacaggtcgaggcataccaggcagaagcaagggaggccctggcatccttgccttctagtcccggtttgttgcagagcttgttggaacgagggaggcagcttggagtggaggtccctgaggcccagcaactgcagcgacaagtggaacaagctcggtggctcgacgaggtgaaacgaaccctcgcaccttccgctcggagagggaccctagccgtgatgagaggtctgttggttgctggagctagcgtggccccaagccccgcagtggacaaggcccaagccgagctgcaggagttactgacaatcgccgagcggtgggaggagaaggctcatttgtgtctggaagctcggcagaaacatcccccagctactctggaagctatcattagggaggccgagaacattcccgtgcatctgcccaacatccaggccctcaaagaagcactggcaaaggcacgcgcctggatcgcagacgtggatgaaattcagaatggggaccactacccctgcttggatgacctagaggggctggtagcagtgggtcgtgacctgcctgtgggcctggaggagctgagacagctagagctgcaagttctcacagctcattcgtggcgcgagaaggcatctaaaacattcctgaagaagaactcttgttatactctgctggaggtgctgtgcccatgtgctgacgccggaagtgatagtaccaaacgcagcagatggatggagaaagagctcgggctttacaaatctgataccgaactcctgggtctcagcgcccaagatctgagggaccctgggagtgtcatagttgcattcaaagagggagagcagaaagagaaggaggggattttacagctccgacgcactaactctgccaagccaagccctttggccagctctagtacagccagtagtactacttctatatgcgtttgtggtcaggttcttgccggcgccggcgccctgcagtgcgatctctgccaggattggttccacgggcggtgcgtgagcgtgccccgcttgttaagctcacccagaccaaaccccaccagcagcccactgctggcttggtgggaatgggatactaaattcctctgtcccctatgtatgcgctcccggcggccccggctggaaaccatccttgcactactggtggcgctgcagcgtttgcccgtgcgactccctgagggagaagctctacagtgcctgactgaaagagccatcagctggcaggggagggctagacaagccctggcctctgaagatgtgaccgccctcctcgggcgcctagcagagctaagacaacgtctccaggccgagcctagaccagaagagcctcccaactacccagctgctcctgcctctgaccccttgagggaaggtagtggaaaggatatgcctaaagtccagggccttctcgagaacggcgactcagttacttccccagagaaagtggctccagaggagggttctgatctggagctcctgtctagcctcctaccacagctgacaggtcctgtgctcgagctccccgaggctacacgcgcaccgctcgaagagctcatgatggagggtgaccttcttgaagtcactttagatgaaaatcacagcatctggcagctgctgcaggccggccaaccccccgacctggagcgtatccggaccctgctcgaactcgaaaaggctgagcggcacggaagtcgggctcgtggaagggctctcgaaagacgacgacggcgtaaagttgaccgcggtggtgaaggggatgatcccgctcgggaggagctggaaccaaagcgagtccgctccagcgggccagaggccgaagaggtacaggaggaggaggagcttgaggaggagaccggcggcgagggaccgccagctcctatccctactaccggcagtccttccacccaagagaatcagaatggcctcgagccagcggaggggaccactagcggaccttccgccccgttttcaaccctgacacccaggctgcacctgccctgcccccaacagcccccacaacagcagttatag

SEQ ID NO: 193687 - DNA, 4551 bp, Artificial Sequence
  Description of Artificial Sequence: Synthetic coding sequence
atggagcccggcagcgacgacttcctgcccccccccgagtgccccgtttttgagcctagttgggccgaattccgcgatcctctggggtacattgccaagattagacccatcgctgagaagagcggcatctgcaagattaggccccctgctgattggcagccgcctttcgccgtggaagtggacaattttcggtttactccacgcatacagcgcctcaatgagctggagatcgtggtggaggaaggcggttacgaggcaatctgtaaggatcgtcggtgggcccgcgtggcccagaggttaaactatccccctggtaagaatatcgggtctctcctgaggtcacactacgagcggattgtgtatccttatgaaatgtatcagtccggagccaacctcgtgcagtgtaacacccgccccttcgataatgaagagaaagacaaggaatacaaaccgcattccatacctctgagacaatctgtccagcccagtaagtttaactcttacggccgacgcgcaaagcggctgcaacctgatcccgagcctactgaagaggatatcgagaaaaacccagaactgaaaaagctacagatttatggggcgggtccaaaaatgatgggcttaggtctcatggctaaggataaaactctgaggaaaaaggataaggaaggccctgagtgcccgccaacggtggtcgtgaaagaagaactgggaggggacgtcaaagttgagagtacaagccccaaaaccttcctggagagcaaggaagagttaagtcactctccggaaccgtgcaccaaaatgaccatgagactccggagaaatcactcaaacgctcagttcatcgagagttacgtatgtcggatgtgtagtcggggtgatgaggacgacaaactgctgctatgcgatggctgtgacgacaactaccacatcttctgcctgctccctccactgccagaaattcctaagggcgtgtggcgctgccctaagtgcgtcatggccgagtgcaaaaggccaccagaagcttttggctttgaacaagctacgcgcgagtacaccctgcagagtttcggcgaaatggctgactcattcaaggctgactatttcaatatgccggtccatatggtccctaccgagcttgtcgagaaggaattttggcggcttgtgaattccattgaagaagacgtgactgtggagtatggagccgacattcactcaaaagagtttggcagcggtttccctgtgtctgactcaaagcgtcacctaactcccgaggaagaggagtacgctacaagcggatggaatctgaatgtgatgcctgtgctggaacagagtgtcctttgtcacattaatgccgatattagcggcatgaaggttccatggctatatgtgggaatggttttctcagctttttgctggcatatcgaggatcactggagctattcaattaattacctccactggggcgaacccaaaacatggtacggtgtgccttctttagccgcagagcatctcgaggaggttatgaagaagcttacccccgagttatttgatagccagcccgaccttctgcaccagcttgtgactttaatgaatccaaacacactgatgtcacacggggtgccagttgtgcgtaccaaccagtgcgccggggaattcgtcatcacattcccacgggcttaccactcaggtttcaaccagggttacaattttgccgaagctgttaacttctgtaccgccgactggctccccgctggtcggcagtgtattgagcattatcgccggctgaggagatactgcgtgttttcacatgaagaactgatttgcaaaatggctgcctgccctgagaaactagatctgaatctggccgcagccgttcataaggaaatgtttatcatggtgcaagaggagagaaggcttaggaaggctttgctggagaaaggtattactgaggccgaacgggaagccttcgaactcctccccgacgatgagagacaatgcatcaaatgtaagactacctgtttcctgtccgccctggcatgttatgattgtcccgatggactggtctgcctcagtcatattaatgatttgtgcaagtgctccagctctcgccagtacctgcggtaccgatacaccttggacgaactgcccgctatgttgcacaagctgaaggtgcgggccgaaagcttcgatacttgggcaaacaaggttagggtggccctcgaggttgaagatggacggaaacgctccctggaggagctccgggccttggagtctgaggctcgcgaaaggaggtttcctaattcagagttgctgcagcagcttaagaattgcttgagcgaagccgaagcgtgcgtcagccgtgcactgggcctggtcagcgggcaggaggccgggccgcacagagtggccggactccaaatgactctgacggagcttcgcgctttcttagaccagatgaataatctcccgtgcgccatgcaccaaatcggagacgtgaagggggtgttagaacaggtggaggcataccaagcggaggctagagaggcgttagccagcctacctagttcccccgggttgctgcagagtcttctcgagcggggacgacagctaggcgtcgaagttccagaggcacaacagctgcagagacaggtcgaacaggctcggtggctggatgaggtaaagcggactttagcaccatcagcacgaaggggcactctggccgtaatgaggggacttctggtggcaggtgcaagtgtggcccctagcccggcggtggataaggcgcaggcagaactgcaggagctcttgacgatcgccgaaagatgggaagagaaggcacatctgtgtcttgaagcgaggcagaaacatcccccagccaccctcgaggccattatccgagaggcagagaatattcccgtgcatttgcctaatatccaggccctgaaggaggccctcgcaaaagcccgcgcatggatcgcagatgtggacgaaattcagaatggggaccactacccctgtctggatgacctggaggggttggtagccgttgggagggacctgcccgtgggcctggaggaacttaggcaactggagttacaggtgctcaccgcccattcctggagggagaaggcatcaaaaacttttctaaaaaagaacagctgttataccctgctggaagtcctatgtccctgtgccgacgccggcagcgacagtaccaaaaggagtaggtggatggagaaagagctggggctttacaaatcagataccgagctgctagggctgtcagctcaggatctgcgagacccgggaagcgttatcgtagcttttaaggagggcgagcagaaggagaaggaggggattttacagcttaggaggaccaactcagcaaagcccagcccactggccagtagctctacggccagttcgacaacatccatctgcgtctgtggccaggttctggccggtgcaggagccctgcagtgcgacctgtgtcaggattggttccacggccggtgtgtgtctgttccaagactgctgagctctcctagaccaaatcccaccagttcgcctttactcgcctggtgggagtgggacacgaaatttctttgccccctgtgtatgcgtagtaggcgccctcgactggagactatcctggcgctgctggtcgccctccagcgtctgcctgttcgcctccctgagggcgaagccctccagtgtctcacggagcgcgcgatttcttggcagggccgcgcccggcaggcactggcaagcgaggacgtgaccgctctgttgggccgtctcgctgagctgagacaacggctgcaagcggagccgcgcccagaggaaccccccaattacccggcagcacccgcctctgatcctctgcgcgagggttcgggcaaagacatgcccaaagtccaggggctacttgaaaatggcgatagtgtgactagccccgaaaaagtggcacccgaggaggggagcgaccttgagctgctttccagcctgctgcctcagctgaccggccctgtacttgagttgcctgaagccacccgggccccattggaggaactaatgatggagggcgacctgcttgaggtgacgctcgatgaaaaccatagtatctggcagctgcttcaggccggtcagccccccgatctggagcgcatccgaaccctgctagagcttgagaaagcagagagacacgggagccgggcgaggggacgagctctggaacggagaagacgccgcaaggtggataggggcggtgagggagatgaccccgctcgcgaagagctggagcctaaaagggtgcggtctagcgggcctgaggccgaagaggtacaggaagaggaagaattggaagaggaaaccggtggtgagggcccacctgcacccattcccaccaccggctcgccctcaacacaggagaaccagaatggtctcgaaccagcggaaggaactacatcgggaccgagcgcgcctttttccacactgacaccccggctgcatctgccttgcccccagcaaccacctcagcaacagttatag

SEQ ID NO: 193688 - DNA, 4683 bp, Artificial Sequence
  Description of Artificial Sequence: Synthetic coding sequence
atggagcccggcagcgacgacttcctgcccccccccgagtgccccgtgtttgaaccttcctgggcagagtttcgcgaccccctggggtatatcgccaagatcagacctatcgctgagaaatccggcatatgcaagatcaggccccccgccgattggcagccgcccttcgccgtggaggttgacaacttcagattcacccctaggattcagcgcctcaacgaactcgaggcccagaccagagtcaagttgaactacctcgaccagattgccaagttctgggaaatccagggcagctcactaaagatcccaaatgtcgaaagacggatcctggatctctattctctttccaagatcgttgtcgaggagggggggtatgaagctatctgcaaagacagaagatgggcacgcgtggcccagaggctgaactatcctccgggaaagaacattgggagcctgctgcggtcacactatgagaggattgtttacccttacgaaatgtaccagagcggagcaaacctggttcaatgcaacacccgcccctttgacaatgaagagaaggacaaagaatacaaaccccattcaatccctctcagacagagcgtacagccctctaaattcaactcctacgggagacgagcgaaacgattgcaacctgatccagagcctacagaagaggacatcgagaaaaacccagagttgaagaagctgcagatttacggcgctgggcccaaaatgatgggcctcggccttatggctaaggacaagactttgaggaagaaagataaggagggcccggaatgcccacccactgttgtggtaaaagaggaactgggtggcgacgtgaaagtcgaatcgacctcccctaagacctttttggaatcaaaggaggagctctcccattcccccgagccttgcactaagatgaccatgcgcctgcggaggaaccacagcaatgctcagtttatagagtcttacgtatgcagaatgtgttcccgtggtgatgaagacgacaagcttctgctgtgcgacgggtgcgatgataattatcacattttctgtctgttgccccctctgcccgaaatccctaagggggtgtggagatgccctaagtgcgtcatggctgaatgcaaacgcccaccggaagcattcggtttcgagcaggctacacgcgagtataccttgcaaagttttggggaaatggctgacagcttcaaggcagactacttcaatatgcccgtgcatatggtcccaacggagctcgttgagaaggaattttggcgtcttgttaattccatagaggaagacgtgactgtggaatatggggctgatatccattccaaggagttcggatccggttttcccgtttccgacagcaagcgccacttaacccctgaggaagaagagtacgccaccagcgggtggaacttgaacgtgatgcctgtgctcgagcaatccgtattgtgtcatataaacgccgatatctcaggcatgaaggtaccttggttgtatgtcgggatggtatttagcgccttctgctggcatatcgaagatcactggtcctatagcattaactacctccactggggggagccgaaaacatggtatggcgtaccctcgctcgcggccgagcatctcgaggaggttatgaagaagctcaccccagagctttttgacagtcagcccgatttgctacatcaactggtcacactaatgaatcccaatacgttgatgtcccatggcgtgcctgtggtgcgaaccaatcagtgtgccggggaatttgtgatcacctttcctagagcctaccattctggcttcaatcagggctacaactttgcagaagccgtcaacttttgcaccgcggactggctccccgctggcaggcagtgcattgaacactaccggcgcctgagacgctactgtgtgttttcccatgaagaactgatttgtaagatggccgcatgccccgaaaagctcgacctcaatttagcggctgcggtgcacaaagaaatgtttattatggtgcaagaagagaggaggttacgaaaagccttgctggagaagggcattaccgaggccgagagggaggccttcgaactgctacctgacgatgagaggcagtgtatcaagtgtaagaccacttgttttcttagcgctcttgcctgttatgactgtcccgatggtctcgtttgtcttagtcatatcaatgacttgtgtaagtgtagcagttcccggcagtatctgaggtacaggtacaccctcgatgagctgcctgccatgctgcataaattgaaagttcgcgccgagtcattcgatacctgggccaataaggttcgcgtggcactagaagtggaagacggaagaaagcgctcgctcgaggagcttcgggcattggaaagcgaggccagggagcgacgatttccaaacagcgagctgcttcaacagctcaagaactgcctgtctgaggctgaggcgtgcgtgagcagggcactcggactggtctcaggccaggaggccgggccccatagggtagctggtctgcaaatgactcttacagaacttagggcttttctcgatcagatgaataacctcccctgcgctatgcaccagattggagatgtgaaaggagtgttggagcaagtggaggcttaccaggccgaggcccgggaagccctagcctcactgcccagcagtcctggtttactgcagagtttgttagagagaggccggcagttgggggtggaagtgccagaggcacagcaattgcagcgccaggtggaacaggcccgatggctggacgaggtcaagcggactctggctccatccgcacgccggggaaccctcgcagtgatgaggggcctgttggttgctggggccagcgtagctccgagccccgcagttgacaaggctcaagcggagcttcaggagcttcttactatcgccgaacgatgggaggaaaaggctcacctgtgcctggaggcacggcagaaacacccaccagcgactctcgaagccataattcgcgaggcggagaatattcctgtgcacctgccaaacatccaggccttgaaggaggccctggccaaggcccgggcctggatcgctgatgttgatgagatccaaaacggcgaccactatccttgccttgacgacctagaagggctggtagcagtgggacgggacctgcctgttggcctggaggagctccgccagctggagctccaggtgctgacagcacacagctggagagagaaggccagcaagactttcctaaagaagaattcatgttacaccctgctagaagtgttatgtccttgtgctgacgctggcagcgattctactaagcgctcacgctggatggagaaggagctcggtctgtacaagagcgacacagagttactagggctgtcagcccaggatttgcgtgaccctggtagtgtaatagtggcgttcaaggaaggcgagcaaaaagaaaaggagggaatactgcagttgcggcgcacaaactccgctaaacccagcccactggcctcctccagcaccgcctcgtcaaccacttcaatttgtgtgtgtggccaggtactagcaggagcaggcgctctgcagtgtgacctatgtcaagattggtttcatggacgctgtgtgtctgtgcccagacttcttagcagccctagaccgaatcccacatccagtccattgcttgcttggtgggagtgggacactaagttcctgtgccctctctgtatgcgaagtcggcgacctcgcctcgaaactatactcgcccttttagtggccttgcagagattgcccgtcagactgcctgagggtgaagccttgcagtgcctcactgagagggccattagctggcaggggcgggccagacaggcactggctagcgaggacgtgactgccctgcttggacgactcgccgaactgcgacagagactgcaggccgaacccaggcccgaagagcctcctaattatcccgctgctccagctagcgatccgctccgagaaggctccggaaaggatatgccaaaagtgcagggactcttagaaaacggagatagcgtcacaagccccgagaaggttgcgcccgaggagggctcaggcaagagagacttggagttgctgtcaagcttgctcccacaacttacagggcctgtgctggaactccccgaggccactagggctccgcttgaggagctgatgatggagggtgatttgctggaggtgacactggacgaaaatcacagtatctggcagcttcttcaggccggccagcccccagacctagaacgtatccgaaccttgctcgagctggagaaagcagaaaggcacggttcccgggccaggggacgagcactggagcgccgcaggcgcagaaaagttgatcgcggcggtgaaggagatgacccagctagggaagagctggaaccaaagcgggtgagatcctccggcccggaagccgaagaagtccaagaggaagaggaactagaagaagagaccggaggcgaggggccgcctgccccaataccaactacgggcagtccctcaacacaagagaaccagaatgggctcgaaccagctgaagggactacatcaggcccttcagcccctttctccaccctgacaccacgcctgcacctaccatgtccccaacagccaccacaacaacagctgtag

SEQ ID NO: 193689 - DNA, 4680 bp, Artificial Sequence
  Description of Artificial Sequence: Synthetic coding sequence
atggagcccggcagcgacgacttcctgcccccccccgagtgccccgtgttcgagccaagctgggctgagttcagggatcctctaggctacattgccaagatccggcctatagcagagaagtctggcatctgcaagatccgccctccggctgattggcagcctccattcgccgtggaagtggacaacttccgtttcacaccccgtatccagcgcttaaatgaacttgaggctcaaaccagagtcaagctgaattatcttgaccagattgctaagttctgggagattcaagggtctagcctcaaaattcctaacgtagagcggcgtattctggacttgtacagcctgagcaaaatcgtggtagaggagggaggatatgaagctatatgtaaggacaggagatgggcacgagtcgcccagcggctcaactaccctcccggcaagaacatcggctctctcctccgcagccattatgagagaattgtgtacccctacgagatgtatcaatcaggagctaacctggtctgtaacacccggccctttgacaacgaggagaaagacaaagagtacaaaccacactccatcccccttcggcaatccgtgcagccctctaagtttaatagttacggacgtagggcaaagcggctccagcctgaccccgagcccacagaagaagacatagaaaagaatcccgagctcaaaaagctgcagatctacggtgctggcccaaagatgatgggcctggggttaatggctaaggataagaccttgagaaaaaaagataaggaaggccccgagtgcccgcccacagtggtggtgaaagaggagttaggtggggacgttaaagttgaatcaactagtccaaagaccttccttgaaagcaaggaggagctgtcacactctcctgagccgtgtactaaaatgactatgcgcctaaggaggaaccatagcaatgcccagttcatagagtcctatgtgtgccggatgtgttcaagaggggacgaggacgataagctactcctttgcgatggctgtgacgacaactatcacatcttttgtcttttgcccccactccccgaaatccccaagggcgtatggcggtgtcccaaatgcgtaatggcggagtgtaaacgaccgccggaggcctttggatttgagcaggccaccagagagtacacactgcagtcctttggtgagatggctgactctttcaaagcggattattttaacatgccagttcacatggtgcccaccgagcttgtggaaaaagaattctggaggctggtgaatagcattgaagaagatgtcactgtcgagtacggagccgatattcattccaaggaattcggatcggggtttcctgtgtctgattccaaaagacatcttactcctgaggaggaagaatatgccacctccggctggaacctcaatgtgatgccagtgctggagcaatctgttctctgccatatcaatgctgacatctccggcatgaaggtcccttggctttatgtgggaatggtcttctctgctttttgttggcatatcgaggatcattggagttattcaattaactacttgcattggggcgaacccaaaacttggtatggtgtacctagcttagccgccgagcatctcgaagaggttatgaaaaagctcacccccgagcttttcgatagccaacctgatctcctccaccagctagtgaccctgatgaatcctaataccttgatgagccatggtgtgcctgttgtgcgcacgaaccagtgcgccggagagttcgtgattacttttcctcgggcttaccactctgggttcaaccaggggtacaactttgctgaggcagtgaacttctgcaccgccgattggctgccggccggacggcaatgcatagagcactataggaggctgcgtaggtattgtgtgttctcccatgaggagctgatctgtaagatggcagcctgcccagagaaactcgacctcaacctggccgctgcagtacataaggagatgttcataatggttcaggaggaacgcagactccgcaaggccttgcttgaaaaaggcattacagaggcagaaagggaggcattcgagttgcttcctgacgatgagcgccagtgtatcaagtgcaaaacaacgtgtttcctgagtgctctcgcgtgctacgactgtccagacggacttgtctgtctgtctcatatcaatgatctgtgtaaatgcagctctagcagacagtacttgcgctaccggtatacacttgacgagctgcccgccatgctacacaagctgaaagtcagagccgagtccttcgacacatgggccaacaaggttcgtgtggcgctggaggttgaggacggaaggaaacgctccctggaggagctcagagcgctggaatccgaggctagagagcgtaggtttcctaactccgagttgctgcagcagctgaaaaactgtctttctgaggcggaagcctgcgtaagtcgggctctgggtctggtgagtggacaggaggcaggaccacatagagtggcaggtttgcaaatgacgctgactgagttgagagccttcctggatcaaatgaataacctcccatgcgctatgcaccaaatcggcgatgttaagggagtgctcgaacaggtggaagcttaccaggcagaggcacgggaagccctagcaagtctcccaagttcacccggcctgctacagtctcttttagagaggggtcgccagctgggagtggaagtgcccgaggcacagcaattgcagagacaggtagagcaagctcgatggctcgatgaggtgaagcgcacactggctcccagcgcacgcagaggaacacttgccgtgatgcgcggactcctggtggccggggccagtgtggctcccagtcctgcggtggacaaggcccaggctgagcttcaggaactcctgactattgcagagagatgggaggaaaaggcccacctctgtttggaggcgaggcaaaaacacccccccgcaactctggaagccattatcagggaggcagaaaatatccctgtccacctccctaacatacaagctctcaaagaagctctagcaaaggcacgagcctggattgccgacgtggatgaaattcaaaacggcgatcattatccctgtctggacgacctggagggcctggtggccgtagggcgggacctgcctgtgggactcgaggagttgaggcagctggagctccaggtgctgacggcccactcctggcgcgagaaagcctcaaagactttccttaagaaaaactcatgctacacacttctagaggttctgtgcccatgcgcggatgcgggttctgacagcaccaagaggtcaaggtggatggaaaaggaactcgggctgtataagtcagacacggaactgctggggctgtccgcacaagatctccgtgatccaggaagcgtaattgtggcctttaaggagggtgaacaaaaagaaaaagagggtatacttcagctacgccgcacaaactctgctaagcctagcccactcgcctcatccagcactgcgtcatcgaccactagcatctgtgtctgcgggcaggtattagccggagctggcgccctgcagtgtgacctctgccaggactggttccacgggcgttgtgtgtctgtaccacgactgctgtcaagcccacgaccaaaccctacctcctctcctctgctggcctggtgggaatgggatactaagttcctgtgccccctttgtatgagatcgagacggccaagattagaaaccattctggcactgctggtggctttgcaacgcttgcccgtgcggttgcctgagggggaggccctgcagtgcttaaccgaacgggcaatctcgtggcagggcagagcaagacaagcactggcaagcgaagatgtaactgccctgctgggccggctcgcagagctacgccagcgactccaggccgagcctaggccagaggagccaccgaattatcccgctgcgcctgccagcgatcctctgcgcgagggatcgggtaaggacatgcctaaggtacaggggctattggaaaatggcgattctgtcactagtccagagaaggtggcccccgaggagggcagtgggaagagggacctggagctactgagtagtttactgccgcagttgacagggccggtgctggagctcccggaagctaccagggctcccctcgaagagcttatgatggagggagacctgctggaggtgacccttgacgaaaatcactctatctggcagttactgcaggcggggcagcctcctgaccttgagcggatccggactttgctcgaactcgaaaaggccgagagacacggctcaagagcacggggtagagcacttgaaagacgccggaggagaaaagtggataggggaggagaaggcgatgacccagcacgcgaagagctcgagccaaagagggtgagaagttctggaccagaggccgaggaggtacaagaagaggaagaactagaagaagagaccggtggcgaggggccgcctgcaccaattcccacaaccggatcacccagcacacaggagaatcaaaatggcttggagccagctgaagggacaaccagcggaccaagcgccccattttcaacactgactccacgtctccatcttccctgccctcagcaacctccccagcagcagctgtag

SEQ ID NO: 193690 - DNA, 4140 bp, Artificial Sequence
  Description of Artificial Sequence: Synthetic coding sequence
atggagcccggcagcgacgacttcctgcccccccccgagtgccccgtgtttgagccttcgtgggccgaattccgtgatccattaggttacatagcaaaaatccggccaatagccgaaaagtccggcatctgtaagattagacccccagccatcgtggtggaggaggggggatatgaggccatctgtaaagacagacggtgggcacgggtcgcccagcggctcaactaccctccagggaagaacataggaagcttgcttcgatcccactacgagaggatagtgtacccatatgaaatgtaccagagcggagccaaccttgttcagtgtaataccagaccatttgacaatgaggagaaggataaagagtacaaacctcatagcataccactaaggcagtcggttcagccgtccaagttcaactcctatggcagacgcgctaaaagactgcagccagatccagagccgactgaggaagatatcgagaaaaaccctgagctgaaaaagctccagatttacggtgccggacccaaaatgatgggcttgggtctaatggccaaagacaaaacattgcggaagaaggacaaagagggtccagagtgtccacctaccgtggtcgttaaagaagagctggggggtgacgtgaaagttgagtccacctcacccaagacctttctggagagcaaagaagaactatctcattcgccggaaccttgtacgaaaatgaccatgcgactaagaaggaatcacagcaatgcccagttcatagaaagctacgtgtgcaggatgtgcagccggggtgatgaggacgacaagctcctgctgtgcgacggatgcgatgacaattaccacattttctgcttgcttccacctctgccagaaatccccaaaggtgtgtggcgctgccctaagtgtgtgatggccgagtgcaaaaggcctccggaggcatttgggtttgaacaagctacacgcgaatatacactccagagcttcggggaaatggccgacagcttcaaggcagattactttaacatgccagttcatatggttcccacggaattagtggaaaaagaattttggagattggtcaactccatcgaagaagacgtgaccgtcgagtatggcgcagatatccattctaaggaatttggcagtgggttccccgtgtccgactctaaacggcacctgacacccgaggaggaagagtatgccacaagcggctggaatctcaatgtgatgcccgtcctggagcagagcgtcttatgccatatcaacgccgatatttctgggatgaaagtcccatggctgtacgtgggaatggtgttcagtgctttttgttggcacattgaagaccattggtcatattctattaattacctgcactggggcgaacccaaaacatggtacggcgtgccatctctggctgccgagcacctggaggaggttatgaagaagttgacgcctgaactttttgattcgcagccagacttgctccaccagctggtcaccctcatgaaccccaacaccctgatgtcacatggcgttcctgttgtgagaactaatcaatgcgcaggtgaattcgtcatcacgttcccccgggcttaccacagcggcttcaaccaaggctataactttgccgaagccgttaacttttgcactgctgattggctacccgcgggccgccagtgcattgaacattaccgcagactccgccggtactgtgtgttcagccacgaagaactgatttgtaagatggccgcctgcccagaaaaactagatttgaacctggccgccgccgtgcataaagaaatgtttattatggtccaagaggaacgacgtctccgcaaggccctgctggaaaaggggattaccgaggcggaacgggaagcctttgagctccttcctgatgacgaaaggcagtgtatcaaatgcaagaccacctgcttcctgagcgcattagcctgttacgactgtcctgatggtctggtgtgtctgtcccacattaatgatctatgcaagtgcagctcttccaggcaatatttaagatatcggtatacactggacgaactccctgcaatgctccataagctcaaagtccgggccgagagcttcgacacatgggccaacaaggttcgcgtcgcgctggaggtggaagacggtagaaaaaggagtctggaggagctgagagctttggagtccgaagcacgggagcgacgttttccaaactcggaattacttcagcagcttaaaaattgtttgtcagaggccgaggcctgcgtgtcccgggcgctgggactggtgagtggccaggaggcaggcccccatagagtcgccggactccaaatgacgttgactgaattaagagcctttctggaccagatgaacaatctgccatgcgcaatgcaccagatcggagatgtcaaaggtgtgttggaacaggtcgaagcttaccaggcggaggcacgcgaggccctggcatccctgccttcctccccagggctccttcagtctcttctggagagaggtcgccaactgggcgtcgaggtaccggaggcgcagcagctccagaggcaggtcgagcaagcccggtggctggatgaagtcaaaagaactcttgccccgagtgctcgaagggggacccttgcggtcatgcgcggacttctcgttgctggggccagtgtcgcaccaagccccgccgtcgacaaagcgcaggccgaactgcaagagctgctgacaatcgctgaaagatgggaggaaaaggcccacctttgcctggaagcccgtcaaaagcacccccccgcgacccttgaggctatcattagagaagccgaaaatataccagtgcatctccccaatatacaggctcttaaggaagcactcgctaaagcacgcgcatggatcgccgacgtggacgagatacaaaatggcgatcattacccgtgtttggacgaccttgaaggtctcgtggccgttggtagggacctccccgtggggcttgaagaattgcggcaattggagctgcaagtgctgactgcacattcttggagagaaaaagcttcaaagactttcctgaagaagaattcgtgctacacactgctggaagtgctgtgcccatgtgccgacgctgggtccgactccactaaaagaagccggtggatggagaaagagctgggcctgtataagagtgacactgagctcctggggctgtctgctcaagatctgagggaccctggctccgttatagttgcctttaaggagggcgagcaaaaggagaaggagggcattcttcagctgaggagaaccaactccgcaaagccgtcgcccctggcttcatcctccacggcctcaagtacaacctcaatatgtgtgtgcgggcaggtcctggcaggggcgggagcccttcaatgcgatctgtgccaggactggttccatgggaggtgcgtttccgtgcccagactgcttagttcgccaaggccaaacccaacctcttctcctctgctggcttggtgggaatgggacacaaaatttctttgccctctttgtatgcggtctcgaaggccaaggttagaaaccattttggcattgctcgtcgccctccagcggctgcctgtccggcttccagagggggaagctctgcaatgtttgactgagagagcaatctcttggcaagggcgtgcccggcaggcattggccagtgaagatgttacggcacttttaggacggttagccgagctgagacaaaggttgcaggctgagcccagaccggaagagcctccaaactacccggcagcgcccgcctcagatcccctgcgagagggttctggaaaagacatgcccaaggttcaagggctgttggaaaacggagacagtgtcacttctccagagaaggtggcccctgaagagggttcagacttggagctcttatcttccctgctgcctcaactcaccggccctgttttggaactccctgaggccacaagagccccactggaggaactcatgatggagggggatttgctggaggtcaccttagatgaaaatcactctatccccgagagcctggacttctgtatattgacccctcggtactgctcagacctgtccagttggggccccgcaccaggtgtcttccctccttggtag

SEQ ID NO: 193691 - DNA, 4620 bp, Artificial Sequence
  Description of Artificial Sequence: Synthetic coding sequence
atggagcccggctgcgacgagttcctgcccccccccgagtgccccgtgttcgagccatcatgggccgagtttcaagacccactcggatatatagcaaagattcggccaatcgctgaaaagtccgggatctgtaagatccgccccccagctgattggcagccccctttcgcggttgaagtcgacaacttccggttcaccccgcgcgtccagagactgaatgaacttgaagcacagacacgtgtgaaacttaactacctcgatcaaatcgctaagttctgggagatccagggaagttccctcaagattccaaacgttgaaaggaagatattggatctgtattctctttctaaaatagtcatagaggaaggcggttacgaggccatctgtaaggataggagatgggccagggtggcccagagactccattacccaccaggcaagaacataggcagtctgctgcggtcccactatgaacgtattatttatccttatgaaatgttccagtccggggctaaccacgtgcaatgcaatacccaccctttcgacaatgaagtcaaagacaaagagtacaaaccccacagcattcccctgaggcagtccgttcaaccatccaagttctcatcttattcaaggagagctaagcgcctccaacccgacccagagcccaccgaagaggatatcgagaagcaccccgaactgaagaaactgcagatctatgggcctggacccaaaatgatgggtctgggcctgatggctaaagataaagacaagaccgtacacaagaaggtaacttgcccccctacagtgactgtcaaggacgagcagagcggggggggcaatgtcagcagtactctgctgaaacaacatttgagcctcgagccatgcactaagacaacgatgcagcttcgtaaaaaccacagttccgcacaattcatcgattcctacatctgtcaggtctgttctcggggcgatgaggacgataaactgctcttttgcgatgggtgcgacgacaactaccacatcttttgtctcctaccaccactccctgaaatcccccgtggtatctggcggtgtcccaagtgtattctggctgagtgtaaacagcctccggaggcattcggctttgagcaggccactcaagagtattcgttacagagctttggcgagatggctgactcttttaagtcagactatttcaatatgcccgtgcacatggtaccgaccgaacttgtggagaaagagttttggaggttggtttcaagtatcgaagaggatgtaacggttgagtacggggccgatatccacagcaaggaattcggctcagggtttcccgtctctaactccaagcagaacctgtctcccgaggaaaaggaatatgcaacgagtggatggaacttgaacgtgatgccagtgcttgatcagtcagtcctttgtcacattaacgcagacatctccggcatgaaggtaccctggttgtatgtcgggatggtgttctccgccttctgctggcacattgaagatcactggtcctatagcatcaactaccttcactggggggaacccaagacctggtatggggtgccttcgctggctgccgaacatctggaagaggtcatgaaaatgctgactccggagctgtttgacagccaacccgacttattgcaccaacttgtgactctgatgaatcccaataccttaatgagtcatggcgtgcctgtggtacgcacaaatcagtgcgccggtgaattcgtaattacctttcccagagcctaccacagcgggtttaatcagggctacaacttcgctgaggctgtcaacttctgtactgctgactggttacctgcgggccgccagtgcatcgagcattatcgaaggttgaggcgttattgcgtattcagtcacgaggagctcatttgcaaaatggcggccttcccagaaacgcttgatctgaaccttgctgtggcggtacacaaggagatgttcataatggtccaggaggaacgtaggctgcgaaaggccttgctggaaaagggcgttacagaggcagaaagagaggcgtttgaactgttgcctgacgatgagcgtcagtgcatcaagtgcaagacaacatgtttcctctccgccctagcttgctatgactgcccggacggactggtgtgtctcagccatattaatgacctctgcaagtgcagttcatccaggcagtatctgagatacaggtataccctcgatgagctgccaaccatgctgcacaagctgaaaattcgcgccgagtcttttgacacgtgggccaacaaggtcagagtggccctcgaggtagaggacgggaggaagcggagctttgaggaactgcgggccttggaatcggaggcccgggagagacgcttccctaactctgaactgctccagcgtctcaaaaactgcttaagtgaggtggaggcttgtatagcacaagtactggggctggttagcgggcaggtggcacgcatggatacgcctcagctgactctcaccgaactcagggtgctcctcgagcagatgggttcgttaccctgtgcaatgcaccagattggagatgtcaaggacgtgctggaacaagttgaggcgtatcaggcggaagcccgggaagccctggcaacactaccatcttctccagggctgttgcggagtttactggagcgcgggcaacagttaggcgttgaggtgcccgaggctcaccagctgcagcaacaggtcgagcaggcgcaatggctggatgaagttaagcaggcccttgccccatccgcacatcggggttcattggttattatgcaggggctgctcgtcatgggagcaaagatcgcatcctcacctagtgtggataaggccagagcggaactccaggaacttctcaccatagcagagcgttgggaggagaaagcccatttctgccttgaggcaaggcaaaaacatccgccggccaccctagaagccatcatcagagagactgagaatatccctgtgcatctgccaaatatccaggcactgaaggaggctttgactaaagcgcaggcctggatcgctgatgttgatgagattcaaaacggtgaccactacccttgtcttgacgacctggagggtttggtagccgtcggaagagacctgcctgtcgggcttgaggagctgcgccaactggagctccaggtgcttactgcacacagttggagggagaaagcctcaaaaacctttctcaagaaaaattcctgctatacactgctagaggtgctctgcccttgtgctgacgccggatccgacagcactaaacgaagtcggtggatggagaaggctttgggcctctaccagtgcgacaccgagctgctggggctttctgcacaagacctgagagaccccggctcggtgattgtggccttcaaggagggggaacagaaggaaaaggaaggcatacttcaactgaggagaactaattctgctaaacctagcccactagccccctcactcatggcctcttcacccacctccatatgcgtgtgcgggcaagtccccgccggcgttggcgtgctgcagtgcgacttgtgccaggactggtttcacggtcagtgcgtcagtgtgccacacttactcaccagtcctaagccctcactgactagtagcccactgctggcttggtgggaatgggatactaaattcctgtgccccctttgcatgcgcagtcgccgtccacgattggaaactattctggccctgctggtagccctgcagaggctacctgttcgcctgccggagggcgaagcgttacaatgcttgactgaaagagccataggctggcaggatcgggcccgaaaggctctcgcgagcgaggatgtcaccgctttgttacgccagttggcggaactgcgtcaacagctccaggctaaaccccggcctgaagaggccagcgtctacacttctgccaccgcttgcgatccaatcagagaaggctctggaaacaacattagtaaggtccaaggcttgctggagaatggcgattccgtgacgtcccccgaaaatatggcccccgggaaaggctctgatctggagctcctgagcagcctcctccctcagctaacgggtcctgttctcgagttgcctgaggccatcagggcccccctggaagagctcatgatggagggcgaccttcttgaagtgactctcgatgaaaatcacagcatttggcagctgttacaggctggacaacctcccgatcttgacaggattcgaaccctgttggagctggaaaaattcgagcatcaggggagccgcacccggtctcgcgctctggagcgtaggcgccgccgccagaaagtggatcagggaaggaatgtagagaacttggtacaacaggagctgcagagcaagcgagctcggagttctggcattatgagccaagtgggcagagaagaggagcactaccaagagaaagccgacagggaaaacatgttcctgactccttccacagaccactcccctttcttgaaaggtaatcaaaacagcttgcagcacaaagatagcggtagctcagctgcctgccctagtctgatgccacttctacagctgtcctactccgatgagcagcagttatag

SEQ ID NO: 193692 - DNA, 4449 bp, Artificial Sequence
  Description of Artificial Sequence: Synthetic coding sequence
atggagcccggctgcgacgagttcctgcccccccccgagtgccccgtcttcgaaccttcatgggctgagttccaggatccacttggatatattgccaaaatccggcctatagccgaaaagagcggcatttgcaaaatacggccacctgctgactggcagcctcctttcgctgtagaagtggacaactttagatttaccccacgggttcagagactaaatgaactagaggcccagactagggttaagttgaactacttggatcagattgccaaattttgggagatccaagggtcctccctgaagatccctaatgtggagcgcaagatcctcgacttatactccctgagtaagcagtgtaacactcacccattcgacaatgaagtgaaggataaagaatacaagccccattccatcccgctccgccagtcagtacagccctcgaaattcagttcctattcaaggcgggcaaagcgcctgcagcccgatccagagcctactgaagaagatatcgaaaaacatcccgagctgaagaagctccagatttacgggcccggtcccaagatgatgggacttggactcatggctaaggataaggataagacagtccataagaaggtgacttgccccccgacagtcaccgtcaaggatgagcagtcaggcggggggaacgtttcctccacgctgctgaaacagcacctgtccctggagccttgtactaaaactacaatgcagcttcgcaaaaatcacagttcggcccagtttatcgacagctacatctgtcaggtgtgctctagaggcgacgaagatgataagctccttttctgcgatggttgtgatgataactaccacattttctgtctgctgcctccactgccggagattccccgcgggatttggagatgtccaaaatgcatcctggccgaatgtaagcaaccccccgaagccttcgggtttgagcaggccacccaagaatattccctgcagagcttcggagaaatggcggattccttcaagagcgactacttcaatatgcccgtgcatatggtccccaccgagctggttgagaaggagttttggcgcttagtttcgagcatcgaagaggatgtcaccgtcgaatatggagctgacatccattcgaaagagtttggttcaggtttcccagtttccaattctaagcagaacctgtccccggaagagaaggaatatgccacgagtggttggaacttgaacgtgatgcccgtgttggatcagtccgttttgtgtcatatcaacgccgacatttccggaatgaaggttccttggttatatgtgggtatggtgttcagcgctttctgctggcacattgaagaccattggtcctattctattaactatctgcactggggggagccgaagacttggtatggcgtgccttctcttgccgcggagcatctggaggaggttatgaaaatgctaacacctgagctgtttgacagccagcctgacctacttcaccaactggtaaccctcatgaatccgaataccctgatgagtcacggggtacccgtggtgcggacaaatcaatgcgccggcgagtttgtgatcacattcccccgagcctatcatagtgggtttaaccagggttataattttgccgaagcagtgaacttctgtactgctgactggctgccagcagggcggcagtgtatagaacactaccgtaggttgcggcgctattgcgtattctcgcatgaagagctgatttgcaagatggctgctttccccgagacccttgatctgaatctcgctgtggcggttcacaaggaaatgttcattatggttcaggaagaacggcgacttagaaaagctcttctcgaaaaaggcgtaacagaagccgaaagagaggcgttcgaattgctgccagatgatgagcgacaatgcattaaatgcaagacaacatgctttctcagtgcccttgcatgctacgattgtcccgacgggctggtttgccttagccacatcaacgacctctgcaagtgctctagtagtcgccagtaccttcggtatcgatacaccttagatgagctgccaactatgcttcacaaactgaagatacgcgcagagtcgttcgacacttgggcgaacaaagttagagtggcgctggaggtggaagatggaagaaaaaggagctttgaggaacttcgagctttagaatctgaggctcgagagcgcaggtttcccaactcagagcttttgcagcggctgaagaactgtctgagtgaggtggaagcctgtattgctcaagtactcggactggtcagcggccaggtggcacggatggatacgccacagctgacgcttactgaactgcgggtcctgctggaacagatgggatctctgccatgcgcaatgcaccagattggggatgtaaaggatgtgctcgagcaggtcgaagcatatcaggctgaggctcgagaagcattggcgaccttaccttcttccccagggctgctacggagtcttctggagaggggacagcagctgggtgtagaagtgcccgaagctcaccagctgcagcagcaggtcgagcaggcgcagtggctcgatgaggtgaagcaagctctagctccttctgctcacagaggttccctcgtgataatgcagggcctgctggtcatgggagcgaaaattgccagctccccctccgtggataaagccagagctgagctgcaggaactacttactatagctgaacgctgggaggaaaaagcccatttttgcttagaggcccgccagaagcacccccctgctacacttgaagccattatccgagagacagagaatatccccgtacatttaccaaatattcaggcattgaaggaagctctcaccaaagcgcaggcctggatcgccgacgtggacgagatccagaacggcgaccattatccgtgcctcgacgatttggaggggctagtagccgtgggacgggacctgcctgtcgggttggaggaactgcggcaactggagctgcaggtgctgacagcccattcttggcgggaaaaggctagtaaaacctttctgaaaaaaaacagttgttacactttgttagaggtgctgtgcccctgcgctgatgcgggatccgactccacaaagaggtctagatggatggaaaaggccctcggcctgtaccagtgcgatactgagctgctcggattgagtgcacaggacctgagggacccgggctccgtgatcgtagcattcaaggagggggaacagaaggagaaggagggaattcttcagttgagacgaactaacagcgccaagcccagtccactcgccccttcgttaatggcgtcgagccctaccagcatttgcgtgtgcggccaagtgccggccggggtcggagtgctgcagtgcgacctgtgtcaagactggttccatggccagtgcgtgagtgtgccccacctcctgacatcacccaaaccaagtttgacctcaagtcccttgctcgcttggtgggagtgggatactaaattcctctgtcctctctgcatgcgctctagacgtcccaggttggaaaccatcctggctttgctcgttgcccttcagagactccctgttcgtctcccagagggagaggccctgcagtgcctgaccgagagggccatcgggtggcaggaccgcgccaggaaggctctggcaagcgaggatgtgaccgccctgctgaggcagctggccgagctgcgtcaacagttacaggccaaaccccggcctgaggaggccagcgtgtatacaagcgccacagcttgtgatcctatcagagaaggatcaggaaataatatctcaaaggtccagggtctgctcgagaatggagatagcgtgactagtccggagaatatggctcccgggaaggggagcgatcttgagttattatcctcattgctgccgcagctgactgggccagtgctagagctcccagaagctatccgcgccccactggaggagttgatgatggagggggacctcttggaggttactctggacgagaaccactctatatggcagctgctgcaggctggtcagccacccgacctggaccggatccggacactgctggaactcgaaaagtttgagcaccaggggagccggactcgttcacgagctttagagagacgtcggcgtagacagaaggttgatcaggggcgaaatgtggaaaacttggtgcaacaggagctgcagtccaagagagccagatcctctggtataatgagtcaggtgggtcgcgaggaagagcattaccaagagaaggccgaccgggaaaatatgttcctgaccccttctaccgaccactcaccgtttcttaaaggaaaccagaactcattgcaacataaagactcaggaagttcagctgcgtgcccttcacttatgcccctgctgcagctctcttacagtgacgaacagcagctgtag

SEQ ID NO: 193693 - DNA, 882 bp, Artificial Sequence
  Description of Artificial Sequence: Synthetic coding sequence
ctgcccaacatccaggccctgaaggaggccctgaccaaggcccaggcctggatcgctgacgtggacgagattcagaatggcgatcattacccctgccttgatgatctggaggggctggtggcggtgggtagagaccttcccgtaggactagaagagctgagacagctcgaactacaggtgctttgcccctgcgccgatgctggatccgactcgaccaagaggagcaggtggatggagaaggcacttggactgtaccaatgcgatacagagctgctgggactgagcgcccaggatctgcgcgacccagggagtgtgatcgtcgctttcaaagaaggggagcaaaaagagaaggaagggatcttacagctccgccgcacaaattcggcgaagccatcccccctggctcctagcctcatggcctccagtccaacatctatctgcgtgtgcggacaggtgccagctggagttggcgtcttgcagtgcgacctatgccaggactggttccacggccagtgcgtgtctgttcctcacctcttaacatcacctaagccgtcccttacgtcatccccactcttggcgtggtgggagtgggatacaaaattcctttgtcctctttgtatgaggtcaagacgtcccaggctcgagaccatcctggctctactggtcgctcttcagcgtctgccagtgagattgcccgagggcgaagcactgcagtgtctgactgagcgcgccattgggtggcaggatagagccaggaaggcactcgcctctgaagacgtgactgctctccttcggcagctcgcagaattgaggcaacagctacaagcgaaaccccggcccgaggaagctagtgtgtacacctccgcgaccgcatgcgattag

SEQ ID NO: 193694 - DNA, 4431 bp, Artificial Sequence
  Description of Artificial Sequence: Synthetic coding sequence
atggagcccggctgcgacgagttcctgcccccccccgagtgccccgtgttcgaaccatcttgggccgagtttcaggacccactcggatacatagctaaaatccggccaatagccgagaaatctgggatttgtaagatccgccctccggccgactggcagccgcccttcgctgtggaggttgataatttccgatttacaccaagggtgcaacgccttaatgaactggagattgttatcgaggaagggggctatgaagccatctgcaaagacagaagatgggcgagagtggctcaaagactgcattacccccctgggaagaacatcggtagcctcctcaggtcccactacgagcgcatcatttacccctatgaaatgttccagtccggggccaaccatgtgcagtgcaacacacatccttttgataacgaggttaaagacaaagaatataagccacactcaatacccttgaggcagagtgtccaaccctccaaattcagcagctatagcagacgtgctaagagactgcaacccgaccctgaacctactgaggaagatatcgagaaacatcctgagctgaaaaagttacagatctatggtcccggccccaagatgatgggtttggggctcatggccaaggacaaagacaagaccgttcacaaaaaagtgacatgccctcctaccgtgaccgtcaaggacgagcagagcgggggtggaaatgtttcctctaccctcttgaaacaacacctgagcctagaaccttgcacaaagacaactatgcagctgaggaagaaccactcttcagcccagtttatcgattcctatatctgtcaggtctgtagtagaggcgatgaagacgataaactcctgttctgtgatgggtgcgacgataactaccacattttctgcctactgccacctctacctgagatcccacggggtatctggaggtgcccaaagtgtatactggctgagtgcaagcaacctcccgaggcctttgggtttgaacaggcgacacaggaatactcattacagagcttcggggagatggccgattcattcaagagcgattacttcaacatgcccgttcatatggtgccaaccgagctggtggagaaagaattttggcggctagtttccagtattgaggaagatgtgactgtggaatatggagcagatattcactctaaggaattcggaagcggctttccagtaagcaattccaagcagaatcttagtccagaggaaaaggagtatgccacctcaggctggaatctaaacgtcatgccagtgttggaccagagcgttctctgtcatatcaacgccgatatttctggaatgaaggtcccttggctgtatgtggggatggtgttctcagccttttgctggcatattgaggatcattggtcttacagtattaattacctgcactggggggagccaaagacctggtacggcgtgcccagcctggctgcagagcacctggaagaagtgatgaagatgcttacccctgagctgtttgacagtcaacccgaccttctccatcaactggttacgctgatgaaccctaataccctgatgagtcacggggtgccagtcgtccgcacaaatcagtgcgctggcgagttcgtgattacgttccctcgtgcttaccatagcgggttcaatcagggctacaacttcgcggaggccgtgaatttctgtacggctgattggttgcctgccggacgacagtgcatagagcactaccggcgcctgcggcggtactgcgtcttcagccatgaagagcttatttgtaagatggcagccttccccgagactttagatcttaatctggccgttgctgtccacaaggagatgttcatcatggtacaagaagaacgcagactgcggaaagcactcttggaaaagggagttacggaagcagagcgggaagcctttgaactgttacccgatgacgaacggcaatgtatcaaatgcaagactacttgtttcctgagtgctctagcctgttatgactgtcctgacggactggtgtgcctcagccacattaacgacctttgcaaatgttcgagttcccgtcaatatctccgataccgctatacattagatgagcttccaactatgctacataagctgaaaatcagggccgaatccttcgatacgtgggcaaataaagttcgagtggctctcgaagttgaagacggacggaaaaggagcttcgaggagctcagagccctagaatcagaggctagggagcgcagattccccaactctgagctcctgcaaagacttaaaaactgccttagtgaagtcgaggcgtgtattgcgcaggtcctgggcctggtgtcgggccaggtagctcgcatggataccccccagttaaccttgacggagcttcgggtactgttggagcagatgggaagcttgccttgtgccatgcatcaaataggggatgtgaaagatgtcctggaacaggtggaagcctaccaggcagaagccagagaggcattagccactctcccttccagtccaggtttactacggagcttgctggagcggggacagcaattgggcgtggaagtgcctgaggcacatcaattgcagcagcaggtggagcaggctcaatggctggacgaggttaagcaggccctggcccccagtgcccatagaggctcccttgtgattatgcaaggcctgctggtcatgggtgcaaaaattgccagctctccttccgtggacaaggctcgggccgaactgcaggagttgttgaccatcgcagaacgctgggaggagaaggcacatttctgcctggaagccaggcaaaagcatccgccagcaactctcgaggccattataagagagaccgagaacattcccgtgcatctaccgaacatacaagcgcttaaggaggctctgaccaaggcccaagcctggattgccgacgtagacgaaattcagaatggagaccattatccctgcctcgatgacttggagggcttagtggccgttggtagggacttgcctgtcggtctcgaggagttgcggcagttagaactgcaggtcctgacggctcacagctggcgggaaaaagcatccaaaacgttcctcaagaagaattcatgttacaccttacttgaggtgctctgtccttgcgcagacgcaggctccgattccacaaaacgctcgcgttggatggagaaggcactcgggttatatcagtgcgacacggagctgctcgggctgtccgcccaggatctgcgcgaccctggatcagtaattgtggcatttaaggagggggaacagaaagagaaggaggggatcctccagttgagaagaacaaacagcgctaagccgtctcccctcgcccctagcctgatggcttcttctccaacttctatctgcgtgtgtggccaggtcccggctggggtcggggtccttcagtgtgacttgtgtcaggattggttccatgggcagtgcgtgagtgtgccacacctcctgacaagtcctaagcctagcctaactagtagccctctactcgcttggtgggaatgggatacaaaattcctatgccccctgtgtatgaggtcacggcgaccaagactcgaaactatcctcgccttgcttgtggcattgcagagactgcctgtacgcctgcctgagggggaagctctacagtgcctcactgagagggcaatcgggtggcaagacagggcgaggaaagctcttgcgagcgaggatgtgactgcgttactgagacagttggccgagctccggcagcaattgcaagcaaagcctagacccgaggaggcctctgtttatacctctgcaactgcttgtgacccaatacgggaggggtctggcaacaacatctctaaggtccagggactgctggaaaacggtgatagcgtcacgtcccccgaaaacatggctcccggcaaaggtagtgatttagagcttctgtcctccctgctacctcagctcaccggcccagtcttggagctccccgaggccatccgggcgccactggaagaactcatgatggagggagatttgctagaggttactctggacgaaaatcacagcatctggcaactgctgcaggcagggcaaccacccgacctcgaccgaatccggacactgcttgagctggagaaattcgagcaccagggcagccggacccgcagcagggcactggagaggaggcgccgtaggcagaaagtagatcaaggacgcaatgttgagaatctcgtccaacaggagctccagagcaaaagggccagatcgagtgggataatgagtcaggttggtcgcgaagaggaacactaccaggaaaaggccgatagagagaatatgttcctgacaccttctacagatcattcaccttttctcaagggaaatcagaactcgcttcagcacaaagacagtggttag

SEQ ID NO: 193695 - DNA, 1278 bp, Artificial Sequence
  Description of Artificial Sequence: Synthetic coding sequence
atggagcccggctgcgacgagttcctgcccccccccgagtgccccgttttcgagccatcgtgggcagagttccaggacccactgggttatatcgcaaagatccgaccgatagccgagaagtctggcatctgtaaaatccgcccaccagcagactggcagccaccattcgccgtggaagttgacaatttcagatttacgccacgtgtgcaacgcctgaatgagctggaagctcagacccgggtgaagctcaactaccttgatcaaattgccaagttctgggagatccaaggctcctctctcaagatacccaatgtggagaggaaaattctagatctgtacagtctctctaaaatcgtcatcgaagagggcggctacgaggctatctgtaaagacagacgctgggcccgggtggcacagcggctgcattaccctcccggaaagaatatcggaagtctcctgcgcagccactatgaaagaattatatacccctatgagatgtttcagtccggcgcaaaccatgtgccagagccaacagaggaggacatcgaaaagcatcccgagcttaagaagttgcagatttatggacctggaccgaagatgatgggcctgggcctgatggctaaggataaggataagaccgttcataagaaagtcacctgcccgcccaccgtgactgtgaaagatgaacagagcggtggcggcaatgtgtcgtccaccctcttaaagcaacacctcagcctggagccttgcacaaaaaccaccatgcagctgcgaaagaaccatagctcggcccagtttatagactcatatatctgccaggtatgctcccgcggcgatgaagacgataagttgctcttttgtgacgggtgtgacgacaattaccatattttctgccttctgccgcccctaccggagatcccccggggcatctggcgatgtcctaaatgcatcctcgctgaatgcaaacaacccccggaagccttcggattcgaacaggcaacccaggagtatagtttgcagagcttcggtgagatggctgatagcttcaaatcagactactttaacatgccagtgcacatggtccctaccgaactcgtggaaaaggagttctggcgactcgtcagctcaatcgaagaagacgtcactgtggaatatggggccgacatccatagtaaggagttcggctctggctttccggtgtccaatagtaagcagaacttgtcccctgaggaaaaggaatacgccaccagtggctggaatcttaacgttatgccatag

SEQ ID NO: 193696 - DNA, 2667 bp, Artificial Sequence
  Description of Artificial Sequence: Synthetic coding sequence
atggagcccggctgcgacgagttcctgcccccccccgagtgccccgtctttgaacctagctgggccgagttccaggacccacttggctatatagccaagatcaggcccatcgcggagaagtcaggcatctgtaaaatcagacccccagccgattggcagccacctttcgccgtcgaggttgataactttcgtttcacgcctcgggttcagcgacttaacgagcttgaagcgcagacgcgggtgaaattgaactatctagaccagattgccaagttctgggaaattcaggggtctagtctgaaaatcccaaacgtcgaacgcaagattcttgatctttattccctgtcaaaaatcgtgatcgaggagggcggctacgaagccatttgtaaggacagacggtgggcccgtgttgcccaaagactgcattacccccctggtaaaaacattgggagtttgctgagatcacactacgaacggatcatttacccatacgaaatgttccaatccggggctaaccacgtgcaatgtaacacacacccttttgacaatgaggtgaaggataaggaatataagcctcatagtataccccttcgccagtcggttcaaccttcaaaatttagctcatattctaggcgcgctaaaaggttgcaacccgacccggaacctacagaagaggacattgagaagcaccctgaattgaaaaagctgcagatttacggcccaggacctaaaatgatgggtttgggcctcatggcaaaggataaggataaaactgtccacaagaaagttacctgtccgcccacagtgaccgtcaaggacgaacagagtggcggagggaacgtaagttctacactgctcaagcagcatctgtccctagagccatgcacgaaaacaaccatgcagcttagaaagaaccattctagcgcccagtttatagactcttatatctgtcaggtgtgtagtagaggggacgaggacgataagttgctgttttgcgatgggtgtgacgataactatcacatcttttgtctgctgccccctctaccagaaattccaaggggtatttggagatgtccgaagtgcatcctagcagaatgcaagcagcccccagaagctttcggtttcgaacaggctacacaggaatactcactgcagagcttcggcgagatggctgattcttttaagagcgattatttcaatatgccagtgcatatggtacctactgagctagtggagaaggagttttggaggttagtgtcatcaatagaggaagacgtgaccgtggaatacggggcagatatccattctaaagaattcggctctggattcccagtttctaactccaaacagaatctgagtcccgaagaaaaagagtatgctactagtggctggaatctgaacgtgatgccagtgctggaccagtctgtcctgtgtcatataaatgctgatatttcgggcatgaaagttccatggctttatgtgggcatggttttcagtgctttttgctggcacatagaggatcactggtcatatagtatcaattaccttcattggggagagcctaaaacatggtatggtgtgccctctctggctgctgaacatctggaggaggtcatgaagatgttaacacccgagctgttcgacagtcagcccgatttgttacaccagctggttaccctgatgaacccaaataccctaatgagccacggcgtccctgttgtgcggacaaaccagtgcgctggggagtttgtgataacattcccacgagcctaccactctggatttaaccagggttacaattttgcagaagcggtcaacttttgtaccgctgactggctgcccgctggtcgacagtgcatcgagcactatcgaaggctccggagatattgcgtgttctcccatgaggagctcatatgtaagatggctgccttccccgagacgctggatctgaatctggccgtggcagtgcacaaagagatgttcatcatggttcaggaagaacggcgcttgcgcaaggccctcctggagaagggcgtgaccgaggctgaacgtgaggcattcgaactgctccctgatgatgaacggcagtgcattaaatgtaagacaacatgcttcctttctgcgctggcgtgctatgactgtcccgacggcctagtgtgcttgagtcacatcaatgacctctgcaagtgcagtagctccaggcaataccttcgttaccggtacaccctggacgaactgccgactatgctgcataaactgaagatacgggccgagtcattcgacacctgggccaacaaggtccgcgtagctctggaggtcgaggatggccggaagcgcagcttcgaggaactgcgtgcattggagagcgaggcacgggagcgcaggtttcctaacagcgagctgcttcaaagattaaaaaactgcctttcggaagtagaggcctgtattgcacaggtactgggcttggtttctggccaagtagcgagaatggacactccgcagctcaccttaaccgagctgcgggtgcttttggaacagatggggtccctgccctgtgcgatgcatcagatcggagatgtgaaagtgctgtcatggaaatggcgccggtatgtcttcccctatcacttatgcgtttacagcatgcagggaaacatcttacccgattag

SEQ ID NO: 193697 - DNA, 4713 bp, Artificial Sequence
  Description of Artificial Sequence: Synthetic coding sequence
atggagcccggctgcgacgagttcctgcccccccccgagtgccccgtcttcgagccctcttgggccgagttccaggaccctttaggctacatagcaaaaattcggcctatcgccgaaaaatctggtatatgcaagattagacctccagcagactggcaaccccccttcgcagttgaggtggacaactttagatttacacctagagtgcagagactgaacgagctggaagcccagacacgggtgaagttgaattatctggaccaaatcgccaaattctgggagatccaaggttcatccttgaaaattcctaatgttgagagaaaaattctagacctgtactccctgtcaaaaattgttatagaagaaggagggtatgaagcaatttgtaaggatcgtcggtgggccagagtggcgcagaggctccattatcccccaggcaaaaacattggatctctgctccgctctcattatgaacgtataatctacccatacgagatgtttcaatccggagccaatcatgtccagtgtaatacgcacccatttgacaatgaggtcaaagacaaggaatacaagccccactcaattccattaaggcaatcagttcagccatccaaattttcctcttacagccggcgagccaagagactgcaacctgaccctgaaccaaccgaggaagatatcgaaaagcatcccgagctcaaaaagcttcagatctacggccctgggcctaaaatgatgggcttgggattaatggccaaggacaaggataaaaccgtgcacaaaaaggttacatgtccccccacggtaaccgtgaaggatgagcaaagcgggggaggcaacgtttcatccacactgctgaaacagcacctatcccttgaaccatgcaccaagaccacaatgcagctcaggaagaaccattcgtccgcccagttcattgactcttacatatgccaggtctgtagtagaggcgatgaagatgacaagttactcttctgtgatgggtgtgatgacaactaccacatcttctgcctgctgccgccgttacccgagatcccgagagggatatggaggtgcccaaaatgcatcctcgccgaatgcaaacagcctccagaggcctttggatttgagcaggccacacaggagtacagccttcagagcttcggcgaaatggctgattcttttaagtctgattactttaacatgcctgtccacatggtacccactgagctggtggagaaagagttctggaggctggtgagttcaattgaagaggacgtgaccgtagagtacggcgcggatatccattccaaagagttcggctccgggttccctgtatcgaacagtaaacaaaacctcagccccgaagagaagcggcagagtcttactgttctgacacggctgatatcatctttttgggcacaagcagttctaccgccctggcctccaaaagtgctgggattacaagaatacgccacttctgggtggaacctgaatgttatgcccgtactcgatcagtcggtcttgtgccacataaacgccgatatcagcggcatgaaagtcccctggctctatgtaggcatggttttctctgccttttgttggcacatcgaggatcattggtcttatagtatcaactatttacactggggggagcctaagacctggtacggcgttcccagtctggctgctgaacatctggaagaggtaatgaagatgctcacccctgagcttttcgacagccagccagacctgctgcaccagctagtaactctgatgaatccaaataccctgatgtctcatggcgtgcctgtcgtgagaaccaaccagtgtgctggggagttcgtgattacatttccacgggcatatcatagtgggttcaaccagggctacaattttgccgaggctgtgaacttctgtacggctgactggctgcctgcaggcaggcagtgtatcgagcattatcgtagattgagacgctactgtgtgtttagtcatgaggagttaatctgtaagatggcagcatttcccgagacactagacctcaatctggccgtggctgtccacaaagagatgttcattatggttcaagaagagcggagactgcgtaaggcactgctagagaagggagttacggaagccgaaagggaggcctttgaactccttcctgatgacgagagacagtgcattaaatgtaaaactacatgtttcctgtctgccctggcgtgttatgattgtcccgacggcttggtttgcctttcccatattaatgacctgtgcaagtgctcttccagcaggcagtacctgagatacagatacactctggatgagttgccaacaatgttgcacaaattgaagatcagggcagagtcattcgacacatgggcaaacaaggtccgcgtagctctcgaagtggaagacggtagaaagagatcattcgaggaactgcgggcactcgagagcgaggcccgtgaacgacgttttccaaactcagaactgttgcaaaggctcaaaaattgcttgtccgaggtcgaagcatgcatcgcccaggtgctcggactggtgagcggccaggtggctcgaatggacaccccacagctcacgctgacagagcttagagtgctgctagaacagatggggtctctgccatgcgctatgcaccaaatcggggacgtgaaagatgtattagaacaggtagaggcttatcaagctgaagcccgcgaagcgctggccacactcccgagcagtcccgggctgctcagaagcctccttgagaggggccagcaactgggtgttgaagtccccgaagcccatcagctgcagcagcaggtggaacaggcacagtggctggatgaagtcaaacaagctcttgcgcctagcgcgcaccgcggaagtctcgtcatcatgcaaggcctcctagtcatgggggctaagattgcctcctcacccagcgtggacaaagcccgggccgagctacaagagctactcactatagccgaaagatgggaagaaaaagcccacttttgtttagaagccaggcagaagcatccgccagcaaccctcgaggccatcattcgagagacggaaaacatccctgttcacctgccaaacatccaagctctgaaagaggcactcactaaagcccaggcctggatcgcagacgtggacgaaattcagaatggagaccactacccctgcctagacgatttggaggggcttgtggcggtgggccgcgacctcccagtgggattggaggagctccgccaactcgagctgcaggtccttaccgcacattcttggagggagaaggcatcgaagacgtttctgaaaaaaaactcttgttacaccctgttggaggtcctatgcccttgcgcggatgccggtagcgacagcaccaagagaagccgatggatggagaaagcccttggtttataccaatgcgatactgagctgctaggtctaagtgcccaggacctccgggatccaggcagcgtgattgtcgcctttaaggaaggcgaacagaaagagaaggagggaattcttcagctcagacggacaaattcagcaaagccctctcccttggccccttcactgatggccagcagccccactagtatctgcgtgtgcggccaagtcccagctggtgtcggggttctgcagtgcgacctgtgtcaggactggtttcatgggcaatgtgtgtctgtgccccacctcctgacgtccccaaagccctctctcaccagttcccccctgctcgcatggtgggaatgggataccaagttcttgtgtcccctctgcatgaggtctaggcggcctagattagaaactattttggccctcctggttgccctgcaacgcctgcccgttcgcttaccggaaggagaggccctgcagtgtttgactgagagagcgatagggtggcaggatagggcacgcaaggcacttgcttcggaggatgtgaccgctctgctgcgacaacttgctgagctgcgtcaacagctgcaagccaagccaaggcctgaggaagcatccgtgtacactagcgccacagcttgcgacccgatccgagaggggtcgggcaacaacatatccaaagttcagggattactagaaaacggagactccgtaacatccccagagaacatggcaccggggaagggatcagacctcgaattgctttcctccctactgccacagctgacgggccctgtgctagagctcccagaagctattcgagctcctcttgaggaacttatgatggagggggatttactcgaagtaacactcgatgaaaatcattcgatttggcagctactgcaagcaggacagccacccgacctggatcgcatccggacattactcgagcttgaaaaattcgagcaccaagggtctcggacacgctcaagggccctggagagacggcgccgaagacagaaggtagaccagggaaggaatgtggaaaatttggtacagcaggagttacagagtaagcgggcccgctctagcggcataatgtcacaggttgggagggaagaagagcattaccaggaaaaagctgatcgggaaaatatgttcttaacccccagtacggaccacagtcctttcttgaagggcaaccaaaactcactccagcataaggattcaggatcctccgctgcatgcccatcattaatgccgctcctgcagctctcatatagcgatgaacagcagctgtag

SEQ ID NO: 193698 - DNA, 3297 bp, Artificial Sequence
  Description of Artificial Sequence: Synthetic coding sequence
atggacctgggcaccctgtacgagagctgcaaccagccccaggacgcaatcaagtgctatcttaacgcaactagaagcaagtcatgttcgaacacttccgccctcgccgccagaataaaatacctgcaggcccagctgtgcaatctaccgcagggatccctgcagaacaagacaaaactgcttccgagcatcgaagaggcgtggtccctgcccataccagctgaactgacctctaggcaaggtgccatgaacacagctcaacaggcctgtaagccacatcaccccaacacggaacccgtcctgggactgagccagaccccaatctcccagcagagcctccctctgcacatgataccgagctctcaagtggatgacttgtcttccccggcaaagcgcaaacgtacttccagccctaccaaaaacaccagcgataactggtcaggggggcatgcggtgtcccacccacccgtccaacagcaggcccacagctggtgcttgaccccccagaagctgcaacatctcgagcagctcagagcaaaccgcaataacctgaaccccgcccagaagttgatgctggaacagctggagtcccagtttgtgctgatgcagcaacaccaaatgcggccaactggggtggctcaagttcgttcaactggaattccgaatggccccaccgctgattcgtccctacctaccaacagcgtgtccgggcagcaacctcaactcgccttgacaagagtgcctagtgtgtcccaacccggagtgagacccgcatgccctggccaacctctggcaaacggtccgttttccgcgggacacgtgccctgcagcacctcacgcaccctcggaagcacagataccatactcattggaaacaatcacatcactggatctgggagcaacggtaacgtgccgtacctgcaaaggaatgccttgacgctccctcacaatcgaacaaaccttacttcttctgccgaagagccttggaagaaccagctgtcaaacagtacacaggggttgcacaaagggcagagttctcatagcgcaggccccaatggggaacggcctctttccagcaccggtccctctcagcatctgcaagctgcaggatctggaatccagaaccagaacggacacccgaccctgcccagtaattctgtgacccagggagccgctttgaatcacctatcaagccatacagctacatccggcggccagcagggtattacactgactaaggaaagtaagccgtccggaaatatactcaccgttccggaaactagtagacacacaggtgaaacccccaacagcaccgcctcggtagagggtctgcccaaccatgttcatcaaatgactgccgacgctgtctgctcgccctcacacggagattcaaagagccctgggctactgagttcggataatccacagttgagcgctctcctcatggggaaggccaacaacaatgttggaactgggacctgcgataaagtcaacaacatccaccctgcagtacacaccaagactgacaactctgttgcgagctcacccagctccgctattagtaccgcaaccccgtcccccaagagtaccgagcaaaccaccaccaactccgtaacctctctaaatagtccgcactctggcctccacaccataaatggagaaggcatggaagagagtcagtcccccatgaaaacagatctgcttcttgtcaaccataagccctcgccccaaataattccaagtatgtctgttagtatctatccgtcctcggccgaggtgctgaaggcatgcagaaacttaggaaaaaacggactgagcaacagcagcattctgctggataaatgtccacctccccgaccaccttcttcgccttatccccccttgccaaaggataagctcaacccgccaactccttctatttatctggaaaataaaagagatgcctttttccctccgctccaccagttttgcactaatcccaataaccccgtgacagtaattcgcgggctagctggcgcattgaagctcgacctcggcctgttcagcaccaaaactctggtggaggcaaacaatgaacatatggtagaagtgaggactcaattgctccaacccgccgacgagaattgggatcctaccggaactaaaaagatctggcattgtgagtctaaccggagccacacaaccatcgctaagtatgcccaatatcaagcatcctcatttcaagagagtctgagggaggagaacgaaaaacggagccatcataaagatcatagtgactctgagagcacaagttctgacaattccggtcggcgcagaaaggggcctttcaaaactatcaaatttggaaccaatattgatctctcagatgataagaagtggaagctccaactacacgagctgacaaagctgcccgcgttcgtgagggtcgtgtcagccggtaacctgctctcccacgttggtcatacaatcctaggaatgaacactgtccaactttatatgaaagtaccggggagtcgtacgcccggccatcaggagaacaacaacttttgttcagtcaacattaatatagggcctggggattgcgagtggttcgtggtgccggaaggatattggggcgtgctcaatgatttctgtgagaagaataacctcaatttcctgatgggcagttggtggcctaacctggaggacctatatgaggcaaatgtgccagtatatcgctttattcagcgccctggggatcttgtctggattaacgcagggaccgtacactgggtgcaagctatcggatggtgcaacaacatcgcttggaacgtgggtcctctgacagcctgccaatataaacttgccgtggaacgttacgaatggaacaaactgcagagtgtcaaatctattgttcccatggtgcacctttcttggaacatggcacgaaacattaaggtgagcgacccaaagctctttgagatgattaaatactgcctcctgcggaccctgaaacagtgtcagaccctgagggaggcccttatcgcagcaggcaaagaaattatctggcacggtaggaccaaggaggagccagctcattactgttctatctgtgaagtcgaggtctttgaccttctattcgtgaccaacgagtccaattcgcgcaaaacatacattgttcattgccaagattgcgcgcggaaaacaagcgggaacctagagaactttgttgtgctcgagcagtacaagatggaagatctgatgcaggtttacgatcagttcacgctcgccccgccactcccatcggctagctcatag

SEQ ID NO: 193699 - DNA, 4206 bp, Artificial Sequence
  Description of Artificial Sequence: Synthetic coding sequence
atgaagagctgcggcgtgagcctggccaccgccgccgccgccgccgccgccttcggtgatgaggagaagaaaatggcggcaggcaaggccagcggggaaagcgaagaggcttcgccttcactgaccgccgaagagagagaagccctgggaggcttggatagccggctgttcggatttgtgaggtttcacgaagacggcgcccgcaccaaggccctgcttgggaaggctgtaagatgttatgagagtctgatccttaaggccgaaggtaaagttgagagcgactttttctgccaactgggtcacttcaatctgttgctagaggattatccaaaagccctctctgcctatcagcggtattactcactgcaaagtgactactggaaaaatgcggcctttctgtacgggctaggccttgtctacttccactacaacgccttccaatgggctatcaaggcgtttcaagaagtcctatacgtagatccctcattttgtagggctaaagaaatacacctgcggctcggcctcatgtttaaggtgaacaccgattacgagagtagtcttaagcattttcagctggccctggtcgactgcaacccctgtacattgagtaatgcggaaattcagtttcacattgctcatttatacgaaacacaacgtaaatatcactcggcaaaggaagcatatgagcagttactgcagactgagaacctgagcgcgcaggtcaaagctactgttctgcaacagctgggatggatgcaccacacagtcgatctgctgggagacaaagcaaccaaagaatcctatgccattcagtatcttcagaagagcctggaggccgacccaaactctggccagtcttggtacttcctcggtcgatgttattcctcaataggcaaagtgcaggacgcttttatcagttacaggcagtctattgataagagtgaagcatccgctgatacctggtgttcaattggagtgctttaccagcagcagaaccagcccatggatgctctccaggcgtatatttgcgcagtacaactggaccacggccacgccgccgcgtggatggatcttggcacgctatatgaaagctgtaaccaaccacaggatgccataaaatgttacttaaacgccaccagatccaagtcatgctccaatacaagtgcattggcagcacggatcaagtacctgcaagcgcaactgtgtaatctgcctcagggatccctgcaaaacaagactaagctgctaccatctatagaagaggcctggtccctgcctataccagctgagttgaccagccgccaaggtgccatgaacacagcccaacaaaacacctcagacaactggagtggaggccatgcagtgtcccacccccctgttcaacagcaggcccacagttggtgtctgacaccacagaaactacagcacctcgaacagctccgtgctaataggaataatctaaacccggcgcagaagctgatgttggagcaattggagtctcaattcgtcctgatgcagcagcaccagatgcgccccacaggggtagcacaggttaggagcacaggtattcccaatggacccaccgcagacagctcacttcctaccaattccgtgtcaggccaacagcctcagctggccttaactcgagtaccctccgtcagtcagccgggtgtgagaccagcatgcccgggccagcctctggctaatggccccttctctgccggccatgtgccatgctctacaagccgcaccctcggcagcactgataccatactgataggtaacaatcacattacaggttccggcagcaatggtaacgttccctacctacagagaaatgccctcactttgccacataacaggactaatctgacgtctagcgctgaggaaccatggaaaaatcaattgagcaattcaactcaaggcctgcataaggggcaatcatcccatagcgccggcccaaatggcgaaaggccattgtcgtctacaggaccttcccagcatctgcaagcagctgggtccgggatccagaaccaaaatgggcatccaactttaccttccaatagcgtgacacagggcgccgcgctcaatcatttgtcatcccataccgctacaagtggaggccaacagggaatcacactcaccaaagaaagtaaaccatccggcaatatcctcaccgttcccgaaacgagccgacacactggggagactccaaatagtactgcaagcgtggaaggcttgcccaaccatgtgcaccagatgactgctgacgccgtctgctctcccagccacggtgacagtaaaagccctggactgttgagtagcgacaaccctcagctttcagctttattgatgggaaaagcaaataacaatgtcggaaccggtacttgtgacaaagtgaacaacattcatccggctgtgcacactaaaacggacaattctgtggcctccagcccttctagcgcaatatcaaccgccaccccctctcctaagagcaccgagcagaccactacaaatagcgtgaccagcctcaatagcccgcactccggactgcacacgatcaatggagagggcatggaggagtctcaaagtccgatgaagactgacctattgcttgtgaatcacaagcctagccctcagatcatcccttctatgtccgtgagcatttatccaagttccgcagaagtactaaaggcatgtagaaatctgggcaaaaatggccttagcaacagctctattctcctagacaaatgccctcccccacggcctccctctagcccttacccaccacttcctaaggataagctcaatcccccgacaccgtctatctacctcgagaacaaacgcgacgctttcttccctcccctgcatcaattctgcacaaaccctaacaatccagtcacggtgattcgggggttggccggagccctgaaactggatctgggtctgttcagtacaaagactctggttgaggcaaataatgagcacatggtcgaagtacgtacccagctgctccagcccgccgatgaaaactgggatcccactggaacaaaaaagatctggcattgcgaaagtaatcgaagccacactacaatagccaaatacgcccagtatcaagccagcagtttccaggagagcttgcgcgaagagaacgaaaagcgcagccatcacaaggaccattccgactcagaatccactagtagcgacaattcagggcgcagaagaaagggaccattcaaaacaattaagtttggaacgaatatcgaccttagtgatgacaagaaatggaaactacagttacacgaactgacgaaacttccagcgttcgtgcgggtggtttctgctggaaatttgctatcccacgtggggcacacgatattgggaatgaacacagtgcagttatatatgaaggtgcccggatctcgcacacccggccaccaagaaaataacaacttttgttccgtgaacatcaatatcggcccaggtgattgtgagtggtttgtggtccctgaggggtactggggagtgcttaacgatttctgcgaaaagaataacctgaattttctcatgggatcttggtggccaaatttggaggacctgtatgaggcaaacgtgccggtgtacaggtttatccagagaccaggagaccttgtgtggataaacgcaggcaccgtgcactgggtgcaagcaattggctggtgtaataatatcgcatggaacgttgggcccctgaccgcctgtcagtataagctggcggtcgagcgttatgaatggaacaagctgcagagcgtcaaatctatcgttccaatggttcaccttagctggaatatggctcgtaacatcaaggtttctgatcccaaactatttgagatgataaaatattgtcttctcagaacgctgaaacaatgtcagacattgagagaggccttgatcgcggccggcaaggagatcatctggcacgggaggacgaaggaagagcctgcgcactattgttcaatttgcgaggtcgaggtttttgacctgctgtttgtaactaacgagtcgaatagtcggaaaacctatatcgttcactgtcaagactgcgcacggaagacaagcggaaacctggagaattttgtggtcctggaacagtataagatggaggatctgatgcaagtgtacgaccaattcacgctcgccccgccactgccgtcggccagtagctag

SEQ ID NO: 193700 - DNA, 4227 bp, Artificial Sequence
  Description of Artificial Sequence: Synthetic coding sequence
atgaagagctgcggcgtgagcctggccaccgccgccgccgccgccgccgcttttggagacgaggagaagaagatggcagctgggaaggcctcgggggagagtgaagaagccagtccgagcctgactgccgaggagcgggaggctcttggcggtctggatagccgcctctttggatttgtgagatttcacgaggatggcgcgaggaccaaggccttgctggggaaagccgttaggtgctacgagtccctaattctgaaagctgaagggaaagtcgagagtgacttcttttgtcagctgggacatttcaacctgttgctcgaggattaccccaaagccctgagcgcttatcagaggtattacagcctgcagtcagactactggaagaacgctgcgtttctctacgggttaggcttggtgtacttccattacaatgctttccagtgggcgattaaagcgttccaggaagttctgtatgtggatcctagcttctgtcgagcaaaagagatccatcttcggttggggcttatgttcaaggttaatactgattacgaatcctcgctcaagcatttccaactggctttggtcgattgcaacccgtgcaccctgtctaatgcagaaattcaattccacatagcacatttatatgaaacccaaagaaaataccattctgccaaagaggcatacgaacaattgctccagaccgagaatctctctgcgcaggtgaaagccacagtcctccaacagctgggctggatgcaccatactgtcgatttgttaggagacaaggctactaaggagtcgtacgctatccagtacctgcaaaaatccctggaggcggaccctaattccggacagtcatggtatttcctgggccgctgctacagctctatcggtaaggttcaggacgcatttatctcgtaccggcagtcaatagataagtctgaggcctccgcagatacctggtgtagtataggcgtactctaccagcagcagaatcagcccatggacgcgcttcaggcctatatttgcgctgttcagctggaccacggtcacgcggctgcatggatggacctcggaactctctacgaaagctgcaatcagcctcaggatgctataaaatgctatctgaacgcgactaggtctaagtcctgctcaaacacttcggctctggcagccagaatcaaatacctgcaagcctgtaaaccccatcacccgaacaccgaaccagtgctggggctctcccagacaccaatatctcaacaaagccttcccctccatatgattccatcatcccaggtggacgatttgtcatctcccgcaaagcgtaaacggacaagctcccctacaaagaacacctccgataactggtccggggggcacgccgttagtcacccacccgtccaacagcaggcccactcctggtgcctcacccctcaaaagcttcagcatctggagcagttgcgagctaataggaataatttaaatcccgcccagaagctcatgctggagcagctcgagagtcagttcgtgctgatgcaacagcaccagatgaggcccactggggttgcacaagttaggtccaccggcattcccaatggtccgactgctgatagctccctcccaacaaactccgtgtccgggcagcagccccagcttgccctgacgcgcgtcccatctgtttctcagccaggagtccgaccggcttgccccggacagcctctggcaaatggaccctttagcgccggccatgttccgtgctccacctccagaaccttgggatctactgataccatccttatcggaaacaatcacatcacaggctccgggtccaatgggaacgtgccgtatctgcagagaaatgccctaacactgccccacaaccgcacaaacctcaccagcagtgcggaggaaccttggaaaaatcagctgtctaactctacccaagggctgcacaaaggacagagtagccactcagcaggccccaatggcgagagaccgcttagttcaactggcccaagtcagcatcttcaggcagccgggtctgggatacagaatcagaacgggcacccgacactcccaagcaatagcgttacgcagggcgctgctctcaaccatctaagcagccatacagccaccagtggcgggcaacaaggcattaccctgacaaaggaatctaagccttccgggaacatcctgactgtgcctgaaaccagtcggcacaccggagagacccccaacagtaccgcatcggtggagggattgcctaaccatgtccaccagatgacagcggatgcggtctgcagcccaagtcatggcgacagcaaatcgcccgggctgctatcttctgacaacccccagctgagcgcattattgatgggtaaggctaataataacgtgggcactggaacatgcgataaggtgaataatattcaccctgccgtccatactaagaccgacaactcggtagcaagcagtccaagctccgcaataagtacagccacgccaagcccaaaatccactgaacagacgactaccaatagcgtcacctccctgaattcaccacattccggtctgcacaccatcaacggagagggaatggaggagagccagagcccaatgaagaccgatcttctgttagtgaaccataaaccaagcccccaaattatccccagcatgtctgtctccatatacccctctagtgctgaagtccttaaggcgtgcagaaacctgggtaagaacgggttgagtaactcctctatcctcctggacaaatgcccccctccccgtcctccttcttctccatacccacccctgccgaaggataagctgaaccctccaactccctcaatctacttggaaaataaaagggatgcgttctttccgcccctgcaccagttctgcacaaaccctaacaaccccgtcaccgttatcagaggccttgctggcgccctcaagctggacttgggattattctctacaaaaaccctcgtcgaagccaataacgagcacatggtggaggtgcgcacgcagctgctccagcccgcggatgagaattgggatcctacgggtacaaagaaaatatggcactgtgagtccaaccggagccacacaaccattgctaaatacgcacaataccaagcctctagcttccaggagtctctgagggaagaaaatgaaaaacgatctcaccataaggaccattctgactcagagtcaaccagctcggataattcagggagacgcaggaagggccccttcaaaacaattaaattcggcaccaatattgacttgagcgacgataaaaagtggaagctgcagctgcacgagctcactaaactccctgccttcgttagggtagtctcagctggcaacttactgagtcatgtaggccacacgatcctgggtatgaacaccgtgcaactatatatgaaagtccccggctcgagaacccccggccatcaggaaaataataacttctgctcggtaaatataaacatcggccctggcgattgcgaatggttcgtcgtgcctgaggggtactggggtgtgctgaacgatttctgcgaaaagaacaacctcaactttctgatgggaagctggtggccgaacctggaggacctctacgaggctaatgtaccggtctacaggtttattcagcgcccaggggacctggtgtggatcaatgcagggacagtgcactgggtgcaggctataggctggtgtaacaacatcgcatggaatgtcggcccactgactgcttgtcagtacaaactggctgttgagaggtatgaatggaataagcttcagtccgtgaaatccatcgtgcccatggtgcatttgtcttggaacatggccaggaatattaaggtctcagacccaaagttgttcgaaatgattaaatactgcttgctgaggactctgaaacagtgccagacattacgcgaggccctgattgccgcaggaaaggagattatatggcacggccgtaccaaggaggaaccggctcattattgtagcatctgcgaggtggaagtcttcgaccttttattcgtaactaatgaaagcaatagtcggaagacttatattgtacattgtcaggactgtgctaggaaaacttccgggaatttggaaaatttcgttgttctggagcagtataaaatggaagacctgatgcaggtgtatgatcaattcacacttgcacctccactgccatccgccagtagttag

SEQ ID NO: 193701 - DNA, 3000 bp, Artificial Sequence
  Description of Artificial Sequence: Synthetic coding sequence
tgaggcaccctgtacgagagctgcaaccagccccaggacgccatcaagtgctaccttaacgcaactcgctccaagtcttgttctaatacatccgcactggcagcaagaatcaaataccttcagaatacctcggacaattggtccggggggcacgctgtctcccaccccccagtccaacagcaggcccactcatggtgcctgactcctcagaagctacaacaccttgagcagttgagggctaacagaaataatcttaatcccgcccagaagctgatgctggagcaactggaaagccagttcgtgttgatgcaacaacaccagatgcgcccgacaggcgtcgcccaagtcagaagtaccgggatccctaacggccctaccgccgactcaagcctcccaacaaattcagtgagcggacaacagccccagctggcactgacacgagtgccgtctgtgtcccaacccggtgtgagacctgcctgtcccggacaacccttagccaacggacctttctcagcaggtcatgtgccctgtagcactagcaggacactcgggtcaactgatacaatcctaatcggcaataaccacatcaccggctccgggagcaacggcaatgtgccgtatctccagcgcaacgctctcactctccctcataaccggactaatttgacgagctcggcggaagaaccctggaagaaccaactgagtaattccacccaggggctgcataaaggccagtccagtcacagcgctggacccaatggagagcggccgcttagctccacaggcccatctcagcatctgcaagctgcgggtagtgggatccagaatcagaacggacacccaaccctaccatccaattccgtcacccaaggcgccgccctcaatcacctgtcttcccacacggcgacctccggcgggcagcagggtattaccctgaccaaggagtcaaagccttccgggaacatcctgaccgtgcccgagacatccaggcataccggggagactcctaatagcacagcttccgtcgaaggcctgcctaaccacgtccatcagatgacagcggacgctgtttgttctcccagtcacggggattctaaatcaccggggctccttagctctgataacccacagctaagcgccctcctgatgggaaaagcaaataacaatgtcggaacagggacttgcgacaaggttaacaacattcatcccgcagttcataccaaaacggacaactccgtggcatcaagcccttcttccgcgatcagcactgcaactccaagccccaagagtactgagcagactaccacaaactcagtcacgagcctcaattctccccactctggtctgcacacaatcaacggggagggaatggaggaatctcagtctccaatgaagaccgacttattgctggtgaatcataagccatccccacaaatcattccctctatgtctgtcagcatttacccaagcagtgccgaggtactgaaagcctgtaggaatttagggaaaaatggactgtccaacagctctattctcctggacaagtgtccacctcccaggccaccgagttccccctaccccccacttcccaaagacaagctgaatcctcccactccctccatttatcttgaaaataaacgggatgctttcttccctcccttacaccagttctgcacgaaccctaacaacccggtcaccgtcattcgggggcttgctggcgcacttaaattggatttaggcctctttagtaccaagaccctggtggaggctaacaacgagcacatggtggaagttcggacccagctcctccagcccgcagatgaaaattgggatcccaccggcactaaaaagatatggcattgtgagtctaacagatctcacacaacaatcgcaaagtatgcccagtatcaggccagcagctttcaggaatcactgagggaagaaaacgagaaacgctctcatcacaaggaccactctgactccgaatcaacatcctctgacaatagcgggaggcggcgtaagggcccattcaagaccatcaagttcggtaccaatatcgatttatccgatgataagaaatggaaacttcagttgcacgagctcaccaagctaccggccttcgtcagggtcgtgtcagccgggaaccttttaagccatgttggtcatactatcttgggtatgaacaccgtacagctatacatgaaggttcccggtagcagaacccctggccaccaagagaataacaatttctgtagcgtgaacattaacatcgggccaggggattgcgaatggttcgtcgtgcctgagggttactggggcgtgctcaatgatttctgtgagaagaacaatctgaacttcctcatgggctcatggtggcccaatcttgaggatctgtacgaggctaacgtgcctgtttacaggttcatccagcggcccggagacttagtctggatcaatgcggggactgtgcactgggtgcaggcaatcggatggtgtaacaacatagcctggaacgtggggccgctgacagcgtgtcaatataaactcgctgtggagcgctacgaatggaataaactgcagagcgttaagtctatagttccaatggtgcatctgtcttggaacatggcccgcaacataaaagtgtccgatcccaaactatttgagatgatcaagtattgcctcttacgtaccctgaagcagtgtcagacacttagagaagccctgattgctgccggaaaggagatcatctggcacggtcgcacaaaggaggagcctgcacactactgcagtatctgcgaggtggaagtgttcgatttactattcgttacaaatgagtctaattcaagaaagacatatatagtccactgccaagattgtgccagaaaaacatccgggaatctggaaaatttcgtagtgctagagcagtacaaaatggaagacctgatgcaggtttatgaccagttcaccctcgctccacctttgccaagcgcgtcgtcctag

SEQ ID NO: 193702 - DNA, 486 bp, Artificial Sequence
  Description of Artificial Sequence: Synthetic coding sequence
tgagcccggaacatcaaggtgagcgaccccaagctgttcgagatgatcaaaatattttccctgtctccgaatttccgcgccgaaaagtgcttaagggatcacttagtccaaccactcagatccaatggcgaaccagagccgctcaggtttactggcgaatattgtttgctgaggaccctgaagcagtgccaaaccttgagagaagccctcatcgctgcagggaaggaaatcatatggcatggcagaactaaggaagagcccgcccattattgctcaatctgtgaggttgaggtgttcgacttgcttttcgtgactaacgaatccaattctcgcaagacttacatcgtccactgtcaggactgtgcaagaaagacttctggaaatctggagaatttcgtggttttagagcagtataagatggaggacttgatgcaggtgtacgatcagtttacactcgctccccccttgccatcagcctcttcatag

SEQ ID NO: 193703 - DNA, 3135 bp, Artificial Sequence
  Description of Artificial Sequence: Synthetic coding sequence
tgaaacaagaccaagctgctgcccagcatcgaggaggcctggagcctgcccattcccgccgagctcaccagccggcaaggcgcaatgaacaccgctcagcaagcttgcaagccccatcaccccaataccgagcccgtgttaggcctgagccaaactcctataagccagcagtctctgccgctgcatatgattccctcatcccaagtggatgatctaagctcccctgcaaaacggaagagaacctcatcaccaactaagaacacaagtgacaattggagcggagggcacgccgtgtctcatccgcccgtgcagcagcaggcccactcttggtgtctgacccctcagaagttacagcatttagagcagctgcgggcaaatcgtaacaatctgaatccagcgcagaagcttatgttggagcagctggagagccaatttgtgttaatgcagcagcaccaaatgcggcctaccggcgtcgcccaggtcagatcgacaggcattcctaatggacccactgcggactcgtcgttgccaactaactctgtgtctggccagcaaccccaactcgccctgaccagggtcccctcagtgagtcagcctggtgtgagacccgcctgccctggacagccgcttgcaaatggaccttttagtgccgggcatgtcccctgctctacaagcagaaccctgggatcaacagatacaatcctgattggcaataaccatataaccggatccggcagcaatgggaatgtgccttacttgcagcgcaatgctttgactctgcctcataatcggaccaacctgacatcctctgctgaggaaccgtggaagaaccagctgtctaattctacgcagggactacataaggggcagagttcacactcggctgggcccaacggcgagcggcccctttcctccaccggcccttctcaacatctgcaggccgctggatccgggatccaaaaccagaatggtcacccaacgcttcctagcaatagcgttacacaaggcgccgccctaaaccacctgagtagtcacaccgcgacctctggtgggcagcagggtattaccctgacgaaagagtccaaaccttccggaaacatcctaacagtgccagaaacgtcccgccacaccggggagacacctaattctacagcatcggtggaagggcttcccaaccacgtgcaccagatgactgccgatgccgtttgctcaccatcacatggggatagtaaaagcccggggctgctctctagtgacaatccccagctcagcgccctcctcatgggtaaggccaataacaacgtcgggaccggcacatgtgataaagtgaataatatccatccagcggtacatacgaagaccgacaactctgtcgcttcaagcccttccagcgcaatttctacagctacccctagccctaaatctacggaacagaccacaactaattctgttacttccctcaatagcccacattcgggcctgcatacaatcaacggagaaggtatggaggaatctcagagtcctatgaagacagatcttctgctggttaaccacaagccctctccacaaattatcccgtccatgagcgttagcatttacccgagtagtgctgaagttctaaaagcctgtagaaacctgggaaagaacggactctccaacagttcaatcctgttagataaatgcccaccgccgcgaccaccaagctccccctatcccccattgccaaaggacaaactaaatccaccaacaccctcgatatatctcgaaaataaaagagatgctttttttcccccgcttcaccaattttgtacaaaccctaataatcctgtgactgtcatccggggattagcaggggctctgaaactggacctgggcctgttttccacaaagacactggtagaggccaacaacgaacacatggtcgaggtcaggacgcagcttctccagcctgccgatgaaaactgggacccgaccggtacaaagaagatatggcactgtgaaagtaaccggagtcacaccacgatcgctaagtacgcacagtaccaagcctcatctttccaggagagcctacgtgaggaaaacgaaaaacgatctcaccataaagaccactcggactcagaaagcacttcatcagacaatagtggaaggagaaggaagggcccctttaagaccatcaaatttggcaccaacattgacctgtcagatgataagaaatggaagctccaactgcacgagttaactaagctccccgcattcgtgcgagtcgttagtgccggaaatctgctctctcatgtggggcacactattctcgggatgaacacggttcaactgtacatgaaggtgcctggttcgcggacccctggccatcaggagaacaataatttctgttcagtgaacatcaacattggtcccggcgactgtgaatggtttgtggtgccggagggctactggggcgtgctaaacgacttttgtgagaagaataatttaaacttcctgatgggttcctggtggccaaatctcgaagacctttacgaggccaatgtacctgtctacaggtttatccagcgacccggtgacctagtctggataaacgccggcactgtccactgggttcaggcgatcggatggtgtaataatatcgcctggaatgtggggccactcacggcttgtcagtataaactagcagtggaaaggtatgaatggaataagctacagtcagtcaaaagtattgtgccaatggttcacctgtcctggaatatggctcgcaacattaaggtctctgacccaaagctgttcgagatgatcaaatattgtctgctgagaactctcaagcaatgtcagactctgcgcgaagcgcttatcgctgccggcaaggagatcatctggcacggcaggacaaaagaagagcctgcccactactgcagcatctgcgaggttgaggtctttgatctcctttttgttactaacgagtcaaatagccgtaagacttatattgtgcattgtcaagactgtgcacgaaagacctccggcaacctggagaatttcgtggtccttgagcagtacaagatggaggacctgatgcaagtgtacgaccaatttactttggcgcctccattgccttccgcttcatcgtag

SEQ ID NO: 193704 - DNA, 675 bp, Artificial Sequence
  Description of Artificial Sequence: Synthetic coding sequence
tgactgcaggcctacatctgcgccgtgcagctggaccacggccacgctgccgcctggatggatctgggaaccctgtacgaatcatgcaatcaacctcaggatgcgatcaagtgctacttaaatgctaccagaagcaaaagttgtagtaatacttctgccctggcagcaagaattaaatacctgcaggcccagctgtgcaacctgccccagggttctctgcagaataaaacgaaactgcttccaagcatcgaagaggcctggtcattacccattccggcggaactcacaagtcggcagggcgcaatgaataccgcacagcagaacacaagcgataactggtctggcggtcatgctgtgtcccatcccccagttcagcagcaggcccacagttggtgcctcacaccacagaagttgcagatgcggcctacgggcgtggcccaagtgagatccacgggaattcccaatggtccaacagccgactcaagcctccccaccaacagcgtgagtggccagcagccccagctggctctgactcgggtgccctctgtgagccagccgggcgtgagaccggcatgtccagggcagcctctggctaacgggccatttagtgccggccacgtgccgtgctcaacctcacggaccctgggctccaccgacacaatactgattggctag

SEQ ID NO: 193705 - DNA, 516 bp, Artificial Sequence
  Description of Artificial Sequence: Synthetic coding sequence
agcctgcagaacaagaccaagctgctgcccagcatcgaggaggcctggagcttgcccataccagctgaacttacaagtaggcagggagccatgaatacagctcagcagaacacttcagacaattggagcggaggtcatgctgtaagccaccctccagttcaacagcaggcacacagctggtgtctgacaccccaaaaactgcagcacctcgagcaactgcgggctaatcggaacaaccttaatccagcccaaaagctcatgctcgaacagttagaatcacagtttgtgctgatgcagcaacatcagatgcgccccacaggggtcgcgcaggtgagatcaactgggatcccaaacggtcctaccgcagactcttcgctccccactaacagcgtgtctgggcagcagccccagctagccttaaccagagtcccatccgtgagtcagccaggcgtgcgtcctgcttgtccagggcaacctttggcaaatgggcccttctgtagaccctgcagtctttag

SEQ ID NO: 193706 - DNA, 4071 bp, Artificial Sequence
  Description of Artificial Sequence: Synthetic coding sequence
atgaagagctgcggcgtgagcctggccaccgccgccgccgccgccgcggcgttcggtgacgaggaaaaaaagatggcagcaggaaaagcttctggggagagcgaagaggcttctccttcccttacagctgaggagcgagaggcactaggagggttagattcaagactgttcggttttgtccggttccacgaggacggtgcgcggacgaaggcactgctggggaaggccgtgaggtgttatgagagcctcatcctcaaggctgaagggaaggttgaaagcgactttttctgtcaactcgggcattttaatttgttgctagaagattatcccaaggcactaagcgcttaccagagatattacagtctccagagtgattattggaaaaatgccgccttcttatacggattaggtctggtgtactttcactataatgccttccagtgggctatcaaggccttccaagaggtgttgtacgttgacccctcattctgcagagctaaggaaattcatctccgcctagggctcatgtttaaggtgaatacagattacgaatcctctctcaaacatttccaattggctctggtagactgcaacccgtgcacactgagcaatgccgagatacagttccatattgctcatctatatgagacacagcgtaagtaccactctgctaaggaggcatatgaacagctcctgcagacagagaatcttagtgcacaggtcaaagcgacagtgctccaacaactcggttggatgcaccacacagtagacctcttgggggacaaagccactaaggagagctatgctatccagtatcttcagaagtcactcgaggccgatccaaattcaggccagtcatggtacttcctgggaaggtgttactcaagcattggcaaggtccaggatgcgtttattagctaccgccagagcatcgataagagcgaagccagcgccgacacatggtgctcaatcggggtgttgtatcaacagcagaaccagcctatggatgccctccaagcgtacatttgcgctgttcagcttgaccacgggcacgccgctgcttggatggacctggggaccctgtatgaaagctgcaatcagcctcaggatgcgattaagtgctacctcaatgctacccgctcaaaatcctgctctaacaccagcgccttggccgcccggatcaagtatttgcagaacaccagcgataattggagcggggggcatgccgtgagccacccccccgtgcaacagcaagcccactcctggtgtttaaccccccagaagctccaacacttggaacagctcagagccaaccggaataatctcaatccagcccagaaacttatgctcgagcagcttgaatctcaattcgtactcatgcaacagcatcagatgcggcctaccggtgtggcacaggtgaggagcaccggcatccccaacggaccgaccgccgatagctccttacccactaactctgtttctgggcaacaaccacagctggcactgacacgggtcccttcagtgtctcagcccggagtacgacccgcgtgtcctgggcagccgctggctaatggaccgttctccgcaggacatgtcccctgcagcaccagccggactctgggaagcaccgataccatcttgattggaaataatcatattactgggtctggctcgaatggaaacgtcccatacctgcagaggaacgccctaactctgccgcataacagaacaaatctcaccagctcagctgaagagccctggaagaaccagttgtcgaacagcacacaggggctgcacaaagggcaaagcagccatagcgctggcccaaatggcgagcggccactgtcttctaccggcccttcacagcacttacaagcggcaggaagcggcattcaaaaccaaaatgggcatccgacgctgccttcgaatagcgtgacacagggggccgcccttaaccatttaagtagccacaccgctacttcgggcggacagcagggcataacactgaccaaagagtccaaaccttccggcaacattctcacagtgcccgagacttctaggcacacaggcgagaccccaaactcgaccgctagcgtcgagggcctgccaaaccacgtgcatcagatgacggccgacgcggtatgcagcccttcccacggggattcaaaaagtcctggcctcctgagcagcgacaatcctcagctctccgccctgctgatgggaaaggctaataacaatgtgggaacgggcacttgcgacaaggtgaataacattcacccagctgtgcatacaaaaaccgataattcagtggctagctccccatcatccgccattagcacggccaccccgagtccaaagtccacagaacagacaacgacaaactcggtcacttcactgaactctccccatagtggcctccatacaatcaatggggaaggcatggaagaatctcaaagtccaatgaaaacagacttactcttggtcaatcacaaaccttcaccccagattatcccttcaatgagtgtgtctatatatccttcgagtgcagaggtcctgaaggcttgtagaaatttgggaaagaatggacttagtaactcttcaattcttctcgataagtgccccccaccacgccccccatcttctccttatccgcctctacccaaagataaactgaatccacctacaccctcgatctacttagaaaataaacgggacgccttcttcccccctctgcatcaattctgcaccaaccccaataaccccgtcacagtgatccgggggctggctggagcactgaagcttgacctaggtctgtttagtaccaaaacactggtggaagccaacaacgagcacatggtggaggtgagaactcagctgctgcaaccggcagacgagaactgggacccgaccggaaccaagaagatatggcattgcgagtctaaccgcagtcataccactattgccaagtatgcgcagtatcaggcctcttcctttcaggagtctctccgcgaggagaatgagaaaaggtctcaccataaggatcattctgactcggagagcactagcagtgataacagcggcaggaggagaaaaggccctttcaagacaatcaaatttggaacgaatatagacctgtccgatgataagaagtggaagcttcagctccatgagttgacaaagctccctgcttttgtccgtgtcgttagcgcagggaaccttctcagtcatgtaggtcatacaattcttggcatgaacacagtccaactttacatgaaagtgcctgggagccgcacaccaggtcaccaggaaaataacaacttctgttccgtaaacataaacatcgggcccggggattgcgagtggttcgtggtgccagagggctactggggagtgctgaacgatttttgtgagaagaataacctcaactttctcatggggtcatggtggcccaacctggaagacctctatgaggctaatgtccctgtatatcggtttattcagagaccaggggacctggtgtggattaatgccggcacagtgcactgggtgcaggccattggatggtgcaacaatatcgcctggaatgtcggtcccctgaccgcatgtcagtataagcttgcagtggagcgctatgaatggaacaagctgcagagcgttaagagcatcgtaccaatggtccacctgagctggaacatggctagaaacattaaagtgtccgatccgaagctttttgaaatgatcaaatattgtctcctcagaacactgaaacagtgtcaaacccttcgggaagccctgattgctgccggcaaggagatcatctggcacggaaggaccaaggaggaaccggctcactactgctccatctgcgaagtagaggtgtttgacctcctgttcgtgacaaacgaatcgaactccagaaaaacctacatcgtgcattgccaggattgtgcccgaaaaacaagcggtaacctggagaacttcgttgtgctggaacaatacaagatggaagatctgatgcaagtttatgatcagtttactctagctcccccgctcccatctgcatcatcatag

SEQ ID NO: 193707 - DNA, 675 bp, Artificial Sequence
  Description of Artificial Sequence: Synthetic coding sequence
atgaagagctgcggcgtgagcctggccaccgccgccgccgccgccgcagccttcggtgatgaagagaagaagatggccgccggaaaggcctccggagagtctgaggaagcgagcccttccctgaccgccgaagaacgcgaggccctaggaggactagattcacggctgtttggatttgtgcgctttcatgaggatggagctcgcacgaaggcacttcttggaaaagctgtccgctgctacgagtctctcattctgaaagcagagggaaaggtggaatcagactttttttgccaattaggacatttcaatctgcttttggaggactacccaaaggccctatcagcctaccagcgatattatagtctccagtccgattattggaagaatgccgcctttttatacgggctgggactggtgtattttcactataatgccttccagtgggccataaaggcatttcaagaagttctgtacgtggatccctctttctgcagggcgaaggaaattcacctgaggttggggctcatgtttaaggtgaatacagactacgaaagtagcctgaaacattttcagctagccctggtagactgtaatccctgtactctcagtaatgcagagattcagtttcatatcgcacacctttatgagacccaggtcggttgcataacactctag

SEQ ID NO: 193708 - DNA, 3969 bp, Artificial Sequence
  Description of Artificial Sequence: Synthetic coding sequence
atgaagagctgcggcgtgagcctggccaccgccgccgccgccgccgccgcgtttggggatgaagaaaagaagatggccgcaggaaaggcctctggagaatcagaagaagccagtcccagtctgacggctgaggagagggaggcactcggaggtctggactctagattgttcggcttcgtcaggttccatgaggacggagcgagaacaaaagcgctgctggggaaagcggtgcgatgttacgagtctctaattctcaaggcagagggcaaagtcgaatcagactttttctgccagttaggtcattttaatctcctgctggaagactatcccaaagctctgtccgcgtaccagcgatactactccctccagagcgactactggaagaacgcagcatttctgtacggcctgggactcgtgtatttccactataacgcattccagtgggccattaaggccttccaggaggttttgtacgtagacccctccttctgtcgtgccaaggaaattcacctgcgtttgggattaatgttcaaggtaaatactgactacgagtctagcctcaagcactttcagctggccctagtcgactgcaatccctgcacactgagtaatgccgagattcagtttcacatcgcccatttgtacgaaacacaacgcaagtaccatagcgccaaggaagcctacgagcagctcctacagactgagaatctctctgcgcaagtgaaagcaaccgtgctgcaacagctcggttggatgcatcataccgtggatttgctgggggacaaggcgacaaaggagtcctatgccatccaatacttacaaaaaagcctcgaggccgacccaaactccggacagtcatggtatttcctcggcagatgttattccagtataggcaaggtgcaggatgcttttattagttatcgtcagtccattgacaagtcagaagctagcgccgacacctggtgttcaattggagttctttatcagcagcagaaccagccgatggacgctctacaggcctacatctgtgccgttcaactggaccatggccacgccgccgcatggatggatctgggaaccttatatgagtcctgtaaccagccccaggatgcgatcaagtgctatttgaacgcaacacggagtaagagctgtagcaacacctcagccctagcggcaaggatcaagtatttgcagaatactagtgacaattggtccggaggacatgcagtaagtcacccacctgtgcagcagcaggcccactcttggtgcctcactccacaaaagttgcagatgagacccactggcgtcgcccaagtgcggagcacaggaatccctaacggacctacagccgatagctctctgcccaccaatagtgtatctggccagcagccacagttagcacttaccagggtgccctctgtatcacagccaggcgttcgtcctgcctgtcccggtcaacctttggcaaacggacccttttctgctgggcacgtgccgtgttccacgagccggacgctcgggagtacagacacaatcttgatagggaacaatcacatcactggtagcggcagtaacggtaacgtgccatatctgcaaaggaacgcgctgacactgccccataaccgtaccaacctgaccagtagcgcggaggaaccatggaaaaaccagcttagtaactctacacagggcctccacaaagggcaatcctctcactctgcagggccaaacggggagcggcccttgtcttcaactggcccttctcagcacctgcaggctgcgggctccggcattcagaaccaaaacggtcaccctacgcttcctagcaactctgtgacacagggggctgccttaaaccatctgtcctcacacactgcgacgagcggtgggcagcaaggcattacattaaccaaagagagcaaaccgtcgggaaacattctcacagttcccgaaacatcacgacacaccggagaaacaccaaactccactgctagcgttgagggcctcccgaaccatgtacaccagatgaccgctgacgctgtgtgtagtccatctcatggcgactccaagagtccaggactgctttcctctgacaacccccaactttcggctcttctgatggggaaagctaataataacgtcggcactggcacttgcgataaagtcaacaacatccatcccgctgtccacacaaaaaccgataactcagtagcgtccagtccctctagtgccatcagcacggcaacaccttcaccaaaatcaaccgagcagacaactactaacagcgtgacctccctgaatagtccacattcaggcctgcacacaatcaacggcgaagggatggaggaatcccagtcccccatgaaaacagacttgctgctggttaaccacaagccgtctccacagattataccctcaatgagtgtctcgatctatccgagctcagccgaggtgctaaaggcctgtcgtaatcttgggaagaatggcctcagcaattcatcaattttgctggacaagtgtccccctccgcggccgccatctagcccttatccgcccctgccgaaagacaagctgaatccccccaccccctcaatctacctcgaaaataagcgggatgccttcttcccgcccctgcaccagttttgtactaatccaaacaatccagtgacagtgattcgtggcttggccggcgccctcaaattagacctggggcttttctcaaccaagaccctggtggaagcaaataacgaacatatggttgaagtacgcacccaactgctgcagcctgccgacgaaaactgggacccaactggaaccaaaaagatctggcattgtgagagcaatcgcagccacactactattgcaaagtacgcccagtatcaagcatcttcgttccaggaaagtttaagggaggaaaacgaaaaacgctcacatcataaggatcactcagatagcgaatcgacatcttccgacaatagtgggagacgccgtaaggggccctttaagactatcaagtttggcacaaacattgatctgtccgacgataagaaatggaagcttcagctgcacgagctgactaaactgcccgcctttgtccgcgtcgtgtccgccgggaaccttctgtcccacgtcgggcatacaatccttggcatgaataccgtgcagctgtacatgaaggtcccggggtctagaaccccaggccaccaggaaaataacaatttttgctccgttaatatcaatattggtcccggggactgcgaatggttcgtcgttccggaggggtactggggcgtgcttaatgacttctgtgagaaaaacaatctcaatttccttatggggagctggtggcccaacctggaggacctttacgaggccaacgttcccgtatatcgcttcatccagaggccgggtgatctggtctggatcaatgccgggactgtgcactgggtgcaggctataggatggtgcaataatatcgcctggaacgttggccctctcacggcttgccagtacaaactcgcggtggaacggtacgagtggaataaactgcagtccgttaagagtatcgttcctatggtacatctgagctggaacatggccagaaacataaaagtgagcgatcccaaactttttgaaatgatcaaatactgcctattaaggactttgaagcaatgccaaacattacgggaagcattgattgccgcagggaaggagatcatttggcatggccggactaaggaagaacccgcgcactattgcagcatctgtgaagtggaggttttcgacctcctgttcgtgacgaatgaaagtaactcccgcaaaacttatatagttcactgtcaggattgtgcgagaaaaacctccgggaatctggaaaactttgtggtgctggagcagtacaaaatggaagatctcatgcaagtctacgaccagtttacattagcaccccctctcccatccgcctcttcctag

SEQ ID NO: 193709 - DNA, 5049 bp, Artificial Sequence
  Description of Artificial Sequence: Synthetic coding sequence
atgcaccgggccgtggacccccccggcgcccgggccgcccgggaggcctttgctctgggaggcctcagctgcgctggagcctggtcctcatgcccaccccaccctccacccaggtctgcctggctgcccggcggacgatgtagtgcttcgatcgggcaaccccctcttcccgctccactgccaccttcacacggttcttcatccggccacccgagtaaaccctattatgctccaggtgcccccacacccaggccacttcatggaaagcttgaatcactccatggttgtgtgcaggccctgctgcgcgagcctgcccagcccggcctgtgggaacaactgggtcagctctatgaaagcgagcacgattcagaagaagcaactcgctgctatcactcagccctgaggtacgggggtagtttcgccgaactggggccaaggattgggagattgcagcaggcccagctttggaatttccacacagggagttgtcagcaccgcgccaaggtgttacctcctctggaacaagtgtggaatctgcttcatctcgagcataaacggaactatggagctaagcggggcggaccccctgttaaaagggccgcagaacctccagttgtgcagcctgtgcccccagccgctcttagcggccctagtggcgaggaaggactatctccaggcgggaagcggagaaggggttgcaattccgaacagactgggctaccccctggactcccactcccacctcctcctctaccccccccacccccacccccccccccgccaccaccaccactccctgggctcgctacatccccaccattccagctgacaaaaccggggctttggagtactcttcacggcgacgcttggggaccagagaggaaggggagtgccccaccggaacgccaggagcagcggcactctctcccccatccctatccctacccggccccagcctacaccgcacatccaccagggcatcgccttgtaccagccgcccctcctggcccaggcccccgccctccaggcgccgaatcccacggatgcctgcctgccacccggccgccagggtcggatttgcgtgagagccgtgttcagcgatcacgcatggactccagcgtgtcccccgcggctaccaccgcatgcgttccctatgcaccatcgcgaccaccggggctgcccggcactacaacgtctagttctagctccagctcctctaatacggggctgaggggcgtcgagccaaatcccggcatccccggcgctgaccactatcagaccccagccttggaagtgtcccaccacggtcgcctcgggccatcagctcattccagccggaagccattcctgggtgcccctgccgccacccctcacctttcgttgcccccaggaccctcctctcccccccctcctccatgtcccaggttgttacgtcctcctcccccccccgcttggctgaaagggcccgcgtgtcgagcagcaagagaggatggcgaaatcctggaggaactgttcttcggaaccgagggcccgcctagacccgcccctccaccccttccccaccgtgagggatttttgggtccaccagccagtagatttagcgtggggacccaggattctcatacaccgcccacgccccctactccaacaacctccagcagcaatagtaacagcggatcgcactcaagtagcccagccggcccagtgtccttcccaccccccccctatcttgcacgtagcatagaccctctgccgcgtccaccctctcccgcccagaacccacaggatccaccacttgtgccactgactctggcactcccgcctgccccgccttcatcttgccatcagaacaccagtggctctttcagacgccctgaatctccccgtccgagggtctcattccccaaaacgcccgaggtgggccctgggccaccccctggccccctttccaaggctccccagccggtgccaccaggagtcggcgagctgcccgcacgcggcccaagactcttcgacttcccgcctaccccactcgaggaccagtttgaggaacctgccgaatttaaaatcctgcctgacggcttagccaatatcatgaaaatgttggacgagtccatccgaaaggaagaggagcaacagcagcacgaggctggcgtggccccacaacctcccttaaaggagcctttcgcctcgctgcagtcgccgtttcctactgatacggccccaacaactaccgctcccgccgtagcagtcaccactacaaccactacgaccactacaaccacagctacacaggaagaagaaaagaaacctcctcccgctcttccccctcctcctcccttagccaagttccctccaccaagtcagcctcaacctcctccaccgcctccacctagccccgccagcctcctcaaatctttggcctcggtcctagagggccagaaatattgctatcgcggaacaggggctgccgtctccacaagaccaggcccattgcctacgacccagtactcacctggaccaccctccggagccactgctctacctcctacatctgcagcccccagcgcgcagggctcaccccagccgtctgcctcatcaagcagtcaattcagtacttccggtgggccttgggcccgtgagagaagagccggagaggagcccgtgcccggcccgatgacaccaacccagcccccaccgccattgagccttcctccagctcggagcgaaagcgaggttctagaggagatcagccgagcctgtgagacactcgttgaaagggtgggaagatctgccactgaccccgcagatcccgtagataccgccgaacccgctgactctgggaccgagagactcttacctccggcacaagctaaggaagaagctggcggggtggccgctgtctccggaagctgcaaacgcaggcaaaaagaacatcaaaaggaacatagacggcaccggcgcgcctgcaaagatagtgttggcagaagaccaagggagggtcgggctaaagctaaagcaaaggtgcccaaagagaaaagtaggagggttctgggtaatctagatttgcagagcgaggagatacagggccgggaaaagagccggccagatctagggggagccagcaaggccaagcctccgaccgctccggcgcccccatccgctcctgcccctagtgcccaaccaaccccgccaagcgccagcgtacccggcaaaaaggccagagaggaagcacccggcccccccggggtgagtcgggctgatatgctgaagctacggtcactttccgagggacccccaaaggagctcaagattcgactcattaaggtagagagcggtgacaaggagacatttattgctagcgaggttgaagagcggagattgagaatggccgacctgacaatctctcactgcgccgctgatgtcgttcgcgcaagccggaacgccaaggttaaggggaaatttcgagaaagctacctgtcacctgcacagtccgtgaaaccaaaaataaacacggaggagaagctgcccagagagaaactgaaccctccaaccccctccatctatctcgaatccaaaagagatgcattttcgcctgtccttctgcagttctgcactgaccccaggaatcctattactgtaattcgggggctcgccggcagtttacgattaaatctgggcttattctcaactaaaaccctcgtggaggccagcggtgagcacacggtggaggttaggacccaagtgcagcagccctctgacgaaaattgggatctgactggaaccaggcagatctggccctgtgaaagcagtcggtcgcatacgacaattgccaaatatgcccaataccaggctagctcgttccaagaatctctgcaagaggaaaaggagagcgaggatgaagagtcagaggagccggacagcactaccggaacccctccgagtagcgctcccgatcccaaaaatcaccacatcatcaagttcggtaccaacattgacttgtccgacgcaaaacggtggaaacctcagcttcaggaactgctcaagctgccagcctttatgcgcgtcacaagcaccggtaacatgctgagccatgtaggccacactatactcggaatgaacaccgttcagttgtacatgaaagtccccggatcacggaccccaggccaccaggagaataacaatttctgcagtgtgaacataaatattggaccaggcgattgtgagtggttcgccgtgcatgagcattactgggaaacaattagtgcattctgtgatcggcatggagtggactaccttaccggctcatggtggcccattctcgacgatctctatgcctctaacatccccgtctatcgtttcgtgcagaggccaggggatctggtgtggattaacgccggtactgtccattgggtgcaggcgactggatggtgtaacaatatagcttggaatgtggggccactgaccgcttaccaataccagctcgcactcgagcgctatgagtggaacgaggtgaagaatgtgaagtctatcgttcctatgatccatgtttcatggaatgtggcccgtacagtgaagatcagcgaccctgacttattcaaaatgatcaagttctgccttctacagagcatgaagcactgccaagtgcagagagaatctctggtccgcgctggcaagaagatcgcatatcagggtcgggtgaaggatgagcccgcctactactgcaatgagtgtgatgtagaagtcttcaatattctgttcgtcacgagcgaaaacggcagtcgcaacacatatctcgtgcactgcgagggatgtgcccggcgccggtccgccggcctccagggggtggtggtactggagcaataccgcacggaggaattagcccaagcctacgacgcattcaccctcgtgcgggcccggagggctcgtggacagcgaagaagagcattgggtcaggccgcagggacgggcttcggttcaccggccgcgccctttcctgagccaccaccggcattctctccgcaggcgccagcctcaaccagtaggtag

SEQ ID NO: 193710 - DNA, 4932 bp, Artificial Sequence
  Description of Artificial Sequence: Synthetic coding sequence
atgcaccgggccgtggacccccccggcgcccgggccgcccgggaggctttcgctcttggtggcttgtcatgtgcgggcgcatggagcagttgtccacctcacccaccgccacgaagcgcgtggctgcctggtggccgctgcagtgccagtattgggcagcctccgcttccagcccccctgccaccctcccacggctcgagctctgggcaccctagtaagccttattacgcacccggagctcctacacctcgccccctccacggaaaactggagagcctccatggttgcgtccaggcgctgcttcgagagcctgcccagccaggcttgtgggaacagctcggtcaactctacgagagcgaacatgatagtgaggaggcgactcgatgctaccacagcgctctgcgctatgggggctctttcgcagagttagggccccgaattggaagattgcagcaggcccagctttggaatttccatactggcagctgccagcaccgggcaaaggttctccctcccctggagcaggtgtggaatctactacatctcgaacacaagaggaactacggagcaaaaagaggggggccgcccgttaaacgggccgctgaaccgcctgtggttcagcccgtcccacctgccgccctgagcggcccttcgggcgaggagggcttatccccaggaggcaagcgccgccggggctgcaacagcgagcagaccggtttgccccccggtcttcctctcccacctccccctctgccgccacctcctccaccacccccccctccgccccccccattgcccgggctggctacctctccacccttccagcttacaaaacctggcctctggagcacgttacacggcgatgcatggggcccggagagaaagggcagtgcacctcctgagcgccaagaacagcggcatagtttgcctcatccgtacccctatcctgctcctgcatacacagctcacccgccaggccaccggcttgtgccagcagccccacctgggccgggtcctagacctcctggtgcagagagtcatggctgcctacctgcgacccgcccccccggaagcgatctgcgggagtcacgagtgcaaaggtccaggatggattctagtgtcagtccagcggccacaactgcctgcgtcccctatgcgccctcacgcccgcctgggctgccgggaaccaccacttcaagctcttcaagctctagtagtaacactggattgcggggcgtcgaacccaatcccggcataccaggcgccgatcattaccagactcccgctctcgaggtgtcccatcacggccgactagggccttccgcccactctagcaggaagcccttcctcggtgccccagccgcaaccccccacctcagcctcccacccgggccatcctccccaccgccccccccatgtccccggcttttgcggcctccgccacccccggcctggctgaaggggcccgcgtgccgggccgcccgcgaggacggcgagatccttgaggaactcttttttgggaccgagggaccaccccggcccgctccaccccccttgccccatagagaaggctttctgggccctcctgcctcgagattctccgtcgggacacaagattcccatacccccccaacccctcccacaccgaccacaagttccagcaactccaactcagggagccactcgtcctcacctgcgggccctgtgtccttccctcctccgccctatctggccaggtcaatcgaccccttacccaggcctccatctcccgcacaaaacccccaagatccacccttggtgcccttgaccctcgccctcccaccagcacccccgagcagctgtcatcagaacacctccggaagttttcgcagacccgagtccccaaggccccgagtgtcatttcccaagactccagaggtgggcccaggcccaccacccggtccgctctcaaaagcaccccagcccgtaccccctggggtgggcgagctgcctgcaagaggacctcggctctttgatttccctccgactccccttgaggaccaatttgaagaaccagcggagtttaagatcttaccagatgggctggcaaacatcatgaagatgctggatgaaagtattcggaaggaagaggagcagcaacagcatgaagctggcgtcgccccccagcctcccttaaaggagccattcgcttctctgcaatccccattccccaccgataccgcccccactacgacggccccggccgtagctgttactacaaccactacgaccaccacaactaccaccgccacccaggaagaagagaagaaacctccgcccgccctgccccccccccccccacttgccaagttccctccaccctcacagccacagccgccaccgcctccgccaccatccccagcaagcctattgaaaagtctggcgtctgtcctcgaaggtcagaaatattgctatcgcgggactggagccgcggtcagtactcgacctggacccttaccaacgactcagtactcacctgggccgccttcaggggccacagcactgcctcccacgtccgctgccccctctgcccagggttcaccacagccaagcgcaagcagcagctcccagttttctacctcaggagggccttgggctagggaacgcagagccggcgaggagccagtgccagggcccatgaccccaacacagcccccacccccactgtcactgcctcctgcccggtccgagtccgaagtgctggaagagatttcccgtgcttgcgagacgctcgtggagcgcgtggggcgcagcgctaccgatcccgcggatcctgtggatacagccgaacctgctgacagcggcaccgaacggctgttgccaccagcacaagccaaggaggaggccgggggtgttgctgctgtgtcaggttcctgtaaaagacggcagaaagagcatcagaaggagcatagacgtcaccgcagagcgtgcaaggactcagtcggccgccgtcctcgggaaggtagggccaaagctaaagcgaaagtgcctaaggaaaagagtcgcagggtgcttggaaatctggacttgcagtccgaagaaatccagggacgagagaaatccaggcccgacctcgggggtgcatctaaggctaagccccctaccgcacccgcccccccatccgcgccggctccaagcgcacagcccacacccccgtcagccagtgtacccggcaaaaaggcccgagaggaggcccccggtccacccggtgtgagtcgcgccgatatgctcaagctgagatctctctcagaggggccacccaaggagttgaaaatccggctgattaaggtcgagtctggggacaaggagacatttatcgcgagcgaggtggaggagcgaagactgcgaatggccgaccttacaatttcgcattgcgcggccgatgtggtacgcgcatcaagaaacgctaaagttaagggaaaattccgagaatcgtacctgagcccagctcagtcagttaaacctaagatcaacacagaggagaagttaccgagagagaagctgaacccacctacccctagcatttatctggagagcaagagggacgctttttccccggtcctccttcaattctgtaccgacccaagaaacccaatcacagttatacggggcctcgccggttccttgagactaaacctgggcctgtttagcactaaaacactggttgaggccagtggggagcacactgtggaggtcaggacccaagtgcaacagccctctgatgaaaattgggacctgaccggtacccggcagatctggccctgcgagtcctcaagatctcacacaacaatcgccaagtacgctcaataccaagcaagcagtttccaggagtccttgcaagaggagaaggagagtgaggacgaagaatctgaggagcccgattcgacaacggggactcctccctccagcgcccccgaccccaagaatcatcacatcataaaatttggaaccaacatcgacctgtctgacgccaagcggtggaaaccgcaactgcaggagttgctgaaactgccagcttttatgcgcgtgacaagcacaggcaacatgctctcccatgtgggtcacactatcctgggaatgaacacagtgcagttgtacatgaaggtcccggggtccaggacccctggacaccaggagaacaacaacttctgcagcgtgaacatcaatataggcccgggtgattgcgagtggttcgctgttcatgaacactactgggaaactatctctgccttttgtgacagacatggggtcgactatcttacaggaagttggtggcccatcctggacgacctttatgcttccaatattcccgtatatcggtttgtgcaacgacctggggatttggtgtggataaatgcggggaccgttcattgggtgcaggcaaccggctggtgtaacaatatcgcatggaacgtcgggcctctgactgcataccagtaccagcttgcactggagagatatgagtggaacgaagttaagaacgtgaagtccatagtaccaatgattcacgtgtcttggaatgtcgcccggaccgtgaagatttccgatcccgatctcttcaaaatgataaagttctgcttactgcagagcatgaagcattgccaggttcagcgggagagcctcgtcagagcaggcaaaaaaatcgcttatcaaggaagagtcaaggatgagccagcatattactgcaacgaatgcgatgtagaggtcttcaatattttgtttgtgacctctgaaaatggaagccggaatacttacttggtacattgcgaagggtgcgcaagacgaagatcagccgggttgcagggggttgtcgtgctggaacagtatagaactgaagaacttgcgcaggcctacgatgctttcaccctcgctcccgctagtacctcccggtag

SEQ ID NO: 193711 - DNA, 1245 bp, Artificial Sequence
  Description of Artificial Sequence: Synthetic coding sequence
atgcacagccggggccgggagatcgtggtgctgctgaacccctggtctatcaacgaagccgtatcttcctattgcacgtattttattaagcaggacagcaagagcttcggaattatggtttcatggaaggggatctattttatactgactttgttctgggggtcattctttgggtcgatcttcatgctgtcgccgtttctgcctctcatgttcgtgaatccgtcctggtataggtggatcaataatagattggtcgcaacttggttgaccctcccggtggccctcctggaaacaatgttcggtgtcaaggtaatcatcacaggagatgcttttgtccctggcgagcgaagcgtgataatcatgaatcacagaactcgcatggactggatgtttctgtggaattgtctgatgagatattcctacctgcgcctggagaaaatctgtttgaaagcaagccttaagggcgtgcccgggttcggctgggctatgcaggccgcagcgtacattttcatccacagaaaatggaaggatgacaagtcacacttcgaagacatgattgactacttttgtgacatccacgagcccctccaacttctgatcttcccagagggcacggatcttactgagaactcaaaatccagatcaaacgcatttgcagagaagaacggcctacaaaagtatgaatacgtgctgcatcctagaacaactgggtttaccttcgtggtcgatagactgagggagggtaaaaatttggacgctgtgcatgatattaccgtggcgtatcctcacaacatccctcaaagtgagaaacacctcctgcaaggcgactttcccagagaaatccatttccacgtgcaccgctatcccatcgacacgcttccgacatccaaagaagacctgcaactctggtgtcacaaaaggtgggaggagaaggaggagcgactccgctcgttctatcaaggagagaagaacttctactttacaggacagagcgtgatcccaccatgcaagtccgagctgcgcgttctggtagtaaaactcctgtccatcctgtattggactctgttctcccctgctatgtgcctgctcatatatttgtacagtctcgtgaaatggtatttcatcataacaattgtgatttttgtgcttcaagagcgaatcttcgggggactagaaatcatagagttggcttgttatagactcctgcataagcagccccacctgaactccaagaagaacgagtag

SEQ ID NO: 193712 - DNA, 927 bp, Artificial Sequence
  Description of Artificial Sequence: Synthetic coding sequence
atgcacagccggggccgggagatcgtggtgctgctgaacccctggtccattaatgaggcagtctcttcttactgcacatattttattaagcaggactctaagtccttcggcatcatggtgagctggaagggaatttatttcatcctcaccctattttggggatccttcttcggctccatctttatgttgtccccattcttaccgctgatgtttgttaatcctagctggtacagatggatcaacaacaggctggtggcaacgtggctgacactgcccgtggcgctgctcgagaccatgttcggggtcaaggtcatcatcacaggtgatgctttcgtgcctggagaacgaagtgttattataatgaaccacaggacgcgcatggattggatgtttttgtggaactgcctgatgagatacagttacctgcgtttggaaaaaatctgtctgaaggcctctctaaagggagttccaggttttggctgggccatgcaggccgccgcctacattttcatacaccggaaatggaaggacgacaaaagtcactttgaagatatgatcgattatttctgcgacattcatgagccattacagctgctcattttccccgaagggacggatctgactgaaaatagcaagtcaaggtctaacgcctttgccgagaagaacggccttcaaaaatacgagtacgtactccacccacgcaccactggctttacattcgtcgtggatcggctcagggagggccgcaggcagtctgagggcagtaagggtcccctgcagggcgagcttcagattactgcacaggggaaccagcgcggccataaacaaatggaaaagcactctatgctgatggattggaagaaccagtaccgtgagataggacatacggcccagagtaacctacagattcagtgctatagtcactag

SEQ ID NO: 193713 - DNA, 927 bp, Artificial Sequence
  Description of Artificial Sequence: Synthetic coding sequence
atgcacagccggggccgggagatcgtggtgctgctgaacccctggtctatcaacgaggctgtctcctcttactgtacatacttcattaaacaagattctaagagctttgggatcatggttagctggaaagggatctactttatacttacactcttctggggttcgttcttcgggagcatcttcatgcttagtccgtttctgccactgatgttcgtcaacccatcatggtaccggtggattaacaaccgtctggtcgccacatggctcacacttccagttgccctcctagagaccatgttcggtgtgaaagtcatcattacaggggacgcattcgtacccggcgaacgatctgtgatcattatgaatcatcggacccggatggactggatgttcctgtggaattgcctgatgcggtattcttacttaaggctggaaaagatttgcctgaaggcctccctgaaaggtgtgcctgggttcgggtgggcaatgcaagccgccgcatacatttttatccacaggaagtggaaagatgataaaagtcattttgaggacatgattgactatttctgcgacatacacgagcccctccagctcctcatttttcctgaaggtacggacctcaccgagaacagcaagtctagaagtaatgctttcgcagaaaagaacggcctgcagaaatacgagtacgtgcttcatcccagaacaaccgggtttaccttcgtggtggatcggctgagagagggaagacgccagtcagaggggtctaaaggtccacttcagggcgaactgcagatcacggcccagggtaatcagcggggacacaagcaaatggaaaaacatagcatgctgatggactggaagaaccagtacagagaaattgggcacaccgcccagtccaacctgcagatccagtgttactcgcactag

SEQ ID NO: 193714 - DNA, 1131 bp, Artificial Sequence
  Description of Artificial Sequence: Synthetic coding sequence
atggtgagctggaagggcatctacttcatcctgaccctgttctggggatccttcttcgggtcaattttcatgctatcgcctttcctgccgctgatgtttgtcaaccctagttggtacagatggattaacaaccgactggtggccacctggctgaccctgcctgtagcactcttagagaccatgttcggagtgaaagttatcattacaggagatgcctttgtacctggggagcgctctgtgattatcatgaaccacagaactcggatggattggatgtttctctggaactgtttgatgcgttactcatatctgcgcctggagaagatttgccttaaagcctctcttaagggcgtgcccggatttgggtgggcaatgcaagctgcagcctatatcttcatccacaggaagtggaaagacgataaatcccattttgaagacatgatagattatttctgcgatattcatgaaccactgcaactcttaattttccctgagggcactgaccttactgagaactccaagagtaggtccaatgctttcgcggaaaaaaatggtctgcagaagtacgagtatgttctgcatcctcgcactacaggattcactttcgtggttgacagactgcgggaaggcaagaatctggacgccgttcacgatatcactgtggcctacccacacaacatcccccaaagcgagaaacatctgcttcagggagactttccccgggaaattcattttcatgtgcatcgctatcctatagacaccctgcccacatcaaaagaggacctccagctgtggtgccacaaacggtgggaagaaaaagaagaacgtctcagaagcttttatcagggagaaaagaatttttattttaccggacagagtgtgatccccccatgcaaatccgagctccgggtgctggtggttaaactcctttccatcctttactggaccctgttttccccagcaatgtgcctgttaatctatctgtactctctggtcaaatggtatttcataatcacgattgttatctttgtgcttcaggaaaggattttcggagggctagagattattgagctggcctgttaccgcctgctccataaacagccacatctgaacagcaagaagaatgaatag

SEQ ID NO: 193715 - DNA, 993 bp, Artificial Sequence
  Description of Artificial Sequence: Synthetic coding sequence
atggtgagctggaagggcatctacttcatcctgaccctgttctggggaagtttcttcggcagcatatttatgctgagcccctttttacccctgatgttcgtgaatcccagctggtacagatggattaacaacaggcttgtggccacctggctaaccctaccagtcgcattgctcgagaccatgttcggcgtcaaggtgattattacaggagacgcatttgtgcctggtgaacgatcagtgatcataatgaatcatcgtacccgcatggactggatgtttctctggaattgcctcatgaggtattcttaccttcgactggagaaaatttgcctgaaagcctctttaaaaggggttcccggattcgggtgggcgatgcaggccgcagcctatatctttatccaccggaagtggaaggatgacaaatcccacttcgaagatatgatagactacttttgcgatatccatgagcctctgcagctccttattttccctgagggcactgatttaacagaaaactctaaaagccgctcgaacgcatttgctgagaaaaatgggcttcagaaatacgagtacgtgttgcatcccaggactactgggtttacctttgttgttgatcgcctgcgcgaggggaaaaacttagatgcagtgcatgacataacagtcgcctacccccataatatcccacagagcgaaaagcaccttctgcagggggactttccacgcgagattcattttcacgtacataggtatccgatcgacactctcccaacttccaaggaagacctgcagttatggtgtcacaagaggtgggaggagaaggaagagaggctacgtagcttttatcagggagagaagaacttttactttactggccagtccgtaattcccccgtgcaagtctgagctcagagtgctcgttgttaaactttataccgtcctagaccccgttcagccctgcaacgttcctactcacatctttgtgcagtcttgctag

SEQ ID NO: 193716 - DNA, 462 bp, Artificial Sequence
  Description of Artificial Sequence: Synthetic coding sequence
atgcacagccggggccgggagatcgtggtgctgctgaacccctggtccatcaacgaagccgtgagtagctattgtacatactttattaagcaggactccaagagcttcggcatcatggtgtcttggaagggaatctatttcatattaactttgttttgggggagttttttcggatctatttttatgctaagccccttcctgccgctgatgtttgtgaatccttcgtggtaccgatggattaacaacaggctggtcgccacatggcttacattgccagtggctcttctagaaacaatgtttggcgtaaaagtgatcattacgggtgatgccttcgtaccgggcgagcgatctgtgatcatcatgaaccacaggacccgaatggactggatgtttctttggaattgcctgatgaggtacagctatcttcggctcgagaagatctgcctgaaggcgagtttgtag

SEQ ID NO: 193717 - DNA, 1131 bp, Artificial Sequence
  Description of Artificial Sequence: Synthetic coding sequence
atggtgagctggaagggcatctacttcatcctgaccctgttctggggatcgttttttggcagtatattcatgctctctccttttctcccactgatgttcgtgaacccgagctggtaccgctggattaacaataggttagtggccacatggctcaccctccctgtcgcccttcttgaaacaatgtttggcgttaaagtcattataaccggcgatgcctttgtgccaggcgagaggagcgtgattattatgaaccataggactcggatggactggatgttcctgtggaattgtctgatgcggtatagttatctccgactggaaaaaatctgtttgaaggcatcactcaagggggtgcctggcttcggatgggcaatgcaggccgctgcttatatattcatccacagaaagtggaaggatgataagtctcactttgaagacatgattgattacttctgtgacattcacgagcctttacagcttctgatcttccctgaaggaaccgatttaaccgaaaacagcaagagcaggagtaacgcgtttgcagagaagaatggattgcagaagtacgaatacgtgctgcaccccagaacaacaggcttcacctttgtggtcgataggctgagagagggaaagaatctcgatgcagtccacgatattacagtggcttatccacacaatatacctcagagtgagaagcatctgcttcagggggatttccctagggaaattcacttccatgttcatcggtaccctattgacacactcccgactagcaaggaggatctacagctgtggtgccataaacgctgggaggagaaggaagaaagattgaggtctttctatcagggcgaaaagaatttttactttaccgggcagtccgtaattcccccctgtaagtcagagttgcgggtgctggtggtgaagttactttctatcttatattggacgttattttctcctgcgatgtgcctcctgatctacttgtattcgttagtcaaatggtactttattattaccatagtgatctttgttctccaagagcgcatctttggggggttggagataatcgagttggcttgctacaggttgctgcacaagcagcctcatctcaacagtaagaaaaacgaatag

SEQ ID NO: 193718 - DNA, 1095 bp, Artificial Sequence
  Description of Artificial Sequence: Synthetic coding sequence
atggccgccatcagcaccagcatccccgtgatcagccagccccagtttaccgctatgaacgagccacagtgcttttacaacgagtcaatcgcattcttttataacagaagtggcaagcacctggcaactgaatggaacaccgtgagtaagctggtaatggggctagggattaccgtatgcatcttcatcatgctcgcaaatttattggtcatggttgccatttatgtgaataggcgcttccattttcccatttactatctcatggcaaacttagctgccgcggatttttttgcggggctggcttacttttatctcatgttcaacaccggccccaacacccgacgactcacggtgtcaacatggctattgagacagggccttattgatacaagcctgaccgcctctgtggctaatctgctcgctattgcgattgagagacacatcacagtttttcgtatgcagctgcacacccgcatgagcaacagacgcgttgtggtggtgatagtggtcatttggactatggctatcgtcatgggagccataccctcagtcgggtggaattgtatctgtgacatcgagaactgtagcaatatggcaccactgtactctgactcctaccttgtgttttgggcaattttcaacctcgtgacctttgtggtaatggtggtgttgtacgctcacatcttcggttacgtgcgtcagcgcactatgcggatgagccgccattcctccggaccaaggcggaatcgtgatactatgatgtcactactcaaaacagtggtcatcgttttgggtgcctttattatctgctggaccccagggttggtcttgctgctccttgatgtgtgttgccctcagtgtgatgtgctggcatacgagaagttcttcctcctgctcgcggaatttaactctgccatgaaccccattatttactcctacagagataaagaaatgagcgctactttccgacaaatattgtgctgccagcgctcagaaaacccaactggcccgactgagggcagcgatcgctcggcatctagcctgaaccacactattctggctggtgtgcacagtaatgaccactctgtcgtctag

SEQ ID NO: 193719 - DNA, 1095 bp, Artificial Sequence
  Description of Artificial Sequence: Synthetic coding sequence
atggccgccatcagcaccagcatccccgtgatcagccagccccagtttactgccatgaatgagcctcagtgtttttataatgagagtattgcctttttttacaaccgatctgggaagcacctggctacggaatggaacaccgtgagtaagttggtcatgggtcttggtataactgtgtgcatcttcataatgttggccaatcttctcgtcatggtagctatctacgtgaatcggaggttccattttcccatttattatctgatggctaacctggctgcagccgatttctttgcaggcctggcctatttctacctgatgttcaacaccggtcccaatacacgcaggctgaccgtcagcacatggctgctgcgccagggcttaatcgacaccagtctaacagctagcgtcgcaaacctgctagctatagccatcgaaagacatattaccgtgtttcgcatgcagctgcacactcggatgtcgaatcggagagtggtcgtcgtgattgtcgtgatttggaccatggcaatagtgatgggagccatcccctcggttgggtggaattgcatctgcgacatcgaaaattgcagtaacatggccccactttattctgactcgtacctggtgttttgggcaatctttaatctggtgaccttcgtcgtaatggttgtgctctatgctcatatatttggctacgtgaggcagagaactatgcgcatgagccggcacagttctggtcctcgtcgaaatagagacaccatgatgtccctgctgaagactgttgtgatcgtcctgggagcttttattatttgctggactcccggcttagtcctcctgctgctcgatgtctgctgtccacagtgtgacgtactagcttacgagaagttcttcctcctgcttgccgaatttaacagtgctatgaaccctattatatactcatatagggataaggagatgagcgctacctttcgccagattctgtgctgtcagaggtcagaaaatccaacaggccctacggaagggagcgaccgtagtgctagcagtttgaaccacaccattttagccggcgtccacagcaacgaccacagcgtagtgtag

SEQ ID NO: 193720 - DNA, 1095 bp, Artificial Sequence
  Description of Artificial Sequence: Synthetic coding sequence
atggccgccatcagcaccagcatccccgtgatcagccagccccagtttacggcaatgaacgagccacagtgtttttacaacgagagcatcgccttcttttataaccgatccggaaagcatctggcgaccgaatggaacaccgtctcgaaactggttatgggactgggaatcaccgtttgcatttttataatgctggcaaatctgttagttatggtggctatctatgttaatcggcggttccactttccaatttactatctgatggccaatctggccgccgcagatttttttgcaggactcgcctacttctatttgatgttcaataccggaccaaacactcgtagactgacagtgagcacttggcttctccggcagggtcttatagatacctctttgactgccagtgtggccaacttgctcgcaattgcgattgagaggcatattacagtcttccgcatgcaacttcacaccaggatgtctaaccggcgtgtggttgtcgtgattgtggtcatttggaccatggctattgtcatgggagccatcccgagtgttggttggaactgtatttgtgacatcgaaaattgtagcaatatggcccccttgtacagtgattcctatctcgtgttttgggcaattttcaatctcgtgacattcgttgtgatggtggttctctatgctcacatcttcggatatgtacggcagcgtaccatgcgcatgtcccgacattcatctgggccacgaaggaaccgcgatacgatgatgtccttgctgaaaacagtcgtcatagttctaggtgcatttattatctgctggacccctggcttagtgctgctactcctggacgtgtgctgcccacagtgtgatgtgcttgcatacgagaaattttttctccttctagccgagttcaatagtgctatgaatcctattatctacagctatcgcgataaagagatgtccgctacttttaggcagattctctgttgccagcgtagcgagaaccccaccgggccaactgaggggtcagatagatctgcatcaagcttgaatcacactatcctggcaggagtgcattcaaacgaccactcggtagtatag

SEQ ID NO: 193721 - DNA, 549 bp, Artificial Sequence
  Description of Artificial Sequence: Synthetic coding sequence
atggccgccatcagcaccagcatccccgtgatcagccagccccagttcactgctatgaatgagccgcagtgcttctataacgagagcattgcctttttttataataggtcaggcaagcacctggccacagaatggaacacagtgtccaaactggtcatgggacttggcattactgtctgcatttttataatgttggccaacttgctggtcatggtggcaatctacgtgaacagaaggtttcattttccaatctactacctaatggctaacctggccgcagcggactttttcgccggcttagcttacttttacctcatgttcaacacaggcccaaacacccgcaggctgactgtgtcaacgtggctcctgaggcagggcctcatagacacttccttaaccgcttccgtggccaacttgctggctatcgcaatagaaagacatataacagtgtttcgtatgcaactgcatacgcgcatgtctaatcgtagggtggtcgttgtgatcgtggtgatctggacgatggcgatcgtgatgggcgctattccatag

SEQ ID NO: 193722 - DNA, 1041 bp, Artificial Sequence
  Description of Artificial Sequence: Synthetic coding sequence
atgaacgagccccagtgcttctacaacgagagcatcgccttcttctacaaccgtagtgggaagcacctcgctaccgagtggaacacagtctccaagctcgtcatggggctggggattactgtttgtatcttcatcatgctagccaacctgctggttatggtagctatttatgtcaacaggagattccactttcccatatattacctcatggctaatctggccgcggccgatttcttcgccggcctcgcctacttttacctaatgtttaatacagggccgaacacccgaagactgactgtctctacctggttgctccggcaaggtctgatagatacgtccttgactgcgagtgtggccaatttgctcgccattgcaatagaaaggcacataactgtatttagaatgcagctgcacacccggatgtcgaacagaagggtggtggtggttatcgtggtcatttggacaatggcgatcgtgatgggggcaatcccctctgtggggtggaattgcatctgcgatattgagaattgttctaacatggctccgctttattcagacagctacctcgtcttttgggcaattttcaacctggtgacctttgtagtgatggtggtgctctatgctcacatctttgggtacgtgcgacagcgtacgatgaggatgtcccgtcactccagcggtcctcgccgaaatcgggatacaatgatgtcactgcttaaaaccgtggtgatcgtgctgggagcgtttattatatgctggacacctgggttggtgctgctcctgctcgatgtatgctgcccccagtgcgacgtcctcgcctacgaaaagttctttttactgctggcggaattcaattcagcgatgaaccccatcatttactcataccgggacaaagaaatgtcagccacttttcgacagatactgtgttgccagcggtcagagaaccccactggacctaccgaaggatctgacagatctgcctccagtctgaaccataccatcttggctggtgttcactctaacgaccattccgtggtttag

SEQ ID NO: 193723 - DNA, 1098 bp, Artificial Sequence
  Description of Artificial Sequence: Synthetic coding sequence
atggaggagggcgcccagcggagcggcgccctgggcgccccccaccagttcaccgccatgaatgaaccccagtgcttttacaacgagtctatcgctttcttttataaccggagcggaaagcacttagccactgaatggaatacagtgagcaagcttgtgatgggcttgggaatcaccgtatgcatcttcattatgcttgcgaatttactggtgatggtggcgatctacgtgaacagacggttccacttccccatctactatctaatggctaacctagccgcagccgattttttcgctggcttggcatatttctacctgatgttcaacacgggacctaacacacggaggctaacagtgtcaacctggctgctgaggcagggactgatcgataccagtttgaccgcttccgtggcgaatctgcttgctatcgctatagaaagacacataaccgttttcaggatgcagctccacactcgcatgtcaaaccgccgggtggtggtggtgattgtagtgatttggacgatggcaattgttatgggcgccatccccagcgttggctggaactgtatctgcgacatcgaaaactgcagcaacatggctcctctttacagtgattcctacttggtattttgggcgatctttaatctagtgacatttgtggtgatggtggttctctacgcacatatctttggctatgtccgtcagaggactatgcgcatgagtcgacattcctccggccccagacgcaacagggacaccatgatgagcctgctgaagacagtagttattgtgttaggagcctttattatttgttggacacctggcctggttctgctgctcctggacgtgtgttgcccgcagtgtgatgtactcgcttatgagaagttcttcctcttgcttgccgagttcaatagcgctatgaatcccattatctattcctatagagataaggaaatgtcagccacttttcggcagattctgtgttgccaacggagtgagaatcctactggaccgaccgagggctctgaccgcagtgcatcgtcactgaaccatacgatattagcaggagttcattctaatgatcactccgttgtgtag

SEQ ID NO: 193724 - DNA, 1098 bp, Artificial Sequence
  Description of Artificial Sequence: Synthetic coding sequence
atgctgctgctgctgatccccgcccacagcagcgtgctggagaacgaattcacagccatgaatgaaccccaatgcttctataatgagagcattgcatttttttacaacaggtcaggcaagcacttggcaactgagtggaataccgtttctaagctcgtgatggggctaggcatcacggtttgtatcttcatcatgttggctaacctcttggtaatggtggccatctatgtgaaccgccgcttccattttcccatttactatctgatggcaaatcttgctgccgccgatttcttcgcagggcttgcctatttctatcttatgtttaataccggacctaacacgaggcgcctcaccgtgtccacatggctgctaaggcaaggattaatagacaccagccttacggccagcgtggccaaccttctcgcaattgctatagagcgccacattactgtttttaggatgcaactgcacacgcgaatgtcgaaccggagagtggtggttgttatagtggtgatatggactatggcaattgtgatgggagctatcccaagtgtcggttggaactgtatatgcgacatcgaaaattgtagtaacatggcaccactgtactccgatagctaccttgtgttttgggctatatttaacctggttacttttgttgttatggtagttctgtatgcacacattttcgggtacgtccgtcagagaacaatgcgcatgtcaagacacagttcgggcccgcgaagaaaccgggatacgatgatgtctctgctgaaaaccgtggtcatcgtgctcggcgcgttcattatatgctggacccccggactggtgcttctgctgcttgacgtatgttgcccccagtgcgatgtcctcgcgtacgaaaagttctttcttcttctcgcagaattcaacagtgctatgaatcccattatctactcttacagagacaaggagatgtccgcaaccttcagacaaatattgtgttgtcagcgatctgagaaccctaccggccctacagaggggtcagatagaagcgcatcatcattgaatcacactatcctggccggcgtgcattcaaatgaccatagcgtggtttag

SEQ ID NO: 193725 - DNA, 1056 bp, Artificial Sequence
  Description of Artificial Sequence: Synthetic coding sequence
atggtgatcatgggccagtgctactacaacgagaccatcggcttcttctacaataacagtggaaaagagctgtcatcacactggcggcctaaggatgtcgtagttgtggctcttggccttacggtgtccgtcttagtgttgctaacgaatctgctggttatcgctgcaatcgctagcaacaggcgtttccatcagccaatctactacttgctcgggaacctggccgccgcagatctgtttgccggggtagcttacctattcctgatgtttcataccgggcctcgcaccgctcgccttagtttagaggggtggtttctcaggcaaggcctcttagatacatctctaaccgcctcagttgccaccctgttagcgatagccgttgagaggcacaggtctgtgatggctgtgcagctgcactccaggctcccccgcggccgggtggtgatgctcatcgtgggcgtgtgggtcgccgccctcgggctgggccttctgccggcacattcttggcactgtctgtgtgccctcgaccggtgctctaggatggcaccgctactctctcggtcctatctcgccgtgtgggccctgtcaagtctcctggtgttcctgctcatggtggctgtgtacacccggatttttttttacgtgcggcggagggtgcagagaatggccgaacacgtgtcttgccatcccagatacagagagacaacactctccctcgtgaagacagttgtgatcatactcggcgctttcgtggtgtgttggacccccggacaggtcgtgctcctcctcgatgggcttggctgtgaaagctgcaatgtcctagcggttgagaagtatttcttgctcctggccgaggcaaattccttggtgaatgccgccgtttactcgtgtcgagacgctgagatgcgtcggacctttcgcagactgctctgctgtgcttgcctccgacagtccaccagggaatcggttcactatacatcttcagcccaggggggcgctagtacccgcattatgctccccgagaatgggcatcctcttatggattcaacactgtag

SEQ ID NO: 193726 - DNA, 1056 bp, Artificial Sequence
  Description of Artificial Sequence: Synthetic coding sequence
atggtgatcatgggccagtgctactacaacgagaccatcggcttcttctataataactccgggaaggagctgtcatcgcattggaggccaaaggatgttgtggttgtcgcgctgggactgactgtgagtgtgctagtcctgcttaccaatcttttagttatcgccgccatcgcatctaatcgtagatttcatcagcccatttattatcttctgggaaacctcgcagccgcagatctgttcgcaggagtggcctacctgttccttatgtttcacacgggacccagaacagcaaggttgagcctcgagggctggttcctccgccaggggctcctcgacacctctctgacagcctcggttgctacgttgttggctattgccgtcgaaagacaccgcagcgtcatggccgtccagctgcatagcagactgcctagggggcgcgttgtgatgctgattgtaggagtgtgggtggctgcacttggcctgggccttctgccagctcactcatggcactgtctgtgcgccctcgatcggtgctcaagaatggccccactactgtcgaggtcgtacttagcagtttgggcacttagctctttactcgtctttctgctgatggttgctgtttacactcgaatatttttctatgttcggcggcgcgttcagcgaatggctgaacacgtcagctgccatcctagatatagggagacaaccttgagcttggttaaaacagtggtgataattcttggcgcctttgtcgtttgctggacgcctggccaggtagtgcttctgttggatggccttggctgtgaatcgtgcaacgttctggcagttgagaagtactttttgctgctcgccgaggctaacagcctcgtgaatgcggcagtgtactcttgcagagacgctgagatgcgccggacatttaggcggctcctatgttgtgcttgcctacggcaatccacccgagagtctgtacattatacctcctccgcccaaggcggtgcatccactcgcatcatgctccccgaaaatgggcatcctcttatggactctacactttag

SEQ ID NO: 193727 - DNA, 1062 bp, Artificial Sequence
  Description of Artificial Sequence: Synthetic coding sequence
atgaacgagtgccactacgacaagcacatggacttcttctacaaccgcagcaacaccgatacagtggatgactggaccgggacaaaactggtaatagtgctctgtgtgggtactttcttctgtctgttcatatttttcagcaattctctggtgatcgccgccgttatcaagaaccgtaagtttcacttccctttttattacctcctcgccaatctggctgcggcggatttttttgcagggatcgcttatgtatttctgatgttcaacacagggcctgtttcaaagaccctgaccgtcaaccgttggttccttcgccaaggcctgctggactcttctctgacggcctcgctgaccaatttgctcgtcattgccgtggaacgacacatgtcgattatgcggatgcgagtacatagtaacttgacaaaaaagcgggtcaccctgctcatattgttggtctgggctattgctatctttatgggcgctgtgcctacgcttggttggaattgtttatgcaacatatccgcatgctcatcgcttgcgccgatatactcaagatcttacctcgttttttggaccgtaagcaatttgatggccttcttaataatggtcgtggtgtacctcagaatctacgtgtacgtcaagcgcaagacaaatgtcctgagcccacatacatccgggtccataagtaggcgcaggacccccatgaagctcatgaagacggtgatgaccgtcctgggagcattcgtggtgtgttggacccccggactggttgtgcttctcttggatggactgaactgcagacagtgtggcgtccaacacgtaaaaaggtggtttctgctcctggctttactgaattccgtcgtaaaccctatcatctattcttacaaggacgaggacatgtacgggaccatgaagaaaatgatttgttgcttcagccaggaaaaccccgagcgccgtccaagtagaattccctcgacagtgttgtccaggagcgacacaggaagtcaatatatcgaagactccatcagccaaggtgccgtctgtaataagagtaccagttag

SEQ ID NO: 193728 - DNA, 1062 bp, Artificial Sequence
  Description of Artificial Sequence: Synthetic coding sequence
atgaacgagtgccactacgacaagcacatggacttcttctacaaccgcagcaatacggacacagtggacgactggacaggtacgaagctcgttatcgtgctttgcgtgggcactttcttttgtttatttatctttttctctaactctcttgttattgctgccgtcatcaagaatcgcaaatttcattttccgttctattatctgctggccaatctcgccgcagccgacttctttgcgggcattgcctatgtattcctaatgttcaacaccggtccagtgtccaagacactgaccgtaaaccgatggtttctgagacaaggcttgttagactctagtctgacggctagcctaactaacttactggtgattgcagtggagagacatatgagcatcatgaggatgagagttcatagcaacttaacaaaaaagcgggtcaccttgctaattctacttgtgtgggccattgctattttcatgggcgccgtgcccactcttggctggaattgtctgtgcaacatatcagcttgctctagcctggctcctatttacagccgatcctacctagtgttctggacagtttccaacctgatggccttcttaatcatggtggtggtatatcttaggatatacgtatatgtaaagcggaagaccaacgttctctccccacacacttcgggcagcatttccagaagacggactcctatgaagctgatgaaaacagtgatgactgtccttggcgcgtttgtcgtctgttggactcccggactggtggtactgctgctggacggcctaaattgtaggcagtgcggagtgcagcacgtcaagcgatggtttctgctattggcacttttgaattctgtggtcaacccgattatatactcctacaaagatgaagacatgtacggcacgatgaaaaaaatgatatgctgcttctctcaggaaaaccctgagagacggccctccagaattccgtcaaccgtgctatcacggtccgatacaggctcacagtacatcgaggacagtatctcacagggagctgtgtgcaataagagtacgtcctag

SEQ ID NO: 193729 - DNA, 1113 bp, Artificial Sequence
  Description of Artificial Sequence: Synthetic coding sequence
atgggcgaccggcggttcatcgacttccagttccaggacagcaactctagcctgaggcccaggctagggaatgcaaccgccaacaacacctgcattgtcgatgattcatttaagtacaacctgaacggagccgtctacagtgtggtgttcatccttggtttaatcacgaatagcgtctctttgtttgtgttttgttttcgaatgaagatgagaagcgagactgccatcttcatcacaaaccttgctgtttccgacctcttgttcgtgtgcactctgccctttaaaatcttttataattttaatcgccactggccatttggagatactctttgtaaaatcagtggaacggcctttctgaccaatatatatggcagcatgctgttcctcacctgcatttctgtggatcgctttctggctatcgtgtacccctttagatcgagaactatcaggacacgaagaaacagtgccatcgtatgtgcaggcgtttggatcttggtgctgagtggcgggatttccgcaagcctgttctccacgaccaacgtgaacaacgctacgacgacatgtttcgagggctttagtaaacgtgtgtggaagacctatctaagtaagatcactatattcatagaggttgtgggctttattattcccctcatactgaatgtgagttgcagtagtgtcgtgttacggactcttcgaaagcctgcaaccttaagccagattggtaccaacaagaaaaaggttcttaagatgatcacagtgcatatggctgtctttgtagtctgttttgtcccatataattctgtgttatttttatacgcgctcgttcgtagccaagcaatcactaactgttttttggaacgatttgcaaagattatgtatccaataaccctgtgtctggctactcttaactgctgctttgaccccttcatatattacttcacgctggaatcctttcaaaagtctttttacattaacgcacacatccgaatggagagtctgttcaaaaccgagaccccattgacaaccaaaccatcattacctgccattcaagaggaagtatctgaccagacaacaaacaatggtggcgaacttatgctcgaatctaccttttag

SEQ ID NO: 193730 - DNA, 1113 bp, Artificial Sequence
  Description of Artificial Sequence: Synthetic coding sequence
atgggcgaccggcggttcatcgacttccagttccaggacagcaactcaagccttagacctcggctgggtaatgccacagctaataacacctgcatcgttgacgacagctttaaatataacctgaacggcgcggtgtacagcgtcgtcttcattctggggctgatcacgaactctgtgtctctgtttgtcttctgcttccgaatgaaaatgaggtcagaaacggcaatttttataacgaatctggccgtgtctgacctgctgttcgtttgcacactgcctttcaagatcttttacaactttaaccgtcattggccttttggggatacgctgtgcaagataagcgggactgccttcttgaccaacatttatgggtcaatgctgttcctgacatgtatcagcgtggatagattcctggcgattgtctatccctttcgcagccgcacgattaggactagacgtaactcagccatcgtatgtgccggagtatggatcttggtactgtccggtggtatttcagcatccttgttctctacaacaaatgtgaataacgccaccacgacctgctttgaagggttttctaaacgggtgtggaaaacttacctgtccaagatcactatctttatagaggtggtcggattcataatccccttaattctgaacgttagctgtagctctgtggtgctgcgcacactccgcaaaccggccacactctctcagatagggaccaacaagaaaaaggtgctgaagatgattaccgtccatatggcagtatttgtggtctgctttgtaccctacaattctgtactgtttctttacgctcttgtgcgttcccaggctattacaaattgtttcctcgaacggtttgcaaaaatcatgtatcccattacgctgtgtctcgctacacttaattgctgctttgatccattcatctactatttcactttagaatcgttccaaaagtcgttttacatcaatgctcacattcgcatggagtcactcttcaagacagagactcctctcaccacgaagccgtctttaccggcaattcaggaagaggtgtctgaccagacgaccaacaacggcggtgaactgatgttagagtccacattttag

SEQ ID NO: 193731 - DNA, 1119 bp, Artificial Sequence
  Description of Artificial Sequence: Synthetic coding sequence
atgctggccaacagcagcagcaccaacagcagcgtgctgccctgcccggactatagaccaactcatagactgcatctggtggtgtacagtctggttttagccgcggggctgcccctgaacgccctggcactgtgggtgtttttaagggcacttagagtgcactctgtggtcagtgtgtacatgtgcaacctggccgcctcagacctgctcttcacactgagcctgcctgtacggctttcgtactacgcacttcaccattggccatttccagatctgctatgtcaaactactggggccatttttcaaatgaacatgtatggctcttgtattttccttatgttgataaacgtagacaggtacgccgcgattgtgcatcctctgcgtctgcggcacctacggcgcccgagagtagcccgtttactgtgcctgggagtttgggcactgattctggtattcgcagtgccagcagctcgcgtgcatcggcctagtagatgtcggtacagagatttggaggtgagactgtgcttcgaatctttctcagacgagctgtggaagggccgtctactcccactggtcctgttagccgaggcattgggcttcctgttaccgctagccgccgtggtttacagctccggccgggtattttggacgctagcacgacctgacgctacacagagtcagcgcaggaggaagacagtcaggctactgttggccaacctggtcatatttttgctgtgcttcgtgccctacaacagcacgctcgccgtgtatggtctcttacgaagtaagcttgttgcagctagcgtgcctgcgcgagatcgcgtgcggggagtcctgatggtgatggttctcttggccggcgctaactgcgtccttgatcctctggtgtactatttttccgcggaaggctttcggaacactctgcgcggtctcggaaccccccatagagcccgcacaagtgctacaaatggtacgcgggccgccctggcgcagtcggagaggagtgcagttaccaccgatgctacccgaccagacgcagcatcacagggcttgctgcgcccaagtgactcacactccttgtcctcctttacccagtgtccacaggattcagccctttag

SEQ ID NO: 193732 - DNA, 1119 bp, Artificial Sequence
  Description of Artificial Sequence: Synthetic coding sequence
atgctggccaacagcagcagcaccaacagcagcgtgctgccctgccccgattatcggcccacgcacaggctgcatttggtagtctactctctagttctagccgcagggcttccattaaatgcactggcactgtgggtgttcctacgtgccctccgggtccacagcgtggtcagcgtatacatgtgcaacttagcagcaagtgatctgctgtttaccttgtcgttgcctgtgcggctgtcctactacgctctgcatcactggccttttccggatctgctgtgccagacaactggagcaatttttcagatgaatatgtacggatcctgtatctttctgatgctcattaatgtggacagatacgcagctatcgtgcacccacttagactgaggcacctcaggcggccgcgtgtggctcgactactgtgcctgggagtctgggcactgatcttggtctttgccgtgcccgccgcacgagtgcatagaccctcacgatgcagatatagagatctcgaagtacgactgtgttttgaatccttttcagacgagctgtggaaaggcagactactccccctggtgctccttgccgaagcgctgggattccttctgcctctcgctgctgtggtttactcctcgggacgcgtattctggacactggctagacctgatgcaacccagagccaacggcggagaaaaacagttcgtctgctgcttgctaatctggtcatatttctcctttgcttcgtcccatataattccacacttgctgtgtacgggctcctgcggtctaagctcgtggccgcttctgtgcctgcacgggacagagtgcgaggagtgctgatggtaatggttctgttggcgggagcaaattgcgttctagatccactggtatactacttctccgcagagggtttccgcaatactctccgcggtctcggaacacctcacagagcgagaacttccgccacaaatggcacaagggcagccttagctcagtctgaacggagcgctgtgacgacagacgcaacacggcccgatgcagccagtcaggggcttttaaggcctagcgactctcatagtctaagcagctttacacagtgtccgcaggatagcgctctttag

SEQ ID NO: 193733 - DNA, 1290 bp, Artificial Sequence
  Description of Artificial Sequence: Synthetic coding sequence
atgctggccaacagcagcagcaccaacagcagcgtgctgccctgccctgattatcgccctacccatagattgcacctggttgtttacagcctagtgcttgctgctgggctcccgctgaatgcactggcactgtgggtattcctgcgggcactgagggtgcatagcgttgtgagcgtttatatgtgtaatctggctgctagtgacctcttatttaccttgtcccttccagtcaggctatcgtattacgccctgcatcattggccttttcccgacctgctgtgccagacaaccggggccattttccagatgaatatgtacggctcctgcattttcttgatgctcattaacgtcgatcgctatgcggcaattgtgcacccgttaaggctcaggcatctgaggaggccccgtgtggctcgactcttgtgtctaggtgtgtgggcactcatcctggtgttcgctgtcccggctgcacgggttcaccggccaagtagatgcaggtacagagacctggaagtgcggctttgttttgaaagcttctctgacgaactgtggaaaggcagattgcttcccctggtcctcctagccgaagctctgggttttctactgcctttggcggcagttgtgtattcgtcaggacgggtgttctggaccctggccaggcccgacgcaacccagagccagcggagaagaaagacagtgagactcttgcttgcgaacctggtaatcttcctgctttgctttgtcccctacaacagtaccctggccgtgtatggtctcctgaggagcaagcttgttgcagcatccgtcccggcacgggaccgagttcgtggtgtacttatggtgatggtgctactggcaggagctaattgcgtgttggatccactggtttactatttctctgccgaaggctttcgaaatacattgaggggcctcgggactccccaccgcgcccgcacatccgctaccaatggtacacgtgccgcactagcccaatctgaaagaagtgccgtcacaaccgacgctactcgcccagatgccgccagccagggcttgcttcggcccagtgactcccacagcctctctagtttcactcatgccattgcactgagcgtacctgacagtcaacggttgtccttttgggaagcctatcgggtctacacacaggaggggggccttggaacctggacctttggctggcaattccagctctctaatgccgaggaatacaaggtgtggaagcctgggccccgagagggcagtgccgctggaaatggcttctttaagctgtag

SEQ ID NO: 193734 - DNA, 1605 bp, Artificial Sequence
  Description of Artificial Sequence: Synthetic coding sequence
atgcggctgcggggctgcggcccccgggccgcccccgccagcagcgccggtgcttcggacgccaggttgctggcaccccctggccggaacccttttgtccacgagctacgactctctgcactgcaaaaagcacaggtagccttgatgaccctaacattgttcccagttagactcttggtcgcagcagctatgatgcttctcgcatggcccttggcacttgttgcttcccttggctcagcggaaaaggagccggagcaaccacctgctctctggcgcaaggtggtcgactttttgctgaaggcaattatgcgcacaatgtggtttgcagggggctttcaccgggtcgccgtgaagggtcgacaggcactgcctaccgaagcagccattctcaccctggcgccccactcctcctacttcgatgccatccctgtgactatgactatgagctcaatcgtcatgaaggctgagtcaagggatattccgatctgggggacactcattcagtacatcagacctgtcttcgttagccggagcgaccaggactccagaaggaagacagtggaagagataaaacgcagggcccaatccaatggtaaatggccccagatcatgatattcccagagggcacttgcactaacaggacctgtctgatcacctttaaaccgggggccttcatcccaggtgcgcctgtccagcctgtggtactccggtaccccaataaactcgatacgattacttggacctggcaggggcctggtgctctggaaattttgtggcttactctgtgtcagttccataaccaggtggaaattgagtttttgcctgtgtacagcccttctgaggaagagaagcgcaacccagcgctgtatgcctcaaatgtgcggcgcgtgatggccgaagccttgggtgtctccgtcacagattatacttttgaagattgccagttggcactggccgaagggcagctcagacttcctgctgacacttgcctgcttgagttcgcccggctagttcgcgggttgggccttaagcccgagaagctggagaaagatctggaccgatacagtgaacgcgcacgtatgaagggtggagagaagattgggatcgcagagttcgctgcctcattggaggttccagtcagcgacctgctcgaggatatgttcagcctgtttgacgagtccggatccggcgaggtcgacctgcgtgagtgcgtagtggccctgtccgtggtctgtaggcccgctcgtaccctggacacaatccaactggcattcaaaatgtatggcgctcaggaagatggatcagtgggcgaaggagacctgtcatgcattcttaagacagcacttggagtggccgaactgaccgtgactgatttattcagagccatcgaccaggaggaaaaaggaaaaatcaccttcgccgactttcaccgctttgccgaaatgtaccctgcatttgcggaggagtacttgtaccctgaccagacacactttgagtcatgcgccgaaacttcacctgccccaattccaaacgggttctgtgcagatttctccccggagaatagcgatgccgggcgaaaaccagtcagaaagaagctcgattag

SEQ ID NO: 193735 - DNA, 1605 bp, Artificial Sequence
  Description of Artificial Sequence: Synthetic coding sequence
atgcggctgcggggctgcggcccccgggccgcccccgccagcagcgctggcgcatctgacgcacgcctgctcgctcctccggggagaaatccatttgtccatgaactgcgactaagtgcactccaaaaagcccaggtggcactcatgactctcactctctttcccgtgcggctgttggtggccgccgctatgatgctgttggcatggcctcttgcactcgtggcctctctcggttccgctgagaaagaaccagagcaaccaccagcgctctggagaaaggtggttgatttcctgctgaaggctatcatgcggacgatgtggtttgcaggaggctttcatagggtggcagtgaagggacgtcaggcattgcccaccgaggctgctattctgacgttagcacctcatagttcctatttcgacgctatccccgtcactatgacaatgtcctcaattgtcatgaaggccgaatcacgggatatcccgatctggggaactcttatccaatacatccggccagtatttgtttcacgctctgaccaggactctaggcggaaaaccgtagaggagattaaacgtagggctcagtcaaatgggaagtggccacagatcatgatatttcccgaaggcacctgtaccaatagaacttgcctgattacatttaagcccggtgcctttatacctggcgctccagtccagcccgtagttctgcgatacccaaacaagctcgacaccatcacctggacgtggcaaggccccggagctctggagatcctctggctaacattgtgccagtttcataaccaggttgaaatagagttcttgcctgtgtattcaccttctgaggaggagaagcgcaatcctgccttgtatgcctccaatgtacgacgcgttatggcggaggccctgggagtatccgtgacggactacactttcgaggactgccaactagccttagctgaaggccagctgcgtctccctgctgacacctgtcttctggagttcgctagactggtaagaggcctgggtctgaagcccgagaagctggagaaagatctcgatcgatactctgagcgggcccgaatgaaaggaggggagaagatcggtatcgcagaatttgctgccagtttggaggtacccgtgtcagatcttcttgaggacatgttctcactgttcgatgaaagtggaagtggcgaagtcgatctgcgcgagtgcgtggtcgcactcagcgtggtctgtcggcccgcccgcacactggacaccattcaactggcctttaagatgtatggggcacaagaagacggaagcgtgggcgagggggacctgagttgcattctgaaaaccgccctgggcgtcgcggagttgacggtgacggatttatttcgcgcaatcgaccaggaggagaaaggcaaaataaccttcgctgacttccatcggtttgctgaaatgtaccctgcatttgctgaagagtacttgtatcccgaccagacccactttgaatcttgcgccgagacatctcccgccccgatcccgaatggcttctgcgctgattttagtcctgagaattcagacgctggacgtaagcctgtccgcaagaagctggactag

SEQ ID NO: 193736 - DNA, 1464 bp, Artificial Sequence
  Description of Artificial Sequence: Synthetic coding sequence
atggccagcagcgccgagggcgacgagggcaccgtggtggccctggcaggtgtgctccaatctggatttcaggaactctcgctgaacaaactcgccacatcactgggagctagtgaacaggcactgagattgataatttcaatattcttaggctatccatttgccctgttttaccgacattacctcttttacaaggaaacctacttgattcacctgtttcacaccttcactggcctttccattgcatatttcaattttggtaaccaactctaccatagcttactgtgtattgtgctccaattcctgatcctccgccttatgggccggaccatcactgctgtgctcacgactttctgtttccagatggcttatctgctagcgggatattactatacggccaccggtaactacgacattaagtggacaatgccacactgcgtgctgacgctaaagctgatcggactagctgtggattattttgatggcggtaaggatcagaactccctgagtagcgagcagcagaagtacgctattaggggagtccccagcctgctggaagtagccggattttcttatttttatggtgccttcctcgttggccctcagttttcaatgaaccactatatgaagctagtgcaaggcgaacttattgatattcccggtaaaatacccaatagtattatcccagctctcaagaggcttagcctggggctgttctaccttgtcggctataccttgctcagtcctcatattactgaggactatctgctcacagaggactacgataaccatcctttctggtttcgttgtatgtatatgttgatttggggtaagtttgtgctttacaaatacgtgacgtgttggttagtcaccgaaggtgtctgcatactcactgggctgggatttaatggattcgaggagaagggaaaagccaagtgggatgcttgcgcaaatatgaaggtctggctgtttgagacgaacccgcgcttcacaggcaccattgcctcttttaacattaacactaatgcctgggttgctcggtacattttcaaaaggcttaagttcctgggaaataaagagctgagccagggattgtccctactcttcttggcactgtggcacggcctccatagcgggtacctggtgtgcttccaaatggaatttttgattgtcattgtcgaaagacaggccgccagactgattcaggagtcacctacgctaagtaagttggccgctatcacggtactgcagccattctattatctggtacagcagacaatccattggctgttcatgggctactctatgaccgctttttgtctgttcacctgggacaagtggctgaaggtgtataaatcgatttatttccttgggcatatctttttcctgagtctcctttttatcctgccctacatccacaaagccatggtgcctcgaaaggaaaaactgaagaaaatggagtag

SEQ ID NO: 193737 - DNA, 1575 bp, Artificial Sequence
  Description of Artificial Sequence: Synthetic coding sequence
atgagccagggcagccccggcgactgggcccccctggaccccacccctggacctccagccagtccaaaccctttcgtgcatgagctccatttatcacgcctgcaacgtgtaaagttctgtcttttgggggccctgctggcacccatacgagtgttgctggcttttattgtcctgttcctgttatggccattcgcctggctgcaggtggccggcctttcagaggagcaattgcaagaaccaattacagggtggcgtaagacggtgtgccacaatggggtcctgggtctctcccgtcttctcttctttctgcttggctttctgcggattagggtcaggggccagcgcgcaagcaggctgcaagctccagtcctggtggctgctcctcacagcacttttttcgatcccattgtgctcctaccttgtgacttgccaaaggtcgtatccagggcagaaaacctgtctgtgccagtgatcggcgctcttctgcggtttaatcaagcaatcctggtctcaaggcacgaccccgcaagccgcaggcgggtggttgaggaggttcgcagacgcgcgacgagtggcggcaaatggccgcaagtgctcttcttccctgagggcacctgtagtaacaaaaaagctctcctgaagtttaagcccggagcgtttatcgctggtgtcccagtgcagccggtcctgatcaggtatcctaatagcctggataccacaagctgggcatggcggggccccggcgttctcaaggttctctggttaaccgcttctcaaccttgtagtattgtcgacgtggagttcctccctgtgtaccatcccagccccgaggagagtcgggatccaacactgtatgccaacaacgtacagagagttatggcgcaggccctggggattcctgccacagagtgcgaattcgtgggctccttgcccgtcattgtcgtggggcggctgaaggtcgctctcgagcctcagctgtgggaactgggaaaggtcctgcgaaaggcggggctgagtgctgggtacgtcgacgccggagctgagcctggaaggtccaggatgatttcccaagaagagtttgccagacaactgcaactgagcgatccacagacagtagcgggagcctttgggtacttccagcaggataccaagggccttgtggactttcgggacgttgcccttgcactggcggcattggatggaggacgtagcttggaagaactgaccaggctggcattcgagctcttcgcagaggaacaggctgagggccccaaccgtcttctttacaaagacgggttttcaaccattttgcacctcttgctagggagcccacaccctgccgctacagcactacatgccgagctctgtcaggcgggatcttctcaggggctgtccctatgtcagttccaaaacttttcactacatgacccactctatggcaagctcttcagcacttacctgcgcccgcctcataccagccgagggacatcacagactcccaacgcatcctctcctgggaatcccacggcactagccaacggcaccgtgcaggcccctaagcagaagggtgactag

SEQ ID NO: 193738 - DNA, 693 bp, Artificial Sequence
  Description of Artificial Sequence: Synthetic coding sequence
atgtgcggcaacaacatgagcacccccctgcccgccatcgtgcccgccgcaagaaaggcaacggctgcagtgattttcctacacgggctgggtgacacaggacacggatgggcagaggcatttgcgggcatcaggagttcacacattaagtacatttgtccccacgcacccgtgaggcctgtgaccctaaacatgaatgtggctatgccctcatggttcgacataatcgggctctcacccgattcccaagaggatgagtccggaatcaaacaggccgccgaaaacatcaaggcactgatcgatcaagaagtgaaaaatggcattccttccaacaggatcatcctcggcggcttctcacagggaggggcactgtccctctacactgccctgaccacacagcagaagttggccggagtaacagcattgagttgctggctgcccctgcgcgccagctttccccagggtccgattgggggagctaacagggacatttccatcctccagtgccacggagattgcgatcccctggtgcctctgatgttcggcagcctgacagtggaaaagctgaaaaccctggtgaatcctgcgaatgtcacatttaaaacctatgaaggaatgatgcatagtagctgccaacaggagatgatggacgtaaagcagtttatcgacaagctactgcctccgatagattag

SEQ ID NO: 193739 - DNA, 645 bp, Artificial Sequence
  Description of Artificial Sequence: Synthetic coding sequence
atgtgcggcaacaacatgagcacccccctgcccgccatcgtgcccgctgctcggaaggcaaccgccgctgtcatctttctgcacggcctcggagatacaggccatgggtgggccgaagcatttgcagggattcgcagctcacatataaagtacatttgcccccatgcctttgatattatcgggctctctcctgactcccaagaggacgagtctgggatcaagcaagctgccgaaaacattaaggcgctcattgaccaggaggtgaagaacgggatcccctctaaccgcatcattctcgggggatttagccaaggtggggcgctgagcttgtacacggcacttacaactcagcagaaactcgccggcgttacggccttgtcttgttggctgccacttagagcaagttttccccagggtcccattggaggcgccaatagagacatctcaatcctgcagtgccatggtgactgtgacccattggttccactcatgttcgggagtctgaccgtggagaaacttaagaccctggtgaaccctgctaatgtgacattcaaaacatatgagggaatgatgcactcatcatgccagcaggagatgatggacgtcaagcagttcatcgacaaactcctgccacccatcgactag

SEQ ID NO: 193740 - DNA, 1092 bp, Artificial Sequence
  Description of Artificial Sequence: Synthetic coding sequence
atggagctgcacgagcggcccgacgagcggcggaaggcccggacctctactcaggggcgcttgggggattggaggcgtgtacacgctgatggctttacccatcgagtttggtccagcagtagctggctcgagcctgcaatgacgagtagaacaagggtcacttggccgagtcccccccggcctctgcctgtgccagccgctgcagctgtggctttcggggcgaagggtaccgatccagcggaggctagaagctcgcgcggaatcgaggaggctggaccacgagcccacggacgggctgggcgggagcccgagaggcgaagatcccggcaacaacgaagagggggtctgcaagccagacgctcaactctccttaaaacctgtgctcgggctagagcgaccgccccgggcgccatgaagatggtggctccatggacccgtttctacagtaattcctgttgcctctgctgtcacgtgcggaccggaactatacttctaggcgtgtggtatctgattataaatgccgtcgtgctgcttattctgctatcagcactggctgatccagatcagtacaacttcagctcttctgagctcgggggggacttcgaattcatggacgatgccaatatgtgtattgcaatcgcgatttcactgctcatgattcttatctgtgccatggccacatacggagcctacaagcagcgtgcagcctggattattccatttttttgttaccagatctttgacttcgcgttgaacatgcttgtggctataaccgtgctgatctaccctaattctatacaggaatacatccggcagctgccacctaactttccatacagggacgatgtgatgtcagtgaacccgacgtgcctggtactcattattctgttattcatttccatcattctgacgtttaagggatacctgatctcctgtgtttggaactgctataggtatatcaacggcagaaacagttcagatgtgctggtgtacgtcacctcaaatgatactacagtgctgcttcccccctatgacgatgccaccgtcaacggagccgctaaagagccccctccgccctacgtgtccgcttag

SEQ ID NO: 193741 - DNA, 954 bp, Artificial Sequence
  Description of Artificial Sequence: Synthetic coding sequence
atgaccagccggacccgggtgacctggcccagccccccccggccccttcccgtccccgcagccgcagccgtggccttcggggctaagggaacagaccccgccgaggctcgcagttccagaggaattgaggaggccggccctagggcacacgggcgcgcaggaagggagcccgaacgacgcagaagcaggcagcagagacgggggggcctgcaggcgaggagatctaccctactcaagacctgcgcacgggccagggcaaccgcaccgggagccatgaaaatggtggccccttggacacggttctattccaattcttgttgtctttgttgtcacgtaagaacgggaacaatattgttgggggtgtggtacctcatcatcaatgcggtcgtcctgctgatccttttatcagccctcgctgatcccgatcagtacaatttctcgtctagtgagctcggcggcgatttcgagttcatggatgacgccaacatgtgtatagcaatagctatctcacttctgatgattctgatttgtgccatggccacatacggggcttacaaacagagggccgcttggattattccatttttttgctaccagatcttcgacttcgcgcttaatatgcttgtggccatcacagtgctcatatatcctaattcaattcaggagtatattaggcagttgccaccaaatttcccttatcgggacgatgtaatgagcgtgaaccccacatgccttgtgctcatcattctgctgtttatatccattattctaaccttcaaaggttacctcatctcctgtgtatggaactgctaccgctatataaacggacggaactcttccgatgtgctcgtctatgtaaccagcaacgacacgaccgttctgcttcctccatatgacgacgctacagtgaacggagctgctaaggagcccccacccccatacgtatctgcttag

SEQ ID NO: 193742 - DNA, 681 bp, Artificial Sequence
  Description of Artificial Sequence: Synthetic coding sequence
atgaagatggtggccccctggacccggttctacagcaacagctgctgcctctgttgtcacgttcgcactggcactatcctacttggcgtgtggtacctgattatcaatgccgtcgtcctgctgattttgctatcagcccttgccgatcctgaccagtataatttttcatcttctgaactgggcggcgatttcgaatttatggacgatgccaatatgtgtatcgcaatcgctattagcctgctgatgatacttatttgcgcgatggccacgtacggagcatacaaacagcgggccgcctggattataccatttttttgttatcaaatcttcgacttcgccttgaacatgctggtggccatcacggtgctgatttacccaaactccatccaggaatatattaggcagctgccgccaaattttccctacagagatgacgtgatgagcgttaatcctacttgcctggtcctgatcatactgctctttatcagtataatcctcacgttcaagggctacctgatatcctgcgtgtggaattgttacaggtatataaacggcagaaactcctctgatgtgctggtttacgtcacctccaatgacaccacggtgcttttacccccctacgacgatgcgaccgtcaatggggcggcaaaggaaccacctcccccatacgtatcagcctag

SEQ ID NO: 193743 - DNA, 789 bp, Artificial Sequence
  Description of Artificial Sequence: Synthetic coding sequence
atggacccccggctgagcaccgtgcggcagacctgctgctgcttcaacgtacggatagcaaccactgccctcgccatttatcatgtgatcatgtctgtccttctattcattgagcactccgtggaggtggctcatggcaaggcgagttgcaaactgtcacagatgggatatctgcggatcgcagaccttatctcctcgtttctgctgatcactatgttgtttataattagcctgtcacttctgatcggggtggtcaagaaccgtgagaaatacctgctgcctttcctgtctttacagatcatggattacctgctgtgccttttaacactgcttggaagttacatcgagttacctgcctacttgaagctcgcgtcccgtagcagagcaagcagttcaaagttcccgctgatgactctgcaactcttggacttttgtctgagcatactgaccctgtgttccagctacatggaagtgcccacgtatctgaactttaagtcaatgaatcacatgaattatttaccttcccaggaggacatgccccataaccagtttattaagatgatgatcatatttagtatcgcattcataactgtgctcatcttcaaggtatacatgttcaagtgcgtttggaggtgctatagactaatcaagtgtatgaattccgtcgaagaaaagcgcaattccaagatgctccagaaagtggtgctcccttcgtacgaagaagcactgtctttgccgtccaagacccctgagggcggcccggctcctccaccgtactccgaagtctag

SEQ ID NO: 193744 - DNA, 873 bp, Artificial Sequence
  Description of Artificial Sequence: Synthetic coding sequence
atggacccccggctgagcaccgtgcggcagacctgctgctgcttcaacgtaagaatcgcgacgaccgccttggcaatataccatgtgataatgagcgtgctcctgttcattgagcatagcgtggaagttgcgcatggcaaagccagttgtaagttgtctcagatgggatatctgagaatagccgatcttatctctagttttctgctgattacaatgctttttatcattagtctcagcttgcttataggagtggtgaagaaccgagagaagtacctgttgcccttcctgtcgctgcagatcatggattatcttctctgcctgctgactctgttgggatcatacatcgaattgccagcctacctgaagttggcttcacgctctagagccagcagttccaagttcccattgatgacattgcagcttctcgacttctgtctctctatattaacactatgttcaagctatatggaggtgccaacatacctgaacttcaaaagcatgaatcacatgaattacctgccatctcaagaagatatgcctcataaccagtttatcaagatgatgataattttttctattgcctttattactgtgttgattttcaaggtttacatgtttaagtgtgtgtggaggtgctaccgccttatcaagtgtatgaatagtgttgaagaaaagaggaatagcaaaatgttgcagaaagtcgtccttccgagttatgaggaggctctgtcccccgctggaccagtgtcatgctcccaattgggccaaaggtttaggctctcacattcctctgggctgagtatcatccagcctaacaatgcctggtttatctccatttctagtgatacctgtctggatgattggccattttag

SEQ ID NO: 193745 - DNA, 11406 bp, Artificial Sequence
  Description of Artificial Sequence: Synthetic coding sequence
atgagcaccgacagcaacagcctggcccgggagttcctgaccgacgtgaacaggctttgcaatgctgtggttcagcgggtggaagcgagggaagaggaggaggaagaaacccacatggcaactctgggacagtatctggttcacggccggggttttctgctgctaaccaagctgaacagtattatcgatcaagctttgacctgcagggaggaattgctaaccctgctgctgagcctcttgcccctcgtctggaaaatcccagttcaggaggaaaaggccacagattttaaccttcccctgtcggccgatattattcttaccaaggaaaaaaatagctctagccagaggagcacccaagagaaattgcatcttgagggttcagcactcagcagccaggtgtcagcaaaagtgaacgtcttccggaaaagcaggagacaacgaaagatcacacaccggtacagcgttcgggacgctcgtaagactcagcttagtacttctgatagcgaggccaactctgatgagaaggggattgccatgaataagcacaggagaccccaccttctgcatcacttcttaacatcatttccaaagcaagaccacccgaaggctaaactcgatcggttggcgacaaaagagcagactccgccggatgctatggcattggagaactctcgcgagattatcccaaggcaaggatcaaacaccgacattttatctgaaccagccgccttatccgtgataagtaatatgaataattctcccttcgatctgtgtcacgtgctcctgagtttgttagagaaagtttgtaagtttgatgtaaccttgaatcacaattcgcctctggcagcctcggtggtccccactcttaccgaattccttgcgggctttggggactgctgttctttatcggataaccttgagtcccgggtggtttcggcaggctggactgaggagcctgtggccctgatccagcggatgctgttcagaacagtgctgcatctgctctccgtggatgtcagtacggccgaaatgatgcctgagaatctccgcaaaaatttaaccgagctactgcgggctgcgctgaaaatacgcatctgcctggagaaacagcctgatcctttcgctcctagacagaagaagacactgcaggaagtccaggaagacttcgtgttctctaagtaccgccacagagccctgctgctccccgagctgttggagggcgttcttcaaattttgatttgctgtctgcagtcagccgcctccaacccattttacttctcacaggccatggatcttgtccaggagtttattcagcaccatggctttaacctgtttgaaacagccgttcttcagatggagtggttagtgctccgggatggagtgcccccagaggctagcgagcacctgaaggcactgattaactcagtaatgaaaatcatgtctactgtgaaaaaggttaaatccgagcagctgcaccactctatgtgtaccagaaaacgccatagacgatgcgagtattcacattttatgcatcatcaccgagacctgtctggactcctggtgagcgcctttaaaaaccaggtgagcaagaacccattcgaggaaacagcggatggggatgtttattaccccgaacggtgctgttgcattgcagtttgcgcccaccaatgtctccgcctgctccagcaggcctctttatcttcaacctgcgtccagatcctctcaggcgtgcataatatcgggatttgctgttgcatggaccctaaatccgttattatccctttactccacgcgtttaaactgcccgcattaaaaaatttccagcagcacattctcaacatcttaaataaactaatactcgaccagttgggcggggccgaaatttcacccaaaattaaaaaagccgcctgcaacatttgtacggtagactccgaccagctagctcagctggaagagaccctccagggaaacctgtgtgatgctgagctgagttcctctttgagtagcccctcgtatcgctttcagggcattcttccatcatcaggcagtgaggacctgctgtggaaatgggacgccttgaaggcctaccagaactttgtgtttgaggaagatcgactgcattctattcagattgctaaccacatatgcaacttgatccagaaagggaacatcgtggtgcagtggaagctttataattatattttcaacccggtgctgcagagaggcgtagagctggctcaccactgccagcacctgagcgtgacaagtgctcagtcgcacgtgtgcagccatcacaaccagtgcctacctcaagacgtgctacaaatatatgtcaagactctaccaatccttctgaagagccgcgtcattcgcgatctgttcctctcatgcaacggagtgagccaaatcattgagctgaactgtttaaacggcatccggagtcactcactcaaggctttcgaaaccttgattatctccttaggtgagcagcaaaaagacgccagcgtgccggacattgacggtatcgacattgagcagaaagagctgagttctgtccacgtgggcaccagcttccaccaccagcaggcatatagcgacagcccacagtctctgagtaagttctatgctgggctgaaagaagcctatccgaagaggcgcaaaaccgtcaaccaggacgtccatattaatacaattaacctctttctttgtgtcgctttcctttgcgtatccaaagaagccgagtccgacagagagagcgccaacgactccgaagatacctcaggctatgacagtactgcttcagagcctctgagccacatgttgccgtgtatttcattggaaagtctcgtcctgccctctccagagcatatgcaccaggctgcagatatttggtctatgtgccggtggatctacatgttgagcagcgtgtttcagaaacagttctacaggcttggagggttcagggtttgccataagctcatattcatgatcatccagaaactttttcggagccacaaggaggagcaaggcaagaaggagggggatacaagtgtgaatgagaaccaggacctgaatcgcatctcccaacctaagcgcacaatgaaggaagacctgttgtctctcgcaattaagagtgatcccatcccctcagaattgggctcactgaagaagtcagccgattccctgggtaaattagagctgcagcacatctcttcaatcaacgtagaggaggtctcagcaaccgaggccgcacctgaagaggctaagttgttcacctctcaggaatcggaaactagcctgcaaagtatccgactgctcgaagccctgctagccatctgtctgcatggagcccgcacgtcccagcagaaaatggagctcgagttgcccaatcagaatctctcagtcgagtccatcctgttcgagatgagagaccacctctcccagtctaaagtaatcgagacgcaacttgccaagccgctatttgatgccctcctgagggttgcactgggcaactactcagctgacttcgagcataacgacgcgatgacagaaaagagccatcagtctgcggaagagctgtcaagccagccgggcgatttctccgaggaggctgaagatagccaatgctgctccttcaagctgctggtagaagaggagggctatgaggctgattcagaaagtaatccagaagatggcgaaacacaggacgatggggtggatctgaagagcgagaccgaaggtttttccgcatcctccagtcctaacgatctgctggagaacttaactcagggtgaaataatctaccccgagatttgcatgctcgaactcaatttactgtccgcatcaaaggctaagctggatgtcctggcccacgtgtttgaaagtttcctcaagatcattcgccaaaaggaaaaaaacgtgtttcttctaatgcagcaggggacagtgaagaatctgctgggcggattcctctccattctgactcaggacgatagcgatttccaagcatgtcagagggtactcgtcgatctcctagtgagtctgatgtcctcgaggacctgctccgaagaactcacattgctgctgcgaatctttttagagaagtcaccctgcacaaaaattctcctgctcggcattctgaaaattatcgaatccgatacgaccatgagtccaagtcagtacttgacttttcccctgctccatgctcccaacctttccaatggcgtgtcttcccagaaataccccggcattctgaattccaaggcgatgggcctgctgaggcgcgcacgcgtttcccggtccaaaaaagaagccgaccgggagtccttcccacatcgcctgttatcctcctggcacatcgcgccagtgcatcttccactgcttggccagaactgttggcctcacctgagtgagggctttagtgttagcttatggtttaacgtggaatgcattcacgaggccgaatccactactgaaaaaggcaagaagatcaaaaagcggaacaagagcctgatcctacccgactccagcttcgacggaactgagtctgatcggcccgaaggcgcggagtacatcaaccctggcgaacgtttaatcgaggaaggatgcatccatatcatttctttgggtagcaaggctcttatgatccaggtctgggccgatccccataacgccacactcatttttcgagtatgcatggattccaatgatgatatgaaggctgttctcctcgcccaggtcgaatcccaggagaatatcttccttccatctaagtggcagcacttggtcctgacctacttgcagcagccccaggggaagcgcaggatacacggtaagatttcgatttgggtgagtggccagcgaaagcccgacgtgacacttgacttcatgttaccaaggaagactagtctctccagtgactctaacaagactttctgtatgatcgggcactgcctgtcgtcacaggaagagtttctacaactggctggcaaatgggacctgggcaatctactgctttttaacggcgccaaagttgggtctcaggaggcattctatctctacgcctgtggccctaaccatacaagcgtgatgccttgcaagtacggcaaaccagtgaatgattattctaagtatatcaataaggagatcctccgctgcgagcagatccgcgagctcttcatgactaagaaggatgtggacatcgggctgcttatagaatctctgtctgttgtgtacacaacatactgtccagcccagtatactatctacgaacccgttatcaggctcaagggccagatgaaaacccagttgagccagcgccccttttccagcaaagaagttcagtcaatcctgctggaacctcaccatctgaagaacttgcaacctaccgagtacaaaaccattcaaggcatcctgcacgagattggcggcactggcatcttcgtctttctctttgcccgagttgttgaactctccagctgtgaggaaacccaagcgctcgccctgagagttatactgtcgctaattaagtacaaccagcaacgtgtgcatgagttagaaaattgtaatggattgtccatgatccaccaggtgctcattaagcaaaaatgtattgtgggcttctatattctgaagacgttgttggaaggctgttgtggggaagatattatctacatgaatgaaaacggagaattcaaactcgacgtagacagcaacgccattatccaagatgtgaagctgctcgaagagctgttactcgattggaaaatctggagcaaagcggagcaaggcgtctgggaaacactgctggccgcgttggaggtgcttatcagggctgaccaccaccagcagatgttcaatatcaaacaactgcttaaggcccaggtggttcatcattttctgctgacatgtcaggttctgcaggaatacaaagaggggcaattgacccccatgccgagagaagtctgtcggtcctttgtgaagattatagcagaggtcctgggatcaccgccagatctagagctactgacaatcattttcaatttcctactcgcagtccacccccctactaatacttatgtgtgccataatcctacaaacttctacttctccctccatatcgacggaaagatcttccaggaaaaggtgaggtcaatcatgtacttgcggcattcatcttctggaggcagatccttgatgagtcctggttttatggtgataagtccctccggcttcactgcctcgccgtatgaaggggaaaattcctctaatatcatcccacagcagatggcggcccatatgcttaggtcaaggtccctcccggctttccctacgtcatctttactgacccaatcacagaagctgaccgggtctctggggtgcagcattgacaggctgcagaacatcgctgacacctacgtggcgacccaatccaaaaagcagaattcgctgggttcctccgatacccttaagaagggaaaagaggacgcctttatttcatcctgtgaaagtgcaaaaactgtctgcgagatggaggccgttttgtctgctcaagtgtctgtgtccgatgtgccaaagggcgtgctgggtttcccggtggtgaaggcagaccataaacagctgggggctgagcccaggtccgaagatgattctcccggcgatgagtcatgcccgcgtcgtcctgactatctcaagggcttagccagtttccagcgcagccatagcacaatagccagtcttggcttggcattcccatcccagaacgggtcagctgcagttgggcgctggcccagtctggtggatcgaaatacagatgattgggaaaatttcgcttactccctgggctacgagcccaattataaccgaacagcgtctgcgcatagcgtgacagaagattgcctggttcccatttgttgcggtttgtacgagctgctctccggagttcttcttatactgcccgacgttctcttagaagatgtcatggataaactcatccaagctgatactctcctcgtgctggtgaaccatccatcacctgccatacagcagggtgtgatcaagcttcttgatgcatattttgccagagcctctaaggagcaaaaggataagtttctgaaaaataggggctttagcctgctagccaaccagctgtacttacacagaggtacacaggagctgttggaatgcttcattgagatgttttttgggcgacacatcggactagatgaggagttcgacctggaggacgtgcggaatatgggtctttttcagaagtggtcagttattccaattctcggactcatcgaaaccagcctctatgataatattctcttgcataacgccctgcttcttctgttgcagattcttaattcctgctccaaggtggccgacatgctgctcgacaacgggttactgtacgtcctgtgcaataccgtggctgccctgaatgggctcgagaagaacattcccatgtctgaatacaagctgctggcttgcgacattcagcagctgtttattgcagtgacaatccacgcatgttcctcatccgggagccaatacttccgggttattgaagaccttattgtgatgttaggttatttacagaactctaaaaacaaacgcactcagaacatggctgtagcactgcagctgagagtgttgcaggctgctatggagttcatccgaactaccgccaatcatgacagcgaaaatctgactgactccctccaaagtcccagtgcacctcaccacgccgtggtgcagaaaagaaagtctatcgctggccctcgtaaatttccgctcgcacagaccgagagcctgcttatgaaaatgcggtccgtggcaaacgatgagctgcatgtcatgatgcagaggcgaatgtctcaggaaaatccgagccaggccaccgagaccgaattagctcagagactacaacgtctcacagtgcttgctgttaaccgcattatttatcaggagtttaactcagatatcattgatatccttagaacacccgaaaacgttactcagtccaagacatctgtgtttcagacagaaattagcgaagaaaacatacatcatgagcaatcttcagtcttcaatccattccagaaggaaattttcacctaccttgtcgaggggttcaaggtctccatagggagctctaaagcctccggtagtaaacagcagtggactaagattctgtggagttgtaaggagacttttcgtatgcaattagggcggctgttagtgcatatcctgtctcctgctcacgccgcacaggaacggaagcagatctttgaaatcgttcacgagccgaaccaccaggaaatcctgcgcgattgtctctcaccaagcctacaacacggagctaagttggtgctctatctttctgagctgattcacaatcaccagggggaactgacggaagaagagcttggaaccgcggagttgttgatgaatgcgttgaaattatgtggccacaagtgtattccaccctcagccagtactaaggccgacctgatcaagatgatcaaagaggaacaaaagaaatatgagaccgaggaaggggttaataaagctgcatggcagaagactgtgaataacaaccagcagagcctcttccagagactggactcaaagagtaaggacatcagcaaaattgcagcagatattactcaggcagtgagcctcagtcagggaaacgagcggaaaaaggtgattcagcacataaggggtatgtacaaagtagacttgagcgcatccaggcactggcaagagctgattcaacagctgacccacgacagggccgtttggtatgacccaatctattacccaacatcatggcagctggatcctaccgagggacctaatagagagcggaggaggctccagaggtgttacttgacaatacccaataagtacctgctgcgcgatcgtcagaagtccgaagatgtggtgaagccccccctctcttacctgttcgaagacaaaacccactcctccttcagcagcacagtgaaggataaagccgctagcgaatccattagagtcaataggaggtgtatatccgtggctccatctcgggaaacagcaggggagctgctcctggggaagtgtggcatgtattttgtggaggacaacgcatcagacaccgtggaatcttcttccctccagggtgaacttgaacccgcttctttcagttggacatatgaagaaattaaagaggttcacaagcggtggtggcagttacgggacaatgccgtcgaaatttttctgaccaacggacgtacactgcttctggcattcgacaataccaaagttagagacgacgtgtatcacaacatcctaaccaacaatttaccaaatcttctcgagtacgggaacatcacagctctaactaatctgtggtatactggccagataactaatttcgaatacttaacccacctcaataagcacgcaggcagaagcttcaatgacctaatgcagtaccctgtgttcccctttattctggctgactatgtgtcagaaacgctggatttaaatgacctgctgatttatcgtaacctgagcaagcctattgctgtccaatataaggaaaaggaagaccgctacgtggatacctacaagtatctcgaggaagaatacagaaaaggtgcacgagaggacgatcctatgcctccagtccagccctatcactacggatcccactactcaaacagtggcacagtgctgcacttcctggtgcggatgcctccttttacgaaaatgttcctggcttaccaggaccagagcttcgacatccccgaccgcacatttcactctaccaacactacgtggaggctttcttcgttcgagtccatgactgacgtgaaggagctaattcccgaatttttttatctgcctgagtttctggtgaatcgagaagggttcgattttggcgtgaggcaaaacggggaaagagtgaaccacgtaaaccttccgccatgggccaggaacgatccaaggttgtttatcctaatccaccgtcaggccctggagtctgactatgtgtcacaaaatatctgtcagtggatcgatctcgtcttcgggtataaacaaaagggaaaggcctccgtgcaggcaatcaatgtctttcatccagccacatacttcggcatggacgtgagcgccgtggaagacccagtgcagcgcagggctttagagacaatgatcaagacatacggccagactccgcgacagctgttccacatggcccacgtctcaaggccaggcgccaagttgaacatagagggcgaactgccagcagccgtgggactgctggttcagttcgcgttcagggagactcgcgagcaagtcaaggagattacctatcccagtcccctgtcttggattaaagggctgaagtggggggagtacgttggaagcccttcagcaccagtgccggtagtgtgtttcagtcagccacacggagaacggttcggatcattgcaggcactgccaacccgcgctatctgcggcctgtccagaaacttttgcctcttaatgacctacagcaaggaacaaggtgtgagatctatgaactctacggatattcaatggtcggccatactgtcttgggggtacgccgataatatcctgaggcttaagagcaaacaaagcgagcccccggttaacttcatccagtcctctcagcagtatcaggtgaccagctgtgcttgggtgcccgatagctgtcagttgttcactggcagcaagtgcggtgtgataaccgcctataccaatcgcttcacctcatctacaccatccgagatcgaaatggagacccagattcatttgtatggccatacagaggaaattacgtccctgtttgtatgcaaaccttatagtattttaatctccgtatcacgtgacggcacctgcatcatttgggatttgaacaggctatgttacgtgcaatctctggctggtcacaagagtcctgttacggccgtgtccgcctctgagactagtggcgatatagcaaccgtgtgcgactccgccggcggcggaagcgatctgaggctgtggacagtgaatggcgacctggtcgggcatgtacactgcagggagattatttgcagcgtggcttttagtaatcagccggagggggtctcaatcaacgtgattgcaggtggcctggagaatggaattgttaggttatggtccacctgggatttaaaaccagtgcgagagattacattccctaagtcgaacaagccaattatttccctcacattcagctgtgatggacatcacttgtataccgctaattcagacggcaccgtaatcgcttggtgcagaaaagaccagcagcgtcttaaacaacccatgttttacagttttctcagcagctatgccgcaggttag

SEQ ID NO: 193746 - DNA, 11406 bp, Artificial Sequence
  Description of Artificial Sequence: Synthetic coding sequence
atgagcaccgacagcaacagcctggcccgggagttcctgaccgacgtaaatcggttgtgcaacgcggtggtgcagcgcgtggaagctagggaagaggaggaagaagaaacacacatggccacactgggacaatatctggttcacggtcggggattcctgctcctgactaaactgaacagcatcatcgaccaggctctgacctgtcgcgaagagctgctgacactgctgctatctctgctgcctctcgtttggaaaatccccgtgcaagaggaaaaggcaacagatttcaatctaccactgtccgccgacatcattttaacaaaagagaaaaactcatcttcacagaggagcactcaggaaaagcttcatttggaaggaagtgctttgtccagtcaagtatccgctaaggttaacgtttttcgcaagagccggcgccagcgcaagataacccatcgttattccgttcgagacgcgcggaagacccagttgagtacgtcggatagtgaagccaactccgatgagaaaggaattgccatgaataagcaccgcaggcctcacctgctgcaccacttcttaacaagcttcccgaagcaggatcaccctaaggcaaaactggatagactggccacgaaagaacagaccccccccgatgcgatggctctggagaacagtcgcgagattattcctcggcaaggcagcaataccgatattctctcagagcccgctgctctgagtgtgatctcaaatatgaacaactctcccttcgacttgtgccacgtcctgctttccctgctcgaaaaagtttgcaagttcgatgtgactctgaaccacaactccccactggcagcttcagtagtgcccacacttacagaattcctggctggtttcggtgactgctgctccctatctgataatctcgagtcgcgcgtggtctctgccggatggacagaggagcctgtggccttaatccagagaatgctgtttcggactgtgcttcatttgctttcagtcgacgtgagcaccgctgagatgatgccggagaacctgcgcaagaaccttaccgagctgctgagagcagcgctgaaaatcagaatctgcttggaaaagcagcctgacccattcgcacctcgccaaaaaaagaccctgcaggaggttcaagaggacttcgtgtttagcaagtatcgccatcgcgcactgcttctgccagagctgctggagggcgtactgcagatcctgatctgctgcctacagtctgcagcctccaacccattctacttctcccaggccatggaccttgtgcaggagttcattcagcatcacggctttaacttatttgagacagccgtcctgcagatggaatggctcgtcctgcgtgacggggtgcctcccgaagccagcgagcatctgaaggccctgataaacagcgttatgaagattatgtctacagtgaagaaagtcaaatcagagcaactgcatcacagcatgtgtacaaggaaacggcaccggcgctgtgaatactcgcattttatgcaccatcacagggacttgagtggactgttagttagcgcgttcaaaaaccaggtctctaagaacccttttgaggagaccgccgacggggatgtctattaccccgagcgatgctgttgtattgcggtctgcgcccatcaatgtttgcggctgctccagcaggctagtctgtcttctacatgcgtgcagattcttagcggtgtccataatatcggaatttgctgctgcatggacccaaaatctgtgatcatccccctgctgcacgccttcaagttgccagcattgaaaaacttccagcagcacattttgaatatccttaacaaattgattctggaccagcttgggggcgcagagatttctcccaagatcaaaaaagctgcttgtaacatttgtacagtggattctgaccagctggctcagctcgaggagaccctccaggggaatctttgcgatgcggagctgtcttcgagcttgagcagcccttcttaccggtttcagggtatcctcccctcctccggttccgaggatctgctctggaagtgggacgcactgaaggcctatcaaaattttgtcttcgaggaggaccggttgcactccatccagatagccaaccacatctgtaacctcatccaaaaaggcaatatcgtggtgcagtggaaactctataattatatttttaacccagtgttacagaggggcgtcgaactggcacatcactgccaacacttgtccgtgacgagcgcacagagtcacgtgtgctcacaccataaccagtgtctgccccaagatgtcctgcaaatatacgtcaaaacacttccaatcttgctaaaatctcgggttatccgggacctcttcttgtcttgcaacggggtgagtcagattattgagctcaattgtttgaatggcattaggtctcatagtctcaaagccttcgagaccctgatcatatctcttggagaacagcaaaaggatgccagcgttccggatatcgacggaatcgacattgagcaaaaggaactgtcctctgtccatgttggcacttcttttcatcaccaacaagcatattctgacagccctcaaagtctctcgaaattctatgccgggttaaaggaggcctatcccaagcgcaggaagaccgttaaccaggacgtgcacattaacactatcaacctgtttctgtgtgtagccttcctctgcgtctctaaggaagctgaatcagaccgagagagcgcaaatgatagcgaggacacaagtggctacgacagtactgcatctgagcctctgtcccacatgcttccttgcatatcccttgagtccctagtcttgccctcaccagagcacatgcaccaggcagccgacatttggagcatgtgtcgatggatatatatgctttctagcgttttccagaagcaattttataggctggggggatttcgggtgtgtcacaagttgattttcatgatcatacagaaactttttcgctcccacaaagaggagcaggggaaaaaagagggggatacatcggttaatgaaaaccaggatctgaatcggatttctcagccaaagcggactatgaaggaggatctactgagtctcgctataaagagtgatcctattccctctgagctgggcagtctaaagaagtccgctgactccctgggcaagctggaattacaacatatctcttctattaacgtggaggaagtgtcagccaccgaagcagctcccgaggaggcaaagctgttcacctcacaggagtcagaaacaagcctgcaaagcattcgcctgctggaggccctgttggccatctgcttgcacggtgctcggacgtctcaacagaaaatggagttagagcttcctaatcagaacctgagcgtcgagtccattctgtttgaaatgagggatcacttgtctcagtcaaaggtgattgaaactcaattggccaaaccactattcgacgcactactgcgagttgctttaggtaattatagtgctgattttgagcacaatgatgctatgaccgaaaagtctcaccagagcgctgaggagctgagtagccaaccaggtgacttcagcgaagaagccgaggattcccagtgctgtagctttaaactgctggttgaggaagaggggtatgaggctgacagtgagagtaatcccgaagacggcgagactcaggacgatggtgtcgatctgaaaagcgagactgaaggctttagcgcgtcatcaagccctaatgacctcctggagaacctgacccagggcgagataatctatccagagatttgtatgctcgaactgaacctgttgagtgcctcaaaggccaagttagatgtattggcccatgtgtttgaatctttccttaaaatcatacgtcagaaggagaaaaatgtattcttgctcatgcagcagggaaccgtcaagaatctgctcggaggatttttgtccatcctgacccaggatgatagtgattttcaggcttgtcaacgggtacttgtggatttactggtctctctgatgtcctcacgcacttgtagtgaggagctcaccttgctcctgagaatattccttgaaaagagtccatgtaccaaaatactgctgctcggaatcctgaaaatcattgagagcgacaccacaatgagtccaagccagtatctgaccttccctttgctgcatgcccccaatctgtctaatggagtctccagtcagaagtacccaggaatcctgaactccaaagccatggggcttcttaggcgcgcccgggtctcccggtcgaaaaaggaagctgaccgtgagtcattcccacacaggctgcttagctcgtggcacatagcacctgttcaccttccccttctcggacagaactgttggccacatttgagtgaggggttctcggttagcctgtggttcaatgtcgaatgcatccatgaggccgagtctactactgagaagggaaaaaaaatcaagaagagaaataagagcctgatcctccccgacagcagttttgatgggactgagtctgatcgaccagagggggcggagtatattaatcccggcgagagacttatagaggaaggctgcattcacatcatatcactgggttcgaaagcgctcatgatccaggtttgggccgacccacacaacgccaccctaatatttcgagtgtgtatggattctaatgacgatatgaaggccgtgctgcttgcccaagtggagagccaggagaatatcttccttcccagcaagtggcagcatcttgtactgacctatctgcagcagccccagggcaaacggagaattcacggcaaaatcagcatttgggtctctggacaaaggaagcctgacgtgacacttgattttatgctgccacgcaaaacaagcctgagtagcgactccaataaaacattctgtatgatcggtcattgcctcagctcccaggaagaattcttgcagttggcaggcaagtgggacctgggtaatctcctgctgtttaatggagcgaaggtgggatcacaagaagcattctacctttatgcctgcggacccaatcataccagcgtgatgccatgtaagtatggtaagccagtgaatgactactcaaagtacatcaacaaagaaatcctgcggtgtgaacagatccgcgagctgtttatgacgaagaaggacgtagatatcggtctcctgatcgagagtctttctgttgtatataccacctactgtcctgcacagtatacgatctatgagcccgtcatcagacttaagggacagatgaagactcagctgtctcagcggcccttctcttcaaaggaggtccaatctatccttctggaaccacaccacctcaagaatctgcagcctaccgaatacaagaccatccaggggattctacacgagataggaggaacggggatcttcgtgttcctcttcgctcgcgtggtggagctgagctcgtgcgaggaaacacaagcgctagcgctgcgggtgatcctgtccctcatcaaatacaatcaacaaagggtgcatgagctggagaactgcaacggtctttccatgattcatcaggtgctcattaagcaaaaatgtatagtgggtttctatattctgaaaacactgctggaaggctgttgtggcgaagatattatctatatgaatgaaaatggcgaatttaaactggatgtggatagtaatgccataatccaggacgttaagttgctggaagaactacttctcgactggaagatttggagcaaagcggaacagggcgtctgggagacgctcctcgcagcgctggaggtcctaattagagcagaccaccatcagcaaatgtttaacattaaacaactactgaaggcccaggtcgtgcatcatttcctgctcacctgccaggtgctgcaggagtacaaggagggacagctcactcccatgccacgtgaagtctgtcggtcttttgtgaagatcatcgctgaagtgctgggtagcccacccgatttggaattacttacgatcatcttcaatttcctattagctgttcacccccccacgaacacgtacgtatgtcacaacccaacgaacttctacttctccctgcacattgatggcaaaatttttcaagaaaaggtgaggagtatcatgtatctgcgtcactcttccagtgggggccggtcccttatgtccccgggtttcatggtcatttctccctcaggcttcactgcctcaccctatgagggcgaaaacagcagcaacatcatcccacagcaaatggccgctcatatgctgcgctcaagatcgctgccagcctttccaacgagttctctgctgactcagtctcagaagttgaccggctctttgggctgtagtatcgatcgccttcaaaatatcgctgacacctatgtggctacacagtcgaagaagcagaattccctggggtcatcagatacactgaaaaagggcaaggaggacgctttcatctcctcctgcgagtcggccaagacggtgtgcgaaatggaggctgttctgtccgcccaggtctcagtaagcgacgtgcccaaaggcgtgttgggtttccctgtcgtgaaggctgatcataagcagttaggagccgagcctcgctcagaagacgactccccaggggatgagagttgccctcggcgacccgactacctgaaaggtttagcatcttttcaaagaagtcactctactatcgctagcctgggactggcatttcctagccaaaacggatctgccgcggtgggacgctggccatcattggtggaccggaatacggacgattgggaaaattttgcttactcactgggctatgaacctaactacaatcggactgcttctgcacattcggtaaccgaggattgcttggtccccatttgctgcggactatacgagctgctgtccggggttctcctgattcttccagacgtgctcctggaagatgtgatggacaagctcatccaggctgacacacttttggttctggtcaatcatcccagtcctgcgatccagcaaggcgtgatcaagcttctcgacgcctacttcgctcgcgcctccaaggagcaaaaggataaattcttgaagaaccggggtttttccttactggccaatcaattgtatctgcacagagggacacaggagctgttagaatgcttcattgaaatgtttttcgggcgccatattggcctggatgaagagttcgatctggaagatgtgaggaatatgggcctgttccagaaatggtccgtcatccctatcctgggccttatcgagaccagcctatacgacaacatcctgctccacaacgccctcctcctgcttctacagattcttaactcttgtagcaaagtcgctgacatgctcctggataatggtctgctctatgtgctctgtaacaccgtcgcagcattgaatggactcgagaagaacatccccatgagcgagtataagcttctggcctgcgacatccagcaactgtttatcgccgtgactatccacgcctgctcaagttctggctcccaatactttagagttatagaagacctcattgtgatgctgggctacttgcaaaacagtaaaaataaacgaacacagaacatggccgttgccctgcaattgcgagtgttgcaggcagctatggagttcatcagaacaaccgcaaatcacgactctgagaacctgacagacagcttgcagtcaccctcggcccctcaccacgctgtcgtgcaaaaaaggaaatctatcgccggaccgcgcaaatttcctctcgctcagaccgaatctttactgatgaagatgcggagtgtggctaacgacgagcttcacgtgatgatgcaaaggcgaatgtctcaggaaaacccatctcaggctactgagacggagctcgcccaaagactccagcgcttgacagttctggccgtgaatcgcatcatttatcaggagtttaactccgacataatcgacatacttcgtacgccagaaaatgtcacacagagtaagacgagtgtctttcagaccgagatctctgaggagaatatacaccacgagcaaagtagtgtgtttaatccattccagaaggaaatttttacgtatctggtggaaggattcaaggtgagcatcggttcatcaaaagcgtccggaagtaagcagcagtggacgaaaattctatggagctgcaaggagacatttcggatgcagctgggtagactcttggtgcacattctgagccccgcgcacgcggctcaggaaaggaagcaaatcttcgagatcgttcacgaacctaaccatcaagagatactccgggactgcttgagtccctcattacagcatggagccaaactcgtgctatatttaagcgagttgatccacaaccatcagggagaactgacggaggaggagctcggaacagccgaacttcttatgaacgctctgaaactttgcgggcacaaatgtatccccccatcagcctcaaccaaagcagatctgataaagatgatcaaggaggaacaaaaaaagtacgaaacggaagaaggcgttaacaaggctgcgtggcaaaagactgtaaacaataatcaacagagcctcttccagagactggacagcaaaagcaaagacatcagcaagatcgctgctgatattactcaggcagtgtcacttagccagggcaacgaacgcaagaaagttatccagcatataagggggatgtacaaggtggatttaagcgcttcacggcattggcaggagctcattcagcagctcacacatgatcgcgcagtgtggtatgatccaatttattaccctacctcctggcagctcgatcccacagagggcccaaaccgggaacgacgacggctccagaggtgctacctgacaattcctaataaatacctcttacgagacaggcaaaagagtgaagatgtggtcaaaccacctctatcgtatctgtttgaggataagacccattcttcctttagcagtacagtgaaagacaaagcagctagcgagtccatacgcgtgaaccggcgctgtatctccgtcgccccttccagggaaacagccggggagctcctactgggaaagtgcggcatgtatttcgtcgaagataatgctagcgataccgtggaaagttcttcactacagggcgagctcgagcccgcttctttctcgtggacctacgaggagatcaaagaggtccacaagagatggtggcagttgcgggataacgctgtggaaatttttttgacaaacggtcggacactcttactggcattcgataatacaaaagtgagagacgatgtgtatcataatatacttacaaataatctccctaacctgttggagtacggtaatatcacagcccttacgaacctctggtatacagggcaaatcaccaattttgagtatctaactcatttaaataaacacgcaggaaggtctttcaatgatttgatgcagtaccccgtcttcccattcatcctggccgactacgtcagtgagacccttgacctcaatgacttattgatctaccggaatctctccaaacccatagcagtgcagtacaaagagaaggaggacaggtatgttgatacatacaagtatttagaggaggagtatagaaaaggagcccgtgaagacgacccaatgccccctgtacagccctatcactatggctcgcactactccaattccggcaccgtcctacactttcttgtgcggatgcctcccttcaccaagatgttcctggcttatcaagaccaatcattcgacatccctgaccgaacctttcacagtacaaacacgacctggaggctgtcctcatttgagagtatgacagatgtaaaggaattgattccagagtttttctatctgcccgagttcttggtaaatcgagagggattcgattttggggtgcgccagaatggagagcgggttaatcacgtgaatttacctccttgggcccggaacgacccacggttatttatcctcatacaccgccaggctctggaatccgactacgtctctcagaacatttgccaatggatcgatctggtgttcgggtacaaacagaagggaaaggcctccgttcaggccataaatgtttttcatcccgctacctacttcgggatggacgtgtccgctgtggaagatcccgtacagcgcagagccttggaaacaatgatcaagacctacggccagacccccaggcagttgtttcacatggctcacgtttcccgcccaggcgctaagctgaacatcgaaggcgaacttcctgctgctgtcgggctgctcgttcagttcgcctttcgggaaactcgagagcaggtgaaagaaataacttatccctcccctctgagctggataaaaggcctgaagtggggagagtatgtcggtagcccctcagcgcccgttccagtggtgtgtttctcgcagccacatggagaaagatttggctcgctacaggccctcccaacccgggctatatgcggcttgagcagaaacttttgcttgcttatgacctattccaaggaacaaggcgtgaggagcatgaactcaactgacatacaatggagtgctattctgtcctggggctacgccgacaacatactgaggctgaaatctaaacagtccgagcccccagtcaattttatccaatctagccaacagtaccaggtcactagctgcgcatgggtgccagattcctgtcagctgttcacaggctctaaatgcggcgttattaccgcctacacaaacagatttacatcctccactcccagtgagattgaaatggaaacccagattcacttatatggccacacggaagaaataactagtctgtttgtttgtaaaccttacagcattctgatctctgtgtcccgagacggcacctgcatcatttgggacctcaatagactgtgctacgttcaaagcctagccgggcacaaaagtccagtcaccgctgtcagcgcatccgagacctccggcgacatagccacagtgtgcgattctgcagggggaggctccgacctacgactttggaccgtgaacggcgacctcgtggggcatgtgcactgccgtgaaataatttgttccgtcgctttctctaatcagcccgagggagtctccatcaatgtaatcgccgggggcttagaaaacggaatcgtccgcctgtggagcacctgggatcttaagcctgttcgcgagatcacgtttccaaagtccaataaacctattatctcccttactttcagctgcgatgggcatcacctgtatactgcgaacagcgacggtaccgtcatcgcatggtgccgaaaagaccagcaacggctgaagcagccgatgttctactctttcctatcctcttatgcagccgggtag

SEQ ID NO: 193747 - DNA, 4149 bp, Artificial Sequence
  Description of Artificial Sequence: Synthetic coding sequence
atgagcaccgacagcaacagcctggcccgggagttcctgaccgacgtcaacaggctgtgcaatgctgtagtgcagcgggtggaggccagggaagaggaggaggaagagacccacatggctactttggggcaatatctggtgcatggcagaggctttctgctgctaactaaactcaatagcattatcgatcaagctttgacctgcagagaggaactgttgactctgctgctgtccttactgccattggtttggaagattcccgtgcaggaggaaaaagccacggacttcaacctccccctgtcagcggatataattcttaccaaggaaaagaactcatcttctcaaaggagcactcaggagaagctgcatctcgagggcagcgcattgagttctcaagtgagtgcaaaggtaaacgtctttaggaagtctcgtcgacaacggaagatcacacacaggtactccgtgagagacgctaggaaaacacagctaagcacctccgactctgaagcaaatagcgatgagaagggaatcgctatgaataaacaccgtcggccacatttgctccatcacttcctgacttcctttccgaagcaagatcatcctaaggccaaactggatcgcttagccacgaaagaacagacacctccggatgcaatggcactggagaacagtcgggaaattatcccccgccaaggaagcaataccgacatcctgagcgaaccggccgcactctcagtgatctccaacatgaacaactcgccttttgacctctgccatgttctcctgtcattgctggagaaggtctgtaagtttgatgtcacactcaaccataacagcccactcgccgcctcggtcgttcctacccttaccgagttccttgcaggcttcggagactgctgtagcctgtccgataacctcgaatctagggtggtcagtgctgggtggaccgaagagcctgtggccttgattcagcggatgctgttcaggacggtcctgcatctcttgtccgttgacgtttctacagcagaaatgatgccggagaacctgcgaaagaaccttaccgaattgttgagggctgccctgaagatccggatctgtctggagaagcagcctgaccccttcgcaccaagacagaaaaagacattgcaggaagtgcaggaggactttgtcttctccaaatacaggcatagggctctccttcttccggaactgcttgaaggagtgctgcaaattctcatttgctgcctccagtccgccgccagtaatcctttctatttctcgcaggcgatggacctggtgcaggaatttatccagcatcatggatttaatctcttcgaaactgccgtgctccagatggagtggcttgtacttagagatggggtgcctcctgaggctagcgagcacctgaaagccctgattaatagcgtcatgaagataatgtcaactgtaaagaaggtgaaaagcgagcagctacatcatagtatgtgcacacggaagaggcatcgccggtgcgaatatagccactttatgcatcaccacagagacttatccgggctgctggtaagcgcttttaaaaaccaggtgagcaaaaacccctttgaagagacagctgacggggacgtctactaccctgaaagatgttgctgcatcgccgtgtgcgcccatcagtgtcttcgtctgctgcagcaagcgagcttgtcctcgacatgtgtccaaattctatccggggtgcacaatatcggcatatgctgttgtatggatccgaaatccgtgatcatacctctgctgcatgcgtttaaactgcctgccttgaagaatttccagcaacacattctgaacatcctgaacaaactgatccttgaccagctggggggggcagaaatctcccctaagatcaaaaaggcggcctgtaatatctgtacagtggactcagaccagcttgcacaacttgaggaaacattgcagggtaatctctgcgacgccgaactctcgtcctcactgtccagtccatcataccgttttcaaggtattctgcctagttcgggctctgaggaccttctgtggaagtgggacgccctgaaggcctatcaaaacttcgtttttgaggaggaccgtctccactccatccaaatcgccaaccatatttgtaatctcattcagaagggaaacatcgtggtacaatggaagctttacaattacattttcaatccagttctccagaggggagtcgagttggcccatcactgtcaacacctgtctgtgactagtgcccagtcgcatgtgtgttcccaccacaatcagtgcctcccccaggacgtcctgcagatttatgtaaaaacactgcctattttgcttaaatcgcgggtgatccgcgacctctttctgtcgtgcaacggggtctcccagattattgaactgaactgcctgaacggaattaggtcacattctctcaaggcttttgagactctgattattagtctgggcgagcagcaaaaggacgcttctgtgccggatattgatggtatcgacatcgagcagaaggaattgagctctgtgcacgtgggcacctcctttcaccaccagcaggcgtatagtgacagcccacagagcctcagtaagttttatgccgggttaaaagaggcctacccaaagcggcggaagactgtcaatcaagatgtgcatattaacaccattaacctcttcttgtgcgttgcatttttatgcgtaagtaaagaggccgagtccgacagagagtcagccaatgacagcgaagatacctctgggtatgactccactgccagcgagcctctgtcacacatgcttccttgtattagtctagaaagcctggtgttgcctagccctgagcacatgcaccaggcggctgatatctggtcaatgtgccgctggatttatatgttgagttctgtgtttcagaagcagttttaccgtttggggggatttcgggtgtgccacaaacttatattcatgatcattcagaaactgtttaggtcccacaaggaagagcagggtaaaaaagaaggtgatactagcgtgaatgaaaaccaggacttgaatcggatctcacaaccgaagaggacaatgaaggaggatcttctctctttagccattaaatctgatccaattcctagcgagctcgggtcccttaagaagagcgcagactcgctcgggaagcttgaattacaacatatatcttcaatcaacgtcgaggaggtgagcgcgacggaagcagctcctgaagaggcgaagctgttcacttctcaggaaagtgaaacctctctgcagtccattagacttttagaggccctgctggccatttgtctgcatggagcaagaacctcacagcaaaagatggagttggagcttcccaatcagaatctgtccgtggagagtatcctgtttgagatgcgagaccatctgagccagagtaaagtcatcgagactcagcttgctaaacctctttttgacgctctcctaagggtggccctgggtaattattcggccgatttcgagcacaacgacgccatgaccgagaagtctcatcaaagtgcagaagagctttcaagccagccaggcgacttctctgaagaggcagaagatagtcagtgctgttcttttaaacttctagtggaggaagagggctatgaggcagatagtgagtcgaaccctgaggacggggagactcaggacgatggtgtcgatctgaaatcggaaaccgaagggtttagtgccagctcgtctcctaatgacctcctcgagaatctcacacagggcgagattatttacccagaaatttgtatgctggaactgaatcttctctctgcatcaaaagctaaactcgacgtgctggcgcatgtgtttgaatccttcctcaaaattatccggcagaaggagaagaatgtctttctgttgatgcagcaggggacagtgaagaatctccttggcggctttctgtccatcctcactcaggacgactcagatttccaagcatgtcaacgagtgcttgtggatcttctcgttagtttgatgtccagccggacctgcagcgaagaactgactctgctgcttcggatatttctcgagaaatctccctgcacccgggccactgatcagaaggtccagtccacttag

SEQ ID NO: 193748 - DNA, 1254 bp, Artificial Sequence
  Description of Artificial Sequence: Synthetic coding sequence
atggccgcccccggcagcgcccggcggcccctgctgctgctgctgttgctcttgttgctcggactaatgcactgcgccagcgccgccatgttcatggttaagaacgggaacgggaccgcttgcattatggcgaacttcagcgccgcctttagcgtgaactatgatactaaatcaggccctaagaatatgacatttgatctaccctccgacgcaacagtggttttgaataggtcaagttgcgggaaagaaaatacttcagatcccagcctggtcattgccttcggacggggccacaccctcacactgaacttcacccgcaatgcaacgcgttattccgtgcagctgatgtccttcgtctacaatctctctgacacacatctgtttccaaacgcctccagcaaagaaatcaagactgttgaatcgattacagacatcagggccgacattgataaaaagtacaggtgtgtgtccggcacccaggtacacatgaataacgttactgtgacattgcatgatgcgacaatacaggcttacctgtccaacagcagtttttctagaggcgaaacccggtgcgagcaagacaggccatctcccacaaccgctccacccgcccccccgagtcctagccccagtcctgtaccgaagagcccgtccgtggataagtataatgtgtctggaacaaatgggacatgcttgctggccagcatgggtctccaactgaacctaacttatgagcgtaaggataacacaaccgtgactcgcctcttgaacataaaccccaataaaacctcagcctctggcagctgcggggcccacttggttactctggaactccactctgaagggacaacagtgctccttttccaattcggtatgaatgcctctagcagtcgcttttttcttcagggcattcagttgaatacaatattaccagatgccagagatccagcctttaaagccgcaaacggaagtctgcgagctctacaggctactgttggcaacagctacaagtgtaatgctgaagagcatgtccgagtaactaaggccttctcagtgaacatcttcaaggtatgggttcaggcctttaaagtcgaaggaggacaattcggttccgttgaggaatgtttactcgacgaaaacagtatgcttatccctattgcagtaggaggtgccctcgctggactggtcctgattgtattaattgcatacctcgtcggcagaaagcgctcccatgcgggatatcagactatttag

SEQ ID NO: 193749 - DNA, 1095 bp, Artificial Sequence
  Description of Artificial Sequence: Synthetic coding sequence
atggccgcccccggcagcgcccggcggcccctgctgctgctgctgcttctccttctgttgggattgatgcactgcgcttctgccgctatgtttatggtgaaaaacgggaacggcaccgcctgtatcatggcaaacttttccgcggcattttctgtgaactacgacaccaagtcgggcccgaagaatatgacctttgacctgcccagcgacgctacagtggtcctgaaccgatcatcatgcggaaaggagaataccagtgacccaagcctcgtgatcgcgtttgggaggggccacacactcacactgaatttcactagaaacgcgacccgatacagcgtccagctcatgagtttcgtgtacaacctgtctgatactcatctattcccaaacgcctcgagcaaggaaacgaggtgtgaacaggaccgaccaagcccaaccactgctcctcctgcccctccttccccatcacccagccccgtcccaaagtccccttctgtcgacaaatataacgtgagtggtacgaatgggacatgtctgctggcctctatgggccttcagctgaatctgacctatgaaagaaaagataatacaaccgttactagacttttgaacatcaaccccaataaaacttctgcctcaggctcatgcggagcccatctcgtgacactcgagctccacagtgaaggaactactgtcctgctttttcagtttggaatgaatgccagtagttcacgattttttctgcaaggcattcaactcaataccatcctaccggacgcgcgggacccagccttcaaggctgctaatggtagtctgcgggcgttgcaggccactgtaggaaatagctacaagtgtaatgcggaagagcacgtgcgcgtgacgaaagcctttagcgtaaacatttttaaggtgtgggtgcaagccttcaaggtggaagggggccaattcgggtccgtggaggaatgtctcctggacgagaactctatgctgattccaatcgcagtggggggcgcacttgccgggctagtgctaatagtgttaattgcctatctcgtcggccgcaagcggtctcatgcgggatatcagacaatttag

SEQ ID NO: 193750 - DNA, 1233 bp, Artificial Sequence
  Description of Artificial Sequence: Synthetic coding sequence
atggtgtgcttccggctgttccccgtgcccggcagcggcctggtgctggtgtgcctggtactgggggccgttcgctcttacgccttggagttaaacctgaccgatagcgaaaatgcaacttgcctttacgccaagtggcagatgaacttcactgtgcgctatgaaaccaccaacaagacatacaaaactgtaaccatctcagatcacggaactgtaacgtataacggctccatctgtggggatgatcagaatggacctaagatagccgtgcagttcgggcctggtttttcatggatcgctaattttaccaaggccgcttccacctattccatcgattccgtcagtttcagctacaacaccggagacaataccacgttccctgatgccgaggataagggtatcctgactgtggatgagctgctcgccatcaggatccccctgaatgacttattccgctgcaattccttaagcacactggagaagaacgacgttgtgcagcattattgggacgtcctggtacaggcctttgtgcagaacgggacagtgagcactaacgaattcctttgtgataaggacaagacatccaccgttgccccaactattcataccacggtgccgagtcccaccactacgcctaccccgaaagagaagccagaggctggcacgtactcagttaataacggaaacgacacctgcctgctggccaccatgggcttgcagttaaacattactcaagataaggtggcctccgtgatcaacataaacccaaatacaacacattcgacgggttcctgccgctcacacacagcattactgcgactcaactcctctacaatcaagtatctcgacttcgtgttcgccgtgaagaatgaaaatagattctacttaaaagaagttaacatttctatgtacctggtcaatgggtccgtgttttcaattgccaacaacaatttgtcttactgggacgctccgctcggaagctcctacatgtgtaataaggaacagactgtgagtgtttccggtgcttttcagattaatacttttgatcttagggtgcagccgttcaacgtgacgcaggggaagtattcgacagcgcaggattgtagtgcggacgacgataattttctggtgccaatcgctgtgggagccgctctggcaggtgttctcattctcgtattgctagcatatttcatcgggctcaaacatcatcatgccggatatgaacagttttag

SEQ ID NO: 193751 - DNA, 1233 bp, Artificial Sequence
  Description of Artificial Sequence: Synthetic coding sequence
atggtgtgcttccggctgttccccgtgcccggcagcggcctggtgcttgtttgtctcgtgttgggagccgttcgcagctacgccctagaactgaacctgactgatagcgaaaatgctacctgcctctacgccaaatggcagatgaactttacagtaagatatgagacaactaacaagacatacaaaactgttaccatttccgaccacggaaccgtgacatataacggcagcatttgtggcgacgaccagaatggcccaaagatcgctgttcaattcggaccaggcttttcctggatagctaactttaccaaggcagcatcaacatattcaattgattcagtatcattctcatacaacaccggggataacacaacctttcccgacgcagaagacaaggggatcctgaccgtggacgagctactggccatccgcattcctctcaacgatctgttcaggtgcaattccctcagcaccctcgaaaagaacgacgtggtgcaacactattgggacgtcctcgtgcaggcctttgtgcaaaatggcacagtgtccacaaatgagtttctgtgtgataaagacaagaccagtacagtagcccccaccatccataccactgttcccagccccacaaccacacccactcccaaggagaaaccagaggcaggcacgtattccgtgaataacggcaatgatacctgcttactggcgacaatggggctccaacttaacattacgcaggataaagtggcttcagttattaacattaatccaaacaccacacattcaacagggtcctgccgctcgcataccgcactattaagactgaattcttccaccataaaatacctagatttcgtctttgccgtgaagaacgagaataggttctatctgaaggaggtaaatatcagtatgtatctggtgaatggttccgtcttcagcatcgccaataataatctgtcatactgggacgctcccctgggctcttcctacatgtgcaacaaggaacagacagtcagcgtgagcggcgctttccagattaatacctttgatctgcgggtacagcctttcaatgttacccagggaaaatacagtacagcccaagaatgttcccttgatgatgacacaatcctaattcccatcatagtcggcgccggtctatcaggtctgattatcgtgatcgttatcgcctacgttatcgggaggcgaaagtcttacgcgggctaccagacgctttag

SEQ ID NO: 193752 - DNA, 1236 bp, Artificial Sequence
  Description of Artificial Sequence: Synthetic coding sequence
atggtgtgcttccggctgttccccgtgcccggcagcggcctggtgctggtgtgtttggttcttggtgccgtgaggtcttatgctctggagctcaatctgaccgactccgaaaatgccacgtgcctgtatgctaagtggcagatgaatttcacagtcaggtatgaaacgactaataagacctacaagaccgttacaattagtgaccatggaactgtgacttataatggctcaatttgcggcgatgaccagaacggtcccaaaattgcagtgcagtttggaccaggattttcttggattgcaaactttaccaaagccgcctccacatactctatagatagtgtgtctttcagctataataccggtgacaatacaacattcccagacgcagaggataagggtattctgacagtggacgaactgcttgccattaggatacctctcaacgacctattcagatgtaattctttgagcacactggagaagaacgacgtggtgcagcactattgggatgtcctggtccaggcttttgtacagaatggtaccgtctccacaaacgagtttctctgtgataaggataaaacctcaactgtggcacctacaatccacaccacagtcccgagtcccaccacaactcctactcccaaggaaaagccagaggccgggacatactcagtcaataacggaaacgatacatgtctgttggcaactatgggattacagctcaacatcacccaggacaaagtcgcatctgtgatcaatatcaatccaaacacaacgcactctacaggaagttgcaggagccacacagctctgttaaggctgaacagttccaccatcaagtaccttgatttcgtttttgccgtcaaaaacgaaaatcggttctatttgaaagaggtgaacatctctatgtacctggtgaatgggtccgtcttctccattgctaataataatttgtcatactgggacgcgcctcttggctcaagctatatgtgtaataaagagcagactgttagcgtctctggagcgttccagattaacaccttcgatttaagagtgcaaccctttaacgtcacacaggggaaatattctaccgctgaagaatgtagcgctgattctgatctgaacttcctaataccggtagcagtgggcgtcgctctcggatttttaatcatcgttgtctttatctcctacatgatcgggcgcagaaagtccaggactggctaccagagcgtgtag

SEQ ID NO: 193753 - DNA, 903 bp, Artificial Sequence
  Description of Artificial Sequence: Synthetic coding sequence
atggtgtgcttccggctgttccccgtgcccggcagcggcctggtgctcgtttgcctggtcctggggatattgaccgtggacgaactgctcgccataagaattccattaaacgatcttttccggtgtaattccctgagcacacttgagaagaatgacgtggtacagcactactgggatgttttagtccaggcatttgtgcagaacggaaccgtgtctaccaacgaatttctgtgcgacaaagataagacctctaccgtggcacccaccatccacaccaccgtgccttctcccactaccaccccaactccaaaagagaagcccgaggctgggacctattccgtaaacaatggtaatgatacctgtctgctggcaactatgggactccagctgaacatcactcaagataaagtcgcttccgtcattaacatcaatccaaacaccacccactccacagggagttgccgcagtcacaccgccctgctcagacttaactcctcaaccatcaagtatttagactttgtattcgctgtgaagaatgagaatcggttttatctgaaggaagtgaatatttcaatgtatctagtgaacggatcagtgttcagtatagctaataacaacctgagctactgggatgccccactggggtcttcttatatgtgtaataaggagcagactgtgtcagtgtctggagcttttcagattaacacatttgacctgagagtccagcctttcaatgttacacagggcaagtatagcaccgcagaggagtgttccgcagactccgacttgaacttcttgatcccagtggccgtgggagtggctctcggttttctgattattgtggtctttatatcttatatgattggccgccgaaagagtcggacgggctaccaaagcgtgtag

SEQ ID NO: 193754 - DNA, 1092 bp, Artificial Sequence
  Description of Artificial Sequence: Synthetic coding sequence
atgaacttcaccgtgcggtacgagaccaccaacaagacctacaagacggtgacaattagcgaccacggcactgttacatacaatggaagcatttgcggagatgaccagaatggtccgaaaattgcagtacaatttggacccggcttttcctggatcgctaatttcactaaggcggcttcaacttattcaattgactccgtttctttcagctataataccggtgataacactacattccccgacgcagaagacaagggtattctgacagtcgacgagctgctggcaatccggatccccttaaacgatctttttcgatgtaacagtctcagcacactggagaaaaatgatgtggtgcaacattattgggacgtgttggtacaggcatttgtgcaaaatgggaccgtgagtacaaatgagtttctgtgcgacaaagataagacttcaaccgttgcccccacaattcatacaacagtcccatccccgaccacaacccctactccgaaggaaaagcctgaggccggaacttacagtgtgaataacggaaacgatacatgcctgcttgctacgatgggcttacagctcaacatcacacaggataaagtggcgagcgtgatcaatattaatcccaatacaacccactccaccggcagctgccgctcgcacactgcactcttacggctgaattccagcactataaagtacttggattttgtatttgcagttaaaaacgagaaccgcttctatttgaaggaggtgaatatttccatgtacctcgtaaatggatccgtgttctcaatcgcgaacaataatctctcctattgggacgctccgctgggatctagctatatgtgcaacaaggaacagacagtcagtgtatcgggagcttttcagatcaacacttttgacttgcgcgtccagcccttcaatgttactcaggggaagtattcaaccgcccaggagtgcagcctggacgatgatactatcttgattcctattatcgtaggagcaggtttgtccggactgatcatcgtcattgtcattgcctatgttattggcagaaggaagagctacgcagggtaccagacattatag

SEQ ID NO: 193755 - DNA, 447 bp, Artificial Sequence
  Description of Artificial Sequence: Synthetic coding sequence
atgaaggccctgatcgtgctgggcctggtgctgctgagcgtgaccgttcagggaaaagtttttgaacggtgtgaattggcccgcacactcaagaggctgggaatggacggatacagaggcatttccctcgccaactggatgtgcctggcgaagtgggagtctgggtataatacacgggctacaaactataacgcgggtgaccgaagtacggactacgggatcttccaaataaactcccgctattggtgtaatgatggaaaaactcctggcgcagtgaacgcctgtcatctatcatgctctgcgctgctgcaagataatattgcagacgccgtcgcttgcgcaaagcgggtggtacgcgaccctcagggcatccgtgcctgggtggcctggcggaacaggtgtcagaatagggatgtgcggcagtatgtgcaggggtgcggcgtctag

SEQ ID NO: 193756 - DNA, 585 bp, Artificial Sequence
  Description of Artificial Sequence: Synthetic coding sequence
atgcaggacgcccccctgagctgcctgagccccaccaagtggagctccgtcagctcagccgactcaacagagaagtccgccagcgcagcaggaacacgcaatctcccgttccagttctgcctccggcaggccctccgaatgaaagcggcaggtatactcaccttgatagggtgcttagtcacaggagctgaatctaaaatctataccagatgtaaactggccaaaatttttagtcgggccgggctcgataactactggggcttcagcctcggcaattggatctgtatggcttactacgaaagtgggtacaacaccacagcgcaaactgtgctcgacgatggttccattgattacggcatctttcagatcaactcctttgcttggtgtagaaggggtaaactgaaggaaaacaatcactgtcatgtggcctgtagcgcgctcgttactgacgatctgaccgacgccatcatatgcgctaaaaaaattgtaaaggagacacagggcatgaactactggcaggggtggaagaaacactgcgaagggcgtgatctcagcgactggaaaaaagactgcgaggtgagctag

SEQ ID NO: 193757 - DNA, 441 bp, Artificial Sequence
  Description of Artificial Sequence: Synthetic coding sequence
atgaaggccagcgtggtgctgagcctgctgggctacctggtggtgccatctggcgcgtatattttgggacggtgcacggttgccaagaaacttcacgacggcggcctggattacttcgagggctacagcctcgagaactgggtgtgtttagcctactttgagagcaaatttaatcctatggccatctacgagaacacacgggagggttacaccggattcggattgttccagatgaggggcagtgattggtgcggggaccatgggcgaaaccgctgccacatgagttgctccgccctcttaaaccctaatctggagaagacgataaaatgcgccaaaactatagtgaaagggaaagaggggatgggagcctggccgacgtggagcagatactgtcaatatagcgacacattagcacgatggcttgatggctgtaaactgtag

SEQ ID NO: 193758 - DNA, 441 bp, Artificial Sequence
  Description of Artificial Sequence: Synthetic coding sequence
atgaaggccagcgtggtgctgagcctgctgggctacctggtggtgcccagtggggcgtacatccttggaagatgcactgtcgccaagaaactgcatgacggaggcctcgattatttcgaaggttatagcctggagaattgggtgtgtctggcttatttcgagagcaaattcaacccaatggccatctatgagaatacaagagaaggttacacgggattcggactctttcagatgcgcggtagcgactggtgtggcgaccacggcagaaaccggtgtcatatgagctgttcggccctgctcaatcccaatctggagaaaaccattaaatgcgccaagaccatcgtgaagggtaaggaaggcatgggggcctggcccacttggagtagatactgtcagtactcagatacacttgcccgctggcttgatgggtgcaaactctag

SEQ ID NO: 193759 - DNA, 447 bp, Artificial Sequence
  Description of Artificial Sequence: Synthetic coding sequence
atgaccaaggccctgctgatctacctggtgagcagcttcctggccctcaatcaggcttcgctaatttctcggtgcgatttggcccaagttttgcagctggaagatctggacggcttcgagggatatagtttgagtgattggctctgtctcgctttcgtggaaagcaaatttaacattagtaaaattaatgagaacgcagacggaagtttcgactacggcctgttccaaataaattcgcactattggtgtaatgattataaatcttacagcgagaacctatgtcacgtggattgccaagacctcctgaacccaaacctccttgcagggatccactgcgccaaacgaattgtgagcggcgccaggggtatgaataactgggttgaatggcgacttcactgtagtggacgccctctgttttactggcttaccggctgtcggctccgctag

SEQ ID NO: 193760 - DNA, 447 bp, Artificial Sequence
  Description of Artificial Sequence: Synthetic coding sequence
atgaccaaggccctgctgatctacctggtgagcagcttcctggcccttaatcaagcgtctctgattagtcgctgcgacctggcccaggtgctccagctggaggatctcgacgggttcgagggctacagcctttccgattggctgtgtctcgcgtttgtggagagtaaatttaacatctccaagatcaatgaaaatgcagacgggagtttcgattatggcctgtttcagattaactcgcattactggtgtaatgactataagtcctatagcgaaaatttgtgccacgttgattgccaggacctcctgaacccaaacctgctggccggcattcattgcgccaagcgtatcgtgtctggtgctcgaggcatgaataactgggtagagtggcgccttcattgcagtgggcgacccctattctactggctgacgggctgtaggctgaggtag

SEQ ID NO: 193761 - DNA, 447 bp, Artificial Sequence
  Description of Artificial Sequence: Synthetic coding sequence
atgaccaaggccctgctgatctacctggtgagcagcttcctggccttgaatcaggcctccttaatcagtagatgcgatctggcacaggttctacagttggaagatttggacggctttgagggatatagcctgtctgactggctctgtctcgcgttcgtcgagtcaaaatttaatatcagcaagatcaatgagaatgccgatgggtcattcgactacgggttgttccagatcaatagccactactggtgcaacgactataaaagctactcagagaatctgtgccatgttgactgccaggatctgttgaacccaaacctgctggcgggaattcattgtgcgaagaggatagtgtccggtgcaagaggtatgaataactgggtggaatggcgattgcattgctcggggagacccctattctactggttgaccggctgtagacttcgatag

SEQ ID NO: 193762 - DNA, 2952 bp, Artificial Sequence
  Description of Artificial Sequence: Synthetic coding sequence
atggagatgaagctgcccggccaggagggcttcgaggccagcagcgctccacgaaacatcccctccggcgagctcgattccaatccagaccctggaaccggcccctcccctgacggtccttcagacacagagtctaaggaactgggggtacccaaagaccccttgctgtttatacagcttaacgaacttctcggatggccccaagcgctcgaatggcgtgagacagggtcatcttccgccagtctcctgctcgatatgggcgagatgccgagcattactttgagcacccatttgcatcacaggtgggtgctctttgaggaaaagctggaggttgctgcagggaggtggtccgctccccacgtgcctacgctggcacttccgtcgctccaaaagctgagatcccttcttgctgaagggctcgttctcctcgactgcccggcacagtctctactcgagctagtggagcaagtgacgcgagttgagtctctgagcccggaactcagagggcagttgcaggccctcctgttacagcgcccacagcactataaccaaactactgggacacgaccctgctggggcagcactcacccacggaaggcttccgataatgaggaagctcctttgcgagaacagtgtcagaaccctttgaggcaaaagttacctcccggcgctgaggcaggcacggtgctggccggggagctgggattcctggctcaaccactgggagcattcgtacgtttaaggaaccccgtcgtactggggagtctaactgaggtctcgctaccgtcacgttttttctgcttactgctgggaccgtgcatgctaggcaaaggataccatgagatgggacgggcagccgcagtactgctgtccgacccacaatttcagtggtccgtcagacgggcgagtaacctgcacgatctgctcgctgcactggacgcgttccttgaggaggtcacagtgctaccacccggacggtgggatcctacggccaggattcctccacccaagtgtctgccttcccagcacaaacgcttaccctctcagcagcgcgaaatcagggggcccgccgtgcctcggttgacatccgccgaggacagacatcggcacggaccgcatgctcactcgcccgaacttcagcggactgggagattgttcggcgggttgattcaggacgtgaggcgcaaggtgccttggtacccaagcgatttcttggacgctctgcacctccagtgcttttcagccgtgttatacatttacttagcaaccgtcactaatgctatcacttttggcgggctcctgggagacgccaccgatggcgcgcagggggtgctggagtcttttctagggaccgccgtggcgggcgccgccttctgcctaatggcagggcagccacttaccatcctctcatcaactggccctgtgctggtgttcgagagattgttgttcagcttctctcgcgattattcgcttgattacctccccttccgtctgtgggtgggcatctgggtggccacgttctgcctagttctggtggccaccgaggctagcgtcctggtgcgctattttacccgctttacggaggaggggttctgtgcattaataagtttgatctttatatatgacgctgttggtaaaatgctcaatcttacacacacctatcccatccagaaaccgggctcgagtgcctatggatgcctctgccagtatccaggtcccggaggaaatgaaagtcagtggatcagaactaggcccaaagaccgagacgacatcgtttccatggaccttggcttgatcaatgcgagcctgctccccccacctgaatgcacccgccagggagggcacccccgtgggcccggatgccacacagttcccgacatcgcctttttctcattgctgctctttctgacaagtttcttttttgccatggccttgaagtgcgtcaagacctctagattttttccttcagtggtgaggaagggcctgtcagatttctcaagcgtgctcgcaattctgcttggatgtggtctggacgcattcctcgggttagccaccccaaagctgatggtgccccgtgagttcaagcccaccctcccagggcgagggtggcttgtctctccttttggagcaaatccctggtggtggagtgtggcagctgctttgcccgccctactcttaagtatactgatcttcatggaccagcaaataacggccgtcatcttgaatcgcatggaataccgcctccagaaaggcgccgggtttcacttggacctattctgtgttgccgtgcttatgctcctaactagtgccctaggattaccctggtacgtttcagcaacagtgatctcattagcacacatggattctctccggcgcgagagtagagcctgtgcacccggtgaacggcccaatttcctcgggatccgggagcagcgcctgaccggactcgttgtgttcatcctgaccggagcctccattttcctcgcgcccgtcctcaagtttattccaatgccagtgttatatgggatatttctctacatgggagtcgctgccctttcaagtattcagttcaccaatagggtgaaactgctattgatgccagctaagcatcaacctgatctgctgctgttaagacacgtgccactcacccgggtccatctctttacagcaatacagttggcttgtttgggcctgctgtggattattaaatctacccccgccgctatcatctttcccctgatgcttctcgggctagtgggtgttaggaaagccttggagcgtgtttttagtccacaggagttgctttggttggacgaattaatgcccgaagaggaacgctctattcccgaaaagggattggaaccggagcatagtttttcaggaagtgactccgaggattcagagttaatgtaccagcctaaggcacctgagatcaacatctccgtcaactag

SEQ ID NO: 193763 - DNA, 123 bp, Artificial Sequence
  Description of Artificial Sequence: Synthetic coding sequence
atgcggttcgcctggaccgtgctgctgctgggccccctgcagctgtgtgcgttagtccattgcgcccccccagccgcgggtcaacagcagccccccagagaacccccagccgcccccgggtag

SEQ ID NO: 193764 - DNA, 1134 bp, Artificial Sequence
  Description of Artificial Sequence: Synthetic coding sequence
atgcggttcgcctggaccgtgctgctgctgggccccctgcagctgtgcgcattagtccactgcgctccccctgcagcagggcagcaacagcctcccagggagcctcccgccgcccccggagcagctagtgcccaacagcctcggacccctatcctgttgattcgcgacaacaggacggccgcggccagaactcgcacagccggatcctccggtgtcaccgccgggcggccccgccccactgcgcggcattggtttcaggctggatatagtacatctcgtgccagggaagccggcgccagcagggctgaaaaccagacagcaccgggggaagtaccagccctatctaatctgcgacccccatcacgcgtggatggcatggtgggggatgacccctataacccatacaagtactctgacgataacccctactacaattattacgacacttatgagcggcccaggccagggggcaggtatcgcccaggatacggaacagggtattttcaatacggactgccagaccttgtggcagacccttactatatccaagccagcacatacgtccagaaaatgagcatgtataaccttcgctgcgccgctgaagagaattgccttgccagcacggcctatcgcgcagatgttagagattacgaccatcgggtcctgctcagattcccccaaagagtgaagaaccaaggcacttcagatttccttccctctaggcccaggtatagctgggagtggcactcatgtcatcagcactatcacagcatggatgagttctcccattacgacctgcttgatgccaacacacagaggcgcgttgccgaaggtcacaaagcttcgttttgcttggaggacacctcctgtgactatgggtaccatcggagatttgcatgcactgctcacacacagggcctttcccccggatgttatgatacctacggcgccgacatagactgccagtggattgatatcactgatgtaaagccagggaactacatcctgaaagtttccgtgaatcctagctatctggtgcccgaaagcgactacacaaataatgtggtgcgctgcgacatcaggtataccggacaccacgcttacgcctcaggctgtacaatatctccttactag

SEQ ID NO: 193765 - DNA, 2325 bp, Artificial Sequence
  Description of Artificial Sequence: Synthetic coding sequence
atggagcggcccctgtgcagccacctgtgcagctgcctggccatgttggcccttctgtcacctctttccctggctcagtacgatagctggcctcattatcccgaatacttccagcagccggctccagagtaccaccaacctcaagccccagccaatgttgccaagattcaattacggctagccgggcagaagagaaagcattccgagggacgagtggaagtgtactacgatggccaatggggaactgtgtgtgacgacgatttcagcatacatgcagcgcatgtcgtatgccgtgagttggggtatgtggaggctaagtcttggacagcatcctcttcttacgggaagggtgagggtcccatttggttggataatctgcactgtactggaaatgaggcaacactcgctgcttgcacttctaacggatggggggtaacagattgtaaacacacagaggacgttggcgtggtctgctccgataaaagaatacctggtttcaagttcgacaacagccttatcaaccaaattgagaatctgaacattcaggtggaagacatacgtattagagccatattgtcaacatatcgtaagaggactccagttatggaaggttacgtggaggtcaaagagggtaaaacatggaagcagatttgcgataagcactggacagcaaaaaattctcgagtcgtgtgtggtatgtttggcttccctggggaaagaacctataacaccaaggtgtacaagatgtttgcgagtcggcggaagcagcgttattggcctttttctatggattgcacgggaaccgaagcccatatttctagttgcaagctggggccccaggtcagcttggaccccatgaaaaatgtgacttgtgaaaacggcctcccagcagtggtctcttgcgtaccggggcaggtattctcaccagacgggccttcgagattccggaaggcatataagccagagcagcccctggtcaggcttcgcgggggggcatatatcggcgagggtagggtggaagtgttaaaaaatggggaatggggcaccgtatgtgatgataaatgggacctggtttccgcaagcgtggtgtgccgagagctcggcttcggatctgcaaaggaggcagtgacaggaagtagacttggacagggcataggcccgattcatctgaatgagattcagtgtacaggaaatgaaaaaagcataatcgactgcaagttcaatgccgagagccagggctgcaatcacgaggaggacgcaggggtgaggtgcaacacccctgctatgggtctgcagaaaaagctccgtctgaatggaggtagaaatccttatgagggaagggtggaggtacttgtggaaaggaacggctcgcttgtgtggggaatggtttgtggtcaaaactgggggattgtggaggcaatggtagtatgtcgtcagctgggcctgggctttgcctcgaacgcttttcaggaaacatggtactggcatggagacgtgaactcaaacaaggtggtgatgagtggggtcaaatgctcaggaactgagctatctctggctcactgtaggcatgacggagaggatgtagcttgcccccaaggcggagtgcagtacggggcgggggtggcctgctcggagacagccccggatctcgtactgaacgccgagatggttcagcaaacaacttacctcgaagaccgccccatgtttatgttgcagtgcgccatggaggaaaactgcctctctgccagcgcggcccagacagatcccactactggatatcgtagattgctcaggttcagctctcagatccacaataacgggcagagcgacttccgccctaagaacggtagacacgcatggatatggcatgattgccaccgtcattaccacagtatggaagtatttacacattatgacctgctgaatttgaatggaaccaaggtagcagaaggacataaggcttctttttgtctggaagatacggagtgtgaaggggacattcagaaaaactacgaatgtgctaattttggcgatcaagggatcaccatgggatgttgggacatgtatcgccatgacatcgactgtcagtgggtcgacataactgacgttcccccaggcgattacctttttcaagtggtcataaacccgaatttcgaggtggccgagtccgactacagtaacaacatcatgaaatgccgatctcgatatgacggacaccggatctggatgtacaactgccatatcggggggagtttcagcgaagagaccgagaaaaagttcgagcacttttctggactgcttaacaaccagctctctcctcagtag

SEQ ID NO: 193766 - DNA, 456 bp, Artificial Sequence
  Description of Artificial Sequence: Synthetic coding sequence
atggagcggcccctgtgcagccacctgtgcagctgcctggccatgctggcccttctgagccccctatctcttgctcagtacgactcgtggccacactaccccgagtattttcagcagcccgcccctgagtatcaccagcctcaggctcccgcaaacgttgcgaagatccagttacgactggctggtcagaaaagaaaacatagcgaagggagagtggaggtctactatgacggtcaatggggtacagtgtgcgatgacgacttcagtatacacgctgcccacgtggtgtgccgcgagcttgggtacgtggaggcaaagagctggaccgcgagtagctcctacggtaaaggggagggcccaatctggctggacaacctgcattgcacaggcaacgaagccaccttggccgcatgcacatccaatggctggggtgttactgactgcaaacatacatag

SEQ ID NO: 193767 - DNA, 291 bp, Artificial Sequence
  Description of Artificial Sequence: Synthetic coding sequence
atggagcggcccctgtgcagccacctgtgcagctgcctggccatgctggctctgttatctcctctgagtcttgctcagtatgacagctggccacattatcccgaatatttccagcaacccgcaccagaatatcatcagcctcaagcaccagctaatgtggccaagatacagctccggcttgcaggccagaagaggaagcatagtgagggacgggtggaggtgtactatgatggccagtgggggacagtgtgtgacgatgatttttcgatacacgcagctcacgtcgtgtag

SEQ ID NO: 193768 - DNA, 420 bp, Artificial Sequence
  Description of Artificial Sequence: Synthetic coding sequence
atggagcggcccctgtgcagccacctgtgcagctgcctggccatgctggccctcttgtccccactcagtttagctcagtacgacagctggccccattacccagaatactttcagcaacctgctcccgaataccaccagccacaggcaccagcaaatgtagcaaagatccaacttcgactggctggtcagaaacgtaagcacagcgaaggacgagtggaagtctactacgatggccagtggggcaccgtgtgcgatgatgatttttctattcatgcagcacacgttgtctgcagagaactggggtacgtggaagccaagagttggacagctagctcaagttatggcaagggcgaggggccgatctggctggacaacctgcactgcactggaaatgaggcgactctcgccgcttgcacgtag

SEQ ID NO: 193769 - DNA, 2262 bp, Artificial Sequence
  Description of Artificial Sequence: Synthetic coding sequence
atgcggcccgtgagcgtgtggcagtggagcccctggggcctgctgctgtgtttgctttgttcttcctgcctcggttcaccatcacccagcacaggccccgagaaaaaagcaggttcccagggccttcggtttaggctcgctggcttcccaaggaagccctacgaggggcgcgtggaaatccaaagggctggcgagtgggggaccatttgcgatgacgattttacccttcaggctgcacacatactttgccgagaactcgggttcactgaggcaaccggctggacccactcggcaaagtatggacccggaaccggcagaatctggctggataatctaagttgctccggaacagaacagagcgttactgagtgtgcaagtagggggtggggcaatagcgattgtactcatgacgaggacgccggggttatttgcaaagaccagagattgcctggatttagtgactctaacgtcatcgaggttgagcatcatttacaagtggaagaggtcaggattagaccagccgtgggctggggtcgacgacctctgccagtgactgaagggttagtggaggtgagactgccagatggatggtctcaggtttgtgacaaaggatggtctgctcataattcccacgtggtctgcggcatgctgggctttccatccgagaaacgggtaaacgcggcattctacaggcttctggcccagcggcaacagcatagctttggactccatggagttgcatgtgtgggtactgaagcacacctcagcctctgctctttagaattctaccgcgcgaatgacacagcccgctgcccagggggaggaccggcagtggtctcatgcgtgcctggacccgtgtatgctgctagctccggccaaaagaaacagcaacagtcaaagccccaaggggaagctcgagtccgcttgaaggggggggcacacccgggtgagggtagagttgaggtgctgaaggcctctacgtggggcaccgtatgcgatcgtaaatgggatctgcacgctgcatcagtcgtgtgtcgcgaactcgggttcggctctgccagggaggcactgtcaggcgcccgaatggggcaggggatgggagctatccacctttcagaggtgcgctgttctgggcaagagctttctctttggaagtgtccacacaaaaacatcacagcagaagactgtagccactcccaggatgcaggtgttaggtgtaatctgccctacacaggagccgagactcgaatcagactctctgggggaaggagtcagcacgaaggccgggtggaagtccaaattgggggtcccggtcctttaaggtggggcttaatttgtggcgacgattggggcaccttagaggccatggtggcctgtagacagctgggccttgggtacgccaaccatgggcttcaggaaacttggtactgggacagcggaaatataacagaggtggtcatgtctggcgtccgatgcactggaaccgagctttctctggatcagtgcgcgcatcacggcacgcatattacatgtaagagaacagggacccggttcacagccggagtcatatgttccgaaactgcatcagatttacttctgcactccgctctagtgcaggagacggcttatattgaggatagaccactgcacatgctttactgcgccgccgaggaaaactgcctggcctccagtgcccgcagcgccaactggccctacgggcataggcgccttctgcgctttagttcacagatccacaacctaggccgcgccgacttcaggccaaaagctggaagacattcctgggtttggcatgagtgtcatgggcactatcattcaatggacatctttacacactacgacattctgacacctaacggcacaaaagtggcagagggccacaaggcctctttctgcctcgaggacaccgaatgccaagaggacgtgtcgaaacgttacgagtgcgctaatttcggcgaacaggggatcaccgtaggatgttgggacttgtatcggcacgatatcgactgtcagtggattgacattactgatgtgaaaccaggaaattatatcttgcaagtcgtcatcaatcctaactttgaggttgccgagtccgatttcactaataatgccatgaagtgcaactgcaaatacgatggacatcgcatatgggtgcacaactgtcacattggagacgctttttccgaagaagccaacagacgttttgaacgttaccccggtcaaacgagcaaccaaatcatctag

SEQ ID NO: 193770 - DNA, 1827 bp, Artificial Sequence
  Description of Artificial Sequence: Synthetic coding sequence
atgcggcccgtgagcgtgtggcagtggagcccctggggcctgctgctgtgcctgctgtgcagctcctgcctgggctctccatcaccatcaacagggcccgaaaagaaggcaggatcccagggtcttaggttcagattggcgggcttcccgaggaagccttatgaaggccgggtagagatccagagggcaggtgaatggggcactatttgtgatgacgatttcacactgcaggcagcgcatattctctgcagggagctagggtttacagaggctacaggctggacacacagcgcaaaatacggacctggcaccggccgtatctggctagacaatctgagctgctctggaaccgaacaaagcgtcacagaatgcgcatccagggggtgggggaacagcgactgtacccacgatgaggatgccggtgtcatttgtaaggatcaaaggctccctggattttctgactccaacgtgattgaagctcgcgtccgcctgaaagggggagctcatccaggggaaggaagggtcgaagtgttgaaagcctccacatggggtaccgtgtgtgatcgtaagtgggatctccatgccgccagtgttgtgtgcagagagcttggcttcggaagcgcgagagaggctttgtccggcgctagaatgggtcaaggcatgggagctatccacctgagcgaggtacgctgttccggacaggaattatctctctggaaatgtcctcataagaatatcacggcagaggattgctcccactcgcaggacgccggggtccgatgcaatctgccttatacaggcgccgaaacaagaattaggttgtccgggggcagatcccagcatgagggcagggtggaggtgcagattggcgggcccgggcctctgcgctggggactgatttgtggtgatgactggggtaccctcgaagccatggtagcctgccggcaactcggattgggctacgccaatcacggacttcaggagacttggtactgggacagtggcaatattacagaggtcgttatgagcggggtaaggtgtaccggaacagagctgtccctggaccagtgcgcccaccacggcactcatattacgtgcaaaagaacaggaacccggtttacagctggagtcatttgttccgagaccgcctcagatctgctgttacatagcgccctcgtgcaagagacagcatacatagaggacagacctctgcacatgctgtactgtgccgcggaagagaattgcttggcatcctctgctcgatcagccaactggccatacggccaccgccgcctccttcgattttcctctcaaatccacaatctcgggcgggctgattttcggcccaaggcaggaagacactcatgggtgtggcacgagtgccacggtcactaccactccatggatatcttcacacactacgacatccttaccccgaatggcaccaaggttgcggaaggtcataaagcatcgttttgtctcgaagacacagagtgccaggaggacgtgagcaaaagatacgaatgtgccaactttggggagcagggcataactgtaggatgctgggatctgtataggcacgacattgactgtcagtggatcgacattacggatgtgaagccaggaaactacattttgcaggtggtgatcaacccgaattttgaagttgcagaaagcgattttaccaataacgccatgaaatgtaattgcaaatatgatgggcaccggatctgggttcacaattgccatatcggcgacgccttctccgaggaggcaaaccgccggttcgagaggtacccagggcaaacatcaaaccagattatatag

SEQ ID NO: 193771 - DNA, 2094 bp, Artificial Sequence
  Description of Artificial Sequence: Synthetic coding sequence
atgcggcccgtgagcgtgtggcagtggagcccctggggcctgctgctgtgtcttttgtgttcgtcttgcttggggtcaccgtcgccttccactggaccggagaaaaaggcaggaagccagggactgcggttccgtctcgccgggtttcctcggaagccctacgagggacgcgtcgaaattcaaagggcaggggagtggggcaccatatgcgatgacgactttaccctacaggcagcgcacattctctgtagagagttaggctttactgaggccaccggctggacccatagcgcaaaatatggccccggcacgggccggatttggcttgataacctcagctgtagcggcacagagcagagcgtgacagaatgcgcaagccgcgggtggggcaattcggattgtacacacgacgaagatgccggggtgatctgtaaggaccagagattgccaggcttttctgactccaatgtgattgaagtcgagcatcatctgcaggttgaggaggtgcggatccgtccagccgtgggatgggggcgacgacctctcccagtgacagagggacttgtggaggtgcggctccctgatggttggtcccaggtctgcgacaaaggctggagcgcccacaacagccacgttgtgtgtggcatgctggggttcccaagtgagaagagggtcaacgctgctttttataggctgcttgcacagagacagcagcattcttttggactccacggggtggcctgcgtagggacggaagcacacctcagcctttgctcacttgagttctatagggctaacgataccgctagatgtccgggcggggggcctgccgtcgttagctgcgtgccgggacctgtgtatgccgcaagcagcggccaaaaaaaacagcaacagtccaaaccccagggggaggccagagtgagactaaaagggggggctcaccctggcgaaggccgtgtggaggtgctgaaagcttctacatgggggacggtgtgcgatcgcaagtgggatctccacgcagctagcgttgtgtgtagggaattgggctttggaagcgctagagaggctctgtcaggagccaggatgggccagggcatgggagctatacacctgagtgaggtgcgttgtagtggccaagagcttagcctgtggaaatgtcctcacaagaatattacggcagaggactgttcacatagtcaggatgctggagtaagatgcaacctgccatatactggagctgagacccgggaaacatggtattgggacagcgggaacattaccgaagttgtgatgtctggggtgagatgtaccggtaccgagctgtctctcgaccagtgcgcacaccacgggactcacattacctgcaaacggacaggcacgcgatttactgccggtgtgatctgcagcgagacggcctcagacctgctgctgcactccgcactggtccaagaaacagcttatattgaggacagacccctccatatgctgtattgtgccgccgaagagaattgtctggcctcctccgccagaagcgcgaattggccatacggacaccggaggctcctgaggtttagcagccaaatccacaacctgggtcgagcggatttccgcccgaaggcgggacggcacagctgggtgtggcatgaatgccacggccattaccattccatggatatctttactcattatgacatcttgacccctaacggaactaaagtggcagagggccacaaagccagcttttgtctagaggacactgagtgccaagaggacgtcagtaagcgatatgaatgtgctaactttggcgaacagggaataacggtcggatgctgggatctgtacaggcacgacatcgattgccagtggatagacattactgatgttaagcctggtaactacatcctgcaagtcgtcattaaccccaacttcgaagtggccgaatccgatttcaccaacaatgctatgaaatgcaactgtaaatatgatgggcatcgcatctgggtccacaattgccacatcggagatgccttcagcgaagaagctaataggcggttcgagcggtaccctggacaaaccagtaaccagattatctag

SEQ ID NO: 193772 - DNA, 912 bp, Artificial Sequence
  Description of Artificial Sequence: Synthetic coding sequence
atgcggcccgtgagcgtgtggcagtggagcccctggggcctgctgttgtgtctcctgtgctccagctgtctggggtccccgagtccctctacaggtccggagaagaaggctggttctcagggtctcagattcagactcgcagggtttccaaggaaaccctatgaagggcgcgttgagatccagagagccggcgagtggggcactatctgcgacgacgatttcaccttgcaagccgctcatatcctgtgccgggagttgggattcacggaagctactgggtggactcattcagccaaatatggaccgggaactggtaggatttggcttgacaatctctcttgctccggaacggagcagtccgtcaccgaatgcgctagccgaggatgggggaactcagattgcacccatgacgaagatgcaggcgtcatctgtaaggatcaaaggcttccaggatttagcgattcaaacgtcattgaggtggagcatcatttgcaggtcgaagaggtgagaatccgccctgcggtggggtggggcaggcgcccactaccagtaacggagggcctagtcgaagtgcggctgcccgacgggtggagccaggtttgtgataaaggatggagtgcccacaatagccacgtggtgtgtggaatgctgggtttcccctccgaaaagagggttaacgccgcattctataggctgctcgcccaacggcagcagcatagtttcggccttcatggggtggcctgcgtggggacagaagcgcacttgagtctgtgctccctcgaattttatcgagcgaacgacacggcgcgatgtccgggcggaggcccagcagtggtctcctgcgtaccaggaccagtctacgctgcctcttccgggcagaagaagcagcagcaaagtaagccacaaggatag

SEQ ID NO: 193773 - DNA, 2271 bp, Artificial Sequence
  Description of Artificial Sequence: Synthetic coding sequence
atggcctggagcccccccgccaccctgttcctgttcctgctgctgctgggacagccccccccttctcggcctcagtcgttgggtaccacgaaactgagacttgttggccccgagtccaaaccagaggagggcaggctagaggtgttgcaccagggacaatgggggaccgtctgcgatgataattttgcgattcaggaggcaacggtagcctgccgacagctgggttttgaagcggccctgacatgggcccattcagctaagtacggacagggagaaggacccatatggctggacaatgtaagatgcgtcggaaccgaaagtagcctggatcaatgcggaagcaacgggtggggtgtgtcggattgctctcactctgaagatgtaggggtaatctgccatcccagacggcatcgaggttatctcagcgagacagtgtccaatgcactgggccctcagggcaggaggctcgaggaagtcaggctgaagccgatcttagcatcagcaaagcagcactcacccgtgaccgagggagccgttgaggtaaagtatgagggacactggaggcaagtgtgtgatcagggctggacaatgaataatagcagggtggtgtgcggaatgctgggcttccccagcgaggttccagtcgattctcactattaccgcaaggtgtgggatctgaaaatgcgggaccccaagagtagattgaagagcttaaccaacaagaactccttttggattcaccaggtaacatgtctaggcaccgaacctcatatggctaattgtcaggtgcaggtcgcgccggcccgcgggaagcttcggcctgcttgcccgggcggcatgcacgctgttgttagttgcgtggcagggcctcatttccgccctcccaaaactaagcctcagcggaaagggagttgggcggaggagccaagggtgagactgaggtctggggcccaggtgggcgaggggagagttgaggtattgatgaatcgacaatggggcactgtctgtgaccaccggtggaatcttattagcgctagcgtagtctgccggcagcttgggtttggaagtgctagggaggccctgttcggagcccgacttggacaggggctgggccccatccatctttccgaggtaaggtgcaggggctatgagcgaaccttatctgactgtcctgcactggaaggctcccagaacggttgccaacacgagaatgacgcagccgtgcggtgcaacgtgcccaacatgggattccagaatcaagtgcggttggcaggcggcagaatccccgaggaggggctgctggaagttcaggttgaggtgaacggggtccccagatggggcagcgtttgctcagagaactggggacttacagaggccatggttgcctgcaggcagctaggcctcgggttcgctattcacgcttataaagagacgtggttttggtccggcacaccaagggcccaagaggtggtcatgagtggggtgagatgcagtggcacagagctggcgcttcagcagtgtcagcggcacggccctgtgcactgcagtcacgggggggggcgctttttagccggagtctcatgcatggattctgccccggatctcgtaatgaacgcgcagttagtgcaggagaccgcctatctcgaagatagaccactctctcagctgtactgcgcacacgaagagaattgtctctcgaaatctgcagaccacatggactggccttatgggtataggagattgctgcgctttagtactcaaatttacaatctcggccgaaccgacttccggcccaagacagggcgggactcttgggtttggcaccaatgccacagacactatcactcaattgaggttttcactcactacgacctattaacattaaacgggtcaaaggttgccgaaggccacaaagcatccttctgcctcgaggatactaactgtccgaccggcctccagagaaggtatgcgtgcgccaacttcggagagcagggtgtgaccgtgggatgctgggacacatatagacacgacatcgattgccagtgggtcgacatcactgatgtcggacccggcaactatattttccaggtaattgtgaacccgcattatgaggtggccgagtctgatttctccaataacatgcttcagtgccgatgcaaatacgacggtcacagagtgtggctccataattgccatacgggcaatagctatcctgccaacgctgagctgagcctcgagcaggaacagcgcctgcgtaataatctcatttag

SEQ ID NO: 193774 - DNA, 1794 bp, Artificial Sequence
  Description of Artificial Sequence: Synthetic coding sequence
atggccgccgtgcaggccgccgaggtgaaggtggacggcagcgagcctaagctgtccaaaaacgaactgaaacggaggctaaaggctgagaaaaaagtggcggaaaaggaagccaagcaaaaggaactctctgagaaacaactgtcacaggctacagcagccgcaacaaaccatacaacagacaatggcgtgggcccggaagaggagtctgtagacccaaatcagtactataagattcgtagccaggctatccatcagctcaaggtgaacggagaggacccatacccgcacaagttccacgtcgacatatccctgaccgacttcattcagaaatacagtcacctgcagcctggagaccatctgacagacatcaccttgaaagtggcgggaaggattcacgctaaacgcgctagcggcggcaagcttattttctatgacttgcgcggcgagggagttaagctccaggtaatggcaaatagcagaaactacaaatccgaagaagagtttatccatataaacaacaaactgcggaggggagatatcataggggtccagggcaacccaggcaagacaaagaagggggagctgtccattatcccatacgaaataaccctgctctcaccttgccttcacatgcttccacacctgcacttcggacttaaggataaggagaccagatatcgccaaagatatttggacctgattctcaacgacttcgtgaggcaaaaatttattattcgctccaagattataacttatatccgctcatttctggacgaactaggctttctagaaatcgagacacccatgatgaatatcataccaggaggggctgtggccaagccgttcatcacataccacaacgagttagacatgaacttgtacatgagaatcgctcccgagctataccataaaatgttggtcgtgggagggattgatcgtgtgtatgaaattggcaggcagttccgcaacgaaggcatcgacctcacacacaacccagaatttactacttgcgaattctatatggcttatgctgattaccacgacctaatggaaatcacagaaaagatggtatccggtatggttaaacatattacgggttcatataaggtgacctatcatcctgacggccccgagggacaagcttatgacgtggacttcactccgccgtttaggaggatcaatatggtcgaagagctcgaaaaggcccttggtatgaagttgccagagaccaatctgtttgaaacggaagagacccgtaagatactggacgatatctgcgtggccaaagccgttgaatgtcccccgcccaggacaacagctcggctccttgacaagctcgtgggggaatttctagaagtgacatgcattaatcccacgttcatttgtgaccatcctcagattatgtcccccttggctaagtggcatcggtctaaggaaggacttactgagaggttcgagttgttcgttatgaagaaagagatatgcaacgcctatacagagctgaacgacccaatgcgccagcggcagctgttcgaggagcaggctaaggccaaggctgccggcgatgacgaagcaatgttcattgacgaaaatttctgtaccgccctggagtacgggttgcctcccactgccggttggggaatgggcatagatcgagtcgcaatgttcctgacagatagcaacaatattaaggaggttctcctgtttcctgccatgaagcccgaagacaagaaagaaaatgtagccaccacagacactctcgagtccaccactgtcggcacctcagtgtag

SEQ ID NO: 193775 - DNA, 1878 bp, Artificial Sequence
  Description of Artificial Sequence: Synthetic coding sequence
atgctgacccaggccgccgtgcggctggtgcggggcagcctgcggaagaccagctgggcggagtgggggcaccgggagttgcgcctgggacagttagcccccttcactgctccccataaggacaagagctttagcgatcagcggtcagaactaaaacgccggttgaaggcagaaaagaaggtggcagaaaaggaagctaagcagaaggaacttagcgaaaaacagctgtcccaggcaactgccgctgcgaccaaccacacaaccgacaacggggtggggcccgaagaagagtcggtggatcccaaccaatactataaaattcgttcacaggcgattcaccaactcaaggttaacggagaagatccatatccacataaatttcatgtggacatttctctgacggactttattcagaaatactcacacctgcaacctggggatcatttgaccgacattactctcaaagtagccgggcggatccacgccaagcgggcttctggaggaaaactcatcttttacgacttaaggggcgagggcgtgaagctacaagtcatggcgaattcaagaaactacaaatccgaagaagaatttatccacattaacaataaactgagacgaggggacattatcggtgttcagggtaaccctggcaagactaaaaagggagagctgtccattatcccatatgaaatcaccttactgtccccatgtttacatatgctgccgcatttgcactttgggctgaaagataaggaaacccggtaccggcagagatatctggaccttatcttgaacgatttcgttagacagaaattcattatccgctccaagatcatcacctacattcgttcatttcttgacgaactgggctttttggagatcgagacgccgatgatgaacatcatccctggtggagcggtcgccaagcccttcataacttaccataatgaactcgatatgaacttgtatatgcgtatcgccccagaactgtatcacaaaatgcttgtcgtcggtggtattgaccgggtttatgaaattgggaggcaatttcggaatgagggaatagacttgacccataacccggaattcacaacctgcgaattttacatggcttatgctgactaccatgacttgatggaaatcaccgaaaagatggtgtctggaatggtcaagcacatcactgggtcctacaaggtgacctaccacccagacggcccagagggccaggcttatgatgttgacttcactcctcctttccgacggatcaacatggttgaggaactggagaaggcgttaggcatgaaactcccggagaccaacttattcgagaccgaggagacccggaagattctggacgatatctgcgtggcgaaggctgtggagtgtcctccaccacggaccacagcccgtctgctcgataaattagtgggggagtttctggaagtgacctgtatcaacccaacgttcatctgcgatcaccctcagattatgagcccacttgccaagtggcatcgcagtaaagaggggttgaccgagagattcgaacttttcgtgatgaagaaggagatctgcaatgcttacacagagctgaacgacccaatgagacagcgccaacttttcgaggagcaggctaaagccaaagcagcaggggacgacgaagccatgtttatagatgaaaatttctgcactgccctggagtatggattgccacctaccgctggctgggggatgggcatcgatcgcgtggccatgtttcttaccgactccaacaatatcaaggaggttttactgtttcctgcaatgaagcccgaagataagaaggagaatgttgcgactaccgacactcttgaatccactacagtaggtacttctgtttag

SEQ ID NO: 193776 - DNA, 1569 bp, Artificial Sequence
  Description of Artificial Sequence: Synthetic coding sequence
atgcagccctggcacggcaaggccatgcagcgggccagcgaggccggcgccaccgcccccaaggcatcagcccgaaacgccagaggcgctccaatggaccccacagaaagtcctgcagcccccgaggccgctctacctaaggccggcaagtttggcccagcaaggaagagtgggagcaggcagaagaagtccgcccctgacacccaggaaaggcctcccgtgcgcgctacaggcgctagagcaaagaaagctcctcaacgcgcgcaagacactcagcctagtgacgccactagcgccccaggtgcagagggactcgagccccctgccgccagggagcctgcactgagtagagctggctcttgccggcagcgaggcgctcgttgttcgacgaagcctagaccacccccggggccctgggacgtccccagtcctggacttccagtgtctgcgcccatcctggtgagaagagacgccgctcccggcgcttctaagctgagggctgttctggagaaattaaagctgtcccgtgatgatatcagtactgccgcaggtatggtaaagggggttgtggaccaccttctgctccgtttaaagtgcgattccgcatttaggggcgtcgggctattgaatacaggatcttactatgagcacgtgaagatctccgcccctaacgagttcgacgtaatgttcaagctcgaggtacccaggatccaattggaagagtactctaatacacgggcctactattttgtaaagttcaagcgtaatcccaaggagaaccctctaagccagtttctggagggcgagatcctgtcagcctcaaaaatgctttctaagttcagaaaaattattaaggaagaaattaatgacattaaggacactgacgtaattatgaagcgaaaacggggaggatcacctgccgtgaccctcctcattagtgagaagatttccgtcgacattacgctggctctggaaagcaaaagcagctggcccgcctcaacccaggagggcttacgaatacaaaactggttgtctgctaaagttcgtaaacaactgagactgaagcctttctacctggtgccaaagcatgccaaggaggggaatggcttccaggaagaaacatggagattgagtttctctcatatcgagaaagaaattttgaacaaccacgggaaaagcaagacctgttgtgaaaacaaggaagagaagtgttgccgtaaggactgcctgaaactgatgaagtacctgttggaacagctgaaggaacgctttaaggataagaagcacctggacaagttcagcagctaccacgtcaagacagcttttttccatgtgtgcacgcagaatccacaggactcgcaatgggaccggaaagacctcggcctctgttttgacaactgcgtcacctatttcctgcagtgcttaaggaccgagaagctcgaaaattatttcatacccgaatttaacttattttcatctaacctgatcgataaacggagtaaagagttcctaacgaaacaaattgaatatgagaggaataatgagttccccgttttcgacgagttctag

SEQ ID NO: 193777 - DNA, 1344 bp, Artificial Sequence
  Description of Artificial Sequence: Synthetic coding sequence
atgcagccctggcacggcaaggccatgcagcgggccagcgaggccggggcaacagctccaaaagcctcagcacgtaatgctcggggagctcccatggatcctactgagtcccccgccgccccagaggccgcactgccaaaggctggaaagttcggccctgccaggaaatccggatcaaggcagaaaaagagcgccccagacacacaggagcgcccccccgtccgagccacaggcgctagggcgaaaaaggcccctcagagagcccaggacactcaacctagtgacgcaacttccgcacctggggctgaaggtctggaacctcctgcagcgagagagcccgccctgagcagggcgggttcctgcaggcaacgcggggccagatgcagcacaaagccacgacccccccctggcccctgggacgtcccatcccccggcctcccagtgagcgccccaattctggtgaggcgggatgccgctccgggcgcctcaaaattgagggcagtgctagaaaaactgaagctcagtcgagacgatatctccacggcggccggaatggtgaaaggtgtcgtggatcaccttctgctccggctgaaatgtgactcagccttcaggggggtgggcctattgaataccgggagttactatgagcacgtgaagatctccgcaccgaatgagttcgacgtcatgtttaaactggaggtccctaggattcagttggaggagtattccaacacgcgggcctactattttgtgaaatttaaaagaaatcctaaggaaaatcctctgagtcaatttctcgaaggggaaatcctgtctgcttccaagatgctgagcaagtttcggaagataatcaaggaggaaattaatgatattaaggatacagatgtgataatgaaacggaaacgagggggcagccccgccgttacccttcttatctctgagaagatttccgttgatatcaccctggccttggagtctaagtctagttggcccgccagcacacaggaaggcctgcgcatacagaattggctttctgccaaggttcggaaacagcttaggctcaagccattctacctggtacctaaacacgcaaaggaggggaacggatttcaggaagagacgtggcggctcagcttctcgcacattgagaaggaaatcctcaacaaccatggcaagtctaagacgtgctgtgaaaataaggaagaaaaatgttgtaggaaggactgcctgaagctgatgaagtatcttctcgaacagctcaaagagagatttaaggacaagaagcacttagataagttctcttcatatcacgttaagaccgcctttttccaccgtttgtattag

SEQ ID NO: 193778 - DNA, 1080 bp, Artificial Sequence
  Description of Artificial Sequence: Synthetic coding sequence
atgatcgccgcccaggccaagctggtgtaccacctgaacaagtactataatgaaaaatgccaggcacggaaagctgctattgcaaagacgattcgcgaggtttgcaaggtagtgtcagatgttctcaaagaggtggaggtgcaagaaccccgattcatttcatcactaaatgagatggacaacagatacgaaggactcgaagtgattagcccgacagaattcgaagttgttctgtatctaaatcagatgggggtcttcaacttcgtggacgacggcagcctcccaggctgcgctgttctgaagctgtcagacggcaggaagcgatccatgtccctgtgggtggagtttataaccgccagtggctatctgtcagctagaaaaataagaagccgattccaaacactggtggctcaggccgtagacaaatgcagctaccgtgatgttgtcaagatggtggcagacaccagcgaggtcaaacttaggataagagacagatacgttgtgcagattacgccagcatttaaatgcacaggcatctggcccagatccgcggcgcactggcctctcccgcacataccttggcccggcccaaacagggtggctgaagttaaagccgaggggttcaacttattgagtaaggagtgtcacagcctggctggtaagcagtcctccgcagagtctgatgcctgggtgttacaattcgctgaggccgagaatcgtctgcagatgggagggtgccgcaagaaatgcctttccattctcaagacacttcgggataggcacctggagcttccaggccagcccctcaataattatcacatgaagacactggtgtcctacgaatgcgaaaagcatccacgggaatccgactgggatgaaagctgcctaggtgataggctgaatgggattttgctgcaattaatttcctgccttcagtgccggcgctgcccccactattttctgccaaacctagatcttttccaaggtaagccacactccgctctggagaacgccgcgaagcagacctggcggctggcacgagaaattttaaccaatcctaagtccctcgaaaagctctag

SEQ ID NO: 193779 - DNA, 1176 bp, Artificial Sequence
  Description of Artificial Sequence: Synthetic coding sequence
atgagcggccccgtgcccagccgggcccgggtgtacaccgacgtgaatacccaccgccctcgcgagtactgggactacgagagccatgtggtggagtggggaaatcaagatgattaccagcttgttagaaaactgggaaggggtaagtattctgaggtattcgaggcgataaatattaccaacaatgaaaaggtcgtggtgaagatcctcaagccagtaaagaaaaaaaaaatcaagcgagagattaaaattctcgagaatctgagggggggcccaaatatcatcacactggctgatatcgtcaaggatccggtgagtcggacaccagcattagtcttcgagcacgtcaacaataccgactttaagcagctttaccaaacgctcaccgattatgacataaggttctatatgtatgagatcctgaaagcactggactattgccactcgatggggattatgcatagagatgtgaaacctcataatgttatgattgaccacgagcacagaaagctcaggctaatcgattggggtttggcagagttctatcacccaggccaagagtataatgtgcgagtagcctcacgctacttcaaggggccagaattgctggttgattatcagatgtatgattacagtttggacatgtggagcctgggatgtatgttggctagcatgattttcagaaaggagcctttttttcatggacacgacaattacgaccagctggtacggattgcaaaggtcctgggaactgaagatctctacgactacatcgacaaatataacatagaactggaccctaggtttaacgacatccttggtaggcactccagaaaaaggtgggagagatttgtccatagtgagaaccagcacctggtcagtcccgaagctctggacttcctggacaaactgctgaggtacgaccaccaaagcaggctgaccgccagagaggcaatggagcatccctatttttacaccgtggtgaaggaccaggctcggatgggttcttcttctatgccaggtggaagtacccctgtgtccagcgccaatatgatgtctggaatctcctccgtacctacaccgagtccactgggcccactggccgggtcccctgtaattgccgcagccaacccattgggaatgcctgttcctgctgctgctggggcccagcagtag

SEQ ID NO: 193780 - DNA, 1347 bp, Artificial Sequence
  Description of Artificial Sequence: Synthetic coding sequence
atgtaccccagcaacaagaagaagaaggtgtggcgggaggagaaggaaagactcctaaaaatgactttagaggaaaggaggaaagagtacctccgcgactacattccgctcaacagcatcctcagctggaaggaagaaatgaaagggaagggacagaatgatgaagaaaacacacaggagacctcacaggtgaagaagtctttgactgaaaaagtttccttgtatcggggggatattaccctgcttgaagtagacgccattgtgaacgctgctaatgctagcttattgggcggagggggcgtggatggttgcatccaccgagcagcagggccatgtctgcttgccgagtgcagaaacctgaatgggtgcgacactggccacgctaaaataacatgtggctacgacctccccgccaagtacgttatccatacagtgggacccatcgcacgaggccacattaatggctcacataaggaagatcttgctaattgttacaagtcttcactgaagctcgtgaaagagaataacattcggtcggtagcctttccctgtataagtactggtatttatggattccccaacgagcccgcagccgtgatcgcgctgaacacgataaaagagtggcttgccaaaaaccaccacgaggtagacaggatcatattctgtgtgtttttagaggtcgattttaagatctacaagaagaaaatgaacgaattcttctccgtggatgataacaatgaagaggaggaagacgttgaaatgaaagaagactccgatgaaaatggcccggaggagaaacaatctgtggaagaaatggaggagcagagtcaggatgccgacggagtgaatactgtgaccgtgccaggcccagcaagtgaggaagctgtggaagactgcaaagacgaggatttcgccaaggacgaaaatatcactaaaggtggcgaagttaccgaccatagtgttagagaccaggaccacccagacggacaggagaatgactctaccaagaatgaaattaagatagagaccgaatcacagagctcttatatggaaactgaagagctttcctccaaccaggaagatgcagtgattgtggaacagcccgaagtcataccactcacggaagatcaggaagagaaggagggcgaaaaggctcccggggaagacacccccaggatgccggggaagtcagagggcagctccgaccttgagaacacacccggccccgacgtggaaatgaatagtcaggtggataaggtcaatgatcccacagaatctcagcaagaagaccagctgatagcaggtgcgcaagacgaggcgaaggaacaaaggaatggtactaaatag

SEQ ID NO: 193781 - DNA, 642 bp, Artificial Sequence
  Description of Artificial Sequence: Synthetic coding sequence
atgaacgagttcttcagcgtggacgacaacaacgaggaggaggaggacgtcgagatgaaggaagactcagacgagaacggcccggaggagaagcagagcgtggaggaaatggaggagcagtctcaggatgctgacggcgttaatactgtaaccgttcccggtcccgcgagcgaggaagccgttgaggactgcaaagacgaagattttgcgaaggacgagaacataaccaaaggaggcgaggtgaccgatcactctgtcagggatcaagaccaccccgacggccaagagaacgacagtaccaagaacgaaatcaagattgagacagagtctcagagctcatatatggagaccgaagaactctcttctaatcaggaggacgcagtgatcgtggagcagcccgaggtgatccctcttaccgaggatcaagaggagaaggagggggagaaggccccaggtgaggacacgcctaggatgcctggtaagtccgaggggtctagcgatctggaaaacactccaggccctgatgtcgaaatgaactcccaagtggataaggtgaacgatcccaccgagtcccagcaggaagaccagctcatcgcaggggctcaggacgaagccaaggaacagcggaacgggactaagtag

SEQ ID NO: 193782 - DNA, 642 bp, Artificial Sequence
  Description of Artificial Sequence: Synthetic coding sequence
atgaacgagttcttcagcgtggacgacaacaacgaggaggaggaggacgtggaaatgaaagaggattcggacgagaacggaccggaggagaagcaatcagtcgaagagatggaagagcagagtcaggatgctgatggagtaaacaccgtcaccgtgcccgggcccgcttccgaggaagccgtcgaggattgtaaggacgaggattttgcaaaagatgaaaatatcaccaaagggggcgaggttacagatcatagtgttcgcgatcaggaccatcctgatggccaggagaacgactcaacaaagaatgaaatcaaaatcgaaactgaatcccagtcatcctatatggaaacagaggagctttcctctaaccaggaggatgctgtgatagtggagcagccggaggttataccgcttactgaggatcaggaggagaaagagggggaaaaggctccaggcgaggacactcctcgtatgccagggaagtctgagggatcttccgatctggaaaataccccagggccagacgtggagatgaactcacaggtggacaaggtgaacgacccaacagagtcccagcaggaagaccaactgatagccggtgcccaggacgaggcaaaggagcagcggaacgggacgaagtag

SEQ ID NO: 193783 - DNA, 1068 bp, Artificial Sequence
  Description of Artificial Sequence: Synthetic coding sequence
atggccgtgcaggagagcgccgcccagctgagcatgaccctgaaggtgcaggagtatcctaccctgaaggttccctacgagaccctgaataaacgcttcagagccgcccaaaagaatattgatagagaaacctcccacgtgactatggtggtcgccgaactcgagaagacactgtcaggctgccctgccgtggactcagtcgtttcattactcgatggcgtggtggaaaaactttcagtcctgaagagaaaagccgtcgaatccatccaggctgaggacgagagcgctaagctgtgcaagcgacggatagaacacttgaaggaacactcaagcgatcagccagccgcggcctccgtctggaaaaggaagcgcatggaccgtatgatggtggagcatctgctcagatgcggatactataacacagcagttaagctggccagacagagtggcatcgagagttgtctggaattctccctgaggatccaagagttcatcgaacttattagacagaacaagagactggatgccgttcggcacgcgcgtaaacacttctcccaggctgaaggcagccagctggatgaagtgcgccaggctatggggatgctggctttcccacccgacactcacatttcaccctacaaggatctcctggacccagctcgatggcggatgctgatccagcagtttcgctacgacaactatcgtctgcatcagttaggtaataactccgtctttacccttactctgcaagccgggctgtcagccataaaaacaccgcagtgctataaagaagacggttcttctaagagccccgattgccccgtgtgcagcaggtctttaaataagctagcacaaccacttcccatggctcactgcgctaacagtaggctagtgtgtaaaatttccggggatgttatgaacgaaaataatccaccaatgatgttacccaacggttacgtctatggatataacagcttgttgagcatccgtcaagacgataaagtcgtgtgtccacgcactaaggaggtgttccacttcagccaagccgagaaggtctacataatgtag

SEQ ID NO: 193784 - DNA, 1191 bp, Artificial Sequence
  Description of Artificial Sequence: Synthetic coding sequence
atggccgtgcaggagagcgccgcccagctgagcatgaccctgaaggtgcaggaatacccgaccttgaaagttccctacgaaactttaaacaagcggtttagagctgcccagaagaatatagatagggaaactagccatgttacaatggtggtagccgagctggaaaagacactttccggttgtccagccgtagatagtgtcgtcagcctgttggacggcgtggttgagaaactgagtgtgctgaaacggaaagccgtggagtctatccaggcagaggatgagagcgccaaattgtgcaaacgaaggattgaacacctcaaagagcactccagcgatcagcccgcagctgctagtgtatggaaacgtaaaaggatggatcggatgatggtcgaacacttgttacgatgcggatactacaacacagccgtcaagcttgcccgccagtctggcatagaggacctggtgaacatcgagatgtttttgacagccaaagaggtggaggaatccctggagcgaagggagaccgcaacctgcctcgcctggtgccacgataacaaatctcggcttcgcaagatgaagtcgtgtcttgagttttctcttcggatccaagagttcattgaactgatccgacaaaacaagaggttagacgcagtgagacacgcccgaaagcacttctctcaggcggaaggatcccagcttgatgaggttcgccaagctatgggaatgctggcctttccaccggatactcatataagtccatacaaagacttactggacccagctcgttggcgcatgctgatacagcaatttagatatgataattacaggcttcaccaacttgggaataactctgtcttcaccttgacactgcaggccggcctttcggccatcaaaacccctcagtgctacaaagaggacggcagttctaagtcacccgactgtcccgtttgctcacggagcctcaacaagctggcccagcctctccctatggctcactgcgctaactccaggctcgtctgcaagatcagcggagatgtgatgaatgagaataatccaccgatgatgcttcccaatggatatgtatacggatacaattctttgttgtcaataagacaggatgacaaggtggtctgccctagaactaaagaagtattccatttcagccaggctgaaaaggtgtacatcatgtag

SEQ ID NO: 193785 - DNA, 987 bp, Artificial Sequence
  Description of Artificial Sequence: Synthetic coding sequence
atggccgtgcaggagagcgccgcccagctgagcatgaccctgaaggtgcaggagtatcctacacttaaagtgccctacgagactctgaacaaacggttccgggccgcacagaaaaatattgacagagagactagccacgtgaccatggttgtggccgagctcgagaagactctgtctggctgtccagctgttgactctgtggttagtttgctggatggcgttgtggagaagctgagcgttcttaaaagaaaagcagtggagtcgattcaagcagaggacgagtcagccaagttatgtaaaagacgcatcgagcacctaaaagagcactcatctgatcagcctgccgccgcttctgtctggaagcggaagaggatggacaggatgatggttgagcacttgttgaggtgtggatactacaacaccgctgtcaaacttgcccgccaatcggggattgagacatgtaagaaagcactgcaaccctcccggcgcgagccagctggaaggggggctccaggccatggtcacgcaggtctgcctgctcggcatgcacacttgccagtgcagggcccttcaggcccctgtacggttgcagacgctgaccccgctgtcccagtcaggcagctgcctacaacaccagcaggcaaacagttttgtgtgcacccacatcccgccggctggccactgagtcaccaggagcagtgctacaaggaagacgggtcgtccaagagtcccgactgccctgtttgttccaggtccctgaataagctcgctcagccccttcctatggcacactgtgccaactctcggctcgtctgtaagatctccggtgacgttatgaatgaaaacaatcccccaatgatgttgccaaatggctacgtttacggctataatagtctcctgtctatccgccaggatgataaggtcgtgtgcccccgcaccaaagaggtcttccattttagtcaggccgaaaaagtgtacatcatgtag

SEQ ID NO: 193786 - DNA, 954 bp, Artificial Sequence
  Description of Artificial Sequence: Synthetic coding sequence
atgaccctgaaggtgcaggagtaccccaccctgaaggtgccctacgagaccctgaataagcgctttcgggctgcacagaaaaatattgacagggagacctctcatgtcacaatggttgtcgccgagctggagaaaacattgtctggttgcccagcagtggattccgtagtgagcttattagacggggtagtggaaaaactgtctgttctgaagaggaaagacctagttaatatagagatgttccttacggcgaaagaggtggaggagtcattggaacgaagagaaacagccacttgcctagcttggtgccatgacaataagagcaggctgcgaaaaatgaaaagctgcctggagttctcgctgaggatccaggaatttatcgagttgattcgccagaataaaaggctggacgcagtccgtcacgcacgcaagcacttttcccaagccgagggatcccagttggatgaggtgcgccaggctatggggatgctcgccttccctccagacacccatatctcgccatacaaagacttactcgaccccgccagatggcgcatgctcatccagcagtttaggtatgataactaccgcctccaccagcttggtaacaattctgtctttactttgaccctgcaggctggcctgagtgcaatcaagaccccacagtgctacaaagaagatgggagctccaaatctcctgactgtcccgtgtgctccagatcccttaacaaactggctcaaccactccccatggcccactgtgccaatagccgcctggtgtgcaagatctccggagacgtgatgaacgaaaacaatcccccgatgatgctgccaaacggatatgtgtatggctataactccctactgagcattagacaggacgacaaggttgtctgccctcggactaaggaagtgttccacttctcacaggctgaaaaagtttacattatgtag

SEQ ID NO: 193787 - DNA, 1305 bp, Artificial Sequence
  Description of Artificial Sequence: Synthetic coding sequence
atggccgtgcaggagagcgccgcccagctgagcatgaccctgaaggtccaggagtaccctacactcaaggtcccttacgagacactaaacaagaggtttcgcgccgcacagaagaatatagaccgcgaaacgagtcacgtaacaatggtcgtggcagagctagaaaaaactttgagcggctgcccagctgtcgatagtgtggtgtcccttctggacggagtggtggagaagctgagcgtgctgaagcggaaggccgtcgaaagcattcaagccgaggacgaatcagcgaagctttgtaagagacgtatcgaacacctgaaagaacattccagtgaccagccagcagcagcctcggtatggaagcggaaaagaatggacaggatgatggtggaacatctgttgcgttgcggatattataacacggccgtgaagctggccagacagagtgggattgaggatctggtcaacatcgagatgtttctcactgccaaggaggtggaagaaagcctcgagagacgcgagaccgcaacctgtctggcttggtgtcacgacaacaagtcccgactacgaaagatgaaaggcagacagaataagcacgaagctaaaaccggcaggaagtctagagctgcttcttcttcaccaaaggaaagtttggacctgggtatggagacgttaaagggaaagccagagctgtcttgtctagagttttcacttcgtatccaggagtttatcgagctgatcaggcagaacaaacgactggacgctgtgcgccatgcccgtaagcatttttcccaggctgagggaagtcaactggatgaggtgcgccaagctatggggatgctcgcctttcctccagatacccatatcagcccatacaaggatctgttggatccggcgcggtggcggatgctgattcagcaatttaggtatgataactacagactgcatcaactggggaacaactccgtgttcactttaacactgcaagcggggttgtccgctattaagacaccacagtgttacaaggaggacggctcttccaaatccccagattgccccgtctgctcgcgctctctgaataagctggcccagcccctgccgatggcacactgcgccaattcacgccttgtttgcaagatttccggcgatgtgatgaacgaaaacaaccctcccatgatgctgccaaacggctacgtgtacggatataactccctgcttagcatccggcaggacgataaggtggtatgtcccagaacaaaggaggtgtttcacttctcccaagctgaaaaggtgtacatcatgtag

SEQ ID NO: 193788 - DNA, 1047 bp, Artificial Sequence
  Description of Artificial Sequence: Synthetic coding sequence
atggtggtggccgagctggagaagaccctgagcggctgccccgccgtggactccgtggttagccttttagatggagtggtggagaaactgagcgttttgaaacggaaagcagtggaatccattcaagcagaggacgagtctgcaaaactgtgcaagaggagaatcgagcatcttaaggagcacagctctgaccagcccgcagcagcgagtgtgtggaaaagaaaaagaatggatagaatgatggtggaacaccttttgagatgtggttactataacacagctgtgaagctcgccagacagagtggaatcgaagacctcgtaaacatcgagatgtttctgaccgctaaggaagtggaggaatccctagagcggcgcgaaacggcaacatgtcttgcatggtgtcacgataacaagtctcggttgaggaagatgaagtcctgtctggagtttagtctccggatccaggaatttattgagcttatcagacagaataaaaggcttgacgcagtacgccatgcacggaaacatttcagccaggcagagggttcacagctcgacgaagtcaggcaagcgatggggatgctggcgttcccgccagacactcacatcagcccatacaaagacctgctagatccagccaggtggaggatgctcatccagcagtttaggtatgacaactaccggctgcaccagctcggaaataatagtgtattcaccctcacgctgcaggccgggcttagcgcaatcaaaactcctcaatgctataaagaggatggatcaagcaagagtcccgattgccctgtgtgtagtcgctcactgaacaaactggctcagcctcttcctatggcccattgcgcgaacagtcgtctcgtgtgcaagatctctggggacgttatgaatgagaacaatcctcctatgatgctgcctaatggctacgtctatggatacaactccctcctgtccatccgacaggacgataaggtggtctgccccaggacaaaagaggtcttccatttctcacaggccgagaaggtgtacatcatgtag

SEQ ID NO: 193789 - DNA, 1188 bp, Artificial Sequence
  Description of Artificial Sequence: Synthetic coding sequence
atgtggaccctgcgggccaccggccgggaggtgggcagcagcagctgtgaggacacagtggcgcctgtgccctacgagacactaaataagaggttcagagcggctcagaaaaatattgaccgggagacctctcatgtcaccatggtggtcgcggagctagaaaagacgttaagtgggtgtcccgctgtggactcggtggtgtctctgctggatggagtcgttgaaaagttaagcgttctcaaacgcaaagccgtggagagcatacaagcagaagacgaaagtgcgaaactttgtaagcggagaatagagcatctgaaagaacattcgtccgatcagccggcggccgcttccgtatggaagagaaagcggatggaccggatgatggttgaacaccttctccgctgtggatattacaatacggccgtcaaacttgcgaggcaatccggaatagaggacctggtcaacattgagatgttcctgaccgctaaagaagtcgaggaaagcctggaaaggagggagactgcaacttgtcttgcttggtgtcatgacaacaagtctagactgcggaaaatgaagagctgtctcgaattctcattgagaatccaagagtttattgagctgataagacagaacaaaagactggacgcagtgcggcatgccaggaagcatttctcccaagcggaaggctcccagctggatgaagtcagacaggcaatgggcatgctggctttcccacccgacacccacatctccccttacaaggatctgctggaccctgcccggtggcggatgcttatccagcagttccggtatgacaattatagactccatcagctagggaataactcagttttcactctaacactgcaggccgggctgtccgccattaaaacaccccagtgttacaaagaagacgggagtagcaaaagcccagactgcccggtttgtagccgctctctgaataagctggcacagccgctccccatggcacactgcgccaattcaaggctcgtttgtaagattagcggcgacgtgatgaacgaaaataaccctccgatgatgctgccaaacggctatgtttacggatataactcccttctgtctattcggcaagacgataaagtggtgtgccctcgtacaaaagaggtgtttcacttctcacaggctgaaaaagtgtatatcatgtag

SEQ ID NO: 193790 - DNA, 987 bp, Artificial Sequence
  Description of Artificial Sequence: Synthetic coding sequence
atggccgtgcaggagagcgccgcccagctgagcatgaccctgaaggttcaagagtaccccacccttaaagtgccgtacgagacgcttaataaaaggttcagggccgcccaaaagaacatcgatcgagaaaccagccatgtcacaatggtggtggccgagctggaaaaaacgctgtctggttgtcccgccgttgactcagtagtcagcttgttagacggggtagtagaaaaactgtcggttctgaagcgcaaagccgtcgaatcgatacaggctgaagacgaaagcgctaagttatgcaaaaggcgtatagagcacctgaaagagcattcctcagatcagcccgctgcagcgtctgtgtggaagcgaaaacggatggacagaatgatggtggagcacctcttgcgttgtggatattacaatactgcagtgaaactggcgcggcagagtggcatcgaaacctgtaagaaggctctgcagccctctaggagagagcctgccggcagaggcgccccgggacacggccatgcaggcctgcccgcccggcatgcacacctgccagtgcaaggaccatccggcccctgtactgtggctgatgccgaccctgcagtccctgtccgccaattacccaccaccccagctgggaaacagttctgcgtgcatccccatcctgccggatggccactgagccatcaggacacctgctataaagaagacggctcctctaagagtccggactgcccggtgtgttctcggtctctcaacaagctggcccagccgctgcccatggcccactgtgctaactcgaggcttgtgtgcaagatcagtggggacgtgatgaatgagaataaccctccaatgatgttgccaaacggctacgtgtacggctacaactctctgctctcaatcaggcaggacgataaagttgtgtgtccacgcaccaaagaagtcttccacttctctcaggccgagaaggtgtacatcatgtag

SEQ ID NO: 193791 - DNA, 1128 bp, Artificial Sequence
  Description of Artificial Sequence: Synthetic coding sequence
atggccgtgcaggagagcgccgcccagctgagcatgaccctgaaggtacaggaatatccaactctcaaagtaccgtacgagaccctcaataaacgatttagagcagcccagaaaaatatagaccgggaaacatcccacgtcacgatggtggtggcagaacttgaaaaactgagtgtcttgaagagaaaggccgtagagtcgatccaggctgaagatgaaagcgctaaattatgtaaacgcaggatcgaacacttaaaggaacattcctccgaccagcccgccgcggcctcagtgtggaagcggaagcgcatggacagaatgatggtcgagcacttgttaagatgcgggtattacaacacggctgttaagttggcccgccagtcagggatcgaggacctcgtaaacatcgagatgttcctcacggccaaggaggtggaagaatcgttggaaagacgcgagaccgcaacttgcctggcttggtgccacgacaataaaagccgtttgcgcaagatgaaatcttgcctggagttcagtctgcgaattcaggagtttatagaactgatcagacagaacaagcgcttagatgctgttcggcatgctcgcaagcatttctctcaggccgaaggatcccagctagacgaagtgcggcaggccatgggtatgctcgccttccctccggacacccacatatctccgtacaaggacctacttgaccccgccagatggcgcatgttgattcagcagttccgttacgacaactatagattacaccagctagggaataactccgtctttacactcacactgcaagccgggctcagcgctatcaagacaccccagtgttacaaggaggacggttcatccaagtcacctgactgcccggtttgctcccgctcccttaataaactggcacagcccctgccaatggcccactgcgccaatagcagactggtgtgcaaaattagcggcgatgtgatgaacgaaaataaccctccaatgatgctccctaatggttatgtgtatgggtataacagtttattatcaatacggcaggatgacaaagttgtgtgccctaggactaaggaagtttttcacttctctcaggcagaaaaggtgtacattatgtag

SEQ ID NO: 193792 - DNA, 1467 bp, Artificial Sequence
  Description of Artificial Sequence: Synthetic coding sequence
atggcccccgccgcctggctgcggagcgccgccgcccgggccctgctcccccctatgttgctgctgctgctgcagcccccacccttactagctcgggctctgcccccagacgcacaccacctccacgccgagcgccgaggtccccagccctggcacgcagccctcccaagttctccagcacctgcgcccgccacacaggaagcgcccagacctgcctctagtctcaggccaccgcgctgcggggttcctgacccctccgatggccttagcgccagaaatcggcaaaaaaggtttgtactatcaggtgggcgctgggagaaaaccgaccttacctataggatacttaggttcccttggcaactcgtgcaggagcaggttaggcagaccatggcagaagcactcaaggtgtggagtgacgtgacacccctcacgttcaccgaggtgcacgaaggacgcgcagacattatgatcgactttgcaaggtactggcacggggatgatttgcccttcgacgggccaggaggcatcctggctcacgcgttcttccctaaaacacacagagaaggcgacgttcattttgattatgatgaaacatggacgattggcgatgatcagggtaccgatctgcttcaggttgctgctcacgagttcgggcatgtgctgggcctccagcacactaccgctgccaaggctttaatgtctgcattctataccttccgctaccccctttcactctcgcccgacgattgtcgcggcgtgcaacacctgtacggccaaccatggcccactgtcacgagtcgcacaccagcactgggtccgcaggccggtatcgatactaacgaaatcgccccccttgaacctgacgcaccgccggacgcttgtgaagcctctttcgatgccgtcagcaccatccgcggcgaactattttttttcaaggcgggttttgtctggcggctgcgcggagggcaattacagcctggctaccctgcgctggcctctcgccattggcaagggctacctagtcccgtcgacgccgcattcgaagacgctcaggggcatatttggttcttccagggtgctcagtactgggtttatgacggggagaaacctgtcctgggccccgcacctctgactgaactcgggctcgtccgctttcccgttcacgctgctttagtgtgggggcccgagaaaaataagatctatttcttccggggacgcgactattggcggttccatcccagtacacggcgcgtcgattccccagtacctaggcgcgcgactgactggcgcggcgtgccatccgaaattgatgccgcgtttcaggatgccgacgggtacgcctatttcctgagaggcagactgtactggaagttcgaccccgtcaaggtcaaggccctggaaggcttccctcgtttagtgggacccgacttttttggctgtgctgagccagcaaatacattcctttag

SEQ ID NO: 193793 - DNA, 1563 bp, Artificial Sequence
  Description of Artificial Sequence: Synthetic coding sequence
atgcggaacaagaagatcctgaaggaggacgagctgctgagcgagacccagcaggcagcattccatcagattgctatggagcctttcgagatcaatgtgcccaaacctaaacgaaggaacggagtcaacttttccttggccgtggtggttatttatcttatcctactgacagccggcgcgggcctgcttgttgttcaggtgctcaatctgcaggcacgcctcagagtgctggaaatgtattttttgaacgataccctcgctgctgaggactctcccagcttttctctccttcagtccgctcacccaggcgaacatttggcacagggagcctctagactacaagtccttcaagctcagcttacttgggtgcgggtgagtcacgaacatctattgcagcgagtggacaacttcacacaaaatccagggatgttcagaataaaaggtgagcaaggagccccaggtctccaggggcacaaaggggccatgggcatgcctggagctccaggaccaccgggtccgcccgcagagaagggcgctaagggcgcaatgggtcgagacggcgccaccgggccctccggtccgcagggccctcctggggttaaaggcgaagctggtctgcaaggaccccagggggctcctggcaagcagggggccaccggtacccctgggcctcaaggggagaaggggtcaaagggggacggcggacttatcggcccaaagggggagacaggtactaagggcgagaaaggagacctcggacttccaggctccaaaggcgatcgcgggatgaaaggtgacgcgggggtgatgggaccccctggcgcccaggggtccaaaggcgactttggccgccctggacctcccgggctagcagggttcccgggcgctaaaggcgaccagggccagccaggcctgcagggagtcccaggtcccccaggtgcagtaggccaccctggggcaaaaggagagcctgggagtgcagggtcgcctggccgtgcgggacttcctggttcgcccggctccccgggcgccaccggactcaagggctctaagggggatacagggcttcagggccagcaaggcagaaaaggcgaaagcggtgtccctggacccgccggagttaagggcgagcagggctcccccggccttgcaggacctaagggtgcccctggacaagcagggcagaagggcgatcagggcgtcaagggttcgtcaggagagcagggagttaaaggagagaaaggcgaacgtggcgagaacagcgtctcagttcgcatcgttggcagctctaatcgtggtcgcgccgaggtttactactccggcacctggggcaccatctgcgacgacgaatggcagaactctgatgcaatagtgttttgtcgaatgctgggatactccaagggacgtgccctttacaaggtgggcgctggcaccgggcagatctggctggacaacgtgcagtgcagaggaacggagagcacgctgtggtcctgtaccaaaaacagctggggccaccacgactgctcacatgaggaagacgccggggtggagtgctcagtgtag

SEQ ID NO: 193794 - DNA, 1329 bp, Artificial Sequence
  Description of Artificial Sequence: Synthetic coding sequence
atgtacttcctgaacgacaccctggccgccgaggacagccccagcttcagcttgctacagagcgctcacccaggagagcaccttgcccagggcgcctctagattgcaggtactccaggcccagctgacctgggtgagagtcagccacgagcatctcttgcaaagagtggacaattttactcagaaccccggaatgtttaggatcaaaggagagcagggcgccccgggcctgcaggggcacaagggagccatggggatgcctggagccccgggccctcctgggccaccggctgaaaagggcgctaaaggagccatgggccgtgacggcgccactggcccatccggacctcagggcccacctggcgtgaagggggaagcaggattgcagggcccacagggcgcaccaggtaaacagggggcaacaggcacacctgggccacagggtgagaaagggagtaagggagatggcggcttgattggccccaagggtgagacgggcaccaaaggggagaaaggagacctcggcctgccaggttccaagggagaccggggtatgaagggggacgccggcgttatgggaccgccaggagctcaggggtcaaagggcgacttcggtcgccctggcccaccaggcttggctggctttcccggcgccaaaggtgaccaaggacagcctggcctacagggtgttcccgggcccccgggcgccgttggtcacccaggagccaagggggagccagggagtgccggatcacccggtcgggcaggattgcccggatctcccgggtccccaggcgccacaggactgaaaggttctaaaggcgatactgggctgcagggacagcagggccgcaaaggggaatccggagtgcctggtccagcgggggttaaaggggagcaaggatctcctgggcttgcgggcccgaagggagccccggggcaggctggacagaaaggcgatcagggcgtgaaaggcagcagtggcgaacagggagtcaagggcgaaaaaggcgagaggggcgagaattctgtctccgttcggatagtgggcagtagcaaccgtgggagagctgaggtgtactatagcggaacatggggtaccatctgcgacgatgaatggcaaaacagcgatgcaatcgtgttctgtcgcatgcttggctactccaaagggagagctttatacaaagtgggcgctggcaccggccagatctggctcgacaatgtgcagtgtcgcgggaccgaatcgactctttggtcttgtacgaagaactcttggggacaccatgattgtagtcatgaagaagatgcaggggtggagtgctccgtgtag

SEQ ID NO: 193795 - DNA, 1356 bp, Artificial Sequence
  Description of Artificial Sequence: Synthetic coding sequence
atggagcagtgggaccacttccacaaccagcaggaggacaccgacagttgttcggagtccgtgaagtttgatgcgcggagtatgactgccctgttgccgcccaaccccaagaacagcccttcactccaggaaaagctaaaatcctttaaggccgccctgatcgctttatacttgcttgttttcgccgtgctgattcctctgatcggcatcgtcgcagcgcagttattaaagtgggaaaccaagaactgtagtgtgtcatcaactaatgctaatgatattacgcagagtctgacagggaaagggaatgacagtgaagaagagatgcggtttcaggaagtgttcatggagcacatgtccaacatggagaagcgcatacagcatatcctggacatggaggctaatctcatggacaccgagcattttcagaacttttctatgacaacagatcagcggttcaatgatatcctgctccagctgagcacactgttctcatccgtccagggccacgggaatgccatcgacgagataagtaaaagccttatctcccttaatacaacactgttggatctgcagcttaatatagagaacctcaatggtaaaatccaggagaacaccttcaaacaacaggaagagatcagcaagctggaagaaagagtgtataatgtgagtgccgaaataatggcgatgaaagaagaacaggttcatttggagcaggagataaagggagaagtcaaggtgctaaacaacatcactaatgatctccggcttaaggactgggaacactcacagacccttaggaatatcactctgattcagggccccccagggcccccaggagagaaaggggaccggggacctactggagagtcaggcccaagagggtttcctggacctatcggtccaccgggactcaaaggcgatcgcggtgcaataggatttcccgggagcagaggtctgcccggatacgcgggcagaccaggcaacagcggccccaagggccagaaaggggagaaaggaagtggcaacactctcactccattcactaaggtgcggctcgtgggaggatcagggccacacgagggccgcgtcgagatcctacactctggtcagtggggtacaatttgcgatgacagatgggaggtccgggtgggacaggtggtgtgccgcagtctggggtaccccggagtgcaggcagtgcacaaagctgcacactttggtcaggggactgggcctatctggctgaacgaagtgttttgctttggccgcgagtcatcaattgaggaatgtaaaatccggcagtggggaaccagagcctgtagtcactccgaggatgctggggtgacgtgtacactgtag

SEQ ID NO: 193796 - DNA, 1167 bp, Artificial Sequence
  Description of Artificial Sequence: Synthetic coding sequence
atggagcagtgggaccacttccacaaccagcaggaggacaccgacagctgttccgagtcggtcaaatttgacgcacgctcgatgacagcccttctgcccccaaaccccaagaatagcccatcgctacaggaaaaactcaagtccttcaaggcagcacttattgcgttatacctgcttgtcttcgcagtgctcattcctctgatcggcatagttgctgcccagctgcttaagtgggagaccaaaaactgttctgtatcgtccacaaacgcaaacgatatcactcagtccttgaccggtaagggaaacgactcagaagaggaaatgcggttccaggaagtctttatggagcacatgagcaacatggagaaaagaatacagcacatcctggatatggaggccaatttgatggatacagagcatttccaaaacttctccatgactactgaccagcggttcaacgatatcttactgcaattaagtacccttttcagctctgtacaaggccatggtaacgctatagacgaaatttctaaatctctgatcagtctgaacacaacccttctggacctccaattgaatatcgaaaacctgaacggcaaaattcaagaaaacaccttcaagcaacaggaggagatctccaaacttgaggaaagggtgtataacgtatctgccgaaataatggccatgaaggaagagcaagttcacttagagcaggaaatcaagggcgaggtcaaggttctcaacaacataacaaatgacctcagactgaaagactgggagcactctcagaccctgaggaatatcactctcatacagggcccacccggaccacctggagagaagggagatagaggccctacaggcgagagcgggccacgcgggttcccagggcccatcggtcctcctggactgaagggcgacagaggcgcaatcgggtttcccggcagcagagggctgcccggatatgccggcaggcctgggaattctggcccaaaggggcagaaaggagagaagggtagcggcaatactctgagtaccggaccgatctggcttaacgaggtgttttgcttcggccgggagagtagcatcgaagagtgtaagattcgacagtggggcacaagagcgtgttctcacagcgaggacgccggcgttacgtgtaccctgtag

SEQ ID NO: 193797 - DNA, 1167 bp, Artificial Sequence
  Description of Artificial Sequence: Synthetic coding sequence
atggagcagtgggaccacttccacaaccagcaggaggacaccgactcatgttctgagtcagtgaagtttgatgcccggagcatgaccgcgctcctgcctccaaacccaaagaactccccgtcattacaggagaaactcaagagctttaaagccgccctgatcgccctgtacctgctggtctttgccgtgctgattcccctgattgggatagtagcggcgcaactcttgaaatgggaaaccaagaactgtagcgtaagctccactaatgccaacgatattacacagtctttaacaggaaagggcaacgactctgaggaggaaatgcgctttcaggaagtttttatggagcatatgagtaatatggaaaagagaattcagcatatccttgacatggaggcgaacctgatggacacggagcattttcagaatttcagtatgactacggatcagcgcttcaatgacattctgcttcaattatcgactctctttagctctgtgcagggtcacgggaatgccatcgacgagataagtaaatcactcatctccctgaacaccactcttctggatctgcaattgaacatagagaacctcaacggcaagatacaggagaacacatttaaacagcaagaggaaattagcaaactcgaagaacgcgtctataatgtttcagctgagatcatggcaatgaaggaggaacaggtacacctcgagcaggaaattaagggagaagttaaagtgctgaataacatcacaaacgatctgaggctgaaagattgggagcattctcaaaccctgagaaacattacactgattcagggccccccgggtcctcctggggagaaaggggacagaggcccaacaggtgagtctggccccagggggtttccaggacctatcggtcctcctgggttgaagggggatcggggggcaattgggtttcccgggtctcggggattgcccggctatgccgggcggcccgggaatagtggtcctaaagggcagaaaggtgagaagggctctggaaatactctaagtaccggccccatctggttaaacgaggtattctgcttcggccgcgaatccagcatcgaggagtgcaaaatccgacagtggggcacaagagcctgctcccacagtgaggacgcgggagtcacgtgcacactgtag

SEQ ID NO: 193798 - DNA, 1077 bp, Artificial Sequence
  Description of Artificial Sequence: Synthetic coding sequence
atggagcagtgggaccacttccacaaccagcaggaggacaccgactcttgcagcgagagtgtgaaattcgatgctaggtctatgacggccctactgcctcccaaccctaaaaacagtccttcactgcaggagaagctcaaaagctttaaagcagcacttatcgccctttacctcttggttttcgcggtgctcataccactgataggaatcgtagccgcccagttgttgaaatgggaaacaaaaaattgctcagtgtcctccaccaatgctaacgatatcactcagtctctgaccggcaaagggaacgacagcgaagaggagatgcgtttccaggaggtgttcatggagcacatgtcaaacatggaaaagcgcattcagcatatcctggatatggaagccaatttgatggatacggagcacttccagaacttttcaatgactaccgaccagcgcttcaatgacatacttcttcagttgtctaccctgttttcttcagttcagggccacggcaacgctattgacgagatatccaagagcttgatttcactcaataccactctgctcgacctgcaattgaacattgagaatttgaatggcaaaatccaagaaaatacatttaagcagcaagaagagatcagtaaactggaggagagggtgtataacgtcagcgcagagattatggctatgaaagaagagcaggtgcatttagaacaggaaatcaagggagaagtcaaagtgctcaacaatattaccaacgatctgaggctgaaggactgggagcacagccagactctgaggaatatcaccctgattcagggtcccccggggccaccaggcgaaaaaggagaccggggccctaccggcgaatctggcccaaggggattcccaggtccaatcggtcctcccgggcttaagggagacagaggagcaattgggtttccagggtcgcgtggattgccgggttatgccggacggccaggaaatagcggaccaaagggacagaaaggcgaaaagggctccggaaatactttacgccccgtccaacttactgaccacatacgggctggaccgtcttag

SEQ ID NO: 193799 - DNA, 1410 bp, Artificial Sequence
  Description of Artificial Sequence: Synthetic coding sequence
atgtgctacctgagcgccatcatcagcatcagcctgctgaacaagaagccaagtatggaacagtgggaccactttcacaaccaacaggaagacactgatagttgcagcgaatccgtcaagttcgatgcccggagcatgacagctctgctccctccaaaccccaagaatagcccgtccctgcaggagaaactgaagtcatttaaagcggctttgatcgccttatatcttctcgtatttgccgtgctaattccgctgattggaatcgtcgcggcgcagctccttaagtgggagaccaaaaactgcagtgtctccagtactaatgccaacgacatcactcagagccttaccggcaaaggtaacgatagcgaggaagaaatgcgcttccaggaggtttttatggaacatatgtccaatatggagaaacggattcagcacattctagatatggaagccaacctgatggacaccgagcactttcagaatttcagtatgacaactgaccagcgattcaacgatattttgctccagttatcaacgctgtttagctcagtgcaaggccatgggaatgccatcgacgagatctctaaaagtctgatctccctaaacactaccctgctggatctccagctgaatatcgaaaatctaaatggaaagattcaggagaatacctttaaacaacaggaagaaatttcaaaactggaggaacgcgtttacaatgtgagcgctgagattatggccatgaaggaagagcaggtacatctggaacaggaaatcaaaggagaggtgaaggtcctgaataacatcacaaatgatctgcggcttaaggactgggagcattcccagactttacgcaatattacattaattcagggccctccgggtcctcctggggaaaagggagacaggggtccaacaggagagagtggccccagagggtttcccgggcccattggaccgccaggtctcaaaggtgataggggagcgatcggcttcccaggcagcagaggactccctggctacgctggcagaccagggaattccgggccaaaaggccaaaagggcgagaaggggtccggcaatactctgacgccttttaccaaagtgagactggtgggcggctctggaccacacgaggggagggtggaaattttgcatagcggtcagtggggaacaatatgcgacgaccggtgggaggtgagagtaggacaggtcgtttgtagatctctggggtaccctggggtgcaagccgtgcataaagccgcccacttcggtcagggcacaggccccatctggctgaacgaggtgttttgcttcggtagagaaagtagcatcgaagaatgcaagatccgccagtggggcacccgtgcctgctcacattctgaagatgctggcgtgacatgcaccctatag

SEQ ID NO: 193800 - DNA, 195 bp, Artificial Sequence
  Description of Artificial Sequence: Synthetic coding sequence
atggagcagtgggaccacttccacaaccagcaggaggacaccgacagctgtagtgaatccgttaaatttgatgctcggtcaatgacagccctgctgcctcctaacccaaaaaattctccatcactgcaggagaagctcaagtcctttaaggcggcattgatcgcactctacctgctcgtgttcgccgtgttatag

SEQ ID NO: 193801 - DNA, 399 bp, Artificial Sequence
  Description of Artificial Sequence: Synthetic coding sequence
atggccatgaaggaggagcaggtgcacctggagcaggagatcaagggggaagttaaagttctgaacaacatcaccaacgacttgagactgaaagactgggaacatagccagactctccgcaacatcactctgatccagggcccccccgggcctcctggagagaaaggggatcgcgggccaactggtgaatccggcccaagagggtttccaggacccattgggcctcctggactcaaaggcgaccgtggagctatcggatttcccggaagccggggtctgccaggatatgccggacgccctggaaattcgggacccaaggggcaaaagggtgaaaaaggctccggaaacacactcagaccagtccagttgaccgatcatattagagccgggccttcttag

SEQ ID NO: 193802 - DNA, 4203 bp, Artificial Sequence
  Description of Artificial Sequence: Synthetic coding sequence
atggagctgctgccccccctgccccagagcttcctgctgctgctgctactaccagccaaaccggctgccggagaggattggcagtgtccaagaacaccctacgccgcgagcagggactttgacgtgaagtatgtggtccccagtttcagcgctggtggtcttgtccaggccatggttacatatgagggtgatcgcaacgagtctgctgtttttgtagctattcgcaatcgcctccatgtgcttggtccggatctgaagagtgtccagtctctggcaacgggccccgccggcgaccctggatgccagacctgcgcagcttgcggccctggtcctcacggcccacctggagataccgatactaaagtactcgtgttagatcccgccttgcctgctctggtcagctgtggcagttctctgcaggggagatgcttcctgcacgatttagaacctcaggggaccgccgtccatctggcggctcctgcatgtctgttctctgcccaccataaccgccctgacgattgcccagattgcgtcgcatcccctctcggtacgcgggtgactgttgtggaacaggggcaggccagctacttctacgtcgcctcatcccttgacgctgcagtggccgcctcattttcccccaggtccgtctccatcagacggcttaaagccgacgcatcaggatttgcccctggttttgtggctctgtccgtgctgcccaagcacctcgtgtcctacagcattgagtacgtacactcctttcataccggtgcttttgtatactttctgactgttcagccggcctctgtgaccgacgatccaagcgccctgcacacccgccttgccagactgtcagctactgagcctgagctgggcgactaccgagagctggtcttagattgccgcttcgcccccaagcggaggcggcgaggcgctcccgaagggggccagccttaccccgtcctccgcgtcgctcattctgcccctgtgggggctcagctagcaacagagctctcaatcgccgagggccaggaggtgctgttcggcgtcttcgtgaccgggaaggacgggggacctggggtagggcccaattccgtggtgtgcgcgttccctatagatctcctggacacactgatcgacgagggggtcgagcgctgctgcgaaagtccagtccacccaggactacgccgaggactggatttttttcagagcccttcattctgtcccaatcctcccggcctcgaagctctctcacccaatacaagttgccgtcatttccctctgctggtcagctctagcttctcccgggtggatctgttcaacgggctgctagggcccgttcaagtcacagccctctatgttacgcgtttagataacgtgacggtggctcacatgggaaccatggacggacgcatcctgcaggtggagctggtgcggtccttgaattacctcctgtatgtctctaacttcagcctcggggactcagggcaaccggtccaacgagacgtgtcccgcttgggggaccatttgttgtttgcctctggggatcaggtgttccaagtgcctatccagggaccaggttgtaggcacttccttacctgcgggcggtgtctgagggcctggcacttcatgggctgtgggtggtgtggaaacatgtgcggccagcaaaaggaatgccccgggtcttggcagcaggatcattgccctcctaaactcactgaatttcatcctcattccggcccactgcggggctctacacgattaaccctgtgtggcagcaacttctatttgcatccctcgggcctggtcccagagggcactcatcaagtgactgtcggacagtccccttgtcgaccattacccaaggacagttccaagttgagacctgtgcctcggaaggactttgtggaggagttcgagtgcgaactcgagccactaggcacccaggccgtcgggccgactaatgtatccctgacagtgactaatatgccaccaggaaagcattttagggtggatggcacctctgttctgagaggcttttctttcatggaacccgtactcattgcagtgcagccattgttcgggccccgggcgggcggaacgtgcctgactcttgaggggcagagcctgagcgtggggacgagtcgcgccgttcttgtgaacgggactgagtgccttcttgccagggtgagtgaaggtcagttgctttgtgccaccccaccaggcgcaaccgtggcgtctgtgccactcagtctgcaggtcggaggagcccaggtgccaggaagttggacattccagtatagggaggatccagttgtcctctccataagccccaactgcggatacattaattctcatattactatttgcggtcaacacctgacaagcgcctggcacttggtgctgtccttccatgacggcctgagagccgtcgagtcccgttgtgagcgtcagctgcctgaacaacagttgtgccgtttgccagaatacgtcgttcgggacccgcagggctgggtcgccggtaacctgtccgcccgcggcgacggagccgcagggttcacattaccaggctttagatttctccctccaccccacccaccgtccgccaacctcgtgcccctcaaacccgaggagcacgccataaagtttgaatatattggcttgggagctgtcgccgattgcgtagggataaacgtaaccgttggaggggagagctgccagcatgagttccgtggagacatggtggtctgtcctttacctccttccttgcagcttgggcaggacggggcgcccctgcaggtttgtgtggatggcgaatgtcacatccttggtcgagtagtacgccctggccctgacggggtgcctcagtcaactctgctcgggattttactccctctgttgcttttggtggctgctctggcgacggccttggtgttttcttactggtggagacgcaagcaactggtgctcccgcctaatcttaatgacctcgctagtttagaccaaaccgcaggggcaacacctctgcccattctgtacagcggctccgactatcgatccgggctggctctgcccgccatcgacggcttggactctactacctgcgtccacggagccagcttcagtgattctgaggacgagtcatgtgtgcccttgctgcgcaaagagtctatccagctgcgcgacctggattccgccctgttagccgaggtgaaagacgttctcatccctcacgagagggtggtgactcattccgacagagtgatcggtaaaggccacttcggagtggtgtatcatggagaatatatagaccaggctcagaataggattcaatgcgccataaagagcctaagcaggattacagagatgcagcaagtggaagctttcctgcgtgaaggcctgttgatgaggggactgaatcatccaaacgtcctggccctcattggtattatgctgcctcctgaaggattacctcacgtgctcctgccgtacatgtgccacggagacctgttgcagttcatacggtccccccagaggaacccaacggtcaaagatttgattagctttggcctacaggtggctagatccatggagtacctcgccgagcagaagtttgtgcatcgagaccttgctgctcgtaattgtatgcttgatgagagttttacagtgaaggtggcagacttcgggctagcacgggacatcctggatcgagagtactactccgtacaacaacaccgtcacgctaggctccccgtcaagtggatggcactggaaagcttgcagacttatcgctttaccactaagtctgatgtatggtccttcggcgtgctgctgtgggaactgctaacgagaggggcccctccgtatcgccacattgatccttttgacctgactcactttttggcgcagggcagacggctgccgcagcccgaatattgtcccgacagcttgtatcaggttatgcagcaatgttgggaagcagaccctgccgtgcgacccacgttcagggtgcttgtgggcgaggtcgaacagatcgtgtccgctctcctgggcgaccactacgtgcagctacccgccacctacatgaacctgggcccaagcacctcccacgaaatgaacgtgaggccagagcagccacagttctcacccatgcctggtaacgtccgcagacctagacctctctctgaaccaccacgacctacgtag

SEQ ID NO: 193803 - DNA, 4056 bp, Artificial Sequence
  Description of Artificial Sequence: Synthetic coding sequence
atggagctgctgccccccctgccccagagcttcctgctgctgctgctcttgccagccaaacccgccgctggcgaagattggcagtgccccaggacaccatacgcggcaagcagagattttgatgttaagtatgtcgtgccctcattttccgcggggggccttgttcaagccatggttacatacgaaggggatagaaacgaaagtgcagtgtttgttgctatcaggaaccggcttcatgttttgggcccagaccttaagtccgtacaaagcctcgctaccggtcccgccggcgacccggggtgtcagacttgtgcggcatgcggacctggaccacatggtcctcccggtgacaccgataccaaggtattagtgttagacccagcccttcccgccttagtgtcctgcggatcatctctccaaggccgttgcttcctgcatgaccttgaaccacaaggaaccgcggtgcaccttgccgctcctgcctgcctgttttccgcacaccacaaccggccagacgattgcccggattgcgtcgcctccccactcggtacccgggttactgtcgtggaacagggccaggcatcttatttttacgtagcgtcatccttggacgccgcagtcgctgcctcgttttctccgcgatcggtttcaatcaggcggctcaaggccgacgcgagcggctttgctccaggctttgttgcattaagcgtgctccctaaacatttggtgtcatattctattgagtacgtgcactcattccacactggtgcatttgtctatttcctgacagttcagccagcctccgtgaccgacgacccgagtgctcttcatacacgtcttgccagacttagcgccactgaacccgaactgggagactacagggaattagtgctagattgcaggttcgcccccaagcggcgtcggcggggggcccccgagggagggcagccctacccagtgctgcgcgtggcccactccgcccccgttggcgctcagctagcaacagagttgtcaatagcggagggtcaggaagtcttgtttggagtattcgtaaccgggaaagacggaggtcccggtgtgggccctaattccgtggtttgtgcatttcccatcgatcttctggacactctaatcgacgagggggtggagcgatgctgcgagtctccagtgcatccgggacttaggcgtggcctagacttctttcagagcccttcattctgtcccaatcccccaggactggaagccctgagtccaaacaccagctgtcgccattttcccctgctcgtatcaagcagcttttcacgtgtggacctgtttaacggactgctaggtcccgtgcaggtaacagccctctacgtaacgcgacttgacaacgttacagtagcgcatatgggtacaatggatggacggattttgcaagtcgagctcgtacgctccctgaactatctcctgtatgtctccaacttcagcctgggtgactccggacagccagttcaaagagacgtttccagactgggcgaccatctgttattcgcctcaggggaccaggtcttccaggtgcctattcaaggtccaggttgcagacacttcctgacttgcggcagatgccttagggcctggcacttcatgggctgcgggtggtgcggaaacatgtgcggacaacaaaaagaatgtcccgggagctggcagcaagatcattgcccaccaaagttgaccgagtttcatcctcattcggggccgctccgagggtctacaaggctgacactttgtgggtccaatttctatctgcacccgtctggcttagtgccagaagggactcaccaagtcaccgtcggtcaatccccatgcagaccactgcccaaggactcatctaaactccgacctgtaccccgcaaggacttcgttgaggaatttgagtgcgagttggagccattggggacccaggccgttgggccaacaaatgtgtctctgacagtgactaatatgccccccgggaagcacttcagggttgatggaacttctgtcttgaggggcttttctttcatggaaccagtgctgatcgcagtgcagccattgttcggaccgcgcgcaggcggcacatgcctgactctcgagggccaatcattaagcgttggcacctccagggccgtgctggtcaacggcacggagtgcttgcttgctagagtcagcgagggtcagctcctttgcgccaccccacccggggccactgtggccagtgttcctctgtccctacaagtgggcggtgcccaggtgcctggctcctggacattccaataccgcgaggaccccgtggtgctgagtatctcccccaactgtgggtacatcaactctcacataactatctgcgggcagcatctgacctccgcctggcacttggtgttgagttttcacgacggactgagggccgtggaatcccgctgcgagaggcagctgcctgaacagcagctctgtcgcctcccagaatatgttgtgcgagatccgcagggctgggtcgctggcaatctgagcgctaggggagacggcgccgctggctttaccctgccggggtttaggttcctgcctccaccccatccaccaagcgcaaatctagttcctctgaagcccgaggagcacgctataaaattcgaagtgtgtgtcgacggggagtgccacatccttgggcgagtggtcaggccaggcccagacggcgtgccccagagcaccctcctgggaatcctactgccgctgctcctacttgtggcggcccttgccacggccctggttttcagttactggtggaggaggaagcagctagtactgccaccgaatctgaacgacctcgcctcattagaccagaccgccggagctaccccattacccatcctgtatagcgggagcgactacaggtctggcctggcactgcccgccattgacgggctggactcaaccacctgcgtacatggcgcttctttctccgatagcgaagacgaaagctgcgtgcctctcttaagaaaagaatccattcagctgcgagaccttgactctgctttgctcgccgaagttaaagacgttctcatcccacacgaaagagtggtgacacattcggacagagttattggaaaggggcactttggcgttgtgtatcatggggagtacatcgaccaagcccagaatcgtattcagtgtgcaatcaaatctctgagcagaatcacagaaatgcagcaggtcgaggcattcttgcgtgagggtcttttaatgcgcggattgaatcatccaaacgtcctggcccttataggaatcatgcttccacccgagggcctgccacacgtcctcctgccttacatgtgccacggcgatctgttgcagtttatcagatccccccagcgcaatccaactgtcaaagatctcatttcctttggcctgcaggtagccagatctatggaatatctggcagaacagaagttcgtccaccgcgacctggctgctagaaattgcatgctcgatgaaagcttcactgttaaggtagcagattttggtctcgcccgggacattcttgacagggaatactactcagtacagcagcaccggcatgccaggttgcctgtgaaatggatggccctagagtcgctccagacctatcgcttcacaaccaagtctgatgtttggtcattcggcgtactgctttgggaactcttgacccgcggggctccaccttaccgccatattgacccctttgatcttacccacttcctggcacaggggaggcgcctgccacagcctgaatattgccccgacagcctataccaggtgatgcagcagtgctgggaagctgacccggccgtgcgtccaacatttcgagtgctggttggcgaagttgagcagattgtttctgctctgcttggcgaccactacgtgcagctgccggctacctacatgaacttgggaccaagtaccagtcacgagatgaacgtgaggcctgaacaaccgcagtttagtcccatgcctggaaatgtaaggagacccagaccactgtccgagccccctagacctacatag

SEQ ID NO: 193804 - DNA, 2157 bp, Artificial Sequence
  Description of Artificial Sequence: Synthetic coding sequence
atggaggacctgggcgagaacaccatggtgctgagcaccctgcggtctctgaataacttcatctcgcagcgcgtcgagggtggaagtggcttggatatttccacctccgctcccggttccctgcagatgcagtatcagcagagtatgcagctggaggaacgtgctgaacagatcagaagtaaatctcacctgatccaggtggaacgggagaaaatgcagatggagttgtcccataaacgtgctagggtggagctggaacgggctgcttccacaagcgcccgaaactatgaaagggaagtggaccgtaatcaggagcttttaactagaatcaggcagctacaggagcgcgaggcaggcgcggaggagaagatgcaggagcagctagagagaaacagacagtgccagcagaacctggacgctgccagcaaaagacttcgtgaaaaagaggactccctggctcaggcaggggaaacaattaacgccctgaagggccggatctccgagctacagtggtctgtgatggaccaagagatgcgggtcaagcgccttgagtcagaaaaacaggagcttcaagagcagttggatcttcagcacaagaaatgtcaggaagcaaaccaaaagatacaagagttacaggccagtcaggaagcccgagctgaccacgagcagcagatcaaggatctggaacaaaagctttcactacaggagcaggatgcggcgatcgtgaaaaacatgaagagtgagctagtgagattgccccggctagaacgagaactgaagcagttgcgggaggaatctgctcacttgcgcgagatgagggagacaaacggtcttctgcaggaggaactcgaaggactgcaaagaaagttaggccgccaagagaaaatgcaggaaaccctcgtcggcctagagctcgagaacgagcgtctgctggccaagctccaatcgtgggagcggctggaccagactatgggacttagcatcagaactccagaagatctaagccggtttgtcgtagagctgcagcagagagagctggcactgaaggataagaattcggctgtgacctcttctgccagaggcctcgaaaaagctcggcagcaactgcaggaagagctaagacaggtgtccggacagcttctcgaggaacgcaaaaagcgagaaacgcacgaagctttagcaagaaggctacaaaagagagttttactcctgaccaaggaacgagacggtatgagggctattttggggtcatacgactctgagctcaccccagctgaatacagtcctcagttgactcgccgtatgcgggaggccgaggatatggtgcaaaaggttcacagccactccgcagagatggaagcgcagctgtcacaagcactggaagaactcggtggtcagaaacagcgagcggacatgctggagatggagctcaaaatgttaaaaagccagtcgtccagcgctgagcagagctttctgttctcaagggaggaggccgatactctgagactgaaggttgaagaattggaaggcgaaaggagccgtcttgaggaggagaagcggatgctggaggcccagctcgaaagacgggctttacagggcgattacgaccagtcccgcaccaaggtcttgcacatgagcctgaatcccacaagcgtcgcccgccaacgcctgagagaggatcattcccaacttcaagcggaatgtgagaggctgcggggtcttttacgggctatggaaagagggggtacagtgccggccgaccttgaggctgccgccgctagcctgcctagctctaaagaggtggcagaactcaagaagcaggtcgagtccgcggagttaaaaaatcagcgtttaaaggaagtcttccagactaaaatccaggaattcagaaaggcctgctataccctgacaggataccaaatcgatattaccaccgagaaccaataccgcctgacttctttgtatgccgaacaccccggcgactgtctcattttcaaggcaacgagcccatccgggagcaagatgcagttgttggagacggagttctcccacacagtcggagagctcattgaggtacacctccgacgccaggactccattccagcgttcctcagctctttaaccctggaactgttctcccggcagacagtggcgtag

SEQ ID NO: 193805 - DNA, 2157 bp, Artificial Sequence
  Description of Artificial Sequence: Synthetic coding sequence
atggaggacctgggcgagaacaccatggtgctgagcaccctgcggtcgttgaacaactttatttcccagcgggttgaaggagggtcaggcctggatataagcacgagcgcacctggatcacttcagatgcaataccagcagtccatgcaactggaggaaagggcagaacagattaggtccaagagccatctcatacaggtggaacgggagaaaatgcagatggagctcagccacaagcgagcacgtgtcgaactggagcgcgccgcttcaacctccgctcggaattatgaacgcgaagtggatcgcaatcaggaactgctgactagaattcggcagcttcaggagcgggaagccggagcagaggagaagatgcaggaacagcttgagaggaaccgacagtgccaacagaatttggatgctgcctctaaaagattaagggagaaggaagacagtctggctcaagccggggaaaccattaacgccctgaagggccgcattagcgaactccagtggagcgtgatggaccaagagatgagggtgaagaggctcgagtctgaaaaacaggagttgcaagagcagttggacttgcagcacaagaaatgccaggaggccaaccagaagattcaggaattgcaggcctctcaggaggcaagggcagatcatgaacaacaaatcaaagacctggagcagaaactgagcctgcaggagcaggacgcagccatagtcaagaacatgaaatcggagctggtgcgcctcccccggttggagcgcgagctaaaacagttaagggaagagtccgcccatcttagagagatgcgagagacaaacgggctgcttcaggaggaactggaaggcctgcagcggaagctgggaagacaggaaaaaatgcaggagacattagtagggctagaattggaaaacgagaggctgctcgccaagctccagagctgggaacggctggatcagactatgggcctctcgattcggacgcccgaggacctgtcccgcttcgtggttgaattgcaacagcgggagctggcactgaaagataaaaacagcgctgtcaccagcagcgcaaggggcttggagaaggccagacaacagttacaagaagaactgaggcaagtcagcggccagctgctcgaagagcgcaagaagagagagacgcacgaggccttggcccggcgcctacagaaacgagtgctgctgctcactaaagaaagagacgggatgagggccatcttaggatcttatgattcagaactcacccctgcggaatatagcccacagttgacaagaaggatgagagaggccgaagatatggtccaaaaagtgcattcccatagcgcagaaatggaggctcagctctcacaggccctggaggaattaggaggtcaaaagcaacgggctgatatgctggaaatggagcttaagatgctgaagtcgcagtcaagctctgctgagcagtcttttctcttcagcagggaggaagcagatacactcagattaaaggttgaagaattggagggggaacgatcaaggttggaggaagaaaagcgcatgctggaggcgcaactagaacgaagagccctccaaggcgactacgatcaaagcagaactaaagtgttgcacatgtctctgaaccccacatccgtcgcacgccaaaggctcagggaagaccactctcagcttcaagcagagtgcgagcgcctgaggggactgctgcgtgccatggaaaggggcggcaccgtgccggctgacctggaggccgctgcagctagcctcccaagttctaaggaggtggccgaattgaaaaagcaggtggaatcagctgagctgaagaatcagcgactaaaggaggtgtttcagacaaaaatccaggaatttcgcaaagcttgctacaccctgactggctatcaaattgatattacaaccgagaaccagtacaggctgaccagcctgtatgccgagcatcccggcgattgtctaattttcaaggcgacatcacccagtggctcaaaaatgcagctcctggaaaccgagttttctcatacagttggggagctaatcgaggtgcacctaaggagacaggattctattccagcatttttaagcagcctcaccttggagcttttttcacgtcagactgtggcctag

SEQ ID NO: 193806 - DNA, 1881 bp, Artificial Sequence
  Description of Artificial Sequence: Synthetic coding sequence
atgctgcccgcccggggctgcgtgcggaagcggaccgtgtggcccaggctggcccgcgtgttgattgtgacactgctgacacttgagctgtcttatgctcctctgccatgtcagctcagcggcgtgccatacaatactggcgatccagtgggcaggtgggccaggccatgtatttggccctgtccttggcacactaccattaacgccctcaagggtcgtatcagcgagctccagtggtcggtgatggaccaggaaatgagagtgaagaggctagagtccgaaaagcaagagctgcaggagcaattggacctgcagcataagaaatgccaagaggctaaccagaagatccaggaactgcaggctagtcaggaagcccgtgcggaccatgaacagcaaatcaaagacctcgaacagaaactcagtctgcaagaacaggacgccgctatagttaagaacatgaaatccgaattggtgcgtttgccaaggctcgagagggaactgaaacagttaagagaagaaagcgcacatttaagggagatgcgagagacaaatggtttgctccaggaagaactggagggcctgcagaggaagctggggcggcaggagaagatgcaagagacattggtgggacttgagcttgagaatgagaggctcctggcaaagctgcaatcatgggagagactggaccagacaatgggactatcaatcaggactcccgaggacctgtctaggtttgttgtggagttgcaacagcgggagctggcactgaaggataagaactcagccgtaacatcatcagctcgcggcctggagaaggcaagacaacagctccaggaagaactacgccaggtgtccgggcagcttcttgaagagcggaagaagagggagactcacgaagcgttggcaaggcgcttgcagaagagagtgcttctgctgaccaaagagcgggatgggatgagagctatactaggttcttatgattctgagctcacgcctgccgagtactcaccacagttgacacgcaggatgagagaggccgaagacatggtgcagaaggtgcacagtcatagtgctgagatggaagcacaactgagccaggctctggaggaacttggggggcagaagcaacgcgccgacatgcttgaaatggagctgaaaatgctcaagtctcagagctcgtcagctgaacaatcttttctcttctcccgcgaagaagcggatactctgcggcttaaggtcgaggaacttgagggcgagcgctcaaggcttgaagaggaaaagaggatgctcgaagctcagctggaaagacgcgctttacagggagactacgaccagtccagaaccaaggttttgcacatgtctctgaaccccacgagcgtggcgaggcagagattgcgcgaggaccactcacagcttcaagcagaatgtgagcgactgagaggcctgctgagagccatggagcggggcggtactgtgccagcagacttagaggcagccgctgcctcattgccatcttccaaggaagtggctgagcttaaaaagcaagtggaaagcgcggaactgaagaaccagagattgaaagaggtctttcagacaaaaatacaggagtttcgtaaagcttgctatacactaaccgggtaccagattgacatcactacggaaaatcaataccgactgacgagcctgtatgctgagcaccctggagattgcctcatattcaaagcaacatcccccagcggctcaaagatgcagctattggagaccgaattctctcacactgtcggggagttaattgaagtgcacttgaggcgacaggattccatccccgctttcctttccagtctgacactggagctattttcccgccagaccgttgcctag

SEQ ID NO: 193807 - DNA, 2157 bp, Artificial Sequence
  Description of Artificial Sequence: Synthetic coding sequence
atggaggacctgggcgagaacaccatggtgctgagcaccctgcggtcgctgaacaacttcatctcacaacgtgtggagggagggtccggactggatatatctacatccgcacccggttctctccagatgcagtaccagcagtcgatgcagctggaggagcgtgcagaacaaatcaggagcaagtctcacctgatccaggtggaacgggagaaaatgcagatggagttgtctcataagcgagcacgagttgagttggagagggctgcctcaactagcgcccgtaactatgaacgcgaggtggatcgcaaccaagagctgttgactcggattagacagctgcaggagagggaggctggcgccgaggaaaaaatgcaggaacagctggaacgcaatcggcaatgccagcagaatttagacgccgcttcaaagcgcctgcgggagaaagaagactcgcttgcgcaggctggggaaaccatcaacgcactgaagggacgcataagtgagctgcaatggagcgtgatggatcaggagatgagggtgaaacgcctagaaagtgaaaaacaggaactgcaggagcagcttgacttgcagcacaagaaatgccaagaagctaatcagaagattcaggaactgcaggcctcccaagaagcgagagcggatcatgagcaacaaatcaaggatctggagcagaagctgagcttacaggaacaggatgccgctattgtgaaaaacatgaagtcagagctggtgcgtctgccccgactggagagagaactcaagcagttgcgggaggaatccgctcacctgcgggaaatgagggaaacaaatggactgctgcaagaagaattagaaggtctgcagaggaagctgggcaggcaggagaagatgcaggaaaccctagttgggcttgagctggaaaacgagcgtctccttgccaaactacagtcttgggagaggcttgatcaaactatggggctgagcattcgcaccccagaagacctgtctcggttcgtagtggagctgcagcagagggagttagccctcaaggacaagaattctgctgtcacgagctctgccagagggcttgaaaaggccaggcagcaactccaggaggagttgcgccaggtgtcaggccagctgctcgaggagcgtaagaaacgggagacgcacgaagcattggctcggcgcttgcagaagcgggttctgctgctgacaaaagagcgggatggcatgcgggccatcctgggaagctacgactctgagcttactccggccgaatattctccccagcttacacggaggatgagggaggcagaagacatggtccagaaagtgcatagtcattctgcagagatggaggcgcaattatcgcaggcactggaagaactgggtggccaaaaacagcgcgccgacatgttggaaatggaactaaagatgcttaagtcccaatctagttcggccgagcagtctttcctgttttctcgagaagaggcggacacgctccggctgaaagtagaagaactggaaggggagagatcccgattagaggaagagaagcgcatgctggaggctcagcttgaaagacgcgcactgcagggagattacgaccagtcgcgtaccaaggtcctgcacatgtctttgaatccaacttccgtggctcgccagcgtctccgggaggaccattcccagttacaagctgagtgtgagaggctccgcggtttactacgtgcaatggagagggggggcactgtcccagccgacctggaggcggccgcagctagcctgccctcatcaaaagaggtggccgaactgaagaagcaagtggagtctgccgagttgaagaatcaaagactcaaagaggtctttcagaccaagatccaagagtttagaaaggcttgttacaccctgaccggttaccagattgatatcactacggagaatcaatataggctgacgtccctttacgctgaacaccctggcgactgcctcattttcaaagccacctccccgagcggaagcaaaatgcagctacttgagacagaattctcacacactgtcggggaactaatcgaggttcatctgcgaagacaggactcaatccccgctttcctgtcgtcgctaaccttagagcttttttctagacagaccgtcgcttag

SEQ ID NO: 193808 - DNA, 474 bp, Artificial Sequence
  Description of Artificial Sequence: Synthetic coding sequence
atggaggacctgggcgagaacaccatggtgctgagcaccctgcggtctttgaataattttatctctcagagagttgaagggggttcaggcctggatattagtacctccgccccaggttctctgcagatgcaatatcagcagtcgatgcagcttgaggagcgggccgagcagatccgaagcaaaagccacctgatccaagtcgaacgggagaaaatgcaaatggagctgagccacaaaagggcccgcgtcgagttggagcgtgcggctagtaccagtgctcggaactacgagagagaggtggatcgcaatcaagagctgctgaccaggatcagacagttacaggagcgggaagcaggcgccgaggaaaagatgcaagaacagttagaacgcaacagacaatgtcagcagaacctggacgccgccagcaaacgattacgagagaaggaggactctctggcccaggccggggaatag

SEQ ID NO: 193809 - DNA, 810 bp, Artificial Sequence
  Description of Artificial Sequence: Synthetic coding sequence
atgcgggagctggagttcgccaagctggagtgctgcctggcctggcagcttcaggctagccggcgggagctggagatggagctgaaaatgcttaaatcccagtcatcctccgcagaacaatctttcctattctcacgcgaggaagctgatactctgcggctaaaggtcgaagagttggagggagagaggtccaggctggaagaagagaagagaatgcttgaagcgcaactcgagaggagagctctgcagggagattatgatcagagccgtaccaaggtgttgcatatgagtctgaatcccaccagtgtagcacgccagcggctgcgcgaagatcactcacagctccaggccgagtgcgagaggttgaggggacttctgcgagcaatggaaagaggggggactgtgcccgcagatctggaggcggccgcagcttctctgccgagttccaaagaagtagccgagctgaaaaagcaagtagaatccgcagagttgaaaaaccagaggctcaaagaggtgttccagacaaagatccaggagttccggaaagcttgctatacactgactgggtatcagatcgacattaccactgaaaatcaataccggctaaccagcttgtatgcagagcaccccggggactgcttaatctttaaggctacctctccttccggatctaaaatgcagctgctggaaacagagtttagtcacacagtgggtgagcttattgaagttcacttgagaagacaggacagcatccccgctttcttgagcagtctgaccctagagttattttctcgtcaaacagtagcctag

SEQ ID NO: 193810 - DNA, 618 bp, Artificial Sequence
  Description of Artificial Sequence: Synthetic coding sequence
atggccctgcagctgagccgggagcagggcatcaccctgcggggcagtgccgagattgtggctgagttctttagttttggaatcaactctatcctttatcaacgcgggatctaccctagcgaaaccttcactcgcgtccagaagtacggtctgaccctattagtcacaaccgatcttgagctgatcaaatatctcaacaacgtggtagagcagttaaaggattggctctacaaatgctcagttcagaaactcgtggttgtcatttcaaacatcgagtccggcgaagttctggagcgttggcagtttgacattgaatgcgacaagaccgctaaagacgactctgcaccccgagaaaagagtcaaaaggccattcaggatgagatccggtcagtcattagacagatcacagccactgtgaccttcctgccactccttgaagtcagctgctcctttgatttgctgatctatacagacaaagacctggtggttcccgagaagtgggaagaatccggaccacaatttattacgaattcagaggaagtgcggctcagatccttcaccaccacaatccacaaagtcaattcaatggtggcatataaaataccagttaacgattag

SEQ ID NO: 193811 - DNA, 1212 bp, Artificial Sequence
  Description of Artificial Sequence: Synthetic coding sequence
atgcccaaccggaaggccagccggaacgcctactacttcttcgtgcaggaaaagatcccagagctgcgacggcgcgggctgccagtcgctcgggtcgcagacgctattccatactgctcctctgattgggccaagcccgtttttacgccactgcggcgcccggggatgctggtgcccaagcaaaacgtgtcgcctccagatatgtccgcactcagtcttaagggggatcaggcgctactcggcggcatcttttattttctgaatattttttctcatggagaactgcccccccactgcgaacagcgctttctgccctgtgagatcggttgcgtgaaatacagcctccaggagggtatcatggcagactttcattcattcattaatcccggggagatccctcgaggcttccggtttcattgccaggccgcgagtgactcctcgcataagatcccaatctcaaactttgaacggggccataatcaggcgacagtgctccagaatctctatcgctttatccatccaaaccctggcaattggccgccgatatattgtaaaagcgatgacagaactagggtcaattggtgtttaaaacatatggctaaggcatcggaaatcaggcaagacctccaactgctcacagtggaagacctcgtggtaggcatttaccaacagaaatttcttaaggagccatccaaaacatggatccgcagcctgctcgatgtggccatgtgggattattcttccaacacaaggtgcaagtggcacgaagagaatgacattcttttttgtgccttggctgtatgcaagaagatcgcgtattgtattagtaactcacttgctaccttattcgggattcagctgactgaagcacacgttccgctccaggactacgaagcatccaattctgtgaccccaaaaatggtggtgctcgatgccgggcgctaccaaaagctgcgggtgggtagcagcggcttctctcatttcaattcatctaacgaggaacagcggagtaatacgcctataggtgactacccttcccgagcaaaaatttcaggccagaattcttccgttaggggaagagggataactagactgttggagtctatcagtaatagcagttcaaacatacacaaattttctaattgcgatactagcctgtccccatacatgagccagaaggacgggtataagagcttttcatcgctctcttag

SEQ ID NO: 193812 - DNA, 1305 bp, Artificial Sequence
  Description of Artificial Sequence: Synthetic coding sequence
atgcccaaccggaaggccagccggaacgcctactacttcttcgtgcaggaaaaaatccctgaactgcggaggcgcggccttcctgtggcgcgggtagccgatgctataccttactgttcttctgactgggctttgctgagagaggaggagaaggaaaagtacgcggaaatggctagggaatggcgggccgcccagggaaaagaccccgggcctagcgagaaacagaagcctgtcttcacccccctccggcgccccggaatgctcgtgcctaaacagaatgtttcaccacctgacatgtcagctctaagcctgaagggagaccaggccctgctgggcgggatcttctacttcctcaacatcttctcacacggagagttgcctcctcattgtgagcagcggtttttaccttgtgagatcggctgcgttaagtattcattgcaggagggtatcatggctgatttccacagctttattaaccccggcgagatccccagaggcttccggttccactgtcaggctgcgagcgatagctcacataaaatcccaatctccaactttgaaagaggccataatcaggctaccgttttgcaaaacctttaccggttcatacaccctaatcctggcaattggccccccatctactgtaagtccgatgacagaacaagagtcaattggtgtctgaagcatatggctaaagccagtgagattcgccaagacttgcaacttctcactgttgaggacctggtggtgggtatttatcagcaaaagtttctaaaggaacctagcaagacttggattaggagtctccttgatgttgctatgtgggactacagttcaaacacccgttgcaaatggcatgaagaaaatgatattctgttttgcgcgctcgcagtgtgtaagaagatcgcatattgcatctccaattctttagctaccctgtttggcattcaactcacagaggctcacgtccccctgcaggactacgaggcttccaattctgttactcccaagatggtcgttctagatgcaggacggtaccagaagctacgggtgggaagctccggattctctcacttcaattcctccaatgaagagcagagaagcaacacgccaatcggcgactatccctcgagggccaagatttccgggcagaactctagcgtccggggccgggggataacaagattattagagtccatctccaacagcagctctaacatacataagttctcaaactgcgacaccagcctatcaccttacatgagtcagaaggacggttacaagtctttttcctccctgagctag

SEQ ID NO: 193813 - DNA, 951 bp, Artificial Sequence
  Description of Artificial Sequence: Synthetic coding sequence
atgcccaaccggaaggccagccggaacgcctactacttcttcgtgcaggagaagatccccgagctgcgtcgcagaggcctgcctgtcgctcgagtggcagacgccattccctactgttcttctgactgggccaaaccggttttcacccctctgcgtcggccgggcatgttagtccctaaacagaatgtgtccccgcctgacatgtccgccttgtccctgaaaggagaccaggctctcctcggcggcatcttttactttctaaacatctttagccacggtgagcttccaccacactgcgagcagcggtttctgccctgcgaaataggttgcgtgaaatactccctccaggagggcattatggcggactttcactcttttattaatcccggcgaaattcccaggggatttcgtttccactgccaggctgccagtgacagttctcacaaaatcccaatttcaaattttgaacggggccataaccaggccactgtcctacaaaatctgtacaggtttatccacccaaacccaggtaactggccccccatttattgtaagtccgacgacaggacgagggtcaattggtgtcttaagcacatggcaaaggccagtgaaattcgccaggacctgcagctactgacagtggaggatctggtagttggtatttaccagcagaaattcctgaaagagccctccaaaacatggattcggtctttgctggacgtagctatgtgggactactcgagtaataccaggtgtaaatggcacgaggagaatgatattctgttttgcgcccttgctgtctgcaagaagatcgcttattgtatcagcaattcacttgctactctgtttggaatccagctgactgaagcccacgtccctttacaggattatgaagccagcaattctgttacacccaaaatggtggtgctagatgcgggtcgctaccagtag

SEQ ID NO: 193814 - DNA, 471 bp, Artificial Sequence
  Description of Artificial Sequence: Synthetic coding sequence
ctgctgcagcggtgcaagtggcacgaggagaacgacatcctgttctgcgctctcgcagtgtgcaaaaaaatcgcctactgtattagtaacagcctggccaccttattcgggatccagctgacggaggctcatgtcccgctgcaggattacgaggcctctaacagcgtcacgccaaagatggtggtgctcgatgcggggcggtatcagaaattaagggtcggatctagtggattcagccatttcaatagtagtaacgaggaacaacggtccaacaccccgatcggggattatccctctagagccaagatcagtggacagaactcctctgtaagaggcagaggcatcactagactccttgagtccatttccaacagcagtagcaacatacataaattctctaactgtgatacgtccctgtctccctacatgagccagaaggacggttataaatctttttctagtctgtcttag

SEQ ID NO: 193815 - DNA, 747 bp, Artificial Sequence
  Description of Artificial Sequence: Synthetic coding sequence
atggaccagcggcagcggcggatcctgggccagcccctgagcatccccacttcccaacctaagcaaaaacgcacatccatgattagcttcttctcgaaggtgtcttggaaactcagattccagaagagggagcctctgaaaaacgtgttctttattctggcggagagagctagggatccctcagcgaaaaagcggcatatggccatgagaaacctggggacaatggcttatgaagcgcccgacaaagtccggaaatataaaaagattgttcttgacctgctcgtttatggcctgtacgaccccgtgaaccttgaggtgattcacgagagcatgaaaacacttacggttgtcctcggcaagatccaggggaagggcctcggttcttttttcatcgacattacacttcagacccgtactctgctggatgatgaaaatgactccttgaggtacagcgcattcgtactctttgggcagctggctgctttcgccgggcggaagtggaaaaagttcttcactagtcaggtgaaacagacacgggattcacttttaatccaccttcaggatcgcaacccacaagtagctaaggcatgtaagaccacctttcaggcatgcagtccttatcttaaattgaaagaggaatattcttttcagtcagaagaggaccagagaaataccaagctgtaccaacagctctcccactatcacccagaaatacttcaattcttttatgccaacaagatattgtag

SEQ ID NO: 193816 - DNA, 747 bp, Artificial Sequence
  Description of Artificial Sequence: Synthetic coding sequence
atggaccagcggcagcggcggatcctgggccagcccctgagcatcccgacttcccagccgaagcagaaacggacctcgatgatatcctttttctcaaaagtgtcttggaagttaaggtttcagaaacgggagcccctgaagaacgtgttctttatactggctgaacgtgccagagaccccagtgccaaaaagagacatatggccatgcgaaatctgggtactatggcctacgaggcgcccgacaaagtgagaaagtacaaaaaaatcgtgcttgatctcctcgtctacggactgtatgaccctgttaatctcgaagtgatccacgagagtatgaaaactctgaccgtggtcctcgggaagatacaaggaaaagggctgggcagcttttttattgatatcacactccagactcgcactctacttgatgacgagaacgactctctaagatatagtgccttcgtgttattcggccaactggccgcattcgctggccggaagtggaaaaaattttttacatcacaggtgaagcagacaagagacagcctcttgatccacttacaggatagaaatccgcaggtcgccaaggcgtgcaaaacaacctttcaggcgtgttctccgtatctgaagttaaaagaggagtacagttttcagtcagaggaggatcaacgaaacaccaaactctatcaacaactcagccactatcaccctgaaatcttgcaattcttctacgccaataagattttgtag

SEQ ID NO: 193817 - DNA, 591 bp, Artificial Sequence
  Description of Artificial Sequence: Synthetic coding sequence
atggaccagcggcagcggcggatcctgggccagcccctgagcatccccacctcccaaccaaagcagaagagaactagtatgataagtttctttagcaaagtgtcctggaagcttcgctttcagaaacgggagcctcttaaaaacgtctttttcattctggcggagcgagctagagacccatccgccaagaagagacacatggctatgcgcaatctcgggaccatggcgtatgaggcacccgacaaagtcaggaagtacaagaagatcgtgcttgatttgcttgtctatggcctttacgaccctgttaatctggaggttatacatgaatctatgaaaacccttacagtggtcctgggtaagatacagggcaaaggactcgggtccttttttattgacatcactctgcagacaagaacactgctggatgacgcctgcaaaactaccttccaagcgtgcagtccatatttaaaacttaaggaggagtactccttccagtcggaagaggaccagaggaacactaaactctatcaacagctttctcactatcatcccgaaatcctccagttcttctatgcaaataaaatcctgtag

SEQ ID NO: 193818 - DNA, 633 bp, Artificial Sequence
  Description of Artificial Sequence: Synthetic coding sequence
atggcctggggcagcaagggcatccagggctgggagaacctggccgagtctagtcacctggccacaacccgtgagtcatctccccctgagtcaggaaccggctccggcagcagccgcggaagtcggttgcaggaacctcaggtgtcttggaagctacggtttcaaaaaagagagcctctgaaaaatgtgttctttattctagcagagagggcacgtgacccaagcgccaaaaagagacacatggcaatgagaaatctcggaaccatggcatatgaggccccagacaaagtgcgcaagtacaaaaaaatcgtcctggacctgctcgtgtatggcctgtacgacccggtgaaccttgaagtcatccatgagtcaatgaagacccttactgtggtcctgggcaagatccaaggcaagggtcttgggtcattctttatcgacattactctccagacaaggacgctgcttgatgacgcatgcaaaactacatttcaggcgtgcagtccctatcttaagctaaaggaggagtacagcttccagtccgaggaagaccagcgtaacactaagctgtaccagcagctttcacattatcaccctgaaatcctccagttcttttatgccaataagattctatag

SEQ ID NO: 193819 - DNA, 789 bp, Artificial Sequence
  Description of Artificial Sequence: Synthetic coding sequence
atggcctggggcagcaagggcatccagggctgggagaacctggccgagagctcccatctggctactaccagggaatcctctccgcccgagtcaggaacaggatcaggctctagtcgtggatcccgtctgcaggagccacaggtttcttggaaactgcgctttcagaagagggagccgttgaaaaatgtcttttttattcttgccgagagagcccgcgatccctcagctaaaaagcgtcacatggctatgcgcaacctgggcacaatggcttacgaagcacccgataaggtgcgcaaatataagaagatcgtgcttgaccttctcgtgtatggcctgtacgatcctgtcaatctggaggttattcacgaatctatgaaaacactgactgtcgttctgggtaaaattcagggcaagggccttggatctttctttattgatatcactctgcagactcgaacattattggacgatgagaatgattccctgcggtacagcgctttcgtcctgtttgggcaattggcagctttcgccggccggaagtggaagaaattcttcacgagtcaggtaaagcagactcgcgactctctgctcatccacctgcaggaccgcaacccgcaggttgccaaagcttgcaagactacttttcaagcttgcagtccctacttgaagctcaaagaagaatacagtttccaatcagaagaggaccagcgtaatacgaagttataccagcagctgtcgcactatcaccccgagattctacaattcttttacgccaataaaatcctgtag

SEQ ID NO: 193820 - DNA, 591 bp, Artificial Sequence
  Description of Artificial Sequence: Synthetic coding sequence
atggaccagcggcagcggcggatcctgggccagcccctgagcatccctacttcacagcccaagcagaagagaaccagtatgataagtttctttagcaaagtgtcttggaaactgcgcttccagaaacgagagcccttgaagaacgtcttctttattctggccgagcgggctagggatccatccgccaagaagaggcacatggccatgagaaacttaggaaccatggcatatgaagctccagacaaagtgcgcaagtacaaaaagatcgtactcgatctcctcgtttatggtctgtatgatccagtgaacctggaggtaattcatgagagcatgaagaccctgactgtagtattaggaaagattcaaggcaaaggtttagggtcttttttcattgatataaccctgcagaccaggaccttactcgacgatgcctgtaagaccacctttcaagcatgtagtccgtatctcaagttaaaagaggaatactcctttcagtccgaagaggatcagcggaacacaaagctgtaccagcaacttagccactaccatcctgagatactgcagtttttctatgcaaataaaattctatag

SEQ ID NO: 193821 - DNA, 771 bp, Artificial Sequence
  Description of Artificial Sequence: Synthetic coding sequence
atgaagctgctggagaacagcagcttcgaggccatcaacagccagttgacagttgagaccggagacgcacatatcataggacgaattgaatcctactcttgcaagatggccggggacgacaagcacatgttcaaacagttctgtcaggaaggtcaaccccatgttcttgaggcgctgtcacctcctcaaacatcagggttgtccccttctcggctgagcaagagccaggggggcgaggaggaaggccctctgtctgacaaatgttcaagaaagactctcttttacctgattgctactctgaatgaaagttttcgtccagactatgacttctccacagcaaggtcacatgagttcagcagggaacctagcctctcttgggtcgtcaatgctgtcaactgcagcctgttctcagcagtccgtgaagatttcaaggatctcaagccacaactctggaatgcagtagatgaagagatatgcctggcagaatgcgacatttatagttacaatcctgacctagactcagacccttttggcgaagatgggagcctgtggagtttcaattactttttttacaataaacgactgaagcgtatagtttttttctcttgccggtccatctctggatcaacctacacgccgtcggaggcggggaatgagctggacatggagctcggagaggaagaagttgaggaggagtctcggtcaggcggaagtggagctgaagaaacctccacgatggaggaagatcgggtccccgtaatttgcatatag

SEQ ID NO: 193822 - DNA, 213 bp, Artificial Sequence
  Description of Artificial Sequence: Synthetic coding sequence
atgaagctgctggagaacagcagcttcgaggccatcaacagccagctgaccgtcgagacgggcgacgcccacatcatcggacggattgagagctacagttgtaagatggccggtgatgataaacacatgtttaaacaattttgtcaggaaggccagccgcacgtgttggaggcactgtcacctcctcagacctccggactatcccccagctag

SEQ ID NO: 193823 - DNA, 771 bp, Artificial Sequence
  Description of Artificial Sequence: Synthetic coding sequence
atgaagctgctggagaacagcagcttcgaggccatcaacagccagcttaccgtcgagacgggtgacgctcacatcatagggcgaatcgagtcctattcctgcaaaatggccggcgatgacaagcatatgtttaagcagttctgtcaggaggggcagcctcacgtgctggaggcactgtctccaccccagacttccggcttgtcccccagcagactctccaagagccagggaggggaggaggaagggccactatcagacaaatgttctcgtaaaacactcttctaccttatcgcgactcttaacgagtcatttcgccctgactacgacttcagtaccgcgcggagtcatgagttttcacgtgagccatctttgagctgggtcgtaaacgctgtcaactgctcactgtttagcgccgttcgagaggatttcaaggatctgaagccgcagctgtggaacgccgttgatgaagaaatttgcctggctgagtgtgacatctacagctataatcccgatttggacagcgacccatttggagaagacggatcactttggtccttcaactacttcttctacaacaaaaggctgaaaagaatcgtcttcttttcttgcagatcaatctccggcagcacttatactcccagcgaagccggcaacgagctagatatggagctgggggaggaggaagtagaggaggaaagtagaagtggcgggtccggagccgaggagactagcacgatggaggaggatcgggtgcctgtgatctgtatttag

SEQ ID NO: 193824 - DNA, 1104 bp, Artificial Sequence
  Description of Artificial Sequence: Synthetic coding sequence
atgcggaagggcaagggccccatctgcctgttcagccggcccaccctccgcccatcccggtccaaggtatccctgatcgaaggtcgcggggcaaacatggcggcgaggtggaggttttggtgtgtctcagtgactatggtggtggcacttctgattgtatgtgacgtcccaagcgcctcagctcagcgcaagaaagaaatggtgctcagcgagaaggtgtcgcagctgatggaatggacaaataagcggcctgtcattcgtatgaacggagacaagttcaggcggctggtcaaagccccccctagaaactatagtgtcatcgttatgttcacagctcttcagttgcatcggcagtgtgttgtatgcaaacaggccgacgaagaattccagatattagccaacagttggcgctattcgagcgcgttcaccaatcggatcttttttgctatggtggacttcgatgaagggagcgatgtgttccagatgctgaacatgaattctgcacccacttttattaacttcccggccaaggggaagccaaaacgcggcgacacctatgaacttcaggtcagaggatttagcgccgaacaaattgcgagatggatagctgacaggaccgacgtgaacatacgcgttattcgcccgccaaactatgcagggcctctcatgcttggactgttgctggctgtcatcggcgggttggtgtatctccgtaggtccaatatggagttcctgtttaacaaaactgggtgggcttttgctgccttgtgtttcgtgcttgccatgaccagcggccagatgtggaatcatatccgcggtccaccatatgcccacaagaatccacacacagggcacgtgaattacattcatgggagttcccaagcacagtttgtggccgaaacacacatagttttgctattcaatggaggtgtcaccttggggatggtcttgttatgcgaagccgcaaccagcgacatggatattggtaagcgcaagatcatgtgtgtggccggcatcgggcttgtagtcctcttcttttcatggatgctaagcattttccggtctaaatatcacggttacccatactccttcctgatgtcttag

SEQ ID NO: 193825 - DNA, 657 bp, Artificial Sequence
  Description of Artificial Sequence: Synthetic coding sequence
atggtggacttcgacgagggcagcgacgtgttccagatgctgaacatgaattctgcacccacatttatcaacttccccgctaagggaaaaccaaaaagaggcgacacctatgaactccaggtgcgaggatttagtgcggagcagatagcccgctggattgcggaccggactgacgtcaatattagagtgatcaggccaccgaactacgcaggccctctgatgctcggactactgctagccgtgattggcggactggtgtaccttaggcgctccaatatggaatttctatttaataagaccggctgggcttttgccgctctttgctttgttttggcaatgacaagtggacagatgtggaaccacatacgaggtcctccgtacgcccataagaatccacacacgggccacgttaactacatccacgggtcctctcaggcacagtttgtggctgaaactcacattgtgctgttgtttaatggtggcgtcaccctgggtatggtcctgctgtgcgaggctgccactagtgatatggacattggtaaaagaaaaatcatgtgtgtcgcaggaattggcttggtcgttctgttcttttcctggatgcttagcatcttccgatctaagtatcacggctatccctatagcttcctcatgtcctag

SEQ ID NO: 193826 - DNA, 330 bp, Artificial Sequence
  Description of Artificial Sequence: Synthetic coding sequence
atggagagcgacttctacctgcggtactacgtgggccacaagggcaaattcggtcacgagtttctcgagtttgaatttagacccgatgggaagctgcggtacgcaaataacagcaattataagaacgatgtgatgatccgaaaagaagaactggagattgtcataggcgatgagcatatttcatttaccacctcaaagatcggatccctgattgatgtgaatcagagcaaggacccggaggggctccgtgtgttctactatcttgtacaggatctgaagtgtctagtctttagcctgattggcctgcactttaagataaaaccaatttag

SEQ ID NO: 193827 - DNA, 441 bp, Artificial Sequence
  Description of Artificial Sequence: Synthetic coding sequence
atggagagcgacttctacctgcggtactacgtgggccacaagggcaaatttggtcatgagtttctcgagtttgagttcaggcccgatggcaagcttcgttatgccaacaacagtaactacaagaacgacgtcatgattcgcaaggaggcctacgttcacaagagtgtcatggaagagttaaaaaggatcattgacgactccgaaattacgaaggaggacgacgccctttggcctcctcctgatagagtgggacgccaagaactggagatagtcatcggcgacgagcatatcagtttcactacatcaaagattggaagcttgatagacgttaatcagtccaaagaccccgagggtctgcgggtgttttactacttggttcaggacctgaagtgcttggtgttctcactgatagggctccactttaagatcaaacctatttag

SEQ ID NO: 193828 - DNA, 1731 bp, Artificial Sequence
  Description of Artificial Sequence: Synthetic coding sequence
atgggcagcatcctgagccggcggatcgccggcgtggaggacatcgacatccaggcaaactcagcttatcgctatccccctaaaagtggaaattatttcgcttcacactttttcatgggcggagaaaaatttgatacacctcatcctgaaggctatcttttcggtgaaaacatggacttaaatttcctgggatcacgacctgtgcaatttccgtacgtgacgccagctccccacgaacccgtgaaaacactgcgcagcctcgtcaacatcaggaaagattcactgcgactggtgcgctataaggacgacgctgacagccccactgaagacggagataaacctagggtgctgtattcgttagaatttaccttcgacgcggacgccagggtcgccattaccatttactgtcaggctagtgaagaatttctcaatggacgcgcggtatactctccaaagtcaccatcgctgcagagcgagaccgtgcactataagcgtggggtgagccagcagttcagcctgccatccttcaaaatcgactttagtgagtggaaggacgatgaacttaatttcgatctggataggggggtgttccccgtggttatccaggctgtcgtcgacgagggcgacgtcgtggaagttacagggcatgcccacgtcttgttggcagccttcgagaaacatatggatggaagcttctcagtgaaacctctcaagcagaaacagattgtagacagagtgagttatctcctacaggaaatctacggtatagagaacaagaacaaccaggaaaccaaacccagcgacgatgagaacagcgataattccaacgaatgtgtcgtctgtctatctgacctcagggatacgctgatcctaccatgtcgtcacctctgcctctgcaccagctgcgcagatacactcaggtatcaagctaacaactgtcctatttgccgcctgccatttcgcgcacttcttcagattcgggctgttcggaagaagcctggcgctctttcgcctgtatccttttccccggtgctggcccagtccctggaacacgatgaacactcctgtcccttcaagaagagcaagcctcaccccgcgtccctcgcttccaagaaacccaagcgggagaccaactcagatagcgtacccccaggctacgagcctatttctttgctcgaagccctaaatggacttagagcggtctcaccagcgatccctagcgccccactgtacgaagagatcacatatagtgggatctccgacgggcttagccaggcatcttgccccctggctgccattgatcacattctggattcatcgaggcaaaagggacgcccacagagcaaggctcctgactctacactacggagcccctcctcccccatccacgaggaagacgaggagaagctgagcgaggatgtggacgcccctccccctctcggtggggctgaactggcgctgcgcgagtcctcatcgcccgaatcattcattacagaagaggtggacgagagttcatctccacagcaaggcacccgtgcggccagcatcgaaaacgtcctgcaggattcttcacccgagcactgtgggcgcggcccaccagctgatatctaccttcctggacgacctacatctatggagacagctcatgggttggcgacaacaagtcccacctggcctcctctcggcgggccctctccagatcccagcgccgctgaactgactccgctatag

SEQ ID NO: 193829 - DNA, 1659 bp, Artificial Sequence
  Description of Artificial Sequence: Synthetic coding sequence
atgggcagcatcctgagccggcggatcgccggcgtggaggacatcgacattcaggctaactccgcctataggtaccctccaaagagtggtaactacttcgcctctcacttcttcatgggcggtgagaaattcgacacgccgcacccagaagggtacctgtttggggagaacatggaccttaatttcttgggttcacggcccgttcagtttccttacgtaactccggcacctcatgagcccgtcaaaactctgagatctctggtgaacatacgcaaggattcccttcgattggtccggtacaaagacgacgcggatagccctactgaggatggcgacaagcccagggtgctgtactcacttgagtttactttcgacgccgatgcacgtgtggcaattacaatctattgccaagcatccgaggagttcttgaatggccgcgcggtgtactcaccaaagtccccatccctgcaaagcgagaccgtccattataaacgtggagtctcacagcagttttcgttgccgagctttaagatcgatttcagcgagtggaaagacgacgaactcaacttcgatctcgaccgtggcgtctttccagtggtcattcaagccgtagtcgacgagggcgacgtcgtcgaggtaacaggtcacgcccacgtgttgcttgccgccttcgaaaaacacatggatgggtctttctccgtcaaacctctgaagcaaaaacagatagtggaccgagtcagctatctgctccaggagatctatgggattgaaaacaaaaataatcaagaaactaaaccaagcgacgacgaaaactcagataacagcaacgagtgtgtcgtttgcctgtctgatctgcgggatactctcattctgccctgcaggcatctgtgcttatgcacctcctgtgccgatacgctccggtatcaggcaaataattgcccaatctgcaggctgccgttccgcgctctcttacagatcagggcagtcaggaaaaagcctggggccttgagccctgtgtcctttagcccagtgttggctcagtccctggagcacgatgaacacagctgtcccttcaaaaagtctaagccccatccagcatctctcgcatccaaaaagccaaagagagaaacaaacagtgactccgtgcctcctggctacgagccaatctccctgttagaggctttaaatggtctgagggcagtctcgcctgcaattccttcggcccctctgtatgaggagatcacgtattctggtatctctgatggccttagccaagcatcttgcccactcgcagcaattgaccatatcttagactcctcgaggcagaaaggcaggccacaaagtaaggcccctgatagcaccttgaggagccctagctccccaattcacgaagaagacgaggaaaagttatcagaggacgtggacgcccccccccccctgggaggtgccgaactcgccctgcgcgaaagttctagtccagagtcgtttataactgaggaggtagatgagagctctagtccccagcaggggaccagggccgccagtattgagaacgtgttacaggactcctctccagaacattgcggtaggggccctcccgccgatatttacctccccgctctcgggcctgatagttgttctgtgggcatcgacgagtag

SEQ ID NO: 193830 - DNA, 1596 bp, Artificial Sequence
  Description of Artificial Sequence: Synthetic coding sequence
atgggcagcatcctgagccggcggatcgccggcgtggaggacatcgatattcaggctaattcagcctataggtacccacccaaatcaggcaattacttcgcaagtcactttttcatggggggtgagaagtttgatacaccgcaccctgagggatacttgttcggggagaacatggatctgaacttcctgggctcccgacccgtgcagtttccttatgtaacccccgctccccatgagcccgttaaaacccttaggtctctggtcaacattaggaaggattcactaaggttggtgaggtacaaagacgacgcggacagcccgacagaagacggggataaacccagagtgctttactccttggaatttacctttgatgcagatgctagagtcgctataaccatttactgccaggctagcgaggagttcctgaatggcagggccgtctacagcccaaaatccccctccttgcagtcggaaaccgttcattataaacgaggagtgagccagcaattctcactaccatcctttaagatagattttagcgagtggaaggatgatgaactgaacttcgacctggatcggggcgtttttccagtggttattcaagccgtagttgacgagggagacgctgtggtcgaggtgacaggtcacgcccacgtgctgctcgctgccttcgaaaagcacatggatggatccttctctgtgaaaccactgaagcagaagcagattgtggatcgcgttagctacctgctgcaagagatctacggaattgagaataagaacaaccaagagactaagcccagcgacgacgaaaactccgacaacagtaacgagtgtgtggtctgcctgtcagacctgagggacaccctaatattgccgtgtcgccacctatgtctttgtacttcctgtgccgacacattgcgataccaggcaaataattgcccgatctgtcgcttgcctttcagagccctgctgcagattcgagcggtgcgaaagaagccaggcgctctgagtcccgtatcattcagccccgtcctagctcaaagcctggaacatgacgaacacagcaattctgactcagtcccccctggttacgaaccaatctctttattggaagccctcaatggcttacgcgcagtgagcccagccatcccctcggcccccctttatgaggagatcacgtattcgggaatttctgacggtctttcacaggcctcctgtcccttagccgctatcgaccatatcttggactccagccgccagaaggggcgtccgcagagcaaggcccctgattcgacgcttcgaagtccaagcagccctatacacgaggaggatgaggagaagctctctgaggacgtggatgcaccgcctccactcgggggcgcagagttggccctacgagaatccagcagccccgagtcttttataaccgaagaggtggacgagtcttcttcacctcagcaaggcacgcgggctgcctcgattgagaacgtgctacaggattcgagccccgagcactgtggcaggggaccgcccgcagacatctacctgcctgcactggggcccgattcctgttcggtgggcattgatgagtag

SEQ ID NO: 193831 - DNA, 963 bp, Artificial Sequence
  Description of Artificial Sequence: Synthetic coding sequence
atgggcagcatcctgagccggcggatcgccggcgtggaggacatcgacatccaggcgaactccgcctatcggtatcccccaaagtcaggcaattactttgccagccacttctttatgggaggtgaaaaattcgatacccctcaccccgaaggatatctgtttggcgagaatatggatctgaatttcctcggctccaggcccgtacagtttccctacgtcacgccagcaccacacgagcctgtaaagacactcaggagccttgtcaatataagaaaggattctttgcgccttgtgcgttataaggacgatgctgattccccaacagaggatggtgacaaaccgagagtgttgtattctttagaattcaccttcgatgctgacgcaagggtggccatcacgatctactgccaggcaagcgaagagtttctgaacggcagagccgtctactcaccaaaatcacccagcctgcagagcgagaccgttcactacaaacggggcgtctcccagcaattctcattaccctcgtttaaaatcgatttcagcgagtggaaggatgacgagctaaacttcgatctcgatcgtggagtgtttcccgtcgtcatacaggccgtcgtggacgagggtgacgtcgtagaagtgactggacatgcgcacgtcctgctggccgccttcgaaaaacacatggatggttccttctctgtcaaaccgcttaaacagaaacaaattgtggaccgcgtatcatatttgttgcaggaaatttatgggatcgaaaacaagaataaccaggagacaaaaccatctgatgatgagaattccgacaatagcaacgagtgtgtggtgtgtctctcagatttgagagatacattaatcttgccatgccgacacctgtgcttatgtactagctgtgcggacacattaaggtatcaagccaataactgtccaatctgccggctgcaactatag

SEQ ID NO: 193832 - DNA, 1632 bp, Artificial Sequence
  Description of Artificial Sequence: Synthetic coding sequence
atggccaagggcgagggcgccgagagcggcagcgccgccggcctgttgcctacctccattctgcagtctaccgagagaccagcccaagtgaagaaagaacctaagaagaagaaacaacagctttctgtctgcaataaattgtgttatgccctgggaggggcaccatatcaggttacggggtgcgccttggggttttttctccagatctacctcctggatgtggctcagaaggacgaggaagtcgttttctgtttctccagcttccaagtcggccccttttcagcctccatcatactgttcgtcggacgcgcctgggacgcgattacagaccccctcgtgggactgtgcatcagcaagagcccatggacttgcttgggacggctgatgccatggattatattttcaactccgctggccgtcatcgcgtacttcttgatttggttcgtccccgactttcctcacggacagacttactggtatttactgttctattgcttatttgagacgatggtgacatgctttcatgttccgtactccgctctgacaatgttcataagcacagagcagactgagcgcgatagcgctactgcgtataggatgaccgtcgaagtcctaggaacagtcctgggtacggcaatccagggccagatcgtgggccaggccgatacaccttgtttccaggacctcaattcttccacggttgcctctcagagcgcgaatcacacacatggaaccactagccaccgcgaaacccagaaagcatatctgctggcagcgggagtaattgtctgtatctatattatttgtgctgtgatcctgattttgggtgtgagagagcagcgcgaaccatatgaggcacaacagtcagaacccatagcgtattttcggggcttaagactggtcatgagtcatggaccctacatcaaactcatcaccggattcctctttacatcattggcatttatgctagtcgaggggaattttgtactgttttgcacgtatacgctgggatttcggaacgagttccaaaatctcctgcttgccatcatgctcagtgccacactaactatccccatttggcagtggttcctgactcggttcggcaagaagaccgcagtctacgtgggcataagctcagcagtccctttcctgattcttgtggcgttgatggaatcgaatttgatcattacttatgctgttgccgttgcggccgggattagcgttgccgccgcatttctgctgccctggagtatgctgccagacgtcattgatgattttcacttgaaacaaccccatttccacggtacggaacccatatttttcagcttctatgtcttcttcacaaaattcgctagcggggtttccctgggaatctcgacgttgtcactcgacttcgctggctatcagacccgcggttgcagccaaccggagcgggtcaagttcacccttaacatgctggtcaccatggcacccattgttctgattctgcttggtctgctcctgtttaagatgtatccaattgatgaagagagacgcaggcagaacaagaaggccctgcaggcactgagagacgaagcatccagctccggctgcagcgagacggattctactgagttggcctcaattttatag

SEQ ID NO: 193833 - DNA, 1593 bp, Artificial Sequence
  Description of Artificial Sequence: Synthetic coding sequence
atggccaagggcgagggcgccgagagcggcagcgccgccggcctgctgcccacctccatccttcagagtaccgaacgcccggcacaagtgaaaaaagagccaaagaaaaagaaacagcaactgtcggtttgcaacaaactgtgctatgccctgggcggagctccctatcaggtgacaggttgtgctctgggattttttctccagatctacctgctggacgtggcccaagtgggcccttttagcgctagtattatccttttcgtaggacgtgcgtgggacgccatcacagaccccttggtcggtctgtgtatttcaaaatcaccctggacctgtttgggccggctgatgccttggataatcttctccacgcccttggctgtgatagcctactttttgatttggttcgtgcctgattttccacacggccagacctactggtatctgcttttttactgtctctttgagacgatggtcacttgctttcatgtgccttacagcgcattaacaatgttcatctctaccgagcagaccgaaagggattcagccaccgcctaccgtatgacggtggaagtgttggggactgtgctggggactgccattcaaggccagatcgtcggtcaggccgacaccccctgctttcaggaccttaactcttcaaccgtggcctctcagagtgctaaccatacacatgggaccacatcccaccgcgaaacccagaaggcatacctgctagccgcaggggtgattgtctgcatctacataatttgtgctgtgatcctcatccttggagtcagggaacagagagagccatatgaagcccagcagagcgagcctatcgcatattttcggggcctgagactggtgatgagtcacggtccatatataaagctgataacagggttcctgttcacttccttagcgttcatgttggtggaaggaaatttcgttctcttttgcacatatactctaggcttcagaaacgagtttcagaacctcttattggccataatgctaagtgcaacccttacgatccctatttggcagtggtttctcacccggtttggcaagaaaacagctgtgtacgtaggtatatcttctgctgtccccttcctgattttggtggcacttatggaaagcaatttgatcattacatacgcagtggcggtggctgctggaattagcgtcgccgctgcattcttgctgccgtggtctatgcttcccgacgtgattgatgactttcacctgaagcaaccccacttccacggaaccgagccaatcttcttctcgttctatgtcttttttaccaaattcgcctctggcgtctcgctaggcatcagtacactaagcctggactttgcagggtaccagacgagaggctgcagccagccggagcgggtgaaatttactcttaacatgctggtaacaatggcccccatcgtcttgatcctgcttgggctgctgttattcaagatgtatcccatcgacgaagagcggcggcgacagaacaagaaagccctccaagccttgcgcgacgaagcgtcttccagcggatgctccgagaccgattctacggaattggcttctatactttag

SEQ ID NO: 193834 - DNA, 1125 bp, Artificial Sequence
  Description of Artificial Sequence: Synthetic coding sequence
atggtgacctgcttccacgtgccctacagcgccctgaccatgttcatctctacggagcaaaccgaacgagacagtgccaccgcctacagaatgacggtggaagtactcggcaccgtcctgggcaccgccatacagggccagatcgtgggacaggccgatactccttgctttcaggacctgaactcctcaaccgtggcgagccagtccgctaaccatactcacgggaccacctcccatcgggaaacgcagaaggcctacctactcgctgccggcgtgattgtgtgcatctatattatctgtgctgtcattttgattttaggagtgcgggagcagcgcgagccttacgaggcacagcaatctgagcccattgcctatttcaggggtttgcgcttggtgatgtcccatgggccctacatcaaactcattacagggtttttattcacttccctcgccttcatgttggtcgaaggcaactttgtcctgttttgcacatacacactgggcttcaggaatgagttccagaatttgcttctggccattatgttatccgcgacgttaacgattccaatctggcaatggtttttaactaggttcgggaaaaaaaccgcagtatacgtggggatttccagcgctgttcccttcctcatcttagtggcacttatggagtccaacttgatcatcacctacgccgtagccgtcgcagctggtataagcgtggcggctgccttcctactcccctggtcgatgctgcccgatgtcattgatgattttcaccttaaacagcctcacttccatggcactgagccgatattcttttccttttacgtgttcttcacgaagttcgcctccggggtgtccctgggtatttctacactgtcactggactttgcaggttaccagacaagaggatgcagtcagccagaaagggtgaaatttacgctcaatatgctcgttaccatggcccccattgttctgatcctgctcggactgctgctgtttaaaatgtatccaattgatgaggaacggaggcgccagaacaaaaaggctttacaggccctgagggacgaagccagcagctcgggctgcagtgagaccgattcaacggagctcgcatcgattctgtag

SEQ ID NO: 193835 - DNA, 801 bp, Artificial Sequence
  Description of Artificial Sequence: Synthetic coding sequence
atggccaagggcgagggcgccgagagcggcagcgccgccggcctgctgcctacttctatcctgcagagtaccgagcggcctgcccagaaggagcctaagaagaaaaagcagcagttgtccgtctgcaacaagctgtgttacgcattgggtggggccccctatcaggtaacggggtgcgccctgggttttttcctgcagatctacttactggacgtggcccaagtgggtcccttctctgccagcatcatcctctttgttggacgggcatgggacgcaattactgaccccctcgtgggattgtgtatctcaaaaagtccctggacctgtcttggccgtttaatgccttggatcattttcagcacgcccttggccgtgattgcctattttctcatatggtttgttcccgacttcccgcacggccaaacatactggtaccttctcttctattgccttttcgagaccatggtgacatgttttcatgtaccctatagcgccctgaccatgttcatctctaccgagcagacagagagggattcagccacagcctatcggatgaccgtagaggttcttggaaccgtgctcggcacagctatccagggccagatagtgggacaagcagacaccccgtgttttcaggatttgaactcatcaaccgttgctagtcaaagcgctaatcacacccacggcacaacctcccatagagagacacagaaggcctacctgctggccgccggagtgatcgtctgtatctacataatttgtgctgtaattttgattctgggggtccgtgagcagcggtag

SEQ ID NO: 193836 - DNA, 2376 bp, Artificial Sequence
  Description of Artificial Sequence: Synthetic coding sequence
atggccgacgacaaggtggccatcctgaccgacgacgaggaggagcagaagcgtaaatacgtccttgccgacccgtttaatgggattagcagggaacccgagcctccctcaaatgaaactccttcgagtacagagactagtgcaattcctgaggaagaaattgattggattgagaaacactgcgttaagataaataatgacctgctgatcagcaaggtcttttacttcttcttttatagtgcctacggctccctgtatcctcttctgcccgtgtactataaacaactggggatgagcccctctcaaagcggcctcttggtggggattagatatttcatcgagttctgctcagctccgttctggggtgtcgtcgcagaccgttttaagaagggcaagatcgtcctcctattctcattgctgtgctgggtcctgtttaatctgggcataggattcgttaaacctgccactcttcggtgcgtgcctaagatcaggcccacgacgcatcctacaaatgcttctcaccaactcactatcctgcccactaattctagctttaccagcttcctcacgatttcacccaaaatgcgcgaaaaaagaaacctactcgaaacccgactgaatgtgtcagatacagtcactctccccacggcacccaacatgaattctgaaccaaccctgcagcctcagacaggcgaaatcaccaacagaatgatggacttgacgctgaactcttccacggcaacaccagtgagtccaggatcggtcacgaaagaaaccactactgtcattgtcaccactacaaagtcactgccttccgaccaggttatgctcgtttatgaccagcaggaggtggaggcgatcttccttgtgatcctggttgtggtgattatcggtgaattcttttccgcatcctccgtcacaattgtggatactgtgaccctccagtatctgggtaaacatcgcgaccgatatggtctgcaacggatgtgggggagcctgggttggggactggctatgctctctgtcgggatcggaatagattatactcatattgaggtgttgattgacgggaaaggctgtaaaccacccgaatatcgaaactaccagatcgtgttcatcgtgttcggggtgctaatgactatggcgctgattgttgctacccagtttcgattccgctataatcattttaagaacgacgacagcaaagggaaggaagtcgagattcctcaagtggagaggaataacagcaccgaatcaagcgaagagacacctaccacgacgagccactcacaggcctttaatttctgggatctgatcaagctcctgtgttcagtgcagtatggttcggtgctcttcgtggcctggttcatggggttcggatatggctttgtcttcacctttctgtactggcacctggaggaccttaatggtaccactaccctgtttggagtgtgttctgtcctgtcccacgtaagcgagcttaccgcatacttcttcagtcacaagttgatcgaactcatcggacacattcgagtgctgtacattggactggcttgtaacacagcaaggtacatttatatatcttatcttgaaaacgcatggacggtgttgccaatggaggtgctgcagggcgtgacccatgccgctatttgggccgcttgtatatcatatctctccgccgccgtgcccccagaactgagaacctcggctcagggtattttgcagggattacaccttgggctggggcggggatgtggagctatgatcgggggagtcctcgtcaactactttggggccgctgcaacgtttcgcggaataggcatggcatgcctagtaatcctcttgctgttcgccctgatccaatggctggctgtccccgatgaggaagaagacaaaacgatgcttgccgaacgcatcccagtgcccagttcccccgtaccaatagcaacaattgatctggttcagcaacagactgaggatgtgatgcctaggatcgagccaaggctgccacctaaaaagaccaaacatcaggaggaacaggaagacgtaaacaagcccgcatggggagtttcttctagcccttgggttacattcgtttacgctctttaccagatcaaagaaatgatgcagcttactagagacaaccgagcatcagaaatccaaccactgcagggtaccaacgagaatcgggagaacagtccggctggccgggcacaaccggtaccctgtgagactcactcggatccctcgagaaatcagccttcccctgacgccgctgcaagccagacccagacaagtccagcccacccgagtgtggatccctgtactgaggaatctgaggaacagcaggcccagctggccgcagggggccattag

SEQ ID NO: 193837 - DNA, 2376 bp, Artificial Sequence
  Description of Artificial Sequence: Synthetic coding sequence
atggccgacgacaaggtggccatcctgaccgacgacgaggaggagcaaaaacggaaatacgtgcttgccgaccctttcaatggaatctctcgtgagcccgaaccaccatccaatgagaccccctcttctacggagacctcagcaatccctgaagaggaaattgattggatcgaaaagcattgcgtgaagatcaataacgacctgctgatatccaaggttttttactttttcttttacagtgcctacggctccctctatcctcttttgccggtgtactataaacagctcggtatgtcacccagccagtcgggcttactggtcgggattcgctacttcatcgagttttgctcggcccctttctggggagtcgtggcagacagatttaaaaaagggaaaattgtactcctattttcattgttatgctgggtcctattcaatttgggaattgggttcgtgaaaccagcgacattacgatgcgttcctaagattaggcctacgacccaccccacgaatgcaagtcaccaactgaccattttacccacaaactcaagctttactagttttctgactatttcgcccaagatgagggagaaaaggaatctgcttgagactcggctgaacgtatccgacacagtaactcttccaactgccccaaatatgaattccgagccaactttgcagccccaaaccggggaaatcacaaataggatgatggacctgacgttgaactcatcaacagcaactcccgtatcaccaggatcggtgacgaaagagactacaacagtgattgtgaccaccaccaaatcccttccatctgaccaagtgatgttggtctacgatcaacaggaggtggaggccatttttctcgtgattctagtggtggttataattggagagttctttagtgcaagttcagttacaatcgttgatacagtgacattgcagtatctgggtaagcaccgagatcgttacggccttcagaggatgtggggcagcctgggatggggtttggctatgctgtctgtaggcataggaattgattatactcatatcgaggttctcatcgatggcaagggctgcaaacccccagagtatcgaaactaccagatagttttcattgtcttcggcgtgctgatgaccatggccctgatcgtcgctacccaattccggtttagatataaccattttaagaacgatgactccaagggaaaggaggtggaaatacctcaagtggaacgcaacaactccactgagagctcagaggaaacacctacaacaacttcacacagccaagcctttaatttctgggacctgatcaagctgttatgtagcgtccaatacggtagcgtcctatttgtggcctggttcatgggctttggatatggcttcgtctttacgtttttgtactggcacctcgaggacctgaatgggaccacgacgctgtttggggtttgcagcgtgctgagccacgtttccgagctgaccgcatattttttttcacacaaactgattgaactaattggccacataagagttctctatatcgggctggcctgcaatactgcccgatacatttacatcagctatctggagaatgcctggactgtcctaccaatggaggtcctgcagggagtgacccatgcggcaatctgggcagcctgtatctcctacttatccgccgcagttccacccgaactgaggacatcagcccaaggtattcttcagggtctacatctggggttaggacggggatgcggcgcgatgattggcggagtgctcgtgaactactttggtgcggcagcgacgttcagggggattggaatggcatgcctagtgatacttctactgtttgcactgatccagtggctagccgtgcctgacgaagaggaggataagactatgcttgcggagcgtatccccgtgcctagctctcccgttcctatagctacaatcgatctggtgcaacagcagacggaagatgtgatgccacgcattgaacctaggctcccccctaagaaaaccaaacaccaggaggagcaggaggatgtgaacaaaccagcctggggggttagttcttctccatgggtcaccttcgtgtatgcactgtatcaaatcaaggagatgatgcagctaaccagagataatagggcctcagagattcagccattgcagggaactaacgagaatcgcgagaattcgccagctgggagagcacagcccgttccctgcgaaacccactcagatccatctaggaaccagccaagcccagatgccgccgcaagtcaaactcagacaagtccggctcaccccagcgtcgatccctgtactgaggagtcggaggaacagcaggcacagctggccgcaggcggccactag

SEQ ID NO: 193838 - DNA, 129 bp, Artificial Sequence
  Description of Artificial Sequence: Synthetic coding sequence
atggccgacgacaaggtggccatcctgaccgacgacgaggaggagcagaagcgcaaatacgtcctggccgatccctttaacggcataagccgggaacctgagcctccctcaaatgagacgccaagttag

SEQ ID NO: 193839 - DNA, 345 bp, Artificial Sequence
  Description of Artificial Sequence: Synthetic coding sequence
atggccgacgacaaggtggccatcctgaccgacgacgaggaggagcagaagagaaagtatgtgctggccgatccttttaatggaatttccagagagccggagcctccttccaacgagaccccatcaagcacggaaacatctgcgatacctgaggaagagatagactggatcgaaaaacactgtgtgaaaattaataacgacctcctgatttctaaagtattttacttttttttttattccgcctacggcagcctctaccctctgctgccagtgtattacaaacagctcggtatgagtccctctcaatccggtttgctggttggaatccgatatttcattgaatag

SEQ ID NO: 193840 - DNA, 471 bp, Artificial Sequence
  Description of Artificial Sequence: Synthetic coding sequence
atggccgacgacaaggtggccatcctgaccgacgacgaggaggagcaaaagcgtaagtatgttctggccgatccctttaacggcatcagcagggagccggaacccccctccaatgagaccccatcctccacagagacttccgccatcccagaagaggaaattgattggatcgaaaagcactgcgtgaaaattaataacgacctgctcatcagtaaagtcttttatttcttcttctattcagcctacggcagcctgtatccactcctgcccgtgtattataagcagctaggaatgagcccctcccagagcgggctcctggtgggcatccggtacttcatagagttctgcagtgctcccttctggggcgtcgtagctgaccggttcaagaaggggaagattgtcttactcttctcactgctttgctgggtcctcttcaatctggggattggatttgtcaaacccgcgacttag

SEQ ID NO: 193841 - DNA, 762 bp, Artificial Sequence
  Description of Artificial Sequence: Synthetic coding sequence
atggaggtgctgcagggcgtgacccacgccgccatctgggccgcctgcatttcctacctgtcagctgctgtgcccccagagctgcggacgagcgcgcagggcatcctacaggggctgcatctgggacttggaagaggttgtggcgccatgatcggaggcgttctcgtaaattatttcggagctgccgccaccttcagggggattggcatggcctgccttgttatcctgctgctgttcgccttaattcagtggctggcagtgcctgatgaggaggaagacaagaccatgctcgctgagagaattcccgtgccctcctcgccagtgcctatcgccaccatcgatttagtgcagcagcaaaccgaggacgtgatgcctcgcatcgaacctcgcctcccccctaaaaaaaccaaacaccaggaggaacaggaggatgtcaataagcctgcttggggtgtctctagctcaccctgggtgaccttcgtgtacgcgctgtatcagattaaggagatgatgcagctgacgagggacaatcgggctagcgagatccagcccttgcaaggaacgaatgagaacagagagaactcgcccgccggccgcgcccaaccagtcccttgtgaaactcatagcgatccaagccgcaatcagcccagccccgacgccgcggcatctcagacccagacctccccagctcatccttccgtggatccatgcaccgaggaaagcgaggaacagcaggcccaacttgctgcgggtggacactag

SEQ ID NO: 193842 - DNA, 696 bp, Artificial Sequence
  Description of Artificial Sequence: Synthetic coding sequence
atggaggtgctgcagggcgtgacccacgccgccatctgggccgcctgcatttcctatcttagcgctgctgtgccccctgagctacgcacatcagctcaggggattcttcagggtctccatttaggtctgggtcgcggttgcggcgctatgatcggcggagtgctggtgaactacttcggcgcggccgcaacctttagaggcataggcatggcctgtctggtgatactgctactcttcgcccttatacagtggctcgccgttccggatgaggaggaggacaaaacgatgctcgctgaaaggattccggtgccttcttcaccagtccccatcgcgactattgatctcgtgcagcagcaaacggaggatgtgaataagccggcctggggagtgtcatcctctccttgggtcacattcgtgtacgccctttaccagattaaggagatgatgcagctaactagagacaacagggcctctgagatacagccactgcagggtacaaacgaaaacagagagaactcccccgccggaagagctcagccggtcccctgcgaaacccactctgacccgtcccgaaaccagccctcgcccgacgccgcagcgtcccagacgcaaactagtcccgcccacccctcggttgatccctgcacagaggaatccgaggaacagcaggcacagctcgccgccggaggacactag

SEQ ID NO: 193843 - DNA, 1557 bp, Artificial Sequence
  Description of Artificial Sequence: Synthetic coding sequence
atggccggcctgcggaacgagagcgagcaggagcccctgctgggcgacacacctggcagtcgcgaatgggacatcctcgaaacagaggaacactacaaatcaaggtggcggagcatccgaattctgtacttgaccatgtttctctccagtgttggtttcagcgtagttatgatgagcatctggccctatctacagaagatcgacccaactgctgacacatcatttctgggatgggtcattgcctcctacagtctgggtcagatggtcgcctcccccatctttggcctgtggtctaattacaggccaagaaaggagcctctgatcgtgtccatattgatttctgtagcggcgaattgcttgtacgcctaccttcatattcctgcctctcataacaaatattacatgctggtcgcccgcggtctactcggcattggtgctgggaacgtagcagtggtgagaagctatactgcgggtgcgacctccctgcaggaacgcacttcctcaatggccaatatcagtatgtgtcaggcattagggttcatcctggggccagttttccagacctgtttcaccttcctaggcgaaaagggcgtgacttgggatgtaatcaaactacagataaatatgtacacaacccccgttctcctcagcgcctttcttggaattctgaatatcatcctcatcttggctattctgcgggaacatagagtcgacgacagcgggcgccaatgtaaaagcatcaatttcgaggaggccagtacagacgaagcccaggtgcctcagggcaacatcgaccaggtagctgttgttgctatcaatgttctgtttttcgtaactttgtttatatttgcattgtttgagacaatcattacccccctgactatggacatgtacgcatggacacaggaacaggccgttttgtacaatgggattattctcgccgcactgggtgtcgaggcagtcgttatcttccttggcgttaagctcctgtcgaagaaaatcggggagagggccatcctgttgggggggctcatagtcgtctgggtaggcttctttatactgttgccttgggggaaccaattcccaaagattcagtgggaggatctgcataataattctatcccgaatacgacgttcggcgaaattatcatagggctgtggaaatctccaatggaggacgacaacgagcgcccaacgggttgcagcattgagcaggcctggtgcttatacacccccgtgatccacttggcacagtttctaacaagcgcagtgctgatcggtctggggtaccctgtttgcaacctaatgtcctacacactgtactctaaaattctcggcccaaagccccaaggcgtgtacatgggatggctgacagccagtggcagcggggcccggattctagggccaatgtttatttcacaggtatatgcgcactggggccctcgatgggccttctcacttgtctgtggcattattgttttaaccatcacattactgggggtggtgtataaaagacttattgccctgtctgttaggtacgggagaatacaggagtag

SEQ ID NO: 193844 - DNA, 462 bp, Artificial Sequence
  Description of Artificial Sequence: Synthetic coding sequence
atgttcctgagcagcgtgggcttcagcgtggtgatgatgagcatctggccctacctgcagaagatcgatccaaccgcagacacttcattcctcggttgggtgatcgctagctactctttaggacaaatggtggcatccccaatttttgggctctggtcaaactatcgcccccgaaaggaaccgctaattgtctccattcttattagcgttgccgctaactgtttgtacgcctacctgcatattcccgcctctcacaataagtactacatgctagtggcccgaggcctccttggcattggcgcggtgtttcaaacttgctttacgtttttaggggagaagggcgttacgtgggatgtgatcaagctgcaaatcaacatgtacaccaccccagtgctactgtcggcgttcttaggcattctcaatatcatccttatactcgctatcctctccaagtaccgttag

SEQ ID NO: 193845 - DNA, 555 bp, Artificial Sequence
  Description of Artificial Sequence: Synthetic coding sequence
atgttcctgagcagcgtgggcttcagcgtggtgatgatgagcatctggccgtatctgcagaagatagaccccacggctgatacatcattcctcggctgggttatcgctagctacagtctcgggcaaatggtggccagccccatttttggcctctggtcaaattaccgtccaagaaaggagccgctgatcgtctccatcctcatttccgtggccgccaactgcctctatgcttacttgcatatacccgcttctcataataaatactacatgctcgtggcacgcggcttgctggggattggagcaggcaatgtagccgtggtgagatcctatacagcgggcgcaacctccctgcaggagaggacttctagcatggcaaatatatcgatgtgtcaagcactgggattcattctcggacctgagaatatcgtgtggatgacgcaggaggactcggtcaaggtgctcatccttaaaaagcaggtgcagatgaaactgcgcttccctaaggaaattctgacaaggctgttattgtggcccagcatgttctgttttctctag

SEQ ID NO: 193846 - DNA, 750 bp, Artificial Sequence
  Description of Artificial Sequence: Synthetic coding sequence
atgggcgagctgatggccttcctgctgcccctgatcatcgtgctgatggtaaaacacagcgattctcgaactcactcgctgagatacttccggttaggggtgtcagatccaattcacggagtacctgaatttatctcagtaggatatgttgactcacaccctattactacgtatgattccgtaactcgccagaaggagccgagagctccctggatggcagagaatctggcacctgaccactgggaacgttacacacagcttctgcggggctggcagcagatgttcaaggtcgagctgaaacgactccagcgccactacaaccactctggcagtcacacctaccagcggatgattggctgcgaactgctggaggacggatcaactaccggatttttacagtatgcctacgacgggcaggattttcttatcttcaataaagacacattgtcttggctggcggtagataacgtggcccatacgattaagcaggcttgggaagcaaaccagcacgaactgctctaccaaaaaaattggcttgaggaggagtgcattgcatggctcaagaggtttcttgagtatggaaaggatacactccagcggacagaatctgaaaccatccctttggtgatgaaggctgtgagcggatcaatcgtcttagtgattgtgctcgctggcgtgggggtgctagtgtggcgcaggaggccccgggagcaaaacggcgccatatatctgcctacccctgaccgctag

SEQ ID NO: 193847 - DNA, 783 bp, Artificial Sequence
  Description of Artificial Sequence: Synthetic coding sequence
atgcggcccgaggaccggatgttccacatccgggccgtgatcctgcgggcactgagcctggcgttccttttgtccctgcggggcgcgggcgccatcaaggccgaccacgtctcaacctacgctgccttcgttcagacccacaggcctaccggagaattcatgttcgaatttgacgaagatgagatgttctacgtggacctcgacaagaaagaaacagtgtggcaccttgaggagttcggccaggccttttcattcgaggcccagggagggttggcgaacatcgccattctcaataacaatctcaacaccttgatccaaaggtcaaaccacactcaggctactaatgacccccccgaagtaaccgttttccccaaagagcctgtcgaactggggcagccaaatactctgatctgtcatatcgacaaatttttcccacccgtactcaacgtgacttggctgtgtaacggggagctggtcaccgagggggtggcagaaagtctcttcctgccccgaactgattattctttccacaagttccattacctgacctttgttccatcagccgaagatttctatgactgtcgcgtggagcactggggtcttgaccagcctctcctgaaacattgggaagcccaagaacctattcagatgccagagacaacagagacggtgttgtgcgccctcggactggttttgggcctcgttgggatcattgtcgggaccgttttgattatcaagtcccttaggtcaggacacgaccctagggcacaaggtactctctag

SEQ ID NO: 193848 - DNA, 783 bp, Artificial Sequence
  Description of Artificial Sequence: Synthetic coding sequence
atgcggcccgaggaccggatgttccacatccgggccgtgatcctgagggccctgtccctagcattcttactgagtctgaggggagcgggggccatcaaagcagatcacgtgtccacatatgccgctttcgtacagacgcatagacccactggtgaatttatgttcgaatttgatgaggacgaaatgttttatgttgatctggacaagaaagaaacggtgtggcacctggaagaatttggccaggcattctcattcgaagcccagggtggactggctaacattgccatactgaataacaatctgaacaccttgattcagcgcagtaatcacactcaagccacaaacgacccgccagaagtgacagtgtttcctaaggagcccgtggaattgggacagccaaatacacttatctgccatatcgataagtttttcccacccgtgcttaacgtcacttggctgtgcaatggagagctggttactgagggcgtagccgagtcactgtttctcccccgtacagattacagttttcacaagtttcactatctgacctttgttccatccgccgaggacttctatgactgtcgggtagaacactgggggcttgatcagcccttactgaaacactgggaagcccaggaacctatacagatgcccgagaccacggaaactgtcctttgtgccctgggcctcgtgctgggtctcgtcgggatcattgtgggtacagtgctcataatcaaatccctgcggtcagggcacgaccctagagcccagggcacgctttag
